United States Patent 10,706,955 (BIOINFORMATIC PROCESSES FOR DETERMINATION OF PEPTIDE BINDING) - sequence listing, part 22

SEQ ID NO: 843195 - protein, 23 aa, Mycobacterium
PDLGRFGVWLGSRSITPGLARRI

SEQ ID NO: 843196 - protein, 26 aa, Mycobacterium
PDLIDPALLRPGRLERLVFVEPPDAE

SEQ ID NO: 843197 - protein, 27 aa, Mycobacterium
PDLIDPALLRPGRLERLVFVEPPDATA

SEQ ID NO: 843198 - protein, 25 aa, Mycobacterium
PDLIDPALLRPGRLERRVFVEPPDA

SEQ ID NO: 843199 - protein, 19 aa, Mycobacterium
PDLIGLRQAVYRREDTRNT

SEQ ID NO: 843200 - protein, 20 aa, Mycobacterium
PDLIRGVFYQAWNPNSVPDK

SEQ ID NO: 843201 - protein, 31 aa, Mycobacterium
PDLKWERFVNAIRLLAEQLGVRKTIGLGAIP

SEQ ID NO: 843202 - protein, 35 aa, Mycobacterium
PDLLAEPTTWAYYPWRRCVVHLVGPRAFHRLRLDR

SEQ ID NO: 843203 - protein, 24 aa, Mycobacterium
PDLLAQLVTAVLGSIRASAGQGGP

SEQ ID NO: 843204 - protein, 19 aa, Mycobacterium
PDLLARAIFDVGAMAGARK

SEQ ID NO: 843205 - protein, 24 aa, Mycobacterium
PDLLARWMCFMLSDAADFVCGSVI

SEQ ID NO: 843206 - protein, 30 aa, Mycobacterium
PDLLASFRTNVIAPFLLTGALAPAMAERGH

SEQ ID NO: 843207 - protein, 23 aa, Mycobacterium
PDLLCFTFNGLSKAYRVAGYRSA

SEQ ID NO: 843208 - protein, 18 aa, Mycobacterium
PDLLLLDEPFGALDALTR

SEQ ID NO: 843209 - protein, 20 aa, Mycobacterium
PDLLPMLEKVAESGKPLLII

SEQ ID NO: 843210 - protein, 21 aa, Mycobacterium
PDLLPMLEKVAESGKPLLIIA

SEQ ID NO: 843211 - protein, 17 aa, Mycobacterium
PDLLPSDIAERAFAVRL

SEQ ID NO: 843212 - protein, 30 aa, Mycobacterium
PDLMALPDPASFTPIPFIKEGLALVHCDPY

SEQ ID NO: 843213 - protein, 27 aa, Mycobacterium
PDLPGLHTGLWAQYLLDQAATVEEALA

SEQ ID NO: 843214 - protein, 19 aa, Mycobacterium
PDLPGWLRRRRPAHAIDLL

SEQ ID NO: 843215 - protein, 17 aa, Mycobacterium
PDLPLRFAINIGSAVMT

SEQ ID NO: 843216 - protein, 21 aa, Mycobacterium
PDLRAVYPTVPQGISADLIAT

SEQ ID NO: 843217 - protein, 23 aa, Mycobacterium
PDLRIRDLSYTGSRMRQLVDLTK

SEQ ID NO: 843218 - protein, 20 aa, Mycobacterium
PDLRLLGALPTLYDPRTTHT

SEQ ID NO: 843219 - protein, 23 aa, Mycobacterium
PDLRNVCGWTLDRPPHHLETSVP

SEQ ID NO: 843220 - protein, 24 aa, Mycobacterium
PDLRNVCGWTLDRPPHQLETSVPG

SEQ ID NO: 843221 - protein, 26 aa, Mycobacterium
PDLRRFEFEYLLNPPPPQAQAIELSL

SEQ ID NO: 843222 - protein, 18 aa, Mycobacterium
PDLTVTDGLLALSGGRQP

SEQ ID NO: 843223 - protein, 19 aa, Mycobacterium
PDLVGYLGRPRFMPESAER

SEQ ID NO: 843224 - protein, 18 aa, Mycobacterium
PDLVLRWAALLHDIGKPT

SEQ ID NO: 843225 - protein, 20 aa, Mycobacterium
PDLVRGIFPTAVVITADGAV

SEQ ID NO: 843226 - protein, 20 aa, Mycobacterium
PDLVRMVMIDAPFPDGTKLV

SEQ ID NO: 843227 - protein, 17 aa, Mycobacterium
PDLVRPLAGLIRTAAAR

SEQ ID NO: 843228 - protein, 24 aa, Mycobacterium
PDLVRRLCWDWEAAPDPFEAVEAF

SEQ ID NO: 843229 - protein, 24 aa, Mycobacterium
PDLVRRLCWDWEGAPDPFEAVETF

SEQ ID NO: 843230 - protein, 21 aa, Mycobacterium
PDLVSDIVLWLASDASSLVTA

SEQ ID NO: 843231 - protein, 28 aa, Mycobacterium
PDMADPTYLRLLPLHQLEGAFGLDDEAY

SEQ ID NO: 843232 - protein, 26 aa, Mycobacterium
PDMDRTWRDFPGVWQWGITDADLEAK

SEQ ID NO: 843233 - protein, 23 aa, Mycobacterium
PDMFTRLMLSLVATGIAPGSFYE

SEQ ID NO: 843234 - protein, 22 aa, Mycobacterium
PDMFTRLMLSLVATGVAPGSFY

SEQ ID NO: 843235 - protein, 21 aa, Mycobacterium
PDMFTRMMLSLVATGIAPGSF

SEQ ID NO: 843236 - protein, 31 aa, Mycobacterium
PDMSGIPGPLAIPSMEYPSAAAAADEMDWEA

SEQ ID NO: 843237 - protein, 26 aa, Mycobacterium
PDMSLRLMRWVFEDWQRVTSEPEDVT

SEQ ID NO: 843238 - protein, 27 aa, Mycobacterium
PDMSTLRRVPWLPATALVMADLSWTDG

SEQ ID NO: 843239 - protein, 27 aa, Mycobacterium
PDNAAQWIGLLSFLMSPGTAAQLSFST

SEQ ID NO: 843240 - protein, 23 aa, Mycobacterium
PDNALDVYFALSLHIRGVVVLEH

SEQ ID NO: 843241 - protein, 22 aa, Mycobacterium
PDNALLFWEALSAEGAERLAHL

SEQ ID NO: 843242 - protein, 24 aa, Mycobacterium
PDNLVWKPTVPLGYGRTYTLTVTS

SEQ ID NO: 843243 - protein, 30 aa, Mycobacterium
PDNLYMIGTFRLAPGQALVLDFEPPETRYW

SEQ ID NO: 843244 - protein, 22 aa, Mycobacterium
PDNMLRIPLGRPGQPEEVATFV

SEQ ID NO: 843245 - protein, 25 aa, Mycobacterium
PDNPASIWRFRLAPRDGGTALNYWM

SEQ ID NO: 843246 - protein, 24 aa, Mycobacterium
PDNRVRRYVCLSGPDQGGCGRLTV

SEQ ID NO: 843247 - protein, 24 aa, Mycobacterium
PDNSQAMTVLLFTEGKALVTLEFD

SEQ ID NO: 843248 - protein, 26 aa, Mycobacterium
PDNVSKLLWANWHRSLGELAMDVVGK

SEQ ID NO: 843249 - protein, 18 aa, Mycobacterium
PDPAVTAITAGSLGGTVE

SEQ ID NO: 843250 - protein, 20 aa, Mycobacterium
PDPAVYHMAATYLGLEPAEI

SEQ ID NO: 843251 - protein, 25 aa, Mycobacterium
PDPDGGLLAYRRLSEALAGENWYLS

SEQ ID NO: 843252 - protein, 18 aa, Mycobacterium
PDPDRVLVGPAVTISFLP

SEQ ID NO: 843253 - protein, 24 aa, Mycobacterium
PDPELVPFVTWTYDDNTTGWQALL

SEQ ID NO: 843254 - protein, 24 aa, Mycobacterium
PDPEQPVEFWPTSAIRAALQGGDI

SEQ ID NO: 843255 - protein, 18 aa, Mycobacterium
PDPESVAIVLFTSGTTSQ

SEQ ID NO: 843256 - protein, 23 aa, Mycobacterium
PDPIRQTLLRYIGVRAAVLRPKS

SEQ ID NO: 843257 - protein, 19 aa, Mycobacterium
PDPLDPHVIVLFGATGDLA

SEQ ID NO: 843258 - protein, 22 aa, Mycobacterium
PDPLIRDPYARLLVNNAGAAVL

SEQ ID NO: 843259 - protein, 20 aa, Mycobacterium
PDPLRTWGQAEVDGQHVFWT

SEQ ID NO: 843260 - protein, 20 aa, Mycobacterium
PDPPAFPTLADDEHPGWASR

SEQ ID NO: 843261 - protein, 21 aa, Mycobacterium
PDPQWPGGALIAVQFVLNYEE

SEQ ID NO: 843262 - protein, 25 aa, Mycobacterium
PDPRSHWMRLPRPIADDPALHTAML

SEQ ID NO: 843263 - protein, 22 aa, Mycobacterium
PDPRWIALLANKYRQYRQAPPS

SEQ ID NO: 843264 - protein, 23 aa, Mycobacterium
PDPTVVRVLGAIEIPVVAQALAR

SEQ ID NO: 843265 - protein, 17 aa, Mycobacterium
PDPVLPSLSLLPHTVRT

SEQ ID NO: 843266 - protein, 30 aa, Mycobacterium
PDPVREIYSMWRPSPLIRARRFEKALNTGA

SEQ ID NO: 843267 - protein, 17 aa, Mycobacterium
PDQALVITIPVSDAPYL

SEQ ID NO: 843268 - protein, 29 aa, Mycobacterium
PDQEVFASRLPYYFPTRLREELHGEIRSH

SEQ ID NO: 843269 - protein, 20 aa, Mycobacterium
PDQFGAFYRAVAAEYDPVAD

SEQ ID NO: 843270 - protein, 22 aa, Mycobacterium
PDQHALLRTITAPVLVVAGAED

SEQ ID NO: 843271 - protein, 25 aa, Mycobacterium
PDQIPALLGILAAGAVYVPVGVDQP

SEQ ID NO: 843272 - protein, 25 aa, Mycobacterium
PDQIQLIEQFQPFYRWHVSDDVRQP

SEQ ID NO: 843273 - protein, 20 aa, Mycobacterium
PDQLRRWIDSLLNAVAGKLS

SEQ ID NO: 843274 - protein, 24 aa, Mycobacterium
PDQLVIVRRQLLSWLQAAEVPDEQ

SEQ ID NO: 843275 - protein, 22 aa, Mycobacterium
PDQPWQLPVLAPAATDIEEVEG

SEQ ID NO: 843276 - protein, 25 aa, Mycobacterium
PDQVNTEFYFKFLRAPDGNGITDPH

SEQ ID NO: 843277 - protein, 25 aa, Mycobacterium
PDQVNTEFYFKFLRAPDGSGITDPH

SEQ ID NO: 843278 - protein, 17 aa, Mycobacterium
PDQWQKLQKDRSKIPAA

SEQ ID NO: 843279 - protein, 22 aa, Mycobacterium
PDQWQLLLDDRSLIPAAVEELL

SEQ ID NO: 843280 - protein, 18 aa, Mycobacterium
PDRAFRHLDLPPVVLDEA

SEQ ID NO: 843281 - protein, 22 aa, Mycobacterium
PDRANRWYQAQGWLVGANYIPA

SEQ ID NO: 843282 - protein, 21 aa, Mycobacterium
PDRAVLQLNIRTFNDATRTAV

SEQ ID NO: 843283 - protein, 22 aa, Mycobacterium
PDRELLIQGGRRYSYKQVIERS

SEQ ID NO: 843284 - protein, 25 aa, Mycobacterium
PDRESFRHLGFGKGPHFCIGAPLAR

SEQ ID NO: 843285 - protein, 36 aa, Mycobacterium
PDRESMWTAYRESPAWGFCMWAIAPDQMYSVEVVGA

SEQ ID NO: 843286 - protein, 19 aa, Mycobacterium
PDRFLVGLAVVELMAAAAA

SEQ ID NO: 843287 - protein, 18 aa, Mycobacterium
PDRFYLGVQWHPEDTDGP

SEQ ID NO: 843288 - protein, 19 aa, Mycobacterium
PDRGCRLNPLALLASQGVP

SEQ ID NO: 843289 - protein, 18 aa, Mycobacterium
PDRGMFTVFLASSAESEK

SEQ ID NO: 843290 - protein, 22 aa, Mycobacterium
PDRGPVLAFVPDERSLHFAMGL

SEQ ID NO: 843291 - protein, 25 aa, Mycobacterium
PDRHLGGVLYLFVRGMCGAATPAAD

SEQ ID NO: 843292 - protein, 20 aa, Mycobacterium
PDRHLGGVLYLFVRGMCGAD

SEQ ID NO: 843293 - protein, 25 aa, Mycobacterium
PDRHPPLLFFMNVPDPKTAKNRLHL

SEQ ID NO: 843294 - protein, 33 aa, Mycobacterium
PDRKDVAALLRWLADGHFVLLGYQRCPVRDGEA

SEQ ID NO: 843295 - protein, 24 aa, Mycobacterium
PDRKGLPSFALLQNRTPGADIRFW

SEQ ID NO: 843296 - protein, 21 aa, Mycobacterium
PDRKTWWRNFLGEGSSITLVG

SEQ ID NO: 843297 - protein, 17 aa, Mycobacterium
PDRLEKTLLLGELALDG

SEQ ID NO: 843298 - protein, 17 aa, Mycobacterium
PDRLILSKYDPVIRKHV

SEQ ID NO: 843299 - protein, 20 aa, Mycobacterium
PDRLRMLRSFDPRAGAHTPD

SEQ ID NO: 843300 - protein, 19 aa, Mycobacterium
PDRLTTIHWLESVQGLPSV

SEQ ID NO: 843301 - protein, 18 aa, Mycobacterium
PDRMLAGYWAANRVMGHL

SEQ ID NO: 843302 - protein, 17 aa, Mycobacterium
PDRNKVLVEGVNRIKKH

SEQ ID NO: 843303 - protein, 24 aa, Mycobacterium
PDRNRILVEGVNRIKKHTAVSTNQ

SEQ ID NO: 843304 - protein, 25 aa, Mycobacterium
PDRPIELRLLEIEPALKALEGVVME

SEQ ID NO: 843305 - protein, 19 aa, Mycobacterium
PDRPVFQRALSWLTERMPG

SEQ ID NO: 843306 - protein, 33 aa, Mycobacterium
PDRQEVAALLRWLGNGNFLLLGYQPCRVDEGMV

SEQ ID NO: 843307 - protein, 18 aa, Mycobacterium
PDRRAWHRAFASTGPDES

SEQ ID NO: 843308 - protein, 25 aa, Mycobacterium
PDRRRRRSVWRRAPLSLTASPSTEA

SEQ ID NO: 843309 - protein, 31 aa, Mycobacterium
PDRSAITFKIPNLWGLLKVKGRFTEFSGDGQ

SEQ ID NO: 843310 - protein, 24 aa, Mycobacterium
PDRSPRAWLFTVARNMIIDERRSA

SEQ ID NO: 843311 - protein, 28 aa, Mycobacterium
PDRSTGLFLWQNIFGVWPADGAVTDEHR

SEQ ID NO: 843312 - protein, 27 aa, Mycobacterium
PDRTTWTPWLKAWRMLIDAKYHGDIYE

SEQ ID NO: 843313 - protein, 20 aa, Mycobacterium
PDRTYEPLLLVRCLQRHPVL

SEQ ID NO: 843314 - protein, 24 aa, Mycobacterium
PDRTYVNIGFWSSVPVGATEGATN

SEQ ID NO: 843315 - protein, 18 aa, Mycobacterium
PDRVAALLLLDPAVGLDG

SEQ ID NO: 843316 - protein, 22 aa, Mycobacterium
PDRVFKLPDNVSFEAGAGLLFN

SEQ ID NO: 843317 - protein, 19 aa, Mycobacterium
PDRVGNVPRIAYLGPEGTF

SEQ ID NO: 843318 - protein, 20 aa, Mycobacterium
PDRVLAYGDCAIIPNPTPEQ

SEQ ID NO: 843319 - protein, 26 aa, Mycobacterium
PDRVPGLFTLVLHTHLPWLAHHGRWP

SEQ ID NO: 843320 - protein, 20 aa, Mycobacterium
PDRVPLRHLGFGYGAHYCLG

SEQ ID NO: 843321 - protein, 18 aa, Mycobacterium
PDRYLTFPQFALDRRELE

SEQ ID NO: 843322 - protein, 20 aa, Mycobacterium
PDRYRLILESRFLRGNSIKE

SEQ ID NO: 843323 - protein, 28 aa, Mycobacterium
PDSAEFRAFYSRVLFWTYEPGRVDDGWG

SEQ ID NO: 843324 - protein, 24 aa, Mycobacterium
PDSAKPFDFVFHGGSGSLKSEIEE

SEQ ID NO: 843325 - protein, 24 aa, Mycobacterium
PDSAQLRLKRLYSGANYRATTSTV

SEQ ID NO: 843326 - protein, 21 aa, Mycobacterium
PDSAQLRLKRMYPGGHYRATT

SEQ ID NO: 843327 - protein, 20 aa, Mycobacterium
PDSAQVRLKRMYPAAGYRAT

SEQ ID NO: 843328 - protein, 24 aa, Mycobacterium
PDSAQVRLKRMYPGAHYRATTATV

SEQ ID NO: 843329 - protein, 25 aa, Mycobacterium
PDSDGYLWIKQDKFRESFAQDLPED

SEQ ID NO: 843330 - protein, 18 aa, Mycobacterium
PDSDLDWLRLTHSDLRNF

SEQ ID NO: 843331 - protein, 25 aa, Mycobacterium
PDSGATWLLPRLAGLTRAKQMLLLG

SEQ ID NO: 843332 - protein, 26 aa, Mycobacterium
PDSGATWLLPRLAGVARAKRMLLLGE

SEQ ID NO: 843333 - protein, 31 aa, Mycobacterium
PDSGATWLLPRLVGLARARRMLLLGEKVAGA

SEQ ID NO: 843334 - protein, 30 aa, Mycobacterium
PDSGSTWLLPRLVGLARARRMLLLGEQVTA

SEQ ID NO: 843335 - protein, 30 aa, Mycobacterium
PDSGSTWLVPRLVGLARARRMLLLGEKVSG

SEQ ID NO: 843336 - protein, 17 aa, Mycobacterium
PDSHDICFIPSGNTQTF

SEQ ID NO: 843337 - protein, 25 aa, Mycobacterium
PDSILRVLALHRFAKAPMLIGGQML

SEQ ID NO: 843338 - protein, 25 aa, Mycobacterium
PDSILRVLAMHRFAKSPMLVGGQML

SEQ ID NO: 843339 - protein, 18 aa, Mycobacterium
PDSKTVFMVLRDPAADMS

SEQ ID NO: 843340 - protein, 23 aa, Mycobacterium
PDSKTVFMVLRDPAADMSLSVTC

SEQ ID NO: 843341 - protein, 17 aa, Mycobacterium
PDSLLHYMRTRGKNKVI

SEQ ID NO: 843342 - protein, 22 aa, Mycobacterium
PDSLLPMPDSLAELLPDSLPRG

SEQ ID NO: 843343 - protein, 27 aa, Mycobacterium
PDSLRSIPTLFWREWSFRLTVGRGTLS

SEQ ID NO: 843344 - protein, 20 aa, Mycobacterium
PDSLTLLGALAAWTDRVRLV

SEQ ID NO: 843345 - protein, 19 aa, Mycobacterium
PDSLWLDHHRIDGACVLPG

SEQ ID NO: 843346 - protein, 21 aa, Mycobacterium
PDSMRAGLQALAWIAHGAGAG

SEQ ID NO: 843347 - protein, 26 aa, Mycobacterium
PDSNGARPFLFTDTVGFVRHLPTQLV

SEQ ID NO: 843348 - protein, 23 aa, Mycobacterium
PDSPLSVLWMGVSTLLLDDGSSA

SEQ ID NO: 843349 - protein, 26 aa, Mycobacterium
PDSPRVVLLGIPTRGVILASRLAANI

SEQ ID NO: 843350 - protein, 25 aa, Mycobacterium
PDSPTRPIGLLGAILAWHGTDNLTE

SEQ ID NO: 843351 - protein, 18 aa, Mycobacterium
PDSPWLADTWRDRFEQML

SEQ ID NO: 843352 - protein, 20 aa, Mycobacterium
PDSPWLDITWRDRFEQMLKR

SEQ ID NO: 843353 - protein, 29 aa, Mycobacterium
PDSQISRPPRWLAGFGSLSLESGERRTLE

SEQ ID NO: 843354 - protein, 31 aa, Mycobacterium
PDSRAYQIVQKYLIERGLAQYVTDYAQSYSI

SEQ ID NO: 843355 - protein, 25 aa, Mycobacterium
PDSTTLYQPMMTLIADLGGNVSSEH

SEQ ID NO: 843356 - protein, 25 aa, Mycobacterium
PDSVARLMRLLISRGVFRRRRDGRF

SEQ ID NO: 843357 - protein, 17 aa, Mycobacterium
PDSWGWGKTAHLLVGSL

SEQ ID NO: 843358 - protein, 23 aa, Mycobacterium
PDSYLRGAQLLDTAPDAAAVFED

SEQ ID NO: 843359 - protein, 18 aa, Mycobacterium
PDTADLLNWLDSQTKRNL

SEQ ID NO: 843360 - protein, 21 aa, Mycobacterium
PDTAILPVHDVARRAELLLLS

SEQ ID NO: 843361 - protein, 17 aa, Mycobacterium
PDTALADLLPPPPADPE

SEQ ID NO: 843362 - protein, 39 aa, Mycobacterium
PDTAPAEWLARGGIMLPIYQREAMWLSFDSDQPTALQVG

SEQ ID NO: 843363 - protein, 21 aa, Mycobacterium
PDTDDLKILGWQPPERFRTTA

SEQ ID NO: 843364 - protein, 25 aa, Mycobacterium
PDTDLRGFQAADVLARWPVPGPDDD

SEQ ID NO: 843365 - protein, 25 aa, Mycobacterium
PDTDSELFRRYWPADLHMIGKDIIR

SEQ ID NO: 843366 - protein, 25 aa, Mycobacterium
PDTDTPLMHAAAPVLRRMAEDLSDQ

SEQ ID NO: 843367 - protein, 19 aa, Mycobacterium
PDTESSIVTALREQLRTQK

SEQ ID NO: 843368 - protein, 23 aa, Mycobacterium
PDTEVVVVLLCNVGSVLPGELHI

SEQ ID NO: 843369 - protein, 27 aa, Mycobacterium
PDTIDPVLLDLLRLGTYQLLRTRVDSY

SEQ ID NO: 843370 - protein, 18 aa, Mycobacterium
PDTLRMQPWDRDQIHRLF

SEQ ID NO: 843371 - protein, 28 aa, Mycobacterium
PDTPEIAQFQWRTKVYWVNGTHSRSSVD

SEQ ID NO: 843372 - protein, 18 aa, Mycobacterium
PDTPFNATRLGRLIAEKT

SEQ ID NO: 843373 - protein, 24 aa, Mycobacterium
PDTPLITLALGELIAHHTDIPPGV

SEQ ID NO: 843374 - protein, 23 aa, Mycobacterium
PDTPLLGCELTLTATVQLAGLRP

SEQ ID NO: 843375 - protein, 17 aa, Mycobacterium
PDTPVTYIGHSYGGAIV

SEQ ID NO: 843376 - protein, 25 aa, Mycobacterium
PDTQTVDFVKEDGRWMMLLFEDKCS

SEQ ID NO: 843377 - protein, 29 aa, Mycobacterium
PDTRLLGETELWQLAFRVVCEHPAALDTD

SEQ ID NO: 843378 - protein, 25 aa, Mycobacterium
PDTSGFFNFTRNLGSSGLLNAGLLQ

SEQ ID NO: 843379 - protein, 26 aa, Mycobacterium
PDTSLAAFNRIFPTAIKATAGNSLSL

SEQ ID NO: 843380 - protein, 24 aa, Mycobacterium
PDTTNVVTAWRLLGSVDPRLRPHR

SEQ ID NO: 843381 - protein, 25 aa, Mycobacterium
PDTVRARIFDLFDELPFAGHPIIGA

SEQ ID NO: 843382 - protein, 26 aa, Mycobacterium
PDTWRDPRGFALKFYTSEGNFDMVGN

SEQ ID NO: 843383 - protein, 17 aa, Mycobacterium
PDTYQPLPVYKPRATRA

SEQ ID NO: 843384 - protein, 19 aa, Mycobacterium
PDVAAAAELLLLAVPDNEL

SEQ ID NO: 843385 - protein, 18 aa, Mycobacterium
PDVAAGAELLLLAVPDSE

SEQ ID NO: 843386 - protein, 24 aa, Mycobacterium
PDVAAILRFAATEVVPRLAGTARE

SEQ ID NO: 843387 - protein, 26 aa, Mycobacterium
PDVAGVLFFAYAISAAVDWLYSGLPS

SEQ ID NO: 843388 - protein, 27 aa, Mycobacterium
PDVAKLIELAFSLGRLGSAGIGVGVSL

SEQ ID NO: 843389 - protein, 32 aa, Mycobacterium
PDVATIIDVPWDGVWWWSRPDGSLQLVPFSRA

SEQ ID NO: 843390 - protein, 19 aa, Mycobacterium
PDVDGMRRYLRAVYRQIGL

SEQ ID NO: 843391 - protein, 17 aa, Mycobacterium
PDVDRLARSMLLLHGDG

SEQ ID NO: 843392 - protein, 26 aa, Mycobacterium
PDVDRLARSMLLLRGGHHDHRVASDE

SEQ ID NO: 843393 - protein, 17 aa, Mycobacterium
PDVDRLARSMLQLHGDH

SEQ ID NO: 843394 - protein, 19 aa, Mycobacterium
PDVEFSALVASPNGAKRAI

SEQ ID NO: 843395 - protein, 19 aa, Mycobacterium
PDVETWLRSLPPAATDGHG

SEQ ID NO: 843396 - protein, 24 aa, Mycobacterium
PDVEVILLVCRGAMNVVTPVVMDD

SEQ ID NO: 843397 - protein, 25 aa, Mycobacterium
PDVFSRFRRAVTDTGLYKDSDRLAV

SEQ ID NO: 843398 - protein, 18 aa, Mycobacterium
PDVFYWAHSTFFMGTIHV

SEQ ID NO: 843399 - protein, 26 aa, Mycobacterium
PDVGWVLRLLSAPGAELVLPIIAPKP

SEQ ID NO: 843400 - protein, 27 aa, Mycobacterium
PDVHASLPVMVWIPGGAFVFGAGQLEL

SEQ ID NO: 843401 - protein, 24 aa, Mycobacterium
PDVIAHGMLTMGLGAAFVSKWSGD

SEQ ID NO: 843402 - protein, 25 aa, Mycobacterium
PDVIAHGMLTMGLGAGFLSAWSGDP

SEQ ID NO: 843403 - protein, 24 aa, Mycobacterium
PDVIAHGMLTMGLGAGFVSSWSGD

SEQ ID NO: 843404 - protein, 17 aa, Mycobacterium
PDVIALRRALLPCRDGD

SEQ ID NO: 843405 - protein, 19 aa, Mycobacterium
PDVIALRRKLYDDCAGYRM

SEQ ID NO: 843406 - protein, 20 aa, Mycobacterium
PDVIIGRYIPNLVPRPFTLD

SEQ ID NO: 843407 - protein, 29 aa, Mycobacterium
PDVIIGRYIPNLVPRPFTLDRDFIQEIRD

SEQ ID NO: 843408 - protein, 18 aa, Mycobacterium
PDVLAGLAAAKAAGLEPV

SEQ ID NO: 843409 - protein, 29 aa, Mycobacterium
PDVLEPLRLHYLRWILFDVGSGLHFQYQG

SEQ ID NO: 843410 - protein, 21 aa, Mycobacterium
PDVLLEHDLVLRRGATAAGVD

SEQ ID NO: 843411 - protein, 20 aa, Mycobacterium
PDVLLVADRYQATVPVPFVP

SEQ ID NO: 843412 - protein, 17 aa, Mycobacterium
PDVLPASDRLRVSALDV

SEQ ID NO: 843413 - protein, 19 aa, Mycobacterium
PDVLTFHGVFPDEDLYLHV

SEQ ID NO: 843414 - protein, 34 aa, Mycobacterium
PDVMMQVFGEHPRFLHSFPPMPLQYKGLMTSEEV

SEQ ID NO: 843415 - protein, 26 aa, Mycobacterium
PDVNLHLVLGSWRILGAVQQSLQIVT

SEQ ID NO: 843416 - protein, 25 aa, Mycobacterium
PDVPEPVLALIGKDLPPVSGPAPAD

SEQ ID NO: 843417 - protein, 23 aa, Mycobacterium
PDVPKHAGLTYFLCDMRQPGIDI

SEQ ID NO: 843418 - protein, 20 aa, Mycobacterium
PDVPVLLRGVTKRYGSTTAV

SEQ ID NO: 843419 - protein, 22 aa, Mycobacterium
PDVQIRYVLLADFDGNPKASKD

SEQ ID NO: 843420 - protein, 25 aa, Mycobacterium
PDVRPTVWGAVPRVWEKLKAGIEFT

SEQ ID NO: 843421 - protein, 19 aa, Mycobacterium
PDVRRVPIFGLGCVAGAAG

SEQ ID NO: 843422 - protein, 18 aa, Mycobacterium
PDVVAERYGGAQYRAFDL

SEQ ID NO: 843423 - protein, 20 aa, Mycobacterium
PDVVALAPLLGVWVGEGTGE

SEQ ID NO: 843424 - protein, 23 aa, Mycobacterium
PDVVAPLAAYVPAVRTGNLVYTS

SEQ ID NO: 843425 - protein, 21 aa, Mycobacterium
PDVVCWLCARHWEMGSTDAPD

SEQ ID NO: 843426 - protein, 25 aa, Mycobacterium
PDVVDGLALFLPQATPAAKPGVQLF

SEQ ID NO: 843427 - protein, 24 aa, Mycobacterium
PDVVHAHDWLVAHPAIALAEHFDV

SEQ ID NO: 843428 - protein, 28 aa, Mycobacterium
PDVVHAHDWLVAHPAIALAQFYDVPMVS

SEQ ID NO: 843429 - protein, 25 aa, Mycobacterium
PDVVHLASPALLGWGGVHAARHLGV

SEQ ID NO: 843430 - protein, 21 aa, Mycobacterium
PDVVILDIGLPGIDGHISVVV

SEQ ID NO: 843431 - protein, 17 aa, Mycobacterium
PDVVLLDVHMPSGGGVA

SEQ ID NO: 843432 - protein, 25 aa, Mycobacterium
PDVVMGNLEFLIANGIHAVVGTTGF

SEQ ID NO: 843433 - protein, 18 aa, Mycobacterium
PDWELICGVARHLGFGDA

SEQ ID NO: 843434 - protein, 17 aa, Mycobacterium
PDWFVREHDLMSEDEAL

SEQ ID NO: 843435 - protein, 20 aa, Mycobacterium
PDWGPFLAPAAPAGAPNVLM

SEQ ID NO: 843436 - protein, 20 aa, Mycobacterium
PDWPHEAVVVGPLHFEPTSA

SEQ ID NO: 843437 - protein, 35 aa, Mycobacterium
PDWQRFHLIGAMNPVYFALLARRRMDLYGATPEDF

SEQ ID NO: 843438 - protein, 36 aa, Mycobacterium
PDWTAADLLWHLTEVHLFWAAVLFRNVTAEDGVAAV

SEQ ID NO: 843439 - protein, 20 aa, Mycobacterium
PDWTEFLALFDQAVQRRIKK

SEQ ID NO: 843440 - protein, 26 aa, Mycobacterium
PDWTSWTPYTYPFNLSQQPALTVPCG

SEQ ID NO: 843441 - protein, 18 aa, Mycobacterium
PDWVAQVVRWQTEDFAGG

SEQ ID NO: 843442 - protein, 30 aa, Mycobacterium
PDYAALIGPRCRAVWLLTARAETVGPGDAD

SEQ ID NO: 843443 - protein, 30 aa, Mycobacterium
PDYEPLCRRLVMSVPFFKAVQRPNVSVLTG

SEQ ID NO: 843444 - protein, 22 aa, Mycobacterium
PDYIIIFGADHVYRMDPEQMMQ

SEQ ID NO: 843445 - protein, 29 aa, Mycobacterium
PDYLQKGSRTLIFLPLAHVLARGIAMACF

SEQ ID NO: 843446 - protein, 26 aa, Mycobacterium
PDYPPSAIMTNYLPRYLRGISDDADS

SEQ ID NO: 843447 - protein, 21 aa, Mycobacterium
PDYRKYGFQIKLADAAFEGAP

SEQ ID NO: 843448 - protein, 17 aa, Mycobacterium
PDYSAMLEPAFGADGLR

SEQ ID NO: 843449 - protein, 17 aa, Mycobacterium
PDYVEFLTNWATSSEWE

SEQ ID NO: 843450 - protein, 20 aa, Mycobacterium
PDYVLAPRHRFPAAPQQIYD

SEQ ID NO: 843451 - protein, 19 aa, Mycobacterium
PDYVLAPRHRFPAAVHQIY

SEQ ID NO: 843452 - protein, 18 aa, Mycobacterium
PEAAHWLACGIEAAYRQP

SEQ ID NO: 843453 - protein, 29 aa, Mycobacterium
PEAAWELGIGVLLTGVWNTLQIASAHMMK

SEQ ID NO: 843454 - protein, 24 aa, Mycobacterium
PEAAYLIPALTTIRQDFAAVGRRA

SEQ ID NO: 843455 - protein, 28 aa, Mycobacterium
PEADLDVLGYWQWREGLLRGIAAHHAGM

SEQ ID NO: 843456 - protein, 18 aa, Mycobacterium
PEAFTMPGGVPLLVPFET

SEQ ID NO: 843457 - protein, 20 aa, Mycobacterium
PEAFTRLAARFLGPAITGVE

SEQ ID NO: 843458 - protein, 30 aa, Mycobacterium
PEAGGAVNVYPIVVLRKAPQPELARKFVAL

SEQ ID NO: 843459 - protein, 29 aa, Mycobacterium
PEAGKQLRLLQQYFFVSCSLQHVLHIMDD

SEQ ID NO: 843460 - protein, 26 aa, Mycobacterium
PEAGLDPKMLFLLATAKLNQAERFGV

SEQ ID NO: 843461 - protein, 26 aa, Mycobacterium
PEAIDPVLLDLLRLGAYQLLRTRVDA

SEQ ID NO: 843462 - protein, 30 aa, Mycobacterium
PEAIDPVLLDLLRLGTYQLLRTRVGSHAAV

SEQ ID NO: 843463 - protein, 18 aa, Mycobacterium
PEAKRFCWNCGKPVGRSS

SEQ ID NO: 843464 - protein, 23 aa, Mycobacterium
PEALASLKPVLDGGIHTAGTSSQ

SEQ ID NO: 843465 - protein, 20 aa, Mycobacterium
PEALRIIARQLPGSSVRSTA

SEQ ID NO: 843466 - protein, 19 aa, Mycobacterium
PEAMARLHGVLRDPHAVSG

SEQ ID NO: 843467 - protein, 29 aa, Mycobacterium
PEAPKPKRLTLFLIPMDRPGFTVRPIGSM

SEQ ID NO: 843468 - protein, 21 aa, Mycobacterium
PEAQMDRFMFKEILTYPNPAE

SEQ ID NO: 843469 - protein, 24 aa, Mycobacterium
PEAQRDRFLFKINVDYPTVEEERE

SEQ ID NO: 843470 - protein, 24 aa, Mycobacterium
PEAQRDRFLFKLNVDYPSPEEERE

SEQ ID NO: 843471 - protein, 31 aa, Mycobacterium
PEARDLVVSAWALLRKRAWFEAGSAITAPPL

SEQ ID NO: 843472 - protein, 17 aa, Mycobacterium
PEARLTIPARATLLLYT

SEQ ID NO: 843473 - protein, 26 aa, Mycobacterium
PEARRFRRFLTHEVWPAIRDTGSYST

SEQ ID NO: 843474 - protein, 23 aa, Mycobacterium
PEARRLLNDPYTLTPDRGAEPEL

SEQ ID NO: 843475 - protein, 18 aa, Mycobacterium
PEARRRGWSAGRFSFNVA

SEQ ID NO: 843476 - protein, 18 aa, Mycobacterium
PEAVLARELELCYAAVAL

SEQ ID NO: 843477 - protein, 17 aa, Mycobacterium
PEAVSLTRRMGMTGKLA

SEQ ID NO: 843478 - protein, 24 aa, Mycobacterium
PEAVTRFLVGGFVEVLRSWMEDPD

SEQ ID NO: 843479 - protein, 17 aa, Mycobacterium
PEAWWYYTFATGQHITF

SEQ ID NO: 843480 - protein, 24 aa, Mycobacterium
PEAYPVVHRILDRTGLSLAEIIGD

SEQ ID NO: 843481 - protein, 26 aa, Mycobacterium
PECAMFQRVMPWWLRAHEIPDLCRCS

SEQ ID NO: 843482 - protein, 27 aa, Mycobacterium
PECQQAVRFGLFHLLQASARAERRAIP

SEQ ID NO: 843483 - protein, 23 aa, Mycobacterium
PEDARLLLSIRRADLLDGGPDAD

SEQ ID NO: 843484 - protein, 25 aa, Mycobacterium
PEDDRGWCFTGWFDTSGSQALLGYQ

SEQ ID NO: 843485 - protein, 17 aa, Mycobacterium
PEDEPFRFVVQDATRIK

SEQ ID NO: 843486 - protein, 20 aa, Mycobacterium
PEDFYAELGLAALISPLRLR

SEQ ID NO: 843487 - protein, 17 aa, Mycobacterium
PEDIAGAVAWLVSDEAK

SEQ ID NO: 843488 - protein, 24 aa, Mycobacterium
PEDIANAVLFLASDEARFITGVTL

SEQ ID NO: 843489 - protein, 18 aa, Mycobacterium
PEDLAAIESIPLSQRGLP

SEQ ID NO: 843490 - protein, 23 aa, Mycobacterium
PEDLAARKFFRAIDMAWKRTSYS

SEQ ID NO: 843491 - protein, 28 aa, Mycobacterium
PEDLAYMIAAGLYRFSLLDIIDIGDIND

SEQ ID NO: 843492 - protein, 18 aa, Mycobacterium
PEDLPFIAVYVRDGPDTN

SEQ ID NO: 843493 - protein, 17 aa, Mycobacterium
PEDLTTLRQLRDAAAPI

SEQ ID NO: 843494 - protein, 33 aa, Mycobacterium
PEDNPMPGGMYRNQVWFPYPGSNVVLCLGMCGQ

SEQ ID NO: 843495 - protein, 26 aa, Mycobacterium
PEDPAEGFAAMWADLRRPELRQLERL

SEQ ID NO: 843496 - protein, 23 aa, Mycobacterium
PEDPDAKPRPLAKARWAGAVDCV

SEQ ID NO: 843497 - protein, 20 aa, Mycobacterium
PEDPEFTERAAPILADLRQL

SEQ ID NO: 843498 - protein, 17 aa, Mycobacterium
PEDPGVMWQFSQAVRGL

SEQ ID NO: 843499 - protein, 22 aa, Mycobacterium
PEDPGVMWQFSQAVRGLAEGCA

SEQ ID NO: 843500 - protein, 21 aa, Mycobacterium
PEDPRSVFYLAQSYYDHGDYA

SEQ ID NO: 843501 - protein, 25 aa, Mycobacterium
PEDQARVILFLASDLSSFVTGHTIA

SEQ ID NO: 843502 - protein, 24 aa, Mycobacterium
PEDRRAFAITLTDKARRLLPALDE

SEQ ID NO: 843503 - protein, 25 aa, Mycobacterium
PEDRRKLLWDNVWKPLASRSTKRGE

SEQ ID NO: 843504 - protein, 23 aa, Mycobacterium
PEDSRWTCVASAIRLGKSFEGWV

SEQ ID NO: 843505 - protein, 27 aa, Mycobacterium
PEDVNRWWTSLTPQQRQRFMAEHPDQI

SEQ ID NO: 843506 - protein, 26 aa, Mycobacterium
PEDWEQFSLWAEDIFKIVRFDSDLAN

SEQ ID NO: 843507 - protein, 24 aa, Mycobacterium
PEDWPVMPCHYTGFKLKPVGFFDG

SEQ ID NO: 843508 - protein, 31 aa, Mycobacterium
PEEANLLGIKPRSALLLITRIAYDQHDTPCE

SEQ ID NO: 843509 - protein, 17 aa, Mycobacterium
PEEDAAIAAAPFAPGMV

SEQ ID NO: 843510 - protein, 23 aa, Mycobacterium
PEEDGLVHHMLIGRAQTILGGTS

SEQ ID NO: 843511 - protein, 25 aa, Mycobacterium
PEEDHHRIFHWTNVILGFGDPDLTT

SEQ ID NO: 843512 - protein, 25 aa, Mycobacterium
PEEDHQRIFHWTNVILGFGDPDLAT

SEQ ID NO: 843513 - protein, 26 aa, Mycobacterium
PEEERTLLDELPVRKLWGIGPVAEER

SEQ ID NO: 843514 - protein, 18 aa, Mycobacterium
PEEFVEFAQYAEGLGFAG

SEQ ID NO: 843515 - protein, 26 aa, Mycobacterium
PEEIAGLLCFLVSDGASFITGQTVLA

SEQ ID NO: 843516 - protein, 22 aa, Mycobacterium
PEEIRGWVANRFYYQVNIPRKD

SEQ ID NO: 843517 - protein, 28 aa, Mycobacterium
PEEKFYPVIDGLLDAWRAAPEHPVPHTK

SEQ ID NO: 843518 - protein, 27 aa, Mycobacterium
PEELADAFAKAWYKLLHRDMGPISRYL

SEQ ID NO: 843519 - protein, 21 aa, Mycobacterium
PEELDSWLRRITAQAGGGAPV

SEQ ID NO: 843520 - protein, 28 aa, Mycobacterium
PEELMNVFAYPFATWRVYLHPTQRAVVD

SEQ ID NO: 843521 - protein, 18 aa, Mycobacterium
PEELNALQAIAALFAQLQ

SEQ ID NO: 843522 - protein, 27 aa, Mycobacterium
PEELSEAFAKAWYKLLHRDMGPISRYL

SEQ ID NO: 843523 - protein, 27 aa, Mycobacterium
PEELTEAFAKAWYKLLHRDMGPISRYL

SEQ ID NO: 843524 - protein, 28 aa, Mycobacterium
PEELTEAFAKAWYKLLHRDMGPVSRYLG

SEQ ID NO: 843525 - protein, 23 aa, Mycobacterium
PEELVARFLADLRWGGFLVTDSS

SEQ ID NO: 843526 - protein, 17 aa, Mycobacterium
PEEMAELLAFCASEKAG

SEQ ID NO: 843527 - protein, 24 aa, Mycobacterium
PEENGLYPDFPRPPVPTGDGAALD

SEQ ID NO: 843528 - protein, 28 aa, Mycobacterium
PEEQAGAILFLLSDLSGYVTGQTLLVDG

SEQ ID NO: 843529 - protein, 26 aa, Mycobacterium
PEEQEWAYRLYLNVAKRNLSINIFQY

SEQ ID NO: 843530 - protein, 26 aa, Mycobacterium
PEEQLMALLDFFGYFSGLTASRRQHP

SEQ ID NO: 843531 - protein, 26 aa, Mycobacterium
PEEQMQILLDFFGYFSDLTAARRAHP

SEQ ID NO: 843532 - protein, 23 aa, Mycobacterium
PEETFPVLVAVLTNVFDGAAVVE

SEQ ID NO: 843533 - protein, 23 aa, Mycobacterium
PEETQLMLAGVRTVFRTVEPMPD

SEQ ID NO: 843534 - protein, 20 aa, Mycobacterium
PEEVALELLRNELGARRIDN

SEQ ID NO: 843535 - protein, 19 aa, Mycobacterium
PEEVATFVVFLASDESRYS

SEQ ID NO: 843536 - protein, 17 aa, Mycobacterium
PEEVKYPPLGSFRHGAS

SEQ ID NO: 843537 - protein, 24 aa, Mycobacterium
PEEVPEAFPFLKACHHPVESDLES

SEQ ID NO: 843538 - protein, 19 aa, Mycobacterium
PEEVRGCFAEMAKVAIALG

SEQ ID NO: 843539 - protein, 17 aa, Mycobacterium
PEEVVFWDEPLPVNANG

SEQ ID NO: 843540 - protein, 25 aa, Mycobacterium
PEFAPPMPHLPEGMPAGAMPVPGVL

SEQ ID NO: 843541 - protein, 21 aa, Mycobacterium
PEFATGYRWDIVLGGGTRTPT

SEQ ID NO: 843542 - protein, 18 aa, Mycobacterium
PEFAVLQRPYQGPPVLDG

SEQ ID NO: 843543 - protein, 19 aa, Mycobacterium
PEFDCYIRDLKWAQRFAYL

SEQ ID NO: 843544 - protein, 18 aa, Mycobacterium
PEFDGRLITVPFSFKEID

SEQ ID NO: 843545 - protein, 18 aa, Mycobacterium
PEFDPFWRDVEDAGLPIV

SEQ ID NO: 843546 - protein, 20 aa, Mycobacterium
PEFELARWSVRNLSPTDRAL

SEQ ID NO: 843547 - protein, 20 aa, Mycobacterium
PEFHLDNPLNYMTPELRAMA

SEQ ID NO: 843548 - protein, 18 aa, Mycobacterium
PEFHLVDTAVLHLGAIPF

SEQ ID NO: 843549 - protein, 27 aa, Mycobacterium
PEFIGRLMELAPLRKIVYSSDGFGPAE

SEQ ID NO: 843550 - protein, 18 aa, Mycobacterium
PEFKLIPIDEATWAPAQI

SEQ ID NO: 843551 - protein, 21 aa, Mycobacterium
PEFKRYWIDDTPQLRYAVPEE

SEQ ID NO: 843552 - protein, 19 aa, Mycobacterium
PEFLAMLHRSEDAVIAAAE

SEQ ID NO: 843553 - protein, 25 aa, Mycobacterium
PEFLDYFAAHHVQVPLRRGDAVFFN

SEQ ID NO: 843554 - protein, 19 aa, Mycobacterium
PEFLTAAANDLSGIGDAVR

SEQ ID NO: 843555 - protein, 17 aa, Mycobacterium
PEFPAFERSTADVVDLI

SEQ ID NO: 843556 - protein, 17 aa, Mycobacterium
PEFPIPTLPVPELNRPT

SEQ ID NO: 843557 - protein, 17 aa, Mycobacterium
PEFRRKAVIIAVGGVYD

SEQ ID NO: 843558 - protein, 18 aa, Mycobacterium
PEFTLLPDEQWSTLSETE

SEQ ID NO: 843559 - protein, 19 aa, Mycobacterium
PEFVENFFMFIAEEVRELM

SEQ ID NO: 843560 - protein, 21 aa, Mycobacterium
PEFVENFFMFIAEEVRELMAE

SEQ ID NO: 843561 - protein, 33 aa, Mycobacterium
PEFVENFFTFIAEDIRRYLAELGFRSIDEAVGH

SEQ ID NO: 843562 - protein, 24 aa, Mycobacterium
PEGAQLISNWRWSDALFTPSDIDH

SEQ ID NO: 843563 - protein, 26 aa, Mycobacterium
PEGARALVKFWDALGGDGVFGGSLIR

SEQ ID NO: 843564 - protein, 25 aa, Mycobacterium
PEGARAVFFVVEADRRQLTILENKL

SEQ ID NO: 843565 - protein, 29 aa, Mycobacterium
PEGDHPAPLLLWIHGGPLASWNAWHWRWN

SEQ ID NO: 843566 - protein, 28 aa, Mycobacterium
PEGDNLDPLFDVLLEHIPPPKGDPEAPL

SEQ ID NO: 843567 - protein, 25 aa, Mycobacterium
PEGDTVAMALQLWVAAHGVASMLVT

SEQ ID NO: 843568 - protein, 39 aa, Mycobacterium
PEGELYFPGSPVLTLRGSFAECVILETLILSILNHDSAV

SEQ ID NO: 843569 - protein, 22 aa, Mycobacterium
PEGFAWVRSNSMRTVLLRHCPS

SEQ ID NO: 843570 - protein, 31 aa, Mycobacterium
PEGFEPSLDLFLTPTFRGYLANYGAVLYPEL

SEQ ID NO: 843571 - protein, 34 aa, Mycobacterium
PEGFEPSMDLFLTPTFRGYLANYGAVLYPELHDC

SEQ ID NO: 843572 - protein, 24 aa, Mycobacterium
PEGFIGHLFATMKPYAPPPPPGAS

SEQ ID NO: 843573 - protein, 30 aa, Mycobacterium
PEGFSPSLDLFLTPTFRGYLANYGAVLYPQ

SEQ ID NO: 843574 - protein, 22 aa, Mycobacterium
PEGFTNGFLMVLHDGAGDMVGM

SEQ ID NO: 843575 - protein, 26 aa, Mycobacterium
PEGGGYPPQPGYPPPPRQPDQGGGYP

SEQ ID NO: 843576 - protein, 23 aa, Mycobacterium
PEGGWPVIAWAHGTVGLGDDCAP

SEQ ID NO: 843577 - protein, 20 aa, Mycobacterium
PEGIEGRVPFRGPLASVIHQ

SEQ ID NO: 843578 - protein, 19 aa, Mycobacterium
PEGIEGRVPFRGPLSTVMH

SEQ ID NO: 843579 - protein, 32 aa, Mycobacterium
PEGKMAAVAKRRGWPILRFSSRGPVGLRRQVR

SEQ ID NO: 843580 - protein, 34 aa, Mycobacterium
PEGLKKNLRRRNGRWYWHWDPAFLTKPSEDPFAR

SEQ ID NO: 843581 - protein, 17 aa, Mycobacterium
PEGLLDRALELAGRIAE

SEQ ID NO: 843582 - protein, 30 aa, Mycobacterium
PEGLPHIPVRLHARSWHRYPEPSPDATAMI

SEQ ID NO: 843583 - protein, 28 aa, Mycobacterium
PEGLRGLYEFFTPLLRNLGHSARVAVVG

SEQ ID NO: 843584 - protein, 25 aa, Mycobacterium
PEGLVAMYDGSFWVSDEYGPYLIHF

SEQ ID NO: 843585 - protein, 23 aa, Mycobacterium
PEGMAGALRRLGLGPWEVEVVQA

SEQ ID NO: 843586 - protein, 19 aa, Mycobacterium
PEGNLWSFGDYRGAPCPPG

SEQ ID NO: 843587 - protein, 19 aa, Mycobacterium
PEGNWLTRAPSLRRKAILM

SEQ ID NO: 843588 - protein, 25 aa, Mycobacterium
PEGPQLLTNWQLSSALFTPADASRL

SEQ ID NO: 843589 - protein, 32 aa, Mycobacterium
PEGPRPYLRIEGTSVFRWAAFEMGKVGQRAME

SEQ ID NO: 843590 - protein, 20 aa, Mycobacterium
PEGRDLLFGLVKCSDILVEN

SEQ ID NO: 843591 - protein, 35 aa, Mycobacterium
PEGRDNPMYAMLMPQPRLVRLLEKRARDLGVDVRW

SEQ ID NO: 843592 - protein, 41 aa, Mycobacterium
PEGRTRFRPHFFPFTEPSAEVDIWFPGKKGGPGWVEWGGCG

SEQ ID NO: 843593 - protein, 21 aa, Mycobacterium
PEGRYEYRWWDGQSWTDQVSH

SEQ ID NO: 843594 - protein, 26 aa, Mycobacterium
PEGSGFLQIMQQFQVERAFIAVQCYA

SEQ ID NO: 843595 - protein, 24 aa, Mycobacterium
PEGSKPFDFVFHGGSGSLKSEIED

SEQ ID NO: 843596 - protein, 25 aa, Mycobacterium
PEGSMLVPFSWQRISLHAAGATAVR

SEQ ID NO: 843597 - protein, 22 aa, Mycobacterium
PEGTDPFVMLFSESAGRVLVAV

SEQ ID NO: 843598 - protein, 24 aa, Mycobacterium
PEGVGAWLVLCCRAIRAGAQEALT

SEQ ID NO: 843599 - protein, 23 aa, Mycobacterium
PEHADLLLRWAGELAPGSWIGVQ

SEQ ID NO: 843600 - protein, 25 aa, Mycobacterium
PEHEPILFAPGILASMWGIQVRSLA

SEQ ID NO: 843601 - protein, 35 aa, Mycobacterium
PEHESLGWDLGALRKAWNLAKHEVAPWWATNSKEC

SEQ ID NO: 843602 - protein, 35 aa, Mycobacterium
PEHHPPMRAFLAVPITIRETVFGNLYLTHVDPERV

SEQ ID NO: 843603 - protein, 30 aa, Mycobacterium
PEHLIKADMTWLLSHWTCVFGTPACQGTVA

SEQ ID NO: 843604 - protein, 18 aa, Mycobacterium
PEHLLVDRASQLTLTAPQ

SEQ ID NO: 843605 - protein, 24 aa, Mycobacterium
PEHQLPEVFTPQGAPRKPLSCDPD

SEQ ID NO: 843606 - protein, 23 aa, Mycobacterium
PEHQRLRRMLTPEFTHRRMQRLR

SEQ ID NO: 843607 - protein, 24 aa, Mycobacterium
PEHQRLRRMLTPEFTIRRIKRLEP

SEQ ID NO: 843608 - protein, 24 aa, Mycobacterium
PEHQVRFRWAPDSVAIWDNRAVQH

SEQ ID NO: 843609 - protein, 23 aa, Mycobacterium
PEHRFVAANAAYRRFSPTFTAVG

SEQ ID NO: 843610 - protein, 25 aa, Mycobacterium
PEHRHWLRRAVAAAAAWVRGGYDQD

SEQ ID NO: 843611 - protein, 27 aa, Mycobacterium
PEHTGFRALLSPYLTRKFALTYADEMR

SEQ ID NO: 843612 - protein, 20 aa, Mycobacterium
PEHTYHVALPGRGEPKRAIL

SEQ ID NO: 843613 - protein, 23 aa, Mycobacterium
PEHTYRVPLPEPGEPKRAILDSY

SEQ ID NO: 843614 - protein, 20 aa, Mycobacterium
PEIAALLTGRGYRLEGFENV

SEQ ID NO: 843615 - protein, 24 aa, Mycobacterium
PEIAEQLLRVLARRLRHTNNTLCD

SEQ ID NO: 843616 - protein, 25 aa, Mycobacterium
PEIAEQLLRVLARRLRRTNDALSDL

SEQ ID NO: 843617 - protein, 23 aa, Mycobacterium
PEIARAYVTALRDLLRALDVSDV

SEQ ID NO: 843618 - protein, 24 aa, Mycobacterium
PEIARAYVTALRDLLRALDVSDVR

SEQ ID NO: 843619 - protein, 21 aa, Mycobacterium
PEIDKGARWDPAELGPVVADL

SEQ ID NO: 843620 - protein, 21 aa, Mycobacterium
PEIDKGARWDPAELGPVVGDL

SEQ ID NO: 843621 - protein, 19 aa, Mycobacterium
PEIDLAGLRFRQCQMSDND

SEQ ID NO: 843622 - protein, 22 aa, Mycobacterium
PEIDPLFAQLKAHGIRLVPVRH

SEQ ID NO: 843623 - protein, 26 aa, Mycobacterium
PEIEKMQGWLQEWGVSSSPAPAPTST

SEQ ID NO: 843624 - protein, 29 aa, Mycobacterium
PEIEQMQAWLTQWGMSTMPMMPGMDGMPG

SEQ ID NO: 843625 - protein, 25 aa, Mycobacterium
PEIEQMQGWLQEWGASSSPAPATST

SEQ ID NO: 843626 - protein, 26 aa, Mycobacterium
PEIEQMQGWLQEWGVGSTPPGDGTMP

SEQ ID NO: 843627 - protein, 27 aa, Mycobacterium
PEIERRFTPGWTLLFSGDEQELDDRKT

SEQ ID NO: 843628 - protein, 20 aa, Mycobacterium
PEIFPVNYVVQRQTILFRTA

SEQ ID NO: 843629 - protein, 20 aa, Mycobacterium
PEIGARLFISARTVQYHLGK

SEQ ID NO: 843630 - protein, 24 aa, Mycobacterium
PEIGARLFISPRTVQYHLRKVFTK

SEQ ID NO: 843631 - protein, 24 aa, Mycobacterium
PEIKAPPAGGTPVGLPSGKPLEAP

SEQ ID NO: 843632 - protein, 18 aa, Mycobacterium
PEILLLDEGIGAVDAEFL

SEQ ID NO: 843633 - protein, 19 aa, Mycobacterium
PEILLLDEGIGAVDAEFMK

SEQ ID NO: 843634 - protein, 21 aa, Mycobacterium
PEILLSFGFVPKMEAKVGLIN

SEQ ID NO: 843635 - protein, 17 aa, Mycobacterium
PEILLTGIIVNKNGDRF

SEQ ID NO: 843636 - protein, 18 aa, Mycobacterium
PEILLTGVIVNKEGKRFV

SEQ ID NO: 843637 - protein, 22 aa, Mycobacterium
PEILQLFSALELLHAWALIHDD

SEQ ID NO: 843638 - protein, 23 aa, Mycobacterium
PEILRTNLAAVILQMAALQLGDI

SEQ ID NO: 843639 - protein, 20 aa, Mycobacterium
PEIMGLGPIEAVKKALANAK

SEQ ID NO: 843640 - protein, 21 aa, Mycobacterium
PEIMGLGPIEAVKKALANANM

SEQ ID NO: 843641 - protein, 25 aa, Mycobacterium
PEINSARLTIGAGLGPMLEAANAWQ

SEQ ID NO: 843642 - protein, 24 aa, Mycobacterium
PEINSARMFVGAGPGPMLSAAAAW

SEQ ID NO: 843643 - protein, 23 aa, Mycobacterium
PEINSARMYAGPGSAPMSAAASA

SEQ ID NO: 843644 - protein, 20 aa, Mycobacterium
PEINSARMYAGPGSGPMLVA

SEQ ID NO: 843645 - protein, 19 aa, Mycobacterium
PEINSGRMYIGPGSGPMLA

SEQ ID NO: 843646 - protein, 24 aa, Mycobacterium
PEINSLRMFGGAGSAPMLSAAAAW

SEQ ID NO: 843647 - protein, 21 aa, Mycobacterium
PEINSLRMFNGAGSTPMLQAS

SEQ ID NO: 843648 - protein, 21 aa, Mycobacterium
PEINSLRMYTGAGAAPMMAAA

SEQ ID NO: 843649 - protein, 24 aa, Mycobacterium
PEINSTRMYAGPGSAPMVAAAAAW

SEQ ID NO: 843650 - protein, 38 aa, Mycobacterium
PEINSVRIFAGAGPQPMLAAATAWDGLAGELAGAASSF

SEQ ID NO: 843651 - protein, 25 aa, Mycobacterium
PEINSVRMFAGAGAAPMLDAAVAWG

SEQ ID NO: 843652 - protein, 19 aa, Mycobacterium
PEIPVIDNISYLLGDDEHP

SEQ ID NO: 843653 - protein, 21 aa, Mycobacterium
PEIRPAHLLMALLTQNDGIAA

SEQ ID NO: 843654 - protein, 20 aa, Mycobacterium
PEIRYLLERRRALGGFVPSR

SEQ ID NO: 843655 - protein, 29 aa, Mycobacterium
PEISPLQARCGWAIGWKKDAFFGRDALLA

SEQ ID NO: 843656 - protein, 26 aa, Mycobacterium
PEITELEINPLLLTPDHALGLDARIV

SEQ ID NO: 843657 - protein, 23 aa, Mycobacterium
PEIVADAVLYLASPHNTYITGEV

SEQ ID NO: 843658 - protein, 22 aa, Mycobacterium
PEIVGEILPAESAPPAPVETGY

SEQ ID NO: 843659 - protein, 18 aa, Mycobacterium
PEIWKRLDAVGLQTTEAC

SEQ ID NO: 843660 - protein, 18 aa, Mycobacterium
PEIWRGIIDLDESMPAEL

SEQ ID NO: 843661 - protein, 17 aa, Mycobacterium
PEIWRRLADVGLQTAEA

SEQ ID NO: 843662 - protein, 19 aa, Mycobacterium
PEKKPEPAKPEPTPAPVVA

SEQ ID NO: 843663 - protein, 19 aa, Mycobacterium
PEKLAKFRDAEKLTFPLLS

SEQ ID NO: 843664 - protein, 20 aa, Mycobacterium
PEKLAKFRDAEKLTFPLLSD

SEQ ID NO: 843665 - protein, 17 aa, Mycobacterium
PEKLRYSPGQFLTLRVP

SEQ ID NO: 843666 - protein, 18 aa, Mycobacterium
PEKNRLPLAVGLKAPLSC

SEQ ID NO: 843667 - protein, 17 aa, Mycobacterium
PEKPGPVAPRYHGRHQL

SEQ ID NO: 843668 - protein, 21 aa, Mycobacterium
PEKQREILILRVVVGLSAEET

SEQ ID NO: 843669 - protein, 23 aa, Mycobacterium
PEKQREILILRVVVGMSAEETAE

SEQ ID NO: 843670 - protein, 31 aa, Mycobacterium
PEKRRAQTVLPLLHAFRAPQAPLRGAPEPTE

SEQ ID NO: 843671 - protein, 23 aa, Mycobacterium
PEKSLDDLRLFAGLVAAARAYAD

SEQ ID NO: 843672 - protein, 28 aa, Mycobacterium
PEKVARFLFGLARRYGPNWLAGAQLALI

SEQ ID NO: 843673 - protein, 25 aa, Mycobacterium
PEKVWPWLVDPDRLRQWSPAIPDRP

SEQ ID NO: 843674 - protein, 20 aa, Mycobacterium
PELAARLSAALSASLSGSLS

SEQ ID NO: 843675 - protein, 20 aa, Mycobacterium
PELADLLLARAMNVPELTPL

SEQ ID NO: 843676 - protein, 27 aa, Mycobacterium
PELAEAALAIRAGALWVAANVDKTLPT

SEQ ID NO: 843677 - protein, 36 aa, Mycobacterium
PELAKAVELLPVPQGWGLGFHLYHVDLPGMRSAGSG

SEQ ID NO: 843678 - protein, 18 aa, Mycobacterium
PELAVLVGGLRVLGANYQ

SEQ ID NO: 843679 - protein, 27 aa, Mycobacterium
PELAYFEVLHELKLIVDLMYEGGIARM

SEQ ID NO: 843680 - protein, 22 aa, Mycobacterium
PELAYSWRHQIPMLAEAGYHVV

SEQ ID NO: 843681 - protein, 26 aa, Mycobacterium
PELCALSWTVYSLPGAPVLDHHELGD

SEQ ID NO: 843682 - protein, 23 aa, Mycobacterium
PELDALIGFFINIVVLRNDLSGN

SEQ ID NO: 843683 - protein, 17 aa, Mycobacterium
PELDNFLRDDFLRNFWM

SEQ ID NO: 843684 - protein, 18 aa, Mycobacterium
PELEDLLTALRLDDAFTG

SEQ ID NO: 843685 - protein, 23 aa, Mycobacterium
PELEEWLGISRTPIREALARLET

SEQ ID NO: 843686 - protein, 22 aa, Mycobacterium
PELERRILLSRVPELPGHLAEE

SEQ ID NO: 843687 - protein, 22 aa, Mycobacterium
PELERRILLSRVPELPQHLAEE

SEQ ID NO: 843688 - protein, 20 aa, Mycobacterium
PELFPWTPQTHRELLRQPRL

SEQ ID NO: 843689 - protein, 21 aa, Mycobacterium
PELGITMDAFIALRAEYRNVC

SEQ ID NO: 843690 - protein, 22 aa, Mycobacterium
PELGRFGVWLGSRSITPELAGQ

SEQ ID NO: 843691 - protein, 26 aa, Mycobacterium
PELGYRLLQRLGADVAEYGFVETSAK

SEQ ID NO: 843692 - protein, 27 aa, Mycobacterium
PELHLLGSVLWRRAMGLVLGGWVRAGD

SEQ ID NO: 843693 - protein, 23 aa, Mycobacterium
PELISRWAAYFPPAGAEAMFRWM

SEQ ID NO: 843694 - protein, 20 aa, Mycobacterium
PELITVRGRRLLARADVVVA

SEQ ID NO: 843695 - protein, 17 aa, Mycobacterium
PELKLHGDPTFIISTAL

SEQ ID NO: 843696 - protein, 23 aa, Mycobacterium
PELKLHGTPTFIISTALATRDFQ

SEQ ID NO: 843697 - protein, 34 aa, Mycobacterium
PELLDPVIDVHLYGTIWVTQPAFLRMREQGYGRI

SEQ ID NO: 843698 - protein, 19 aa, Mycobacterium
PELLPRITAMTVRDGKVCA

SEQ ID NO: 843699 - protein, 18 aa, Mycobacterium
PELLQPIRRMAHGCASSA

SEQ ID NO: 843700 - protein, 19 aa, Mycobacterium
PELMRLRERMRNWRFYDHL

SEQ ID NO: 843701 - protein, 25 aa, Mycobacterium
PELPADTRWHPVNALPPMAFDHGPM

SEQ ID NO: 843702 - protein, 23 aa, Mycobacterium
PELPGRVLIVGSGFIAAEFAHVF

SEQ ID NO: 843703 - protein, 24 aa, Mycobacterium
PELPRGFKHRPCHLSLAWTKPKTK

SEQ ID NO: 843704 - protein, 21 aa, Mycobacterium
PELPWELLRRSAIGAVSVDAG

SEQ ID NO: 843705 - protein, 17 aa, Mycobacterium
PELRALIEAAWAKLAAP

SEQ ID NO: 843706 - protein, 20 aa, Mycobacterium
PELRQFERLFFECYARAAQG

SEQ ID NO: 843707 - protein, 19 aa, Mycobacterium
PELRQLERLFFECYSRAAQ

SEQ ID NO: 843708 - protein, 25 aa, Mycobacterium
PELRSYLDAIFAKYAAPGVCHPDDE

SEQ ID NO: 843709 - protein, 25 aa, Mycobacterium
PELSALAWTVYSLPGAPAVDHYELA

SEQ ID NO: 843710 - protein, 25 aa, Mycobacterium
PELSGLARAIGFRDPARRLSLVTAI

SEQ ID NO: 843711 - protein, 33 aa, Mycobacterium
PELSLYALRDSVGTPFLLLAGLEPDLKWERFIT

SEQ ID NO: 843712 - protein, 33 aa, Mycobacterium
PELSLYALRDTIGTPFLLLAGMEPDLKWERFIT

SEQ ID NO: 843713 - protein, 34 aa, Mycobacterium
PELSLYALRDTVGTPFLLLAGMEPDLKWERFITA

SEQ ID NO: 843714 - protein, 18 aa, Mycobacterium
PELSPPRVFGALRINVDG

SEQ ID NO: 843715 - protein, 27 aa, Mycobacterium
PELTGKWLGAFFMGPVNTRIVRRSNAL

SEQ ID NO: 843716 - protein, 26 aa, Mycobacterium
PELTRLLVSVTGGFPFLVSAALSAIP

SEQ ID NO: 843717 - protein, 19 aa, Mycobacterium
PELTSMICWMIVGLPLDSR

SEQ ID NO: 843718 - protein, 24 aa, Mycobacterium
PELVALLAGRRIAVLTGAGLSTDS

SEQ ID NO: 843719 - protein, 18 aa, Mycobacterium
PELVAPWEEPFEPTDPEV

SEQ ID NO: 843720 - protein, 24 aa, Mycobacterium
PELVDHLVYLAAFVPAARPRFTDY

SEQ ID NO: 843721 - protein, 24 aa, Mycobacterium
PELVGEVLAVIKDLADAGWTMVIV

SEQ ID NO: 843722 - protein, 25 aa, Mycobacterium
PELVKLRQYFDHPSLVQLYAEAVSA

SEQ ID NO: 843723 - protein, 30 aa, Mycobacterium
PELVPDHISLWGSLIQFRRHFDQYVNLRPV

SEQ ID NO: 843724 - protein, 23 aa, Mycobacterium
PELVRRLCWEWAGPRQGAADAID

SEQ ID NO: 843725 - protein, 17 aa, Mycobacterium
PELVRRLVVAGSSPGGG

SEQ ID NO: 843726 - protein, 22 aa, Mycobacterium
PELVRRWRAGYFSALDASSGGH

SEQ ID NO: 843727 - protein, 18 aa, Mycobacterium
PELWKDLGAAGLLGVHLP

SEQ ID NO: 843728 - protein, 38 aa, Mycobacterium
PELYGRLMAYLPTAIAPAAFRWLGRRDAPNRLMNVAVS

SEQ ID NO: 843729 - protein, 28 aa, Mycobacterium
PELYIAMLGALRNGSVVSPLFSAFGPEP

SEQ ID NO: 843730 - protein, 22 aa, Mycobacterium
PEMGMVKIFNLLTGMLDDHRYV

SEQ ID NO: 843731 - protein, 23 aa, Mycobacterium
PEMGMVKVFNLLTGLLDDHSYLV

SEQ ID NO: 843732 - protein, 24 aa, Mycobacterium
PEMGRAILALYRSAADTAAVAEAG

SEQ ID NO: 843733 - protein, 25 aa, Mycobacterium
PEMGRPRFGSWLRNSTRGALAMDPR

SEQ ID NO: 843734 - protein, 34 aa, Mycobacterium
PEMHLFTILGQRQLLFWTWLAYGGRLLRGKLPTI

SEQ ID NO: 843735 - protein, 17 aa, Mycobacterium
PEMIRWPGKISAGVVSN

SEQ ID NO: 843736 - protein, 34 aa, Mycobacterium
PEMLPPGVSTLSWLDAAQLPLALLSSDMRDRQII

SEQ ID NO: 843737 - protein, 25 aa, Mycobacterium
PEMNLGQLALVLRGKYLVDIQSVTK

SEQ ID NO: 843738 - protein, 25 aa, Mycobacterium
PEMNLGQLALVLRGKYLVDVQSVSK

SEQ ID NO: 843739 - protein, 25 aa, Mycobacterium
PEMNLGQLALVLRGKYLVDVQSVTK

SEQ ID NO: 843740 - protein, 36 aa, Mycobacterium
PEMPIGAVLLSWLPLFHDMGLILGICAPLVAGRSAV

SEQ ID NO: 843741 - protein, 19 aa, Mycobacterium
PEMPRTASLDILLRRNPRG

SEQ ID NO: 843742 - protein, 18 aa, Mycobacterium
PEMREWLRNWIAKATGVS

SEQ ID NO: 843743 - protein, 20 aa, Mycobacterium
PEMRPYIAEVSRIADTFVSC

SEQ ID NO: 843744 - protein, 30 aa, Mycobacterium
PEMVPLSFAQSRLWFMGQLHGPSPVHNMAI

SEQ ID NO: 843745 - protein, 26 aa, Mycobacterium
PENADWDLIMRIASPRGFMATEDVAK

SEQ ID NO: 843746 - protein, 17 aa, Mycobacterium
PENAGVGGFAWLTLGSV

SEQ ID NO: 843747 - protein, 17 aa, Mycobacterium
PENLDGAWMSPSSRYRA

SEQ ID NO: 843748 - protein, 21 aa, Mycobacterium
PENLPVGYYTQPTLLADVDPD

SEQ ID NO: 843749 - protein, 22 aa, Mycobacterium
PENPDPLGMPLQTALIGDAQLR

SEQ ID NO: 843750 - protein, 25 aa, Mycobacterium
PENPTLVPAERYYSPAFAALEVERM

SEQ ID NO: 843751 - protein, 24 aa, Mycobacterium
PENRLMVYRRTLSRRWAGPAFLLN

SEQ ID NO: 843752 - protein, 26 aa, Mycobacterium
PENVKFFFTGIPWKTYPQTLKAFVAL

SEQ ID NO: 843753 - protein, 23 aa, Mycobacterium
PENVYFYMTVYNEPYVQPPEPEN

SEQ ID NO: 843754 - protein, 18 aa, Mycobacterium
PENWWAPQPPTEPDLTAP

SEQ ID NO: 843755 - protein, 23 aa, Mycobacterium
PENWWEWHKLIGPLAADGYRVLC

SEQ ID NO: 843756 - protein, 17 aa, Mycobacterium
PEPAAEMFFAALATGDI

SEQ ID NO: 843757 - protein, 19 aa, Mycobacterium
PEPAKPEPTPAPVVAAAPA

SEQ ID NO: 843758 - protein, 20 aa, Mycobacterium
PEPALLDLIARFVRAAQGER

SEQ ID NO: 843759 - protein, 23 aa, Mycobacterium
PEPALPSLRRLIESPRHDVVAVL

SEQ ID NO: 843760 - protein, 24 aa, Mycobacterium
PEPAPAPPQPVYEAPAQPAAPQSE

SEQ ID NO: 843761 - protein, 30 aa, Mycobacterium
PEPAQRLVAVARLRLLCREFGITEIGAVSA

SEQ ID NO: 843762 - protein, 23 aa, Mycobacterium
PEPDWPQTDGPKYAWLHENRPLI

SEQ ID NO: 843763 - protein, 23 aa, Mycobacterium
PEPEVLSVLRRLAPRARITARVG

SEQ ID NO: 843764 - protein, 19 aa, Mycobacterium
PEPGFRIVWGISRNTRRWW

SEQ ID NO: 843765 - protein, 26 aa, Mycobacterium
PEPGLDPKMLFLLATAKLNQAERFGV

SEQ ID NO: 843766 - protein, 25 aa, Mycobacterium
PEPHPAIPATPWQHTRHWITAAAGA

SEQ ID NO: 843767 - protein, 25 aa, Mycobacterium
PEPHPTLPTTPWQHTRHWVDATSPS

SEQ ID NO: 843768 - protein, 18 aa, Mycobacterium
PEPHRRPLQVIAESARTL

SEQ ID NO: 843769 - protein, 24 aa, Mycobacterium
PEPKGCVFEYVYLARPDSTLVGRS

SEQ ID NO: 843770 - protein, 24 aa, Mycobacterium
PEPLDELRLLANILGVARDAEVLA

SEQ ID NO: 843771 - protein, 17 aa, Mycobacterium
PEPLGMPLQYMVSGMAV

SEQ ID NO: 843772 - protein, 26 aa, Mycobacterium
PEPLKASVLLAWDQAIRRVRGRGAAR

SEQ ID NO: 843773 - protein, 18 aa, Mycobacterium
PEPLPAGPTRRVPLGRIA

SEQ ID NO: 843774 - protein, 17 aa, Mycobacterium
PEPMRIPLALVELVKRE

SEQ ID NO: 843775 - protein, 52 aa, Mycobacterium
PEPPAEPLPTNFPGPRPAFGTPSYFAQLAFAVLHVLALPITVPVQAIIGKTE

SEQ ID NO: 843776 - protein, 25 aa, Mycobacterium
PEPPERTRMWWRPAESIPNDPVLNC

SEQ ID NO: 843777 - protein, 25 aa, Mycobacterium
PEPTLSRTAALWHLSTSISARLRQS

SEQ ID NO: 843778 - protein, 20 aa, Mycobacterium
PEPTRYWRQATCAMPDYAEV

SEQ ID NO: 843779 - protein, 27 aa, Mycobacterium
PEPVDNPFFAWLWKTLSTHETESVRRM

SEQ ID NO: 843780 - protein, 22 aa, Mycobacterium
PEPVLHAALGPGALVAEVGSEQ

SEQ ID NO: 843781 - protein, 30 aa, Mycobacterium
PEPVREILSMWRPSPLIRARRFEKALNTGA

SEQ ID NO: 843782 - protein, 27 aa, Mycobacterium
PEPWRVEALVLLAFSAYVRGDGPLAGI

SEQ ID NO: 843783 - protein, 26 aa, Mycobacterium
PEPWRVEALVLLGFSAYARGDGPLAG

SEQ ID NO: 843784 - protein, 22 aa, Mycobacterium
PEPYLTGAHLLGLEPRVCAVFE

SEQ ID NO: 843785 - protein, 19 aa, Mycobacterium
PEQDLPLLRPGDEVYVSWA

SEQ ID NO: 843786 - protein, 28 aa, Mycobacterium
PEQEYFLVDRHFFLARPDLINAGRTLFG

SEQ ID NO: 843787 - protein, 18 aa, Mycobacterium
PEQFTPKRMTYELFGSPG

SEQ ID NO: 843788 - protein, 23 aa, Mycobacterium
PEQFWQALLRGEDFITEVPPARW

SEQ ID NO: 843789 - protein, 26 aa, Mycobacterium
PEQGPTRGWWEPTVQRYLLTDSQTAG

SEQ ID NO: 843790 - protein, 25 aa, Mycobacterium
PEQGWMLSAVWLHPDNEPGVLILAV

SEQ ID NO: 843791 - protein, 24 aa, Mycobacterium
PEQIAKTWLSMGPSIVAVTAGGEG

SEQ ID NO: 843792 - protein, 20 aa, Mycobacterium
PEQKKRWLPGFVSGRLIAAI

SEQ ID NO: 843793 - protein, 28 aa, Mycobacterium
PEQLFAIGYAACFHSALRMIGRQEKADI

SEQ ID NO: 843794 - protein, 25 aa, Mycobacterium
PEQLNGIFAVNVNGTFYAVQACLDA

SEQ ID NO: 843795 - protein, 26 aa, Mycobacterium
PEQMQRFLRGWGDALWDTGIEFGTLG

SEQ ID NO: 843796 - protein, 27 aa, Mycobacterium
PEQMSALLMAIFWRGMDSGETARWTSA

SEQ ID NO: 843797 - protein, 25 aa, Mycobacterium
PEQQIDVEKLLRLIEYGLTPSGPGP

SEQ ID NO: 843798 - protein, 24 aa, Mycobacterium
PEQTARAWLACGPAIVALTLGDQG

SEQ ID NO: 843799 - protein, 21 aa, Mycobacterium
PEQVKRWWDSLRDEQRRLLVD

SEQ ID NO: 843800 - protein, 23 aa, Mycobacterium
PEQVQNILRRWADNLWDTGIQFG

SEQ ID NO: 843801 - protein, 23 aa, Mycobacterium
PEQWGGLQCDPTLFYEAVRRIAS

SEQ ID NO: 843802 - protein, 24 aa, Mycobacterium
PEQWGGLQCDPTLFYEAVRRLASA

SEQ ID NO: 843803 - protein, 21 aa, Mycobacterium
PERAKYLASTYSVLVTSAKDA

SEQ ID NO: 843804 - protein, 23 aa, Mycobacterium
PERDFPTLIDLYQQGRLPLDKFV

SEQ ID NO: 843805 - protein, 20 aa, Mycobacterium
PERDFPTLVSLYQQGRLPLD

SEQ ID NO: 843806 - protein, 24 aa, Mycobacterium
PERDRAIILTALLAGLRAAELRGA

SEQ ID NO: 843807 - protein, 19 aa, Mycobacterium
PERDRVLVEGVNRIKKHTA

SEQ ID NO: 843808 - protein, 25 aa, Mycobacterium
PERDTGAWRAIWSYSAKRARRDQKT

SEQ ID NO: 843809 - protein, 24 aa, Mycobacterium
PERERTVLVLRFFESMTQTQIAER

SEQ ID NO: 843810 - protein, 19 aa, Mycobacterium
PERFLRLITDHRVTFLTTV

SEQ ID NO: 843811 - protein, 23 aa, Mycobacterium
PERGARTFLISVAAELAGMHAQT

SEQ ID NO: 843812 - protein, 25 aa, Mycobacterium
PERGLLLAHHPLLLRGVDTVAANTA

SEQ ID NO: 843813 - protein, 25 aa, Mycobacterium
PERGPAWHLGVLPLTDGSTAVSLVA

SEQ ID NO: 843814 - protein, 30 aa, Mycobacterium; identical to SEQ ID NO: 129972

SEQ ID NO: 843815 - protein, 26 aa, Mycobacterium
PERGYHLELITPVPLPRKPSGDLARL

SEQ ID NO: 843816 - protein, 34 aa, Mycobacterium
PERHLDFPALAALADVFYPRVFLGLGRSVPAGTV

SEQ ID NO: 843817 - protein, 21 aa, Mycobacterium
PERIDTDVLAALRAAERDPAG

SEQ ID NO: 843818 - protein, 23 aa, Mycobacterium
PERLRALERLERVARRLRAPQHA

SEQ ID NO: 843819 - protein, 21 aa, Mycobacterium
PERLSLFLVPTDAPGLVKHRL

SEQ ID NO: 843820 - protein, 19 aa, Mycobacterium
PERLVIDPGLGFAKTAEHN

SEQ ID NO: 843821 - protein, 30 aa, Mycobacterium
PERMEAVLDNPLILLTNKKISQVQEIMPTL

SEQ ID NO: 843822 - protein, 23 aa, Mycobacterium
PERMRLGALARHIAEELPLLGSC

SEQ ID NO: 843823 - protein, 24 aa, Mycobacterium
PERNRPWPYASRRPPTPRPSRLRR

SEQ ID NO: 843824 - protein, 19 aa, Mycobacterium
PERNRVLVEGVNRIKKHTA

SEQ ID NO: 843825 - protein, 18 aa, Mycobacterium
PERQPLLSYFRLHEQRRE

SEQ ID NO: 843826 - protein, 29 aa, Mycobacterium
PERQRQASLLPLLHNYQQPSPPVCGAMAP

SEQ ID NO: 843827 - protein, 26 aa, Mycobacterium
PERQRQYSLLPLLHNYQQPEKPINGS

SEQ ID NO: 843828 - protein, 18 aa, Mycobacterium
PERRAGVAVVPILADINA

SEQ ID NO: 843829 - protein, 34 aa, Mycobacterium
PERRARLMLEMHVLGPLQLSQLAIPAMRERGRGW

SEQ ID NO: 843830 - protein, 31 aa, Mycobacterium
PERRDDTLSPWPTWPLVLRTSPAHAEGGARR

SEQ ID NO: 843831 - protein, 25 aa, Mycobacterium
PERTRWGLPVDRLRFAMSNYQRLTF

SEQ ID NO: 843832 - protein, 34 aa, Mycobacterium
PERVELRYIMPLGEIIFDFFDSLKSRTRGYASLD

SEQ ID NO: 843833 - protein, 19 aa, Mycobacterium
PERVELRYTMPLGEIIFDF

SEQ ID NO: 843834 - protein, 27 aa, Mycobacterium
PERVLFRRIAVFLGGFDLDAAQAVAGD

SEQ ID NO: 843835 - protein, 28 aa, Mycobacterium
PERVLGLHFFNPVPVLPLVELVSTLVTS

SEQ ID NO: 843836 - protein, 25 aa, Mycobacterium
PERVRPCFRLLRSLRDQARDLDLIG

SEQ ID NO: 843837 - protein, 30 aa, Mycobacterium
PESESRLALPRWLAESLPAPLPRGTVAVLS

SEQ ID NO: 843838 - protein, 20 aa, Mycobacterium
PESFIKIPPDRRYPGDWRVI

SEQ ID NO: 843839 - protein, 25 aa, Mycobacterium
PESGAFLRQFLASPPGQRQQMAQML

SEQ ID NO: 843840 - protein, 24 aa, Mycobacterium
PESGTLPEPEIWARLVRALGVVDD

SEQ ID NO: 843841 - protein, 23 aa, Mycobacterium
PESIDHLLAWAPQSVLTHRHRRH

SEQ ID NO: 843842 - protein, 18 aa, Mycobacterium
PESKRFCWNCGKPVGRSS

SEQ ID NO: 843843 - protein, 19 aa, Mycobacterium
PESLLIDGDPWGGGLDLVL

SEQ ID NO: 843844 - protein, 23 aa, Mycobacterium
PESLSFCWTLVRDAENMPGAELE

SEQ ID NO: 843845 - protein, 23 aa, Mycobacterium
PESLSFCWTLVRDSADMPDAELE

SEQ ID NO: 843846 - protein, 26 aa, Mycobacterium
PESLTAFTALLPFSLDGFQRRACEAL

SEQ ID NO: 843847 - protein, 24 aa, Mycobacterium
PESMIGRIFSPPEFKLIPIDEATW

SEQ ID NO: 843848 - protein, 22 aa, Mycobacterium
PESMLFPHLYGPLPIAAVTSVA

SEQ ID NO: 843849 - protein, 19 aa, Mycobacterium
PESPRELGAWGLTEREARM

SEQ ID NO: 843850 - protein, 23 aa, Mycobacterium
PESRDQLRRHLEACPGCFKHYGL

SEQ ID NO: 843851 - protein, 33 aa, Mycobacterium
PESRFLREIPQELLNWRRLAPKPSFSAPVSGAG

SEQ ID NO: 843852 - protein, 21 aa, Mycobacterium
PESRLILEHANIPPARETQTE

SEQ ID NO: 843853 - protein, 20 aa, Mycobacterium
PESRLMLETAGERPHYMPLF

SEQ ID NO: 843854 - protein, 23 aa, Mycobacterium
PESTLVLARLTKGILPDGVFNVV

SEQ ID NO: 843855 - protein, 18 aa, Mycobacterium
PESVLPSLSLLAHTVRTA

SEQ ID NO: 843856 - protein, 17 aa, Mycobacterium
PESWLLVGISETADRLT

SEQ ID NO: 843857 - protein, 33 aa, Mycobacterium
PESYAVAWTCLFRNLRLTAGQTLLLRGATSSLG

SEQ ID NO: 843858 - protein, 20 aa, Mycobacterium
PESYAWIPFGGGIHRCIGAA

SEQ ID NO: 843859 - protein, 27 aa, Mycobacterium
PETDARLNWRGLIHRVTGIDLGPGKNA

SEQ ID NO: 843860 - protein, 26 aa, Mycobacterium
PETDEMYTLFPRLAPGRAMIVIPREG

SEQ ID NO: 843861 - protein, 28 aa, Mycobacterium
PETDFADYWFANLRNTVRFDRAAAAAVR

SEQ ID NO: 843862 - protein, 26 aa, Mycobacterium
PETDFPRWFGRNWRRQAMLRYGENPH

SEQ ID NO: 843863 - protein, 32 aa, Mycobacterium
PETDVVVSWLPLFHDMGMMGFLIVPMCRAMST

SEQ ID NO: 843864 - protein, 18 aa, Mycobacterium
PETELTVVAPRRQQFTGD

SEQ ID NO: 843865 - protein, 24 aa, Mycobacterium
PETESLLEWAVAQQLPRDAVIVDL

SEQ ID NO: 843866 - protein, 23 aa, Mycobacterium
PETFPTITIVGPTIDIGVGGTQS

SEQ ID NO: 843867 - protein, 23 aa, Mycobacterium
PETGCVTVLRYVAVDDFGRVINE

SEQ ID NO: 843868 - protein, 33 aa, Mycobacterium
PETIMHFLLSGARPWRRSLKTTLLAAFDLKSNR

SEQ ID NO: 843869 - protein, 32 aa, Mycobacterium
PETKIEPSLTRISALMDLLGSPQLAYPSIHVA

SEQ ID NO: 843870 - protein, 27 aa, Mycobacterium
PETLADLAFAWRVCRAVKSNAIVIAAG

SEQ ID NO: 843871 - protein, 22 aa, Mycobacterium
PETLARAILALAKGIAIEGLVD

SEQ ID NO: 843872 - protein, 23 aa, Mycobacterium
PETLLYKKSSVLFGIDLAKRDIA

SEQ ID NO: 843873 - protein, 22 aa, Mycobacterium
PETLRALGLPAMSPTIGGHEGS

SEQ ID NO: 843874 - protein, 17 aa, Mycobacterium
PETLRSLYFLSSRVTGG

SEQ ID NO: 843875 - protein, 23 aa, Mycobacterium
PETLVCFDWLLEAFSHLGVAAPE

SEQ ID NO: 843876 - protein, 20 aa, Mycobacterium
PETNYQIGFVPQGIGADLIA

SEQ ID NO: 843877 - protein, 24 aa, Mycobacterium
PETPARLFYERSFGKLDETVGGAL

SEQ ID NO: 843878 - protein, 24 aa, Mycobacterium
PETPDMLWDVLLASTLIGNRFALW

SEQ ID NO: 843879 - protein, 18 aa, Mycobacterium
PETPLDALWLAEMIEQLD

SEQ ID NO: 843880 - protein, 20 aa, Mycobacterium
PETPLDALWLAEMIEQLDLP

SEQ ID NO: 843881 - protein, 24 aa, Mycobacterium
PETPTAVVAFASWPQQCVLRGTLA

SEQ ID NO: 843882 - protein, 28 aa, Mycobacterium
PETQAVLALLESPLGRLLHAAATGELAA

SEQ ID NO: 843883 - protein, 18 aa, Mycobacterium
PETRERVRRWARARLDRP

SEQ ID NO: 843884 - protein, 20 aa, Mycobacterium
PETRRHILASDLTALAHKDP

SEQ ID NO: 843885 - protein, 29 aa, Mycobacterium
PEVAAAWDRVFWIMADTLIALERNLYDEA

SEQ ID NO: 843886 - protein, 23 aa, Mycobacterium
PEVADLVAMLRLVGDPTAGAAAM

SEQ ID NO: 843887 - protein, 20 aa, Mycobacterium
PEVADVVAMLRLVADPTAGA

SEQ ID NO: 843888 - protein, 18 aa, Mycobacterium
PEVADVVAMLRLVAEPTA

SEQ ID NO: 843889 - protein, 31 aa, Mycobacterium
PEVAEVWRRGSVIGSWLLDLTAIALHESPEL

SEQ ID NO: 843890 - protein, 18 aa, Mycobacterium
PEVAPIARYLAFYPDRVT

SEQ ID NO: 843891 - protein, 25 aa, Mycobacterium
PEVDAFFSAAFFLLGVYGVLTTVTS

SEQ ID NO: 843892 - protein, 18 aa, Mycobacterium
PEVDTDLLKIWLATDDHG

SEQ ID NO: 843893 - protein, 23 aa, Mycobacterium
PEVEWQGKPFVYRQRPMAAPADS

SEQ ID NO: 843894 - protein, 26 aa, Mycobacterium
PEVFAAEYWGRTPLLSHADALPRDFC

SEQ ID NO: 843895 - protein, 25 aa, Mycobacterium
PEVFARFRRAVTDTGLYKDSDRLAI

SEQ ID NO: 843896 - protein, 21 aa, Mycobacterium
PEVFDALPIAQRTALRQVLVR

SEQ ID NO: 843897 - protein, 17 aa, Mycobacterium
PEVFTPQGAPHATLTCD

SEQ ID NO: 843898 - protein, 17 aa, Mycobacterium
PEVGGTWYYNRYPGARC

SEQ ID NO: 843899 - protein, 26 aa, Mycobacterium
PEVGTRFRFIAFPIPVADFSGALSCE

SEQ ID NO: 843900 - protein, 19 aa, Mycobacterium
PEVIFCSFGDMLRVPGSEK

SEQ ID NO: 843901 - protein, 18 aa, Mycobacterium
PEVKSWAAFIATRRNHHA

SEQ ID NO: 843902 - protein, 17 aa, Mycobacterium
PEVLDLLDELGLADRTL

SEQ ID NO: 843903 - protein, 23 aa, Mycobacterium
PEVLGLAALLCLSESRRAARRTS

SEQ ID NO: 843904 - protein, 17 aa, Mycobacterium
PEVLRYVDAPQPAPRAG

SEQ ID NO: 843905 - protein, 20 aa, Mycobacterium
PEVLSLLAQTYQAAAAMLVK

SEQ ID NO: 843906 - protein, 25 aa, Mycobacterium
PEVNNPLGILYRDAYRAVPGIVSRV

SEQ ID NO: 843907 - protein, 24 aa, Mycobacterium
PEVNSLRMFTGAGSAPMLDAATAW

SEQ ID NO: 843908 - protein, 17 aa, Mycobacterium
PEVPIRPGKGEALWRSL

SEQ ID NO: 843909 - protein, 18 aa, Mycobacterium
PEVPIRPGKGEALWRSLA

SEQ ID NO: 843910 - protein, 22 aa, Mycobacterium
PEVPPALRRLVLEGRAGVERSL

SEQ ID NO: 843911 - protein, 20 aa, Mycobacterium
PEVPSLVVPTPGKPAPAPPA

SEQ ID NO: 843912 - protein, 26 aa, Mycobacterium
PEVPWEAMRFAVTTRPTFWSRRQRGR

SEQ ID NO: 843913 - protein, 28 aa, Mycobacterium
PEVQNIASGMLLPLGVRRLRAYGSTRNV

SEQ ID NO: 843914 - protein, 30 aa, Mycobacterium; identical to SEQ ID NO: 221177

SEQ ID NO: 843915 - protein, 28 aa, Mycobacterium
PEVRNFLVANALYWLQEFHVDGLRVDAV

SEQ ID NO: 843916 - protein, 22 aa, Mycobacterium
PEVSFLRTYVREDMDKCLCFYD

SEQ ID NO: 843917 - protein, 23 aa, Mycobacterium
PEVSLWDLAPLDILVREAGGRFT

SEQ ID NO: 843918 - protein, 24 aa, Mycobacterium
PEVSPGPEPMPVTAAPAAPAPAPP

SEQ ID NO: 843919 - protein, 25 aa, Mycobacterium
PEVVKTLMLTLFDSAFTAGTFHGDL

SEQ ID NO: 843920 - protein, 25 aa, Mycobacterium
PEVVRALVRHPRLAKRYLAIEGHRA

SEQ ID NO: 843921 - protein, 26 aa, Mycobacterium
PEVVSVFLAPPSWDELVRRLSGRGTE

SEQ ID NO: 843922 - protein, 26 aa, Mycobacterium
PEVVTKPSWLWSFGKGMNIPDLRVPN

SEQ ID NO: 843923 - protein, 18 aa, Mycobacterium
PEVWTWVAVSGLNLLYQG

SEQ ID NO: 843924 - protein, 30 aa, Mycobacterium
PEWARRWQRLLFDNGWLLPGNPPEFGGRNA

SEQ ID NO: 843925 - protein, 18 aa, Mycobacterium
PEWHLHLASIHDPLWQRM

SEQ ID NO: 843926 - protein, 19 aa, Mycobacterium
PEWHWEFDPLGRAKVHPDD

SEQ ID NO: 843927 - protein, 29 aa, Mycobacterium
PEWLDRIQIKYMNPVIKPLAGKVPGISVI

SEQ ID NO: 843928 - protein, 32 aa, Mycobacterium
PEWLRRAVMAVIWTGTVPFATAGSWFSIAWSD

SEQ ID NO: 843929 - protein, 22 aa, Mycobacterium
PEWMAAFALHLERCGFESVVVV

SEQ ID NO: 843930 - protein, 18 aa, Mycobacterium
PEWNLDFASALTRLLTAT

SEQ ID NO: 843931 - protein, 18 aa, Mycobacterium
PEWNLDFATALTRLLTAT

SEQ ID NO: 843932 - protein, 19 aa, Mycobacterium
PEWPRYRATDRACLLIGKK

SEQ ID NO: 843933 - protein, 17 aa, Mycobacterium
PEWSERWPEFVASFTAA

SEQ ID NO: 843934 - protein, 17 aa, Mycobacterium
PEWTASVTSLAALDGPG

SEQ ID NO: 843935 - protein, 19 aa, Mycobacterium
PEWTDRWPELVASFTAATR

SEQ ID NO: 843936 - protein, 21 aa, Mycobacterium
PEYAPGWLAVTEDPAALLGLE

SEQ ID NO: 843937 - protein, 24 aa, Mycobacterium
PEYGERVAVVLSGLRKLESAISKA

SEQ ID NO: 843938 - protein, 18 aa, Mycobacterium
PEYGIGAAVAKWTATGRT

SEQ ID NO: 843939 - protein, 21 aa, Mycobacterium
PEYKFVLAEVDYLKPYWDAHP

SEQ ID NO: 843940 - protein, 25 aa, Mycobacterium
PEYKQVALFSATMPPAIRKITTKYL

SEQ ID NO: 843941 - protein, 20 aa, Mycobacterium
PEYNGTIPGVLKNAIDWLSR

SEQ ID NO: 843942 - protein, 18 aa, Mycobacterium
PEYRDFLDLAHRFDGVYL

SEQ ID NO: 843943 - protein, 18 aa, Mycobacterium
PEYRFIRDAVRRCEDIGV

SEQ ID NO: 843944 - protein, 17 aa, Mycobacterium
PEYRGALQLVPGAQTIA

SEQ ID NO: 843945 - protein, 19 aa, Mycobacterium
PEYSTLDWFEPLQYVDDGK

SEQ ID NO: 843946 - protein, 26 aa, Mycobacterium
PFAAAKEGCLLLVYPNVIAVERQLRV

SEQ ID NO: 843947 - protein, 27 aa, Mycobacterium
PFAAGGKTLWGIPWTESESQAAGTGLL

SEQ ID NO: 843948 - protein, 20 aa, Mycobacterium
PFADLLVPKLTASVTDGAVG

SEQ ID NO: 843949 - protein, 18 aa, Mycobacterium
PFADVIVFARDWGFRLEE

SEQ ID NO: 843950 - protein, 20 aa, Mycobacterium
PFAEALRALVPCLGAGGLGG

SEQ ID NO: 843951 - protein, 30 aa, Mycobacterium
PFAEPAHWDGFLRGLTPFSASQGVSLHVLP

SEQ ID NO: 843952 - protein, 18 aa, Mycobacterium
PFAGGSWVIWSRGDQAGS

SEQ ID NO: 843953 - protein, 29 aa, Mycobacterium
PFAGHPIVGVSWWLRERGMPIKTLHVPAG

SEQ ID NO: 843954 - protein, 26 aa, Mycobacterium
PFAGHPTVGAAWWLRDRGTPIKTLQV

SEQ ID NO: 843955 - protein, 27 aa, Mycobacterium
PFAGHPTVGLAWWLRERGTPVNTLQVP

SEQ ID NO: 843956 - protein, 31 aa, Mycobacterium; identical to SEQ ID NO: 129988

SEQ ID NO: 843957 - protein, 17 aa, Mycobacterium
PFAIETPMLRRQQSEGK

SEQ ID NO: 843958 - protein, 21 aa, Mycobacterium
PFAIQELTLPLALAGDDLIGQ

SEQ ID NO: 843959 - protein, 29 aa, Mycobacterium
PFAMHNFGSFFRFSLNGNLSFAYQPVEMD

SEQ ID NO: 843960 - protein, 20 aa, Mycobacterium
PFAPEIYRAPLSYPFRDAEF

SEQ ID NO: 843961 - protein, 29 aa, Mycobacterium
PFAPEIYRAPLSYPYRDGLLDKELATDGE

SEQ ID NO: 843962 - protein, 19 aa, Mycobacterium
PFAPEVYRAPMAYPYRWPS

SEQ ID NO: 843963 - protein, 23 aa, Mycobacterium
PFAQALRLALIDAAPDVAQDPVV

SEQ ID NO: 843964 - protein, 19 aa, Mycobacterium
PFARDIFRYYRSDAAAAIE

SEQ ID NO: 843965 - protein, 24 aa, Mycobacterium
PFAVAIARFRLTVAALKASGLSNL

SEQ ID NO: 843966 - protein, 27 aa, Mycobacterium
PFAVLRLQYQVARLPLQLIEDQVMTRL

SEQ ID NO: 843967 - protein, 17 aa, Mycobacterium
PFAVTVIDAPHSTERRA

SEQ ID NO: 843968 - protein, 18 aa, Mycobacterium
PFAYEGVFGHLAAGAVPG

SEQ ID NO: 843969 - protein, 18 aa, Mycobacterium
PFAYQGVFGHLAAGAVPG

SEQ ID NO: 843970 - protein, 30 aa, Mycobacterium
PFCGVAVRGFPNYFFITGPDPDAQARYIVE

SEQ ID NO: 843971 - protein, 20 aa, Mycobacterium
PFCYQLVEIPFKLHHPMWRE

SEQ ID NO: 843972 - protein, 30 aa, Mycobacterium
PFDDAALAREFLLSWFVYTAWELEEAKRIS

SEQ ID NO: 843973 - protein, 30 aa, Mycobacterium
PFDLGELVARLRALLRRRGAGSGGLADSAI

SEQ ID NO: 843974 - protein, 19 aa, Mycobacterium
PFDLIFIDADKENNLAYVE

SEQ ID NO: 843975 - protein, 28 aa, Mycobacterium
PFDLQKDLPIRVLLIALGADDHYLAWSV

SEQ ID NO: 843976 - protein, 20 aa, Mycobacterium
PFDLSIQIPLRARLYRVADD

SEQ ID NO: 843977 - protein, 21 aa, Mycobacterium
PFDMRALLTDPRLQTRMAVLQ

SEQ ID NO: 843978 - protein, 19 aa, Mycobacterium
PFDPVTQWAAIEPVLRHAA

SEQ ID NO: 843979 - protein, 22 aa, Mycobacterium
PFDRPSYWDLFEPALRAAVDDD

SEQ ID NO: 843980 - protein, 25 aa, Mycobacterium
PFDSEHPLFLLYTSGTTGKPKGIVH

SEQ ID NO: 843981 - protein, 21 aa, Mycobacterium
PFDTGTRLWLDGLLAGMFARA

SEQ ID NO: 843982 - protein, 34 aa, Mycobacterium
PFDYNGLRLTYPDIRLVYWAGGNPFHHHQNLPRL

SEQ ID NO: 843983 - protein, 20 aa, Mycobacterium
PFEALGDIYRYFHAEEQRHA

SEQ ID NO: 843984 - protein, 21 aa, Mycobacterium
PFEDGGWIWFDITTNTAVRVH

SEQ ID NO: 843985 - protein, 18 aa, Mycobacterium
PFEGATLLLLHTTGAKSG

SEQ ID NO: 843986 - protein, 30 aa, Mycobacterium
PFEHARIRLAYGMRLRRLRRYRNARVVLRA

SEQ ID NO: 843987 - protein, 18 aa, Mycobacterium
PFELARTQLIVGQLQRRL

SEQ ID NO: 843988 - protein, 19 aa, Mycobacterium
PFENGTLLLLHTTGAKSGQ

SEQ ID NO: 843989 - protein, 18 aa, Mycobacterium
PFEPFAVAAVELADEGLI

SEQ ID NO: 843990 - protein, 21 aa, Mycobacterium
PFERKQYVAKFLGLSDGVIGE

SEQ ID NO: 843991 - protein, 21 aa, Mycobacterium
PFERRGFGFGFGPVDRRALHE

SEQ ID NO: 843992 - protein, 25 aa, Mycobacterium
PFESKFWGQYRVVKSALPKLSSDAS

SEQ ID NO: 843993 - protein, 25 aa, Mycobacterium
PFESLLEWVHALVAAQRPSPRWYAD

SEQ ID NO: 843994 - protein, 25 aa, Mycobacterium
PFESMTLPATVTATLLRGRITARDG

SEQ ID NO: 843995 - protein, 22 aa, Mycobacterium
PFETMTLPATVTATLLRGRVTA

SEQ ID NO: 843996 - protein, 20 aa, Mycobacterium
PFETPPNWSQFARMLNTVIA

SEQ ID NO: 843997 - protein, 19 aa, Mycobacterium
PFFAPIVEVLGPPSAAAFT

SEQ ID NO: 843998 - protein, 19 aa, Mycobacterium
PFFATITGSPRIGPRRELK

SEQ ID NO: 843999 - protein, 19 aa, Mycobacterium
PFFQLLYNERCAPAADWFS

SEQ ID NO: 844000 - protein, 30 aa, Mycobacterium
PFGAASTFALLLALLDDPYLDRLEGRAPRI

SEQ ID NO: 844001 - protein, 19 aa, Mycobacterium
PFGAPLAGYGALPDDARRA

SEQ ID NO: 844002 - protein, 21 aa, Mycobacterium
PFGELTFPLPSTELPYLHPVT

SEQ ID NO: 844003 - protein, 21 aa, Mycobacterium
PFGELVFPLPSTDLPYLHPVT

SEQ ID NO: 844004 - protein, 17 aa, Mycobacterium
PFGGILGGPTPATGPEP

SEQ ID NO: 844005 - protein, 22 aa, Mycobacterium
PFGLDTIITPNLFPGVSISADL

SEQ ID NO: 844006 - protein, 32 aa, Mycobacterium; identical to SEQ ID NO: 121585

SEQ ID NO: 844007 - protein, 17 aa, Mycobacterium
PFGLRFGPDPSSLSRCT

SEQ ID NO: 844008 - protein, 22 aa, Mycobacterium
PFGLSVIFPPNLPLPAKIVTEV

SEQ ID NO: 844009 - protein, 26 aa, Mycobacterium
PFGLTMFFPANFPLPAKIVYQVLEPI

SEQ ID NO: 844010 - protein, 19 aa, Mycobacterium
PFGMDEFLARLRAAVRRNA

SEQ ID NO: 844011 - protein, 17 aa, Mycobacterium
PFGPDLLFAASDIPGFV

SEQ ID NO: 844012 - protein, 19 aa, Mycobacterium
PFGTIPLLGLDVFEHAYYL

SEQ ID NO: 844013 - protein, 18 aa, Mycobacterium
PFGVPFIHIPVTRDTRAD

SEQ ID NO: 844014 - protein, 18 aa, Mycobacterium
PFHVDPNDVRFIYFFDSK

SEQ ID NO: 844015 - protein, 17 aa, Mycobacterium
PFIARYRKEVTGSLDDG

SEQ ID NO: 844016 - protein, 26 aa, Mycobacterium
PFIRERLTRAWTGLRAMRSYALATLE

SEQ ID NO: 844017 - protein, 25 aa, Mycobacterium
PFIRERLTRAWTGLRAMRSYALATM

SEQ ID NO: 844018 - protein, 17 aa, Mycobacterium
PFKDRYKLQRFGRGGFV

SEQ ID NO: 844019 - protein, 35 aa, Mycobacterium
PFKGGLRFHPSVYLGIVKFLGFEQIFKNSLTGMPI

SEQ ID NO: 844020 - protein, 17 aa, Mycobacterium
PFKPGDNGCWYLFRHDH

SEQ ID NO: 844021 - protein, 26 aa, Mycobacterium
PFLANLDQFVQFLRDGQFDQIEQNHA

SEQ ID NO: 844022 - protein, 21 aa, Mycobacterium
PFLDLHGPAILRSGLTSAAVA

SEQ ID NO: 844023 - protein, 21 aa, Mycobacterium
PFLEYEPPEAAHWLASGVAAA

SEQ ID NO: 844024 - protein, 34 aa, Mycobacterium
PFLGQIVSNQFGYGQLIFAALGNATRDFTLGLAG

SEQ ID NO: 844025 - protein, 25 aa, Mycobacterium
PFLGRFDVHIPARRLVLIDDELGEN

SEQ ID NO: 844026 - protein, 17 aa, Mycobacterium
PFLNQYWHPYRLGGKAT

SEQ ID NO: 844027 - protein, 18 aa, Mycobacterium
PFLQHLLAHRDVTRLKVT

SEQ ID NO: 844028 - protein, 18 aa, Mycobacterium
PFLRTGDLGFFLDGELFV

SEQ ID NO: 844029 - protein, 37 aa, Mycobacterium
PFLSYGQFTGFAPRDLCALWPVPATSTPHAASPAGPG

SEQ ID NO: 844030 - protein, 26 aa, Mycobacterium
PFLSYGQFTGLAPRDLCALWPVPATS

SEQ ID NO: 844031 - protein, 19 aa, Mycobacterium
PFMMVFDLLDLTAYGRQES

SEQ ID NO: 844032 - protein, 19 aa, Mycobacterium
PFNATRLGRLIAEKTDIPA

SEQ ID NO: 844033 - protein, 18 aa, Mycobacterium
PFNLGKGPAIRLVLLTVP

SEQ ID NO: 844034 - protein, 31 aa, Mycobacterium
PFNTGNYPFSIGPIYIWNDPSPIGTTVFDRL

SEQ ID NO: 844035 - protein, 19 aa, Mycobacterium
PFNVSYRYVEEELLYLLTD

SEQ ID NO: 844036 - protein, 26 aa, Mycobacterium
PFPAHAVVDIPVHIPFTGEIGPITLN

SEQ ID NO: 844037 - protein, 21 aa, Mycobacterium
PFPGITIKLLWEGDNGAKAVV

SEQ ID NO: 844038 - protein, 17 aa, Mycobacterium
PFPHMRFPNDWIAHDED

SEQ ID NO: 844039 - protein, 20 aa, Mycobacterium
PFPIQAATLPDSLNGRDVLG

SEQ ID NO: 844040 - protein, 17 aa, Mycobacterium
PFPLADFIFDTTRSALD

SEQ ID NO: 844041 - protein, 18 aa, Mycobacterium
PFPLPDAIPVVPLPDAVP

SEQ ID NO: 844042 - protein, 17 aa, Mycobacterium
PFPPLPFTPEGDDISEQ

SEQ ID NO: 844043 - protein, 18 aa, Mycobacterium
PFPSIVADDFTFLDGVMA

SEQ ID NO: 844044 - protein, 20 aa, Mycobacterium
PFPTTARLTGRWLRGRLPVA

SEQ ID NO: 844045 - protein, 26 aa, Mycobacterium
PFQGTVTLSFLIHGDPDAYFQQVRAA

SEQ ID NO: 844046 - protein, 18 aa, Mycobacterium
PFQIDRLAEAFHGAGRHT

SEQ ID NO: 844047 - protein, 19 aa, Mycobacterium
PFQISQLAEAFHTAGRCTA

SEQ ID NO: 844048 - protein, 20 aa, Mycobacterium
PFQNPRVGPLALCYRVFMLP

SEQ ID NO: 844049 - protein, 17 aa, Mycobacterium
PFQSLLNRLPDATLWSV

SEQ ID NO: 844050 - protein, 19 aa, Mycobacterium
PFRDALVKAFDTQAGPAIT

SEQ ID NO: 844051 - protein, 18 aa, Mycobacterium
PFRDPEIQTIRRLGGLAM

SEQ ID NO: 844052 - protein, 18 aa, Mycobacterium
PFRGHYRHVVHDTTLGGV

SEQ ID NO: 844053 - protein, 19 aa, Mycobacterium
PFRGHYRHVVRDTALAGVE

SEQ ID NO: 844054 - protein, 18 aa, Mycobacterium
PFRGPLNSVIHQLTGGLR

SEQ ID NO: 844055 - protein, 17 aa, Mycobacterium
PFRGYSLCVFPDALDTG

SEQ ID NO: 844056 - protein, 18 aa, Mycobacterium
PFRLDFPSTYRLGRRHNT

SEQ ID NO: 844057 - protein, 18 aa, Mycobacterium
PFRNVICLSVNDAVLHGL

SEQ ID NO: 844058 - protein, 23 aa, Mycobacterium
PFRSAVGFVFLDLARDPRLCASL

SEQ ID NO: 844059 - protein, 17 aa, Mycobacterium
PFSEWYPGGNGGPDGSG

SEQ ID NO: 844060 - protein, 21 aa, Mycobacterium
PFSGLRVLDMTTFWAGPSCTH

SEQ ID NO: 844061 - protein, 18 aa, Mycobacterium
PFSLAWMTAVGERTERIV

SEQ ID NO: 844062 - protein, 35 aa, Mycobacterium
PFSLENGLLTGIRKLARPKLKAHYAERLEALYAEL

SEQ ID NO: 844063 - protein, 22 aa, Mycobacterium
PFSLENGLLTGIRKLAWPKLKQ

SEQ ID NO: 844064 - protein, 17 aa, Mycobacterium
PFSLRASARRDQVRATA

SEQ ID NO: 844065 - protein, 19 aa, Mycobacterium
PFSRRRPVTAPPPTYRGCT

SEQ ID NO: 844066 - protein, 19 aa, Mycobacterium
PFTANLTSLFLGPTGVPIP

SEQ ID NO: 844067 - protein, 19 aa, Mycobacterium
PFTARYFEVILGVWERRSS

SEQ ID NO: 844068 - protein, 18 aa, Mycobacterium
PFTASGLAQWGPPATRDF

SEQ ID NO: 844069 - protein, 27 aa, Mycobacterium
PFTAVGELWKAISPHLSPISNIVSMLN

SEQ ID NO: 844070 - protein, 26 aa, Mycobacterium
PFTGARLVQALRRAGFRPEDALYLPT

SEQ ID NO: 844071 - protein, 18 aa, Mycobacterium
PFTITGRAAPPFPLTMRA

SEQ ID NO: 844072 - protein, 35 aa, Mycobacterium
PFTLENGLLTGIRKLARPKLKAHYGERLEQLYTDL

SEQ ID NO: 844073 - protein, 22 aa, Mycobacterium
PFTLENGLLTGIRKLAWPKLRQ

SEQ ID NO: 844074 - protein, 32 aa, Mycobacterium
PFTLRRTDGLPVWIYQFKISPHPSIPHAPDAE

SEQ ID NO: 844075 - protein, 20 aa, Mycobacterium
PFTMRTWDRLLAALEVPERS

SEQ ID NO: 844076 - protein, 25 aa, Mycobacterium
PFTRSGQLVELLYATIPAATRRTGG

SEQ ID NO: 844077 - protein, 20 aa, Mycobacterium
PFTSRLCLAAVRSAEGILTQ

SEQ ID NO: 844078 - protein, 31 aa, Mycobacterium
PFTVTRPDGLPVWIYQFKISPHPTIPKATVP

SEQ ID NO: 844079 - protein, 30 aa, Mycobacterium
PFTVTRPDGLPVWIYQFKISTHPTIAPATT

SEQ ID NO: 844080 - protein, 19 aa, Mycobacterium
PFVAMGFAAAHTTTLRLIP

SEQ ID NO: 844081 - protein, 24 aa, Mycobacterium
PFVDGAVWYLGEVLRRGRSLPWQY

SEQ ID NO: 844082 - protein, 17 aa, Mycobacterium
PFVDRPLGDTKARTRTG

SEQ ID NO: 844083 - protein, 19 aa, Mycobacterium
PFVEFAYIAPEMRAFYDYI

SEQ ID NO: 844084 - protein, 17 aa, Mycobacterium
PFVHVKYLDLTAAQVDS

SEQ ID NO: 844085 - protein, 17 aa, Mycobacterium
PFVLVNNAQRIPLSITD

SEQ ID NO: 844086 - protein, 17 aa, Mycobacterium
PFVSTSGTLLLSLMGRN

SEQ ID NO: 844087 - protein, 20 aa, Mycobacterium
PFYDGAVFHRVIDGFMIQGG

SEQ ID NO: 844088 - protein, 21 aa, Mycobacterium
PFYDGAVFHRVIRGFMIQGGD

SEQ ID NO: 844089 - protein, 24 aa, Mycobacterium
PFYDGAVFHRVIRGFMIQGGDPTG

SEQ ID NO: 844090 - protein, 19 aa, Mycobacterium
PFYQGKVATATFFAKNMLP

SEQ ID NO: 844091 - protein, 35 aa, Mycobacterium
PFYRVLELVPQLSWPRPYHPMINFFDGGAPPLSQL

SEQ ID NO: 844092 - protein, 18 aa, Mycobacterium
PFYTGKQKILDSGGRVAR

SEQ ID NO: 844093 - protein, 19 aa, Mycobacterium
PGAAGLAGTGGQAGNEGVG

SEQ ID NO: 844094 - protein, 23 aa, Mycobacterium
PGACYYVLVFAKGAFPAEFEARP

SEQ ID NO: 844095 - protein, 30 aa, Mycobacterium
PGADATELAMFFLTGLFALLATGTHDPALL

SEQ ID NO: 844096 - protein, 20 aa, Mycobacterium
PGADAYLLDDGLRPVPVGVV

SEQ ID NO: 844097 - protein, 18 aa, Mycobacterium
PGADDIMLGYQSLSFHDA

SEQ ID NO: 844098 - protein, 24 aa, Mycobacterium
PGADFHPYLDMGPVDEVFSKGAYS

SEQ ID NO: 844099 - protein, 23 aa, Mycobacterium
PGADFYLRRAPGTTATTLTATTT

SEQ ID NO: 844100 - protein, 29 aa, Mycobacterium
PGADLVVFPELFLCGYRLDVVADAAIEMI

SEQ ID NO: 844101 - protein, 24 aa, Mycobacterium
PGAEAMLSHFRFYTSSTQYGTFDV

SEQ ID NO: 844102 - protein, 24 aa, Mycobacterium
PGAEEAWLQGWLLRAGNGVNVAVP

SEQ ID NO: 844103 - protein, 27 aa, Mycobacterium
PGAEHSLYGWLHYSLRRTWDYFVRHLH

SEQ ID NO: 844104 - protein, 24 aa, Mycobacterium
PGAEIARRPGMSRVLYALPIEFDI

SEQ ID NO: 844105 - protein, 30 aa, Mycobacterium
PGAERQAALNRLLFPGPAKELEDHREAYGD

SEQ ID NO: 844106 - protein, 32 aa, Mycobacterium
PGAGEVLPALWHWVYFLDWPPTAALGTDGHPR

SEQ ID NO: 844107 - protein, 33 aa, Mycobacterium
PGAGHPILYVAQMWDWIFPLGDTPDYEPDPATS

SEQ ID NO: 844108 - protein, 24 aa, Mycobacterium
PGAGIDYGLLRYLRADTAAALNSV

SEQ ID NO: 844109 - protein, 24 aa, Mycobacterium
PGAGLFILAFAQRQFGDGMPGPNG

SEQ ID NO: 844110 - protein, 31 aa, Mycobacterium
PGAGSYWRAYAHYTRWLFTPGPVLHTLGEYA

SEQ ID NO: 844111 - protein, 28 aa, Mycobacterium
PGAHQHIALVPQWDFLELLAAAAEAEPT

SEQ ID NO: 844112 - protein, 29 aa, Mycobacterium
PGAKTLARLLWGLAYQRLPGTLVLIDGRH

SEQ ID NO: 844113 - protein, 25 aa, Mycobacterium
PGALGSALYLYEKPGALLFSEWRAL

SEQ ID NO: 844114 - protein, 18 aa, Mycobacterium
PGALIGFLGPRVYQLLYG

SEQ ID NO: 844115 - protein, 17 aa, Mycobacterium
PGALMRFTTARSWLSQW

SEQ ID NO: 844116 - protein, 19 aa, Mycobacterium
PGALPAFSDDRWELYDLSR

SEQ ID NO: 844117 - protein, 17 aa, Mycobacterium
PGALPGRLRSRRAPHRG

SEQ ID NO: 844118 - protein, 19 aa, Mycobacterium
PGALRRFLDEVLGPGDDIT

SEQ ID NO: 844119 - protein, 28 aa, Mycobacterium
PGAPQLDPALFDLGLPVFGICYGFQVMA

SEQ ID NO: 844120 - protein, 24 aa, Mycobacterium
PGAPRDEWLQLYGLDQEGRIALHV

SEQ ID NO: 844121 - protein, 29 aa, Mycobacterium
PGAPTPARLIPIVNPITLTRNFIAAIPVG

SEQ ID NO: 844122 - protein, 22 aa, Mycobacterium
PGAQSILKRALASSAPADAASL

SEQ ID NO: 844123 - protein, 24 aa, Mycobacterium
PGARAMLAAFLESSARHAGPVVAF

SEQ ID NO: 844124 - protein, 21 aa, Mycobacterium
PGARIRFMLADAAPVAAVTTA

SEQ ID NO: 844125 - protein, 20 aa, Mycobacterium
PGARPGWSSFFEDLSRRPRP

SEQ ID NO: 844126 - protein, 21 aa, Mycobacterium
PGARRLMDRLIVESAVGRGTT

SEQ ID NO: 844127 - protein, 23 aa, Mycobacterium
PGARYYVLVFDRAAFPAESPVNA

SEQ ID NO: 844128 - protein, 28 aa, Mycobacterium
PGASLWDGILTDPLAWHFAFHQCRDVPE

SEQ ID NO: 844129 - protein, 18 aa, Mycobacterium
PGASWQRCRTHYTTNLMA

SEQ ID NO: 844130 - protein, 23 aa, Mycobacterium
PGASYFVLVFDRAAMPADGPVNA

SEQ ID NO: 844131 - protein, 24 aa, Mycobacterium
PGASYWYAHADQWRYDGYGADKLA

SEQ ID NO: 844132 - protein, 18 aa, Mycobacterium
PGASYYVLASTATALPAD

SEQ ID NO: 844133 - protein, 21 aa, Mycobacterium
PGATILLRLDRDVPGDVRAEI

SEQ ID NO: 844134 - protein, 30 aa, Mycobacterium
PGATPEMFRWWFWWHSFEPERYSLWHPWCH

SEQ ID NO: 844135 - protein, 23 aa, Mycobacterium
PGATPWPGPLGRIRDWGIGLVTT

SEQ ID NO: 844136 - protein, 23 aa, Mycobacterium
PGATVKILVCEPQWVTDGYVDLN

SEQ ID NO: 844137 - protein, 22 aa, Mycobacterium
PGAVRIPTQFMVALMAVGADAH

SEQ ID NO: 844138 - protein, 18 aa, Mycobacterium
PGAWLTTVARNRALDRLR

SEQ ID NO: 844139 - protein, 32 aa, Mycobacterium
PGAYRALVMIASRKLLKWIDPPAPEWHWEFDP

SEQ ID NO: 844140 - protein, 22 aa, Mycobacterium
PGAYRAYLVVDEVEVAFGDVCP

SEQ ID NO: 844141 - protein, 17 aa, Mycobacterium
PGAYVAGWIKRGPTGFI

SEQ ID NO: 844142 - protein, 22 aa, Mycobacterium
PGAYVYLYRDLPDEVPVPFDIP

SEQ ID NO: 844143 - protein, 18 aa, Mycobacterium
PGCALAVLAALPAWSGDP

SEQ ID NO: 844144 - protein, 18 aa, Mycobacterium
PGCHVYRTLDDLDAIHAC

SEQ ID NO: 844145 - protein, 19 aa, Mycobacterium
PGCLAVAALLEAYRVSATV

SEQ ID NO: 844146 - protein, 30 aa, Mycobacterium
PGCPPRPEMLLYAILKLHEKIQEMPLGVNR

SEQ ID NO: 844147 - protein, 30 aa, Mycobacterium; identical to SEQ ID NO: 116508

SEQ ID NO: 844148 - protein, 28 aa, Mycobacterium
PGCYPTAALLALWPALAAGLVEPAVTIV

SEQ ID NO: 844149 - protein, 26 aa, Mycobacterium
PGCYPTSALLALLPAVAAGLVEPNVT

SEQ ID NO: 844150 - protein, 17 aa, Mycobacterium
PGDAGVLAALLLNRIML

SEQ ID NO: 844151 - protein, 23 aa, Mycobacterium
PGDAIGGIGGKGGIGYSGGGNGG

SEQ ID NO: 844152 - protein, 57 aa, Mycobacterium
PGDALWGEAFFAPYVDMGAWPVPNLLALAQQRGISLLTLGFMQATPDGKLAWAGLSA

SEQ ID NO: 844153 - protein, 20 aa, Mycobacterium
PGDAPGYTTVWARMFAGDAA

SEQ ID NO: 844154 - protein, 27 aa, Mycobacterium
PGDARSELWFFYHLGRILREKLAGSTD

SEQ ID NO: 844155 - protein, 28 aa, Mycobacterium
PGDARSELWFFYHLGRKLREKLAGSTDE

SEQ ID NO: 844156 - protein, 27 aa, Mycobacterium
PGDARSELWFFYHLGRKLREKLSGSTD

SEQ ID NO: 844157 - protein, 27 aa, Mycobacterium
PGDARSELWFFYHLGRRLRDKLGGSTD

SEQ ID NO: 844158 - protein, 20 aa, Mycobacterium
PGDAYWLLRHAIACPDPVMY

SEQ ID NO: 844159 - protein, 37 aa, Mycobacterium
PGDDNPLPFTIRLAALAQLRIRMLSLVSAENLAEAGS

SEQ ID NO: 844160 - protein, 24 aa, Mycobacterium
PGDELLFIADSFLERSVWAAVYST

SEQ ID NO: 844161 - protein, 26 aa, Mycobacterium
PGDELPPLWHWVALPQWCSSSALSSD

SEQ ID NO: 844162 - protein, 37 aa, Mycobacterium
PGDEQVWPLLRSIPLRELRRTGLLGKLLVLAGQAENT

SEQ ID NO: 844163 - protein, 31 aa, Mycobacterium
PGDERPFFAYLPFQAPHWPLQAPDESIAKYR

SEQ ID NO: 844164 - protein, 22 aa, Mycobacterium
PGDEWPAVLTKIKAADIVIVST

SEQ ID NO: 844165 - protein, 21 aa, Mycobacterium
PGDFGSPLRLLAQALEFTDPI

SEQ ID NO: 844166 - protein, 17 aa, Mycobacterium
PGDFLSAGGHFQAPGHA

SEQ ID NO: 844167 - protein, 23 aa, Mycobacterium
PGDFVILNWRAVCGQCRACKRGR

SEQ ID NO: 844168 - protein, 23 aa, Mycobacterium
PGDGGTWFLQRAIGYERAAEMTF

SEQ ID NO: 844169 - protein, 23 aa, Mycobacterium
PGDGGTWFLQRAIGYERAAEMTL

SEQ ID NO: 844170 - protein, 27 aa, Mycobacterium
PGDLDEDLRWQPELWRALVSRVAADPP

SEQ ID NO: 844171 - protein, 20 aa, Mycobacterium
PGDLDVWRMVHQAESVPSGL

SEQ ID NO: 844172 - protein, 18 aa, Mycobacterium
PGDLLFHIRAESLDVCFE

SEQ ID NO: 844173 - protein, 20 aa, Mycobacterium
PGDLLFHLRAESMDVCFELA

SEQ ID NO: 844174 - protein, 24 aa, Mycobacterium
PGDLTFTYDTGLYLEFRAGGPDDY

SEQ ID NO: 844175 - protein, 17 aa, Mycobacterium
PGDMVDVPAAPYLHLFV

SEQ ID NO: 844176 - protein, 23 aa, Mycobacterium
PGDNIPPLVAVAQQLGLQGGDLI

SEQ ID NO: 844177 - protein, 27 aa, Mycobacterium
PGDPDRVVLLRRLLGCRGTARVRVLLQ

SEQ ID NO: 844178 - protein, 23 aa, Mycobacterium
PGDPGLLTVRARAVLTGATVAFT

SEQ ID NO: 844179 - protein, 20 aa, Mycobacterium
PGDPGVLPTVWDAWSARLAV

SEQ ID NO: 844180 - protein, 20 aa, Mycobacterium
PGDPLFAFDPIYQSITDAKA

SEQ ID NO: 844181 - protein, 20 aa, Mycobacterium
PGDPLVGLLAQAFKITSDDV

SEQ ID NO: 844182 - protein, 18 aa, Mycobacterium
PGDPPLAGSLLIGGEGRV

SEQ ID NO: 844183 - protein, 24 aa, Mycobacterium
PGDPPLAGSLLIGGSGRVAEPLRT

SEQ ID NO: 844184 - protein, 25 aa, Mycobacterium
PGDPSIFVTPPFWIRSREQVEDDPL

SEQ ID NO: 844185 - protein, 25 aa, Mycobacterium
PGDRAHLLNCYLWQEPDGVTLIDTG

SEQ ID NO: 844186 - protein, 22 aa, Mycobacterium
PGDRAPVVLHQRGQFGAVGVQH

SEQ ID NO: 844187 - protein, 20 aa, Mycobacterium
PGDRIPYAPPFGVAMAAWDT

SEQ ID NO: 844188 - protein, 24 aa, Mycobacterium
PGDRRPMLWLEVMKPMASNAVDRE

SEQ ID NO: 844189 - protein, 23 aa, Mycobacterium
PGDRRPVMVWVHGGAYVLGSASQ

SEQ ID NO: 844190 - protein, 24 aa, Mycobacterium
PGDRVMVPFNIFCGSCYFCARGLY

SEQ ID NO: 844191 - protein, 21 aa, Mycobacterium
PGDTLLIVDGLFFQQASVRHK

SEQ ID NO: 844192 - protein, 24 aa, Mycobacterium
PGDTWLCDRSWNRPRWKIDELVEA

SEQ ID NO: 844193 - protein, 24 aa, Mycobacterium
PGDVFGELALFDPGPRTSTVITLT

SEQ ID NO: 844194 - protein, 24 aa, Mycobacterium
PGDVFPLDSFSWHVLSSLADHVET

SEQ ID NO: 844195 - protein, 20 aa, Mycobacterium
PGDVLYLPRGQVHSAETRSE

SEQ ID NO: 844196 - protein, 23 aa, Mycobacterium
PGDVRGLPAGTQFQRDALAVGEA

SEQ ID NO: 844197 - protein, 20 aa, Mycobacterium
PGDVTLWPTLTGGETIDLLA

SEQ ID NO: 844198 - protein, 24 aa, Mycobacterium
PGDVVVRCADLYRGALPTLTVDEV

SEQ ID NO: 844199 - protein, 24 aa, Mycobacterium
PGDVWAGPVSLDRLARPQFTMHAG

SEQ ID NO: 844200 - protein, 24 aa, Mycobacterium
PGDWESWYIEWRALADRIAAIAAK

SEQ ID NO: 844201 - protein, 20 aa, Mycobacterium
PGDWIIIHMGFAVEKTDRAG

SEQ ID NO: 844202 - protein, 20 aa, Mycobacterium
PGDWLPRQWPVEVIELKPLT

SEQ ID NO: 844203 - protein, 19 aa, Mycobacterium
PGEAGWGNAMRWLLTGDEF

SEQ ID NO: 844204 - protein, 20 aa, Mycobacterium
PGEFDLSSLRWALSGAEQVD

SEQ ID NO: 844205 - protein, 17 aa, Mycobacterium
PGEFGWRVPSLSLADES

SEQ ID NO: 844206 - protein, 19 aa, Mycobacterium
PGEFVLASTLELFTLPDDL

SEQ ID NO: 844207 - protein, 23 aa, Mycobacterium
PGEIAAAVAWLLSADAAYVSGSV

SEQ ID NO: 844208 - protein, 19 aa, Mycobacterium
PGELAPKLALAATAELAGA

SEQ ID NO: 844209 - protein, 20 aa, Mycobacterium
PGELAPKLALAATAELAGTA

SEQ ID NO: 844210 - protein, 26 aa, Mycobacterium
PGELAVAIVPVPWRLSLKAVAAALGV

SEQ ID NO: 844211 - protein, 21 aa, Mycobacterium
PGELDWPGTWTDRAGRDRTPS

SEQ ID NO: 844212 - protein, 17 aa, Mycobacterium
PGELLKAPRSWCEPVYN

SEQ ID NO: 844213 - protein, 17 aa, Mycobacterium
PGELREFLADKVVRWWL

SEQ ID NO: 844214 - protein, 29 aa, Mycobacterium
PGELSVHYPFPTMDLVVLDDALKYGSRAA

SEQ ID NO: 844215 - protein, 20 aa, Mycobacterium
PGEPLLTLRADVRGLLTAER

SEQ ID NO: 844216 - protein, 24 aa, Mycobacterium
PGEPPPPQPAFTPAPSDWSPNFDV

SEQ ID NO: 844217 - protein, 24 aa, Mycobacterium
PGEPPYVRGPYPTMYVNQPWTIRQ

SEQ ID NO: 844218 - protein, 25 aa, Mycobacterium
PGEPSWPTPWGPGRPGWHLECSAMA

SEQ ID NO: 844219 - protein, 25 aa, Mycobacterium
PGEPSWPTPWGRGRPGWHLECSAMA

SEQ ID NO: 844220 - protein, 24 aa, Mycobacterium
PGEQYLLYEYDGQWVLALGVQTMV

SEQ ID NO: 844221 - protein, 17 aa, Mycobacterium
PGERHWTLFRQLAADID

SEQ ID NO: 844222 - protein, 25 aa, Mycobacterium
PGETASIFLPSVPSLLQLASELEAQ

SEQ ID NO: 844223 - protein, 20 aa, Mycobacterium
PGETLLETARRAGLEPPFSC

SEQ ID NO: 844224 - protein, 26 aa, Mycobacterium
PGEVLWTAMPLFHLSAAPIVLAPMLV

SEQ ID NO: 844225 - protein, 39 aa, Mycobacterium
PGEYLVIDWAQAAPGLFLFCAVLAFSRWRFVAFATDQKA

SEQ ID NO: 844226 - protein, 17 aa, Mycobacterium
PGEYRYLPEWLASNGWE

SEQ ID NO: 844227 - protein, 24 aa, Mycobacterium
PGEYSCLTLVWAVLDRASAGWRGF

SEQ ID NO: 844228 - protein, 24 aa, Mycobacterium
PGFAGDLLVLTLARIISQIDTIHI

SEQ ID NO: 844229 - protein, 26 aa, Mycobacterium
PGFANDLLPLALMGTCQRIDQVRCIE

SEQ ID NO: 844230 - protein, 25 aa, Mycobacterium
PGFDDRPFSVFYSLAVLSVGQEHAI

SEQ ID NO: 844231 - protein, 21 aa, Mycobacterium
PGFDLNVKVPFDVPAGTTIAT

SEQ ID NO: 844232 - protein, 19 aa, Mycobacterium
PGFERTMIARALDFWNDEV

SEQ ID NO: 844233 - protein, 18 aa, Mycobacterium
PGFFVTRQLDVRAAQAGV

SEQ ID NO: 844234 - protein, 23 aa, Mycobacterium
PGFGDRRKAMLQDMAILTGGQVI

SEQ ID NO: 844235 - protein, 23 aa, Mycobacterium
PGFGDRRKAMLQDMAILTGGQVV

SEQ ID NO: 844236 - protein, 27 aa, Mycobacterium
PGFGEVKAQIFLALLGKQYGVTPKGWR

SEQ ID NO: 844237 - protein, 17 aa, Mycobacterium
PGFGFLREEFTEPHIVR

SEQ ID NO: 844238 - protein, 20 aa, Mycobacterium
PGFLAMVADFCRARGILLVA

SEQ ID NO: 844239 - protein, 19 aa, Mycobacterium
PGFLGSALLPRILKRTDST

SEQ ID NO: 844240 - protein, 25 aa, Mycobacterium
PGFMGLGMIYTAMPVTNAVAAVVAA

SEQ ID NO: 844241 - protein, 19 aa, Mycobacterium
PGFMSHKELGLMPLRGVIR

SEQ ID NO: 844242 - protein, 30 aa, Mycobacterium
PGFRRAARAAPLITPLMRLAANRLWRDDLA

SEQ ID NO: 844243 - protein, 19 aa, Mycobacterium
PGFSPDTPLLVAAAAAGVP

SEQ ID NO: 844244 - protein, 19 aa, Mycobacterium
PGFSWKPLHTMPGVSTYYT

SEQ ID NO: 844245 - protein, 23 aa, Mycobacterium
PGFTTISMYPRMWAASGVDYPTL

SEQ ID NO: 844246 - protein, 20 aa, Mycobacterium
PGFVVSITALLRDNPDPTDE

SEQ ID NO: 844247 - protein, 19 aa, Mycobacterium
PGGAGGHAGLFGIGGAGGE

SEQ ID NO: 844248 - protein, 22 aa, Mycobacterium
PGGANLRAAWLTMIAVASTHQG

SEQ ID NO: 844249 - protein, 26 aa, Mycobacterium
PGGARDLIRAFWPGALSLVVTQAPSL

SEQ ID NO: 844250 - protein, 36 aa, Mycobacterium
PGGARPPLRGFPNAPMRTVHLWAAPEPPIEAPPGPA

SEQ ID NO: 844251 - protein, 24 aa, Mycobacterium
PGGCGRDYRILSVAMLEVTFCGFA

SEQ ID NO: 844252 - protein, 19 aa, Mycobacterium
PGGFGGHGGDALLFGNGGN

SEQ ID NO: 844253 - protein, 24 aa, Mycobacterium
PGGFGLVELRLVDWHGWLFVDPSG

SEQ ID NO: 844254 - protein, 26 aa, Mycobacterium
PGGFKAVVDIDLLGTFNVSKAAYELW

SEQ ID NO: 844255 - protein, 18 aa, Mycobacterium
PGGFRYGPAFGVELQFWV

SEQ ID NO: 844256 - protein, 28 aa, Mycobacterium
PGGHFSLPALQLLISGLPKFLNLEEGIG

SEQ ID NO: 844257 - protein, 28 aa, Mycobacterium
PGGIHDWVLLTPGGLLYWPQINQQLGIV

SEQ ID NO: 844258 - protein, 17 aa, Mycobacterium
PGGIRFAYLSAPQAAVP

SEQ ID NO: 844259 - protein, 23 aa, Mycobacterium
PGGKRRSWAVLGEMAELGDDAIT

SEQ ID NO: 844260 - protein, 25 aa, Mycobacterium
PGGKSPLPPMPIGGPPPASPEPPAA

SEQ ID NO: 844261 - protein, 22 aa, Mycobacterium
PGGKTVFVFPGQGSQLLGMGRG

SEQ ID NO: 844262 - protein, 24 aa, Mycobacterium
PGGKTVVFALYDKVTLQDVAAPME

SEQ ID NO: 844263 - protein, 23 aa, Mycobacterium
PGGLALGIFLKKAGFRDFTIFDR

SEQ ID NO: 844264 - protein, 21 aa, Mycobacterium
PGGLAVLSYTVWLGPFGGHEM

SEQ ID NO: 844265 - protein, 19 aa, Mycobacterium
PGGLIEQLSVRESQLRSIA

SEQ ID NO: 844266 - protein, 28 aa, Mycobacterium
PGGLLPREALNLIRLISEPGLNGIEVVE

SEQ ID NO: 844267 - protein, 20 aa, Mycobacterium
PGGLPPWGSLLEIEPAEVVQ

SEQ ID NO: 844268 - protein, 18 aa, Mycobacterium
PGGLRWIAVHQPDGYDPP

SEQ ID NO: 844269 - protein, 25 aa, Mycobacterium
PGGLSCFMLPRILPDGTRNRMFLQR

SEQ ID NO: 844270 - protein, 24 aa, Mycobacterium
PGGLSGLLDVFRASGASVVDVTHW

SEQ ID NO: 844271 - protein, 19 aa, Mycobacterium
PGGPFDLLVLSEVAYYLRA

SEQ ID NO: 844272 - protein, 23 aa, Mycobacterium
PGGPFRGVPFLIKDLYALYAGQP

SEQ ID NO: 844273 - protein, 24 aa, Mycobacterium
PGGPIRFLVRARRWPGGELEILAD

SEQ ID NO: 844274 - protein, 28 aa, Mycobacterium
PGGQCRHNLGYWAGGDWWGAGPGAHGHV

SEQ ID NO: 844275 - protein, 24 aa, Mycobacterium
PGGQLATYLAAWQAGASAVDGASS

SEQ ID NO: 844276 - protein, 31 aa, Mycobacterium
PGGQMLFDLPPRWFTLFSRLGIRTSLRYKIP

SEQ ID NO: 844277 - protein, 18 aa, Mycobacterium
PGGRILLVAVGAGITAGA

SEQ ID NO: 844278 - protein, 18 aa, Mycobacterium
PGGRLCIADLRPSGGGIV

SEQ ID NO: 844279 - protein, 23 aa, Mycobacterium
PGGRLGLPADFLIAPDGTVAAAK

SEQ ID NO: 844280 - protein, 23 aa, Mycobacterium
PGGRLVFNSFLARDGYVPDDPAV

SEQ ID NO: 844281 - protein, 25 aa, Mycobacterium
PGGRLVFNVFMPRPGFMSDDAVNEL

SEQ ID NO: 844282 - protein, 17 aa, Mycobacterium
PGGRRRASVVGSVAVVG

SEQ ID NO: 844283 - protein, 23 aa, Mycobacterium
PGGSLYFPALAVPTGTLTLPAVA

SEQ ID NO: 844284 - protein, 21 aa, Mycobacterium
PGGTEVTLRFSDGEVVTMHVI

SEQ ID NO: 844285 - protein, 25 aa, Mycobacterium
PGGTGGVGGWLYGNGGAGGAGGVGA

SEQ ID NO: 844286 - protein, 25 aa, Mycobacterium
PGGTGHFYRWRTADGFLSDIRSAAT

SEQ ID NO: 844287 - protein, 20 aa, Mycobacterium
PGGTPPMPYAGGGWVVWERR

SEQ ID NO: 844288 - protein, 20 aa, Mycobacterium
PGGTVFYFGVADDDAYPINM

SEQ ID NO: 844289 - protein, 20 aa, Mycobacterium
PGGTVFYFGVADDDAYPISM

SEQ ID NO: 844290 - protein, 24 aa, Mycobacterium
PGGVGAIRKVGMWPVFVQEETVAY

SEQ ID NO: 844291 - protein, 30 aa, Mycobacterium
PGGVKLAAGWLVEHAGFGKGYPDPALTGQA

SEQ ID NO: 844292 - protein, 24 aa, Mycobacterium
PGGVPVWSPYIRGERTPFHDPGRR

SEQ ID NO: 844293 - protein, 23 aa, Mycobacterium
PGGVVDLRFRFTLDGTYISRLTI

SEQ ID NO: 844294 - protein, 29 aa, Mycobacterium
PGGWMVFDTIPWLMSVYSRRRGWRLSEHY

SEQ ID NO: 844295 - protein, 24 aa, Mycobacterium
PGGYLAWLREAVGPQTWIVIEKIL

SEQ ID NO: 844296 - protein, 26 aa, Mycobacterium
PGHAFPALALCLKFLAAGDQPTLLTG

SEQ ID NO: 844297 - protein, 24 aa, Mycobacterium
PGHALDPVLLDRLAHTLRAVPARA

SEQ ID NO: 844298 - protein, 19 aa, Mycobacterium
PGHELLTAQLYFPGDPHND

SEQ ID NO: 844299 - protein, 24 aa, Mycobacterium
PGHELLTAQLYFPGDPHNGDDIAT

SEQ ID NO: 844300 - protein, 32 aa, Mycobacterium
PGHFAGVLTVVLKLFSIVRPDRAYFGEKDYQQ

SEQ ID NO: 844301 - protein, 33 aa, Mycobacterium
PGHFAGVLTVVLKLLQIVRPDRAYFGEKDYQQL

SEQ ID NO: 844302 - protein, 30 aa, Mycobacterium
PGHGMSEHFPFSAAGAALLCGWSTDDYGLS

SEQ ID NO: 844303 - protein, 25 aa, Mycobacterium
PGHIARMFGLVFGGEPADHLPDTER

SEQ ID NO: 844304 - protein, 22 aa, Mycobacterium
PGHLPIAQALSFRAAGLTLPTA

SEQ ID NO: 844305 - protein, 25 aa, Mycobacterium
PGHNIALYFRDAEGYWFEYSVEEEI

SEQ ID NO: 844306 - protein, 18 aa, Mycobacterium
PGHPLLGRRMPDLEVRTA

SEQ ID NO: 844307 - protein, 23 aa, Mycobacterium
PGHPPPHWVGPPPPGGWNGPPPP

SEQ ID NO: 844308 - protein, 25 aa, Mycobacterium
PGHPQLSLLRLGATLGFTVVALDRP

SEQ ID NO: 844309 - protein, 26 aa, Mycobacterium
PGHPQLSLLRLGATLGFTVVALDRPG

SEQ ID NO: 844310 - protein, 25 aa, Mycobacterium
PGHPTGGWWDGMVGPGAPIDTDRWC

SEQ ID NO: 844311 - protein, 28 aa, Mycobacterium
PGHPVVIARRHWPEILARMTGDHGAAAY

SEQ ID NO: 844312 - protein, 30 aa, Mycobacterium
PGHQLALTALQLDPILDLRMRLGEGTGATL

SEQ ID NO: 844313 - protein, 19 aa, Mycobacterium
PGHRLMENWHPLGVVGVIT

SEQ ID NO: 844314 - protein, 19 aa, Mycobacterium
PGHRLMETWHPLGVVGVIT

SEQ ID NO: 844315 - protein, 42 aa, Mycobacterium
PGHRLMETWHPLGVVGVITAFNFPVAVWSWNTAIALVCGDTV

SEQ ID NO: 844316 - protein, 19 aa, Mycobacterium
PGHSQWYIERFRSLARAGE

SEQ ID NO: 844317 - protein, 25 aa, Mycobacterium
PGHSTPGWWDGMVGPGAPIDTNRWC

SEQ ID NO: 844318 - protein, 23 aa, Mycobacterium
PGHTPGSSVLWLDAGQPAVLVGD

SEQ ID NO: 844319 - protein, 30 aa, Mycobacterium
PGHVDLVRSLFFDPLPENLLAPFTAALEHI

SEQ ID NO: 844320 - protein, 19 aa, Mycobacterium
PGHVGAAWRGTWHGGLEFT

SEQ ID NO: 844321 - protein, 25 aa, Mycobacterium
PGHVGAVWRGTWHGGLEFTKKCCAP

SEQ ID NO: 844322 - protein, 32 aa, Mycobacterium
PGHVPLIKRIVLKTVVLLSPRTRRLNLTDAHN

SEQ ID NO: 844323 - protein, 20 aa, Mycobacterium
PGHVYPLFEEAIRIAGGVSI

SEQ ID NO: 844324 - protein, 22 aa, Mycobacterium
PGHYAVMFDWSLIDRTDSDLAA

SEQ ID NO: 844325 - protein, 24 aa, Mycobacterium
PGIAGNLTGLFNTGSNMSGVFSLE

SEQ ID NO: 844326 - protein, 31 aa, Mycobacterium
PGIDFTNDPLLQFRNFSYLDTQLIRLGGPNF

SEQ ID NO: 844327 - protein, 32 aa, Mycobacterium; identical to SEQ ID NO: 130028

SEQ ID NO: 844328 - protein, 33 aa, Mycobacterium; identical to SEQ ID NO: 121594

SEQ ID NO: 844329 - protein, 17 aa, Mycobacterium
PGIDIELSKVLHASEAV

SEQ ID NO: 844330 - protein, 17 aa, Mycobacterium
PGIDIELSKVLHASERV

SEQ ID NO: 844331 - protein, 20 aa, Mycobacterium
PGIDPILKMLLDAVPMTFCA

SEQ ID NO: 844332 - protein, 20 aa, Mycobacterium
PGIDRPLTSEKHFRRARGRK

SEQ ID NO: 844333 - protein, 20 aa, Mycobacterium
PGIDVRFGIGWGAVSVLDEA

SEQ ID NO: 844334 - protein, 23 aa, Mycobacterium
PGIERMLQLLLDGFTMLRSTLVD

SEQ ID NO: 844335 - protein, 17 aa, Mycobacterium
PGIEWVCGRWTGAQVDK

SEQ ID NO: 844336 - protein, 19 aa, Mycobacterium
PGIGAPTRFGFFGTPVVPI

SEQ ID NO: 844337 - protein, 26 aa, Mycobacterium
PGIKAGSDVLPWLPARGVYLLVERGS

SEQ ID NO: 844338 - protein, 23 aa, Mycobacterium
PGILDRHFCLYGPAAIGWGTRSR

SEQ ID NO: 844339 - protein, 18 aa, Mycobacterium
PGIPHDGFLADALMRNKG

SEQ ID NO: 844340 - protein, 17 aa, Mycobacterium
PGIPLNIGVNVDLAIPV

SEQ ID NO: 844341 - protein, 20 aa, Mycobacterium
PGIRRVFDAPGLLSTLAPSA

SEQ ID NO: 844342 - protein, 23 aa, Mycobacterium
PGIRTTLDLPLITGKGLYTPMVS

SEQ ID NO: 844343 - protein, 22 aa, Mycobacterium
PGIRTTLDLPLVTGKGLYAPST

SEQ ID NO: 844344 - protein, 21 aa, Mycobacterium
PGIRTTLDLPLVTGKGLYAPT

SEQ ID NO: 844345 - protein, 21 aa, Mycobacterium
PGIRTTLELPLVTGKGLYLPP

SEQ ID NO: 844346 - protein, 25 aa, Mycobacterium
PGITNGRIPRLYGRQASEFVIRRAM

SEQ ID NO: 844347 - protein, 26 aa, Mycobacterium
PGITVPGFNLPALTLPSMSLPAITTP

SEQ ID NO: 844348 - protein, 23 aa, Mycobacterium
PGIYYPPLRRLMEGQLRRLERRY

SEQ ID NO: 844349 - protein, 24 aa, Mycobacterium
PGKAGRLNSIFDPADPASVPAGNT

SEQ ID NO: 844350 - protein, 24 aa, Mycobacterium
PGKAKALRQFAYEAGVPLAQTVAV

SEQ ID NO: 844351 - protein, 25 aa, Mycobacterium
PGKHGFIGLINALSAFPKPLICAVN

SEQ ID NO: 844352 - protein, 28 aa, Mycobacterium
PGKIDMTEWWAYLDGVRSTYPLSYGPQS

SEQ ID NO: 844353 - protein, 29 aa, Mycobacterium
PGKNDALDALLWRAARPGEPSWPSPFGPG

SEQ ID NO: 844354 - protein, 20 aa, Mycobacterium
PGKPRGFMLFVGGFATYNDI

SEQ ID NO: 844355 - protein, 21 aa, Mycobacterium
PGKPRGFMLFVGGFATYNDIC

SEQ ID NO: 844356 - protein, 27 aa, Mycobacterium
PGKPTLAARWRPVLEPVLAELAAGELV

SEQ ID NO: 844357 - protein, 17 aa, Mycobacterium
PGKRAHLLEPRDIFAAL

SEQ ID NO: 844358 - protein, 29 aa, Mycobacterium
PGKRKYAMTTLIDLAPRPALPDITEKALA

SEQ ID NO: 844359 - protein, 17 aa, Mycobacterium
PGKRPFHTIIPGFVTKD

SEQ ID NO: 844360 - protein, 17 aa, Mycobacterium
PGKRPRSSMAPTLVFER

SEQ ID NO: 844361 - protein, 18 aa, Mycobacterium
PGKRRLKIAVITRSIHVE

SEQ ID NO: 844362 - protein, 17 aa, Mycobacterium
PGKSFAFTTFPLPEVNF

SEQ ID NO: 844363 - protein, 18 aa, Mycobacterium
PGKTWTGLSLRWLQERGQ

SEQ ID NO: 844364 - protein, 25 aa, Mycobacterium
PGKVRRVRLLPPDPPATRQAVDAIM

SEQ ID NO: 844365 - protein, 17 aa, Mycobacterium
PGLAAMLDYARTDDIVV

SEQ ID NO: 844366 - protein, 25 aa, Mycobacterium
PGLAERVWYGGGLASAIWAGTQGLN

SEQ ID NO: 844367 - protein, 26 aa, Mycobacterium
PGLAGYGIPLLVGALSGLIGFGNNDT

SEQ ID NO: 844368 - protein, 22 aa, Mycobacterium
PGLANIALLRRPAGMDQATWLT

SEQ ID NO: 844369 - protein, 20 aa, Mycobacterium
PGLARLIAGRFRGAIRRRLG

SEQ ID NO: 844370 - protein, 17 aa, Mycobacterium
PGLDATLLDWSQLGTGA

SEQ ID NO: 844371 - protein, 33 aa, Mycobacterium
PGLDDFAPICRTFHILPIPWVTAADITNAVLFL

SEQ ID NO: 844372 - protein, 24 aa, Mycobacterium
PGLDVVDLHRLAMICRARKATLVV

SEQ ID NO: 844373 - protein, 17 aa, Mycobacterium
PGLESSPFVATPISRES

SEQ ID NO: 844374 - protein, 18 aa, Mycobacterium
PGLFKTPLLGSLPEEAQK

SEQ ID NO: 844375 - protein, 18 aa, Mycobacterium
PGLFRLRERMLTALLDAG

SEQ ID NO: 844376 - protein, 23 aa, Mycobacterium
PGLFTLVLHTHLPWLAHHGRWPV

SEQ ID NO: 844377 - protein, 29 aa, Mycobacterium
PGLFTMVLHTHLPWLANHGRWPVGEEWLY

SEQ ID NO: 844378 - protein, 19 aa, Mycobacterium
PGLFTYTQTLTLWHGVDRL

SEQ ID NO: 844379 - protein, 18 aa, Mycobacterium
PGLGGWRRPQEELDESSR

SEQ ID NO: 844380 - protein, 18 aa, Mycobacterium
PGLGRDAVIGLKFLVLGF

SEQ ID NO: 844381 - protein, 25 aa, Mycobacterium
PGLGRKAPIYVLEDAPWSAFRDRDN

SEQ ID NO: 844382 - protein, 18 aa, Mycobacterium
PGLIARYEQSPDDHSYPL

SEQ ID NO: 844383 - protein, 20 aa, Mycobacterium
PGLIDELGTLTWRQLDERIN

SEQ ID NO: 844384 - protein, 18 aa, Mycobacterium
PGLIQQLIAGVPPGTRIG

SEQ ID NO: 844385 - protein, 23 aa, Mycobacterium
PGLIRTDLVAPVFALPEVSEDYR

SEQ ID NO: 844386 - protein, 25 aa, Mycobacterium
PGLLDLSALWQIYSVDRPDLKDRPF

SEQ ID NO: 844387 - protein, 29 aa, Mycobacterium
PGLLDLSCLWQVYGVDRPALKDPTFVPAT

SEQ ID NO: 844388 - protein, 19 aa, Mycobacterium
PGLLHPIEPPSLLSIEPPD

SEQ ID NO: 844389 - protein, 17 aa, Mycobacterium
PGLLIDAPSIMRGAVTG

SEQ ID NO: 844390 - protein, 19 aa, Mycobacterium
PGLLLLDEPFSALDPVTRA

SEQ ID NO: 844391 - protein, 24 aa, Mycobacterium
PGLPGEDPFYLPPAGYHHAEPGTV

SEQ ID NO: 844392 - protein, 26 aa, Mycobacterium
PGLPLDGVRILDATAWWAGPSSTHIL

SEQ ID NO: 844393 - protein, 20 aa, Mycobacterium
PGLPPWPGMDGFTGQLLHAA

SEQ ID NO: 844394 - protein, 22 aa, Mycobacterium
PGLQYKAIIAAERMIPRNLMRA

SEQ ID NO: 844395 - protein, 20 aa, Mycobacterium
PGLREVMRNFFKLVSQQIAE

SEQ ID NO: 844396 - protein, 27 aa, Mycobacterium
PGLRKIARFLPRGYALHRGLKLQRAVM

SEQ ID NO: 844397 - protein, 23 aa, Mycobacterium
PGLRKLIADLQSWLTAITGYDEV

SEQ ID NO: 844398 - protein, 25 aa, Mycobacterium
PGLRKLLDETLGPGWLRNLDRLSEL

SEQ ID NO: 844399 - protein, 17 aa, Mycobacterium
PGLRRPRRLCRSKPMKT

SEQ ID NO: 844400 - protein, 30 aa, Mycobacterium
PGLRTGRHLSDCAPWLWEAHVRHGDAGPAQ

SEQ ID NO: 844401 - protein, 21 aa, Mycobacterium
PGLSATRFVACPYVGAEAPGQ

SEQ ID NO: 844402 - protein, 23 aa, Mycobacterium
PGLSIPQRAFIFGGKAAPGYFMA

SEQ ID NO: 844403 - protein, 24 aa, Mycobacterium
PGLVHGGFLGVFFDCVIQHHNCVS

SEQ ID NO: 844404 - protein, 25 aa, Mycobacterium
PGLVHGGFLGVFFDCVIQHHNCVTG

SEQ ID NO: 844405 - protein, 19 aa, Mycobacterium
PGLVRWTGLYDTRYVEGAM

SEQ ID NO: 844406 - protein, 21 aa, Mycobacterium
PGLVVSPQYDSLLAKVIVHVR

SEQ ID NO: 844407 - protein, 35 aa, Mycobacterium
PGLWDELYRINLHHVFLLTRAFLPAMVDRHAGAIV

SEQ ID NO: 844408 - protein, 19 aa, Mycobacterium
PGLYAPMIHPWSGTGMLED

SEQ ID NO: 844409 - protein, 23 aa, Mycobacterium
PGLYRMWYCARGAQYSIYHAVSE

SEQ ID NO: 844410 - protein, 25 aa, Mycobacterium
PGMALNRLQYALLKEATLIVEEGVA

SEQ ID NO: 844411 - protein, 20 aa, Mycobacterium
PGMDGLWFAGSWCGHGFSTS

SEQ ID NO: 844412 - protein, 20 aa, Mycobacterium
PGMFSRIVIDYYGATTPITQ

SEQ ID NO: 844413 - protein, 22 aa, Mycobacterium
PGMFTLVLHTHLPWLAHHGRWP

SEQ ID NO: 844414 - protein, 19 aa, Mycobacterium
PGMIVGEIALLRNVPRTAT

SEQ ID NO: 844415 - protein, 20 aa, Mycobacterium
PGMLTEWLELPGAAERIASW

SEQ ID NO: 844416 - protein, 25 aa, Mycobacterium
PGMNEIVFPAAILQPPFFDAQADDA

SEQ ID NO: 844417 - protein, 19 aa, Mycobacterium
PGMQEMLYPTSYLKGRGLG

SEQ ID NO: 844418 - protein, 33 aa, Mycobacterium
PGMRKLLAQEWVRFGWYFLITRRDPAGLREWIA

SEQ ID NO: 844419 - protein, 29 aa, Mycobacterium
PGMTNVEDFKFFWVTGLTADGKIVVANNY

SEQ ID NO: 844420 - protein, 22 aa, Mycobacterium
PGMTVAWQLPSHVNAAVVMLAL

SEQ ID NO: 844421 - protein, 19 aa, Mycobacterium
PGNAHFTFRGCEGDSLLML

SEQ ID NO: 844422 - protein, 22 aa, Mycobacterium
PGNALFVLDGRLRPVPAGVVGE

SEQ ID NO: 844423 - protein, 19 aa, Mycobacterium
PGNAVVDILLRRPPRTRSG

SEQ ID NO: 844424 - protein, 26 aa, Mycobacterium
PGNDAVQLQLFWDYQFNLDGYPAYQQ

SEQ ID NO: 844425 - protein, 31 aa, Mycobacterium
PGNDGRGYVLRRLLRRVIRSAKLLNIDTAIV

SEQ ID NO: 844426 - protein, 31 aa, Mycobacterium
PGNDGRGYVLRRLLRRVIRSAKLLNIDTPIV

SEQ ID NO: 844427 - protein, 25 aa, Mycobacterium
PGNDLPVWHGVARRGHRGLEQCHVA

SEQ ID NO: 844428 - protein, 32 aa, Mycobacterium
PGNEGRGYVLRRLLRRIIRAAKLLGVEQPIMG

SEQ ID NO: 844429 - protein, 32 aa, Mycobacterium
PGNEGRGYVLRRLLRRIIRAAKLLGVEQPVMG

SEQ ID NO: 844430 - protein, 32 aa, Mycobacterium
PGNEGRGYVLRRLLRRIIRSTKLLGVEKPMMG

SEQ ID NO: 844431 - protein, 21 aa, Mycobacterium
PGNFDPIPSAYLRGLPQMQTQ

SEQ ID NO: 844432 - protein, 23 aa, Mycobacterium
PGNFRVGLGWIIDALRRQAPGPR

SEQ ID NO: 844433 - protein, 26 aa, Mycobacterium
PGNIPIQSPGPWRRSGAGQPAGTLVC

SEQ ID NO: 844434 - protein, 25 aa, Mycobacterium
PGNPPPRMFRLPADRALLNRMGFNN

SEQ ID NO: 844435 - protein, 24 aa, Mycobacterium
PGNPVILPTVWDAWSAHLAVDAGF

SEQ ID NO: 844436 - protein, 20 aa, Mycobacterium
PGNRTFYLQAVHDKRVISVI

SEQ ID NO: 844437 - protein, 20 aa, Mycobacterium
PGNRTFYLQAVHDKRVISVV

SEQ ID NO: 844438 - protein, 26 aa, Mycobacterium
PGNSLFINVNCWGKLVTGVGAALRKG

SEQ ID NO: 844439 - protein, 18 aa, Mycobacterium
PGNSLYVTVNCWGNLARG

SEQ ID NO: 844440 - protein, 20 aa, Mycobacterium
PGNVWQTIEIPRLIGNLNVT

SEQ ID NO: 844441 - protein, 20 aa, Mycobacterium
PGNWWTVMAQSPAALRHAVR

SEQ ID NO: 844442 - protein, 26 aa, Mycobacterium
PGPCAFPDIVPWPTQAAPPPVTAPLI

SEQ ID NO: 844443 - protein, 25 aa, Mycobacterium
PGPDGLPSVFVYDGYPGGAGFAERG

SEQ ID NO: 844444 - protein, 22 aa, Mycobacterium
PGPDGPIPLRIYRPTDATDASV

SEQ ID NO: 844445 - protein, 20 aa, Mycobacterium
PGPDGWIRAVGYHDSVAGEL

SEQ ID NO: 844446 - protein, 25 aa, Mycobacterium
PGPFDAYLTMRGLKTLVLRMRQHSE

SEQ ID NO: 844447 - protein, 33 aa, Mycobacterium
PGPFHVGILLANVPDFVFWLGGAALAGATVVGL

SEQ ID NO: 844448 - protein, 22 aa, Mycobacterium
PGPFQFLRVIGAYYTPRFHPSQ

SEQ ID NO: 844449 - protein, 24 aa, Mycobacterium
PGPFRFVMMVLRHIPRPIFRKLPI

SEQ ID NO: 844450 - protein, 23 aa, Mycobacterium
PGPGARPSAILAYPLVAACPTIT

SEQ ID NO: 844451 - protein, 18 aa, Mycobacterium
PGPGLTISRDLPKLGYKG

SEQ ID NO: 844452 - protein, 28 aa, Mycobacterium
PGPGTFTYWDYTQLRFPKNRGMRIDFIL

SEQ ID NO: 844453 - protein, 24 aa, Mycobacterium
PGPIGERADWWWYDPFQPQPPPNN

SEQ ID NO: 844454 - protein, 26 aa, Mycobacterium
PGPKGFLDFPIPIDGLYLGGAGCHGG

SEQ ID NO: 844455 - protein, 29 aa, Mycobacterium
PGPKRQAALNRLLFPGPTAEFEAHRETYG

SEQ ID NO: 844456 - protein, 21 aa, Mycobacterium
PGPLKALLREAVRDTVFIDAR

SEQ ID NO: 844457 - protein, 19 aa, Mycobacterium
PGPLLAQFDVFADAVLAAA

SEQ ID NO: 844458 - protein, 18 aa, Mycobacterium
PGPLSLELSKRRAAAVSH

SEQ ID NO: 844459 - protein, 25 aa, Mycobacterium
PGPNVDLPVPPGWQLTQDSGTSYGG

SEQ ID NO: 844460 - protein, 23 aa, Mycobacterium
PGPQVPLYLLGCQVKSMYPLGPI

SEQ ID NO: 844461 - protein, 21 aa, Mycobacterium
PGPRALQLLDLGSPTIDFVNI

SEQ ID NO: 844462 - protein, 25 aa, Mycobacterium
PGPRGFLDLPIPIDGLYLAGAGCHG

SEQ ID NO: 844463 - protein, 26 aa, Mycobacterium
PGPRGFLGQPIPIEGLYLGSAGCHGG

SEQ ID NO: 844464 - protein, 28 aa, Mycobacterium
PGPSGVYRTLLLRVLPGTEPSVVARFED

SEQ ID NO: 844465 - protein, 23 aa, Mycobacterium
PGPSPYGPPPIYVGALGPQLTRA

SEQ ID NO: 844466 - protein, 26 aa, Mycobacterium
PGPTALLAPQWVPWEERVRPGDLSPG

SEQ ID NO: 844467 - protein, 23 aa, Mycobacterium
PGPTDTPLFHAQPEKLKEALVKA

SEQ ID NO: 844468 - protein, 19 aa, Mycobacterium
PGPTVRAPLGLIAGARSGD

SEQ ID NO: 844469 - protein, 26 aa, Mycobacterium
PGQAGGAGGLLIGNGGNGAPGAVGQA

SEQ ID NO: 844470 - protein, 24 aa, Mycobacterium
PGQDNISKLLWANWHRELGEIAMD

SEQ ID NO: 844471 - protein, 24 aa, Mycobacterium
PGQFTFPMEFTPKGPDWQLTRNTA

SEQ ID NO: 844472 - protein, 33 aa, Mycobacterium
PGQHGWGHVLFGKIPDWLGITDPSTGLDKHGLP

SEQ ID NO: 844473 - protein, 26 aa, Mycobacterium
PGQHPLPAVIFRTPYDKRGMVSQLWA

SEQ ID NO: 844474 - protein, 26 aa, Mycobacterium
PGQIEDLWTVMYRGGFYRGGGIHMSA

SEQ ID NO: 844475 - protein, 36 aa, Mycobacterium
PGQIETLLSPALLPETRFAAPLLARGLPACPGVVSG

SEQ ID NO: 844476 - protein, 24 aa, Mycobacterium
PGQPAQIWQFAQPVTTAGVLTIAA

SEQ ID NO: 844477 - protein, 24 aa, Mycobacterium
PGQPPAFLRALGERTDWTDLRVYG

SEQ ID NO: 844478 - protein, 24 aa, Mycobacterium
PGQPPAFLRALGVRKDWTDLRVYG

SEQ ID NO: 844479 - protein, 17 aa, Mycobacterium
PGQPPIVIPLASGQYNN

SEQ ID NO: 844480 - protein, 26 aa, Mycobacterium
PGQPTDYGYLLIKPGDVGGGLTAPQS

SEQ ID NO: 844481 - protein, 28 aa, Mycobacterium
PGQPTDYSALLITPADIGGGLTAPQPPV

SEQ ID NO: 844482 - protein, 18 aa, Mycobacterium
PGQRIKPPYVAAYVLLDG

SEQ ID NO: 844483 - protein, 17 aa, Mycobacterium
PGQRKFAFPRTTLTFDC

SEQ ID NO: 844484 - protein, 23 aa, Mycobacterium
PGQRRACAYVLARAAWYRGDIHE

SEQ ID NO: 844485 - protein, 31 aa, Mycobacterium
PGQSGNVVVPVRAGFHLLVAAANDAGEGGDV

SEQ ID NO: 844486 - protein, 30 aa, Mycobacterium
PGQTPPSPPTLLWPIGVPFSDGLNTLAQFK

SEQ ID NO: 844487 - protein, 19 aa, Mycobacterium
PGQTYLGLAIQHVRYWAST

SEQ ID NO: 844488 - protein, 23 aa, Mycobacterium
PGQVAAFLGVLLGGGTVVTINPS

SEQ ID NO: 844489 - protein, 19 aa, Mycobacterium
PGQWLLKSPAHLWQLDTLL

SEQ ID NO: 844490 - protein, 26 aa, Mycobacterium
PGQYIGIGLLVDGRWRWRSYSLTSSP

SEQ ID NO: 844491 - protein, 27 aa, Mycobacterium
PGQYIGIGLLVDGRWRWRSYSLTSSPV

SEQ ID NO: 844492 - protein, 21 aa, Mycobacterium
PGRAPVVPALGMALLGARAAG

SEQ ID NO: 844493 - protein, 31 aa, Mycobacterium
PGRAQFHYLESWLLPSLGLRATVFHFNPGHE

SEQ ID NO: 844494 - protein, 29 aa, Mycobacterium
PGRAQFHYLQSWLLPSLGLRATIFHFNPG

SEQ ID NO: 844495 - protein, 25 aa, Mycobacterium
PGRAQFHYVESWLVPALGLRANIFH

SEQ ID NO: 844496 - protein, 17 aa, Mycobacterium
PGRDDFLGEFPLSSESI

SEQ ID NO: 844497 - protein, 35 aa, Mycobacterium
PGRDRGLTWLPLYHDMGLTFLLTGFMSGSEMWLAP

SEQ ID NO: 844498 - protein, 17 aa, Mycobacterium
PGRDYVFEHYRAITGLI

SEQ ID NO: 844499 - protein, 18 aa, Mycobacterium
PGREAYPGDVFYLHSRLL

SEQ ID NO: 844500 - protein, 24 aa, Mycobacterium
PGREPLLMALQRELRRRTGVLVPV

SEQ ID NO: 844501 - protein, 26 aa, Mycobacterium
PGRFIPMAIPAIWNPGLAAAEVRRVA

SEQ ID NO: 844502 - protein, 24 aa, Mycobacterium
PGRFRQLGPINWVIAKLGARTVRA

SEQ ID NO: 844503 - protein, 32 aa, Mycobacterium
PGRGLVLQPGMALALEPWWGRGTARLIVDDDG

SEQ ID NO: 844504 - protein, 22 aa, Mycobacterium
PGRGRIGRIRLTMRSRGRALGP

SEQ ID NO: 844505 - protein, 24 aa, Mycobacterium
PGRGRIWLRIKGHLDGRPAFGDDA

SEQ ID NO: 844506 - protein, 41 aa, Mycobacterium
PGRGWVQYEPYGTVLIIGAWNYPFYLTLGPAVGAIAAGNTV

SEQ ID NO: 844507 - protein, 20 aa, Mycobacterium
PGRHMALNALAALLAAREIG

SEQ ID NO: 844508 - protein, 23 aa, Mycobacterium
PGRHPVLVAKQLASLAALAPKRV

SEQ ID NO: 844509 - protein, 17 aa, Mycobacterium
PGRHQLFLHGCDISRGD

SEQ ID NO: 844510 - protein, 22 aa, Mycobacterium
PGRHRRIRLDAVLAYQQETRAR

SEQ ID NO: 844511 - protein, 19 aa, Mycobacterium
PGRIGYWQVGVPPSGPMDD

SEQ ID NO: 844512 - protein, 22 aa, Mycobacterium
PGRKGPWWDRSETKWIAEALFS

SEQ ID NO: 844513 - protein, 19 aa, Mycobacterium
PGRLEGPDPSLLAAAYSVV

SEQ ID NO: 844514 - protein, 23 aa, Mycobacterium
PGRLSSKFWKLLGASTERNQARS

SEQ ID NO: 844515 - protein, 21 aa, Mycobacterium
PGRLSSRFWKLLGASTEKDRS

SEQ ID NO: 844516 - protein, 23 aa, Mycobacterium
PGRLSSRFWRLLGASTEKNRNRS

SEQ ID NO: 844517 - protein, 23 aa, Mycobacterium
PGRLSSRFWRLLGASTEKNRSRS

SEQ ID NO: 844518 - protein, 17 aa, Mycobacterium
PGRLVAGLVRRGVPALG

SEQ ID NO: 844519 - protein, 30 aa, Mycobacterium
PGRLVVCLDLDWRPQFRVDLISSYKAHRVA

SEQ ID NO: 844520 - protein, 18 aa, Mycobacterium
PGRLYPGVSSPLAGDPHI

SEQ ID NO: 844521 - protein, 22 aa, Mycobacterium
PGRNMYQFVEPWRASFQEIAEF

SEQ ID NO: 844522 - protein, 29 aa, Mycobacterium
PGRPAMIHVDLYRLLDRPGTALLGELDSL

SEQ ID NO: 844523 - protein, 25 aa, Mycobacterium
PGRPAMIHVDVYRLLDHGSADLLGE

SEQ ID NO: 844524 - protein, 24 aa, Mycobacterium
PGRPFGIYIHVPFCATRCGYCDFN

SEQ ID NO: 844525 - protein, 18 aa, Mycobacterium
PGRPIDAFVVRKAAKVHG

SEQ ID NO: 844526 - protein, 23 aa, Mycobacterium
PGRPRAGLAVPRAGWHRHRRDRA

SEQ ID NO: 844527 - protein, 18 aa, Mycobacterium
PGRPTGWPEWAAANVVRA

SEQ ID NO: 844528 - protein, 20 aa, Mycobacterium
PGRQVWYFDADGNQFRKLTP

SEQ ID NO: 844529 - protein, 18 aa, Mycobacterium
PGRRAAWLVIDVRDVAAV

SEQ ID NO: 844530 - protein, 27 aa, Mycobacterium
PGRRGLSTRWRPVLEPVLEKLAAEQLI

SEQ ID NO: 844531 - protein, 37 aa, Mycobacterium
PGRRLVLSFEYRTLWAEAVPGRVWRRGAGAVKAWSEA

SEQ ID NO: 844532 - protein, 23 aa, Mycobacterium
PGRRQHVVLASKFFGNMFPGDPN

SEQ ID NO: 844533 - protein, 25 aa, Mycobacterium
PGRRQPPKSLPPLRRPEVLARVARS

SEQ ID NO: 844534 - protein, 25 aa, Mycobacterium
PGRSIDYGLLRYLRGDTRAVLRKYR

SEQ ID NO: 844535 - protein, 17 aa, Mycobacterium
PGRSRFYRPLPRPEVIA

SEQ ID NO: 844536 - protein, 32 aa, Mycobacterium
PGRTYQFNALFLDPYLWKLQLGGKRLVQKARQ

SEQ ID NO: 844537 - protein, 31 aa, Mycobacterium
PGRVELVELLGPRYVLIIRAGAHRLTAVAEA

SEQ ID NO: 844538 - protein, 23 aa, Mycobacterium
PGRVPVWSPYLRGERSPFHDPDR

SEQ ID NO: 844539 - protein, 20 aa, Mycobacterium
PGRVVVLPWDRHIAAGTEIH

SEQ ID NO: 844540 - protein, 20 aa, Mycobacterium
PGRVWFSTFGDPVAFRILDL

SEQ ID NO: 844541 - protein, 26 aa, Mycobacterium
PGSARELILTLRRDHLLAPHTSDAGA

SEQ ID NO: 844542 - protein, 29 aa, Mycobacterium
PGSEAPAEMHFYFPRFRALCMAENATHNL

SEQ ID NO: 844543 - protein, 24 aa, Mycobacterium
PGSEPLVYALARELHRLSGIRVPT

SEQ ID NO: 844544 - protein, 21 aa, Mycobacterium
PGSFWSGDTLPLTPGYRLGSE

SEQ ID NO: 844545 - protein, 17 aa, Mycobacterium
PGSFYALPQSPQLFKQL

SEQ ID NO: 844546 - protein, 33 aa, Mycobacterium
PGSGPAPVKPFPAPLLNLRPGTIPPSTVSAGVG

SEQ ID NO: 844547 - protein, 25 aa, Mycobacterium
PGSHDLLLISPIILYDHPEIAEQSS

SEQ ID NO: 844548 - protein, 25 aa, Mycobacterium
PGSKSLTNRALILAALATSQGTSTI

SEQ ID NO: 844549 - protein, 18 aa, Mycobacterium
PGSLILETTWQTHTGWLI

SEQ ID NO: 844550 - protein, 20 aa, Mycobacterium
PGSLPVLNRAAVESAIRIGL

SEQ ID NO: 844551 - protein, 27 aa, Mycobacterium
PGSLQMSSPCQVLWTTLGSPVHRNLLG

SEQ ID NO: 844552 - protein, 23 aa, Mycobacterium
PGSNVVLCLGMCGQMIYVNRAAQ

SEQ ID NO: 844553 - protein, 23 aa, Mycobacterium
PGSNVVLCLGMCGQMIYVNRRAQ

SEQ ID NO: 844554 - protein, 23 aa, Mycobacterium
PGSPAHHVLSLVQIPVVSGLAEN

SEQ ID NO: 844555 - protein, 24 aa, Mycobacterium
PGSPAHHVLSLVQLPVAGGLAENL

SEQ ID NO: 844556 - protein, 23 aa, Mycobacterium
PGSPAHHVLSLVRIPVVSGDAEN

SEQ ID NO: 844557 - protein, 22 aa, Mycobacterium
PGSPFLELAPLAAGGMYDDECP

SEQ ID NO: 844558 - protein, 27 aa, Mycobacterium
PGSPPATLLDYFPEDFLMVIDESHVTV

SEQ ID NO: 844559 - protein, 25 aa, Mycobacterium
PGSPSPLHLQRAPAGFYRWLASEVG

SEQ ID NO: 844560 - protein, 17 aa, Mycobacterium
PGSPWLADTWRDRFEEM

SEQ ID NO: 844561 - protein, 28 aa, Mycobacterium
PGSRARFGDVLPFLVKVLAADEPLSLQA

SEQ ID NO: 844562 - protein, 23 aa, Mycobacterium
PGSRLFFPAWDTTTAELPPMTTP

SEQ ID NO: 844563 - protein, 23 aa, Mycobacterium
PGSRLFFPGWDTTTAELPPMAQP

SEQ ID NO: 844564 - protein, 25 aa, Mycobacterium
PGSRRLMDRLFVESEPGRGTVVEMW

SEQ ID NO: 844565 - protein, 24 aa, Mycobacterium
PGSRRRVAFVFPGQGSQWPSMGVE

SEQ ID NO: 844566 - protein, 31 aa, Mycobacterium
PGSTFRESLLPMMILMDPPRHDQLRALVSKA

SEQ ID NO: 844567 - protein, 25 aa, Mycobacterium
PGSVKRFAALLSNAKTIFWNGPMGV

SEQ ID NO: 844568 - protein, 20 aa, Mycobacterium
PGSVVLRRIATRTGIPDYGY

SEQ ID NO: 844569 - protein, 24 aa, Mycobacterium
PGSVYPTLQLLTDEGLITASESEG

SEQ ID NO: 844570 - protein, 20 aa, Mycobacterium
PGSWLLLSACEATDPLTAQL

SEQ ID NO: 844571 - protein, 22 aa, Mycobacterium
PGSWRYRLLPMRWKTSDGWRDT

SEQ ID NO: 844572 - protein, 23 aa, Mycobacterium
PGTACRVMMSMLASGIFSSAMDP

SEQ ID NO: 844573 - protein, 23 aa, Mycobacterium
PGTADCILAFDLLAAADEKNLGY

SEQ ID NO: 844574 - protein, 17 aa, Mycobacterium
PGTAFAATFTPGERRDA

SEQ ID NO: 844575 - protein, 19 aa, Mycobacterium
PGTALWLYAHPLRGSLNDH

SEQ ID NO: 844576 - protein, 27 aa, Mycobacterium
PGTDDGFAYRIVYVDPALVFESSDRRL

SEQ ID NO: 844577 - protein, 25 aa, Mycobacterium
PGTDLALLNGLLHLLVENGAVDAEF

SEQ ID NO: 844578 - protein, 24 aa, Mycobacterium
PGTDQPVEFWSTAAIRAALEGGDI

SEQ ID NO: 844579 - protein, 25 aa, Mycobacterium
PGTDRVLNHILWRDDPPHDEWQPLP

SEQ ID NO: 844580 - protein, 27 aa, Mycobacterium
PGTFEGWLHRITTNLFLDMVRRRARIR

SEQ ID NO: 844581 - protein, 25 aa, Mycobacterium
PGTFEGWLHRITTNLFLDMVRRRTR

SEQ ID NO: 844582 - protein, 29 aa, Mycobacterium
PGTGLVSLLKLQLALSHFSWNDVLETRLA

SEQ ID NO: 844583 - protein, 28 aa, Mycobacterium
PGTGQAGGPGGWLWGDGGDGGSGTPGTA

SEQ ID NO: 844584 - protein, 19 aa, Mycobacterium
PGTIASVAAVALYIGEVLG

SEQ ID NO: 844585 - protein, 18 aa, Mycobacterium
PGTIASVAAVAMYIGEVL

SEQ ID NO: 844586 - protein, 24 aa, Mycobacterium
PGTIDRPGVWWQFQRLRAETSPGP

SEQ ID NO: 844587 - protein, 28 aa, Mycobacterium
PGTLELSEWWAYLEGVRKTYPLSYGPQS

SEQ ID NO: 844588 - protein, 18 aa, Mycobacterium
PGTLIVVSHDRYLLERVT

SEQ ID NO: 844589 - protein, 32 aa, Mycobacterium
PGTLTSARWGLLEPPQPWLPASAIAEAGLILV

SEQ ID NO: 844590 - protein, 26 aa, Mycobacterium
PGTNIEFIVAQLLRLGKLGSFDFNSR

SEQ ID NO: 844591 - protein, 20 aa, Mycobacterium
PGTPEWLAAITPSKVAAILG

SEQ ID NO: 844592 - protein, 20 aa, Mycobacterium
PGTPFAIALAIEQLTALLPD

SEQ ID NO: 844593 - protein, 19 aa, Mycobacterium
PGTPLLGSWQLSIKRQADN

SEQ ID NO: 844594 - protein, 18 aa, Mycobacterium
PGTPPDRHWAIRSTQGQP

SEQ ID NO: 844595 - protein, 21 aa, Mycobacterium
PGTPPGPWLRTGDLGAFSEGE

SEQ ID NO: 844596 - protein, 26 aa, Mycobacterium
PGTPPLPELPLLYFGIPANDQLEQYW

SEQ ID NO: 844597 - protein, 18 aa, Mycobacterium
PGTPVTYVGHSYGGAIVG

SEQ ID NO: 844598 - protein, 24 aa, Mycobacterium
PGTQDLLLISPIILYDHPEVAEQS

SEQ ID NO: 844599 - protein, 21 aa, Mycobacterium
PGTRAITWSDAAQLPLALLEP

SEQ ID NO: 844600 - protein, 20 aa, Mycobacterium
PGTRLAIIGLGGLGHMGVKL

SEQ ID NO: 844601 - protein, 22 aa, Mycobacterium
PGTRMRVALSALTMAEFFRDEQ

SEQ ID NO: 844602 - protein, 21 aa, Mycobacterium
PGTRMRVALSALTMAEYFRDE

SEQ ID NO: 844603 - protein, 24 aa, Mycobacterium
PGTRRRVPGLRREELALLAGVSVD

SEQ ID NO: 844604 - protein, 24 aa, Mycobacterium
PGTSFRVHCREWFDGAIHNDDSAD

SEQ ID NO: 844605 - protein, 23 aa, Mycobacterium
PGTSPFDHFIYVIASDGDIEEGV

SEQ ID NO: 844606 - protein, 21 aa, Mycobacterium
PGTSYWYAHTDQWRYDGYRAD

SEQ ID NO: 844607 - protein, 27 aa, Mycobacterium
PGTVDEYPNWRLPLPLTLEELQADPRV

SEQ ID NO: 844608 - protein, 38 aa, Mycobacterium
PGTWGPGQPPPPLWSLVQSFVLEAWPDGDVAGLRAAAS

SEQ ID NO: 844609 - protein, 21 aa, Mycobacterium
PGTWRAVVDYPFDEAGFTSAD

SEQ ID NO: 844610 - protein, 27 aa, Mycobacterium
PGTYLAGFFEMRPLPYAEAGFGYPEAG

SEQ ID NO: 844611 - protein, 27 aa, Mycobacterium
PGTYLNSFYEIRPLPYAEAGYGYPEAG

SEQ ID NO: 844612 - protein, 28 aa, Mycobacterium
PGVAATHQAILGDRLRLPLDADLSSAVT

SEQ ID NO: 844613 - protein, 23 aa, Mycobacterium
PGVAMMVVLISRGGYITVTVRYD

SEQ ID NO: 844614 - protein, 27 aa, Mycobacterium
PGVAPKPLRGMPPFSGPQGPFAGIAAG

SEQ ID NO: 844615 - protein, 24 aa, Mycobacterium
PGVAVAPRKQWPSGLASLGLQLSG

SEQ ID NO: 844616 - protein, 24 aa, Mycobacterium
PGVDHEWHHGWLLRSGRGATRRAN

SEQ ID NO: 844617 - protein, 18 aa, Mycobacterium
PGVDPRKVVLWGSSFSGS

SEQ ID NO: 844618 - protein, 17 aa, Mycobacterium
PGVDVLFLDTGYHFVET

SEQ ID NO: 844619 - protein, 26 aa, Mycobacterium
PGVELRLLQTMLALFDLVRKAQGPDQ

SEQ ID NO: 844620 - protein, 20 aa, Mycobacterium
PGVERCWLDGWLLRAGHGAT

SEQ ID NO: 844621 - protein, 25 aa, Mycobacterium
PGVFQPLHLILLANAGMTIGEIFDL

SEQ ID NO: 844622 - protein, 20 aa, Mycobacterium
PGVGLLLRHGATDQVLLAGR

SEQ ID NO: 844623 - protein, 20 aa, Mycobacterium
PGVGLRYEFIDHKGDRIGII

SEQ ID NO: 844624 - protein, 20 aa, Mycobacterium
PGVGLRYEFISHKGERIGII

SEQ ID NO: 844625 - protein, 23 aa, Mycobacterium
PGVGPWEGPWPDDPRYDPDLLRD

SEQ ID NO: 844626 - protein, 24 aa, Mycobacterium
PGVKLSERFLLADIHLDWAVDRGG

SEQ ID NO: 844627 - protein, 23 aa, Mycobacterium
PGVKTYLDLPLFAGRPAPGLVTS

SEQ ID NO: 844628 - protein, 19 aa, Mycobacterium
PGVLAPPFSLGPRTDVRRG

SEQ ID NO: 844629 - protein, 17 aa, Mycobacterium
PGVLARVASLFSRRGYN

SEQ ID NO: 844630 - protein, 31 aa, Mycobacterium
PGVLGPAGTAPIPPSSLPAATGTRGDSPPYG

SEQ ID NO: 844631 - protein, 22 aa, Mycobacterium
PGVLLTQIAAIRALARQGMDLV

SEQ ID NO: 844632 - protein, 19 aa, Mycobacterium
PGVLLTQIAAVRALARQGM

SEQ ID NO: 844633 - protein, 23 aa, Mycobacterium
PGVLSPTLPVPKSIPRPEYAWKP

SEQ ID NO: 844634 - protein, 24 aa, Mycobacterium
PGVLTVVPPSWRPDLRQPADLVEE

SEQ ID NO: 844635 - protein, 17 aa, Mycobacterium
PGVMWQFAQAVRGLADG

SEQ ID NO: 844636 - protein, 26 aa, Mycobacterium
PGVPGGRGLALFIAGDNLRKGAALNT

SEQ ID NO: 844637 - protein, 24 aa, Mycobacterium
PGVPLPELPSILCATDLAPADTAG

SEQ ID NO: 844638 - protein, 30 aa, Mycobacterium
PGVPNWLDTTGLRRGFMTMRWTYSQPTERL

SEQ ID NO: 844639 - protein, 26 aa, Mycobacterium
PGVPPGVPGAGGTGGLLFGATGVNGL

SEQ ID NO: 844640 - protein, 24 aa, Mycobacterium
PGVQYHLANTLRWNGLRPTQAAAV

SEQ ID NO: 844641 - protein, 27 aa, Mycobacterium
PGVRELLWEPMRLYPADIISAITNSSV

SEQ ID NO: 844642 - protein, 29 aa, Mycobacterium
PGVRGPDQPALWRAVAIRGVTTAAATTAA

SEQ ID NO: 844643 - protein, 26 aa, Mycobacterium
PGVRPARYRFLTRNRLVAAVAGAAVV

SEQ ID NO: 844644 - protein, 24 aa, Mycobacterium
PGVRQFERLLAKALRKATTKLAVD

SEQ ID NO: 844645 - protein, 24 aa, Mycobacterium
PGVRQFERLLAKALRKATTKLVDD

SEQ ID NO: 844646 - protein, 17 aa, Mycobacterium
PGVRQFERLLAKVLRKV

SEQ ID NO: 844647 - protein, 27 aa, Mycobacterium
PGVRSVELLPYLRLHYQQAGLSANLVD

SEQ ID NO: 844648 - protein, 20 aa, Mycobacterium
PGVRVIDYGIRGMHLAYDLL

SEQ ID NO: 844649 - protein, 18 aa, Mycobacterium
PGVRWPDLALQGGRLHWS

SEQ ID NO: 844650 - protein, 18 aa, Mycobacterium
PGVSFLLRHGATERVLLS

SEQ ID NO: 844651 - protein, 18 aa, Mycobacterium
PGVSWRRIVDVALVAREV

SEQ ID NO: 844652 - protein, 24 aa, Mycobacterium
PGVTFGSFTLPYFTIDDPNGGNWT

SEQ ID NO: 844653 - protein, 27 aa, Mycobacterium
PGVTPTPLRGMPPFSGPQGPFAGITAA

SEQ ID NO: 844654 - protein, 17 aa, Mycobacterium
PGVTWLPRWVSAHLNGQ

SEQ ID NO: 844655 - protein, 33 aa, Mycobacterium
PGVVGFSTGLIYIPGLFAFTDELVALVSAAASC

SEQ ID NO: 844656 - protein, 25 aa, Mycobacterium
PGVVMRPLMRLFDRAGRALYGAYLR

SEQ ID NO: 844657 - protein, 27 aa, Mycobacterium
PGVVRFLPMEELIAAFLTVLFPGLEIV

SEQ ID NO: 844658 - protein, 18 aa, Mycobacterium
PGVWLIDVERVQREPSAH

SEQ ID NO: 844659 - protein, 24 aa, Mycobacterium
PGVWQGLYESLLTERLYQALAEST

SEQ ID NO: 844660 - protein, 26 aa, Mycobacterium
PGVYVRSFYFFDPDGITLEFACWTKE

SEQ ID NO: 844661 - protein, 26 aa, Mycobacterium
PGVYVRSFYFLDPDGITLEFACWTKE

SEQ ID NO: 844662 - protein, 24 aa, Mycobacterium
PGWDARLPEQPRLLIKWVEACYGA

SEQ ID NO: 844663 - protein, 17 aa, Mycobacterium
PGWHRLPDKATDPHYGE

SEQ ID NO: 844664 - protein, 17 aa, Mycobacterium
PGWLGLPDGLTLRVAAI

SEQ ID NO: 844665 - protein, 17 aa, Mycobacterium
PGWRRRLIDDTGSVPSL

SEQ ID NO: 844666 - protein, 20 aa, Mycobacterium
PGWRRYPECVATEPSTPIAD

SEQ ID NO: 844667 - protein, 18 aa, Mycobacterium
PGWRTDFLTQMGLTVLQV

SEQ ID NO: 844668 - protein, 23 aa, Mycobacterium
PGWRYLHYEHTLVHAWVAAAQGA

SEQ ID NO: 844669 - protein, 20 aa, Mycobacterium
PGWTNALMLATSAYGACDDA

SEQ ID NO: 844670 - protein, 29 aa, Mycobacterium
PGWVLPRVNFRHPAWARSTFKRMPATEQA

SEQ ID NO: 844671 - protein, 21 aa, Mycobacterium
PGWVLPRVNFRHPAWARSTFT

SEQ ID NO: 844672 - protein, 28 aa, Mycobacterium
PGYAAFMPLNYFVHLATLIVEGVFGRHP

SEQ ID NO: 844673 - protein, 31 aa, Mycobacterium
PGYANFAVAQPPLKLVLLENPGHGGSLNHLG

SEQ ID NO: 844674 - protein, 17 aa, Mycobacterium
PGYDLRYLTGSRAQTFE

SEQ ID NO: 844675 - protein, 20 aa, Mycobacterium
PGYFMAKRIIKLINAVGETV

SEQ ID NO: 844676 - protein, 21 aa, Mycobacterium
PGYFMAKRIIKLITAVGDTIN

SEQ ID NO: 844677 - protein, 26 aa, Mycobacterium
PGYLARADMMFALSVPLPGHHIINAS

SEQ ID NO: 844678 - protein, 20 aa, Mycobacterium
PGYMVPSAVVVLDVLPLTVN

SEQ ID NO: 844679 - protein, 19 aa, Mycobacterium
PGYNEFFPALLDEGICVFL

SEQ ID NO: 844680 - protein, 20 aa, Mycobacterium
PGYPFARQRHWVEPKHMAWA

SEQ ID NO: 844681 - protein, 20 aa, Mycobacterium
PGYPFRCKRVLLGDDFYRAL

SEQ ID NO: 844682 - protein, 23 aa, Mycobacterium
PGYQFLRMMLQVLSHQDGSTRRW

SEQ ID NO: 844683 - protein, 20 aa, Mycobacterium
PGYQVRFARRIQTETPLPAA

SEQ ID NO: 844684 - protein, 22 aa, Mycobacterium
PGYRALHAKGTLYRGTFTATPE

SEQ ID NO: 844685 - protein, 18 aa, Mycobacterium
PGYSWTPIILSDGAHHTN

SEQ ID NO: 844686 - protein, 22 aa, Mycobacterium
PGYSWTPIILSDGAHHTNASYY

SEQ ID NO: 844687 - protein, 20 aa, Mycobacterium
PGYSWTPIILSDGAHHTNAT

SEQ ID NO: 844688 - protein, 22 aa, Mycobacterium
PGYSWTPIILSDGAHHTNATYY

SEQ ID NO: 844689 - protein, 18 aa, Mycobacterium
PGYVLRVLEWMPRQGSRN

SEQ ID NO: 844690 - protein, 18 aa, Mycobacterium
PGYWHPAHFASAAATLDR

SEQ ID NO: 844691 - protein, 33 aa, Mycobacterium
PGYYDILHSHYWLSGQVGWLAADRWAVPLVHTA

SEQ ID NO: 844692 - protein, 18 aa, Mycobacterium
PHAAITTDLIVGFPGETE

SEQ ID NO: 844693 - protein, 29 aa, Mycobacterium
PHAAKWVVRIVLSLMYWPAESEDVERLMV

SEQ ID NO: 844694 - protein, 19 aa, Mycobacterium
PHADYPLVTVGRLVLDRNF

SEQ ID NO: 844695 - protein, 18 aa, Mycobacterium
PHALAMLRGFNLIDQLSE

SEQ ID NO: 844696 - protein, 18 aa, Mycobacterium
PHALFAIHRREAPVYWHE

SEQ ID NO: 844697 - protein, 19 aa, Mycobacterium
PHAMQKRMAKMLQRAVDEV

SEQ ID NO: 844698 - protein, 23 aa, Mycobacterium
PHAMSPLSLPFWEGCRSGELRYQ

SEQ ID NO: 844699 - protein, 30 aa, Mycobacterium
PHAPTGAQWDAALGYWQQLRTDPGAVFDTE

SEQ ID NO: 844700 - protein, 21 aa, Mycobacterium
PHAPVTEYFVWFGDEYQVDET

SEQ ID NO: 844701 - protein, 22 aa, Mycobacterium
PHARLLIIAFVPGGRVGVRGID

SEQ ID NO: 844702 - protein, 24 aa, Mycobacterium
PHARRFEQLIDSIDPRIRADGYWP

SEQ ID NO: 844703 - protein, 28 aa, Mycobacterium
PHARTLVDGFGIPKPLRYAEMLHPENLP

SEQ ID NO: 844704 - protein, 17 aa, Mycobacterium
PHASYEPKWDGFRSICF

SEQ ID NO: 844705 - protein, 18 aa, Mycobacterium
PHAVFRKFGLCRICLREM

SEQ ID NO: 844706 - protein, 18 aa, Mycobacterium
PHAVKWQGVIYLEDGLHR

SEQ ID NO: 844707 - protein, 18 aa, Mycobacterium
PHAYRFGTVGWPFPATEV

SEQ ID NO: 844708 - protein, 27 aa, Mycobacterium
PHCAAVGRISYLLGLRGPAVAVDTACS

SEQ ID NO: 844709 - protein, 25 aa, Mycobacterium
PHDDGVWIGIAYSLNRLPSDIDAVV

SEQ ID NO: 844710 - protein, 25 aa, Mycobacterium
PHDGPLPVMFFVHGGGYVLGSSATP

SEQ ID NO: 844711 - protein, 22 aa, Mycobacterium
PHDRRYLLFNPVTKSKVTSEGE

SEQ ID NO: 844712 - protein, 27 aa, Mycobacterium
PHDTTHPLFFNIPTPGPAPADTEESAG

SEQ ID NO: 844713 - protein, 23 aa, Mycobacterium
PHDVFRRNIWVSPFWEGCVADVV

SEQ ID NO: 844714 - protein, 24 aa, Mycobacterium
PHDVFRRNIWVSPFWEGSVADVVQ

SEQ ID NO: 844715 - protein, 20 aa, Mycobacterium
PHEANLDGIFGLLSNVVWTN

SEQ ID NO: 844716 - protein, 22 aa, Mycobacterium
PHEARILLAKNPAGWQEALSMV

SEQ ID NO: 844717 - protein, 29 aa, Mycobacterium
PHEEFATLRREAPVWWNPQPRTVGGFADE

SEQ ID NO: 844718 - protein, 23 aa, Mycobacterium
PHEFEALDRSWERAWESDRDYSD

SEQ ID NO: 844719 - protein, 18 aa, Mycobacterium
PHEIAYRQMMLESMTAGR

SEQ ID NO: 844720 - protein, 21 aa, Mycobacterium
PHELAIALYGVSRHAGAVPLA

SEQ ID NO: 844721 - protein, 25 aa, Mycobacterium
PHELRAFAARLLGIPAQGVRVIMRD

SEQ ID NO: 844722 - protein, 27 aa, Mycobacterium
PHELRAFAARLLGIPAQHVRVIMRDTG

SEQ ID NO: 844723 - protein, 27 aa, Mycobacterium
PHENAQFLVFCAAVIRAVHKFAGLLRV

SEQ ID NO: 844724 - protein, 27 aa, Mycobacterium
PHENAQFLVFCAAVIRAVHKYAGLLRV

SEQ ID NO: 844725 - protein, 19 aa, Mycobacterium
PHENLYGISWNPLTTIAVL

SEQ ID NO: 844726 - protein, 24 aa, Mycobacterium
PHENLYGISWNPVNTMLALQRIDG

SEQ ID NO: 844727 - protein, 18 aa, Mycobacterium
PHEPLLATMLETDRTRVM

SEQ ID NO: 844728 - protein, 20 aa, Mycobacterium
PHEREAVLRLLRDGLPTVPR

SEQ ID NO: 844729 - protein, 17 aa, Mycobacterium
PHEVALSGSGKGGAKYG

SEQ ID NO: 844730 - protein, 24 aa, Mycobacterium
PHEVPLNFLNPRPGTPFGDLEVLP

SEQ ID NO: 844731 - protein, 25 aa, Mycobacterium
PHFDLTIQYLRPAVPGTLLTCVART

SEQ ID NO: 844732 - protein, 18 aa, Mycobacterium
PHFEWRGLGFISQSALRL

SEQ ID NO: 844733 - protein, 25 aa, Mycobacterium
PHFEWRGLGFISQSALRLSDDFAEF

SEQ ID NO: 844734 - protein, 31 aa, Mycobacterium
PHFNDAIVRPLLRFFFRSWFRVEVSGIENLP

SEQ ID NO: 844735 - protein, 19 aa, Mycobacterium
PHFSYFAELAASYQWERQV

SEQ ID NO: 844736 - protein, 27 aa, Mycobacterium
PHGAHPYYVPAQLFPTADGYLGLFVTH

SEQ ID NO: 844737 - protein, 24 aa, Mycobacterium
PHGDGPFPAVVLLGPYSFEKEQAP

SEQ ID NO: 844738 - protein, 27 aa, Mycobacterium
PHGDKFFSLRRRVPVLTTVIDTPAHTA

SEQ ID NO: 844739 - protein, 19 aa, Mycobacterium
PHGGIAFGWDRITALLAGA

SEQ ID NO: 844740 - protein, 20 aa, Mycobacterium
PHGGIAFGWDRITALLAGVD

SEQ ID NO: 844741 - protein, 19 aa, Mycobacterium
PHGGIAFGWDRVTALLAGT

SEQ ID NO: 844742 - protein, 18 aa, Mycobacterium
PHGLAFDGPTLYVAQSDQ

SEQ ID NO: 844743 - protein, 21 aa, Mycobacterium
PHGLTRIDPVLRDAAVELGAF

SEQ ID NO: 844744 - protein, 26 aa, Mycobacterium
PHGMRTVALWEPPLLPITGENGAPVR

SEQ ID NO: 844745 - protein, 29 aa, Mycobacterium
PHGRANGIFLPHVLRYNASLPTKFMPAPG

SEQ ID NO: 844746 - protein, 18 aa, Mycobacterium
PHGRPLDLYVCDGKGCVG

SEQ ID NO: 844747 - protein, 19 aa, Mycobacterium
PHGVRPLSLGRLDRGWVVA

SEQ ID NO: 844748 - protein, 25 aa, Mycobacterium
PHHDDLILLFAIHSIANYSAPVFDP

SEQ ID NO: 844749 - protein, 22 aa, Mycobacterium
PHHDRARHYLPDGPGAVFAFGV

SEQ ID NO: 844750 - protein, 26 aa, Mycobacterium
PHHESTLTALLALASARWTAGDSLGA

SEQ ID NO: 844751 - protein, 23 aa, Mycobacterium
PHHHATVLGDRLRRLPAGLRSAV

SEQ ID NO: 844752 - protein, 18 aa, Mycobacterium
PHHRMLNPGGWTTRKNPR

SEQ ID NO: 844753 - protein, 18 aa, Mycobacterium
PHHRMLNPGGWTTRKNTR

SEQ ID NO: 844754 - protein, 26 aa, Mycobacterium
PHHTRLRKIISRGFTPRAIGRLEAEL

SEQ ID NO: 844755 - protein, 17 aa, Mycobacterium
PHIAMTVAMLRQAGVDV

SEQ ID NO: 844756 - protein, 17 aa, Mycobacterium
PHIAMTVSMLRDAGVEV

SEQ ID NO: 844757 - protein, 36 aa, Mycobacterium
PHIDLSRTVGWFTTKYPVALNFRRPAGGLSWGQVVA

SEQ ID NO: 844758 - protein, 22 aa, Mycobacterium
PHIEKRFSMPWSHPARRMREFV

SEQ ID NO: 844759 - protein, 20 aa, Mycobacterium
PHIEKRFSMPWSHPVRRMRE

SEQ ID NO: 844760 - protein, 20 aa, Mycobacterium
PHIGARFPLADTPAALRYVA

SEQ ID NO: 844761 - protein, 25 aa, Mycobacterium
PHIGDWKPITLPQIASLSAANPTVQ

SEQ ID NO: 844762 - protein, 19 aa, Mycobacterium
PHKAPRLSWAAELVAHHDP

SEQ ID NO: 844763 - protein, 21 aa, Mycobacterium
PHKLSLARQDQLRRLAATGEP

SEQ ID NO: 844764 - protein, 23 aa, Mycobacterium
PHKQIEHALTTLAVLRDHVPDVH

SEQ ID NO: 844765 - protein, 29 aa, Mycobacterium
PHKRNPVLSILIRRAALSAPPLAATLHTA

SEQ ID NO: 844766 - protein, 28 aa, Mycobacterium
PHKRNPVLSILIRRAALSAPQLAATLHT

SEQ ID NO: 844767 - protein, 17 aa, Mycobacterium
PHLADVKPFGRHVMKHV

SEQ ID NO: 844768 - protein, 19 aa, Mycobacterium
PHLGTLVDAFGIPEALLAT

SEQ ID NO: 844769 - protein, 21 aa, Mycobacterium
PHLHFEVLLGGSQRIDPQGWL

SEQ ID NO: 844770 - protein, 23 aa, Mycobacterium
PHLHVHVFPARNLSDFGFANVDR

SEQ ID NO: 844771 - protein, 23 aa, Mycobacterium
PHLHVHVFPTRRLSDFGFANVDR

SEQ ID NO: 844772 - protein, 19 aa, Mycobacterium
PHLLTADMVRPGAAVLDVG

SEQ ID NO: 844773 - protein, 30 aa, Mycobacterium
PHLNDAIFLPLLRVLFNSWFRVEVSGIENL

SEQ ID NO: 844774 - protein, 20 aa, Mycobacterium
PHLRKPRVLTIDRIPDSAGE

SEQ ID NO: 844775 - protein, 21 aa, Mycobacterium
PHLRTDKWSPFPAYARSKLAV

SEQ ID NO: 844776 - protein, 17 aa, Mycobacterium
PHLSRRLIVKYAKDLEQ

SEQ ID NO: 844777 - protein, 27 aa, Mycobacterium
PHLSTLLALMLTYRLGSLEALLGPSHS

SEQ ID NO: 844778 - protein, 21 aa, Mycobacterium
PHLSVLKNVAMAPRKLRRLPA

SEQ ID NO: 844779 - protein, 17 aa, Mycobacterium
PHLVLQSDRIFFAVWSV

SEQ ID NO: 844780 - protein, 27 aa, Mycobacterium
PHLVRAMPQVVPLLPSMGRGKRALVRA

SEQ ID NO: 844781 - protein, 25 aa, Mycobacterium
PHMPPLDHLDTAFPAALRSAGVDPD

SEQ ID NO: 844782 - protein, 25 aa, Mycobacterium
PHMPPLDHLNTAFLAALRSAGVERD

SEQ ID NO: 844783 - protein, 47 aa, Mycobacterium; identical to SEQ ID NO: 130084

SEQ ID NO: 844784 - protein, 20 aa, Mycobacterium
PHNLRELAEAVYWCLDNHEA

SEQ ID NO: 844785 - protein, 19 aa, Mycobacterium
PHNLVNWTRIAYNSDPGVV

SEQ ID NO: 844786 - protein, 37 aa, Mycobacterium
PHNTFHLRHRLFEPLQGTLPEPEIWARLVRALGVVDE

SEQ ID NO: 844787 - protein, 24 aa, Mycobacterium
PHNWTPDIIWNAYAAIDAPKVRNC

SEQ ID NO: 844788 - protein, 23 aa, Mycobacterium
PHPACATPPTRPRVSPARLHNSR

SEQ ID NO: 844789 - protein, 18 aa, Mycobacterium
PHPALPKGSSIYGGTKIF

SEQ ID NO: 844790 - protein, 18 aa, Mycobacterium
PHPELLRAWGFDADAAGL

SEQ ID NO: 844791 - protein, 17 aa, Mycobacterium
PHPFRGAPNEPYCLPYT

SEQ ID NO: 844792 - protein, 24 aa, Mycobacterium
PHPGQRIVGLSKLARLVHGYAARL

SEQ ID NO: 844793 - protein, 18 aa, Mycobacterium
PHPGTRYTQIAVLEDGIV

SEQ ID NO: 844794 - protein, 17 aa, Mycobacterium
PHPHIYPATGAPNATVA

SEQ ID NO: 844795 - protein, 23 aa, Mycobacterium
PHPKDEFWVPRRLGGGAPTQEDS

SEQ ID NO: 844796 - protein, 18 aa, Mycobacterium
PHPLMPRRNPDAPPARAR

SEQ ID NO: 844797 - protein, 19 aa, Mycobacterium
PHPPEAIGPRYVAAMGGID

SEQ ID NO: 844798 - protein, 24 aa, Mycobacterium
PHPPHWLVELLAQRLTTLARYPSI

SEQ ID NO: 844799 - protein, 25 aa, Mycobacterium
PHPPRRVWDAIINPSSWWESPEQSA

SEQ ID NO: 844800 - protein, 17 aa, Mycobacterium
PHPPVWVACTRPSSVGM

SEQ ID NO: 844801 - protein, 18 aa, Mycobacterium
PHPRGWGTFARYLGHYCR

SEQ ID NO: 844802 - protein, 20 aa, Mycobacterium
PHPRTGVLTDFLFTRHGRRL

SEQ ID NO: 844803 - protein, 18 aa, Mycobacterium
PHPRYELIPQMIVHDGDT

SEQ ID NO: 844804 - protein, 23 aa, Mycobacterium
PHPSARITRIDTDRARLLPGVRA

SEQ ID NO: 844805 - protein, 17 aa, Mycobacterium
PHPVAFRPDLRVPLLTL

SEQ ID NO: 844806 - protein, 25 aa, Mycobacterium
PHPVRDRAWHFVAATFDAATGTAVL

SEQ ID NO: 844807 - protein, 24 aa, Mycobacterium
PHPYLPDLIMCRPDLAPVLLDAVA

SEQ ID NO: 844808 - protein, 21 aa, Mycobacterium
PHQHVLVLLIHHIAADGWSLG

SEQ ID NO: 844809 - protein, 19 aa, Mycobacterium
PHQLLLDRKITKAKRLLVE

SEQ ID NO: 844810 - protein, 25 aa, Mycobacterium
PHQPSPYRLGTWSALPHLRTRDCEA

SEQ ID NO: 844811 - protein, 18 aa, Mycobacterium
PHRAPWRRPTHLSDVPWN

SEQ ID NO: 844812 - protein, 19 aa, Mycobacterium
PHRAQFGAVVSLDLRRLDR

SEQ ID NO: 844813 - protein, 19 aa, Mycobacterium
PHRDMEIVTWVLDGELAHA

SEQ ID NO: 844814 - protein, 20 aa, Mycobacterium
PHRDMEIVTWVLEGELTHRD

SEQ ID NO: 844815 - protein, 21 aa, Mycobacterium
PHRDMEIVTWVLKGELTHRDS

SEQ ID NO: 844816 - protein, 20 aa, Mycobacterium
PHRDMEIVTWVLRGELSHRD

SEQ ID NO: 844817 - protein, 25 aa, Mycobacterium
PHRGVALHPVMLDAALQGLAAALGD

SEQ ID NO: 844818 - protein, 30 aa, Mycobacterium
PHRLAVCLDLDWRPAWRVAAIPSYKAHRVV

SEQ ID NO: 844819 - protein, 26 aa, Mycobacterium
PHRLGKWLHNHPGLPRLINMYGITET

SEQ ID NO: 844820 - protein, 23 aa, Mycobacterium
PHRLSTWLHHHPGLPRMINMYGI

SEQ ID NO: 844821 - protein, 18 aa, Mycobacterium
PHRLVLCARLGPMGAARI

SEQ ID NO: 844822 - protein, 20 aa, Mycobacterium
PHRNLTAFLVEKPVGFGEVV

SEQ ID NO: 844823 - protein, 20 aa, Mycobacterium
PHRVCRYLEDLAGDYHRFYD

SEQ ID NO: 844824 - protein, 21 aa, Mycobacterium
PHRVCRYLEDLAGDYHRFYDS

SEQ ID NO: 844825 - protein, 23 aa, Mycobacterium
PHRVCRYLEDLAGDYHRFYDSCR

SEQ ID NO: 844826 - protein, 19 aa, Mycobacterium
PHRVLAWKELCNSLSGVCP

SEQ ID NO: 844827 - protein, 31 aa, Mycobacterium
PHSFGAPMDVWWFRLPRHPGDPRGLAGVLRS

SEQ ID NO: 844828 - protein, 18 aa, Mycobacterium
PHSVHTYFLRPGDSRHAV

SEQ ID NO: 844829 - protein, 30 aa, Mycobacterium
PHSVRVVRQPWWAPIVDIPAGPAVLISGDT

SEQ ID NO: 844830 - protein, 24 aa, Mycobacterium
PHTKPPDFWAWLIAAVKAIDPDVL

SEQ ID NO: 844831 - protein, 25 aa, Mycobacterium
PHTKPPNFWAWLIGQIKAVDPDVLF

SEQ ID NO: 844832 - protein, 25 aa, Mycobacterium
PHTLAALRCGALSEWRATLIARESA

SEQ ID NO: 844833 - protein, 18 aa, Mycobacterium
PHTLLEMNTGLYNSVFSA

SEQ ID NO: 844834 - protein, 18 aa, Mycobacterium
PHTPMIMIGPGTGIAPFR

SEQ ID NO: 844835 - protein, 24 aa, Mycobacterium
PHTRRFEQLIDSIDPRIRADGYWP

SEQ ID NO: 844836 - protein, 18 aa, Mycobacterium
PHTRWQPLPTWFERLTRA

SEQ ID NO: 844837 - protein, 19 aa, Mycobacterium
PHTVLISALGFAFATATER

SEQ ID NO: 844838 - protein, 24 aa, Mycobacterium
PHTWAALECGALSEWRATLIVRES

SEQ ID NO: 844839 - protein, 21 aa, Mycobacterium
PHVAALLGCAVLTGGGAVLNV

SEQ ID NO: 844840 - protein, 27 aa, Mycobacterium
PHVGLIRTALFNWAYARHCGGDFVFRI

SEQ ID NO: 844841 - protein, 23 aa, Mycobacterium
PHVGRRLVVFLGSTIGNLTPAPR

SEQ ID NO: 844842 - protein, 19 aa, Mycobacterium
PHVGTVFLIPGRGDTLRIN

SEQ ID NO: 844843 - protein, 21 aa, Mycobacterium
PHVLQLIMDSLRYWVIEMHVD

SEQ ID NO: 844844 - protein, 28 aa, Mycobacterium
PHVLREWFGQLVMHSMALTLSGNYTDFF

SEQ ID NO: 844845 - protein, 18 aa, Mycobacterium
PHVLTAHSLEPMRPWKAE

SEQ ID NO: 844846 - protein, 17 aa, Mycobacterium
PHVPAELFGLDNVVLFP

SEQ ID NO: 844847 - protein, 18 aa, Mycobacterium
PHVRLRLRLSQSGASAYL

SEQ ID NO: 844848 - protein, 25 aa, Mycobacterium
PHVRRVLLLCWRDTGHPQGGGSEAY

SEQ ID NO: 844849 - protein, 17 aa, Mycobacterium
PHVTLARRVGGPALSRA

SEQ ID NO: 844850 - protein, 19 aa, Mycobacterium
PHVTYPRALGLLGATDVAL

SEQ ID NO: 844851 - protein, 22 aa, Mycobacterium
PHVVPVVFAVDNDLIFTAVDAK

SEQ ID NO: 844852 - protein, 22 aa, Mycobacterium
PHYIHSFSPGALPTESLAAPDL

SEQ ID NO: 844853 - protein, 24 aa, Mycobacterium
PHYVDHLAAFLDAIGARRAHISGE

SEQ ID NO: 844854 - protein, 29 aa, Mycobacterium
PHYYLADEILMEKSLNWLTTRNAQRSITE

SEQ ID NO: 844855 - protein, 21 aa, Mycobacterium
PHYYLAEEIMLEKSLSWLTTR

SEQ ID NO: 844856 - protein, 28 aa, Mycobacterium
PIAARILEHFGLAEFFQVIAGASPDGVR

SEQ ID NO: 844857 - protein, 20 aa, Mycobacterium
PIAARLFGFPTVIAHGMFSA

SEQ ID NO: 844858 - protein, 20 aa, Mycobacterium
PIAARLGLAGWPRAAEESIV

SEQ ID NO: 844859 - protein, 24 aa, Mycobacterium
PIAESFGPVALPPTDPRYVDGGPG

SEQ ID NO: 844860 - protein, 24 aa, Mycobacterium
PIAGQLRFWEHNLAGMPERLVLPT

SEQ ID NO: 844861 - protein, 30 aa, Mycobacterium
PIALAAEVPPWIGPLDVLIVAGDDPGDPAL

SEQ ID NO: 844862 - protein, 21 aa, Mycobacterium
PIALGERLFSRWDAKTILASG

SEQ ID NO: 844863 - protein, 20 aa, Mycobacterium
PIALQRLGRTAKRPEWLAAG

SEQ ID NO: 844864 - protein, 27 aa, Mycobacterium
PIALRDRLIVELLYATGIRVSELCGLD

SEQ ID NO: 844865 - protein, 17 aa, Mycobacterium
PIALSVTLAAVRRAREL

SEQ ID NO: 844866 - protein, 25 aa, Mycobacterium
PIAPGAVRRAGLPRPRRGSGHFRGP

SEQ ID NO: 844867 - protein, 28 aa, Mycobacterium
PIAPPNASLLTRFMYRVTKRRYGQVPEP

SEQ ID NO: 844868 - protein, 23 aa, Mycobacterium
PIAQGGMQWVGRAELVAAVANAG

SEQ ID NO: 844869 - protein, 27 aa, Mycobacterium
PIARPIASFRRSYPVSIPALSTASLST

SEQ ID NO: 844870 - protein, 22 aa, Mycobacterium
PIASELILPIALAVQNRISVTD

SEQ ID NO: 844871 - protein, 24 aa, Mycobacterium
PIASIFAWTRGLAHRGKLDNTPAV

SEQ ID NO: 844872 - protein, 26 aa, Mycobacterium
PIASQRWMWRQIPGAQFARVPGRRGG

SEQ ID NO: 844873 - protein, 17 aa, Mycobacterium
PIATVSMPLSWDELRNA

SEQ ID NO: 844874 - protein, 24 aa, Mycobacterium
PIAVKEAVLPFHRFRRADGAAIDS

SEQ ID NO: 844875 - protein, 17 aa, Mycobacterium
PIAVPPGSEAAFAGAMS

SEQ ID NO: 844876 - protein, 19 aa, Mycobacterium
PIAWDELAPRRRPHEETLD

SEQ ID NO: 844877 - protein, 20 aa, Mycobacterium
PIAYGALPKDALGAGLGALG

SEQ ID NO: 844878 - protein, 18 aa, Mycobacterium
PICAFSHCRDVVAAVTNA

SEQ ID NO: 844879 - protein, 18 aa, Mycobacterium
PICCPGCGPTLRYRDRAG

SEQ ID NO: 844880 - protein, 19 aa, Mycobacterium
PIDAPLTQPPPAPANDTGL

SEQ ID NO: 844881 - protein, 22 aa, Mycobacterium
PIDAVFLDINMPGLSGIELAGV

SEQ ID NO: 844882 - protein, 19 aa, Mycobacterium
PIDDAPPPTPRRPLNTVLE

SEQ ID NO: 844883 - protein, 17 aa, Mycobacterium
PIDDITLDYLRLTGRPD

SEQ ID NO: 844884 - protein, 28 aa, Mycobacterium
PIDDNLFLRDLVMALRWVRDNVAAFGGD

SEQ ID NO: 844885 - protein, 26 aa, Mycobacterium
PIDEIPMLLQPGVLSLAWGSVVRQLA

SEQ ID NO: 844886 - protein, 34 aa, Mycobacterium
PIDGRCTGWLLTTAPSGLLPFTSRLSGAEWRSWR

SEQ ID NO: 844887 - protein, 20 aa, Mycobacterium
PIDKAVVVAVRPGTNFTRTD

SEQ ID NO: 844888 - protein, 17 aa, Mycobacterium
PIDLGHDPAFVPDDVSA

SEQ ID NO: 844889 - protein, 17 aa, Mycobacterium
PIDLKVGSWFVSTHPSS

SEQ ID NO: 844890 - protein, 19 aa, Mycobacterium
PIDLNDLMLGGKVIRGCIE

SEQ ID NO: 844891 - protein, 28 aa, Mycobacterium
PIDNASRRFFTMIGTLIRGRVTVGGSAA

SEQ ID NO: 844892 - protein, 28 aa, Mycobacterium
PIDNPNRRFFTMIGTLIRGRVTVGGSAA

SEQ ID NO: 844893 - protein, 17 aa, Mycobacterium
PIDPPFGLVAMAWRDDD

SEQ ID NO: 844894 - protein, 17 aa, Mycobacterium
PIDPPFGLVAMAWRDED

SEQ ID NO: 844895 - protein, 31 aa, Mycobacterium
PIDRGQLLDTLAALLIGRKPRLPAKTVCTEC

SEQ ID NO: 844896 - protein, 18 aa, Mycobacterium
PIDRLERLAALKERGMLT

SEQ ID NO: 844897 - protein, 21 aa, Mycobacterium
PIDSPLVWVLDPIDGTFNYAA

SEQ ID NO: 844898 - protein, 24 aa, Mycobacterium
PIDVDYPYLWRNLTEVVGTVLEAL

SEQ ID NO: 844899 - protein, 27 aa, Mycobacterium
PIEAGRPCRLLCLLFDDGDGCAGHSDG

SEQ ID NO: 844900 - protein, 18 aa, Mycobacterium
PIEFTLPPAKFGEKWRTV

SEQ ID NO: 844901 - protein, 29 aa, Mycobacterium
PIEGQPLDRPFAWALIKLDGADTPLIHAV

SEQ ID NO: 844902 - protein, 17 aa, Mycobacterium
PIEIVARFLGVLELYRS

SEQ ID NO: 844903 - protein, 27 aa, Mycobacterium
PIEIVGRFLALLELYRARAVTFSQPEA

SEQ ID NO: 844904 - protein, 25 aa, Mycobacterium
PIEKKPLNHFLPGSAVLSFGTAGCN

SEQ ID NO: 844905 - protein, 29 aa, Mycobacterium
PIENPGRRFFTMLGTLIRGRVTVGGSAAA

SEQ ID NO: 844906 - protein, 28 aa, Mycobacterium
PIENPNRRFFTMLGTLIRGRVTVGGSAG

SEQ ID NO: 844907 - protein, 24 aa, Mycobacterium
PIENTDVVLWYVFGIHHITRAEDW

SEQ ID NO: 844908 - protein, 25 aa, Mycobacterium
PIEPRLSLQWWVKVESLAKAAGDAV

SEQ ID NO: 844909 - protein, 24 aa, Mycobacterium
PIEPRLSLQWWVRVETLAKAAGDA

SEQ ID NO: 844910 - protein, 25 aa, Mycobacterium
PIEPSPYLPTSRRFVNPIYLRVEAI

SEQ ID NO: 844911 - protein, 39 aa, Mycobacterium
PIERTCDFLEWFLDNVPITPIWLCPLRLRDRDGWPLYPM

SEQ ID NO: 844912 - protein, 34 aa, Mycobacterium
PIERTVEFLQWFLGTIPIEPIWLCPLRLRDDNSW

SEQ ID NO: 844913 - protein, 34 aa, Mycobacterium
PIERYLDVLWRIHQGPLFIAVVELLIAARTEPDL

SEQ ID NO: 844914 - protein, 17 aa, Mycobacterium
PIEVMAPIRDESDMFLA

SEQ ID NO: 844915 - protein, 17 aa, Mycobacterium
PIEWARAGRPLPSEYIS

SEQ ID NO: 844916 - protein, 23 aa, Mycobacterium
PIEYMEGPYRYSGTLWGKPVTGF

SEQ ID NO: 844917 - protein, 17 aa, Mycobacterium
PIFADPLAARLLGVTEA

SEQ ID NO: 844918 - protein, 26 aa, Mycobacterium
PIFEQMLIDDGILLRKYWFSVSDEEQ

SEQ ID NO: 844919 - protein, 20 aa, Mycobacterium
PIFIADYVLAGYGTGAIMAV

SEQ ID NO: 844920 - protein, 19 aa, Mycobacterium
PIGAFKMRGAFNAVGTVRG

SEQ ID NO: 844921 - protein, 24 aa, Mycobacterium
PIGAPSFAEALRWGAEVYHALKSV

SEQ ID NO: 844922 - protein, 29 aa, Mycobacterium
PIGDRARQAFVDLPDYLAPSDTDPVWDSQ

SEQ ID NO: 844923 - protein, 18 aa, Mycobacterium
PIGFDQPAQRRAAILETG

SEQ ID NO: 844924 - protein, 21 aa, Mycobacterium
PIGFPPDWPFYEMQTEQTMCR

SEQ ID NO: 844925 - protein, 17 aa, Mycobacterium
PIGFQFVARHFDEPLLI

SEQ ID NO: 844926 - protein, 17 aa, Mycobacterium
PIGGLGKSDYRWLQGPN

SEQ ID NO: 844927 - protein, 26 aa, Mycobacterium
PIGGLYGDITYPVTSPLAITMGFAAS

SEQ ID NO: 844928 - protein, 26 aa, Mycobacterium
PIGGPLDWVPRRLALLAAFPRNRECT

SEQ ID NO: 844929 - protein, 20 aa, Mycobacterium
PIGIVRFYADLLRTYQFSED

SEQ ID NO: 844930 - protein, 20 aa, Mycobacterium
PIGLLIGTDRLTRTSLAPHP

SEQ ID NO: 844931 - protein, 22 aa, Mycobacterium
PIGNDWLALLLEPPENTRTPGT

SEQ ID NO: 844932 - protein, 27 aa, Mycobacterium
PIGNSQVFILDTLLRPVPPGVAGELYI

SEQ ID NO: 844933 - protein, 32 aa, Mycobacterium
PIGPPPGVTPKPLKGMPPFSGPQGPFAGITAG

SEQ ID NO: 844934 - protein, 20 aa, Mycobacterium
PIGRIDGWGHRTVGLGLRQK

SEQ ID NO: 844935 - protein, 20 aa, Mycobacterium
PIGRLSVPQNWVTASPAGDP

SEQ ID NO: 844936 - protein, 32 aa, Mycobacterium
PIGVVAAITPWNFPLQTAMTKILPALAAGATV

SEQ ID NO: 844937 - protein, 17 aa, Mycobacterium
PIHAAGQALLWEDSFDI

SEQ ID NO: 844938 - protein, 26 aa, Mycobacterium
PIHDVDYWKKGLRHSVYFTQGIRNAV

SEQ ID NO: 844939 - protein, 20 aa, Mycobacterium
PIHLLDFLRMSGDTPVMLLH

SEQ ID NO: 844940 - protein, 20 aa, Mycobacterium
PIHPLQVGVDWVTAAPHAAL

SEQ ID NO: 844941 - protein, 32 aa, Mycobacterium
PIHQGILQEAAYPFYYTRFREMSDADFQVLPQ

SEQ ID NO: 844942 - protein, 30 aa, Mycobacterium
PIHVGDVGPIVLPPIRITGPTLTGNIGGPT

SEQ ID NO: 844943 - protein, 19 aa, Mycobacterium
PIIAEWLGERGFSFDEPEV

SEQ ID NO: 844944 - protein, 17 aa, Mycobacterium
PIIFPRNSDGLYLLQRV

SEQ ID NO: 844945 - protein, 22 aa, Mycobacterium
PIILKGLFHFTSRPAALNGITA

SEQ ID NO: 844946 - protein, 22 aa, Mycobacterium
PIINGLRKILPPKVAYPIARWI

SEQ ID NO: 844947 - protein, 21 aa, Mycobacterium
PIIPHIVWGAQRIWTKGRPKN

SEQ ID NO: 844948 - protein, 24 aa, Mycobacterium
PIIQRPNWAALGDAAADGGFVFMS

SEQ ID NO: 844949 - protein, 19 aa, Mycobacterium
PIIVKILEAVPIQLVSPDG

SEQ ID NO: 844950 - protein, 22 aa, Mycobacterium
PIKGTLPLDAWPSALRASAKEV

SEQ ID NO: 844951 - protein, 23 aa, Mycobacterium
PIKGTLPLDAWPSALRASPKEVA

SEQ ID NO: 844952 - protein, 23 aa, Mycobacterium
PIKGTLPLEAWPSALRASPKEVA

SEQ ID NO: 844953 - protein, 25 aa, Mycobacterium
PIKIGYLMDFRLPEGFPTTYFEDLT

SEQ ID NO: 844954 - protein, 18 aa, Mycobacterium
PIKQLRPPQGAPNVLIVL

SEQ ID NO: 844955 - protein, 19 aa, Mycobacterium
PIKSLFVYNSNPVSQGPAQ

SEQ ID NO: 844956 - protein, 27 aa, Mycobacterium
PIKVGYLMDFTLPPGFPEDLFASFTQT

SEQ ID NO: 844957 - protein, 27 aa, Mycobacterium
PIKVGYLMDFTLPPGFPEELMASFTRC

SEQ ID NO: 844958 - protein, 26 aa, Mycobacterium
PIKVGYLMDFTLPPGFPEELRASFTR

SEQ ID NO: 844959 - protein, 23 aa, Mycobacterium
PILAGQVPAWRPGTRHGYHAITL

SEQ ID NO: 844960 - protein, 20 aa, Mycobacterium
PILCDLILIRGTGGTPAARH

SEQ ID NO: 844961 - protein, 29 aa, Mycobacterium
PILDVRLVKIEMRAFPTAKAELPDFTNPI

SEQ ID NO: 844962 - protein, 19 aa, Mycobacterium
PILEVPRTDLDRMTANHLH

SEQ ID NO: 844963 - protein, 21 aa, Mycobacterium
PILGAIYVPAKQLLYYAAKGH

SEQ ID NO: 844964 - protein, 18 aa, Mycobacterium
PILHGLCTYGMTCKALVD

SEQ ID NO: 844965 - protein, 21 aa, Mycobacterium
PILHLPSHWPWTDHWLALWRN

SEQ ID NO: 844966 - protein, 18 aa, Mycobacterium
PILIGDPARQHGPIRVEA

SEQ ID NO: 844967 - protein, 20 aa, Mycobacterium
PILLVCSAPRVRRAIIAAGV

SEQ ID NO: 844968 - protein, 23 aa, Mycobacterium
PILPYVDRVLYLVDGRFLIGTVE

SEQ ID NO: 844969 - protein, 20 aa, Mycobacterium
PILPYVDRVLYLVDGRFRIG

SEQ ID NO: 844970 - protein, 27 aa, Mycobacterium
PILQGLSIKRVLLNPGAMRTPHWHANA

SEQ ID NO: 844971 - protein, 19 aa, Mycobacterium
PILTLYGIPHRDCGSYASG

SEQ ID NO: 844972 - protein, 22 aa, Mycobacterium
PIMIRGTVFGHLYLTHVDPGRV

SEQ ID NO: 844973 - protein, 18 aa, Mycobacterium
PIMLAQCRLSGLLSRSVI

SEQ ID NO: 844974 - protein, 26 aa, Mycobacterium
PIMPPKMLHMILPRADYQIVEDSWNV

SEQ ID NO: 844975 - protein, 31 aa, Mycobacterium
PIMSNGSNQLVVWWLLDPPTGARSINLLNAP

SEQ ID NO: 844976 - protein, 33 aa, Mycobacterium
PIMVALNRNAFVRMVLTNWFGQNCLAIAGAEAE

SEQ ID NO: 844977 - protein, 28 aa, Mycobacterium
PINDLELLNCLLLLFMAGLDTVSNQLSY

SEQ ID NO: 844978 - protein, 23 aa, Mycobacterium
PINGIHWELAWLPKIPSPQQCWA

SEQ ID NO: 844979 - protein, 17 aa, Mycobacterium
PINIRWSPPEIAYALRD

SEQ ID NO: 844980 - protein, 26 aa, Mycobacterium
PINPEAWRWYRTVIGADRLPIVDTWW

SEQ ID NO: 844981 - protein, 19 aa, Mycobacterium
PINQLPPPPPPGAAPVVMM

SEQ ID NO: 844982 - protein, 20 aa, Mycobacterium
PINVMRLCLHPRGLAQRLLN

SEQ ID NO: 844983 - protein, 21 aa, Mycobacterium
PIPAIAPAQWRLTVSGCVDKP

SEQ ID NO: 844984 - protein, 33 aa, Mycobacterium
PIPDKGRILTAMSVFFFGLLTVPNHLAGPPDDP

SEQ ID NO: 844985 - protein, 19 aa, Mycobacterium
PIPDLPWVSAAAESQTMSA

SEQ ID NO: 844986 - protein, 17 aa, Mycobacterium
PIPDMQIRITRDGQLQD

SEQ ID NO: 844987 - protein, 27 aa, Mycobacterium
PIPGAAMFVLDKWLQPVPAGVVGELYL

SEQ ID NO: 844988 - protein, 25 aa, Mycobacterium
PIPGRGELLLRTLSTAICASDVHFM

SEQ ID NO: 844989 - protein, 20 aa, Mycobacterium
PIPHGLLFERFLNPERPSAP

SEQ ID NO: 844990 - protein, 19 aa, Mycobacterium
PIPIPAIVGLGPLRSIPPI

SEQ ID NO: 844991 - protein, 18 aa, Mycobacterium
PIPLLQQLHDRTGGRIRV

SEQ ID NO: 844992 - protein, 19 aa, Mycobacterium
PIPPATLPDRLRAAGFRDV

SEQ ID NO: 844993 - protein, 24 aa, Mycobacterium
PIPPNSIAALIAPAPNPPATTRDE

SEQ ID NO: 844994 - protein, 20 aa, Mycobacterium
PIPQDWRPCDIGYTMLGFHV

SEQ ID NO: 844995 - protein, 19 aa, Mycobacterium
PIPRLPQYLAESRGLGCSI

SEQ ID NO: 844996 - protein, 25 aa, Mycobacterium
PIPVCLDIDAGWRPLGGPVHLGPKR

SEQ ID NO: 844997 - protein, 22 aa, Mycobacterium
PIPVPVAYHTFGGWKASGFGDL

SEQ ID NO: 844998 - protein, 20 aa, Mycobacterium
PIPVVEVILPAVRRAVAATR

SEQ ID NO: 844999 - protein, 23 aa, Mycobacterium
PIQRIWAGWAPTFGILEHVGRKS

SEQ ID NO: 845000 - protein, 17 aa, Mycobacterium
PIRIGVNAGSLDKRFLQ

SEQ ID NO: 845001 - protein, 19 aa, Mycobacterium
PIRIGVNAGSLGKRIIQRY

SEQ ID NO: 845002 - protein, 39 aa, Mycobacterium
PIRIMMTGETYFTLRCYFDDRPIFLGRNGRISVFPSERA

SEQ ID NO: 845003 - protein, 17 aa, Mycobacterium
PIRLDDIRLHPASVGFP

SEQ ID NO: 845004 - protein, 17 aa, Mycobacterium
PIRLSPPIGLSSARYTQ

SEQ ID NO: 845005 - protein, 27 aa, Mycobacterium
PIRRLREYLITLRQLLDAGTADFHGQT

SEQ ID NO: 845006 - protein, 18 aa, Mycobacterium
PIRRQIFSGVRLAWDVED

SEQ ID NO: 845007 - protein, 17 aa, Mycobacterium
PIRTLVDSTLEKWDEIW

SEQ ID NO: 845008 - protein, 21 aa, Mycobacterium
PIRVRDGTLLLLRPVLPGDSE

SEQ ID NO: 845009 - protein, 24 aa, Mycobacterium
PISAPGMRRMLEGWLPAAAAAGIT

SEQ ID NO: 845010 - protein, 19 aa, Mycobacterium
PISFRGLERTQIRALGLLK

SEQ ID NO: 845011 - protein, 23 aa, Mycobacterium
PISGLVGLEVWARGFSPIEFEPD

SEQ ID NO: 845012 - protein, 17 aa, Mycobacterium
PISMPAYARAFEPKIRW

SEQ ID NO: 845013 - protein, 24 aa, Mycobacterium
PISMRSLGWLPQPNPRHPGRRPWS

SEQ ID NO: 845014 - protein, 20 aa, Mycobacterium
PISMTYAVVPALRYNPELAQ

SEQ ID NO: 845015 - protein, 23 aa, Mycobacterium
PISRYLGPWIAEPQLWQDPVPDV

SEQ ID NO: 845016 - protein, 17 aa, Mycobacterium
PISSAFCRPTSICWPLP

SEQ ID NO: 845017 - protein, 25 aa, Mycobacterium
PISTASVVTLLRGLASGGAAVVLVS

SEQ ID NO: 845018 - protein, 32 aa, Mycobacterium
PISVADVHFAAARWPVFVPAAVNDGFSAVHAV

SEQ ID NO: 845019 - protein, 18 aa, Mycobacterium
PISWRVIMSELEARWQAV

SEQ ID NO: 845020 - protein, 21 aa, Mycobacterium
PISYLAAPIFDGAEARYELQL

SEQ ID NO: 845021 - protein, 24 aa, Mycobacterium
PITAAILRGVLRVFEDFRYIREIH

SEQ ID NO: 845022 - protein, 19 aa, Mycobacterium
PITDGWMLPVFRAAASPNA

SEQ ID NO: 845023 - protein, 19 aa, Mycobacterium
PITDSLFVIGYQLGCQSDV

SEQ ID NO: 845024 - protein, 25 aa, Mycobacterium
PITMSDLRFFHFLGKEIFPGGQMCG

SEQ ID NO: 845025 - protein, 26 aa, Mycobacterium
PITMTKLRFMKFIMDEIFPGGDLPQA

SEQ ID NO: 845026 - protein, 19 aa, Mycobacterium
PITPFKPRKISTKGVWQTI

SEQ ID NO: 845027 - protein, 30 aa, Mycobacterium
PITRHPYASALVFWFGWPASEVPGMYLSVS

SEQ ID NO: 845028 - protein, 31 aa, Mycobacterium
PITSELPVGDYWFWNLRNIVRFDKAIAAAVQ

SEQ ID NO: 845029 - protein, 18 aa, Mycobacterium
PITSFTDQGRRPAIVVPL

SEQ ID NO: 845030 - protein, 19 aa, Mycobacterium
PITSPFGLYDCDVPCDGSI

SEQ ID NO: 845031 - protein, 19 aa, Mycobacterium
PITVVELYERLRNGPLEGL

SEQ ID NO: 845032 - protein, 17 aa, Mycobacterium
PIVAAVAGYALGGGCEL

SEQ ID NO: 845033 - protein, 28 aa, Mycobacterium
PIVARGWRSPLQLLFIDGGHTEAAAAQD

SEQ ID NO: 845034 - protein, 28 aa, Mycobacterium
PIVELLRSRIFFDWFDAAGVDDIPAVFA

SEQ ID NO: 845035 - protein, 24 aa, Mycobacterium
PIVESEFWAFPRSCNPTGGLMSTA

SEQ ID NO: 845036 - protein, 23 aa, Mycobacterium
PIVGPLAPGQVLRIGPTAGTGTP

SEQ ID NO: 845037 - protein, 19 aa, Mycobacterium
PIVHFYGRKELAHILSTAK

SEQ ID NO: 845038 - protein, 27 aa, Mycobacterium
PIVHVHLGLYGAFTEWPRAGAVLPEPV

SEQ ID NO: 845039 - protein, 31 aa, Mycobacterium
PIVLLDPVGHYEGLWTWLCGLLDSGYVSQVA

SEQ ID NO: 845040 - protein, 32 aa, Mycobacterium
PIVMLDPLGHYEGLWTWLCGLLDSGYVSQPAM

SEQ ID NO: 845041 - protein, 20 aa, Mycobacterium
PIVPHIVWGAQRIWTKGHPK

SEQ ID NO: 845042 - protein, 27 aa, Mycobacterium
PIVPMFHANAWGLPYAALMAGAGLVMP

SEQ ID NO: 845043 - protein, 26 aa, Mycobacterium
PIVPMFHVNAWGLPYAAVMSGASLVL

SEQ ID NO: 845044 - protein, 19 aa, Mycobacterium
PIVPVFTRHDFAAPVSFVD

SEQ ID NO: 845045 - protein, 19 aa, Mycobacterium
PIVQNWNTFWSAVTGVYSP

SEQ ID NO: 845046 - protein, 25 aa, Mycobacterium
PIVRLRRQLLPPSDRVRYVAQSALD

SEQ ID NO: 845047 - protein, 33 aa, Mycobacterium
PIVTHRYRNGLPSLQLLYIDDAIEGLACIIEKK

SEQ ID NO: 845048 - protein, 29 aa, Mycobacterium
PIVVFSHIPLFAMYPEWGWGTDDSAQALS

SEQ ID NO: 845049 - protein, 31 aa, Mycobacterium
PIVVKDRPGFLLNALLLPYLNDVISEYDDGL

SEQ ID NO: 845050 - protein, 17 aa, Mycobacterium
PIVVLVGEPIEPTLGVE

SEQ ID NO: 845051 - protein, 18 aa, Mycobacterium
PIVVLWASQTGTAEELAA

SEQ ID NO: 845052 - protein, 18 aa, Mycobacterium
PIWGAFARRYVDANFGST

SEQ ID NO: 845053 - protein, 17 aa, Mycobacterium
PIYAGIAMPRTSAAALI

SEQ ID NO: 845054 - protein, 19 aa, Mycobacterium
PIYDEDFVLALPPGHPLSG

SEQ ID NO: 845055 - protein, 21 aa, Mycobacterium
PIYEEDFVLALPPGHPMADRH

SEQ ID NO: 845056 - protein, 22 aa, Mycobacterium
PIYEGPAVLFIPTIDEKWSREQ

SEQ ID NO: 845057 - protein, 20 aa, Mycobacterium
PIYGLQAWNFYHTAEFTASV

SEQ ID NO: 845058 - protein, 21 aa, Mycobacterium
PKAARRLIRHLNTKELPAGFD

SEQ ID NO: 845059 - protein, 20 aa, Mycobacterium
PKAFLAALFHALSGANRYLD

SEQ ID NO: 845060 - protein, 32 aa, Mycobacterium
PKALQAITYVALRRWLLLRLARRYGKVFSVNL

SEQ ID NO: 845061 - protein, 19 aa, Mycobacterium
PKARFYFVHSYAAQRWEGS

SEQ ID NO: 845062 - protein, 23 aa, Mycobacterium
PKASWPWVKTLLHSVFDQPDAES

SEQ ID NO: 845063 - protein, 28 aa, Mycobacterium
PKATVLFVDYLTLLPPVGAPAPPLADAD

SEQ ID NO: 845064 - protein, 30 aa, Mycobacterium
PKAVLLANRTFFAVPDILRNEGLNWVTWVD

SEQ ID NO: 845065 - protein, 20 aa, Mycobacterium
PKAVVINPYFDWANDRPPDH

SEQ ID NO: 845066 - protein, 24 aa, Mycobacterium
PKDGRIPFVPMPHAALSGFYGSIY

SEQ ID NO: 845067 - protein, 27 aa, Mycobacterium
PKDKLDSYVRPLLALSSERVSKGGNPL

SEQ ID NO: 845068 - protein, 26 aa, Mycobacterium
PKDKLDTYVRPLLAISAERVSAGKDP

SEQ ID NO: 845069 - protein, 26 aa, Mycobacterium
PKDKLDTYVRPLLAISSERVQAGRNP

SEQ ID NO: 845070 - protein, 20 aa, Mycobacterium
PKDLLRNAIVSFLRYIDTNR

SEQ ID NO: 845071 - protein, 17 aa, Mycobacterium
PKDLVKALFRLIGSAKH

SEQ ID NO: 845072 - protein, 24 aa, Mycobacterium
PKDRDIAMVFQSYALYPHMTVRQN

SEQ ID NO: 845073 - protein, 23 aa, Mycobacterium
PKEILDVLFDLESLPQWSSIHRK

SEQ ID NO: 845074 - protein, 20 aa, Mycobacterium
PKELLRTAVLAFLNYIDANR

SEQ ID NO: 845075 - protein, 31 aa, Mycobacterium
PKEMWDAFSEEYLAPVWPLERVKQRVDASEE

SEQ ID NO: 845076 - protein, 25 aa, Mycobacterium
PKETLAFFAGIGIPIAEVWGMSELS

SEQ ID NO: 845077 - protein, 23 aa, Mycobacterium
PKETLDYYRDFYNAAGKDGLLLL

SEQ ID NO: 845078 - protein, 17 aa, Mycobacterium
PKEVALHHKDGWTVGAM

SEQ ID NO: 845079 - protein, 17 aa, Mycobacterium
PKEWKNPTRWLAERLNR

SEQ ID NO: 845080 - protein, 20 aa, Mycobacterium
PKEYPQYWPGYYAVFFDDPI

SEQ ID NO: 845081 - protein, 29 aa, Mycobacterium
PKFFPPAMKRWWLYRRLADVAALEHYTAM

SEQ ID NO: 845082 - protein, 19 aa, Mycobacterium
PKFGEPLHRFGAITPSVCN

SEQ ID NO: 845083 - protein, 31 aa, Mycobacterium
PKFVSTSGRYLPRSVLLPAIRIGNKLRGGPS

SEQ ID NO: 845084 - protein, 18 aa, Mycobacterium
PKGALLTAAALIASASAT

SEQ ID NO: 845085 - protein, 20 aa, Mycobacterium
PKGALLTAAALTASAAATHQ

SEQ ID NO: 845086 - protein, 24 aa, Mycobacterium
PKGALVHRLIRAGGALFTAHTNAD

SEQ ID NO: 845087 - protein, 30 aa, Mycobacterium
PKGAMYPQWLVANLWQKKWLTDDVIPSIGV

SEQ ID NO: 845088 - protein, 25 aa, Mycobacterium
PKGDFFHAPIEWQQRLWPTEEFELA

SEQ ID NO: 845089 - protein, 23 aa, Mycobacterium
PKGKALLYGPSDTWSRLGAASSP

SEQ ID NO: 845090 - protein, 23 aa, Mycobacterium
PKGKPLAVLLATGEQYYISGTVP

SEQ ID NO: 845091 - protein, 23 aa, Mycobacterium
PKGQLFAYIRDVAAAWDGSDPIR

SEQ ID NO: 845092 - protein, 19 aa, Mycobacterium
PKGRELFLELVDRSDIIVE

SEQ ID NO: 845093 - protein, 21 aa, Mycobacterium
PKGVLWRQHDIFMTSFGGRNL

SEQ ID NO: 845094 - protein, 19 aa, Mycobacterium
PKGVMWRHEDIYRSLFGGI

SEQ ID NO: 845095 - protein, 29 aa, Mycobacterium
PKGVPVPHRPIAEYFVWFGGEYDVTNEDR

SEQ ID NO: 845096 - protein, 23 aa, Mycobacterium
PKGYFPVPALTHLEGPYLNMVRD

SEQ ID NO: 845097 - protein, 19 aa, Mycobacterium
PKGYIGQPIPIDGLYLGSA

SEQ ID NO: 845098 - protein, 24 aa, Mycobacterium
PKGYVDQPIPIAGLYLAGAGCHGG

SEQ ID NO: 845099 - protein, 17 aa, Mycobacterium
PKHKGITYFLVDMKAPG

SEQ ID NO: 845100 - protein, 27 aa, Mycobacterium
PKHKSLTMFLVPLDTPGIEIQGIRTVD

SEQ ID NO: 845101 - protein, 34 aa, Mycobacterium
PKHPSLEWIPDWLWKLNLKILGPFAVWVTVGLYD

SEQ ID NO: 845102 - protein, 19 aa, Mycobacterium
PKHQGLSLLLVPMDQPAVV

SEQ ID NO: 845103 - protein, 26 aa, Mycobacterium
PKHQSLTMFLVPLDSPGVEIQPIRTV

SEQ ID NO: 845104 - protein, 19 aa, Mycobacterium
PKHWAKLCQLIGRPDLLTD

SEQ ID NO: 845105 - protein, 19 aa, Mycobacterium
PKHYWSIYQKMIVKGRDFD

SEQ ID NO: 845106 - protein, 18 aa, Mycobacterium
PKIMGPAKPLGPIEQEDY

SEQ ID NO: 845107 - protein, 18 aa, Mycobacterium
PKIPFAPVPTGRKIPPAW

SEQ ID NO: 845108 - protein, 32 aa, Mycobacterium
PKIRRWWPRRYRRSSFYWKLIGYDQRFGIADR

SEQ ID NO: 845109 - protein, 21 aa, Mycobacterium
PKISELLVIARTFLADTLGAQ

SEQ ID NO: 845110 - protein, 30 aa, Mycobacterium
PKIVEGRLTGFFKDAVLLEQPSVSDSKKSV

SEQ ID NO: 845111 - protein, 20 aa, Mycobacterium
PKIVEGRVTGFYKDVVLLDQ

SEQ ID NO: 845112 - protein, 22 aa, Mycobacterium
PKLFIFPHAGGTPQYYVPFAKT

SEQ ID NO: 845113 - protein, 19 aa, Mycobacterium
PKLGPLISSFLKPAIPRQA

SEQ ID NO: 845114 - protein, 20 aa, Mycobacterium
PKLLQPMGLVHGGVYCSMIE

SEQ ID NO: 845115 - protein, 20 aa, Mycobacterium
PKLLVSRQLRPVLQVVWPVL

SEQ ID NO: 845116 - protein, 30 aa, Mycobacterium
PKLPDGTPFPTLYYLTHPALTAAASRLESS

SEQ ID NO: 845117 - protein, 30 aa, Mycobacterium; identical to SEQ ID NO: 121635

SEQ ID NO: 845118 - protein, 21 aa, Mycobacterium
PKLPDLVVCRPELAEAVLAVT

SEQ ID NO: 845119 - protein, 25 aa, Mycobacterium
PKLRAGSFFPSLLERRRRIDRALHA

SEQ ID NO: 845120 - protein, 25 aa, Mycobacterium
PKLRAGSFFPSLLERRRRIDRSGSS

SEQ ID NO: 845121 - protein, 27 aa, Mycobacterium
PKLRVGSFFPSLLERRRRIDKALHAVI

SEQ ID NO: 845122 - protein, 18 aa, Mycobacterium
PKLSMHLLDAIAAGPVGI

SEQ ID NO: 845123 - protein, 25 aa, Mycobacterium
PKMSKFEVLTAMAFAAFADAPIDVA

SEQ ID NO: 845124 - protein, 31 aa, Mycobacterium
PKNLSSHLMYGLWWNFPVPDIERTDLLVIMG

SEQ ID NO: 845125 - protein, 30 aa, Mycobacterium
PKNLSSHLMYGLWWNFPVPDIERTDLMVIM

SEQ ID NO: 845126 - protein, 17 aa, Mycobacterium
PKNPVWYHNIKKNPRVE

SEQ ID NO: 845127 - protein, 20 aa, Mycobacterium
PKNTLDLRAPRPGDPPYVAV

SEQ ID NO: 845128 - protein, 25 aa, Mycobacterium
PKPFALEELLARMRALLRRTSPVDG

SEQ ID NO: 845129 - protein, 31 aa, Mycobacterium
PKPFALEELLARMRALLRRTTIDESADAATL

SEQ ID NO: 845130 - protein, 21 aa, Mycobacterium
PKPFALEELLARMRALLRRTV

SEQ ID NO: 845131 - protein, 19 aa, Mycobacterium
PKPISGHPPPPPRPAAFAP

SEQ ID NO: 845132 - protein, 19 aa, Mycobacterium
PKPKDYLDAAWSLAPFTGL

SEQ ID NO: 845133 - protein, 26 aa, Mycobacterium
PKPMQKPHPPVWVACTRPATVQMAAQ

SEQ ID NO: 845134 - protein, 25 aa, Mycobacterium
PKPPLEPLAVERLYLDNYFSIAKAQ

SEQ ID NO: 845135 - protein, 22 aa, Mycobacterium
PKPTRPPMPIGGPPPTPEPQQG

SEQ ID NO: 845136 - protein, 20 aa, Mycobacterium
PKPVAQMPVLLAGGGSLPDR

SEQ ID NO: 845137 - protein, 23 aa, Mycobacterium
PKPVRLTLLQDLFERLRTVPQAT

SEQ ID NO: 845138 - protein, 17 aa, Mycobacterium
PKQTTFLRAHSGFDVKH

SEQ ID NO: 845139 - protein, 23 aa, Mycobacterium
PKQWPRFVRVAPALPRTETFKVL

SEQ ID NO: 845140 - protein, 25 aa, Mycobacterium
PKRGELLPYIPEPWRSKYFLTRNVG

SEQ ID NO: 845141 - protein, 26 aa, Mycobacterium
PKRIDFACYSAIYYTLRRENLVDVTE

SEQ ID NO: 845142 - protein, 18 aa, Mycobacterium
PKRIKPLKIILDTTTLEG

SEQ ID NO: 845143 - protein, 18 aa, Mycobacterium
PKRKGISYFLLDMTSPGV

SEQ ID NO: 845144 - protein, 27 aa, Mycobacterium
PKRQAALNRLLFPSPTKEFEQHREAYG

SEQ ID NO: 845145 - protein, 20 aa, Mycobacterium
PKRSLHYAGAATTLAAAAVT

SEQ ID NO: 845146 - protein, 19 aa, Mycobacterium
PKRVFLVDSLPKNPSGKLL

SEQ ID NO: 845147 - protein, 24 aa, Mycobacterium
PKSDIPLLATLYESGRLLLDEMVT

SEQ ID NO: 845148 - protein, 26 aa, Mycobacterium
PKSGSRAPWRLKQNYFFDLRMIRYDK

SEQ ID NO: 845149 - protein, 31 aa, Mycobacterium
PKSGSRAPWRLKQNYFFDMRTIRRGKVDDEG

SEQ ID NO: 845150 - protein, 17 aa, Mycobacterium
PKSIPRPEYAWKPTVQE

SEQ ID NO: 845151 - protein, 21 aa, Mycobacterium
PKSLPPKWFYDATGSDLFDQI

SEQ ID NO: 845152 - protein, 21 aa, Mycobacterium
PKSLPPKWFYDAVGSDLFDQI

SEQ ID NO: 845153 - protein, 23 aa, Mycobacterium
PKSLPPKWFYDAVGSELFDQITR

SEQ ID NO: 845154 - protein, 25 aa, Mycobacterium
PKSLPPKWFYDSLGSHLFDQITRLP

SEQ ID NO: 845155 - protein, 24 aa, Mycobacterium
PKSMRAVAWLPQPNPRHPGRRPWS

SEQ ID NO: 845156 - protein, 18 aa, Mycobacterium
PKSVVINPYFDWGNDRPP

SEQ ID NO: 845157 - protein, 24 aa, Mycobacterium
PKSVVISPYFDWGNDRPPDRHYAD

SEQ ID NO: 845158 - protein, 27 aa, Mycobacterium
PKTERLDLRRFYRSTLPMHYIDAVDDR

SEQ ID NO: 845159 - protein, 20 aa, Mycobacterium
PKTFDYLANLEWIRAQQNLA

SEQ ID NO: 845160 - protein, 25 aa, Mycobacterium
PKTMSAYITSLRPIVDHLGKRTVQS

SEQ ID NO: 845161 - protein, 24 aa, Mycobacterium
PKTRDIVSLRLKPIEPGKFDFKPG

SEQ ID NO: 845162 - protein, 17 aa, Mycobacterium
PKTVPPLRRPEVLARIA

SEQ ID NO: 845163 - protein, 20 aa, Mycobacterium
PKVDIAAVNPWMLRMAGEVA

SEQ ID NO: 845164 - protein, 38 aa, Mycobacterium
PKVFGSWNLHRAMSGQPLDWFCLFSSGAALLGSPGQGA

SEQ ID NO: 845165 - protein, 18 aa, Mycobacterium
PKVLCVHRRFRDGDVPLA

SEQ ID NO: 845166 - protein, 24 aa, Mycobacterium
PKVLESDAWRRLSATRDDRVFAVN

SEQ ID NO: 845167 - protein, 22 aa, Mycobacterium
PKVRLVPFVHRLIAPLVEHDKV

SEQ ID NO: 845168 - protein, 17 aa, Mycobacterium
PKVRYPAGALARGLSLL

SEQ ID NO: 845169 - protein, 18 aa, Mycobacterium
PKVTRNGGGAALPYKRRL

SEQ ID NO: 845170 - protein, 26 aa, Mycobacterium
PKVTRRGGGAALPYKRRLFGQIVSAA

SEQ ID NO: 845171 - protein, 18 aa, Mycobacterium
PKYRGYMHRHQGTRWNTV

SEQ ID NO: 845172 - protein, 22 aa, Mycobacterium
PLAAALMRVGIAPTLIGTRGAN

SEQ ID NO: 845173 - protein, 18 aa, Mycobacterium
PLAAFVHALGDVGFDVAV

SEQ ID NO: 845174 - protein, 28 aa, Mycobacterium
PLAAIDAALLAAALWRGVELVITSMGGE

SEQ ID NO: 845175 - protein, 20 aa, Mycobacterium
PLAALTRLISERIAAADFAG

SEQ ID NO: 845176 - protein, 24 aa, Mycobacterium
PLAALTTLRVGPVARRVITCATSD

SEQ ID NO: 845177 - protein, 25 aa, Mycobacterium
PLADQFWGDRYGVVADPFGHHWSLG

SEQ ID NO: 845178 - protein, 26 aa, Mycobacterium
PLADVALFVLDSWLRPVPVGVAGELY

SEQ ID NO: 845179 - protein, 24 aa, Mycobacterium
PLAELLPSLRRGGVAAVSPIGVLG

SEQ ID NO: 845180 - protein, 19 aa, Mycobacterium
PLAELMPQMLRGGVAAVSS

SEQ ID NO: 845181 - protein, 17 aa, Mycobacterium
PLAERLLTISDAVEHWL

SEQ ID NO: 845182 - protein, 17 aa, Mycobacterium
PLAFLDHMGLTPTPVRR

SEQ ID NO: 845183 - protein, 20 aa, Mycobacterium
PLAFLSAVRERFDGPLVLAG

SEQ ID NO: 845184 - protein, 20 aa, Mycobacterium
PLAGAPFYVNPNSAAMRAAQ

SEQ ID NO: 845185 - protein, 25 aa, Mycobacterium
PLAGKFERLYRAAPLMRFGGGTNEV

SEQ ID NO: 845186 - protein, 29 aa, Mycobacterium
PLAGLRVGDWLVDPQWWAARREHAAATVT

SEQ ID NO: 845187 - protein, 26 aa, Mycobacterium
PLAGRRLIRFPELAAYPFVVLDRDHT

SEQ ID NO: 845188 - protein, 25 aa, Mycobacterium
PLAGTFERLYRAAPLMRFGGGTNEV

SEQ ID NO: 845189 - protein, 25 aa, Mycobacterium
PLAGVRLLAPIPRPPSIRDSLCFLD

SEQ ID NO: 845190 - protein, 26 aa, Mycobacterium
PLAHLGFFVLDEWLHPVPAGVTGELY

SEQ ID NO: 845191 - protein, 29 aa, Mycobacterium
PLAHPFQPLLHPRLREFALREGLADAAQR

SEQ ID NO: 845192 - protein, 21 aa, Mycobacterium
PLAIMRLRRIRRRTARFFGTY

SEQ ID NO: 845193 - protein, 17 aa, Mycobacterium
PLAKFYSVPPQQIVVIH

SEQ ID NO: 845194 - protein, 20 aa, Mycobacterium
PLAKVLYSETNLALTEFGLG

SEQ ID NO: 845195 - protein, 17 aa, Mycobacterium
PLAKVPFERALELAGPD

SEQ ID NO: 845196 - protein, 20 aa, Mycobacterium
PLALAAVLDGRRLYKRRADL

SEQ ID NO: 845197 - protein, 26 aa, Mycobacterium
PLALFHTKRFASLAQRLMLLAKNGGC

SEQ ID NO: 845198 - protein, 18 aa, Mycobacterium
PLALGRLMDNPTVTSIAG

SEQ ID NO: 845199 - protein, 18 aa, Mycobacterium
PLALLGPLARRAGARRIV

SEQ ID NO: 845200 - protein, 18 aa, Mycobacterium
PLALLTRAIEDLAEGTGL

SEQ ID NO: 845201 - protein, 18 aa, Mycobacterium
PLALMAPLARAAGARRVI

SEQ ID NO: 845202 - protein, 17 aa, Mycobacterium
PLALPKPEAVSDKGLRV

SEQ ID NO: 845203 - protein, 27 aa, Mycobacterium
PLALRDRLIVELLYATGIRVSELCGLD

SEQ ID NO: 845204 - protein, 26 aa, Mycobacterium
PLALSLNEFPYPPLPAVKAALSAAVD

SEQ ID NO: 845205 - protein, 26 aa, Mycobacterium
PLAMGTFYDTIVKPALEAVALPASRP

SEQ ID NO: 845206 - protein, 20 aa, Mycobacterium
PLANLTLDRFRELLFNPETL

SEQ ID NO: 845207 - protein, 32 aa, Mycobacterium
PLAPGLTTVPDALVGLCWPAVFAAIGSAVTDT

SEQ ID NO: 845208 - protein, 32 aa, Mycobacterium
PLAPSLTTVPDALVGLCWPAVFAAIGSAVTDT

SEQ ID NO: 845209 - protein, 18 aa, Mycobacterium
PLAQGWLRASHRKLDVAR

SEQ ID NO: 845210 - protein, 26 aa, Mycobacterium
PLARPTLKLLNIVPGPLAGALRTSLD

SEQ ID NO: 845211 - protein, 18 aa, Mycobacterium
PLARTHWRPLYLGGAATL

SEQ ID NO: 845212 - protein, 29 aa, Mycobacterium
PLARTRIRPHFFPFTEPSAEVDVWFANKK

SEQ ID NO: 845213 - protein, 22 aa, Mycobacterium
PLASALMRVGIAPTLIGTRGGH

SEQ ID NO: 845214 - protein, 18 aa, Mycobacterium
PLASGMFGDFAAADAFHE

SEQ ID NO: 845215 - protein, 21 aa, Mycobacterium
PLASTTYYFSSLEDLIARAVE

SEQ ID NO: 845216 - protein, 18 aa, Mycobacterium
PLASVTGVLQALFIGPML

SEQ ID NO: 845217 - protein, 18 aa, Mycobacterium
PLATLAREQLAASLGVPH

SEQ ID NO: 845218 - protein, 18 aa, Mycobacterium
PLATLIYTSGSTGTPKGA

SEQ ID NO: 845219 - protein, 20 aa, Mycobacterium
PLATLVVNSIRKTLKAVAVK

SEQ ID NO: 845220 - protein, 26 aa, Mycobacterium
PLATMAGYHLGWWDVNGSGTGGWSGR

SEQ ID NO: 845221 - protein, 23 aa, Mycobacterium
PLATTFVDYLLPTATEVPLIEYG

SEQ ID NO: 845222 - protein, 21 aa, Mycobacterium
PLATTFVDYLLPTATEVPPIE

SEQ ID NO: 845223 - protein, 23 aa, Mycobacterium
PLATTFVDYLLPTATEVPPIEFG

SEQ ID NO: 845224 - protein, 21 aa, Mycobacterium
PLATTGLYPPGSTFKIITAGA

SEQ ID NO: 845225 - protein, 18 aa, Mycobacterium
PLAVAQRVGNRPGLVMRP

SEQ ID NO: 845226 - protein, 28 aa, Mycobacterium
PLAVDPAHPFPFVSGLSLNLAITVKHPD

SEQ ID NO: 845227 - protein, 29 aa, Mycobacterium
PLAVDPAHPFPFVSGLSLNLAITVRHPDD

SEQ ID NO: 845228 - protein, 26 aa, Mycobacterium
PLAVDPAHPFPFVSGLSLNLAVTVRQ

SEQ ID NO: 845229 - protein, 29 aa, Mycobacterium
PLAVDPAHPFPYISGLSLNLAITVQVPET

SEQ ID NO: 845230 - protein, 18 aa, Mycobacterium
PLAVGLKAPLSCLNEARF

SEQ ID NO: 845231 - protein, 21 aa, Mycobacterium
PLAVRGTRLAILKGLDVPLHE

SEQ ID NO: 845232 - protein, 24 aa, Mycobacterium
PLAYLRERESWFLDIDISVSWNGC

SEQ ID NO: 845233 - protein, 17 aa, Mycobacterium
PLCGHLLARAGATVVKI

SEQ ID NO: 845234 - protein, 18 aa, Mycobacterium
PLCIDTESADFYVDTLDR

SEQ ID NO: 845235 - protein, 20 aa, Mycobacterium
PLCLGIDPHPELLRAWDLPA

SEQ ID NO: 845236 - protein, 32 aa, Mycobacterium
PLCLGIDPHPELLRAWDLPATADGLAAFCDIC

SEQ ID NO: 845237 - protein, 26 aa, Mycobacterium
PLCLGIDPHPELLRSWNLGVDVDGLS

SEQ ID NO: 845238 - protein, 24 aa, Mycobacterium
PLDAEVAARWVLDADPPVTAYIEC

SEQ ID NO: 845239 - protein, 19 aa, Mycobacterium
PLDAFEKVIKINLIGTFNV

SEQ ID NO: 845240 - protein, 23 aa, Mycobacterium
PLDALLLGEMIAEAGLPPGVVSI

SEQ ID NO: 845241 - protein, 31 aa, Mycobacterium
PLDDQFWGDRYGVVADPFGHQWSMGRPVREV

SEQ ID NO: 845242 - protein, 25 aa, Mycobacterium
PLDEVDGFVWHAYLPNITPGQRYGF

SEQ ID NO: 845243 - protein, 18 aa, Mycobacterium
PLDFFADGIARTSPARAA

SEQ ID NO: 845244 - protein, 20 aa, Mycobacterium
PLDFFAPMVEQVFAREPWSV

SEQ ID NO: 845245 - protein, 20 aa, Mycobacterium
PLDFFIDGVARTSPARAAYV

SEQ ID NO: 845246 - protein, 20 aa, Mycobacterium
PLDFREYWKRNYGPTLAAYR

SEQ ID NO: 845247 - protein, 17 aa, Mycobacterium
PLDFVFPYAVRSPDPRV

SEQ ID NO: 845248 - protein, 17 aa, Mycobacterium
PLDGMELPVVSPRNVQI

SEQ ID NO: 845249 - protein, 21 aa, Mycobacterium
PLDIEITFIDPARWGFDADGF

SEQ ID NO: 845250 - protein, 25 aa, Mycobacterium
PLDKTRPLWEMYLVEGLAGNRIAVY

SEQ ID NO: 845251 - protein, 23 aa, Mycobacterium
PLDKVLDAFYRVAAAKSISTEAA

SEQ ID NO: 845252 - protein, 21 aa, Mycobacterium
PLDLALPEFVCLRILSMYPGM

SEQ ID NO: 845253 - protein, 19 aa, Mycobacterium
PLDLAVRDWARRDSDVAAR

SEQ ID NO: 845254 - protein, 17 aa, Mycobacterium
PLDLTFATLRSVSPIHI

SEQ ID NO: 845255 - protein, 20 aa, Mycobacterium
PLDPLFDVDSVIKVLRGKHS

SEQ ID NO: 845256 - protein, 17 aa, Mycobacterium
PLDPLYQSFCQLLADQL

SEQ ID NO: 845257 - protein, 26 aa, Mycobacterium
PLDPRRFMDLLKNRPAGMYRAKGFVD

SEQ ID NO: 845258 - protein, 26 aa, Mycobacterium
PLDQARAILFLACDLSAFVTGHTIPT

SEQ ID NO: 845259 - protein, 24 aa, Mycobacterium
PLDRGAAGIALLAGMPPRPGERDL

SEQ ID NO: 845260 - protein, 26 aa, Mycobacterium
PLDRGRPLWELYLIQGLSGGRVAIMT

SEQ ID NO: 845261 - protein, 24 aa, Mycobacterium
PLDRRIEGFLRREGLVRLAEDGDA

SEQ ID NO: 845262 - protein, 19 aa, Mycobacterium
PLDRRRPLWEMWVIEGVAG

SEQ ID NO: 845263 - protein, 23 aa, Mycobacterium
PLDRSRPLWEMWVIEGVAGTDCH

SEQ ID NO: 845264 - protein, 23 aa, Mycobacterium
PLDRSRPLWEMWVIENVAGTDAH

SEQ ID NO: 845265 - protein, 25 aa, Mycobacterium
PLDRSRPLWEMYFVEGLAGGRIAVV

SEQ ID NO: 845266 - protein, 41 aa, Mycobacterium
PLDRVLELVPWLRKGQWGAPLLFYLDAGIPPLSALANCHVE

SEQ ID NO: 845267 - protein, 23 aa, Mycobacterium
PLDSGKHWLAAHRLSLFGTQEWD

SEQ ID NO: 845268 - protein, 33 aa, Mycobacterium
PLDTDPPLQHGFRQLLNPFFHPKRLAASDERVR

SEQ ID NO: 845269 - protein, 23 aa, Mycobacterium
PLDVFRRNIWVSPFWEGCVSDVV

SEQ ID NO: 845270 - protein, 19 aa, Mycobacterium
PLDVIITNANIYLPLSNLT

SEQ ID NO: 845271 - protein, 20 aa, Mycobacterium
PLDVYRMLRVTNPSPYMYLL

SEQ ID NO: 845272 - protein, 17 aa, Mycobacterium
PLDYRTLRSAEKALRDQ

SEQ ID NO: 845273 - protein, 21 aa, Mycobacterium
PLEAWTMLRDNAAAVLVDVRT

SEQ ID NO: 845274 - protein, 23 aa, Mycobacterium
PLEDQFWGDRYGVVRDPFGHQWS

SEQ ID NO: 845275 - protein, 31 aa, Mycobacterium
PLEELAGAFLLVWTTTPWTLPSNLAVAVNPE

SEQ ID NO: 845276 - protein, 26 aa, Mycobacterium
PLEEYHRLWEPKIPLGRIGRPEELTG

SEQ ID NO: 845277 - protein, 23 aa, Mycobacterium
PLEGLRILDLGIIVAGGELSRLF

SEQ ID NO: 845278 - protein, 30 aa, Mycobacterium
PLEGQPLAKPFAWALIKLDGADTSLLHAVD

SEQ ID NO: 845279 - protein, 30 aa, Mycobacterium
PLEGQPLDRPFAWALIKLDGADTALLHAVA

SEQ ID NO: 845280 - protein, 27 aa, Mycobacterium
PLEGQPLDRPFAWALIKLDGADTPMMH

SEQ ID NO: 845281 - protein, 17 aa, Mycobacterium
PLEHRGFEVIGEAGTPV

SEQ ID NO: 845282 - protein, 19 aa, Mycobacterium
PLEILALQSTYGAGGSNAL

SEQ ID NO: 845283 - protein, 18 aa, Mycobacterium
PLEILGVEAMDLESVLRS

SEQ ID NO: 845284 - protein, 18 aa, Mycobacterium
PLELLSFVAAATTTLGLS

SEQ ID NO: 845285 - protein, 20 aa, Mycobacterium
PLERLKVAIQLLFESSRPDP

SEQ ID NO: 845286 - protein, 17 aa, Mycobacterium
PLETVGEVIGWVNRHVG

SEQ ID NO: 845287 - protein, 18 aa, Mycobacterium
PLEVGTRVVFPYFFCCHT

SEQ ID NO: 845288 - protein, 19 aa, Mycobacterium
PLFSTRNLMLVRKRPFNEH

SEQ ID NO: 845289 - protein, 19 aa, Mycobacterium
PLFSTRNLMLVRKRPFNKH

SEQ ID NO: 845290 - protein, 19 aa, Mycobacterium
PLFTGTITVKYLRGTPLGP

SEQ ID NO: 845291 - protein, 20 aa, Mycobacterium
PLFTRTASGLAFTPGGLRLA

SEQ ID NO: 845292 - protein, 20 aa, Mycobacterium
PLFTRTGAGLAFTPGGLRLA

SEQ ID NO: 845293 - protein, 23 aa, Mycobacterium
PLGAEALALLRLPMVRPTVQVVG

SEQ ID NO: 845294 - protein, 23 aa, Mycobacterium
PLGAGIRWGATLPGTGAGDVVAV

SEQ ID NO: 845295 - protein, 22 aa, Mycobacterium
PLGALDLKLRHAMQFELKRIQR

SEQ ID NO: 845296 - protein, 20 aa, Mycobacterium
PLGDLRDEPNGRKSVPGWLL

SEQ ID NO: 845297 - protein, 24 aa, Mycobacterium
PLGDPIEIAALHKAFREAGDTRTQ

SEQ ID NO: 845298 - protein, 23 aa, Mycobacterium
PLGDVFVSIRPPAGASADGPLLT

SEQ ID NO: 845299 - protein, 22 aa, Mycobacterium
PLGGWEITYLGPTTYRTTVSME

SEQ ID NO: 845300 - protein, 19 aa, Mycobacterium
PLGKDMFFRYNQSLQHFIN

SEQ ID NO: 845301 - protein, 18 aa, Mycobacterium
PLGLAKRLADAGVPVVGT

SEQ ID NO: 845302 - protein, 25 aa, Mycobacterium
PLGLDIQLALYVCYELHYRGFDGVD

SEQ ID NO: 845303 - protein, 18 aa, Mycobacterium
PLGLFAESLPRHLEIIYE

SEQ ID NO: 845304 - protein, 29 aa, Mycobacterium
PLGLIQDREIALIGNLMYVRDDFAAAIDM

SEQ ID NO: 845305 - protein, 19 aa, Mycobacterium
PLGLLLTRRSENATVTLCH

SEQ ID NO: 845306 - protein, 24 aa, Mycobacterium
PLGLSIRRWCAPVLGLPAHASADE

SEQ ID NO: 845307 - protein, 17 aa, Mycobacterium
PLGMPLQYMVSGMAVAA

SEQ ID NO: 845308 - protein, 19 aa, Mycobacterium
PLGMPLQYMVSGMAVAATH

SEQ ID NO: 845309 - protein, 20 aa, Mycobacterium
PLGPGTVFVYSGRGSQWAGM

SEQ ID NO: 845310 - protein, 20 aa, Mycobacterium
PLGPLTIRTVYRARLRVPAD

SEQ ID NO: 845311 - protein, 25 aa, Mycobacterium
PLGPPAYVLPEEPLLVAPSVAELQK

SEQ ID NO: 845312 - protein, 25 aa, Mycobacterium
PLGPVAVFGASNFPLAFSVAGGDTA

SEQ ID NO: 845313 - protein, 38 aa, Mycobacterium
PLGPVGIISPFNFPAMVPMWFFPIAIAAGNTVVVKPSE

SEQ ID NO: 845314 - protein, 18 aa, Mycobacterium
PLGPVYQAGTLSGNPVAM

SEQ ID NO: 845315 - protein, 18 aa, Mycobacterium
PLGPVYQAGTLSGNPVAV

SEQ ID NO: 845316 - protein, 19 aa, Mycobacterium
PLGPWIVTDLDPADLEIRT

SEQ ID NO: 845317 - protein, 24 aa, Mycobacterium
PLGQALRIAWWSYVHRVDTDMEAA

SEQ ID NO: 845318 - protein, 19 aa, Mycobacterium
PLGRIDGWGHRTVGLGLRQ

SEQ ID NO: 845319 - protein, 28 aa, Mycobacterium
PLGSKMNRFFLRGALVARLLSEAAWKQY

SEQ ID NO: 845320 - protein, 27 aa, Mycobacterium
PLGTDIFTIRRLRFADGVPLSVDLACF

SEQ ID NO: 845321 - protein, 20 aa, Mycobacterium
PLGTRLCHFYRGIGLTIYEG

SEQ ID NO: 845322 - protein, 19 aa, Mycobacterium
PLGVLELMSALHDGDWAAA

SEQ ID NO: 845323 - protein, 23 aa, Mycobacterium
PLGVNLFVPQPSVADWMALDYYA

SEQ ID NO: 845324 - protein, 19 aa, Mycobacterium
PLGVTLTQLPATPATIVEL

SEQ ID NO: 845325 - protein, 19 aa, Mycobacterium
PLGVTMRLYAPRPEVVAGE

SEQ ID NO: 845326 - protein, 35 aa, Mycobacterium
PLGVVGVIAPWNFPMPIACWGFAPALAAGNAVLVK

SEQ ID NO: 845327 - protein, 20 aa, Mycobacterium
PLGWRGALRIGVKMAGALET

SEQ ID NO: 845328 - protein, 19 aa, Mycobacterium
PLGYLMFRAGAVMRPRVLA

SEQ ID NO: 845329 - protein, 26 aa, Mycobacterium
PLGYPSIYDGWHYGTGSPGTNLPIQL

SEQ ID NO: 845330 - protein, 23 aa, Mycobacterium
PLHEPRLWPEYHPGYFGAFVRDP

SEQ ID NO: 845331 - protein, 24 aa, Mycobacterium
PLHGSIRLGLIPTVAPYVLPTVLA

SEQ ID NO: 845332 - protein, 19 aa, Mycobacterium
PLHHAVLMMIPEAWERHEN

SEQ ID NO: 845333 - protein, 19 aa, Mycobacterium
PLHHIRRPQRDIITGLRQP

SEQ ID NO: 845334 - protein, 19 aa, Mycobacterium
PLHLSLVFGISHNTARRYT

SEQ ID NO: 845335 - protein, 17 aa, Mycobacterium
PLHMQIGALNRYLRMVA

SEQ ID NO: 845336 - protein, 18 aa, Mycobacterium
PLHPGFAASWQRLRTAPA

SEQ ID NO: 845337 - protein, 23 aa, Mycobacterium
PLHSDPWFARELAGFPKPILHGL

SEQ ID NO: 845338 - protein, 18 aa, Mycobacterium
PLIAAYDFTRFGTIADVG

SEQ ID NO: 845339 - protein, 17 aa, Mycobacterium
PLIADRVVAWLADRYAR

SEQ ID NO: 845340 - protein, 17 aa, Mycobacterium
PLIADRVVAWLTARYAA

SEQ ID NO: 845341 - protein, 19 aa, Mycobacterium
PLIDLFRPHVTGLETLPAN

SEQ ID NO: 845342 - protein, 18 aa, Mycobacterium
PLILADEPTAHLDFIQVE

SEQ ID NO: 845343 - protein, 18 aa, Mycobacterium
PLILGRLHKAQPDVHVLI

SEQ ID NO: 845344 - protein, 33 aa, Mycobacterium
PLILRIGAIILHPYIELYLGESFFSAPQLRRWD

SEQ ID NO: 845345 - protein, 17 aa, Mycobacterium
PLINRQLIQGMIADSVV

SEQ ID NO: 845346 - protein, 25 aa, Mycobacterium
PLIRDEFAFLLVSAAGPTWAQMAVS

SEQ ID NO: 845347 - protein, 19 aa, Mycobacterium
PLIRDPYARLLASHAGTGV

SEQ ID NO: 845348 - protein, 17 aa, Mycobacterium
PLIRSTVYGAAALASRA

SEQ ID NO: 845349 - protein, 25 aa, Mycobacterium
PLISWDKAFGLVKINPLAAWSDDDM

SEQ ID NO: 845350 - protein, 21 aa, Mycobacterium
PLITLPRGTGIRRQLDRACRA

SEQ ID NO: 845351 - protein, 18 aa, Mycobacterium
PLITMRRYHTVRVPLADV

SEQ ID NO: 845352 - protein, 21 aa, Mycobacterium
PLKFDIIGLLARHPEMARAFL

SEQ ID NO: 845353 - protein, 23 aa, Mycobacterium
PLKGVRTLLQAVARLRTVRDLEL

SEQ ID NO: 845354 - protein, 18 aa, Mycobacterium
PLKLTKRPADLATKQAAA

SEQ ID NO: 845355 - protein, 19 aa, Mycobacterium
PLKLVLIENPGHGGTINHL

SEQ ID NO: 845356 - protein, 29 aa, Mycobacterium
PLKPGQTIPLARTAPALDLDALIGGFHPL

SEQ ID NO: 845357 - protein, 21 aa, Mycobacterium
PLKYEIALSNTYDLWFTEWAP

SEQ ID NO: 845358 - protein, 19 aa, Mycobacterium
PLLAAELWERGRLVRSLGD

SEQ ID NO: 845359 - protein, 28 aa, Mycobacterium
PLLAALPERDRLVLKLRFFEDRTQSQIA

SEQ ID NO: 845360 - protein, 18 aa, Mycobacterium
PLLAEWDYGNYEGLTTAQ

SEQ ID NO: 845361 - protein, 20 aa, Mycobacterium
PLLCAGIIGYRSLLRADLPP

SEQ ID NO: 845362 - protein, 31 aa, Mycobacterium
PLLCAGIIGYRSLLRAELPAGGRLGLYGFGG

SEQ ID NO: 845363 - protein, 21 aa, Mycobacterium
PLLCAGIIGYRSLLRAELPPG

SEQ ID NO: 845364 - protein, 26 aa, Mycobacterium
PLLDLGWLLVCWPDGPNPIDAGSALG

SEQ ID NO: 845365 - protein, 17 aa, Mycobacterium
PLLDYYRDELKTVDAIG

SEQ ID NO: 845366 - protein, 17 aa, Mycobacterium
PLLEFYDTEVKTVDAIG

SEQ ID NO: 845367 - protein, 20 aa, Mycobacterium
PLLERAKFLAIFASNLDEFY

SEQ ID NO: 845368 - protein, 22 aa, Mycobacterium
PLLERTFAWLEEHWPAEPAARE

SEQ ID NO: 845369 - protein, 26 aa, Mycobacterium
PLLESPDILIFAWGATVPMIAHAAGV

SEQ ID NO: 845370 - protein, 27 aa, Mycobacterium
PLLGHTLPLLRNPLSFLLSLPARGDLV

SEQ ID NO: 845371 - protein, 20 aa, Mycobacterium
PLLGKTYHAIEGKGAFLGGQ

SEQ ID NO: 845372 - protein, 17 aa, Mycobacterium
PLLISLAAQLESINNWA

SEQ ID NO: 845373 - protein, 18 aa, Mycobacterium
PLLKLWVEAYGRSLIEPD

SEQ ID NO: 845374 - protein, 19 aa, Mycobacterium
PLLKRVALELGGNNASIVL

SEQ ID NO: 845375 - protein, 18 aa, Mycobacterium
PLLNISVGGGPSLPVIVD

SEQ ID NO: 845376 - protein, 22 aa, Mycobacterium
PLLPAARLSELTGCTVHLKVEG

SEQ ID NO: 845377 - protein, 21 aa, Mycobacterium
PLLPHQCARLAQRSALAVGRL

SEQ ID NO: 845378 - protein, 19 aa, Mycobacterium
PLLPVPIPIQVPQKQAPAT

SEQ ID NO: 845379 - protein, 17 aa, Mycobacterium
PLLPVPIPVPVPQTQAP

SEQ ID NO: 845380 - protein, 19 aa, Mycobacterium
PLLQEQYFAVLPADDPLAT

SEQ ID NO: 845381 - protein, 17 aa, Mycobacterium
PLLQERGSFRTEYRGHT

SEQ ID NO: 845382 - protein, 21 aa, Mycobacterium
PLLQVDMWEHAFYLQYKNVKA

SEQ ID NO: 845383 - protein, 20 aa, Mycobacterium
PLLRCRRTLEPLADALCLAP

SEQ ID NO: 845384 - protein, 34 aa, Mycobacterium
PLLRRPDLLVSLLTYWQHHPALSYLFSGRFVGTT

SEQ ID NO: 845385 - protein, 37 aa, Mycobacterium
PLLRRPDLLVSLLTYWQRHPALSYLFAGRFIGTTSQA

SEQ ID NO: 845386 - protein, 28 aa, Mycobacterium
PLLRRPDLLVSLLTYWQRHPSLSYLFAG

SEQ ID NO: 845387 - protein, 27 aa, Mycobacterium
PLLRRPDLLVSLLTYWQRHPSLSYVFA

SEQ ID NO: 845388 - protein, 19 aa, Mycobacterium
PLLRSQVNFQLLAVPFHLY

SEQ ID NO: 845389 - protein, 28 aa, Mycobacterium
PLLSAINSPFQAILGRPLIGDGADGITN

SEQ ID NO: 845390 - protein, 24 aa, Mycobacterium
PLLSKVLTRGIIKWGIRDARELES

SEQ ID NO: 845391 - protein, 17 aa, Mycobacterium
PLLTIERVRLCKRDGEL

SEQ ID NO: 845392 - protein, 19 aa, Mycobacterium
PLLVACDLQRPGAVNQLQI

SEQ ID NO: 845393 - protein, 21 aa, Mycobacterium
PLLVESGMASLFPLVVIVHAD

SEQ ID NO: 845394 - protein, 20 aa, Mycobacterium
PLLVSVFLDKDFTFVVSSEA

SEQ ID NO: 845395 - protein, 24 aa, Mycobacterium
PLLVTAAARLLAAALLECFPSNVT

SEQ ID NO: 845396 - protein, 23 aa, Mycobacterium
PLMAGVHVSPFPDPTHFGWPVEQ

SEQ ID NO: 845397 - protein, 26 aa, Mycobacterium
PLMPPQMLHMILPRKDYQIVDDSWDV

SEQ ID NO: 845398 - protein, 25 aa, Mycobacterium
PLMQEEIFGPILPIVTAETLDAAID

SEQ ID NO: 845399 - protein, 23 aa, Mycobacterium
PLMTDEIFGPILPVLTVQNLDEA

SEQ ID NO: 845400 - protein, 26 aa, Mycobacterium
PLNAAFDLFGRRWAILVVWELRSGTK

SEQ ID NO: 845401 - protein, 30 aa, Mycobacterium
PLNGLDVPGIVWFRGLLRKLADDGCAVVVA

SEQ ID NO: 845402 - protein, 25 aa, Mycobacterium
PLNGTPRALIVVPTRELCLQVTDDL

SEQ ID NO: 845403 - protein, 17 aa, Mycobacterium
PLNIALSTRFPYTGFRP

SEQ ID NO: 845404 - protein, 20 aa, Mycobacterium
PLNIPLSGFLAKLVTRAYHL

SEQ ID NO: 845405 - protein, 18 aa, Mycobacterium
PLNLLVRAAVSYARRPPR

SEQ ID NO: 845406 - protein, 23 aa, Mycobacterium
PLNSTEFWALRRTGYPRSDDADD

SEQ ID NO: 845407 - protein, 23 aa, Mycobacterium
PLNTFDVITIPAGVFRCFKNVGD

SEQ ID NO: 845408 - protein, 29 aa, Mycobacterium
PLNTFPGEPPFLRGPYPTMYVNQPWTIRQ

SEQ ID NO: 845409 - protein, 24 aa, Mycobacterium
PLNYTIHPEGFLTYRVVGESDHGY

SEQ ID NO: 845410 - protein, 19 aa, Mycobacterium
PLPADGTVFPVAFHKVLPA

SEQ ID NO: 845411 - protein, 20 aa, Mycobacterium
PLPAEIYPITEARSAFRRMQ

SEQ ID NO: 845412 - protein, 20 aa, Mycobacterium
PLPAEIYPLTEARTAFRRMQ

SEQ ID NO: 845413 - protein, 17 aa, Mycobacterium
PLPAPRFSRTRPDVPRP

SEQ ID NO: 845414 - protein, 24 aa, Mycobacterium
PLPARPQFAYPPLERGMELPPGVN

SEQ ID NO: 845415 - protein, 18 aa, Mycobacterium
PLPASFDTPGRAGLTIAI

SEQ ID NO: 845416 - protein, 22 aa, Mycobacterium
PLPAVLAWVTPYHRKWASALDR

SEQ ID NO: 845417 - protein, 17 aa, Mycobacterium
PLPAWTHQSLLLNRAGQ

SEQ ID NO: 845418 - protein, 24 aa, Mycobacterium
PLPAWTHSTLLLDRELESSAPGVP

SEQ ID NO: 845419 - protein, 19 aa, Mycobacterium
PLPDIYRPTAAMATPTPDA

SEQ ID NO: 845420 - protein, 17 aa, Mycobacterium
PLPDMCYAAAATGDPDL

SEQ ID NO: 845421 - protein, 20 aa, Mycobacterium
PLPELLPSMRRGGIAAVSPT

SEQ ID NO: 845422 - protein, 27 aa, Mycobacterium
PLPEPAELLVAVARLRLLARAAGITEV

SEQ ID NO: 845423 - protein, 29 aa, Mycobacterium
PLPEPARRLVAVARLRLLCRDSGITEVSA

SEQ ID NO: 845424 - protein, 26 aa, Mycobacterium
PLPGARDLLRRVAATGLQVVLATSAP

SEQ ID NO: 845425 - protein, 22 aa, Mycobacterium
PLPGEWPYVRGADALRDVKSGW

SEQ ID NO: 845426 - protein, 27 aa, Mycobacterium
PLPGPDYLADFFNYITPQFGVTTSQAL

SEQ ID NO: 845427 - protein, 30 aa, Mycobacterium
PLPGQPLDRPFAWALIKLDGADTPLLHAVD

SEQ ID NO: 845428 - protein, 20 aa, Mycobacterium
PLPHGLLITHVNLGLDALQL

SEQ ID NO: 845429 - protein, 26 aa, Mycobacterium
PLPIQYIDYALWQRACLGDPADPDSM

SEQ ID NO: 845430 - protein, 24 aa, Mycobacterium
PLPKKRRNMFAQLGIERVDYKDTS

SEQ ID NO: 845431 - protein, 18 aa, Mycobacterium
PLPLTPRHKRDPGLSEEE

SEQ ID NO: 845432 - protein, 21 aa, Mycobacterium
PLPNLLTRLEPLLAKRPAAVV

SEQ ID NO: 845433 - protein, 24 aa, Mycobacterium
PLPNRTYGRYTPWGRLAEWRGKYD

SEQ ID NO: 845434 - protein, 18 aa, Mycobacterium
PLPNSLHGRWTRAALAAG

SEQ ID NO: 845435 - protein, 18 aa, Mycobacterium
PLPPAAELRYTLQPDGWP

SEQ ID NO: 845436 - protein, 29 aa, Mycobacterium
PLPPKRAGLLIRAMYRIAKRRYGQVPEPF

SEQ ID NO: 845437 - protein, 29 aa, Mycobacterium
PLPPKRAGLLVGALYRIAKRRLGEVPEPF

SEQ ID NO: 845438 - protein, 17 aa, Mycobacterium
PLPRDLLRDNYILKATP

SEQ ID NO: 845439 - protein, 21 aa, Mycobacterium
PLPRPLMHTIAILDPQRDHID

SEQ ID NO: 845440 - protein, 25 aa, Mycobacterium
PLPRRVVENLYRQAPMYLTKPLLES

SEQ ID NO: 845441 - protein, 24 aa, Mycobacterium
PLPRWQIALYRRTDGRPLWTDPTL

SEQ ID NO: 845442 - protein, 20 aa, Mycobacterium
PLPSAVRIPTQYLIAMMAVG

SEQ ID NO: 845443 - protein, 18 aa, Mycobacterium
PLPTALREMIRYVRPPWL

SEQ ID NO: 845444 - protein, 20 aa, Mycobacterium
PLPTAVTPEELWLRAVAAGG

SEQ ID NO: 845445 - protein, 20 aa, Mycobacterium
PLPTVWPGSAYPLGATYDGA

SEQ ID NO: 845446 - protein, 20 aa, Mycobacterium
PLPVPWAVQTADRIPKQRYY

SEQ ID NO: 845447 - protein, 25 aa, Mycobacterium
PLPVQYIDYTLWQRAQFGDLEDPGS

SEQ ID NO: 845448 - protein, 18 aa, Mycobacterium
PLPVWNRHDPVSVQFWDD

SEQ ID NO: 845449 - protein, 27 aa, Mycobacterium
PLQAKALWAFNMAPLTLTAVPGFVPWT

SEQ ID NO: 845450 - protein, 27 aa, Mycobacterium
PLQGLSRRFWFAHLRSDPDDVAIAIDR

SEQ ID NO: 845451 - protein, 22 aa, Mycobacterium
PLQGLSRRFWFGHLSDPVEELR

SEQ ID NO: 845452 - protein, 29 aa, Mycobacterium
PLQGQPLDRPFAWALIKLDGADTLLMHAV

SEQ ID NO: 845453 - protein, 19 aa, Mycobacterium
PLQHNGFDIAISALSRVPG

SEQ ID NO: 845454 - protein, 18 aa, Mycobacterium
PLQHPDTFQRLGVDPPRG

SEQ ID NO: 845455 - protein, 18 aa, Mycobacterium
PLQLMGRRVLSVFPVPPI

SEQ ID NO: 845456 - protein, 18 aa, Mycobacterium
PLQPLLDVINAPARALLG

SEQ ID NO: 845457 - protein, 23 aa, Mycobacterium
PLQPRLPDLLRTPSGRIELAPPQ

SEQ ID NO: 845458 - protein, 20 aa, Mycobacterium
PLQPWRVRAAIRYWRDIDEE

SEQ ID NO: 845459 - protein, 18 aa, Mycobacterium
PLQQLTQPLQQLTSMLGS

SEQ ID NO: 845460 - protein, 17 aa, Mycobacterium
PLQQPHPPVWVACTRPS

SEQ ID NO: 845461 - protein, 20 aa, Mycobacterium
PLQWDCFRFGIIQRTDHFTC

SEQ ID NO: 845462 - protein, 33 aa, Mycobacterium
PLQYNQLDPYLPDFLMCRKELAPVLLGAMRRTW

SEQ ID NO: 845463 - protein, 23 aa, Mycobacterium
PLRAIPFIGRPLADLIQPDLRVL

SEQ ID NO: 845464 - protein, 18 aa, Mycobacterium
PLRDNAIQAVWPAEPLGA

SEQ ID NO: 845465 - protein, 21 aa, Mycobacterium
PLREAASTRLLILAGVLVAEG

SEQ ID NO: 845466 - protein, 20 aa, Mycobacterium
PLREDNEHFGWGSGIHTCMG

SEQ ID NO: 845467 - protein, 22 aa, Mycobacterium
PLREDNEHFGWGSGIHTCMGGP

SEQ ID NO: 845468 - protein, 20 aa, Mycobacterium
PLRELLAACRRHRALLVIDE

SEQ ID NO: 845469 - protein, 17 aa, Mycobacterium
PLREPVRSLVWVRGNVV

SEQ ID NO: 845470 - protein, 21 aa, Mycobacterium
PLRFGDYVAKLQYVPLSPSVA

SEQ ID NO: 845471 - protein, 26 aa, Mycobacterium
PLRFLGNMGLRPWPPPGRLRAVSGNY

SEQ ID NO: 845472 - protein, 18 aa, Mycobacterium
PLRFTAQAAQMLPPKGRR

SEQ ID NO: 845473 - protein, 35 aa, Mycobacterium
PLRFTAQAAQMLPPKGRRWLNKKLGLDNVFLEFDT

SEQ ID NO: 845474 - protein, 19 aa, Mycobacterium
PLRGWRDGRRLTPGPTVVG

SEQ ID NO: 845475 - protein, 30 aa, Mycobacterium
PLRIAHAWSFTFDAAWQPLAALLDGHSVHI

SEQ ID NO: 845476 - protein, 19 aa, Mycobacterium
PLRIALAAPTGKAAARLQE

SEQ ID NO: 845477 - protein, 17 aa, Mycobacterium
PLRIGILGAARIAPMAL

SEQ ID NO: 845478 - protein, 19 aa, Mycobacterium
PLRLDNLTQPALTPLRTEL

SEQ ID NO: 845479 - protein, 21 aa, Mycobacterium
PLRLFWARDYSDYHPEAPGGS

SEQ ID NO: 845480 - protein, 18 aa, Mycobacterium
PLRLRDIAAHPASVGFPA

SEQ ID NO: 845481 - protein, 19 aa, Mycobacterium
PLRMHYLDEGPIEGPPIVL

SEQ ID NO: 845482 - protein, 17 aa, Mycobacterium
PLRMLRAARFVSQLGFA

SEQ ID NO: 845483 - protein, 20 aa, Mycobacterium
PLRMLRAARFVSQLGFSVAP

SEQ ID NO: 845484 - protein, 34 aa, Mycobacterium
PLRNALFDLPPYRGTWPQIWIAAHGPRMLRVVGR

SEQ ID NO: 845485 - protein, 34 aa, Mycobacterium
PLRPGWRNRIGLHQLFPLLAHVVLFGGGHAQRTH

SEQ ID NO: 845486 - protein, 19 aa, Mycobacterium
PLRPLPFHAVFDTDLYAEI

SEQ ID NO: 845487 - protein, 17 aa, Mycobacterium
PLRPPSLLAVEPPDHTR

SEQ ID NO: 845488 - protein, 17 aa, Mycobacterium
PLRPSFVSGLRNEIQVV

SEQ ID NO: 845489 - protein, 19 aa, Mycobacterium
PLRRDCFRVLLELPGGVAG

SEQ ID NO: 845490 - protein, 18 aa, Mycobacterium
PLRREVEWFLAHRRCSNA

SEQ ID NO: 845491 - protein, 18 aa, Mycobacterium
PLRRHRNLHRWVMAEVPS

SEQ ID NO: 845492 - protein, 17 aa, Mycobacterium
PLRRLVEGSGMASVILY

SEQ ID NO: 845493 - protein, 17 aa, Mycobacterium
PLRRNRIVGADLLEPLS

SEQ ID NO: 845494 - protein, 19 aa, Mycobacterium
PLRRRPLAEFVNLDRWDGA

SEQ ID NO: 845495 - protein, 18 aa, Mycobacterium
PLRTMMPISTRGVDGDAS

SEQ ID NO: 845496 - protein, 19 aa, Mycobacterium
PLRTWGQAEVDGQHVFWTV

SEQ ID NO: 845497 - protein, 19 aa, Mycobacterium
PLRVAHAWSFTFDAAWQPL

SEQ ID NO: 845498 - protein, 20 aa, Mycobacterium
PLRVQLIAKTDFIAPPDIDW

SEQ ID NO: 845499 - protein, 19 aa, Mycobacterium
PLRVVVLPMETGEPKQHRT

SEQ ID NO: 845500 - protein, 26 aa, Mycobacterium
PLSASQLRSWFAYRVDGPSWVNNIPF

SEQ ID NO: 845501 - protein, 28 aa, Mycobacterium
PLSCPADYQLLLALRAYADVVLVGAGTA

SEQ ID NO: 845502 - protein, 30 aa, Mycobacterium
PLSDAEVGALWPMVVLRTVVLIVSDAQQAV

SEQ ID NO: 845503 - protein, 22 aa, Mycobacterium
PLSDLIALVQKGLAALAGAFPN

SEQ ID NO: 845504 - protein, 25 aa, Mycobacterium
PLSEYVLGLARHIIRPELRGGAGFD

SEQ ID NO: 845505 - protein, 20 aa, Mycobacterium
PLSFPIPGWNVCVDFPITAG

SEQ ID NO: 845506 - protein, 17 aa, Mycobacterium
PLSGGMVGFFAYDMVRR

SEQ ID NO: 845507 - protein, 26 aa, Mycobacterium
PLSGGRVWTWKWPETLSARGWQWCRV

SEQ ID NO: 845508 - protein, 33 aa, Mycobacterium
PLSGHLGEIRLSEFMLPPIHLNPVDGNSLTGTI

SEQ ID NO: 845509 - protein, 24 aa, Mycobacterium
PLSGTLPEPEIWSRLVRALDVVDD

SEQ ID NO: 845510 - protein, 19 aa, Mycobacterium
PLSGTWIEIRFTLTDVVRS

SEQ ID NO: 845511 - protein, 17 aa, Mycobacterium
PLSLKPFDYLPRPLRRS

SEQ ID NO: 845512 - protein, 20 aa, Mycobacterium
PLSLPLLMSGLDGRFSHKTV

SEQ ID NO: 845513 - protein, 25 aa, Mycobacterium
PLSMKPTGWFQVAWSDEIAIGDVHT

SEQ ID NO: 845514 - protein, 27 aa, Mycobacterium
PLSPEHVVTLVRYLAAPAAEAVNGQLF

SEQ ID NO: 845515 - protein, 29 aa, Mycobacterium
PLSPRRAGLLTRAMYRIAKRRYGQVPEPF

SEQ ID NO: 845516 - protein, 21 aa, Mycobacterium
PLSPVMRRRSATRRLEILEVS

SEQ ID NO: 845517 - protein, 17 aa, Mycobacterium
PLSRLTPFKQQLIDPLA

SEQ ID NO: 845518 - protein, 28 aa, Mycobacterium
PLSRNALATAWWMYWRMTKEAEAAQRRS

SEQ ID NO: 845519 - protein, 23 aa, Mycobacterium
PLSTTGLFAGRAIDICSPGDPVC

SEQ ID NO: 845520 - protein, 18 aa, Mycobacterium
PLSVFEFVEALDDAGLPP

SEQ ID NO: 845521 - protein, 17 aa, Mycobacterium
PLTAHFLGGAAIADSPE

SEQ ID NO: 845522 - protein, 21 aa, Mycobacterium
PLTALAIAAILTDAGVPAGVV

SEQ ID NO: 845523 - protein, 20 aa, Mycobacterium
PLTALPMRRAVIMLLCGKAD

SEQ ID NO: 845524 - protein, 20 aa, Mycobacterium
PLTARKLTVPLVAGGKPVEG

SEQ ID NO: 845525 - protein, 24 aa, Mycobacterium
PLTDHLSALGIPTWYARFAAQAMA

SEQ ID NO: 845526 - protein, 19 aa, Mycobacterium
PLTEVYFADTFDELGPLGA

SEQ ID NO: 845527 - protein, 20 aa, Mycobacterium
PLTGIPRALVVVPTRELCIQ

SEQ ID NO: 845528 - protein, 25 aa, Mycobacterium
PLTHAQLRIWLLDRRNAGGPELCAQ

SEQ ID NO: 845529 - protein, 21 aa, Mycobacterium
PLTHFTQIFVLPTFVRGGTNV

SEQ ID NO: 845530 - protein, 17 aa, Mycobacterium
PLTIDHVKPRLLGHWGT

SEQ ID NO: 845531 - protein, 17 aa, Mycobacterium
PLTILLPGARDRSPRIR

SEQ ID NO: 845532 - protein, 18 aa, Mycobacterium
PLTLNVVLHRQNIDRIGA

SEQ ID NO: 845533 - protein, 27 aa, Mycobacterium
PLTLPSGTATLWAWLGTNATPAMDALR

SEQ ID NO: 845534 - protein, 32 aa, Mycobacterium
PLTLSAPKPMLPIAGFPFLTHVLSRVAAAGID

SEQ ID NO: 845535 - protein, 22 aa, Mycobacterium
PLTMEMAKFIRFIVTDIFPGGR

SEQ ID NO: 845536 - protein, 18 aa, Mycobacterium
PLTMYRTERFHVSVLFWL

SEQ ID NO: 845537 - protein, 26 aa, Mycobacterium
PLTPIQEGLLFHTTFARAAGALEGDE

SEQ ID NO: 845538 - protein, 28 aa, Mycobacterium
PLTPQQRAWLNLVQPLTIVEGFALLSVP

SEQ ID NO: 845539 - protein, 28 aa, Mycobacterium
PLTSAFGPRTGLWLLLLAKGGGDTGVSA

SEQ ID NO: 845540 - protein, 24 aa, Mycobacterium
PLTSLDIGLPLDQVRPLIGNAFVD

SEQ ID NO: 845541 - protein, 19 aa, Mycobacterium
PLTTILDPSLPLTVTEWDE

SEQ ID NO: 845542 - protein, 21 aa, Mycobacterium
PLTTILDPSLPLTVTEWDEWG

SEQ ID NO: 845543 - protein, 20 aa, Mycobacterium
PLTTLTLARLASEAGLPDGV

SEQ ID NO: 845544 - protein, 23 aa, Mycobacterium
PLTTNLMAQKFLEAGLPEGVLSV

SEQ ID NO: 845545 - protein, 17 aa, Mycobacterium
PLTVETWRDPATRSWWV

SEQ ID NO: 845546 - protein, 34 aa, Mycobacterium
PLTYGGTPAPLWLAAFERSPLPALDLAQCRRLIV

SEQ ID NO: 845547 - protein, 20 aa, Mycobacterium
PLVAPQQWAALLDANGFAGS

SEQ ID NO: 845548 - protein, 25 aa, Mycobacterium
PLVATVYERLWRPAAFYVASGVTTG

SEQ ID NO: 845549 - protein, 17 aa, Mycobacterium
PLVDEDIVISAPAVYEE

SEQ ID NO: 845550 - protein, 17 aa, Mycobacterium
PLVEAGMVYVTLPPLFV

SEQ ID NO: 845551 - protein, 18 aa, Mycobacterium
PLVEGTRFYMHTASVSIC

SEQ ID NO: 845552 - protein, 24 aa, Mycobacterium
PLVEQEILWRLLTGPHGDTVRQIA

SEQ ID NO: 845553 - protein, 17 aa, Mycobacterium
PLVERFKTIQPWLTDGI

SEQ ID NO: 845554 - protein, 24 aa, Mycobacterium
PLVFDAPRRAMPPRHLADMSLEQS

SEQ ID NO: 845555 - protein, 23 aa, Mycobacterium
PLVGRLLNKLGVSASSLWIRHEK

SEQ ID NO: 845556 - protein, 19 aa, Mycobacterium
PLVGTYRTKDDRYVQLMML

SEQ ID NO: 845557 - protein, 27 aa, Mycobacterium
PLVHCADFARDSRWSRFAAAALTADIH

SEQ ID NO: 845558 - protein, 17 aa, Mycobacterium
PLVHSTPMPYDNYFGGV

SEQ ID NO: 845559 - protein, 17 aa, Mycobacterium
PLVHTAHTLAAVKNAAL

SEQ ID NO: 845560 - protein, 18 aa, Mycobacterium
PLVIIHNSGHKAFFNSHA

SEQ ID NO: 845561 - protein, 33 aa, Mycobacterium
PLVILLHGFPESWYSWRHQIPALAAAGYRVVAV

SEQ ID NO: 845562 - protein, 17 aa, Mycobacterium
PLVKLLRERAEPAVAPW

SEQ ID NO: 845563 - protein, 20 aa, Mycobacterium
PLVLGALTPRIVSLDVQYFG

SEQ ID NO: 845564 - protein, 17 aa, Mycobacterium
PLVLISAGIGITPMIGI

SEQ ID NO: 845565 - protein, 19 aa, Mycobacterium
PLVLRLRSNPQYSAPVVGP

SEQ ID NO: 845566 - protein, 18 aa, Mycobacterium
PLVLRMMVPPLPPPPPSA

SEQ ID NO: 845567 - protein, 17 aa, Mycobacterium
PLVLTEAVTQFLGAVAE

SEQ ID NO: 845568 - protein, 17 aa, Mycobacterium
PLVMVAVSGGRLLAPCW

SEQ ID NO: 845569 - protein, 25 aa, Mycobacterium
PLVNSCVVAYLSALTLLECVMTTMR

SEQ ID NO: 845570 - protein, 17 aa, Mycobacterium
PLVPCWHGDIPVATQDS

SEQ ID NO: 845571 - protein, 19 aa, Mycobacterium
PLVPIDSPPYHAAAFGISD

SEQ ID NO: 845572 - protein, 20 aa, Mycobacterium
PLVPTLNWVPSPEIQARLDA

SEQ ID NO: 845573 - protein, 27 aa, Mycobacterium
PLVQPIRDIPYLGPPLADLIQPDLRVL

SEQ ID NO: 845574 - protein, 24 aa, Mycobacterium
PLVRAVGLDPFIRIIDGEIDFEDD

SEQ ID NO: 845575 - protein, 17 aa, Mycobacterium
PLVRQIFVYGNSERSFL

SEQ ID NO: 845576 - protein, 20 aa, Mycobacterium
PLVRQIYIYGNSARAYLLAV

SEQ ID NO: 845577 - protein, 19 aa, Mycobacterium
PLVRQIYVYGNSAHPYLLA

SEQ ID NO: 845578 - protein, 19 aa, Mycobacterium
PLVRQIYVYGNSSQPYLLA

SEQ ID NO: 845579 - protein, 24 aa, Mycobacterium
PLVRTAIDPAILPIAREWTRGAVK

SEQ ID NO: 845580 - protein, 24 aa, Mycobacterium
PLVRTAVDPRLRAIAAEWTRGAVK

SEQ ID NO: 845581 - protein, 31 aa, Mycobacterium
PLVSAYHKLLVWDLMRRPRVTRMAESVLNPL

SEQ ID NO: 845582 - protein, 20 aa, Mycobacterium
PLVSSFSMPGGIYAPMIHPW

SEQ ID NO: 845583 - protein, 17 aa, Mycobacterium
PLVVFTAAGSLVAMGTL

SEQ ID NO: 845584 - protein, 18 aa, Mycobacterium
PLVVMRRYHDSDRLAYQI

SEQ ID NO: 845585 - protein, 18 aa, Mycobacterium
PLVYYTDPMKLLTHLNDV

SEQ ID NO: 845586 - protein, 19 aa, Mycobacterium
PLWELHVIEGLEGKQFAIY

SEQ ID NO: 845587 - protein, 17 aa, Mycobacterium
PLWELWVIEGVEGGRIA

SEQ ID NO: 845588 - protein, 25 aa, Mycobacterium
PLWIVRRTMVDMIRPIEFQDMLRCR

SEQ ID NO: 845589 - protein, 17 aa, Mycobacterium
PLWPGLAEPVQLAQGPQ

SEQ ID NO: 845590 - protein, 42 aa, Mycobacterium
PLYATRRFEWNKPWAQRICGHLPLPRLVWPADVVGTVTPEAA

SEQ ID NO: 845591 - protein, 26 aa, Mycobacterium
PLYEERYVLLAPPEMLPPGVSTLSWL

SEQ ID NO: 845592 - protein, 17 aa, Mycobacterium
PLYIELPVTVEIVVTHT

SEQ ID NO: 845593 - protein, 20 aa, Mycobacterium
PLYLEEALRLGVRQASIISI

SEQ ID NO: 845594 - protein, 19 aa, Mycobacterium
PLYLELPVSVELEVTHTEP

SEQ ID NO: 845595 - protein, 21 aa, Mycobacterium
PLYLMEYAHPVKSPYFGVPHE

SEQ ID NO: 845596 - protein, 19 aa, Mycobacterium
PLYLRHLVDAALGTGSLRQ

SEQ ID NO: 845597 - protein, 19 aa, Mycobacterium
PLYMHDGVMWTVKHEVPNW

SEQ ID NO: 845598 - protein, 19 aa, Mycobacterium
PLYPTLHEYLRTSGVPVLA

SEQ ID NO: 845599 - protein, 28 aa, Mycobacterium
PLYQRWAKLWEGLLLACQPGVGAGELLN

SEQ ID NO: 845600 - protein, 19 aa, Mycobacterium
PLYVQRGLIPPTPTVRTQA

SEQ ID NO: 845601 - protein, 23 aa, Mycobacterium
PMAAILLGLLADGEPVAGLTWLP

SEQ ID NO: 845602 - protein, 23 aa, Mycobacterium
PMAAILLGLLHEGEPVAGLTWLP

SEQ ID NO: 845603 - protein, 19 aa, Mycobacterium
PMAAPPEVAAPAAAAPASA

SEQ ID NO: 845604 - protein, 30 aa, Mycobacterium
PMAEAYGLGVLLYAPLAGGLLTGKYRRGET

SEQ ID NO: 845605 - protein, 18 aa, Mycobacterium
PMAFVRALLRTDVTDLTV

SEQ ID NO: 845606 - protein, 37 aa, Mycobacterium
PMAGILLGLLHRGDPVAGLTWLPFVDQRYTAVTGGPL

SEQ ID NO: 845607 - protein, 34 aa, Mycobacterium
PMALLQPRRLIADEGLFGALRFAKNVLTQPAARK

SEQ ID NO: 845608 - protein, 20 aa, Mycobacterium
PMALLQPRRLVADEGLLGAL

SEQ ID NO: 845609 - protein, 35 aa, Mycobacterium
PMARFVDTFRRVLGDPALPHLFFVDGGALAVENAL

SEQ ID NO: 845610 - protein, 24 aa, Mycobacterium
PMARFVQTFVRVLGDPALPHLFFV

SEQ ID NO: 845611 - protein, 18 aa, Mycobacterium
PMATITLSSAPALRLSGD

SEQ ID NO: 845612 - protein, 19 aa, Mycobacterium
PMATPPWDTKAPKDSVVAW

SEQ ID NO: 845613 - protein, 20 aa, Mycobacterium
PMCDVFLVLAQAPGGLSCFF

SEQ ID NO: 845614 - protein, 29 aa, Mycobacterium
PMDCAEVLDWPAKLRLLEGFRQRENLNWS

SEQ ID NO: 845615 - protein, 17 aa, Mycobacterium
PMDIPGVTVRPLTQMDG

SEQ ID NO: 845616 - protein, 18 aa, Mycobacterium
PMDSVWRGALPADNGFEY

SEQ ID NO: 845617 - protein, 19 aa, Mycobacterium
PMDVPVFASGFYDKFGFDR

SEQ ID NO: 845618 - protein, 24 aa, Mycobacterium
PMEHPLPEVFTQVGAPRAGLTCDT

SEQ ID NO: 845619 - protein, 18 aa, Mycobacterium
PMEISYPVLWRNLTELVG

SEQ ID NO: 845620 - protein, 27 aa, Mycobacterium
PMEIVGRFLALLELYRSRAVAFDQSEP

SEQ ID NO: 845621 - protein, 25 aa, Mycobacterium
PMEIYLRLMFLKFRYRLGYESLCRE

SEQ ID NO: 845622 - protein, 26 aa, Mycobacterium
PMEPSPYLPTSRRFFNPIYLRVEAIP

SEQ ID NO: 845623 - protein, 26 aa, Mycobacterium
PMEPSPYLPTSRRYFNPLYLRVEAIP

SEQ ID NO: 845624 - protein, 24 aa, Mycobacterium
PMERGPFYSIDISADSSLFYPIPG

SEQ ID NO: 845625 - protein, 25 aa, Mycobacterium
PMERPGLPAVLVGPGPFVGRGRELE

SEQ ID NO: 845626 - protein, 25 aa, Mycobacterium
PMEVPQLGYMALFADPAGAMVGLWQ

SEQ ID NO: 845627 - protein, 27 aa, Mycobacterium
PMEVVSTGLRYLIVPVGPGALERARIS

SEQ ID NO: 845628 - protein, 26 aa, Mycobacterium
PMFHANAWGLIYSALMCGADLVLPDR

SEQ ID NO: 845629 - protein, 20 aa, Mycobacterium
PMFRQRVVPSPPPAPPRWEH

SEQ ID NO: 845630 - protein, 17 aa, Mycobacterium
PMFVREALIGSGSAQIE

SEQ ID NO: 845631 - protein, 26 aa, Mycobacterium
PMGAREFHKFLLDKQREIAAVVAGAR

SEQ ID NO: 845632 - protein, 24 aa, Mycobacterium
PMGAREFQRFLLAKQREITAVVDE

SEQ ID NO: 845633 - protein, 18 aa, Mycobacterium
PMGFGYPIDHPDLQSITE

SEQ ID NO: 845634 - protein, 20 aa, Mycobacterium
PMGMLGSPVDIGHLAAFLAT

SEQ ID NO: 845635 - protein, 19 aa, Mycobacterium
PMGPDLVAPAVGWLAHETC

SEQ ID NO: 845636 - protein, 24 aa, Mycobacterium
PMGPELVAPVVGWLAHESCSVSGE

SEQ ID NO: 845637 - protein, 25 aa, Mycobacterium
PMGPELVAPVVGWLAHESCSVTGEI

SEQ ID NO: 845638 - protein, 25 aa, Mycobacterium
PMGTHLYVCGPAGFIEFVSATAAAL

SEQ ID NO: 845639 - protein, 22 aa, Mycobacterium
PMHAGLVWASLFSHPGLTWADI

SEQ ID NO: 845640 - protein, 19 aa, Mycobacterium
PMHDTPLGPLLPGVTLRQI

SEQ ID NO: 845641 - protein, 22 aa, Mycobacterium
PMHLVSPWLDLTARPVQEVAAA

SEQ ID NO: 845642 - protein, 22 aa, Mycobacterium
PMHRYYSTIKDLTRLLGGPSHR

SEQ ID NO: 845643 - protein, 17 aa, Mycobacterium
PMIGPDAITPRAAVRSP

SEQ ID NO: 845644 - protein, 17 aa, Mycobacterium
PMILKRFVKGITEEAVF

SEQ ID NO: 845645 - protein, 18 aa, Mycobacterium
PMIMIGPGTGIAPFRAFL

SEQ ID NO: 845646 - protein, 20 aa, Mycobacterium
PMIPLDDALRPKWLFGQSVH

SEQ ID NO: 845647 - protein, 32 aa, Mycobacterium
PMIREWLTVLLRRDLGLLLLINVPGGEPTRAA

SEQ ID NO: 845648 - protein, 29 aa, Mycobacterium
PMIREWLTVLLRRDLGLLVTITVPGREAT

SEQ ID NO: 845649 - protein, 19 aa, Mycobacterium
PMIVGALPFDVSEPAALMV

SEQ ID NO: 845650 - protein, 19 aa, Mycobacterium
PMIVPSRRLNPTPAISAEH

SEQ ID NO: 845651 - protein, 37 aa, Mycobacterium
PMKMNETMLISAPIFHAWGLGCLQISTPLRATVILQE

SEQ ID NO: 845652 - protein, 18 aa, Mycobacterium
PMLAQRLGAWVPLDEVPD

SEQ ID NO: 845653 - protein, 18 aa, Mycobacterium
PMLEAMISVDLWLNETTR

SEQ ID NO: 845654 - protein, 18 aa, Mycobacterium
PMLEAYTALGALASATST

SEQ ID NO: 845655 - protein, 24 aa, Mycobacterium
PMLEVRPWRILNGIPGRATCSYGA

SEQ ID NO: 845656 - protein, 18 aa, Mycobacterium
PMLFEWTDRDTLLYALGV

SEQ ID NO: 845657 - protein, 19 aa, Mycobacterium
PMLGTWQSIVLVDLNRDNP

SEQ ID NO: 845658 - protein, 17 aa, Mycobacterium
PMLKRLEALGLITRTRS

SEQ ID NO: 845659 - protein, 28 aa, Mycobacterium
PMLPPEINSLLMFNGAGSAPMLQAATAW

SEQ ID NO: 845660 - protein, 41 aa, Mycobacterium
PMLTDVKLLARLFGLPYFPVTPLFPLAGPAGLVPLPSKWRI

SEQ ID NO: 845661 - protein, 20 aa, Mycobacterium
PMNSPAWYDNNPDLAVECAV

SEQ ID NO: 845662 - protein, 18 aa, Mycobacterium
PMNVMGFAVKTADDYQLA

SEQ ID NO: 845663 - protein, 17 aa, Mycobacterium
PMPAPMTPAGGGLSSTG

SEQ ID NO: 845664 - protein, 18 aa, Mycobacterium
PMPFERARTRLLLGQLQR

SEQ ID NO: 845665 - protein, 26 aa, Mycobacterium
PMPGVEWRHIIDVALVVREVLEDYGL

SEQ ID NO: 845666 - protein, 20 aa, Mycobacterium
PMPGVEWRRILDVAQVVREV

SEQ ID NO: 845667 - protein, 20 aa, Mycobacterium
PMPKNLPPWIRAKLGASFTS

SEQ ID NO: 845668 - protein, 17 aa, Mycobacterium
PMPLMHTLELNAATVDT

SEQ ID NO: 845669 - protein, 28 aa, Mycobacterium
PMPQGRGFFFEKVFPAFWGLKATKNYRG

SEQ ID NO: 845670 - protein, 24 aa, Mycobacterium
PMPTLVEWQVLPGAWVQVFLDPDR

SEQ ID NO: 845671 - protein, 19 aa, Mycobacterium
PMPVIAASLFARFASRQED

SEQ ID NO: 845672 - protein, 19 aa, Mycobacterium
PMPVRSALLPYLPVEHDDP

SEQ ID NO: 845673 - protein, 21 aa, Mycobacterium
PMQMICILLGVPESERHWLFH

SEQ ID NO: 845674 - protein, 35 aa, Mycobacterium
PMQMVGPRPLIWHVMRYYAHFGHKEFILCLGYGAD

SEQ ID NO: 845675 - protein, 25 aa, Mycobacterium
PMQYAILHHNFFVERLIPAGTTHRP

SEQ ID NO: 845676 - protein, 19 aa, Mycobacterium
PMRCVFALTAMGFIPASPA

SEQ ID NO: 845677 - protein, 27 aa, Mycobacterium
PMREDMCILLAARRVPAALKWIEDRRE

SEQ ID NO: 845678 - protein, 21 aa, Mycobacterium
PMREDMCIMLAARKTAGALKW

SEQ ID NO: 845679 - protein, 21 aa, Mycobacterium
PMREDMCIMLAARKVPAALKW

SEQ ID NO: 845680 - protein, 20 aa, Mycobacterium
PMREDMCIMLAARKVPGALK

SEQ ID NO: 845681 - protein, 19 aa, Mycobacterium
PMRFGEELAMLIPQSRFVA

SEQ ID NO: 845682 - protein, 17 aa, Mycobacterium
PMRLGRVLVDPDGYLFL

SEQ ID NO: 845683 - protein, 17 aa, Mycobacterium
PMRLMTHLGEKHGVEAV

SEQ ID NO: 845684 - protein, 19 aa, Mycobacterium
PMRPDLLELFDIAELEKYY

SEQ ID NO: 845685 - protein, 17 aa, Mycobacterium
PMRRLIATLPALEVPRP

SEQ ID NO: 845686 - protein, 19 aa, Mycobacterium
PMRVIGMLLGIPESEQIGV

SEQ ID NO: 845687 - protein, 19 aa, Mycobacterium
PMRVIGMLLGLPEDRQRQI

SEQ ID NO: 845688 - protein, 23 aa, Mycobacterium
PMRWTCVEPLKKWRLDVEPNNSG

SEQ ID NO: 845689 - protein, 17 aa, Mycobacterium
PMRYRLLETIRQYAQEK

SEQ ID NO: 845690 - protein, 25 aa, Mycobacterium
PMSAALCKRLLWDSAIHHYTPRQVA

SEQ ID NO: 845691 - protein, 26 aa, Mycobacterium
PMSDGSRRKWLNRMFQLLGESDCTEQ

SEQ ID NO: 845692 - protein, 24 aa, Mycobacterium
PMSRRLIEFPAAVGSLRATQGIAL

SEQ ID NO: 845693 - protein, 25 aa, Mycobacterium
PMSRTDVEDIFWLQATIARELAATT

SEQ ID NO: 845694 - protein, 28 aa, Mycobacterium
PMSTYLYTISMMHCMTVSLALDGVGLGT

SEQ ID NO: 845695 - protein, 21 aa, Mycobacterium
PMSVPPGWDPLPSAAGAKVAT

SEQ ID NO: 845696 - protein, 18 aa, Mycobacterium
PMTLRWLTDRFEGRPLTE

SEQ ID NO: 845697 - protein, 18 aa, Mycobacterium
PMTPFERKIVHDAVAAVD

SEQ ID NO: 845698 - protein, 19 aa, Mycobacterium
PMTTPPWDTKAPKENVIAW

SEQ ID NO: 845699 - protein, 20 aa, Mycobacterium
PMVAEPLRLLDCARPVNGAV

SEQ ID NO: 845700 - protein, 21 aa, Mycobacterium
PMVEFLCLAPLVTAQHRVAAR

SEQ ID NO: 845701 - protein, 18 aa, Mycobacterium
PMVHPYVASKWGVRGLAK

SEQ ID NO: 845702 - protein, 17 aa, Mycobacterium
PMVIERLAAPGSLPGID

SEQ ID NO: 845703 - protein, 25 aa, Mycobacterium
PMVPGETLLQSARRAGLEPPFSCEA

SEQ ID NO: 845704 - protein, 22 aa, Mycobacterium
PMVRHPIPPMIHGATQSATWMS

SEQ ID NO: 845705 - protein, 23 aa, Mycobacterium
PMVSHLRSAKLWGRETRLYYIHR

SEQ ID NO: 845706 - protein, 17 aa, Mycobacterium
PMWLELSIDDGQAYLEH

SEQ ID NO: 845707 - protein, 20 aa, Mycobacterium
PMYLFRGDVPIRELAKGFPK

SEQ ID NO: 845708 - protein, 19 aa, Mycobacterium
PMYREDFVLALPSGHPLAG

SEQ ID NO: 845709 - protein, 18 aa, Mycobacterium
PMYSPFKLLDPVANVAEM

SEQ ID NO: 845710 - protein, 21 aa, Mycobacterium
PNAAIFLVNPPISDPSHGSGI

SEQ ID NO: 845711 - protein, 35 aa, Mycobacterium
PNADQPPLRGFPNAPMRAVHLWAAPERVTEAASPS

SEQ ID NO: 845712 - protein, 25 aa, Mycobacterium
PNAECWIHLQLPPSIDAERLAFIET

SEQ ID NO: 845713 - protein, 26 aa, Mycobacterium
PNAELTEFIRWRDLTCRFPGCDAPAM

SEQ ID NO: 845714 - protein, 22 aa, Mycobacterium
PNAFDMVAVERAILLAAFAGVA

SEQ ID NO: 845715 - protein, 23 aa, Mycobacterium
PNAGLRTYLAVRGGISVTPVLGS

SEQ ID NO: 845716 - protein, 24 aa, Mycobacterium
PNAHILPVPMMNILNGGAHADTAV

SEQ ID NO: 845717 - protein, 24 aa, Mycobacterium
PNAHILPVPMMNILNGGAHADTGV

SEQ ID NO: 845718 - protein, 25 aa, Mycobacterium
PNAHYKLRIFTPGGELAFAGHPTLG

SEQ ID NO: 845719 - protein, 25 aa, Mycobacterium
PNALDWLIEQMGLASGATLLDSGAG

SEQ ID NO: 845720 - protein, 20 aa, Mycobacterium
PNAMLVVRLDFHLDRLVMAV

SEQ ID NO: 845721 - protein, 19 aa, Mycobacterium
PNAMVLWEAQFGDFVNGAQ

SEQ ID NO: 845722 - protein, 24 aa, Mycobacterium
PNARRDAMFPPKAFDALVEIVEAA

SEQ ID NO: 845723 - protein, 25 aa, Mycobacterium
PNARTRFVLVGLPGTPPPATGADRT

SEQ ID NO: 845724 - protein, 26 aa, Mycobacterium
PNATSQLYYVLYGRGFAAVNGRLIEW

SEQ ID NO: 845725 - protein, 22 aa, Mycobacterium
PNAVDAWARLAAEPRFPLDAVD

SEQ ID NO: 845726 - protein, 20 aa, Mycobacterium
PNAYRFGTVGWPFPATEAKI

SEQ ID NO: 845727 - protein, 20 aa, Mycobacterium
PNCGFGRRLANLGGTVLVGT

SEQ ID NO: 845728 - protein, 17 aa, Mycobacterium
PNDAGAFIVIAWGVTDF

SEQ ID NO: 845729 - protein, 22 aa, Mycobacterium
PNDIDPEWAFQDLGFDSVKATE

SEQ ID NO: 845730 - protein, 35 aa, Mycobacterium
PNDPAVLLIMGLGAQLLLWRKGFCEKLINQGLRVI

SEQ ID NO: 845731 - protein, 24 aa, Mycobacterium
PNDWVKTLRYQGDVPSLPGSRESS

SEQ ID NO: 845732 - protein, 17 aa, Mycobacterium
PNEAIARAALTRAIHKL

SEQ ID NO: 845733 - protein, 25 aa, Mycobacterium
PNEIAHILVLRSRFPGGFTSEVRGI

SEQ ID NO: 845734 - protein, 24 aa, Mycobacterium
PNEPGAIFDDRLAYEAWQRQYDSA

SEQ ID NO: 845735 - protein, 31 aa, Mycobacterium; identical to SEQ ID NO: 130207

SEQ ID NO: 845736 - protein, 19 aa, Mycobacterium
PNFRRNGVLMAKHGIYDPR

SEQ ID NO: 845737 - protein, 28 aa, Mycobacterium
PNFTGRSWPLADVRLLAPILASKVIAVG

SEQ ID NO: 845738 - protein, 28 aa, Mycobacterium
PNFTGRSWPLADVRLLAPILASKVVCVG

SEQ ID NO: 845739 - protein, 18 aa, Mycobacterium
PNFTPFLANSIEAAEAMV

SEQ ID NO: 845740 - protein, 18 aa, Mycobacterium
PNGAWYTSGVRLGTPALT

SEQ ID NO: 845741 - protein, 32 aa, Mycobacterium
PNGCMATSGSLIRWFQTLIGGAELTELDDEAA

SEQ ID NO: 845742 - protein, 29 aa, Mycobacterium
PNGCMATSGSLIRWFQTLSGGHDLVALDD

SEQ ID NO: 845743 - protein, 24 aa, Mycobacterium
PNGEWIPAVLRAAHARLLQKRKGG

SEQ ID NO: 845744 - protein, 30 aa, Mycobacterium
PNGGIFTRFPGMHIPFVDLTFTSPTPPDTP

SEQ ID NO: 845745 - protein, 26 aa, Mycobacterium
PNGGLLSRFPGLSLPALGLDFYGGTP

SEQ ID NO: 845746 - protein, 23 aa, Mycobacterium
PNGLPIHGLLAAYPGWRVTAESA

SEQ ID NO: 845747 - protein, 22 aa, Mycobacterium
PNGLPIHGVLAAYPGWRVTDES

SEQ ID NO: 845748 - protein, 17 aa, Mycobacterium
PNGLQLRQQRVPLGVVG

SEQ ID NO: 845749 - protein, 24 aa, Mycobacterium
PNGPAQQALLAQALDSAKLTPADI

SEQ ID NO: 845750 - protein, 25 aa, Mycobacterium
PNGRPAVVTPLLLASAYHARRDIPD

SEQ ID NO: 845751 - protein, 20 aa, Mycobacterium
PNGSHLVDYPPMLLARDGRD

SEQ ID NO: 845752 - protein, 24 aa, Mycobacterium
PNGSPYVTPLVRKLATEHDIDLAQ

SEQ ID NO: 845753 - protein, 22 aa, Mycobacterium
PNGTYYVLEKFAYIVMDSSTYG

SEQ ID NO: 845754 - protein, 18 aa, Mycobacterium
PNGVHFHPPRSLWCDGRA

SEQ ID NO: 845755 - protein, 21 aa, Mycobacterium
PNGYLLTVNYAVRITNRGLFV

SEQ ID NO: 845756 - protein, 28 aa, Mycobacterium
PNHDPAAVGDWMLLAAIEALIDGHEYLT

SEQ ID NO: 845757 - protein, 19 aa, Mycobacterium
PNHFSHMRAFPSADFRAVV

SEQ ID NO: 845758 - protein, 19 aa, Mycobacterium
PNHKLQRLTDVALALHELA

SEQ ID NO: 845759 - protein, 25 aa, Mycobacterium
PNHPYRLDGVALRPPTAAPKLGAHT

SEQ ID NO: 845760 - protein, 31 aa, Mycobacterium
PNHYQKLTALENLRFFASLYAGPTRDPMELL

SEQ ID NO: 845761 - protein, 28 aa, Mycobacterium
PNHYQKLTGLENLQFFASLYSAPTLDPM

SEQ ID NO: 845762 - protein, 27 aa, Mycobacterium
PNHYQKLTGLENLRFFASLYAQPTLDP

SEQ ID NO: 845763 - protein, 28 aa, Mycobacterium
PNHYQKLTGLENLRFFASLYSGATADPM

SEQ ID NO: 845764 - protein, 19 aa, Mycobacterium
PNIARLLPAARAAGVRVVH

SEQ ID NO: 845765 - protein, 23 aa, Mycobacterium
PNIDHIEILTRGAVRRAKLYYLR

SEQ ID NO: 845766 - protein, 25 aa, Mycobacterium
PNIDPIAVQLIKWLPTRSADFVNRW

SEQ ID NO: 845767 - protein, 25 aa, Mycobacterium
PNIENLLRRESFDSAWRLGAEAQTG

SEQ ID NO: 845768 - protein, 20 aa, Mycobacterium
PNIIDLMHFSETARAHRRIE

SEQ ID NO: 845769 - protein, 19 aa, Mycobacterium
PNIKRDAMFPPKAFDALGE

SEQ ID NO: 845770 - protein, 33 aa, Mycobacterium
PNILYDIPPRSVVPIEWDTIRRLAQHPNIVAIK

SEQ ID NO: 845771 - protein, 20 aa, Mycobacterium
PNIRIRQGTRWRTGVATLRP

SEQ ID NO: 845772 - protein, 25 aa, Mycobacterium
PNIYNKHMIFPKPGVDLSDPASFAS

SEQ ID NO: 845773 - protein, 25 aa, Mycobacterium
PNKAIARFIVRFNDAFRKYGTSDNV

SEQ ID NO: 845774 - protein, 26 aa, Mycobacterium
PNKESLLVELLVGISSRLLAGARDVT

SEQ ID NO: 845775 - protein, 26 aa, Mycobacterium
PNKESLLVELLVGISTRLLAGARQVR

SEQ ID NO: 845776 - protein, 20 aa, Mycobacterium
PNKLLLDPYSKAIEGTFAWN

SEQ ID NO: 845777 - protein, 20 aa, Mycobacterium
PNKLVLDPYAKAIDGQFDWG

SEQ ID NO: 845778 - protein, 23 aa, Mycobacterium
PNKNIRLVIEWLDRYSDSLSLAS

SEQ ID NO: 845779 - protein, 25 aa, Mycobacterium
PNKRSVFLDVIPWALTRKTEHEATH

SEQ ID NO: 845780 - protein, 27 aa, Mycobacterium
PNKVARFPKFDWPRIDAPSVRSGANIE

SEQ ID NO: 845781 - protein, 29 aa, Mycobacterium
PNKVARFPKFDWPRIDAPYLRPGADIEAL

SEQ ID NO: 845782 - protein, 25 aa, Mycobacterium
PNLARLYEPMWLRETNRHRGAAVAL

SEQ ID NO: 845783 - protein, 23 aa, Mycobacterium
PNLDKRILRLPKAHIKAVGTHPV

SEQ ID NO: 845784 - protein, 23 aa, Mycobacterium
PNLDKRIVRLPKAHIKAVGTHPV

SEQ ID NO: 845785 - protein, 21 aa, Mycobacterium
PNLELLYAAAMFHDVGLTDHY

SEQ ID NO: 845786 - protein, 25 aa, Mycobacterium
PNLHPLGDPPYYAFRIVLGDLGTSG

SEQ ID NO: 845787 - protein, 34 aa, Mycobacterium
PNLLFVNAGMVQFVPFFLGQRTPPYATATSIQKC

SEQ ID NO: 845788 - protein, 32 aa, Mycobacterium
PNLLFVNAGMVQFVPYFLGARTPEYPTATSIQ

SEQ ID NO: 845789 - protein, 34 aa, Mycobacterium; identical to SEQ ID NO: 116610

SEQ ID NO: 845790 - protein, 34 aa, Mycobacterium
PNLLFVNAGMVQFVPYFLGQRTPPWNRATSIQKC

SEQ ID NO: 845791 - protein, 23 aa, Mycobacterium
PNLQAVASGYLMHRHERLEQVRA

SEQ ID NO: 845792 - protein, 27 aa, Mycobacterium
PNLQNPILSLMFFLTSSRIFGRGKGVR

SEQ ID NO: 845793 - protein, 21 aa, Mycobacterium
PNLRAGFFQGDLKRPVQVIPE

SEQ ID NO: 845794 - protein, 24 aa, Mycobacterium
PNLSLPPITVPALTIPAATTPANV

SEQ ID NO: 845795 - protein, 17 aa, Mycobacterium
PNLSLVHNWPRIQDGDD

SEQ ID NO: 845796 - protein, 29 aa, Mycobacterium
PNLTALPTCPPLVIWDLTTPQPPQSDLLH

SEQ ID NO: 845797 - protein, 18 aa, Mycobacterium
PNLTVVPAARSTLDKLMV

SEQ ID NO: 845798 - protein, 26 aa, Mycobacterium
PNMRTVVHCLPPRDWTEPGFMGLGMI

SEQ ID NO: 845799 - protein, 18 aa, Mycobacterium
PNMRWRTFCAELVAIADK

SEQ ID NO: 845800 - protein, 19 aa, Mycobacterium
PNMTVLTGATVTRLVVGRN

SEQ ID NO: 845801 - protein, 31 aa, Mycobacterium
PNNSLSLVENFLWMTFGLPAEPYHADPEVVR

SEQ ID NO: 845802 - protein, 24 aa, Mycobacterium
PNPANRFHSWIYRARPDVQCIVHT

SEQ ID NO: 845803 - protein, 25 aa, Mycobacterium
PNPAPSTLLLALMSGFERRGRWNVP

SEQ ID NO: 845804 - protein, 25 aa, Mycobacterium
PNPARLAALAAPPERRQWWIDRVKA

SEQ ID NO: 845805 - protein, 22 aa, Mycobacterium
PNPDLLIPVPPESIPKTDIGKI

SEQ ID NO: 845806 - protein, 22 aa, Mycobacterium
PNPESVLWRYDKCELETYTALS

SEQ ID NO: 845807 - protein, 30 aa, Mycobacterium
PNPNLYPLGKPPYYAFQIILGDLGTSGGLR

SEQ ID NO: 845808 - protein, 27 aa, Mycobacterium
PNPQFGFPNNYFLNPALENAYAAFWRD

SEQ ID NO: 845809 - protein, 25 aa, Mycobacterium
PNPRLISTELLLRDEFRPATTLNVL

SEQ ID NO: 845810 - protein, 23 aa, Mycobacterium
PNPTDMPVVPFAGSPQLPGNTLA

SEQ ID NO: 845811 - protein, 37 aa, Mycobacterium
PNPVEYYLASLLSCQIVTWRFWAAKLGISVDDISATA

SEQ ID NO: 845812 - protein, 48 aa, Mycobacterium
PNQLGPFLHWLLWAHRDLKVYLLKSNLRLLPALDGFWFGVTPVALLNQ

SEQ ID NO: 845813 - protein, 26 aa, Mycobacterium
PNQPPLPALAGTPFPLADFIFDTTRS

SEQ ID NO: 845814 - protein, 27 aa, Mycobacterium
PNRAWRLYRRLGFTDVIRGYHFAGDPR

SEQ ID NO: 845815 - protein, 21 aa, Mycobacterium
PNRAWRLYRRLGFTDVIRRYH

SEQ ID NO: 845816 - protein, 17 aa, Mycobacterium
PNRIWAAVFLSGATIDG

SEQ ID NO: 845817 - protein, 25 aa, Mycobacterium
PNRLEILLVLHRAPGIFVGDLAEVL

SEQ ID NO: 845818 - protein, 23 aa, Mycobacterium
PNRPTGSFLFLGPTGVGKTELAK

SEQ ID NO: 845819 - protein, 36 aa, Mycobacterium
PNRTANIALLHFLDGEKRYIIAPQGLSQGDVVETGP

SEQ ID NO: 845820 - protein, 29 aa, Mycobacterium
PNRTARIALLHFLDGEKRYIIAPVGLSQG

SEQ ID NO: 845821 - protein, 26 aa, Mycobacterium
PNRVGINFLPMRLTLDLAGSPATASY

SEQ ID NO: 845822 - protein, 24 aa, Mycobacterium
PNSAALIPLLRRDGMTDGEVDRVF

SEQ ID NO: 845823 - protein, 31 aa, Mycobacterium
PNSAKELIRAFWPGALSLVVHQAPSLQWDLG

SEQ ID NO: 845824 - protein, 31 aa, Mycobacterium
PNSGMRWWAQWTPFTYPFNMTQQPALSIPVG

SEQ ID NO: 845825 - protein, 23 aa, Mycobacterium
PNSGTDMLLGIGGTPEGIIAAAA

SEQ ID NO: 845826 - protein, 18 aa, Mycobacterium
PNSKTVFMVLRDPAADMS

SEQ ID NO: 845827 - protein, 39 aa, Mycobacterium
PNSNGLWYEGSYTEAAWIDDWTMLAQRYANTPTVIGADL

SEQ ID NO: 845828 - protein, 30 aa, Mycobacterium
PNSTLSSYLNKMLWILTGNFAKRGGQHLHS

SEQ ID NO: 845829 - protein, 39 aa, Mycobacterium
PNSTSWLQVIWDLLTGSGPAWWQTLWNVWGPNANVWNTI

SEQ ID NO: 845830 - protein, 17 aa, Mycobacterium
PNSVAFCCLFYGAAKLG

SEQ ID NO: 845831 - protein, 38 aa, Mycobacterium
PNTAALCMPFQFPDGTPSAFLSWRVWVPRGPEHFELFH

SEQ ID NO: 845832 - protein, 36 aa, Mycobacterium
PNTATHRFLAHLPGYQGWQWAVVVAAYAGADHATVS

SEQ ID NO: 845833 - protein, 21 aa, Mycobacterium
PNTCRPAVAAGPTGPTHTGCA

SEQ ID NO: 845834 - protein, 20 aa, Mycobacterium
PNTKYPPIKQLRPPQGAPNV

SEQ ID NO: 845835 - protein, 24 aa, Mycobacterium
PNTVRYRLKRITDFTGRDPTSPRD

SEQ ID NO: 845836 - protein, 28 aa, Mycobacterium
PNVAPLFHTRYEPIWRLCSELDLTIVQH

SEQ ID NO: 845837 - protein, 25 aa, Mycobacterium
PNVARWIRRFAGHAVSPEKAAEKIL

SEQ ID NO: 845838 - protein, 28 aa, Mycobacterium
PNVDDLNVIALRYLPDDRLSPLPDDAFA

SEQ ID NO: 845839 - protein, 25 aa, Mycobacterium
PNVGLMQPWRFIRITDTGLRRRIHT

SEQ ID NO: 845840 - protein, 24 aa, Mycobacterium
PNVLYLVWDDIGIATWDCFGGLVD

SEQ ID NO: 845841 - protein, 21 aa, Mycobacterium
PNVLYLVWDDTGIATWDCFGG

SEQ ID NO: 845842 - protein, 30 aa, Mycobacterium
PNVTLAFLKEGHMVYAFPGAIDTNLVPPQR

SEQ ID NO: 845843 - protein, 17 aa, Mycobacterium
PNVWPRNIARDDTGVAR

SEQ ID NO: 845844 - protein, 20 aa, Mycobacterium
PNWLSVLPQDFSNMAAVQQG

SEQ ID NO: 845845 - protein, 20 aa, Mycobacterium
PNYLPSIAPMPLSPTKMLEP

SEQ ID NO: 845846 - protein, 25 aa, Mycobacterium
PNYSLRMSWDFLSRSTAGLLDWDDR

SEQ ID NO: 845847 - protein, 20 aa, Mycobacterium
PNYVALSEIRIRLVTRGHGM

SEQ ID NO: 845848 - protein, 24 aa, Mycobacterium
PPAALRRRIMLERAAWRLRQGAGV

SEQ ID NO: 845849 - protein, 19 aa, Mycobacterium
PPAAPRRKPIQMPGLQDVA

SEQ ID NO: 845850 - protein, 28 aa, Mycobacterium
PPADGTPPVLLFVGRLEYEKGIHDAIAA

SEQ ID NO: 845851 - protein, 33 aa, Mycobacterium
PPADLVREFALPVPSMVIALLLGVPPEDLELFQ

SEQ ID NO: 845852 - protein, 25 aa, Mycobacterium
PPADTRPVEFWPTAAIRAALESDDL

SEQ ID NO: 845853 - protein, 17 aa, Mycobacterium
PPAEPFPLPIHTGDVRV

SEQ ID NO: 845854 - protein, 18 aa, Mycobacterium
PPAFAAAIGIRPGQRKHF

SEQ ID NO: 845855 - protein, 18 aa, Mycobacterium
PPAGFYGTVASVSGNTIT

SEQ ID NO: 845856 - protein, 24 aa, Mycobacterium
PPAGRDLLLRLINESPDGAVAPSL

SEQ ID NO: 845857 - protein, 18 aa, Mycobacterium
PPAGTLVGIAKRELKGTP

SEQ ID NO: 845858 - protein, 18 aa, Mycobacterium
PPAGTPPVAPTAPSAGVF

SEQ ID NO: 845859 - protein, 19 aa, Mycobacterium
PPAGWPAALGDFTMVWTAE

SEQ ID NO: 845860 - protein, 20 aa, Mycobacterium
PPAIALAVRDALDGTLVEMG

SEQ ID NO: 845861 - protein, 19 aa, Mycobacterium
PPAIALSVRDALDGVLVEM

SEQ ID NO: 845862 - protein, 19 aa, Mycobacterium
PPALRRALDLLADPPADPD

SEQ ID NO: 845863 - protein, 19 aa, Mycobacterium
PPALRRALDLLIDPPADPD

SEQ ID NO: 845864 - protein, 28 aa, Mycobacterium
PPALSVPFSAFPRPENYPSLPTVSFVIP

SEQ ID NO: 845865 - protein, 17 aa, Mycobacterium
PPAMPSLVLHPQPGGGL

SEQ ID NO: 845866 - protein, 23 aa, Mycobacterium
PPANDPGVLAAPPEGIPPGDIAP

SEQ ID NO: 845867 - protein, 20 aa, Mycobacterium
PPAPAPFDALAAPAPAPLPP

SEQ ID NO: 845868 - protein, 40 aa, Mycobacterium
PPAPEPAYVPPPPPAFVPPPPPPPLNYPQPRLRDRIIERI

SEQ ID NO: 845869 - protein, 23 aa, Mycobacterium
PPAPKAPPRPRGPRRPARRLLVA

SEQ ID NO: 845870 - protein, 19 aa, Mycobacterium
PPAPLDAAILFAPVGDLVL

SEQ ID NO: 845871 - protein, 22 aa, Mycobacterium
PPAPPAPAPAPAAPAPASTAPA

SEQ ID NO: 845872 - protein, 29 aa, Mycobacterium
PPAPPRVIPKGLQGIAFFAARRRATEQLA

SEQ ID NO: 845873 - protein, 28 aa, Mycobacterium
PPAQPQGLIPGFLMPPGDGSTGLASGMT

SEQ ID NO: 845874 - protein, 27 aa, Mycobacterium
PPAQPQGLIPSFLMPPSDGSGGTPVTG

SEQ ID NO: 845875 - protein, 22 aa, Mycobacterium
PPARDRLPFSGLRVLDMTTFWA

SEQ ID NO: 845876 - protein, 17 aa, Mycobacterium
PPARRRLMALGRAFSVA

SEQ ID NO: 845877 - protein, 24 aa, Mycobacterium
PPASHHLRWLAVSNCLLDIPEDVT

SEQ ID NO: 845878 - protein, 25 aa, Mycobacterium
PPASVPIWYDYTPGGNIRIMTGASS

SEQ ID NO: 845879 - protein, 24 aa, Mycobacterium
PPASVPIWYDYTPGGNIRINTGAG

SEQ ID NO: 845880 - protein, 24 aa, Mycobacterium
PPASVPIWYDYTPGGNVRIMTGAS

SEQ ID NO: 845881 - protein, 24 aa, Mycobacterium
PPAVLWRMREHLDFRMVRIGSAGA

SEQ ID NO: 845882 - protein, 28 aa, Mycobacterium
PPAWATAAPAYRPVALALPASAAGLATN

SEQ ID NO: 845883 - protein, 20 aa, Mycobacterium
PPAWELLPHELALASVLLGE

SEQ ID NO: 845884 - protein, 18 aa, Mycobacterium
PPAWIGVGTLDLFHDEDL

SEQ ID NO: 845885 - protein, 21 aa, Mycobacterium
PPCLGYVFYAPPRAVPRAHRF

SEQ ID NO: 845886 - protein, 27 aa, Mycobacterium
PPDAELTERPDLFPAWDSLSEAQQKLF

SEQ ID NO: 845887 - protein, 18 aa, Mycobacterium
PPDCAHDARWIYYSSGTT

SEQ ID NO: 845888 - protein, 21 aa, Mycobacterium
PPDCHNFRRLFYQAIERGGEG

SEQ ID NO: 845889 - protein, 24 aa, Mycobacterium
PPDCTPWVIGGLWPTELSRDAPET

SEQ ID NO: 845890 - protein, 18 aa, Mycobacterium
PPDELVGVNYYRPTGRGG

SEQ ID NO: 845891 - protein, 17 aa, Mycobacterium
PPDFVWVEADLPKLLAE

SEQ ID NO: 845892 - protein, 25 aa, Mycobacterium
PPDGAPPFPGALWLQVRDLAATQEQ

SEQ ID NO: 845893 - protein, 17 aa, Mycobacterium
PPDHTRLRRLVSKAFAP

SEQ ID NO: 845894 - protein, 17 aa, Mycobacterium
PPDLRMLRLIDADAHRD

SEQ ID NO: 845895 - protein, 26 aa, Mycobacterium
PPDMAIVPMRLIPNAELHIFPNSGHW

SEQ ID NO: 845896 - protein, 23 aa, Mycobacterium
PPDPGQICYLGFTSGTTGEPKGA

SEQ ID NO: 845897 - protein, 27 aa, Mycobacterium
PPDQELAFLHPLPVRRLWGVGAVTADK

SEQ ID NO: 845898 - protein, 17 aa, Mycobacterium
PPDRFPGAITAPVAPRA

SEQ ID NO: 845899 - protein, 25 aa, Mycobacterium
PPDRWWRREYLLTSELYIASVMAVI

SEQ ID NO: 845900 - protein, 17 aa, Mycobacterium
PPDSEQHRRVLAVLAYL

SEQ ID NO: 845901 - protein, 41 aa, Mycobacterium
PPDSTLLGEGTRWAYYPWRRAVVAVLGPRGFRALRLDRNRN

SEQ ID NO: 845902 - protein, 25 aa, Mycobacterium
PPDTELTERPSLFPAWDSLSDSQKK

SEQ ID NO: 845903 - protein, 21 aa, Mycobacterium
PPDTELVGMLNLLIGGGFDTT

SEQ ID NO: 845904 - protein, 17 aa, Mycobacterium
PPDTRWHPVSDLPPMAF

SEQ ID NO: 845905 - protein, 19 aa, Mycobacterium
PPDVAAAAELLLLTVPDSE

SEQ ID NO: 845906 - protein, 27 aa, Mycobacterium
PPDVKDAMIDWWGPGLVEYYGATEQHG

SEQ ID NO: 845907 - protein, 24 aa, Mycobacterium
PPEAAAWLSSALEAAYRPAPAALR

SEQ ID NO: 845908 - protein, 21 aa, Mycobacterium
PPEAHAEVFPFVFTAARLTEH

SEQ ID NO: 845909 - protein, 33 aa, Mycobacterium
PPEAPWVRPPLRSMKWMETFLDTLISYGFDDRA

SEQ ID NO: 845910 - protein, 27 aa, Mycobacterium
PPEAVYPLIQALIDLPPGGAHGRMFVM

SEQ ID NO: 845911 - protein, 19 aa, Mycobacterium
PPECSWVLFLWSLGRLWVT

SEQ ID NO: 845912 - protein, 29 aa, Mycobacterium
PPEDELAFLHPLPVRRLWGVGAKTAAKLQ

SEQ ID NO: 845913 - protein, 27 aa, Mycobacterium
PPEDRRKLLWDNVWKPLASRSTKRGER

SEQ ID NO: 845914 - protein, 29 aa, Mycobacterium
PPEEELAFLHPLPVRRLWGVGAKTADKLH

SEQ ID NO: 845915 - protein, 20 aa, Mycobacterium
PPEFAWDYRVFGSGGTAPAA

SEQ ID NO: 845916 - protein, 17 aa, Mycobacterium
PPEIMAVLCANLDSLEP

SEQ ID NO: 845917 - protein, 27 aa, Mycobacterium
PPEINSSRMFAGAGAAPMLDAAAAWAG

SEQ ID NO: 845918 - protein, 37 aa, Mycobacterium
PPEKFRSMMALMVEAPFLLIRAALPHMYRNEFGRVIN

SEQ ID NO: 845919 - protein, 17 aa, Mycobacterium
PPELLSGVRALTDATRR

SEQ ID NO: 845920 - protein, 18 aa, Mycobacterium
PPELLVVNKIDAADGLVL

SEQ ID NO: 845921 - protein, 18 aa, Mycobacterium
PPELLVVNKIDAASDLTL

SEQ ID NO: 845922 - protein, 20 aa, Mycobacterium
PPELLYVGRLEYEKGVHDAI

SEQ ID NO: 845923 - protein, 22 aa, Mycobacterium
PPELLYVGRLEYEKGVHNAIAA

SEQ ID NO: 845924 - protein, 17 aa, Mycobacterium
PPELTITNLHRSYAVLA

SEQ ID NO: 845925 - protein, 18 aa, Mycobacterium
PPEPAMAWRYLQLDADDT

SEQ ID NO: 845926 - protein, 23 aa, Mycobacterium
PPEPRYRPSRKLADFVRCRDQTC

SEQ ID NO: 845927 - protein, 21 aa, Mycobacterium
PPEQGGYPPQQGYPPRQPEQG

SEQ ID NO: 845928 - protein, 31 aa, Mycobacterium
PPEQWGPGPLPNAGPPWGPAPQVPNGPSGLQ

SEQ ID NO: 845929 - protein, 18 aa, Mycobacterium
PPERFTRFETWLTKSMGD

SEQ ID NO: 845930 - protein, 23 aa, Mycobacterium
PPERLQMAVAYGSAAAALPGTTL

SEQ ID NO: 845931 - protein, 28 aa, Mycobacterium
PPEVAALRFFWPRLTPGAFVLLDDYANR

SEQ ID NO: 845932 - protein, 28 aa, Mycobacterium
PPEVAANRALLMMLVATNLFGQNTPAIA

SEQ ID NO: 845933 - protein, 25 aa, Mycobacterium
PPEVAPGLRLFGGLIAAQALGAAGA

SEQ ID NO: 845934 - protein, 24 aa, Mycobacterium
PPEVLRIRDVLSYQADLAGATFVD

SEQ ID NO: 845935 - protein, 26 aa, Mycobacterium
PPEVNSLRMYSGPGSAPMLAAMAAWD

SEQ ID NO: 845936 - protein, 39 aa, Mycobacterium
PPFAQWIPEPLWALQRKLMAPFFVWLTVGLYDPPVRELM

SEQ ID NO: 845937 - protein, 19 aa, Mycobacterium
PPFEVLAERLTDNRPICLM

SEQ ID NO: 845938 - protein, 18 aa, Mycobacterium
PPFPLRRDRRPLMRAVVC

SEQ ID NO: 845939 - protein, 19 aa, Mycobacterium
PPFRAALIRAADDLYRFVL

SEQ ID NO: 845940 - protein, 18 aa, Mycobacterium
PPFRAKQLAHQYYGRLIA

SEQ ID NO: 845941 - protein, 19 aa, Mycobacterium
PPFRSMAKPVLTAVNGICC

SEQ ID NO: 845942 - protein, 18 aa, Mycobacterium
PPFTSWQPPGVPPVPPQL

SEQ ID NO: 845943 - protein, 19 aa, Mycobacterium
PPFVAIWDNVVTELNGTGG

SEQ ID NO: 845944 - protein, 19 aa, Mycobacterium
PPGALAVSAGRQRNIEGWV

SEQ ID NO: 845945 - protein, 26 aa, Mycobacterium
PPGARELIRAFWPGALSLVVVQAPSL

SEQ ID NO: 845946 - protein, 17 aa, Mycobacterium
PPGCPFTPRCPLAVDEC

SEQ ID NO: 845947 - protein, 22 aa, Mycobacterium
PPGCQPAPLDLIPTFADEKISA

SEQ ID NO: 845948 - protein, 26 aa, Mycobacterium
PPGDAQIYGIFTPGYVAAAEVAHVAV

SEQ ID NO: 845949 - protein, 40 aa, Mycobacterium
PPGFVSGLRTRRRLLRHRRQHGGLPPDPFPAHDGPRQGRR

SEQ ID NO: 845950 - protein, 23 aa, Mycobacterium
PPGGLRAITLRPRRPAGCTAADY

SEQ ID NO: 845951 - protein, 17 aa, Mycobacterium
PPGGWPEPLRSTALAGR

SEQ ID NO: 845952 - protein, 21 aa, Mycobacterium
PPGGWPEPLRTKALDGRGPVK

SEQ ID NO: 845953 - protein, 22 aa, Mycobacterium
PPGGWPEPLRTKALQGRGPARP

SEQ ID NO: 845954 - protein, 21 aa, Mycobacterium
PPGILLFEDPPLHDIHRRLLS

SEQ ID NO: 845955 - protein, 40 aa, Mycobacterium
PPGIPLFEDPPLHDLHRRLLSRVFTLRRMLAVDGLVREFC

SEQ ID NO: 845956 - protein, 17 aa, Mycobacterium
PPGLGIPELRRAITADR

SEQ ID NO: 845957 - protein, 26 aa, Mycobacterium
PPGLPDHRIRVGSLTWPGAHSWPDRG

SEQ ID NO: 845958 - protein, 26 aa, Mycobacterium
PPGLVHGGFLGVFFDCVIQHHNCVTG

SEQ ID NO: 845959 - protein, 19 aa, Mycobacterium
PPGPTQAFFRWASGRDGHN

SEQ ID NO: 845960 - protein, 19 aa, Mycobacterium
PPGPVPPVPVAPPPVVPPV

SEQ ID NO: 845961 - protein, 19 aa, Mycobacterium
PPGPVRVLALHGLTGHGQR

SEQ ID NO: 845962 - protein, 17 aa, Mycobacterium
PPGRPAVHQFRRAGLRA

SEQ ID NO: 845963 - protein, 17 aa, Mycobacterium
PPGRPEGRPWTYTPPVT

SEQ ID NO: 845964 - protein, 24 aa, Mycobacterium
PPGRPLVDDLGRAGLPGHHQRHGV

SEQ ID NO: 845965 - protein, 23 aa, Mycobacterium
PPGSFGIMIAMGPGFSSEFVLLG

SEQ ID NO: 845966 - protein, 23 aa, Mycobacterium
PPGSFYHRGARLDWMAATTLLTG

SEQ ID NO: 845967 - protein, 28 aa, Mycobacterium
PPGVEPKPLKGMPPFSGPQGPFAGITSG

SEQ ID NO: 845968 - protein, 25 aa, Mycobacterium
PPGVPPQWYADLVAKLAPLPCRVAV

SEQ ID NO: 845969 - protein, 17 aa, Mycobacterium
PPGVRRPAGTPDGVPVT

SEQ ID NO: 845970 - protein, 18 aa, Mycobacterium
PPGYFQRVREICDSYDVL

SEQ ID NO: 845971 - protein, 21 aa, Mycobacterium
PPGYGEMFAALGFGDLVRSAR

SEQ ID NO: 845972 - protein, 24 aa, Mycobacterium
PPHLERLLDITGILEYLTATPDTS

SEQ ID NO: 845973 - protein, 20 aa, Mycobacterium
PPHLGEWLINLGEAAEYMFD

SEQ ID NO: 845974 - protein, 21 aa, Mycobacterium
PPHNLRELAEAVFWCLENHDA

SEQ ID NO: 845975 - protein, 18 aa, Mycobacterium
PPHPLLGRLRRRLNDIYA

SEQ ID NO: 845976 - protein, 19 aa, Mycobacterium
PPHVRLPSHVTLLEPATRR

SEQ ID NO: 845977 - protein, 27 aa, Mycobacterium
PPIARPTLRWVNIVPGPLAGALRSSLD

SEQ ID NO: 845978 - protein, 20 aa, Mycobacterium
PPIKSLFVYNSNPVSQGPAQ

SEQ ID NO: 845979 - protein, 18 aa, Mycobacterium
PPITDGFYYDFDVAEPFT

SEQ ID NO: 845980 - protein, 18 aa, Mycobacterium
PPITIPSIHLPSTTLAEF

SEQ ID NO: 845981 - protein, 29 aa, Mycobacterium
PPIVHSVGLGTVNGITLGFSDAAPNQAGN

SEQ ID NO: 845982 - protein, 18 aa, Mycobacterium
PPIYFGFGSTPVTSPAET

SEQ ID NO: 845983 - protein, 23 aa, Mycobacterium
PPKAGEVLVRLAATGLCHSDEHI

SEQ ID NO: 845984 - protein, 24 aa, Mycobacterium
PPKATAVLSMPMHRFRNPCTGAPT

SEQ ID NO: 845985 - protein, 21 aa, Mycobacterium
PPKDPTLRRLLPDFYRNDDQD

SEQ ID NO: 845986 - protein, 20 aa, Mycobacterium
PPKLRHWVKEVKAAMAALDI

SEQ ID NO: 845987 - protein, 27 aa, Mycobacterium
PPKPPAAIKIDPPPPAQPQGLIPGFLM

SEQ ID NO: 845988 - protein, 26 aa, Mycobacterium
PPKPPAAIKIDPPPPAQPQGLIPSFL

SEQ ID NO: 845989 - protein, 36 aa, Mycobacterium
PPKPVEIIGNLLPPALKWKAFFKRQASNPKYLQDGD

SEQ ID NO: 845990 - protein, 43 aa, Mycobacterium
PPKRPPMPNLVPLSLSLWAGIYQVLFAFRAGSGVVLMDRFSPT

SEQ ID NO: 845991 - protein, 23 aa, Mycobacterium
PPKSPLPPMPVSGPPPEPPELPP

SEQ ID NO: 845992 - protein, 19 aa, Mycobacterium
PPLAGHLRHRIPPVAQHVP

SEQ ID NO: 845993 - protein, 17 aa, Mycobacterium
PPLAPGGLRVTALGGIS

SEQ ID NO: 845994 - protein, 24 aa, Mycobacterium
PPLDETRLHRLQALNPAAYAQLNT

SEQ ID NO: 845995 - protein, 20 aa, Mycobacterium
PPLDPATIGKGLLLSHTLTK

SEQ ID NO: 845996 - protein, 24 aa, Mycobacterium
PPLEDYLGDFRFYLDFYTRQSSRG

SEQ ID NO: 845997 - protein, 28 aa, Mycobacterium
PPLGQPPIPPWASPPPPPSLQATRDAYN

SEQ ID NO: 845998 - protein, 22 aa, Mycobacterium
PPLHGFDEFLPVVWGGVEHAAT

SEQ ID NO: 845999 - protein, 19 aa, Mycobacterium
PPLHPLPFHAMFDADLYGE

SEQ ID NO: 846000 - protein, 17 aa, Mycobacterium
PPLHTVHRLLVSRAFTP

SEQ ID NO: 846001 - protein, 20 aa, Mycobacterium
PPLKVDVSLPLPAIGRFARD

SEQ ID NO: 846002 - protein, 34 aa, Mycobacterium
PPLLLIHGYPFNSWDWALIWPTLVERFTVIAPDM

SEQ ID NO: 846003 - protein, 23 aa, Mycobacterium
PPLQDLIERMLFAEAIETQKCFD

SEQ ID NO: 846004 - protein, 19 aa, Mycobacterium
PPLQGPGRFLADYEAGLDA

SEQ ID NO: 846005 - protein, 17 aa, Mycobacterium
PPLRAKLPRVTAAPVLD

SEQ ID NO: 846006 - protein, 19 aa, Mycobacterium
PPLRVTGHADWLSLRRQVQ

SEQ ID NO: 846007 - protein, 19 aa, Mycobacterium
PPLSGGMVGFFAYDLVRRL

SEQ ID NO: 846008 - protein, 19 aa, Mycobacterium
PPLSGGMVGFFAYDMVRRL

SEQ ID NO: 846009 - protein, 19 aa, Mycobacterium
PPLSGGMVGFLAYDIVRRL

SEQ ID NO: 846010 - protein, 25 aa, Mycobacterium
PPLSSGLVGFFAYDMVRRLERLPEL

SEQ ID NO: 846011 - protein, 18 aa, Mycobacterium
PPLTLMPIEYMTPTVEDR

SEQ ID NO: 846012 - protein, 32 aa, Mycobacterium
PPMADWLEAFVALRTHVLVRFGRWDELIAQPL

SEQ ID NO: 846013 - protein, 34 aa, Mycobacterium
PPMADWLEAFVPLRVHVLVRFGRWADLIATALPE

SEQ ID NO: 846014 - protein, 19 aa, Mycobacterium
PPMAGLWADDKTLADGVFG

SEQ ID NO: 846015 - protein, 19 aa, Mycobacterium
PPMARGFQYGYLVADEYAA

SEQ ID NO: 846016 - protein, 19 aa, Mycobacterium
PPMIMRDTIFCAIPEDADR

SEQ ID NO: 846017 - protein, 22 aa, Mycobacterium
PPMKWNAWGDPAAAKPLSEGIR

SEQ ID NO: 846018 - protein, 22 aa, Mycobacterium
PPMPPVPPWPPAPPAAPGVVLL

SEQ ID NO: 846019 - protein, 22 aa, Mycobacterium
PPMQYAILRHNFFVERLIPAGT

SEQ ID NO: 846020 - protein, 18 aa, Mycobacterium
PPMVDQIRFFAGAARVLE

SEQ ID NO: 846021 - protein, 25 aa, Mycobacterium
PPNHTRIRRLFAKALRRGRIEELRP

SEQ ID NO: 846022 - protein, 19 aa, Mycobacterium
PPNPTIELLWTGPGPGDDE

SEQ ID NO: 846023 - protein, 37 aa, Mycobacterium
PPNVAYFLEHGLRDVGRWRIPVILGLRSDVGEDDVRA

SEQ ID NO: 846024 - protein, 25 aa, Mycobacterium
PPNVPTPFGVLPPLQATTSLPGYLA

SEQ ID NO: 846025 - protein, 24 aa, Mycobacterium
PPNVRAMNFLGEPPVNIGPAYQGK

SEQ ID NO: 846026 - protein, 21 aa, Mycobacterium
PPPAALTGEWFGALAVIAPSV

SEQ ID NO: 846027 - protein, 39 aa, Mycobacterium
PPPANPLHPLALRLAHPKQVIMLGRPTLHRPVSTLLADP

SEQ ID NO: 846028 - protein, 25 aa, Mycobacterium
PPPAYAGPVLPVAPPAPMTLPGVPA

SEQ ID NO: 846029 - protein, 21 aa, Mycobacterium
PPPDRMLIGLSVLGLLEEAAG

SEQ ID NO: 846030 - protein, 19 aa, Mycobacterium
PPPFVMRQFVKTSVFLPER

SEQ ID NO: 846031 - protein, 25 aa, Mycobacterium
PPPGAAPVDVPPPPGAAPVDAPAPA

SEQ ID NO: 846032 - protein, 24 aa, Mycobacterium
PPPGHLLEYLSDPTIRPLDGEEAI

SEQ ID NO: 846033 - protein, 27 aa, Mycobacterium
PPPGKGPFNRMLLPSSTPPLEPDDPLN

SEQ ID NO: 846034 - protein, 30 aa, Mycobacterium
PPPGSTLVSWLPFYHDMGLVLGVCAAILGG

SEQ ID NO: 846035 - protein, 20 aa, Mycobacterium
PPPIAAPAPEPLAAPVAGCP

SEQ ID NO: 846036 - protein, 19 aa, Mycobacterium
PPPIPIYVGGLSDIALRRA

SEQ ID NO: 846037 - protein, 23 aa, Mycobacterium
PPPLDVMAALRAPGIGVIAEVKR

SEQ ID NO: 846038 - protein, 24 aa, Mycobacterium
PPPLPDTPPVSALPDTPPLGAPAP

SEQ ID NO: 846039 - protein, 22 aa, Mycobacterium
PPPPDLYQGPSARAPWEIARPV

SEQ ID NO: 846040 - protein, 19 aa, Mycobacterium
PPPPIQLPPIIIGGPPAPR

SEQ ID NO: 846041 - protein, 18 aa, Mycobacterium
PPPPLVALYLRRPDAKPM

SEQ ID NO: 846042 - protein, 19 aa, Mycobacterium
PPPPPPRWRPRPAEPVAPA

SEQ ID NO: 846043 - protein, 26 aa, Mycobacterium
PPPPPPSALHPRPDPWEQRVPGWNAP

SEQ ID NO: 846044 - protein, 24 aa, Mycobacterium
PPPQNEQTPFYPRSPYGVAKVYSY

SEQ ID NO: 846045 - protein, 23 aa, Mycobacterium
PPPQRQWLDIPSWEWHKSGAEPV

SEQ ID NO: 846046 - protein, 28 aa, Mycobacterium
PPPQSEQTPFYPRSPYGAAKVYSYWVTR

SEQ ID NO: 846047 - protein, 27 aa, Mycobacterium
PPPSEGWRRWLYMVSGKLINLGESPRV

SEQ ID NO: 846048 - protein, 19 aa, Mycobacterium
PPPSPLSAHREWIDSCYAA

SEQ ID NO: 846049 - protein, 22 aa, Mycobacterium
PPPVELAGAPWAEVLARRLRIS

SEQ ID NO: 846050 - protein, 29 aa, Mycobacterium
PPQAQFGGLPHPTILAAARLLGVDEVWAI

SEQ ID NO: 846051 - protein, 35 aa, Mycobacterium
PPQDTTMVSWLPFYHDMGLIQGVFATLLCPPDGPD

SEQ ID NO: 846052 - protein, 29 aa, Mycobacterium
PPQEKFYPVIDGLLDAWRAAPEHPIPHTK

SEQ ID NO: 846053 - protein, 19 aa, Mycobacterium
PPQGDPLRKWSASGAPIAP

SEQ ID NO: 846054 - protein, 28 aa, Mycobacterium
PPQKQPRLPPPAAVLRITPSRIRRYAAV

SEQ ID NO: 846055 - protein, 40 aa, Mycobacterium
PPQNEDTPFYPRSPYAVAKLYSYWITKNYREAYGMFAVNG

SEQ ID NO: 846056 - protein, 28 aa, Mycobacterium
PPQPAQGWMFAAMPLSFLGLNDNSLYTM

SEQ ID NO: 846057 - protein, 24 aa, Mycobacterium
PPQPLDGYIFAGMRVPFTGVDDNP

SEQ ID NO: 846058 - protein, 18 aa, Mycobacterium
PPQQFLYQPAVDQVLRAG

SEQ ID NO: 846059 - protein, 23 aa, Mycobacterium
PPQRITLTLPAIQRSREVWLIVS

SEQ ID NO: 846060 - protein, 24 aa, Mycobacterium
PPQRITLTLPAIQRSREVWLVVSG

SEQ ID NO: 846061 - protein, 24 aa, Mycobacterium
PPQRITLTLPAVQRSREVWLMVSG

SEQ ID NO: 846062 - protein, 30 aa, Mycobacterium
PPQTSFGGLPHPTILAAARLLGVDEVWAVG

SEQ ID NO: 846063 - protein, 26 aa, Mycobacterium
PPQTYKWETFLTSELPGYLASKGVRR

SEQ ID NO: 846064 - protein, 18 aa, Mycobacterium
PPRAPEVSFYPWRDGGLG

SEQ ID NO: 846065 - protein, 20 aa, Mycobacterium
PPRAVLIRPDGHVAWVAGGS

SEQ ID NO: 846066 - protein, 23 aa, Mycobacterium
PPRCQRWAVRHPHGGLRRAVHVD

SEQ ID NO: 846067 - protein, 17 aa, Mycobacterium
PPRDHQKIFHWTNVILG

SEQ ID NO: 846068 - protein, 21 aa, Mycobacterium
PPRFLDIAMFIAMDPPKHDRQ

SEQ ID NO: 846069 - protein, 17 aa, Mycobacterium
PPRGGHFAPYEQPELYA

SEQ ID NO: 846070 - protein, 19 aa, Mycobacterium
PPRKWWQAGPGEGSIGFTE

SEQ ID NO: 846071 - protein, 26 aa, Mycobacterium
PPRLDVLQRAWFDKWLKGIDNGIDRY

SEQ ID NO: 846072 - protein, 23 aa, Mycobacterium
PPRPAWDRPLPPPGGQWGYGPIN

SEQ ID NO: 846073 - protein, 20 aa, Mycobacterium
PPRPEPLPHTPYPELSTGML

SEQ ID NO: 846074 - protein, 17 aa, Mycobacterium
PPRPLTHDLIRDLIAAL

SEQ ID NO: 846075 - protein, 20 aa, Mycobacterium
PPRPPWLPEEDEQRGFLRSL

SEQ ID NO: 846076 - protein, 30 aa, Mycobacterium
PPRPSPGWMFAAMPLIFPEGRDNPMYAMLM

SEQ ID NO: 846077 - protein, 28 aa, Mycobacterium
PPRQGPPGFLFLDPPDHTRLRKLVSKAF

SEQ ID NO: 846078 - protein, 20 aa, Mycobacterium
PPRQRQLIILRDLVGTSAEE

SEQ ID NO: 846079 - protein, 20 aa, Mycobacterium
PPRRLVFAADVPKLDQPLPR

SEQ ID NO: 846080 - protein, 17 aa, Mycobacterium
PPRVRTIAILRICALLR

SEQ ID NO: 846081 - protein, 19 aa, Mycobacterium
PPRWDTLIVGLDWETEKLD

SEQ ID NO: 846082 - protein, 25 aa, Mycobacterium
PPRWRPDHRPPWLAGYLARARQVVP

SEQ ID NO: 846083 - protein, 19 aa, Mycobacterium
PPRYQTGVLAKYVKLVGSA

SEQ ID NO: 846084 - protein, 24 aa, Mycobacterium
PPSAYPAQQRPLLHPSLEDEDAHY

SEQ ID NO: 846085 - protein, 24 aa, Mycobacterium
PPSDAVYYPLYTKCAELGLPLCIN

SEQ ID NO: 846086 - protein, 24 aa, Mycobacterium
PPSDTRAYFRGECLRKFGADIAAA

SEQ ID NO: 846087 - protein, 24 aa, Mycobacterium
PPSHHYLAAYHWLDRGFSNGFEAD

SEQ ID NO: 846088 - protein, 20 aa, Mycobacterium
PPSHILGLLNIVTALRTGVR

SEQ ID NO: 846089 - protein, 17 aa, Mycobacterium
PPSITMLARCVIGLQWI

SEQ ID NO: 846090 - protein, 19 aa, Mycobacterium
PPSIWGGMAAARFKGVVDR

SEQ ID NO: 846091 - protein, 21 aa, Mycobacterium
PPSLLSAFDSALTGPLGPVSL

SEQ ID NO: 846092 - protein, 24 aa, Mycobacterium
PPSPKPVLSYLAGVGYTLADLTER

SEQ ID NO: 846093 - protein, 24 aa, Mycobacterium
PPSPLSMLKMLETALSIAVSGTAA

SEQ ID NO: 846094 - protein, 17 aa, Mycobacterium
PPSPRRGPVKRAPKPAK

SEQ ID NO: 846095 - protein, 22 aa, Mycobacterium
PPSRLRHFITNVRTFAGADSEH

SEQ ID NO: 846096 - protein, 24 aa, Mycobacterium
PPSRYSRDLPPETLSWLYESMVVT

SEQ ID NO: 846097 - protein, 26 aa, Mycobacterium
PPSSASEFGVYWPTLIPASEVAHTVV

SEQ ID NO: 846098 - protein, 17 aa, Mycobacterium
PPSWLRQVLPDPQYAPG

SEQ ID NO: 846099 - protein, 21 aa, Mycobacterium
PPSWVAFPPEINTSRLQAGAG

SEQ ID NO: 846100 - protein, 20 aa, Mycobacterium
PPSYALPEEPLLSAPTVAEL

SEQ ID NO: 846101 - protein, 22 aa, Mycobacterium
PPSYTRGYVGTALRLLERKIAQ

SEQ ID NO: 846102 - protein, 19 aa, Mycobacterium
PPTACLPASGVPRSTSEFG

SEQ ID NO: 846103 - protein, 25 aa, Mycobacterium
PPTEGWRRLVYVLSGQLINLGESPR

SEQ ID NO: 846104 - protein, 23 aa, Mycobacterium
PPTFRVRDLPARGWILLGEWPGT

SEQ ID NO: 846105 - protein, 31 aa, Mycobacterium; identical to SEQ ID NO: 710445

SEQ ID NO: 846106 - protein, 19 aa, Mycobacterium
PPTGPAPAPPPVIGTGMPA

SEQ ID NO: 846107 - protein, 21 aa, Mycobacterium
PPTIIETMHWMGSMGALNFFA

SEQ ID NO: 846108 - protein, 20 aa, Mycobacterium
PPTLLSTYFEHVNGRYIFHK

SEQ ID NO: 846109 - protein, 25 aa, Mycobacterium
PPTNVNVVLLSFPQTFSGYFAPAGV

SEQ ID NO: 846110 - protein, 20 aa, Mycobacterium
PPTPSPLRRTGEWEWEFETD

SEQ ID NO: 846111 - protein, 30 aa, Mycobacterium
PPTPTQLRTMGRLLGWRLGLDGVDPKGTVQ

SEQ ID NO: 846112 - protein, 22 aa, Mycobacterium
PPTRLLNLALEIGCVFSIDTDA

SEQ ID NO: 846113 - protein, 26 aa, Mycobacterium
PPTTAPPAAPLIPPSTVPATGAGFTH

SEQ ID NO: 846114 - protein, 33 aa, Mycobacterium
PPTTELITGLYGYRIPLVYLVQSTSAGVEVSLG

SEQ ID NO: 846115 - protein, 24 aa, Mycobacterium
PPTTELMYAWHLPDAIEAMVGVGR

SEQ ID NO: 846116 - protein, 21 aa, Mycobacterium
PPTVELLFREDFNAYGIEVVQ

SEQ ID NO: 846117 - protein, 23 aa, Mycobacterium
PPTVHPSLWRQSTLVAKQGLYEV

SEQ ID NO: 846118 - protein, 17 aa, Mycobacterium
PPTWLTIETADVATALS

SEQ ID NO: 846119 - protein, 19 aa, Mycobacterium
PPTYYLPPGCFADGVLRPA

SEQ ID NO: 846120 - protein, 21 aa, Mycobacterium
PPVAVGLALAGKRKGLDRVTV

SEQ ID NO: 846121 - protein, 31 aa, Mycobacterium
PPVCHCGGLIRPDIVWFGEPLPDEPWQSAVE

SEQ ID NO: 846122 - protein, 31 aa, Mycobacterium
PPVCHCGGLIRPDIVWFGEQLPDEPWRRAVE

SEQ ID NO: 846123 - protein, 34 aa, Mycobacterium
PPVCPCSGLIRPSVVWFGEPLPDAAWNRSVLAVS

SEQ ID NO: 846124 - protein, 33 aa, Mycobacterium
PPVGDLRWRPPQPVKPWTGVRLTLRYGPSAPQP

SEQ ID NO: 846125 - protein, 24 aa, Mycobacterium
PPVGPLRFRAPQPAQPWSGVRHCH

SEQ ID NO: 846126 - protein, 30 aa, Mycobacterium
PPVGPLRLRAPRPALPWTGVRTCRAWGAAS

SEQ ID NO: 846127 - protein, 17 aa, Mycobacterium
PPVLFWMHGGGMVIGNR

SEQ ID NO: 846128 - protein, 17 aa, Mycobacterium
PPVMLQTWTMPAPKLEG

SEQ ID NO: 846129 - protein, 36 aa, Mycobacterium
PPVPGKFYWMTPTQVRWRPFQFWPANTAVNIDAAGT

SEQ ID NO: 846130 - protein, 29 aa, Mycobacterium
PPVQLDKKWLKPTAYMMAKFGMTLCALGI

SEQ ID NO: 846131 - protein, 29 aa, Mycobacterium
PPVQTIVEIRLFGGALAREPRHRSAFCHR

SEQ ID NO: 846132 - protein, 17 aa, Mycobacterium
PPVRAYSVNWDAIAQCE

SEQ ID NO: 846133 - protein, 22 aa, Mycobacterium
PPVVAPPSMPSAPAGPISGAPV

SEQ ID NO: 846134 - protein, 20 aa, Mycobacterium
PPVVLAYLAPQTSQLRLGSG

SEQ ID NO: 846135 - protein, 17 aa, Mycobacterium
PPVVLYFHGGGFVMGDL

SEQ ID NO: 846136 - protein, 17 aa, Mycobacterium
PPVVWEADRGWFVTEPF

SEQ ID NO: 846137 - protein, 18 aa, Mycobacterium
PPVWTPLPVHYADYTLWH

SEQ ID NO: 846138 - protein, 18 aa, Mycobacterium
PPWARMYTSGSWAGMLAA

SEQ ID NO: 846139 - protein, 21 aa, Mycobacterium
PPWWLKPANKVFIQLSRLGLS

SEQ ID NO: 846140 - protein, 21 aa, Mycobacterium
PPWWLKPANKVFIQMSRLGMS

SEQ ID NO: 846141 - protein, 20 aa, Mycobacterium
PPYARNMRFYPTAAAAQRAG

SEQ ID NO: 846142 - protein, 17 aa, Mycobacterium
PPYDLTYDDVFVVPNHS

SEQ ID NO: 846143 - protein, 19 aa, Mycobacterium
PPYDLTYNDVFVVPGRSEV

SEQ ID NO: 846144 - protein, 21 aa, Mycobacterium
PPYELAPMLWHRFDDLAGNVR

SEQ ID NO: 846145 - protein, 22 aa, Mycobacterium
PPYERYSMFVVPGDTPGINVLR

SEQ ID NO: 846146 - protein, 28 aa, Mycobacterium
PPYQPDLRKILNPLFTRTFLTKFEPEMR

SEQ ID NO: 846147 - protein, 20 aa, Mycobacterium
PPYRGRVDMTFNVPPGIDHS

SEQ ID NO: 846148 - protein, 24 aa, Mycobacterium
PQAACDGPRFRWVQGLQVACERGF

SEQ ID NO: 846149 - protein, 25 aa, Mycobacterium
PQAAKLVEWLKLALDEPHLLKTLGA

SEQ ID NO: 846150 - protein, 28 aa, Mycobacterium
PQAAKWVVRVVLSLVYWPGEDEEAERRL

SEQ ID NO: 846151 - protein, 47 aa, Mycobacterium
PQAATLVQIFVVALNFGITAAELARRPYWIHPALTEVVENALLALDK

SEQ ID NO: 846152 - protein, 28 aa, Mycobacterium
PQAELAQQTWFRLSALAERVSATVRIAG

SEQ ID NO: 846153 - protein, 23 aa, Mycobacterium
PQAFDGLRLAGRPVRRPDLTIAT

SEQ ID NO: 846154 - protein, 18 aa, Mycobacterium
PQAFLLDEPLSNLDAKLR

SEQ ID NO: 846155 - protein, 26 aa, Mycobacterium
PQAGLSAFLAMWRKIVIDSNFHAGCP

SEQ ID NO: 846156 - protein, 33 aa, Mycobacterium
PQAHNALNLAAWRRLKLLFDDLARESDLRVVVI

SEQ ID NO: 846157 - protein, 21 aa, Mycobacterium
PQAIPVIVDWLQHLDERVPPE

SEQ ID NO: 846158 - protein, 21 aa, Mycobacterium
PQAKALFKVLSTNAEAATTLG

SEQ ID NO: 846159 - protein, 30 aa, Mycobacterium
PQALIRVGLAPTFGRIPPPTPRRSLADVFE

SEQ ID NO: 846160 - protein, 22 aa, Mycobacterium
PQALLLQLLDPAIRANPYPVCA

SEQ ID NO: 846161 - protein, 17 aa, Mycobacterium
PQALRRSLTWDQGHEML

SEQ ID NO: 846162 - protein, 18 aa, Mycobacterium
PQALVALAQRYGAWLGAH

SEQ ID NO: 846163 - protein, 31 aa, Mycobacterium
PQAPKRQAGISFLLFDMKTPGITLRPIKTID

SEQ ID NO: 846164 - protein, 30 aa, Mycobacterium
PQAPKRQAGISFLLFDMKTPGVTLRPIKTI

SEQ ID NO: 846165 - protein, 27 aa, Mycobacterium
PQAPPYVAVPYLDRMDLAYAAADLAIC

SEQ ID NO: 846166 - protein, 35 aa, Mycobacterium
PQAPQRRLVFRSDIPKLPRPLPRYLTPDLDRRLTQ

SEQ ID NO: 846167 - protein, 22 aa, Mycobacterium
PQAQAMLPKAIAAGVRIACGTD

SEQ ID NO: 846168 - protein, 23 aa, Mycobacterium
PQAQGRGLGYTLHPHRPAPSGGK

SEQ ID NO: 846169 - protein, 19 aa, Mycobacterium
PQARYILPSFIEHSSFGVK

SEQ ID NO: 846170 - protein, 20 aa, Mycobacterium
PQAVPMKVLFDPKIAAKAAP

SEQ ID NO: 846171 - protein, 24 aa, Mycobacterium
PQAVRDWLLAERRILTTFVGVQRA

SEQ ID NO: 846172 - protein, 20 aa, Mycobacterium
PQCPRRWRYLSPAIPADPDG

SEQ ID NO: 846173 - protein, 21 aa, Mycobacterium
PQCPRRWRYLSPAIPADPGGG

SEQ ID NO: 846174 - protein, 22 aa, Mycobacterium
PQCPRRWRYLSPAIPADPGGGI

SEQ ID NO: 846175 - protein, 24 aa, Mycobacterium
PQDDPMVQVIDYGIRGMHLAYDLL

SEQ ID NO: 846176 - protein, 22 aa, Mycobacterium
PQDFYDRLLASKPLPGTGKPDP

SEQ ID NO: 846177 - protein, 27 aa, Mycobacterium
PQDHALPHWAGVVPLALRAGTPEPAAD

SEQ ID NO: 846178 - protein, 26 aa, Mycobacterium
PQDLPLPHWAGVVPLTLTAGTPVPAA

SEQ ID NO: 846179 - protein, 17 aa, Mycobacterium
PQDLTPHSALPPAVAEY

SEQ ID NO: 846180 - protein, 23 aa, Mycobacterium
PQDRLSDVLARYGPEDPVHRAVD

SEQ ID NO: 846181 - protein, 24 aa, Mycobacterium
PQDSRLLTRELFYTAVTRAKERVQ

SEQ ID NO: 846182 - protein, 33 aa, Mycobacterium
PQDVQAESFDWPESLFAERTWHIARPLPERAVI

SEQ ID NO: 846183 - protein, 17 aa, Mycobacterium
PQEELFNPMAVSALGRD

SEQ ID NO: 846184 - protein, 22 aa, Mycobacterium
PQEEWAGRLRRLIAEQASVILR

SEQ ID NO: 846185 - protein, 20 aa, Mycobacterium
PQEFAVLRQAGTERPFTGEY

SEQ ID NO: 846186 - protein, 21 aa, Mycobacterium
PQEFPKFVRPMLTTEKFEDAA

SEQ ID NO: 846187 - protein, 17 aa, Mycobacterium
PQEIAIALDRSISRTEA

SEQ ID NO: 846188 - protein, 27 aa, Mycobacterium
PQEKLYPVIDALLDAWRSTGDRAIPHT

SEQ ID NO: 846189 - protein, 22 aa, Mycobacterium
PQELALLRLLEGPRFCGHPDLR

SEQ ID NO: 846190 - protein, 25 aa, Mycobacterium
PQENLPMVLLVHGGPWARDCWYYQP

SEQ ID NO: 846191 - protein, 23 aa, Mycobacterium
PQERYFTFTYSPIIGGRGAVTAV

SEQ ID NO: 846192 - protein, 24 aa, Mycobacterium
PQESQILLVNGLSLIGSDRGLGPR

SEQ ID NO: 846193 - protein, 23 aa, Mycobacterium
PQESRLRLVLVRGGLPVPQTQIE

SEQ ID NO: 846194 - protein, 22 aa, Mycobacterium
PQESRLWQLRSAEANLLEDERL

SEQ ID NO: 846195 - protein, 24 aa, Mycobacterium
PQETRLRLVLVRAGLPRPVTQIPV

SEQ ID NO: 846196 - protein, 25 aa, Mycobacterium
PQETRLRLVLVRRGLPRPVTQVPVT

SEQ ID NO: 846197 - protein, 19 aa, Mycobacterium
PQEWTDIEWFSALEPTADA

SEQ ID NO: 846198 - protein, 29 aa, Mycobacterium
PQFAQQALHAFRKFGFQLVIVATVQNATT

SEQ ID NO: 846199 - protein, 23 aa, Mycobacterium
PQFATWLAVLQRSLNDGTPVRFA

SEQ ID NO: 846200 - protein, 19 aa, Mycobacterium
PQFPSLPQWPGEPEPVDTT

SEQ ID NO: 846201 - protein, 20 aa, Mycobacterium
PQFRSLRMWESQAPTPPPEA

SEQ ID NO: 846202 - protein, 26 aa, Mycobacterium
PQFSFPARGILTSRFGARWGTLHAGL

SEQ ID NO: 846203 - protein, 24 aa, Mycobacterium
PQGAALFPVLGTPTGELNLPPQQD

SEQ ID NO: 846204 - protein, 26 aa, Mycobacterium
PQGARTIALWEPALIPDLLGENGAPV

SEQ ID NO: 846205 - protein, 24 aa, Mycobacterium
PQGDSLRAWSAAGGPPGALFGYLA

SEQ ID NO: 846206 - protein, 17 aa, Mycobacterium
PQGFSTELLLRAYRHAG

SEQ ID NO: 846207 - protein, 25 aa, Mycobacterium
PQGGLLLAHHPLLLRGVDTVAADTA

SEQ ID NO: 846208 - protein, 36 aa, Mycobacterium
PQGLEYIIAFYGAMAAGFIAVPLPVPALGQLDERVN

SEQ ID NO: 846209 - protein, 22 aa, Mycobacterium
PQGMDFLHGRWLVLRRGKRNVA

SEQ ID NO: 846210 - protein, 21 aa, Mycobacterium
PQGRLFLYGFSDGHVNGFHNH

SEQ ID NO: 846211 - protein, 41 aa, Mycobacterium
PQGRTRFRPHFFPFTEPSAEVDIWFPDKKGGPGWVEWGGCG

SEQ ID NO: 846212 - protein, 27 aa, Mycobacterium
PQHGGPQFGLILALMTQGLAISDYPDM

SEQ ID NO: 846213 - protein, 20 aa, Mycobacterium
PQHLQLVLHKLHDAGATVTQ

SEQ ID NO: 846214 - protein, 19 aa, Mycobacterium
PQHRLFLECAWAAMEDAGY

SEQ ID NO: 846215 - protein, 20 aa, Mycobacterium
PQHSWALRYRLAGNRSLSVG

SEQ ID NO: 846216 - protein, 19 aa, Mycobacterium
PQHTLLNTLQRRYVGHLRG

SEQ ID NO: 846217 - protein, 29 aa, Mycobacterium
PQIAPLEFPPYVQSVLPPAPPPMPATPIN

SEQ ID NO: 846218 - protein, 23 aa, Mycobacterium
PQIARAYVTALRDLLRALDVSDV

SEQ ID NO: 846219 - protein, 24 aa, Mycobacterium
PQIDKPKVLILGSGPNRIGQGIEF

SEQ ID NO: 846220 - protein, 17 aa, Mycobacterium
PQIDLRVGSWYVSTHPE

SEQ ID NO: 846221 - protein, 20 aa, Mycobacterium
PQIDPDLRAGSQWPALAARV

SEQ ID NO: 846222 - protein, 23 aa, Mycobacterium
PQIDPFTARFGVPLPRGLREEAG

SEQ ID NO: 846223 - protein, 24 aa, Mycobacterium
PQIDWSKVHLFWGDDRYVPEDDDE

SEQ ID NO: 846224 - protein, 23 aa, Mycobacterium
PQIERGWRHYLLSTAGRSYLDMV

SEQ ID NO: 846225 - protein, 25 aa, Mycobacterium
PQIREFEPNWLVWTHGCPGGESVQQ

SEQ ID NO: 846226 - protein, 18 aa, Mycobacterium
PQIRPDEWPEQVGLDWFP

SEQ ID NO: 846227 - protein, 23 aa, Mycobacterium
PQISAMLRRLGIQGDFKGGFRVT

SEQ ID NO: 846228 - protein, 20 aa, Mycobacterium
PQKLWKPLHSIRNASRLWQA

SEQ ID NO: 846229 - protein, 17 aa, Mycobacterium
PQKVRRIRRLAAIWLAA

SEQ ID NO: 846230 - protein, 23 aa, Mycobacterium
PQLARFLVMGAMNWTAEWWDPRR

SEQ ID NO: 846231 - protein, 23 aa, Mycobacterium
PQLDRHRPLFRCWVIDGVPDDMF

SEQ ID NO: 846232 - protein, 21 aa, Mycobacterium
PQLDWILANLDKPHTVTSLSR

SEQ ID NO: 846233 - protein, 25 aa, Mycobacterium
PQLFKQLLMVAGMERYYQIARCYRD

SEQ ID NO: 846234 - protein, 17 aa, Mycobacterium
PQLIASEANFGAKAALM

SEQ ID NO: 846235 - protein, 17 aa, Mycobacterium
PQLILEWDYTRDSYDAD

SEQ ID NO: 846236 - protein, 22 aa, Mycobacterium
PQLLAGFPYPHLLTVAVRLADR

SEQ ID NO: 846237 - protein, 31 aa, Mycobacterium
PQLLDQLETAGVERLFLPYVALQLLAEHGVR

SEQ ID NO: 846238 - protein, 19 aa, Mycobacterium
PQLLGSLTGDLARARGWSG

SEQ ID NO: 846239 - protein, 18 aa, Mycobacterium
PQLMRLQRRLNSPGWRSA

SEQ ID NO: 846240 - protein, 21 aa, Mycobacterium
PQLPKLLRDGLARGRLRFSED

SEQ ID NO: 846241 - protein, 23 aa, Mycobacterium
PQLPVAHVETFRSGLLAWPSVAA

SEQ ID NO: 846242 - protein, 17 aa, Mycobacterium
PQLQANWTWARSALHDK

SEQ ID NO: 846243 - protein, 24 aa, Mycobacterium
PQLSNMMTPFLPTWAVEPEDIADA

SEQ ID NO: 846244 - protein, 29 aa, Mycobacterium
PQLSTITPRWLLHLLSWVPVEAGIYRVNR

SEQ ID NO: 846245 - protein, 18 aa, Mycobacterium
PQLTALVGGLRALDVNHG

SEQ ID NO: 846246 - protein, 25 aa, Mycobacterium
PQLVPAWMIVTAWTRLCEHGTLSQV

SEQ ID NO: 846247 - protein, 35 aa, Mycobacterium
PQLYGKMMAYLPTAFAPAAFRWLGLRDMPNKLMNV

SEQ ID NO: 846248 - protein, 17 aa, Mycobacterium
PQMLIFRPAPGLGRAET

SEQ ID NO: 846249 - protein, 18 aa, Mycobacterium
PQMMQQMLQSITGALGGA

SEQ ID NO: 846250 - protein, 18 aa, Mycobacterium
PQMTVLLGGLRVLGANHG

SEQ ID NO: 846251 - protein, 33 aa, Mycobacterium
PQMVENGLPLTLWLARFLKFIQTEIFPGGHPPT

SEQ ID NO: 846252 - protein, 31 aa, Mycobacterium
PQNLTSGDFPVLWPVLTRWADNDMFGHLNNA

SEQ ID NO: 846253 - protein, 18 aa, Mycobacterium
PQNPYSALRRAYGDDVLA

SEQ ID NO: 846254 - protein, 26 aa, Mycobacterium
PQNVQGYLLYRFVDEDTTVVWVQLRP

SEQ ID NO: 846255 - protein, 22 aa, Mycobacterium
PQNYVALPQQLWLDGINSGDGF

SEQ ID NO: 846256 - protein, 17 aa, Mycobacterium
PQPAPAPRFSRTRPQPP

SEQ ID NO: 846257 - protein, 24 aa, Mycobacterium
PQPARPVDLLLDGIALRATAGQVP

SEQ ID NO: 846258 - protein, 21 aa, Mycobacterium
PQPDDWVLIHVGFAMAKIDET

SEQ ID NO: 846259 - protein, 21 aa, Mycobacterium
PQPEPLRRYKQGEPPLVGSLL

SEQ ID NO: 846260 - protein, 19 aa, Mycobacterium
PQPHYDAVTRWVNERRLTV

SEQ ID NO: 846261 - protein, 17 aa, Mycobacterium
PQPLGRLARDLAKKRGW

SEQ ID NO: 846262 - protein, 17 aa, Mycobacterium
PQPLPRAVADHVAAVVL

SEQ ID NO: 846263 - protein, 23 aa, Mycobacterium
PQPQLNNRQIYWPRGKTLGGSSS

SEQ ID NO: 846264 - protein, 17 aa, Mycobacterium
PQPRPAGYVIVGDTASL

SEQ ID NO: 846265 - protein, 18 aa, Mycobacterium
PQPRPVWYEVTPAGEIQL

SEQ ID NO: 846266 - protein, 24 aa, Mycobacterium
PQPSPGWMFSAMPLDFSGVPDNPM

SEQ ID NO: 846267 - protein, 19 aa, Mycobacterium
PQPTSVQGQWQWVPQQPQG

SEQ ID NO: 846268 - protein, 20 aa, Mycobacterium
PQQALLYRMCGDRNPLHSDP

SEQ ID NO: 846269 - protein, 25 aa, Mycobacterium
PQQHPYWPTEYFPAKREAAWAKFEP

SEQ ID NO: 846270 - protein, 20 aa, Mycobacterium
PQQPGRYFTVRAGSLVAWDS

SEQ ID NO: 846271 - protein, 20 aa, Mycobacterium
PQQQLAQTQPIPPMGADGTQ

SEQ ID NO: 846272 - protein, 19 aa, Mycobacterium
PQQRLYRQALELHPQYVLE

SEQ ID NO: 846273 - protein, 17 aa, Mycobacterium
PQQRMYTLLAPGRYQPM

SEQ ID NO: 846274 - protein, 20 aa, Mycobacterium
PQQRPFTMRYLDAPPRVALD

SEQ ID NO: 846275 - protein, 24 aa, Mycobacterium
PQQRRPYRPLRRPNSDSLHAVVAV

SEQ ID NO: 846276 - protein, 21 aa, Mycobacterium
PQQRVSLRVAWRALENSGINP

SEQ ID NO: 846277 - protein, 27 aa, Mycobacterium
PQQVDSIPLVVLIHGGAWQSKLGADVF

SEQ ID NO: 846278 - protein, 25 aa, Mycobacterium
PQRAAQIILAAVRKGKPRVLVGPDV

SEQ ID NO: 846279 - protein, 32 aa, Mycobacterium
PQRATHSSWAFAQLGAFLSYKAARAGVPIVQV

SEQ ID NO: 846280 - protein, 17 aa, Mycobacterium
PQRDQAWKDYLSGKNPD

SEQ ID NO: 846281 - protein, 17 aa, Mycobacterium
PQRDVAFAGGIDLCHSR

SEQ ID NO: 846282 - protein, 22 aa, Mycobacterium
PQRENCVLAYRAPGPRLLYGEL

SEQ ID NO: 846283 - protein, 38 aa, Mycobacterium
PQRGYDLELITPVPLPRKLSADLLRLPMRVRRAVRETR

SEQ ID NO: 846284 - protein, 30 aa, Mycobacterium
PQRGYDLELITPVPLPRKPSKDLLRLPMRV

SEQ ID NO: 846285 - protein, 19 aa, Mycobacterium
PQRHPDLARLQRRTGIRHR

SEQ ID NO: 846286 - protein, 24 aa, Mycobacterium
PQRITLTLPAIQRSREVWLMVSGG

SEQ ID NO: 846287 - protein, 22 aa, Mycobacterium
PQRKDYPLGGIPVEYHGAEIPP

SEQ ID NO: 846288 - protein, 22 aa, Mycobacterium
PQRKDYPLGGIPVEYHGAQIPP

SEQ ID NO: 846289 - protein, 17 aa, Mycobacterium
PQRLAPHSYALGAEVKH

SEQ ID NO: 846290 - protein, 17 aa, Mycobacterium
PQRLILAHRDRALSPER

SEQ ID NO: 846291 - protein, 23 aa, Mycobacterium
PQRLQTWLNRHPGLPRLINLYGI

SEQ ID NO: 846292 - protein, 24 aa, Mycobacterium
PQRLRDWLHNHPGLPRLINMYGAT

SEQ ID NO: 846293 - protein, 40 aa, Mycobacterium
PQRPQRPQLVLARIARAVPALLWPNWAIPMQPNNIEYESV

SEQ ID NO: 846294 - protein, 25 aa, Mycobacterium
PQRPVRRPVLPVGRQHRLRLDGITE

SEQ ID NO: 846295 - protein, 25 aa, Mycobacterium
PQRQALDRLLVLGTLLEGHAEHVMD

SEQ ID NO: 846296 - protein, 33 aa, Mycobacterium
PQRQPGLLERSARWRPWRSYATQHLWTTLEHSV

SEQ ID NO: 846297 - protein, 17 aa, Mycobacterium
PQRRTLFLLSSTDAYPQ

SEQ ID NO: 846298 - protein, 24 aa, Mycobacterium
PQRTISVPTLYALGALGSLRARLT

SEQ ID NO: 846299 - protein, 22 aa, Mycobacterium
PQRTSGFRLERYADDLAAVLDA

SEQ ID NO: 846300 - protein, 26 aa, Mycobacterium
PQRVGWANAMELLLTGKPMSAARAKE

SEQ ID NO: 846301 - protein, 26 aa, Mycobacterium
PQRVGWANAMELLLTGKPMSAQRAKE

SEQ ID NO: 846302 - protein, 20 aa, Mycobacterium
PQSALYLSDVITRGGFPEGC

SEQ ID NO: 846303 - protein, 28 aa, Mycobacterium
PQSDLFVKPVLNLWEFAKPTIAQVHGYC

SEQ ID NO: 846304 - protein, 19 aa, Mycobacterium
PQSDRLGGFKPADIADLLE

SEQ ID NO: 846305 - protein, 17 aa, Mycobacterium
PQSEAIDWTFPLSVRDV

SEQ ID NO: 846306 - protein, 21 aa, Mycobacterium
PQSFGFSSLGGWLATRAGGHF

SEQ ID NO: 846307 - protein, 22 aa, Mycobacterium
PQSHHLYRHQRLRWPQDKGDGR

SEQ ID NO: 846308 - protein, 25 aa, Mycobacterium
PQSLPFFVQEACRQWELPAADTVIT

SEQ ID NO: 846309 - protein, 24 aa, Mycobacterium
PQSPLLAAARRLAPGGAIVIGGRM

SEQ ID NO: 846310 - protein, 25 aa, Mycobacterium
PQSPRNWRYLSLAIPPDPEGYIEFH

SEQ ID NO: 846311 - protein, 23 aa, Mycobacterium
PQSRRSWAVLGEMAELGADAITE

SEQ ID NO: 846312 - protein, 23 aa, Mycobacterium
PQSWKQFLHPARQRLWSSDGAPA

SEQ ID NO: 846313 - protein, 24 aa, Mycobacterium
PQTACDGPRFRWVQGLQVCCENGF

SEQ ID NO: 846314 - protein, 24 aa, Mycobacterium
PQTATLIPLLRRDGMSDGDVNRVF

SEQ ID NO: 846315 - protein, 26 aa, Mycobacterium
PQTGLALIEFPLLGVIIHAATGALLY

SEQ ID NO: 846316 - protein, 17 aa, Mycobacterium
PQTLALADLPAPVLPDA

SEQ ID NO: 846317 - protein, 21 aa, Mycobacterium
PQTMLATFYAKALDADFDKPI

SEQ ID NO: 846318 - protein, 20 aa, Mycobacterium
PQTMLATFYAKALDARLPTP

SEQ ID NO: 846319 - protein, 22 aa, Mycobacterium
PQTRIWWGAYLGTEDELLVAGT

SEQ ID NO: 846320 - protein, 22 aa, Mycobacterium
PQTRTFHHPGGLIDYVKHINRV

SEQ ID NO: 846321 - protein, 26 aa, Mycobacterium
PQTVDPLDGAALRYAFGCFPSGVIAV

SEQ ID NO: 846322 - protein, 21 aa, Mycobacterium
PQTVWVTGCSSWYLGKDGLPE

SEQ ID NO: 846323 - protein, 21 aa, Mycobacterium
PQVAALLGCAVLTGGGAVLNV

SEQ ID NO: 846324 - protein, 27 aa, Mycobacterium
PQVAFFGDNIPLLLKGLTRVGNQGAYG

SEQ ID NO: 846325 - protein, 21 aa, Mycobacterium
PQVDKGARWDPAELGPVVADL

SEQ ID NO: 846326 - protein, 18 aa, Mycobacterium
PQVEVFAPELELARAWRA

SEQ ID NO: 846327 - protein, 19 aa, Mycobacterium
PQVLFARPQPQPAAVQPVQ

SEQ ID NO: 846328 - protein, 25 aa, Mycobacterium
PQVRVLPERIYLHQLDPNPPGPDSD

SEQ ID NO: 846329 - protein, 23 aa, Mycobacterium
PQVRVLYLGRGLAKATKWGPAEV

SEQ ID NO: 846330 - protein, 17 aa, Mycobacterium
PQVVQLSTGAWFDPADP

SEQ ID NO: 846331 - protein, 32 aa, Mycobacterium
PQWARDWQRLLFDNGWLLPAQPPEFGGRNANV

SEQ ID NO: 846332 - protein, 20 aa, Mycobacterium
PQWLKDLRKNGPHPKNLVAA

SEQ ID NO: 846333 - protein, 24 aa, Mycobacterium
PQYDIPQLLSMYKAGKLNLDDMIT

SEQ ID NO: 846334 - protein, 24 aa, Mycobacterium
PQYDIPQLLSMYKAGKLNLDDMVT

SEQ ID NO: 846335 - protein, 23 aa, Mycobacterium
PQYDIPQLLSMYKARKLNIDDMI

SEQ ID NO: 846336 - protein, 24 aa, Mycobacterium
PQYDIPQLLSMYRAGKLNLDDMIT

SEQ ID NO: 846337 - protein, 17 aa, Mycobacterium
PQYFAQCAIAASVRTIA

SEQ ID NO: 846338 - protein, 28 aa, Mycobacterium
PQYSEPFTRFPMRSVWPDMFSVYKAQGR

SEQ ID NO: 846339 - protein, 17 aa, Mycobacterium
PRAAPQPPRITPEDVER

SEQ ID NO: 846340 - protein, 30 aa, Mycobacterium
PRAARELIRAFWPGALSLVVHQAPSLQWDL

SEQ ID NO: 846341 - protein, 23 aa, Mycobacterium
PRAAVEPLVLMLAPLAPHLAEEL

SEQ ID NO: 846342 - protein, 25 aa, Mycobacterium
PRADIPRLVSLYRSGKLLLDEAVTT

SEQ ID NO: 846343 - protein, 27 aa, Mycobacterium
PRADPDLPWPGRLPAPSPAVLLDDPVE

SEQ ID NO: 846344 - protein, 20 aa, Mycobacterium
PRADVRDLYAWAERFRTGVI

SEQ ID NO: 846345 - protein, 25 aa, Mycobacterium
PRAFGNLLIQRATLRGFIVLDHFGR

SEQ ID NO: 846346 - protein, 25 aa, Mycobacterium
PRAGELCAPVRFLVRRDSVVMELTA

SEQ ID NO: 846347 - protein, 22 aa, Mycobacterium
PRAGLLCMPTLSTHGYEVIART

SEQ ID NO: 846348 - protein, 24 aa, Mycobacterium
PRAGPHQRLLRERVDGAQAGPGVH

SEQ ID NO: 846349 - protein, 24 aa, Mycobacterium
PRAILVVSAHWYINATAVTAMPHP

SEQ ID NO: 846350 - protein, 18 aa, Mycobacterium
PRAIVAPIVGAFYKKLGG

SEQ ID NO: 846351 - protein, 23 aa, Mycobacterium
PRALKRMNTMMTKLALIRPRRVA

SEQ ID NO: 846352 - protein, 23 aa, Mycobacterium
PRALRLPLSRRLATLPLSATPEG

SEQ ID NO: 846353 - protein, 36 aa, Mycobacterium
PRALSKFRRDHVGFIFQFFNLIPTLTAKENVEVIVE

SEQ ID NO: 846354 - protein, 23 aa, Mycobacterium
PRARAFFLSMASGGGFLLYLQLH

SEQ ID NO: 846355 - protein, 21 aa, Mycobacterium
PRARELYADWPVIAADAVAGF

SEQ ID NO: 846356 - protein, 23 aa, Mycobacterium
PRARKQFMLDDVRPTVVLATADA

SEQ ID NO: 846357 - protein, 22 aa, Mycobacterium
PRARLIFNVPRPETMARHLREA

SEQ ID NO: 846358 - protein, 24 aa, Mycobacterium
PRATIALCRTARALALLRGRDHVV

SEQ ID NO: 846359 - protein, 22 aa, Mycobacterium
PRAVGVAFAIARARKLGVPCAW

SEQ ID NO: 846360 - protein, 20 aa, Mycobacterium
PRAVHVVPAGWLPKTSSGKL

SEQ ID NO: 846361 - protein, 17 aa, Mycobacterium
PRAVLQAIFQALAPRPS

SEQ ID NO: 846362 - protein, 18 aa, Mycobacterium
PRAVQFLDSLPLNATGKV

SEQ ID NO: 846363 - protein, 25 aa, Mycobacterium
PRAVQYLFRRQLASTPTEYIRRVRL

SEQ ID NO: 846364 - protein, 23 aa, Mycobacterium
PRAVVWLMVRPLANSIAAGEMFA

SEQ ID NO: 846365 - protein, 18 aa, Mycobacterium
PRCTVADPTLFSHRRDAP

SEQ ID NO: 846366 - protein, 26 aa, Mycobacterium
PRCTVADPTLFSHRRGAPTGRLASLV

SEQ ID NO: 846367 - protein, 36 aa, Mycobacterium
PRDAPWFPKDVPAWSVRWVILHVINELARHAGHADI

SEQ ID NO: 846368 - protein, 22 aa, Mycobacterium
PRDARLGSVGKLLPGLEGKIAD

SEQ ID NO: 846369 - protein, 23 aa, Mycobacterium
PRDARLGSVGKLLPGLEGRIAED

SEQ ID NO: 846370 - protein, 17 aa, Mycobacterium
PRDFAVYDTTRPYSLAF

SEQ ID NO: 846371 - protein, 19 aa, Mycobacterium
PRDFTLWKGAKPGEPSWPT

SEQ ID NO: 846372 - protein, 37 aa, Mycobacterium
PRDGVLLLSRFSFRVRYLWFRAWVNSPAGARLGLVPI

SEQ ID NO: 846373 - protein, 23 aa, Mycobacterium
PRDGWTLVSWNGKPVWPGWAAKR

SEQ ID NO: 846374 - protein, 27 aa, Mycobacterium
PRDHQHPLPFLLLVRGSVRARAVVNSD

SEQ ID NO: 846375 - protein, 18 aa, Mycobacterium
PRDISNAVLFLASDEARY

SEQ ID NO: 846376 - protein, 24 aa, Mycobacterium
PRDKRMEIALTYIYGVGRTRSNEI

SEQ ID NO: 846377 - protein, 25 aa, Mycobacterium
PRDLCALWPVPATSVPHAASPAAPG

SEQ ID NO: 846378 - protein, 25 aa, Mycobacterium
PRDLCALWPVPPTSAPHAAPAMAPG

SEQ ID NO: 846379 - protein, 19 aa, Mycobacterium
PRDLNQLITDWLGVGRRIP

SEQ ID NO: 846380 - protein, 20 aa, Mycobacterium
PRDMSSLRRISYGSAPVPPG

SEQ ID NO: 846381 - protein, 26 aa, Mycobacterium
PRDPDLAYEFLRPELRTIQPYGVQVD

SEQ ID NO: 846382 - protein, 22 aa, Mycobacterium
PRDPLLRLSNFFDEGSVELLHE

SEQ ID NO: 846383 - protein, 24 aa, Mycobacterium
PRDRMPVLYCKTGVRSAQALAVLK

SEQ ID NO: 846384 - protein, 22 aa, Mycobacterium
PRDRVDALLDPGSPFLELSPLA

SEQ ID NO: 846385 - protein, 26 aa, Mycobacterium
PRDSSAVPVLLVPPLAASATCYDLAP

SEQ ID NO: 846386 - protein, 30 aa, Mycobacterium
PRDTLLPPDLFNRFIHDAFWRDPERIPAGL

SEQ ID NO: 846387 - protein, 28 aa, Mycobacterium
PRDVEVRSLPWSYTITTRLPAVFANVVA

SEQ ID NO: 846388 - protein, 30 aa, Mycobacterium
PRDVGQLGGLHFFLVVFPQSGRVVNGLVNW

SEQ ID NO: 846389 - protein, 17 aa, Mycobacterium
PRDYLLVATPGAGKTTF

SEQ ID NO: 846390 - protein, 18 aa, Mycobacterium
PREAAPPTTARPAGMPPW

SEQ ID NO: 846391 - protein, 20 aa, Mycobacterium
PREAEWLDVPHRRPLLAITR

SEQ ID NO: 846392 - protein, 21 aa, Mycobacterium
PREALRRWMDRYASFVAAKRG

SEQ ID NO: 846393 - protein, 26 aa, Mycobacterium
PREAQNRIRRLLRLSATNTLDAQLDL

SEQ ID NO: 846394 - protein, 24 aa, Mycobacterium
PREDLDLFRRLSFDLISIPTDIVA

SEQ ID NO: 846395 - protein, 17 aa, Mycobacterium
PREEFDAWLIEQAGSPV

SEQ ID NO: 846396 - protein, 35 aa, Mycobacterium
PREFLGAQYDAGLAWVHLPRGFGGLDLPRKAQELV

SEQ ID NO: 846397 - protein, 19 aa, Mycobacterium
PREFLRLITEHRVTFLTTV

SEQ ID NO: 846398 - protein, 26 aa, Mycobacterium
PREFTDACEILLLLKDNLAGHHRELV

SEQ ID NO: 846399 - protein, 17 aa, Mycobacterium
PREGVWSQWHSLAFDVS

SEQ ID NO: 846400 - protein, 34 aa, Mycobacterium
PREIGTALEAMRAIGVPVYLLPGNHDPLDASSVY

SEQ ID NO: 846401 - protein, 17 aa, Mycobacterium
PREKYIGLIMAPGGSTH

SEQ ID NO: 846402 - protein, 25 aa, Mycobacterium
PRELAGWLAAALTKADGIASAEVAG

SEQ ID NO: 846403 - protein, 21 aa, Mycobacterium
PRELGGWAAPLPTALSVYEKF

SEQ ID NO: 846404 - protein, 22 aa, Mycobacterium
PRELHLLDELPRRGIGKLDRRA

SEQ ID NO: 846405 - protein, 22 aa, Mycobacterium
PRELTAHWDRWPTSVTWSADGS

SEQ ID NO: 846406 - protein, 26 aa, Mycobacterium
PRELVLDAYLLRAMGVAGWAPALIEC

SEQ ID NO: 846407 - protein, 25 aa, Mycobacterium
PREPDFAYNFLKVEWRTIQHYGVQV

SEQ ID NO: 846408 - protein, 18 aa, Mycobacterium
PRERFSTLKARLGDAFEV

SEQ ID NO: 846409 - protein, 21 aa, Mycobacterium
PRERIDELRRLVGPWGEVHET

SEQ ID NO: 846410 - protein, 27 aa, Mycobacterium
PRERIPAVFDWLYSWFSEPDYRGCAFI

SEQ ID NO: 846411 - protein, 26 aa, Mycobacterium
PRERLALMMALLARPRLWKLERAMRE

SEQ ID NO: 846412 - protein, 20 aa, Mycobacterium
PRERLMARLAGEAGLRRAEV

SEQ ID NO: 846413 - protein, 23 aa, Mycobacterium
PRESLIRLQLRDAGLPRAQTQVP

SEQ ID NO: 846414 - protein, 25 aa, Mycobacterium
PRETGRLWGRHILNSAVLGELLEAG

SEQ ID NO: 846415 - protein, 28 aa, Mycobacterium
PRETRTRLLLFDAGFPRPTTQIPAVDER

SEQ ID NO: 846416 - protein, 18 aa, Mycobacterium
PREVCIGLSPAWGRSVWL

SEQ ID NO: 846417 - protein, 19 aa, Mycobacterium
PREVELLKVTLRLLQEHGY

SEQ ID NO: 846418 - protein, 21 aa, Mycobacterium
PREVLGILHAVLFAPEDLSLV

SEQ ID NO: 846419 - protein, 19 aa, Mycobacterium
PREVLVVEQLLTTLHLPML

SEQ ID NO: 846420 - protein, 24 aa, Mycobacterium
PREVVHLALRTLLAEAGENGGGDD

SEQ ID NO: 846421 - protein, 29 aa, Mycobacterium
PRFADELAWWVYICWREGLCRIDPGDLKW

SEQ ID NO: 846422 - protein, 29 aa, Mycobacterium
PRFAEEIAWWVWWCWDQQLRKIEPSLLAW

SEQ ID NO: 846423 - protein, 19 aa, Mycobacterium
PRFALAGSYALWAYGAPEP

SEQ ID NO: 846424 - protein, 21 aa, Mycobacterium
PRFHSKIVELNLLAPLLVSQH

SEQ ID NO: 846425 - protein, 17 aa, Mycobacterium
PRFIAIPESPRPVVQIP

SEQ ID NO: 846426 - protein, 30 aa, Mycobacterium
PRFKTAATWPPTWKAWRRIRRYRPDVVIAE

SEQ ID NO: 846427 - protein, 21 aa, Mycobacterium
PRFLLHAPRYRDGTIERVRCP

SEQ ID NO: 846428 - protein, 19 aa, Mycobacterium
PRFLRLLGSWVGGGYTLPE

SEQ ID NO: 846429 - protein, 18 aa, Mycobacterium
PRFREHIPLMIGGSGEKK

SEQ ID NO: 846430 - protein, 19 aa, Mycobacterium
PRFSTRAESRWFAGAGFSL

SEQ ID NO: 846431 - protein, 17 aa, Mycobacterium
PRFYRPPPRPDVIATLD

SEQ ID NO: 846432 - protein, 24 aa, Mycobacterium
PRGADGLTLVPYLEGERSPNLPRA

SEQ ID NO: 846433 - protein, 24 aa, Mycobacterium
PRGALLQIAVGERPPLRQVLGGPS

SEQ ID NO: 846434 - protein, 23 aa, Mycobacterium
PRGAPFRLRVVRRPTVGYDGTAN

SEQ ID NO: 846435 - protein, 29 aa, Mycobacterium
PRGGPGMQEMLYPTAFLKGRGLGASCALI

SEQ ID NO: 846436 - protein, 25 aa, Mycobacterium
PRGGTLQLLRPLFSAGLGGRLGDGR

SEQ ID NO: 846437 - protein, 24 aa, Mycobacterium
PRGKKLLDVLLDAGIDAPYVCRES

SEQ ID NO: 846438 - protein, 24 aa, Mycobacterium
PRGLPQHLHVLAPGKKILHDDMLD

SEQ ID NO: 846439 - protein, 26 aa, Mycobacterium
PRGLSRYFRDYALRMRAYQIDSQSWQ

SEQ ID NO: 846440 - protein, 18 aa, Mycobacterium
PRGPDYWAVNLRGRVRFA

SEQ ID NO: 846441 - protein, 26 aa, Mycobacterium
PRGRARRKFGFYDQDLQPALWVRQGA

SEQ ID NO: 846442 - protein, 21 aa, Mycobacterium
PRGSAYHYFPGGRTQLLCEAV

SEQ ID NO: 846443 - protein, 22 aa, Mycobacterium
PRGSAYHYFPGGRTQLLCEAVD

SEQ ID NO: 846444 - protein, 25 aa, Mycobacterium
PRGTLRLLNVHRWSERTLIALVMQH

SEQ ID NO: 846445 - protein, 21 aa, Mycobacterium
PRGVFGISLTTRRRPPTASDA

SEQ ID NO: 846446 - protein, 32 aa, Mycobacterium
PRGVNRWAVSLAYLTDLLFARSVVSIGLASEE

SEQ ID NO: 846447 - protein, 17 aa, Mycobacterium
PRGYGLHRGLKLPRALM

SEQ ID NO: 846448 - protein, 25 aa, Mycobacterium
PRGYRDLIMLRGLTETGLLPYDPGS

SEQ ID NO: 846449 - protein, 22 aa, Mycobacterium
PRHAQFRRLLAPTTSPRALRAI

SEQ ID NO: 846450 - protein, 25 aa, Mycobacterium
PRHIDTPLLILTALRDRIVSSSASH

SEQ ID NO: 846451 - protein, 23 aa, Mycobacterium
PRHYDTLRRALLSTLRTSLGDSW

SEQ ID NO: 846452 - protein, 25 aa, Mycobacterium
PRIAAMGFDVVYLPPIHPIGKIHRK

SEQ ID NO: 846453 - protein, 24 aa, Mycobacterium
PRIAGMGFDVVYLPPIHPIGKVHR

SEQ ID NO: 846454 - protein, 20 aa, Mycobacterium
PRIAGPCGMVIFGVTGDLAR

SEQ ID NO: 846455 - protein, 18 aa, Mycobacterium
PRIALMAKALNTLGPRWV

SEQ ID NO: 846456 - protein, 18 aa, Mycobacterium
PRIAPQSPAFLTALLASA

SEQ ID NO: 846457 - protein, 25 aa, Mycobacterium
PRIARMGFNVVYLPPIHPIGKVHRK

SEQ ID NO: 846458 - protein, 25 aa, Mycobacterium
PRIATGPTVLTIRARPPGTTITEQQ

SEQ ID NO: 846459 - protein, 20 aa, Mycobacterium
PRIDGYCRWLGRSAAVWHGD

SEQ ID NO: 846460 - protein, 19 aa, Mycobacterium
PRIDPRYLSDPAGRDRAAM

SEQ ID NO: 846461 - protein, 19 aa, Mycobacterium
PRIEELLTADRVALRQLIT

SEQ ID NO: 846462 - protein, 21 aa, Mycobacterium
PRIFRELLPIGRDVTTAVLLD

SEQ ID NO: 846463 - protein, 25 aa, Mycobacterium
PRIGAYQRRGAVSTLLLVAQRVPYQ

SEQ ID NO: 846464 - protein, 20 aa, Mycobacterium
PRIGEFNLPAPLAAVSDLLL

SEQ ID NO: 846465 - protein, 19 aa, Mycobacterium
PRIGFVDGAWWPRGNDLSA

SEQ ID NO: 846466 - protein, 27 aa, Mycobacterium
PRIGHLPYLLTLPGHGFYWFQLTACEE

SEQ ID NO: 846467 - protein, 27 aa, Mycobacterium
PRIGHLPYLLTLPGHGFYWFRLSGCEE

SEQ ID NO: 846468 - protein, 24 aa, Mycobacterium
PRIGIPMAVVYGFAYLADAIGSVL

SEQ ID NO: 846469 - protein, 28 aa, Mycobacterium
PRIIRAGRHLAKPKRYIPGLPLDIEDDA

SEQ ID NO: 846470 - protein, 19 aa, Mycobacterium
PRIIRAGRHLARPKRYIPG

SEQ ID NO: 846471 - protein, 23 aa, Mycobacterium
PRIKARLAKLNPPPTRDIPVLIG

SEQ ID NO: 846472 - protein, 18 aa, Mycobacterium
PRIKSIAHLGVRTRDFAF

SEQ ID NO: 846473 - protein, 23 aa, Mycobacterium
PRIKTRLAKLNPAPTRDIPVLIG

SEQ ID NO: 846474 - protein, 25 aa, Mycobacterium
PRILDLLDDLGVGATFFIPGWVAEH

SEQ ID NO: 846475 - protein, 20 aa, Mycobacterium
PRILVNPTGKFVLGGPMGDA

SEQ ID NO: 846476 - protein, 35 aa, Mycobacterium
PRIPHALYRPTFVKSLVMVPIRKLEPIGAIGNYWA

SEQ ID NO: 846477 - protein, 19 aa, Mycobacterium
PRIRQWVIANPHRALALAA

SEQ ID NO: 846478 - protein, 27 aa, Mycobacterium
PRKEILPMRGLFTQTVALRLRSRDEVA

SEQ ID NO: 846479 - protein, 25 aa, Mycobacterium
PRKLREAADLWRRLTDAVGVDKRDA

SEQ ID NO: 846480 - protein, 17 aa, Mycobacterium
PRKQFPRRRIVAAYQIV

SEQ ID NO: 846481 - protein, 43 aa, Mycobacterium
PRKVVGVISPWNYPVALGYWDVIPALLAGCSVLLKPSERTPLS

SEQ ID NO: 846482 - protein, 19 aa, Mycobacterium
PRLAEAVRQLFVFQRTPST

SEQ ID NO: 846483 - protein, 26 aa, Mycobacterium
PRLAEEIFVLADLARQKARAAQHAFM

SEQ ID NO: 846484 - protein, 17 aa, Mycobacterium
PRLAFPTPSRRAVFHAR

SEQ ID NO: 846485 - protein, 27 aa, Mycobacterium
PRLAPARALTPPPTPHWRLITSGSGDL

SEQ ID NO: 846486 - protein, 17 aa, Mycobacterium
PRLARQCGRWGAIAIVA

SEQ ID NO: 846487 - protein, 20 aa, Mycobacterium
PRLARRYLMLEGHRALTELA

SEQ ID NO: 846488 - protein, 18 aa, Mycobacterium
PRLDGLALVAQLRADPRT

SEQ ID NO: 846489 - protein, 20 aa, Mycobacterium
PRLEIIRLVGTLDPGSDFET

SEQ ID NO: 846490 - protein, 20 aa, Mycobacterium
PRLELLIELLTGGSKAPAPV

SEQ ID NO: 846491 - protein, 18 aa, Mycobacterium
PRLFGLAYRLLGSASEAE

SEQ ID NO: 846492 - protein, 18 aa, Mycobacterium
PRLHAYSAKLNAALDKVK

SEQ ID NO: 846493 - protein, 18 aa, Mycobacterium
PRLIATVRSLLSGDGVTF

SEQ ID NO: 846494 - protein, 29 aa, Mycobacterium
PRLITDACEILLILKDNLAGRHRELVEHF

SEQ ID NO: 846495 - protein, 17 aa, Mycobacterium
PRLKLMHLAVRAMPGSG

SEQ ID NO: 846496 - protein, 26 aa, Mycobacterium
PRLKRGSRPVILSFGLLGPGKGVEHV

SEQ ID NO: 846497 - protein, 17 aa, Mycobacterium
PRLLVEYWAHEAALMAV

SEQ ID NO: 846498 - protein, 20 aa, Mycobacterium
PRLMSKWIEFAFGVSSPEAL

SEQ ID NO: 846499 - protein, 26 aa, Mycobacterium
PRLNADTLLPLLRQHAPSADLVVGMS

SEQ ID NO: 846500 - protein, 25 aa, Mycobacterium
PRLNRSVISALWWVHWRVTKNPEEA

SEQ ID NO: 846501 - protein, 19 aa, Mycobacterium
PRLPMLPDGWESDGGTAPD

SEQ ID NO: 846502 - protein, 19 aa, Mycobacterium
PRLPRRREAVDRRAEVVSG

SEQ ID NO: 846503 - protein, 21 aa, Mycobacterium
PRLRELVIMRIGWLTACDYEW

SEQ ID NO: 846504 - protein, 29 aa, Mycobacterium
PRLRMRHAPFRIGPIERDAWLRCMRTAVD

SEQ ID NO: 846505 - protein, 24 aa, Mycobacterium
PRLRPLVFRRGPHPRDGARCAGMD

SEQ ID NO: 846506 - protein, 27 aa, Mycobacterium
PRLRSRVAEIWRRGLFAGVPGTGGRHE

SEQ ID NO: 846507 - protein, 20 aa, Mycobacterium
PRLRVVHVLSQPASAWPGET

SEQ ID NO: 846508 - protein, 42 aa, Mycobacterium
PRLTKAFLRFSNHLLFRSTLDPRLRELAILRIARRRNCEYEW

SEQ ID NO: 846509 - protein, 28 aa, Mycobacterium
PRLWLLGSSMYSAHLAAAKGLPYVFAHH

SEQ ID NO: 846510 - protein, 25 aa, Mycobacterium
PRMIGVLRGFDPDVVHLASPALLGY

SEQ ID NO: 846511 - protein, 18 aa, Mycobacterium
PRMPLVSEITALLRAGFY

SEQ ID NO: 846512 - protein, 19 aa, Mycobacterium
PRMRGVLALFEGVATGAAD

SEQ ID NO: 846513 - protein, 19 aa, Mycobacterium
PRMVAYTLAALVGQLAHRR

SEQ ID NO: 846514 - protein, 19 aa, Mycobacterium
PRMVMVRMPAFGLDGPWRN

SEQ ID NO: 846515 - protein, 44 aa, Mycobacterium
PRNAVAFAPMIFLGREFWTEKLPVLPVLQALFVGGKKLAPEDFD

SEQ ID NO: 846516 - protein, 17 aa, Mycobacterium
PRNDRWQALARLAIRDD

SEQ ID NO: 846517 - protein, 23 aa, Mycobacterium
PRNFARRGIRSYVLPSSASFDQV

SEQ ID NO: 846518 - protein, 25 aa, Mycobacterium
PRNGRTWPPTAWSFDGTTPTPPDWP

SEQ ID NO: 846519 - protein, 20 aa, Mycobacterium
PRNPYLEGFLAPVRAEVTAT

SEQ ID NO: 846520 - protein, 22 aa, Mycobacterium
PRNSRVLLLWGAANRDPAHFDA

SEQ ID NO: 846521 - protein, 28 aa, Mycobacterium
PRNWETFHMAQLIPWIEANFRTYAEYDG

SEQ ID NO: 846522 - protein, 24 aa, Mycobacterium
PRPAKLHPFVALHGPRHTAPATPG

SEQ ID NO: 846523 - protein, 22 aa, Mycobacterium
PRPDLILLDLNLPKYDGRQLLE

SEQ ID NO: 846524 - protein, 22 aa, Mycobacterium
PRPEHQVVVFGAGPIGLGATLA

SEQ ID NO: 846525 - protein, 25 aa, Mycobacterium
PRPGELCAPVRFLVREDTVVMELTA

SEQ ID NO: 846526 - protein, 24 aa, Mycobacterium
PRPGKTVLFLGRYDEPRKGMSVLL

SEQ ID NO: 846527 - protein, 17 aa, Mycobacterium
PRPGYLPRIIGGAVHHG

SEQ ID NO: 846528 - protein, 25 aa, Mycobacterium
PRPIRDSLYRLVARTRYRVFGRYDT

SEQ ID NO: 846529 - protein, 19 aa, Mycobacterium
PRPPEERRIIRRKSFSMVP

SEQ ID NO: 846530 - protein, 19 aa, Mycobacterium
PRPQGPASFLFLDPPDHTR

SEQ ID NO: 846531 - protein, 28 aa, Mycobacterium
PRPQSADELLRLAPNVWPRNIARDDTGV

SEQ ID NO: 846532 - protein, 17 aa, Mycobacterium
PRPRALATLDAALHSGL

SEQ ID NO: 846533 - protein, 36 aa, Mycobacterium
PRPRPTPLPLSFAQSRLWFIYKYEGPSATYNVPLAV

SEQ ID NO: 846534 - protein, 18 aa, Mycobacterium
PRPRPTVPVGEYAEVLLY

SEQ ID NO: 846535 - protein, 22 aa, Mycobacterium
PRPRRPRCPRSRPGTPAANSAA

SEQ ID NO: 846536 - protein, 20 aa, Mycobacterium
PRPVHPAPVGRRRGHLRVLP

SEQ ID NO: 846537 - protein, 26 aa, Mycobacterium
PRQEDIVNRWTWIPFGAGRHRCVGAA

SEQ ID NO: 846538 - protein, 17 aa, Mycobacterium
PRQELGRSLILNGHIDV

SEQ ID NO: 846539 - protein, 21 aa, Mycobacterium
PRQIQFYCVDMGGGGLIYVED

SEQ ID NO: 846540 - protein, 19 aa, Mycobacterium
PRQLAFLEGISFLDRFTAD

SEQ ID NO: 846541 - protein, 19 aa, Mycobacterium
PRQLRRWHPGYGIVLTGPS

SEQ ID NO: 846542 - protein, 19 aa, Mycobacterium
PRQMAGTSYWYAHTDQWRY

SEQ ID NO: 846543 - protein, 23 aa, Mycobacterium
PRQMPGLWTIPHTTPGKSQIGGA

SEQ ID NO: 846544 - protein, 18 aa, Mycobacterium
PRQNAALLAAWRERPQAT

SEQ ID NO: 846545 - protein, 18 aa, Mycobacterium
PRQPLQLMRQRVLSVFPV

SEQ ID NO: 846546 - protein, 21 aa, Mycobacterium
PRQRHRWLLEQVSFIAAIEHY

SEQ ID NO: 846547 - protein, 24 aa, Mycobacterium
PRQRLALELAWELFEDARIVAESV

SEQ ID NO: 846548 - protein, 21 aa, Mycobacterium
PRQRLALELAWELLEDAFIVP

SEQ ID NO: 846549 - protein, 39 aa, Mycobacterium
PRQSVTVIGIDLLYLGPITIPQINITGPVLSFEIGPATL

SEQ ID NO: 846550 - protein, 23 aa, Mycobacterium
PRQTLWQAWNRSGLQKRWLAAAE

SEQ ID NO: 846551 - protein, 24 aa, Mycobacterium
PRQVPGLWTIPHTAAGKSQIGGAS

SEQ ID NO: 846552 - protein, 18 aa, Mycobacterium
PRQVVTPVTLPLLRRASR

SEQ ID NO: 846553 - protein, 20 aa, Mycobacterium
PRQVYSWDITKLAGPVKGVY

SEQ ID NO: 846554 - protein, 36 aa, Mycobacterium
PRQWLEIRYLDSVPDTFWPALAFMVVTLLDDPAAAE

SEQ ID NO: 846555 - protein, 23 aa, Mycobacterium
PRRARVTLRMLLTHTSGIAGDLS

SEQ ID NO: 846556 - protein, 29 aa, Mycobacterium
PRRFATDLLERFRDLILLQAVPDAAARGV

SEQ ID NO: 846557 - protein, 24 aa, Mycobacterium
PRRGRFLPPIDLPRRMFAGGEIEL

SEQ ID NO: 846558 - protein, 17 aa, Mycobacterium
PRRGVPIRVMAAAAGLS

SEQ ID NO: 846559 - protein, 18 aa, Mycobacterium
PRRKAALIPAARNAILPP

SEQ ID NO: 846560 - protein, 27 aa, Mycobacterium
PRRLRELIVLRTAYLMDCAYELGQHRD

SEQ ID NO: 846561 - protein, 23 aa, Mycobacterium
PRRPYVSIAIAHGIRRFEFMIHP

SEQ ID NO: 846562 - protein, 27 aa, Mycobacterium
PRRQTTLAKLAALRPVFRAGGIVTAGS

SEQ ID NO: 846563 - protein, 18 aa, Mycobacterium
PRRRTILLAAPLGRMISP

SEQ ID NO: 846564 - protein, 17 aa, Mycobacterium
PRRRTTPRKGDLREAAI

SEQ ID NO: 846565 - protein, 17 aa, Mycobacterium
PRRSFTIVGDLAQRRSP

SEQ ID NO: 846566 - protein, 35 aa, Mycobacterium
PRRTNNPWIRFHVPRQWPPWRLVAGIPTTTIAQTI

SEQ ID NO: 846567 - protein, 24 aa, Mycobacterium
PRRVLDPAIYREAALRLDRHFTIS

SEQ ID NO: 846568 - protein, 25 aa, Mycobacterium
PRRVPADRLVRVLGLLPGNPRIGAG

SEQ ID NO: 846569 - protein, 19 aa, Mycobacterium
PRRVVTEVPLWSTRVARWL

SEQ ID NO: 846570 - protein, 17 aa, Mycobacterium
PRRWGRIDYRTLNRRAR

SEQ ID NO: 846571 - protein, 26 aa, Mycobacterium
PRRWPGQAPEGVFLLRTVEDCLTIRE

SEQ ID NO: 846572 - protein, 21 aa, Mycobacterium
PRRYDTFFFVAALPAGQDADG

SEQ ID NO: 846573 - protein, 31 aa, Mycobacterium
PRRYGVRWHYRVPVWSEFVEVHWSRWGEAYV

SEQ ID NO: 846574 - protein, 26 aa, Mycobacterium
PRSAGTAILFLLMPGQESAWHTVRSA

SEQ ID NO: 846575 - protein, 28 aa, Mycobacterium
PRSAGTAILFLLMPGQQSAWHTVRSAEL

SEQ ID NO: 846576 - protein, 24 aa, Mycobacterium
PRSARDFWALTRWFRAGDYVFEAP

SEQ ID NO: 846577 - protein, 20 aa, Mycobacterium
PRSDILAFTLPGFATGERTK

SEQ ID NO: 846578 - protein, 17 aa, Mycobacterium
PRSEHLAWKIAQVAADP

SEQ ID NO: 846579 - protein, 19 aa, Mycobacterium
PRSGVPQVIFYAEPERQEK

SEQ ID NO: 846580 - protein, 21 aa, Mycobacterium
PRSIGLVDHTGACAALAAGLC

SEQ ID NO: 846581 - protein, 30 aa, Mycobacterium
PRSLLTEGILPPELLFAHPGYVRAANGIEV

SEQ ID NO: 846582 - protein, 17 aa, Mycobacterium
PRSLVWSAAWEMTREAE

SEQ ID NO: 846583 - protein, 19 aa, Mycobacterium
PRSVEFLDVLPLNATGKVV

SEQ ID NO: 846584 - protein, 20 aa, Mycobacterium
PRSVLRPGAFTPAVLGAGMR

SEQ ID NO: 846585 - protein, 23 aa, Mycobacterium
PRSWWSDAVFYQVYPRSFADSDG

SEQ ID NO: 846586 - protein, 19 aa, Mycobacterium
PRTAAVPVLLLSARAGQEA

SEQ ID NO: 846587 - protein, 24 aa, Mycobacterium
PRTAGPAVLLRQTSFRALAEPRLF

SEQ ID NO: 846588 - protein, 26 aa, Mycobacterium
PRTEEWGRLIIPHTPAAPARAKTVLE

SEQ ID NO: 846589 - protein, 23 aa, Mycobacterium
PRTEFRLPVLHATDYPRLPVMGS

SEQ ID NO: 846590 - protein, 21 aa, Mycobacterium
PRTELRLFGKPESFITRRMGV

SEQ ID NO: 846591 - protein, 32 aa, Mycobacterium
PRTEWDRVIGINLTATFLVAKAALARMIEQPR

SEQ ID NO: 846592 - protein, 23 aa, Mycobacterium
PRTFSRYFATKDAIALALIDEVL

SEQ ID NO: 846593 - protein, 25 aa, Mycobacterium
PRTGEREWFDLCRGPHIPTTKHIPA

SEQ ID NO: 846594 - protein, 19 aa, Mycobacterium
PRTGLVERALIAAYAGGLT

SEQ ID NO: 846595 - protein, 27 aa, Mycobacterium
PRTIAAERLIRVLQLVPKNPRLGARPR

SEQ ID NO: 846596 - protein, 18 aa, Mycobacterium
PRTLAWSAAWEMTRDAEL

SEQ ID NO: 846597 - protein, 18 aa, Mycobacterium
PRTLAWSAAWEMTREAEL

SEQ ID NO: 846598 - protein, 30 aa, Mycobacterium
PRTLRAYGYDLLAFCRWLGSVDVELSSVTT

SEQ ID NO: 846599 - protein, 29 aa, Mycobacterium
PRTPCRTFSAFLGLSHWIHTFTQAGKPGA

SEQ ID NO: 846600 - protein, 25 aa, Mycobacterium
PRTPRHGFFLLSLQRDVDATLSALA

SEQ ID NO: 846601 - protein, 23 aa, Mycobacterium
PRTQFLHCNDVVPTIYQVVGIEA

SEQ ID NO: 846602 - protein, 28 aa, Mycobacterium
PRTRAGLGPFDDAWRTQMSFVIAVPDFI

SEQ ID NO: 846603 - protein, 28 aa, Mycobacterium
PRTRFNRRIGPHRRFAFASVPLADVKAV

SEQ ID NO: 846604 - protein, 19 aa, Mycobacterium
PRTRFSYKLTRRRAPSDPT

SEQ ID NO: 846605 - protein, 19 aa, Mycobacterium
PRTRSLVLVSYRPEYRGTL

SEQ ID NO: 846606 - protein, 25 aa, Mycobacterium
PRTSVPMLLSLYQAGAVKLDELVTR

SEQ ID NO: 846607 - protein, 20 aa, Mycobacterium
PRTTVGWKGLINDPAMDGSF

SEQ ID NO: 846608 - protein, 28 aa, Mycobacterium
PRVAHAQWLLNRLAPTGLNRLASRFLAA

SEQ ID NO: 846609 - protein, 27 aa, Mycobacterium
PRVARMNFDIVYLPPIHPIGKVHRKGR

SEQ ID NO: 846610 - protein, 17 aa, Mycobacterium
PRVAVALYGLLDALLFR

SEQ ID NO: 846611 - protein, 25 aa, Mycobacterium
PRVCDMFFLRYRKELDQRAGDGLTA

SEQ ID NO: 846612 - protein, 24 aa, Mycobacterium
PRVDAVIFLLRSLNAADIGLLTQI

SEQ ID NO: 846613 - protein, 23 aa, Mycobacterium
PRVDGPQVLLRQTSFRALAEPRR

SEQ ID NO: 846614 - protein, 25 aa, Mycobacterium
PRVDIQMPIAVDPEWDRPGRAVTNR

SEQ ID NO: 846615 - protein, 28 aa, Mycobacterium
PRVDLSRTVGWFTTKYPVALTPGRLSWS

SEQ ID NO: 846616 - protein, 18 aa, Mycobacterium
PRVEPELVFVMKERLSGP

SEQ ID NO: 846617 - protein, 19 aa, Mycobacterium
PRVEVEVGFILNADLPGAG

SEQ ID NO: 846618 - protein, 18 aa, Mycobacterium
PRVEVEVGFILSDDLPGA

SEQ ID NO: 846619 - protein, 29 aa, Mycobacterium
PRVHLFFGGRFPCDLYDLKTLWTIASTNP

SEQ ID NO: 846620 - protein, 20 aa, Mycobacterium
PRVHWKILDAWQAAAAQVGI

SEQ ID NO: 846621 - protein, 25 aa, Mycobacterium
PRVITDACEILLILKDNLAGHHREL

SEQ ID NO: 846622 - protein, 18 aa, Mycobacterium
PRVIWGLAPGASGSKARP

SEQ ID NO: 846623 - protein, 25 aa, Mycobacterium
PRVKVPALLRGYLRLGAQVCGEPAH

SEQ ID NO: 846624 - protein, 20 aa, Mycobacterium
PRVLPWQECPGAVASAARIT

SEQ ID NO: 846625 - protein, 18 aa, Mycobacterium
PRVLQFKPGLLLNRDLCE

SEQ ID NO: 846626 - protein, 19 aa, Mycobacterium
PRVLRLAARRSAGAHPYLT

SEQ ID NO: 846627 - protein, 18 aa, Mycobacterium
PRVNPWTTPIPKAYLCSS

SEQ ID NO: 846628 - protein, 24 aa, Mycobacterium
PRVNRPIVDFSLTHSYVAAPVMPT

SEQ ID NO: 846629 - protein, 25 aa, Mycobacterium
PRVQWLAAARRALTAAPYDAFGYGD

SEQ ID NO: 846630 - protein, 18 aa, Mycobacterium
PRVRRDLASALRSAAAGL

SEQ ID NO: 846631 - protein, 24 aa, Mycobacterium
PRVRWRAMLELLRDEGFGVQPPRR

SEQ ID NO: 846632 - protein, 23 aa, Mycobacterium
PRVSPFPAVFQDVSLVVPADVPA

SEQ ID NO: 846633 - protein, 23 aa, Mycobacterium
PRVSPFPAVFQDVSLVVSADVPA

SEQ ID NO: 846634 - protein, 34 aa, Mycobacterium
PRVSPLAYFDIDGKLIVIGSFAGAPVSPAWVHNL

SEQ ID NO: 846635 - protein, 17 aa, Mycobacterium
PRVSPLLYLHDGDRIAL

SEQ ID NO: 846636 - protein, 27 aa, Mycobacterium
PRVVHGEQFFKFHRPIKPGDTLVAKSK

SEQ ID NO: 846637 - protein, 19 aa, Mycobacterium
PRVVLVGIPTRGATLAKRL

SEQ ID NO: 846638 - protein, 22 aa, Mycobacterium
PRVWFGERWIDSILDLFKENVR

SEQ ID NO: 846639 - protein, 20 aa, Mycobacterium
PRVYEHLYGEPFPSGVQTAE

SEQ ID NO: 846640 - protein, 22 aa, Mycobacterium
PRVYQLLYGEPFPEGVQTAENL

SEQ ID NO: 846641 - protein, 18 aa, Mycobacterium
PRWAATADWLGAPYVPAP

SEQ ID NO: 846642 - protein, 17 aa, Mycobacterium
PRWGTSLATGWASIHGF

SEQ ID NO: 846643 - protein, 17 aa, Mycobacterium
PRWSKLADMFTPDGPEA

SEQ ID NO: 846644 - protein, 19 aa, Mycobacterium
PRYAAFFEQTYRLLPRDGR

SEQ ID NO: 846645 - protein, 32 aa, Mycobacterium
PRYAELIKRTQWWGRQMLIWGVHVHVGISSAN

SEQ ID NO: 846646 - protein, 31 aa, Mycobacterium
PRYAELIKRTQWWGRQMLIWGVHVHVGVSSA

SEQ ID NO: 846647 - protein, 20 aa, Mycobacterium
PRYAPYVIADKVSGLYIVIA

SEQ ID NO: 846648 - protein, 29 aa, Mycobacterium
PRYLADLRDFCRRHEVLLIFDEIATGFGR

SEQ ID NO: 846649 - protein, 25 aa, Mycobacterium
PRYLHMLADYQLLAREQLICATHVH

SEQ ID NO: 846650 - protein, 21 aa, Mycobacterium
PRYQIVMGERRWRAAQEAGLA

SEQ ID NO: 846651 - protein, 20 aa, Mycobacterium
PRYVEFLEELPLNATGKVMK

SEQ ID NO: 846652 - protein, 27 aa, Mycobacterium
PSAAGYALAARLLLPAVAHALGEWTGG

SEQ ID NO: 846653 - protein, 20 aa, Mycobacterium
PSAAPYRNFVTWLGAQDRDA

SEQ ID NO: 846654 - protein, 23 aa, Mycobacterium
PSADLILLYLIQHCPDLSVDAAS

SEQ ID NO: 846655 - protein, 24 aa, Mycobacterium
PSADPVFIKQLLDIGAQNIIVPMI

SEQ ID NO: 846656 - protein, 28 aa, Mycobacterium
PSAEQRPRRFAYPPNLFVVDGGAPQVNA

SEQ ID NO: 846657 - protein, 18 aa, Mycobacterium
PSAEYPCVLITGRTVYHF

SEQ ID NO: 846658 - protein, 28 aa, Mycobacterium
PSAFDTIIEMWLPLAWSLNMVNRSMGHD

SEQ ID NO: 846659 - protein, 28 aa, Mycobacterium
PSAFPAIIDMWLPLSWSLNMVNRSMGHD

SEQ ID NO: 846660 - protein, 24 aa, Mycobacterium
PSAFTRRGSLLPSGPRRRYAAQTS

SEQ ID NO: 846661 - protein, 23 aa, Mycobacterium
PSAGFFILGPTMAQSLYAEGNEE

SEQ ID NO: 846662 - protein, 22 aa, Mycobacterium
PSAIGPLRRALSVSPASLWPTV

SEQ ID NO: 846663 - protein, 17 aa, Mycobacterium
PSAIVWAAQMGTITLHP

SEQ ID NO: 846664 - protein, 32 aa, Mycobacterium
PSALAQPLRAVLLALAFEWGVALHGLYAVRDR

SEQ ID NO: 846665 - protein, 24 aa, Mycobacterium
PSALRPILDAWLFTIDDDARQQGA

SEQ ID NO: 846666 - protein, 29 aa, Mycobacterium
PSALTLDDVVKFLLPRGATKKAAKGAATT

SEQ ID NO: 846667 - protein, 25 aa, Mycobacterium
PSALYNIPLALRLSGGLDVQALSHA

SEQ ID NO: 846668 - protein, 23 aa, Mycobacterium
PSANFFCLGPLMAQALYIEGNEQ

SEQ ID NO: 846669 - protein, 17 aa, Mycobacterium
PSANPLVNLAVGPLQFD

SEQ ID NO: 846670 - protein, 29 aa, Mycobacterium
PSANPYLASAAILGLALDGIKRRAPLPPE

SEQ ID NO: 846671 - protein, 21 aa, Mycobacterium
PSAPDWHRKEWEPFWAAAEEA

SEQ ID NO: 846672 - protein, 21 aa, Mycobacterium
PSAQRTPLLFQAGASARGVRF

SEQ ID NO: 846673 - protein, 17 aa, Mycobacterium
PSARAARVVVPDFQLSL

SEQ ID NO: 846674 - protein, 22 aa, Mycobacterium
PSARARIGLSRFLPGGGAEMDV

SEQ ID NO: 846675 - protein, 26 aa, Mycobacterium
PSARNRVMFGPPGRLYTYRSHGIHVC

SEQ ID NO: 846676 - protein, 22 aa, Mycobacterium
PSARPPAEVFLPGESTNQIPRP

SEQ ID NO: 846677 - protein, 26 aa, Mycobacterium
PSARSAWPRHLLPALTTAGFATELRN

SEQ ID NO: 846678 - protein, 23 aa, Mycobacterium
PSARTLVIIPTYNERDNLLSIVS

SEQ ID NO: 846679 - protein, 26 aa, Mycobacterium
PSASFGTLWIKSPANMLGYWSNPQRT

SEQ ID NO: 846680 - protein, 23 aa, Mycobacterium
PSASLMIRMRRLSDRFVRVRNTR

SEQ ID NO: 846681 - protein, 25 aa, Mycobacterium
PSASLWLAELWKEAGLPDGVFNVLQ

SEQ ID NO: 846682 - protein, 24 aa, Mycobacterium
PSASLWMAELWKEAGLPDGVFNVL

SEQ ID NO: 846683 - protein, 18 aa, Mycobacterium
PSASTPHERWLRAVAAGG

SEQ ID NO: 846684 - protein, 17 aa, Mycobacterium
PSASWMLEYYPIRELRE

SEQ ID NO: 846685 - protein, 27 aa, Mycobacterium
PSATAMVQAFQPYLAWLHTTAAQCQEI

SEQ ID NO: 846686 - protein, 31 aa, Mycobacterium
PSATLRVAPSASWMFEYYPIRELRQLADGSC

SEQ ID NO: 846687 - protein, 22 aa, Mycobacterium
PSAWSVEGLLPYLTADAQDALF

SEQ ID NO: 846688 - protein, 20 aa, Mycobacterium
PSCRFWNLVVWNQFMATCGA

SEQ ID NO: 846689 - protein, 24 aa, Mycobacterium
PSDAEWLVPFDGDGHWDLCLDYRR

SEQ ID NO: 846690 - protein, 17 aa, Mycobacterium
PSDAVGISGMKAWRAVL

SEQ ID NO: 846691 - protein, 23 aa, Mycobacterium
PSDAVYYPLYAKCAELDLPLCIN

SEQ ID NO: 846692 - protein, 22 aa, Mycobacterium
PSDAVYYPLYTKCAELDLPLCV

SEQ ID NO: 846693 - protein, 24 aa, Mycobacterium
PSDDEPLRLIWCGRLSPEKRVLEA

SEQ ID NO: 846694 - protein, 37 aa, Mycobacterium
PSDDVPAYRRWLGTRLPYYANWIRLKSYWGTSDNNYP

SEQ ID NO: 846695 - protein, 21 aa, Mycobacterium
PSDFLHGRWLVLRRGKRNIAG

SEQ ID NO: 846696 - protein, 24 aa, Mycobacterium
PSDFYDQLYKLLGLEQLTDAINLL

SEQ ID NO: 846697 - protein, 27 aa, Mycobacterium
PSDGIEQLIFAPRGPLAEVRARRAIAL

SEQ ID NO: 846698 - protein, 25 aa, Mycobacterium
PSDGITYLLIPMKSPGITVRPLRDI

SEQ ID NO: 846699 - protein, 18 aa, Mycobacterium
PSDITIAAVFPDGPQRYF

SEQ ID NO: 846700 - protein, 19 aa, Mycobacterium
PSDLAYTLARRRSHQPVRA

SEQ ID NO: 846701 - protein, 18 aa, Mycobacterium
PSDLEYDRYLWLLEEMKT

SEQ ID NO: 846702 - protein, 23 aa, Mycobacterium
PSDLTVFALHRRATADGAGELVD

SEQ ID NO: 846703 - protein, 28 aa, Mycobacterium
PSDLVFNDFLIAVARMRALDPVTSELVR

SEQ ID NO: 846704 - protein, 25 aa, Mycobacterium
PSDMFGELAIFDPGPRTSSVTALTA

SEQ ID NO: 846705 - protein, 24 aa, Mycobacterium
PSDMFGELAIFDPGPRTSTVTALS

SEQ ID NO: 846706 - protein, 22 aa, Mycobacterium
PSDMKGLWGFVPACSTPDAADV

SEQ ID NO: 846707 - protein, 22 aa, Mycobacterium
PSDMTVFALYRQAERDGTGQLG

SEQ ID NO: 846708 - protein, 25 aa, Mycobacterium
PSDPTIYRLYEALSVYGPAIKEAIH

SEQ ID NO: 846709 - protein, 17 aa, Mycobacterium
PSDPYWADLARMLALDS

SEQ ID NO: 846710 - protein, 17 aa, Mycobacterium
PSDRFMDMIKQPPVTIG

SEQ ID NO: 846711 - protein, 25 aa, Mycobacterium
PSDTALVFMHPIGGGAYLPMINALA

SEQ ID NO: 846712 - protein, 24 aa, Mycobacterium
PSDTVLVFMHPIGGGAYLPMINGL

SEQ ID NO: 846713 - protein, 24 aa, Mycobacterium
PSDVAYTLLRTRRLRRHRAVIRAG

SEQ ID NO: 846714 - protein, 24 aa, Mycobacterium
PSDVLDVLTFCDLTTGPDGAPVSP

SEQ ID NO: 846715 - protein, 21 aa, Mycobacterium
PSDVLQCYLDLVLDGLVARLA

SEQ ID NO: 846716 - protein, 22 aa, Mycobacterium
PSEHWTVVRIALPETLARYVVQ

SEQ ID NO: 846717 - protein, 23 aa, Mycobacterium
PSEITLRTWVGQSCPAYATSSGK

SEQ ID NO: 846718 - protein, 21 aa, Mycobacterium
PSELAPLAALRFGELCLVAGL

SEQ ID NO: 846719 - protein, 24 aa, Mycobacterium
PSELCSFPLRQCGSGNLFGGNEPA

SEQ ID NO: 846720 - protein, 24 aa, Mycobacterium
PSELDILLDRRLSASDAAERIGCV

SEQ ID NO: 846721 - protein, 25 aa, Mycobacterium
PSELPAPHHRPYWGLHGVFPASMGR

SEQ ID NO: 846722 - protein, 20 aa, Mycobacterium
PSELTPLTALATQALIARAA

SEQ ID NO: 846723 - protein, 34 aa, Mycobacterium
PSEQSLVERLIPDFLWIDTEYTAKLSLDGLEHNK

SEQ ID NO: 846724 - protein, 19 aa, Mycobacterium
PSERVGVACYALPAARRAL

SEQ ID NO: 846725 - protein, 25 aa, Mycobacterium
PSESTLLRHFHRCELMGPTAGQPGE

SEQ ID NO: 846726 - protein, 26 aa, Mycobacterium
PSEVASVALFLACDLSSYMTGTVLDV

SEQ ID NO: 846727 - protein, 20 aa, Mycobacterium
PSEVIPGIMGGVVGGLGGVL

SEQ ID NO: 846728 - protein, 24 aa, Mycobacterium
PSEVNFYRPLIEHPKVMRVVALSG

SEQ ID NO: 846729 - protein, 24 aa, Mycobacterium
PSEVTPLTSLLLAQGLAESGLPDG

SEQ ID NO: 846730 - protein, 18 aa, Mycobacterium
PSFAEVPAGWRVVFGEST

SEQ ID NO: 846731 - protein, 24 aa, Mycobacterium
PSFDDYRHLTVPVTLILGALNEGA

SEQ ID NO: 846732 - protein, 19 aa, Mycobacterium
PSFLKVLAGMHNEIVGELK

SEQ ID NO: 846733 - protein, 22 aa, Mycobacterium
PSFLKVLAGMQNEIAGQLKSAT

SEQ ID NO: 846734 - protein, 25 aa, Mycobacterium
PSFRERVRYRSVQWAHGPKLVEHGH

SEQ ID NO: 846735 - protein, 28 aa, Mycobacterium
PSFSVVAPLLSRSLILQLQPLADNDIRE

SEQ ID NO: 846736 - protein, 28 aa, Mycobacterium
PSGDDLISAWLYRPPGDGPAPLLVMAHG

SEQ ID NO: 846737 - protein, 25 aa, Mycobacterium
PSGDPLRRWGPFPPEGPHPERSGLF

SEQ ID NO: 846738 - protein, 18 aa, Mycobacterium
PSGENFALHLIPSGVLTP

SEQ ID NO: 846739 - protein, 29 aa, Mycobacterium
PSGFDKYNPFVWDVYLTSIEPSASTTPWM

SEQ ID NO: 846740 - protein, 20 aa, Mycobacterium
PSGFLDIWRDYTLFDHVERF

SEQ ID NO: 846741 - protein, 18 aa, Mycobacterium
PSGFMLFGLVDHGGWITK

SEQ ID NO: 846742 - protein, 36 aa, Mycobacterium
PSGGNPLHPLALPLLRPRQVIMLGRPTLHRPVSALL

SEQ ID NO: 846743 - protein, 18 aa, Mycobacterium
PSGHTAFDASGQSAADAS

SEQ ID NO: 846744 - protein, 23 aa, Mycobacterium
PSGISLPAGVRLLEPGRRGGRVA

SEQ ID NO: 846745 - protein, 21 aa, Mycobacterium
PSGLDFVRGLIGCLAAGVVPV

SEQ ID NO: 846746 - protein, 20 aa, Mycobacterium
PSGLLLGAVMMLVHVGQGDV

SEQ ID NO: 846747 - protein, 24 aa, Mycobacterium
PSGLQQILQSLPNLGLGNKGNANL

SEQ ID NO: 846748 - protein, 25 aa, Mycobacterium
PSGLVFDDFLPAVARMRALDPVTSE

SEQ ID NO: 846749 - protein, 25 aa, Mycobacterium
PSGNVEYFLRLRAETDSPLEGDALE

SEQ ID NO: 846750 - protein, 25 aa, Mycobacterium
PSGNVEYFLWLRAQTDRGLVDDELV

SEQ ID NO: 846751 - protein, 27 aa, Mycobacterium
PSGNVEYFLWLRAQTDRPLSDDTLSDA

SEQ ID NO: 846752 - protein, 27 aa, Mycobacterium
PSGNVEYFLWLRAQTDRWLAGDELVDA

SEQ ID NO: 846753 - protein, 31 aa, Mycobacterium
PSGPGIPYPGFWLVPQWRTDEILLDRLRQFG

SEQ ID NO: 846754 - protein, 24 aa, Mycobacterium
PSGPVHLVALPRFPEPGSAVEQGS

SEQ ID NO: 846755 - protein, 24 aa, Mycobacterium
PSGQPVLLIMGLGAQLPMWPDEFC

SEQ ID NO: 846756 - protein, 20 aa, Mycobacterium
PSGQTVLGLLPRLAELLDGR

SEQ ID NO: 846757 - protein, 32 aa, Mycobacterium
PSGQVLTHQLPIAPKPLPPLLVRESEGFIEVF

SEQ ID NO: 846758 - protein, 25 aa, Mycobacterium
PSGRFRELGPINWVLAKAAARTVRA

SEQ ID NO: 846759 - protein, 25 aa, Mycobacterium
PSGRGFWFPPTVLTPQRTDRTVTEE

SEQ ID NO: 846760 - protein, 24 aa, Mycobacterium
PSGRLRQLGPVNWVLAKLGARAVR

SEQ ID NO: 846761 - protein, 18 aa, Mycobacterium
PSGSPSPAPAKPAWVRGS

SEQ ID NO: 846762 - protein, 18 aa, Mycobacterium
PSGSVYHRFPTRAALCGE

SEQ ID NO: 846763 - protein, 25 aa, Mycobacterium
PSGTRSIVVFAAASLKPAFTQISEQ

SEQ ID NO: 846764 - protein, 19 aa, Mycobacterium
PSGTSWWLTGLDAIDGHTL

SEQ ID NO: 846765 - protein, 17 aa, Mycobacterium
PSGTYRGDESVPDHGAE

SEQ ID NO: 846766 - protein, 25 aa, Mycobacterium
PSGVATPMLINPVTEKLFADGSPEG

SEQ ID NO: 846767 - protein, 19 aa, Mycobacterium
PSGVFRPYAGVSTAILLFT

SEQ ID NO: 846768 - protein, 23 aa, Mycobacterium
PSGVSSIFNIGFANLGGLSFGNA

SEQ ID NO: 846769 - protein, 22 aa, Mycobacterium
PSGWDKLTKHLLRKGFEFKELE

SEQ ID NO: 846770 - protein, 19 aa, Mycobacterium
PSGWETLTKHLLRKGFEFK

SEQ ID NO: 846771 - protein, 19 aa, Mycobacterium
PSHHRGCYGCFGPSAVPQT

SEQ ID NO: 846772 - protein, 17 aa, Mycobacterium
PSHHWIIRDMLGLPYEK

SEQ ID NO: 846773 - protein, 19 aa, Mycobacterium
PSHHWIIRDMLGLPYERPA

SEQ ID NO: 846774 - protein, 25 aa, Mycobacterium
PSHILQLLHHLYRAGFDVIKTEGLY

SEQ ID NO: 846775 - protein, 19 aa, Mycobacterium
PSHKLLIRAGYVRAVGPGI

SEQ ID NO: 846776 - protein, 22 aa, Mycobacterium
PSHLQLVLHKLYDAGATVTQTD

SEQ ID NO: 846777 - protein, 18 aa, Mycobacterium
PSHLYPAELARRAKTLGE

SEQ ID NO: 846778 - protein, 21 aa, Mycobacterium
PSHTRGYIGTALRLLEHKISH

SEQ ID NO: 846779 - protein, 17 aa, Mycobacterium
PSIEHWPARAIKHHRRI

SEQ ID NO: 846780 - protein, 18 aa, Mycobacterium
PSIGPWITTLRLLKNNGV

SEQ ID NO: 846781 - protein, 25 aa, Mycobacterium
PSIHTKYWYPLFEAACENKTVLCTH

SEQ ID NO: 846782 - protein, 23 aa, Mycobacterium
PSIKEKFLELLPNRVITDSIGSS

SEQ ID NO: 846783 - protein, 18 aa, Mycobacterium
PSIRRHWPEPESLLLHAL

SEQ ID NO: 846784 - protein, 20 aa, Mycobacterium
PSIVAVVPPAVDPVSLQTAA

SEQ ID NO: 846785 - protein, 24 aa, Mycobacterium
PSKELRWSALTTSGDGELWAANLS

SEQ ID NO: 846786 - protein, 25 aa, Mycobacterium
PSKGAWQFIAPTFARYHQPGTSTDI

SEQ ID NO: 846787 - protein, 24 aa, Mycobacterium
PSKQAPFEPLPGYVTHVPYGDADA

SEQ ID NO: 846788 - protein, 23 aa, Mycobacterium
PSKRAPFAPLPGDVTYVPYGDAA

SEQ ID NO: 846789 - protein, 26 aa, Mycobacterium
PSKRRIHGVIFFPQWIRVHGERTVCY

SEQ ID NO: 846790 - protein, 19 aa, Mycobacterium
PSKSVHVGWSAWAIVRVGR

SEQ ID NO: 846791 - protein, 21 aa, Mycobacterium
PSLAFRLIHVADTYNPIAPKD

SEQ ID NO: 846792 - protein, 22 aa, Mycobacterium
PSLARKPRFAILKGRGNYLCLN

SEQ ID NO: 846793 - protein, 25 aa, Mycobacterium
PSLAWAETYPGTLSYYLASAFREVW

SEQ ID NO: 846794 - protein, 27 aa, Mycobacterium
PSLAWSETYPSTLAYYLASAFGEVWMQ

SEQ ID NO: 846795 - protein, 17 aa, Mycobacterium
PSLDGVVLHYFLHAEPT

SEQ ID NO: 846796 - protein, 21 aa, Mycobacterium
PSLDLYREPDPFRVPRPSEIR

SEQ ID NO: 846797 - protein, 25 aa, Mycobacterium
PSLDRTLHLPALRPGEVNRATSTMT

SEQ ID NO: 846798 - protein, 21 aa, Mycobacterium
PSLDYRRLLPQNLGQARMLRR

SEQ ID NO: 846799 - protein, 22 aa, Mycobacterium
PSLEPRWFAWVDNMHDWCISRQ

SEQ ID NO: 846800 - protein, 20 aa, Mycobacterium
PSLEPYLQPVAGAAGLLGAD

SEQ ID NO: 846801 - protein, 17 aa, Mycobacterium
PSLEWIARSQEFGRAIR

SEQ ID NO: 846802 - protein, 17 aa, Mycobacterium
PSLFGKPGKAVSIGYVA

SEQ ID NO: 846803 - protein, 19 aa, Mycobacterium
PSLHNSQPWRWVDHGTSVD

SEQ ID NO: 846804 - protein, 27 aa, Mycobacterium
PSLIFHLGPGLKELWVWPSGGIGQDQL

SEQ ID NO: 846805 - protein, 20 aa, Mycobacterium
PSLITLEDLSAYPAKKREPL

SEQ ID NO: 846806 - protein, 20 aa, Mycobacterium
PSLLFSILHFRDTCNPIPPT

SEQ ID NO: 846807 - protein, 17 aa, Mycobacterium
PSLLTSWDRSIPASDVT

SEQ ID NO: 846808 - protein, 33 aa, Mycobacterium
PSLMERLYKASWRFTPFFWQEIDEGILPALYAA

SEQ ID NO: 846809 - protein, 20 aa, Mycobacterium
PSLMQILNSNAVNTTCLVPT

SEQ ID NO: 846810 - protein, 24 aa, Mycobacterium
PSLPFAKLRVAPTASWMFEYYPMR

SEQ ID NO: 846811 - protein, 21 aa, Mycobacterium
PSLPGQWPYVRGGDALRDVNS

SEQ ID NO: 846812 - protein, 19 aa, Mycobacterium
PSLQRGCAWSGDGWDVQQT

SEQ ID NO: 846813 - protein, 23 aa, Mycobacterium
PSLRPELLESLLFPREAINSAAY

SEQ ID NO: 846814 - protein, 18 aa, Mycobacterium
PSLRRHVFYPRTLAPGTL

SEQ ID NO: 846815 - protein, 21 aa, Mycobacterium
PSLSMLALNIASGPIVATFHT

SEQ ID NO: 846816 - protein, 21 aa, Mycobacterium
PSLVRLRPAPSLGLPAPLSEL

SEQ ID NO: 846817 - protein, 23 aa, Mycobacterium
PSMFARLRDVGLLSTVPLAVLAL

SEQ ID NO: 846818 - protein, 19 aa, Mycobacterium
PSMIRVDGVKLLSFDYDEL

SEQ ID NO: 846819 - protein, 17 aa, Mycobacterium
PSMLWSMTVDLEWPGSL

SEQ ID NO: 846820 - protein, 22 aa, Mycobacterium
PSMPVPPPMVKLLLNNVLEQLA

SEQ ID NO: 846821 - protein, 30 aa, Mycobacterium
PSMSPPGKDLWWFWTGLTPSYPEDGWDVAR

SEQ ID NO: 846822 - protein, 20 aa, Mycobacterium
PSMVPVAVRAGGPPVASVAG

SEQ ID NO: 846823 - protein, 25 aa, Mycobacterium
PSNEYRYLLIASPAGAYFKGGIKPV

SEQ ID NO: 846824 - protein, 23 aa, Mycobacterium
PSNGPPPASRWSRRKPEAAVRLE

SEQ ID NO: 846825 - protein, 27 aa, Mycobacterium
PSNLGQPFYNFLLTVLFEWGVAVHDTD

SEQ ID NO: 846826 - protein, 17 aa, Mycobacterium
PSNLIRSITWDQGIEMA

SEQ ID NO: 846827 - protein, 22 aa, Mycobacterium
PSNLMLRGRLIDALRSDVIRGR

SEQ ID NO: 846828 - protein, 20 aa, Mycobacterium
PSNPYLEDFLAPVSAEVTAT

SEQ ID NO: 846829 - protein, 19 aa, Mycobacterium
PSNSVNLGWSAWAIDWLTQ

SEQ ID NO: 846830 - protein, 34 aa, Mycobacterium
PSNTKCLCRIHHLLKTFWLGWSDRQLPDGTVIWT

SEQ ID NO: 846831 - protein, 30 aa, Mycobacterium
PSNVIGVSLPLLRSLLGRAGLSVASLWAAN

SEQ ID NO: 846832 - protein, 17 aa, Mycobacterium
PSPASPLWRSRRTIRTE

SEQ ID NO: 846833 - protein, 23 aa, Mycobacterium
PSPDLRVRWHHAPDDDWGAYADE

SEQ ID NO: 846834 - protein, 25 aa, Mycobacterium
PSPFHLCATVARRLLDAGYTELSEI

SEQ ID NO: 846835 - protein, 20 aa, Mycobacterium
PSPHIPWDSLPVRVVDTAMP

SEQ ID NO: 846836 - protein, 18 aa, Mycobacterium
PSPHKAIIFMDPPEHRHM

SEQ ID NO: 846837 - protein, 17 aa, Mycobacterium
PSPLFLERKGYNSAVLQ

SEQ ID NO: 846838 - protein, 18 aa, Mycobacterium
PSPLTPLAGLALAKVIDE

SEQ ID NO: 846839 - protein, 28 aa, Mycobacterium
PSPLVERVPGMRAKLFDAARLAAGAIGY

SEQ ID NO: 846840 - protein, 20 aa, Mycobacterium
PSPPHLPQPPSVPMSGAPAE

SEQ ID NO: 846841 - protein, 34 aa, Mycobacterium
PSPPTPRLFLDIPNPLASIALPPPASLVAPTSID

SEQ ID NO: 846842 - protein, 22 aa, Mycobacterium
PSPRLLSLFQQVLEYNDGARVT

SEQ ID NO: 846843 - protein, 20 aa, Mycobacterium
PSPRRVAGQRRSWSGPGPDA

SEQ ID NO: 846844 - protein, 19 aa, Mycobacterium
PSPTAIPIPFPVPAGITKG

SEQ ID NO: 846845 - protein, 20 aa, Mycobacterium
PSPTARSWTRRWPTVFGIRH

SEQ ID NO: 846846 - protein, 25 aa, Mycobacterium
PSPVLIAQAYLFASDGYAVRVRLQG

SEQ ID NO: 846847 - protein, 17 aa, Mycobacterium
PSPVTFGPFLVVALEHD

SEQ ID NO: 846848 - protein, 22 aa, Mycobacterium
PSPYMYLLHVPNDAGGTDFSIV

SEQ ID NO: 846849 - protein, 22 aa, Mycobacterium
PSPYMYLLHVPNDAGGTDFSVV

SEQ ID NO: 846850 - protein, 24 aa, Mycobacterium
PSQALVAWGPFLFAVAYQAFSWVG

SEQ ID NO: 846851 - protein, 17 aa, Mycobacterium
PSQGLPMRNVLAVVAGT

SEQ ID NO: 846852 - protein, 33 aa, Mycobacterium
PSQISTRLFQFMPRRVLLPLLKNQHPSLRRDRS

SEQ ID NO: 846853 - protein, 32 aa, Mycobacterium; identical to SEQ ID NO: 221440

SEQ ID NO: 846854 - protein, 31 aa, Mycobacterium
PSQIVESVPMYKLRRYFPPDSRPGQSPVGPP

SEQ ID NO: 846855 - protein, 31 aa, Mycobacterium
PSQIVESVPMYKLRRYFPPDTRPGHAPVGPP

SEQ ID NO: 846856 - protein, 30 aa, Mycobacterium
PSQIVESVPMYKLRRYFPPDVRGDKPPVGP

SEQ ID NO: 846857 - protein, 33 aa, Mycobacterium
PSQLRARSWWDGPDIVLLVDDWHMITAAGGLMP

SEQ ID NO: 846858 - protein, 34 aa, Mycobacterium
PSQLSTRLFQFMPRRLLLPLLKSQHPGLKRDRSA

SEQ ID NO: 846859 - protein, 20 aa, Mycobacterium
PSQPVLPRTAKLPADFRVVI

SEQ ID NO: 846860 - protein, 24 aa, Mycobacterium
PSQRIGTPFTLLHGLADDVVPAAA

SEQ ID NO: 846861 - protein, 18 aa, Mycobacterium
PSQRLRMAVAYGSAAAAL

SEQ ID NO: 846862 - protein, 25 aa, Mycobacterium
PSQRPLLLVFADSLSYYGPTGGLPA

SEQ ID NO: 846863 - protein, 23 aa, Mycobacterium
PSRADAARILTALLRDLPGGRAV

SEQ ID NO: 846864 - protein, 34 aa, Mycobacterium
PSRADLDRVLPDRPGLFFAIDAHSMWANTAALQM

SEQ ID NO: 846865 - protein, 18 aa, Mycobacterium
PSRALLGRPMIGNGFDGA

SEQ ID NO: 846866 - protein, 17 aa, Mycobacterium
PSRAPRHGWFGLVRPDG

SEQ ID NO: 846867 - protein, 27 aa, Mycobacterium
PSRARRIYRIGFGAARRARRGRAQRVP

SEQ ID NO: 846868 - protein, 28 aa, Mycobacterium
PSRDELMARLWLRSIARYQDGVLTALAL

SEQ ID NO: 846869 - protein, 27 aa, Mycobacterium
PSRDIPRFVALWQAGRLPVESLVSSSI

SEQ ID NO: 846870 - protein, 26 aa, Mycobacterium
PSRDIPRFVSLWQSGRLPVESLVSAT

SEQ ID NO: 846871 - protein, 24 aa, Mycobacterium
PSRDIPRFVSLWRSGRLPVESLVS

SEQ ID NO: 846872 - protein, 19 aa, Mycobacterium
PSREGALLCGDFYDVVQTP

SEQ ID NO: 846873 - protein, 18 aa, Mycobacterium
PSRGLIGWRTDFLTETRG

SEQ ID NO: 846874 - protein, 19 aa, Mycobacterium
PSRIIVTMRGNPYADKPRL

SEQ ID NO: 846875 - protein, 18 aa, Mycobacterium
PSRIVLTPLISDFLARGV

SEQ ID NO: 846876 - protein, 21 aa, Mycobacterium
PSRLLALQNAFVARHRGRRVH

SEQ ID NO: 846877 - protein, 29 aa, Mycobacterium
PSRLVVCLDLDWRPQFRVDLVPSYKAHRV

SEQ ID NO: 846878 - protein, 21 aa, Mycobacterium
PSRPFFEFLTDWLDAWVAYFA

SEQ ID NO: 846879 - protein, 23 aa, Mycobacterium
PSRPFGIGLVHWVMTERPDLFDI

SEQ ID NO: 846880 - protein, 29 aa, Mycobacterium
PSRREGSQWLALLLEPPSNAVAPGTPEWQ

SEQ ID NO: 846881 - protein, 20 aa, Mycobacterium
PSRSVHWHGDLRLPAAAAAR

SEQ ID NO: 846882 - protein, 22 aa, Mycobacterium
PSRYEVHFACDPRFNKLLGPIP

SEQ ID NO: 846883 - protein, 31 aa, Mycobacterium
PSSDADLTYWRRALTPLPDPLELPGAASTYS

SEQ ID NO: 846884 - protein, 26 aa, Mycobacterium
PSSFIDYFDSLIGWERYRASQFGIAH

SEQ ID NO: 846885 - protein, 25 aa, Mycobacterium
PSSGEYVFYPRVLAPRTLADDLEWR

SEQ ID NO: 846886 - protein, 33 aa, Mycobacterium
PSSHFGYGILTWHLPMLFRTPPGYNLLVRGPAN

SEQ ID NO: 846887 - protein, 20 aa, Mycobacterium
PSSILFYTKTKTVTSRWPSG

SEQ ID NO: 846888 - protein, 26 aa, Mycobacterium
PSSLDPYYLTPLYPHRHAIAGLQAAA

SEQ ID NO: 846889 - protein, 19 aa, Mycobacterium
PSSLWFGDEREDPARWLTG

SEQ ID NO: 846890 - protein, 19 aa, Mycobacterium
PSSNFRPPSDPDTPMIMVG

SEQ ID NO: 846891 - protein, 32 aa, Mycobacterium; identical to SEQ ID NO: 116684

SEQ ID NO: 846892 - protein, 32 aa, Mycobacterium
PSSPALASILPSFPALLRKQLKGAPMPAPRAI

SEQ ID NO: 846893 - protein, 17 aa, Mycobacterium
PSSPFSGGALLGDRIRM

SEQ ID NO: 846894 - protein, 18 aa, Mycobacterium
PSSPFSGGALLGDRIRMA

SEQ ID NO: 846895 - protein, 19 aa, Mycobacterium
PSSPFSGGALLGDRIRMAA

SEQ ID NO: 846896 - protein, 32 aa, Mycobacterium
PSSPGLAGILPSFPALLRKQLKGAPMPAPRAI

SEQ ID NO: 846897 - protein, 32 aa, Mycobacterium
PSSPGLASILPSFPALLKKQLKGAPMPAPRAI

SEQ ID NO: 846898 - protein, 19 aa, Mycobacterium
PSSSPRPPSKRSSRPAPEK

SEQ ID NO: 846899 - protein, 24 aa, Mycobacterium
PSSSYLWRNVLPHTEGLGRLVACD

SEQ ID NO: 846900 - protein, 28 aa, Mycobacterium
PSTAEPADYLPLFVAPQPVRFEDRYEDS

SEQ ID NO: 846901 - protein, 33 aa, Mycobacterium
PSTAKEWHQYWIDTRLQWYVELGIDPENLRLFE

SEQ ID NO: 846902 - protein, 35 aa, Mycobacterium
PSTAPEWHKYWIDTRLQWYVDLGIDPENLRLYDHP

SEQ ID NO: 846903 - protein, 25 aa, Mycobacterium
PSTARSLVLLFEALFDPRPAGSPVS

SEQ ID NO: 846904 - protein, 35 aa, Mycobacterium
PSTELVPYRELSTVALLGALPKAPSAGWRKWVYRA

SEQ ID NO: 846905 - protein, 30 aa, Mycobacterium
PSTFDYQWQLLTYAFNLPDPSDFPALPGQI

SEQ ID NO: 846906 - protein, 23 aa, Mycobacterium
PSTHTIFVLGRPVTAGAFGAVAK

SEQ ID NO: 846907 - protein, 23 aa, Mycobacterium
PSTHVIFVLGRPVTAGAFGAVAR

SEQ ID NO: 846908 - protein, 24 aa, Mycobacterium
PSTIRSAGWFRSSTLYVPGSQNFQ

SEQ ID NO: 846909 - protein, 20 aa, Mycobacterium
PSTLLLALMSGFERRGRWNV

SEQ ID NO: 846910 - protein, 25 aa, Mycobacterium
PSTLQMLADCPLRWLLERHGGARGR

SEQ ID NO: 846911 - protein, 25 aa, Mycobacterium
PSTLQMLTDCPLRWLLERHGGDDGR

SEQ ID NO: 846912 - protein, 17 aa, Mycobacterium
PSTPRQLALYQALIRIG

SEQ ID NO: 846913 - protein, 23 aa, Mycobacterium
PSTRRHYLPAFPGSDLSLAGWTR

SEQ ID NO: 846914 - protein, 18 aa, Mycobacterium
PSTRYLARAMTRHLRRRG

SEQ ID NO: 846915 - protein, 24 aa, Mycobacterium
PSTSKLTIYVGRHHRVAGAPAHRA

SEQ ID NO: 846916 - protein, 19 aa, Mycobacterium
PSTTLAEFAIPGGPGYLNT

SEQ ID NO: 846917 - protein, 30 aa, Mycobacterium
PSTYAPGQALPLTLLLHSLALGQTQFAAID

SEQ ID NO: 846918 - protein, 28 aa, Mycobacterium
PSVAEGALLLMLAALRQLPRLDRDIRSG

SEQ ID NO: 846919 - protein, 25 aa, Mycobacterium
PSVAIPLGPFLPTAAELSATLGTGP

SEQ ID NO: 846920 - protein, 26 aa, Mycobacterium
PSVAKLLPYVLYETLGPTLPDGMAGA

SEQ ID NO: 846921 - protein, 29 aa, Mycobacterium
PSVATMAALANFFRIKPAYFTDDEYYEKL

SEQ ID NO: 846922 - protein, 21 aa, Mycobacterium
PSVAYRYPFAETDDVWVPIGL

SEQ ID NO: 846923 - protein, 21 aa, Mycobacterium
PSVCDWMIFGKGHCIVIDATN

SEQ ID NO: 846924 - protein, 35 aa, Mycobacterium
PSVDEPFSALAFKIAVHPFFGKLTYVRVYSGVVES

SEQ ID NO: 846925 - protein, 27 aa, Mycobacterium
PSVGLMQPWRFIRITDAALRRRIHALV

SEQ ID NO: 846926 - protein, 19 aa, Mycobacterium
PSVILALSSVRRSYNDLMM

SEQ ID NO: 846927 - protein, 17 aa, Mycobacterium
PSVIVAKTWTLSGLDHI

SEQ ID NO: 846928 - protein, 18 aa, Mycobacterium
PSVLFTGAETPDPTFDHG

SEQ ID NO: 846929 - protein, 18 aa, Mycobacterium
PSVLPRLESFARSVRRAP

SEQ ID NO: 846930 - protein, 21 aa, Mycobacterium
PSVLPVLPQLLAELTDWDMAS

SEQ ID NO: 846931 - protein, 26 aa, Mycobacterium
PSVLRALTWLPVASFLYVLPRVVLGS

SEQ ID NO: 846932 - protein, 19 aa, Mycobacterium
PSVLYNLRVHPVGRPDIVA

SEQ ID NO: 846933 - protein, 18 aa, Mycobacterium
PSVPAGPLPAYGADLRPT

SEQ ID NO: 846934 - protein, 21 aa, Mycobacterium
PSVPALMRGYLRLGAQVCGEP

SEQ ID NO: 846935 - protein, 25 aa, Mycobacterium
PSVPDHISLWGLRLNITQNFDQWAN

SEQ ID NO: 846936 - protein, 23 aa, Mycobacterium
PSVPDVNAFWRNVDHCSAPVTTT

SEQ ID NO: 846937 - protein, 18 aa, Mycobacterium
PSVPLRLAELFVEAGLPP

SEQ ID NO: 846938 - protein, 23 aa, Mycobacterium
PSVPRLLHPVARALARPGLRLNY

SEQ ID NO: 846939 - protein, 27 aa, Mycobacterium
PSVQPQPILAPLTPAAIFLVATIDAGG

SEQ ID NO: 846940 - protein, 17 aa, Mycobacterium
PSVSFGDDPLRMLRAAR

SEQ ID NO: 846941 - protein, 22 aa, Mycobacterium
PSVVAGLRWRAPARFPEFTLPT

SEQ ID NO: 846942 - protein, 19 aa, Mycobacterium
PSVVPLRKAPRDAEGWVTA

SEQ ID NO: 846943 - protein, 17 aa, Mycobacterium
PSWAVATPDIRAVAAAL

SEQ ID NO: 846944 - protein, 24 aa, Mycobacterium
PSWAVKAPAILPDADLLPGAVAAD

SEQ ID NO: 846945 - protein, 25 aa, Mycobacterium
PSWHEGPATNMWGGAPAAGAGASSA

SEQ ID NO: 846946 - protein, 18 aa, Mycobacterium
PSWRFKAWNQQWQRLFQG

SEQ ID NO: 846947 - protein, 25 aa, Mycobacterium
PSWTAAAPVRLLTAALRDAGLSAAP

SEQ ID NO: 846948 - protein, 17 aa, Mycobacterium
PSWTIEDVAEHLGDIRD

SEQ ID NO: 846949 - protein, 17 aa, Mycobacterium
PSYARWLSGQDWTPAYR

SEQ ID NO: 846950 - protein, 22 aa, Mycobacterium
PSYDLNLFLSGIEQAINGDPAG

SEQ ID NO: 846951 - protein, 25 aa, Mycobacterium
PSYKACFLAMLRRFHELGVKELNGH

SEQ ID NO: 846952 - protein, 24 aa, Mycobacterium
PSYKSCFLAMMRRFYDQGLTEING

SEQ ID NO: 846953 - protein, 38 aa, Mycobacterium
PSYSALGGRAWAAAGLTPLRPWRSALAAALAAACGAAP

SEQ ID NO: 846954 - protein, 25 aa, Mycobacterium
PTAAAFIDFLFPGHPGQPQAWTPEE

SEQ ID NO: 846955 - protein, 19 aa, Mycobacterium
PTAAIVSVSLLLDHLGETE

SEQ ID NO: 846956 - protein, 18 aa, Mycobacterium
PTAARLLYELFAQTSAAG

SEQ ID NO: 846957 - protein, 18 aa, Mycobacterium
PTADAFRRQVFELVDIAF

SEQ ID NO: 846958 - protein, 20 aa, Mycobacterium
PTADFNVTLLAGATLGGGPT

SEQ ID NO: 846959 - protein, 26 aa, Mycobacterium
PTADGWIMIAAYDPARWNALCDALGA

SEQ ID NO: 846960 - protein, 25 aa, Mycobacterium
PTADGYLALFITHDGFWKSFADEAG

SEQ ID NO: 846961 - protein, 26 aa, Mycobacterium
PTADGYLALFITHDGFWRSFAGEAGI

SEQ ID NO: 846962 - protein, 24 aa, Mycobacterium
PTAFPLVLTHGWPGSVLEFLEVLG

SEQ ID NO: 846963 - protein, 21 aa, Mycobacterium
PTAFVLPLHRRDDDAGWASAD

SEQ ID NO: 846964 - protein, 18 aa, Mycobacterium
PTAFYRHFSSLDDLGVAL

SEQ ID NO: 846965 - protein, 23 aa, Mycobacterium
PTAGIALKPLPDTMFRAASASAA

SEQ ID NO: 846966 - protein, 34 aa, Mycobacterium
PTAGPAALRVLTGPRWRLGAHDLVVLWRRATGFG

SEQ ID NO: 846967 - protein, 22 aa, Mycobacterium
PTAIVHLAAVIPPGIYRSPALG

SEQ ID NO: 846968 - protein, 25 aa, Mycobacterium
PTAKPQLNVLLWQRAKDPQRGAWSL

SEQ ID NO: 846969 - protein, 24 aa, Mycobacterium
PTAKQYSVVILKRGPRFGDESSAQ

SEQ ID NO: 846970 - protein, 19 aa, Mycobacterium
PTALERILSQHTGTGRGED

SEQ ID NO: 846971 - protein, 24 aa, Mycobacterium
PTALLAPKWVPWQERIRPGDLGPG

SEQ ID NO: 846972 - protein, 19 aa, Mycobacterium
PTALLDIYGDRLPSRYART

SEQ ID NO: 846973 - protein, 29 aa, Mycobacterium
PTALMRHGVPLLRELALRLGNAYTLAAPV

SEQ ID NO: 846974 - protein, 29 aa, Mycobacterium
PTALRELIRYVRPPRLRRWARDGYGWLQP

SEQ ID NO: 846975 - protein, 20 aa, Mycobacterium
PTALSALKPLIRTTKHRARL

SEQ ID NO: 846976 - protein, 36 aa, Mycobacterium
PTALVANLPYNVAVPALLHLLAEFPSIRTVMVMVQA

SEQ ID NO: 846977 - protein, 22 aa, Mycobacterium
PTAMFAVNDFAAIGAAGAIRNR

SEQ ID NO: 846978 - protein, 19 aa, Mycobacterium
PTAMMLSNAFLIERDLLGT

SEQ ID NO: 846979 - protein, 21 aa, Mycobacterium
PTAPLLRHRAVAELPEIDKVR

SEQ ID NO: 846980 - protein, 26 aa, Mycobacterium
PTAPVYLYHPIHDLLLPIQYTDQLAE

SEQ ID NO: 846981 - protein, 36 aa, Mycobacterium
PTAPYAQTPLHPLALSLIRPRQVIMLGRPTLHRSVS

SEQ ID NO: 846982 - protein, 19 aa, Mycobacterium
PTAQQMVDAIAWAGDFLTG

SEQ ID NO: 846983 - protein, 23 aa, Mycobacterium
PTAQRWFHEFEGAGLDGVIAKPL

SEQ ID NO: 846984 - protein, 28 aa, Mycobacterium
PTARAIPEMFRKAFKLAETERPAAVFLA

SEQ ID NO: 846985 - protein, 21 aa, Mycobacterium
PTARRILAHFGLDRHFEVIAG

SEQ ID NO: 846986 - protein, 19 aa, Mycobacterium
PTARRILAHFGLEQHFEVI

SEQ ID NO: 846987 - protein, 25 aa, Mycobacterium
PTARSMAYFSLGYLLKRSEPVRATA

SEQ ID NO: 846988 - protein, 29 aa, Mycobacterium
PTASFAASPFRWLAWLSESRAGLTAAPNF

SEQ ID NO: 846989 - protein, 24 aa, Mycobacterium
PTATAFPWRRQSAVVQWYVETPSS

SEQ ID NO: 846990 - protein, 25 aa, Mycobacterium
PTATLIHLPIHASWLNQVEIYFSIL

SEQ ID NO: 846991 - protein, 20 aa, Mycobacterium
PTAVDILSAILARDGAQLSA

SEQ ID NO: 846992 - protein, 22 aa, Mycobacterium
PTAVPLTFFRKASASITGPFDD

SEQ ID NO: 846993 - protein, 19 aa, Mycobacterium
PTAVRVIHGPDKVARFLLG

SEQ ID NO: 846994 - protein, 27 aa, Mycobacterium
PTAWCAEGLLIYLPPEAQDKLFDDIHH

SEQ ID NO: 846995 - protein, 17 aa, Mycobacterium
PTAYDRVLATRFGVNAA

SEQ ID NO: 846996 - protein, 30 aa, Mycobacterium
PTDADPELLIGRYIPNLVPRPFTLDRDFIE

SEQ ID NO: 846997 - protein, 22 aa, Mycobacterium
PTDAMAGYYAEFARGGFGLVIT

SEQ ID NO: 846998 - protein, 31 aa, Mycobacterium
PTDAPGFHVPFYWWTFNMPTDHGEVELTNVR

SEQ ID NO: 846999 - protein, 32 aa, Mycobacterium
PTDDDLIAGAAYRWLRSWPTAPADPWDVPSGW

SEQ ID NO: 847000 - protein, 21 aa, Mycobacterium
PTDEPLWSESWYADFVDAAQG

SEQ ID NO: 847001 - protein, 20 aa, Mycobacterium
PTDGGYRITASWRFCSGQHH

SEQ ID NO: 847002 - protein, 24 aa, Mycobacterium
PTDKMVQVLRYLYESRPALSLRAI

SEQ ID NO: 847003 - protein, 29 aa, Mycobacterium
PTDPDGEPFWFPNWTRLVYAGNGLFSSEE

SEQ ID NO: 847004 - protein, 27 aa, Mycobacterium
PTDPGLVRWTSLYDMRFVEGPMPGKDG

SEQ ID NO: 847005 - protein, 28 aa, Mycobacterium
PTDPNGEPFWFPNWTRLVYAGDGLFCSE

SEQ ID NO: 847006 - protein, 28 aa, Mycobacterium
PTDPQGEPFWFPNWTRLVYAGDGLFSSE

SEQ ID NO: 847007 - protein, 23 aa, Mycobacterium
PTDPTVYRFYEALQVYGGALKEL

SEQ ID NO: 847008 - protein, 23 aa, Mycobacterium
PTDQLLKVPAGSGPVLVIAPSTA

SEQ ID NO: 847009 - protein, 32 aa, Mycobacterium
PTDRIDPVLLDLLRLGTYQLLRTRVEPHAAVS

SEQ ID NO: 847010 - protein, 18 aa, Mycobacterium
PTDRLALLGSRLRGGATA

SEQ ID NO: 847011 - protein, 25 aa, Mycobacterium
PTDRLLRESISARSFLALGIPAKHA

SEQ ID NO: 847012 - protein, 24 aa, Mycobacterium
PTDRTPVFYCKTGVRSAEVLAIAK

SEQ ID NO: 847013 - protein, 28 aa, Mycobacterium
PTDTLDGGYWYRNLRQRVEFERATTALL

SEQ ID NO: 847014 - protein, 31 aa, Mycobacterium
PTDTPGFTVPYYWWTLNMPTDHGEVALEDVR

SEQ ID NO: 847015 - protein, 18 aa, Mycobacterium
PTDVGWAAAFLTSDVASY

SEQ ID NO: 847016 - protein, 22 aa, Mycobacterium
PTDVLVEFLGHGMTLLVIDNCE

SEQ ID NO: 847017 - protein, 24 aa, Mycobacterium
PTDVPRTWILTTRDRALSVASQHA

SEQ ID NO: 847018 - protein, 20 aa, Mycobacterium
PTDWHLQHLGSRAVAGAALV

SEQ ID NO: 847019 - protein, 24 aa, Mycobacterium
PTEAPLAQGYYYSPTILDGVNRDM

SEQ ID NO: 847020 - protein, 20 aa, Mycobacterium
PTEIPLPQRIIDVALNESIL

SEQ ID NO: 847021 - protein, 25 aa, Mycobacterium
PTELARLLRIAVARLGITSVRFTGG

SEQ ID NO: 847022 - protein, 24 aa, Mycobacterium
PTELEWREWELELLEAGGHSNGAA

SEQ ID NO: 847023 - protein, 20 aa, Mycobacterium
PTELMRWVHPSLVASTQGTG

SEQ ID NO: 847024 - protein, 23 aa, Mycobacterium
PTELTSRLFTLEWEPKPLDQTAA

SEQ ID NO: 847025 - protein, 26 aa, Mycobacterium
PTEPVLKLLKITGDWQKFKGLPGAEG

SEQ ID NO: 847026 - protein, 20 aa, Mycobacterium
PTERFVYKEFLLEDVPNMAW

SEQ ID NO: 847027 - protein, 20 aa, Mycobacterium
PTETLRHTSFAQPALFAVEM

SEQ ID NO: 847028 - protein, 17 aa, Mycobacterium
PTEVEVHHLPFVETMAA

SEQ ID NO: 847029 - protein, 18 aa, Mycobacterium
PTEWLNLPVGGVALDVGS

SEQ ID NO: 847030 - protein, 19 aa, Mycobacterium
PTFADTPSGWRVVFGEASR

SEQ ID NO: 847031 - protein, 18 aa, Mycobacterium
PTFADVPAGWRVAFGADT

SEQ ID NO: 847032 - protein, 21 aa, Mycobacterium
PTFAELLAQVRRRSLAAFEHQ

SEQ ID NO: 847033 - protein, 20 aa, Mycobacterium
PTFDAVREKIETRYGTAIGS

SEQ ID NO: 847034 - protein, 18 aa, Mycobacterium
PTFEQWLGSPLVNDIMYF

SEQ ID NO: 847035 - protein, 34 aa, Mycobacterium
PTFIHPEDRFMLKDPIYGLGPRVAQLVAGAFFRE

SEQ ID NO: 847036 - protein, 18 aa, Mycobacterium
PTGALKFELQIESPQAVI

SEQ ID NO: 847037 - protein, 24 aa, Mycobacterium
PTGAVLLQLRWLCLEGRPDPVDEF

SEQ ID NO: 847038 - protein, 17 aa, Mycobacterium
PTGCRFAARCAHAFSKC

SEQ ID NO: 847039 - protein, 24 aa, Mycobacterium
PTGDAELLIIGWGSSYGPIGEACR

SEQ ID NO: 847040 - protein, 25 aa, Mycobacterium
PTGDAELLLIGWGSSYGPIGEACRR

SEQ ID NO: 847041 - protein, 24 aa, Mycobacterium
PTGDAELLLLGWGSSYGPIGEACR

SEQ ID NO: 847042 - protein, 24 aa, Mycobacterium
PTGDAELLMLGWGSSYGPIGEACR

SEQ ID NO: 847043 - protein, 22 aa, Mycobacterium
PTGDAPLVWRAAARLGIGSDAA

SEQ ID NO: 847044 - protein, 25 aa, Mycobacterium
PTGDAQLLMIGWGSSYGPIGEACRR

SEQ ID NO: 847045 - protein, 29 aa, Mycobacterium
PTGERAHCWWYQPFQPQPPPAPPPAPHRN

SEQ ID NO: 847046 - protein, 26 aa, Mycobacterium
PTGERGAWLWMRVGSDVLVDNAFRLL

SEQ ID NO: 847047 - protein, 22 aa, Mycobacterium
PTGEWVAAITRLADAEAAVAQC

SEQ ID NO: 847048 - protein, 25 aa, Mycobacterium
PTGGADDFLAWFFRAERGELDPFVL

SEQ ID NO: 847049 - protein, 24 aa, Mycobacterium
PTGGPMLLNLLPNAHLIMTPRTGH

SEQ ID NO: 847050 - protein, 26 aa, Mycobacterium
PTGGRRLFVFLGSTIGNLTPGPRAEF

SEQ ID NO: 847051 - protein, 23 aa, Mycobacterium
PTGHTLLLLDATGSYHREVARQL

SEQ ID NO: 847052 - protein, 26 aa, Mycobacterium
PTGHYLGCVQLQRLLREPPAELVGGI

SEQ ID NO: 847053 - protein, 18 aa, Mycobacterium
PTGIWDQLFRPLVAGQRW

SEQ ID NO: 847054 - protein, 18 aa, Mycobacterium
PTGKILKKELRKPHWDGR

SEQ ID NO: 847055 - protein, 20 aa, Mycobacterium
PTGLAQIWDVTRQLRGEAGP

SEQ ID NO: 847056 - protein, 21 aa, Mycobacterium
PTGLRDRVRWRGWSAGPGPAL

SEQ ID NO: 847057 - protein, 31 aa, Mycobacterium
PTGLRKMRRYPFVAAKFPRALRRAMRALEPC

SEQ ID NO: 847058 - protein, 21 aa, Mycobacterium
PTGLRNLFKLSSLASFEGQLG

SEQ ID NO: 847059 - protein, 24 aa, Mycobacterium
PTGLSAFRKRFPDRFFDVGIAEQH

SEQ ID NO: 847060 - protein, 17 aa, Mycobacterium
PTGLSKFGERFPDRLFD

SEQ ID NO: 847061 - protein, 35 aa, Mycobacterium
PTGPLEWLLLADGMPIAWRGQLLTGKPWPRVTGAD

SEQ ID NO: 847062 - protein, 24 aa, Mycobacterium
PTGQAFIDALRPRLGDRSVDVYPV

SEQ ID NO: 847063 - protein, 27 aa, Mycobacterium
PTGQRLRLLESLDLFGVAIAIEALRRG

SEQ ID NO: 847064 - protein, 29 aa, Mycobacterium
PTGSGKTLAAFLWALDSLARCPDRTAGTR

SEQ ID NO: 847065 - protein, 20 aa, Mycobacterium
PTGSIWCFATAETRQWWGGM

SEQ ID NO: 847066 - protein, 18 aa, Mycobacterium
PTGSLWCYATPETREWWG

SEQ ID NO: 847067 - protein, 31 aa, Mycobacterium
PTGWRLHGHPQWWIDIAAEWGRRDYWQQWRD

SEQ ID NO: 847068 - protein, 18 aa, Mycobacterium
PTGYIRDTFEHLGIPEAA

SEQ ID NO: 847069 - protein, 18 aa, Mycobacterium
PTHAPGEHPMFKAMAASS

SEQ ID NO: 847070 - protein, 24 aa, Mycobacterium
PTHATYYSIAPPLPGTRISRRSIV

SEQ ID NO: 847071 - protein, 21 aa, Mycobacterium
PTHCWFEPKGWGFQVYPALDC

SEQ ID NO: 847072 - protein, 31 aa, Mycobacterium
PTHFAGMLTVVLKLFNIIAPDRAYFGEKDYQ

SEQ ID NO: 847073 - protein, 33 aa, Mycobacterium
PTHFAGMLTVVLKLLQIVAPDRAYFGEKDYQQL

SEQ ID NO: 847074 - protein, 34 aa, Mycobacterium
PTHFAGVLTVVLKLLQIVAPDRAFFGEKDYQQLV

SEQ ID NO: 847075 - protein, 27 aa, Mycobacterium
PTHGRIPMYPISPFGPLAHGGPITRTV

SEQ ID NO: 847076 - protein, 21 aa, Mycobacterium
PTHGTVIPKQIGVTTSTPGTT

SEQ ID NO: 847077 - protein, 24 aa, Mycobacterium
PTHIMQIVTWLAQSPQLLAVALGQ

SEQ ID NO: 847078 - protein, 26 aa, Mycobacterium
PTHPANTKCYCRLHWRALCSPDCGPN

SEQ ID NO: 847079 - protein, 31 aa, Mycobacterium
PTHPSNLKLLCRHHHLLKTFYTGPDGWRDRQ

SEQ ID NO: 847080 - protein, 29 aa, Mycobacterium
PTHQIGDLIVLFAYNPFSTSAPTKPSAGG

SEQ ID NO: 847081 - protein, 19 aa, Mycobacterium
PTIADLLKPLGYATGQFGK

SEQ ID NO: 847082 - protein, 20 aa, Mycobacterium
PTIAVLYYRAQHLAGNTAYV

SEQ ID NO: 847083 - protein, 20 aa, Mycobacterium
PTIFPGHWYSAERSAPLSEV

SEQ ID NO: 847084 - protein, 21 aa, Mycobacterium
PTIMQPHNPPYYPRLVEAAGY

SEQ ID NO: 847085 - protein, 24 aa, Mycobacterium
PTISALTAGPAIDIGPGDPVRTIS

SEQ ID NO: 847086 - protein, 28 aa, Mycobacterium
PTISSQLPPLFNDLIRRPVRRRVDNDTM

SEQ ID NO: 847087 - protein, 32 aa, Mycobacterium
PTIYDDLRVIDNVRYFAALYGTSPAAADQAVD

SEQ ID NO: 847088 - protein, 32 aa, Mycobacterium
PTIYNDLRIVDNVRYFATLYGFDGRAADAAIE

SEQ ID NO: 847089 - protein, 18 aa, Mycobacterium
PTKEFLAHREQYGDTSRL

SEQ ID NO: 847090 - protein, 23 aa, Mycobacterium
PTKHAGLLAWVREIAELTQPDRV

SEQ ID NO: 847091 - protein, 22 aa, Mycobacterium
PTKQDASTPPTPPARRGRAARR

SEQ ID NO: 847092 - protein, 17 aa, Mycobacterium
PTKTLVASAYAAHLARR

SEQ ID NO: 847093 - protein, 21 aa, Mycobacterium
PTKTSMGWSLPAEKIGPALED

SEQ ID NO: 847094 - protein, 19 aa, Mycobacterium
PTKVLNRYSGRTLRFAAAS

SEQ ID NO: 847095 - protein, 23 aa, Mycobacterium
PTLADAVLPLRWTDGGDARVRVL

SEQ ID NO: 847096 - protein, 23 aa, Mycobacterium
PTLADAVLPLRWTDGGENRVRVL

SEQ ID NO: 847097 - protein, 17 aa, Mycobacterium
PTLATVPVYALPSYFMA

SEQ ID NO: 847098 - protein, 25 aa, Mycobacterium
PTLDYVVVKAPRFAFEKFPGADATL

SEQ ID NO: 847099 - protein, 26 aa, Mycobacterium
PTLDYVVVKSPRFAFEKFPGADPTLT

SEQ ID NO: 847100 - protein, 17 aa, Mycobacterium
PTLFVFTSIGRLGHDRD

SEQ ID NO: 847101 - protein, 18 aa, Mycobacterium
PTLGEFFTALRERRILGV

SEQ ID NO: 847102 - protein, 20 aa, Mycobacterium
PTLHDVVVLEREICVAYDAT

SEQ ID NO: 847103 - protein, 18 aa, Mycobacterium
PTLHRPVSALLADPKVPV

SEQ ID NO: 847104 - protein, 19 aa, Mycobacterium
PTLHRPVSALLADPKVPVF

SEQ ID NO: 847105 - protein, 17 aa, Mycobacterium
PTLLAPALGAATIGDGL

SEQ ID NO: 847106 - protein, 26 aa, Mycobacterium
PTLNNMGTPFLPQWACEPEDVAAAVC

SEQ ID NO: 847107 - protein, 19 aa, Mycobacterium
PTLNRLIETARGRVIVACF

SEQ ID NO: 847108 - protein, 29 aa, Mycobacterium
PTLPFTGTPPMPTMPFTPPPAATPDTTEA

SEQ ID NO: 847109 - protein, 28 aa, Mycobacterium
PTLPTLATVARRLPALFSAFRTVRKGPG

SEQ ID NO: 847110 - protein, 17 aa, Mycobacterium
PTLQLMLSGLRAVGIDG

SEQ ID NO: 847111 - protein, 25 aa, Mycobacterium
PTLSSLMAWPTEHLTNAADYWSSTG

SEQ ID NO: 847112 - protein, 31 aa, Mycobacterium
PTLSVTRRRHLLAQFLFRGDAVDLPVRALSG

SEQ ID NO: 847113 - protein, 22 aa, Mycobacterium
PTLTARLPDGSLAARQPLRVVV

SEQ ID NO: 847114 - protein, 21 aa, Mycobacterium
PTLVAALAQLQARCRRIASIC

SEQ ID NO: 847115 - protein, 17 aa, Mycobacterium
PTLVYRLLTRKPHSGDY

SEQ ID NO: 847116 - protein, 18 aa, Mycobacterium
PTLWPQREALKAALQFPA

SEQ ID NO: 847117 - protein, 30 aa, Mycobacterium
PTMARRVARWMVVFLQRPGGQAQFSVWSGL

SEQ ID NO: 847118 - protein, 19 aa, Mycobacterium
PTMCVRGWFPDGQQLHQRG

SEQ ID NO: 847119 - protein, 19 aa, Mycobacterium
PTMGRVLLIAPTFEPTLSE

SEQ ID NO: 847120 - protein, 32 aa, Mycobacterium
PTMIEMLLGKGLLDAVPLKTLIYGASPITVDT

SEQ ID NO: 847121 - protein, 23 aa, Mycobacterium
PTMITVIAWRTALVTPAALPAID

SEQ ID NO: 847122 - protein, 19 aa, Mycobacterium
PTMMGEVRRYFRDHGWSLK

SEQ ID NO: 847123 - protein, 18 aa, Mycobacterium
PTMQDYFEAKARLVDPTS

SEQ ID NO: 847124 - protein, 17 aa, Mycobacterium
PTNAVLYELLIAARTDD

SEQ ID NO: 847125 - protein, 24 aa, Mycobacterium
PTNDNRFLFYPAIKELTLDVASVV

SEQ ID NO: 847126 - protein, 30 aa, Mycobacterium
PTNHLDADSIGWLRAFLQNHNGGLVVISHD

SEQ ID NO: 847127 - protein, 30 aa, Mycobacterium
PTNHLDADSIGWLRSFLQNHDGGLVVISHN

SEQ ID NO: 847128 - protein, 18 aa, Mycobacterium
PTNLGRLVLGKEAPLPCT

SEQ ID NO: 847129 - protein, 20 aa, Mycobacterium
PTNLGRLVLNNPAPLPCTPR

SEQ ID NO: 847130 - protein, 24 aa, Mycobacterium
PTNLGRLVLNTPAPLPCTPRGIVH

SEQ ID NO: 847131 - protein, 25 aa, Mycobacterium
PTNLGRLVLNTPAPLPCTPRGIVHL

SEQ ID NO: 847132 - protein, 23 aa, Mycobacterium
PTNRKLILVIAVNRTFCGSKFID

SEQ ID NO: 847133 - protein, 27 aa, Mycobacterium
PTNVNTPLFMNEGTMKLFRPDLENPGP

SEQ ID NO: 847134 - protein, 19 aa, Mycobacterium
PTNYRLLASILTGYVARHP

SEQ ID NO: 847135 - protein, 25 aa, Mycobacterium
PTPAANSIAWLIWHSARVQDVQVAD

SEQ ID NO: 847136 - protein, 34 aa, Mycobacterium
PTPADAADALALAICHCWRAPMIARLAAAETLAA

SEQ ID NO: 847137 - protein, 22 aa, Mycobacterium
PTPASDLYSLGATLFCALTGHA

SEQ ID NO: 847138 - protein, 25 aa, Mycobacterium
PTPAYRCLDLYYPDYATACEAVTTP

SEQ ID NO: 847139 - protein, 28 aa, Mycobacterium
PTPDANSIAWLLWHSARVQDLQLADVAG

SEQ ID NO: 847140 - protein, 29 aa, Mycobacterium
PTPDMKLDMPLVDFFSHGGSLKSSWYGDC

SEQ ID NO: 847141 - protein, 30 aa, Mycobacterium
PTPDMKLEMPLIDFFSRGGSLKSSWYGDCL

SEQ ID NO: 847142 - protein, 30 aa, Mycobacterium
PTPDMRLDMPLVDFFSRGGALKSSWYGDCL

SEQ ID NO: 847143 - protein, 24 aa, Mycobacterium
PTPEHRYGRDLRAETLCWLYEMMV

SEQ ID NO: 847144 - protein, 30 aa, Mycobacterium
PTPEMRLDMPLLDFFSHGGALKSSWYGDCL

SEQ ID NO: 847145 - protein, 27 aa, Mycobacterium
PTPETWRRIPSWKFHLANVDPGRARTV

SEQ ID NO: 847146 - protein, 24 aa, Mycobacterium
PTPEWELRHRLARSSNLLADGRVY

SEQ ID NO: 847147 - protein, 20 aa, Mycobacterium
PTPFGLFPDVNYLEVAGMLA

SEQ ID NO: 847148 - protein, 20 aa, Mycobacterium
PTPFGLFPDVSLQVVADALV

SEQ ID NO: 847149 - protein, 29 aa, Mycobacterium
PTPGRAQFHYLESWLLPALHLRVTVFHFN

SEQ ID NO: 847150 - protein, 34 aa, Mycobacterium
PTPGRAQFHYLESWLLPSLGLRATVFHFNPGHER

SEQ ID NO: 847151 - protein, 17 aa, Mycobacterium
PTPHHRPHWGEEGVLPA

SEQ ID NO: 847152 - protein, 22 aa, Mycobacterium
PTPIDYFVAEVLRIISGGRIIW

SEQ ID NO: 847153 - protein, 27 aa, Mycobacterium
PTPLERDTCWPWLEAEWRLVSEHVRTI

SEQ ID NO: 847154 - protein, 21 aa, Mycobacterium
PTPLPAALGVFPASAQALSTS

SEQ ID NO: 847155 - protein, 28 aa, Mycobacterium
PTPLQRLTDPFWLTDTFTLDGDERVDAR

SEQ ID NO: 847156 - protein, 19 aa, Mycobacterium
PTPPPAAAPPPRQAEPRPV

SEQ ID NO: 847157 - protein, 18 aa, Mycobacterium
PTPPPSPPRRLVFEVTPT

SEQ ID NO: 847158 - protein, 25 aa, Mycobacterium
PTPSPFAASLLFGYVGAFMYEGDSP

SEQ ID NO: 847159 - protein, 20 aa, Mycobacterium
PTPVAWTRMRAPRSLMDTIG

SEQ ID NO: 847160 - protein, 22 aa, Mycobacterium
PTPVAWTRMRAPRSLMGAIGSE

SEQ ID NO: 847161 - protein, 19 aa, Mycobacterium
PTPVVGVLGILDNVSRRLP

SEQ ID NO: 847162 - protein, 24 aa, Mycobacterium
PTQGEGPWHLLPKGPVVCSSESPA

SEQ ID NO: 847163 - protein, 25 aa, Mycobacterium
PTQQKLFAESGFAWAPDGRHIAWVQ

SEQ ID NO: 847164 - protein, 23 aa, Mycobacterium
PTQREAFDLFPANLTRGLVMTRN

SEQ ID NO: 847165 - protein, 24 aa, Mycobacterium
PTQVESMILPPIAHEVRVISIAQF

SEQ ID NO: 847166 - protein, 20 aa, Mycobacterium
PTQVLLGRPLIGNGADGTAA

SEQ ID NO: 847167 - protein, 24 aa, Mycobacterium
PTQWVNRYQALVDPLVATPGKTSD

SEQ ID NO: 847168 - protein, 17 aa, Mycobacterium
PTQYDTLRRALYQTLRG

SEQ ID NO: 847169 - protein, 20 aa, Mycobacterium
PTRAAILLSLRSRPGYPSEL

SEQ ID NO: 847170 - protein, 25 aa, Mycobacterium
PTRDRDFTCFYLRAGELIAADCINR

SEQ ID NO: 847171 - protein, 25 aa, Mycobacterium
PTRERDFTCFYLRAGELLAADCINR

SEQ ID NO: 847172 - protein, 18 aa, Mycobacterium
PTRGAPLCAFRETSRILA

SEQ ID NO: 847173 - protein, 19 aa, Mycobacterium
PTRGAPLCAFRETSRILAG

SEQ ID NO: 847174 - protein, 30 aa, Mycobacterium
PTRHNYGLALWQNRIERILAEWVAELRVRI

SEQ ID NO: 847175 - protein, 20 aa, Mycobacterium
PTRHPYALGLLQHYTEKTLA

SEQ ID NO: 847176 - protein, 25 aa, Mycobacterium
PTRHTFGLALLQYRIERTLSEWVGE

SEQ ID NO: 847177 - protein, 20 aa, Mycobacterium
PTRITAVLGILKAYTTRVGS

SEQ ID NO: 847178 - protein, 29 aa, Mycobacterium
PTRLRNHNGYLLRWDNEGFLFDPGEGTQR

SEQ ID NO: 847179 - protein, 17 aa, Mycobacterium
PTRLRVFDLILTHGMAT

SEQ ID NO: 847180 - protein, 23 aa, Mycobacterium
PTRLSPAWVYSKAMRRRAPWLQE

SEQ ID NO: 847181 - protein, 24 aa, Mycobacterium
PTRMMSLQMVAVQLALKTAIAEVQ

SEQ ID NO: 847182 - protein, 23 aa, Mycobacterium
PTRPEPPLPPGPPRRRAQPPTAP

SEQ ID NO: 847183 - protein, 17 aa, Mycobacterium
PTRPGWPNTLAGDGRTE

SEQ ID NO: 847184 - protein, 22 aa, Mycobacterium
PTRPHPLFAAFVKAAIDYKEGE

SEQ ID NO: 847185 - protein, 25 aa, Mycobacterium
PTRPHPLFVAFVKAAIDYKGGELLP

SEQ ID NO: 847186 - protein, 24 aa, Mycobacterium
PTRPPFTGLPVDPTGLLARTLALP

SEQ ID NO: 847187 - protein, 31 aa, Mycobacterium
PTRPTAWLAEGLLMYLPAEAQDKLFTQIGEL

SEQ ID NO: 847188 - protein, 24 aa, Mycobacterium
PTRRGAQLTAALTAPTAPTVSVVD

SEQ ID NO: 847189 - protein, 24 aa, Mycobacterium
PTRRIRAMRWGLVPNWATARQDGR

SEQ ID NO: 847190 - protein, 27 aa, Mycobacterium
PTRRLHAPRLLRLIDPIIRTTIGKTVY

SEQ ID NO: 847191 - protein, 26 aa, Mycobacterium
PTRTELGTYMFFLDCAGHIDDDPVAE

SEQ ID NO: 847192 - protein, 39 aa, Mycobacterium
PTRTHRLLHAGAIDLRIGGPFRLFPKAAAPGALHFQAGD

SEQ ID NO: 847193 - protein, 36 aa, Mycobacterium
PTRTHRLLHAGAIDLRIGGPFRLFPKAENPGALHFQ

SEQ ID NO: 847194 - protein, 23 aa, Mycobacterium
PTRTVAGYPPLSRQRLCVLDYVR

SEQ ID NO: 847195 - protein, 21 aa, Mycobacterium
PTRYAVLPHMRAACWDAMVTL

SEQ ID NO: 847196 - protein, 17 aa, Mycobacterium
PTRYRLLETVRQYAQEK

SEQ ID NO: 847197 - protein, 23 aa, Mycobacterium
PTSAIAVLTFASEWKALELGRAA

SEQ ID NO: 847198 - protein, 22 aa, Mycobacterium
PTSALLDATFPPASVTGTPKLR

SEQ ID NO: 847199 - protein, 17 aa, Mycobacterium
PTSGGLIPYLTVTDARA

SEQ ID NO: 847200 - protein, 17 aa, Mycobacterium
PTSMWIEIVTTAHEVGL

SEQ ID NO: 847201 - protein, 17 aa, Mycobacterium
PTSMWIEVITTAHEVGL

SEQ ID NO: 847202 - protein, 28 aa, Mycobacterium
PTSPTAAPQRRPSAGPAGLPSCTGTASA

SEQ ID NO: 847203 - protein, 23 aa, Mycobacterium
PTSRLSCQMQVSEAWDGLIVHLP

SEQ ID NO: 847204 - protein, 17 aa, Mycobacterium
PTSRRVLAALGDKVLKL

SEQ ID NO: 847205 - protein, 25 aa, Mycobacterium
PTSSFMFRDLIPLLARNHRVIAPDH

SEQ ID NO: 847206 - protein, 24 aa, Mycobacterium
PTSSGWRMLSGDETGWLLGDYILS

SEQ ID NO: 847207 - protein, 25 aa, Mycobacterium
PTSSYMFRHLLPALADRYHVVAPDH

SEQ ID NO: 847208 - protein, 27 aa, Mycobacterium
PTSTIALAWLLRRSPVIVPIPGTSSVD

SEQ ID NO: 847209 - protein, 24 aa, Mycobacterium
PTSTSPIHVAQQQALAAINTPAQA

SEQ ID NO: 847210 - protein, 25 aa, Mycobacterium
PTSTSPIHVAQQQALVAINSPVQDL

SEQ ID NO: 847211 - protein, 26 aa, Mycobacterium
PTSVAAIAWMGYEPPPNPLDTATAGD

SEQ ID NO: 847212 - protein, 17 aa, Mycobacterium
PTSVHEALVPFTKAFKD

SEQ ID NO: 847213 - protein, 32 aa, Mycobacterium
PTSVLPYGFPYLAWVLGRLLRKLDLGVVDVLG

SEQ ID NO: 847214 - protein, 25 aa, Mycobacterium
PTTALDIAGVRYVPLRPTDLGVDLV

SEQ ID NO: 847215 - protein, 17 aa, Mycobacterium
PTTARLTGRWLRGRLPT

SEQ ID NO: 847216 - protein, 21 aa, Mycobacterium
PTTAYTYFKSKDTLIGEVYLR

SEQ ID NO: 847217 - protein, 20 aa, Mycobacterium
PTTDLATWPPVGAVPVEIAD

SEQ ID NO: 847218 - protein, 22 aa, Mycobacterium
PTTELLVPSLRMLIGGGAPCPP

SEQ ID NO: 847219 - protein, 21 aa, Mycobacterium
PTTFRTMPYWESVEPFPLPQE

SEQ ID NO: 847220 - protein, 24 aa, Mycobacterium
PTTGPPPVSRWSRRKPEAYARLEA

SEQ ID NO: 847221 - protein, 20 aa, Mycobacterium
PTTKHIPAFRLTRSSAAYWR

SEQ ID NO: 847222 - protein, 22 aa, Mycobacterium
PTTLIDALIRQGAADLTIVSNN

SEQ ID NO: 847223 - protein, 23 aa, Mycobacterium
PTTLLDLRNARMLRAAFATLPTQ

SEQ ID NO: 847224 - protein, 28 aa, Mycobacterium
PTTLLEAAILQWYWLKDKFPGDDQWNSL

SEQ ID NO: 847225 - protein, 20 aa, Mycobacterium
PTTLPYIPEGKICHWGGWGG

SEQ ID NO: 847226 - protein, 29 aa, Mycobacterium
PTTMNCLPITPGWNYMVRLYRAQRRFSTA

SEQ ID NO: 847227 - protein, 18 aa, Mycobacterium
PTTMVPAALVLLDSLPRT

SEQ ID NO: 847228 - protein, 23 aa, Mycobacterium
PTTPDSRKLFIRQGFDRWDELPA

SEQ ID NO: 847229 - protein, 18 aa, Mycobacterium
PTTPRFVGHGHLLVATHL

SEQ ID NO: 847230 - protein, 25 aa, Mycobacterium
PTTQGLFTLFDPFGKVIERLPIQTH

SEQ ID NO: 847231 - protein, 24 aa, Mycobacterium
PTTRHIPAFKLTRSSAAYWRGDQK

SEQ ID NO: 847232 - protein, 25 aa, Mycobacterium
PTTSCTWWVYHDLADIPDHVYHRVG

SEQ ID NO: 847233 - protein, 20 aa, Mycobacterium
PTTSPMVPGPAAMPAAASAA

SEQ ID NO: 847234 - protein, 25 aa, Mycobacterium
PTTVINRWLRLLPASGAPAPSSWEN

SEQ ID NO: 847235 - protein, 25 aa, Mycobacterium
PTTVSALQMAFFGALVQAGSGEFTY

SEQ ID NO: 847236 - protein, 27 aa, Mycobacterium
PTTVVAAPTPFVWIIGRTQTNGPADYP

SEQ ID NO: 847237 - protein, 17 aa, Mycobacterium
PTTWWCAPFEVDGDIGA

SEQ ID NO: 847238 - protein, 24 aa, Mycobacterium
PTVAAFLSIHNMCAWMVDSFGTEE

SEQ ID NO: 847239 - protein, 18 aa, Mycobacterium
PTVADWVRWISSDGDKPA

SEQ ID NO: 847240 - protein, 18 aa, Mycobacterium
PTVAEWVRWLSAGGDKPT

SEQ ID NO: 847241 - protein, 22 aa, Mycobacterium
PTVAGMRMLGVDPVLSATLARP

SEQ ID NO: 847242 - protein, 27 aa, Mycobacterium
PTVAKLLPYVLYETLGPTLPDGLAGAA

SEQ ID NO: 847243 - protein, 32 aa, Mycobacterium
PTVAQLLPYVLYETLGPTLPDGLRGAAALWGL

SEQ ID NO: 847244 - protein, 26 aa, Mycobacterium
PTVATVPWTTDRLLHALTRESDTTKW

SEQ ID NO: 847245 - protein, 21 aa, Mycobacterium
PTVAVLYYRAQQLAGNIAYVD

SEQ ID NO: 847246 - protein, 20 aa, Mycobacterium
PTVELVELLGPRAIVTVRSG

SEQ ID NO: 847247 - protein, 17 aa, Mycobacterium
PTVIYPLGAFEPGQLLD

SEQ ID NO: 847248 - protein, 18 aa, Mycobacterium
PTVLLLHGFPSSSFDFRS

SEQ ID NO: 847249 - protein, 21 aa, Mycobacterium
PTVNNMLRVGARQFKMPRPSL

SEQ ID NO: 847250 - protein, 22 aa, Mycobacterium
PTVPALPPRMVPLSDSLVMIGP

SEQ ID NO: 847251 - protein, 18 aa, Mycobacterium
PTVQSFLGLATTCGPAAA

SEQ ID NO: 847252 - protein, 18 aa, Mycobacterium
PTVRFPGIDIELSKVLHA

SEQ ID NO: 847253 - protein, 18 aa, Mycobacterium
PTVRRLAPLLGAGGDGPA

SEQ ID NO: 847254 - protein, 29 aa, Mycobacterium
PTVRSRILAALPHLLLLDAVGASESGAQM

SEQ ID NO: 847255 - protein, 17 aa, Mycobacterium
PTVTGAVPTIWNAVLHH

SEQ ID NO: 847256 - protein, 35 aa, Mycobacterium
PTVTPTVIVLPGPPRELQPMWRRAIETPAAQQAIA

SEQ ID NO: 847257 - protein, 26 aa, Mycobacterium
PTVTTKVGFLPPPYFAATTIEEFMDL

SEQ ID NO: 847258 - protein, 23 aa, Mycobacterium
PTVTTPQMFIHRLTLQARSDRKH

SEQ ID NO: 847259 - protein, 17 aa, Mycobacterium
PTVWLRVAGDESCARAL

SEQ ID NO: 847260 - protein, 20 aa, Mycobacterium
PTVYDLLGMTPPDTVRGIAQ

SEQ ID NO: 847261 - protein, 25 aa, Mycobacterium
PTVYFTTPHFDGYPAVLVVLSEIEA

SEQ ID NO: 847262 - protein, 25 aa, Mycobacterium
PTVYNDLRVIDNIRYFAELCGVDGQ

SEQ ID NO: 847263 - protein, 18 aa, Mycobacterium
PTWAPLPVQYADYAAWQS

SEQ ID NO: 847264 - protein, 30 aa, Mycobacterium
PTWKKSFGLHPLLAFLDRPEIAGGEALAGL

SEQ ID NO: 847265 - protein, 21 aa, Mycobacterium
PTWRLARVQARRWLPRCCSRP

SEQ ID NO: 847266 - protein, 20 aa, Mycobacterium
PTWSDRCYFFAASPDGTLLL

SEQ ID NO: 847267 - protein, 19 aa, Mycobacterium
PTYEVIPTPGAWSDYFRGI

SEQ ID NO: 847268 - protein, 17 aa, Mycobacterium
PTYEYLVTQLKALQFLR

SEQ ID NO: 847269 - protein, 19 aa, Mycobacterium
PTYGRWLAKNLSNVALPVN

SEQ ID NO: 847270 - protein, 17 aa, Mycobacterium
PTYILRGLTELHLDFTP

SEQ ID NO: 847271 - protein, 25 aa, Mycobacterium
PTYKATYTGLLKLFLDQFGQGELGQ

SEQ ID NO: 847272 - protein, 19 aa, Mycobacterium
PTYLNDFVQLLAALGRRYD

SEQ ID NO: 847273 - protein, 22 aa, Mycobacterium
PTYLYRYDFAPRTLQWAGLGAT

SEQ ID NO: 847274 - protein, 23 aa, Mycobacterium
PTYLYRYDYAPRTLRWSGFGATH

SEQ ID NO: 847275 - protein, 27 aa, Mycobacterium
PTYQSTLRLLHYYAFPAELVGRDDVWR

SEQ ID NO: 847276 - protein, 21 aa, Mycobacterium
PTYRTIFYEELPACLNALTLD

SEQ ID NO: 847277 - protein, 25 aa, Mycobacterium
PTYSYWFEPNPYWSRLYAPGSELKK

SEQ ID NO: 847278 - protein, 21 aa, Mycobacterium
PTYVYRYDYAPRALRWSGLGA

SEQ ID NO: 847279 - protein, 23 aa, Mycobacterium
PVAAACASMNYQMSRYGVSRDGS

SEQ ID NO: 847280 - protein, 28 aa, Mycobacterium
PVAAADQLILMRLIIGRAARRHGLRISL

SEQ ID NO: 847281 - protein, 24 aa, Mycobacterium
PVAAEPFAMWVLEDDFSHGRPPLE

SEQ ID NO: 847282 - protein, 19 aa, Mycobacterium
PVAAFPPRELAVAWCEADH

SEQ ID NO: 847283 - protein, 26 aa, Mycobacterium
PVAAGEPLFTLYTDTPERFGAAVAEL

SEQ ID NO: 847284 - protein, 17 aa, Mycobacterium
PVAALDGALAKALVLRA

SEQ ID NO: 847285 - protein, 27 aa, Mycobacterium
PVAALSELPLLLLDEGHCLRDQALDVC

SEQ ID NO: 847286 - protein, 18 aa, Mycobacterium
PVAALSLATRQLVEICRA

SEQ ID NO: 847287 - protein, 31 aa, Mycobacterium
PVAARVRNAGAIFLGPWSPVSLGDYCAGSNH

SEQ ID NO: 847288 - protein, 26 aa, Mycobacterium
PVADFLMMGLAYHRFALANPQRYQLI

SEQ ID NO: 847289 - protein, 26 aa, Mycobacterium
PVADHLPGLSALLRISRDVGSVLLGG

SEQ ID NO: 847290 - protein, 33 aa, Mycobacterium
PVADLARQYAQSSSILFLGRHVGYPVALEGALK

SEQ ID NO: 847291 - protein, 19 aa, Mycobacterium
PVADLNIAAWLLDHVDSPA

SEQ ID NO: 847292 - protein, 25 aa, Mycobacterium
PVADPTLTLHLWKGGPPDVSESLRE

SEQ ID NO: 847293 - protein, 27 aa, Mycobacterium
PVAEFAQLRRTAPVWWNAQQESIFDDG

SEQ ID NO: 847294 - protein, 27 aa, Mycobacterium
PVAGPLVGRLGWWLESRLSPRMHRRNQ

SEQ ID NO: 847295 - protein, 17 aa, Mycobacterium
PVAGSRQLMECIGSPDA

SEQ ID NO: 847296 - protein, 25 aa, Mycobacterium
PVAHAYLTAMPMLVITGQKAVRDNR

SEQ ID NO: 847297 - protein, 19 aa, Mycobacterium
PVAITAGPPRSSGTTLANL

SEQ ID NO: 847298 - protein, 20 aa, Mycobacterium
PVALALVKRGLPADTELMTG

SEQ ID NO: 847299 - protein, 19 aa, Mycobacterium
PVALARRIQLLYDGALLGS

SEQ ID NO: 847300 - protein, 22 aa, Mycobacterium
PVALIPLARRDIPDCLAEELRR

SEQ ID NO: 847301 - protein, 18 aa, Mycobacterium
PVALKYPPRQFGVGKERN

SEQ ID NO: 847302 - protein, 17 aa, Mycobacterium
PVALLAPGTSFARWSTL

SEQ ID NO: 847303 - protein, 20 aa, Mycobacterium
PVALMAKRLPGLAYRPRTID

SEQ ID NO: 847304 - protein, 17 aa, Mycobacterium
PVALMQVGLTTMASGLP

SEQ ID NO: 847305 - protein, 21 aa, Mycobacterium
PVALNYLRPFIGARELLHSTP

SEQ ID NO: 847306 - protein, 19 aa, Mycobacterium
PVALRRLRRQLLRAEEAAG

SEQ ID NO: 847307 - protein, 22 aa, Mycobacterium
PVALRRTRWKIWKFQHDNTATF

SEQ ID NO: 847308 - protein, 22 aa, Mycobacterium
PVALYHTKRLASPGQRIVLYAQ

SEQ ID NO: 847309 - protein, 21 aa, Mycobacterium
PVALYHTKRLASPGQRVVLYA

SEQ ID NO: 847310 - protein, 22 aa, Mycobacterium
PVAPAARPQLPAGALTSASAAD

SEQ ID NO: 847311 - protein, 24 aa, Mycobacterium
PVAPEAVPMRLRFARSVRISMEGN

SEQ ID NO: 847312 - protein, 30 aa, Mycobacterium
PVAPMEPSPYLPTSRRFVNPLYLRVEAVPE

SEQ ID NO: 847313 - protein, 21 aa, Mycobacterium
PVAPMGFISTRYYVSMNVADK

SEQ ID NO: 847314 - protein, 24 aa, Mycobacterium
PVAQMAWIVEKFWSWMDCDGHPEN

SEQ ID NO: 847315 - protein, 31 aa, Mycobacterium
PVAQVAPWNYPMMMAVWKFAPALAAGCTVVL

SEQ ID NO: 847316 - protein, 29 aa, Mycobacterium
PVAQYTPEQWWPFIGHLSLDQSIAQGVTL

SEQ ID NO: 847317 - protein, 20 aa, Mycobacterium
PVARAVLGVPYTWAAMRATR

SEQ ID NO: 847318 - protein, 17 aa, Mycobacterium
PVARRLMEVYAGFLAHT

SEQ ID NO: 847319 - protein, 28 aa, Mycobacterium
PVARVEPIWLDWVSRWPTPSATAAASAA

SEQ ID NO: 847320 - protein, 18 aa, Mycobacterium
PVARYWPEFAQAGKRDIT

SEQ ID NO: 847321 - protein, 17 aa, Mycobacterium
PVASWFRHRGARISMVP

SEQ ID NO: 847322 - protein, 23 aa, Mycobacterium
PVATLILAELRKAVATPGVAFIA

SEQ ID NO: 847323 - protein, 30 aa, Mycobacterium
PVATRVRRAFWLLERFAPALGSRWATELWC

SEQ ID NO: 847324 - protein, 20 aa, Mycobacterium
PVATTLLLPSVLDAVRGTGI

SEQ ID NO: 847325 - protein, 25 aa, Mycobacterium
PVATVYFKTILALMTRNAVVVAPHP

SEQ ID NO: 847326 - protein, 26 aa, Mycobacterium
PVATVYFKVILALMTRNAVVVAPHPR

SEQ ID NO: 847327 - protein, 26 aa, Mycobacterium
PVAVKEAVLPFHRFRRADGAQIDSLL

SEQ ID NO: 847328 - protein, 24 aa, Mycobacterium
PVAVRAHLAPYLPGHPLAAELSDD

SEQ ID NO: 847329 - protein, 30 aa, Mycobacterium
PVAVRSHLAPFLPGHPFAPELPPGRPVSSA

SEQ ID NO: 847330 - protein, 28 aa, Mycobacterium
PVAVRSHLAPFLPGHPFAPELPQGDPVS

SEQ ID NO: 847331 - protein, 22 aa, Mycobacterium
PVAVSASFLWAPDPGPMRLVTS

SEQ ID NO: 847332 - protein, 32 aa, Mycobacterium
PVAVSWNYRGKLGYHWVIVGIDYEYNRKFGVY

SEQ ID NO: 847333 - protein, 25 aa, Mycobacterium
PVAVVAYASWPSETILRGTLADIAG

SEQ ID NO: 847334 - protein, 30 aa, Mycobacterium
PVAVVLAGDPWPHLFLPFREGASQESELPS

SEQ ID NO: 847335 - protein, 20 aa, Mycobacterium
PVAWIHATALRTEPLAYAGR

SEQ ID NO: 847336 - protein, 20 aa, Mycobacterium
PVAWIHATALRTEPLAYSGR

SEQ ID NO: 847337 - protein, 20 aa, Mycobacterium
PVAYFDIDGKIYIVGSAAGR

SEQ ID NO: 847338 - protein, 19 aa, Mycobacterium
PVAYRRFVTWLSGQDNDAA

SEQ ID NO: 847339 - protein, 19 aa, Mycobacterium
PVCAAAALAVLRVVASEGL

SEQ ID NO: 847340 - protein, 18 aa, Mycobacterium
PVCAGFDRIRGLVCHGRG

SEQ ID NO: 847341 - protein, 18 aa, Mycobacterium
PVCRPDCPGLCPDCGIAL

SEQ ID NO: 847342 - protein, 18 aa, Mycobacterium
PVDAGSALMIMTLGAEKG

SEQ ID NO: 847343 - protein, 24 aa, Mycobacterium
PVDAGSALMIMTLGAGKGAEVTVE

SEQ ID NO: 847344 - protein, 18 aa, Mycobacterium
PVDAVLCAYIALYAARRP

SEQ ID NO: 847345 - protein, 21 aa, Mycobacterium
PVDAVLRLIDQIDGLAVHVYD

SEQ ID NO: 847346 - protein, 24 aa, Mycobacterium
PVDCDGFELFLRELSRFGLDPGVA

SEQ ID NO: 847347 - protein, 28 aa, Mycobacterium
PVDDPPWHPLPFHAVFDAPLYGEIRRAH

SEQ ID NO: 847348 - protein, 25 aa, Mycobacterium
PVDDTLQLYFLCAHPSLSPASAVAL

SEQ ID NO: 847349 - protein, 20 aa, Mycobacterium
PVDEVWPGILGFEDTVLPQL

SEQ ID NO: 847350 - protein, 23 aa, Mycobacterium
PVDFGSFLIPRTEYRIDDVWHVV

SEQ ID NO: 847351 - protein, 21 aa, Mycobacterium
PVDGFRWQGISGKLHDSLLAA

SEQ ID NO: 847352 - protein, 24 aa, Mycobacterium
PVDGLPSIFVYDGYPGGAGFADRG

SEQ ID NO: 847353 - protein, 25 aa, Mycobacterium
PVDGMEALLPLLRPSDFATLPDHLP

SEQ ID NO: 847354 - protein, 28 aa, Mycobacterium
PVDHIDPILLDLLRLGAYQILRTRVDDH

SEQ ID NO: 847355 - protein, 21 aa, Mycobacterium
PVDIGHLAAFLATDEAGYITG

SEQ ID NO: 847356 - protein, 28 aa, Mycobacterium
PVDIKKQMIAWWGPIIDEYYAASEAVGA

SEQ ID NO: 847357 - protein, 33 aa, Mycobacterium
PVDITGRLRQILELLLPGTVTEASLPYFRQFLG

SEQ ID NO: 847358 - protein, 30 aa, Mycobacterium
PVDITIISPVDYMLYTPLLPDVAGGVVDAR

SEQ ID NO: 847359 - protein, 32 aa, Mycobacterium
PVDLHDWQQWWDWVPGAYWRHPFGPGSDIDGA

SEQ ID NO: 847360 - protein, 17 aa, Mycobacterium
PVDLIVADLSFISLASV

SEQ ID NO: 847361 - protein, 29 aa, Mycobacterium
PVDLRDWRQWWRWVPGASWRHPFGPDSDV

SEQ ID NO: 847362 - protein, 29 aa, Mycobacterium
PVDPDAAQRMWRLTRGNVLYLRNIVEQEV

SEQ ID NO: 847363 - protein, 29 aa, Mycobacterium
PVDPVARRLWGVPVVLNQGLGAKTGLVIG

SEQ ID NO: 847364 - protein, 22 aa, Mycobacterium
PVDRPIPRPQAPRPGAPRPGAP

SEQ ID NO: 847365 - protein, 25 aa, Mycobacterium
PVDRTMAFALLIGPLAFGRISTLTE

SEQ ID NO: 847366 - protein, 27 aa, Mycobacterium
PVDRTTLFRLALIATARLTTSGSGVDV

SEQ ID NO: 847367 - protein, 23 aa, Mycobacterium
PVDSPRLRLALGPGVMLPPTLIQ

SEQ ID NO: 847368 - protein, 25 aa, Mycobacterium
PVDTFAGFIFLNPDPNAQPLRDFLG

SEQ ID NO: 847369 - protein, 22 aa, Mycobacterium
PVDTLIELGGKTWRFVDTAGLR

SEQ ID NO: 847370 - protein, 23 aa, Mycobacterium
PVDTRFPALPLTLGEAIEAFRAD

SEQ ID NO: 847371 - protein, 34 aa, Mycobacterium
PVDVHALPMVFDLMSGIYWRPGESGGLLWGMSNP

SEQ ID NO: 847372 - protein, 23 aa, Mycobacterium
PVDWRFKGLPASWAGRTPADIVG

SEQ ID NO: 847373 - protein, 28 aa, Mycobacterium
PVDWTEEHSYFFRLSAYQDKLLAHYEAH

SEQ ID NO: 847374 - protein, 27 aa, Mycobacterium
PVEDCYAALLWLAHQPWVDPDRVAVGG

SEQ ID NO: 847375 - protein, 17 aa, Mycobacterium
PVEDCYAALLWLRQQQW

SEQ ID NO: 847376 - protein, 17 aa, Mycobacterium
PVEDCYSALKWLSALPA

SEQ ID NO: 847377 - protein, 20 aa, Mycobacterium
PVEKVRYRTVQQPNSLAYDE

SEQ ID NO: 847378 - protein, 19 aa, Mycobacterium
PVELICRNSRPPHGVLTRR

SEQ ID NO: 847379 - protein, 29 aa, Mycobacterium
PVELKALHEFFTPLLRNVGKSGRLLVIGT

SEQ ID NO: 847380 - protein, 23 aa, Mycobacterium
PVELLRDLVAIYDAGRREPIPLP

SEQ ID NO: 847381 - protein, 24 aa, Mycobacterium
PVEMLLPLHHLKAAGFGIDVATVS

SEQ ID NO: 847382 - protein, 23 aa, Mycobacterium
PVEMQLIMDWLGEQRARTPGAKF

SEQ ID NO: 847383 - protein, 25 aa, Mycobacterium
PVERIWQIYADPRQLEKIWGPPEYP

SEQ ID NO: 847384 - protein, 19 aa, Mycobacterium
PVERIYRDVRLLRLYEGTS

SEQ ID NO: 847385 - protein, 24 aa, Mycobacterium
PVERPLIVLGMPRTGTTVISYLLD

SEQ ID NO: 847386 - protein, 23 aa, Mycobacterium
PVERTKFMRFLDERKIGFRQLFA

SEQ ID NO: 847387 - protein, 25 aa, Mycobacterium
PVERVRDTMYPGLTRKLVTADDAEM

SEQ ID NO: 847388 - protein, 18 aa, Mycobacterium
PVERWYRDLRAIGIAEGV

SEQ ID NO: 847389 - protein, 20 aa, Mycobacterium
PVETAFRQLAPRPVTAAWGA

SEQ ID NO: 847390 - protein, 24 aa, Mycobacterium
PVETFIPVAAISELLLRPGQTLAY

SEQ ID NO: 847391 - protein, 20 aa, Mycobacterium
PVETLAYAQDLLDRGLAFNA

SEQ ID NO: 847392 - protein, 31 aa, Mycobacterium
PVETPPPADPAPAEPPAPAAAPAAEPTPAAG

SEQ ID NO: 847393 - protein, 22 aa, Mycobacterium
PVETPTLVIPPPVTGPKHESAT

SEQ ID NO: 847394 - protein, 25 aa, Mycobacterium
PVEVAHAVAYFAHPLSRSTTGSTLM

SEQ ID NO: 847395 - protein, 17 aa, Mycobacterium
PVEVLFDAICRENGIEH

SEQ ID NO: 847396 - protein, 19 aa, Mycobacterium
PVEWLRIPPGGTVLDIGCG

SEQ ID NO: 847397 - protein, 17 aa, Mycobacterium
PVEYLAETVLAMCHLPA

SEQ ID NO: 847398 - protein, 18 aa, Mycobacterium
PVEYLAETVLAMCHRPAA

SEQ ID NO: 847399 - protein, 27 aa, Mycobacterium
PVFDGRRVALMLAVHPLCPLSARQIRV

SEQ ID NO: 847400 - protein, 20 aa, Mycobacterium
PVFDQLVHLAGHRPIERYGS

SEQ ID NO: 847401 - protein, 24 aa, Mycobacterium
PVFERFGADLPPLKGVYLAAMAGG

SEQ ID NO: 847402 - protein, 30 aa, Mycobacterium
PVFGALLARGWRIFFAHRTFAWSSDAVGQA

SEQ ID NO: 847403 - protein, 17 aa, Mycobacterium
PVFKIAGAAIEAGADLD

SEQ ID NO: 847404 - protein, 26 aa, Mycobacterium
PVFMAGLWSVWKPDKSAAPLLSCTII

SEQ ID NO: 847405 - protein, 25 aa, Mycobacterium
PVFNEPFAGFWLTPKQHQDALAERH

SEQ ID NO: 847406 - protein, 26 aa, Mycobacterium
PVFNVNFMPLNHLGGRIPLSTAFQAG

SEQ ID NO: 847407 - protein, 18 aa, Mycobacterium
PVFPGLRYEEWKLEDPHG

SEQ ID NO: 847408 - protein, 27 aa, Mycobacterium
PVFSAWTLQLYLRYEAAIADLVGIRMA

SEQ ID NO: 847409 - protein, 23 aa, Mycobacterium
PVFTRGSAMGARTTCPARTAVTA

SEQ ID NO: 847410 - protein, 17 aa, Mycobacterium
PVFVTLSGWAHDLRAYD

SEQ ID NO: 847411 - protein, 20 aa, Mycobacterium
PVFYVQQAMKVPWVEPSDIS

SEQ ID NO: 847412 - protein, 22 aa, Mycobacterium
PVGALVLCGPTTRFTRRDIEPF

SEQ ID NO: 847413 - protein, 32 aa, Mycobacterium
PVGALVVFEVMVRPLIRLALGRRQSQRRIIQA

SEQ ID NO: 847414 - protein, 26 aa, Mycobacterium
PVGAPPTLFTPGYYNDLTVPVGVIDP

SEQ ID NO: 847415 - protein, 24 aa, Mycobacterium
PVGDPARPLTVTGGLTFAGGPWSN

SEQ ID NO: 847416 - protein, 24 aa, Mycobacterium
PVGDPRWRSVLPQDFSNMAAVQRG

SEQ ID NO: 847417 - protein, 24 aa, Mycobacterium
PVGDSGFYFVSRWDLVVEATERAE

SEQ ID NO: 847418 - protein, 28 aa, Mycobacterium
PVGDTRFLYYMGWNLAVTVPWKNAIGLA

SEQ ID NO: 847419 - protein, 27 aa, Mycobacterium
PVGDVYACPFAIHDRFLAGNVLSDNGF

SEQ ID NO: 847420 - protein, 32 aa, Mycobacterium
PVGEEWLYQSWAAAYLPLMRVLNTLAGEDRQG

SEQ ID NO: 847421 - protein, 32 aa, Mycobacterium
PVGEEWLYQSWAAAYLPLVRVLRTLAAEGRSH

SEQ ID NO: 847422 - protein, 34 aa, Mycobacterium
PVGEEWLYQSWSAAYLPLFKVLRTLAAEGRENLL

SEQ ID NO: 847423 - protein, 34 aa, Mycobacterium
PVGEEWLYQSWSAAYLPLFRVLRALAGEDRRGLV

SEQ ID NO: 847424 - protein, 33 aa, Mycobacterium
PVGEEWLYQSWSAAYLPLFRVLRTLADEGRRGL

SEQ ID NO: 847425 - protein, 33 aa, Mycobacterium
PVGEEWLYQSWSAAYLPLIRVLRTLAAENRRHL

SEQ ID NO: 847426 - protein, 26 aa, Mycobacterium
PVGEPPFFELPPIIEIDGIPRVFFIA

SEQ ID NO: 847427 - protein, 27 aa, Mycobacterium
PVGERRSMWWVFAELGRRLGYELGNLG

SEQ ID NO: 847428 - protein, 23 aa, Mycobacterium
PVGESQWWEKSPIFAALNTNKKG

SEQ ID NO: 847429 - protein, 21 aa, Mycobacterium
PVGFAALNRLLAERALSQEVH

SEQ ID NO: 847430 - protein, 18 aa, Mycobacterium
PVGFFDGNPALDVPPSPP

SEQ ID NO: 847431 - protein, 24 aa, Mycobacterium
PVGGFPITVGWLHAIRRGHARLHR

SEQ ID NO: 847432 - protein, 23 aa, Mycobacterium
PVGGLSVPPAWTSAAGPAVASGA

SEQ ID NO: 847433 - protein, 17 aa, Mycobacterium
PVGGLYDQFLGAAETDP

SEQ ID NO: 847434 - protein, 26 aa, Mycobacterium
PVGILCLELLVHAWDFAFATDRRVVV

SEQ ID NO: 847435 - protein, 23 aa, Mycobacterium
PVGLFAIMSAYLLGASKVIAVDR

SEQ ID NO: 847436 - protein, 17 aa, Mycobacterium
PVGLIFAVRDHGAPALA

SEQ ID NO: 847437 - protein, 18 aa, Mycobacterium
PVGLMRRVGLGDTLRMAL

SEQ ID NO: 847438 - protein, 19 aa, Mycobacterium
PVGLRRQVRTLAGLGSIVP

SEQ ID NO: 847439 - protein, 18 aa, Mycobacterium
PVGLVAQCRTVVSTWSQV

SEQ ID NO: 847440 - protein, 38 aa, Mycobacterium
PVGPVAIISPFNFPAMVPLWFIPVALAAGNTVVLKPSE

SEQ ID NO: 847441 - protein, 25 aa, Mycobacterium
PVGQIPQWLFAFDAAGMALLRALAV

SEQ ID NO: 847442 - protein, 22 aa, Mycobacterium
PVGQLAWIVEKFWAWADCDGHP

SEQ ID NO: 847443 - protein, 24 aa, Mycobacterium
PVGQLIHKPPQLSWEVAGSLYVVG

SEQ ID NO: 847444 - protein, 26 aa, Mycobacterium
PVGTALSPLAFLDSLGTNGSLTRAIG

SEQ ID NO: 847445 - protein, 34 aa, Mycobacterium
PVGTLLVRGPYGRGFPFSLVFAGLYAARGYHVVL

SEQ ID NO: 847446 - protein, 22 aa, Mycobacterium
PVGTPDPGAFWRVAAEHGVKAL

SEQ ID NO: 847447 - protein, 28 aa, Mycobacterium
PVGVLNERWLTYYRKLPPAAVMNDLRTV

SEQ ID NO: 847448 - protein, 18 aa, Mycobacterium
PVGWFYPSEKEAAPLEVA

SEQ ID NO: 847449 - protein, 17 aa, Mycobacterium
PVGWVEPRDISNAVLFL

SEQ ID NO: 847450 - protein, 22 aa, Mycobacterium
PVGWYRLGRPLFSTRNLMLVRK

SEQ ID NO: 847451 - protein, 23 aa, Mycobacterium
PVGYASMLTWMRSKGKLGQVGVE

SEQ ID NO: 847452 - protein, 24 aa, Mycobacterium
PVGYTVRVLPRHPLLASGTELGLV

SEQ ID NO: 847453 - protein, 18 aa, Mycobacterium
PVHAECAGLIYLAAELDG

SEQ ID NO: 847454 - protein, 22 aa, Mycobacterium
PVHAVFIRAPWVERIGPDVEVL

SEQ ID NO: 847455 - protein, 24 aa, Mycobacterium
PVHDAPWGLFPAEGEDKWVAVTVR

SEQ ID NO: 847456 - protein, 17 aa, Mycobacterium
PVHDIVEILLAAAPSTR

SEQ ID NO: 847457 - protein, 34 aa, Mycobacterium
PVHEGHDWMYVLSGRLRLILGDRDFTIKPGEAVE

SEQ ID NO: 847458 - protein, 27 aa, Mycobacterium
PVHEGRDWMYVLSGKLRLILGEQDFTV

SEQ ID NO: 847459 - protein, 18 aa, Mycobacterium
PVHFMLVAEFDDVLDEDA

SEQ ID NO: 847460 - protein, 22 aa, Mycobacterium
PVHFVQMWVVPDESGIDPSYQQ

SEQ ID NO: 847461 - protein, 19 aa, Mycobacterium
PVHGIVYFAPEARAAVEDL

SEQ ID NO: 847462 - protein, 19 aa, Mycobacterium
PVHHKLAFFQSDAGPGFCH

SEQ ID NO: 847463 - protein, 25 aa, Mycobacterium
PVHHRYLIPVAGRDGLTPATLAPLT

SEQ ID NO: 847464 - protein, 19 aa, Mycobacterium
PVHHVVLAPPFRLDEAAVP

SEQ ID NO: 847465 - protein, 21 aa, Mycobacterium
PVHISAAIPPLAEHRARISYA

SEQ ID NO: 847466 - protein, 19 aa, Mycobacterium
PVHQLPQPIAWPGSSDRNF

SEQ ID NO: 847467 - protein, 25 aa, Mycobacterium
PVHRIWQVYADPRQLEKVWGPPSHP

SEQ ID NO: 847468 - protein, 21 aa, Mycobacterium
PVHRRRVGLMPQEGALFPHLS

SEQ ID NO: 847469 - protein, 18 aa, Mycobacterium
PVIAAIRTRRPDLDPEEL

SEQ ID NO: 847470 - protein, 27 aa, Mycobacterium
PVIAANRVLLMELLATNFLGQNTPAIA

SEQ ID NO: 847471 - protein, 21 aa, Mycobacterium
PVIADIHFQPKYIFAAIDAGC

SEQ ID NO: 847472 - protein, 17 aa, Mycobacterium
PVIADRLGLPETDLTVR

SEQ ID NO: 847473 - protein, 19 aa, Mycobacterium
PVIAGYEMPMGAVPGLGEH

SEQ ID NO: 847474 - protein, 18 aa, Mycobacterium
PVICALLGAPPEDWQLFS

SEQ ID NO: 847475 - protein, 18 aa, Mycobacterium
PVIDTSAQLLLGSLIDEL

SEQ ID NO: 847476 - protein, 21 aa, Mycobacterium
PVIEERWRSGAVRPQFAGPLR

SEQ ID NO: 847477 - protein, 19 aa, Mycobacterium
PVIERIYRMYADGAGLRYI

SEQ ID NO: 847478 - protein, 23 aa, Mycobacterium
PVIETRIVRREGIRRAFGATPDH

SEQ ID NO: 847479 - protein, 19 aa, Mycobacterium
PVIEYWVRPKGVAPDLLFA

SEQ ID NO: 847480 - protein, 18 aa, Mycobacterium
PVIGFNYLGRLAAGADLS

SEQ ID NO: 847481 - protein, 19 aa, Mycobacterium
PVIGLFADGNMPVRWSGPP

SEQ ID NO: 847482 - protein, 29 aa, Mycobacterium
PVIGTKELIAWLPTLLGLGAADTVVVPEL

SEQ ID NO: 847483 - protein, 27 aa, Mycobacterium
PVIGTKELIAWLPTLLGLGSDDVVVVP

SEQ ID NO: 847484 - protein, 20 aa, Mycobacterium
PVIHRRLRDACPHVHLLIVD

SEQ ID NO: 847485 - protein, 18 aa, Mycobacterium
PVIIFEHVQLYNTSADID

SEQ ID NO: 847486 - protein, 18 aa, Mycobacterium
PVIIFEHVQLYNTSADVE

SEQ ID NO: 847487 - protein, 19 aa, Mycobacterium
PVILPGSRFTPFLTVPGAE

SEQ ID NO: 847488 - protein, 20 aa, Mycobacterium
PVILTVPRRAAPTAPARTAS

SEQ ID NO: 847489 - protein, 19 aa, Mycobacterium
PVIMPFRGEYYALRPERRG

SEQ ID NO: 847490 - protein, 24 aa, Mycobacterium
PVINVNFMPLNHLGGRIPISTAVQ

SEQ ID NO: 847491 - protein, 19 aa, Mycobacterium
PVIQMWARPRGVAPDALFA

SEQ ID NO: 847492 - protein, 22 aa, Mycobacterium
PVIQMWARPRGVAPDPLFALMC

SEQ ID NO: 847493 - protein, 21 aa, Mycobacterium
PVIREYIRRSHAPEHIGWQVA

SEQ ID NO: 847494 - protein, 17 aa, Mycobacterium
PVIRGRVVLLTFDHAVA

SEQ ID NO: 847495 - protein, 18 aa, Mycobacterium
PVIRRLLVDHAADSGALV

SEQ ID NO: 847496 - protein, 20 aa, Mycobacterium
PVISMLRSLDHRDAFGDVVV

SEQ ID NO: 847497 - protein, 26 aa, Mycobacterium
PVISQACVIVPAPASLWAGSPREALA

SEQ ID NO: 847498 - protein, 17 aa, Mycobacterium
PVISRFWDDPESWTLET

SEQ ID NO: 847499 - protein, 18 aa, Mycobacterium
PVITGGETFHPRGRAGAA

SEQ ID NO: 847500 - protein, 18 aa, Mycobacterium
PVIVIMPSPKGSATLHAK

SEQ ID NO: 847501 - protein, 18 aa, Mycobacterium
PVIVVMPSPKGMGLLHSK

SEQ ID NO: 847502 - protein, 18 aa, Mycobacterium
PVKAERWAALATAYFETV

SEQ ID NO: 847503 - protein, 25 aa, Mycobacterium
PVKDLITRHIPLDDVLDAFQIVKKG

SEQ ID NO: 847504 - protein, 20 aa, Mycobacterium
PVKFDGHMTLYMADRYHDDA

SEQ ID NO: 847505 - protein, 28 aa, Mycobacterium
PVKIILQALQGFLNFLRNLAAETLSGPL

SEQ ID NO: 847506 - protein, 34 aa, Mycobacterium
PVKLESWFGYFVSRALPAVNRRLMAPFGVDRFER

SEQ ID NO: 847507 - protein, 19 aa, Mycobacterium
PVKLVLTRKQMYSSVGFRP

SEQ ID NO: 847508 - protein, 17 aa, Mycobacterium
PVKMVVFNNGALSFVEL

SEQ ID NO: 847509 - protein, 19 aa, Mycobacterium
PVKRVPLARSLRAAQRHDY

SEQ ID NO: 847510 - protein, 21 aa, Mycobacterium
PVKSIIFMDPPEHRHMRSLLN

SEQ ID NO: 847511 - protein, 20 aa, Mycobacterium
PVLAIRFAQALTEAGLPAGA

SEQ ID NO: 847512 - protein, 20 aa, Mycobacterium
PVLAIYGIPHRDCGSFAAGG

SEQ ID NO: 847513 - protein, 19 aa, Mycobacterium
PVLAVALAKDPADRFACCT

SEQ ID NO: 847514 - protein, 18 aa, Mycobacterium
PVLAVLTAVVMYQTVTGA

SEQ ID NO: 847515 - protein, 18 aa, Mycobacterium
PVLAVRRAADADEAFELA

SEQ ID NO: 847516 - protein, 25 aa, Mycobacterium
PVLDQLRMRYLDDETWHGDIVVVSH

SEQ ID NO: 847517 - protein, 25 aa, Mycobacterium
PVLDRYDYVLIDCQPSLGLLTINGL

SEQ ID NO: 847518 - protein, 19 aa, Mycobacterium
PVLDVLVAALGRTITEWRG

SEQ ID NO: 847519 - protein, 23 aa, Mycobacterium
PVLEHLLPQWAGHVEAHVAGWVG

SEQ ID NO: 847520 - protein, 24 aa, Mycobacterium
PVLEVALRLPRIGYVGAMGSRQTH

SEQ ID NO: 847521 - protein, 17 aa, Mycobacterium
PVLFPRPTKNIDGTHPI

SEQ ID NO: 847522 - protein, 24 aa, Mycobacterium
PVLGADGLPFAYLDLGWEESLVAV

SEQ ID NO: 847523 - protein, 17 aa, Mycobacterium
PVLGARPLRRTIQREIE

SEQ ID NO: 847524 - protein, 41 aa, Mycobacterium
PVLGGWHTVLISPFAFLAKPARWMQLLATHPATVTAAPNFA

SEQ ID NO: 847525 - protein, 27 aa, Mycobacterium
PVLGIHFLRDAYLKRYPDYPRGITVPA

SEQ ID NO: 847526 - protein, 28 aa, Mycobacterium
PVLGRLPVRLIYLPWAAQAWTRSGVDPR

SEQ ID NO: 847527 - protein, 20 aa, Mycobacterium
PVLGRVRVPIRWLADMRAMS

SEQ ID NO: 847528 - protein, 17 aa, Mycobacterium
PVLGYKLVDVPELGYFL

SEQ ID NO: 847529 - protein, 19 aa, Mycobacterium
PVLHLYDDRLLYLDRYRRE

SEQ ID NO: 847530 - protein, 21 aa, Mycobacterium
PVLHSLNYLLGRLDEKYLTTL

SEQ ID NO: 847531 - protein, 18 aa, Mycobacterium
PVLIAYLAAQTSQLRLGS

SEQ ID NO: 847532 - protein, 21 aa, Mycobacterium
PVLIERPFVVTPKGTRLARPV

SEQ ID NO: 847533 - protein, 18 aa, Mycobacterium
PVLIFDDADLDKAIMMAS

SEQ ID NO: 847534 - protein, 17 aa, Mycobacterium
PVLIFDDANLDNAIMMA

SEQ ID NO: 847535 - protein, 20 aa, Mycobacterium
PVLKIPRLQDAYFKRFPDYP

SEQ ID NO: 847536 - protein, 20 aa, Mycobacterium
PVLKIPRLQDAYFKRFPGYP

SEQ ID NO: 847537 - protein, 19 aa, Mycobacterium
PVLKKWRIFERDDFTGEAA

SEQ ID NO: 847538 - protein, 20 aa, Mycobacterium
PVLLERCVALLTPALTRHHP

SEQ ID NO: 847539 - protein, 20 aa, Mycobacterium
PVLLESYLDGPEVSLFCVVD

SEQ ID NO: 847540 - protein, 41 aa, Mycobacterium
PVLLQEIFASYFGVRLPAPVPYRSFITWLSEQDRAAAQAAW

SEQ ID NO: 847541 - protein, 26 aa, Mycobacterium
PVLLRNIMENPAWYTAYTPYQPEISQ

SEQ ID NO: 847542 - protein, 20 aa, Mycobacterium
PVLLTGTRWLDQARAAGVES

SEQ ID NO: 847543 - protein, 17 aa, Mycobacterium
PVLPCHVGNPDLWFAET

SEQ ID NO: 847544 - protein, 19 aa, Mycobacterium
PVLPEWRLEQLDVYMIHPF

SEQ ID NO: 847545 - protein, 17 aa, Mycobacterium
PVLPRAQVPPIQAFRQR

SEQ ID NO: 847546 - protein, 20 aa, Mycobacterium
PVLPVSEFGLRDAADAFRLM

SEQ ID NO: 847547 - protein, 37 aa, Mycobacterium
PVLRALGLKRKLVLGPWFRPVYRILVAARRLRGTRAD

SEQ ID NO: 847548 - protein, 19 aa, Mycobacterium
PVLRAMRRSYRADRYLGII

SEQ ID NO: 847549 - protein, 26 aa, Mycobacterium
PVLRDLAPEPRLVVGMSLGGLTALRI

SEQ ID NO: 847550 - protein, 21 aa, Mycobacterium
PVLRKDFVISPYQIHEARAHG

SEQ ID NO: 847551 - protein, 17 aa, Mycobacterium
PVLSAPMRYGAPDAVAL

SEQ ID NO: 847552 - protein, 31 aa, Mycobacterium
PVLSGWDGAPLFPYFRDLTPAPVVLGNDANV

SEQ ID NO: 847553 - protein, 19 aa, Mycobacterium
PVLSSGCFYTLGIPGAESE

SEQ ID NO: 847554 - protein, 18 aa, Mycobacterium
PVLSVHAPCLLITQRVWG

SEQ ID NO: 847555 - protein, 19 aa, Mycobacterium
PVLVAALGPVMLQIAGERA

SEQ ID NO: 847556 - protein, 17 aa, Mycobacterium
PVLVHPDPRGVLGGLAA

SEQ ID NO: 847557 - protein, 20 aa, Mycobacterium
PVLVRHLWERGVPAGARLVD

SEQ ID NO: 847558 - protein, 25 aa, Mycobacterium
PVMADFWETALFRAGLYRGSALQAH

SEQ ID NO: 847559 - protein, 23 aa, Mycobacterium
PVMCDFWETVLFHAGRYRGSALT

SEQ ID NO: 847560 - protein, 32 aa, Mycobacterium
PVMFEGGQMPIHMRLPKLKGFKNRFRTEYQVV

SEQ ID NO: 847561 - protein, 28 aa, Mycobacterium
PVMFRCVDVVLLNKIDLVPYLDADVDTY

SEQ ID NO: 847562 - protein, 21 aa, Mycobacterium
PVMGRYNRRITADSPFTLTGP

SEQ ID NO: 847563 - protein, 22 aa, Mycobacterium
PVMLQSWTMPPPKLAGIHERGG

SEQ ID NO: 847564 - protein, 23 aa, Mycobacterium
PVMMPVICQGPCGATATLLQHRF

SEQ ID NO: 847565 - protein, 19 aa, Mycobacterium
PVMPCAYTGFHLKPIGFFD

SEQ ID NO: 847566 - protein, 20 aa, Mycobacterium
PVMQTFGEPVWIISQGPQVL

SEQ ID NO: 847567 - protein, 23 aa, Mycobacterium
PVMSMLRTLLRRNQITDITHLHS

SEQ ID NO: 847568 - protein, 20 aa, Mycobacterium
PVMSMLRTLVRRNQITDIAH

SEQ ID NO: 847569 - protein, 19 aa, Mycobacterium
PVMVWLHGGAYVLGSGSQA

SEQ ID NO: 847570 - protein, 26 aa, Mycobacterium
PVNDDEDFLYLFFPETEPGRKLGVES

SEQ ID NO: 847571 - protein, 23 aa, Mycobacterium
PVNDPLLVVPAMAAVTKHLGFGV

SEQ ID NO: 847572 - protein, 27 aa, Mycobacterium
PVNDWLMEQLIMIDALKRGSAKRITAV

SEQ ID NO: 847573 - protein, 23 aa, Mycobacterium
PVNHVLPAWDVTCGIYTALSVVT

SEQ ID NO: 847574 - protein, 20 aa, Mycobacterium
PVNLAARLVAAAAPGQVLAD

SEQ ID NO: 847575 - protein, 22 aa, Mycobacterium
PVNLAARLVGAAAPGQILADAA

SEQ ID NO: 847576 - protein, 28 aa, Mycobacterium
PVNLRDWRQWWTWVPGACWKHPKGPGSS

SEQ ID NO: 847577 - protein, 26 aa, Mycobacterium
PVNNWLMEQLIMIDALKRGSAKRITA

SEQ ID NO: 847578 - protein, 26 aa, Mycobacterium
PVNQTWVRWWVMQHAYRFIQEFEASV

SEQ ID NO: 847579 - protein, 24 aa, Mycobacterium
PVNTPLLQELFAKDPERAARRLVH

SEQ ID NO: 847580 - protein, 25 aa, Mycobacterium
PVNTPLLQELFAKDPERAARRLVHI

SEQ ID NO: 847581 - protein, 31 aa, Mycobacterium
PVNTVFQTYALFPFMSVWDNVAFGLRYQKAP

SEQ ID NO: 847582 - protein, 17 aa, Mycobacterium
PVPADLREDWPTALAAA

SEQ ID NO: 847583 - protein, 23 aa, Mycobacterium
PVPAFALALMRRSLSGSNIGGIA

SEQ ID NO: 847584 - protein, 17 aa, Mycobacterium
PVPALRAAIERAFSSES

SEQ ID NO: 847585 - protein, 17 aa, Mycobacterium
PVPALSPLLNRIAELAP

SEQ ID NO: 847586 - protein, 18 aa, Mycobacterium
PVPALVRGYLRLGARVCG

SEQ ID NO: 847587 - protein, 18 aa, Mycobacterium
PVPARWSRRKPEAAARLE

SEQ ID NO: 847588 - protein, 18 aa, Mycobacterium
PVPAVLEVRGEVFFRVAD

SEQ ID NO: 847589 - protein, 21 aa, Mycobacterium
PVPAYATLALGADPIARHGND

SEQ ID NO: 847590 - protein, 21 aa, Mycobacterium
PVPELQYPIYGPDGELWRVDF

SEQ ID NO: 847591 - protein, 27 aa, Mycobacterium
PVPGAALFVLDGWLRPVAPGVVGELYV

SEQ ID NO: 847592 - protein, 27 aa, Mycobacterium
PVPGAALFVLDTWLQPVPAGVVGELYV

SEQ ID NO: 847593 - protein, 20 aa, Mycobacterium
PVPGAYVAGWIKRGPSGFIG

SEQ ID NO: 847594 - protein, 17 aa, Mycobacterium
PVPGFASSLSYYDGLRT

SEQ ID NO: 847595 - protein, 25 aa, Mycobacterium
PVPGKPALLLGAFDLGGLGYVVEEF

SEQ ID NO: 847596 - protein, 19 aa, Mycobacterium
PVPGLYLSGGGTHPGPSVS

SEQ ID NO: 847597 - protein, 27 aa, Mycobacterium
PVPGPEPVLMLPMTLPGAGIAPTLSTA

SEQ ID NO: 847598 - protein, 25 aa, Mycobacterium
PVPHAPIAEYFVWFGDEYHVDETDR

SEQ ID NO: 847599 - protein, 29 aa, Mycobacterium
PVPHDPGRSLFWLSLSLQSDGTALRLVFE

SEQ ID NO: 847600 - protein, 22 aa, Mycobacterium
PVPHRPVAEYFVWFKDEYEISE

SEQ ID NO: 847601 - protein, 23 aa, Mycobacterium
PVPHTKVIGHRWSARSWQVRDFL

SEQ ID NO: 847602 - protein, 20 aa, Mycobacterium
PVPIPNDLALLLSASVKRYP

SEQ ID NO: 847603 - protein, 24 aa, Mycobacterium
PVPIRHWFVDGLLHDWAREMLSTT

SEQ ID NO: 847604 - protein, 22 aa, Mycobacterium
PVPKEGLLPMTLPSDADLDVPG

SEQ ID NO: 847605 - protein, 25 aa, Mycobacterium
PVPLSEYVLGLARQVIRPEFRGGAG

SEQ ID NO: 847606 - protein, 19 aa, Mycobacterium
PVPLYFQVAQVFEKAILDG

SEQ ID NO: 847607 - protein, 19 aa, Mycobacterium
PVPMHAVLPPRLRSAFDHD

SEQ ID NO: 847608 - protein, 19 aa, Mycobacterium
PVPNLPPGFDFTDPDIHAE

SEQ ID NO: 847609 - protein, 19 aa, Mycobacterium
PVPNLPPGFDFTDPDVHAE

SEQ ID NO: 847610 - protein, 26 aa, Mycobacterium
PVPPAKLIGWTARFLGMVKPGDQVDF

SEQ ID NO: 847611 - protein, 20 aa, Mycobacterium
PVPPLPPLPLVLNPPAPPGP

SEQ ID NO: 847612 - protein, 17 aa, Mycobacterium
PVPPVESFRSWWERTEG

SEQ ID NO: 847613 - protein, 24 aa, Mycobacterium
PVPQLLAMGLLRRIDAETVILPRH

SEQ ID NO: 847614 - protein, 17 aa, Mycobacterium
PVPQRHRVRRVRADDTG

SEQ ID NO: 847615 - protein, 19 aa, Mycobacterium
PVPRAPYGLAGSRALSWVT

SEQ ID NO: 847616 - protein, 17 aa, Mycobacterium
PVPRFRGHLLDAGICDA

SEQ ID NO: 847617 - protein, 23 aa, Mycobacterium
PVPRLLAAGLLRRIDDDTVILPR

SEQ ID NO: 847618 - protein, 20 aa, Mycobacterium
PVPRPERQYYWFGEPIDTTE

SEQ ID NO: 847619 - protein, 21 aa, Mycobacterium
PVPRPERQYYWFGEPIDTTEF

SEQ ID NO: 847620 - protein, 17 aa, Mycobacterium
PVPSRWIDPNSVPDWLI

SEQ ID NO: 847621 - protein, 18 aa, Mycobacterium
PVPSWPPGLSFEASEGAG

SEQ ID NO: 847622 - protein, 19 aa, Mycobacterium
PVPTGFLDWQRQIGQEILA

SEQ ID NO: 847623 - protein, 26 aa, Mycobacterium
PVPTPKVLTRLPLSGIRVLDLTTFWA

SEQ ID NO: 847624 - protein, 17 aa, Mycobacterium
PVPVEMAATGAPGAETA

SEQ ID NO: 847625 - protein, 23 aa, Mycobacterium
PVPVFIADYVLLGYGTGAIMAVP

SEQ ID NO: 847626 - protein, 18 aa, Mycobacterium
PVPVGVVGELYYAGDQLA

SEQ ID NO: 847627 - protein, 19 aa, Mycobacterium
PVPVGVVGELYYAGDQLAR

SEQ ID NO: 847628 - protein, 18 aa, Mycobacterium
PVPVIMAATGPAIAMGSF

SEQ ID NO: 847629 - protein, 25 aa, Mycobacterium
PVPVRSVLGFLTVWDPLSRADADAL

SEQ ID NO: 847630 - protein, 25 aa, Mycobacterium
PVPVTPRRWGRIPRTYIRLDGDRAL

SEQ ID NO: 847631 - protein, 17 aa, Mycobacterium
PVPWAVQAVDRIPKQRY

SEQ ID NO: 847632 - protein, 17 aa, Mycobacterium
PVPWIDHVVAARLLDRL

SEQ ID NO: 847633 - protein, 28 aa, Mycobacterium
PVQAELYGDLLTILAALATAGGAGHRDW

SEQ ID NO: 847634 - protein, 25 aa, Mycobacterium
PVQAIHLTDLILAAQPLHAAARAVA

SEQ ID NO: 847635 - protein, 26 aa, Mycobacterium
PVQARAGWAVGWKKDAFWGREALTQE

SEQ ID NO: 847636 - protein, 19 aa, Mycobacterium
PVQAVLTRLFNLAAAREGN

SEQ ID NO: 847637 - protein, 20 aa, Mycobacterium
PVQAVWLPHSVSAIRTKLFA

SEQ ID NO: 847638 - protein, 17 aa, Mycobacterium
PVQHGYWLETMRAAAQK

SEQ ID NO: 847639 - protein, 21 aa, Mycobacterium
PVQIRALLERELPVYIVSIGR

SEQ ID NO: 847640 - protein, 19 aa, Mycobacterium
PVQLAAPARRGATADLLAC

SEQ ID NO: 847641 - protein, 21 aa, Mycobacterium
PVQLPIIPGHEFAGVIAAVGA

SEQ ID NO: 847642 - protein, 29 aa, Mycobacterium
PVQMIVADLSFISLATVLPALTACAVRDA

SEQ ID NO: 847643 - protein, 29 aa, Mycobacterium
PVQNDLLELYRLIELLRPGTFTSVKTFQR

SEQ ID NO: 847644 - protein, 17 aa, Mycobacterium
PVQNVFLGREIPRPGLL

SEQ ID NO: 847645 - protein, 19 aa, Mycobacterium
PVQQPYPPLYLGCGPAGFK

SEQ ID NO: 847646 - protein, 21 aa, Mycobacterium
PVQRLLAAGLLQRIDDETVLL

SEQ ID NO: 847647 - protein, 20 aa, Mycobacterium
PVQRPHPPIWFGANAPKALA

SEQ ID NO: 847648 - protein, 25 aa, Mycobacterium
PVQRPHPPIWFGGHAPAALARAVRF

SEQ ID NO: 847649 - protein, 25 aa, Mycobacterium
PVQRPHPPIWFGGLAPKALARAVRL

SEQ ID NO: 847650 - protein, 25 aa, Mycobacterium
PVQRPHPPIWFGGRAPTALARAVRH

SEQ ID NO: 847651 - protein, 26 aa, Mycobacterium
PVQSLRLYERYGLLMPARSQGGTRRY

SEQ ID NO: 847652 - protein, 23 aa, Mycobacterium
PVQTYLPDFNPTGDPRRARVTLR

SEQ ID NO: 847653 - protein, 19 aa, Mycobacterium
PVQTYLPGFNPAGDPRRAA

SEQ ID NO: 847654 - protein, 25 aa, Mycobacterium
PVQVILADPVIAWRYLDLRGDDLTP

SEQ ID NO: 847655 - protein, 31 aa, Mycobacterium
PVQVMPTNVPRWLSLPARLVMQSLIGRVRLP

SEQ ID NO: 847656 - protein, 28 aa, Mycobacterium
PVQVRTGEWFYLRPVLPGDVERTLNGPV

SEQ ID NO: 847657 - protein, 24 aa, Mycobacterium
PVQVRTLLARELPVYVISLGRAFR

SEQ ID NO: 847658 - protein, 20 aa, Mycobacterium
PVQWQVIDRAFRGHATLILI

SEQ ID NO: 847659 - protein, 17 aa, Mycobacterium
PVRAACAAGVRAVVLTN

SEQ ID NO: 847660 - protein, 17 aa, Mycobacterium
PVRAADPQFLRGDPVAL

SEQ ID NO: 847661 - protein, 17 aa, Mycobacterium
PVRADFSPALTLRSLTT

SEQ ID NO: 847662 - protein, 19 aa, Mycobacterium
PVRALSRVVPMLKPIVPDP

SEQ ID NO: 847663 - protein, 26 aa, Mycobacterium
PVRAPFAYEGLFGHLAASAAPGIEEV

SEQ ID NO: 847664 - protein, 19 aa, Mycobacterium
PVRDRIPVLIAALGPKNVA

SEQ ID NO: 847665 - protein, 20 aa, Mycobacterium
PVREIVGMSARLMERWSSRR

SEQ ID NO: 847666 - protein, 19 aa, Mycobacterium
PVRELHAHLIRQSVAGNVV

SEQ ID NO: 847667 - protein, 26 aa, Mycobacterium
PVREPVRSLVWIRGRLHPVPADMIGA

SEQ ID NO: 847668 - protein, 26 aa, Mycobacterium
PVREPVRSLVWIRGRLQRVPWGAVSS

SEQ ID NO: 847669 - protein, 23 aa, Mycobacterium
PVRERIPILLAALGPKNVELAAE

SEQ ID NO: 847670 - protein, 23 aa, Mycobacterium
PVRERIPVLLAALGPKNVELAAE

SEQ ID NO: 847671 - protein, 20 aa, Mycobacterium
PVRFNAIDAGVLHLGGTRLP

SEQ ID NO: 847672 - protein, 23 aa, Mycobacterium
PVRFPGVPTWFSRTPGRVAGPAP

SEQ ID NO: 847673 - protein, 21 aa, Mycobacterium
PVRGPMAPADRFHAAVRKAKI

SEQ ID NO: 847674 - protein, 19 aa, Mycobacterium
PVRHILDQLLVEFTTIGFL

SEQ ID NO: 847675 - protein, 22 aa, Mycobacterium
PVRHIMDQLLVEFTTIGFLSDD

SEQ ID NO: 847676 - protein, 17 aa, Mycobacterium
PVRHRLYEYVCSQPGPV

SEQ ID NO: 847677 - protein, 19 aa, Mycobacterium
PVRKLDFVPLASMLTVVLA

SEQ ID NO: 847678 - protein, 20 aa, Mycobacterium
PVRLKEAIRRFGPIFAQYYG

SEQ ID NO: 847679 - protein, 24 aa, Mycobacterium
PVRLRDGAEFYLRPILPGDSQRLA

SEQ ID NO: 847680 - protein, 21 aa, Mycobacterium
PVRLRLGIGYVIQHAGLMPHL

SEQ ID NO: 847681 - protein, 17 aa, Mycobacterium
PVRMTALGIWRAMQGAE

SEQ ID NO: 847682 - protein, 20 aa, Mycobacterium
PVRNPLYRQQANPARKVYGR

SEQ ID NO: 847683 - protein, 30 aa, Mycobacterium
PVRNVLRLLGPLLRPILRAVFVVQRRLEGR

SEQ ID NO: 847684 - protein, 17 aa, Mycobacterium
PVRPGHSYLITGGFGGF

SEQ ID NO: 847685 - protein, 26 aa, Mycobacterium
PVRPPLARNLRFYPTAAAAQAAGFRA

SEQ ID NO: 847686 - protein, 21 aa, Mycobacterium
PVRPYERLLYAAFNGDRQLFA

SEQ ID NO: 847687 - protein, 21 aa, Mycobacterium
PVRQPVCDLVHFTVGPRPLAA

SEQ ID NO: 847688 - protein, 26 aa, Mycobacterium
PVRRAGAVVPVRRRPIPAFEGRRLRD

SEQ ID NO: 847689 - protein, 21 aa, Mycobacterium
PVRRRIFHLEIGRAHAPWFHW

SEQ ID NO: 847690 - protein, 22 aa, Mycobacterium
PVRSVLEFLAIDDPLSVDDLAA

SEQ ID NO: 847691 - protein, 19 aa, Mycobacterium
PVRTKDLMFTGRTLNAQEA

SEQ ID NO: 847692 - protein, 30 aa, Mycobacterium
PVRTPIGRYGGMFKPLTAIDLGVAALKGLL

SEQ ID NO: 847693 - protein, 25 aa, Mycobacterium
PVRTPIGRYGGMFRSLTAVDLGVTA

SEQ ID NO: 847694 - protein, 18 aa, Mycobacterium
PVRVLAWTTLGELADLPN

SEQ ID NO: 847695 - protein, 26 aa, Mycobacterium
PVRVRALPSWLRLDARFGSVYRHRAD

SEQ ID NO: 847696 - protein, 18 aa, Mycobacterium
PVRWDLCTATLRDRFQNA

SEQ ID NO: 847697 - protein, 20 aa, Mycobacterium
PVRWDLCTEYFKTANDTPAA

SEQ ID NO: 847698 - protein, 26 aa, Mycobacterium
PVSALVSFEVFIRPALRSAMGLPDPD

SEQ ID NO: 847699 - protein, 26 aa, Mycobacterium
PVSALVSFEVFLRPALRAAMGLTDTQ

SEQ ID NO: 847700 - protein, 32 aa, Mycobacterium
PVSALVVFEIMVRPLIRLSLGKRQPMRRIVQA

SEQ ID NO: 847701 - protein, 27 aa, Mycobacterium
PVSASVELPPAFRFNLIPDGMRDDREH

SEQ ID NO: 847702 - protein, 25 aa, Mycobacterium
PVSAVLDFMWEIHQGPIFVATMELW

SEQ ID NO: 847703 - protein, 24 aa, Mycobacterium
PVSEAYHPPFAFAGGRIARVNIDT

SEQ ID NO: 847704 - protein, 27 aa, Mycobacterium
PVSGAALLVLDKWLRPVPAGVVGELYV

SEQ ID NO: 847705 - protein, 26 aa, Mycobacterium
PVSGAPVWFVPEAFEFVLRAANDPEH

SEQ ID NO: 847706 - protein, 26 aa, Mycobacterium
PVSGPLPVMFFIHGGGYFLGSSATPL

SEQ ID NO: 847707 - protein, 22 aa, Mycobacterium
PVSGSPLYPLKLAADAVAVIDR

SEQ ID NO: 847708 - protein, 23 aa, Mycobacterium
PVSGTWIDIRFSLPPNTVDGGIP

SEQ ID NO: 847709 - protein, 31 aa, Mycobacterium
PVSGVDGLFLPLHLLCLRDMGLMLGEYWDLT

SEQ ID NO: 847710 - protein, 30 aa, Mycobacterium
PVSGVEGLFLPFHLLCLRDMGLMLGEYWDL

SEQ ID NO: 847711 - protein, 32 aa, Mycobacterium
PVSKADYETLLRSYRRLLQFLRSRDADGAEAH

SEQ ID NO: 847712 - protein, 19 aa, Mycobacterium
PVSKPLPGRLPAELNRALL

SEQ ID NO: 847713 - protein, 19 aa, Mycobacterium
PVSLQQRRRMSRQPVRGEH

SEQ ID NO: 847714 - protein, 25 aa, Mycobacterium
PVSMVTGWWDLLLVGQLRDYEELQK

SEQ ID NO: 847715 - protein, 30 aa, Mycobacterium
PVSPQRASLMTRLLWRYAKRRFGEVPEPFT

SEQ ID NO: 847716 - protein, 18 aa, Mycobacterium
PVSRPLAGVLLGAAAGML

SEQ ID NO: 847717 - protein, 23 aa, Mycobacterium
PVSRPRIIMLLGGLRELTAITVE

SEQ ID NO: 847718 - protein, 28 aa, Mycobacterium
PVSTEAQFLLMRHVFGLGYRRYEWKCDS

SEQ ID NO: 847719 - protein, 26 aa, Mycobacterium
PVSTVRRWLRRLPAAHLERIYQGGTR

SEQ ID NO: 847720 - protein, 29 aa, Mycobacterium
PVSTYALLHRAARMWPDRSAVTVIPDTTR

SEQ ID NO: 847721 - protein, 26 aa, Mycobacterium
PVSVSCYYPLLLAAARWHGVTVQFRA

SEQ ID NO: 847722 - protein, 17 aa, Mycobacterium
PVSVYPLKIEDLATTAA

SEQ ID NO: 847723 - protein, 19 aa, Mycobacterium
PVSWSDAAGRPLCMLTTAM

SEQ ID NO: 847724 - protein, 19 aa, Mycobacterium
PVSWYWKSDDRANFLKVVA

SEQ ID NO: 847725 - protein, 18 aa, Mycobacterium
PVSYPYRDGLLDKELATD

SEQ ID NO: 847726 - protein, 19 aa, Mycobacterium
PVTAVAWLARKVEAFGVRL

SEQ ID NO: 847727 - protein, 19 aa, Mycobacterium
PVTAVAWLARKVESFGVRL

SEQ ID NO: 847728 - protein, 19 aa, Mycobacterium
PVTCDDLVLSWAAQSGRFP

SEQ ID NO: 847729 - protein, 33 aa, Mycobacterium
PVTDAPYLGFQLGSLWYISLDYINHQTSLNGTQ

SEQ ID NO: 847730 - protein, 18 aa, Mycobacterium
PVTDGAVLPILHLNGYKI

SEQ ID NO: 847731 - protein, 19 aa, Mycobacterium
PVTDWQLQFDLPSNESITN

SEQ ID NO: 847732 - protein, 21 aa, Mycobacterium
PVTFLALSKPIDGADAPIERL

SEQ ID NO: 847733 - protein, 19 aa, Mycobacterium
PVTFVDIAGLVKGASEGAG

SEQ ID NO: 847734 - protein, 33 aa, Mycobacterium
PVTGIDPAAASPWWLQRRLLLCGIRATSPAVDV

SEQ ID NO: 847735 - protein, 33 aa, Mycobacterium
PVTGIDPAAVSPWWLQRRLLLAGIRATSPAVDV

SEQ ID NO: 847736 - protein, 34 aa, Mycobacterium
PVTGIDPAAVSPWWMQRRLLLSGIRAISPAVDVT

SEQ ID NO: 847737 - protein, 34 aa, Mycobacterium
PVTGIDPKAVSPWWLQRRLLLSGIRAISPAVDVT

SEQ ID NO: 847738 - protein, 17 aa, Mycobacterium
PVTGLFGGTGGAGGAGG

SEQ ID NO: 847739 - protein, 28 aa, Mycobacterium
PVTGYLVLDKPWPSMLRGIWGDPERFKE

SEQ ID NO: 847740 - protein, 17 aa, Mycobacterium
PVTGYPGWSHYGASKAA

SEQ ID NO: 847741 - protein, 19 aa, Mycobacterium
PVTIGIWLDANWGKRQFRM

SEQ ID NO: 847742 - protein, 19 aa, Mycobacterium
PVTKLIKLIPQAKNLFPEY

SEQ ID NO: 847743 - protein, 25 aa, Mycobacterium
PVTNGPVWVLAGFGAQHRKMGKSLY

SEQ ID NO: 847744 - protein, 17 aa, Mycobacterium
PVTPFTASGDVDVDLLA

SEQ ID NO: 847745 - protein, 27 aa, Mycobacterium
PVTRAAFFVLDEWLRPVPAGVVGELYL

SEQ ID NO: 847746 - protein, 24 aa, Mycobacterium
PVTRASFYYYFSDKTELFIELGTD

SEQ ID NO: 847747 - protein, 27 aa, Mycobacterium
PVTRDQLIPRYSLGCKRPSFHNSYLAT

SEQ ID NO: 847748 - protein, 26 aa, Mycobacterium
PVTRPRLYEVIVEQLCAYIYSNEMEP

SEQ ID NO: 847749 - protein, 30 aa, Mycobacterium
PVTRSTAPPRILWLDPATAGQLIFEVRAMD

SEQ ID NO: 847750 - protein, 18 aa, Mycobacterium
PVTRTVLCKGFDAAGVTF

SEQ ID NO: 847751 - protein, 22 aa, Mycobacterium
PVTSPTYVLARVHPARGPGRPA

SEQ ID NO: 847752 - protein, 29 aa, Mycobacterium
PVTTEAYLGYALWRLSPTVMKVIARLSGE

SEQ ID NO: 847753 - protein, 30 aa, Mycobacterium
PVTVDRFPTFDWPRIDAPYIRPGADVAALE

SEQ ID NO: 847754 - protein, 22 aa, Mycobacterium
PVTVEVVIATAWDSPFEGPTPP

SEQ ID NO: 847755 - protein, 25 aa, Mycobacterium
PVTVSYTLPVLPTGLVPGQGGGLNV

SEQ ID NO: 847756 - protein, 20 aa, Mycobacterium
PVTWAEWPESAAGIFRGFRS

SEQ ID NO: 847757 - protein, 26 aa, Mycobacterium
PVVAANRSLLLTLIATNFFGQNTPAI

SEQ ID NO: 847758 - protein, 23 aa, Mycobacterium
PVVAEPFAMWAIEDDFADGRPPL

SEQ ID NO: 847759 - protein, 17 aa, Mycobacterium
PVVAPWIHRGLTSQDVL

SEQ ID NO: 847760 - protein, 18 aa, Mycobacterium
PVVASIARKLGALTVGVV

SEQ ID NO: 847761 - protein, 20 aa, Mycobacterium
PVVDGLPFELELGRSGRVLN

SEQ ID NO: 847762 - protein, 25 aa, Mycobacterium
PVVDLPFWETLLKPMESVQAALNRR

SEQ ID NO: 847763 - protein, 19 aa, Mycobacterium
PVVDLRRRLLPRSPRITDL

SEQ ID NO: 847764 - protein, 28 aa, Mycobacterium
PVVELLRSRIFFDWFDAVGVDDIPAVFA

SEQ ID NO: 847765 - protein, 17 aa, Mycobacterium
PVVEVILPAVRRAVAAT

SEQ ID NO: 847766 - protein, 21 aa, Mycobacterium
PVVGHPLRLRVPRYRCVDTAC

SEQ ID NO: 847767 - protein, 34 aa, Mycobacterium
PVVGIDPAAVSPWWLQRRLMLCGIRAISPAVDAT

SEQ ID NO: 847768 - protein, 18 aa, Mycobacterium
PVVGLAHAAGVASPVPFL

SEQ ID NO: 847769 - protein, 17 aa, Mycobacterium
PVVGRALDALLDPNKRK

SEQ ID NO: 847770 - protein, 25 aa, Mycobacterium
PVVHVHLGLYGAFTEWARSAGELLP

SEQ ID NO: 847771 - protein, 17 aa, Mycobacterium
PVVIAGLPRTGTTHLHN

SEQ ID NO: 847772 - protein, 18 aa, Mycobacterium
PVVILNTAGFYDGLTLQM

SEQ ID NO: 847773 - protein, 20 aa, Mycobacterium
PVVKSFWDLFAMIADTQKVP

SEQ ID NO: 847774 - protein, 20 aa, Mycobacterium
PVVLDLSRLRFLSVEGFRAL

SEQ ID NO: 847775 - protein, 25 aa, Mycobacterium
PVVLSPQASFLPYPQEYRSPFGVSG

SEQ ID NO: 847776 - protein, 19 aa, Mycobacterium
PVVLSRFGVKIVGRSRRLT

SEQ ID NO: 847777 - protein, 19 aa, Mycobacterium
PVVPASRWPNPPAGVAAEN

SEQ ID NO: 847778 - protein, 17 aa, Mycobacterium
PVVQIPLGNDLIHAPTG

SEQ ID NO: 847779 - protein, 25 aa, Mycobacterium
PVVSALILRALVTRVPQAALDLPEP

SEQ ID NO: 847780 - protein, 18 aa, Mycobacterium
PVVTERLLRNMFLGDPPG

SEQ ID NO: 847781 - protein, 19 aa, Mycobacterium
PVVVVLWSPRSDVCVELVD

SEQ ID NO: 847782 - protein, 20 aa, Mycobacterium
PVVWTVLMSSLSWFLVLEQA

SEQ ID NO: 847783 - protein, 18 aa, Mycobacterium
PVVWVKDASRSVPVAAAL

SEQ ID NO: 847784 - protein, 25 aa, Mycobacterium
PVVYKARILGDWFINGKDPVPDLAS

SEQ ID NO: 847785 - protein, 32 aa, Mycobacterium
PVWCPLPGTKIEGLYISFLRSPDGVVFEFVER

SEQ ID NO: 847786 - protein, 19 aa, Mycobacterium
PVWSYRDRSLLGLTDDHRL

SEQ ID NO: 847787 - protein, 17 aa, Mycobacterium
PVWTARGWEPRFGLDLP

SEQ ID NO: 847788 - protein, 17 aa, Mycobacterium
PVWTEVLGLLDEYARRG

SEQ ID NO: 847789 - protein, 24 aa, Mycobacterium
PVWTLRLHLTGQRLWHDPRRRQCG

SEQ ID NO: 847790 - protein, 20 aa, Mycobacterium
PVWYEVTPAGEIQLFTGPDA

SEQ ID NO: 847791 - protein, 17 aa, Mycobacterium
PVYALTTGPRWPDVSGN

SEQ ID NO: 847792 - protein, 17 aa, Mycobacterium
PVYAWKGETLEEYWWAA

SEQ ID NO: 847793 - protein, 24 aa, Mycobacterium
PVYGRVLMVAPFTEPTLGSAGFAG

SEQ ID NO: 847794 - protein, 34 aa, Mycobacterium
PVYHGHFKCNWYKLSEMPVLWAYARDLFQTPGFG

SEQ ID NO: 847795 - protein, 19 aa, Mycobacterium
PVYICGPGPFMDAAREALE

SEQ ID NO: 847796 - protein, 28 aa, Mycobacterium
PVYKLIHTYGVALPLHPEFRTVPMVWYI

SEQ ID NO: 847797 - protein, 20 aa, Mycobacterium
PVYKMPWGTMHPTTISAPIV

SEQ ID NO: 847798 - protein, 19 aa, Mycobacterium
PVYKMPWGTMHPTTITAPI

SEQ ID NO: 847799 - protein, 19 aa, Mycobacterium
PVYPLVIRAGAGSPRDTLS

SEQ ID NO: 847800 - protein, 19 aa, Mycobacterium
PVYQLRRWYQQFYVDAADI

SEQ ID NO: 847801 - protein, 19 aa, Mycobacterium
PVYQLRRWYQQFYVDVAEV

SEQ ID NO: 847802 - protein, 19 aa, Mycobacterium
PVYVPPPGDLPPMPPMPAP

SEQ ID NO: 847803 - protein, 32 aa, Mycobacterium
PWADHEWRGWWGDEPPFHTPVFVLTHHPRPSF

SEQ ID NO: 847804 - protein, 27 aa, Mycobacterium
PWAGSYYVEWLTHQLAQKARAHIAEVA

SEQ ID NO: 847805 - protein, 28 aa, Mycobacterium
PWAIRHNYVLDFLAFHRDRIDENMQFGI

SEQ ID NO: 847806 - protein, 18 aa, Mycobacterium
PWALVHFTVRLPENSPHN

SEQ ID NO: 847807 - protein, 20 aa, Mycobacterium
PWAQERYRQMVRWNSPDRGG

SEQ ID NO: 847808 - protein, 19 aa, Mycobacterium
PWDQRMCLIPDADLYEAIS

SEQ ID NO: 847809 - protein, 19 aa, Mycobacterium
PWDQRMCLIPDADLYNAIA

SEQ ID NO: 847810 - protein, 24 aa, Mycobacterium
PWENGHLRILQRALSRRIPDHRNL

SEQ ID NO: 847811 - protein, 30 aa, Mycobacterium
PWERDWSYGWSLMRIGALLRRSDMSLLDQW

SEQ ID NO: 847812 - protein, 29 aa, Mycobacterium
PWERDWSYGWSLMRIGALLRRTDMSLLDQ

SEQ ID NO: 847813 - protein, 18 aa, Mycobacterium
PWFESWLEHTDHSDPFWD

SEQ ID NO: 847814 - protein, 18 aa, Mycobacterium
PWFRRRAVELISYSVKYK

SEQ ID NO: 847815 - protein, 26 aa, Mycobacterium
PWGGSYYVEWLTHQLAERARAHIKEV

SEQ ID NO: 847816 - protein, 27 aa, Mycobacterium
PWGGSYYVEWLTHQLAQKARAHIAEVA

SEQ ID NO: 847817 - protein, 26 aa, Mycobacterium
PWGGSYYVEWLTHQLAQRARAHIEEV

SEQ ID NO: 847818 - protein, 27 aa, Mycobacterium
PWGGSYYVEWLTHQLAQRARAHINEVA

SEQ ID NO: 847819 - protein, 27 aa, Mycobacterium
PWGGSYYVEWLTHQLASRAREHIREVT

SEQ ID NO: 847820 - protein, 27 aa, Mycobacterium
PWGGSYYVEWLTYQLAEKARGHIREIA

SEQ ID NO: 847821 - protein, 40 aa, Mycobacterium
PWGISNFQIFPNIEILIYGGWYLLYRYWPTSHNTHRFEAY

SEQ ID NO: 847822 - protein, 41 aa, Mycobacterium
PWGISNFQIFPNIEILIYGGWYLLYRYWPTSHNTHRFEAYT

SEQ ID NO: 847823 - protein, 40 aa, Mycobacterium
PWGISNFQIFPNIEILIYGGWYLLYRYWPTSHNTHRYEAF

SEQ ID NO: 847824 - protein, 41 aa, Mycobacterium
PWGITNFQIFPNLEILIYHGWYLLYRYWPTSHNTHKFEAYN

SEQ ID NO: 847825 - protein, 17 aa, Mycobacterium
PWGLGTPCWPYFEDVKI

SEQ ID NO: 847826 - protein, 17 aa, Mycobacterium
PWHAPTGPVPAYPRASN

SEQ ID NO: 847827 - protein, 22 aa, Mycobacterium
PWIGNIDLSFPYLDTAATRTIG

SEQ ID NO: 847828 - protein, 18 aa, Mycobacterium
PWLSIRDSGVNLRTRKRM

SEQ ID NO: 847829 - protein, 20 aa, Mycobacterium
PWNLKLSHPDLLYSPTQSWV

SEQ ID NO: 847830 - protein, 19 aa, Mycobacterium
PWPAAWPPASKGRPYTLLG

SEQ ID NO: 847831 - protein, 17 aa, Mycobacterium
PWPAHKELFDRAWKSPD

SEQ ID NO: 847832 - protein, 18 aa, Mycobacterium
PWPAVDGERIAAVSAFGM

SEQ ID NO: 847833 - protein, 17 aa, Mycobacterium
PWPIIREAAKVGLYSME

SEQ ID NO: 847834 - protein, 22 aa, Mycobacterium
PWPRELNTPRWLLPHAAKTSYV

SEQ ID NO: 847835 - protein, 21 aa, Mycobacterium
PWQELARRSGATLRWYGVTDD

SEQ ID NO: 847836 - protein, 19 aa, Mycobacterium
PWQIYRGDDAWRPTLRRVM

SEQ ID NO: 847837 - protein, 23 aa, Mycobacterium
PWQRDLNSLVYVLAGRGAVGPAG

SEQ ID NO: 847838 - protein, 18 aa, Mycobacterium
PWQRELVDPVLARALQPP

SEQ ID NO: 847839 - protein, 33 aa, Mycobacterium
PWRAEEPIVIVAPMFHAWGFSQLVLAASLACTI

SEQ ID NO: 847840 - protein, 27 aa, Mycobacterium
PWRLHQNYVKDVWLLRRGRLDDDVIFT

SEQ ID NO: 847841 - protein, 20 aa, Mycobacterium
PWRTPDIGALPPGLNPGGIE

SEQ ID NO: 847842 - protein, 17 aa, Mycobacterium
PWTGVRTCRAWGAASIQ

SEQ ID NO: 847843 - protein, 25 aa, Mycobacterium
PWTRADGLVPLRHSLVINAITDDGE

SEQ ID NO: 847844 - protein, 24 aa, Mycobacterium
PWVELNTHPLYRPSRGLPPVGSGL

SEQ ID NO: 847845 - protein, 23 aa, Mycobacterium
PWVGNIDLSFPYLDTAATRAIGV

SEQ ID NO: 847846 - protein, 31 aa, Mycobacterium
PWVPPKVMAPHLWRFLLYQPVVASAGVPLQT

SEQ ID NO: 847847 - protein, 20 aa, Mycobacterium
PWWLKYVNKVMIGLSKVGVG

SEQ ID NO: 847848 - protein, 17 aa, Mycobacterium
PWYEGPSLLHHLEQVHI

SEQ ID NO: 847849 - protein, 21 aa, Mycobacterium
PYAEFANLLGLTGIRCDDPAK

SEQ ID NO: 847850 - protein, 20 aa, Mycobacterium
PYAEPPLGALRLRSPEPAQP

SEQ ID NO: 847851 - protein, 18 aa, Mycobacterium
PYAEVFCRAVGGWAADVL

SEQ ID NO: 847852 - protein, 22 aa, Mycobacterium
PYAEWRGMFAGNGMLLPRSVTA

SEQ ID NO: 847853 - protein, 19 aa, Mycobacterium
PYAGFLEAASARAVGASAS

SEQ ID NO: 847854 - protein, 31 aa, Mycobacterium; identical to SEQ ID NO: 130465

SEQ ID NO: 847855 - protein, 36 aa, Mycobacterium
PYALQDFSLFHVLRYGFRPSKIAFLAWHAWSDAERG

SEQ ID NO: 847856 - protein, 24 aa, Mycobacterium
PYARSRPISIADVDLAPPGRDEVL

SEQ ID NO: 847857 - protein, 27 aa, Mycobacterium
PYATRQLWRGMKPPARVLAAYAKAIEE

SEQ ID NO: 847858 - protein, 19 aa, Mycobacterium
PYAVDWYNSNNWSNGVPDA

SEQ ID NO: 847859 - protein, 19 aa, Mycobacterium
PYAVPVICALLGAPARDWA

SEQ ID NO: 847860 - protein, 33 aa, Mycobacterium
PYCALACAELLYRAGLPRALYAVVPGPGSVVGT

SEQ ID NO: 847861 - protein, 24 aa, Mycobacterium
PYCLDGMHHWLANWRLRAAEAASV

SEQ ID NO: 847862 - protein, 24 aa, Mycobacterium
PYCLDGMHHWLANWRLRAAEATSV

SEQ ID NO: 847863 - protein, 25 aa, Mycobacterium
PYCLDGMHHWLANWRLRATEAASVR

SEQ ID NO: 847864 - protein, 19 aa, Mycobacterium
PYCLGGMHHWLANWRLRAA

SEQ ID NO: 847865 - protein, 25 aa, Mycobacterium
PYCLTGMHHWLANWQLRALEATTLR

SEQ ID NO: 847866 - protein, 19 aa, Mycobacterium
PYDATLTLRLRAAGIPILG

SEQ ID NO: 847867 - protein, 20 aa, Mycobacterium
PYDGPFRIWHGSATSTFAVE

SEQ ID NO: 847868 - protein, 23 aa, Mycobacterium
PYDKLALCTGARPRRLSIPGADL

SEQ ID NO: 847869 - protein, 19 aa, Mycobacterium
PYDKPPLSKQFLAGSWDQS

SEQ ID NO: 847870 - protein, 19 aa, Mycobacterium
PYDKRLIDLTPAAVGPYVV

SEQ ID NO: 847871 - protein, 17 aa, Mycobacterium
PYDLAARGKKLSFETAR

SEQ ID NO: 847872 - protein, 26 aa, Mycobacterium
PYDLPAAMPGFGWPTAVLSGGRDLTT

SEQ ID NO: 847873 - protein, 30 aa, Mycobacterium
PYDLSFSRFELLRLLAFSRTGALPITKASD

SEQ ID NO: 847874 - protein, 20 aa, Mycobacterium
PYDLVAEMPHFGWPTAVVSG

SEQ ID NO: 847875 - protein, 17 aa, Mycobacterium
PYDPIIFDTGHQAYVHK

SEQ ID NO: 847876 - protein, 28 aa, Mycobacterium
PYDVELIADPYPMFKRLRDEAPLYYNSE

SEQ ID NO: 847877 - protein, 17 aa, Mycobacterium
PYDVHEVIVRLVDGGTF

SEQ ID NO: 847878 - protein, 19 aa, Mycobacterium
PYEDAIALAANWIWERGQE

SEQ ID NO: 847879 - protein, 27 aa, Mycobacterium
PYEKIMNAIFELWSGIMPERAIACSFN

SEQ ID NO: 847880 - protein, 18 aa, Mycobacterium
PYERSTCFWQRIAYLYSR

SEQ ID NO: 847881 - protein, 19 aa, Mycobacterium
PYERSTCFWQRIAYLYSRF

SEQ ID NO: 847882 - protein, 20 aa, Mycobacterium
PYERSTCFWQRIAYLYSRFD

SEQ ID NO: 847883 - protein, 25 aa, Mycobacterium
PYERSTCFWQRIAYLYSRFDALIEA

SEQ ID NO: 847884 - protein, 25 aa, Mycobacterium
PYESMTLPARVTATLLRGKITARDG

SEQ ID NO: 847885 - protein, 23 aa, Mycobacterium
PYEVPAIDVLPMAPAPSGTGLGR

SEQ ID NO: 847886 - protein, 18 aa, Mycobacterium
PYFRVFNPTSQAAKFDPS

SEQ ID NO: 847887 - protein, 20 aa, Mycobacterium
PYFVGKPNPMMFRSALNRIE

SEQ ID NO: 847888 - protein, 22 aa, Mycobacterium
PYGEWLHSGLLELTTLPDRGHI

SEQ ID NO: 847889 - protein, 24 aa, Mycobacterium
PYGHGWVTWFPPEGPPRTERFGPT

SEQ ID NO: 847890 - protein, 30 aa, Mycobacterium
PYGKDRLPKRRWWGWGINPQFRILRQPGQV

SEQ ID NO: 847891 - protein, 18 aa, Mycobacterium
PYGLCFSPDPVSAHLATV

SEQ ID NO: 847892 - protein, 17 aa, Mycobacterium
PYGLRVNGPLALAVGRR

SEQ ID NO: 847893 - protein, 29 aa, Mycobacterium
PYGRFVDSLLRWGLTRWWQGHRFYDEGRR

SEQ ID NO: 847894 - protein, 25 aa, Mycobacterium
PYGTKQIGPGLWYPIDDSMSGPAPA

SEQ ID NO: 847895 - protein, 21 aa, Mycobacterium
PYGTLAALRDPLGALICLGHP

SEQ ID NO: 847896 - protein, 26 aa, Mycobacterium
PYGVDFVHNTWRFGIDRVLAGVAMSE

SEQ ID NO: 847897 - protein, 18 aa, Mycobacterium
PYHSQLMDPILGELATAL

SEQ ID NO: 847898 - protein, 26 aa, Mycobacterium
PYHVDFVHNTWRFGIDRILAGVAMSD

SEQ ID NO: 847899 - protein, 22 aa, Mycobacterium
PYIAFIPQWDFLDFLAEKAERY

SEQ ID NO: 847900 - protein, 19 aa, Mycobacterium
PYIAMVPQWDLLNLLAEAA

SEQ ID NO: 847901 - protein, 36 aa, Mycobacterium
PYKGGLRFHPSVYLGIVKFLGFEQIFKNALTGLPIG

SEQ ID NO: 847902 - protein, 24 aa, Mycobacterium
PYLPDLLMCRPEVAGRLLDVIWSA

SEQ ID NO: 847903 - protein, 20 aa, Mycobacterium
PYLQVVLQRRLPVVVVDQPK

SEQ ID NO: 847904 - protein, 19 aa, Mycobacterium
PYLRVRLHMSRHDIVITGY

SEQ ID NO: 847905 - protein, 18 aa, Mycobacterium
PYLSQVERGLRKPSADVL

SEQ ID NO: 847906 - protein, 22 aa, Mycobacterium
PYLWLEDVTGESALDWVRARNG

SEQ ID NO: 847907 - protein, 19 aa, Mycobacterium
PYMATDLPGLQPFMPPYVP

SEQ ID NO: 847908 - protein, 19 aa, Mycobacterium
PYMTGFPGRSLLSAGRRLT

SEQ ID NO: 847909 - protein, 23 aa, Mycobacterium
PYNDIVNWKWTDIPGALGFTDHL

SEQ ID NO: 847910 - protein, 17 aa, Mycobacterium
PYPELVAGRDELLAKLL

SEQ ID NO: 847911 - protein, 27 aa, Mycobacterium
PYPENQLLALAHSLLARGVIDEAELQQ

SEQ ID NO: 847912 - protein, 20 aa, Mycobacterium
PYPILSHVYAALKSRDLSFE

SEQ ID NO: 847913 - protein, 21 aa, Mycobacterium
PYPSPDPFEPFAVAAVELADE

SEQ ID NO: 847914 - protein, 20 aa, Mycobacterium
PYPSPDPFEPFAVAAVELAE

SEQ ID NO: 847915 - protein, 19 aa, Mycobacterium
PYPTDLAPLLAEHVLPILS

SEQ ID NO: 847916 - protein, 19 aa, Mycobacterium
PYPTPIICALLGAPREDWP

SEQ ID NO: 847917 - protein, 20 aa, Mycobacterium
PYPWPFDGPVDPGRTAVLCI

SEQ ID NO: 847918 - protein, 17 aa, Mycobacterium
PYPYYRRLRDEAPLYHN

SEQ ID NO: 847919 - protein, 27 aa, Mycobacterium
PYQEWLDRNLVPLDALPAGKYLRMPHD

SEQ ID NO: 847920 - protein, 23 aa, Mycobacterium
PYQGAIYLTFILPVDAHADTYFR

SEQ ID NO: 847921 - protein, 20 aa, Mycobacterium
PYQIIHPPAPVPVRQARGDG

SEQ ID NO: 847922 - protein, 23 aa, Mycobacterium
PYQPGHIPFIKPTDQLGYRADPG

SEQ ID NO: 847923 - protein, 24 aa, Mycobacterium
PYQRFRGWEIAGLTAGLVGLGAVG

SEQ ID NO: 847924 - protein, 23 aa, Mycobacterium
PYRANMWALRALGVRRVFAPCAV

SEQ ID NO: 847925 - protein, 19 aa, Mycobacterium
PYRELYRRGAYLPPGYRET

SEQ ID NO: 847926 - protein, 18 aa, Mycobacterium
PYRKLINQGYIQAFAYTD

SEQ ID NO: 847927 - protein, 31 aa, Mycobacterium
PYRLAGELGMPPWRVQKAQKQARRWSRDSVA

SEQ ID NO: 847928 - protein, 25 aa, Mycobacterium
PYRRCWAPRRPWESCRCPRAGPPPP

SEQ ID NO: 847929 - protein, 18 aa, Mycobacterium
PYRRQIFAGVRLAWSIED

SEQ ID NO: 847930 - protein, 18 aa, Mycobacterium
PYRRQIFSGVRLAWDVED

SEQ ID NO: 847931 - protein, 20 aa, Mycobacterium
PYRVPVRIVFVEQLPRNDVG

SEQ ID NO: 847932 - protein, 17 aa, Mycobacterium
PYRYRGMLGGQPVTAFA

SEQ ID NO: 847933 - protein, 23 aa, Mycobacterium
PYSGAPMVLWARGPARLDEVVSR

SEQ ID NO: 847934 - protein, 17 aa, Mycobacterium
PYSLLMGSVQVADDVSL

SEQ ID NO: 847935 - protein, 24 aa, Mycobacterium
PYSMLEVLAPTMIDYAPAGLAAEM

SEQ ID NO: 847936 - protein, 22 aa, Mycobacterium
PYSPEFLARYRRAQAARNHAIT

SEQ ID NO: 847937 - protein, 21 aa, Mycobacterium
PYSQAFLDRYQGQIPNQGIGA

SEQ ID NO: 847938 - protein, 17 aa, Mycobacterium
PYSYWDYLRDQGPVFRE

SEQ ID NO: 847939 - protein, 31 aa, Mycobacterium
PYTDALCAQAVRLIFDALPRAYDDPDDLSAR

SEQ ID NO: 847940 - protein, 21 aa, Mycobacterium
PYTELEYARRTWRIKPRDWLH

SEQ ID NO: 847941 - protein, 17 aa, Mycobacterium
PYTILAIGPPRSMRDVF

SEQ ID NO: 847942 - protein, 26 aa, Mycobacterium
PYTKLDLVRYYLSVADGALRGVAGRP

SEQ ID NO: 847943 - protein, 20 aa, Mycobacterium
PYTLLAVTAARWPDRTAIVD

SEQ ID NO: 847944 - protein, 20 aa, Mycobacterium
PYTQFLPQFDQCRAVQIDID

SEQ ID NO: 847945 - protein, 19 aa, Mycobacterium
PYTRKPYPPFMTSTLQQEA

SEQ ID NO: 847946 - protein, 19 aa, Mycobacterium
PYTVRALADLLGRPAEELA

SEQ ID NO: 847947 - protein, 19 aa, Mycobacterium
PYVCELMDLRPGQERWRKS

SEQ ID NO: 847948 - protein, 17 aa, Mycobacterium
PYVLIVPTYGGGHPVPG

SEQ ID NO: 847949 - protein, 35 aa, Mycobacterium
PYVLQDFSLFQVLRYGFRPSKVAFLAWHAWHDPER

SEQ ID NO: 847950 - protein, 17 aa, Mycobacterium
PYVLRRGPRHLRPRSNT

SEQ ID NO: 847951 - protein, 20 aa, Mycobacterium
PYWADLARMLALDSARGRKA

SEQ ID NO: 847952 - protein, 17 aa, Mycobacterium
PYYLAAEVTFDSLDDLR

SEQ ID NO: 847953 - protein, 19 aa, Mycobacterium
PYYNAIVWQDTRTDRIASA

SEQ ID NO: 847954 - protein, 17 aa, Mycobacterium
PYYRALVARVYGSAVSH

SEQ ID NO: 847955 - protein, 23 aa, Mycobacterium
QAAADLSGIRRKAAKRLAKEVTA

SEQ ID NO: 847956 - protein, 29 aa, Mycobacterium
QAAAEWFARILFSLFSTPSPIRDMDDAQA

SEQ ID NO: 847957 - protein, 17 aa, Mycobacterium
QAAAIPTTSVLSAGSDE

SEQ ID NO: 847958 - protein, 20 aa, Mycobacterium
QAAAMLSRSLLWQGRPEQAE

SEQ ID NO: 847959 - protein, 25 aa, Mycobacterium
QAAAPSLLTLYGCGALTAAKLVGET

SEQ ID NO: 847960 - protein, 21 aa, Mycobacterium
QAAAPTVILGAPSGPDVRIVS

SEQ ID NO: 847961 - protein, 24 aa, Mycobacterium
QAAAYPFMTPIFGKGVVFDASPER

SEQ ID NO: 847962 - protein, 19 aa, Mycobacterium
QAADFLRPGHVAPLLAEPH

SEQ ID NO: 847963 - protein, 27 aa, Mycobacterium
QAADLSWLFMTDWISSPLPGNAPAPGT

SEQ ID NO: 847964 - protein, 33 aa, Mycobacterium
QAAEYLSGRWALKFGFPLMPVDGILVGTAAMAT

SEQ ID NO: 847965 - protein, 27 aa, Mycobacterium
QAAFFNAVLVRYPDLLDTYLTVGGLCH

SEQ ID NO: 847966 - protein, 17 aa, Mycobacterium
QAAGKYPPPPGASEIIG

SEQ ID NO: 847967 - protein, 31 aa, Mycobacterium
QAAGLAAWSLVHGFAMLWLNEAIDTDADAVV

SEQ ID NO: 847968 - protein, 19 aa, Mycobacterium
QAAGPLGWRGALRIGVKMA

SEQ ID NO: 847969 - protein, 29 aa, Mycobacterium
QAAGVPVAFLTAWYGLSDLAGVRSGESVL

SEQ ID NO: 847970 - protein, 31 aa, Mycobacterium
QAAGVPVVFLTAYYGLSVLAGLRAGQRVLVH

SEQ ID NO: 847971 - protein, 18 aa, Mycobacterium
QAAHGCELVLVLGGDGTF

SEQ ID NO: 847972 - protein, 22 aa, Mycobacterium
QAAHLVMVFQQNLAELVIKGDS

SEQ ID NO: 847973 - protein, 21 aa, Mycobacterium
QAAIFLDRPLESLNQIVLHLG

SEQ ID NO: 847974 - protein, 27 aa, Mycobacterium
QAAITRTLMRDLLPPPLHGLHGIEFAG

SEQ ID NO: 847975 - protein, 24 aa, Mycobacterium
QAAKLAEWLKLALDEPHLLKTLGA

SEQ ID NO: 847976 - protein, 26 aa, Mycobacterium
QAAKNLRIPVLLIRGKLSDVVSPEGV

SEQ ID NO: 847977 - protein, 27 aa, Mycobacterium
QAAKRTSELIPLCHQLALTGVDIEFDV

SEQ ID NO: 847978 - protein, 19 aa, Mycobacterium
QAALARFHEAAAKQVQELN

SEQ ID NO: 847979 - protein, 19 aa, Mycobacterium
QAALFPVAYTVGTDFRPAA

SEQ ID NO: 847980 - protein, 17 aa, Mycobacterium
QAALFTAYGTLYQQVSA

SEQ ID NO: 847981 - protein, 24 aa, Mycobacterium
QAALLEPYQVTTPLWAATSIVVDP

SEQ ID NO: 847982 - protein, 40 aa, Mycobacterium
QAALQFYGELFLFDYPVHIPQLLTWLSQSPQLLAVALGQA

SEQ ID NO: 847983 - protein, 17 aa, Mycobacterium
QAALTPVAFTRGTEFRP

SEQ ID NO: 847984 - protein, 24 aa, Mycobacterium
QAAMFDGRFAGFADFLILSDGQYR

SEQ ID NO: 847985 - protein, 24 aa, Mycobacterium
QAAMFDGRFAGFADFLLLEEGPDG

SEQ ID NO: 847986 - protein, 27 aa, Mycobacterium
QAAMFDGRFLGFADFLVRDGEQYRVVD

SEQ ID NO: 847987 - protein, 25 aa, Mycobacterium
QAAMFDGRFLGFADFVVREGEHYLV

SEQ ID NO: 847988 - protein, 24 aa, Mycobacterium
QAAPAMRLVSSLLPTNLAAAPAAA

SEQ ID NO: 847989 - protein, 20 aa, Mycobacterium
QAAPGFQLVISYNPGYQSVL

SEQ ID NO: 847990 - protein, 23 aa, Mycobacterium
QAAQFHSQFVQAMQAGAGSYATA

SEQ ID NO: 847991 - protein, 18 aa, Mycobacterium
QAAQRRAPVAIGPYGPEV

SEQ ID NO: 847992 - protein, 30 aa, Mycobacterium
QAAQWIVRVVMSLAVWPIGDAAAEAGLVER

SEQ ID NO: 847993 - protein, 23 aa, Mycobacterium
QAAQYTFILDRMAQLADGDGQHA

SEQ ID NO: 847994 - protein, 22 aa, Mycobacterium
QAARHWYRAGFQPAIQLCLRQH

SEQ ID NO: 847995 - protein, 21 aa, Mycobacterium
QAARLMVDTVRRHQPDSLRKV

SEQ ID NO: 847996 - protein, 18 aa, Mycobacterium
QAARLVRALAAGTGLTVI

SEQ ID NO: 847997 - protein, 32 aa, Mycobacterium
QAARPVLFSTFLMWILANLFTKLPEIGDVDKP

SEQ ID NO: 847998 - protein, 25 aa, Mycobacterium
QAARRGGEWLDWFDAEGIAGVGMGM

SEQ ID NO: 847999 - protein, 28 aa, Mycobacterium
QAARVVPTNFLVLFPEHEKHSLSEHEEL

SEQ ID NO: 848000 - protein, 25 aa, Mycobacterium
QAASFHQQFVQLMSGGATEYAAAEA

SEQ ID NO: 848001 - protein, 24 aa, Mycobacterium
QAASHRGLRVSIYRPGFIQGDSRT

SEQ ID NO: 848002 - protein, 22 aa, Mycobacterium
QAASLDRMTGGRLTLGVGIGIS

SEQ ID NO: 848003 - protein, 23 aa, Mycobacterium
QAASLLLERLAYAVLNRTTPAAH

SEQ ID NO: 848004 - protein, 25 aa, Mycobacterium
QAASPLTWFANYDIRYVDGAVPAAE

SEQ ID NO: 848005 - protein, 25 aa, Mycobacterium
QAASRYHPQRPLRLAPGAIGDLPPT

SEQ ID NO: 848006 - protein, 25 aa, Mycobacterium
QAATAALVASAAWPGQEAKVATPGL

SEQ ID NO: 848007 - protein, 23 aa, Mycobacterium
QAATAKWRRHGFEPDFTVIEFEG

SEQ ID NO: 848008 - protein, 18 aa, Mycobacterium
QAATAPWLPLQHAEALDE

SEQ ID NO: 848009 - protein, 23 aa, Mycobacterium
QAATDLPPGTFLLVQHSGGGRAK

SEQ ID NO: 848010 - protein, 27 aa, Mycobacterium
QAATRPPTFVLFTSGFLEAGYRRFLER

SEQ ID NO: 848011 - protein, 17 aa, Mycobacterium
QAAVAAFREGVRLLTGE

SEQ ID NO: 848012 - protein, 22 aa, Mycobacterium
QAAVLLFLNSRAASYISGQVVW

SEQ ID NO: 848013 - protein, 24 aa, Mycobacterium
QAAVQLAVYRMAWAALRGCPESSV

SEQ ID NO: 848014 - protein, 17 aa, Mycobacterium
QAAVRLALRLRRDELID

SEQ ID NO: 848015 - protein, 19 aa, Mycobacterium
QAAVWALLHSAQSEHPGRI

SEQ ID NO: 848016 - protein, 23 aa, Mycobacterium
QAAWAVLVAYYNRLRCGAGDYID

SEQ ID NO: 848017 - protein, 21 aa, Mycobacterium
QAAWELCVPHLQPLIANLVTE

SEQ ID NO: 848018 - protein, 24 aa, Mycobacterium
QACAALRDIAITEQLLRRIEDAAA

SEQ ID NO: 848019 - protein, 24 aa, Mycobacterium
QACAANTRMLVHRSLFDEAVANVA

SEQ ID NO: 848020 - protein, 19 aa, Mycobacterium
QACEEAIELFHAAPGCVRS

SEQ ID NO: 848021 - protein, 18 aa, Mycobacterium
QACESGTRLLLHASIHDE

SEQ ID NO: 848022 - protein, 23 aa, Mycobacterium
QACGQPFFGFISACVEQALAFLR

SEQ ID NO: 848023 - protein, 20 aa, Mycobacterium
QACILNSRLLLPEAIHDEVV

SEQ ID NO: 848024 - protein, 22 aa, Mycobacterium
QACRLLPNLVTVLGWEHCDHSG

SEQ ID NO: 848025 - protein, 18 aa, Mycobacterium
QACSTLIGLAPTNAELLK

SEQ ID NO: 848026 - protein, 24 aa, Mycobacterium
QACVNPARALGLPAAGLAAGARAD

SEQ ID NO: 848027 - protein, 28 aa, Mycobacterium
QADAALLRGVWWPALHATRKVPPHRQRL

SEQ ID NO: 848028 - protein, 23 aa, Mycobacterium
QADPIVAHIFRTHFWFTEERLRT

SEQ ID NO: 848029 - protein, 25 aa, Mycobacterium
QADPPQWLIDLRKNGPHPKNLVAAK

SEQ ID NO: 848030 - protein, 28 aa, Mycobacterium
QADPSADLILIYLIQNFPDLGVDAAAIA

SEQ ID NO: 848031 - protein, 24 aa, Mycobacterium
QADRDTLWIDLIGELVPQTSSVEA

SEQ ID NO: 848032 - protein, 23 aa, Mycobacterium
QADRPKVLILGSGPNRIGQGIEF

SEQ ID NO: 848033 - protein, 22 aa, Mycobacterium
QADRPLAVSLPTRQCTIDKVTA

SEQ ID NO: 848034 - protein, 24 aa, Mycobacterium
QADTEAFLLKRLEALGGKVIRPAT

SEQ ID NO: 848035 - protein, 23 aa, Mycobacterium
QADVPFFFKQWGGRTPKALGREL

SEQ ID NO: 848036 - protein, 19 aa, Mycobacterium
QADVVVHLAFIKLGSRAES

SEQ ID NO: 848037 - protein, 17 aa, Mycobacterium
QADYRVHPALLDACFQS

SEQ ID NO: 848038 - protein, 38 aa, Mycobacterium
QAEAASASPLAGLLAAINAPVQSLTGRPLIGNGANGTP

SEQ ID NO: 848039 - protein, 27 aa, Mycobacterium
QAEADGFAALWYASAVAGDPLVAMAFA

SEQ ID NO: 848040 - protein, 26 aa, Mycobacterium
QAEAFHAQFAQLMANGAGTYASAEAA

SEQ ID NO: 848041 - protein, 24 aa, Mycobacterium
QAEAYPFMTPIFGKGVVFDADPER

SEQ ID NO: 848042 - protein, 33 aa, Mycobacterium
QAEAYRAISLLLRRPPGREAYPGDVFYLHSRLL

SEQ ID NO: 848043 - protein, 34 aa, Mycobacterium; identical to SEQ ID NO: 221554

SEQ ID NO: 848044 - protein, 23 aa, Mycobacterium
QAEDLVMRYVAEAGLPAVAMCVS

SEQ ID NO: 848045 - protein, 21 aa, Mycobacterium
QAEELVLRYATERGLPAVAMC

SEQ ID NO: 848046 - protein, 25 aa, Mycobacterium
QAEESAFVLLALQAPVAGDLRSIVS

SEQ ID NO: 848047 - protein, 28 aa, Mycobacterium
QAEFDAERWYRILQDQNVSVWYTAPTGI

SEQ ID NO: 848048 - protein, 23 aa, Mycobacterium
QAEGFRHRIADARLLLNNALEAG

SEQ ID NO: 848049 - protein, 24 aa, Mycobacterium
QAEILAYLNWVADKLDLRRDIALR

SEQ ID NO: 848050 - protein, 19 aa, Mycobacterium
QAELAWMFMQSMCEGGDLD

SEQ ID NO: 848051 - protein, 17 aa, Mycobacterium
QAELPFATIADPAKELY

SEQ ID NO: 848052 - protein, 20 aa, Mycobacterium
QAELRRTPAITGADYERGER

SEQ ID NO: 848053 - protein, 36 aa, Mycobacterium
QAEPLKVVLNLWRPGWLPWVIHAMRLGAGVRDGIPT

SEQ ID NO: 848054 - protein, 27 aa, Mycobacterium
QAEPQRRALDQLLVLGTLLEGHADHVM

SEQ ID NO: 848055 - protein, 29 aa, Mycobacterium
QAEQISYAFAIYYLPKPSADPFATLDALL

SEQ ID NO: 848056 - protein, 24 aa, Mycobacterium
QAESIRKFCILPVDFTVLTGELTP

SEQ ID NO: 848057 - protein, 39 aa, Mycobacterium
QAESLWAELSRSLPAPWRVEALVQLAFSAYVRGDGPLAG

SEQ ID NO: 848058 - protein, 18 aa, Mycobacterium
QAETFLNGVFPLDRNRLT

SEQ ID NO: 848059 - protein, 24 aa, Mycobacterium
QAETFPGLRLLVLNDRLAESLGLD

SEQ ID NO: 848060 - protein, 28 aa, Mycobacterium
QAEYGEVLPLPMVSWLYEHGNFRRFTHT

SEQ ID NO: 848061 - protein, 19 aa, Mycobacterium
QAFADYLQKPYPARTTLFG

SEQ ID NO: 848062 - protein, 21 aa, Mycobacterium
QAFDGLRLAGRPVRRPDLTIA

SEQ ID NO: 848063 - protein, 20 aa, Mycobacterium
QAFDGLRLAGRRVRRPDLTI

SEQ ID NO: 848064 - protein, 17 aa, Mycobacterium
QAFFDFIEHDSQGYRLI

SEQ ID NO: 848065 - protein, 20 aa, Mycobacterium
QAFQTWPMLGAVIAGATGGS

SEQ ID NO: 848066 - protein, 17 aa, Mycobacterium
QAFRDRAPRRLDVLDGP

SEQ ID NO: 848067 - protein, 35 aa, Mycobacterium
QAFSVQAATFHEQLVRSLAAGGFSYATAEAANASP

SEQ ID NO: 848068 - protein, 18 aa, Mycobacterium
QAFTEAVSRRPANAEVTL

SEQ ID NO: 848069 - protein, 23 aa, Mycobacterium
QAFTQVELFTGLPAPREAMAAAL

SEQ ID NO: 848070 - protein, 29 aa, Mycobacterium
QAGAETPVWTFLGPRPAHWWVRRRLHEVV

SEQ ID NO: 848071 - protein, 20 aa, Mycobacterium
QAGALDFIPAKRVGTAAEVA

SEQ ID NO: 848072 - protein, 24 aa, Mycobacterium
QAGAPFPLAPMQHAMWVGREDDQQ

SEQ ID NO: 848073 - protein, 27 aa, Mycobacterium
QAGASPAYWYRAVLWNVLMSADQTLGE

SEQ ID NO: 848074 - protein, 27 aa, Mycobacterium
QAGDRAIIARPPFWDITGEHLGVDVDV

SEQ ID NO: 848075 - protein, 22 aa, Mycobacterium
QAGDYSLCWSFTDGVLSPGIHT

SEQ ID NO: 848076 - protein, 23 aa, Mycobacterium
QAGEGPWHLLPKGPVVCSSAAPA

SEQ ID NO: 848077 - protein, 20 aa, Mycobacterium
QAGFGTSTLLRHHFRRLIGV

SEQ ID NO: 848078 - protein, 19 aa, Mycobacterium
QAGGFIWADPDRDLALVAL

SEQ ID NO: 848079 - protein, 23 aa, Mycobacterium
QAGGIAVSLWAREKLSADLGIAD

SEQ ID NO: 848080 - protein, 24 aa, Mycobacterium
QAGGLSVYEGEWWHFDGPGADQPR

SEQ ID NO: 848081 - protein, 24 aa, Mycobacterium
QAGGRWLRSALISNLKIVSSSDPA

SEQ ID NO: 848082 - protein, 33 aa, Mycobacterium
QAGINTTIWVLRGHAFLGYWRTDSALSTVSTTE

SEQ ID NO: 848083 - protein, 23 aa, Mycobacterium
QAGLDVFGRLDIVVANAGIAPMQ

SEQ ID NO: 848084 - protein, 21 aa, Mycobacterium
QAGLFPHMTIRQNVGLVPGLL

SEQ ID NO: 848085 - protein, 18 aa, Mycobacterium
QAGLFPIAYTIGTDFKKA

SEQ ID NO: 848086 - protein, 23 aa, Mycobacterium
QAGLKWPNDVLAGPPGSLGKLAG

SEQ ID NO: 848087 - protein, 19 aa, Mycobacterium
QAGLLLVVALLDGQPRQFL

SEQ ID NO: 848088 - protein, 23 aa, Mycobacterium
QAGLRADLLGQLPFDLTEGQRHV

SEQ ID NO: 848089 - protein, 23 aa, Mycobacterium
QAGLRNLYLVPPSPLDELRRQFP

SEQ ID NO: 848090 - protein, 24 aa, Mycobacterium
QAGLRTDYLFRIANHRGGIVLGTG

SEQ ID NO: 848091 - protein, 24 aa, Mycobacterium
QAGLRTDYLFRIANQRGGIVLGTG

SEQ ID NO: 848092 - protein, 25 aa, Mycobacterium
QAGLRTDYLFRLANHRGGIVLGTGD

SEQ ID NO: 848093 - protein, 21 aa, Mycobacterium
QAGLRTVCLDFKLYAGGMAST

SEQ ID NO: 848094 - protein, 26 aa, Mycobacterium
QAGLTVNFPYLLDVQATHAAWIIARA

SEQ ID NO: 848095 - protein, 24 aa, Mycobacterium
QAGMQVSLHWPYSANVHCEIDVDD

SEQ ID NO: 848096 - protein, 25 aa, Mycobacterium
QAGNIARLSWLAAGFPEEVPGVTVD

SEQ ID NO: 848097 - protein, 22 aa, Mycobacterium
QAGNLFMSVANRIPFAMTARAV

SEQ ID NO: 848098 - protein, 22 aa, Mycobacterium
QAGNPFQISQLAEAFHAAGRCS

SEQ ID NO: 848099 - protein, 19 aa, Mycobacterium
QAGNPFQISQLAEAFHTAG

SEQ ID NO: 848100 - protein, 24 aa, Mycobacterium
QAGPLRRVRAVLAAAARCHRQGQD

SEQ ID NO: 848101 - protein, 25 aa, Mycobacterium
QAGPSRMVLISPALHLTLRGPEVDA

SEQ ID NO: 848102 - protein, 23 aa, Mycobacterium
QAGPVPIRVPPLGSAAQPPATGS

SEQ ID NO: 848103 - protein, 25 aa, Mycobacterium
QAGQKFAREIFFLGRPYTAEQMHAM

SEQ ID NO: 848104 - protein, 26 aa, Mycobacterium
QAGQPWAKAPFGQRIHLALRPTDAPT

SEQ ID NO: 848105 - protein, 23 aa, Mycobacterium
QAGRHRGPRGPAVEGRPLALVGQ

SEQ ID NO: 848106 - protein, 20 aa, Mycobacterium
QAGRKWLLEYGDAGAREAML

SEQ ID NO: 848107 - protein, 17 aa, Mycobacterium
QAGRLPVESLVSSSIRL

SEQ ID NO: 848108 - protein, 21 aa, Mycobacterium
QAGSIYPAMQNFYLAARAQGL

SEQ ID NO: 848109 - protein, 30 aa, Mycobacterium
QAGSLNRPGYLRFDFSWQGALSEAQRQEVE

SEQ ID NO: 848110 - protein, 18 aa, Mycobacterium
QAGSPFQIDRLAEAFHGA

SEQ ID NO: 848111 - protein, 23 aa, Mycobacterium
QAGTFITAVYYPAENQIFTMLQQ

SEQ ID NO: 848112 - protein, 26 aa, Mycobacterium
QAGTPAFIVVGKIRDAWNIQRDADGT

SEQ ID NO: 848113 - protein, 23 aa, Mycobacterium
QAGTPLAVYAANNSLTAAQLAAQ

SEQ ID NO: 848114 - protein, 32 aa, Mycobacterium
QAGTPPKILPEFTSYRRWCELMWHRASAPQVQ

SEQ ID NO: 848115 - protein, 25 aa, Mycobacterium
QAGVEGFALFMTWLAHARSSVDDAA

SEQ ID NO: 848116 - protein, 26 aa, Mycobacterium
QAGVQLAVHPLASRALFGVPSAELPV

SEQ ID NO: 848117 - protein, 21 aa, Mycobacterium
QAHEFPAEFYRAIADGGWLGM

SEQ ID NO: 848118 - protein, 20 aa, Mycobacterium
QAHEFPTEFYRAIADGGWLG

SEQ ID NO: 848119 - protein, 23 aa, Mycobacterium
QAHFLSPMRAAIDMGLRPTNHTD

SEQ ID NO: 848120 - protein, 22 aa, Mycobacterium
QAHGLPAISLGWGLWDQASNMT

SEQ ID NO: 848121 - protein, 23 aa, Mycobacterium
QAHLRHLNPFPANLGEVLARYPK

SEQ ID NO: 848122 - protein, 20 aa, Mycobacterium
QAHLYYKRAYTDAALLGGAE

SEQ ID NO: 848123 - protein, 19 aa, Mycobacterium
QAHPDLKGVYAQNDDMALG

SEQ ID NO: 848124 - protein, 20 aa, Mycobacterium
QAHQFLVDEAYLLDAQQYEA

SEQ ID NO: 848125 - protein, 21 aa, Mycobacterium
QAHRFAWLPFGGGAHKRIGMH

SEQ ID NO: 848126 - protein, 27 aa, Mycobacterium
QAHTRMRPHYFPFTEPSAEVDVWFENK

SEQ ID NO: 848127 - protein, 21 aa, Mycobacterium
QAHTTVYAALRLLGLGEASAA

SEQ ID NO: 848128 - protein, 17 aa, Mycobacterium
QAIAAHGAQFLAAGALG

SEQ ID NO: 848129 - protein, 32 aa, Mycobacterium
QAIAAWNRAFDDGVFCALALPPAVGENEALMR

SEQ ID NO: 848130 - protein, 19 aa, Mycobacterium
QAIAQYRPIYEARLAQMAK

SEQ ID NO: 848131 - protein, 20 aa, Mycobacterium
QAICAFVVLCADFEVHDGIV

SEQ ID NO: 848132 - protein, 21 aa, Mycobacterium
QAIEEILRWEPPALQIARYVT

SEQ ID NO: 848133 - protein, 20 aa, Mycobacterium
QAIELATSPRWEMLRACEAP

SEQ ID NO: 848134 - protein, 18 aa, Mycobacterium
QAIIEWVPPSMLASRQEG

SEQ ID NO: 848135 - protein, 26 aa, Mycobacterium
QAILANAYHLYLQPGPDIVAEAGGLG

SEQ ID NO: 848136 - protein, 25 aa, Mycobacterium
QAIQGIVEAVFGKAKEILGTVIGRN

SEQ ID NO: 848137 - protein, 18 aa, Mycobacterium
QAIRWARSQFGVELVWAI

SEQ ID NO: 848138 - protein, 29 aa, Mycobacterium
QAIRYYFGKSVYQLGLKQAIQLGALVPYR

SEQ ID NO: 848139 - protein, 19 aa, Mycobacterium
QAISDRIAAWGLADEPALR

SEQ ID NO: 848140 - protein, 20 aa, Mycobacterium
QAISQVMPFLVDLPVGEPNA

SEQ ID NO: 848141 - protein, 27 aa, Mycobacterium
QAISTALVLMTERYFYRAFTQGTSLTD

SEQ ID NO: 848142 - protein, 22 aa, Mycobacterium
QAITGPFFSGLTTVLGPAATHN

SEQ ID NO: 848143 - protein, 18 aa, Mycobacterium
QAKALLPVITSDGSPPPQ

SEQ ID NO: 848144 - protein, 20 aa, Mycobacterium
QAKALLPVLTADASPAPQSD

SEQ ID NO: 848145 - protein, 25 aa, Mycobacterium
QAKELFVPPALFPDYLRTARRLSTR

SEQ ID NO: 848146 - protein, 18 aa, Mycobacterium
QAKFLTRDSLRWVIANKA

SEQ ID NO: 848147 - protein, 17 aa, Mycobacterium
QAKGFSLYAIRTILAGR

SEQ ID NO: 848148 - protein, 23 aa, Mycobacterium
QAKGVLMAVYRVSAEQAFRVLQW

SEQ ID NO: 848149 - protein, 17 aa, Mycobacterium
QAKLDWVEKFMAGEVEP

SEQ ID NO: 848150 - protein, 17 aa, Mycobacterium
QAKLDWVQEFMVNELEP

SEQ ID NO: 848151 - protein, 18 aa, Mycobacterium
QAKNMGLFGYAIPQQWGG

SEQ ID NO: 848152 - protein, 23 aa, Mycobacterium
QAKPPEQIVVPPGPDPVPAPADD

SEQ ID NO: 848153 - protein, 22 aa, Mycobacterium
QAKQLTVTLASRLLARALDDTV

SEQ ID NO: 848154 - protein, 29 aa, Mycobacterium
QAKQMGLFGYAIPPQWGGLGLNLVQDVEL

SEQ ID NO: 848155 - protein, 19 aa, Mycobacterium
QALAECLPYYKDLFEQVKA

SEQ ID NO: 848156 - protein, 20 aa, Mycobacterium
QALALFLSAPDANFLLIGTD

SEQ ID NO: 848157 - protein, 23 aa, Mycobacterium
QALAPAPSYRGFVSWLAQQDREA

SEQ ID NO: 848158 - protein, 24 aa, Mycobacterium
QALATVMLSLMQGFEALGKGGVGS

SEQ ID NO: 848159 - protein, 17 aa, Mycobacterium
QALDGLYARLSPGGFCI

SEQ ID NO: 848160 - protein, 18 aa, Mycobacterium
QALDILSRIEAPIVTAAH

SEQ ID NO: 848161 - protein, 27 aa, Mycobacterium
QALDIPARPVVVGPVTFLALSKPIDGA

SEQ ID NO: 848162 - protein, 20 aa, Mycobacterium
QALDQLLVLGTLLEGHADHV

SEQ ID NO: 848163 - protein, 21 aa, Mycobacterium
QALDRQGLYGDYFSFYLCDLL

SEQ ID NO: 848164 - protein, 24 aa, Mycobacterium
QALDSPYFHPGFAAAVHATGRPVS

SEQ ID NO: 848165 - protein, 20 aa, Mycobacterium
QALEDVGFFTLLQPEQWGGL

SEQ ID NO: 848166 - protein, 23 aa, Mycobacterium
QALERLDRALAHTAILGVQTNVE

SEQ ID NO: 848167 - protein, 25 aa, Mycobacterium
QALERLETLLALIEGWVQTVVTDAL

SEQ ID NO: 848168 - protein, 26 aa, Mycobacterium
QALERLETLLALIEGWVQVVVAAALG

SEQ ID NO: 848169 - protein, 26 aa, Mycobacterium
QALERLETLLALIEGWVQVVVTAALG

SEQ ID NO: 848170 - protein, 21 aa, Mycobacterium
QALFEAGFFGTSWPKAYGGQD

SEQ ID NO: 848171 - protein, 19 aa, Mycobacterium
QALFTPEQFWPVTPGLGNL

SEQ ID NO: 848172 - protein, 20 aa, Mycobacterium
QALGDKRGIRRFGDAFIPMD

SEQ ID NO: 848173 - protein, 20 aa, Mycobacterium
QALGGERFDLVYTGLGALCW

SEQ ID NO: 848174 - protein, 26 aa, Mycobacterium
QALGNTPLVGLQRLSPRWDSGGDGSP

SEQ ID NO: 848175 - protein, 20 aa, Mycobacterium
QALGWLDMLDEIPGTAVPLV

SEQ ID NO: 848176 - protein, 19 aa, Mycobacterium
QALLDRRANRPSTFPLQQA

SEQ ID NO: 848177 - protein, 17 aa, Mycobacterium
QALLGHESILTTERYVA

SEQ ID NO: 848178 - protein, 18 aa, Mycobacterium
QALLGRPDWSPGDKAQLV

SEQ ID NO: 848179 - protein, 18 aa, Mycobacterium
QALLQRPDLGHAPSAVLA

SEQ ID NO: 848180 - protein, 25 aa, Mycobacterium
QALLRGVERLARFPGPNGLAQEIFT

SEQ ID NO: 848181 - protein, 18 aa, Mycobacterium
QALPGPMTIFADGVDFAA

SEQ ID NO: 848182 - protein, 24 aa, Mycobacterium
QALPWLADHVVDDACLLPGMAYVD

SEQ ID NO: 848183 - protein, 28 aa, Mycobacterium
QALQSPKPLWALWRLGSDPAFARISMEF

SEQ ID NO: 848184 - protein, 22 aa, Mycobacterium
QALQVKLIDPPPSVSRNRREAA

SEQ ID NO: 848185 - protein, 18 aa, Mycobacterium
QALQWAMSVAARRAEAVL

SEQ ID NO: 848186 - protein, 20 aa, Mycobacterium
QALQWAMSVAGRRAAALLAG

SEQ ID NO: 848187 - protein, 29 aa, Mycobacterium
QALRAKVFPKLVNVLKLRSGLAEIAGLAR

SEQ ID NO: 848188 - protein, 25 aa, Mycobacterium
QALRAQGFTILLSRDVPVNNDAIRP

SEQ ID NO: 848189 - protein, 28 aa, Mycobacterium
QALRESAELRWRWNAGFSLVFARHYATT

SEQ ID NO: 848190 - protein, 26 aa, Mycobacterium
QALRLASALQPLWHTRGRILEGCAWF

SEQ ID NO: 848191 - protein, 25 aa, Mycobacterium
QALRLGHNYIGTEHLLLALLELDDS

SEQ ID NO: 848192 - protein, 17 aa, Mycobacterium
QALRLLGSVALARASRG

SEQ ID NO: 848193 - protein, 17 aa, Mycobacterium
QALRVGAAGYLLKSISS

SEQ ID NO: 848194 - protein, 24 aa, Mycobacterium
QALSLKLIDPPPSLSRARREAERP

SEQ ID NO: 848195 - protein, 23 aa, Mycobacterium
QALSLKLIDPPPSLSRTRREAVE

SEQ ID NO: 848196 - protein, 24 aa, Mycobacterium
QALTFAMQVGLAAVLRSRGVTPAA

SEQ ID NO: 848197 - protein, 21 aa, Mycobacterium
QALTRAIHKLPIKARIITREE

SEQ ID NO: 848198 - protein, 24 aa, Mycobacterium
QALTTLLGARRWIRMPAVRFGPDT

SEQ ID NO: 848199 - protein, 18 aa, Mycobacterium
QALVGTPLDPITPAEGVV

SEQ ID NO: 848200 - protein, 17 aa, Mycobacterium
QALYPTPPFARLAGQRE

SEQ ID NO: 848201 - protein, 17 aa, Mycobacterium
QAMAIVAPTPRFAQRKT

SEQ ID NO: 848202 - protein, 28 aa, Mycobacterium
QAMASAAAPYAGWLGLAAARATTAAAQA

SEQ ID NO: 848203 - protein, 17 aa, Mycobacterium
QAMEYLPWANRLQEGDD

SEQ ID NO: 848204 - protein, 19 aa, Mycobacterium
QAMINYMACRTAFFDTFFL

SEQ ID NO: 848205 - protein, 17 aa, Mycobacterium
QAMLREAIQIIRDLLCG

SEQ ID NO: 848206 - protein, 20 aa, Mycobacterium
QAMRHGLMPATLHVDAPSPR

SEQ ID NO: 848207 - protein, 17 aa, Mycobacterium
QAMRRIVPARALSPISS

SEQ ID NO: 848208 - protein, 28 aa, Mycobacterium
QAMTDLQCWRAPWKTLVDLGWTELAASD

SEQ ID NO: 848209 - protein, 19 aa, Mycobacterium
QANDKIRILTNKIVLAVDG

SEQ ID NO: 848210 - protein, 24 aa, Mycobacterium
QANHLIAGLIAIGAIDIGIACGIE

SEQ ID NO: 848211 - protein, 29 aa, Mycobacterium
QANIRYVTGAPQLWIAGTRPFGPMCVLVR

SEQ ID NO: 848212 - protein, 30 aa, Mycobacterium
QANIRYVTGAPQLWIAGTRPFGPMCVMMRG

SEQ ID NO: 848213 - protein, 29 aa, Mycobacterium
QANVPLGIIPLLLVDMWEHAYYLQYKNVK

SEQ ID NO: 848214 - protein, 19 aa, Mycobacterium
QANWNNSVTPWYGFFVNVG

SEQ ID NO: 848215 - protein, 19 aa, Mycobacterium
QANYAGRPSPLYEATRLSE

SEQ ID NO: 848216 - protein, 25 aa, Mycobacterium
QAPAEPGMASPLLFALSSTSADGLR

SEQ ID NO: 848217 - protein, 17 aa, Mycobacterium
QAPAHVRTWGRNARLTD

SEQ ID NO: 848218 - protein, 20 aa, Mycobacterium
QAPALLFLHGSGGHAEAYVR

SEQ ID NO: 848219 - protein, 29 aa, Mycobacterium
QAPDGTNLDPLFDVLLEHVPPPQGDSEAP

SEQ ID NO: 848220 - protein, 24 aa, Mycobacterium
QAPFHIYQRALATGAFREVSATGS

SEQ ID NO: 848221 - protein, 20 aa, Mycobacterium
QAPFIVDALRDQLATGIQLG

SEQ ID NO: 848222 - protein, 26 aa, Mycobacterium
QAPGGLSCFFLPRVLPDGSRNRMRLQ

SEQ ID NO: 848223 - protein, 27 aa, Mycobacterium
QAPGGLSCFLLPRILPDGSRNRMFLQR

SEQ ID NO: 848224 - protein, 20 aa, Mycobacterium
QAPHPGMAPGARPGPVPKPG

SEQ ID NO: 848225 - protein, 27 aa, Mycobacterium
QAPKGLSCFMLPRILPDGTRNRMLLQR

SEQ ID NO: 848226 - protein, 25 aa, Mycobacterium
QAPMGLIPGWGRLLSKILAAFFTHR

SEQ ID NO: 848227 - protein, 33 aa, Mycobacterium
QAPNSTLCSYLDKLLWILTGNFAKPGGQHLHST

SEQ ID NO: 848228 - protein, 32 aa, Mycobacterium
QAPNSTLCSYLNKLLWILTGNFAKKGGQHLHS

SEQ ID NO: 848229 - protein, 32 aa, Mycobacterium
QAPNSTLCSYLNKLLWVLTGNFAKRGGQHLHS

SEQ ID NO: 848230 - protein, 32 aa, Mycobacterium
QAPNSTLCSYLNKMLWILTGNFAKQGGQHLHS

SEQ ID NO: 848231 - protein, 24 aa, Mycobacterium
QAPQPFNPFAPPPPPVELGPAPGP

SEQ ID NO: 848232 - protein, 24 aa, Mycobacterium
QAPRAWRMRIFVQKTDGQVKVSNV

SEQ ID NO: 848233 - protein, 28 aa, Mycobacterium
QAPRLRFPRAVRPWQHVLDCLNGYLTLA

SEQ ID NO: 848234 - protein, 20 aa, Mycobacterium
QAQAFARGGLIRPAVLVHSI

SEQ ID NO: 848235 - protein, 24 aa, Mycobacterium
QAQELLLALLPESGKAHRVGITGV

SEQ ID NO: 848236 - protein, 21 aa, Mycobacterium
QAQERPPLRAVDRTRTPLLSV

SEQ ID NO: 848237 - protein, 27 aa, Mycobacterium
QAQFGGLPHPTILAAAQLLGVQEVWAV

SEQ ID NO: 848238 - protein, 22 aa, Mycobacterium
QAQIMALLRDLRTEYHMAVVLI

SEQ ID NO: 848239 - protein, 27 aa, Mycobacterium
QAQISKPMLYLYYGSKEDLFGACLHRE

SEQ ID NO: 848240 - protein, 17 aa, Mycobacterium
QAQLPVPTVASAVLDPT

SEQ ID NO: 848241 - protein, 21 aa, Mycobacterium
QAQMFVYGTTLLERKRREPPT

SEQ ID NO: 848242 - protein, 20 aa, Mycobacterium
QAQPVTDPARRRGGRRPDRH

SEQ ID NO: 848243 - protein, 25 aa, Mycobacterium
QAQRFTHTCFLATPYEQYLEVAETL

SEQ ID NO: 848244 - protein, 21 aa, Mycobacterium
QARADMVGRWLYAFGPATVTD

SEQ ID NO: 848245 - protein, 27 aa, Mycobacterium
QARALRFWEVMYPSPPPGLAGPDDDRR

SEQ ID NO: 848246 - protein, 27 aa, Mycobacterium
QARALYEKNWLRLISDVDYAPVPLVPA

SEQ ID NO: 848247 - protein, 17 aa, Mycobacterium
QARDELALLPDLPGRRA

SEQ ID NO: 848248 - protein, 22 aa, Mycobacterium
QARDELDLLPDVAGRRALAALV

SEQ ID NO: 848249 - protein, 17 aa, Mycobacterium
QARDLAFVMFSGAGSKL

SEQ ID NO: 848250 - protein, 25 aa, Mycobacterium
QARDLRYTLLDDVPVATLISGHALS

SEQ ID NO: 848251 - protein, 22 aa, Mycobacterium
QARDRILLIAREQLNPTTHYDR

SEQ ID NO: 848252 - protein, 34 aa, Mycobacterium
QARFATYPVLAVQGWAAFHDLKLRAVIGTAEQLA

SEQ ID NO: 848253 - protein, 28 aa, Mycobacterium
QARFDGLPHPTILAAARLLGVDEVWAVG

SEQ ID NO: 848254 - protein, 23 aa, Mycobacterium
QARGFTPAMALAAGFANTLARWS

SEQ ID NO: 848255 - protein, 23 aa, Mycobacterium
QARGIRYIGFRHEASAANAAAAA

SEQ ID NO: 848256 - protein, 26 aa, Mycobacterium
QARGQDVFPMTLLGTFSPYMVVHRSS

SEQ ID NO: 848257 - protein, 26 aa, Mycobacterium
QARGQNVFPMTLLGTFSPYMVVHRSS

SEQ ID NO: 848258 - protein, 32 aa, Mycobacterium
QARIEFKLRDWLFARQRYWGEPFPIVYDADGR

SEQ ID NO: 848259 - protein, 22 aa, Mycobacterium
QARIRWELPAHAIDRHIRAMTP

SEQ ID NO: 848260 - protein, 18 aa, Mycobacterium
QARKSFIDSVKGTAKEVV

SEQ ID NO: 848261 - protein, 21 aa, Mycobacterium
QARLAVEPQLREPLPRLGTVP

SEQ ID NO: 848262 - protein, 23 aa, Mycobacterium
QARLIPHIHALIRLDPPDSDDSG

SEQ ID NO: 848263 - protein, 21 aa, Mycobacterium
QARLLLPVTADLLRGSGRPLP

SEQ ID NO: 848264 - protein, 17 aa, Mycobacterium
QARMFWKSMSAVEAKHI

SEQ ID NO: 848265 - protein, 25 aa, Mycobacterium
QARPFVLLDRFELNAWAAAVRKHRP

SEQ ID NO: 848266 - protein, 25 aa, Mycobacterium
QARPNYFEFLLPAVARRRADRSGPP

SEQ ID NO: 848267 - protein, 26 aa, Mycobacterium
QARPPARLIGWTARFLGMVHPGDEVD

SEQ ID NO: 848268 - protein, 26 aa, Mycobacterium
QARPPARLIGWTARFLGMVRPGDEVA

SEQ ID NO: 848269 - protein, 21 aa, Mycobacterium
QARRILTEIPGPRSRDLAERR

SEQ ID NO: 848270 - protein, 26 aa, Mycobacterium
QARRKKLMQRLPFLAAPDDGPIANAF

SEQ ID NO: 848271 - protein, 28 aa, Mycobacterium
QARRLPDALARFPITRLVSSPQVRAIET

SEQ ID NO: 848272 - protein, 24 aa, Mycobacterium
QARRLVVRGFFGEIIAKIAVPEIR

SEQ ID NO: 848273 - protein, 27 aa, Mycobacterium
QARRLVVRGFFGELIQKIAVPAVRDRL

SEQ ID NO: 848274 - protein, 25 aa, Mycobacterium
QARRLVVRGFFNEIIAKIAVPAVRE

SEQ ID NO: 848275 - protein, 18 aa, Mycobacterium
QARRRPIQLSGGQRQRVA

SEQ ID NO: 848276 - protein, 18 aa, Mycobacterium
QARRWTRDAVAEAMRVVA

SEQ ID NO: 848277 - protein, 28 aa, Mycobacterium
QARSRPIAPLLDGLRRLGVRLDGDGLPF

SEQ ID NO: 848278 - protein, 24 aa, Mycobacterium
QARSSVAALIRSVVRPPLADADLS

SEQ ID NO: 848279 - protein, 25 aa, Mycobacterium
QARTILGLPVDTMMISPGAAHRVER

SEQ ID NO: 848280 - protein, 27 aa, Mycobacterium
QARTYEKMSLFIVPAETPGIEIVRNVG

SEQ ID NO: 848281 - protein, 22 aa, Mycobacterium
QARVEGLLERVSRRFQREAGRT

SEQ ID NO: 848282 - protein, 17 aa, Mycobacterium
QARWLPITLGHELAHHY

SEQ ID NO: 848283 - protein, 23 aa, Mycobacterium
QASACILCECNCGIVVQVRDRTL

SEQ ID NO: 848284 - protein, 20 aa, Mycobacterium
QASAKRQLGLAWPADRPLPP

SEQ ID NO: 848285 - protein, 17 aa, Mycobacterium
QASGMSTFSLGLADIGQ

SEQ ID NO: 848286 - protein, 21 aa, Mycobacterium
QASHLYVFQRTPNYSVPAGNR

SEQ ID NO: 848287 - protein, 21 aa, Mycobacterium
QASLLPLLHNYQHPEKPIRGS

SEQ ID NO: 848288 - protein, 22 aa, Mycobacterium
QASLYYHFKTKDDILDALLAMT

SEQ ID NO: 848289 - protein, 23 aa, Mycobacterium
QASPLSMMTKLFDGLTVGAHSDG

SEQ ID NO: 848290 - protein, 31 aa, Mycobacterium
QASPPDMKLPISLALGWPDRVPGVAAACDFS

SEQ ID NO: 848291 - protein, 29 aa, Mycobacterium
QASPPDMKLPISLALGWPRRVPGAARYCD

SEQ ID NO: 848292 - protein, 30 aa, Mycobacterium
QASPPDMKLPISLALGWPRRVPGAATSCDF

SEQ ID NO: 848293 - protein, 21 aa, Mycobacterium
QASRLLKPYNPALEVAPFATA

SEQ ID NO: 848294 - protein, 21 aa, Mycobacterium
QASRLLLRVLGIDPPDHELDV

SEQ ID NO: 848295 - protein, 23 aa, Mycobacterium
QASRLLLRVLGIDPPTHDLDVWS

SEQ ID NO: 848296 - protein, 22 aa, Mycobacterium
QASRLLPNLVTVLGWESCDHTG

SEQ ID NO: 848297 - protein, 25 aa, Mycobacterium
QASRVLHELAPGLVLWECDKTIYRA

SEQ ID NO: 848298 - protein, 26 aa, Mycobacterium
QASSAEFVRLLLAASIRGLVGMIPPG

SEQ ID NO: 848299 - protein, 31 aa, Mycobacterium
QASVVRREIGVPTVFNLLGPLTNPARPRAGL

SEQ ID NO: 848300 - protein, 37 aa, Mycobacterium
QATARPPTFVLFTTGFLEAGYRRFLERRLREAFGFEG

SEQ ID NO: 848301 - protein, 20 aa, Mycobacterium
QATATLAFINGIMLTFVAGQ

SEQ ID NO: 848302 - protein, 26 aa, Mycobacterium
QATDLPRWRQFAFGVLGFAQGSGPEP

SEQ ID NO: 848303 - protein, 36 aa, Mycobacterium; identical to SEQ ID NO: 130516

SEQ ID NO: 848304 - protein, 26 aa, Mycobacterium
QATGARAAFLIRFGTGVLPEPKTILQ

SEQ ID NO: 848305 - protein, 26 aa, Mycobacterium
QATGARVAFLIRFGAGVLPEPKSVIQ

SEQ ID NO: 848306 - protein, 25 aa, Mycobacterium
QATGARVAFLIRFGAGVLPEPKTVI

SEQ ID NO: 848307 - protein, 26 aa, Mycobacterium
QATGARVAFLLRFGTGVLPEPKTVLQ

SEQ ID NO: 848308 - protein, 29 aa, Mycobacterium
QATGDNGLIPLRWALACLLADIGSTAHTL

SEQ ID NO: 848309 - protein, 26 aa, Mycobacterium
QATGGNFAFFARDFPDLTALTRPGFP

SEQ ID NO: 848310 - protein, 25 aa, Mycobacterium
QATIPIVHAVSRVVDVPYAEIVASV

SEQ ID NO: 848311 - protein, 24 aa, Mycobacterium
QATIPIVYAVSRVVEVPYAEIVAS

SEQ ID NO: 848312 - protein, 23 aa, Mycobacterium
QATPLEKLARILNTPLAAAVADH

SEQ ID NO: 848313 - protein, 22 aa, Mycobacterium
QATRLLPNLVTVLGWESCDHTG

SEQ ID NO: 848314 - protein, 36 aa, Mycobacterium
QATSRPPTFVLFTTGFLEAGYRRFLERRLRESFGFD

SEQ ID NO: 848315 - protein, 26 aa, Mycobacterium
QATVSRRLALLLLAPEVRKAVETGRL

SEQ ID NO: 848316 - protein, 23 aa, Mycobacterium
QATYHRWRNQFGGLKADDAKRLK

SEQ ID NO: 848317 - protein, 24 aa, Mycobacterium
QAVAAHLTLLLIELARLARDVVGD

SEQ ID NO: 848318 - protein, 19 aa, Mycobacterium
QAVALLFSRSPQAIVAILA

SEQ ID NO: 848319 - protein, 20 aa, Mycobacterium
QAVAMPYRTLFMTLQQLLVG

SEQ ID NO: 848320 - protein, 19 aa, Mycobacterium
QAVAPLHYFNDRAGSIYAG

SEQ ID NO: 848321 - protein, 26 aa, Mycobacterium
QAVATNLLRYLWPDVTLVSGPAGGPA

SEQ ID NO: 848322 - protein, 23 aa, Mycobacterium
QAVDDYLLAYIRSEKSRTITSND

SEQ ID NO: 848323 - protein, 18 aa, Mycobacterium
QAVDHAVFLLDKTGPPPP

SEQ ID NO: 848324 - protein, 37 aa, Mycobacterium
QAVEQQLLGVINAPTQALLGRPLIGDGTAGAPGQNGG

SEQ ID NO: 848325 - protein, 24 aa, Mycobacterium
QAVGAAAWGLRLAVGATASGVSAT

SEQ ID NO: 848326 - protein, 26 aa, Mycobacterium
QAVGHAAWFLHVQGVLVPAAGGVGLV

SEQ ID NO: 848327 - protein, 25 aa, Mycobacterium
QAVGVPGGWLYALGDTTGRARLSHI

SEQ ID NO: 848328 - protein, 20 aa, Mycobacterium
QAVIAMLKNADLDVALQFVN

SEQ ID NO: 848329 - protein, 21 aa, Mycobacterium
QAVIDDLRRGWNGASADAAIE

SEQ ID NO: 848330 - protein, 24 aa, Mycobacterium
QAVKLDEWLRLSLDEPELLKTLGA

SEQ ID NO: 848331 - protein, 27 aa, Mycobacterium
QAVLAALPQAVVVRTAWVYTGGDGTDF

SEQ ID NO: 848332 - protein, 25 aa, Mycobacterium
QAVLASWRMLLDAGRLQDGEPHLAG

SEQ ID NO: 848333 - protein, 27 aa, Mycobacterium
QAVLDLINSPAVALTGRPLIGNGADGA

SEQ ID NO: 848334 - protein, 28 aa, Mycobacterium
QAVLEDPLILLHQDKISSLPDLLPLLEK

SEQ ID NO: 848335 - protein, 18 aa, Mycobacterium
QAVLPGMLSAGWGRIVNV

SEQ ID NO: 848336 - protein, 25 aa, Mycobacterium
QAVLTSPVSFLQRPARWLQMLATSS

SEQ ID NO: 848337 - protein, 23 aa, Mycobacterium
QAVMFSHLGLDYLIVDEADKFRR

SEQ ID NO: 848338 - protein, 21 aa, Mycobacterium
QAVPGTIWTPPPGGGAHHLGY

SEQ ID NO: 848339 - protein, 20 aa, Mycobacterium
QAVPIMVDWLQNLDERIPAE

SEQ ID NO: 848340 - protein, 20 aa, Mycobacterium
QAVPIMVDWLRHIDERVPAG

SEQ ID NO: 848341 - protein, 28 aa, Mycobacterium
QAVQDWPNILPDDFTILDAIFAVYATVG

SEQ ID NO: 848342 - protein, 25 aa, Mycobacterium
QAVQRLLHRRLLGPLLRGQDATPPA

SEQ ID NO: 848343 - protein, 23 aa, Mycobacterium
QAVQRVLHIGLRRALLGGEIRQP

SEQ ID NO: 848344 - protein, 26 aa, Mycobacterium
QAVQSLGILRRPLSTSLLSAADIKAN

SEQ ID NO: 848345 - protein, 26 aa, Mycobacterium
QAVRLTQRLHAPLRVVTFAVRGRTML

SEQ ID NO: 848346 - protein, 22 aa, Mycobacterium
QAVRRLLAQLMAFEEVNRYLTE

SEQ ID NO: 848347 - protein, 19 aa, Mycobacterium
QAVRTHFFDAFFSAAVDAG

SEQ ID NO: 848348 - protein, 18 aa, Mycobacterium
QAVRTHFFDAYFTHATQA

SEQ ID NO: 848349 - protein, 22 aa, Mycobacterium
QAVRTHFFDEYFAAAAGAGIEQ

SEQ ID NO: 848350 - protein, 24 aa, Mycobacterium
QAVRTHFFDEYFADAVATGIRQVV

SEQ ID NO: 848351 - protein, 19 aa, Mycobacterium
QAVRTNFFDTYFADAVAAG

SEQ ID NO: 848352 - protein, 17 aa, Mycobacterium
QAVRYPELWRDNGSFDA

SEQ ID NO: 848353 - protein, 28 aa, Mycobacterium
QAVSSQAALFHDQFVQALTTGASSYASA

SEQ ID NO: 848354 - protein, 31 aa, Mycobacterium
QAVSTQAAEFHDRFVAALTAGADAYSSAEAS

SEQ ID NO: 848355 - protein, 31 aa, Mycobacterium
QAVSVRAAAFHYRFVASLFAGTESYVATEAA

SEQ ID NO: 848356 - protein, 29 aa, Mycobacterium
QAVTALAESPWLVQPLAAPAGAGKTHSLK

SEQ ID NO: 848357 - protein, 24 aa, Mycobacterium
QAVTASVWPMIASNRVRPIIGSRL

SEQ ID NO: 848358 - protein, 20 aa, Mycobacterium
QAVVELLRRGITARDILTRE

SEQ ID NO: 848359 - protein, 19 aa, Mycobacterium
QAVVLLKNDLRDGEPILPL

SEQ ID NO: 848360 - protein, 21 aa, Mycobacterium
QAVVPSMRPAPYSVAPGIDCI

SEQ ID NO: 848361 - protein, 21 aa, Mycobacterium
QAVWDIRRLLSWIRAQQPDAM

SEQ ID NO: 848362 - protein, 22 aa, Mycobacterium
QAVYETPFWRAHGLSGTGFASR

SEQ ID NO: 848363 - protein, 25 aa, Mycobacterium
QAVYQRFPANLVLGLLRATPEIADG

SEQ ID NO: 848364 - protein, 20 aa, Mycobacterium
QAWEALLEHVNFPLRNMHAM

SEQ ID NO: 848365 - protein, 17 aa, Mycobacterium
QAWRNIVFGEADIAICG

SEQ ID NO: 848366 - protein, 17 aa, Mycobacterium
QAWRNIVMGEADIAICG

SEQ ID NO: 848367 - protein, 17 aa, Mycobacterium
QAYARYADWKKVQRPLI

SEQ ID NO: 848368 - protein, 19 aa, Mycobacterium
QAYCDLLEVRWLLSERAGQ

SEQ ID NO: 848369 - protein, 31 aa, Mycobacterium
QAYKCRVRKPWWRVPYLRPADLFLTYMNADT

SEQ ID NO: 848370 - protein, 30 aa, Mycobacterium
QAYQHPTRLHWYVPPSVRWIDRLKGVSPEF

SEQ ID NO: 848371 - protein, 30 aa, Mycobacterium
QAYQHPTRLHWYVPQSIRWIDRLKGVSPEL

SEQ ID NO: 848372 - protein, 24 aa, Mycobacterium
QAYRQVLAPWLSRKAVEKYRPRMQ

SEQ ID NO: 848373 - protein, 21 aa, Mycobacterium
QCCAVVAYGALLGDALLAIPP

SEQ ID NO: 848374 - protein, 21 aa, Mycobacterium
QCCAVVAYGALLGDALLGVPP

SEQ ID NO: 848375 - protein, 23 aa, Mycobacterium
QCDALMIVLGSPRGGPASALDTL

SEQ ID NO: 848376 - protein, 21 aa, Mycobacterium
QCFLQTDLFNQGVRPAVNVGV

SEQ ID NO: 848377 - protein, 27 aa, Mycobacterium
QCGSTAEVLAWAAQLRAAALPGVVDVV

SEQ ID NO: 848378 - protein, 36 aa, Mycobacterium
QCHSLAFDYSVWEIWAPLLYGARLLIVPDGVVRSSE

SEQ ID NO: 848379 - protein, 33 aa, Mycobacterium
QCHSLAFDYSVWEIWGALLYGGRLLVVPDAVVR

SEQ ID NO: 848380 - protein, 25 aa, Mycobacterium
QCHVHRYMRPLLERIRKGDIDPTII

SEQ ID NO: 848381 - protein, 18 aa, Mycobacterium
QCILYTALDAYVRHFPVV

SEQ ID NO: 848382 - protein, 25 aa, Mycobacterium
QCLAPGARLVFNAFLACGGYTPDQA

SEQ ID NO: 848383 - protein, 25 aa, Mycobacterium
QCLRSPYGLLYTRLTERGGVPMETE

SEQ ID NO: 848384 - protein, 30 aa, Mycobacterium
QCQDSYRVSSLYPFLLTIAVSMTLQQTERG

SEQ ID NO: 848385 - protein, 29 aa, Mycobacterium
QCRDRFVPFTELALPLTATGHHDGTPRSV

SEQ ID NO: 848386 - protein, 24 aa, Mycobacterium
QCRLRADAILRRRTDRLPLGAPTA

SEQ ID NO: 848387 - protein, 20 aa, Mycobacterium
QCRLTIWHACWMMDNGAKGR

SEQ ID NO: 848388 - protein, 28 aa, Mycobacterium
QCTTKPLSTLLFPNWNTTTPQPPTPRPH

SEQ ID NO: 848389 - protein, 20 aa, Mycobacterium
QCVALLFPRCAEAIMAMLAV

SEQ ID NO: 848390 - protein, 17 aa, Mycobacterium
QDAAAMYGYAAGAAAAS

SEQ ID NO: 848391 - protein, 32 aa, Mycobacterium
QDAFDYVRDLLSYLPPNNYADPPLYPVAIPEG

SEQ ID NO: 848392 - protein, 32 aa, Mycobacterium
QDAFVTKDRWSMEWYYPILGGALRGPRAQARI

SEQ ID NO: 848393 - protein, 18 aa, Mycobacterium
QDAIWRGVYYTPGGAQPS

SEQ ID NO: 848394 - protein, 25 aa, Mycobacterium
QDAKPVIGTVMRQGYQLGEHVLRNA

SEQ ID NO: 848395 - protein, 32 aa, Mycobacterium
QDAKPVIGTVMRQGYQLGEHVLRNALVAVVDT

SEQ ID NO: 848396 - protein, 18 aa, Mycobacterium
QDALLADDRIRHLRGRVA

SEQ ID NO: 848397 - protein, 19 aa, Mycobacterium
QDALPGTPLIAMVPVSLRS

SEQ ID NO: 848398 - protein, 20 aa, Mycobacterium
QDALTFCDLTTGPDGSPISP

SEQ ID NO: 848399 - protein, 17 aa, Mycobacterium
QDAMQYGVLAGYPLVNL

SEQ ID NO: 848400 - protein, 25 aa, Mycobacterium
QDAPIPGRLFAGPGLAQPSGVSPAA

SEQ ID NO: 848401 - protein, 22 aa, Mycobacterium
QDAPYYMVATLSFDSAEALKAA

SEQ ID NO: 848402 - protein, 21 aa, Mycobacterium
QDAWFYLDELEAIIREWIAVI

SEQ ID NO: 848403 - protein, 17 aa, Mycobacterium
QDAWLRWSTHRGAAVED

SEQ ID NO: 848404 - protein, 27 aa, Mycobacterium
QDDPPYVAVPYLDRMDLAYAAADLVIC

SEQ ID NO: 848405 - protein, 25 aa, Mycobacterium
QDDRVLPADLYRRLSTDLGANGCKV

SEQ ID NO: 848406 - protein, 27 aa, Mycobacterium
QDDVALLLYRHPAPLELTFPAHADHLA

SEQ ID NO: 848407 - protein, 27 aa, Mycobacterium
QDDVVLLLYRHPAPLELNFPADVSQLA

SEQ ID NO: 848408 - protein, 31 aa, Mycobacterium
QDDVVLLLYRHPAPLELTFPADVSHLAPART

SEQ ID NO: 848409 - protein, 26 aa, Mycobacterium
QDDWKLRLIRTLSSRGILFGTVHTAQ

SEQ ID NO: 848410 - protein, 22 aa, Mycobacterium
QDELLRIWQATGKTILFITHGI

SEQ ID NO: 848411 - protein, 26 aa, Mycobacterium
QDERFYYPAYMGPYGWLGLDFAIAEV

SEQ ID NO: 848412 - protein, 19 aa, Mycobacterium
QDERSLWQGLAQLAVGVTH

SEQ ID NO: 848413 - protein, 23 aa, Mycobacterium
QDESGLCKVLAAPDGRILGAHVI

SEQ ID NO: 848414 - protein, 24 aa, Mycobacterium
QDETLTVLWHSITWQYLAAQERAA

SEQ ID NO: 848415 - protein, 18 aa, Mycobacterium
QDEVSAAIAALFSVHGQT

SEQ ID NO: 848416 - protein, 20 aa, Mycobacterium
QDFCRRRISVGTTTALVFGS

SEQ ID NO: 848417 - protein, 23 aa, Mycobacterium
QDFEGWARWVSPGGALIIHDVFP

SEQ ID NO: 848418 - protein, 17 aa, Mycobacterium
QDFFFRKIARDQGGALL

SEQ ID NO: 848419 - protein, 20 aa, Mycobacterium
QDFFFRKIVKDQGKSLAFIS

SEQ ID NO: 848420 - protein, 20 aa, Mycobacterium
QDFPALAPGVRVPVRFTLGE

SEQ ID NO: 848421 - protein, 23 aa, Mycobacterium
QDGAAVAWLSPLVPLVDSEPTTA

SEQ ID NO: 848422 - protein, 27 aa, Mycobacterium
QDGANLAWKLAAVIHGWAGEALLQSYS

SEQ ID NO: 848423 - protein, 26 aa, Mycobacterium
QDGCGLPLFCLPPGGGISWAYRNLSP

SEQ ID NO: 848424 - protein, 24 aa, Mycobacterium
QDGFGLVVYSPLAQGLLTNKYLES

SEQ ID NO: 848425 - protein, 24 aa, Mycobacterium
QDGGDPSGQFGGTGGAGGSGGAGA

SEQ ID NO: 848426 - protein, 24 aa, Mycobacterium
QDGKYPSRAFLAELNPGFASFVED

SEQ ID NO: 848427 - protein, 24 aa, Mycobacterium
QDGLGEYFAPGLPVAFDGAHAAGA

SEQ ID NO: 848428 - protein, 23 aa, Mycobacterium
QDGMLWFEVMAPMASSAAGREAA

SEQ ID NO: 848429 - protein, 23 aa, Mycobacterium
QDGQVWLRGEVCPYVVFEQLKEP

SEQ ID NO: 848430 - protein, 25 aa, Mycobacterium
QDGSFGWIGIANLPSRFAAATYLPD

SEQ ID NO: 848431 - protein, 25 aa, Mycobacterium
QDGSFGWIGIANLPSTFAAATYLPD

SEQ ID NO: 848432 - protein, 22 aa, Mycobacterium
QDGSITLPYWMIYDDSEGEVPP

SEQ ID NO: 848433 - protein, 28 aa, Mycobacterium
QDGTGQNGGILFGNGGSGWNSDVVGMDG

SEQ ID NO: 848434 - protein, 21 aa, Mycobacterium
QDGWLGVGWPKEYGGHGFGPL

SEQ ID NO: 848435 - protein, 22 aa, Mycobacterium
QDHAFDLSSLRFALNGAEGIDV

SEQ ID NO: 848436 - protein, 21 aa, Mycobacterium
QDHPAFGCVWEYDVALEPRNT

SEQ ID NO: 848437 - protein, 23 aa, Mycobacterium
QDHRDPVLGTMGWLGCEIRRYLQ

SEQ ID NO: 848438 - protein, 24 aa, Mycobacterium
QDIDPMRLRAILDDAARRLGVDDV

SEQ ID NO: 848439 - protein, 21 aa, Mycobacterium
QDIIVAMHRLLAATPSRLKLI

SEQ ID NO: 848440 - protein, 25 aa, Mycobacterium
QDINLKSVFFCCKAALRHMVPAQKG

SEQ ID NO: 848441 - protein, 25 aa, Mycobacterium
QDIVVLGLPRGGVPVAFEVAKALHA

SEQ ID NO: 848442 - protein, 21 aa, Mycobacterium
QDKLALLLEFADELPPLPAEL

SEQ ID NO: 848443 - protein, 27 aa, Mycobacterium
QDKLDTYVRPLLSISAERVSRGGEPLF

SEQ ID NO: 848444 - protein, 24 aa, Mycobacterium
QDKLKLLLEFADELPALPAELEEQ

SEQ ID NO: 848445 - protein, 20 aa, Mycobacterium
QDKTLMRRKLRDIGAPVPGF

SEQ ID NO: 848446 - protein, 21 aa, Mycobacterium
QDLDLSAFVLFSSAAGVLGSP

SEQ ID NO: 848447 - protein, 17 aa, Mycobacterium
QDLGLPTERGRLKVRAD

SEQ ID NO: 848448 - protein, 22 aa, Mycobacterium
QDLIGRGVLAVRGRGLWAGVDI

SEQ ID NO: 848449 - protein, 27 aa, Mycobacterium
QDLLATGPISWLLQLGADLSTGYTAAV

SEQ ID NO: 848450 - protein, 24 aa, Mycobacterium
QDLRGLLGAFMFSGPQLDQLAGTL

SEQ ID NO: 848451 - protein, 24 aa, Mycobacterium
QDLRGLLGAFMFSGPQLDQPAGTL

SEQ ID NO: 848452 - protein, 18 aa, Mycobacterium
QDLRRRIALRQSVEMVRT

SEQ ID NO: 848453 - protein, 18 aa, Mycobacterium
QDLRRRVALRQSVEMVRT

SEQ ID NO: 848454 - protein, 23 aa, Mycobacterium
QDLSELLWSFAPPARPRPATLAE

SEQ ID NO: 848455 - protein, 21 aa, Mycobacterium
QDLSPDQWRLLRAAVAEAPDD

SEQ ID NO: 848456 - protein, 23 aa, Mycobacterium
QDLTTLRAKAWRQIRGGSVGLIP

SEQ ID NO: 848457 - protein, 17 aa, Mycobacterium
QDLVAEGAVYRVPGRGS

SEQ ID NO: 848458 - protein, 18 aa, Mycobacterium
QDLYFAGARISRFYPFGA

SEQ ID NO: 848459 - protein, 27 aa, Mycobacterium
QDMRCKWRKWLYFQCNWKVAMEAFNET

SEQ ID NO: 848460 - protein, 17 aa, Mycobacterium
QDMVGIEYPIMQDGMGP

SEQ ID NO: 848461 - protein, 21 aa, Mycobacterium
QDMVTLLRSGFSPVAFVMGNC

SEQ ID NO: 848462 - protein, 19 aa, Mycobacterium
QDNNIQAWIIDPLSKLYRD

SEQ ID NO: 848463 - protein, 17 aa, Mycobacterium
QDPEALRRRTLITAAQY

SEQ ID NO: 848464 - protein, 17 aa, Mycobacterium
QDPEGLYRMLRSEAPVC

SEQ ID NO: 848465 - protein, 24 aa, Mycobacterium
QDPLPGILDYLRRALRAFHRNPEM

SEQ ID NO: 848466 - protein, 25 aa, Mycobacterium
QDPRFTIAAIPPRQDPRDAVVARDG

SEQ ID NO: 848467 - protein, 28 aa, Mycobacterium
QDPRYTLWAAWHRSGLQRRWLSAAERGG

SEQ ID NO: 848468 - protein, 24 aa, Mycobacterium
QDPSQWLLWPSLDRRWHSHHNSDD

SEQ ID NO: 848469 - protein, 24 aa, Mycobacterium
QDQGRPFLAFVYGIAAHKVADAHR

SEQ ID NO: 848470 - protein, 24 aa, Mycobacterium
QDQLDLFRPAVKWGGPIFEWARIP

SEQ ID NO: 848471 - protein, 17 aa, Mycobacterium
QDQLRVLIDHIADYDLV

SEQ ID NO: 848472 - protein, 17 aa, Mycobacterium
QDQLVTVLGISAGSYAA

SEQ ID NO: 848473 - protein, 22 aa, Mycobacterium
QDQVSHLAFFDDAAKLALRQPD

SEQ ID NO: 848474 - protein, 18 aa, Mycobacterium
QDQVTMLAGVRHGLTLGG

SEQ ID NO: 848475 - protein, 19 aa, Mycobacterium
QDRCPADLFAALLVSSDPS

SEQ ID NO: 848476 - protein, 26 aa, Mycobacterium
QDRDQIRLWLDLLLERRPGEIATTAE

SEQ ID NO: 848477 - protein, 20 aa, Mycobacterium
QDRFFAARNAATAERDAEFR

SEQ ID NO: 848478 - protein, 18 aa, Mycobacterium
QDRFFRALPEMAVRWQAD

SEQ ID NO: 848479 - protein, 18 aa, Mycobacterium
QDRGAAQAAWRRVLAGFD

SEQ ID NO: 848480 - protein, 20 aa, Mycobacterium
QDRIFTVPVVSLPIVEKAIE

SEQ ID NO: 848481 - protein, 20 aa, Mycobacterium
QDRLFIQIGELSPPGSRIAA

SEQ ID NO: 848482 - protein, 22 aa, Mycobacterium
QDRLMSRHLLGTEWQQRELPQP

SEQ ID NO: 848483 - protein, 22 aa, Mycobacterium
QDRMPVLYCKTGVRSAEALAAL

SEQ ID NO: 848484 - protein, 23 aa, Mycobacterium
QDRNIWQCPVVLLADVRSVGVQG

SEQ ID NO: 848485 - protein, 25 aa, Mycobacterium
QDRRTWEELIYLFAEIADAGTAVVA

SEQ ID NO: 848486 - protein, 17 aa, Mycobacterium
QDRRWATAWSPEQISHR

SEQ ID NO: 848487 - protein, 26 aa, Mycobacterium
QDRVTWLENTIRWSWELGDVAMWDNR

SEQ ID NO: 848488 - protein, 19 aa, Mycobacterium
QDSAYAWAYNVEKGNKTRI

SEQ ID NO: 848489 - protein, 17 aa, Mycobacterium
QDSGLPVIVLRTSRFFP

SEQ ID NO: 848490 - protein, 25 aa, Mycobacterium
QDSHRPAMEVLLMGGRPIREPTFQY

SEQ ID NO: 848491 - protein, 18 aa, Mycobacterium
QDSLRHSVLAFLAAREDA

SEQ ID NO: 848492 - protein, 22 aa, Mycobacterium
QDSVLPVKLNFPPPLAHLGSDP

SEQ ID NO: 848493 - protein, 22 aa, Mycobacterium
QDTAYAWAYNLGKGGKTRIIGP

SEQ ID NO: 848494 - protein, 20 aa, Mycobacterium
QDTAYAWAYNVEKGEKTRII

SEQ ID NO: 848495 - protein, 24 aa, Mycobacterium
QDTDKPWMMYYSTGATHAPHHVAK

SEQ ID NO: 848496 - protein, 24 aa, Mycobacterium
QDTDPIQWQVLERAFRGVSTLIMI

SEQ ID NO: 848497 - protein, 22 aa, Mycobacterium
QDTFTYGLLYQRESDLAEGCRQ

SEQ ID NO: 848498 - protein, 20 aa, Mycobacterium
QDTFYIAPEDSRQLLRTHTS

SEQ ID NO: 848499 - protein, 26 aa, Mycobacterium
QDTGSPFWLRMAPNLDFDPLTDVNGF

SEQ ID NO: 848500 - protein, 18 aa, Mycobacterium
QDTLDRWAADQYAMQPAY

SEQ ID NO: 848501 - protein, 24 aa, Mycobacterium
QDTNRYLGGRPPYGYRLVDAGPHP

SEQ ID NO: 848502 - protein, 26 aa, Mycobacterium
QDTSSAVVVPYFWSDQYDVKIQCLGE

SEQ ID NO: 848503 - protein, 24 aa, Mycobacterium
QDTTRYLGGRPPYGYQLVDAGPHP

SEQ ID NO: 848504 - protein, 23 aa, Mycobacterium
QDTTRYLGGRPPYGYRLVDAGPH

SEQ ID NO: 848505 - protein, 21 aa, Mycobacterium
QDTVIIYRRTEAQMPAHEEER

SEQ ID NO: 848506 - protein, 27 aa, Mycobacterium
QDVFASRLPLYFPKPLRERFTGEIRTH

SEQ ID NO: 848507 - protein, 23 aa, Mycobacterium
QDVFDRYLPAVADLRLRHLENDA

SEQ ID NO: 848508 - protein, 18 aa, Mycobacterium
QDVFFIRGRGIVATGRVE

SEQ ID NO: 848509 - protein, 26 aa, Mycobacterium
QDVFPTRPIVGLLGFLGLRSNLVPNH

SEQ ID NO: 848510 - protein, 29 aa, Mycobacterium
QDVKRFRTTLLPKALGAWHLDRLTRKDDL

SEQ ID NO: 848511 - protein, 26 aa, Mycobacterium
QDVPTAVVVPYFWSDQYDVKIQCLGE

SEQ ID NO: 848512 - protein, 18 aa, Mycobacterium
QDVRVLVDVRLTPLSRKP

SEQ ID NO: 848513 - protein, 17 aa, Mycobacterium
QDWDSTLAINLSGTFLM

SEQ ID NO: 848514 - protein, 27 aa, Mycobacterium
QDWEYLRTLYAERAPRFLASAVPGLNP

SEQ ID NO: 848515 - protein, 22 aa, Mycobacterium
QDWGGLIGLRLAAEHPERFARL

SEQ ID NO: 848516 - protein, 21 aa, Mycobacterium
QDWGLPPFRPDRLAATGYAAL

SEQ ID NO: 848517 - protein, 21 aa, Mycobacterium
QDWGLPPWRPDRLADTGYAAL

SEQ ID NO: 848518 - protein, 37 aa, Mycobacterium
QDWTPPTRPVPAPPPGYPPRPPWPDRPYPQADHPVPP

SEQ ID NO: 848519 - protein, 27 aa, Mycobacterium
QDYLNARPITTPFGLYDCDVPCDGAVA

SEQ ID NO: 848520 - protein, 23 aa, Mycobacterium
QDYQLQLVPKMLRAMRPDLTIGF

SEQ ID NO: 848521 - protein, 18 aa, Mycobacterium
QDYQLQLVPKMLRMLRPD

SEQ ID NO: 848522 - protein, 26 aa, Mycobacterium
QDYRTVGEAPYYRILRDATERAHQAG

SEQ ID NO: 848523 - protein, 28 aa, Mycobacterium
QEAAGDGWFWPNAAAHPSLPRGALLQVA

SEQ ID NO: 848524 - protein, 17 aa, Mycobacterium
QEACFVTWTASFDVIGD

SEQ ID NO: 848525 - protein, 31 aa, Mycobacterium; identical to SEQ ID NO: 130532

SEQ ID NO: 848526 - protein, 30 aa, Mycobacterium
QEAIDPLLPEVAWSWLVEALESRTEHMTAL

SEQ ID NO: 848527 - protein, 26 aa, Mycobacterium
QEAKVATPGLAAMAPAAMGATAGSVA

SEQ ID NO: 848528 - protein, 25 aa, Mycobacterium
QEASAVVSVPYFWSDQYDVKIQCLG

SEQ ID NO: 848529 - protein, 17 aa, Mycobacterium
QEAWLRWDAAPGRDDVA

SEQ ID NO: 848530 - protein, 22 aa, Mycobacterium
QEAYTLAMLLAEALGPDAFRQR

SEQ ID NO: 848531 - protein, 22 aa, Mycobacterium
QECPFMEFTPGYVLRVIDELPK

SEQ ID NO: 848532 - protein, 26 aa, Mycobacterium
QEDARVLLEHLGVPRWRLMGVFGDPD

SEQ ID NO: 848533 - protein, 23 aa, Mycobacterium
QEDFAYHDFLVKKSDMPGQTPPS

SEQ ID NO: 848534 - protein, 26 aa, Mycobacterium
QEDFDTAFWRQHAFIDNFLGGVNDYF

SEQ ID NO: 848535 - protein, 24 aa, Mycobacterium
QEDLIGALSVIRPLSRSTTEEVAV

SEQ ID NO: 848536 - protein, 24 aa, Mycobacterium
QEDLVGALGVIRPLSRSATEEVSV

SEQ ID NO: 848537 - protein, 23 aa, Mycobacterium
QEEPGRWAEYLLASRATTIYGGT

SEQ ID NO: 848538 - protein, 18 aa, Mycobacterium
QEEQLKTALLSRDRIGQA

SEQ ID NO: 848539 - protein, 24 aa, Mycobacterium
QEEVDHWLALDPISRYRSYLQGQG

SEQ ID NO: 848540 - protein, 23 aa, Mycobacterium
QEEVFGPVLAVIPFRDSDEALEI

SEQ ID NO: 848541 - protein, 19 aa, Mycobacterium
QEEVFGPVLSVLRYRDDED

SEQ ID NO: 848542 - protein, 19 aa, Mycobacterium
QEFDVLRRAGTERPFTGEY

SEQ ID NO: 848543 - protein, 27 aa, Mycobacterium
QEFGTLATWLVFVLNVALGSVDAPGGA

SEQ ID NO: 848544 - protein, 18 aa, Mycobacterium
QEFIPELLQMHARGHFPI

SEQ ID NO: 848545 - protein, 19 aa, Mycobacterium
QEFLAALPTLAMTAFEDLS

SEQ ID NO: 848546 - protein, 20 aa, Mycobacterium
QEFLRTWSYPDYLAACGSSA

SEQ ID NO: 848547 - protein, 24 aa, Mycobacterium
QEFNLKKMWLSPNGTIRNILGGTI

SEQ ID NO: 848548 - protein, 31 aa, Mycobacterium
QEFQHTSEALTPLLWVPGVAAELAEAASRCT

SEQ ID NO: 848549 - protein, 20 aa, Mycobacterium
QEFSSRLRRWRLAGGADAGL

SEQ ID NO: 848550 - protein, 20 aa, Mycobacterium
QEFVLVWVDGKYDDALTSTW

SEQ ID NO: 848551 - protein, 21 aa, Mycobacterium
QEFVVDMTVWIDLAGAAASDE

SEQ ID NO: 848552 - protein, 32 aa, Mycobacterium
QEGDRGVSWLPFFHDMGLITVLLTSVLGHSFT

SEQ ID NO: 848553 - protein, 28 aa, Mycobacterium
QEGKGFQYILDGLNPERMLIAAEALGIG

SEQ ID NO: 848554 - protein, 22 aa, Mycobacterium
QEGLDKVFQVLRAPHTEEPTNW

SEQ ID NO: 848555 - protein, 23 aa, Mycobacterium
QEGLLVSIRHRGLFVIEMTPDEV

SEQ ID NO: 848556 - protein, 18 aa, Mycobacterium
QEGLPDIAWFTPDGAEMT

SEQ ID NO: 848557 - protein, 28 aa, Mycobacterium
QEGNEREYWIRRSWRSTGASIREILLVS

SEQ ID NO: 848558 - protein, 24 aa, Mycobacterium
QEGQRLWLSWAMANRDPRLFDQPD

SEQ ID NO: 848559 - protein, 24 aa, Mycobacterium
QEGRAQVVAYLTAALKLFGDSGFH

SEQ ID NO: 848560 - protein, 26 aa, Mycobacterium
QEGTPPFRRMAKPVLAAINGICCGAG

SEQ ID NO: 848561 - protein, 30 aa, Mycobacterium
QEHALFLRQTPIFEHMLIDDGILLRKYWFS

SEQ ID NO: 848562 - protein, 20 aa, Mycobacterium
QEHLRRFVALDYHRSWHTGL

SEQ ID NO: 848563 - protein, 23 aa, Mycobacterium
QEHVLPALRDPRQARRLMLGLGG

SEQ ID NO: 848564 - protein, 18 aa, Mycobacterium
QEHWPSEVAAREPVLLWG

SEQ ID NO: 848565 - protein, 17 aa, Mycobacterium
QEIAAVLISPALAEGLD

SEQ ID NO: 848566 - protein, 18 aa, Mycobacterium
QEIARIYTVMRERELGLA

SEQ ID NO: 848567 - protein, 27 aa, Mycobacterium
QEIATLERQLQLLDKLIGAATQDLQDP

SEQ ID NO: 848568 - protein, 17 aa, Mycobacterium
QEILRDGVIPRRLITSC

SEQ ID NO: 848569 - protein, 24 aa, Mycobacterium
QEISRLIGRSLRACIDLAALGENT

SEQ ID NO: 848570 - protein, 22 aa, Mycobacterium
QEISRLIGRSLRACIDLSALGE

SEQ ID NO: 848571 - protein, 25 aa, Mycobacterium
QEISRLVGRSLRACIDLAALGENTI

SEQ ID NO: 848572 - protein, 17 aa, Mycobacterium
QEKALRFYTEVLGFVVK

SEQ ID NO: 848573 - protein, 20 aa, Mycobacterium
QEKGLRFYTDVLGFVLKHDV

SEQ ID NO: 848574 - protein, 24 aa, Mycobacterium
QEKLGRLHADYLAARGLLREGVAS

SEQ ID NO: 848575 - protein, 34 aa, Mycobacterium
QEKVADSWIQIEQFRLLVLRTAWLIDKHHDYQKV

SEQ ID NO: 848576 - protein, 24 aa, Mycobacterium
QELARWIAEPPSPTRPGRASALTD

SEQ ID NO: 848577 - protein, 24 aa, Mycobacterium
QELGADFFVFSGHKIYGPTGIGVL

SEQ ID NO: 848578 - protein, 25 aa, Mycobacterium
QELGADICYILTPYFECSGKPGVLE

SEQ ID NO: 848579 - protein, 25 aa, Mycobacterium
QELHLDPLPLLIRDGVPSIALRGQE

SEQ ID NO: 848580 - protein, 20 aa, Mycobacterium
QELHRQAMALAQHLRSRMPA

SEQ ID NO: 848581 - protein, 29 aa, Mycobacterium
QELKQALWELIWAGWVTGDTFAPVRAVLS

SEQ ID NO: 848582 - protein, 27 aa, Mycobacterium
QELMPDVLHWLGIRKIHRLVSMSNMKY

SEQ ID NO: 848583 - protein, 21 aa, Mycobacterium
QELNPRLIILSISGFGHDGPE

SEQ ID NO: 848584 - protein, 23 aa, Mycobacterium
QELRGILGAFMFSGPQLEQLAGT

SEQ ID NO: 848585 - protein, 23 aa, Mycobacterium
QELRGLLGAFMFSGPQLEQPAGT

SEQ ID NO: 848586 - protein, 23 aa, Mycobacterium
QELSFLTTLRDDGVRRLALRAAE

SEQ ID NO: 848587 - protein, 30 aa, Mycobacterium
QELVDYVRGVLYFRTGRWPDVLNQFPEGKV

SEQ ID NO: 848588 - protein, 21 aa, Mycobacterium
QELWEWLHYDEGIPLTRRAIK

SEQ ID NO: 848589 - protein, 21 aa, Mycobacterium
QELWFHEYQQLMKRRALVAGQ

SEQ ID NO: 848590 - protein, 26 aa, Mycobacterium
QEMLGVARLLTFLPGGAMSQSGYLAP

SEQ ID NO: 848591 - protein, 25 aa, Mycobacterium
QEMMRPLRALLVEPVAALGSSDVER

SEQ ID NO: 848592 - protein, 19 aa, Mycobacterium
QEMQMIQQMLSSVTGAMGG

SEQ ID NO: 848593 - protein, 20 aa, Mycobacterium
QEMSRLLEPGRTYQFNALFL

SEQ ID NO: 848594 - protein, 17 aa, Mycobacterium
QENAPAPPLARMFETAE

SEQ ID NO: 848595 - protein, 26 aa, Mycobacterium
QENKYRLVFDKLALKAGDRLLDVGCG

SEQ ID NO: 848596 - protein, 25 aa, Mycobacterium
QENKYRLVFEKLGLQPGDRLLDVGC

SEQ ID NO: 848597 - protein, 20 aa, Mycobacterium
QEPAPAALLTVLAATADGLT

SEQ ID NO: 848598 - protein, 28 aa, Mycobacterium
QEPDWVNTIFLSTRFQAWRVGGYNEYLY

SEQ ID NO: 848599 - protein, 25 aa, Mycobacterium
QEPGSLVDYVIMGQVLTAGAGQMPA

SEQ ID NO: 848600 - protein, 17 aa, Mycobacterium
QEPMTALNPVYTIGWQI

SEQ ID NO: 848601 - protein, 24 aa, Mycobacterium
QEPPAAVSVPYFWSDQYDVKIQAL

SEQ ID NO: 848602 - protein, 24 aa, Mycobacterium
QEPPPLLFDQTAALTHLRLTRRDD

SEQ ID NO: 848603 - protein, 24 aa, Mycobacterium
QEPRSRLCCACFDGNYPIELPKET

SEQ ID NO: 848604 - protein, 22 aa, Mycobacterium
QEPVAVFALDRPALEAAMRTWE

SEQ ID NO: 848605 - protein, 25 aa, Mycobacterium
QEQGRWADYLLASRATTIYGGTSEV

SEQ ID NO: 848606 - protein, 18 aa, Mycobacterium
QEQIDEFPDLRRVHLVPA

SEQ ID NO: 848607 - protein, 22 aa, Mycobacterium
QEQRFSIVPLGPDSTLLQVDLD

SEQ ID NO: 848608 - protein, 23 aa, Mycobacterium
QEQRTNWLNNFYFGGEHGVEGSI

SEQ ID NO: 848609 - protein, 18 aa, Mycobacterium
QEQYGCIFMWYQPHGKEP

SEQ ID NO: 848610 - protein, 17 aa, Mycobacterium
QERAELINWLLDRGFDV

SEQ ID NO: 848611 - protein, 25 aa, Mycobacterium
QERFGRWLELIGPPPRSIYEIGSGK

SEQ ID NO: 848612 - protein, 21 aa, Mycobacterium
QERGLRETGFWRFVSDPDDPS

SEQ ID NO: 848613 - protein, 17 aa, Mycobacterium
QERLAARAAAGRLARPA

SEQ ID NO: 848614 - protein, 28 aa, Mycobacterium
QERLGALAGAMRPPAPPGAPGMPGAPGA

SEQ ID NO: 848615 - protein, 28 aa, Mycobacterium
QERLGALAGAMRPPGAPGAPGAPGAPGM

SEQ ID NO: 848616 - protein, 30 aa, Mycobacterium
QERLIADQVRWIWLLLDDTLRAEGIYVNPN

SEQ ID NO: 848617 - protein, 18 aa, Mycobacterium
QERPLALVVVKPGADITP

SEQ ID NO: 848618 - protein, 17 aa, Mycobacterium
QERPLAVVVLHEGSSAD

SEQ ID NO: 848619 - protein, 24 aa, Mycobacterium
QERRTDWLNNFYFGGDHGVSDSVA

SEQ ID NO: 848620 - protein, 25 aa, Mycobacterium
QERRTDWLNNFYFGGEHGVADSVAR

SEQ ID NO: 848621 - protein, 24 aa, Mycobacterium
QERYPLLEETLELDLSGLAEDEKE

SEQ ID NO: 848622 - protein, 23 aa, Mycobacterium
QERYPLLEETLELDLSGLSEEEK

SEQ ID NO: 848623 - protein, 27 aa, Mycobacterium
QESAPQAGPLWGIPVAVKDIYDVAGYR

SEQ ID NO: 848624 - protein, 30 aa, Mycobacterium
QESATVFENWLTGLARWFGQLDVDEATSRR

SEQ ID NO: 848625 - protein, 18 aa, Mycobacterium
QESLEAILALFRAAPTER

SEQ ID NO: 848626 - protein, 17 aa, Mycobacterium
QESLEAILALLRAAPGE

SEQ ID NO: 848627 - protein, 21 aa, Mycobacterium
QESQRFEDMIRRATARWRHHG

SEQ ID NO: 848628 - protein, 21 aa, Mycobacterium
QETARMFGLPESGLAETLRDA

SEQ ID NO: 848629 - protein, 29 aa, Mycobacterium
QETLIALTRVRELIDRYPLRGIKGPMGTA

SEQ ID NO: 848630 - protein, 22 aa, Mycobacterium
QETRLRLLLTSAGMRPSHTQIE

SEQ ID NO: 848631 - protein, 29 aa, Mycobacterium
QETTLLSLYITLMHFGGIIVPPGYTDPLK

SEQ ID NO: 848632 - protein, 26 aa, Mycobacterium
QETTLLTLYVTLMHFGGIIVAPGYTD

SEQ ID NO: 848633 - protein, 26 aa, Mycobacterium
QETYLRALGALPRFAGRSTVRTWLLS

SEQ ID NO: 848634 - protein, 22 aa, Mycobacterium
QEVARFVEIAGRYGYLLATPEE

SEQ ID NO: 848635 - protein, 21 aa, Mycobacterium
QEVCKIFADAFLHGVRVPEPP

SEQ ID NO: 848636 - protein, 21 aa, Mycobacterium
QEVEALLCREARDGVQKLHGN

SEQ ID NO: 848637 - protein, 25 aa, Mycobacterium
QEVENLLIMHPKLLDAAVFGVPNDE

SEQ ID NO: 848638 - protein, 21 aa, Mycobacterium
QEVLEYLLRSGVTGLRVAVQL

SEQ ID NO: 848639 - protein, 18 aa, Mycobacterium
QEVLPLLEEVLGGGVAEA

SEQ ID NO: 848640 - protein, 25 aa, Mycobacterium
QEVLSALGRYVTMNQNLTGTGFSGD

SEQ ID NO: 848641 - protein, 23 aa, Mycobacterium
QEVLTALIDQLLVDPKLTAQITR

SEQ ID NO: 848642 - protein, 20 aa, Mycobacterium
QEVLVRLTPRNYSISSSPLV

SEQ ID NO: 848643 - protein, 24 aa, Mycobacterium
QEVQQFLRLAQAPAATSRFLDLGT

SEQ ID NO: 848644 - protein, 27 aa, Mycobacterium
QEVRELKRANEILKRAASFFGAELDRQ

SEQ ID NO: 848645 - protein, 25 aa, Mycobacterium
QEVSSPRVLSDLFWIGRYAERAEHT

SEQ ID NO: 848646 - protein, 20 aa, Mycobacterium
QEWPPHIKALADAASKRGDA

SEQ ID NO: 848647 - protein, 17 aa, Mycobacterium
QEWQEVLVRLTPRNYSI

SEQ ID NO: 848648 - protein, 17 aa, Mycobacterium
QEYRDSVLPPSVRARVV

SEQ ID NO: 848649 - protein, 21 aa, Mycobacterium
QFAAPVWMPRAKRAPIRAVQE

SEQ ID NO: 848650 - protein, 22 aa, Mycobacterium
QFAIYGELPSYRAMLDREGYAG

SEQ ID NO: 848651 - protein, 19 aa, Mycobacterium
QFAKVIIKLEPFTGEDGAT

SEQ ID NO: 848652 - protein, 20 aa, Mycobacterium
QFALILSPRGFGASAPFYGT

SEQ ID NO: 848653 - protein, 20 aa, Mycobacterium
QFANGEKFHFPARIARPLSH

SEQ ID NO: 848654 - protein, 25 aa, Mycobacterium
QFASEFNIPFVPLDTLKTQFERVAA

SEQ ID NO: 848655 - protein, 19 aa, Mycobacterium
QFASTPLAPATPIVSRLVA

SEQ ID NO: 848656 - protein, 32 aa, Mycobacterium
QFATFPETVVPYYPYFSFVQRPFEMSVEHLKL

SEQ ID NO: 848657 - protein, 24 aa, Mycobacterium
QFAVALFALLRAGVVPVMCLTGHR

SEQ ID NO: 848658 - protein, 17 aa, Mycobacterium
QFAVGLSRQLYGRTIAS

SEQ ID NO: 848659 - protein, 18 aa, Mycobacterium
QFAYQFPHLVERLILVGA

SEQ ID NO: 848660 - protein, 21 aa, Mycobacterium
QFCQSWPKDALHIERFAAKPD

SEQ ID NO: 848661 - protein, 29 aa, Mycobacterium
QFCSMIYPTQYRMPDYYRWLLYKADHGPA

SEQ ID NO: 848662 - protein, 21 aa, Mycobacterium
QFDCSGLVQWAYAQAGIQLER

SEQ ID NO: 848663 - protein, 24 aa, Mycobacterium
QFDDRPVEYWPTAAIRAALETDDL

SEQ ID NO: 848664 - protein, 21 aa, Mycobacterium
QFDHVALSRVYELMAQGIPVV

SEQ ID NO: 848665 - protein, 19 aa, Mycobacterium
QFDIPLREPLVPDADDGSA

SEQ ID NO: 848666 - protein, 20 aa, Mycobacterium
QFDPPPVMRLLEVTSAYPPT

SEQ ID NO: 848667 - protein, 19 aa, Mycobacterium
QFDRPIAGFQLTQEKLANM

SEQ ID NO: 848668 - protein, 24 aa, Mycobacterium
QFDSLEELFFTLYDQRATLISEQV

SEQ ID NO: 848669 - protein, 17 aa, Mycobacterium
QFDVFADAVLAAAGPAV

SEQ ID NO: 848670 - protein, 27 aa, Mycobacterium
QFEALRPHLLAVAYRLTGTYADAEDIV

SEQ ID NO: 848671 - protein, 26 aa, Mycobacterium
QFEEWDVRIVPRDLLAPLPGKASQQQ

SEQ ID NO: 848672 - protein, 18 aa, Mycobacterium
QFEFIVMQQFSTLGQSVS

SEQ ID NO: 848673 - protein, 26 aa, Mycobacterium
QFERAAQCRSIWPRAMAFAAIGAAEL

SEQ ID NO: 848674 - protein, 18 aa, Mycobacterium
QFFGVRLRSPVLIGAMTG

SEQ ID NO: 848675 - protein, 25 aa, Mycobacterium
QFFRERWQRLLRSLYPIGGVVFDGD

SEQ ID NO: 848676 - protein, 17 aa, Mycobacterium
QFFSQAKTRWSGCANRS

SEQ ID NO: 848677 - protein, 19 aa, Mycobacterium
QFGAVVSLDLRRLDRLISL

SEQ ID NO: 848678 - protein, 26 aa, Mycobacterium
QFGDDGIIQWLIHRLPGLSETFVEFG

SEQ ID NO: 848679 - protein, 18 aa, Mycobacterium
QFGFQLGLAFQIVDDVMG

SEQ ID NO: 848680 - protein, 24 aa, Mycobacterium
QFGPNPLTLPLEQLSADAAVTPDG

SEQ ID NO: 848681 - protein, 20 aa, Mycobacterium
QFGPYRLRRLVGRGGMGDVY

SEQ ID NO: 848682 - protein, 17 aa, Mycobacterium
QFGRLDIVVANAGVLNW

SEQ ID NO: 848683 - protein, 18 aa, Mycobacterium
QFGRSPLSYLLDDQLPTN

SEQ ID NO: 848684 - protein, 18 aa, Mycobacterium
QFGSCQAIWRLDGGYCAA

SEQ ID NO: 848685 - protein, 23 aa, Mycobacterium
QFHDLIAFVLRVLAKPPVMALPS

SEQ ID NO: 848686 - protein, 18 aa, Mycobacterium
QFHTLGRKVVDFTDEILG

SEQ ID NO: 848687 - protein, 19 aa, Mycobacterium
QFIDYCINMLYITAAPYVP

SEQ ID NO: 848688 - protein, 25 aa, Mycobacterium
QFIKVAFLPNFNVKSAHLIYPAADL

SEQ ID NO: 848689 - protein, 27 aa, Mycobacterium
QFIRAGSIIQLLLGNIGRPGGGIFALR

SEQ ID NO: 848690 - protein, 27 aa, Mycobacterium
QFIRAGSIIQLLLGNIGRPGGGVFALR

SEQ ID NO: 848691 - protein, 33 aa, Mycobacterium
QFIRDAKVIAPDKPWFTYLCPGAGHAPHHVFKE

SEQ ID NO: 848692 - protein, 17 aa, Mycobacterium
QFKAVVSGAQKLPAEGP

SEQ ID NO: 848693 - protein, 19 aa, Mycobacterium
QFKDRLAPNVLYPQRLGNP

SEQ ID NO: 848694 - protein, 25 aa, Mycobacterium
QFKPKPLFYRQPIYYMSNAQTFVPT

SEQ ID NO: 848695 - protein, 17 aa, Mycobacterium
QFLAVRDGLLEQARLAG

SEQ ID NO: 848696 - protein, 30 aa, Mycobacterium
QFLEQHPAVRWVRYPFLGTHPQYELAKRQM

SEQ ID NO: 848697 - protein, 25 aa, Mycobacterium
QFLGGRSHWLRRVAALTQQGVRREL

SEQ ID NO: 848698 - protein, 18 aa, Mycobacterium
QFLKRLPANQVYRRLNWN

SEQ ID NO: 848699 - protein, 17 aa, Mycobacterium
QFLVDILSDLRTDRLVR

SEQ ID NO: 848700 - protein, 20 aa, Mycobacterium
QFLYQPAVDQVLRAGVARFA

SEQ ID NO: 848701 - protein, 19 aa, Mycobacterium
QFMVPAMWTALTQVSDFDS

SEQ ID NO: 848702 - protein, 41 aa, Mycobacterium
QFNDVGLLVNFPLSQWLKFAPPIAYGALPKDALGAGLGALG

SEQ ID NO: 848703 - protein, 25 aa, Mycobacterium
QFNLPYIHVVVNNSYLGLIRQAQRQ

SEQ ID NO: 848704 - protein, 25 aa, Mycobacterium
QFNNYLQRDSLLPERIRELVILRTA

SEQ ID NO: 848705 - protein, 17 aa, Mycobacterium
QFPAYSLTALIGGDLSK

SEQ ID NO: 848706 - protein, 19 aa, Mycobacterium
QFPEELGKMGFVFNFITYG

SEQ ID NO: 848707 - protein, 27 aa, Mycobacterium
QFPGAVWSFSIGWGCDKLITAADLAPV

SEQ ID NO: 848708 - protein, 24 aa, Mycobacterium
QFPVAKYGIALDNWSIRRLTSLVG

SEQ ID NO: 848709 - protein, 17 aa, Mycobacterium
QFQDFLVLIDRADLLDD

SEQ ID NO: 848710 - protein, 23 aa, Mycobacterium
QFQETMRTLDLKLSAWHCNVEKP

SEQ ID NO: 848711 - protein, 25 aa, Mycobacterium
QFQLDAFGEALLLFAAAARLDRLDK

SEQ ID NO: 848712 - protein, 21 aa, Mycobacterium
QFRAELKLPLILLGGITNRDT

SEQ ID NO: 848713 - protein, 21 aa, Mycobacterium
QFRFITRSPAQTRILDAALQL

SEQ ID NO: 848714 - protein, 18 aa, Mycobacterium
QFRVLVLGVPAPSGPIVD

SEQ ID NO: 848715 - protein, 18 aa, Mycobacterium
QFRYYIKDAPIISDAEFD

SEQ ID NO: 848716 - protein, 18 aa, Mycobacterium
QFRYYVRDAPIITDAEFD

SEQ ID NO: 848717 - protein, 18 aa, Mycobacterium
QFSLADWTRSLWPGAVTL

SEQ ID NO: 848718 - protein, 26 aa, Mycobacterium
QFTALAWSLMKLTTLHRTIKPELLDH

SEQ ID NO: 848719 - protein, 25 aa, Mycobacterium
QFTAMAWSLMKLTTLHRTIKPELLE

SEQ ID NO: 848720 - protein, 24 aa, Mycobacterium
QFTANPWLAGYMQQALGLLTTEPA

SEQ ID NO: 848721 - protein, 18 aa, Mycobacterium
QFTCPYHGWSYSMDGSLV

SEQ ID NO: 848722 - protein, 20 aa, Mycobacterium
QFTESLLDRMPAGGAVTNVS

SEQ ID NO: 848723 - protein, 20 aa, Mycobacterium
QFTGRPLFGPGTNGAPGTGQ

SEQ ID NO: 848724 - protein, 26 aa, Mycobacterium
QFVPTMFVRMLKLPEKVRRAYDVSTL

SEQ ID NO: 848725 - protein, 18 aa, Mycobacterium
QFVPTMFVRMLRMPEEAR

SEQ ID NO: 848726 - protein, 20 aa, Mycobacterium
QFVRECARVLRPSGLLLVST

SEQ ID NO: 848727 - protein, 19 aa, Mycobacterium
QFVSLALSNIFGQNAPAIA

SEQ ID NO: 848728 - protein, 31 aa, Mycobacterium
QFVTVALVVPLFDWYQHLLPDRLHQIGDILP

SEQ ID NO: 848729 - protein, 23 aa, Mycobacterium
QFVVKTLVGILDWGLDPQQAVSM

SEQ ID NO: 848730 - protein, 23 aa, Mycobacterium
QFVVKTVVGLLDWGLDPQQAVSM

SEQ ID NO: 848731 - protein, 17 aa, Mycobacterium
QFWGERLRHPTLAWLEP

SEQ ID NO: 848732 - protein, 20 aa, Mycobacterium
QFYAAMLAGLGLDAVNLPPQ

SEQ ID NO: 848733 - protein, 19 aa, Mycobacterium
QFYAAMLAGLGLDGADLPG

SEQ ID NO: 848734 - protein, 22 aa, Mycobacterium
QFYDLDYFALINDPVGAVDDIY

SEQ ID NO: 848735 - protein, 17 aa, Mycobacterium
QFYLHFCVHRLAIDSGE

SEQ ID NO: 848736 - protein, 18 aa, Mycobacterium
QGAFLAVINAWPDGSKPT

SEQ ID NO: 848737 - protein, 23 aa, Mycobacterium
QGAFLRQLGWHTLARGWDGRAMA

SEQ ID NO: 848738 - protein, 25 aa, Mycobacterium
QGAGGLGFAFPAALAAAIATGRRTF

SEQ ID NO: 848739 - protein, 19 aa, Mycobacterium
QGAGGMRFHDPRYLADLRA

SEQ ID NO: 848740 - protein, 24 aa, Mycobacterium
QGAGGMRFHDPRYLADLRDFCRRH

SEQ ID NO: 848741 - protein, 28 aa, Mycobacterium
QGAGILNFVFGEMWLRPGLGMKERRLIT

SEQ ID NO: 848742 - protein, 24 aa, Mycobacterium
QGAGILNFVFGEMWLRPNLGMKER

SEQ ID NO: 848743 - protein, 23 aa, Mycobacterium
QGAGPLGILATGLFAQAGAGRVI

SEQ ID NO: 848744 - protein, 20 aa, Mycobacterium
QGAGRLLAVRPGSVDVLADG

SEQ ID NO: 848745 - protein, 26 aa, Mycobacterium
QGAGTPLFCLPPGGGLSWIYRNLGAY

SEQ ID NO: 848746 - protein, 32 aa, Mycobacterium
QGAITSLQYVGLLRLWYSVKISRDPAGNPLTA

SEQ ID NO: 848747 - protein, 23 aa, Mycobacterium
QGALAALYRRSVTGTGQVVDVAL

SEQ ID NO: 848748 - protein, 23 aa, Mycobacterium
QGALAALYRRTVTGRGQVVDAAL

SEQ ID NO: 848749 - protein, 27 aa, Mycobacterium
QGALFDTPILVPPQAAMLGTGAIVKRP

SEQ ID NO: 848750 - protein, 18 aa, Mycobacterium
QGALVVLVARDDPLDTYL

SEQ ID NO: 848751 - protein, 18 aa, Mycobacterium
QGAPRGAPFRLRVVRRPT

SEQ ID NO: 848752 - protein, 23 aa, Mycobacterium
QGAQWPAGLRRAAVSSFGLSGTN

SEQ ID NO: 848753 - protein, 27 aa, Mycobacterium
QGASLHDALLALLPLVGVWRGEGEGRG

SEQ ID NO: 848754 - protein, 28 aa, Mycobacterium
QGATGLNWYLTDPTLQFSMAYYLQPDEL

SEQ ID NO: 848755 - protein, 21 aa, Mycobacterium
QGAVGGASGWLLGNGGAGGDG

SEQ ID NO: 848756 - protein, 20 aa, Mycobacterium
QGAVLKLMRAGDYRLTVTGW

SEQ ID NO: 848757 - protein, 27 aa, Mycobacterium
QGAVRLFCSFITSPYYDWPTQCELWFG

SEQ ID NO: 848758 - protein, 24 aa, Mycobacterium
QGCHLTWVMAIRPSGPAGRLGMLL

SEQ ID NO: 848759 - protein, 27 aa, Mycobacterium
QGCVHTRIPFVLWTAEGIAKFRAFVED

SEQ ID NO: 848760 - protein, 24 aa, Mycobacterium
QGDDRPVIFLCRSGNRSIGSAELA

SEQ ID NO: 848761 - protein, 29 aa, Mycobacterium
QGDFIKDFASPFTLLVIADLLGVPDEDRG

SEQ ID NO: 848762 - protein, 18 aa, Mycobacterium
QGDLFVRLCDVDRKGRSH

SEQ ID NO: 848763 - protein, 21 aa, Mycobacterium
QGDLGFFWVTAVTTDATIVVA

SEQ ID NO: 848764 - protein, 24 aa, Mycobacterium
QGDLTGPFAGVPFLIKDLGQDYKG

SEQ ID NO: 848765 - protein, 23 aa, Mycobacterium
QGDNWWLRARILSQIDGLGLSLG

SEQ ID NO: 848766 - protein, 19 aa, Mycobacterium
QGDPALTFMLIESGRVQVS

SEQ ID NO: 848767 - protein, 24 aa, Mycobacterium
QGDPGGPFAKLSRQLVEVADKNIE

SEQ ID NO: 848768 - protein, 33 aa, Mycobacterium
QGDPSLPVLTPQQRAWLKLVKPLVIAEGFALLS

SEQ ID NO: 848769 - protein, 24 aa, Mycobacterium
QGDSFRYHHLFGDVLRARLRASEP

SEQ ID NO: 848770 - protein, 24 aa, Mycobacterium
QGEASEMWAMEQQKLNSRGEEFKI

SEQ ID NO: 848771 - protein, 22 aa, Mycobacterium
QGEFRPDLAAGWLTEAFYSLVS

SEQ ID NO: 848772 - protein, 26 aa, Mycobacterium
QGEGFVSVELLFLPGTYATCPACQGA

SEQ ID NO: 848773 - protein, 30 aa, Mycobacterium
QGELAGAYLLVWTTTPWTLPSNLAVAVHPD

SEQ ID NO: 848774 - protein, 18 aa, Mycobacterium
QGELLRLVGRKPGISVRE

SEQ ID NO: 848775 - protein, 22 aa, Mycobacterium
QGELRVAIPVFVGIDYASRVGA

SEQ ID NO: 848776 - protein, 23 aa, Mycobacterium
QGEPVLIQLAMPGGALLYAQVWI

SEQ ID NO: 848777 - protein, 23 aa, Mycobacterium
QGEQFGMVFTKDGGRLFLHTVGS

SEQ ID NO: 848778 - protein, 29 aa, Mycobacterium
QGETASIFLPSVPNLLLLASEMEAQRNHV

SEQ ID NO: 848779 - protein, 20 aa, Mycobacterium
QGEVLAPFRDRYFGAISGVW

SEQ ID NO: 848780 - protein, 26 aa, Mycobacterium
QGEWTVPTRLALVRRMGSVDLDLTRA

SEQ ID NO: 848781 - protein, 21 aa, Mycobacterium
QGEYAGLLAIKAYHEARGDAD

SEQ ID NO: 848782 - protein, 21 aa, Mycobacterium
QGEYAGLLAIQAYHHARGDSG

SEQ ID NO: 848783 - protein, 21 aa, Mycobacterium
QGFDIAVFQFVKSAKWKVGEE

SEQ ID NO: 848784 - protein, 23 aa, Mycobacterium
QGFFDAFCYAPLSALLGGLGSGW

SEQ ID NO: 848785 - protein, 24 aa, Mycobacterium
QGFGVLTEIDMRFTLKAKLGEEIE

SEQ ID NO: 848786 - protein, 32 aa, Mycobacterium
QGFRPASLHQAYLALRAWGLPVSEHTTLVNDM

SEQ ID NO: 848787 - protein, 19 aa, Mycobacterium
QGFVKVFCRKSTGVVIGGV

SEQ ID NO: 848788 - protein, 17 aa, Mycobacterium
QGFVRRAGVRKSGAGRP

SEQ ID NO: 848789 - protein, 25 aa, Mycobacterium
QGFWARLGHSVAFFTGTAYGSTPTA

SEQ ID NO: 848790 - protein, 17 aa, Mycobacterium
QGGDYHDTGLAPDTGLA

SEQ ID NO: 848791 - protein, 17 aa, Mycobacterium
QGGFLDFDAAIATPDQM

SEQ ID NO: 848792 - protein, 21 aa, Mycobacterium
QGGFSEWPALLTFAEPGEQGG

SEQ ID NO: 848793 - protein, 21 aa, Mycobacterium
QGGIALKPLIARALRMGDEVH

SEQ ID NO: 848794 - protein, 23 aa, Mycobacterium
QGGNATLFGYGGHGGAGGSSLNL

SEQ ID NO: 848795 - protein, 20 aa, Mycobacterium
QGGPPYGFLVAALNRYRRLD

SEQ ID NO: 848796 - protein, 22 aa, Mycobacterium
QGGSIYPAMQNFYLAARAQGLG

SEQ ID NO: 848797 - protein, 17 aa, Mycobacterium
QGGWLEFDAAIATPDQM

SEQ ID NO: 848798 - protein, 21 aa, Mycobacterium
QGGWPMTCFLTPDGRPFYCGT

SEQ ID NO: 848799 - protein, 22 aa, Mycobacterium
QGIAQLFDVPPLPYEEVKIATA

SEQ ID NO: 848800 - protein, 35 aa, Mycobacterium
QGIELHFFDYQFGHGLPVITVPWSALTDVLAPDMV

SEQ ID NO: 848801 - protein, 20 aa, Mycobacterium
QGIEVARRLLPDVPQVAVFD

SEQ ID NO: 848802 - protein, 20 aa, Mycobacterium
QGIFGVELFIKGDQVYFSEV

SEQ ID NO: 848803 - protein, 25 aa, Mycobacterium
QGIGRRLLDELLTFADGGVVYLEVR

SEQ ID NO: 848804 - protein, 26 aa, Mycobacterium
QGIMDWHFDFLKYPELAGKWQEHART

SEQ ID NO: 848805 - protein, 20 aa, Mycobacterium
QGIPAQFLVDILSDLRTDRL

SEQ ID NO: 848806 - protein, 20 aa, Mycobacterium
QGISAELIAARWGFSRAQLD

SEQ ID NO: 848807 - protein, 20 aa, Mycobacterium
QGISAELIAARWGFSRTQLD

SEQ ID NO: 848808 - protein, 20 aa, Mycobacterium
QGISAELIAARWGLSRTQLD

SEQ ID NO: 848809 - protein, 29 aa, Mycobacterium
QGIVLLQNRGLLPLTLGSGVRIAVIGGYA

SEQ ID NO: 848810 - protein, 22 aa, Mycobacterium
QGIVPHLLVMTATPIPRTVALT

SEQ ID NO: 848811 - protein, 22 aa, Mycobacterium
QGKFLLNVPLFQRESVHPDIDR

SEQ ID NO: 848812 - protein, 18 aa, Mycobacterium
QGKFLSLLAGAIGARRIL

SEQ ID NO: 848813 - protein, 17 aa, Mycobacterium
QGKGLWAQLSAKGLGIL

SEQ ID NO: 848814 - protein, 22 aa, Mycobacterium
QGKILYVGISNAPAWQVSRMQA

SEQ ID NO: 848815 - protein, 24 aa, Mycobacterium
QGKKILRLAFHFLDAQSIEQCVLG

SEQ ID NO: 848816 - protein, 24 aa, Mycobacterium
QGKTPVVYVVGRKALNYYSFRNRK

SEQ ID NO: 848817 - protein, 17 aa, Mycobacterium
QGLAARAAEAVALLALI

SEQ ID NO: 848818 - protein, 19 aa, Mycobacterium
QGLARVDFFLAEDGPLINE

SEQ ID NO: 848819 - protein, 23 aa, Mycobacterium
QGLDGMSRISGWLTPEARAGLEA

SEQ ID NO: 848820 - protein, 25 aa, Mycobacterium
QGLDGMSRLTGWLTPEARAGLDAVL

SEQ ID NO: 848821 - protein, 21 aa, Mycobacterium
QGLDVRIFRPSLISPTAAGFG

SEQ ID NO: 848822 - protein, 22 aa, Mycobacterium
QGLDYITAFLGALQAGVIAIPL

SEQ ID NO: 848823 - protein, 24 aa, Mycobacterium
QGLEMWLADFPQPRPPRDTWDANP

SEQ ID NO: 848824 - protein, 23 aa, Mycobacterium
QGLEMWLAEFPQPRPPRETWPDN

SEQ ID NO: 848825 - protein, 27 aa, Mycobacterium
QGLEYIIAFLGVLEAGLIAVPLPVPQF

SEQ ID NO: 848826 - protein, 21 aa, Mycobacterium
QGLGFAIAQRFIAEGARVVLG

SEQ ID NO: 848827 - protein, 18 aa, Mycobacterium
QGLGSWPIAAGRGGKWST

SEQ ID NO: 848828 - protein, 17 aa, Mycobacterium
QGLHRQRIVVVLAVGER

SEQ ID NO: 848829 - protein, 20 aa, Mycobacterium
QGLLVDFVRERGLNAIVKGL

SEQ ID NO: 848830 - protein, 17 aa, Mycobacterium
QGLLVPPHPITATVPLE

SEQ ID NO: 848831 - protein, 17 aa, Mycobacterium
QGLNLGVQDAFNLGWKL

SEQ ID NO: 848832 - protein, 24 aa, Mycobacterium
QGLPISIDIIRFVKFIVTEIFPGG

SEQ ID NO: 848833 - protein, 31 aa, Mycobacterium
QGLQAFNLGLWKTLARPQLSIPRGAYVTVGF

SEQ ID NO: 848834 - protein, 23 aa, Mycobacterium
QGLQGLIPGLTPPAPAAPAAPAT

SEQ ID NO: 848835 - protein, 26 aa, Mycobacterium
QGLTLATKLTRWPAVDGRRLAAVSAF

SEQ ID NO: 848836 - protein, 26 aa, Mycobacterium
QGLVGFSYGFTIPALPAQLEAQIPVN

SEQ ID NO: 848837 - protein, 26 aa, Mycobacterium
QGLVQLSYKVTIPEFPYHGDVHGLVE

SEQ ID NO: 848838 - protein, 21 aa, Mycobacterium
QGLVRVLAYEHPELRATLVDL

SEQ ID NO: 848839 - protein, 17 aa, Mycobacterium
QGLYHHVAGTKPTVAMI

SEQ ID NO: 848840 - protein, 23 aa, Mycobacterium
QGLYTPEQYWPLTGLTSLTVGQS

SEQ ID NO: 848841 - protein, 24 aa, Mycobacterium
QGMDPSQMLSGMTGALTGALSSIG

SEQ ID NO: 848842 - protein, 17 aa, Mycobacterium
QGMFLTTHYFGTKIMRY

SEQ ID NO: 848843 - protein, 31 aa, Mycobacterium
QGMLMEAYNMAVAWNLPVVFVCKDNKWGITT

SEQ ID NO: 848844 - protein, 20 aa, Mycobacterium
QGMQGVFIQAVYYPGENQIQ

SEQ ID NO: 848845 - protein, 22 aa, Mycobacterium
QGNILSHEGAALGGSTTAGGAG

SEQ ID NO: 848846 - protein, 20 aa, Mycobacterium
QGNSLGMPWVLDAVQDFGID

SEQ ID NO: 848847 - protein, 17 aa, Mycobacterium
QGNYIFPEGFDPETNEW

SEQ ID NO: 848848 - protein, 27 aa, Mycobacterium
QGPGIDLRPFWTLGVAALMRDLAADEV

SEQ ID NO: 848849 - protein, 17 aa, Mycobacterium
QGPLVGPAQWSGEIWRS

SEQ ID NO: 848850 - protein, 27 aa, Mycobacterium
QGPSAVFNIPWVLQLRGILHTEALRQA

SEQ ID NO: 848851 - protein, 29 aa, Mycobacterium
QGPSGRWYADAHLPYLAWLVETSVDGARL

SEQ ID NO: 848852 - protein, 35 aa, Mycobacterium
QGPTTTTYYMIPTQNLPLLEPLRALPLGNTVADLI

SEQ ID NO: 848853 - protein, 21 aa, Mycobacterium
QGQPIDLLFSRARRIQDELGV

SEQ ID NO: 848854 - protein, 30 aa, Mycobacterium
QGQRIDPVLARSWLLVNGAHYERFQAAAHS

SEQ ID NO: 848855 - protein, 28 aa, Mycobacterium
QGRASWYRNRWVRSLPVCAALGEPAPNR

SEQ ID NO: 848856 - protein, 24 aa, Mycobacterium
QGRAWYRHGSALTPAPKLGQLTDE

SEQ ID NO: 848857 - protein, 26 aa, Mycobacterium
QGRDLSLVYDIPLGLSLTAALKRTVI

SEQ ID NO: 848858 - protein, 17 aa, Mycobacterium
QGRFPYRNDGALGWAGT

SEQ ID NO: 848859 - protein, 19 aa, Mycobacterium
QGRGLVRLARRVWPDGPWD

SEQ ID NO: 848860 - protein, 20 aa, Mycobacterium
QGRGLVRLARRVWPDHDWDA

SEQ ID NO: 848861 - protein, 22 aa, Mycobacterium
QGRILLIKRRDNTLWALPGGGH

SEQ ID NO: 848862 - protein, 22 aa, Mycobacterium
QGRIRRTMPLAGFAARAAGGRM

SEQ ID NO: 848863 - protein, 17 aa, Mycobacterium
QGRKWFQLYMWRDRDRS

SEQ ID NO: 848864 - protein, 19 aa, Mycobacterium
QGRLAGKVALITGGARGQG

SEQ ID NO: 848865 - protein, 18 aa, Mycobacterium
QGRLRLGPGWVSHLLQDL

SEQ ID NO: 848866 - protein, 26 aa, Mycobacterium
QGRMYRRPFIILGQQYLADPSRSAGN

SEQ ID NO: 848867 - protein, 28 aa, Mycobacterium
QGRPDHFYHPFGLLPSPQHIPLSHFWAR

SEQ ID NO: 848868 - protein, 24 aa, Mycobacterium
QGRPELRRALAEYLARARGVRARP

SEQ ID NO: 848869 - protein, 23 aa, Mycobacterium
QGRQLKNLVPITTFLRRSPHLSA

SEQ ID NO: 848870 - protein, 30 aa, Mycobacterium
QGRQLKNLVPITTFLRRSPYLAAVRTAIAE

SEQ ID NO: 848871 - protein, 27 aa, Mycobacterium
QGRQLKSLVPITKFLRRSPYLSAVRTA

SEQ ID NO: 848872 - protein, 23 aa, Mycobacterium
QGRSSVRTWLYRIATNTCLTSLE

SEQ ID NO: 848873 - protein, 23 aa, Mycobacterium
QGRTAFFTAPYLADGPGGEKNWS

SEQ ID NO: 848874 - protein, 33 aa, Mycobacterium
QGRTQPLFTGTITVKYLRGTPLGPLRCEAWVDR

SEQ ID NO: 848875 - protein, 23 aa, Mycobacterium
QGRTRLMKFYQCIQNVVIPTQPG

SEQ ID NO: 848876 - protein, 22 aa, Mycobacterium
QGRVNPYFRQLYSETAQALVGL

SEQ ID NO: 848877 - protein, 21 aa, Mycobacterium
QGRWASLRWFERRIIDTEAAP

SEQ ID NO: 848878 - protein, 18 aa, Mycobacterium
QGSAAFFDWMNSGKLAYA

SEQ ID NO: 848879 - protein, 25 aa, Mycobacterium
QGSAQPPWDFPPPSLDLDDYDFPRA

SEQ ID NO: 848880 - protein, 18 aa, Mycobacterium
QGSFFFGAPTEYADMLGA

SEQ ID NO: 848881 - protein, 17 aa, Mycobacterium
QGSFLGYRVTVCDARAV

SEQ ID NO: 848882 - protein, 24 aa, Mycobacterium
QGSGWAWLGYDTLGKKLLTFQMYD

SEQ ID NO: 848883 - protein, 24 aa, Mycobacterium
QGSKDIFLNILTTNGLCVKFLHDW

SEQ ID NO: 848884 - protein, 23 aa, Mycobacterium
QGSLARLSAVWGGTASDAYVAVQ

SEQ ID NO: 848885 - protein, 20 aa, Mycobacterium
QGSLSMFSIHRYGSEEQKNE

SEQ ID NO: 848886 - protein, 22 aa, Mycobacterium
QGSMFIATMELWIAARTDAELS

SEQ ID NO: 848887 - protein, 25 aa, Mycobacterium
QGSPNLFMNILTTNGLCVRFLTDWA

SEQ ID NO: 848888 - protein, 22 aa, Mycobacterium
QGSQLFDYWRDPDGFMVEHFTD

SEQ ID NO: 848889 - protein, 29 aa, Mycobacterium
QGSQTQGMLSPWLELPGAADQIASWSQAS

SEQ ID NO: 848890 - protein, 25 aa, Mycobacterium
QGSTAARLFYAYADTLLALGRNDEA

SEQ ID NO: 848891 - protein, 23 aa, Mycobacterium
QGSVRFRHPLIRAAVYHSSSAAE

SEQ ID NO: 848892 - protein, 25 aa, Mycobacterium
QGSVTREIWLVRVRAALARARRDEA

SEQ ID NO: 848893 - protein, 29 aa, Mycobacterium
QGSYRPIELWRSQRWLCPYGGAAVAGAEL

SEQ ID NO: 848894 - protein, 18 aa, Mycobacterium
QGTAMQHLKLHGSLYMMA

SEQ ID NO: 848895 - protein, 25 aa, Mycobacterium
QGTEPDAVLLDQAFTAAVLKVHDNV

SEQ ID NO: 848896 - protein, 26 aa, Mycobacterium
QGTGERRWLDAATRLLNLALDHFADP

SEQ ID NO: 848897 - protein, 25 aa, Mycobacterium
QGTGPWGAFDLTLGKAMYAGFTLGG

SEQ ID NO: 848898 - protein, 20 aa, Mycobacterium
QGTLDHDWALAARAALERDQ

SEQ ID NO: 848899 - protein, 24 aa, Mycobacterium
QGTNLHHALALAGRHLRKHPNAQP

SEQ ID NO: 848900 - protein, 27 aa, Mycobacterium
QGTPARWAALGIAGWALHVVDPVDADG

SEQ ID NO: 848901 - protein, 18 aa, Mycobacterium
QGTPLRTPYAAAKAALET

SEQ ID NO: 848902 - protein, 18 aa, Mycobacterium
QGTQVGLLGVSPLSNHPL

SEQ ID NO: 848903 - protein, 25 aa, Mycobacterium
QGTVLQWITTFGNPLTWDDLEWLRS

SEQ ID NO: 848904 - protein, 34 aa, Mycobacterium
QGVAWAATTLGIPSTVFMPVGAALPKIVATRAYG

SEQ ID NO: 848905 - protein, 26 aa, Mycobacterium
QGVDPDRLTWIMPRDSWLLDRETMQP

SEQ ID NO: 848906 - protein, 37 aa, Mycobacterium
QGVEEHLLGVLNSPTQALLGRPLIGDGAAGAPGQDGG

SEQ ID NO: 848907 - protein, 30 aa, Mycobacterium
QGVEKDLLVPPYTLGAWLGDGTSAAAQITT

SEQ ID NO: 848908 - protein, 24 aa, Mycobacterium
QGVGFRPFVHRLATELGLSGFVGN

SEQ ID NO: 848909 - protein, 17 aa, Mycobacterium
QGVGMYAALKRAADTTF

SEQ ID NO: 848910 - protein, 31 aa, Mycobacterium
QGVGRPIRRIPLSPAMFHAIGWVSDLLGNVL

SEQ ID NO: 848911 - protein, 21 aa, Mycobacterium
QGVILTELHLGGGQAGPHVGG

SEQ ID NO: 848912 - protein, 26 aa, Mycobacterium
QGVNDLFLPLRYGQVALREKMPRRFY

SEQ ID NO: 848913 - protein, 31 aa, Mycobacterium
QGVPIPYVVILRREWDFLFNHLRSTTAVVDY

SEQ ID NO: 848914 - protein, 22 aa, Mycobacterium
QGVRIFDHRGLYSTLTGTDEPP

SEQ ID NO: 848915 - protein, 25 aa, Mycobacterium
QGVRPRVWFGERWITSIFDLFEENV

SEQ ID NO: 848916 - protein, 34 aa, Mycobacterium
QGVRRSVLAGVPWPHGWNRAYFTPVTVLDGRACV

SEQ ID NO: 848917 - protein, 31 aa, Mycobacterium
QGVSIPDYPNFFLVLGPYGYVFGPYHMLIES

SEQ ID NO: 848918 - protein, 29 aa, Mycobacterium
QGVVARIDWARFLPLYQQAGRRAFLAELE

SEQ ID NO: 848919 - protein, 17 aa, Mycobacterium
QGVWVHPEWRGLGLGTA

SEQ ID NO: 848920 - protein, 22 aa, Mycobacterium
QGWAPIVRWAVAPKVRGGMQMV

SEQ ID NO: 848921 - protein, 23 aa, Mycobacterium
QGWLADHAVGGVVIFPGAGFVEL

SEQ ID NO: 848922 - protein, 23 aa, Mycobacterium
QGWQLAMALLPYERSTCFWQRIA

SEQ ID NO: 848923 - protein, 21 aa, Mycobacterium
QGWQLITTQLNFERAALGNLG

SEQ ID NO: 848924 - protein, 17 aa, Mycobacterium
QGWRLDLVDIPTDRHWS

SEQ ID NO: 848925 - protein, 17 aa, Mycobacterium
QGWSLVVLDINLDLSTA

SEQ ID NO: 848926 - protein, 23 aa, Mycobacterium
QGWVPVIGPFFNRGLMLLDFQEH

SEQ ID NO: 848927 - protein, 22 aa, Mycobacterium
QGYAQIIGIWLGEKTTAAGQQY

SEQ ID NO: 848928 - protein, 20 aa, Mycobacterium
QGYHMATFGFILGEVVRRTT

SEQ ID NO: 848929 - protein, 26 aa, Mycobacterium
QGYHMTTFGFILGEVFRRITGRTIGH

SEQ ID NO: 848930 - protein, 26 aa, Mycobacterium
QGYHMTTFGFILGEVFRRITGRTVGQ

SEQ ID NO: 848931 - protein, 26 aa, Mycobacterium
QGYHMTTFGFILGEVFRRVTGRTIGQ

SEQ ID NO: 848932 - protein, 19 aa, Mycobacterium
QGYPGVLFVAAGTEAEFAA

SEQ ID NO: 848933 - protein, 17 aa, Mycobacterium
QGYRLIFENDLVGVPQV

SEQ ID NO: 848934 - protein, 26 aa, Mycobacterium
QGYRQLRGFAQRWSDPGWAIEGAAGL

SEQ ID NO: 848935 - protein, 18 aa, Mycobacterium
QGYWVVELAAGSRAPKVL

SEQ ID NO: 848936 - protein, 22 aa, Mycobacterium
QHAKAFLETLDGRPVSARVDAA

SEQ ID NO: 848937 - protein, 24 aa, Mycobacterium
QHAKLLSLLVRMSRARRVLEIGTL

SEQ ID NO: 848938 - protein, 24 aa, Mycobacterium
QHAKLWYQVVLGFLNLHVLGQDAD

SEQ ID NO: 848939 - protein, 17 aa, Mycobacterium
QHALVTQRFLDAGLVVF

SEQ ID NO: 848940 - protein, 23 aa, Mycobacterium
QHAQLAMYQLAVAEGMVPAGDEP

SEQ ID NO: 848941 - protein, 23 aa, Mycobacterium
QHAQLGYLLARTNPDVPKHAGIT

SEQ ID NO: 848942 - protein, 18 aa, Mycobacterium
QHAWSLPQLTMREKSFVF

SEQ ID NO: 848943 - protein, 19 aa, Mycobacterium
QHCVAVLFAAMFEDTALRA

SEQ ID NO: 848944 - protein, 25 aa, Mycobacterium
QHDIDTVWFGAAAPLALLAPRARQA

SEQ ID NO: 848945 - protein, 28 aa, Mycobacterium
QHEAIEEQFFWPAVRKALGDGLVDKAVE

SEQ ID NO: 848946 - protein, 25 aa, Mycobacterium
QHEAMYLGDGMMLEAPYTGSVVKIS

SEQ ID NO: 848947 - protein, 25 aa, Mycobacterium
QHEAYAALKAWGLPVAEQTARVRGL

SEQ ID NO: 848948 - protein, 18 aa, Mycobacterium
QHEDPNAPGLHQSRHDTP

SEQ ID NO: 848949 - protein, 26 aa, Mycobacterium
QHEKSAILYLARHLPAPGRDGVGAAT

SEQ ID NO: 848950 - protein, 22 aa, Mycobacterium
QHELLDGVRWLREQADVSRPDW

SEQ ID NO: 848951 - protein, 25 aa, Mycobacterium
QHESMYLGDGMMLEAPYTGSVVKIS

SEQ ID NO: 848952 - protein, 28 aa, Mycobacterium
QHETGHLDGFLYIDKLIGRNARAAKRAV

SEQ ID NO: 848953 - protein, 30 aa, Mycobacterium
QHETGHLDGFLYLDCLIGRYARSAKRAVKS

SEQ ID NO: 848954 - protein, 28 aa, Mycobacterium
QHETGHLDGFLYLDSLIGRNARAAKRAV

SEQ ID NO: 848955 - protein, 30 aa, Mycobacterium
QHETGHLDGYLYLDCLIGRHARSAKRAVKS

SEQ ID NO: 848956 - protein, 20 aa, Mycobacterium
QHFGSKDELLLALFDRTMAQ

SEQ ID NO: 848957 - protein, 27 aa, Mycobacterium
QHFSDAALVLGFERRSWRTNSGPHGVQ

SEQ ID NO: 848958 - protein, 21 aa, Mycobacterium
QHFSSKDELLLALFDRTMSQT

SEQ ID NO: 848959 - protein, 26 aa, Mycobacterium
QHGGTGRLLVVFQPHLYSRTKAFAAE

SEQ ID NO: 848960 - protein, 26 aa, Mycobacterium
QHGKTFFLATRLLTPAQRPAVHALYG

SEQ ID NO: 848961 - protein, 33 aa, Mycobacterium
QHGPLPAEMPAAALWWRLAGTLAPPSLEGTDTK

SEQ ID NO: 848962 - protein, 26 aa, Mycobacterium
QHGRRDGDILFLQGLMFVVGSTDEEA

SEQ ID NO: 848963 - protein, 23 aa, Mycobacterium
QHGSPPLALLTKAIEELMAGSGL

SEQ ID NO: 848964 - protein, 24 aa, Mycobacterium
QHGSPPLALLTKAIEELMAGSGLR

SEQ ID NO: 848965 - protein, 23 aa, Mycobacterium
QHGVPVNALVRAYRLGQRRMNEL

SEQ ID NO: 848966 - protein, 27 aa, Mycobacterium
QHHDMGLISAYLFIPLIGGTTHAMSPL

SEQ ID NO: 848967 - protein, 20 aa, Mycobacterium
QHHNGQPVALLAPGTSFARW

SEQ ID NO: 848968 - protein, 18 aa, Mycobacterium
QHHRLKTFGGWRDKQLAD

SEQ ID NO: 848969 - protein, 18 aa, Mycobacterium
QHHSWPDMLDEMRATAGW

SEQ ID NO: 848970 - protein, 17 aa, Mycobacterium
QHILARWSRGPEPPAER

SEQ ID NO: 848971 - protein, 19 aa, Mycobacterium
QHILLTRTPAITGRYEFLT

SEQ ID NO: 848972 - protein, 25 aa, Mycobacterium
QHIPSANLLAWYERSRRDLPWRRPD

SEQ ID NO: 848973 - protein, 22 aa, Mycobacterium
QHKLPIVFVVLRNGEYAILKSF

SEQ ID NO: 848974 - protein, 25 aa, Mycobacterium
QHLAHRVLGHRLILGFEASSAKITP

SEQ ID NO: 848975 - protein, 18 aa, Mycobacterium
QHLATQLSALFRTRRFRV

SEQ ID NO: 848976 - protein, 18 aa, Mycobacterium
QHLELARDIAQRFNGRFP

SEQ ID NO: 848977 - protein, 19 aa, Mycobacterium
QHLELARDLAQRFNARFPD

SEQ ID NO: 848978 - protein, 22 aa, Mycobacterium
QHLFGTAIHNDGVMATIGVSPF

SEQ ID NO: 848979 - protein, 18 aa, Mycobacterium
QHLHSWMAPLMGGFFGYT

SEQ ID NO: 848980 - protein, 18 aa, Mycobacterium
QHLIDWKGNDWTPESGEK

SEQ ID NO: 848981 - protein, 17 aa, Mycobacterium
QHLIDWKGRDWTPDSDE

SEQ ID NO: 848982 - protein, 27 aa, Mycobacterium
QHLKTMKGQWAPFQSLLDLADDEQAIA

SEQ ID NO: 848983 - protein, 20 aa, Mycobacterium
QHLLAPGLYIVHGDAAAGGG

SEQ ID NO: 848984 - protein, 23 aa, Mycobacterium
QHLLSLGHRRIAYVGGPVTAACN

SEQ ID NO: 848985 - protein, 22 aa, Mycobacterium
QHLRFRRAIQAIGGLASLDQSG

SEQ ID NO: 848986 - protein, 24 aa, Mycobacterium
QHLRLPLREVVWGGDAALLDTTEF

SEQ ID NO: 848987 - protein, 21 aa, Mycobacterium
QHLTAIPRDDLPMAPAAAVTI

SEQ ID NO: 848988 - protein, 23 aa, Mycobacterium
QHLTVYQRTPIWVVPKADAKVPG

SEQ ID NO: 848989 - protein, 24 aa, Mycobacterium
QHLVPNTGLRRILSRELEFTNLED

SEQ ID NO: 848990 - protein, 20 aa, Mycobacterium
QHMSPPLPMIGAGELISAAG

SEQ ID NO: 848991 - protein, 17 aa, Mycobacterium
QHNAEVLGALGLSAQEI

SEQ ID NO: 848992 - protein, 21 aa, Mycobacterium
QHNAPQWDILPIQFADYAVWQ

SEQ ID NO: 848993 - protein, 18 aa, Mycobacterium
QHNPIYATPYILADIEPL

SEQ ID NO: 848994 - protein, 24 aa, Mycobacterium
QHNWTLLHALPELVATGIPVLVGA

SEQ ID NO: 848995 - protein, 24 aa, Mycobacterium
QHNYLGAEHLLLGLVGEGTGLGAR

SEQ ID NO: 848996 - protein, 20 aa, Mycobacterium
QHPCLVPAPLNTQVLAGYAR

SEQ ID NO: 848997 - protein, 26 aa, Mycobacterium
QHPDGVLVVWIDLADRRPFTLEDQTL

SEQ ID NO: 848998 - protein, 25 aa, Mycobacterium
QHPEGVLVVWIDLAEQRPFTLEDQT

SEQ ID NO: 848999 - protein, 18 aa, Mycobacterium
QHPLARRVDDVLTAGLVK

SEQ ID NO: 849000 - protein, 22 aa, Mycobacterium
QHPLLTVIANHSVALLNVIRAI

SEQ ID NO: 849001 - protein, 21 aa, Mycobacterium
QHPLPESLVGDAARFLLEGMP

SEQ ID NO: 849002 - protein, 27 aa, Mycobacterium
QHPRLVCNPRWTLGQIIAEPALIRGDR

SEQ ID NO: 849003 - protein, 24 aa, Mycobacterium
QHQAARLGELFRTSRFRVYSTNDV

SEQ ID NO: 849004 - protein, 26 aa, Mycobacterium
QHQDERNFYALDRLWRDCPIVPVDLD

SEQ ID NO: 849005 - protein, 24 aa, Mycobacterium
QHQMWAAQFIKYENPRTWLNSGGL

SEQ ID NO: 849006 - protein, 25 aa, Mycobacterium
QHQMWAAQFISYEKPKTWLNSGGLG

SEQ ID NO: 849007 - protein, 20 aa, Mycobacterium
QHQMWAAQFVSYEKPRTWIN

SEQ ID NO: 849008 - protein, 24 aa, Mycobacterium
QHQPPAQLPWRPPAGRVRSGVLRC

SEQ ID NO: 849009 - protein, 25 aa, Mycobacterium
QHQRRPLPIAELPRGNHRQGDHRGG

SEQ ID NO: 849010 - protein, 30 aa, Mycobacterium
QHQVADILPLTPLQQGLLFHASFAQDPGDD

SEQ ID NO: 849011 - protein, 23 aa, Mycobacterium
QHRALRSQIPDVYKGFAALSGAA

SEQ ID NO: 849012 - protein, 26 aa, Mycobacterium
QHRGTPVLVRPFRGADLAVAADITAR

SEQ ID NO: 849013 - protein, 17 aa, Mycobacterium
QHRIAEAGLPISVDPIP

SEQ ID NO: 849014 - protein, 17 aa, Mycobacterium
QHRIWFAHGVTPVLMNL

SEQ ID NO: 849015 - protein, 23 aa, Mycobacterium
QHRKVLVQPAFTEAPYPPQALRE

SEQ ID NO: 849016 - protein, 22 aa, Mycobacterium
QHRLDALVRIEGFRSWTELDAD

SEQ ID NO: 849017 - protein, 17 aa, Mycobacterium
QHRLGGSGGLAGHPIGN

SEQ ID NO: 849018 - protein, 26 aa, Mycobacterium
QHRLHVNRWFYDCPPDFHRKLGDMYV

SEQ ID NO: 849019 - protein, 19 aa, Mycobacterium
QHRLRELGILTDRDRIARD

SEQ ID NO: 849020 - protein, 22 aa, Mycobacterium
QHRLWGRYFVAPNGVADLGEPS

SEQ ID NO: 849021 - protein, 20 aa, Mycobacterium
QHRMWFVQAVDPGSALLNVC

SEQ ID NO: 849022 - protein, 24 aa, Mycobacterium
QHRSGALWILNSAALNRIGLAGHV

SEQ ID NO: 849023 - protein, 21 aa, Mycobacterium
QHRSRLYELLRYADYTQFDSD

SEQ ID NO: 849024 - protein, 25 aa, Mycobacterium
QHRTVRYNYWLEPEAKQQLLVAAHQ

SEQ ID NO: 849025 - protein, 24 aa, Mycobacterium
QHSLWPAFADVPAGWRVVHGEADR

SEQ ID NO: 849026 - protein, 24 aa, Mycobacterium
QHSLWPAFADVPAGWRVVYGESDR

SEQ ID NO: 849027 - protein, 25 aa, Mycobacterium
QHSLWPAFVDVPAGWRVVFGAADRA

SEQ ID NO: 849028 - protein, 20 aa, Mycobacterium
QHSLWPTFADVPAGWRVAFG

SEQ ID NO: 849029 - protein, 25 aa, Mycobacterium
QHSLWPTFADVPAGWRVVFGEASRA

SEQ ID NO: 849030 - protein, 24 aa, Mycobacterium
QHSLWPTFADVPAGWRVVHGEGTR

SEQ ID NO: 849031 - protein, 24 aa, Mycobacterium
QHSLWPVFADIPAGWRVVYGEATR

SEQ ID NO: 849032 - protein, 23 aa, Mycobacterium
QHSLWPVFAGVPAGWTVAFGGAG

SEQ ID NO: 849033 - protein, 20 aa, Mycobacterium
QHTFLWQHTAAMVPGFTGAT

SEQ ID NO: 849034 - protein, 19 aa, Mycobacterium
QHTWFGLSALAERVGTTVR

SEQ ID NO: 849035 - protein, 30 aa, Mycobacterium
QHVALQLPHRPLAGDLFQLGFPCGISAFGV

SEQ ID NO: 849036 - protein, 23 aa, Mycobacterium
QHVDWIGDLLDYMAAHGYSTVEA

SEQ ID NO: 849037 - protein, 23 aa, Mycobacterium
QHVLGPLAMLEIAGLAISEAGTW

SEQ ID NO: 849038 - protein, 19 aa, Mycobacterium
QHVPAVTYLLAVRDADGAV

SEQ ID NO: 849039 - protein, 20 aa, Mycobacterium
QHVRGTFGIGLVDWVMRTEA

SEQ ID NO: 849040 - protein, 24 aa, Mycobacterium
QHVRPKFRWIELPERIEAALVRMA

SEQ ID NO: 849041 - protein, 18 aa, Mycobacterium
QHVRPMELLGLTATPERG

SEQ ID NO: 849042 - protein, 25 aa, Mycobacterium
QHVTVYVRPAAWGVWTFYQLSDEER

SEQ ID NO: 849043 - protein, 17 aa, Mycobacterium
QHYAFLVSEDDFDAIYG

SEQ ID NO: 849044 - protein, 18 aa, Mycobacterium
QHYESMLGRLILPDLGAA

SEQ ID NO: 849045 - protein, 18 aa, Mycobacterium
QIAADALGLPLQRVRFSL

SEQ ID NO: 849046 - protein, 17 aa, Mycobacterium
QIAALRWVRDNIAAFGG

SEQ ID NO: 849047 - protein, 25 aa, Mycobacterium
QIAAMALWFLNFSTWDGAAGIYLED

SEQ ID NO: 849048 - protein, 31 aa, Mycobacterium
QIAASGLLGAGLRPWRLAKVLPATALTLAQT

SEQ ID NO: 849049 - protein, 19 aa, Mycobacterium
QIADALMRKLDPRGAIVVI

SEQ ID NO: 849050 - protein, 26 aa, Mycobacterium
QIAGGQFLQVFRRRGWINCGQAGPLG

SEQ ID NO: 849051 - protein, 24 aa, Mycobacterium
QIAGPLTELLLRVPRDAKYHNVRR

SEQ ID NO: 849052 - protein, 19 aa, Mycobacterium
QIAISAWGLLSPEGRCATF

SEQ ID NO: 849053 - protein, 20 aa, Mycobacterium
QIAISAWGLLSPQGRCATFD

SEQ ID NO: 849054 - protein, 17 aa, Mycobacterium
QIALMAPGPEVAALRTL

SEQ ID NO: 849055 - protein, 27 aa, Mycobacterium
QIANFFNAIPTALLSFTTIVTGPNPIS

SEQ ID NO: 849056 - protein, 17 aa, Mycobacterium
QIAPLQATWTREAAEAY

SEQ ID NO: 849057 - protein, 17 aa, Mycobacterium
QIAPLQQLWTREAAAAY

SEQ ID NO: 849058 - protein, 22 aa, Mycobacterium
QIAQAFVSERIALAAQAYSSAQ

SEQ ID NO: 849059 - protein, 22 aa, Mycobacterium
QIAQTVIAYEPVWAIGTGRVAS

SEQ ID NO: 849060 - protein, 17 aa, Mycobacterium
QIARERLQLTRLASDWR

SEQ ID NO: 849061 - protein, 25 aa, Mycobacterium
QIARLWNTTWDLKSGLKPDEISKHF

SEQ ID NO: 849062 - protein, 29 aa, Mycobacterium
QIATSGLMGFALRPLRLATVVPATIRTLA

SEQ ID NO: 849063 - protein, 17 aa, Mycobacterium
QIAYYKDRAREDPRRVM

SEQ ID NO: 849064 - protein, 18 aa, Mycobacterium
QIAYYKDRAREDPRRVMA

SEQ ID NO: 849065 - protein, 23 aa, Mycobacterium
QICPSCSDLYARDTWQLVHAGTA

SEQ ID NO: 849066 - protein, 24 aa, Mycobacterium
QICPSCSDLYARDTWQLVHAGTAG

SEQ ID NO: 849067 - protein, 19 aa, Mycobacterium
QIDALVRVAAVLNLTPESF

SEQ ID NO: 849068 - protein, 29 aa, Mycobacterium
QIDAPIALEFLLQMLVPLDVATRGFLDGT

SEQ ID NO: 849069 - protein, 25 aa, Mycobacterium
QIDEEGKLVLAQRVRTATKAIGAMV

SEQ ID NO: 849070 - protein, 25 aa, Mycobacterium
QIDEFAMPVAPWMFGAAGREHMKQY

SEQ ID NO: 849071 - protein, 17 aa, Mycobacterium
QIDEYLEFYHGPGVQHL

SEQ ID NO: 849072 - protein, 24 aa, Mycobacterium
QIDGEWVDWFPPTHPDRPDAPNMD

SEQ ID NO: 849073 - protein, 19 aa, Mycobacterium
QIDGQLWQIVEFQHVKPGK

SEQ ID NO: 849074 - protein, 18 aa, Mycobacterium
QIDHLLSTQGKRFELVDG

SEQ ID NO: 849075 - protein, 31 aa, Mycobacterium
QIDLTVVNPLVDATWRFMTLDTDGKIRMDCS

SEQ ID NO: 849076 - protein, 30 aa, Mycobacterium
QIDPDLRTPSLWPKLAKVLVAETPVRGAMG

SEQ ID NO: 849077 - protein, 30 aa, Mycobacterium
QIDPDLTTPSLWPKLAAVLVAETPVRGAMG

SEQ ID NO: 849078 - protein, 28 aa, Mycobacterium
QIDPNAEFFAAPLSWQQELWPTEEFELA

SEQ ID NO: 849079 - protein, 25 aa, Mycobacterium
QIDPNAEFFAAPLSWQRELWPTEEF

SEQ ID NO: 849080 - protein, 23 aa, Mycobacterium
QIDRDPHLAARYLDCIPAAVEEL

SEQ ID NO: 849081 - protein, 24 aa, Mycobacterium
QIDRLLVPLLRGDEWWALGMSEPE

SEQ ID NO: 849082 - protein, 24 aa, Mycobacterium
QIDTPLVFLQNTTGYMVGAEYEQG

SEQ ID NO: 849083 - protein, 20 aa, Mycobacterium
QIDTTWRRTSYSALVRAADA

SEQ ID NO: 849084 - protein, 18 aa, Mycobacterium
QIEAFITALPAVLDTAAE

SEQ ID NO: 849085 - protein, 20 aa, Mycobacterium
QIEHAYLGLGQLLGRPVGQD

SEQ ID NO: 849086 - protein, 17 aa, Mycobacterium
QIEHHLFPDLPSNRYPE

SEQ ID NO: 849087 - protein, 18 aa, Mycobacterium
QIELLKLQNHALLAQANE

SEQ ID NO: 849088 - protein, 19 aa, Mycobacterium
QIEMGIIPPGTQLTPRPEQ

SEQ ID NO: 849089 - protein, 23 aa, Mycobacterium
QIEPEVGLACRVNWRGDVVVSLE

SEQ ID NO: 849090 - protein, 27 aa, Mycobacterium
QIETNVFGALWITQAALPYLREQRSGH

SEQ ID NO: 849091 - protein, 21 aa, Mycobacterium
QIETPTLFFAGSEDPMRLAES

SEQ ID NO: 849092 - protein, 17 aa, Mycobacterium
QIFADRMYVLDGGTAHV

SEQ ID NO: 849093 - protein, 21 aa, Mycobacterium
QIFEITLDEALKIYAEPKRRG

SEQ ID NO: 849094 - protein, 31 aa, Mycobacterium
QIFGDRVVWVPWRRPGFQLGLDIADIKRRNP

SEQ ID NO: 849095 - protein, 21 aa, Mycobacterium
QIFVTAPVYPPSGLLTGIIVN

SEQ ID NO: 849096 - protein, 26 aa, Mycobacterium
QIGASPELRPWLAEELAPGAHITDED

SEQ ID NO: 849097 - protein, 26 aa, Mycobacterium
QIGGGLLLASGKFPRIASAALAVTVL

SEQ ID NO: 849098 - protein, 26 aa, Mycobacterium
QIGKGDIVVLLESMKMEIPVLAEIGG

SEQ ID NO: 849099 - protein, 26 aa, Mycobacterium
QIGKGDIVVLLESMKMEIPVLAEVDG

SEQ ID NO: 849100 - protein, 27 aa, Mycobacterium
QIGKGDIVVLLESMKMEIPVLAEVGGT

SEQ ID NO: 849101 - protein, 23 aa, Mycobacterium
QIGKLSELWFDALAGICAHVRDG

SEQ ID NO: 849102 - protein, 25 aa, Mycobacterium
QIGRLVLEALTRLLRKDRLVTDVRI

SEQ ID NO: 849103 - protein, 17 aa, Mycobacterium
QIGSRLGLWPSDIKILA

SEQ ID NO: 849104 - protein, 24 aa, Mycobacterium
QIGTLLPCNVVVRADPERDGTIII

SEQ ID NO: 849105 - protein, 25 aa, Mycobacterium
QIGTLLPCNVVVRSDPEQAGTIVIE

SEQ ID NO: 849106 - protein, 31 aa, Mycobacterium
QIGTNHLGAFALTNLLLPKLTDRVIAVSSVA

SEQ ID NO: 849107 - protein, 21 aa, Mycobacterium
QIGTQLFIRHRARGLALTAAG

SEQ ID NO: 849108 - protein, 17 aa, Mycobacterium
QIGTRLGLWPSDIDVLS

SEQ ID NO: 849109 - protein, 21 aa, Mycobacterium
QIGYAALFRIAAGAMLGHDTP

SEQ ID NO: 849110 - protein, 19 aa, Mycobacterium
QIHGGIGFTWEHPAHLYLK

SEQ ID NO: 849111 - protein, 31 aa, Mycobacterium; identical to SEQ ID NO: 130601

SEQ ID NO: 849112 - protein, 18 aa, Mycobacterium
QIHPSVMRAIADVGYESP

SEQ ID NO: 849113 - protein, 18 aa, Mycobacterium
QIIAGYLPDFRMPQTATS

SEQ ID NO: 849114 - protein, 26 aa, Mycobacterium
QIIDRLIEWVAFTPLQNATGEPAISL

SEQ ID NO: 849115 - protein, 18 aa, Mycobacterium
QIIPGFLSFHPMGAQVGQ

SEQ ID NO: 849116 - protein, 18 aa, Mycobacterium
QIIRLCLSARGPITFCGE

SEQ ID NO: 849117 - protein, 22 aa, Mycobacterium
QIKRFRILPSLWEPGGDEITLT

SEQ ID NO: 849118 - protein, 22 aa, Mycobacterium
QIKRFRILPTLWEPGGDEITLT

SEQ ID NO: 849119 - protein, 22 aa, Mycobacterium
QIKTFTVLPDVWEPGSEYLTPT

SEQ ID NO: 849120 - protein, 17 aa, Mycobacterium
QIKWLFDKLLGPRPHWS

SEQ ID NO: 849121 - protein, 18 aa, Mycobacterium
QILAARPLLARLASEVPA

SEQ ID NO: 849122 - protein, 25 aa, Mycobacterium
QILAEAALAIRSGALWVAANVDRTL

SEQ ID NO: 849123 - protein, 18 aa, Mycobacterium
QILAQTRHFVRTAVIPRE

SEQ ID NO: 849124 - protein, 24 aa, Mycobacterium
QILDTLIKEKWLTANGVIGFFPAN

SEQ ID NO: 849125 - protein, 19 aa, Mycobacterium
QILGLLRELQDNLGLTYLF

SEQ ID NO: 849126 - protein, 19 aa, Mycobacterium
QILIWYPNFVLPVVDSFVY

SEQ ID NO: 849127 - protein, 17 aa, Mycobacterium
QILIYPVLDADFDTPSY

SEQ ID NO: 849128 - protein, 27 aa, Mycobacterium
QILKPVLVRAQERRKWLPVHPVGRRTW

SEQ ID NO: 849129 - protein, 18 aa, Mycobacterium
QILLDIYAAFTHQNEATR

SEQ ID NO: 849130 - protein, 17 aa, Mycobacterium
QILLNPAHPSRITQGVT

SEQ ID NO: 849131 - protein, 25 aa, Mycobacterium
QILQRLVDWVAFTPLQNATGDPAIS

SEQ ID NO: 849132 - protein, 20 aa, Mycobacterium
QILRALRINLSVRGYEVITA

SEQ ID NO: 849133 - protein, 20 aa, Mycobacterium
QILRALRINLSVRGYEVVTA

SEQ ID NO: 849134 - protein, 27 aa, Mycobacterium
QILSLAQTLLRHHPDLDRLASSVAAGG

SEQ ID NO: 849135 - protein, 19 aa, Mycobacterium
QINIPAFTTNEFTIAPIGI

SEQ ID NO: 849136 - protein, 26 aa, Mycobacterium
QINPNLILADFSFAPKNSPWFDRKGF

SEQ ID NO: 849137 - protein, 29 aa, Mycobacterium
QINSPGWVGLMRWLKPVLSTPIGETPVLK

SEQ ID NO: 849138 - protein, 19 aa, Mycobacterium
QIPALFTNMTVRENLWTAA

SEQ ID NO: 849139 - protein, 18 aa, Mycobacterium
QIPECKAVVVFIDDLDRC

SEQ ID NO: 849140 - protein, 19 aa, Mycobacterium
QIPGPPQATLPQSPDGQGP

SEQ ID NO: 849141 - protein, 18 aa, Mycobacterium
QIPLGNDLIHAPTGAVLL

SEQ ID NO: 849142 - protein, 21 aa, Mycobacterium
QIPLRARLYRVADDEHILAIT

SEQ ID NO: 849143 - protein, 19 aa, Mycobacterium
QIPNFLPADYAVLDGIFAI

SEQ ID NO: 849144 - protein, 17 aa, Mycobacterium
QIPRFCDHPLLDPVGAC

SEQ ID NO: 849145 - protein, 20 aa, Mycobacterium
QIPRLENVLKETLRLHPPLI

SEQ ID NO: 849146 - protein, 26 aa, Mycobacterium
QIPVFAGTRPIAFLDMGWEEYGVAVE

SEQ ID NO: 849147 - protein, 25 aa, Mycobacterium
QIPVRLHARSWHRYPEPPPDSVAMV

SEQ ID NO: 849148 - protein, 23 aa, Mycobacterium
QIPVVREAYRPSEDRLDWARRVL

SEQ ID NO: 849149 - protein, 23 aa, Mycobacterium
QIQEIRPGKPPSIGGLPAVNDGD

SEQ ID NO: 849150 - protein, 22 aa, Mycobacterium
QIQHGSPPLALLTRAIEDLAEG

SEQ ID NO: 849151 - protein, 17 aa, Mycobacterium
QIQKMRMRPGIATELHQ

SEQ ID NO: 849152 - protein, 17 aa, Mycobacterium
QIQRAKADEREEIGDAT

SEQ ID NO: 849153 - protein, 19 aa, Mycobacterium
QIQSLLRGKYKIGVLGKGG

SEQ ID NO: 849154 - protein, 23 aa, Mycobacterium
QIRDAFIPMLLPANRAIGDDGTT

SEQ ID NO: 849155 - protein, 43 aa, Mycobacterium
QIRDAVELPFLHKDLYKEYSLRPPKGVLLYGPPGCGKTLIAKA

SEQ ID NO: 849156 - protein, 23 aa, Mycobacterium
QIRDAVELPFLHKDLYQEYSLRP

SEQ ID NO: 849157 - protein, 26 aa, Mycobacterium
QIRDQVRILVTLRDGGFFSQLANLGD

SEQ ID NO: 849158 - protein, 18 aa, Mycobacterium
QIRDSDYARFIADHTGQG

SEQ ID NO: 849159 - protein, 18 aa, Mycobacterium
QIRELAVAAFRAIDCQGL

SEQ ID NO: 849160 - protein, 18 aa, Mycobacterium
QIRKLLLDTPDPLQWDCF

SEQ ID NO: 849161 - protein, 17 aa, Mycobacterium
QIRLDGLGRAYYRSRLA

SEQ ID NO: 849162 - protein, 25 aa, Mycobacterium
QIRLGGDMALFAGLGRLLLEADDRA

SEQ ID NO: 849163 - protein, 17 aa, Mycobacterium
QIRPLEVSGLHGNRIHK

SEQ ID NO: 849164 - protein, 22 aa, Mycobacterium
QIRRSLELVFSHGIAVVARLTE

SEQ ID NO: 849165 - protein, 20 aa, Mycobacterium
QIRRYCVRCLDPLVGSDRFD

SEQ ID NO: 849166 - protein, 17 aa, Mycobacterium
QIRRYGFHGTSHRYVSE

SEQ ID NO: 849167 - protein, 19 aa, Mycobacterium
QIRWLFGKLLAEKPGRNPR

SEQ ID NO: 849168 - protein, 19 aa, Mycobacterium
QISAAFTTFRIRAAAPARS

SEQ ID NO: 849169 - protein, 17 aa, Mycobacterium
QISAMLKRLGIEGDFKG

SEQ ID NO: 849170 - protein, 23 aa, Mycobacterium
QISDGQLHRRPGPGLGIEIDPDK

SEQ ID NO: 849171 - protein, 19 aa, Mycobacterium
QISGLPFSGPIGGVRVALI

SEQ ID NO: 849172 - protein, 24 aa, Mycobacterium
QISRLAELWFDALAGICAHVRGGG

SEQ ID NO: 849173 - protein, 18 aa, Mycobacterium
QISWGRPVFKAGKIFAMF

SEQ ID NO: 849174 - protein, 26 aa, Mycobacterium
QITAQLLPRPIGLIIGLQLTANPFVL

SEQ ID NO: 849175 - protein, 19 aa, Mycobacterium
QITATLEPLAAACGLRVTT

SEQ ID NO: 849176 - protein, 30 aa, Mycobacterium
QITAVLPGRPPLPTLFLPHNRGKKSVAVDL

SEQ ID NO: 849177 - protein, 18 aa, Mycobacterium
QITDPVAVLIAPGSKVGS

SEQ ID NO: 849178 - protein, 22 aa, Mycobacterium
QITPFAMIQLADRGQFFVEPGQ

SEQ ID NO: 849179 - protein, 24 aa, Mycobacterium
QITRYFRPRFAAVPFKAGEEQARY

SEQ ID NO: 849180 - protein, 17 aa, Mycobacterium
QIVDEPFIIGVVGPAFS

SEQ ID NO: 849181 - protein, 22 aa, Mycobacterium
QIVDFLAGFRDTAGVAPVLVET

SEQ ID NO: 849182 - protein, 19 aa, Mycobacterium
QIVDGFLRSRTIACALVVA

SEQ ID NO: 849183 - protein, 22 aa, Mycobacterium
QIVLARLRLGLTWQELADAIDR

SEQ ID NO: 849184 - protein, 20 aa, Mycobacterium
QIVMLLATRNELRLTDVSAY

SEQ ID NO: 849185 - protein, 21 aa, Mycobacterium
QIVPCWECLFCKRGQYHMCQP

SEQ ID NO: 849186 - protein, 24 aa, Mycobacterium
QIVPSRVDLPWRTTTAAPGDVPAL

SEQ ID NO: 849187 - protein, 17 aa, Mycobacterium
QIVPVHAALPWSERVAT

SEQ ID NO: 849188 - protein, 19 aa, Mycobacterium
QIWERLSVDVLDLWDNVRA

SEQ ID NO: 849189 - protein, 18 aa, Mycobacterium
QIYGYPYLTPRTATMLHQ

SEQ ID NO: 849190 - protein, 19 aa, Mycobacterium
QIYGYPYLTPRTEQMLRVA

SEQ ID NO: 849191 - protein, 19 aa, Mycobacterium
QIYRLDAVPNTKRLPYSLK

SEQ ID NO: 849192 - protein, 37 aa, Mycobacterium
QIYVVPQLDAKVLWQLKRALPGPFTRTLGLVERMASW

SEQ ID NO: 849193 - protein, 21 aa, Mycobacterium
QKAFMEILSQGTRFKPGKAKE

SEQ ID NO: 849194 - protein, 25 aa, Mycobacterium
QKAIIGRWLHADASILLLDEPTRGV

SEQ ID NO: 849195 - protein, 23 aa, Mycobacterium
QKAKIFLALLGKQYGVQPKDWRK

SEQ ID NO: 849196 - protein, 23 aa, Mycobacterium
QKANLRLVVVDYMQLMTSGKKHE

SEQ ID NO: 849197 - protein, 18 aa, Mycobacterium
QKANRRHLLEHKATKRTR

SEQ ID NO: 849198 - protein, 24 aa, Mycobacterium
QKARFTSAFTFQYSPRPGTPAADM

SEQ ID NO: 849199 - protein, 24 aa, Mycobacterium
QKDRFLTPLLRADEFWCQGFSEPG

SEQ ID NO: 849200 - protein, 18 aa, Mycobacterium
QKDWLPRMASGETKVVFA

SEQ ID NO: 849201 - protein, 26 aa, Mycobacterium
QKERWLPELVTLEKIACWAITEPDAG

SEQ ID NO: 849202 - protein, 17 aa, Mycobacterium
QKFLPSILAGEVHFAIG

SEQ ID NO: 849203 - protein, 18 aa, Mycobacterium
QKFNPLVRLDSVNGGSVE

SEQ ID NO: 849204 - protein, 19 aa, Mycobacterium
QKFNPLVRLDTVNGGSVED

SEQ ID NO: 849205 - protein, 23 aa, Mycobacterium
QKFRFYRPIVTGDKLYFHTYLDS

SEQ ID NO: 849206 - protein, 20 aa, Mycobacterium
QKHRFMVLPMRPEGTDGWDE

SEQ ID NO: 849207 - protein, 25 aa, Mycobacterium
QKISELYDRVGFAAAGKFNEFDNLR

SEQ ID NO: 849208 - protein, 27 aa, Mycobacterium
QKIWSSRAPFADRAFGLFRSDPDAQRH

SEQ ID NO: 849209 - protein, 19 aa, Mycobacterium
QKKKFLPGILSGEVHFAIG

SEQ ID NO: 849210 - protein, 23 aa, Mycobacterium
QKLADERGIPWDLIRGADSAEAT

SEQ ID NO: 849211 - protein, 24 aa, Mycobacterium
QKLIAGWRVLLSQLPFHDPADEPL

SEQ ID NO: 849212 - protein, 19 aa, Mycobacterium
QKLIGIVSIGDVVKSRMGE

SEQ ID NO: 849213 - protein, 22 aa, Mycobacterium
QKLKVLVSIFGRETPVELTFSQ

SEQ ID NO: 849214 - protein, 20 aa, Mycobacterium
QKLMRHTGPAMSAFNAWVLL

SEQ ID NO: 849215 - protein, 24 aa, Mycobacterium
QKLPAARFVDWWLEASLLDFQSQL

SEQ ID NO: 849216 - protein, 33 aa, Mycobacterium
QKLPNPPQLREFPFNVFARFLPGRDIRATAEQR

SEQ ID NO: 849217 - protein, 17 aa, Mycobacterium
QKLREHLEACPGCLKHY

SEQ ID NO: 849218 - protein, 26 aa, Mycobacterium
QKLSRLERFDRTIYLFDVELDHERNR

SEQ ID NO: 849219 - protein, 21 aa, Mycobacterium
QKNEWLPRLAAGDAIGCFGLT

SEQ ID NO: 849220 - protein, 20 aa, Mycobacterium
QKNEWLPRLASGDAIGCFGL

SEQ ID NO: 849221 - protein, 36 aa, Mycobacterium
QKNLPLLHAVNSGAPLWDWMKSIPGFDGGGLVSGPD

SEQ ID NO: 849222 - protein, 19 aa, Mycobacterium
QKPAWLDRAWARIREEVAA

SEQ ID NO: 849223 - protein, 20 aa, Mycobacterium
QKPHWAAPSTTAPVDATVTV

SEQ ID NO: 849224 - protein, 28 aa, Mycobacterium
QKQDEARMIMRNVWSPVSQQAGSGLPAL

SEQ ID NO: 849225 - protein, 23 aa, Mycobacterium
QKQGWSLVLLDLGVDLTTAAGRM

SEQ ID NO: 849226 - protein, 28 aa, Mycobacterium
QKQKFLRPLFTGEHLYCQLFSEPGAGSD

SEQ ID NO: 849227 - protein, 18 aa, Mycobacterium
QKQLRRLAATGEPVPELA

SEQ ID NO: 849228 - protein, 23 aa, Mycobacterium
QKQRFLPPTFRGEMMWCQLFSEP

SEQ ID NO: 849229 - protein, 20 aa, Mycobacterium
QKQRFLPRMATGETRGSFSM

SEQ ID NO: 849230 - protein, 24 aa, Mycobacterium
QKQRIGIARALALQPKILALDEPV

SEQ ID NO: 849231 - protein, 26 aa, Mycobacterium
QKQYPFLGAPFWVGRGFGLNLSVVTD

SEQ ID NO: 849232 - protein, 21 aa, Mycobacterium
QKRDRIRYHGGDFIELIVGGK

SEQ ID NO: 849233 - protein, 20 aa, Mycobacterium
QKRFPNIATLLDGVRPLYDD

SEQ ID NO: 849234 - protein, 21 aa, Mycobacterium
QKRKFLPRMATGETRGAFSMS

SEQ ID NO: 849235 - protein, 28 aa, Mycobacterium
QKRKFLRPLFTGEHLYCQLFSEPGAGSD

SEQ ID NO: 849236 - protein, 18 aa, Mycobacterium
QKRLLQIELLKLQKWSQA

SEQ ID NO: 849237 - protein, 18 aa, Mycobacterium
QKRLQEELAWVRSGAKAR

SEQ ID NO: 849238 - protein, 18 aa, Mycobacterium
QKRLTEELAWVRSGAKAR

SEQ ID NO: 849239 - protein, 17 aa, Mycobacterium
QKRPGYILLSTDVARFP

SEQ ID NO: 849240 - protein, 24 aa, Mycobacterium
QKRQAAYGPAKFIATGLAKHLAVE

SEQ ID NO: 849241 - protein, 28 aa, Mycobacterium
QKRQDFLGAPFWIGRGFGLNLSVVTDPA

SEQ ID NO: 849242 - protein, 24 aa, Mycobacterium
QKRQRIIYHGNGFVELIAVGHGYD

SEQ ID NO: 849243 - protein, 18 aa, Mycobacterium
QKRRADAILVRRTDRLPL

SEQ ID NO: 849244 - protein, 18 aa, Mycobacterium
QKRRAIDLIAPHGGVLAA

SEQ ID NO: 849245 - protein, 26 aa, Mycobacterium
QKRREFLTDVSLLGGLIIASADTAGK

SEQ ID NO: 849246 - protein, 22 aa, Mycobacterium
QKRRLMVDLYQRVLDGVVDLGF

SEQ ID NO: 849247 - protein, 25 aa, Mycobacterium
QKRVRALLTGFLLATLAGDKTYRDF

SEQ ID NO: 849248 - protein, 24 aa, Mycobacterium
QKSDLRLIVVDYMQLMTSGKKYES

SEQ ID NO: 849249 - protein, 20 aa, Mycobacterium
QKSFHLPKILGGEVIWCQGF

SEQ ID NO: 849250 - protein, 19 aa, Mycobacterium
QKSHFLPRIVRGECFFGIG

SEQ ID NO: 849251 - protein, 28 aa, Mycobacterium
QKSHMLFPEFSDFFSGFPSFAGIRSMFD

SEQ ID NO: 849252 - protein, 32 aa, Mycobacterium
QKSRAVRLLAAKNLAPYITLMERHLDRSAKVS

SEQ ID NO: 849253 - protein, 24 aa, Mycobacterium
QKTDLQLIVVDYLQLMTSGKKVES

SEQ ID NO: 849254 - protein, 31 aa, Mycobacterium
QKTNPDRFAGLPHPTILAAAALLGVDEVWAV

SEQ ID NO: 849255 - protein, 25 aa, Mycobacterium
QKVAFKGFLLSDVPNFAYVFGYTNS

SEQ ID NO: 849256 - protein, 23 aa, Mycobacterium
QKVGRFEFFMESERWEWSDAVAR

SEQ ID NO: 849257 - protein, 25 aa, Mycobacterium
QKVKHRVFHYPGGLVDFVKHINRTK

SEQ ID NO: 849258 - protein, 32 aa, Mycobacterium
QKVKLVNNALFAGQIGLLAEAIRLGERLGVPE

SEQ ID NO: 849259 - protein, 33 aa, Mycobacterium
QKVLRRRGDGRWAWRWDPAFATSNFQFLQSDSD

SEQ ID NO: 849260 - protein, 28 aa, Mycobacterium
QKVSARVYPALVPLEHPLASVNGAFNAV

SEQ ID NO: 849261 - protein, 29 aa, Mycobacterium
QKWAELVYDGLWYSPLKRSLEAFVADTQQ

SEQ ID NO: 849262 - protein, 30 aa, Mycobacterium
QKWGELVYDGLWYSPLKRALESFVAHTQEH

SEQ ID NO: 849263 - protein, 23 aa, Mycobacterium
QKYLDRRGLRRPAVNWAALSDIR

SEQ ID NO: 849264 - protein, 17 aa, Mycobacterium
QKYLWNVLVDYWFRMEI

SEQ ID NO: 849265 - protein, 28 aa, Mycobacterium
QLAAATPWWEPGTAQGYHMTTFGFILGE

SEQ ID NO: 849266 - protein, 20 aa, Mycobacterium
QLAALRDALLPGLVTGEVAV

SEQ ID NO: 849267 - protein, 21 aa, Mycobacterium
QLAAQLAVYLGPPGYGEMFSA

SEQ ID NO: 849268 - protein, 19 aa, Mycobacterium
QLAAVPYLESVVAAAGAIA

SEQ ID NO: 849269 - protein, 26 aa, Mycobacterium
QLAAVRAFMGPQFRGPGKPFAEEQPC

SEQ ID NO: 849270 - protein, 17 aa, Mycobacterium
QLAAYLTGSSRYAEAAQ

SEQ ID NO: 849271 - protein, 23 aa, Mycobacterium
QLACWEHYNPLARYALIADGEQI

SEQ ID NO: 849272 - protein, 26 aa, Mycobacterium
QLADAIDRPVVWTTAALLGQHPIPVE

SEQ ID NO: 849273 - protein, 23 aa, Mycobacterium
QLADARWAGAPLSAAAAKMDAMP

SEQ ID NO: 849274 - protein, 22 aa, Mycobacterium
QLADIPVTPWQHTQFWVEDRSG

SEQ ID NO: 849275 - protein, 18 aa, Mycobacterium
QLADVAATLLTYGRRRVH

SEQ ID NO: 849276 - protein, 17 aa, Mycobacterium
QLAEILAIQPIDAAAVL

SEQ ID NO: 849277 - protein, 18 aa, Mycobacterium
QLAEKLPPYMVPTAVMVL

SEQ ID NO: 849278 - protein, 24 aa, Mycobacterium
QLAELLRTQILERALSPGSRLPTE

SEQ ID NO: 849279 - protein, 26 aa, Mycobacterium
QLAFAKTPPTVIMLAGLQGAGKTTLA

SEQ ID NO: 849280 - protein, 20 aa, Mycobacterium
QLAFAKTPPTVVMLAGLQGS

SEQ ID NO: 849281 - protein, 21 aa, Mycobacterium
QLAFLRYAYRCLEDLHCGSGW

SEQ ID NO: 849282 - protein, 30 aa, Mycobacterium
QLAGNALLDLFLRIIGELVRRHWSSTGGQP

SEQ ID NO: 849283 - protein, 17 aa, Mycobacterium
QLAIARALITTPKCLIL

SEQ ID NO: 849284 - protein, 20 aa, Mycobacterium
QLAKAMDRKVYLPSGGTLVI

SEQ ID NO: 849285 - protein, 25 aa, Mycobacterium
QLAKAMERKVWLPSGGTLVIDRTEA

SEQ ID NO: 849286 - protein, 20 aa, Mycobacterium
QLALAWISCQNYTAAADFLQ

SEQ ID NO: 849287 - protein, 23 aa, Mycobacterium
QLALDVEGGRRLIFSPNGSNIRR

SEQ ID NO: 849288 - protein, 17 aa, Mycobacterium
QLALELSYRTVRHWFGT

SEQ ID NO: 849289 - protein, 17 aa, Mycobacterium
QLALIRPGAEVTALREI

SEQ ID NO: 849290 - protein, 18 aa, Mycobacterium
QLALSVCYELHYRGFAGV

SEQ ID NO: 849291 - protein, 21 aa, Mycobacterium
QLALVIHHLAIDGVSWRILLD

SEQ ID NO: 849292 - protein, 18 aa, Mycobacterium
QLAMYQLAVAEGLVDAGT

SEQ ID NO: 849293 - protein, 24 aa, Mycobacterium
QLANRLMRWTGFSPDKVARICLDA

SEQ ID NO: 849294 - protein, 20 aa, Mycobacterium
QLAPLAELLRRALDDALATV

SEQ ID NO: 849295 - protein, 17 aa, Mycobacterium
QLAPRPVTAAWGAAAGR

SEQ ID NO: 849296 - protein, 21 aa, Mycobacterium
QLAPVGPPRRLVDPAALAHGS

SEQ ID NO: 849297 - protein, 26 aa, Mycobacterium
QLAQQVIRAIWRTPKPVVAALEGSAY

SEQ ID NO: 849298 - protein, 33 aa, Mycobacterium
QLARAELQIVFHTLLRRIPTLKLAIPIDEVPFK

SEQ ID NO: 849299 - protein, 32 aa, Mycobacterium
QLARAELQIVFHTLLRRIPTLRLAIPLEEVPF

SEQ ID NO: 849300 - protein, 32 aa, Mycobacterium
QLARAELQIVYRTLLQRIPTLTLATALEDVPF

SEQ ID NO: 849301 - protein, 32 aa, Mycobacterium
QLARAELQIVYRTLLRRIPTLALAIPVEDVPF

SEQ ID NO: 849302 - protein, 21 aa, Mycobacterium
QLARGYWKRPALTATRFVANP

SEQ ID NO: 849303 - protein, 18 aa, Mycobacterium
QLARHWPQGRLSKAYAAY

SEQ ID NO: 849304 - protein, 17 aa, Mycobacterium
QLARKFPNYMRKTLMTM

SEQ ID NO: 849305 - protein, 19 aa, Mycobacterium
QLARLAAIGGFRKWDRMVK

SEQ ID NO: 849306 - protein, 24 aa, Mycobacterium
QLARLELKLMLGKILQRLPDMRLA

SEQ ID NO: 849307 - protein, 20 aa, Mycobacterium
QLARLVWRIQGLKFTVTGIE

SEQ ID NO: 849308 - protein, 30 aa, Mycobacterium
QLARMELQIVLPTLLRRVPTLRLAVPLDEL

SEQ ID NO: 849309 - protein, 31 aa, Mycobacterium
QLARMELQIVLPTLLRRVPTLRLAVPLEELP

SEQ ID NO: 849310 - protein, 25 aa, Mycobacterium
QLARQQLAALFRELLHRLPDIEVCG

SEQ ID NO: 849311 - protein, 23 aa, Mycobacterium
QLASEGIGMLRFDNLGLGDSEGD

SEQ ID NO: 849312 - protein, 25 aa, Mycobacterium
QLATSLQPLWLTRGGLREGSDWLDA

SEQ ID NO: 849313 - protein, 28 aa, Mycobacterium
QLAVLDNPLRKVVLARALRLTADAPLDA

SEQ ID NO: 849314 - protein, 30 aa, Mycobacterium
QLAVLVPELLLIGQLIDRSGMAWCISAFGR

SEQ ID NO: 849315 - protein, 19 aa, Mycobacterium
QLAVRAVRAWIADGGVLVL

SEQ ID NO: 849316 - protein, 25 aa, Mycobacterium
QLAVTFRNGWLWATVEGRAELVGPD

SEQ ID NO: 849317 - protein, 20 aa, Mycobacterium
QLAYERWLLDTKLAQRDPDL

SEQ ID NO: 849318 - protein, 19 aa, Mycobacterium
QLAYYDGLSYSQVSERLAA

SEQ ID NO: 849319 - protein, 19 aa, Mycobacterium
QLAYYDGLTYAQVSERLAT

SEQ ID NO: 849320 - protein, 20 aa, Mycobacterium
QLCHDGFVYRFRHDERDLGD

SEQ ID NO: 849321 - protein, 19 aa, Mycobacterium
QLCHSGLQNDFPPLRTTKS

SEQ ID NO: 849322 - protein, 17 aa, Mycobacterium
QLCSAALITWFNDHFDD

SEQ ID NO: 849323 - protein, 21 aa, Mycobacterium
QLCWSFYQRLIAAYAHPDRRR

SEQ ID NO: 849324 - protein, 19 aa, Mycobacterium
QLDALLWQSEPFGARLRAA

SEQ ID NO: 849325 - protein, 24 aa, Mycobacterium
QLDALLWRAARAGEPSWPSPFGPG

SEQ ID NO: 849326 - protein, 18 aa, Mycobacterium
QLDDDMIHMPFFNIVAER

SEQ ID NO: 849327 - protein, 25 aa, Mycobacterium
QLDEAVALLRRATVTLAPTGYSWGP

SEQ ID NO: 849328 - protein, 25 aa, Mycobacterium
QLDENPYLPPYYHPGPDAPEIRYML

SEQ ID NO: 849329 - protein, 25 aa, Mycobacterium
QLDEPIGIVRFYADLLSRYEFSEDL

SEQ ID NO: 849330 - protein, 17 aa, Mycobacterium
QLDFHWTHQLRPRLDGL

SEQ ID NO: 849331 - protein, 35 aa, Mycobacterium
QLDGETHTVSWPRNAKLLDVLLAKGLDAPFSCREG

SEQ ID NO: 849332 - protein, 22 aa, Mycobacterium
QLDGRRLKWLNFVCADSTGALW

SEQ ID NO: 849333 - protein, 26 aa, Mycobacterium
QLDIEIWPTCIVLPAEYRIALQISGH

SEQ ID NO: 849334 - protein, 27 aa, Mycobacterium
QLDIMVTWGHLYISLNQPAIAPPGECV

SEQ ID NO: 849335 - protein, 28 aa, Mycobacterium
QLDIMVTWGHLYISLNQPAIEPPGECVP

SEQ ID NO: 849336 - protein, 21 aa, Mycobacterium
QLDITGYWRFDSETWDAAFAL

SEQ ID NO: 849337 - protein, 18 aa, Mycobacterium
QLDIVHRRLLRAKGSGQR

SEQ ID NO: 849338 - protein, 19 aa, Mycobacterium
QLDIWLSHESGLAGAEWQL

SEQ ID NO: 849339 - protein, 24 aa, Mycobacterium
QLDKYVEYNLIPSLFTEHAFYFGD

SEQ ID NO: 849340 - protein, 17 aa, Mycobacterium
QLDLALVVLHRTVRFVE

SEQ ID NO: 849341 - protein, 26 aa, Mycobacterium
QLDLGPIVLFVYYEPSILADPELAAY

SEQ ID NO: 849342 - protein, 27 aa, Mycobacterium
QLDMLMGALGPMLSSGIASGIDLAGLA

SEQ ID NO: 849343 - protein, 22 aa, Mycobacterium
QLDNFLITDVYLGATSIILPGP

SEQ ID NO: 849344 - protein, 23 aa, Mycobacterium
QLDNTLFAWQRFTDPRRVLLMGD

SEQ ID NO: 849345 - protein, 20 aa, Mycobacterium
QLDPALFDLDIPVFGICYGF

SEQ ID NO: 849346 - protein, 22 aa, Mycobacterium
QLDPAVFDLGVPVFGICYGFQA

SEQ ID NO: 849347 - protein, 22 aa, Mycobacterium
QLDPRTRLLLGTNPDGSLTALL

SEQ ID NO: 849348 - protein, 31 aa, Mycobacterium
QLDQPIDIVRYYAELLATYPLTEDLGNIESR

SEQ ID NO: 849349 - protein, 23 aa, Mycobacterium
QLDRLKALVLARATLDAADTDGA

SEQ ID NO: 849350 - protein, 32 aa, Mycobacterium
QLDSAALRDALLDLYEFWLTTKATELGITADS

SEQ ID NO: 849351 - protein, 24 aa, Mycobacterium
QLDTTLRTALTPLTGILNQAQSSG

SEQ ID NO: 849352 - protein, 17 aa, Mycobacterium
QLDVPPRFQAKGLGSGG

SEQ ID NO: 849353 - protein, 20 aa, Mycobacterium
QLDWAQLRRATAENPFAVAF

SEQ ID NO: 849354 - protein, 21 aa, Mycobacterium
QLDWGTYVFDFGRREVRNFLV

SEQ ID NO: 849355 - protein, 18 aa, Mycobacterium
QLDYLEIRDPMLGPPPAE

SEQ ID NO: 849356 - protein, 23 aa, Mycobacterium
QLEADVKRWVTLAAESLATVEKV

SEQ ID NO: 849357 - protein, 28 aa, Mycobacterium
QLEDRVGTPWRLTWYRGMAALLNGDYDQ

SEQ ID NO: 849358 - protein, 25 aa, Mycobacterium
QLEEDPYLPPYFHPGSDAPEIRYMI

SEQ ID NO: 849359 - protein, 25 aa, Mycobacterium
QLEEDPYLPPYYHPGPDAPEIRYML

SEQ ID NO: 849360 - protein, 25 aa, Mycobacterium
QLEEDPYLPPYYHPGPEAPEIRYLL

SEQ ID NO: 849361 - protein, 19 aa, Mycobacterium
QLEIELNWIDEHIGDHPYG

SEQ ID NO: 849362 - protein, 19 aa, Mycobacterium
QLEIFTKFSIPINIARVMH

SEQ ID NO: 849363 - protein, 19 aa, Mycobacterium
QLEKIFPICTRGASDTARF

SEQ ID NO: 849364 - protein, 18 aa, Mycobacterium
QLELKWRAIKEDLERAHA

SEQ ID NO: 849365 - protein, 17 aa, Mycobacterium
QLELMPGARTTLRTLRR

SEQ ID NO: 849366 - protein, 21 aa, Mycobacterium
QLELSLLGPIRNPELMKAFKM

SEQ ID NO: 849367 - protein, 21 aa, Mycobacterium
QLELSLLGPLRNPELMKAYKV

SEQ ID NO: 849368 - protein, 22 aa, Mycobacterium
QLEMRLNRQLADIEKLQVNVRQ

SEQ ID NO: 849369 - protein, 24 aa, Mycobacterium
QLEPGMTAWDLYGGAGVFAASLAE

SEQ ID NO: 849370 - protein, 36 aa, Mycobacterium
QLEQKKFRINLFDLPMTLLPGMLTSPAWELGVVRIR

SEQ ID NO: 849371 - protein, 24 aa, Mycobacterium
QLETELDVTLFYRTTRQVSLTPAG

SEQ ID NO: 849372 - protein, 24 aa, Mycobacterium
QLEWLARALAQRPVSEPLFDAVLA

SEQ ID NO: 849373 - protein, 21 aa, Mycobacterium
QLEYDYLIYAVGSTGATPAVP

SEQ ID NO: 849374 - protein, 24 aa, Mycobacterium
QLFATLPIERLTTQLLANLGLPHG

SEQ ID NO: 849375 - protein, 17 aa, Mycobacterium
QLFDTFADMELAWGPTW

SEQ ID NO: 849376 - protein, 20 aa, Mycobacterium
QLFGGYGYTQDFPVERMMRD

SEQ ID NO: 849377 - protein, 20 aa, Mycobacterium
QLFISSHTVEWHLRKVFAKL

SEQ ID NO: 849378 - protein, 17 aa, Mycobacterium
QLFQAIGLSQELLDEYF

SEQ ID NO: 849379 - protein, 26 aa, Mycobacterium
QLFRSTGIPVCLWFFAKDKKARSGQV

SEQ ID NO: 849380 - protein, 29 aa, Mycobacterium
QLFRSTGIPVCLWFFAMDKKAGCQGAIDR

SEQ ID NO: 849381 - protein, 21 aa, Mycobacterium
QLFVDMAHFAGLVAAGLHPSP

SEQ ID NO: 849382 - protein, 23 aa, Mycobacterium
QLGADIMFAFDELTTLINTREYQ

SEQ ID NO: 849383 - protein, 35 aa, Mycobacterium
QLGASYLDTGAMYRIVTLWVLRAGVDLTDPAAIAA

SEQ ID NO: 849384 - protein, 20 aa, Mycobacterium
QLGDDWPSHILVPAIHRNRA

SEQ ID NO: 849385 - protein, 20 aa, Mycobacterium
QLGFKLVYKKDCGRFGRLRN

SEQ ID NO: 849386 - protein, 22 aa, Mycobacterium
QLGIELLTLDELLGRADFISVH

SEQ ID NO: 849387 - protein, 17 aa, Mycobacterium
QLGLIGMQLTLTELWRS

SEQ ID NO: 849388 - protein, 29 aa, Mycobacterium
QLGLIRSVKPLPKSGWRKAVHRLSGGAIN

SEQ ID NO: 849389 - protein, 20 aa, Mycobacterium
QLGLLRRVENLYTGLPEHHA

SEQ ID NO: 849390 - protein, 27 aa, Mycobacterium
QLGPEGVPVFLLPANPVSALVVFEVMV

SEQ ID NO: 849391 - protein, 22 aa, Mycobacterium
QLGQLRPLYRPGLVHMYHALTW

SEQ ID NO: 849392 - protein, 28 aa, Mycobacterium
QLGRDRVPVFLLPANPVSALVVFEIMVR

SEQ ID NO: 849393 - protein, 25 aa, Mycobacterium
QLGRRLPGYMVPAAVVVLDALPLTV

SEQ ID NO: 849394 - protein, 24 aa, Mycobacterium
QLGRWLPEMFGTADDPKLGAFCSS

SEQ ID NO: 849395 - protein, 25 aa, Mycobacterium
QLGSILERFLALYVYNRVPVVAERL

SEQ ID NO: 849396 - protein, 34 aa, Mycobacterium
QLGSLLLELQQLALDWYLFETGVRSQRLADCAVS

SEQ ID NO: 849397 - protein, 26 aa, Mycobacterium
QLGSPGGQFVLWRDALDAVPTAGDGK

SEQ ID NO: 849398 - protein, 34 aa, Mycobacterium; identical to SEQ ID NO: 130645

SEQ ID NO: 849399 - protein, 18 aa, Mycobacterium
QLGTSMRADWAAFARSGV

SEQ ID NO: 849400 - protein, 17 aa, Mycobacterium
QLGTVEYRTAWQLQREL

SEQ ID NO: 849401 - protein, 17 aa, Mycobacterium
QLGVDFWVDGVNPPGYT

SEQ ID NO: 849402 - protein, 17 aa, Mycobacterium
QLGVPQPEPLRRYKQGE

SEQ ID NO: 849403 - protein, 17 aa, Mycobacterium
QLGVRIAPPPPTTDADE

SEQ ID NO: 849404 - protein, 30 aa, Mycobacterium
QLGWDVELIGRIGWTCRDVWWAATQDPRSW

SEQ ID NO: 849405 - protein, 20 aa, Mycobacterium
QLGWRPKYSAAETLSALAAA

SEQ ID NO: 849406 - protein, 18 aa, Mycobacterium
QLHDLNWVPADRGWLPDL

SEQ ID NO: 849407 - protein, 28 aa, Mycobacterium
QLHEVGIALMAEFDSIAERVGHATTGYI

SEQ ID NO: 849408 - protein, 20 aa, Mycobacterium
QLHGELLPALGLSASDLDAV

SEQ ID NO: 849409 - protein, 19 aa, Mycobacterium
QLHLACFAAFDDIGSVIHS

SEQ ID NO: 849410 - protein, 19 aa, Mycobacterium
QLHQRGMLRPLRSAELSDG

SEQ ID NO: 849411 - protein, 20 aa, Mycobacterium
QLHYARTLEIWAAALEAKKE

SEQ ID NO: 849412 - protein, 20 aa, Mycobacterium
QLIAPNRMMRKWLSANNFLG

SEQ ID NO: 849413 - protein, 17 aa, Mycobacterium
QLIAVDNVWVPPAGGEE

SEQ ID NO: 849414 - protein, 21 aa, Mycobacterium
QLIDINLIDPLARLLEQTLLG

SEQ ID NO: 849415 - protein, 17 aa, Mycobacterium
QLIHRYPDKIAICRTLS

SEQ ID NO: 849416 - protein, 18 aa, Mycobacterium
QLINHPVRERIPISIAAL

SEQ ID NO: 849417 - protein, 19 aa, Mycobacterium
QLIQDSLGWVPYTQLANLT

SEQ ID NO: 849418 - protein, 20 aa, Mycobacterium
QLIQESLGWVPYTQLANITG

SEQ ID NO: 849419 - protein, 18 aa, Mycobacterium
QLIQLKLATMEVARMNVR

SEQ ID NO: 849420 - protein, 26 aa, Mycobacterium
QLISTVLSLRDGIIPPTLNLENPDPA

SEQ ID NO: 849421 - protein, 21 aa, Mycobacterium
QLISYVDPVRRKVIHAIVAHN

SEQ ID NO: 849422 - protein, 19 aa, Mycobacterium
QLIVNRALELAGAEQAILL

SEQ ID NO: 849423 - protein, 18 aa, Mycobacterium
QLIVYRAFYGPDIDGWPE

SEQ ID NO: 849424 - protein, 20 aa, Mycobacterium
QLKAVLLLVAEYGIPKAWRA

SEQ ID NO: 849425 - protein, 31 aa, Mycobacterium
QLKDELDVCPPILVLTGRPDDAWLARWSRAE

SEQ ID NO: 849426 - protein, 27 aa, Mycobacterium
QLKEAHELIYRPLRHPDGPPQPQVEYK

SEQ ID NO: 849427 - protein, 22 aa, Mycobacterium
QLKLALLNEILGRSVWAPSIFG

SEQ ID NO: 849428 - protein, 20 aa, Mycobacterium
QLKPGSVLIGFLAPRTQPEL

SEQ ID NO: 849429 - protein, 18 aa, Mycobacterium
QLKPLVFEGTQFGGALMT

SEQ ID NO: 849430 - protein, 17 aa, Mycobacterium
QLKPQRGALPFAASPTL

SEQ ID NO: 849431 - protein, 17 aa, Mycobacterium
QLKRSHLELGGKAPAVV

SEQ ID NO: 849432 - protein, 22 aa, Mycobacterium
QLKTDSALLSSILTYHVVQGQA

SEQ ID NO: 849433 - protein, 20 aa, Mycobacterium
QLKTYYLPSEGRRIRLRVSA

SEQ ID NO: 849434 - protein, 18 aa, Mycobacterium
QLLALHLGRLKDAGRISP

SEQ ID NO: 849435 - protein, 19 aa, Mycobacterium
QLLALPARVVDFDSATIAV

SEQ ID NO: 849436 - protein, 19 aa, Mycobacterium
QLLAYNCSPSFNWKKHLDD

SEQ ID NO: 849437 - protein, 20 aa, Mycobacterium
QLLDPLPRFDGMRPVLGAWI

SEQ ID NO: 849438 - protein, 18 aa, Mycobacterium
QLLELDFVGSIVEPAFAY

SEQ ID NO: 849439 - protein, 24 aa, Mycobacterium
QLLERFGMFGIRISIAGLAAGIAD

SEQ ID NO: 849440 - protein, 19 aa, Mycobacterium
QLLERFRTLAAEHLEVIVG

SEQ ID NO: 849441 - protein, 18 aa, Mycobacterium
QLLEVLLRDVPSANLEIG

SEQ ID NO: 849442 - protein, 18 aa, Mycobacterium
QLLFNQPGALPPAALEDL

SEQ ID NO: 849443 - protein, 19 aa, Mycobacterium
QLLGEGYTLVRREYMTAIG

SEQ ID NO: 849444 - protein, 18 aa, Mycobacterium
QLLGFRLHHRRRYLRPPD

SEQ ID NO: 849445 - protein, 20 aa, Mycobacterium
QLLGGYGVHLHYPVQRLMRD

SEQ ID NO: 849446 - protein, 21 aa, Mycobacterium
QLLGIAYLRHVLQVEPIASAP

SEQ ID NO: 849447 - protein, 21 aa, Mycobacterium
QLLIEWQRDFFDFGHVAKGYA

SEQ ID NO: 849448 - protein, 17 aa, Mycobacterium
QLLIIDEEFAKRPELVR

SEQ ID NO: 849449 - protein, 17 aa, Mycobacterium
QLLLDAPHRVRTASLLC

SEQ ID NO: 849450 - protein, 20 aa, Mycobacterium
QLLMTTFKTIAKKHGMECLF

SEQ ID NO: 849451 - protein, 19 aa, Mycobacterium
QLLPKLPAPLSRNALATAW

SEQ ID NO: 849452 - protein, 31 aa, Mycobacterium
QLLPVYDKPMVYYPLSTLMMAGIRDILVITT

SEQ ID NO: 849453 - protein, 19 aa, Mycobacterium
QLLQEVWGYDFFGGTRTVD

SEQ ID NO: 849454 - protein, 18 aa, Mycobacterium
QLLQVLHINPKTARYRFF

SEQ ID NO: 849455 - protein, 21 aa, Mycobacterium
QLLQVPPVRRTLEVPSIVPVK

SEQ ID NO: 849456 - protein, 19 aa, Mycobacterium
QLLRALAIAQLTDSGLAKS

SEQ ID NO: 849457 - protein, 17 aa, Mycobacterium
QLLRAQRKLIAEGGFPF

SEQ ID NO: 849458 - protein, 25 aa, Mycobacterium
QLLRDIIQTIPRPELFALSSKQLLE

SEQ ID NO: 849459 - protein, 21 aa, Mycobacterium
QLLRRSVRRFNAEPVPPELVE

SEQ ID NO: 849460 - protein, 21 aa, Mycobacterium
QLLRSAGMRVTRPRIAVLRSV

SEQ ID NO: 849461 - protein, 23 aa, Mycobacterium
QLLRTVMGRHRDAMRQRYVDPFR

SEQ ID NO: 849462 - protein, 17 aa, Mycobacterium
QLLSWLTGQHDVAFGTT

SEQ ID NO: 849463 - protein, 19 aa, Mycobacterium
QLLSYNCSPSFNWKQHLDD

SEQ ID NO: 849464 - protein, 27 aa, Mycobacterium
QLLTAFAARRMQLPVKLVLTRKQMYSS

SEQ ID NO: 849465 - protein, 28 aa, Mycobacterium
QLLTAPSTRQWLFPSPLLRARQARGHLI

SEQ ID NO: 849466 - protein, 18 aa, Mycobacterium
QLLTVLVIDPTTARYRFF

SEQ ID NO: 849467 - protein, 28 aa, Mycobacterium
QLLVTPAMLWLFIRGVRFMYSVDPHLPP

SEQ ID NO: 849468 - protein, 17 aa, Mycobacterium
QLLVYPMLDDRSSFVPS

SEQ ID NO: 849469 - protein, 19 aa, Mycobacterium
QLLVYPMLDDRTCLPDPEL

SEQ ID NO: 849470 - protein, 18 aa, Mycobacterium
QLLWAEHQAATPAVRRAL

SEQ ID NO: 849471 - protein, 18 aa, Mycobacterium
QLLWALGSREMSVNDLAA

SEQ ID NO: 849472 - protein, 17 aa, Mycobacterium
QLLYRTGDRARYLPDGN

SEQ ID NO: 849473 - protein, 18 aa, Mycobacterium
QLMAFGATTLYAADRVRC

SEQ ID NO: 849474 - protein, 19 aa, Mycobacterium
QLMALIATNFFGQNTPAIM

SEQ ID NO: 849475 - protein, 20 aa, Mycobacterium
QLMALIATNFLGQNASAIAA

SEQ ID NO: 849476 - protein, 19 aa, Mycobacterium
QLMCVCRACYLLFTDARAE

SEQ ID NO: 849477 - protein, 19 aa, Mycobacterium
QLMCVCRACYLLFTHDHAE

SEQ ID NO: 849478 - protein, 25 aa, Mycobacterium
QLMEANWVKRVLFLADRTALVTQAA

SEQ ID NO: 849479 - protein, 18 aa, Mycobacterium
QLMFNVDAGVVFSAAIGR

SEQ ID NO: 849480 - protein, 20 aa, Mycobacterium
QLMKAALPFGLWVPVLPGTR

SEQ ID NO: 849481 - protein, 18 aa, Mycobacterium
QLMRRSIRQFANEPVPPQ

SEQ ID NO: 849482 - protein, 21 aa, Mycobacterium
QLMSSLFQSFGLSPSSASGLS

SEQ ID NO: 849483 - protein, 23 aa, Mycobacterium
QLMTDIFALAMELGGAISGEHGV

SEQ ID NO: 849484 - protein, 20 aa, Mycobacterium
QLMTDIFSLAMELGGAISGE

SEQ ID NO: 849485 - protein, 19 aa, Mycobacterium
QLMTLYPSMSSEDAWAMIK

SEQ ID NO: 849486 - protein, 20 aa, Mycobacterium
QLMVDLYKRVIDGVADLGFP

SEQ ID NO: 849487 - protein, 25 aa, Mycobacterium
QLMYASLVHGSALQLPPPAGYLDFS

SEQ ID NO: 849488 - protein, 24 aa, Mycobacterium
QLNAALYRIALLQIQHNGPSEAYY

SEQ ID NO: 849489 - protein, 19 aa, Mycobacterium
QLNAIRRLHPALQQLRTIY

SEQ ID NO: 849490 - protein, 25 aa, Mycobacterium
QLNDFCVHLLRSAFATVLVARVDLD

SEQ ID NO: 849491 - protein, 31 aa, Mycobacterium
QLNDLLGVGFARRRVSPKTRYVLVHPGVVNT

SEQ ID NO: 849492 - protein, 18 aa, Mycobacterium
QLNIPPELNILCGLAIGY

SEQ ID NO: 849493 - protein, 22 aa, Mycobacterium
QLNIQISAFQFTPDLTLEAVGA

SEQ ID NO: 849494 - protein, 26 aa, Mycobacterium
QLNIYEPPRFFEAFLRGRAYTEPPDL

SEQ ID NO: 849495 - protein, 17 aa, Mycobacterium
QLNKLINVIKIVELDEG

SEQ ID NO: 849496 - protein, 17 aa, Mycobacterium
QLNLILKGDNSGTVEAL

SEQ ID NO: 849497 - protein, 17 aa, Mycobacterium
QLNLPWNRDFNALVYVL

SEQ ID NO: 849498 - protein, 24 aa, Mycobacterium
QLNPGGWLALQVPGNFGAPSHALM

SEQ ID NO: 849499 - protein, 30 aa, Mycobacterium
QLNTRLLRYFVKRYTLKRGALAFGKMLPVG

SEQ ID NO: 849500 - protein, 26 aa, Mycobacterium
QLPAKLRYAGPFFRYERPQAGRYRQL

SEQ ID NO: 849501 - protein, 21 aa, Mycobacterium
QLPALFDMFQYFNGVTASRRE

SEQ ID NO: 849502 - protein, 24 aa, Mycobacterium
QLPAPGYVVWRAAANHFRLRRIDG

SEQ ID NO: 849503 - protein, 17 aa, Mycobacterium
QLPDDVMKSLWSTARRA

SEQ ID NO: 849504 - protein, 26 aa, Mycobacterium
QLPEAQLDRFLLKLNVPLPPREQEIA

SEQ ID NO: 849505 - protein, 26 aa, Mycobacterium
QLPEAQLDRFLLKLTVPLPPRDQEIA

SEQ ID NO: 849506 - protein, 21 aa, Mycobacterium
QLPEPPALDFALPTHAHWDHV

SEQ ID NO: 849507 - protein, 23 aa, Mycobacterium
QLPGHKVYPWVAKVRHSTPGVGL

SEQ ID NO: 849508 - protein, 20 aa, Mycobacterium
QLPGLPRSWLLTKHADVRLV

SEQ ID NO: 849509 - protein, 24 aa, Mycobacterium
QLPGQPRIRRRSERRGLLMTHMLP

SEQ ID NO: 849510 - protein, 23 aa, Mycobacterium
QLPGYGWVFPMGDGIFNIGLGYV

SEQ ID NO: 849511 - protein, 20 aa, Mycobacterium
QLPHGDWVLTRPRLTGICGS

SEQ ID NO: 849512 - protein, 17 aa, Mycobacterium
QLPKMRAIVGFAAETGD

SEQ ID NO: 849513 - protein, 18 aa, Mycobacterium
QLPKPLQDLADNLWAMHN

SEQ ID NO: 849514 - protein, 20 aa, Mycobacterium
QLPKTAILGLLAIAVFAPEN

SEQ ID NO: 849515 - protein, 19 aa, Mycobacterium
QLPLACVLEGGTWAAGRAS

SEQ ID NO: 849516 - protein, 28 aa, Mycobacterium
QLPNSARFCVALFGLLRAGAIPVMCLPG

SEQ ID NO: 849517 - protein, 18 aa, Mycobacterium
QLPQPILRNHELAKLINL

SEQ ID NO: 849518 - protein, 19 aa, Mycobacterium
QLPQYFLDLRDERCQSAIA

SEQ ID NO: 849519 - protein, 18 aa, Mycobacterium
QLPRDTSLVTILRGPRVI

SEQ ID NO: 849520 - protein, 32 aa, Mycobacterium
QLPRQLLRSWYMFYFQLPLLPERSARWILPLL

SEQ ID NO: 849521 - protein, 23 aa, Mycobacterium
QLPSMFADVRRELAVKAVAQAAT

SEQ ID NO: 849522 - protein, 27 aa, Mycobacterium
QLPSMFADVRRELAVRAVARAATVTDS

SEQ ID NO: 849523 - protein, 25 aa, Mycobacterium
QLPTDAWLADLGSYPLRDLPRPERV

SEQ ID NO: 849524 - protein, 22 aa, Mycobacterium
QLPVETLRRAMTDRPLHHFPTR

SEQ ID NO: 849525 - protein, 17 aa, Mycobacterium
QLPVKMVVFNNGALSFV

SEQ ID NO: 849526 - protein, 17 aa, Mycobacterium
QLPVPTVASAVLDPTQI

SEQ ID NO: 849527 - protein, 18 aa, Mycobacterium
QLPVVCSVRGWAVGFGCN

SEQ ID NO: 849528 - protein, 19 aa, Mycobacterium
QLPVVCTVRGWAVGLGCNL

SEQ ID NO: 849529 - protein, 26 aa, Mycobacterium
QLQAAASAIPAFNLGLGNIGDFNLGN

SEQ ID NO: 849530 - protein, 20 aa, Mycobacterium
QLQDLRRSLLQPPRQLWPQH

SEQ ID NO: 849531 - protein, 20 aa, Mycobacterium
QLQFAGLLGTPIGHPAAAAA

SEQ ID NO: 849532 - protein, 22 aa, Mycobacterium
QLQIHLVGANRLAAAVLPGMLE

SEQ ID NO: 849533 - protein, 25 aa, Mycobacterium
QLQKPTRLLPLFSGPAARPMNGVTV

SEQ ID NO: 849534 - protein, 17 aa, Mycobacterium
QLQKRLAQRRLTLEVSA

SEQ ID NO: 849535 - protein, 20 aa, Mycobacterium
QLQLNVLGVHDLTLAVLPGM

SEQ ID NO: 849536 - protein, 26 aa, Mycobacterium
QLQNKIRAMQVLGARLQAIAEEQAMA

SEQ ID NO: 849537 - protein, 24 aa, Mycobacterium
QLQPGRVVVLPWDKHIAAGGEIHL

SEQ ID NO: 849538 - protein, 17 aa, Mycobacterium
QLQQLPPELPRGFKHRP

SEQ ID NO: 849539 - protein, 25 aa, Mycobacterium
QLQQMVLPLCAKAFGTSPTAGVVTF

SEQ ID NO: 849540 - protein, 24 aa, Mycobacterium
QLQQSGLDWTLFFRRLAGAARGDA

SEQ ID NO: 849541 - protein, 28 aa, Mycobacterium
QLQRAENTWLAKLPADFFDLIMFDEGHH

SEQ ID NO: 849542 - protein, 18 aa, Mycobacterium
QLQSVYAPLAESIRRLID

SEQ ID NO: 849543 - protein, 21 aa, Mycobacterium
QLQTRFPTIAALLDWVLPLHD

SEQ ID NO: 849544 - protein, 26 aa, Mycobacterium
QLQVPLPVASLLRDRFLTLVATGGAD

SEQ ID NO: 849545 - protein, 19 aa, Mycobacterium
QLRADLLRPWANWITPEAE

SEQ ID NO: 849546 - protein, 19 aa, Mycobacterium
QLRALPDGLTYGLLRYLNP

SEQ ID NO: 849547 - protein, 29 aa, Mycobacterium
QLRALPDGLTYGLLRYLNPGVDLTGPEPT

SEQ ID NO: 849548 - protein, 25 aa, Mycobacterium
QLRALPDPLTYGLLRYLNPEVDLGA

SEQ ID NO: 849549 - protein, 24 aa, Mycobacterium
QLRARLVELIPESAFRDSPVRFVG

SEQ ID NO: 849550 - protein, 17 aa, Mycobacterium
QLRARSWWSGPDVVLLV

SEQ ID NO: 849551 - protein, 20 aa, Mycobacterium
QLRAVFMDFLTYLRSPEATT

SEQ ID NO: 849552 - protein, 23 aa, Mycobacterium
QLRDEGFGRVWISQLPYEPDLLT

SEQ ID NO: 849553 - protein, 29 aa, Mycobacterium
QLRDKIKNLRLPLLILHSPTDNTVGIENA

SEQ ID NO: 849554 - protein, 17 aa, Mycobacterium
QLRDLFLSDGPTAMETI

SEQ ID NO: 849555 - protein, 21 aa, Mycobacterium
QLRDMGLFGLMIPEEYGGLGE

SEQ ID NO: 849556 - protein, 24 aa, Mycobacterium
QLRDTHIELERLVHALPAGPNQRD

SEQ ID NO: 849557 - protein, 27 aa, Mycobacterium
QLREVARILGPLLPAAHRDALSDTSDR

SEQ ID NO: 849558 - protein, 22 aa, Mycobacterium
QLRFEAFLVGVGRRQPDDPERL

SEQ ID NO: 849559 - protein, 17 aa, Mycobacterium
QLRGLVSRMFTPRSIAA

SEQ ID NO: 849560 - protein, 25 aa, Mycobacterium
QLRGRVERMHRACLILTFGGGTNEV

SEQ ID NO: 849561 - protein, 20 aa, Mycobacterium
QLRIRELLNRIGERVDGVDV

SEQ ID NO: 849562 - protein, 18 aa, Mycobacterium
QLRLLLRDVFISAGGTHD

SEQ ID NO: 849563 - protein, 26 aa, Mycobacterium
QLRLQRPIMFDPYRRNRTTGSFILVD

SEQ ID NO: 849564 - protein, 17 aa, Mycobacterium
QLRLSMIAELRQLQQSL

SEQ ID NO: 849565 - protein, 17 aa, Mycobacterium
QLRNRRRRVAGRPGQNR

SEQ ID NO: 849566 - protein, 28 aa, Mycobacterium
QLRNSWYIMFFQLPELPERLLPRVIPRL

SEQ ID NO: 849567 - protein, 33 aa, Mycobacterium
QLRNYLADKVVRWWLPERWTFVDEIPRTSVGKY

SEQ ID NO: 849568 - protein, 24 aa, Mycobacterium
QLRTYVRVPYRARVPMTRAALMHR

SEQ ID NO: 849569 - protein, 23 aa, Mycobacterium
QLRVFQRSPAYTLPWRVHRFEAG

SEQ ID NO: 849570 - protein, 21 aa, Mycobacterium
QLRWATEKLARYERMRIRMLA

SEQ ID NO: 849571 - protein, 17 aa, Mycobacterium
QLRWLRRSGRDYELGMR

SEQ ID NO: 849572 - protein, 18 aa, Mycobacterium
QLRWLRRSGRDYELGMRL

SEQ ID NO: 849573 - protein, 20 aa, Mycobacterium
QLSALFRTRRFRVYTTDDVI

SEQ ID NO: 849574 - protein, 28 aa, Mycobacterium
QLSAQAITFHEQFVRALSSAGGAYAAAE

SEQ ID NO: 849575 - protein, 20 aa, Mycobacterium
QLSDFPLVPVRVDSWEGLVF

SEQ ID NO: 849576 - protein, 23 aa, Mycobacterium
QLSDLQVVLGTYPITPASDILHE

SEQ ID NO: 849577 - protein, 19 aa, Mycobacterium
QLSEKILFEEIGPGQLVTV

SEQ ID NO: 849578 - protein, 23 aa, Mycobacterium
QLSELLLMMGDTTRQLQKFPSIA

SEQ ID NO: 849579 - protein, 28 aa, Mycobacterium
QLSENGWRTFFRGLANDGVQGPSVANYM

SEQ ID NO: 849580 - protein, 18 aa, Mycobacterium
QLSGGFARYSVDPYWVVP

SEQ ID NO: 849581 - protein, 30 aa, Mycobacterium
QLSQREAWPVLRRNLSVLALRGADPRELLT

SEQ ID NO: 849582 - protein, 20 aa, Mycobacterium
QLSRAIHGIATFPKLGGAAG

SEQ ID NO: 849583 - protein, 18 aa, Mycobacterium
QLSRRGFIGAGIASGLAL

SEQ ID NO: 849584 - protein, 28 aa, Mycobacterium
QLSTITPRFLLHLLSWVPVEAGIYRVNR

SEQ ID NO: 849585 - protein, 22 aa, Mycobacterium
QLSVVITRQFFRNATAEIEEAV

SEQ ID NO: 849586 - protein, 27 aa, Mycobacterium
QLTAEKYLELLLNAVIRGLLTAAQAGR

SEQ ID NO: 849587 - protein, 19 aa, Mycobacterium
QLTAFTAQLPFTLDDFQVR

SEQ ID NO: 849588 - protein, 25 aa, Mycobacterium
QLTANPFVLYPSYREIAHLPLAERV

SEQ ID NO: 849589 - protein, 18 aa, Mycobacterium
QLTDLFDALDKPGGAAAN

SEQ ID NO: 849590 - protein, 19 aa, Mycobacterium
QLTDLLAPRDPHDADDIVL

SEQ ID NO: 849591 - protein, 18 aa, Mycobacterium
QLTDMRDLAPAVARLRHL

SEQ ID NO: 849592 - protein, 17 aa, Mycobacterium
QLTEIVHAYFPKGWQMA

SEQ ID NO: 849593 - protein, 25 aa, Mycobacterium
QLTKAMDRKVWLPSGGTLVIDRTEA

SEQ ID NO: 849594 - protein, 23 aa, Mycobacterium
QLTKFYGRQFDRIGNVDGKYLAI

SEQ ID NO: 849595 - protein, 23 aa, Mycobacterium
QLTKGAMYFHFKSKHALAVELID

SEQ ID NO: 849596 - protein, 21 aa, Mycobacterium
QLTKRIRLNVPLVSSAMDTVT

SEQ ID NO: 849597 - protein, 21 aa, Mycobacterium
QLTLRLYRGPNLDPAESGSPL

SEQ ID NO: 849598 - protein, 26 aa, Mycobacterium
QLTLSPFTAIALSKWSALSPTGRCNS

SEQ ID NO: 849599 - protein, 19 aa, Mycobacterium
QLTPQHYAFLVSEDDFDAI

SEQ ID NO: 849600 - protein, 25 aa, Mycobacterium
QLTQAGWVGVRWRNLTGGIVALHAG

SEQ ID NO: 849601 - protein, 17 aa, Mycobacterium
QLTRLYELPIPVIAAVN

SEQ ID NO: 849602 - protein, 26 aa, Mycobacterium
QLTSLVHAWHRLDPWPDVRDGLELLR

SEQ ID NO: 849603 - protein, 21 aa, Mycobacterium
QLTTKIRLKVPLVSSAMDTVT

SEQ ID NO: 849604 - protein, 17 aa, Mycobacterium
QLVALPTPSTPGLTNTG

SEQ ID NO: 849605 - protein, 28 aa, Mycobacterium
QLVDDVAPWEQLKLRVLNAAHSTLAYLG

SEQ ID NO: 849606 - protein, 25 aa, Mycobacterium
QLVDLLGAFRRGGSWRRIGLMDCGE

SEQ ID NO: 849607 - protein, 33 aa, Mycobacterium
QLVDRVKTWLQFPQWFYLNIPVNTMVAPRLTPG

SEQ ID NO: 849608 - protein, 22 aa, Mycobacterium
QLVEAPLPTWTHRSLLLNRAGH

SEQ ID NO: 849609 - protein, 19 aa, Mycobacterium
QLVEGLPVATAPRVIEDLA

SEQ ID NO: 849610 - protein, 20 aa, Mycobacterium
QLVEQFLTQFYGEQAELGSA

SEQ ID NO: 849611 - protein, 20 aa, Mycobacterium
QLVGALKVRLAPAKAVAKIT

SEQ ID NO: 849612 - protein, 18 aa, Mycobacterium
QLVGCYRMLPPPGAIAAG

SEQ ID NO: 849613 - protein, 21 aa, Mycobacterium
QLVGLGIMRYGIRSEPLHSMS

SEQ ID NO: 849614 - protein, 22 aa, Mycobacterium
QLVGRAVDLVQLFPAAAYGKNG

SEQ ID NO: 849615 - protein, 23 aa, Mycobacterium
QLVGYPIIGLIEPLDVVNYVRRL

SEQ ID NO: 849616 - protein, 18 aa, Mycobacterium
QLVGYPIVQLAEPIDVVN

SEQ ID NO: 849617 - protein, 19 aa, Mycobacterium
QLVLRYHKDRGLPAVAMCV

SEQ ID NO: 849618 - protein, 33 aa, Mycobacterium; identical to SEQ ID NO: 116862

SEQ ID NO: 849619 - protein, 33 aa, Mycobacterium
QLVNRVKTWLQFPQWFYLDLPVNTMVAPRLTPG

SEQ ID NO: 849620 - protein, 33 aa, Mycobacterium
QLVNRVKTWLQFPQWFYLNIPVNTMVAPRLTPG

SEQ ID NO: 849621 - protein, 29 aa, Mycobacterium
QLVNSDPYGAGWLVDVRVSDVSALESAIS

SEQ ID NO: 849622 - protein, 25 aa, Mycobacterium
QLVQQVLHRMLLGPLLRGADPTPPA

SEQ ID NO: 849623 - protein, 29 aa, Mycobacterium
QLVQRVKTWLQFPQWFYNDSPPNTMVAPR

SEQ ID NO: 849624 - protein, 31 aa, Mycobacterium
QLVQRVKTWLQFPQWFYNNLPVNTMVAPRLT

SEQ ID NO: 849625 - protein, 42 aa, Mycobacterium
QLVRAGGPPWFAVSPLMHAAGMWTAFAALLHGLTVVMYDDRN

SEQ ID NO: 849626 - protein, 29 aa, Mycobacterium
QLVRALPTALWTGWALRLSPPALAHSSSR

SEQ ID NO: 849627 - protein, 21 aa, Mycobacterium
QLVRTLVRQLLPTGAVGLPDI

SEQ ID NO: 849628 - protein, 20 aa, Mycobacterium
QLVSLPGYPFARQRHWVEPK

SEQ ID NO: 849629 - protein, 21 aa, Mycobacterium
QLVSVLPLRRMLPVGDGHPVL

SEQ ID NO: 849630 - protein, 20 aa, Mycobacterium
QLVVPVLNARFALNAANARW

SEQ ID NO: 849631 - protein, 21 aa, Mycobacterium
QLVVPVLNARFALNAANARWG

SEQ ID NO: 849632 - protein, 29 aa, Mycobacterium
QLVVSPAMLLLWIRGVRFLYSLDPYLPPG

SEQ ID NO: 849633 - protein, 17 aa, Mycobacterium
QLWHFGLQPDDAAAFVG

SEQ ID NO: 849634 - protein, 17 aa, Mycobacterium
QLWNTADAYRPLYAHLM

SEQ ID NO: 849635 - protein, 20 aa, Mycobacterium
QLWQIVEFQHVKPGKGPAFV

SEQ ID NO: 849636 - protein, 22 aa, Mycobacterium
QLWQTYLGRRSCKTIDSERTCP

SEQ ID NO: 849637 - protein, 34 aa, Mycobacterium
QLWRELRCPLIHYRMVLLQSFIGRNGWHRRIVMG

SEQ ID NO: 849638 - protein, 23 aa, Mycobacterium
QLWSTLMQRWISLTTAAIKAERG

SEQ ID NO: 849639 - protein, 20 aa, Mycobacterium
QLWVAGTRPFGPTCVVVRET

SEQ ID NO: 849640 - protein, 25 aa, Mycobacterium
QLWVTDLTFVPTWAGVAYVCFIVDA

SEQ ID NO: 849641 - protein, 20 aa, Mycobacterium
QLWWNKEFCRIVVIDGQHRA

SEQ ID NO: 849642 - protein, 19 aa, Mycobacterium
QLYLDTLADWPHDELKLPD

SEQ ID NO: 849643 - protein, 17 aa, Mycobacterium
QLYPLLAHVVLFGGGHV

SEQ ID NO: 849644 - protein, 21 aa, Mycobacterium
QLYTALLGRLRELGYRTVLAV

SEQ ID NO: 849645 - protein, 24 aa, Mycobacterium
QMAGRWRVKHPDLAALHRQAADLA

SEQ ID NO: 849646 - protein, 25 aa, Mycobacterium
QMAGVFPFGALAPLVSGDLSAARRW

SEQ ID NO: 849647 - protein, 19 aa, Mycobacterium
QMDQYFSRFGGVRDYLMAV

SEQ ID NO: 849648 - protein, 22 aa, Mycobacterium
QMDTYDLVLTPRWTWHDHENAT

SEQ ID NO: 849649 - protein, 24 aa, Mycobacterium
QMECWLPELVTYEKVGAWAITEPD

SEQ ID NO: 849650 - protein, 17 aa, Mycobacterium
QMELVGGTLICLVRADS

SEQ ID NO: 849651 - protein, 22 aa, Mycobacterium
QMEQYFARFGGVRDYLMAVVEQ

SEQ ID NO: 849652 - protein, 24 aa, Mycobacterium
QMERFSVDALLNMAAKAGLHIELT

SEQ ID NO: 849653 - protein, 17 aa, Mycobacterium
QMFFFSAATYNGHRIHY

SEQ ID NO: 849654 - protein, 24 aa, Mycobacterium
QMGKDGWLTLNWPKEYGGQDRSPM

SEQ ID NO: 849655 - protein, 18 aa, Mycobacterium
QMGLVMKAATAIAAGKAD

SEQ ID NO: 849656 - protein, 22 aa, Mycobacterium
QMHTPIPTRIEIPSAAIALADR

SEQ ID NO: 849657 - protein, 29 aa, Mycobacterium
QMIDFMATRTAFFDEFFLGAADTGVRQVV

SEQ ID NO: 849658 - protein, 21 aa, Mycobacterium
QMIDWWGPIIDEYYASSEAHG

SEQ ID NO: 849659 - protein, 25 aa, Mycobacterium
QMIKQPLWFQRAQVAALMLADAVTA

SEQ ID NO: 849660 - protein, 17 aa, Mycobacterium
QMILGHLGEMLPFAAHR

SEQ ID NO: 849661 - protein, 18 aa, Mycobacterium
QMKALFGEGLHPNADAIT

SEQ ID NO: 849662 - protein, 24 aa, Mycobacterium
QMKQMGLFGLMIPEEYGGLGESLL

SEQ ID NO: 849663 - protein, 23 aa, Mycobacterium
QMKRLRRVLVTYPDITFGRYTGE

SEQ ID NO: 849664 - protein, 17 aa, Mycobacterium
QMLAAALEAEVGLYRAV

SEQ ID NO: 849665 - protein, 25 aa, Mycobacterium
QMLAEKIDIGSMGDYPLLINGSKTQ

SEQ ID NO: 849666 - protein, 19 aa, Mycobacterium
QMLAIGRALMARPKILLLD

SEQ ID NO: 849667 - protein, 19 aa, Mycobacterium
QMLAIGRALMARPKVLLLD

SEQ ID NO: 849668 - protein, 20 aa, Mycobacterium
QMLAYNCSPSFNWKKHLDDA

SEQ ID NO: 849669 - protein, 23 aa, Mycobacterium
QMLAYNCSPSFNWKKHLDDETIA

SEQ ID NO: 849670 - protein, 17 aa, Mycobacterium
QMLDLYKRVIDGVIDLG

SEQ ID NO: 849671 - protein, 18 aa, Mycobacterium
QMLDTAVLLGALPTRVAG

SEQ ID NO: 849672 - protein, 17 aa, Mycobacterium
QMLGHIEVPYRVIDVAA

SEQ ID NO: 849673 - protein, 17 aa, Mycobacterium
QMLLLNPVGIDASENRE

SEQ ID NO: 849674 - protein, 20 aa, Mycobacterium
QMLTAAAADLAKIGAAIDTV

SEQ ID NO: 849675 - protein, 18 aa, Mycobacterium
QMLVKLCLKDGIPLINIV

SEQ ID NO: 849676 - protein, 18 aa, Mycobacterium
QMMAKLRTGQPLGPVPLV

SEQ ID NO: 849677 - protein, 28 aa, Mycobacterium
QMMDQLMNWRYTFGGVVRIGGVATDAYM

SEQ ID NO: 849678 - protein, 20 aa, Mycobacterium
QMMDWWGPIIDEYYASSEAI

SEQ ID NO: 849679 - protein, 31 aa, Mycobacterium
QMMQAPMQMMQPLQSMMGMFANPGAMGGAAT

SEQ ID NO: 849680 - protein, 17 aa, Mycobacterium
QMMSDPQLTGYFANFMV

SEQ ID NO: 849681 - protein, 28 aa, Mycobacterium
QMNHDDWRWVIDIDLWGSIHAVEAFVPR

SEQ ID NO: 849682 - protein, 21 aa, Mycobacterium
QMNTAFRNIVTMLNGVRDGLI

SEQ ID NO: 849683 - protein, 19 aa, Mycobacterium
QMPPLRPSAWQMTNDGVAY

SEQ ID NO: 849684 - protein, 25 aa, Mycobacterium
QMQIKAIFSVLLRDFEFEMAQPSES

SEQ ID NO: 849685 - protein, 25 aa, Mycobacterium
QMQIKAIFSVLLREYDFEMAQPADS

SEQ ID NO: 849686 - protein, 24 aa, Mycobacterium
QMQIKAIFSVLLREYEFEMAQPAE

SEQ ID NO: 849687 - protein, 27 aa, Mycobacterium
QMQTAAPDFRLFWDNAYMVHTLTPDFI

SEQ ID NO: 849688 - protein, 24 aa, Mycobacterium
QMRFRQLCLVGWPTVLQRIDELLH

SEQ ID NO: 849689 - protein, 26 aa, Mycobacterium
QMRLFAKYVIPAFPDVLASRPTLNAS

SEQ ID NO: 849690 - protein, 19 aa, Mycobacterium
QMRLTFARSLINDPELLFL

SEQ ID NO: 849691 - protein, 21 aa, Mycobacterium
QMRLTFARSLINKPELLFLDE

SEQ ID NO: 849692 - protein, 23 aa, Mycobacterium
QMRNFWATLMLSQGTPMILHGDE

SEQ ID NO: 849693 - protein, 19 aa, Mycobacterium
QMRPHLLSVAYRLTGTVAD

SEQ ID NO: 849694 - protein, 19 aa, Mycobacterium
QMRTAAPDFRLFWDNAYAV

SEQ ID NO: 849695 - protein, 27 aa, Mycobacterium
QMSAAQLRQWFQFRIDGPNPVNNVPFA

SEQ ID NO: 849696 - protein, 22 aa, Mycobacterium
QMSGRWKVKHPDLITLYQQAVT

SEQ ID NO: 849697 - protein, 17 aa, Mycobacterium
QMSLLPELPTSPAESFT

SEQ ID NO: 849698 - protein, 26 aa, Mycobacterium
QMSTIQLDFNFPERFGLEYTAADGTR

SEQ ID NO: 849699 - protein, 17 aa, Mycobacterium
QMTAPLLTAAVVLVFSV

SEQ ID NO: 849700 - protein, 18 aa, Mycobacterium
QMTMRVFTGLTLLDTIQG

SEQ ID NO: 849701 - protein, 26 aa, Mycobacterium
QMTVPPGYVMLLRTLGGMIGVLVQLD

SEQ ID NO: 849702 - protein, 17 aa, Mycobacterium
QMTWLDEDSPSALKPGT

SEQ ID NO: 849703 - protein, 32 aa, Mycobacterium
QMVDAGLPLTLWLARFLKFIQTEIFPGGHPPT

SEQ ID NO: 849704 - protein, 28 aa, Mycobacterium
QMVEDISQLVYLHLRFHGYGDGKWTDSA

SEQ ID NO: 849705 - protein, 28 aa, Mycobacterium
QMVEDVSQLVYLHLRFHGYGDGKWTDSA

SEQ ID NO: 849706 - protein, 25 aa, Mycobacterium
QMVEWAKALVVPGKRRILGLTGAPA

SEQ ID NO: 849707 - protein, 25 aa, Mycobacterium
QMVTVVLFRDGVAMRYFPIAAKGAT

SEQ ID NO: 849708 - protein, 17 aa, Mycobacterium
QMWTINLPQVGNAITGS

SEQ ID NO: 849709 - protein, 26 aa, Mycobacterium
QNAAPADLFMLIYTSGTSGDPKAVKC

SEQ ID NO: 849710 - protein, 21 aa, Mycobacterium
QNAFMNILSQGTRFKPDKAKE

SEQ ID NO: 849711 - protein, 24 aa, Mycobacterium
QNAHWRPEHYYAPGTQITAEAQIY

SEQ ID NO: 849712 - protein, 27 aa, Mycobacterium
QNAKQRLRECWLWSRAYTISGGSSEMM

SEQ ID NO: 849713 - protein, 34 aa, Mycobacterium
QNALGWDRGALLPKLVRMFGTMAVPMTLAHEYGH

SEQ ID NO: 849714 - protein, 21 aa, Mycobacterium
QNAMMLQQKIAERTKLLSQLE

SEQ ID NO: 849715 - protein, 21 aa, Mycobacterium
QNAMVLQQKIAERTKLLSQLE

SEQ ID NO: 849716 - protein, 19 aa, Mycobacterium
QNANLLRRLDATVQIRLTG

SEQ ID NO: 849717 - protein, 24 aa, Mycobacterium
QNAQLLTPHLIAAGIDLLVIHGTI

SEQ ID NO: 849718 - protein, 25 aa, Mycobacterium
QNATKPWLLYYSTGATHAPHHVFKE

SEQ ID NO: 849719 - protein, 22 aa, Mycobacterium
QNAWVNPIMWDAFMGWVGVDQY

SEQ ID NO: 849720 - protein, 23 aa, Mycobacterium
QNAWVNPIMWNAFMGWIGVDQYD

SEQ ID NO: 849721 - protein, 22 aa, Mycobacterium
QNCSLICPFVVQGAVQIPASVL

SEQ ID NO: 849722 - protein, 17 aa, Mycobacterium
QNDFCAKGGWLDHIGVD

SEQ ID NO: 849723 - protein, 26 aa, Mycobacterium
QNDMDTLLMLLAAAGVAFVITVPGAD

SEQ ID NO: 849724 - protein, 23 aa, Mycobacterium
QNDSVRLLGLLRELRDDGAAVVL

SEQ ID NO: 849725 - protein, 25 aa, Mycobacterium
QNDTRYAVFPAARRLAVQMRGVTRV

SEQ ID NO: 849726 - protein, 20 aa, Mycobacterium
QNFLFLSRRLIGANTSRGSV

SEQ ID NO: 849727 - protein, 20 aa, Mycobacterium
QNFLFLSRRLIGANTTRGAV

SEQ ID NO: 849728 - protein, 21 aa, Mycobacterium
QNGGDGGLLWGNGGAGGVGTA

SEQ ID NO: 849729 - protein, 18 aa, Mycobacterium
QNGLMGYVLAELGFRVRR

SEQ ID NO: 849730 - protein, 25 aa, Mycobacterium
QNGLNPFMTRVLLDAGIPSTCAVET

SEQ ID NO: 849731 - protein, 19 aa, Mycobacterium
QNGLPFLARFAFGRRVAVL

SEQ ID NO: 849732 - protein, 18 aa, Mycobacterium
QNGRGVFVLAATSNPEGA

SEQ ID NO: 849733 - protein, 18 aa, Mycobacterium
QNGVLPQSLHFDNPSPHI

SEQ ID NO: 849734 - protein, 26 aa, Mycobacterium
QNGVWAIFSTLDPRVLQFKPGLLLNR

SEQ ID NO: 849735 - protein, 24 aa, Mycobacterium
QNHAQLAMYQLAVAAGLLDDGDEP

SEQ ID NO: 849736 - protein, 23 aa, Mycobacterium
QNHGPAFAALTRILRRPDGSVET

SEQ ID NO: 849737 - protein, 18 aa, Mycobacterium
QNHLLQVLALVTMEPPVG

SEQ ID NO: 849738 - protein, 26 aa, Mycobacterium
QNHTSYLDWLPTLLAVRERGRRAYFM

SEQ ID NO: 849739 - protein, 23 aa, Mycobacterium
QNHTSYLDWLPTLMAVRERRRRA

SEQ ID NO: 849740 - protein, 20 aa, Mycobacterium
QNHVVFMDLPIVFDLDIAMR

SEQ ID NO: 849741 - protein, 20 aa, Mycobacterium
QNIAFPLTLAKMKKADIAQK

SEQ ID NO: 849742 - protein, 20 aa, Mycobacterium
QNIAFPLTLAKMKKAEIAKK

SEQ ID NO: 849743 - protein, 24 aa, Mycobacterium
QNILGLDIKGHIVKKLLVAEASDI

SEQ ID NO: 849744 - protein, 23 aa, Mycobacterium
QNIREAMRVADRMYVLVGGRNRF

SEQ ID NO: 849745 - protein, 19 aa, Mycobacterium
QNISAILISPPQAPAKAQW

SEQ ID NO: 849746 - protein, 22 aa, Mycobacterium
QNIVGQRYLGLSLGREGSPELP

SEQ ID NO: 849747 - protein, 18 aa, Mycobacterium
QNIYSDFLRDSGPGLHHI

SEQ ID NO: 849748 - protein, 22 aa, Mycobacterium
QNKARAMQVLAARLQALAEEQA

SEQ ID NO: 849749 - protein, 28 aa, Mycobacterium
QNKPDFPPTLMGRLLLDALTGSGVTPWI

SEQ ID NO: 849750 - protein, 24 aa, Mycobacterium
QNLEHTVLGIFRHISRPTYDDAAR

SEQ ID NO: 849751 - protein, 20 aa, Mycobacterium
QNLEQSLLAVINAPSQALTG

SEQ ID NO: 849752 - protein, 27 aa, Mycobacterium
QNLFGEESLFINFGYWRDHPTTLDEAS

SEQ ID NO: 849753 - protein, 30 aa, Mycobacterium
QNLQEWLQALFPFNPFSPQGWSMHPSLSMF

SEQ ID NO: 849754 - protein, 21 aa, Mycobacterium
QNLQFCNCVLNYDLPWNPMRI

SEQ ID NO: 849755 - protein, 24 aa, Mycobacterium
QNLRDLPFTLTYLFDDDGSAHLAG

SEQ ID NO: 849756 - protein, 25 aa, Mycobacterium
QNLTQFYHPLDMFGEWNRAYGPAGF

SEQ ID NO: 849757 - protein, 29 aa, Mycobacterium
QNMEINVTGVFRYTDTWPAAIHLVSSGAV

SEQ ID NO: 849758 - protein, 24 aa, Mycobacterium
QNPESPVLVLSHYVEERYAADLIA

SEQ ID NO: 849759 - protein, 24 aa, Mycobacterium
QNPESPVLVLSHYVEERYASDLIA

SEQ ID NO: 849760 - protein, 17 aa, Mycobacterium
QNPEYCWTFLDPADHRH

SEQ ID NO: 849761 - protein, 18 aa, Mycobacterium
QNPIIPILREHEVGFITA

SEQ ID NO: 849762 - protein, 28 aa, Mycobacterium
QNPYTTTPGKRFLWYRGRQLGGRLHTWS

SEQ ID NO: 849763 - protein, 19 aa, Mycobacterium
QNQFNTLKRRYVWDGPNLG

SEQ ID NO: 849764 - protein, 28 aa, Mycobacterium
QNRAHPRHIPLQRLPLPRPTAAVSLRQA

SEQ ID NO: 849765 - protein, 21 aa, Mycobacterium
QNRAQRWADVVSLLTPVVTDE

SEQ ID NO: 849766 - protein, 18 aa, Mycobacterium
QNRCLLYHLIGGGNGDWD

SEQ ID NO: 849767 - protein, 19 aa, Mycobacterium
QNRIFTTPVITLPIVEKAI

SEQ ID NO: 849768 - protein, 20 aa, Mycobacterium
QNRIFTTPVITLPIVEKAIE

SEQ ID NO: 849769 - protein, 19 aa, Mycobacterium
QNRLFAEAFRVLRPGGVFA

SEQ ID NO: 849770 - protein, 26 aa, Mycobacterium
QNRSQFVSLVRSNLFGFNAPAIAAVE

SEQ ID NO: 849771 - protein, 19 aa, Mycobacterium
QNRWHYFHQKAVANGLLAP

SEQ ID NO: 849772 - protein, 51 aa, Mycobacterium
QNRWYYFHQRAVVNGLLRPEDVFLPVIPTPFGFGLWTSHTTPIYLGATAVI

SEQ ID NO: 849773 - protein, 24 aa, Mycobacterium
QNSCRFFGWDPFKLTPRDQATAGA

SEQ ID NO: 849774 - protein, 25 aa, Mycobacterium
QNSGHLFYNRRLRAATTRFSVRMKH

SEQ ID NO: 849775 - protein, 24 aa, Mycobacterium
QNSIDIATHAVDKVKEVLIGKDDD

SEQ ID NO: 849776 - protein, 22 aa, Mycobacterium
QNSIVAALRRQLTTQQTQLANL

SEQ ID NO: 849777 - protein, 20 aa, Mycobacterium
QNTLAMMYRVTGMSTHFLSL

SEQ ID NO: 849778 - protein, 23 aa, Mycobacterium
QNTLKILLALNRKIDDTHIVLIE

SEQ ID NO: 849779 - protein, 18 aa, Mycobacterium
QNTWVIFMTDHGPALPRA

SEQ ID NO: 849780 - protein, 17 aa, Mycobacterium
QNVCFLYHVLGGGTGDW

SEQ ID NO: 849781 - protein, 28 aa, Mycobacterium
QNVFLGREIPRPGLLGRFGFMDEKTMRK

SEQ ID NO: 849782 - protein, 21 aa, Mycobacterium
QNVYAYVLDQALKLVPAGVVG

SEQ ID NO: 849783 - protein, 18 aa, Mycobacterium
QNYALYPHLTVAENIAFP

SEQ ID NO: 849784 - protein, 24 aa, Mycobacterium
QNYALYPHMSVYRNLAYGLRQRRT

SEQ ID NO: 849785 - protein, 17 aa, Mycobacterium
QNYLRDIHLIRRGKIDD

SEQ ID NO: 849786 - protein, 27 aa, Mycobacterium
QPAADNPYLWQLLAGRYPGVTVPWLAH

SEQ ID NO: 849787 - protein, 21 aa, Mycobacterium
QPAAPPPPPPPPESPAPTSPA

SEQ ID NO: 849788 - protein, 18 aa, Mycobacterium
QPAARKRVLVMRNTFRKH

SEQ ID NO: 849789 - protein, 24 aa, Mycobacterium
QPAELAPLYVLLASDDASYISGAR

SEQ ID NO: 849790 - protein, 22 aa, Mycobacterium
QPAGLYWYHPHFHTATAHQGWN

SEQ ID NO: 849791 - protein, 24 aa, Mycobacterium
QPAIVITEHFLPEIFICCLNNDIA

SEQ ID NO: 849792 - protein, 18 aa, Mycobacterium
QPAKYRQLLQHILQHVAD

SEQ ID NO: 849793 - protein, 21 aa, Mycobacterium
QPALAVRRLVAVLAAAFSAPP

SEQ ID NO: 849794 - protein, 31 aa, Mycobacterium
QPALFAVELGLARLWQSWGFEPDVVLGHSVG

SEQ ID NO: 849795 - protein, 29 aa, Mycobacterium
QPALFAVELGLARLWQSWGFEPDVVVGHS

SEQ ID NO: 849796 - protein, 26 aa, Mycobacterium
QPALFAVETALYRLAQSWGFQPDFVM

SEQ ID NO: 849797 - protein, 32 aa, Mycobacterium
QPALFAVEVALFAVLRHWGVQPDFVMGHSVGE

SEQ ID NO: 849798 - protein, 17 aa, Mycobacterium
QPALLLEQLDAAASLIP

SEQ ID NO: 849799 - protein, 25 aa, Mycobacterium
QPANAFVMSFLGAVSEINGILVRPH

SEQ ID NO: 849800 - protein, 19 aa, Mycobacterium
QPARLPFWRGDSVGRPAEL

SEQ ID NO: 849801 - protein, 26 aa, Mycobacterium
QPARQRSRLRLVRRHHLGHRDRPHPV

SEQ ID NO: 849802 - protein, 24 aa, Mycobacterium
QPARRPHYFPRPADQRRVIRRKSF

SEQ ID NO: 849803 - protein, 33 aa, Mycobacterium
QPATLARFAQRFARFHLHPRALRPSYGLAEATV

SEQ ID NO: 849804 - protein, 23 aa, Mycobacterium
QPATLPPPAQRLAPGPAPSQLSD

SEQ ID NO: 849805 - protein, 20 aa, Mycobacterium
QPAVLLQHRAWWSHQGGTWA

SEQ ID NO: 849806 - protein, 25 aa, Mycobacterium
QPAWAYSVIALRWAAKYYAAEREFA

SEQ ID NO: 849807 - protein, 29 aa, Mycobacterium
QPDAPRIGGITPFLRFATLASHAGLALAP

SEQ ID NO: 849808 - protein, 28 aa, Mycobacterium
QPDDYFVGGRALIARLLAAAQRHPNSSA

SEQ ID NO: 849809 - protein, 17 aa, Mycobacterium
QPDFRGCMFINTAGELG

SEQ ID NO: 849810 - protein, 23 aa, Mycobacterium
QPDTSIVLYPPNATPGITDEERR

SEQ ID NO: 849811 - protein, 17 aa, Mycobacterium
QPEAYTWLTAELANLRL

SEQ ID NO: 849812 - protein, 29 aa, Mycobacterium
QPEHGVWGGYRLAPGPGLKRNRKELRIIA

SEQ ID NO: 849813 - protein, 25 aa, Mycobacterium
QPEHLIAGYLAALDDAARTGPVVVG

SEQ ID NO: 849814 - protein, 33 aa, Mycobacterium
QPELQSLAQLWSDGLVALLEPRIGPRAARVVSI

SEQ ID NO: 849815 - protein, 26 aa, Mycobacterium
QPEQRRRWGIREVPLHVLVDGVDLRD

SEQ ID NO: 849816 - protein, 24 aa, Mycobacterium
QPEQWGGLQCDPTLFYEATRRLAS

SEQ ID NO: 849817 - protein, 24 aa, Mycobacterium
QPERLRSGWLNGIKHWQVDYHSDS

SEQ ID NO: 849818 - protein, 22 aa, Mycobacterium
QPETAFPHWFARNWRRQAILRY

SEQ ID NO: 849819 - protein, 27 aa, Mycobacterium
QPETRGHEFLQFLAAVRAELTDPLTPV

SEQ ID NO: 849820 - protein, 25 aa, Mycobacterium
QPEYQIEIHLGRPARLTLPELDAAL

SEQ ID NO: 849821 - protein, 20 aa, Mycobacterium
QPFDAEQPLFLLYTSGTTGK

SEQ ID NO: 849822 - protein, 22 aa, Mycobacterium
QPFGIYVHVPFCVTRCGYCDFN

SEQ ID NO: 849823 - protein, 23 aa, Mycobacterium
QPFGRAVPQYGFRPTFVARPPAA

SEQ ID NO: 849824 - protein, 19 aa, Mycobacterium
QPFLRPFIDFGYATGLPGP

SEQ ID NO: 849825 - protein, 18 aa, Mycobacterium
QPFTFTFPSGAVLPSVVV

SEQ ID NO: 849826 - protein, 24 aa, Mycobacterium
QPGALVLFSPLADLTLGLSAERER

SEQ ID NO: 849827 - protein, 26 aa, Mycobacterium
QPGDHHVWFSGPTGTFIKVGYRGNLV

SEQ ID NO: 849828 - protein, 21 aa, Mycobacterium
QPGDILVFEGPRNAFYLGAAE

SEQ ID NO: 849829 - protein, 27 aa, Mycobacterium
QPGDKFFRTTPYLPLSWQRKAVQMIAP

SEQ ID NO: 849830 - protein, 29 aa, Mycobacterium
QPGELVARIPPRWGSLTRELLAVNMVMAG

SEQ ID NO: 849831 - protein, 22 aa, Mycobacterium
QPGIEQILVLLPQGIAQLQGPN

SEQ ID NO: 849832 - protein, 27 aa, Mycobacterium
QPGITGFRRSHAAALVIQRLLGGHPGG

SEQ ID NO: 849833 - protein, 23 aa, Mycobacterium
QPGIVFFRYVLGMPVEDIPLYIE

SEQ ID NO: 849834 - protein, 33 aa, Mycobacterium
QPGMRKLLLQEWLRYGWYFLISRRDPAGLREWI

SEQ ID NO: 849835 - protein, 25 aa, Mycobacterium
QPGPVSVVFLAIDRFKVINSRLGQD

SEQ ID NO: 849836 - protein, 26 aa, Mycobacterium
QPGQAELLTPFTTQYFAAISGVWARR

SEQ ID NO: 849837 - protein, 34 aa, Mycobacterium
QPGTFEGWLHRITTNLFLDMVRRRARIRMEALPE

SEQ ID NO: 849838 - protein, 34 aa, Mycobacterium
QPGTFEGWLHRITTNLFLDMVRRRGRIRMEALPE

SEQ ID NO: 849839 - protein, 28 aa, Mycobacterium
QPGTFEGWLHRITTNLFLDMVRRRSRIR

SEQ ID NO: 849840 - protein, 20 aa, Mycobacterium
QPGTLSCLVNLTNPPKRPAG

SEQ ID NO: 849841 - protein, 23 aa, Mycobacterium
QPGTSIVLYPPTADPAITEEEGK

SEQ ID NO: 849842 - protein, 21 aa, Mycobacterium
QPGVGEYLAPGLPAAFDGAHP

SEQ ID NO: 849843 - protein, 19 aa, Mycobacterium
QPHCRSHVTYKGALQGDPA

SEQ ID NO: 849844 - protein, 20 aa, Mycobacterium
QPHEIESELDWLAALRTDSD

SEQ ID NO: 849845 - protein, 30 aa, Mycobacterium
QPHEPWVAPVAPKAPWIPQASFGVSRFGGN

SEQ ID NO: 849846 - protein, 26 aa, Mycobacterium
QPHHDDLILLFAIRSIANYSAPVFDP

SEQ ID NO: 849847 - protein, 17 aa, Mycobacterium
QPHLADNAAFFAETLPG

SEQ ID NO: 849848 - protein, 30 aa, Mycobacterium
QPIGPTLAITPWNFPLAMGTRKIGPALAAG

SEQ ID NO: 849849 - protein, 21 aa, Mycobacterium
QPIHDLLAAADKYWAAAAPHG

SEQ ID NO: 849850 - protein, 20 aa, Mycobacterium
QPIHTLLTAADRAWASVAGH

SEQ ID NO: 849851 - protein, 20 aa, Mycobacterium
QPIIDLRRRLLPADPRITCL

SEQ ID NO: 849852 - protein, 22 aa, Mycobacterium
QPIRQIFFRFGEVIIEVVGAPD

SEQ ID NO: 849853 - protein, 21 aa, Mycobacterium
QPIRRYHVDAAILFSDIVVPL

SEQ ID NO: 849854 - protein, 25 aa, Mycobacterium
QPIVDAVGMSLPFAPLCQPDCPGLC

SEQ ID NO: 849855 - protein, 26 aa, Mycobacterium
QPKEHFDFFPLTIDVEERMYAAGRIP

SEQ ID NO: 849856 - protein, 27 aa, Mycobacterium
QPKGVVGVISPWNYPMTLTASDSVPAL

SEQ ID NO: 849857 - protein, 23 aa, Mycobacterium
QPKLTFSWRLMPENLSDAGVSWK

SEQ ID NO: 849858 - protein, 23 aa, Mycobacterium
QPKRPPLAPLVPAAALFVRPSIP

SEQ ID NO: 849859 - protein, 22 aa, Mycobacterium
QPKTRIWWGAYLGTDDELLIAG

SEQ ID NO: 849860 - protein, 19 aa, Mycobacterium
QPLALLPEPNPGDLFFDFE

SEQ ID NO: 849861 - protein, 24 aa, Mycobacterium
QPLAYVHPQLPRPSGPSSPSPLLG

SEQ ID NO: 849862 - protein, 19 aa, Mycobacterium
QPLDRGWLDMAFSLPLLGT

SEQ ID NO: 849863 - protein, 17 aa, Mycobacterium
QPLEKLFGTATARPVIP

SEQ ID NO: 849864 - protein, 17 aa, Mycobacterium
QPLFLLYTSGTTGKPKG

SEQ ID NO: 849865 - protein, 19 aa, Mycobacterium
QPLFLLYTSGTTGKPKGIV

SEQ ID NO: 849866 - protein, 21 aa, Mycobacterium
QPLGLIGFWEGQPGRTQADVE

SEQ ID NO: 849867 - protein, 39 aa, Mycobacterium
QPLGPVAIISPFNFPAMVPMWFFPVAIAAGNTVVLKPSE

SEQ ID NO: 849868 - protein, 18 aa, Mycobacterium
QPLIVAATLLAYQELTQR

SEQ ID NO: 849869 - protein, 18 aa, Mycobacterium
QPLKAPDIVLRAVAKLPG

SEQ ID NO: 849870 - protein, 17 aa, Mycobacterium
QPLLIVSSDLHRAYDTA

SEQ ID NO: 849871 - protein, 18 aa, Mycobacterium
QPLMSLPNPDRGDLFFDF

SEQ ID NO: 849872 - protein, 17 aa, Mycobacterium
QPLNPAWDHRFLEIIDG

SEQ ID NO: 849873 - protein, 17 aa, Mycobacterium
QPLNPVWDQRFLEIIDG

SEQ ID NO: 849874 - protein, 30 aa, Mycobacterium
QPLPGQPLDRPFAWALIKLDGADTPLLHAV

SEQ ID NO: 849875 - protein, 24 aa, Mycobacterium
QPLQGCYKIALLSLKGGVGKTTVT

SEQ ID NO: 849876 - protein, 17 aa, Mycobacterium
QPLRVRAAMKPISTVPR

SEQ ID NO: 849877 - protein, 18 aa, Mycobacterium
QPLRVRAAMKPISTVPRA

SEQ ID NO: 849878 - protein, 20 aa, Mycobacterium
QPLRVRAAMKPISTVPRALA

SEQ ID NO: 849879 - protein, 20 aa, Mycobacterium
QPLSWAIMVSLAELWRSVGV

SEQ ID NO: 849880 - protein, 24 aa, Mycobacterium
QPLTVMESLFIPPSGFHVSPVLAY

SEQ ID NO: 849881 - protein, 18 aa, Mycobacterium
QPLVDHPMRFLGGDGPQV

SEQ ID NO: 849882 - protein, 33 aa, Mycobacterium
QPMLATPGFIEMAWQAPIYLIAGGLGVEVEEVR

SEQ ID NO: 849883 - protein, 21 aa, Mycobacterium
QPMRRIVQARTLSPITSMPGR

SEQ ID NO: 849884 - protein, 19 aa, Mycobacterium
QPMRRIVQARTLSPITSVA

SEQ ID NO: 849885 - protein, 19 aa, Mycobacterium
QPNRAFLRNWRDALELPPQ

SEQ ID NO: 849886 - protein, 23 aa, Mycobacterium
QPPAPTLSPRRTTRQLMVRDVGV

SEQ ID NO: 849887 - protein, 20 aa, Mycobacterium
QPPDRWPDALLLLGDQIYAD

SEQ ID NO: 849888 - protein, 20 aa, Mycobacterium
QPPELIPFSGPARKALELTV

SEQ ID NO: 849889 - protein, 18 aa, Mycobacterium
QPPGPQFGPLRRVRAVLA

SEQ ID NO: 849890 - protein, 18 aa, Mycobacterium
QPPIVIPLASGQYNNVVS

SEQ ID NO: 849891 - protein, 17 aa, Mycobacterium
QPPIVVLWASQTGTAEE

SEQ ID NO: 849892 - protein, 18 aa, Mycobacterium
QPPKTVPPLRRPEVRARM

SEQ ID NO: 849893 - protein, 17 aa, Mycobacterium
QPPLALTAVILAGEAFA

SEQ ID NO: 849894 - protein, 26 aa, Mycobacterium
QPPLDETRLHRLQALNPAAYAQLNTA

SEQ ID NO: 849895 - protein, 19 aa, Mycobacterium
QPPMVLLSVEYQPDGRLKD

SEQ ID NO: 849896 - protein, 22 aa, Mycobacterium
QPPQTFIMFSSAAATWGGTRQG

SEQ ID NO: 849897 - protein, 27 aa, Mycobacterium
QPPRGKYDPLPWPQDFDLPPMPTPVEP

SEQ ID NO: 849898 - protein, 26 aa, Mycobacterium
QPPVTIGALYQPKTLELCVPGDFVCS

SEQ ID NO: 849899 - protein, 35 aa, Mycobacterium
QPQAGNLFLSLADRIPFALTAWTVGVLMRLPQRGV

SEQ ID NO: 849900 - protein, 20 aa, Mycobacterium
QPQARYILPSFIEHSSFGVK

SEQ ID NO: 849901 - protein, 29 aa, Mycobacterium
QPQGRTFDLVLFAQSFHWVEPTTALQKVR

SEQ ID NO: 849902 - protein, 19 aa, Mycobacterium
QPQHQLDLGLPPYATPGEL

SEQ ID NO: 849903 - protein, 20 aa, Mycobacterium
QPQLSNFLRKPRNAGLRTYQ

SEQ ID NO: 849904 - protein, 20 aa, Mycobacterium
QPQLVGGQPAQPFAVGGEPH

SEQ ID NO: 849905 - protein, 18 aa, Mycobacterium
QPQPLAYLRERESWFLDI

SEQ ID NO: 849906 - protein, 20 aa, Mycobacterium
QPQQPWWGGPMTALVDEFSD

SEQ ID NO: 849907 - protein, 29 aa, Mycobacterium
QPRALGRAGRWRRWDWVSGCPAGWHTVDA

SEQ ID NO: 849908 - protein, 26 aa, Mycobacterium
QPRDIASLVSYLVSDEAWYITGTAIN

SEQ ID NO: 849909 - protein, 21 aa, Mycobacterium
QPRFPFVARRYAYTGRQKMLQ

SEQ ID NO: 849910 - protein, 20 aa, Mycobacterium
QPRIHALGQRRIDVARQGAQ

SEQ ID NO: 849911 - protein, 26 aa, Mycobacterium
QPRPFGPPGFLFLDPPDHTRLRRLVS

SEQ ID NO: 849912 - protein, 20 aa, Mycobacterium
QPRPLVPAMFSGVLSRLRRT

SEQ ID NO: 849913 - protein, 29 aa, Mycobacterium
QPRRLVRHGHWPQEWYPMRRNAGQPPPFP

SEQ ID NO: 849914 - protein, 28 aa, Mycobacterium
QPRRRLELPTYPFQRRRFWPKTSGIAVD

SEQ ID NO: 849915 - protein, 25 aa, Mycobacterium
QPRSAILTFLAAREAAHHRLFGHVP

SEQ ID NO: 849916 - protein, 27 aa, Mycobacterium
QPRVSPLAYLPVDGKILIVGSYAGGPK

SEQ ID NO: 849917 - protein, 29 aa, Mycobacterium
QPSAWIAEGLLIYLPADAQELLFAGIDAL

SEQ ID NO: 849918 - protein, 22 aa, Mycobacterium
QPSHELLRQFVIQRFMARVFNA

SEQ ID NO: 849919 - protein, 25 aa, Mycobacterium
QPSIALWNLARFAEALLPLLADDAE

SEQ ID NO: 849920 - protein, 22 aa, Mycobacterium
QPSKTVFVFPGQGGQYPAMAAE

SEQ ID NO: 849921 - protein, 17 aa, Mycobacterium
QPSLFHHFTAKQEIFRT

SEQ ID NO: 849922 - protein, 29 aa, Mycobacterium
QPSRRVRLMRWGLVPPWAKAGPDGGLPDT

SEQ ID NO: 849923 - protein, 20 aa, Mycobacterium
QPSTVTALAAREAAIAAGAA

SEQ ID NO: 849924 - protein, 26 aa, Mycobacterium
QPTAAAFIDFLFPGHPGQPQAWTPEE

SEQ ID NO: 849925 - protein, 17 aa, Mycobacterium
QPTAWIAEGLFGYLPPE

SEQ ID NO: 849926 - protein, 18 aa, Mycobacterium
QPTAYVLPLHRGEDGWES

SEQ ID NO: 849927 - protein, 25 aa, Mycobacterium
QPTEPVLALLKITGDWQKFKGLPGA

SEQ ID NO: 849928 - protein, 31 aa, Mycobacterium
QPTEPVLKLLKITGDWQKFKGLPGAEGSLKV

SEQ ID NO: 849929 - protein, 30 aa, Mycobacterium
QPTEPVLQLLKITGDWQKFKGLPGAEGTLK

SEQ ID NO: 849930 - protein, 30 aa, Mycobacterium
QPTGEWIELLPRTNLLPDTRHRFLVSTKDV

SEQ ID NO: 849931 - protein, 20 aa, Mycobacterium
QPTIIGHDGWLAIDRAEIAR

SEQ ID NO: 849932 - protein, 19 aa, Mycobacterium
QPTPFTTIAWRLAHVIVGV

SEQ ID NO: 849933 - protein, 19 aa, Mycobacterium
QPTTLPALLRLLGVQNASA

SEQ ID NO: 849934 - protein, 23 aa, Mycobacterium
QPTTRSFLAQPLRVAIAGDWHSD

SEQ ID NO: 849935 - protein, 27 aa, Mycobacterium
QPTVAAFIDFLFPGQPGQRPAWAPEES

SEQ ID NO: 849936 - protein, 26 aa, Mycobacterium
QPVERLVGEWLLPAAAAGLDAWGVDP

SEQ ID NO: 849937 - protein, 25 aa, Mycobacterium
QPVGFPGIVPVIGGASLPIRNVGPD

SEQ ID NO: 849938 - protein, 28 aa, Mycobacterium
QPVGSPVAWFYDPPWTIPCLRRNEIAVP

SEQ ID NO: 849939 - protein, 19 aa, Mycobacterium
QPVGYPIGGYLGLMGGDPA

SEQ ID NO: 849940 - protein, 23 aa, Mycobacterium
QPVHFVQMWVAPDETGITPSYQQ

SEQ ID NO: 849941 - protein, 21 aa, Mycobacterium
QPVHTVYIPGNRYSATTPAEW

SEQ ID NO: 849942 - protein, 28 aa, Mycobacterium
QPVKAAPDQWPALTAPPATAAPADSAAT

SEQ ID NO: 849943 - protein, 22 aa, Mycobacterium
QPVLFAVMVSLARTLISYGIEP

SEQ ID NO: 849944 - protein, 19 aa, Mycobacterium
QPVLMGVQLALTQLWRSYG

SEQ ID NO: 849945 - protein, 17 aa, Mycobacterium
QPVLPRTAKLPPDFKVV

SEQ ID NO: 849946 - protein, 19 aa, Mycobacterium
QPVLRKWRIFERDDINGEG

SEQ ID NO: 849947 - protein, 23 aa, Mycobacterium
QPVPGRLSLFRTQHGHRRASLGG

SEQ ID NO: 849948 - protein, 17 aa, Mycobacterium
QPVRALISICAAGGQGV

SEQ ID NO: 849949 - protein, 25 aa, Mycobacterium
QPVTGLMGFLGRRQHLVPNTGLRRI

SEQ ID NO: 849950 - protein, 23 aa, Mycobacterium
QPVVFSHLYAIEYWTLMNTKNAK

SEQ ID NO: 849951 - protein, 27 aa, Mycobacterium
QPVVMAPRTTFLPFPQNYRCPFGVGGE

SEQ ID NO: 849952 - protein, 17 aa, Mycobacterium
QPVYRVAAKLRLMADEL

SEQ ID NO: 849953 - protein, 26 aa, Mycobacterium
QPWDRDQIHRLFDDLEFRVLRDRLFD

SEQ ID NO: 849954 - protein, 20 aa, Mycobacterium
QPWHMVFVSGPARDRLVAAM

SEQ ID NO: 849955 - protein, 20 aa, Mycobacterium
QPWHRWESLDALGNYLRSAN

SEQ ID NO: 849956 - protein, 17 aa, Mycobacterium
QPWLTRTAEAALNPLIG

SEQ ID NO: 849957 - protein, 23 aa, Mycobacterium
QPWPGLIEAYRDRLPIEDSWTPI

SEQ ID NO: 849958 - protein, 17 aa, Mycobacterium
QPWRADLLGKRLHRALG

SEQ ID NO: 849959 - protein, 22 aa, Mycobacterium
QPWRADLLGKRLHRALGPLVHV

SEQ ID NO: 849960 - protein, 33 aa, Mycobacterium
QPWTKAHLLQPLQNLFLALTFEWGIALHGVDLG

SEQ ID NO: 849961 - protein, 26 aa, Mycobacterium
QPYGGAWLNSWLDRDLGISGRLSVRD

SEQ ID NO: 849962 - protein, 29 aa, Mycobacterium
QQADTFHAQFVQLLNSGASAYTGAEAANV

SEQ ID NO: 849963 - protein, 23 aa, Mycobacterium
QQAERIIEVLWAPSPTSVFLVAI

SEQ ID NO: 849964 - protein, 20 aa, Mycobacterium
QQALEMGLVWRLCEPDQLDD

SEQ ID NO: 849965 - protein, 26 aa, Mycobacterium
QQANHLIAGLIYSGAIDTGIACGIES

SEQ ID NO: 849966 - protein, 33 aa, Mycobacterium
QQAPNSTLVSYLNKMLWILTGNFAKKGGQHLHS

SEQ ID NO: 849967 - protein, 26 aa, Mycobacterium
QQARRPDLILLDLNLPKYDGRQLLEK

SEQ ID NO: 849968 - protein, 18 aa, Mycobacterium
QQAVRLPDALKRFPVTRV

SEQ ID NO: 849969 - protein, 20 aa, Mycobacterium
QQDAFRIVAFGLTDEQARLT

SEQ ID NO: 849970 - protein, 26 aa, Mycobacterium
QQEGFAARPFLAPAPLAPTGHGVACE

SEQ ID NO: 849971 - protein, 24 aa, Mycobacterium
QQEGRGRPAKRYRLTAAGRAKLEH

SEQ ID NO: 849972 - protein, 17 aa, Mycobacterium
QQEINRVLIERAQEGKF

SEQ ID NO: 849973 - protein, 34 aa, Mycobacterium
QQELDRWLALDPIPRFRRYLQDLGLWSQSLEDRV

SEQ ID NO: 849974 - protein, 22 aa, Mycobacterium
QQELYLTDVISILRGDGRAIHA

SEQ ID NO: 849975 - protein, 24 aa, Mycobacterium
QQEPPAGYPPPPQGGTPPANYRAP

SEQ ID NO: 849976 - protein, 27 aa, Mycobacterium
QQERDLMGTLLLELTFDAPRRLEMLHG

SEQ ID NO: 849977 - protein, 18 aa, Mycobacterium
QQERVLLDLLGEGLTNKQ

SEQ ID NO: 849978 - protein, 26 aa, Mycobacterium
QQEVFGPVLVLLPFDDDDEAVRLAND

SEQ ID NO: 849979 - protein, 20 aa, Mycobacterium
QQEWLPTMLGGHTIGAYSLS

SEQ ID NO: 849980 - protein, 26 aa, Mycobacterium
QQFAPLIDLRWWQERPAERSELYRRL

SEQ ID NO: 849981 - protein, 26 aa, Mycobacterium
QQFINDAPLFLVWVADLGRARRIAER

SEQ ID NO: 849982 - protein, 27 aa, Mycobacterium
QQFLADPRVRPLPPMPACAVAACTRPA

SEQ ID NO: 849983 - protein, 26 aa, Mycobacterium
QQFTPVRRVLLPRFPRRRRRPQCRCG

SEQ ID NO: 849984 - protein, 29 aa, Mycobacterium
QQGKFELSTPIPITILLTQPPPVEGEGMP

SEQ ID NO: 849985 - protein, 26 aa, Mycobacterium
QQGRFQILLLELMGSTLLLLDEPTDN

SEQ ID NO: 849986 - protein, 18 aa, Mycobacterium
QQGRLPLDRFVSERIGIE

SEQ ID NO: 849987 - protein, 18 aa, Mycobacterium
QQGYKPMHSYGVAKLAQL

SEQ ID NO: 849988 - protein, 24 aa, Mycobacterium
QQHAQLAMYQLAVSEGLVAPGGDT

SEQ ID NO: 849989 - protein, 18 aa, Mycobacterium
QQHFFVSCSLQRVLHILE

SEQ ID NO: 849990 - protein, 17 aa, Mycobacterium
QQHLPVRMSAKHWRRWR

SEQ ID NO: 849991 - protein, 22 aa, Mycobacterium
QQIEQRVLWLSTAMIHHANRVR

SEQ ID NO: 849992 - protein, 19 aa, Mycobacterium
QQIFQGVQGIVQSATEGAG

SEQ ID NO: 849993 - protein, 21 aa, Mycobacterium
QQIGSLIRHLVAAPGNRIDQA

SEQ ID NO: 849994 - protein, 24 aa, Mycobacterium
QQIIGAIAFCQPIVTADLCDMLFG

SEQ ID NO: 849995 - protein, 26 aa, Mycobacterium
QQIKDQGLWAIFLDEELGGPGFGQLK

SEQ ID NO: 849996 - protein, 21 aa, Mycobacterium
QQIMDRLLRLQVADDRVGDVR

SEQ ID NO: 849997 - protein, 19 aa, Mycobacterium
QQIQQLVVARRLLGLSSAE

SEQ ID NO: 849998 - protein, 20 aa, Mycobacterium
QQIQQLVVARRLLGLTSAEL

SEQ ID NO: 849999 - protein, 25 aa, Mycobacterium
QQITNPRLTLLGALPTLYDSRTTHS

SEQ ID NO: 850000 - protein, 33 aa, Mycobacterium
QQKVVLAKWMARGIDLLLLDEPTRGLDIGAKGD

SEQ ID NO: 850001 - protein, 30 aa, Mycobacterium
QQLARAELQIVFQTLLRRVPTMELAVPIEE

SEQ ID NO: 850002 - protein, 32 aa, Mycobacterium
QQLARAELQIVYRTLFRRVPTLELAIPVEDVP

SEQ ID NO: 850003 - protein, 21 aa, Mycobacterium
QQLATAWTGDLVKLLAADRAH

SEQ ID NO: 850004 - protein, 29 aa, Mycobacterium
QQLCDEWARRGWLAVRYNLPYRRRRPKGP

SEQ ID NO: 850005 - protein, 20 aa, Mycobacterium
QQLCHLIGRPDLLDDERFVD

SEQ ID NO: 850006 - protein, 27 aa, Mycobacterium
QQLFDTNFFGLVRLTREVLPHLRAQGG

SEQ ID NO: 850007 - protein, 25 aa, Mycobacterium
QQLGADLLAVVARLNRLATQRIQMP

SEQ ID NO: 850008 - protein, 23 aa, Mycobacterium
QQLIEIARILAQDAKVVFFDEPT

SEQ ID NO: 850009 - protein, 32 aa, Mycobacterium
QQLLAAINAPTQTLLGRPLIGNGADGAPGQNG

SEQ ID NO: 850010 - protein, 21 aa, Mycobacterium
QQLLQMLHSRGFTAYFRHLHT

SEQ ID NO: 850011 - protein, 24 aa, Mycobacterium
QQLNPLVWGALTPQIVALNLEYYG

SEQ ID NO: 850012 - protein, 22 aa, Mycobacterium
QQLRAVLVADNPGYWVLHCHNS

SEQ ID NO: 850013 - protein, 21 aa, Mycobacterium
QQLSDLLRRQLHQAAARLCAR

SEQ ID NO: 850014 - protein, 26 aa, Mycobacterium
QQLSTQVGVFSDQFVAALSASASGYS

SEQ ID NO: 850015 - protein, 19 aa, Mycobacterium
QQLVIEVYRPRLSGPVPSE

SEQ ID NO: 850016 - protein, 25 aa, Mycobacterium
QQNFTPPAPRYKTGVLAKYVKLVGS

SEQ ID NO: 850017 - protein, 18 aa, Mycobacterium
QQNGFVDTRIDPEGYPRI

SEQ ID NO: 850018 - protein, 17 aa, Mycobacterium
QQPLAIAIFTRTPDCDP

SEQ ID NO: 850019 - protein, 19 aa, Mycobacterium
QQPLFAQSPLLLGERAAPC

SEQ ID NO: 850020 - protein, 17 aa, Mycobacterium
QQPLWWHSSVMADAVGR

SEQ ID NO: 850021 - protein, 33 aa, Mycobacterium
QQPVGQWVGQRAQLLLGVFDDGPQRRVAGNHLR

SEQ ID NO: 850022 - protein, 20 aa, Mycobacterium
QQQRFLPRMATGECRGAFSM

SEQ ID NO: 850023 - protein, 25 aa, Mycobacterium
QQQRILRRWTNGSPWLFAAPKMNPD

SEQ ID NO: 850024 - protein, 39 aa, Mycobacterium
QQQRVALARALAARPRVLLLDEPFAALDAGLRVRVREDI

SEQ ID NO: 850025 - protein, 21 aa, Mycobacterium
QQQTWVIGGLKDLVVLKSTGS

SEQ ID NO: 850026 - protein, 24 aa, Mycobacterium
QQQVLFCGLWYDDEFVRTPEGWRM

SEQ ID NO: 850027 - protein, 19 aa, Mycobacterium
QQRAPLPVKLYAAASRPPV

SEQ ID NO: 850028 - protein, 26 aa, Mycobacterium
QQRDSTYYATLIMWIGCHADSHEYAR

SEQ ID NO: 850029 - protein, 17 aa, Mycobacterium
QQRFLRSRANTIEGGTS

SEQ ID NO: 850030 - protein, 28 aa, Mycobacterium
QQRIRQRFPHTLAAKLKLLPTPYRNPDG

SEQ ID NO: 850031 - protein, 21 aa, Mycobacterium
QQRIWDPLLSLLAAAQATSTL

SEQ ID NO: 850032 - protein, 33 aa, Mycobacterium
QQRKNQEQFFARLQMVGLFSEPVVREGDNVTDV

SEQ ID NO: 850033 - protein, 22 aa, Mycobacterium
QQRKVPRRLLKAARLGLVDLDK

SEQ ID NO: 850034 - protein, 29 aa, Mycobacterium
QQRLAPRTPLARVFWPGSRIVMTRTEICF

SEQ ID NO: 850035 - protein, 17 aa, Mycobacterium
QQRLARRRVAEAGLSHL

SEQ ID NO: 850036 - protein, 18 aa, Mycobacterium
QQRLLLEVAWEALENAGI

SEQ ID NO: 850037 - protein, 25 aa, Mycobacterium
QQRLNPLAYFNIDGKIYIVGSFGGA

SEQ ID NO: 850038 - protein, 25 aa, Mycobacterium
QQRLVRRIIPLAASMKHKKFFGEAE

SEQ ID NO: 850039 - protein, 17 aa, Mycobacterium
QQRLYRQALELHPQYVL

SEQ ID NO: 850040 - protein, 23 aa, Mycobacterium
QQRNFITTLLLSQGVPMLAHGDE

SEQ ID NO: 850041 - protein, 23 aa, Mycobacterium
QQRNFLTTLLLSQGVPMIGHGDE

SEQ ID NO: 850042 - protein, 25 aa, Mycobacterium
QQRQQSVLPLLKMYEKPQPAIDGSA

SEQ ID NO: 850043 - protein, 24 aa, Mycobacterium
QQRRAQAILRRRTDRLPFDPPARW

SEQ ID NO: 850044 - protein, 21 aa, Mycobacterium
QQRRDMQWICRDGDRAKNHLL

SEQ ID NO: 850045 - protein, 17 aa, Mycobacterium
QQRRYTLLGLSGLGGRY

SEQ ID NO: 850046 - protein, 23 aa, Mycobacterium
QQRSRLYELLRYADYQQFDSSIY

SEQ ID NO: 850047 - protein, 26 aa, Mycobacterium
QQRTPPAFYIWRAFARYSPVLPAGRI

SEQ ID NO: 850048 - protein, 17 aa, Mycobacterium
QQRTVLEGRLEQLRTFE

SEQ ID NO: 850049 - protein, 19 aa, Mycobacterium
QQRTVLEGRLEQLRTFERE

SEQ ID NO: 850050 - protein, 32 aa, Mycobacterium
QQRVALARALAIAPRVLLLDEPLSALDAKVRA

SEQ ID NO: 850051 - protein, 33 aa, Mycobacterium
QQRVALARALAIRPRVLLLDEPLSALDAKVRTQ

SEQ ID NO: 850052 - protein, 42 aa, Mycobacterium
QQRVALARALARQPALMLLDEPFSALDTGLRASTRKAVATLL

SEQ ID NO: 850053 - protein, 35 aa, Mycobacterium
QQRVSPLAYFRIDGKLIIIGSFAGSPVSPAWVHNL

SEQ ID NO: 850054 - protein, 23 aa, Mycobacterium
QQRWLSRHYPGMKPKYLFVGMVH

SEQ ID NO: 850055 - protein, 18 aa, Mycobacterium
QQSADKADWLIGKDILGP

SEQ ID NO: 850056 - protein, 23 aa, Mycobacterium
QQSEKLFRYLKKVAVELDEARAR

SEQ ID NO: 850057 - protein, 23 aa, Mycobacterium
QQSFLHFSPQYVGNPPGLPDVVM

SEQ ID NO: 850058 - protein, 18 aa, Mycobacterium
QQSKMFVDGVWTGGAADA

SEQ ID NO: 850059 - protein, 26 aa, Mycobacterium
QQSKNPVLQLFIEVSMRLTRRFALSS

SEQ ID NO: 850060 - protein, 21 aa, Mycobacterium
QQSMILVPMDTPGVTIIRSTP

SEQ ID NO: 850061 - protein, 22 aa, Mycobacterium
QQSRWIIEPVLRLLDCCQESDG

SEQ ID NO: 850062 - protein, 35 aa, Mycobacterium
QQTLNAINAPFDALTGRPLIGNGTPGAAGSGADGT

SEQ ID NO: 850063 - protein, 28 aa, Mycobacterium
QQTPVSRVLPIWSEWVRRWPTPSATAAA

SEQ ID NO: 850064 - protein, 18 aa, Mycobacterium
QQTVQFVKSRDLVLDTPV

SEQ ID NO: 850065 - protein, 25 aa, Mycobacterium
QQVAELLFDVLGPTALDSGSSAPLH

SEQ ID NO: 850066 - protein, 30 aa, Mycobacterium; identical to SEQ ID NO: 116893

SEQ ID NO: 850067 - protein, 18 aa, Mycobacterium
QQVFGMAEGLLNYTRPDD

SEQ ID NO: 850068 - protein, 24 aa, Mycobacterium
QQVLPTYAVICCPAFGAAGKVGKF

SEQ ID NO: 850069 - protein, 23 aa, Mycobacterium
QQVLSRFLHDFAGLGADWTAANI

SEQ ID NO: 850070 - protein, 37 aa, Mycobacterium
QQVPGLAEAAGFHPEWPLIGAAHHLLRAHARGAFSAA

SEQ ID NO: 850071 - protein, 30 aa, Mycobacterium
QQVPRALGLPRMRRVLLVDGQLVADPAGRD

SEQ ID NO: 850072 - protein, 35 aa, Mycobacterium
QQVPSEQSVLLPLVPLLPRWLVRRTVGVAAGNVSS

SEQ ID NO: 850073 - protein, 17 aa, Mycobacterium
QQVQLYDWLVLNGERVL

SEQ ID NO: 850074 - protein, 17 aa, Mycobacterium
QQVVLPPERARLGFGTV

SEQ ID NO: 850075 - protein, 20 aa, Mycobacterium
QQYAILDGRLRHLPGGVDEY

SEQ ID NO: 850076 - protein, 31 aa, Mycobacterium
QQYAVADVLPLTPLQQGLLFHASFANDPGDD

SEQ ID NO: 850077 - protein, 18 aa, Mycobacterium
QQYGITRIVFHNHGDIVL

SEQ ID NO: 850078 - protein, 18 aa, Mycobacterium
QQYIAIAVYFDDADLPQL

SEQ ID NO: 850079 - protein, 18 aa, Mycobacterium
QQYIAIAVYFDSEDLPQL

SEQ ID NO: 850080 - protein, 19 aa, Mycobacterium
QQYLAVAVYFDGADLPQLA

SEQ ID NO: 850081 - protein, 24 aa, Mycobacterium
QQYRDRYIFAGLQPGQRIPRKWLD

SEQ ID NO: 850082 - protein, 31 aa, Mycobacterium
QRAALADPGPMPPAPPVPPAANPAIMAMPEA

SEQ ID NO: 850083 - protein, 30 aa, Mycobacterium
QRAALADPGPVPPAPPAPPAANPAIMAMPE

SEQ ID NO: 850084 - protein, 18 aa, Mycobacterium
QRAALPPMHEGRVDVIAG

SEQ ID NO: 850085 - protein, 18 aa, Mycobacterium
QRAALPPMHEGRVDVIGG

SEQ ID NO: 850086 - protein, 26 aa, Mycobacterium
QRAEAVQHTWFGLSALAERVGATVRI

SEQ ID NO: 850087 - protein, 17 aa, Mycobacterium
QRAGLELLAFGGRFVEI

SEQ ID NO: 850088 - protein, 30 aa, Mycobacterium
QRAGLGIGFTAVLPRLTPATGLGAAAVAAY

SEQ ID NO: 850089 - protein, 18 aa, Mycobacterium
QRAGLSTVFIPQRNEPDL

SEQ ID NO: 850090 - protein, 18 aa, Mycobacterium
QRAHDQFRWFAGGWKVNA

SEQ ID NO: 850091 - protein, 23 aa, Mycobacterium
QRAHWPVGTLQLTAIAACCGRQA

SEQ ID NO: 850092 - protein, 27 aa, Mycobacterium
QRAKNMFALGLVSWMYGRPIQTSETFI

SEQ ID NO: 850093 - protein, 18 aa, Mycobacterium
QRAKQLGMSGYSHLTKGK

SEQ ID NO: 850094 - protein, 27 aa, Mycobacterium
QRAKQLWFNRILPFARNLQAGEPVAAP

SEQ ID NO: 850095 - protein, 23 aa, Mycobacterium
QRALDEWRLLMAAALVGLVEETM

SEQ ID NO: 850096 - protein, 19 aa, Mycobacterium
QRALDVFSWESVAAQTVAV

SEQ ID NO: 850097 - protein, 20 aa, Mycobacterium
QRALLPDELYTDAGATVGDA

SEQ ID NO: 850098 - protein, 18 aa, Mycobacterium
QRALSLLGVTDIALIDDA

SEQ ID NO: 850099 - protein, 18 aa, Mycobacterium
QRALSWLTERMPGPPVRR

SEQ ID NO: 850100 - protein, 18 aa, Mycobacterium
QRAPFVVPLGIGAHLRKW

SEQ ID NO: 850101 - protein, 26 aa, Mycobacterium
QRAPGEILCLPYFLGEKSPVHDPDLR

SEQ ID NO: 850102 - protein, 18 aa, Mycobacterium
QRAPMWLEHSRRPGWQAA

SEQ ID NO: 850103 - protein, 19 aa, Mycobacterium
QRAPRRPNAERWIAVVADG

SEQ ID NO: 850104 - protein, 17 aa, Mycobacterium
QRAQVWQAMWEFEQALT

SEQ ID NO: 850105 - protein, 29 aa, Mycobacterium
QRARDIATAHWLTWRHQLAEMISVSQLAM

SEQ ID NO: 850106 - protein, 29 aa, Mycobacterium
QRARSAQYTLLLDTLAETPLQDPESRPAL

SEQ ID NO: 850107 - protein, 17 aa, Mycobacterium
QRAVDATFWPRLFGNCH

SEQ ID NO: 850108 - protein, 17 aa, Mycobacterium
QRAVEAIVRRCDALLVV

SEQ ID NO: 850109 - protein, 18 aa, Mycobacterium
QRAVHRVFTLLAAGRPVL

SEQ ID NO: 850110 - protein, 19 aa, Mycobacterium
QRAYGIKPFSMAMGSLKVA

SEQ ID NO: 850111 - protein, 24 aa, Mycobacterium
QRAYSAWLWTGRRGVIAGLAASAV

SEQ ID NO: 850112 - protein, 29 aa, Mycobacterium
QRCASRLHGYLYMVLHANVIHGLPASHPR

SEQ ID NO: 850113 - protein, 28 aa, Mycobacterium
QRCEQFPIWLHTYNYHRGHTALGGQPPA

SEQ ID NO: 850114 - protein, 27 aa, Mycobacterium
QRCESLRDNLWQLIDSKVATAIAIDDR

SEQ ID NO: 850115 - protein, 27 aa, Mycobacterium
QRCESLRDNLWYLVDAKVATAIAVDDG

SEQ ID NO: 850116 - protein, 19 aa, Mycobacterium
QRCIAVLYAAMYGDTTLRA

SEQ ID NO: 850117 - protein, 17 aa, Mycobacterium
QRCLDLIAATNPLPRRV

SEQ ID NO: 850118 - protein, 25 aa, Mycobacterium
QRCTADNIGAWLDGLHAAKRALPVT

SEQ ID NO: 850119 - protein, 17 aa, Mycobacterium
QRCWLRQLTPPANREQE

SEQ ID NO: 850120 - protein, 22 aa, Mycobacterium
QRDALYRRGLQAGRKFLQSWNY

SEQ ID NO: 850121 - protein, 21 aa, Mycobacterium
QRDFARWQKGVAGVLAKSTRK

SEQ ID NO: 850122 - protein, 29 aa, Mycobacterium
QRDFRNQLGDVWFLLATLLGHRSAEVTRN

SEQ ID NO: 850123 - protein, 20 aa, Mycobacterium
QRDFTLWKGAKPGEPSWPTP

SEQ ID NO: 850124 - protein, 25 aa, Mycobacterium
QRDGELLWWSAMLVNKTLAKLGGMH

SEQ ID NO: 850125 - protein, 25 aa, Mycobacterium
QRDLAYTTIMTVLQRLAKKNLVSQI

SEQ ID NO: 850126 - protein, 24 aa, Mycobacterium
QRDLSSIVFILQGAAVMPPSLLHT

SEQ ID NO: 850127 - protein, 23 aa, Mycobacterium
QRDPVLAELPGRFLFGFDDGRGD

SEQ ID NO: 850128 - protein, 24 aa, Mycobacterium
QRDRAKMFALLWQSLRRQRQLTRR

SEQ ID NO: 850129 - protein, 27 aa, Mycobacterium
QRDRFGWPILRGTQRWCQLFSEPGAGS

SEQ ID NO: 850130 - protein, 20 aa, Mycobacterium
QRDRILIITINRPKAKNSVN

SEQ ID NO: 850131 - protein, 23 aa, Mycobacterium
QRDRVLLITINRPDARNAVNRAV

SEQ ID NO: 850132 - protein, 24 aa, Mycobacterium
QRDSRLVQIYARRLALDLNQPHVV

SEQ ID NO: 850133 - protein, 25 aa, Mycobacterium
QRDVATALRWTLKGVKSRVAAAVGG

SEQ ID NO: 850134 - protein, 22 aa, Mycobacterium
QRDVPLAPLVRAHRLGHARFLE

SEQ ID NO: 850135 - protein, 25 aa, Mycobacterium
QRDYPAPPGAFWVPRRLGGGAPTPE

SEQ ID NO: 850136 - protein, 18 aa, Mycobacterium
QREAFAWHIDLAKRTGKP

SEQ ID NO: 850137 - protein, 27 aa, Mycobacterium
QREAIVHYRALFEQLLGVHPTSNMPNT

SEQ ID NO: 850138 - protein, 32 aa, Mycobacterium
QREALATAPPPPAAPPAPAPDALPPANDPGVL

SEQ ID NO: 850139 - protein, 28 aa, Mycobacterium
QREARLQQPLYVLPAKGIFTSNFGYRWG

SEQ ID NO: 850140 - protein, 22 aa, Mycobacterium
QREEIRWDLANQPGTVLQVDPD

SEQ ID NO: 850141 - protein, 20 aa, Mycobacterium
QREFDDGAYIRPILDDMHMH

SEQ ID NO: 850142 - protein, 18 aa, Mycobacterium
QREIDSRQRLQMWRHAGR

SEQ ID NO: 850143 - protein, 32 aa, Mycobacterium
QREIGYVFQRAALLEWRSVRKNILLQAEMRGM

SEQ ID NO: 850144 - protein, 24 aa, Mycobacterium
QRELDGLPERFDRDLWAKLVEADI

SEQ ID NO: 850145 - protein, 25 aa, Mycobacterium
QRELDRYLPFLATTKVLIAAVRAGM

SEQ ID NO: 850146 - protein, 20 aa, Mycobacterium
QRELLAAAIRLTRPGGVVLY

SEQ ID NO: 850147 - protein, 17 aa, Mycobacterium
QREPVFGALALAGVDVE

SEQ ID NO: 850148 - protein, 23 aa, Mycobacterium
QRERIHRVAQWLYSGAPQTLDPV

SEQ ID NO: 850149 - protein, 17 aa, Mycobacterium
QRESLRTLGLRKIRQSV

SEQ ID NO: 850150 - protein, 18 aa, Mycobacterium
QREVGVRSTLARLGLAPN

SEQ ID NO: 850151 - protein, 24 aa, Mycobacterium
QREVRFYRDIAPRLDGPLAPCYHA

SEQ ID NO: 850152 - protein, 17 aa, Mycobacterium
QREWLRRPPPTLGEHNE

SEQ ID NO: 850153 - protein, 18 aa, Mycobacterium
QREYELAGRLMAAAIARS

SEQ ID NO: 850154 - protein, 17 aa, Mycobacterium
QRFAALIRGLNPVLGRL

SEQ ID NO: 850155 - protein, 25 aa, Mycobacterium
QRFADAMAPFGLRASAATPAYGMAE

SEQ ID NO: 850156 - protein, 23 aa, Mycobacterium
QRFAPLNSWPDNVSLDKARRLLW

SEQ ID NO: 850157 - protein, 23 aa, Mycobacterium
QRFAPLRAAIQMSLQLPARVAPE

SEQ ID NO: 850158 - protein, 27 aa, Mycobacterium
QRFDPDIWQVAYLIAPVAGWVHKSPDS

SEQ ID NO: 850159 - protein, 23 aa, Mycobacterium
QRFDPQRYLASKPSAFAWIPFGG

SEQ ID NO: 850160 - protein, 21 aa, Mycobacterium
QRFEPWYTPQRIECTMMTVEP

SEQ ID NO: 850161 - protein, 24 aa, Mycobacterium
QRFPTAAWPTLPLEDYALGQDNLD

SEQ ID NO: 850162 - protein, 19 aa, Mycobacterium
QRFPTTAVLLPRSSANPDG

SEQ ID NO: 850163 - protein, 18 aa, Mycobacterium
QRFQVTASRFGRSVDVAA

SEQ ID NO: 850164 - protein, 17 aa, Mycobacterium
QRFRHNLGRGLLGRRIE

SEQ ID NO: 850165 - protein, 20 aa, Mycobacterium
QRFTRRFAPFNLPEAVIRPT

SEQ ID NO: 850166 - protein, 26 aa, Mycobacterium
QRFTSALVISQWCRMPHGTDPRSYYE

SEQ ID NO: 850167 - protein, 19 aa, Mycobacterium
QRGAILMDAADLLRRRHEE

SEQ ID NO: 850168 - protein, 18 aa, Mycobacterium
QRGARGNNWLFFGDQHRA

SEQ ID NO: 850169 - protein, 19 aa, Mycobacterium
QRGAVDVLIFPNAIRVVEE

SEQ ID NO: 850170 - protein, 24 aa, Mycobacterium
QRGDILWCQLFSEPGAGSDLASLT

SEQ ID NO: 850171 - protein, 18 aa, Mycobacterium
QRGEAMLAPVVFTSALDL

SEQ ID NO: 850172 - protein, 26 aa, Mycobacterium
QRGGRLRHPLPGVQLADDVGVARVLV

SEQ ID NO: 850173 - protein, 36 aa, Mycobacterium
QRGIGIIAPFDLALERELWRWVPAEVSLHLARTPYE

SEQ ID NO: 850174 - protein, 25 aa, Mycobacterium
QRGKSLEVIPKHIPWEVAALNEPMA

SEQ ID NO: 850175 - protein, 21 aa, Mycobacterium
QRGLPLLDLKDLRAVITHLTS

SEQ ID NO: 850176 - protein, 26 aa, Mycobacterium
QRGRLSLQWGLVRLSVRDGTVLPERP

SEQ ID NO: 850177 - protein, 26 aa, Mycobacterium
QRGSEPWVLLRVQQLGLPDITTEQLW

SEQ ID NO: 850178 - protein, 24 aa, Mycobacterium
QRGTTPIVLTMTAALRAEAESAAG

SEQ ID NO: 850179 - protein, 22 aa, Mycobacterium
QRHALDQLLVLGTLLEGHADHV

SEQ ID NO: 850180 - protein, 27 aa, Mycobacterium
QRHDFYVLDEFTYPLKWGWVDVDDVVE

SEQ ID NO: 850181 - protein, 29 aa, Mycobacterium
QRHDFYVLDEFTYPLKWGWVDVHEVVEVL

SEQ ID NO: 850182 - protein, 18 aa, Mycobacterium
QRHDIKAVVLLHEMLRHC

SEQ ID NO: 850183 - protein, 17 aa, Mycobacterium
QRHELTSRWSILCPSCD

SEQ ID NO: 850184 - protein, 25 aa, Mycobacterium
QRHHLGQIGQLLSPIGQLPGDHTVG

SEQ ID NO: 850185 - protein, 25 aa, Mycobacterium
QRHLKRLWGLPATQLGVVAWPAQRK

SEQ ID NO: 850186 - protein, 23 aa, Mycobacterium
QRHLKRLWGLPGTQLGVVAWPPT

SEQ ID NO: 850187 - protein, 22 aa, Mycobacterium
QRHRIMGRLTYYRATRPDGPAR

SEQ ID NO: 850188 - protein, 23 aa, Mycobacterium
QRHVFDPLGLQDTHYLPPAAACG

SEQ ID NO: 850189 - protein, 21 aa, Mycobacterium
QRIAPLVAEWADNLGRGIEVA

SEQ ID NO: 850190 - protein, 30 aa, Mycobacterium
QRIEDTWQYFYKGAYWRRGPVTMTAIAAVD

SEQ ID NO: 850191 - protein, 17 aa, Mycobacterium
QRIGAMRFKIYDAGYQK

SEQ ID NO: 850192 - protein, 21 aa, Mycobacterium
QRIKFSALYAKALALGFDVVV

SEQ ID NO: 850193 - protein, 21 aa, Mycobacterium
QRILHELDLYPMGCAIGALRQ

SEQ ID NO: 850194 - protein, 25 aa, Mycobacterium
QRIPRALTRLEVPLIGAVNGPAIGA

SEQ ID NO: 850195 - protein, 24 aa, Mycobacterium
QRIRPWHERYPQVHVYPIANRADV

SEQ ID NO: 850196 - protein, 19 aa, Mycobacterium
QRITLTLPAIARSREVWLM

SEQ ID NO: 850197 - protein, 27 aa, Mycobacterium
QRKAGELPFGYFARGWLDAQALKVAQG

SEQ ID NO: 850198 - protein, 21 aa, Mycobacterium
QRKALLDRLTAQQLPDGWDAD

SEQ ID NO: 850199 - protein, 23 aa, Mycobacterium
QRKASRAAVLWKVGMAIPINTNP

SEQ ID NO: 850200 - protein, 32 aa, Mycobacterium
QRKLSALLSDGPVVLFFYPAAMTPGCTKEACH

SEQ ID NO: 850201 - protein, 26 aa, Mycobacterium
QRKPYSWLRQILPAPHYPPGYLNEFG

SEQ ID NO: 850202 - protein, 25 aa, Mycobacterium
QRKQALLWARRFAEYDVRWFEEPVS

SEQ ID NO: 850203 - protein, 42 aa, Mycobacterium
QRKRYAVAVDLPPGTWTAALIGAWWPAPSTALRAGAQHWNAA

SEQ ID NO: 850204 - protein, 17 aa, Mycobacterium
QRKSVEDIEWLWDAVWD

SEQ ID NO: 850205 - protein, 22 aa, Mycobacterium
QRKVRMFGGPFSYSHPLSPPVT

SEQ ID NO: 850206 - protein, 17 aa, Mycobacterium
QRLAIRLHDSVGATLFS

SEQ ID NO: 850207 - protein, 26 aa, Mycobacterium
QRLAPAPPYRNFVTWLADRDLDAARA

SEQ ID NO: 850208 - protein, 25 aa, Mycobacterium
QRLATRARTMLWANRFRWSRCTTGD

SEQ ID NO: 850209 - protein, 26 aa, Mycobacterium
QRLATRHLLRYPGLQRAAERGAPVLA

SEQ ID NO: 850210 - protein, 18 aa, Mycobacterium
QRLFDFHYRIEIYTPAAQ

SEQ ID NO: 850211 - protein, 25 aa, Mycobacterium
QRLGGPVLLVLEDVDLWCHDRTTGD

SEQ ID NO: 850212 - protein, 18 aa, Mycobacterium
QRLGIARALITDPDFIVL

SEQ ID NO: 850213 - protein, 25 aa, Mycobacterium
QRLGLEWLHRLALEPRRLARRYLRD

SEQ ID NO: 850214 - protein, 23 aa, Mycobacterium
QRLGLRGDLLWSFRRRHTEIHAR

SEQ ID NO: 850215 - protein, 26 aa, Mycobacterium
QRLGPVLFRELLALHFSPTRPSDDDW

SEQ ID NO: 850216 - protein, 26 aa, Mycobacterium
QRLGVDPPRGVLLYGPPGCGKTFVVR

SEQ ID NO: 850217 - protein, 26 aa, Mycobacterium
QRLGVEPPRGVLLYGPPGCGKTFVVR

SEQ ID NO: 850218 - protein, 25 aa, Mycobacterium
QRLGVLHVAPLPQPLIGLTESTTGP

SEQ ID NO: 850219 - protein, 20 aa, Mycobacterium
QRLHALRRACAAGALATLVP

SEQ ID NO: 850220 - protein, 22 aa, Mycobacterium
QRLLGLLHTELPWTTTLGDHTP

SEQ ID NO: 850221 - protein, 17 aa, Mycobacterium
QRLLLECPKPVLAVKPH

SEQ ID NO: 850222 - protein, 18 aa, Mycobacterium
QRLRDEAPLYRNDELGFW

SEQ ID NO: 850223 - protein, 18 aa, Mycobacterium
QRLRLLRHQQHDLLVGVV

SEQ ID NO: 850224 - protein, 20 aa, Mycobacterium
QRLRQAWLEAKRDDVLLTAQ

SEQ ID NO: 850225 - protein, 19 aa, Mycobacterium
QRLRTRPFDLGAPVWVDDP

SEQ ID NO: 850226 - protein, 18 aa, Mycobacterium
QRLSAFELQARTILGLAV

SEQ ID NO: 850227 - protein, 22 aa, Mycobacterium
QRLSSWFDSHPGLPRMINMYGI

SEQ ID NO: 850228 - protein, 25 aa, Mycobacterium
QRLTGLLMLMAADPARRLSSIDLLD

SEQ ID NO: 850229 - protein, 22 aa, Mycobacterium
QRLVLGLDLDVLLGLDGLVHAL

SEQ ID NO: 850230 - protein, 23 aa, Mycobacterium
QRLVLGLDLDVLLGLDGLVHALV

SEQ ID NO: 850231 - protein, 33 aa, Mycobacterium
QRLVWRFCQQYPQAARRLIRHLNARQLPAGYPV

SEQ ID NO: 850232 - protein, 17 aa, Mycobacterium
QRLWRTREALAEVLGGY

SEQ ID NO: 850233 - protein, 26 aa, Mycobacterium
QRLYSFKDILVLKIVKRLLDTGISLH

SEQ ID NO: 850234 - protein, 29 aa, Mycobacterium
QRLYSFKDILVLKIVKRLLDTGISLHNIR

SEQ ID NO: 850235 - protein, 30 aa, Mycobacterium
QRLYSFKDILVLKIVKRLLDTGISLHNIRV

SEQ ID NO: 850236 - protein, 28 aa, Mycobacterium
QRLYSFKDILVLKIVKRLLDTGISLQNI

SEQ ID NO: 850237 - protein, 18 aa, Mycobacterium
QRLYTARTAAALSVSEAA

SEQ ID NO: 850238 - protein, 17 aa, Mycobacterium
QRMALALGFDLDEMEFV

SEQ ID NO: 850239 - protein, 24 aa, Mycobacterium
QRMDLMFTVGGYLTLAMALNTFEV

SEQ ID NO: 850240 - protein, 17 aa, Mycobacterium
QRMEAPPPGVHGAPNNP

SEQ ID NO: 850241 - protein, 20 aa, Mycobacterium
QRMMGLKFRDPRIPTLEEFA

SEQ ID NO: 850242 - protein, 22 aa, Mycobacterium
QRMRDMLWAAIFPSIDISTDPA

SEQ ID NO: 850243 - protein, 24 aa, Mycobacterium
QRMRHGMYWSGDLAYRDADGWIYL

SEQ ID NO: 850244 - protein, 29 aa, Mycobacterium
QRNDFYVLDEFTYPLKWGWVDVDEVVDVL

SEQ ID NO: 850245 - protein, 25 aa, Mycobacterium
QRNGERYQFLRWGQGAFDDFKVVPP

SEQ ID NO: 850246 - protein, 25 aa, Mycobacterium
QRNGERYQFLRWGQGAFQDFKVVPP

SEQ ID NO: 850247 - protein, 26 aa, Mycobacterium
QRNGERYQFLRWGQGAFRDFKVVPPG

SEQ ID NO: 850248 - protein, 27 aa, Mycobacterium
QRNGERYQFLRWGQGAFRDFKVVPPGT

SEQ ID NO: 850249 - protein, 22 aa, Mycobacterium
QRNMLFHSVLPYFAGVETTSAT

SEQ ID NO: 850250 - protein, 24 aa, Mycobacterium
QRPARWIRLLATNRGVFTAAPNFA

SEQ ID NO: 850251 - protein, 18 aa, Mycobacterium
QRPIIWGPGKARAVQEFA

SEQ ID NO: 850252 - protein, 22 aa, Mycobacterium
QRPIVGPSWRMARNPARVARGA

SEQ ID NO: 850253 - protein, 18 aa, Mycobacterium
QRPLIKLRPNLQSRQRWV

SEQ ID NO: 850254 - protein, 21 aa, Mycobacterium
QRPLYEIKANLFKALAHPARI

SEQ ID NO: 850255 - protein, 23 aa, Mycobacterium
QRPPICVLGLGLIGGSLMRAATA

SEQ ID NO: 850256 - protein, 30 aa, Mycobacterium
QRPQSAEELLYLAPNVWPRNTTRDEQGCAR

SEQ ID NO: 850257 - protein, 22 aa, Mycobacterium
QRPRLPICLGAFTPAGLRRIGR

SEQ ID NO: 850258 - protein, 24 aa, Mycobacterium
QRQGELALWAPLLGQEAAQVGSAR

SEQ ID NO: 850259 - protein, 19 aa, Mycobacterium
QRQIVVAGRVLLLASRSKT

SEQ ID NO: 850260 - protein, 30 aa, Mycobacterium
QRQLDARAMTWRLHVFPAVVDVPGATGAAA

SEQ ID NO: 850261 - protein, 25 aa, Mycobacterium
QRQQLAIARALITSPKTLILDEPTE

SEQ ID NO: 850262 - protein, 26 aa, Mycobacterium
QRQQSVLPLLDAYRKPERPLRGAPAP

SEQ ID NO: 850263 - protein, 24 aa, Mycobacterium
QRQRANLARALALGPDLLVADEPT

SEQ ID NO: 850264 - protein, 22 aa, Mycobacterium
QRQRIGIARALALQPKLIIADE

SEQ ID NO: 850265 - protein, 33 aa, Mycobacterium
QRQRMALARALAVDPQVLLLDEPFGALDAKVRD

SEQ ID NO: 850266 - protein, 26 aa, Mycobacterium
QRQRVWVAMVLAQQTPLILLDEPTTY

SEQ ID NO: 850267 - protein, 22 aa, Mycobacterium
QRQRWLPDMLGGSTIGAYSLSE

SEQ ID NO: 850268 - protein, 21 aa, Mycobacterium
QRQTVAIAKSVLWNSKVVLLD

SEQ ID NO: 850269 - protein, 21 aa, Mycobacterium
QRQVMYWLDPVGGTAGFRDHP

SEQ ID NO: 850270 - protein, 19 aa, Mycobacterium
QRRAFGEALVDKPLIRRKL

SEQ ID NO: 850271 - protein, 25 aa, Mycobacterium
QRRAFGGALIDKPLMRRKLAELIVD

SEQ ID NO: 850272 - protein, 19 aa, Mycobacterium
QRRARVFMKFIQLVNDHVD

SEQ ID NO: 850273 - protein, 19 aa, Mycobacterium
QRRDDVIAMLAARKVTAPA

SEQ ID NO: 850274 - protein, 25 aa, Mycobacterium
QRRDIAPRRILPDSAIIEAALTDPK

SEQ ID NO: 850275 - protein, 22 aa, Mycobacterium
QRRDMMWICRDGDRAKNHLLEA

SEQ ID NO: 850276 - protein, 23 aa, Mycobacterium
QRREELWTFGLIEQKSRARGNTP

SEQ ID NO: 850277 - protein, 20 aa, Mycobacterium
QRREVLLQAALLSCASLDPS

SEQ ID NO: 850278 - protein, 27 aa, Mycobacterium
QRRGCSIARLILLDALLTVPNSDVLNS

SEQ ID NO: 850279 - protein, 26 aa, Mycobacterium
QRRGGSYTVYVWAGLAMAAARLGLGP

SEQ ID NO: 850280 - protein, 32 aa, Mycobacterium
QRRHYAYLKKVLQALTFLRGPQTWVLKSPQHC

SEQ ID NO: 850281 - protein, 31 aa, Mycobacterium
QRRIWALERRRAEVPWVTWGTTIMIARSVAK

SEQ ID NO: 850282 - protein, 24 aa, Mycobacterium
QRRLEIARALATEPKLLCLDEPAA

SEQ ID NO: 850283 - protein, 18 aa, Mycobacterium
QRRLLGAALDRHSHFRQR

SEQ ID NO: 850284 - protein, 18 aa, Mycobacterium
QRRLPDTPVLPPPDVAAS

SEQ ID NO: 850285 - protein, 21 aa, Mycobacterium
QRRLRTLAQLGWLVIRVIAED

SEQ ID NO: 850286 - protein, 25 aa, Mycobacterium
QRRQLWHFGLLPDEVPEFLAEYGWR

SEQ ID NO: 850287 - protein, 22 aa, Mycobacterium
QRRRLLESYLCELAASKLGLTP

SEQ ID NO: 850288 - protein, 23 aa, Mycobacterium
QRRRLPMVELPDYILIGADGPIR

SEQ ID NO: 850289 - protein, 20 aa, Mycobacterium
QRRRVELARILFGASEGGAG

SEQ ID NO: 850290 - protein, 22 aa, Mycobacterium
QRRRVQLAALLIGDWDVIALDE

SEQ ID NO: 850291 - protein, 22 aa, Mycobacterium
QRRRVQLARLLIGDWDVIALDE

SEQ ID NO: 850292 - protein, 17 aa, Mycobacterium
QRRRVRWACTRRSRRVT

SEQ ID NO: 850293 - protein, 24 aa, Mycobacterium
QRRRWLSKTELLSRLPRVQADPGL

SEQ ID NO: 850294 - protein, 19 aa, Mycobacterium
QRRSFLEGDALTRARNLLD

SEQ ID NO: 850295 - protein, 20 aa, Mycobacterium
QRRTEGRFALYSTGTPDSAE

SEQ ID NO: 850296 - protein, 20 aa, Mycobacterium
QRRTLLPDRIDSLIAGPGRD

SEQ ID NO: 850297 - protein, 26 aa, Mycobacterium
QRRTQTTILPGLPSGWRNLPSQDQVV

SEQ ID NO: 850298 - protein, 25 aa, Mycobacterium
QRRVFAHALTWLFGELIAQRAEDPI

SEQ ID NO: 850299 - protein, 23 aa, Mycobacterium
QRRVRVDMYRRLGYYPTETSEHS

SEQ ID NO: 850300 - protein, 22 aa, Mycobacterium
QRRWPPFTDWPDPWVLVGALAQ

SEQ ID NO: 850301 - protein, 22 aa, Mycobacterium
QRRWQPFTDWPDPWVLVGALAQ

SEQ ID NO: 850302 - protein, 18 aa, Mycobacterium
QRRYPAWPASYDASLRVP

SEQ ID NO: 850303 - protein, 19 aa, Mycobacterium
QRRYVEAWVQVLCRSQQGL

SEQ ID NO: 850304 - protein, 31 aa, Mycobacterium
QRSAGARIFFVDYLTMLPPAGTPAPPLSPAD

SEQ ID NO: 850305 - protein, 19 aa, Mycobacterium
QRSFIGIQFLLDEAIPCPQ

SEQ ID NO: 850306 - protein, 21 aa, Mycobacterium
QRSFSLEDLSLRYLRRELRAE

SEQ ID NO: 850307 - protein, 22 aa, Mycobacterium
QRSGFPVLVIGCGEAGLLAGIK

SEQ ID NO: 850308 - protein, 26 aa, Mycobacterium
QRSGVTWSNLLKLAGLPASAAGRLVV

SEQ ID NO: 850309 - protein, 20 aa, Mycobacterium
QRSIPPQIVRLTGITTAMLC

SEQ ID NO: 850310 - protein, 28 aa, Mycobacterium
QRSITERVLPAVLLLKAVGLAAQRFGEF

SEQ ID NO: 850311 - protein, 23 aa, Mycobacterium
QRSKTERLGRRYEYLDAEPTASA

SEQ ID NO: 850312 - protein, 19 aa, Mycobacterium
QRSLPVLREDLDRFGKARR

SEQ ID NO: 850313 - protein, 40 aa, Mycobacterium
QRSQGKWYPGEPLPRWQIALYWRTDGLPLWTDAELLADPW

SEQ ID NO: 850314 - protein, 20 aa, Mycobacterium
QRSRLFKQLGNSTLGAVVSI

SEQ ID NO: 850315 - protein, 41 aa, Mycobacterium
QRSTVVLAMWQYLLHRYTQQDALLVGLPFPARPAGVPEAAI

SEQ ID NO: 850316 - protein, 30 aa, Mycobacterium
QRTAQVAASLRYVAAWNSAFLPSKDLTEGI

SEQ ID NO: 850317 - protein, 19 aa, Mycobacterium
QRTGLPHVTWKFATSVDGR

SEQ ID NO: 850318 - protein, 19 aa, Mycobacterium
QRTGLPHVTWKYATSIDGR

SEQ ID NO: 850319 - protein, 22 aa, Mycobacterium
QRTKGISIRRAPAPAWSHFTFN

SEQ ID NO: 850320 - protein, 33 aa, Mycobacterium
QRTMQLNYLGAVQLILKFIPGMRDRGFGHIVNV

SEQ ID NO: 850321 - protein, 33 aa, Mycobacterium
QRTMQLNYLGAVQLILKFIPGMRERGFGHIINV

SEQ ID NO: 850322 - protein, 32 aa, Mycobacterium
QRTMQLNYLGAVQLILKFIPGMRERKFGQIIN

SEQ ID NO: 850323 - protein, 22 aa, Mycobacterium
QRTRPDMWSVLEYGCHVRDVHR

SEQ ID NO: 850324 - protein, 20 aa, Mycobacterium
QRTRPVLTAALRRARTRIRL

SEQ ID NO: 850325 - protein, 25 aa, Mycobacterium
QRTSGYIILGWRPGTGPRSPAATIA

SEQ ID NO: 850326 - protein, 23 aa, Mycobacterium
QRTVHIHPTVAEFLPTILGELQP

SEQ ID NO: 850327 - protein, 20 aa, Mycobacterium
QRVAIARALALRPKVILFDE

SEQ ID NO: 850328 - protein, 23 aa, Mycobacterium
QRVAIARALVLDPALIVADEALS

SEQ ID NO: 850329 - protein, 19 aa, Mycobacterium
QRVALARALAAKPRVLLLD

SEQ ID NO: 850330 - protein, 19 aa, Mycobacterium
QRVALARALVRNPPVLLLD

SEQ ID NO: 850331 - protein, 19 aa, Mycobacterium
QRVALPNIKRLLPAARAAS

SEQ ID NO: 850332 - protein, 27 aa, Mycobacterium
QRVATGRLRLVLLLSPPRTGSTALANA

SEQ ID NO: 850333 - protein, 24 aa, Mycobacterium
QRVAYVLHDLFAVPFGDIAAVLDT

SEQ ID NO: 850334 - protein, 21 aa, Mycobacterium
QRVDLIKDEGYRRKFRKEMAQ

SEQ ID NO: 850335 - protein, 22 aa, Mycobacterium
QRVEPWYTPERIECAMMTVDPG

SEQ ID NO: 850336 - protein, 32 aa, Mycobacterium
QRVFDRFGAPPVPLVPLILDHNLRNTRQIADA

SEQ ID NO: 850337 - protein, 19 aa, Mycobacterium
QRVFLVDSSKFGRHSQARH

SEQ ID NO: 850338 - protein, 19 aa, Mycobacterium
QRVFNRYGSPPVPLVPLIL

SEQ ID NO: 850339 - protein, 25 aa, Mycobacterium
QRVFTDVDLVLLPSAGLASPTVAGM

SEQ ID NO: 850340 - protein, 33 aa, Mycobacterium
QRVKANLFYRGLTFHRYPLIGDTIYTRTEVVAL

SEQ ID NO: 850341 - protein, 19 aa, Mycobacterium
QRVLGIRRNADVALFSVGA

SEQ ID NO: 850342 - protein, 19 aa, Mycobacterium
QRVLPVPQLRGDGAARIVE

SEQ ID NO: 850343 - protein, 19 aa, Mycobacterium
QRVLVWGETALRVAPDAGT

SEQ ID NO: 850344 - protein, 17 aa, Mycobacterium
QRVMIAIALACDPELLI

SEQ ID NO: 850345 - protein, 22 aa, Mycobacterium
QRVMKSLGTQSLQLPKIGADLE

SEQ ID NO: 850346 - protein, 25 aa, Mycobacterium
QRVPGGLVRPPVFWDQLMAECKASP

SEQ ID NO: 850347 - protein, 24 aa, Mycobacterium
QRVPRALQRCEVPVIAAVNGAAIG

SEQ ID NO: 850348 - protein, 19 aa, Mycobacterium
QRVPVLAVKRKNAINEPLF

SEQ ID NO: 850349 - protein, 18 aa, Mycobacterium
QRVQFGRPLSAFQSVQQS

SEQ ID NO: 850350 - protein, 18 aa, Mycobacterium
QRVRDGLLEIGRKLGIPP

SEQ ID NO: 850351 - protein, 29 aa, Mycobacterium
QRVRQRPELFLGVFERRAQRGPAGDDLPP

SEQ ID NO: 850352 - protein, 29 aa, Mycobacterium
QRVSARVYPALVPLSHPLATVNGAFNAVV

SEQ ID NO: 850353 - protein, 29 aa, Mycobacterium
QRVSARVYPALVPLTHPLATVNGAFNAVV

SEQ ID NO: 850354 - protein, 25 aa, Mycobacterium
QRVVSFLERYFPIPAPWEKVAADVS

SEQ ID NO: 850355 - protein, 26 aa, Mycobacterium
QRWAELVYDGLWYSPLKEALESFVAK

SEQ ID NO: 850356 - protein, 28 aa, Mycobacterium
QRWAELVYDGLWYSPLKIALESFVAKTQ

SEQ ID NO: 850357 - protein, 28 aa, Mycobacterium
QRWAELVYDGLWYSPLKTALEAFVDKTQ

SEQ ID NO: 850358 - protein, 26 aa, Mycobacterium
QRWAELVYDGLWYSPLKTALESFVAK

SEQ ID NO: 850359 - protein, 17 aa, Mycobacterium
QRWAKTWEFQALMKARA

SEQ ID NO: 850360 - protein, 32 aa, Mycobacterium
QRWARGAGGLLLITHDRWFLDEVATTTWEVHD

SEQ ID NO: 850361 - protein, 21 aa, Mycobacterium
QRWARNTGGLLLVTHDRWFLD

SEQ ID NO: 850362 - protein, 21 aa, Mycobacterium
QRWDLVRDGIFVGYQLDRVFA

SEQ ID NO: 850363 - protein, 19 aa, Mycobacterium
QRWEGSPDAVLTWATHRVP

SEQ ID NO: 850364 - protein, 32 aa, Mycobacterium
QRWKKYNIFNLVWNTLLALLFEWGVALQHLEI

SEQ ID NO: 850365 - protein, 31 aa, Mycobacterium
QRWKRFNIFNLVYNTLLALLFEWGVGLQHVE

SEQ ID NO: 850366 - protein, 31 aa, Mycobacterium
QRWKRYNIFNLVWNTLLALGFEWGVALQHLE

SEQ ID NO: 850367 - protein, 17 aa, Mycobacterium
QRWLGRIAPQLPVASPV

SEQ ID NO: 850368 - protein, 22 aa, Mycobacterium
QRWLTTKYPQLQSKYLFLGLKN

SEQ ID NO: 850369 - protein, 17 aa, Mycobacterium
QRWMEFSAKSDLLMYGS

SEQ ID NO: 850370 - protein, 29 aa, Mycobacterium
QRWPAVHVLDAARLFRLALEGAEPGTVAH

SEQ ID NO: 850371 - protein, 21 aa, Mycobacterium
QRWPTWYYCCCGGLFDIHQQF

SEQ ID NO: 850372 - protein, 22 aa, Mycobacterium
QRWQAVMLNNYGTPPIALASGD

SEQ ID NO: 850373 - protein, 20 aa, Mycobacterium
QRWSSDIAAGWWQAALDAYD

SEQ ID NO: 850374 - protein, 20 aa, Mycobacterium
QRWTADPIVGFAGAGAQDSE

SEQ ID NO: 850375 - protein, 29 aa, Mycobacterium
QRWTPMNLGNLFFNTLLCVAFEWGVGLQH

SEQ ID NO: 850376 - protein, 17 aa, Mycobacterium
QRWVRLGCDIDLSGLFY

SEQ ID NO: 850377 - protein, 17 aa, Mycobacterium
QRWVWSDTIARIHGYQP

SEQ ID NO: 850378 - protein, 17 aa, Mycobacterium
QRYAMFMSFSLAAGAGR

SEQ ID NO: 850379 - protein, 37 aa, Mycobacterium
QRYAVPLDWSQPLALGTFYDTILKPALEAVGLPATRP

SEQ ID NO: 850380 - protein, 20 aa, Mycobacterium
QRYDATLPGMRRIVEALFHD

SEQ ID NO: 850381 - protein, 17 aa, Mycobacterium
QRYDDVALLAAPRPEPA

SEQ ID NO: 850382 - protein, 26 aa, Mycobacterium
QRYERRRAALLPALRAAGFAVDYSEA

SEQ ID NO: 850383 - protein, 19 aa, Mycobacterium
QRYFSSVWVLARKAVADDV

SEQ ID NO: 850384 - protein, 23 aa, Mycobacterium
QRYGEFNGFWRDDGFQPATGVHV

SEQ ID NO: 850385 - protein, 23 aa, Mycobacterium
QRYGFRVYGPWDPSKGLRCDPSK

SEQ ID NO: 850386 - protein, 17 aa, Mycobacterium
QRYNFQFTGQRFYRIRG

SEQ ID NO: 850387 - protein, 21 aa, Mycobacterium
QRYNFQFTGQRFYRIRNGRLD

SEQ ID NO: 850388 - protein, 24 aa, Mycobacterium
QRYRDRYIFAGLQPGQRIPRKWLD

SEQ ID NO: 850389 - protein, 24 aa, Mycobacterium
QRYRRYLTGCADFFRRGITEVAQF

SEQ ID NO: 850390 - protein, 19 aa, Mycobacterium
QRYRVGPNYLQLPVNRPKN

SEQ ID NO: 850391 - protein, 24 aa, Mycobacterium
QRYYDPEFYALETELLWPRVWQMA

SEQ ID NO: 850392 - protein, 30 aa, Mycobacterium
QSAAAGLRPLRPWRPALVAALAAADRPLPS

SEQ ID NO: 850393 - protein, 22 aa, Mycobacterium
QSAARLLAAQLPAGSPVLIVGT

SEQ ID NO: 850394 - protein, 22 aa, Mycobacterium
QSAARVLAAQLPADARVLVVGT

SEQ ID NO: 850395 - protein, 28 aa, Mycobacterium
QSADNPFPVRGVAIRVAGWIDKLGAVWV

SEQ ID NO: 850396 - protein, 33 aa, Mycobacterium
QSALGLPTHALPWYPLLRLPVNVTRSVAALALP

SEQ ID NO: 850397 - protein, 18 aa, Mycobacterium
QSALGTLASLLGSVGNLA

SEQ ID NO: 850398 - protein, 29 aa, Mycobacterium
QSALTGFERFLPLLFAYDLPPIAEEMRKF

SEQ ID NO: 850399 - protein, 19 aa, Mycobacterium
QSAPGQVLGFFLADKFNQD

SEQ ID NO: 850400 - protein, 29 aa, Mycobacterium
QSAQPVLLAHHLLAHAHPLLRDVDRIVDF

SEQ ID NO: 850401 - protein, 29 aa, Mycobacterium
QSAQPVLLAHHLLAHAHPLLRDVDRLADF

SEQ ID NO: 850402 - protein, 27 aa, Mycobacterium
QSARARHETYIGPWLPEPVDTTADPAL

SEQ ID NO: 850403 - protein, 31 aa, Mycobacterium
QSARDAGIALRFQLLWYPSTTFDTSLPSFRE

SEQ ID NO: 850404 - protein, 39 aa, Mycobacterium
QSARFAESFLRLGLVSGIGGAWFLTRIVGVAKAMELTLT

SEQ ID NO: 850405 - protein, 31 aa, Mycobacterium
QSASPGFDIFLWELFGPLVAGARLVFMDAAR

SEQ ID NO: 850406 - protein, 29 aa, Mycobacterium
QSAVGDIPWNLIWALLKEVAEAYLAFNVW

SEQ ID NO: 850407 - protein, 27 aa, Mycobacterium
QSCDDHLIIIVGNRLPAFELPPRAVFV

SEQ ID NO: 850408 - protein, 18 aa, Mycobacterium
QSCPFLPDGYDFTDPDVL

SEQ ID NO: 850409 - protein, 17 aa, Mycobacterium
QSDAFRLLRLMIHALRD

SEQ ID NO: 850410 - protein, 26 aa, Mycobacterium
QSDEIACLVLYGIHRARLRCPSDLAV

SEQ ID NO: 850411 - protein, 28 aa, Mycobacterium
QSDFDEAVFFQWLDKMPGAWSHGGARQT

SEQ ID NO: 850412 - protein, 32 aa, Mycobacterium
QSDRFRQLLDTPGPFASIYFEDSHDTHDAADQ

SEQ ID NO: 850413 - protein, 19 aa, Mycobacterium
QSEEALAYLIYTSGSTGEP

SEQ ID NO: 850414 - protein, 21 aa, Mycobacterium
QSEGLRRFAALSGASVGAEKL

SEQ ID NO: 850415 - protein, 20 aa, Mycobacterium
QSEGLRRFAALSGRSVGAEK

SEQ ID NO: 850416 - protein, 19 aa, Mycobacterium
QSEGLRRFAALSGTSVGAE

SEQ ID NO: 850417 - protein, 34 aa, Mycobacterium
QSESNAMWALSIPIPFIKPVGAGAGGYFAPHVRA

SEQ ID NO: 850418 - protein, 29 aa, Mycobacterium
QSESNAMWALSIPVPFSVPVGAGAGGYFA

SEQ ID NO: 850419 - protein, 31 aa, Mycobacterium
QSESNAMWALSIPVPFTKPVGAGAGGYFAPH

SEQ ID NO: 850420 - protein, 26 aa, Mycobacterium
QSETTGLRFPLFVKAVAGGGGRGMRR

SEQ ID NO: 850421 - protein, 20 aa, Mycobacterium
QSFALFTRPEGLRRWMAITA

SEQ ID NO: 850422 - protein, 22 aa, Mycobacterium
QSFGPATSWPTPGFVPSADVVK

SEQ ID NO: 850423 - protein, 17 aa, Mycobacterium
QSFLKRVGCRPYEQVML

SEQ ID NO: 850424 - protein, 18 aa, Mycobacterium
QSGEQFWRDYLAGLSAPT

SEQ ID NO: 850425 - protein, 29 aa, Mycobacterium
QSGKGQILLALELFGLYELDEQILHTAHA

SEQ ID NO: 850426 - protein, 25 aa, Mycobacterium
QSGKYRRVLALAWEKQSESNAMWAL

SEQ ID NO: 850427 - protein, 26 aa, Mycobacterium
QSGSGRLLVVFQPHLYSRTKAFAAEF

SEQ ID NO: 850428 - protein, 24 aa, Mycobacterium
QSGSIGLGFAIPVDQAKRIADELI

SEQ ID NO: 850429 - protein, 25 aa, Mycobacterium
QSGSIGLGFAIPVDQAKRIADELIQ

SEQ ID NO: 850430 - protein, 37 aa, Mycobacterium
QSGSILCDPWVNPAYFASWFPFPDNSALDWDALGDCD

SEQ ID NO: 850431 - protein, 17 aa, Mycobacterium
QSGYSFTVPVQRPILAP

SEQ ID NO: 850432 - protein, 25 aa, Mycobacterium
QSHAWIQGWAGGWWDYDPTNDSEIN

SEQ ID NO: 850433 - protein, 18 aa, Mycobacterium
QSHGGIGFTWEHPAHLYY

SEQ ID NO: 850434 - protein, 19 aa, Mycobacterium
QSHYFHVRPADQFDAMIHI

SEQ ID NO: 850435 - protein, 17 aa, Mycobacterium
QSIDLLAQLPVIASAHE

SEQ ID NO: 850436 - protein, 18 aa, Mycobacterium
QSIRPDVVMLRMPGFGLD

SEQ ID NO: 850437 - protein, 28 aa, Mycobacterium
QSITPDTLRQALLGKVLMVGDAVSLLPR

SEQ ID NO: 850438 - protein, 26 aa, Mycobacterium
QSIWEPTVALARKLWQVGVGTAVYSP

SEQ ID NO: 850439 - protein, 23 aa, Mycobacterium
QSKAAHALAALYAVDTRAGTTDD

SEQ ID NO: 850440 - protein, 25 aa, Mycobacterium
QSKMTTLLEIVKKLPPRMVVSRARL

SEQ ID NO: 850441 - protein, 24 aa, Mycobacterium
QSKSAGIWVSSLLGLPSSARVLEV

SEQ ID NO: 850442 - protein, 32 aa, Mycobacterium
QSLARAVYGQLPAYALPLFVRVVESMAHTTTF

SEQ ID NO: 850443 - protein, 19 aa, Mycobacterium
QSLAVAATLHECGVRPGDA

SEQ ID NO: 850444 - protein, 20 aa, Mycobacterium
QSLEGGYFIGPTLFDHVKTD

SEQ ID NO: 850445 - protein, 24 aa, Mycobacterium
QSLIDRLRIETASPVTPIVNLSGG

SEQ ID NO: 850446 - protein, 24 aa, Mycobacterium
QSLIQSMLKVLTRWPELRGDMDAN

SEQ ID NO: 850447 - protein, 32 aa, Mycobacterium
QSLLDAANGETMAMLGRPLIGNGADGAPGQAG

SEQ ID NO: 850448 - protein, 18 aa, Mycobacterium
QSLLNRLPDATLWSVMER

SEQ ID NO: 850449 - protein, 25 aa, Mycobacterium
QSLLSDLLRDALALEPLVAGRHSQR

SEQ ID NO: 850450 - protein, 20 aa, Mycobacterium
QSLMTLTTLDPPVAAVVSMW

SEQ ID NO: 850451 - protein, 32 aa, Mycobacterium
QSLNSTLCSYLNKMLWILTGNFAKRGAQHLHS

SEQ ID NO: 850452 - protein, 33 aa, Mycobacterium
QSLPLQDASMLMYPFSMAMSPLMNLMSSSLRGS

SEQ ID NO: 850453 - protein, 26 aa, Mycobacterium
QSLQPHYARTLALWAQALYAYRDEAI

SEQ ID NO: 850454 - protein, 33 aa, Mycobacterium
QSLSAQAAAFHERFLQTLSGGAGAYAAAEAANA

SEQ ID NO: 850455 - protein, 26 aa, Mycobacterium
QSLVPMLAMRLAYFDHLIDVSRLGEL

SEQ ID NO: 850456 - protein, 26 aa, Mycobacterium
QSLVPMLSMRLAFFDHLIDISRLAEL

SEQ ID NO: 850457 - protein, 27 aa, Mycobacterium
QSLVPMLSMRLAYFDHLIDISRLPELH

SEQ ID NO: 850458 - protein, 22 aa, Mycobacterium
QSLYHSGAFFQLYVTALEVGVI

SEQ ID NO: 850459 - protein, 17 aa, Mycobacterium
QSMSPAAIIAYSAALLA

SEQ ID NO: 850460 - protein, 30 aa, Mycobacterium
QSNFPLGIIPLLLLDMWEHAFYLQYKNVKV

SEQ ID NO: 850461 - protein, 24 aa, Mycobacterium
QSNNISRVAWLTAGLPDHVGATTV

SEQ ID NO: 850462 - protein, 25 aa, Mycobacterium
QSNPSRWRRNLMACSGIEFCKLSFA

SEQ ID NO: 850463 - protein, 20 aa, Mycobacterium
QSPDLIADFTAKIPIAVIGE

SEQ ID NO: 850464 - protein, 23 aa, Mycobacterium
QSPHEFFDYQVLLGYLASRAGRL

SEQ ID NO: 850465 - protein, 18 aa, Mycobacterium
QSPILQRGLREFLAAGPE

SEQ ID NO: 850466 - protein, 27 aa, Mycobacterium
QSPKESWLRLLIIGAGLPRPTTQIPVA

SEQ ID NO: 850467 - protein, 27 aa, Mycobacterium
QSPKESWLRLVLIDAGLPRPTTQIRVT

SEQ ID NO: 850468 - protein, 27 aa, Mycobacterium
QSPKESWLRLVLIQAGLPRPQTQIPVV

SEQ ID NO: 850469 - protein, 27 aa, Mycobacterium
QSPKETWLRLLLLDDGLPRPQTQIRVA

SEQ ID NO: 850470 - protein, 25 aa, Mycobacterium
QSPKPPAPTLSPRRSTRQLMVGDVG

SEQ ID NO: 850471 - protein, 19 aa, Mycobacterium
QSPPDTPNPGWLYAARLRQ

SEQ ID NO: 850472 - protein, 29 aa, Mycobacterium
QSPPDTPNPGWLYATRLRQMKTLLSEGIR

SEQ ID NO: 850473 - protein, 23 aa, Mycobacterium
QSPQAVVAWLQQFLDELRIAMHC

SEQ ID NO: 850474 - protein, 27 aa, Mycobacterium
QSPRESYLRLLLIDAGLPRPQTQIPVL

SEQ ID NO: 850475 - protein, 27 aa, Mycobacterium
QSPRGGTLRLMRPLFAAGLGGRLGDGR

SEQ ID NO: 850476 - protein, 17 aa, Mycobacterium
QSPRLVAYTATKSALSS

SEQ ID NO: 850477 - protein, 18 aa, Mycobacterium
QSPRVWSTTLLREPIDLL

SEQ ID NO: 850478 - protein, 24 aa, Mycobacterium
QSQADYFMRLLLQNRRLIEQRLDD

SEQ ID NO: 850479 - protein, 19 aa, Mycobacterium
QSRAYVLDSALRPVPHGAA

SEQ ID NO: 850480 - protein, 21 aa, Mycobacterium
QSRCALGSLPWSSVLHCQRGR

SEQ ID NO: 850481 - protein, 29 aa, Mycobacterium
QSRHRRRTRPGLVDPGRRYEYLDSDGYAA

SEQ ID NO: 850482 - protein, 24 aa, Mycobacterium
QSRHVAWVIAWALRHGVTEVEATA

SEQ ID NO: 850483 - protein, 22 aa, Mycobacterium
QSRIRRLVVLNIPPVWQQPGRV

SEQ ID NO: 850484 - protein, 24 aa, Mycobacterium
QSRKGLISSWKAFAPAHAGKVAIE

SEQ ID NO: 850485 - protein, 24 aa, Mycobacterium
QSRKGLISSWKAFAPAWAGKVAIE

SEQ ID NO: 850486 - protein, 23 aa, Mycobacterium
QSRKGLISSWKAYAPAHAGKVAI

SEQ ID NO: 850487 - protein, 17 aa, Mycobacterium
QSRLACVAGLRAIAKVA

SEQ ID NO: 850488 - protein, 18 aa, Mycobacterium
QSRLHRWRFNLTTGAVHE

SEQ ID NO: 850489 - protein, 19 aa, Mycobacterium
QSRMPLYDGTLGYAAAKAA

SEQ ID NO: 850490 - protein, 17 aa, Mycobacterium
QSRPCEVSYRGDARPIP

SEQ ID NO: 850491 - protein, 35 aa, Mycobacterium
QSRRGHRHGVLAGQLRGFLALPGQQRPQPGVHPVD

SEQ ID NO: 850492 - protein, 27 aa, Mycobacterium
QSRTSMKWRAYPADVLPLWVAEMDVKL

SEQ ID NO: 850493 - protein, 22 aa, Mycobacterium
QSRYRVFIIDEAHMVTTAGFNA

SEQ ID NO: 850494 - protein, 17 aa, Mycobacterium
QSSFANNGGPGRDGADG

SEQ ID NO: 850495 - protein, 17 aa, Mycobacterium
QSSFARVLTDFVRGRNP

SEQ ID NO: 850496 - protein, 20 aa, Mycobacterium
QSSFYANWYQPACGKAGCST

SEQ ID NO: 850497 - protein, 24 aa, Mycobacterium
QSSIDIATHAVDRVKEVFTGKDDD

SEQ ID NO: 850498 - protein, 18 aa, Mycobacterium
QSSLAKVMYFTAPVLNDS

SEQ ID NO: 850499 - protein, 25 aa, Mycobacterium
QSSTAAWLYSGFYGLAKVGINGLTQ

SEQ ID NO: 850500 - protein, 21 aa, Mycobacterium
QSSVRGLLRVAGRTFRVQRAT

SEQ ID NO: 850501 - protein, 34 aa, Mycobacterium
QSTEFAQPALFALGIALAALWQSFGVAPDVVMGH

SEQ ID NO: 850502 - protein, 24 aa, Mycobacterium
QSTGNFDLFVVGSGFFGLTIAERA

SEQ ID NO: 850503 - protein, 26 aa, Mycobacterium
QSTIDLNTLSFRRLRVLGTTFSVRTA

SEQ ID NO: 850504 - protein, 19 aa, Mycobacterium
QSTPRRWTFFGRDANGTQH

SEQ ID NO: 850505 - protein, 17 aa, Mycobacterium
QSTRRIAELYATDPEFA

SEQ ID NO: 850506 - protein, 36 aa, Mycobacterium
QSVAINLLGPMRLTASLLPALLRKSHATILNVTSGL

SEQ ID NO: 850507 - protein, 20 aa, Mycobacterium
QSVDLPLATLAREQLAASLG

SEQ ID NO: 850508 - protein, 25 aa, Mycobacterium
QSVIDAVGLALPFSPVCGPDCQGLC

SEQ ID NO: 850509 - protein, 25 aa, Mycobacterium
QSVIDLNLIATFNISRLAAAHMAKN

SEQ ID NO: 850510 - protein, 23 aa, Mycobacterium
QSVIFGAALRELAAKYPDRLTVI

SEQ ID NO: 850511 - protein, 18 aa, Mycobacterium
QSVLPVVVFLHGGGWTVG

SEQ ID NO: 850512 - protein, 18 aa, Mycobacterium
QSVPVLVHPDPRGVLGGL

SEQ ID NO: 850513 - protein, 27 aa, Mycobacterium
QSVSRTMFGWLLGGLSRTSLGNTAIHN

SEQ ID NO: 850514 - protein, 24 aa, Mycobacterium
QSWAGKGVLLKLIARMVRARVFGE

SEQ ID NO: 850515 - protein, 30 aa, Mycobacterium
QSWEHGRFSAPYLRDSLLAAGALCETLETA

SEQ ID NO: 850516 - protein, 19 aa, Mycobacterium
QSWGIGRWSPLGEKVLDSP

SEQ ID NO: 850517 - protein, 26 aa, Mycobacterium
QSWPFPIVPIVLIVAHPRNLPPLPGR

SEQ ID NO: 850518 - protein, 17 aa, Mycobacterium
QSWQRIQQAHPGRFILG

SEQ ID NO: 850519 - protein, 20 aa, Mycobacterium
QSYALYPHMTVRQNIAFPLT

SEQ ID NO: 850520 - protein, 31 aa, Mycobacterium
QSYALYPHMTVRQNIAFPLTLAKMSKDDINA

SEQ ID NO: 850521 - protein, 33 aa, Mycobacterium
QTAANILLSSRFPMWMAWGPDLTFFCNDAYRNV

SEQ ID NO: 850522 - protein, 36 aa, Mycobacterium
QTAAQELLAVINTPTQTLLGRPLIGNGADGAPGQAG

SEQ ID NO: 850523 - protein, 24 aa, Mycobacterium
QTADGAPFHRLCFGLAAGGVGNRF

SEQ ID NO: 850524 - protein, 28 aa, Mycobacterium
QTAEALKPYYRFLCKRPLSNDEYLPMFN

SEQ ID NO: 850525 - protein, 27 aa, Mycobacterium
QTAEALKPYYRFLCKRPLSNDEYLPTF

SEQ ID NO: 850526 - protein, 29 aa, Mycobacterium
QTAERGLFDFFFLAEGLRLREHRGKIHDL

SEQ ID NO: 850527 - protein, 31 aa, Mycobacterium
QTAGGFFFLVELLDATSFWQSARAGILESLG

SEQ ID NO: 850528 - protein, 27 aa, Mycobacterium
QTAGMLEPLRMYAHIPRLLNAYGRLEQ

SEQ ID NO: 850529 - protein, 20 aa, Mycobacterium
QTAIFAFPYDVEAVAKIATL

SEQ ID NO: 850530 - protein, 25 aa, Mycobacterium
QTALGEGFFINQLITWTVGDGETVA

SEQ ID NO: 850531 - protein, 26 aa, Mycobacterium
QTALGEGWFINQHIIWQVGDEDVAEM

SEQ ID NO: 850532 - protein, 17 aa, Mycobacterium
QTALIRLSRLQISDEIA

SEQ ID NO: 850533 - protein, 32 aa, Mycobacterium
QTALRTMIPERARRAYPIRPIIETLADTGSVT

SEQ ID NO: 850534 - protein, 23 aa, Mycobacterium
QTALTPLLHKAAANPEVILAGVC

SEQ ID NO: 850535 - protein, 20 aa, Mycobacterium
QTATLWFEVAKPLMSTNPQR

SEQ ID NO: 850536 - protein, 21 aa, Mycobacterium
QTAVLIETLVALGAEVRWASC

SEQ ID NO: 850537 - protein, 31 aa, Mycobacterium
QTAVLYDHFTPYTLIQLEELGFCGKGEAKDF

SEQ ID NO: 850538 - protein, 18 aa, Mycobacterium
QTAVVYQVYIRSFADGNG

SEQ ID NO: 850539 - protein, 19 aa, Mycobacterium
QTCLATRRYVRRQRSWFRR

SEQ ID NO: 850540 - protein, 24 aa, Mycobacterium
QTDGNFVLYTAEKPVWHTDTKGKK

SEQ ID NO: 850541 - protein, 25 aa, Mycobacterium
QTDGNFVLYTPERPVWHSDTVGSKS

SEQ ID NO: 850542 - protein, 29 aa, Mycobacterium
QTDLGMMMRYFLMPTSDWTDEETLAIVKQ

SEQ ID NO: 850543 - protein, 23 aa, Mycobacterium
QTDSERVFALITAAIRTHDGDVS

SEQ ID NO: 850544 - protein, 23 aa, Mycobacterium
QTDSERVFALITATIRAHGGDQS

SEQ ID NO: 850545 - protein, 22 aa, Mycobacterium
QTDTGWVWKFDPAIFSGSLQGQ

SEQ ID NO: 850546 - protein, 24 aa, Mycobacterium
QTDTPLIFLQNVTGFMVGTEYEQG

SEQ ID NO: 850547 - protein, 21 aa, Mycobacterium
QTDYGVKPYSLLMGSVQVADD

SEQ ID NO: 850548 - protein, 26 aa, Mycobacterium
QTDYRALLEFFFQIHDPTTKDRQGND

SEQ ID NO: 850549 - protein, 24 aa, Mycobacterium
QTEAQMVRLLVAYAAWHLDRDHHM

SEQ ID NO: 850550 - protein, 24 aa, Mycobacterium
QTEAQMVRLLVQYAAWHLDRDHHM

SEQ ID NO: 850551 - protein, 25 aa, Mycobacterium
QTEAQMVRLLVYYAATQLDANHHME

SEQ ID NO: 850552 - protein, 27 aa, Mycobacterium
QTEAQMVRLLVYYAAWHLDRNHHMEVS

SEQ ID NO: 850553 - protein, 26 aa, Mycobacterium
QTEGMLSPWLELPGAADRIATWSQAS

SEQ ID NO: 850554 - protein, 23 aa, Mycobacterium
QTEKPKVLILGSGPNRIGQGIEF

SEQ ID NO: 850555 - protein, 20 aa, Mycobacterium
QTELGLAYLFISHDLAVIRQ

SEQ ID NO: 850556 - protein, 17 aa, Mycobacterium
QTELVGHNVLPGRWSFQ

SEQ ID NO: 850557 - protein, 24 aa, Mycobacterium
QTERTMLVPLIDALHRRMREERVM

SEQ ID NO: 850558 - protein, 22 aa, Mycobacterium
QTESLTESQTESPLPLAISSRM

SEQ ID NO: 850559 - protein, 18 aa, Mycobacterium
QTFIGRMNTVPPTVWGGV

SEQ ID NO: 850560 - protein, 17 aa, Mycobacterium
QTFLRRVQQLPAHTQTL

SEQ ID NO: 850561 - protein, 23 aa, Mycobacterium
QTFVGTRRYVRRQRSWFRRDHRV

SEQ ID NO: 850562 - protein, 29 aa, Mycobacterium
QTFVTGDRFASILDPFGHRWTVMTRVENL

SEQ ID NO: 850563 - protein, 17 aa, Mycobacterium
QTGAPLPTLADAVLPLR

SEQ ID NO: 850564 - protein, 25 aa, Mycobacterium
QTGATLFPHLTFDPLRTLQAIERHR

SEQ ID NO: 850565 - protein, 24 aa, Mycobacterium
QTGETFVFIEQWADAEALTAHSTA

SEQ ID NO: 850566 - protein, 17 aa, Mycobacterium
QTGFARTGAWFASEHEG

SEQ ID NO: 850567 - protein, 28 aa, Mycobacterium
QTGGKPFGVDLLLPPKYVGADEGGIDAK

SEQ ID NO: 850568 - protein, 25 aa, Mycobacterium
QTGKRKWILGKLHKDRKFDGAMAGV

SEQ ID NO: 850569 - protein, 18 aa, Mycobacterium
QTGLLGDANLRGLVFVES

SEQ ID NO: 850570 - protein, 23 aa, Mycobacterium
QTGLPALQRYLTDNRKIIAWVNS

SEQ ID NO: 850571 - protein, 21 aa, Mycobacterium
QTGMRLALFEVFDPATTPYAI

SEQ ID NO: 850572 - protein, 26 aa, Mycobacterium
QTGQKFAREIFFLGRAYDAQTMHQMG

SEQ ID NO: 850573 - protein, 23 aa, Mycobacterium
QTGSYAPPTNLLVNGQPVTGTGT

SEQ ID NO: 850574 - protein, 25 aa, Mycobacterium
QTGTWLGMRAVIPHMVSQHGGSIIN

SEQ ID NO: 850575 - protein, 27 aa, Mycobacterium
QTGVTPMRWIIDQRVLRARRLLEETGL

SEQ ID NO: 850576 - protein, 32 aa, Mycobacterium
QTGYAPCFAALAGLAPLVGYPGGPPLGTSMRY

SEQ ID NO: 850577 - protein, 26 aa, Mycobacterium
QTGYAPCFAALAGLAPLVGYRGGPPL

SEQ ID NO: 850578 - protein, 24 aa, Mycobacterium
QTHAALVELLCTLPVDMAADRIST

SEQ ID NO: 850579 - protein, 37 aa, Mycobacterium
QTHAGSILCDPWLNPAYFTSWFPFPDNSALDWGAVGD

SEQ ID NO: 850580 - protein, 30 aa, Mycobacterium
QTHAWLADHAVFDTVLLPGAALAELALVAG

SEQ ID NO: 850581 - protein, 20 aa, Mycobacterium
QTHDSLRRFLLEETYELLDA

SEQ ID NO: 850582 - protein, 21 aa, Mycobacterium
QTHISSLRRTLGDGFVLTAGA

SEQ ID NO: 850583 - protein, 23 aa, Mycobacterium
QTHSMVLVTYRPDYRGALRGVRG

SEQ ID NO: 850584 - protein, 29 aa, Mycobacterium
QTIAEQLMPHWLLALQDAAKRRGTTAPQV

SEQ ID NO: 850585 - protein, 18 aa, Mycobacterium
QTIAWTMLGVALSAYEHW

SEQ ID NO: 850586 - protein, 17 aa, Mycobacterium
QTIDWPFRAVEALEAGA

SEQ ID NO: 850587 - protein, 31 aa, Mycobacterium; identical to SEQ ID NO: 130786

SEQ ID NO: 850588 - protein, 26 aa, Mycobacterium
QTISEQLMPHWLLSLQADAARRGDTA

SEQ ID NO: 850589 - protein, 27 aa, Mycobacterium
QTKDIPVYRFVLRAYAAQLVQDHANMT

SEQ ID NO: 850590 - protein, 35 aa, Mycobacterium
QTKPTLMLLDGNSLAFRAFYALPAENFKTRGGLTT

SEQ ID NO: 850591 - protein, 33 aa, Mycobacterium
QTLANLYLALDRDLAIIPVLNKIDLPAADPDRY

SEQ ID NO: 850592 - protein, 32 aa, Mycobacterium
QTLANLYLALDRDLHIIPVLNKIDLPAADPDR

SEQ ID NO: 850593 - protein, 33 aa, Mycobacterium; identical to SEQ ID NO: 221843

SEQ ID NO: 850594 - protein, 26 aa, Mycobacterium
QTLAQLALAWVLRDPAVSSTLIGASS

SEQ ID NO: 850595 - protein, 27 aa, Mycobacterium
QTLEAWFMHIPGMKVIVPSTPRDGKGL

SEQ ID NO: 850596 - protein, 20 aa, Mycobacterium
QTLEPDWQLDGDGWKITIEG

SEQ ID NO: 850597 - protein, 25 aa, Mycobacterium
QTLERDLHFFLLAAVRLRRCIEQVS

SEQ ID NO: 850598 - protein, 26 aa, Mycobacterium
QTLFSDGFFLTKRDMDWFMDHFLDGA

SEQ ID NO: 850599 - protein, 19 aa, Mycobacterium
QTLKLFQVCKHRGIPIITV

SEQ ID NO: 850600 - protein, 19 aa, Mycobacterium
QTLLRLTGAHREYLQRWTR

SEQ ID NO: 850601 - protein, 18 aa, Mycobacterium
QTLLRTVLAPMFASRAMN

SEQ ID NO: 850602 - protein, 18 aa, Mycobacterium
QTLLVWNQSFEIAPNRWR

SEQ ID NO: 850603 - protein, 34 aa, Mycobacterium
QTLMPGPANQRGLRRGWQRGEHPPTVTRAPVIFQ

SEQ ID NO: 850604 - protein, 18 aa, Mycobacterium
QTLPVLPCHVGNPDLWFA

SEQ ID NO: 850605 - protein, 28 aa, Mycobacterium
QTLQRIKDLVIPPAWKNVWISPHANGHV

SEQ ID NO: 850606 - protein, 33 aa, Mycobacterium
QTLQRIKDLVIPPAWQKVWIAPYPNGHIQAVGT

SEQ ID NO: 850607 - protein, 17 aa, Mycobacterium
QTLRPYPELVAGRDELL

SEQ ID NO: 850608 - protein, 24 aa, Mycobacterium
QTLSAYLTMQLLEAAGLPPGVINL

SEQ ID NO: 850609 - protein, 26 aa, Mycobacterium
QTLSFVARRLLAERVMIVFACREKIT

SEQ ID NO: 850610 - protein, 20 aa, Mycobacterium
QTLTAAAPWIGIAIPIVSNA

SEQ ID NO: 850611 - protein, 17 aa, Mycobacterium
QTLVLYRPDPDGDEVLG

SEQ ID NO: 850612 - protein, 18 aa, Mycobacterium
QTLVTLHRRLFDATTELE

SEQ ID NO: 850613 - protein, 26 aa, Mycobacterium
QTLYRTMGLWRYRAGTIGPWNLREWV

SEQ ID NO: 850614 - protein, 34 aa, Mycobacterium
QTMFGAAMKLLPRIPLPEILPHNLVLSNVPGPQE

SEQ ID NO: 850615 - protein, 26 aa, Mycobacterium
QTMMSIFGTPFFVCTSSAGLMMSAMS

SEQ ID NO: 850616 - protein, 27 aa, Mycobacterium
QTMSPAPQAPLGMFARISPAGVVAAPA

SEQ ID NO: 850617 - protein, 25 aa, Mycobacterium
QTMVDLLSTVLIRWERDDEVRAVVV

SEQ ID NO: 850618 - protein, 25 aa, Mycobacterium
QTMVQPGLLSWRDVARVMSENPARI

SEQ ID NO: 850619 - protein, 17 aa, Mycobacterium
QTNPLLGVASQLLMLAG

SEQ ID NO: 850620 - protein, 28 aa, Mycobacterium
QTNVFGPLRIARAFAPILKANGGGAIVN

SEQ ID NO: 850621 - protein, 33 aa, Mycobacterium
QTPADACYILLSGEARVYVGRDPVAVLGPGEVI

SEQ ID NO: 850622 - protein, 24 aa, Mycobacterium
QTPARKALILNLAPEPGETAGFSA

SEQ ID NO: 850623 - protein, 25 aa, Mycobacterium
QTPASILHLFSLIGDLLPPGVVNIV

SEQ ID NO: 850624 - protein, 24 aa, Mycobacterium
QTPDRFLVGLAVLSLMAAAADEKP

SEQ ID NO: 850625 - protein, 27 aa, Mycobacterium
QTPGMLTPWLELPGAADRLAAWSQISG

SEQ ID NO: 850626 - protein, 27 aa, Mycobacterium
QTPGSARRLMLRPFSAADDRDVFAERT

SEQ ID NO: 850627 - protein, 18 aa, Mycobacterium
QTPKGLPLGVQFVAPLGG

SEQ ID NO: 850628 - protein, 17 aa, Mycobacterium
QTPLGLAKRLADAGVPV

SEQ ID NO: 850629 - protein, 22 aa, Mycobacterium
QTPLMIVLEDIHWADNATLLAL

SEQ ID NO: 850630 - protein, 25 aa, Mycobacterium
QTPLRTMVPERARRAYPVGPVIETL

SEQ ID NO: 850631 - protein, 25 aa, Mycobacterium
QTPQGFARELLLRAYQRAGTADFTD

SEQ ID NO: 850632 - protein, 31 aa, Mycobacterium
QTPVAYVDVPGYYPFWAITKHADVMAIERDN

SEQ ID NO: 850633 - protein, 25 aa, Mycobacterium
QTQCEMLRALIHKTAWSMDTYGPFS

SEQ ID NO: 850634 - protein, 29 aa, Mycobacterium
QTQESTLGLIFHWADQKGLPLLDIKDLRS

SEQ ID NO: 850635 - protein, 23 aa, Mycobacterium
QTQKPKVLILGSGPNRIGQGIEF

SEQ ID NO: 850636 - protein, 26 aa, Mycobacterium
QTQSISLLALLARLTVAALKQFPELN

SEQ ID NO: 850637 - protein, 26 aa, Mycobacterium
QTRAALLHRFGMFGIRISVAVMRVGV

SEQ ID NO: 850638 - protein, 17 aa, Mycobacterium
QTRAEPHLARITCPALV

SEQ ID NO: 850639 - protein, 23 aa, Mycobacterium
QTRAERHLARIDCPALVINAEQD

SEQ ID NO: 850640 - protein, 27 aa, Mycobacterium
QTREHVLLARQVGVPYILVALNKADAV

SEQ ID NO: 850641 - protein, 31 aa, Mycobacterium
QTREHVLLARQVGVPYILVALNKADMVDDEE

SEQ ID NO: 850642 - protein, 29 aa, Mycobacterium
QTREHVLLARQVGVPYILVALNKSDMVDD

SEQ ID NO: 850643 - protein, 17 aa, Mycobacterium
QTRELVFAKTPPTVIML

SEQ ID NO: 850644 - protein, 28 aa, Mycobacterium
QTRGKPYGVDLLLPPKYVGAEQGGIDPV

SEQ ID NO: 850645 - protein, 18 aa, Mycobacterium
QTRHLLFSVSKSLVAAVV

SEQ ID NO: 850646 - protein, 18 aa, Mycobacterium
QTRIRFVPPEHWGNHEWD

SEQ ID NO: 850647 - protein, 22 aa, Mycobacterium
QTRLIVVDRAEPERKHPRPVDA

SEQ ID NO: 850648 - protein, 33 aa, Mycobacterium
QTRMSGMLRHRPQPALLLLADLRRIHRIAAGAS

SEQ ID NO: 850649 - protein, 25 aa, Mycobacterium
QTRQRWLVLTLPEQSDDVWVAGFSA

SEQ ID NO: 850650 - protein, 25 aa, Mycobacterium
QTRQVIDLVRRLAGQGLGVVLISHN

SEQ ID NO: 850651 - protein, 24 aa, Mycobacterium
QTRRFLVDLSPVDRPPFSCPIDDV

SEQ ID NO: 850652 - protein, 20 aa, Mycobacterium
QTRVSAWIALQSLPPENRPV

SEQ ID NO: 850653 - protein, 25 aa, Mycobacterium
QTRWKNYEIGLKTLGWLAGATEVYG

SEQ ID NO: 850654 - protein, 26 aa, Mycobacterium
QTSAESYLVFEKLLDAAAKSGANAIH

SEQ ID NO: 850655 - protein, 28 aa, Mycobacterium
QTSENNYPYTYWWLKGYNDAVAEVAVAR

SEQ ID NO: 850656 - protein, 19 aa, Mycobacterium
QTSIAAGATDALHPGLALR

SEQ ID NO: 850657 - protein, 23 aa, Mycobacterium
QTSLEPRHLVLPMFVADGVDEPR

SEQ ID NO: 850658 - protein, 23 aa, Mycobacterium
QTSSPAHLTMPYVAPGDGEVVGI

SEQ ID NO: 850659 - protein, 36 aa, Mycobacterium
QTSVPVQVLVPRKDMFVTPALQRFTGAIPGGGRVVP

SEQ ID NO: 850660 - protein, 29 aa, Mycobacterium
QTTGRLGLLPLRWALACLLIDIESVTFSA

SEQ ID NO: 850661 - protein, 24 aa, Mycobacterium
QTTHFERIQMFGQAIYPSGDGYVV

SEQ ID NO: 850662 - protein, 23 aa, Mycobacterium
QTTLTRYPGMYHGFLMRPDGTAR

SEQ ID NO: 850663 - protein, 24 aa, Mycobacterium
QTTPSRWRRNLMACTGIEYCKLSF

SEQ ID NO: 850664 - protein, 23 aa, Mycobacterium
QTTQRMLTRLGAPQRTAHFADTQ

SEQ ID NO: 850665 - protein, 24 aa, Mycobacterium
QTTRARRWLRRKLRGGQPRRSPRV

SEQ ID NO: 850666 - protein, 27 aa, Mycobacterium
QTTRRFDALKIFLTLRALGERRIGAMI

SEQ ID NO: 850667 - protein, 27 aa, Mycobacterium
QTTRRFDALKVLVTLRAVGQRQVAAMI

SEQ ID NO: 850668 - protein, 27 aa, Mycobacterium
QTTTRLKFLVAFRPGFISPTLAAHQAA

SEQ ID NO: 850669 - protein, 20 aa, Mycobacterium
QTTVQRIVDLRLAGNGTKAI

SEQ ID NO: 850670 - protein, 29 aa, Mycobacterium
QTVAQITLQNYFRMYNKLAGMTGTAETEA

SEQ ID NO: 850671 - protein, 25 aa, Mycobacterium
QTVARWLVLHLRRPGGQTQFAAPVW

SEQ ID NO: 850672 - protein, 31 aa, Mycobacterium
QTVAVLDFVIPGLADAIRRAGLPKVPTSVLS

SEQ ID NO: 850673 - protein, 27 aa, Mycobacterium
QTVAVLDFVIPGLADAIRRSGLPKIPT

SEQ ID NO: 850674 - protein, 30 aa, Mycobacterium
QTVAVLDYMIPGLADAIRRSGLPKVPTSVL

SEQ ID NO: 850675 - protein, 22 aa, Mycobacterium
QTVEFIKSRDLVYDTPVTLAPD

SEQ ID NO: 850676 - protein, 18 aa, Mycobacterium
QTVFDLTVQWALDRHTFG

SEQ ID NO: 850677 - protein, 37 aa, Mycobacterium
QTVGADVLGAVNAPTMAVLGRPLIGDGVDAAAGSGHN

SEQ ID NO: 850678 - protein, 25 aa, Mycobacterium
QTVGPFYGYALPIPGGNELVPPGSP

SEQ ID NO: 850679 - protein, 22 aa, Mycobacterium
QTVLWARMLDRLAGDTPPAIVC

SEQ ID NO: 850680 - protein, 20 aa, Mycobacterium
QTVQLIVVGAERFNRAGDVT

SEQ ID NO: 850681 - protein, 36 aa, Mycobacterium
QTVQQDVLGLINAPTQALLGRGLIGDGAAGTASHPD

SEQ ID NO: 850682 - protein, 20 aa, Mycobacterium
QTVREWLAAEPFRAPEAAEL

SEQ ID NO: 850683 - protein, 20 aa, Mycobacterium
QTVRPKILSPQYSDYQVLQG

SEQ ID NO: 850684 - protein, 27 aa, Mycobacterium
QTVSHLRFGPQPIKAPYLVQRAGFVGC

SEQ ID NO: 850685 - protein, 30 aa, Mycobacterium
QTVSHLRFGPQPIRAPYLVQQASFVGCHHQ

SEQ ID NO: 850686 - protein, 20 aa, Mycobacterium
QTVSYTREFIRCRQIEALLC

SEQ ID NO: 850687 - protein, 25 aa, Mycobacterium
QTVTLDICRAHLGLAFRMHVTAATM

SEQ ID NO: 850688 - protein, 27 aa, Mycobacterium
QTVTLEDALRLLSLPRVVGVDPESGEE

SEQ ID NO: 850689 - protein, 21 aa, Mycobacterium
QTVVIGLYPSWDISPEALGLA

SEQ ID NO: 850690 - protein, 18 aa, Mycobacterium
QTVVKRGYRLAIDPTTIG

SEQ ID NO: 850691 - protein, 24 aa, Mycobacterium
QTVVPAARALPLAGVATAAETGPA

SEQ ID NO: 850692 - protein, 31 aa, Mycobacterium
QTVVPRRDVFVTPALQRFTGAIPQGARVIAI

SEQ ID NO: 850693 - protein, 24 aa, Mycobacterium
QTVYRYFPHPEAIRLACAMRAADG

SEQ ID NO: 850694 - protein, 17 aa, Mycobacterium
QTVYRYFSSTEALLVAA

SEQ ID NO: 850695 - protein, 19 aa, Mycobacterium
QTWEAALFAAHHGLSKLIV

SEQ ID NO: 850696 - protein, 17 aa, Mycobacterium
QTWYLRTLRDEGAVAKR

SEQ ID NO: 850697 - protein, 25 aa, Mycobacterium
QTYAARIVPWLSVARVARASTDDLE

SEQ ID NO: 850698 - protein, 20 aa, Mycobacterium
QTYELLGRTPHRPVRLRPAP

SEQ ID NO: 850699 - protein, 19 aa, Mycobacterium
QTYFTTPHFDGYPAVLVNL

SEQ ID NO: 850700 - protein, 36 aa, Mycobacterium
QTYNTPAIGTLLLLADQIDWLLAGGGLDWATKRTAD

SEQ ID NO: 850701 - protein, 33 aa, Mycobacterium
QTYVGTRRYVRRQRSWFRRDHRVHWLDAGKGEA

SEQ ID NO: 850702 - protein, 22 aa, Mycobacterium
QVAAPLAAYVPAVRTGNLIYTA

SEQ ID NO: 850703 - protein, 19 aa, Mycobacterium
QVAAVLRQAQRLQSVMDDQ

SEQ ID NO: 850704 - protein, 23 aa, Mycobacterium
QVAELLFDVLGPAALDSGVTAPL

SEQ ID NO: 850705 - protein, 22 aa, Mycobacterium
QVAELLFDVLGPIALDSGTGAA

SEQ ID NO: 850706 - protein, 24 aa, Mycobacterium
QVAELRRLWRGEPPFEGADPVGPA

SEQ ID NO: 850707 - protein, 33 aa, Mycobacterium
QVAELYDAFTINPILLLEETGLVAAAKGGHFFL

SEQ ID NO: 850708 - protein, 26 aa, Mycobacterium
QVAESLRYVAAWNSAFLPSKDLAEAV

SEQ ID NO: 850709 - protein, 26 aa, Mycobacterium
QVAGITYRQLDYWARTSLVVPSIRSA

SEQ ID NO: 850710 - protein, 31 aa, Mycobacterium
QVAGRIRSAGAIFVGPWAPVSLGDYCAGSNH

SEQ ID NO: 850711 - protein, 22 aa, Mycobacterium
QVAKRLPMWTIYEMLGLPEDER

SEQ ID NO: 850712 - protein, 17 aa, Mycobacterium
QVALHHQKWTVGGMAKG

SEQ ID NO: 850713 - protein, 25 aa, Mycobacterium
QVALVNAWSAAFARYGRTVGQVLLT

SEQ ID NO: 850714 - protein, 18 aa, Mycobacterium
QVAQILRFAATEVVPRLN

SEQ ID NO: 850715 - protein, 25 aa, Mycobacterium
QVARLWEHWGKPDIVWYPGGHTGFF

SEQ ID NO: 850716 - protein, 31 aa, Mycobacterium
QVASRIRSAGAIFVGPWAPVSLGDYCAGSNH

SEQ ID NO: 850717 - protein, 19 aa, Mycobacterium
QVATFLSGPWQSDLTAAGF

SEQ ID NO: 850718 - protein, 26 aa, Mycobacterium
QVATPKGEIAALLPPPVIAGYEMPMG

SEQ ID NO: 850719 - protein, 23 aa, Mycobacterium
QVAVSLREFGFSDRIVIVDAEAR

SEQ ID NO: 850720 - protein, 22 aa, Mycobacterium
QVAYQLAFHEGSRYPLDRGAAG

SEQ ID NO: 850721 - protein, 24 aa, Mycobacterium
QVCPSCSDLYARDTWQLVHAGTAG

SEQ ID NO: 850722 - protein, 18 aa, Mycobacterium
QVCPVCLGLPGSLPVLNQ

SEQ ID NO: 850723 - protein, 22 aa, Mycobacterium
QVCPVCLGLPGSLPVLNQSAVE

SEQ ID NO: 850724 - protein, 19 aa, Mycobacterium
QVCPVCLGLPGSLPVLNQT

SEQ ID NO: 850725 - protein, 24 aa, Mycobacterium
QVCPVCLGLPGSLPVLNRAAVESA

SEQ ID NO: 850726 - protein, 31 aa, Mycobacterium
QVCRKAPGFAKWFLRRRITKLLPAGYPVDVH

SEQ ID NO: 850727 - protein, 19 aa, Mycobacterium
QVDAILARLGPDPLRPRSD

SEQ ID NO: 850728 - protein, 30 aa, Mycobacterium
QVDALAQFVPWPQLVIYRNQGRLLYDGGDN

SEQ ID NO: 850729 - protein, 23 aa, Mycobacterium
QVDGEWVDWFPPTHPDSPEAPNM

SEQ ID NO: 850730 - protein, 18 aa, Mycobacterium
QVDKPLSAAYDPFFGPAP

SEQ ID NO: 850731 - protein, 26 aa, Mycobacterium
QVDLAQPDPVLQPPGPARGPPAVVAE

SEQ ID NO: 850732 - protein, 26 aa, Mycobacterium
QVDLDSMDWLNFLLGIHKRMHVDIPE

SEQ ID NO: 850733 - protein, 26 aa, Mycobacterium
QVDLDSMDWLSFLRGIHKRLHVDIPE

SEQ ID NO: 850734 - protein, 23 aa, Mycobacterium
QVDLSRTVGWFTAKYPVSLRVGG

SEQ ID NO: 850735 - protein, 18 aa, Mycobacterium
QVDLWTFGDSGKSIIVLS

SEQ ID NO: 850736 - protein, 17 aa, Mycobacterium
QVDLWTFGDTGRSIIVL

SEQ ID NO: 850737 - protein, 17 aa, Mycobacterium
QVDMRCLLIIGSSQTQW

SEQ ID NO: 850738 - protein, 33 aa, Mycobacterium
QVDPNGPFFLVPWTWRQHLWPTEKFELAHSRVA

SEQ ID NO: 850739 - protein, 25 aa, Mycobacterium
QVDQKFLFHRPIKDGDRLRGVMTIL

SEQ ID NO: 850740 - protein, 24 aa, Mycobacterium
QVDRGLTYVFISHDLAVVSAISDQ

SEQ ID NO: 850741 - protein, 24 aa, Mycobacterium
QVDTALDRLLLGTALRQLSDDHRA

SEQ ID NO: 850742 - protein, 17 aa, Mycobacterium
QVEFADVILLNKTDLVT

SEQ ID NO: 850743 - protein, 35 aa, Mycobacterium
QVEFVVYVAALQLGWRWLPRRLTLEPLAYNRYQYE

SEQ ID NO: 850744 - protein, 23 aa, Mycobacterium
QVELSTIRLLAKLPTIAAYAYKK

SEQ ID NO: 850745 - protein, 24 aa, Mycobacterium
QVELSTIRLLAKLPTIAAYAYKKS

SEQ ID NO: 850746 - protein, 27 aa, Mycobacterium
QVEPQAFLFQLLDPAIRADPYPLCARL

SEQ ID NO: 850747 - protein, 33 aa, Mycobacterium
QVESLSIYATPGEPLIPIVRMVQAIDAAEHRKL

SEQ ID NO: 850748 - protein, 19 aa, Mycobacterium
QVFELGTAPDFPTSVEIAV

SEQ ID NO: 850749 - protein, 27 aa, Mycobacterium
QVFGDGPIDLLMLPGPLIPIDCVDLEP

SEQ ID NO: 850750 - protein, 18 aa, Mycobacterium
QVFGMAEGLLNFTRLEDP

SEQ ID NO: 850751 - protein, 20 aa, Mycobacterium
QVFGMAEGLLNFTRLEDPPD

SEQ ID NO: 850752 - protein, 19 aa, Mycobacterium
QVFICGPGPFMDAAREALV

SEQ ID NO: 850753 - protein, 18 aa, Mycobacterium
QVFIGMRTSDVLTHAWDL

SEQ ID NO: 850754 - protein, 27 aa, Mycobacterium
QVFRDYGYRRLRAKARIKFLVKDWGVE

SEQ ID NO: 850755 - protein, 26 aa, Mycobacterium
QVFTPDYYCLDYRAAGLTPQSWFARQ

SEQ ID NO: 850756 - protein, 18 aa, Mycobacterium
QVFTYRPGRRTPKIACPI

SEQ ID NO: 850757 - protein, 18 aa, Mycobacterium
QVFYKAFSHVPTSGAEAE

SEQ ID NO: 850758 - protein, 24 aa, Mycobacterium
QVGDLFVIAVRTSPDRHQGLSLLV

SEQ ID NO: 850759 - protein, 17 aa, Mycobacterium
QVGFMRRFDPEYAELKT

SEQ ID NO: 850760 - protein, 18 aa, Mycobacterium
QVGGMADFFGYTAAFADP

SEQ ID NO: 850761 - protein, 18 aa, Mycobacterium
QVGKGDVVVLLESMKMEI

SEQ ID NO: 850762 - protein, 17 aa, Mycobacterium
QVGLAQTLILNGFLVRL

SEQ ID NO: 850763 - protein, 17 aa, Mycobacterium
QVGLLGVSPLSNHPLAG

SEQ ID NO: 850764 - protein, 25 aa, Mycobacterium
QVGLPYVLTLVAPVVGRLAPGLPVQ

SEQ ID NO: 850765 - protein, 18 aa, Mycobacterium
QVGLRNLCDLGMGLLSGA

SEQ ID NO: 850766 - protein, 25 aa, Mycobacterium
QVGMARFNAIWAGPETLPLPIEIEE

SEQ ID NO: 850767 - protein, 25 aa, Mycobacterium
QVGNKQWLLDEPTFKPNVTLDISKF

SEQ ID NO: 850768 - protein, 18 aa, Mycobacterium
QVGPLAKFYSVTPGDIIV

SEQ ID NO: 850769 - protein, 33 aa, Mycobacterium
QVGPMLEDWKSWGQARHSYFLRPSDIARAVTFV

SEQ ID NO: 850770 - protein, 26 aa, Mycobacterium
QVGQKFAREIFFLGRAYTAEQMHHMG

SEQ ID NO: 850771 - protein, 26 aa, Mycobacterium
QVGQKFAREIFFLGRPYTAEQMHHMG

SEQ ID NO: 850772 - protein, 25 aa, Mycobacterium
QVGQKFAREIFFLGRPYTAEQMHRM

SEQ ID NO: 850773 - protein, 25 aa, Mycobacterium
QVGQKFAREIFFLGRTYTAEQMHHM

SEQ ID NO: 850774 - protein, 32 aa, Mycobacterium
QVGSDRARFSPFQKLIILDVPDDKVDYLVTEL

SEQ ID NO: 850775 - protein, 21 aa, Mycobacterium
QVGSSYVWGGAAPGGFDCSGL

SEQ ID NO: 850776 - protein, 25 aa, Mycobacterium
QVGVKLFALLVRFSVRPGHEDAFDA

SEQ ID NO: 850777 - protein, 19 aa, Mycobacterium
QVGVLLARLGLPEDTDDLT

SEQ ID NO: 850778 - protein, 21 aa, Mycobacterium
QVGVPELPWPDPDGWLSTVGA

SEQ ID NO: 850779 - protein, 20 aa, Mycobacterium
QVGYRDLAGFGRRFIDVDPE

SEQ ID NO: 850780 - protein, 21 aa, Mycobacterium
QVHCAEMLDTRLRRIGALLAD

SEQ ID NO: 850781 - protein, 20 aa, Mycobacterium
QVHFSLAHPGALDDLVPFAE

SEQ ID NO: 850782 - protein, 20 aa, Mycobacterium
QVHFSLAHPGPLDDLVPFAE

SEQ ID NO: 850783 - protein, 22 aa, Mycobacterium
QVHGVGPLWDFLAEKKSAITEY

SEQ ID NO: 850784 - protein, 19 aa, Mycobacterium
QVHLALGSAGYLERDWRAE

SEQ ID NO: 850785 - protein, 19 aa, Mycobacterium
QVHRFIQISAFGAGEPAPT

SEQ ID NO: 850786 - protein, 18 aa, Mycobacterium
QVHSLHGYFLRPGDAKER

SEQ ID NO: 850787 - protein, 22 aa, Mycobacterium
QVIARAAEILRLLQAHPGGLSQ

SEQ ID NO: 850788 - protein, 24 aa, Mycobacterium
QVIARIMGLPRHDYPRFQRLSIEL

SEQ ID NO: 850789 - protein, 24 aa, Mycobacterium
QVIDGVREGALPPGTRLPTVRDLA

SEQ ID NO: 850790 - protein, 18 aa, Mycobacterium
QVIELHDCFSANEFLLYE

SEQ ID NO: 850791 - protein, 26 aa, Mycobacterium
QVIERLRKWVTFTPLQNVTGDPAISL

SEQ ID NO: 850792 - protein, 17 aa, Mycobacterium
QVIGLVTGNDRLAQEAK

SEQ ID NO: 850793 - protein, 17 aa, Mycobacterium
QVIICGKPNFYTGRGTF

SEQ ID NO: 850794 - protein, 32 aa, Mycobacterium
QVILECEPYRRLAFTFHTFTKDLTTVGLSEDV

SEQ ID NO: 850795 - protein, 17 aa, Mycobacterium
QVILQRLRDAENEKVYG

SEQ ID NO: 850796 - protein, 19 aa, Mycobacterium
QVINVHLKGTWNGTRLAAA

SEQ ID NO: 850797 - protein, 23 aa, Mycobacterium
QVIPADPVMAWRYIQLGPEDPDP

SEQ ID NO: 850798 - protein, 29 aa, Mycobacterium
QVIPRASFDEQWRLTARLLASVPAGEVKR

SEQ ID NO: 850799 - protein, 21 aa, Mycobacterium
QVIVAEIRRLLGAAWTDERGT

SEQ ID NO: 850800 - protein, 25 aa, Mycobacterium
QVIVPWAKWGSRLSTLPLPNRTYGR

SEQ ID NO: 850801 - protein, 25 aa, Mycobacterium
QVIVYRRLELPLDEIARLLDEGNAV

SEQ ID NO: 850802 - protein, 21 aa, Mycobacterium
QVKTILVARSLSALFPEIHEI

SEQ ID NO: 850803 - protein, 17 aa, Mycobacterium
QVLAIELPQPECFESFL

SEQ ID NO: 850804 - protein, 18 aa, Mycobacterium
QVLAIKQTLYRTSGDSPI

SEQ ID NO: 850805 - protein, 33 aa, Mycobacterium
QVLARQGIYGDFFSFYLCDIVLKLNGKGGQPVY

SEQ ID NO: 850806 - protein, 24 aa, Mycobacterium
QVLDFPEALQRKLLQKYAPADDIA

SEQ ID NO: 850807 - protein, 17 aa, Mycobacterium
QVLDGDLDALFDALAAA

SEQ ID NO: 850808 - protein, 25 aa, Mycobacterium
QVLDRLIDWVSFTPLQNVTGEPAIS

SEQ ID NO: 850809 - protein, 24 aa, Mycobacterium
QVLDTAVLLGALPPRVAGITDDLD

SEQ ID NO: 850810 - protein, 25 aa, Mycobacterium
QVLERFGMFGIRISIALLAAGITDS

SEQ ID NO: 850811 - protein, 23 aa, Mycobacterium
QVLFTPEQLWPFTSNLGSLTFGQ

SEQ ID NO: 850812 - protein, 19 aa, Mycobacterium
QVLGADMAAIHDQFVQALN

SEQ ID NO: 850813 - protein, 24 aa, Mycobacterium
QVLGAPPVLPLSYLVGTDGTVRRV

SEQ ID NO: 850814 - protein, 20 aa, Mycobacterium
QVLGQAAHLWTRTSLRPADV

SEQ ID NO: 850815 - protein, 19 aa, Mycobacterium
QVLGQAAHLWTRTSLRPDD

SEQ ID NO: 850816 - protein, 18 aa, Mycobacterium
QVLHARWGGELYWHQGSH

SEQ ID NO: 850817 - protein, 24 aa, Mycobacterium
QVLINENLLSPPPATVARLSDYPY

SEQ ID NO: 850818 - protein, 24 aa, Mycobacterium
QVLIPAPDYPLWTAATSLAGGTAV

SEQ ID NO: 850819 - protein, 23 aa, Mycobacterium
QVLIPAPDYPLWTACTSLAGGTP

SEQ ID NO: 850820 - protein, 20 aa, Mycobacterium
QVLIPSPDYPLWTASTSLAG

SEQ ID NO: 850821 - protein, 19 aa, Mycobacterium
QVLKALDGRFIAAGPSGSP

SEQ ID NO: 850822 - protein, 24 aa, Mycobacterium
QVLKAVWATIGYDLPLPLPRISYE

SEQ ID NO: 850823 - protein, 20 aa, Mycobacterium
QVLKILRRRSLAALRAQVEP

SEQ ID NO: 850824 - protein, 24 aa, Mycobacterium
QVLMQAVDVLRRLLDDASLATSLA

SEQ ID NO: 850825 - protein, 26 aa, Mycobacterium
QVLNRLIEWVSFTPLHNVTGEPAISL

SEQ ID NO: 850826 - protein, 19 aa, Mycobacterium
QVLPDPVALLRRGGGADLA

SEQ ID NO: 850827 - protein, 27 aa, Mycobacterium
QVLPRAEFADGWRALAHTLAGRPAGEI

SEQ ID NO: 850828 - protein, 17 aa, Mycobacterium
QVLPYLTVKARPFIDQT

SEQ ID NO: 850829 - protein, 45 aa, Mycobacterium
QVLQHLSSPPWYIRIWDFLKSIPIPVWDQLLNLEYMYGALIYDTQ

SEQ ID NO: 850830 - protein, 17 aa, Mycobacterium
QVLQLPDDRLDELLALA

SEQ ID NO: 850831 - protein, 17 aa, Mycobacterium
QVLQLPDERLDDLLSLA

SEQ ID NO: 850832 - protein, 19 aa, Mycobacterium
QVLRALDGHFIAAGPSGSP

SEQ ID NO: 850833 - protein, 23 aa, Mycobacterium
QVLRALDGRFIPAGPSGSPLRGL

SEQ ID NO: 850834 - protein, 22 aa, Mycobacterium
QVLRRQPLPLSLLATHPIDLSR

SEQ ID NO: 850835 - protein, 19 aa, Mycobacterium
QVLSPVAPLMNKMSMRVQG

SEQ ID NO: 850836 - protein, 24 aa, Mycobacterium
QVLSRFLHDFAGIDATWTPANIAD

SEQ ID NO: 850837 - protein, 24 aa, Mycobacterium
QVLSRFLHEFAGIDAAWTPANIAE

SEQ ID NO: 850838 - protein, 20 aa, Mycobacterium
QVLSRFLHEFAGLGAEWTPA

SEQ ID NO: 850839 - protein, 17 aa, Mycobacterium
QVLSRLRAHLTDNGRAV

SEQ ID NO: 850840 - protein, 35 aa, Mycobacterium
QVLSTTELLVRFFGRRNMLLLLDNCEHLIHACVAL

SEQ ID NO: 850841 - protein, 20 aa, Mycobacterium
QVLTFLTRRGLEADLKSGVL

SEQ ID NO: 850842 - protein, 19 aa, Mycobacterium
QVLVWQDMAGMTSGKTAKF

SEQ ID NO: 850843 - protein, 17 aa, Mycobacterium
QVMAAMGDLKFWGDFDG

SEQ ID NO: 850844 - protein, 26 aa, Mycobacterium
QVMADPLPYYRILRDHHPVYYMPQWD

SEQ ID NO: 850845 - protein, 27 aa, Mycobacterium
QVMAPDRPFFAYWAPGATHAPHHVAPE

SEQ ID NO: 850846 - protein, 23 aa, Mycobacterium
QVMPVKMPSWLGVPARLVMASLI

SEQ ID NO: 850847 - protein, 18 aa, Mycobacterium
QVMPYFGQEFLEQSQAKG

SEQ ID NO: 850848 - protein, 24 aa, Mycobacterium
QVMRDMLAAPEEFDWLATRLEIAR

SEQ ID NO: 850849 - protein, 18 aa, Mycobacterium
QVMRRLWKGEMIFNHDGP

SEQ ID NO: 850850 - protein, 18 aa, Mycobacterium
QVMTSRPCPTCRGVGVVI

SEQ ID NO: 850851 - protein, 33 aa, Mycobacterium
QVNILPAKYLNRLSDLLFILSRVANPDGDVLWK

SEQ ID NO: 850852 - protein, 24 aa, Mycobacterium
QVNLNLAMLTLMQKNLQGTIFGGG

SEQ ID NO: 850853 - protein, 19 aa, Mycobacterium
QVNNIHLVRGMLGRPGCGL

SEQ ID NO: 850854 - protein, 21 aa, Mycobacterium
QVNRIILTRPAVEAGERLGFL

SEQ ID NO: 850855 - protein, 28 aa, Mycobacterium
QVNRKVLPGYILVRMDLTDDSWAAVRNT

SEQ ID NO: 850856 - protein, 22 aa, Mycobacterium
QVNRPIAVSLPTRQCTIDKVSA

SEQ ID NO: 850857 - protein, 31 aa, Mycobacterium
QVNVLPAKYLNRLSDLLFILARAANPEGDVL

SEQ ID NO: 850858 - protein, 29 aa, Mycobacterium
QVNVTANLLLLQGLLPRMAAAGFGRVVAV

SEQ ID NO: 850859 - protein, 19 aa, Mycobacterium
QVNWIADAIAFLDEHGYAA

SEQ ID NO: 850860 - protein, 20 aa, Mycobacterium
QVNYAGRPSPLYEAPRLSEH

SEQ ID NO: 850861 - protein, 28 aa, Mycobacterium
QVNYLGVVELLHAWRPALAAAERAKVVV

SEQ ID NO: 850862 - protein, 23 aa, Mycobacterium
QVPAAVRFLSCEPLLGPLNGLNL

SEQ ID NO: 850863 - protein, 24 aa, Mycobacterium
QVPAKFEASALRKADPPVPGVVLH

SEQ ID NO: 850864 - protein, 23 aa, Mycobacterium
QVPALREELLTALIKSLPKDLRR

SEQ ID NO: 850865 - protein, 26 aa, Mycobacterium
QVPDGEDLSWLWDVNFEHFACDNGES

SEQ ID NO: 850866 - protein, 24 aa, Mycobacterium
QVPDLRALIDRRYGAALVAHAPAG

SEQ ID NO: 850867 - protein, 27 aa, Mycobacterium
QVPEGVTLLGRWWGMNGQGFAIVETDD

SEQ ID NO: 850868 - protein, 21 aa, Mycobacterium
QVPFLVRDELCHVFGLAREQV

SEQ ID NO: 850869 - protein, 20 aa, Mycobacterium
QVPFVDPLTTILDPALPLTV

SEQ ID NO: 850870 - protein, 19 aa, Mycobacterium
QVPFVDPLTTILDPSLPLT

SEQ ID NO: 850871 - protein, 17 aa, Mycobacterium
QVPGACDSTLLIAERVQ

SEQ ID NO: 850872 - protein, 17 aa, Mycobacterium
QVPGACDSTLLIGERVQ

SEQ ID NO: 850873 - protein, 25 aa, Mycobacterium
QVPGGAWVLGWRRPQAYPLMSNLVS

SEQ ID NO: 850874 - protein, 18 aa, Mycobacterium
QVPGLPWDDPGTIDRRHH

SEQ ID NO: 850875 - protein, 26 aa, Mycobacterium
QVPIQSSILGAFPRGTSVKVSVTRTA

SEQ ID NO: 850876 - protein, 19 aa, Mycobacterium
QVPLAPWRSYQNYFRELPV

SEQ ID NO: 850877 - protein, 19 aa, Mycobacterium
QVPLRRGDAVFFNPALYHG

SEQ ID NO: 850878 - protein, 26 aa, Mycobacterium
QVPPGGLHLWLRLPDQTDLDRLVRDC

SEQ ID NO: 850879 - protein, 19 aa, Mycobacterium
QVPPKMWPADRAAFDRYWE

SEQ ID NO: 850880 - protein, 27 aa, Mycobacterium
QVPPNGLPVILGPDHPLTGGYPVVGVV

SEQ ID NO: 850881 - protein, 25 aa, Mycobacterium
QVPQWPRRWRFLSPAIPADPQGYVE

SEQ ID NO: 850882 - protein, 18 aa, Mycobacterium
QVPRRGYVPSLACARCRT

SEQ ID NO: 850883 - protein, 18 aa, Mycobacterium
QVPRRGYVPSLACGRCRA

SEQ ID NO: 850884 - protein, 18 aa, Mycobacterium
QVPRWLSELDSYSAYDGY

SEQ ID NO: 850885 - protein, 30 aa, Mycobacterium
QVPSDSALPPFLTPGLTGPGLVDPRINAPI

SEQ ID NO: 850886 - protein, 18 aa, Mycobacterium
QVPVARRTLWDDAIRSIE

SEQ ID NO: 850887 - protein, 19 aa, Mycobacterium
QVPVFALGRYAGARRHAIL

SEQ ID NO: 850888 - protein, 27 aa, Mycobacterium
QVPVFDGYTPIAFLDIGWPQYLVAVEY

SEQ ID NO: 850889 - protein, 17 aa, Mycobacterium
QVPVVRKAYRPSDEKLD

SEQ ID NO: 850890 - protein, 42 aa, Mycobacterium
QVQAPATDPAPAAPSLRPISGLLSVVTLGTTLIPNAPTEPAD

SEQ ID NO: 850891 - protein, 32 aa, Mycobacterium
QVQLNVLGVHDLVLAVLPGMVARRAGGILISG

SEQ ID NO: 850892 - protein, 17 aa, Mycobacterium
QVQLPYTIGHENAGWVE

SEQ ID NO: 850893 - protein, 19 aa, Mycobacterium
QVQTLLTPLLPNGGAGAIN

SEQ ID NO: 850894 - protein, 25 aa, Mycobacterium
QVRAEMLVLSAIRPVDTETAPLAPA

SEQ ID NO: 850895 - protein, 20 aa, Mycobacterium
QVRDNCQAYLLVALEDRTAD

SEQ ID NO: 850896 - protein, 22 aa, Mycobacterium
QVRDPWLRRQLTPDAAPERTHT

SEQ ID NO: 850897 - protein, 18 aa, Mycobacterium
QVRERLALGFGSSSFRYA

SEQ ID NO: 850898 - protein, 24 aa, Mycobacterium
QVREVATFVLFLASDESSYATGSE

SEQ ID NO: 850899 - protein, 27 aa, Mycobacterium
QVRNKFVALGFSPGFADAYIGFLSATV

SEQ ID NO: 850900 - protein, 19 aa, Mycobacterium
QVRQWLTAHLPSVELHPAY

SEQ ID NO: 850901 - protein, 20 aa, Mycobacterium
QVRRLLGIPELHAVAAVVPL

SEQ ID NO: 850902 - protein, 24 aa, Mycobacterium
QVRSLRPDLDVRLAFLELSEPNLL

SEQ ID NO: 850903 - protein, 24 aa, Mycobacterium
QVRTLLAHELPVYIVSIGRTFRTD

SEQ ID NO: 850904 - protein, 20 aa, Mycobacterium
QVRTLLARELPVYIVSIGRT

SEQ ID NO: 850905 - protein, 20 aa, Mycobacterium
QVRTRYERLAPDAPIVVVGA

SEQ ID NO: 850906 - protein, 20 aa, Mycobacterium
QVRVFRAFGFDRFVIANEVT

SEQ ID NO: 850907 - protein, 25 aa, Mycobacterium
QVRVHQLEAVGLPARRVRGPLAGVG

SEQ ID NO: 850908 - protein, 18 aa, Mycobacterium
QVRWLNEAGFGTLRIPAE

SEQ ID NO: 850909 - protein, 20 aa, Mycobacterium
QVRYFLLREVPFGQDGSFSE

SEQ ID NO: 850910 - protein, 28 aa, Mycobacterium
QVSGFNSGFFNWGTANSGLFSLSKLAIK

SEQ ID NO: 850911 - protein, 33 aa, Mycobacterium
QVSGLNAVLSFLTNPNPLFVDHAWHGVSGVLAD

SEQ ID NO: 850912 - protein, 18 aa, Mycobacterium
QVSGYSLEHLLPENGFDV

SEQ ID NO: 850913 - protein, 23 aa, Mycobacterium
QVSHWFDGLPISRGPLPGSRDAD

SEQ ID NO: 850914 - protein, 28 aa, Mycobacterium
QVSIGLLRQHLSPGQLIHGIVTEGGEAA

SEQ ID NO: 850915 - protein, 28 aa, Mycobacterium
QVSLLDIALRIWRPRWAVWAAHVARSGG

SEQ ID NO: 850916 - protein, 21 aa, Mycobacterium
QVSVLPYRFGTHSGWLEACYD

SEQ ID NO: 850917 - protein, 28 aa, Mycobacterium
QVSVLVWSAIMINTFNRISILSRHPIKR

SEQ ID NO: 850918 - protein, 25 aa, Mycobacterium
QVSVVLSYLGGLILAFANGSPEPLS

SEQ ID NO: 850919 - protein, 17 aa, Mycobacterium
QVTANYIVGLALAQARG

SEQ ID NO: 850920 - protein, 17 aa, Mycobacterium
QVTEAFWNAIRHARPIA

SEQ ID NO: 850921 - protein, 17 aa, Mycobacterium
QVTEAFWNSIRHAKPIA

SEQ ID NO: 850922 - protein, 17 aa, Mycobacterium
QVTEAFWNSIRHAQPLA

SEQ ID NO: 850923 - protein, 21 aa, Mycobacterium
QVTELLPFGRPQLTGGPLRSA

SEQ ID NO: 850924 - protein, 27 aa, Mycobacterium
QVTIWKGMELLGPVPVLPGLGTLFEGG

SEQ ID NO: 850925 - protein, 25 aa, Mycobacterium
QVTKGALYFHFRSKHALACAIVEYH

SEQ ID NO: 850926 - protein, 19 aa, Mycobacterium
QVTKLARTYKPYGPVLSDA

SEQ ID NO: 850927 - protein, 24 aa, Mycobacterium
QVTKVPAHLPGEHPMFKAMAAANG

SEQ ID NO: 850928 - protein, 23 aa, Mycobacterium
QVTQAVLPGMLDAGWGRVVNVTS

SEQ ID NO: 850929 - protein, 22 aa, Mycobacterium
QVTRALLPKLIDSGDGLIVTVT

SEQ ID NO: 850930 - protein, 22 aa, Mycobacterium
QVTRIILTRPAVEAGERLGFLP

SEQ ID NO: 850931 - protein, 31 aa, Mycobacterium
QVVDDLAAFARPYLSRLWARLHGRDVWQEPC

SEQ ID NO: 850932 - protein, 35 aa, Mycobacterium; identical to SEQ ID NO: 116943

SEQ ID NO: 850933 - protein, 18 aa, Mycobacterium
QVVIGYDMRDSSPALAAA

SEQ ID NO: 850934 - protein, 22 aa, Mycobacterium
QVVKDYVAFPALTALSPGATYA

SEQ ID NO: 850935 - protein, 17 aa, Mycobacterium
QVVLTWLNFPGQQDNPA

SEQ ID NO: 850936 - protein, 37 aa, Mycobacterium
QVVRAADRSGFVVNFLLVPYLLAAIRMAESGFATVED

SEQ ID NO: 850937 - protein, 23 aa, Mycobacterium
QVVRLDTVLPVARQLLGSDVYIH

SEQ ID NO: 850938 - protein, 24 aa, Mycobacterium
QVVSRELIDLIFHSDPVTGNAAMQ

SEQ ID NO: 850939 - protein, 19 aa, Mycobacterium
QVVVPPFKSKAILGRPNGA

SEQ ID NO: 850940 - protein, 17 aa, Mycobacterium
QVWPEHLAPPRAIVSLR

SEQ ID NO: 850941 - protein, 27 aa, Mycobacterium
QVWTQFHSYAFDFSVWEIWGALLHGGR

SEQ ID NO: 850942 - protein, 18 aa, Mycobacterium
QVYGQRCWIRQLTPYASR

SEQ ID NO: 850943 - protein, 22 aa, Mycobacterium
QVYRDAMRLGYLQDIADAGAVI

SEQ ID NO: 850944 - protein, 26 aa, Mycobacterium
QWAGLDLLILRVAALFHENLKVLHSR

SEQ ID NO: 850945 - protein, 18 aa, Mycobacterium
QWAQPWEIQALLRAHSVA

SEQ ID NO: 850946 - protein, 18 aa, Mycobacterium
QWAQPWEVQALLRAHSVA

SEQ ID NO: 850947 - protein, 18 aa, Mycobacterium
QWCDAQVLKILRRRSLAA

SEQ ID NO: 850948 - protein, 17 aa, Mycobacterium
QWDALVRDPSLLPGAIE

SEQ ID NO: 850949 - protein, 17 aa, Mycobacterium
QWDFLDFLAEKASAYPE

SEQ ID NO: 850950 - protein, 17 aa, Mycobacterium
QWDLLQSDRELLPGAIE

SEQ ID NO: 850951 - protein, 30 aa, Mycobacterium
QWDPFQNMVVIYALFPNIVLSVTIANGELF

SEQ ID NO: 850952 - protein, 25 aa, Mycobacterium
QWEGDPSALLTWATHHVPFLAAVEN

SEQ ID NO: 850953 - protein, 22 aa, Mycobacterium
QWEKPFLAIFGARDPILGQADR

SEQ ID NO: 850954 - protein, 18 aa, Mycobacterium
QWELLRRRPELAMRAVEE

SEQ ID NO: 850955 - protein, 32 aa, Mycobacterium
QWERVIKIFNDRFYVPFRLSAKNKHRVTLGQE

SEQ ID NO: 850956 - protein, 27 aa, Mycobacterium
QWEVPLMLFVIATPEILTAASSDLAAV

SEQ ID NO: 850957 - protein, 17 aa, Mycobacterium
QWFSAFLADRAVRKPST

SEQ ID NO: 850958 - protein, 21 aa, Mycobacterium
QWGGLQCDPGLFYEAVRRLAS

SEQ ID NO: 850959 - protein, 18 aa, Mycobacterium
QWGQWTVHFDLDAASMAQ

SEQ ID NO: 850960 - protein, 20 aa, Mycobacterium
QWGRVHLPREDSARYRFVEA

SEQ ID NO: 850961 - protein, 19 aa, Mycobacterium
QWHLERQLKTLPLVERTYR

SEQ ID NO: 850962 - protein, 21 aa, Mycobacterium
QWHTDVTFVDRIPKASILRAV

SEQ ID NO: 850963 - protein, 21 aa, Mycobacterium
QWIEAEVPAAWRSAAAKDAAT

SEQ ID NO: 850964 - protein, 36 aa, Mycobacterium
QWIPDRLWALQRRLLAPFFVWLTVGLYDPPVRELMG

SEQ ID NO: 850965 - protein, 21 aa, Mycobacterium
QWKLTRYLDGDPEPWPGAGTN

SEQ ID NO: 850966 - protein, 17 aa, Mycobacterium
QWLEGCAVQRIMFRDGL

SEQ ID NO: 850967 - protein, 18 aa, Mycobacterium
QWLSVKLMGDPAIARVDS

SEQ ID NO: 850968 - protein, 17 aa, Mycobacterium
QWLSWIGIDDLVDIYLR

SEQ ID NO: 850969 - protein, 22 aa, Mycobacterium
QWNLHVDALRRRGWLDGAGELT

SEQ ID NO: 850970 - protein, 25 aa, Mycobacterium
QWPGMARRLLADEPVFAEALDEIEP

SEQ ID NO: 850971 - protein, 17 aa, Mycobacterium
QWPGYVTRLQAPVIPHM

SEQ ID NO: 850972 - protein, 20 aa, Mycobacterium
QWQDYILATPGPLEWDCFRF

SEQ ID NO: 850973 - protein, 19 aa, Mycobacterium
QWQRELTVPALGRALSEPP

SEQ ID NO: 850974 - protein, 22 aa, Mycobacterium
QWRAEILDRLRAERPRLVVLGM

SEQ ID NO: 850975 - protein, 18 aa, Mycobacterium
QWREWELELAPGADAELL

SEQ ID NO: 850976 - protein, 31 aa, Mycobacterium
QWRHTFAVNIDSFFYVTKAALEYLPDGGAII

SEQ ID NO: 850977 - protein, 18 aa, Mycobacterium
QWRQLKRALGNPDWADDP

SEQ ID NO: 850978 - protein, 19 aa, Mycobacterium
QWRTAMINIPVFPDSTPQD

SEQ ID NO: 850979 - protein, 18 aa, Mycobacterium
QWSAQNLDFLVAVARSCV

SEQ ID NO: 850980 - protein, 30 aa, Mycobacterium
QWSAYLPPAPAEALFRWLGTKDGQNKVMNL

SEQ ID NO: 850981 - protein, 20 aa, Mycobacterium
QWSSIYARLIRLSDYLNRYG

SEQ ID NO: 850982 - protein, 17 aa, Mycobacterium
QWTDEIFKAFNFHPDAT

SEQ ID NO: 850983 - protein, 17 aa, Mycobacterium
QWTLVTPPDPDPRMLRP

SEQ ID NO: 850984 - protein, 22 aa, Mycobacterium
QWVELLPRTALLPDTRHRFLVD

SEQ ID NO: 850985 - protein, 21 aa, Mycobacterium
QWVPTMFVRMLKLPKEIRDRY

SEQ ID NO: 850986 - protein, 20 aa, Mycobacterium
QWWQQQVVLGLQRRGFPMHA

SEQ ID NO: 850987 - protein, 19 aa, Mycobacterium
QYAFTRPIAAHMFSNYDGV

SEQ ID NO: 850988 - protein, 25 aa, Mycobacterium
QYAKAWRTIAKLSLPDKYLTYTADN

SEQ ID NO: 850989 - protein, 25 aa, Mycobacterium
QYAKTWRTIAKLSLPDRFLHATADN

SEQ ID NO: 850990 - protein, 26 aa, Mycobacterium
QYAKTWRTLAKLSLPNKYLRYDTDNA

SEQ ID NO: 850991 - protein, 18 aa, Mycobacterium
QYALLSPETIWVLNDTGV

SEQ ID NO: 850992 - protein, 24 aa, Mycobacterium
QYAPDLLQHFLDGSGKPATVPVDN

SEQ ID NO: 850993 - protein, 20 aa, Mycobacterium
QYASLQLFIHAVVAGILANV

SEQ ID NO: 850994 - protein, 26 aa, Mycobacterium
QYASLQLYILAIVAGVLRAVVDDGEA

SEQ ID NO: 850995 - protein, 17 aa, Mycobacterium
QYAVLRALADHPTASAS

SEQ ID NO: 850996 - protein, 19 aa, Mycobacterium
QYDATLPGMRRIVEALFHD

SEQ ID NO: 850997 - protein, 17 aa, Mycobacterium
QYDIERLSAFYSVSYET

SEQ ID NO: 850998 - protein, 21 aa, Mycobacterium
QYDIVRLLRLYDEGKLKLDEL

SEQ ID NO: 850999 - protein, 22 aa, Mycobacterium
QYDYFLRDSSAAIAFIEACRRR

SEQ ID NO: 851000 - protein, 19 aa, Mycobacterium
QYEAPLGITLRELLEYAGG

SEQ ID NO: 851001 - protein, 20 aa, Mycobacterium
QYEKRQRAAAERLARIRESM

SEQ ID NO: 851002 - protein, 25 aa, Mycobacterium
QYEQDALIAWTILGQLKPQIGHVYG

SEQ ID NO: 851003 - protein, 24 aa, Mycobacterium
QYEVRLIHRPLAEGVPTSLYYQHN

SEQ ID NO: 851004 - protein, 27 aa, Mycobacterium
QYEVVQGNWFFFRGADRKIPAITLMSN

SEQ ID NO: 851005 - protein, 20 aa, Mycobacterium
QYFEIMGSRGIYHDGWFAGA

SEQ ID NO: 851006 - protein, 33 aa, Mycobacterium
QYFEMFGSRAIYQDGWWACTRLDKAPWDFSPQT

SEQ ID NO: 851007 - protein, 20 aa, Mycobacterium
QYFGRLISDPSQMTDLPAGV

SEQ ID NO: 851008 - protein, 20 aa, Mycobacterium
QYFHVTPWVAWTDAGPRGQM

SEQ ID NO: 851009 - protein, 22 aa, Mycobacterium
QYFTQAFVLREKNPKLYDLFMD

SEQ ID NO: 851010 - protein, 32 aa, Mycobacterium
QYGALIGLVQGLLMMRHMMFVGYSLQDEDFHE

SEQ ID NO: 851011 - protein, 19 aa, Mycobacterium
QYGITRILFHNHGDIGLTT

SEQ ID NO: 851012 - protein, 25 aa, Mycobacterium
QYGKSWRTIAKLSLPDRFLSDTRDD

SEQ ID NO: 851013 - protein, 25 aa, Mycobacterium
QYGKTWRTIAKLSLPDKFLKDTADN

SEQ ID NO: 851014 - protein, 25 aa, Mycobacterium
QYGKTWRTLAKLSLPNKYLRDNADN

SEQ ID NO: 851015 - protein, 18 aa, Mycobacterium
QYGLPVNGLWGGTFSELI

SEQ ID NO: 851016 - protein, 26 aa, Mycobacterium
QYGVEPQQLFAYLQENNQLPSMFADV

SEQ ID NO: 851017 - protein, 21 aa, Mycobacterium
QYGVTVVAYTWAMLREIVDDP

SEQ ID NO: 851018 - protein, 24 aa, Mycobacterium
QYHFSRLAPALNRFFWGLSDKISR

SEQ ID NO: 851019 - protein, 28 aa, Mycobacterium
QYIGIGLLVEGRWRWRSYSLTSPPAERP

SEQ ID NO: 851020 - protein, 30 aa, Mycobacterium
QYLATQLKAMQFLRGGRRWLLKSPQHLEQV

SEQ ID NO: 851021 - protein, 25 aa, Mycobacterium
QYLDHVFRMDWVAGSPFPADDENDA

SEQ ID NO: 851022 - protein, 24 aa, Mycobacterium
QYLRRALDCFLSCQVRLLIVDDVH

SEQ ID NO: 851023 - protein, 18 aa, Mycobacterium
QYLTANYFTPPHIREIRP

SEQ ID NO: 851024 - protein, 21 aa, Mycobacterium
QYLVGFIGARRPDRSALMTRL

SEQ ID NO: 851025 - protein, 17 aa, Mycobacterium
QYMEMWVQDATAMYGYA

SEQ ID NO: 851026 - protein, 21 aa, Mycobacterium
QYNLMFPMRAVKHWNRWCEGA

SEQ ID NO: 851027 - protein, 20 aa, Mycobacterium
QYNSYLKQYLVLYTDGGSND

SEQ ID NO: 851028 - protein, 18 aa, Mycobacterium
QYPPVVMSMLLTQSARSL

SEQ ID NO: 851029 - protein, 18 aa, Mycobacterium
QYQAWKHTQLVIDVVPGR

SEQ ID NO: 851030 - protein, 23 aa, Mycobacterium
QYQLSQRFPKYMRKTLMTMAQRR

SEQ ID NO: 851031 - protein, 36 aa, Mycobacterium
QYQPLGVVLAVMPWNFPLWQAVRFAAPALMAGNVGL

SEQ ID NO: 851032 - protein, 18 aa, Mycobacterium
QYRDGCFSVGGRPALDWA

SEQ ID NO: 851033 - protein, 20 aa, Mycobacterium
QYRDMRIIGIGGGTTEILTS

SEQ ID NO: 851034 - protein, 24 aa, Mycobacterium
QYRELLQEFLFKLDLDEETRQRAQ

SEQ ID NO: 851035 - protein, 17 aa, Mycobacterium
QYRGLRRRLATSGLDVI

SEQ ID NO: 851036 - protein, 27 aa, Mycobacterium
QYRHAFGRRLWELPAGLLDVAGEPPQQ

SEQ ID NO: 851037 - protein, 27 aa, Mycobacterium
QYRHPLGHRLWELPAGLLDIAGEDSQR

SEQ ID NO: 851038 - protein, 28 aa, Mycobacterium
QYRHPLGRRLWELPAGLLDLGGEPPEVT

SEQ ID NO: 851039 - protein, 30 aa, Mycobacterium
QYRIGDVLPLTPLQQGLLYYAGSGRGGDDL

SEQ ID NO: 851040 - protein, 18 aa, Mycobacterium
QYRYFRAPYPEPIEELKQ

SEQ ID NO: 851041 - protein, 20 aa, Mycobacterium
QYSDFIAWPVRMDVERRTPA

SEQ ID NO: 851042 - protein, 23 aa, Mycobacterium
QYSHRWWVRPHWRQQAKGPNRSL

SEQ ID NO: 851043 - protein, 31 aa, Mycobacterium
QYTLLYDGYADFPQYPLNLLADLNAFAGIQF

SEQ ID NO: 851044 - protein, 22 aa, Mycobacterium
QYTLRMFTPRRPRSTWSKINVG

SEQ ID NO: 851045 - protein, 29 aa, Mycobacterium
QYTTVMHRPLLTLVERLGEVLPAGLDRMF

SEQ ID NO: 851046 - protein, 17 aa, Mycobacterium
QYVALDFVARIRGQTRF

SEQ ID NO: 851047 - protein, 19 aa, Mycobacterium
QYVDILTSTLFAAPVYQTY

SEQ ID NO: 851048 - protein, 29 aa, Mycobacterium
QYVDLVSMFAPITRWAAGIPTPRAIPEMV

SEQ ID NO: 851049 - protein, 18 aa, Mycobacterium
QYVEIWVGVLRQLDPGLA

SEQ ID NO: 851050 - protein, 18 aa, Mycobacterium
QYVFLITNTDPDAPKHKS

SEQ ID NO: 851051 - protein, 18 aa, Mycobacterium
QYVGIPILRLHDTIYRKT

SEQ ID NO: 851052 - protein, 17 aa, Mycobacterium
QYVNLTVEIDGRRFTRC

SEQ ID NO: 851053 - protein, 33 aa, Mycobacterium
QYVPVNRVGAYLPAGRFPLLASAFMTVGVAKAA

SEQ ID NO: 851054 - protein, 24 aa, Mycobacterium
QYVRLGLVIDGRYHWRAYSLTSDP

SEQ ID NO: 851055 - protein, 17 aa, Mycobacterium
QYYGRLIADPRAMTDLP

SEQ ID NO: 851056 - protein, 20 aa, Mycobacterium
QYYLHLFDTEQPDLNWEHPD

SEQ ID NO: 851057 - protein, 26 aa, Mycobacterium
RAAAAWMRTMFAVVPLAVGDRARDAH

SEQ ID NO: 851058 - protein, 18 aa, Mycobacterium
RAAAELGFRTAFVARPLE

SEQ ID NO: 851059 - protein, 26 aa, Mycobacterium
RAAAFYGHVLGWVFDPETQRVTNTGQ

SEQ ID NO: 851060 - protein, 17 aa, Mycobacterium
RAAAGLHRLGIAPGDRV

SEQ ID NO: 851061 - protein, 32 aa, Mycobacterium
RAAALGCESLREDLWRLVDTKVESVIAIDDRT

SEQ ID NO: 851062 - protein, 18 aa, Mycobacterium
RAAALGDDRWRDLLDNHD

SEQ ID NO: 851063 - protein, 29 aa, Mycobacterium
RAAALLAGLKMPIVHGMWLSAAAQHAVTA

SEQ ID NO: 851064 - protein, 23 aa, Mycobacterium
RAAALTVYFQFLELRHKIDLHNM

SEQ ID NO: 851065 - protein, 17 aa, Mycobacterium
RAAALVQLALPGTAYVY

SEQ ID NO: 851066 - protein, 28 aa, Mycobacterium
RAAAVNFPDVLFIAGKYQIKIPPPFIPG

SEQ ID NO: 851067 - protein, 30 aa, Mycobacterium
RAADGILVPPVDGPWRLGLSSAGTFENLQL

SEQ ID NO: 851068 - protein, 26 aa, Mycobacterium
RAADPTRLVFFQPNQLFAAGIHTDLG

SEQ ID NO: 851069 - protein, 25 aa, Mycobacterium
RAADPVFMLTGPIPATRHALEKTGL

SEQ ID NO: 851070 - protein, 29 aa, Mycobacterium
RAADQFDQRLLLRRVQRGAVGLGPRGERR

SEQ ID NO: 851071 - protein, 27 aa, Mycobacterium
RAADREMMRPLRDLLVEPVAALGSNDV

SEQ ID NO: 851072 - protein, 25 aa, Mycobacterium
RAADRLMITPPPLSKQIKLLEKELG

SEQ ID NO: 851073 - protein, 33 aa, Mycobacterium
RAADWPADLLMLQQLGFRLLAMTPHGDARELGE

SEQ ID NO: 851074 - protein, 25 aa, Mycobacterium
RAAEDALWRWMSAAALVRARGDGGV

SEQ ID NO: 851075 - protein, 24 aa, Mycobacterium
RAAEFYHAVFGWDVEAPPQAEFGG

SEQ ID NO: 851076 - protein, 26 aa, Mycobacterium
RAAEIFSRGPLPSPYMLFVHDVAESW

SEQ ID NO: 851077 - protein, 18 aa, Mycobacterium
RAAELADRFAAIAAGALG

SEQ ID NO: 851078 - protein, 24 aa, Mycobacterium
RAAELAKLPLFERLAQRIVDGERN

SEQ ID NO: 851079 - protein, 17 aa, Mycobacterium
RAAEPLLLIVDVSKPRP

SEQ ID NO: 851080 - protein, 22 aa, Mycobacterium
RAAERFCVPHVLVPVEIPSPDA

SEQ ID NO: 851081 - protein, 21 aa, Mycobacterium
RAAERFGFTGALIPTGAWCED

SEQ ID NO: 851082 - protein, 18 aa, Mycobacterium
RAAESAALALLFGAGTDP

SEQ ID NO: 851083 - protein, 26 aa, Mycobacterium
RAAESLRAFPRPLLYAGAAADAGAEL

SEQ ID NO: 851084 - protein, 26 aa, Mycobacterium
RAAESRPLWYLMPDGVVQYVSKRRLY

SEQ ID NO: 851085 - protein, 21 aa, Mycobacterium
RAAETFGFTGALIPTGAWCED

SEQ ID NO: 851086 - protein, 24 aa, Mycobacterium
RAAFERRWELGGVLFGKTFPDQTT

SEQ ID NO: 851087 - protein, 24 aa, Mycobacterium
RAAFERRWELGGVLFSKTFSDQMI

SEQ ID NO: 851088 - protein, 22 aa, Mycobacterium
RAAFLLVNDLAVLTLRPRLIEV

SEQ ID NO: 851089 - protein, 18 aa, Mycobacterium
RAAFRRAWGAEPIDMGMG

SEQ ID NO: 851090 - protein, 18 aa, Mycobacterium
RAAFRRYAETHQGAVHVL

SEQ ID NO: 851091 - protein, 19 aa, Mycobacterium
RAAGALAIPYPLVEELLSV

SEQ ID NO: 851092 - protein, 22 aa, Mycobacterium
RAAGFYRKLGWSAAGDLPDGSI

SEQ ID NO: 851093 - protein, 26 aa, Mycobacterium
RAAGHQAIKLTFVNPLITADLATGVI

SEQ ID NO: 851094 - protein, 25 aa, Mycobacterium
RAAGKRVFVFPGQGSQWLGMGAALY

SEQ ID NO: 851095 - protein, 25 aa, Mycobacterium
RAAGLNPFALLASQGVPLAFGSDSP

SEQ ID NO: 851096 - protein, 26 aa, Mycobacterium
RAAGLPPLVGVLPRAAAAPLLQVSGR

SEQ ID NO: 851097 - protein, 17 aa, Mycobacterium
RAAGLPVLASSAPSTSA

SEQ ID NO: 851098 - protein, 21 aa, Mycobacterium
RAAGLTPQSWFARQAGLVDTD

SEQ ID NO: 851099 - protein, 17 aa, Mycobacterium
RAAGPYAALGSRAPDAV

SEQ ID NO: 851100 - protein, 23 aa, Mycobacterium
RAAGVRLLRIGMVSPLCADTVLG

SEQ ID NO: 851101 - protein, 19 aa, Mycobacterium
RAAGWDPPRYTTTAFEMAH

SEQ ID NO: 851102 - protein, 18 aa, Mycobacterium
RAAGYTYEDAEYTNVSQW

SEQ ID NO: 851103 - protein, 21 aa, Mycobacterium
RAAGYWRDQLLDSVLRTAART

SEQ ID NO: 851104 - protein, 26 aa, Mycobacterium
RAAHEALGLPYVWGGGGALGPTGGGF

SEQ ID NO: 851105 - protein, 20 aa, Mycobacterium
RAAHPFGVAAPRIAASALTP

SEQ ID NO: 851106 - protein, 33 aa, Mycobacterium
RAAHVLTLAPPLNLNPYWLGAHPSYTLSKYGMT

SEQ ID NO: 851107 - protein, 30 aa, Mycobacterium
RAAIGQPPIPWSYMEAYIRAYQALLAGEVV

SEQ ID NO: 851108 - protein, 18 aa, Mycobacterium
RAAILRSLDAPPKSFWRL

SEQ ID NO: 851109 - protein, 21 aa, Mycobacterium
RAAISAFWDKAIEPTTRIEFF

SEQ ID NO: 851110 - protein, 25 aa, Mycobacterium
RAAISGLRPPVLDDLGLAGGLASLA

SEQ ID NO: 851111 - protein, 24 aa, Mycobacterium
RAAISGLRPPVLDDLGLSGGLASL

SEQ ID NO: 851112 - protein, 21 aa, Mycobacterium
RAAIWAVLVRDFFQAWVRRSD

SEQ ID NO: 851113 - protein, 23 aa, Mycobacterium
RAAKPALPAVSSRSAVSSGAASP

SEQ ID NO: 851114 - protein, 21 aa, Mycobacterium
RAAKQYLTYVGGAPFQPAVAH

SEQ ID NO: 851115 - protein, 30 aa, Mycobacterium
RAALAMVRRHRLMETFLVNELGYGWDEVHD

SEQ ID NO: 851116 - protein, 22 aa, Mycobacterium
RAALERWGRIDFLINAAGVGSP

SEQ ID NO: 851117 - protein, 28 aa, Mycobacterium
RAALESGRLLRFPGAYSPLVARLVAEIG

SEQ ID NO: 851118 - protein, 26 aa, Mycobacterium
RAALGYELTLYLLRNPDARASVAAQR

SEQ ID NO: 851119 - protein, 28 aa, Mycobacterium
RAALIARVFARMGFGPELQPATGSNRAA

SEQ ID NO: 851120 - protein, 25 aa, Mycobacterium
RAALKTWLYRIATTACLRALENRAR

SEQ ID NO: 851121 - protein, 25 aa, Mycobacterium
RAALLDRFGMFGIRISIAVLRAGVS

SEQ ID NO: 851122 - protein, 17 aa, Mycobacterium
RAALLHMVWRHELLIDL

SEQ ID NO: 851123 - protein, 18 aa, Mycobacterium
RAALPEELSWVTPHSFRR

SEQ ID NO: 851124 - protein, 19 aa, Mycobacterium
RAALRAVPAERLWVNPDCG

SEQ ID NO: 851125 - protein, 28 aa, Mycobacterium
RAALRRAMPVLGICRGAQVLNVALGGTL

SEQ ID NO: 851126 - protein, 26 aa, Mycobacterium
RAALRTWLYRIATTACLRALQHRARR

SEQ ID NO: 851127 - protein, 27 aa, Mycobacterium
RAALTAYCELWSRWVTATRDIVANGQV

SEQ ID NO: 851128 - protein, 18 aa, Mycobacterium
RAALTDYAALLRLHRVER

SEQ ID NO: 851129 - protein, 21 aa, Mycobacterium
RAALTKLTLPSDNPLVGKRVS

SEQ ID NO: 851130 - protein, 28 aa, Mycobacterium
RAAMAAGALSYLVKPFPTTELAARLSGY

SEQ ID NO: 851131 - protein, 41 aa, Mycobacterium
RAAMIHPLEVLANRNVFVQLIRTNLFGLNAPAIMAAEGQYE

SEQ ID NO: 851132 - protein, 17 aa, Mycobacterium
RAAMLAGNLPAVAAAAV

SEQ ID NO: 851133 - protein, 26 aa, Mycobacterium
RAAMNLTIPILLIRGKLSDVVSSEGV

SEQ ID NO: 851134 - protein, 27 aa, Mycobacterium
RAAMRIAPRTMLCAIAWRVHEQVAGAR

SEQ ID NO: 851135 - protein, 23 aa, Mycobacterium
RAAMSQLWQRFNAVAVTNGHAWS

SEQ ID NO: 851136 - protein, 23 aa, Mycobacterium
RAAMVHPLAVAANRNGFVQLVMS

SEQ ID NO: 851137 - protein, 23 aa, Mycobacterium
RAANFPLPPVQPTKPPKANEVKI

SEQ ID NO: 851138 - protein, 22 aa, Mycobacterium
RAANLRLVTLDPPFAAAVSVWV

SEQ ID NO: 851139 - protein, 26 aa, Mycobacterium
RAAPDPALVMIVVSWLSGELRQRQIG

SEQ ID NO: 851140 - protein, 17 aa, Mycobacterium
RAAPILADLRQLEAIAV

SEQ ID NO: 851141 - protein, 24 aa, Mycobacterium
RAAPIRPLYTRVLLKLGGEMFGGG

SEQ ID NO: 851142 - protein, 17 aa, Mycobacterium
RAAQLAPSLGFARYIIS

SEQ ID NO: 851143 - protein, 25 aa, Mycobacterium
RAARAVWQALPGETWPHRLAEAAAV

SEQ ID NO: 851144 - protein, 18 aa, Mycobacterium
RAARGVGVFGRRAVGLGA

SEQ ID NO: 851145 - protein, 28 aa, Mycobacterium
RAARLTPVDWFARRTALVDANTGAAVDL

SEQ ID NO: 851146 - protein, 17 aa, Mycobacterium
RAARLYEVLARPGARHR

SEQ ID NO: 851147 - protein, 32 aa, Mycobacterium; identical to SEQ ID NO: 716994

SEQ ID NO: 851148 - protein, 26 aa, Mycobacterium
RAARTPRFISPGRFRGKVVVVTGAAQ

SEQ ID NO: 851149 - protein, 29 aa, Mycobacterium
RAARYASGWWSFLTPPEKLAERIDFIKSQ

SEQ ID NO: 851150 - protein, 18 aa, Mycobacterium
RAARYIAEGLAHNYWIEF

SEQ ID NO: 851151 - protein, 18 aa, Mycobacterium
RAASDILDRALGDRLGRL

SEQ ID NO: 851152 - protein, 18 aa, Mycobacterium
RAATEIVSRYYNLVLADC

SEQ ID NO: 851153 - protein, 23 aa, Mycobacterium
RAATLLRLPDVSALLDASLAGRP

SEQ ID NO: 851154 - protein, 17 aa, Mycobacterium
RAATSLLPGFETITYRE

SEQ ID NO: 851155 - protein, 24 aa, Mycobacterium
RAATTPVPLRRSLSRRLAPHDPVL

SEQ ID NO: 851156 - protein, 23 aa, Mycobacterium
RAATVHPALVAANRAQFVSLALS

SEQ ID NO: 851157 - protein, 35 aa, Mycobacterium
RAATVHPALVAINRTRLVSLVTSNLLGLNAPAIAA

SEQ ID NO: 851158 - protein, 19 aa, Mycobacterium
RAATVLPAAVAANRNALVQ

SEQ ID NO: 851159 - protein, 35 aa, Mycobacterium
RAAVAHGALAYLLKPFTFAAFRDRLERYRRYREAL

SEQ ID NO: 851160 - protein, 23 aa, Mycobacterium
RAAVARLYRRRFSWLSQGTTPTS

SEQ ID NO: 851161 - protein, 21 aa, Mycobacterium
RAAVEPLVLMLAPLAPHLAEE

SEQ ID NO: 851162 - protein, 25 aa, Mycobacterium
RAAVEPLVLMLAPLAPHMAEELWLR

SEQ ID NO: 851163 - protein, 20 aa, Mycobacterium
RAAVFAFPYDVEAVTKIAAL

SEQ ID NO: 851164 - protein, 21 aa, Mycobacterium
RAAVFLRAADLLAGPWREKIA

SEQ ID NO: 851165 - protein, 24 aa, Mycobacterium
RAAVFLRAADLLAGPWREKIAAAT

SEQ ID NO: 851166 - protein, 25 aa, Mycobacterium
RAAVFLRAADLLAGPWREKIVAATM

SEQ ID NO: 851167 - protein, 19 aa, Mycobacterium
RAAVFSWTVPMDLELTGPM

SEQ ID NO: 851168 - protein, 26 aa, Mycobacterium
RAAVGPDFPIIYRFSQWKANAYDARI

SEQ ID NO: 851169 - protein, 27 aa, Mycobacterium
RAAVGPDFPILYRFSQWKQADYTATLA

SEQ ID NO: 851170 - protein, 41 aa, Mycobacterium
RAAVPRQVALADLLRFYRLAQELVWQWMFGRITADSRDAAE

SEQ ID NO: 851171 - protein, 24 aa, Mycobacterium
RAAVQIGRRLAKLARTHQVIVVTH

SEQ ID NO: 851172 - protein, 17 aa, Mycobacterium
RAAWLVIDVRDVAAVHA

SEQ ID NO: 851173 - protein, 20 aa, Mycobacterium
RAAWRAARLLVLDAFTTAEA

SEQ ID NO: 851174 - protein, 18 aa, Mycobacterium
RAAWRLRQGAGVAEVAAA

SEQ ID NO: 851175 - protein, 18 aa, Mycobacterium
RAAWVDIPEVVGAATVTG

SEQ ID NO: 851176 - protein, 22 aa, Mycobacterium
RAAYFEMFPGVWRHGDWITLTE

SEQ ID NO: 851177 - protein, 23 aa, Mycobacterium
RAAYPRIDLLINNAGVMWTPKQV

SEQ ID NO: 851178 - protein, 21 aa, Mycobacterium
RAAYYSALLPEPTGIRQGVAS

SEQ ID NO: 851179 - protein, 32 aa, Mycobacterium
RACGFDTPYPPARLERLWLPGPDRLLDCVERA

SEQ ID NO: 851180 - protein, 21 aa, Mycobacterium
RACGRAFLPADLVTSVRDGLV

SEQ ID NO: 851181 - protein, 20 aa, Mycobacterium
RACGRIPGLERVRFTSPHPA

SEQ ID NO: 851182 - protein, 18 aa, Mycobacterium
RACGYVHPALVPLQAIEL

SEQ ID NO: 851183 - protein, 20 aa, Mycobacterium
RACHGFDSLLPEWTTSQRLF

SEQ ID NO: 851184 - protein, 18 aa, Mycobacterium
RACLAAEDPVFGVVLIAA

SEQ ID NO: 851185 - protein, 17 aa, Mycobacterium
RACPWANRTIIVRRLLG

SEQ ID NO: 851186 - protein, 27 aa, Mycobacterium
RADAAQQRWFRLSALAERVSATVRIAS

SEQ ID NO: 851187 - protein, 26 aa, Mycobacterium
RADAARILAALIRDIPGGAAVDTAAV

SEQ ID NO: 851188 - protein, 25 aa, Mycobacterium
RADAFGVASVPIPGTRRASRVQENV

SEQ ID NO: 851189 - protein, 19 aa, Mycobacterium
RADAILQRRTDRLPFETPP

SEQ ID NO: 851190 - protein, 20 aa, Mycobacterium
RADAILRRRTDRRPFRAPSE

SEQ ID NO: 851191 - protein, 26 aa, Mycobacterium
RADARLAMRLILQQHGALPAEPVRPA

SEQ ID NO: 851192 - protein, 29 aa, Mycobacterium
RADAWGVTTLWIGSGPRPPAGAAHHILWV

SEQ ID NO: 851193 - protein, 22 aa, Mycobacterium
RADDFMAAARRLSALPVVAAVG

SEQ ID NO: 851194 - protein, 20 aa, Mycobacterium
RADDLSLKKFAHAAVMERAS

SEQ ID NO: 851195 - protein, 21 aa, Mycobacterium
RADENPWWWDVLTHGRSSRYA

SEQ ID NO: 851196 - protein, 24 aa, Mycobacterium
RADESHVLLFRFSHAPKTSVRSLR

SEQ ID NO: 851197 - protein, 21 aa, Mycobacterium
RADFARLRELAGGPLDVVAAD

SEQ ID NO: 851198 - protein, 18 aa, Mycobacterium
RADFDFIDQFIADHAIDV

SEQ ID NO: 851199 - protein, 21 aa, Mycobacterium
RADFPILKRTMRGGKQLAYLD

SEQ ID NO: 851200 - protein, 20 aa, Mycobacterium
RADFPILKRVMRGGNQLAYL

SEQ ID NO: 851201 - protein, 20 aa, Mycobacterium
RADFPILQRVMRGGNQLAYL

SEQ ID NO: 851202 - protein, 21 aa, Mycobacterium
RADFPILRETVNGKPLIWFDN

SEQ ID NO: 851203 - protein, 21 aa, Mycobacterium
RADGFLTLPGGLGTLEELLEC

SEQ ID NO: 851204 - protein, 18 aa, Mycobacterium
RADGHAHRGLGRAVGVDH

SEQ ID NO: 851205 - protein, 20 aa, Mycobacterium
RADGITFFPFRRIFVVARVK

SEQ ID NO: 851206 - protein, 32 aa, Mycobacterium
RADGLPVAHLTYLSWRGLVQMEPPRRPEPDRP

SEQ ID NO: 851207 - protein, 18 aa, Mycobacterium
RADGQWRFRRRRCQFVTS

SEQ ID NO: 851208 - protein, 18 aa, Mycobacterium
RADGQWVELLPRTALLPD

SEQ ID NO: 851209 - protein, 32 aa, Mycobacterium
RADGVRAPVLAWLHPPGFDFGPALLADVQIAV

SEQ ID NO: 851210 - protein, 23 aa, Mycobacterium
RADGVRGVLLQEAGHRLPPLGEL

SEQ ID NO: 851211 - protein, 18 aa, Mycobacterium
RADIARLAGLYQSGQLQL

SEQ ID NO: 851212 - protein, 22 aa, Mycobacterium
RADILPRPDTYYGFSKAALEAL

SEQ ID NO: 851213 - protein, 21 aa, Mycobacterium
RADIPLPMVTLQTVGPTLQVY

SEQ ID NO: 851214 - protein, 24 aa, Mycobacterium
RADIPRLLSLYREGKLLLDETVTH

SEQ ID NO: 851215 - protein, 17 aa, Mycobacterium
RADKLAAAPHAKIGAAI

SEQ ID NO: 851216 - protein, 27 aa, Mycobacterium
RADKLYLVADLLPQVFGWARSVDPCQP

SEQ ID NO: 851217 - protein, 24 aa, Mycobacterium
RADKYRALMAERSPLYRRAATIRV

SEQ ID NO: 851218 - protein, 23 aa, Mycobacterium
RADLPSTPWLIPESTGLDLLYRM

SEQ ID NO: 851219 - protein, 23 aa, Mycobacterium
RADLQAWLREHADFLARPSNAAL

SEQ ID NO: 851220 - protein, 29 aa, Mycobacterium
RADLREWVAMFLDWLAQPVTRAALPGLIT

SEQ ID NO: 851221 - protein, 18 aa, Mycobacterium
RADLRRFLAQGRVEVMGG

SEQ ID NO: 851222 - protein, 17 aa, Mycobacterium
RADLRTWLDDNDLTPGP

SEQ ID NO: 851223 - protein, 17 aa, Mycobacterium
RADLTSPLAFLESPSRW

SEQ ID NO: 851224 - protein, 33 aa, Mycobacterium
RADMRVAHPLIARAHLLLRFDGAKWIAIDNGSP

SEQ ID NO: 851225 - protein, 23 aa, Mycobacterium
RADQALIYRLSGDRNPLHSDPWF

SEQ ID NO: 851226 - protein, 24 aa, Mycobacterium
RADQRVRFVLLGDGNQRVHLQSMA

SEQ ID NO: 851227 - protein, 25 aa, Mycobacterium
RADRDAWEFVLLKGALARELPVFGI

SEQ ID NO: 851228 - protein, 25 aa, Mycobacterium
RADRDFVLRFRLDQGRLSSSALLVA

SEQ ID NO: 851229 - protein, 19 aa, Mycobacterium
RADRFLPNGWCMLPPLQSC

SEQ ID NO: 851230 - protein, 23 aa, Mycobacterium
RADRIVYDFIKRESAKRGIPMGQ

SEQ ID NO: 851231 - protein, 23 aa, Mycobacterium
RADSAPWLPIERAAPLDGGADWV

SEQ ID NO: 851232 - protein, 25 aa, Mycobacterium
RADSTPWPTYPLMFRVTSAHEEGGE

SEQ ID NO: 851233 - protein, 18 aa, Mycobacterium
RADTAERLAPLPGPQLLL

SEQ ID NO: 851234 - protein, 23 aa, Mycobacterium
RADTPLLFLHNTTGYMVGKDYEE

SEQ ID NO: 851235 - protein, 23 aa, Mycobacterium
RADTPLLFLHNTTGYMVGKQYEE

SEQ ID NO: 851236 - protein, 19 aa, Mycobacterium
RADVAAVLVAVLDAPQTAG

SEQ ID NO: 851237 - protein, 31 aa, Mycobacterium
RADVKFGIEPWFRYFQKIAAFPQMTMSGDRL

SEQ ID NO: 851238 - protein, 30 aa, Mycobacterium
RADVKFGIEPWFRYFQKVAAFPQMTMPGEQ

SEQ ID NO: 851239 - protein, 23 aa, Mycobacterium
RADVLRLALPPRHARVEKENRVP

SEQ ID NO: 851240 - protein, 20 aa, Mycobacterium
RADVQLLRLSFGRFGDHVAA

SEQ ID NO: 851241 - protein, 24 aa, Mycobacterium
RADVVFASHHWPTWGRDSIVEFLS

SEQ ID NO: 851242 - protein, 24 aa, Mycobacterium
RADVVFASHHWPTWGRERIVEFLA

SEQ ID NO: 851243 - protein, 21 aa, Mycobacterium
RADWLSVTRWANWLASVRYSG

SEQ ID NO: 851244 - protein, 21 aa, Mycobacterium
RADWPTAVRAAGLDSAAPTAW

SEQ ID NO: 851245 - protein, 23 aa, Mycobacterium
RADWRELFTANLETMFFMSQAVA

SEQ ID NO: 851246 - protein, 31 aa, Mycobacterium
RAEAAYPLGRGFRPKVWPPVRRIDGAYGDRN

SEQ ID NO: 851247 - protein, 26 aa, Mycobacterium
RAEAPPLPWSLVDLGLSSAAPQRPPR

SEQ ID NO: 851248 - protein, 25 aa, Mycobacterium
RAEDRAALIGYLPTGFPDVPTSIAA

SEQ ID NO: 851249 - protein, 25 aa, Mycobacterium
RAEEDGFSSLWYASGVAGDPLTAMA

SEQ ID NO: 851250 - protein, 28 aa, Mycobacterium
RAEEFIRVARKFWDSWAPDAVIADVDAG

SEQ ID NO: 851251 - protein, 26 aa, Mycobacterium
RAEEQRPIWYLVPDGVVQYVAKRGLY

SEQ ID NO: 851252 - protein, 25 aa, Mycobacterium
RAEESAFVLLALQAPVAGDLRSIVS

SEQ ID NO: 851253 - protein, 25 aa, Mycobacterium
RAEFEDILAFWFDRGVDGFRIDVAH

SEQ ID NO: 851254 - protein, 19 aa, Mycobacterium
RAEFGDRLPVVLLDGREHS

SEQ ID NO: 851255 - protein, 19 aa, Mycobacterium
RAEFQRITQDLLDRTRKPF

SEQ ID NO: 851256 - protein, 20 aa, Mycobacterium
RAEFQRITQDLLDRTRKPFQ

SEQ ID NO: 851257 - protein, 18 aa, Mycobacterium
RAEFVAFLDANLPSEAAT

SEQ ID NO: 851258 - protein, 26 aa, Mycobacterium
RAEGLIAQQPRRGFMVLPVTGRDVTD

SEQ ID NO: 851259 - protein, 25 aa, Mycobacterium
RAEGLIAQQPRRGFVVLPVTGRDVT

SEQ ID NO: 851260 - protein, 25 aa, Mycobacterium
RAEGLPLVAELLATGGPFPQRLHLN

SEQ ID NO: 851261 - protein, 29 aa, Mycobacterium
RAEGTFEYQALLFIPSHAPFDLFQQNATV

SEQ ID NO: 851262 - protein, 17 aa, Mycobacterium
RAEHLMLVDLGRNDLGR

SEQ ID NO: 851263 - protein, 20 aa, Mycobacterium
RAEHRLFDRSSTHDWAAIAE

SEQ ID NO: 851264 - protein, 18 aa, Mycobacterium
RAEIAFIGAWTDAGARRD

SEQ ID NO: 851265 - protein, 23 aa, Mycobacterium
RAEIDALLARLPEPGAGDTPDNQ

SEQ ID NO: 851266 - protein, 22 aa, Mycobacterium
RAEIDALLARLPRPGDQEDPEK

SEQ ID NO: 851267 - protein, 23 aa, Mycobacterium
RAEITKWLIEEKGFCGVAAEADW

SEQ ID NO: 851268 - protein, 29 aa, Mycobacterium
RAEKFRALMSQRIPLYRRVSTIRVDTNRR

SEQ ID NO: 851269 - protein, 24 aa, Mycobacterium
RAEKYHALMSQRVPLYREVATIKV

SEQ ID NO: 851270 - protein, 29 aa, Mycobacterium
RAEKYRKLMAERVPLYRKVATIRINTNRR

SEQ ID NO: 851271 - protein, 19 aa, Mycobacterium
RAELDLPADWEPLGAIAIG

SEQ ID NO: 851272 - protein, 19 aa, Mycobacterium
RAELELPDDWEPLGAIAIG

SEQ ID NO: 851273 - protein, 19 aa, Mycobacterium
RAELFPLATLVTPNLDEVR

SEQ ID NO: 851274 - protein, 18 aa, Mycobacterium
RAELIAAPVLDADLLRRG

SEQ ID NO: 851275 - protein, 18 aa, Mycobacterium
RAELIALPVFGGPRQKQQ

SEQ ID NO: 851276 - protein, 21 aa, Mycobacterium
RAELILDAYEWHTSVAGGARG

SEQ ID NO: 851277 - protein, 21 aa, Mycobacterium
RAELLLLSVPDAELSGLVKGL

SEQ ID NO: 851278 - protein, 24 aa, Mycobacterium
RAELLQDRLVWQAASLLLAYPDDE

SEQ ID NO: 851279 - protein, 18 aa, Mycobacterium
RAELQLPADWEPLGAIAI

SEQ ID NO: 851280 - protein, 25 aa, Mycobacterium
RAELTRILMAWRRDVRRTRGTDGEA

SEQ ID NO: 851281 - protein, 17 aa, Mycobacterium
RAELVEELGIDVFLVMP

SEQ ID NO: 851282 - protein, 20 aa, Mycobacterium
RAELVRRWLATFGPATVTDV

SEQ ID NO: 851283 - protein, 29 aa, Mycobacterium
RAEMEMKVLLWAVQRLIGGLSAIGAERDI

SEQ ID NO: 851284 - protein, 28 aa, Mycobacterium
RAEMEMKVLLWAVQRLIGGLSTIGAERD

SEQ ID NO: 851285 - protein, 26 aa, Mycobacterium
RAEMMDRFIHVFASWLGVQPQRVETE

SEQ ID NO: 851286 - protein, 25 aa, Mycobacterium
RAENRLNHLLAQQIPPARKVVSGAN

SEQ ID NO: 851287 - protein, 22 aa, Mycobacterium
RAEPIFATVAPGVDAAPRTPGR

SEQ ID NO: 851288 - protein, 18 aa, Mycobacterium
RAEQFLKRLPANQVYRRL

SEQ ID NO: 851289 - protein, 30 aa, Mycobacterium; identical to SEQ ID NO: 717201

SEQ ID NO: 851290 - protein, 19 aa, Mycobacterium
RAEQRLLAGQRRLASAIAG

SEQ ID NO: 851291 - protein, 25 aa, Mycobacterium
RAEQSRPIWYLVPDGVVQYVAKRDL

SEQ ID NO: 851292 - protein, 32 aa, Mycobacterium
RAEQVRIHLAPNDGFRLPAPDVPIVMVGPGTG

SEQ ID NO: 851293 - protein, 25 aa, Mycobacterium
RAERAELIAWLLEQGITADEIRLAN

SEQ ID NO: 851294 - protein, 24 aa, Mycobacterium
RAERAELIDWLFGQGITAAEIRTT

SEQ ID NO: 851295 - protein, 25 aa, Mycobacterium
RAERARVIGLFRYQLIREAAEPAHS

SEQ ID NO: 851296 - protein, 44 aa, Mycobacterium
RAEREARLSRPLFVMPTKGVWTSGFGYRWGVLHGGIDIANSIGT

SEQ ID NO: 851297 - protein, 23 aa, Mycobacterium
RAERGTRVLYVSPLKALAVDVER

SEQ ID NO: 851298 - protein, 24 aa, Mycobacterium
RAERRALLVDAAFRLFGDGGETAL

SEQ ID NO: 851299 - protein, 24 aa, Mycobacterium
RAERRSRVLLAGHLDTVPVAGNLP

SEQ ID NO: 851300 - protein, 27 aa, Mycobacterium
RAESALPRLLKRLVIMGGAFDYRGNTT

SEQ ID NO: 851301 - protein, 24 aa, Mycobacterium
RAESHNWLTYYGAYDGKRYSLLDQ

SEQ ID NO: 851302 - protein, 31 aa, Mycobacterium
RAETMRRFLAAFAPFGLRPDALRPGYGLAEA

SEQ ID NO: 851303 - protein, 18 aa, Mycobacterium
RAETPPALPFPQTPGAAA

SEQ ID NO: 851304 - protein, 21 aa, Mycobacterium
RAEVFLAALADLLLEREQVLL

SEQ ID NO: 851305 - protein, 21 aa, Mycobacterium
RAEVIRRRLAYEADPAGFVSR

SEQ ID NO: 851306 - protein, 23 aa, Mycobacterium
RAEVLPLLEEVLGGGVAAALART

SEQ ID NO: 851307 - protein, 18 aa, Mycobacterium
RAEWTVFFREYHALTGER

SEQ ID NO: 851308 - protein, 19 aa, Mycobacterium
RAEYGDRLPVVLLDGVEHS

SEQ ID NO: 851309 - protein, 26 aa, Mycobacterium
RAFAATPAPLLRWGVAQFDPTLRSPV

SEQ ID NO: 851310 - protein, 24 aa, Mycobacterium
RAFANLLVQRATLQGFIILDHLHR

SEQ ID NO: 851311 - protein, 27 aa, Mycobacterium
RAFDGAPGLRLALALPPIEVAVTARLT

SEQ ID NO: 851312 - protein, 35 aa, Mycobacterium
RAFDLFEPGRPRMHQWMIELAGLFDAGVLEPLPVT

SEQ ID NO: 851313 - protein, 23 aa, Mycobacterium
RAFDQLMMDVALHKLPVTMVLDR

SEQ ID NO: 851314 - protein, 19 aa, Mycobacterium
RAFDQWRNIFRDGLRRMQS

SEQ ID NO: 851315 - protein, 25 aa, Mycobacterium
RAFEEGFVVPLPPDKLTGKKVAVVG

SEQ ID NO: 851316 - protein, 26 aa, Mycobacterium
RAFEQLFLRHQRHLYRLARLTSRTPE

SEQ ID NO: 851317 - protein, 20 aa, Mycobacterium
RAFIAEHAPPIPPRAGVRSA

SEQ ID NO: 851318 - protein, 17 aa, Mycobacterium
RAFIPRSVWQKMGDDFL

SEQ ID NO: 851319 - protein, 17 aa, Mycobacterium
RAFLLTDELIAEDFSFY

SEQ ID NO: 851320 - protein, 35 aa, Mycobacterium
RAFNHASGRIKLAWFLLHVARYLPALIYSTDPGWG

SEQ ID NO: 851321 - protein, 25 aa, Mycobacterium
RAFPGLTLALPDVLGTKIGRLVAAE

SEQ ID NO: 851322 - protein, 17 aa, Mycobacterium
RAFPYLGHPVYVDPHSS

SEQ ID NO: 851323 - protein, 19 aa, Mycobacterium
RAFRYLPSAPRCKLCNNPF

SEQ ID NO: 851324 - protein, 27 aa, Mycobacterium
RAFSDDLVLLPASSIPVPGPVGVLDTL

SEQ ID NO: 851325 - protein, 27 aa, Mycobacterium
RAFTALIYPHKPHMAAWLNQWGRSFAA

SEQ ID NO: 851326 - protein, 20 aa, Mycobacterium
RAFTDANYWRARLAESGADV

SEQ ID NO: 851327 - protein, 17 aa, Mycobacterium
RAFVETCLDVHVLDGYG

SEQ ID NO: 851328 - protein, 27 aa, Mycobacterium
RAFVNGGFPNLSWPLTPGHEIAGTIAE

SEQ ID NO: 851329 - protein, 18 aa, Mycobacterium
RAFVPHSVWRRIGDDFLG

SEQ ID NO: 851330 - protein, 20 aa, Mycobacterium
RAFYRIRQSWSGKVVLLKLI

SEQ ID NO: 851331 - protein, 25 aa, Mycobacterium
RAFYRRWAEFTDNLSWPQLIELAKS

SEQ ID NO: 851332 - protein, 26 aa, Mycobacterium
RAGATHAFFVPPVIARFLDAGEAAHA

SEQ ID NO: 851333 - protein, 32 aa, Mycobacterium
RAGDPEFLPLVRRLARFLPADLRVLDIARAPT

SEQ ID NO: 851334 - protein, 17 aa, Mycobacterium
RAGEKIMLMFESANFDE

SEQ ID NO: 851335 - protein, 23 aa, Mycobacterium
RAGEKVVMFYASGNWDEDAFCHP

SEQ ID NO: 851336 - protein, 20 aa, Mycobacterium
RAGFTVFIQGAADPWREASG

SEQ ID NO: 851337 - protein, 19 aa, Mycobacterium
RAGGFKHRAKVEISWVGSD

SEQ ID NO: 851338 - protein, 25 aa, Mycobacterium
RAGGPRRSRHACPHHLRGSAGHTGD

SEQ ID NO: 851339 - protein, 20 aa, Mycobacterium
RAGGQFLWDALSQAIDAAGL

SEQ ID NO: 851340 - protein, 24 aa, Mycobacterium
RAGHAAVVPVLPLTDTIKAVDANG

SEQ ID NO: 851341 - protein, 18 aa, Mycobacterium
RAGHETLLTLSPTQRART

SEQ ID NO: 851342 - protein, 23 aa, Mycobacterium
RAGHQLKFWTPGGSSTPLLTDEH

SEQ ID NO: 851343 - protein, 26 aa, Mycobacterium
RAGIDMTKLPSFMWLDVDDVIQESLA

SEQ ID NO: 851344 - protein, 27 aa, Mycobacterium
RAGIEFPAPALLYGYGAYEICTDPSFS

SEQ ID NO: 851345 - protein, 26 aa, Mycobacterium
RAGIELLAFGGRFIELGKRDIYRDSQ

SEQ ID NO: 851346 - protein, 23 aa, Mycobacterium
RAGIPPFYVMDVWLAAAERQRTH

SEQ ID NO: 851347 - protein, 19 aa, Mycobacterium
RAGLAELLPPHMVPRHFEL

SEQ ID NO: 851348 - protein, 17 aa, Mycobacterium
RAGLAHLLTRPGDVPPF

SEQ ID NO: 851349 - protein, 25 aa, Mycobacterium
RAGLGIRFVAVLPRLTPATDLGAEA

SEQ ID NO: 851350 - protein, 25 aa, Mycobacterium
RAGLHSLPWDGLKLSRGEPAIPTRM

SEQ ID NO: 851351 - protein, 30 aa, Mycobacterium
RAGLIDGIHLEGPWLSTLRCGAHQPVLMRD

SEQ ID NO: 851352 - protein, 22 aa, Mycobacterium
RAGLKAIYLSGWQVAGDANLSG

SEQ ID NO: 851353 - protein, 17 aa, Mycobacterium
RAGLMPNAKGVFSVLNT

SEQ ID NO: 851354 - protein, 17 aa, Mycobacterium
RAGLRPAGIWAYEAHRV

SEQ ID NO: 851355 - protein, 27 aa, Mycobacterium
RAGLRWQQVVLLRAYAKYLRQASFPYS

SEQ ID NO: 851356 - protein, 24 aa, Mycobacterium
RAGLTASRFVACPFGAAGARMYRT

SEQ ID NO: 851357 - protein, 25 aa, Mycobacterium
RAGLTGSRFVACPFGAAGLRMYRTG

SEQ ID NO: 851358 - protein, 23 aa, Mycobacterium
RAGLTKSYLSKIERGQSTPSIAV

SEQ ID NO: 851359 - protein, 25 aa, Mycobacterium
RAGMIFIRRNIAGDPLYKYVLKEYV

SEQ ID NO: 851360 - protein, 25 aa, Mycobacterium
RAGMLALLDGLHAQGFVAASQSARE

SEQ ID NO: 851361 - protein, 17 aa, Mycobacterium
RAGMTPPFSCEAGNCGT

SEQ ID NO: 851362 - protein, 27 aa, Mycobacterium
RAGNASLVLSFLGEFFVEANRGACPAG

SEQ ID NO: 851363 - protein, 23 aa, Mycobacterium
RAGNLRWEINGTHGDLLLTSPAP

SEQ ID NO: 851364 - protein, 26 aa, Mycobacterium
RAGPGRITELPPLLAAPPVKIRYTTT

SEQ ID NO: 851365 - protein, 17 aa, Mycobacterium
RAGPHLMMVFPASAGDL

SEQ ID NO: 851366 - protein, 23 aa, Mycobacterium
RAGPPTVVWPVTAVSAVTVVSVV

SEQ ID NO: 851367 - protein, 22 aa, Mycobacterium
RAGPYGMPILDDAAAWFVGKIL

SEQ ID NO: 851368 - protein, 24 aa, Mycobacterium
RAGQAAWLSVMYAIVEAASEKLEI

SEQ ID NO: 851369 - protein, 29 aa, Mycobacterium
RAGRKRSHWMWFVFPQLRGLGGSPTAVHY

SEQ ID NO: 851370 - protein, 26 aa, Mycobacterium
RAGRPGAALLFVSPRERHLLKAIEKA

SEQ ID NO: 851371 - protein, 20 aa, Mycobacterium
RAGRQARIIALLSTQSVRSQ

SEQ ID NO: 851372 - protein, 23 aa, Mycobacterium
RAGRQARIVAILSTQPVSSQSEL

SEQ ID NO: 851373 - protein, 22 aa, Mycobacterium
RAGRQDRIVAILSSASISSQSE

SEQ ID NO: 851374 - protein, 23 aa, Mycobacterium
RAGRQDRIVAILSSASISSQSEL

SEQ ID NO: 851375 - protein, 33 aa, Mycobacterium
RAGRRKLLGRRQVLPGVGLYLDGGFGVGKTHLL

SEQ ID NO: 851376 - protein, 26 aa, Mycobacterium
RAGRSGTALLFVSPRERHLLKAIEKA

SEQ ID NO: 851377 - protein, 26 aa, Mycobacterium
RAGRSGTALLFVTPRERHLLGAIERV

SEQ ID NO: 851378 - protein, 17 aa, Mycobacterium
RAGRSLPRRDRGTALLC

SEQ ID NO: 851379 - protein, 25 aa, Mycobacterium
RAGSARAWWCLTAAGISGVRILDGG

SEQ ID NO: 851380 - protein, 34 aa, Mycobacterium
RAGSILCDPWVNPAYFASWFPFPDNSQLDWDALG

SEQ ID NO: 851381 - protein, 31 aa, Mycobacterium
RAGSVAWDLAWTDAGAPLWTFPRAAWERELL

SEQ ID NO: 851382 - protein, 22 aa, Mycobacterium
RAGTLPYAALSAAGDMVSITTV

SEQ ID NO: 851383 - protein, 18 aa, Mycobacterium
RAGTVWINAYRVVAPHVP

SEQ ID NO: 851384 - protein, 22 aa, Mycobacterium
RAGVAFTPINYRLSADAIQALV

SEQ ID NO: 851385 - protein, 21 aa, Mycobacterium
RAGVAFTPINYRLSAEGIQAL

SEQ ID NO: 851386 - protein, 28 aa, Mycobacterium
RAGVARSGFYFYFDSKYAVLAVIIAEAM

SEQ ID NO: 851387 - protein, 25 aa, Mycobacterium
RAGVFLRAADLLAGPWREKIAAATM

SEQ ID NO: 851388 - protein, 21 aa, Mycobacterium
RAGVGPEIVDDVIWGCVSQVG

SEQ ID NO: 851389 - protein, 27 aa, Mycobacterium
RAGVGRSGFYFYFDSKYSVLAQMVGDA

SEQ ID NO: 851390 - protein, 26 aa, Mycobacterium
RAGVGTLVMTHYVPAIIAGQEDQWRA

SEQ ID NO: 851391 - protein, 35 aa, Mycobacterium
RAGVLALDIRPALRGRLALAWRLDGPVGPAARAFL

SEQ ID NO: 851392 - protein, 24 aa, Mycobacterium
RAGVRQFVILASGLDARAYRLPWP

SEQ ID NO: 851393 - protein, 30 aa, Mycobacterium
RAGVVNRILAYVAPILLGGPITAVDDVGVP

SEQ ID NO: 851394 - protein, 17 aa, Mycobacterium
RAGWIDGMRDKFADMVE

SEQ ID NO: 851395 - protein, 23 aa, Mycobacterium
RAGWLRWSDKLAAAPLRPGKGPI

SEQ ID NO: 851396 - protein, 22 aa, Mycobacterium
RAGWLRWSDKLGAAPLRPGKGP

SEQ ID NO: 851397 - protein, 18 aa, Mycobacterium
RAGWLTAADDLLEALLSD

SEQ ID NO: 851398 - protein, 22 aa, Mycobacterium
RAGWLWSRRRGIVAGLAASALH

SEQ ID NO: 851399 - protein, 17 aa, Mycobacterium
RAGWLYIDPAGPTCALA

SEQ ID NO: 851400 - protein, 19 aa, Mycobacterium
RAGYWRQVRAQLAVTPVML

SEQ ID NO: 851401 - protein, 17 aa, Mycobacterium
RAGYWRQVRTQLLVTPA

SEQ ID NO: 851402 - protein, 27 aa, Mycobacterium
RAHDAPTYRWPMVPALALVASMPVLGA

SEQ ID NO: 851403 - protein, 18 aa, Mycobacterium
RAHDLVFTMGLDAALIGL

SEQ ID NO: 851404 - protein, 30 aa, Mycobacterium
RAHDVARCWLYLGFTRLASGALQAADECWE

SEQ ID NO: 851405 - protein, 28 aa, Mycobacterium
RAHDVARCWLYLGLTRLASGALEAADQC

SEQ ID NO: 851406 - protein, 28 aa, Mycobacterium
RAHDVARCWLYLGLTRLGAGALEAADEC

SEQ ID NO: 851407 - protein, 28 aa, Mycobacterium
RAHDVSRSWLYFGLIRFRVGALDEADEC

SEQ ID NO: 851408 - protein, 28 aa, Mycobacterium
RAHGADLILLIVAALEQTALVSLLDRTE

SEQ ID NO: 851409 - protein, 28 aa, Mycobacterium
RAHGADLLLLIVAALEQPALESLLERTE

SEQ ID NO: 851410 - protein, 28 aa, Mycobacterium
RAHGADMLLLIVAALDQPVLESLLERTE

SEQ ID NO: 851411 - protein, 28 aa, Mycobacterium
RAHGADMLLLIVAALDQSALVSMLDRTE

SEQ ID NO: 851412 - protein, 26 aa, Mycobacterium
RAHGADMLLLIVAALEQSALVSMLDR

SEQ ID NO: 851413 - protein, 26 aa, Mycobacterium
RAHGERPLFPFLRGCLAGGAPITPEL

SEQ ID NO: 851414 - protein, 21 aa, Mycobacterium
RAHGFDLDMAGLVYFGDRNEA

SEQ ID NO: 851415 - protein, 25 aa, Mycobacterium
RAHGGRLLVRLAGVADRNGADELRG

SEQ ID NO: 851416 - protein, 28 aa, Mycobacterium
RAHGLPGISLAWGLWDQASAMTGGLDAA

SEQ ID NO: 851417 - protein, 21 aa, Mycobacterium
RAHGQLPNMRAIVGFAAETGD

SEQ ID NO: 851418 - protein, 19 aa, Mycobacterium
RAHGRTWDLLRLTRMPTVQ

SEQ ID NO: 851419 - protein, 17 aa, Mycobacterium
RAHLAAAARHAAALIGI

SEQ ID NO: 851420 - protein, 27 aa, Mycobacterium
RAHLIDAARPFIFDTGLAPAAVGAAGA

SEQ ID NO: 851421 - protein, 27 aa, Mycobacterium
RAHLIDAARPFIFDTGLAPAAVGSALA

SEQ ID NO: 851422 - protein, 20 aa, Mycobacterium
RAHLLAVALPPTVPHAFPVT

SEQ ID NO: 851423 - protein, 21 aa, Mycobacterium
RAHLLEPRDIFAALPDKRWPR

SEQ ID NO: 851424 - protein, 23 aa, Mycobacterium
RAHLLYGEWLRRMNRRNDARHHL

SEQ ID NO: 851425 - protein, 19 aa, Mycobacterium
RAHLPMSLRAMVTAAMCVP

SEQ ID NO: 851426 - protein, 20 aa, Mycobacterium
RAHNLFAGTPISPHIGDVAE

SEQ ID NO: 851427 - protein, 19 aa, Mycobacterium
RAHQILLARVETALRPYDL

SEQ ID NO: 851428 - protein, 17 aa, Mycobacterium
RAHRAWLRSTLAGLLKQ

SEQ ID NO: 851429 - protein, 24 aa, Mycobacterium
RAHRKGLAAFRRAGGRIVETVPPT

SEQ ID NO: 851430 - protein, 20 aa, Mycobacterium
RAHRPVRTAVVAASLPELVE

SEQ ID NO: 851431 - protein, 19 aa, Mycobacterium
RAHRPVRTAVVASGLPELV

SEQ ID NO: 851432 - protein, 18 aa, Mycobacterium
RAHSMFDPELYRDKAEVQ

SEQ ID NO: 851433 - protein, 18 aa, Mycobacterium
RAHTVILFHAGLLTPEQR

SEQ ID NO: 851434 - protein, 21 aa, Mycobacterium
RAHTWGPLTQKKLAAAIDVWV

SEQ ID NO: 851435 - protein, 25 aa, Mycobacterium
RAHVEAFARYYRYPFRPANVDAYRR

SEQ ID NO: 851436 - protein, 25 aa, Mycobacterium
RAHVSRVAIRPLPAKVAPELEEAID

SEQ ID NO: 851437 - protein, 18 aa, Mycobacterium
RAHWPVGTLQLAAIAACC

SEQ ID NO: 851438 - protein, 29 aa, Mycobacterium
RAIAANFRDIMITLGMFTHDALIGGEGAG

SEQ ID NO: 851439 - protein, 26 aa, Mycobacterium
RAIAEKWGVIALPDKPGLDAAGMLDP

SEQ ID NO: 851440 - protein, 21 aa, Mycobacterium
RAICSTNGARRARSALWAASS

SEQ ID NO: 851441 - protein, 17 aa, Mycobacterium
RAIDELTPFARAAAAHA

SEQ ID NO: 851442 - protein, 18 aa, Mycobacterium
RAIDRLGPELSLREIAEE

SEQ ID NO: 851443 - protein, 20 aa, Mycobacterium
RAIDVLADPARIAKLGLRAP

SEQ ID NO: 851444 - protein, 23 aa, Mycobacterium
RAIDVPALRLHPFLAGVAIRDTD

SEQ ID NO: 851445 - protein, 22 aa, Mycobacterium
RAIEAGLYRYDGDPLIFDADPD

SEQ ID NO: 851446 - protein, 26 aa, Mycobacterium
RAIEWTGPYLAVLPELATSGYVFTDI

SEQ ID NO: 851447 - protein, 17 aa, Mycobacterium
RAIFGEVLGIPVPNLIA

SEQ ID NO: 851448 - protein, 18 aa, Mycobacterium
RAIGRLTDLGWGARLRRL

SEQ ID NO: 851449 - protein, 21 aa, Mycobacterium
RAIGVIYLPATERQSHYYHVR

SEQ ID NO: 851450 - protein, 27 aa, Mycobacterium
RAIHFQEWWVRYRAQVPTHSFAFIGSE

SEQ ID NO: 851451 - protein, 26 aa, Mycobacterium
RAIIREPAVFLFDEPLSNLDAKLRVE

SEQ ID NO: 851452 - protein, 26 aa, Mycobacterium
RAIIREPSVFLFDEPLSNLDAKLRVE

SEQ ID NO: 851453 - protein, 18 aa, Mycobacterium
RAIISAHLGGHTAHHNGC

SEQ ID NO: 851454 - protein, 17 aa, Mycobacterium
RAILLSALAEASSSRAG

SEQ ID NO: 851455 - protein, 18 aa, Mycobacterium
RAILLTHAHIDHFGTAIW

SEQ ID NO: 851456 - protein, 18 aa, Mycobacterium
RAILLTHAHIDHLGSAIW

SEQ ID NO: 851457 - protein, 23 aa, Mycobacterium
RAINDLLATMLWHGALDARLREL

SEQ ID NO: 851458 - protein, 23 aa, Mycobacterium
RAINDLLATMLWHGALDPRLREL

SEQ ID NO: 851459 - protein, 18 aa, Mycobacterium
RAINIAADSPKLAQLMSQ

SEQ ID NO: 851460 - protein, 20 aa, Mycobacterium
RAIPEMFRKAFKVAETERPA

SEQ ID NO: 851461 - protein, 24 aa, Mycobacterium
RAIPHIHALIRLDPPGDPATTASG

SEQ ID NO: 851462 - protein, 19 aa, Mycobacterium
RAIPPLYSLDPAMPVLLRP

SEQ ID NO: 851463 - protein, 17 aa, Mycobacterium
RAIPRGGVFGRRQGAGV

SEQ ID NO: 851464 - protein, 18 aa, Mycobacterium
RAIQKHELIPGTDGFYRM

SEQ ID NO: 851465 - protein, 21 aa, Mycobacterium
RAIQRFPQTFYPTNSFNFASY

SEQ ID NO: 851466 - protein, 28 aa, Mycobacterium
RAIRGRGLGLTIITPSLLVAVELADEPD

SEQ ID NO: 851467 - protein, 20 aa, Mycobacterium
RAISPLAVQKYMPNGAAAAV

SEQ ID NO: 851468 - protein, 20 aa, Mycobacterium
RAISSFARMDAVLITAVNGT

SEQ ID NO: 851469 - protein, 21 aa, Mycobacterium
RAITAIVRRDAKTPDTDDSAG

SEQ ID NO: 851470 - protein, 17 aa, Mycobacterium
RAITTSAPLLIAQARLV

SEQ ID NO: 851471 - protein, 17 aa, Mycobacterium
RAIVGDRGRPPFTKEVD

SEQ ID NO: 851472 - protein, 17 aa, Mycobacterium
RAIVRSPKAFLMDEPLS

SEQ ID NO: 851473 - protein, 36 aa, Mycobacterium
RAIVYPRGIPGRLSWAMLRPLYTAALRALAADVIAS

SEQ ID NO: 851474 - protein, 19 aa, Mycobacterium
RAIWGFRAPGRPHGDRFIQ

SEQ ID NO: 851475 - protein, 17 aa, Mycobacterium
RAKAEFAEREGVNLTFL

SEQ ID NO: 851476 - protein, 24 aa, Mycobacterium
RAKAMAMVMLALPGAVFVYNGEEL

SEQ ID NO: 851477 - protein, 23 aa, Mycobacterium
RAKARYELALLAGRDPELAAALS

SEQ ID NO: 851478 - protein, 24 aa, Mycobacterium
RAKDNVTRLKLLGKLPAALGVDIP

SEQ ID NO: 851479 - protein, 24 aa, Mycobacterium
RAKHALFDRLVYHKLRAALGGDCH

SEQ ID NO: 851480 - protein, 24 aa, Mycobacterium
RAKHALFDRLVYRKLRAALGGDCH

SEQ ID NO: 851481 - protein, 24 aa, Mycobacterium
RAKIGMYIALRLLRDGAHTTITTR

SEQ ID NO: 851482 - protein, 29 aa, Mycobacterium
RAKIVDPSWFNWPALPVAMADTIVPDFPL

SEQ ID NO: 851483 - protein, 23 aa, Mycobacterium
RAKKQRFVYLGSGPLTGLARESA

SEQ ID NO: 851484 - protein, 17 aa, Mycobacterium
RAKKVLELSLREALQLG

SEQ ID NO: 851485 - protein, 23 aa, Mycobacterium
RAKLEEVLQWPPGTIARIRQGEP

SEQ ID NO: 851486 - protein, 19 aa, Mycobacterium
RAKLPAAQIHRVLTQVARA

SEQ ID NO: 851487 - protein, 19 aa, Mycobacterium
RAKLTPDYDFGCKRPAVSS

SEQ ID NO: 851488 - protein, 21 aa, Mycobacterium
RAKLTYMGINPDTAPMPEINQ

SEQ ID NO: 851489 - protein, 18 aa, Mycobacterium
RAKMMQLLEPDRIGVTLS

SEQ ID NO: 851490 - protein, 17 aa, Mycobacterium
RAKQLAHQYYGRLIADP

SEQ ID NO: 851491 - protein, 25 aa, Mycobacterium
RAKQRMELRLFTLLSAEAQGRNPDP

SEQ ID NO: 851492 - protein, 24 aa, Mycobacterium
RAKQWREKFGSQLLPSPVPAEDIN

SEQ ID NO: 851493 - protein, 17 aa, Mycobacterium
RAKSWYERLNAEDPNRK

SEQ ID NO: 851494 - protein, 20 aa, Mycobacterium
RAKTILARQAPPSLRAVFDA

SEQ ID NO: 851495 - protein, 18 aa, Mycobacterium
RAKVLARYAVWLGDHRDE

SEQ ID NO: 851496 - protein, 28 aa, Mycobacterium
RAKVNTFCAPPTVWRMLIQADLGARPEG

SEQ ID NO: 851497 - protein, 18 aa, Mycobacterium
RAKVRKLPALDTEALRPA

SEQ ID NO: 851498 - protein, 18 aa, Mycobacterium
RAKWLVAADGLHSQVRRS

SEQ ID NO: 851499 - protein, 26 aa, Mycobacterium
RALAAEPRVLLLDEPMAALDVTAAPP

SEQ ID NO: 851500 - protein, 27 aa, Mycobacterium
RALAAKPRVLLLDEPFAALDAGLRVRV

SEQ ID NO: 851501 - protein, 24 aa, Mycobacterium
RALAEFKALFQMKFYGVALFRSRG

SEQ ID NO: 851502 - protein, 28 aa, Mycobacterium
RALAEFKAMFQMKFYAVALLRSRGSLPA

SEQ ID NO: 851503 - protein, 19 aa, Mycobacterium
RALAFYRDVLGMDVVFETL

SEQ ID NO: 851504 - protein, 29 aa, Mycobacterium
RALAGIPRLQFAHADLLVRSFGTLQNVLA

SEQ ID NO: 851505 - protein, 29 aa, Mycobacterium
RALAKGRRTVWIPWALGPAAAVMRVLPQS

SEQ ID NO: 851506 - protein, 19 aa, Mycobacterium
RALALLADRNHVLPDDIKA

SEQ ID NO: 851507 - protein, 17 aa, Mycobacterium
RALAMAVQWARERHQFG

SEQ ID NO: 851508 - protein, 19 aa, Mycobacterium
RALAPLDVIVLIETPLGAL

SEQ ID NO: 851509 - protein, 22 aa, Mycobacterium
RALASTWYHDPAAPVRAGDFVA

SEQ ID NO: 851510 - protein, 21 aa, Mycobacterium
RALASWFAITRPPIGAEVAGQ

SEQ ID NO: 851511 - protein, 26 aa, Mycobacterium
RALDAHRGLPMPFELARTQLIVGQLQ

SEQ ID NO: 851512 - protein, 23 aa, Mycobacterium
RALDALLAGFLEDVTATIGDGWS

SEQ ID NO: 851513 - protein, 17 aa, Mycobacterium
RALDEWRVLSAAALVGL

SEQ ID NO: 851514 - protein, 19 aa, Mycobacterium
RALDPQLRETFLGARAQLP

SEQ ID NO: 851515 - protein, 21 aa, Mycobacterium
RALDQFSAENWRVIYAGRRGD

SEQ ID NO: 851516 - protein, 22 aa, Mycobacterium
RALDRAGFKIVATGLRECIAAD

SEQ ID NO: 851517 - protein, 21 aa, Mycobacterium
RALDRAGFKIVATGLRECITG

SEQ ID NO: 851518 - protein, 23 aa, Mycobacterium
RALDRAGFKIVATGLRECLTGEA

SEQ ID NO: 851519 - protein, 18 aa, Mycobacterium
RALDRKFVRVALGGVRDE

SEQ ID NO: 851520 - protein, 23 aa, Mycobacterium
RALDSLLELLPSGSWLDRADATA

SEQ ID NO: 851521 - protein, 21 aa, Mycobacterium
RALDYTLPWDVDGVEDAMPVD

SEQ ID NO: 851522 - protein, 19 aa, Mycobacterium
RALEELLQLIRTTANVRTR

SEQ ID NO: 851523 - protein, 25 aa, Mycobacterium
RALEGLVEFLPSKTWFDKTDADNAY

SEQ ID NO: 851524 - protein, 24 aa, Mycobacterium
RALEIAKVNRLPVLYLVESGGADL

SEQ ID NO: 851525 - protein, 19 aa, Mycobacterium
RALEPWSFGIYAGGQSILI

SEQ ID NO: 851526 - protein, 19 aa, Mycobacterium
RALERFLGVRLFNRAPAGL

SEQ ID NO: 851527 - protein, 17 aa, Mycobacterium
RALERFQEPFLDQLRRD

SEQ ID NO: 851528 - protein, 25 aa, Mycobacterium
RALERRLRLVLLERGPTGSRLTDAG

SEQ ID NO: 851529 - protein, 20 aa, Mycobacterium
RALESMGCRTFGFAGGREDA

SEQ ID NO: 851530 - protein, 19 aa, Mycobacterium
RALEVFSWESVAAQTVAVY

SEQ ID NO: 851531 - protein, 21 aa, Mycobacterium
RALEVLAEAGLAPRLRLVPIH

SEQ ID NO: 851532 - protein, 25 aa, Mycobacterium
RALFEAKALFQMKFYAVALYRTRGV

SEQ ID NO: 851533 - protein, 18 aa, Mycobacterium
RALFYGSPGIEASTPQQL

SEQ ID NO: 851534 - protein, 32 aa, Mycobacterium
RALGARYLDTGAMYRMVTLAVLRAGIDPGDVD

SEQ ID NO: 851535 - protein, 31 aa, Mycobacterium
RALGDPHYAYKLDWLAALRDSAEGWLRDDPG

SEQ ID NO: 851536 - protein, 29 aa, Mycobacterium
RALGEIHAMWRINELLNWQVAAAGEDINM

SEQ ID NO: 851537 - protein, 29 aa, Mycobacterium
RALGEIHAMWRINELLNWQVAAAGEDINV

SEQ ID NO: 851538 - protein, 30 aa, Mycobacterium
RALGFPVRMFTVLFALGRLPGWIAHWREMH

SEQ ID NO: 851539 - protein, 18 aa, Mycobacterium
RALGHRVYGRIMAVRTNH

SEQ ID NO: 851540 - protein, 33 aa, Mycobacterium
RALGIPARPVVVGPITFLALSKAVGGAVAPISR

SEQ ID NO: 851541 - protein, 23 aa, Mycobacterium
RALGLDRFHLFGNSWGGMLAQQY

SEQ ID NO: 851542 - protein, 19 aa, Mycobacterium
RALGLRPRARIVSQALVGA

SEQ ID NO: 851543 - protein, 20 aa, Mycobacterium
RALGRYLVGQAAAAGARKLG

SEQ ID NO: 851544 - protein, 21 aa, Mycobacterium
RALGVAAWDAAAGQLVRVARG

SEQ ID NO: 851545 - protein, 17 aa, Mycobacterium
RALGVFSWEAVAAQTVR

SEQ ID NO: 851546 - protein, 25 aa, Mycobacterium
RALGVKPALSYIPLTVRVREEPCAD

SEQ ID NO: 851547 - protein, 25 aa, Mycobacterium
RALHFPPQPEPPLPHQFRAGIHTDY

SEQ ID NO: 851548 - protein, 20 aa, Mycobacterium
RALIAVRGLHRFAAAEGIAA

SEQ ID NO: 851549 - protein, 23 aa, Mycobacterium
RALIAVRGLHRFAAAEGLAALDV

SEQ ID NO: 851550 - protein, 25 aa, Mycobacterium
RALIAVRGLHRFAAIEGLAPTDVAR

SEQ ID NO: 851551 - protein, 27 aa, Mycobacterium
RALIHAHLLAAARRREYRRWLDAQCAA

SEQ ID NO: 851552 - protein, 20 aa, Mycobacterium
RALILAQPEDRPALKKAGFL

SEQ ID NO: 851553 - protein, 20 aa, Mycobacterium
RALISAILRRRGLTARVTVP

SEQ ID NO: 851554 - protein, 17 aa, Mycobacterium
RALIVSPPKAGKTTILQ

SEQ ID NO: 851555 - protein, 19 aa, Mycobacterium
RALKRLKVVAAFQNSTNSP

SEQ ID NO: 851556 - protein, 22 aa, Mycobacterium
RALLAALIATNWFGQNSAAIAA

SEQ ID NO: 851557 - protein, 18 aa, Mycobacterium
RALLAATDLPVVETFQAA

SEQ ID NO: 851558 - protein, 21 aa, Mycobacterium
RALLAQLVATNLFGQNTAAIA

SEQ ID NO: 851559 - protein, 18 aa, Mycobacterium
RALLARGFKYGTAPGALV

SEQ ID NO: 851560 - protein, 20 aa, Mycobacterium
RALLDLFNPAQLDVLIRVGA

SEQ ID NO: 851561 - protein, 19 aa, Mycobacterium
RALLDLLANKWSALIIGLL

SEQ ID NO: 851562 - protein, 18 aa, Mycobacterium
RALLGAAPLSPTLQDYRK

SEQ ID NO: 851563 - protein, 17 aa, Mycobacterium
RALLGLPITVRGADFGS

SEQ ID NO: 851564 - protein, 18 aa, Mycobacterium
RALLLDEGVSVLTQTPSA

SEQ ID NO: 851565 - protein, 17 aa, Mycobacterium
RALLLEHLSPGVALTGL

SEQ ID NO: 851566 - protein, 18 aa, Mycobacterium
RALLLPRRHPGKRSPLWH

SEQ ID NO: 851567 - protein, 23 aa, Mycobacterium
RALLLPRRHPGKRSPLWHQRQRA

SEQ ID NO: 851568 - protein, 22 aa, Mycobacterium
RALLPTFLEEALRLESPFRGHH

SEQ ID NO: 851569 - protein, 19 aa, Mycobacterium
RALLQGDALLQLLTEPLDP

SEQ ID NO: 851570 - protein, 19 aa, Mycobacterium
RALLRRTSGVDAVLAQLAI

SEQ ID NO: 851571 - protein, 25 aa, Mycobacterium
RALMAAGLVDYLQVTIFPVVTGQTG

SEQ ID NO: 851572 - protein, 26 aa, Mycobacterium
RALMCRLLTDRPGIPGLVSFDVNWRE

SEQ ID NO: 851573 - protein, 17 aa, Mycobacterium
RALMDALHRAGIGVIVD

SEQ ID NO: 851574 - protein, 19 aa, Mycobacterium
RALMMALLATNFLGQNTAA

SEQ ID NO: 851575 - protein, 22 aa, Mycobacterium
RALMMVTSVHPSLGALLSAHQS

SEQ ID NO: 851576 - protein, 31 aa, Mycobacterium
RALMRALGIPAPIILHWSPDSTRILVARIDQ

SEQ ID NO: 851577 - protein, 27 aa, Mycobacterium
RALNRPTPLMLPGFAARAALGEFADEG

SEQ ID NO: 851578 - protein, 19 aa, Mycobacterium
RALNVQRYPRGIAETGFIQ

SEQ ID NO: 851579 - protein, 25 aa, Mycobacterium
RALPDGLTYGLLRYLNPEAGLDDPD

SEQ ID NO: 851580 - protein, 25 aa, Mycobacterium
RALPDGLTYGLLRYLNTEVGLQGPD

SEQ ID NO: 851581 - protein, 26 aa, Mycobacterium
RALPDPLGYGLLRHLAHATGLDAADP

SEQ ID NO: 851582 - protein, 17 aa, Mycobacterium
RALPLTCDVRDAAAVAA

SEQ ID NO: 851583 - protein, 17 aa, Mycobacterium
RALPSPPRGYNPAPAPE

SEQ ID NO: 851584 - protein, 17 aa, Mycobacterium
RALPSTFATWRERRKLI

SEQ ID NO: 851585 - protein, 18 aa, Mycobacterium
RALQRLENARRRQAVVSH

SEQ ID NO: 851586 - protein, 18 aa, Mycobacterium
RALQRLPGHLQQQALLRV

SEQ ID NO: 851587 - protein, 28 aa, Mycobacterium
RALQSPQPLWALWRFGTDPGFTRISMEF

SEQ ID NO: 851588 - protein, 22 aa, Mycobacterium
RALQVLAARLQAMAEEQALADA

SEQ ID NO: 851589 - protein, 17 aa, Mycobacterium
RALQVMFVLRELRAGVH

SEQ ID NO: 851590 - protein, 22 aa, Mycobacterium
RALQYMFRRHLEMTPMEYLRRV

SEQ ID NO: 851591 - protein, 17 aa, Mycobacterium
RALRDQQAAADRAKAAV

SEQ ID NO: 851592 - protein, 17 aa, Mycobacterium
RALRDRLIDGVLSAIED

SEQ ID NO: 851593 - protein, 33 aa, Mycobacterium
RALRGGKRTVWIPRPLGALAFVMRWVPSSVWRR

SEQ ID NO: 851594 - protein, 19 aa, Mycobacterium
RALRILGVRASDLEPSLGA

SEQ ID NO: 851595 - protein, 26 aa, Mycobacterium
RALRKRAPGMRFAGLGGATETATHNT

SEQ ID NO: 851596 - protein, 20 aa, Mycobacterium
RALRLDQLLHSKVLPVTFGF

SEQ ID NO: 851597 - protein, 17 aa, Mycobacterium
RALRLHRQITLAQLSET

SEQ ID NO: 851598 - protein, 22 aa, Mycobacterium
RALRMDAPATAYLIGLVHPAPH

SEQ ID NO: 851599 - protein, 17 aa, Mycobacterium
RALRMSTPLALTEEELV

SEQ ID NO: 851600 - protein, 21 aa, Mycobacterium
RALRPARLLVSGSAPLPVPVF

SEQ ID NO: 851601 - protein, 17 aa, Mycobacterium
RALRPHAATLVDGFGVP

SEQ ID NO: 851602 - protein, 27 aa, Mycobacterium
RALRPVRAPRWLPTPARRRAAHAVAEM

SEQ ID NO: 851603 - protein, 20 aa, Mycobacterium
RALRRMFGGLLPPENEEAAM

SEQ ID NO: 851604 - protein, 28 aa, Mycobacterium
RALRRRVHRLAWITPEPTRYWRQATCAM

SEQ ID NO: 851605 - protein, 22 aa, Mycobacterium
RALRTWLLRRLEESRFWFDAQG

SEQ ID NO: 851606 - protein, 18 aa, Mycobacterium
RALRVIDWFIGATTERRY

SEQ ID NO: 851607 - protein, 17 aa, Mycobacterium
RALSATKRLVWSGLGSS

SEQ ID NO: 851608 - protein, 21 aa, Mycobacterium
RALSIALVALPYYQTTNPQLA

SEQ ID NO: 851609 - protein, 19 aa, Mycobacterium
RALSVFSRGPRRRPRRRHV

SEQ ID NO: 851610 - protein, 20 aa, Mycobacterium
RALTGLHLEFAPALPQPPNS

SEQ ID NO: 851611 - protein, 32 aa, Mycobacterium
RALTIARELADPALLIRALVARGVITAYDADV

SEQ ID NO: 851612 - protein, 20 aa, Mycobacterium
RALTIARELDEPALLARVLT

SEQ ID NO: 851613 - protein, 20 aa, Mycobacterium
RALVAVLLDGAEWYRRKTVA

SEQ ID NO: 851614 - protein, 20 aa, Mycobacterium
RALVDALPDGPARFIVVGGD

SEQ ID NO: 851615 - protein, 31 aa, Mycobacterium
RALVDLNTWTLLKWLDEPCPFYDWRVNEPDK

SEQ ID NO: 851616 - protein, 36 aa, Mycobacterium
RALVDVARQILASSYIWFFLCPVAPEIAIRSRAQVK

SEQ ID NO: 851617 - protein, 20 aa, Mycobacterium
RALVLAFNKWDLVDEDRREL

SEQ ID NO: 851618 - protein, 20 aa, Mycobacterium
RALVLAFNKWDLVDEDRRYL

SEQ ID NO: 851619 - protein, 17 aa, Mycobacterium
RALVLTGAGGAFCSGAD

SEQ ID NO: 851620 - protein, 18 aa, Mycobacterium
RALVTAPLRGPGLAKLQH

SEQ ID NO: 851621 - protein, 18 aa, Mycobacterium
RALWDGQVPGACDSTLLI

SEQ ID NO: 851622 - protein, 18 aa, Mycobacterium
RALWDSQVPGACDSTLLI

SEQ ID NO: 851623 - protein, 17 aa, Mycobacterium
RALWVRETLLLTTTGAT

SEQ ID NO: 851624 - protein, 20 aa, Mycobacterium
RALYELGHTGIPIYNVNSNC

SEQ ID NO: 851625 - protein, 19 aa, Mycobacterium
RALYRHTLAPLKGAGRAVV

SEQ ID NO: 851626 - protein, 20 aa, Mycobacterium
RALYRLEARELLDVPIIGVA

SEQ ID NO: 851627 - protein, 23 aa, Mycobacterium
RALYTVLRALHRHLERADLAPAD

SEQ ID NO: 851628 - protein, 25 aa, Mycobacterium
RAMAGWQVTVLLPRGGDARSLRILG

SEQ ID NO: 851629 - protein, 26 aa, Mycobacterium
RAMDRLGLLAMLTRALERAGTDIVWA

SEQ ID NO: 851630 - protein, 18 aa, Mycobacterium
RAMEQYLLELLNLSPEEL

SEQ ID NO: 851631 - protein, 30 aa, Mycobacterium
RAMGFPTRMFTVLFALGRLPGWIAHWREMH

SEQ ID NO: 851632 - protein, 24 aa, Mycobacterium
RAMGPMQFIPETWGHFGVDANNDG

SEQ ID NO: 851633 - protein, 19 aa, Mycobacterium
RAMIFDSVYDIYRGVVTYV

SEQ ID NO: 851634 - protein, 17 aa, Mycobacterium
RAMILDSPLLSRHDIVI

SEQ ID NO: 851635 - protein, 19 aa, Mycobacterium
RAMLAAAPPGYRLSIPDST

SEQ ID NO: 851636 - protein, 19 aa, Mycobacterium
RAMLFLLATAKLNQAERFG

SEQ ID NO: 851637 - protein, 17 aa, Mycobacterium
RAMLRNNLTLKSGVTLD

SEQ ID NO: 851638 - protein, 20 aa, Mycobacterium
RAMMQLLLEYASGGTVFLEV

SEQ ID NO: 851639 - protein, 24 aa, Mycobacterium
RAMQLFGPIYRRSIARRGDEKMLR

SEQ ID NO: 851640 - protein, 18 aa, Mycobacterium
RAMQVLAARLQALAEEQA

SEQ ID NO: 851641 - protein, 19 aa, Mycobacterium
RAMQVLAARLQALAEEQAS

SEQ ID NO: 851642 - protein, 33 aa, Mycobacterium
RAMRRVHGRKWRKLFPPGTLPQAAPGSPIAYTT

SEQ ID NO: 851643 - protein, 19 aa, Mycobacterium
RAMTFIRRSGVHDSGRPHA

SEQ ID NO: 851644 - protein, 19 aa, Mycobacterium
RAMTLLNQPGHRSLSSIAL

SEQ ID NO: 851645 - protein, 18 aa, Mycobacterium
RAMTMLLVACPCAVGLAT

SEQ ID NO: 851646 - protein, 25 aa, Mycobacterium
RAMTPMKDLLGPDPILLPGDPDTEA

SEQ ID NO: 851647 - protein, 20 aa, Mycobacterium
RAMVNLHRRYQLTTTQLAAA

SEQ ID NO: 851648 - protein, 19 aa, Mycobacterium
RAMVNLHRRYRITTTQLAA

SEQ ID NO: 851649 - protein, 30 aa, Mycobacterium
RANGFRDIICPPLFLQYAVLGVTHLEALRP

SEQ ID NO: 851650 - protein, 32 aa, Mycobacterium
RANGFRDIICPPLYLQYAVLGVSRLKSLRPDG

SEQ ID NO: 851651 - protein, 17 aa, Mycobacterium
RANGPLALGPYGPEILG

SEQ ID NO: 851652 - protein, 23 aa, Mycobacterium
RANGQLVPRVPAPLFRSSMKTVE

SEQ ID NO: 851653 - protein, 27 aa, Mycobacterium
RANHIRVRFAARQWGTRGARINSISPG

SEQ ID NO: 851654 - protein, 22 aa, Mycobacterium
RANIIVPAMPIWMGVRSSVMQR

SEQ ID NO: 851655 - protein, 23 aa, Mycobacterium
RANILVLCGPIWLGDNSSVMKLV

SEQ ID NO: 851656 - protein, 21 aa, Mycobacterium
RANLVGINWAPPFEGAFAGDP

SEQ ID NO: 851657 - protein, 23 aa, Mycobacterium
RANRKVFLAVVAYQPGVIESRAD

SEQ ID NO: 851658 - protein, 18 aa, Mycobacterium
RANRWYQAQGWPVGANYI

SEQ ID NO: 851659 - protein, 26 aa, Mycobacterium
RANYAKALRMFAVLPTIVAADMRRRR

SEQ ID NO: 851660 - protein, 18 aa, Mycobacterium
RAPAALLLHGFPTSSYMF

SEQ ID NO: 851661 - protein, 24 aa, Mycobacterium
RAPADLLSGYYHAVHQLTLEYVAA

SEQ ID NO: 851662 - protein, 22 aa, Mycobacterium
RAPAIALAVRDALHGTLVEMGS

SEQ ID NO: 851663 - protein, 21 aa, Mycobacterium
RAPALTDRLVWQCASLLLSYP

SEQ ID NO: 851664 - protein, 18 aa, Mycobacterium
RAPDPAQDSLRHAVLAFL

SEQ ID NO: 851665 - protein, 19 aa, Mycobacterium
RAPELWGTVFRELGVDAVC

SEQ ID NO: 851666 - protein, 19 aa, Mycobacterium
RAPESVQINWVYRGGRADL

SEQ ID NO: 851667 - protein, 22 aa, Mycobacterium
RAPEVAEIVGVPLIAAMRPEPN

SEQ ID NO: 851668 - protein, 21 aa, Mycobacterium
RAPFLIYQRALKTGDFREVRA

SEQ ID NO: 851669 - protein, 17 aa, Mycobacterium
RAPGGVLLPTLRAPKIA

SEQ ID NO: 851670 - protein, 17 aa, Mycobacterium
RAPGPPSDRCRAHRHRA

SEQ ID NO: 851671 - protein, 18 aa, Mycobacterium
RAPGTPPLALPKPEAVSD

SEQ ID NO: 851672 - protein, 21 aa, Mycobacterium
RAPIPSAEPRRRGFLPRVAAD

SEQ ID NO: 851673 - protein, 19 aa, Mycobacterium
RAPIRVRLTQQRPPAEVEA

SEQ ID NO: 851674 - protein, 19 aa, Mycobacterium
RAPKVLPFSALDAPNGVAV

SEQ ID NO: 851675 - protein, 23 aa, Mycobacterium
RAPLELPGPLLRISPHLDTTAED

SEQ ID NO: 851676 - protein, 17 aa, Mycobacterium
RAPLLYNSQPWRWAAEG

SEQ ID NO: 851677 - protein, 19 aa, Mycobacterium
RAPLSVTVQGRAGVGCRTV

SEQ ID NO: 851678 - protein, 20 aa, Mycobacterium
RAPMPLNVIGLNNIAPAIMQ

SEQ ID NO: 851679 - protein, 17 aa, Mycobacterium
RAPMSYPFRDAEFGGKE

SEQ ID NO: 851680 - protein, 21 aa, Mycobacterium
RAPMWDLSWRTPALLAERGFL

SEQ ID NO: 851681 - protein, 20 aa, Mycobacterium
RAPQLRRWYPSTGGSWDAGP

SEQ ID NO: 851682 - protein, 23 aa, Mycobacterium
RAPRAGLTFEFVVAEPGWTMYMV

SEQ ID NO: 851683 - protein, 22 aa, Mycobacterium
RAPRPGLIALPWDRPLADWAAP

SEQ ID NO: 851684 - protein, 30 aa, Mycobacterium
RAPRRRLDLPTYPFQRRHFWPKTSGIAGVD

SEQ ID NO: 851685 - protein, 29 aa, Mycobacterium
RAPSLHNSQPWRWVAASGAVDLFLDPHRM

SEQ ID NO: 851686 - protein, 25 aa, Mycobacterium
RAPSLHNSQPWRWVVGGPTVDLFAD

SEQ ID NO: 851687 - protein, 29 aa, Mycobacterium
RAPSLYNTQPWLWVTDGTGLDLFLDTSRV

SEQ ID NO: 851688 - protein, 28 aa, Mycobacterium
RAPVLYCRFHGWRYKLDGSLHAATRKDL

SEQ ID NO: 851689 - protein, 19 aa, Mycobacterium
RAPVPALHRLTVAALRAVA

SEQ ID NO: 851690 - protein, 25 aa, Mycobacterium
RAPYRDLRFLARLCAAAAQIKRLGV

SEQ ID NO: 851691 - protein, 24 aa, Mycobacterium
RAQAAALLLGPIVLGKLSTLPEFD

SEQ ID NO: 851692 - protein, 27 aa, Mycobacterium
RAQAKALVPQLLAFGASRVYAADRVRC

SEQ ID NO: 851693 - protein, 24 aa, Mycobacterium
RAQAPQLPFLRQGCAAWNVPKAAD

SEQ ID NO: 851694 - protein, 23 aa, Mycobacterium
RAQAQVVAWWSPAYFEPNGGLSR

SEQ ID NO: 851695 - protein, 23 aa, Mycobacterium
RAQARIAIPRQVHLPWGTVSLPR

SEQ ID NO: 851696 - protein, 23 aa, Mycobacterium
RAQAYELMRSIRLPGSHFRGDIA

SEQ ID NO: 851697 - protein, 21 aa, Mycobacterium
RAQEAVYSAPYLRDGKAAIVR

SEQ ID NO: 851698 - protein, 18 aa, Mycobacterium
RAQELMLTNRTLSATEAY

SEQ ID NO: 851699 - protein, 24 aa, Mycobacterium
RAQEQLATVLGICAGSYAATEAAN

SEQ ID NO: 851700 - protein, 24 aa, Mycobacterium
RAQEREFLFFTTHVNDPLPAAVGL

SEQ ID NO: 851701 - protein, 17 aa, Mycobacterium
RAQEVLTRLADDSYDLV

SEQ ID NO: 851702 - protein, 21 aa, Mycobacterium
RAQGFLLSRPIDSAAMESLLA

SEQ ID NO: 851703 - protein, 19 aa, Mycobacterium
RAQGLPATSIAWGAWGEIG

SEQ ID NO: 851704 - protein, 18 aa, Mycobacterium
RAQGTPLSPGTFLATITG

SEQ ID NO: 851705 - protein, 21 aa, Mycobacterium
RAQHADVVWFGAAAPLALLSS

SEQ ID NO: 851706 - protein, 28 aa, Mycobacterium
RAQIETNLFGALWVTQAALPILRAQRSG

SEQ ID NO: 851707 - protein, 23 aa, Mycobacterium
RAQIHPWAWVVNNSTSAAHPTAP

SEQ ID NO: 851708 - protein, 28 aa, Mycobacterium
RAQIKYINPLMAPIARFLPSFATVTHYG

SEQ ID NO: 851709 - protein, 26 aa, Mycobacterium
RAQILAIATDWLTRLYGQGPNAEWVY

SEQ ID NO: 851710 - protein, 20 aa, Mycobacterium
RAQLIGADLAHRVRLARPRA

SEQ ID NO: 851711 - protein, 24 aa, Mycobacterium
RAQLIVYHHMWSDGAEWQCSGCTG

SEQ ID NO: 851712 - protein, 24 aa, Mycobacterium
RAQLIVYHHMWTDGAEWQCGGCTG

SEQ ID NO: 851713 - protein, 17 aa, Mycobacterium
RAQLLVAMGRPLPEEMH

SEQ ID NO: 851714 - protein, 18 aa, Mycobacterium
RAQLQLPADWEPLGAIAI

SEQ ID NO: 851715 - protein, 24 aa, Mycobacterium
RAQLRPIEPPPAASAFDLSASAPA

SEQ ID NO: 851716 - protein, 18 aa, Mycobacterium
RAQLSRVPEWFRYNAGLL

SEQ ID NO: 851717 - protein, 21 aa, Mycobacterium
RAQMATLPRLKPREFYDLVVE

SEQ ID NO: 851718 - protein, 35 aa, Mycobacterium
RAQMATLPRLRPRVFYDLVVEVALIRPGPIQGGSV

SEQ ID NO: 851719 - protein, 25 aa, Mycobacterium
RAQPSHWRRNLMACSGIEFCKLSFA

SEQ ID NO: 851720 - protein, 22 aa, Mycobacterium
RAQRAMHYLLRTPRSGSSNMQF

SEQ ID NO: 851721 - protein, 17 aa, Mycobacterium
RAQRRARRGEDRGLGRA

SEQ ID NO: 851722 - protein, 29 aa, Mycobacterium
RAQTQRAVENFPISFRPLERTQIRAMGLL

SEQ ID NO: 851723 - protein, 25 aa, Mycobacterium
RAQTRLAVVSALFGLVRAGDRIPAY

SEQ ID NO: 851724 - protein, 21 aa, Mycobacterium
RAQVRPIHRPPRSPADRHPHC

SEQ ID NO: 851725 - protein, 19 aa, Mycobacterium
RARAAAACTGCAAGAAVAA

SEQ ID NO: 851726 - protein, 29 aa, Mycobacterium
RARAAFENGPWPRLARSERARLLLGIADA

SEQ ID NO: 851727 - protein, 21 aa, Mycobacterium
RARAALARRYLAVEGHRVLAH

SEQ ID NO: 851728 - protein, 17 aa, Mycobacterium
RARADLPSTPWLIPEST

SEQ ID NO: 851729 - protein, 22 aa, Mycobacterium
RARAFALGQLRSLAERHGYPVR

SEQ ID NO: 851730 - protein, 24 aa, Mycobacterium
RARAGLFLAMQYPVEVPGVSMSNF

SEQ ID NO: 851731 - protein, 24 aa, Mycobacterium
RARAGLFLAMQYPVEVPGVSVSNF

SEQ ID NO: 851732 - protein, 22 aa, Mycobacterium
RARAILAKVPTPNDAVLVAVSP

SEQ ID NO: 851733 - protein, 25 aa, Mycobacterium
RARAMAMVMLALPGAVFIYNGEELG

SEQ ID NO: 851734 - protein, 19 aa, Mycobacterium
RARAMKLFRQMEGRAAFEV

SEQ ID NO: 851735 - protein, 18 aa, Mycobacterium
RARAPLNEQVRQPICGLV

SEQ ID NO: 851736 - protein, 25 aa, Mycobacterium
RARARLAVGSALFGLLRADDPVPAY

SEQ ID NO: 851737 - protein, 26 aa, Mycobacterium
RARASARRLGLDRIPLYQIHQSNPVV

SEQ ID NO: 851738 - protein, 22 aa, Mycobacterium
RARAVYLDAMLAAMFAGRLATG

SEQ ID NO: 851739 - protein, 24 aa, Mycobacterium
RARAYNFECWIYGSDPEANADIVE

SEQ ID NO: 851740 - protein, 20 aa, Mycobacterium
RARCGAHDPARMRDPDPAEI

SEQ ID NO: 851741 - protein, 18 aa, Mycobacterium
RARDAFEFALVRAALRRA

SEQ ID NO: 851742 - protein, 17 aa, Mycobacterium
RARDDLGWQPRYDYRRI

SEQ ID NO: 851743 - protein, 20 aa, Mycobacterium
RARDMIAERGATSCYWDYHP

SEQ ID NO: 851744 - protein, 19 aa, Mycobacterium
RARDPLWQPMNRAPGRTGN

SEQ ID NO: 851745 - protein, 22 aa, Mycobacterium
RARDWPAPPAGPWWAPADDPHL

SEQ ID NO: 851746 - protein, 23 aa, Mycobacterium
RAREELLVTWHGQPSPFLTASTA

SEQ ID NO: 851747 - protein, 29 aa, Mycobacterium
RARENALLERGLLPSPLLLDDPGVDIVAR

SEQ ID NO: 851748 - protein, 29 aa, Mycobacterium
RARENALLERGLLPSPLLLDNAGVDIVAR

SEQ ID NO: 851749 - protein, 32 aa, Mycobacterium
RARENALLERGLLPSPLLLDRPGVDIVARYRP

SEQ ID NO: 851750 - protein, 27 aa, Mycobacterium
RARENALLERGLLPSPLLLDSPGVDIV

SEQ ID NO: 851751 - protein, 23 aa, Mycobacterium
RARERLAVGSALFGLVRADDRIP

SEQ ID NO: 851752 - protein, 17 aa, Mycobacterium
RARFGTLTGVDRPVATG

SEQ ID NO: 851753 - protein, 19 aa, Mycobacterium
RARFTPQLTLAYRDAVAVA

SEQ ID NO: 851754 - protein, 29 aa, Mycobacterium
RARFTPSLKLLWRMAFAFAGESERGKRMR

SEQ ID NO: 851755 - protein, 20 aa, Mycobacterium
RARFTPYQKLVILDVADDKV

SEQ ID NO: 851756 - protein, 19 aa, Mycobacterium
RARFWPTAMTTLSTHDTKR

SEQ ID NO: 851757 - protein, 20 aa, Mycobacterium
RARGAQLVTRLFLADPEFAE

SEQ ID NO: 851758 - protein, 23 aa, Mycobacterium
RARGIPVLVLAGQVTLPQQALQA

SEQ ID NO: 851759 - protein, 21 aa, Mycobacterium
RARGLTPVPSRPFRSSPPSRR

SEQ ID NO: 851760 - protein, 20 aa, Mycobacterium
RARGWSGRVAQGAVFGRWRA

SEQ ID NO: 851761 - protein, 29 aa, Mycobacterium
RARHHVRRLWLRSVPPEAAMLELLLGAWL

SEQ ID NO: 851762 - protein, 24 aa, Mycobacterium
RARHKGCTLLVTDGDWEGASTRLE

SEQ ID NO: 851763 - protein, 25 aa, Mycobacterium
RARHRGCTLLVTDGDWEGAPTRLEA

SEQ ID NO: 851764 - protein, 19 aa, Mycobacterium
RARHTAVRFGDPSQATPLE

SEQ ID NO: 851765 - protein, 20 aa, Mycobacterium
RARIEHLRLAEKFDAVLLAS

SEQ ID NO: 851766 - protein, 17 aa, Mycobacterium
RARIGHLLDPGTFQEFG

SEQ ID NO: 851767 - protein, 21 aa, Mycobacterium
RARIVSYDNDFGRFSGVQWDV

SEQ ID NO: 851768 - protein, 22 aa, Mycobacterium
RARKLIDSQLTQAGWVVQDKKD

SEQ ID NO: 851769 - protein, 21 aa, Mycobacterium
RARLADRLPAYMVPVAVVTLD

SEQ ID NO: 851770 - protein, 27 aa, Mycobacterium
RARLAYLRACNRLWALADPDGARSLAD

SEQ ID NO: 851771 - protein, 17 aa, Mycobacterium
RARLFPKGLATLIDRRD

SEQ ID NO: 851772 - protein, 18 aa, Mycobacterium
RARLGTRRIRRSCRPKPP

SEQ ID NO: 851773 - protein, 34 aa, Mycobacterium
RARLIALTRELGVTEFMLLQAAVAIALHKSGQGT

SEQ ID NO: 851774 - protein, 24 aa, Mycobacterium
RARLSGMPVVFWLDTERPHEVELR

SEQ ID NO: 851775 - protein, 18 aa, Mycobacterium
RARLTPDHPLGCKRLVFA

SEQ ID NO: 851776 - protein, 20 aa, Mycobacterium
RARMGIGRVITVLTDDPRKA

SEQ ID NO: 851777 - protein, 18 aa, Mycobacterium
RARMQQRWPVVMVDEFQD

SEQ ID NO: 851778 - protein, 19 aa, Mycobacterium
RARMWPLAMTTLTTHDTKR

SEQ ID NO: 851779 - protein, 19 aa, Mycobacterium
RARMWWRPEGQVPDDPVLT

SEQ ID NO: 851780 - protein, 18 aa, Mycobacterium
RARNPKLIYARLSAFGGN

SEQ ID NO: 851781 - protein, 19 aa, Mycobacterium
RARNPKLIYARLSAFGGNG

SEQ ID NO: 851782 - protein, 31 aa, Mycobacterium
RARNVLAFKLNPLVIKELPLPRPKFEIFVYS

SEQ ID NO: 851783 - protein, 19 aa, Mycobacterium
RARPCMIFVAARRSATVSW

SEQ ID NO: 851784 - protein, 22 aa, Mycobacterium
RARPLLPGLVGEPADRGDPVAD

SEQ ID NO: 851785 - protein, 17 aa, Mycobacterium
RARPMWKLTLIEGLSDG

SEQ ID NO: 851786 - protein, 18 aa, Mycobacterium
RARPQLAVTFRNGWLWAT

SEQ ID NO: 851787 - protein, 19 aa, Mycobacterium
RARPQLQHAFSGRGARAGQ

SEQ ID NO: 851788 - protein, 25 aa, Mycobacterium
RARPRNLKLRALSWGAAPASDTLLR

SEQ ID NO: 851789 - protein, 18 aa, Mycobacterium
RARPRPSARLRRAPAGQG

SEQ ID NO: 851790 - protein, 28 aa, Mycobacterium
RARQKGCTLLVTDGDWQGPSARLEARVC

SEQ ID NO: 851791 - protein, 25 aa, Mycobacterium
RARQRGCTLLVTDGDWQGASARLDA

SEQ ID NO: 851792 - protein, 24 aa, Mycobacterium
RARQSGMTTVFWLDDERPHENELR

SEQ ID NO: 851793 - protein, 19 aa, Mycobacterium
RARRAIALCTPREAIARDA

SEQ ID NO: 851794 - protein, 20 aa, Mycobacterium
RARRALAEFQVEGLATVIPF

SEQ ID NO: 851795 - protein, 18 aa, Mycobacterium
RARRDGFVDVPRAAAISA

SEQ ID NO: 851796 - protein, 20 aa, Mycobacterium
RARRDGKIPAVLYGHGADPQ

SEQ ID NO: 851797 - protein, 20 aa, Mycobacterium
RARREGKIPAVLYGHGADPQ

SEQ ID NO: 851798 - protein, 19 aa, Mycobacterium
RARREIGQVLRRLIDGLLE

SEQ ID NO: 851799 - protein, 21 aa, Mycobacterium
RARREVVLYASFDPADLRAEE

SEQ ID NO: 851800 - protein, 29 aa, Mycobacterium
RARRHHAALLALRYRLWHGRGPGLPPNDR

SEQ ID NO: 851801 - protein, 22 aa, Mycobacterium
RARRLAAFLIGRGLVPGDRVMV

SEQ ID NO: 851802 - protein, 20 aa, Mycobacterium
RARRLARALHQWGFGASRER

SEQ ID NO: 851803 - protein, 21 aa, Mycobacterium
RARRLARARAQILSLAQTRLR

SEQ ID NO: 851804 - protein, 23 aa, Mycobacterium
RARRLRVAGAGLIRSWRARNGER

SEQ ID NO: 851805 - protein, 28 aa, Mycobacterium
RARRLTVLGQFFRFARNRRVVLVDPTHG

SEQ ID NO: 851806 - protein, 17 aa, Mycobacterium
RARRMLGAVPYAENVPL

SEQ ID NO: 851807 - protein, 18 aa, Mycobacterium
RARRPLVVVLTDGRATAG

SEQ ID NO: 851808 - protein, 25 aa, Mycobacterium
RARRRIGMVFQQFNLFPNMTVIENL

SEQ ID NO: 851809 - protein, 17 aa, Mycobacterium
RARRRLLVTAVDGDPGG

SEQ ID NO: 851810 - protein, 18 aa, Mycobacterium
RARRTAKLVGNVGGRYLD

SEQ ID NO: 851811 - protein, 19 aa, Mycobacterium
RARRYVAKYTICPAIAHGL

SEQ ID NO: 851812 - protein, 27 aa, Mycobacterium
RARSELLPVMYSAEALALLAAVKHAFD

SEQ ID NO: 851813 - protein, 22 aa, Mycobacterium
RARSGQMLLRRNGFRAAHPVVE

SEQ ID NO: 851814 - protein, 18 aa, Mycobacterium
RARSKGCTLLVTGGDWQG

SEQ ID NO: 851815 - protein, 19 aa, Mycobacterium
RARSRFLSHLYRYAEDPEP

SEQ ID NO: 851816 - protein, 35 aa, Mycobacterium
RARSTRVEFWAFDILFLDGRLLTKATYTDRRKLLE

SEQ ID NO: 851817 - protein, 34 aa, Mycobacterium
RARSTRVEFWAFDILWLDGRSLLRAKYSDRRKIL

SEQ ID NO: 851818 - protein, 25 aa, Mycobacterium
RARSWDHRKLGLAPMPVGGSTAPAV

SEQ ID NO: 851819 - protein, 26 aa, Mycobacterium
RARSWDHRKLGLPAMPVGGSTAPAVL

SEQ ID NO: 851820 - protein, 18 aa, Mycobacterium
RARSWHRYPEPSPDDVAM

SEQ ID NO: 851821 - protein, 22 aa, Mycobacterium
RARTAAPLDRPRLPRSRLPTGE

SEQ ID NO: 851822 - protein, 20 aa, Mycobacterium
RARTFALRQLQSLAAYAGYA

SEQ ID NO: 851823 - protein, 18 aa, Mycobacterium
RARTRISWLDSRHSFSFG

SEQ ID NO: 851824 - protein, 26 aa, Mycobacterium
RARTRQLWLDGTLPAFTSWVNPAATR

SEQ ID NO: 851825 - protein, 20 aa, Mycobacterium
RARVGHSYIKALMAETSAIF

SEQ ID NO: 851826 - protein, 26 aa, Mycobacterium
RARVIELLKLVRLPDPERRYDCYPHQ

SEQ ID NO: 851827 - protein, 25 aa, Mycobacterium
RARVLHCAALRRLADKTQVVGPRDG

SEQ ID NO: 851828 - protein, 24 aa, Mycobacterium
RARVLHCAALRRLADKTQVVGPRH

SEQ ID NO: 851829 - protein, 27 aa, Mycobacterium
RARVQQVLLPTLLDWLSDTPDPDAGLL

SEQ ID NO: 851830 - protein, 26 aa, Mycobacterium
RARVTTRTFFRYFADKQAVVFADAER

SEQ ID NO: 851831 - protein, 23 aa, Mycobacterium
RARYLLDGLDILPLTAPVINLAE

SEQ ID NO: 851832 - protein, 22 aa, Mycobacterium
RARYLMLRLLERANAGRVAIPA

SEQ ID NO: 851833 - protein, 19 aa, Mycobacterium
RARYRAVFPNVYVSNGAGL

SEQ ID NO: 851834 - protein, 27 aa, Mycobacterium
RASAAWMRTMFAILPLSVGVKNADAHE

SEQ ID NO: 851835 - protein, 25 aa, Mycobacterium
RASAGSIFAIPVIVAPDTSAALGAL

SEQ ID NO: 851836 - protein, 21 aa, Mycobacterium
RASALAAYLLGRNDPVAQVPR

SEQ ID NO: 851837 - protein, 32 aa, Mycobacterium
RASALRRRDQGRALLPWMLGYQVPMWPERKLT

SEQ ID NO: 851838 - protein, 23 aa, Mycobacterium
RASANLDRHWRNLRTLFSHNPTV

SEQ ID NO: 851839 - protein, 20 aa, Mycobacterium
RASAPHVWAIGDVASWRDTV

SEQ ID NO: 851840 - protein, 25 aa, Mycobacterium
RASAWPEYPTMDPLANVAGMLRVVS

SEQ ID NO: 851841 - protein, 27 aa, Mycobacterium
RASCKFMKMITPAALLRCLVEGADEVH

SEQ ID NO: 851842 - protein, 26 aa, Mycobacterium
RASCKYMKMITPAALLRCLVEGADEV

SEQ ID NO: 851843 - protein, 27 aa, Mycobacterium
RASCKYMKMITPAALLRCLVEGADEVH

SEQ ID NO: 851844 - protein, 25 aa, Mycobacterium
RASCRYMKMITPAAMLRCLVEGADE

SEQ ID NO: 851845 - protein, 28 aa, Mycobacterium
RASCTYMKMITPAALLRCLVEGRDEVDV

SEQ ID NO: 851846 - protein, 27 aa, Mycobacterium
RASDGAVPLVLLLPGGGAQYVGMGRGL

SEQ ID NO: 851847 - protein, 24 aa, Mycobacterium
RASDLEFDGLRLPASALLGPEGQA

SEQ ID NO: 851848 - protein, 23 aa, Mycobacterium
RASEAVIYRRFGYGIATSSATYR

SEQ ID NO: 851849 - protein, 23 aa, Mycobacterium
RASFEHRAVVVGGNRGELATGLA

SEQ ID NO: 851850 - protein, 28 aa, Mycobacterium
RASFELTQKALMAGIPVLAAVSAPSSLA

SEQ ID NO: 851851 - protein, 30 aa, Mycobacterium
RASFYIYFEDKGHLLRRLAAQVFDDLAHEA

SEQ ID NO: 851852 - protein, 28 aa, Mycobacterium
RASFYIYFEDKGHLLRRLAGQVFGDLAD

SEQ ID NO: 851853 - protein, 20 aa, Mycobacterium
RASGGWPWLAPGNDPGELLT

SEQ ID NO: 851854 - protein, 24 aa, Mycobacterium
RASGLPVPEWFPMLGGHEGSGVVE

SEQ ID NO: 851855 - protein, 23 aa, Mycobacterium
RASGLPYALYRLAGVISPDTQAG

SEQ ID NO: 851856 - protein, 26 aa, Mycobacterium
RASGRQYRFVLPGPVLSLGEQARCLE

SEQ ID NO: 851857 - protein, 24 aa, Mycobacterium
RASGVPLLAVWGDKDPFFGPDGAR

SEQ ID NO: 851858 - protein, 23 aa, Mycobacterium
RASIYLTDLLPRHGVRRIAVNDN

SEQ ID NO: 851859 - protein, 24 aa, Mycobacterium
RASKAAIIHFTKCAAIELAHYEVR

SEQ ID NO: 851860 - protein, 24 aa, Mycobacterium
RASKPLVRLRVPFTLSRYEIDNVE

SEQ ID NO: 851861 - protein, 25 aa, Mycobacterium
RASLESYARYWREAFRLPTMNHRKV

SEQ ID NO: 851862 - protein, 19 aa, Mycobacterium
RASLRYQYYETSDGNYVVF

SEQ ID NO: 851863 - protein, 22 aa, Mycobacterium
RASLSQVLPPYMVPAAFVVIDE

SEQ ID NO: 851864 - protein, 18 aa, Mycobacterium
RASLWRNGIQRYVPVCST

SEQ ID NO: 851865 - protein, 23 aa, Mycobacterium
RASPVRVFYYVFDLLHLDGMSTV

SEQ ID NO: 851866 - protein, 22 aa, Mycobacterium
RASPWLTRHPEMPEWHLHLASI

SEQ ID NO: 851867 - protein, 26 aa, Mycobacterium
RASQEAFLFGPPPLGPDAPPLDRLVA

SEQ ID NO: 851868 - protein, 25 aa, Mycobacterium
RASQQAFLFGPPPLGPEAAPLDRLI

SEQ ID NO: 851869 - protein, 23 aa, Mycobacterium
RASRVELPLLSPEQARTFCRAVR

SEQ ID NO: 851870 - protein, 24 aa, Mycobacterium
RASRVQLPLLSPAQARAFCHEVRG

SEQ ID NO: 851871 - protein, 25 aa, Mycobacterium
RASSKYALVIYAAKRARQINDYYNQ

SEQ ID NO: 851872 - protein, 27 aa, Mycobacterium
RASSWPTDLELLRDKGFRLLAMTPDPS

SEQ ID NO: 851873 - protein, 19 aa, Mycobacterium
RASTFARFRERFAPHGLQP

SEQ ID NO: 851874 - protein, 17 aa, Mycobacterium
RASTLFLRRGEQPPGPR

SEQ ID NO: 851875 - protein, 22 aa, Mycobacterium
RASYFVWTYLKSTGDYDIYLVN

SEQ ID NO: 851876 - protein, 26 aa, Mycobacterium
RATAADRQFWRTCLAARTAVTRPTQL

SEQ ID NO: 851877 - protein, 19 aa, Mycobacterium
RATAEICPLPLAAYQVSGE

SEQ ID NO: 851878 - protein, 33 aa, Mycobacterium
RATAGWRRYPMRLISPLARRFLKSRAAYRDTPG

SEQ ID NO: 851879 - protein, 28 aa, Mycobacterium
RATAKAAEPLLLILDVEKPRSADISIHV

SEQ ID NO: 851880 - protein, 17 aa, Mycobacterium
RATALRRAGRHVGERRL

SEQ ID NO: 851881 - protein, 24 aa, Mycobacterium
RATDLIGYGPYLDRIPARDGQVRH

SEQ ID NO: 851882 - protein, 20 aa, Mycobacterium
RATDLLAMTSLGPLRLRNVG

SEQ ID NO: 851883 - protein, 24 aa, Mycobacterium
RATELVLTNGLWRGTVDSTMFVDA

SEQ ID NO: 851884 - protein, 18 aa, Mycobacterium
RATESTKFLVLELSARRP

SEQ ID NO: 851885 - protein, 21 aa, Mycobacterium
RATFDAVFLSDWPALADNPPT

SEQ ID NO: 851886 - protein, 23 aa, Mycobacterium
RATGCPIAVSRWATSAGSAGRSG

SEQ ID NO: 851887 - protein, 27 aa, Mycobacterium
RATGFDTPYPPARLEKLWLPGVDRLLD

SEQ ID NO: 851888 - protein, 35 aa, Mycobacterium
RATGIFRDKLVYERGGWYFTSRVLEWDSVPSRHPL

SEQ ID NO: 851889 - protein, 21 aa, Mycobacterium
RATGIGSWPGTAARPAAEVVV

SEQ ID NO: 851890 - protein, 22 aa, Mycobacterium
RATGRPLSFQPLPDFASVLDDD

SEQ ID NO: 851891 - protein, 25 aa, Mycobacterium
RATGSLCNLWKLPKGMVLHPDAIDL

SEQ ID NO: 851892 - protein, 19 aa, Mycobacterium
RATHIVVWATLDKSLGRAA

SEQ ID NO: 851893 - protein, 18 aa, Mycobacterium
RATHLKWDEARAALLDHR

SEQ ID NO: 851894 - protein, 21 aa, Mycobacterium
RATIASTAWLPQLGIPEGFAA

SEQ ID NO: 851895 - protein, 17 aa, Mycobacterium
RATINELRYPATLFSDG

SEQ ID NO: 851896 - protein, 24 aa, Mycobacterium
RATISELVLVPGPTALLAPKWVPW

SEQ ID NO: 851897 - protein, 20 aa, Mycobacterium
RATKRALWGALEYGLTDACR

SEQ ID NO: 851898 - protein, 18 aa, Mycobacterium
RATLALPGGLRWIAVHQP

SEQ ID NO: 851899 - protein, 19 aa, Mycobacterium
RATLALPGGLRWLAQHQPD

SEQ ID NO: 851900 - protein, 25 aa, Mycobacterium
RATLANGFFDLPYTAPVDAATGKPV

SEQ ID NO: 851901 - protein, 20 aa, Mycobacterium
RATLGLDPGFRTGVKVAVVD

SEQ ID NO: 851902 - protein, 17 aa, Mycobacterium
RATLPLGRIHRPPAARG

SEQ ID NO: 851903 - protein, 20 aa, Mycobacterium
RATLRRLYRHPRSGQLVAME

SEQ ID NO: 851904 - protein, 23 aa, Mycobacterium
RATLYRHFATKNDLVLAVLQRRE

SEQ ID NO: 851905 - protein, 24 aa, Mycobacterium
RATLYRHFATKNDLVLAVLQRREE

SEQ ID NO: 851906 - protein, 18 aa, Mycobacterium
RATPLTELPWVGHRSRNW

SEQ ID NO: 851907 - protein, 25 aa, Mycobacterium
RATQPLSVFFFDILHRDGDDLLDAP

SEQ ID NO: 851908 - protein, 22 aa, Mycobacterium
RATQRLGVLHRDPLPPALAGLG

SEQ ID NO: 851909 - protein, 17 aa, Mycobacterium
RATRFVYDPNFRPRLTT

SEQ ID NO: 851910 - protein, 25 aa, Mycobacterium
RATRPLRAPRWLPTPARHRARAASA

SEQ ID NO: 851911 - protein, 24 aa, Mycobacterium
RATRRAIPIDLRGDWPVALRAAGL

SEQ ID NO: 851912 - protein, 22 aa, Mycobacterium
RATSHWSTLPLLKPFGVTPVGD

SEQ ID NO: 851913 - protein, 27 aa, Mycobacterium
RATSVESPFRFLVFDDPIQAMDPSKID

SEQ ID NO: 851914 - protein, 23 aa, Mycobacterium
RATVAQRRWAALAPAERAAALRA

SEQ ID NO: 851915 - protein, 18 aa, Mycobacterium
RATVGTRRRIQVAGAGLI

SEQ ID NO: 851916 - protein, 18 aa, Mycobacterium
RATVLIFPDLNTGNNTYK

SEQ ID NO: 851917 - protein, 24 aa, Mycobacterium
RATVWSIINGWHAAAGPLPEFAEA

SEQ ID NO: 851918 - protein, 20 aa, Mycobacterium
RATVYRYFPSREAVMSGVII

SEQ ID NO: 851919 - protein, 21 aa, Mycobacterium
RATWQRHHVFAEAQRLVRGSG

SEQ ID NO: 851920 - protein, 17 aa, Mycobacterium
RATYITAERTRNAAHRT

SEQ ID NO: 851921 - protein, 22 aa, Mycobacterium
RAVADAGLTWIGPPVAAIESMG

SEQ ID NO: 851922 - protein, 19 aa, Mycobacterium
RAVAGFYLAFEAVDDSDRL

SEQ ID NO: 851923 - protein, 19 aa, Mycobacterium
RAVAGQRIVFAPGAVKMSA

SEQ ID NO: 851924 - protein, 17 aa, Mycobacterium
RAVALICSLKPSPAESS

SEQ ID NO: 851925 - protein, 21 aa, Mycobacterium
RAVAPVPFLSSAVLATVALLH

SEQ ID NO: 851926 - protein, 26 aa, Mycobacterium
RAVARYVAELLVWDRAVRADVDDSVH

SEQ ID NO: 851927 - protein, 19 aa, Mycobacterium
RAVATRPQLLLLDEPFSAL

SEQ ID NO: 851928 - protein, 29 aa, Mycobacterium
RAVCDLEPYWEALRKVYAPFESGLPSPTG

SEQ ID NO: 851929 - protein, 24 aa, Mycobacterium
RAVDAVSFRLRRGSTLAIAGESGS

SEQ ID NO: 851930 - protein, 24 aa, Mycobacterium
RAVDGVSFRLRRAGTLAIAGESGS

SEQ ID NO: 851931 - protein, 29 aa, Mycobacterium
RAVDRAVALLAAARRPLVVLGKGAAYAQA

SEQ ID NO: 851932 - protein, 24 aa, Mycobacterium
RAVDSVSFRLRRGSTLAVVGESGS

SEQ ID NO: 851933 - protein, 27 aa, Mycobacterium
RAVEAWRGFSRWLMRAYDVLVDEDQIA

SEQ ID NO: 851934 - protein, 21 aa, Mycobacterium
RAVEELLRVYPIVQTARKATR

SEQ ID NO: 851935 - protein, 20 aa, Mycobacterium
RAVEFASAILRRGIDVNFMV

SEQ ID NO: 851936 - protein, 29 aa, Mycobacterium
RAVELRAHLFVPDLLECLAQLAHLAGSHP

SEQ ID NO: 851937 - protein, 18 aa, Mycobacterium
RAVFTPGLAGLVLGEYRR

SEQ ID NO: 851938 - protein, 20 aa, Mycobacterium
RAVFVLLRELADVILVGAGT

SEQ ID NO: 851939 - protein, 17 aa, Mycobacterium
RAVFWFHGTPGARRQIP

SEQ ID NO: 851940 - protein, 24 aa, Mycobacterium
RAVGALLVPPGDAPWRLGMSAAGT

SEQ ID NO: 851941 - protein, 23 aa, Mycobacterium
RAVGIEFLIRWATGELRASDVDD

SEQ ID NO: 851942 - protein, 28 aa, Mycobacterium
RAVGLAGFPNFFLLIGPNSPIGNNSLIS

SEQ ID NO: 851943 - protein, 17 aa, Mycobacterium
RAVGLDPFIRIVDGQVD

SEQ ID NO: 851944 - protein, 18 aa, Mycobacterium
RAVGPGGLFLALPGARAD

SEQ ID NO: 851945 - protein, 20 aa, Mycobacterium
RAVGPGGLFLALPGARSDGH

SEQ ID NO: 851946 - protein, 29 aa, Mycobacterium
RAVGRKFIDFYLGLSNYVNNWLKLGFTED

SEQ ID NO: 851947 - protein, 17 aa, Mycobacterium
RAVGVAQAVLWVLDGNA

SEQ ID NO: 851948 - protein, 29 aa, Mycobacterium
RAVHGGMIPLFYDWLFGMVVSTADIRPTR

SEQ ID NO: 851949 - protein, 19 aa, Mycobacterium
RAVIARRYYLEGRTRVQIA

SEQ ID NO: 851950 - protein, 18 aa, Mycobacterium
RAVIEWGMRCTCPSIDAC

SEQ ID NO: 851951 - protein, 18 aa, Mycobacterium
RAVIEWGMRCTCPSIDSC

SEQ ID NO: 851952 - protein, 42 aa, Mycobacterium
RAVILAPQGLDYIAAFLGSMQAGLIAVPLPLPHRGSSDARVS

SEQ ID NO: 851953 - protein, 28 aa, Mycobacterium
RAVILAPQGLDYVVAFLASLQAGRIGVP

SEQ ID NO: 851954 - protein, 20 aa, Mycobacterium
RAVKLFAEDQLPLATVGGVA

SEQ ID NO: 851955 - protein, 27 aa, Mycobacterium
RAVKTFFRRVPLAQRLLQEGLELVYAG

SEQ ID NO: 851956 - protein, 19 aa, Mycobacterium
RAVLAALTRFRATPTVCDD

SEQ ID NO: 851957 - protein, 17 aa, Mycobacterium
RAVLDAEEKWKPGLPAP

SEQ ID NO: 851958 - protein, 21 aa, Mycobacterium
RAVLDLRPPIGRSGRGIVASA

SEQ ID NO: 851959 - protein, 31 aa, Mycobacterium
RAVLDLTIYDKLPIAPWLPDRLWGGLTRLSR

SEQ ID NO: 851960 - protein, 18 aa, Mycobacterium
RAVLDVLAVIVVMPVGKG

SEQ ID NO: 851961 - protein, 20 aa, Mycobacterium
RAVLLSYAEFEALAATAAPA

SEQ ID NO: 851962 - protein, 19 aa, Mycobacterium
RAVLPVLQSWLAREGSGTL

SEQ ID NO: 851963 - protein, 17 aa, Mycobacterium
RAVLRRLIGDKAVKMVF

SEQ ID NO: 851964 - protein, 20 aa, Mycobacterium
RAVLSRAVLWHCEDRVIRHG

SEQ ID NO: 851965 - protein, 20 aa, Mycobacterium
RAVLVMREVLQWKASEVGEA

SEQ ID NO: 851966 - protein, 22 aa, Mycobacterium
RAVLYRRWPNKQELVLAAVAHE

SEQ ID NO: 851967 - protein, 38 aa, Mycobacterium
RAVNLASRFSYWIPFSIPVLAPALMRRGAARRLQAIDT

SEQ ID NO: 851968 - protein, 18 aa, Mycobacterium
RAVNPSIIYARGSALGPR

SEQ ID NO: 851969 - protein, 17 aa, Mycobacterium
RAVNVPARLVSVYAPGC

SEQ ID NO: 851970 - protein, 25 aa, Mycobacterium
RAVPDGVKIPWYGPPMSAASMGTAR

SEQ ID NO: 851971 - protein, 19 aa, Mycobacterium
RAVPQYGFRPNFVVRPPAA

SEQ ID NO: 851972 - protein, 31 aa, Mycobacterium
RAVPVLACGAYRLVELHRLADVAVPVRGVQT

SEQ ID NO: 851973 - protein, 22 aa, Mycobacterium
RAVPVLFVSEPIVLPGMVVPIE

SEQ ID NO: 851974 - protein, 21 aa, Mycobacterium
RAVRDLLADIGLSTLPLTSGS

SEQ ID NO: 851975 - protein, 25 aa, Mycobacterium
RAVRDRLDYRILAEILALELGDTAG

SEQ ID NO: 851976 - protein, 25 aa, Mycobacterium
RAVRENVWPMIADGRVKPIIGAELP

SEQ ID NO: 851977 - protein, 25 aa, Mycobacterium
RAVRERLDYRILAEILALELGDTAD

SEQ ID NO: 851978 - protein, 18 aa, Mycobacterium
RAVRLLTQRVASAAGTGA

SEQ ID NO: 851979 - protein, 28 aa, Mycobacterium
RAVRTIFKKLFDAGLIYRAERLVNWSPE

SEQ ID NO: 851980 - protein, 21 aa, Mycobacterium
RAVRTIFKRLFDAGLIYQAER

SEQ ID NO: 851981 - protein, 25 aa, Mycobacterium
RAVRTIFKRLFDAGLIYQAERLVNW

SEQ ID NO: 851982 - protein, 28 aa, Mycobacterium
RAVSAIGMSPWLVNPLSAPAGAGKTHSL

SEQ ID NO: 851983 - protein, 24 aa, Mycobacterium
RAVSGALLALLDRPNSGAGQHVRI

SEQ ID NO: 851984 - protein, 24 aa, Mycobacterium
RAVSSPRVLSDLFWMGRYGERAEN

SEQ ID NO: 851985 - protein, 19 aa, Mycobacterium
RAVTFTVWQAIIEAADELD

SEQ ID NO: 851986 - protein, 19 aa, Mycobacterium
RAVTLAALAPRPGERLWDV

SEQ ID NO: 851987 - protein, 19 aa, Mycobacterium
RAVTLAALGPRPGQRLWDV

SEQ ID NO: 851988 - protein, 20 aa, Mycobacterium
RAVTTTPWLTSRHSFSFGDH

SEQ ID NO: 851989 - protein, 19 aa, Mycobacterium
RAVVGHRRSLLPAGITAVA

SEQ ID NO: 851990 - protein, 20 aa, Mycobacterium
RAVVGQRRSLLPAGITAVSG

SEQ ID NO: 851991 - protein, 27 aa, Mycobacterium
RAVVKALKAVPLLKPVVPDPGVGLQLV

SEQ ID NO: 851992 - protein, 28 aa, Mycobacterium
RAVVVRVDPQWVWVKFSTDPGRLAAPWE

SEQ ID NO: 851993 - protein, 20 aa, Mycobacterium
RAVYPELLAMKAAGRPEHEL

SEQ ID NO: 851994 - protein, 20 aa, Mycobacterium
RAWDVANLDAAAKAIEDASK

SEQ ID NO: 851995 - protein, 20 aa, Mycobacterium
RAWEHGRFGAPYLRDSLLSA

SEQ ID NO: 851996 - protein, 18 aa, Mycobacterium
RAWELMGMRVHWQSSNDL

SEQ ID NO: 851997 - protein, 17 aa, Mycobacterium
RAWLMEDFDDRIGVAVE

SEQ ID NO: 851998 - protein, 19 aa, Mycobacterium
RAWLRDPAPLFRTNVEGLR

SEQ ID NO: 851999 - protein, 17 aa, Mycobacterium
RAWPDQEGLARDISRAG

SEQ ID NO: 852000 - protein, 17 aa, Mycobacterium
RAWPSRRSWEAMARVLA

SEQ ID NO: 852001 - protein, 20 aa, Mycobacterium
RAWRPMFTRGFSYGGKSTLK

SEQ ID NO: 852002 - protein, 17 aa, Mycobacterium
RAWRRYGVKPWRRETFK

SEQ ID NO: 852003 - protein, 19 aa, Mycobacterium
RAWTQVDVIELDPALRKLV

SEQ ID NO: 852004 - protein, 19 aa, Mycobacterium
RAWVALNVGLFDDARIWIE

SEQ ID NO: 852005 - protein, 21 aa, Mycobacterium
RAWWGNFLMQKANEANVALDE

SEQ ID NO: 852006 - protein, 18 aa, Mycobacterium
RAWWVLSAAGIDNVRILD

SEQ ID NO: 852007 - protein, 18 aa, Mycobacterium
RAYALQSFVGKPAVWRRK

SEQ ID NO: 852008 - protein, 21 aa, Mycobacterium
RAYATLLTRLTGEAPTVVLSD

SEQ ID NO: 852009 - protein, 28 aa, Mycobacterium
RAYERAYDRLFTALDWLEDRLADQRYLV

SEQ ID NO: 852010 - protein, 23 aa, Mycobacterium
RAYIPPVDGPLSTAALTVRVRDE

SEQ ID NO: 852011 - protein, 19 aa, Mycobacterium
RAYIRALASHRADDVPFAP

SEQ ID NO: 852012 - protein, 24 aa, Mycobacterium
RAYKPLNWMSPPCRLVEQADGETP

SEQ ID NO: 852013 - protein, 25 aa, Mycobacterium
RAYLDFGEPLPLRKRLEELRADESG

SEQ ID NO: 852014 - protein, 25 aa, Mycobacterium
RAYLDFGEPLPLRKRLEELRAEESG

SEQ ID NO: 852015 - protein, 26 aa, Mycobacterium
RAYLDFGEPLPLRKRLEELRALQKTS

SEQ ID NO: 852016 - protein, 25 aa, Mycobacterium
RAYLDFGEPLPLRKRLEELRTDESG

SEQ ID NO: 852017 - protein, 19 aa, Mycobacterium
RAYLYPIAAGRPKATKLPR

SEQ ID NO: 852018 - protein, 17 aa, Mycobacterium
RAYMALLMEGWSHPELR

SEQ ID NO: 852019 - protein, 18 aa, Mycobacterium
RAYMEQAVWAPYGNEQLA

SEQ ID NO: 852020 - protein, 17 aa, Mycobacterium
RAYMFADGHLNTDVVGR

SEQ ID NO: 852021 - protein, 25 aa, Mycobacterium
RAYNPVLRFLLERPVYAKISRDNLE

SEQ ID NO: 852022 - protein, 18 aa, Mycobacterium
RAYRALADPIAVCAALQL

SEQ ID NO: 852023 - protein, 31 aa, Mycobacterium
RAYRDQLRAHCPQVRFLHLAGSPALIGVRLA

SEQ ID NO: 852024 - protein, 20 aa, Mycobacterium
RAYREIFAGLYTDPDAVLNT

SEQ ID NO: 852025 - protein, 20 aa, Mycobacterium
RAYREIFAGLYTDPDTVLNT

SEQ ID NO: 852026 - protein, 24 aa, Mycobacterium
RAYRGGMVPGFPNLFISSAPNYSP

SEQ ID NO: 852027 - protein, 17 aa, Mycobacterium
RAYRLAVPASAQWFDLD

SEQ ID NO: 852028 - protein, 19 aa, Mycobacterium
RAYRPLRRCIQVVYQNPYS

SEQ ID NO: 852029 - protein, 26 aa, Mycobacterium
RAYRVGPGLDLLAFSVLRQLDVRDRA

SEQ ID NO: 852030 - protein, 29 aa, Mycobacterium
RAYTAYAPMAGISWLADFVERSPFAQAFR

SEQ ID NO: 852031 - protein, 20 aa, Mycobacterium
RAYTRAVMQRWLAGEDVVTE

SEQ ID NO: 852032 - protein, 40 aa, Mycobacterium
RAYTRYQPLGVVLAVMPWNFPLWQAVRFAAPALMAGNVGI

SEQ ID NO: 852033 - protein, 17 aa, Mycobacterium
RAYTSTYVEGYRLLRGW

SEQ ID NO: 852034 - protein, 22 aa, Mycobacterium
RAYVLDSWLRPVPSGAAGELYL

SEQ ID NO: 852035 - protein, 17 aa, Mycobacterium
RAYYWPKLVELYADFDK

SEQ ID NO: 852036 - protein, 21 aa, Mycobacterium
RCADCRYLTAKWVGRCPECSS

SEQ ID NO: 852037 - protein, 28 aa, Mycobacterium
RCADDIAALWLLKQIAVTIERFVRETRG

SEQ ID NO: 852038 - protein, 34 aa, Mycobacterium
RCADFVEWFLQNVPIEPIWLCPLRLRDSADGGAS

SEQ ID NO: 852039 - protein, 31 aa, Mycobacterium
RCAGRRPTWSPLPVQYIDYALWQHDYLGEVS

SEQ ID NO: 852040 - protein, 19 aa, Mycobacterium
RCALAWSTETATLAREHNN

SEQ ID NO: 852041 - protein, 22 aa, Mycobacterium
RCAPGMPVLGISAGLHAVVALP

SEQ ID NO: 852042 - protein, 17 aa, Mycobacterium
RCARTLIIIGGYNGFSY

SEQ ID NO: 852043 - protein, 23 aa, Mycobacterium
RCATLRFDLIEDLGYNKQLASSV

SEQ ID NO: 852044 - protein, 18 aa, Mycobacterium
RCDFGPVLSIARAIREQV

SEQ ID NO: 852045 - protein, 17 aa, Mycobacterium
RCDLLASGGLDDRKSSG

SEQ ID NO: 852046 - protein, 24 aa, Mycobacterium
RCDPLFVMAAPGQPLPPLPADVLR

SEQ ID NO: 852047 - protein, 17 aa, Mycobacterium
RCDRGFQVLNPAYPELR

SEQ ID NO: 852048 - protein, 18 aa, Mycobacterium
RCDSGLAAAYRRAHESYL

SEQ ID NO: 852049 - protein, 18 aa, Mycobacterium
RCEEREGFWSGSLRADCA

SEQ ID NO: 852050 - protein, 25 aa, Mycobacterium
RCEIARRVFATCRRLGIGTVAVYTD

SEQ ID NO: 852051 - protein, 29 aa, Mycobacterium
RCENHYNVGWAWALDAPFQWMKQVASHFG

SEQ ID NO: 852052 - protein, 23 aa, Mycobacterium
RCENHYNVGWAWALDSPFQWMKQ

SEQ ID NO: 852053 - protein, 17 aa, Mycobacterium
RCEPAELAAIREALRIV

SEQ ID NO: 852054 - protein, 19 aa, Mycobacterium
RCEPWYTPERIECTMMTVQ

SEQ ID NO: 852055 - protein, 22 aa, Mycobacterium
RCETDPERWPTFVPTNGGSVNA

SEQ ID NO: 852056 - protein, 18 aa, Mycobacterium
RCEVAASSKLLRPAGDRV

SEQ ID NO: 852057 - protein, 25 aa, Mycobacterium
RCEYALLRVFDAKLGWAPAPPRDDE

SEQ ID NO: 852058 - protein, 30 aa, Mycobacterium
RCGDVDRVTLFRAWYSRRNFGQLAGTAQIS

SEQ ID NO: 852059 - protein, 23 aa, Mycobacterium
RCGEALSAFLLDATMTGLATCTV

SEQ ID NO: 852060 - protein, 26 aa, Mycobacterium
RCGGKPLAGPGWYYPPTVITDITKDM

SEQ ID NO: 852061 - protein, 34 aa, Mycobacterium
RCGGNPAWDLPLVFGPIALAYNLPGNPALVVSSD

SEQ ID NO: 852062 - protein, 30 aa, Mycobacterium
RCGGSPAWNLPVVFGPIAVTYNISGVSSLN

SEQ ID NO: 852063 - protein, 22 aa, Mycobacterium
RCGHLTLRRFRPPTSPVNQHRR

SEQ ID NO: 852064 - protein, 26 aa, Mycobacterium
RCGLPLATYFSGPKLRWLLDNDRDLR

SEQ ID NO: 852065 - protein, 27 aa, Mycobacterium
RCGSPAWNLPVVFGPIAITYNVRGVSS

SEQ ID NO: 852066 - protein, 17 aa, Mycobacterium
RCHVMVAPVLPGLTDSD

SEQ ID NO: 852067 - protein, 19 aa, Mycobacterium
RCIAPTWPLGAHPEPLRRG

SEQ ID NO: 852068 - protein, 17 aa, Mycobacterium
RCIGCGFCIEACPTRAL

SEQ ID NO: 852069 - protein, 19 aa, Mycobacterium
RCIPSPTGYLYTQVTDWTS

SEQ ID NO: 852070 - protein, 26 aa, Mycobacterium
RCISGGLLLCWPCDLIVAADDAQFSD

SEQ ID NO: 852071 - protein, 32 aa, Mycobacterium
RCITAETRLYLPMPFFWVGGFGSGILSTLLAG

SEQ ID NO: 852072 - protein, 17 aa, Mycobacterium
RCLKRQLARIVYRHLHT

SEQ ID NO: 852073 - protein, 26 aa, Mycobacterium
RCLKRRLSDAVYRQLLRDATTEAGAG

SEQ ID NO: 852074 - protein, 18 aa, Mycobacterium
RCLRAFEQPPAALVLAGG

SEQ ID NO: 852075 - protein, 26 aa, Mycobacterium
RCLRMTVYIACAPSFHELSAVADGAS

SEQ ID NO: 852076 - protein, 22 aa, Mycobacterium
RCNIIVPAMPIWMGVRSSVMQR

SEQ ID NO: 852077 - protein, 25 aa, Mycobacterium
RCNLRCGYCMPAEGLNWLPGEQLLG

SEQ ID NO: 852078 - protein, 25 aa, Mycobacterium
RCNLRCNYCMPAEGLDWLPGQQLLR

SEQ ID NO: 852079 - protein, 26 aa, Mycobacterium
RCNLRCSYCMPAEGLDWLPGEQLLRP

SEQ ID NO: 852080 - protein, 25 aa, Mycobacterium
RCNLRCTYCMPAEGLDWLPGEQLLT

SEQ ID NO: 852081 - protein, 25 aa, Mycobacterium
RCNLRCTYCMPAEGLDWLRSETLLT

SEQ ID NO: 852082 - protein, 25 aa, Mycobacterium
RCNLRCTYCMPAEGLNWLPGDALLS

SEQ ID NO: 852083 - protein, 19 aa, Mycobacterium
RCPAWGATTLWIGSGERPK

SEQ ID NO: 852084 - protein, 19 aa, Mycobacterium
RCPPTTFQRPRVVVFAGDH

SEQ ID NO: 852085 - protein, 19 aa, Mycobacterium
RCPRCVAVADYVFIEPAEP

SEQ ID NO: 852086 - protein, 17 aa, Mycobacterium
RCPVLYAPAMHTEMWQH

SEQ ID NO: 852087 - protein, 18 aa, Mycobacterium
RCPWHGFDFDPFTGEAAG

SEQ ID NO: 852088 - protein, 28 aa, Mycobacterium
RCPWRAGPFGMPILDDAVAWFVGRTVSR

SEQ ID NO: 852089 - protein, 19 aa, Mycobacterium
RCPYFRAEEPLPWGCNKRT

SEQ ID NO: 852090 - protein, 20 aa, Mycobacterium
RCQGHTLCAMIAPDSFQLSD

SEQ ID NO: 852091 - protein, 22 aa, Mycobacterium
RCQGHTLCAMIAPDSFQLSDID

SEQ ID NO: 852092 - protein, 24 aa, Mycobacterium
RCQGHTLCAMIAPDSFRLSDIDGT

SEQ ID NO: 852093 - protein, 22 aa, Mycobacterium
RCQGHTLCAMIAPESFQLSDID

SEQ ID NO: 852094 - protein, 21 aa, Mycobacterium
RCQGHTLCSMIAPEAFRLDDV

SEQ ID NO: 852095 - protein, 25 aa, Mycobacterium
RCQGYAQCCFLAPRAFKLAGEEALV

SEQ ID NO: 852096 - protein, 19 aa, Mycobacterium
RCQQVWCPVCALAAVVNGE

SEQ ID NO: 852097 - protein, 28 aa, Mycobacterium
RCQSCGGPCWHWKGSVWGYTCTDCIDRY

SEQ ID NO: 852098 - protein, 17 aa, Mycobacterium
RCRALELGLIGYAANQT

SEQ ID NO: 852099 - protein, 18 aa, Mycobacterium
RCRRAIPRHLRWGPMRCR

SEQ ID NO: 852100 - protein, 23 aa, Mycobacterium
RCRSSFDYRYRTYYALVRGCLVY

SEQ ID NO: 852101 - protein, 21 aa, Mycobacterium
RCRVRPIHRPPRTPADRHPHC

SEQ ID NO: 852102 - protein, 31 aa, Mycobacterium
RCSNLLQPLRSVLLAIMFEWGIALQGWESQQ

SEQ ID NO: 852103 - protein, 25 aa, Mycobacterium
RCTGHGRCYTLAPDVFDADEVGHCV

SEQ ID NO: 852104 - protein, 19 aa, Mycobacterium
RCTGHGRCYTLAPGVFDAD

SEQ ID NO: 852105 - protein, 27 aa, Mycobacterium
RCTLVPYAKRTPKLARTRSWPTLEVNG

SEQ ID NO: 852106 - protein, 18 aa, Mycobacterium
RCTPRDPIYPLVDFLTRS

SEQ ID NO: 852107 - protein, 17 aa, Mycobacterium
RCTVADPTLFSHRRGAP

SEQ ID NO: 852108 - protein, 17 aa, Mycobacterium
RCVELLAPALTREGATL

SEQ ID NO: 852109 - protein, 27 aa, Mycobacterium
RCVPAPTYPWQRQRFWLDERNAAEVGI

SEQ ID NO: 852110 - protein, 17 aa, Mycobacterium
RCVRQLRDAMREHVEDL

SEQ ID NO: 852111 - protein, 19 aa, Mycobacterium
RCVSAPLLAGAFAVAKEWE

SEQ ID NO: 852112 - protein, 17 aa, Mycobacterium
RCVYWAGGNPFHHHQNL

SEQ ID NO: 852113 - protein, 22 aa, Mycobacterium
RCWSTWNTLCAFLYTDELIPSN

SEQ ID NO: 852114 - protein, 19 aa, Mycobacterium
RCWSVISGLVGGPWQGAAS

SEQ ID NO: 852115 - protein, 29 aa, Mycobacterium
RCYAVLERLLPVKCFYLPTAVRGFEREGI

SEQ ID NO: 852116 - protein, 26 aa, Mycobacterium
RDAALDKAIRLFWERGFEATSTRDLS

SEQ ID NO: 852117 - protein, 22 aa, Mycobacterium
RDAALLLAFDRATTGFGWSRPG

SEQ ID NO: 852118 - protein, 29 aa, Mycobacterium
RDAALRQVPLTLAYVLPGAAVQSWIQVPL

SEQ ID NO: 852119 - protein, 20 aa, Mycobacterium
RDAARLTAAPLLRDERLTRS

SEQ ID NO: 852120 - protein, 26 aa, Mycobacterium
RDAATALGLVARLPWHTTRTPVTAAA

SEQ ID NO: 852121 - protein, 30 aa, Mycobacterium
RDAAWIAERIGLRVTPKTRVLIAPFTDVIG

SEQ ID NO: 852122 - protein, 19 aa, Mycobacterium
RDAAWPAICAQLRETVGVA

SEQ ID NO: 852123 - protein, 27 aa, Mycobacterium
RDACLEYALAHDERFGIWGGLSERERR

SEQ ID NO: 852124 - protein, 24 aa, Mycobacterium
RDADGWIYLAGRTADWMRVDGENL

SEQ ID NO: 852125 - protein, 25 aa, Mycobacterium
RDADGWIYLAGRTADWMRVDGENLT

SEQ ID NO: 852126 - protein, 24 aa, Mycobacterium
RDADGWIYLAGRTADWMRVDGENM

SEQ ID NO: 852127 - protein, 24 aa, Mycobacterium
RDADGWIYLAGRTSDWMRVDGENL

SEQ ID NO: 852128 - protein, 25 aa, Mycobacterium
RDADPIRLGWTLFTLTICQGVLGND

SEQ ID NO: 852129 - protein, 24 aa, Mycobacterium
RDAELLAMAQLIGAAGTLVARRRG

SEQ ID NO: 852130 - protein, 21 aa, Mycobacterium
RDAEYLFDTFIDLMNEGKGES

SEQ ID NO: 852131 - protein, 18 aa, Mycobacterium
RDAFAMFYDHTCTRVYGL

SEQ ID NO: 852132 - protein, 17 aa, Mycobacterium
RDAFLQKRPPDWSRFPR

SEQ ID NO: 852133 - protein, 29 aa, Mycobacterium
RDAFNLAINALLAIGFEWGIALRHLEARD

SEQ ID NO: 852134 - protein, 25 aa, Mycobacterium
RDAGAMAYLVKPFSKTDLVPAIEVA

SEQ ID NO: 852135 - protein, 30 aa, Mycobacterium
RDAGAMAYLVKPFTISDLIPAIELAVSRFG

SEQ ID NO: 852136 - protein, 30 aa, Mycobacterium; identical to SEQ ID NO: 117018

SEQ ID NO: 852137 - protein, 30 aa, Mycobacterium
RDAGAMAYLVKPFTVSDLVPAIELAVSRFS

SEQ ID NO: 852138 - protein, 25 aa, Mycobacterium
RDAGCVLQQGFLYSHPLEVTDLGDY

SEQ ID NO: 852139 - protein, 34 aa, Mycobacterium
RDAGMTDTLYRMPWSTMFPLGISSAVIGIAEGAL

SEQ ID NO: 852140 - protein, 25 aa, Mycobacterium
RDAIADTMFPILLTAVSEVACDAGE

SEQ ID NO: 852141 - protein, 30 aa, Mycobacterium
RDALAEGILAAVKRLYLLGKNDRPTGTFTF

SEQ ID NO: 852142 - protein, 32 aa, Mycobacterium
RDALDRTLIDLATYFRDALVLSFGAAGQGRVA

SEQ ID NO: 852143 - protein, 23 aa, Mycobacterium
RDALIRKLWDRHVIMLPSGADSV

SEQ ID NO: 852144 - protein, 18 aa, Mycobacterium
RDALLWNDTRSASSADDL

SEQ ID NO: 852145 - protein, 23 aa, Mycobacterium
RDALPLLDQLYGVARRYTRNQAD

SEQ ID NO: 852146 - protein, 18 aa, Mycobacterium
RDALRFWIAERPEIAEQL

SEQ ID NO: 852147 - protein, 22 aa, Mycobacterium
RDALRLRHYVLTAAADAAAGSN

SEQ ID NO: 852148 - protein, 19 aa, Mycobacterium
RDALRRIDIALQQAGASLT

SEQ ID NO: 852149 - protein, 24 aa, Mycobacterium
RDALRRIEIALGRAGAALTDVVRT

SEQ ID NO: 852150 - protein, 23 aa, Mycobacterium
RDAMPTFRQVFLAGASDMTLERR

SEQ ID NO: 852151 - protein, 24 aa, Mycobacterium
RDAMPTFRQVFLAGASDMTLERRC

SEQ ID NO: 852152 - protein, 31 aa, Mycobacterium
RDAPDEKWALLPLTPFIPKAAARRLADVALE

SEQ ID NO: 852153 - protein, 18 aa, Mycobacterium
RDAPLPDGFFRTVNPANI

SEQ ID NO: 852154 - protein, 29 aa, Mycobacterium
RDAPPAIDLPRDFPRPLRGSFRGARVPIV

SEQ ID NO: 852155 - protein, 17 aa, Mycobacterium
RDAPQGEFLLFDDRVHT

SEQ ID NO: 852156 - protein, 17 aa, Mycobacterium
RDAQRILALADLIAEME

SEQ ID NO: 852157 - protein, 20 aa, Mycobacterium
RDARFQIPPGINLLAQGVTS

SEQ ID NO: 852158 - protein, 22 aa, Mycobacterium
RDARLGTVGKLLPGLEGKVADD

SEQ ID NO: 852159 - protein, 43 aa, Mycobacterium
RDARQLIITELIKTTPPGSALYYGYDIIADLINLETPAAELKY

SEQ ID NO: 852160 - protein, 25 aa, Mycobacterium
RDASLLQWIVYEEEYFRAGAPGRAS

SEQ ID NO: 852161 - protein, 33 aa, Mycobacterium
RDASVRPIVRYLFDRPMLPRINAIRADLGVAPV

SEQ ID NO: 852162 - protein, 25 aa, Mycobacterium
RDATLLQWVVFEEEYFRAGAPGRAS

SEQ ID NO: 852163 - protein, 17 aa, Mycobacterium
RDATTGGVARRGGRYRV

SEQ ID NO: 852164 - protein, 18 aa, Mycobacterium
RDATYLYRDGSDFVFMDS

SEQ ID NO: 852165 - protein, 20 aa, Mycobacterium
RDATYLYRDGSDFVFMDSED

SEQ ID NO: 852166 - protein, 24 aa, Mycobacterium
RDAVIARRILAADMALLADLDAQI

SEQ ID NO: 852167 - protein, 27 aa, Mycobacterium
RDAVRSLPFFGNLAYRFMHSVKAGIKD

SEQ ID NO: 852168 - protein, 26 aa, Mycobacterium
RDAVSKYWVIDEIRPARIHANLPPEV

SEQ ID NO: 852169 - protein, 25 aa, Mycobacterium
RDAVSKYWVIDEIRPARIHANVPES

SEQ ID NO: 852170 - protein, 25 aa, Mycobacterium
RDAVTSMIPVGRWGRPEELAHAVAF

SEQ ID NO: 852171 - protein, 23 aa, Mycobacterium
RDAVVARDGLVLGELPAGSLVGT

SEQ ID NO: 852172 - protein, 17 aa, Mycobacterium
RDAWLRCMHTAVASIDA

SEQ ID NO: 852173 - protein, 18 aa, Mycobacterium
RDAWLRCMHTAVASIDSA

SEQ ID NO: 852174 - protein, 24 aa, Mycobacterium
RDAWWDERNLLPLLKEVDIPVYLG

SEQ ID NO: 852175 - protein, 23 aa, Mycobacterium
RDAYQRIFGRLGLDYVIVAATSG

SEQ ID NO: 852176 - protein, 27 aa, Mycobacterium
RDCDTLLIVGTNFPYSQFLPDYGQARA

SEQ ID NO: 852177 - protein, 33 aa, Mycobacterium
RDCEAEVDWILRNSFPVCPIAELSRRLRAAGYP

SEQ ID NO: 852178 - protein, 18 aa, Mycobacterium
RDCFSRIAPGLPSGVIRI

SEQ ID NO: 852179 - protein, 18 aa, Mycobacterium
RDCWYYQPEVQLLANRGY

SEQ ID NO: 852180 - protein, 22 aa, Mycobacterium
RDDALLAFPAMQAMPTPYVEAS

SEQ ID NO: 852181 - protein, 18 aa, Mycobacterium
RDDAPPPGPAWDLQQGWL

SEQ ID NO: 852182 - protein, 18 aa, Mycobacterium
RDDAWRFATFLAAQPAFT

SEQ ID NO: 852183 - protein, 24 aa, Mycobacterium
RDDEARGVIWPTIPPDILGQAGTA

SEQ ID NO: 852184 - protein, 24 aa, Mycobacterium
RDDEARGVIWPTIPPDILGQSGTA

SEQ ID NO: 852185 - protein, 24 aa, Mycobacterium
RDDELSRWLGVSRTPIREALARLE

SEQ ID NO: 852186 - protein, 22 aa, Mycobacterium
RDDFPLVFQQFQATPFRQVTEA

SEQ ID NO: 852187 - protein, 23 aa, Mycobacterium
RDDFQIVLVDTPGLHRPRTLLGQ

SEQ ID NO: 852188 - protein, 30 aa, Mycobacterium
RDDGHYVVGPLLWQAGLLAPVEGGLQYLAE

SEQ ID NO: 852189 - protein, 24 aa, Mycobacterium
RDDGRPGWRPLPQLLAGSDIVSLH

SEQ ID NO: 852190 - protein, 19 aa, Mycobacterium
RDDGRWRIVRADRARAGFS

SEQ ID NO: 852191 - protein, 23 aa, Mycobacterium
RDDGYRFMVLGRALERVDMTVRL

SEQ ID NO: 852192 - protein, 21 aa, Mycobacterium
RDDHWLVSGAKYYATGSLYAD

SEQ ID NO: 852193 - protein, 24 aa, Mycobacterium
RDDIDPCRVALWGTSLSGGHVLAV

SEQ ID NO: 852194 - protein, 18 aa, Mycobacterium
RDDLCSEILPLLASARGV

SEQ ID NO: 852195 - protein, 22 aa, Mycobacterium
RDDLGWQPRYDYRRILDCLAAE

SEQ ID NO: 852196 - protein, 25 aa, Mycobacterium
RDDLILAALEYWVARHRYAGIAVPP

SEQ ID NO: 852197 - protein, 18 aa, Mycobacterium
RDDLLLVAGMRVSQREKL

SEQ ID NO: 852198 - protein, 24 aa, Mycobacterium
RDDLNSFLGLHYPSTDIPAQARAL

SEQ ID NO: 852199 - protein, 22 aa, Mycobacterium
RDDLPMGRLTVIATGGTISTGT

SEQ ID NO: 852200 - protein, 25 aa, Mycobacterium
RDDLQTVIAMLKQADLDVALQFVNY

SEQ ID NO: 852201 - protein, 25 aa, Mycobacterium
RDDLRIGPHRVWWLSGLAADPAVTA

SEQ ID NO: 852202 - protein, 21 aa, Mycobacterium
RDDLRWHDLRHSGAVLAAATG

SEQ ID NO: 852203 - protein, 18 aa, Mycobacterium
RDDLSYHAELDWWTSPFV

SEQ ID NO: 852204 - protein, 26 aa, Mycobacterium
RDDLVAAPLLGIAYGYCGAPDQWWQQ

SEQ ID NO: 852205 - protein, 22 aa, Mycobacterium
RDDLYLAALKQDPIRQAPIVIV

SEQ ID NO: 852206 - protein, 29 aa, Mycobacterium
RDDPALLDRYLKALLDGILPRHAGCGTPA

SEQ ID NO: 852207 - protein, 29 aa, Mycobacterium
RDDPFGDVRWFDIGPCYIFHVANAYETTS

SEQ ID NO: 852208 - protein, 28 aa, Mycobacterium
RDDPFGEIRWFDIDPCYIFHVVNAYEHG

SEQ ID NO: 852209 - protein, 25 aa, Mycobacterium
RDDPLLIHVVVHALNQWLDEVWGFN

SEQ ID NO: 852210 - protein, 28 aa, Mycobacterium
RDDPPYQGAIYLTFALPAGARADAYFRD

SEQ ID NO: 852211 - protein, 24 aa, Mycobacterium
RDDPQRVAQLHRTAALWLKEHDRL

SEQ ID NO: 852212 - protein, 23 aa, Mycobacterium
RDDRDGWQALRDSAGLTPVARAR

SEQ ID NO: 852213 - protein, 26 aa, Mycobacterium
RDDRGVDLIAPSALELVVHRRPGVVS

SEQ ID NO: 852214 - protein, 19 aa, Mycobacterium
RDDRLRLIFTCCHPALSQE

SEQ ID NO: 852215 - protein, 31 aa, Mycobacterium
RDDSPYPVRTPLPVVLPEPMLEQLQQAQAQA

SEQ ID NO: 852216 - protein, 29 aa, Mycobacterium
RDDTAARLAGFPPPQLLLNYLGAAHTDGG

SEQ ID NO: 852217 - protein, 29 aa, Mycobacterium
RDDTRSPWPTWPIMLRTKLSPAHAEGGRR

SEQ ID NO: 852218 - protein, 23 aa, Mycobacterium
RDDWAVHIALWQRPSDGQREITD

SEQ ID NO: 852219 - protein, 20 aa, Mycobacterium
RDDWAVHVALWQRTTNGRPQ

SEQ ID NO: 852220 - protein, 18 aa, Mycobacterium
RDDWPAALRAKGFDPTRP

SEQ ID NO: 852221 - protein, 23 aa, Mycobacterium
RDDYALEVFALLGEIYLVRSAYD

SEQ ID NO: 852222 - protein, 24 aa, Mycobacterium
RDDYTRDLLAARPVLERAGPGPVT

SEQ ID NO: 852223 - protein, 24 aa, Mycobacterium
RDEAGFLYFAGRRGDWIRVDGENT

SEQ ID NO: 852224 - protein, 17 aa, Mycobacterium
RDEANPKGVWRRTTLES

SEQ ID NO: 852225 - protein, 23 aa, Mycobacterium
RDEAPIYYNEKYDFWALSRHSDV

SEQ ID NO: 852226 - protein, 17 aa, Mycobacterium
RDEAPIYYNERYNFWAL

SEQ ID NO: 852227 - protein, 28 aa, Mycobacterium
RDEAPLYYNDKFGFWGLSRFADVEAALR

SEQ ID NO: 852228 - protein, 26 aa, Mycobacterium
RDEAVHGYYIGYKFQKGLALADDATR

SEQ ID NO: 852229 - protein, 26 aa, Mycobacterium
RDEAVHGYYIGYKFQRGLALVDDARK

SEQ ID NO: 852230 - protein, 25 aa, Mycobacterium
RDEAVHGYYIGYKFQRGLALVDEVK

SEQ ID NO: 852231 - protein, 25 aa, Mycobacterium
RDEAVHGYYIGYKYQRGLALVDEAK

SEQ ID NO: 852232 - protein, 18 aa, Mycobacterium
RDEDGRWGLGPAITELAA

SEQ ID NO: 852233 - protein, 29 aa, Mycobacterium
RDEDHLQGHWLLARLGKRVLRPGGVELTR

SEQ ID NO: 852234 - protein, 18 aa, Mycobacterium
RDEDIFTDPFTFDIARDP

SEQ ID NO: 852235 - protein, 19 aa, Mycobacterium
RDEDIVYARRLAVAGVPTE

SEQ ID NO: 852236 - protein, 24 aa, Mycobacterium
RDEDPLMPDPLHAPVLLGIDGSPA

SEQ ID NO: 852237 - protein, 26 aa, Mycobacterium
RDEGNRALLASWWTETWNAGGGDFVK

SEQ ID NO: 852238 - protein, 25 aa, Mycobacterium
RDEGQWQVRWATTGLHPKLGEHQTF

SEQ ID NO: 852239 - protein, 22 aa, Mycobacterium
RDEGWLAEHMLILKLTSPEGAA

SEQ ID NO: 852240 - protein, 20 aa, Mycobacterium
RDEIFGPVLSVLTVRDEAEA

SEQ ID NO: 852241 - protein, 25 aa, Mycobacterium
RDEIWAKGLELYPGWRKYEVRAGKR

SEQ ID NO: 852242 - protein, 20 aa, Mycobacterium
RDELALLPDLPGRRALQTLV

SEQ ID NO: 852243 - protein, 19 aa, Mycobacterium
RDELFVTLAQGLLAEISSG

SEQ ID NO: 852244 - protein, 27 aa, Mycobacterium
RDELGDWRVILHSPYGLRVNGPLALAV

SEQ ID NO: 852245 - protein, 25 aa, Mycobacterium
RDELGLPEMGLVGRQLWDQSGLTPN

SEQ ID NO: 852246 - protein, 27 aa, Mycobacterium
RDELGLPEMGLVGRQLWQQSGLTPDDI

SEQ ID NO: 852247 - protein, 18 aa, Mycobacterium
RDELGSYVLTVGGIEPRK

SEQ ID NO: 852248 - protein, 24 aa, Mycobacterium
RDELLARLWECGVIMLGCGTDSVR

SEQ ID NO: 852249 - protein, 17 aa, Mycobacterium
RDELLDNVMLYWVTASA

SEQ ID NO: 852250 - protein, 21 aa, Mycobacterium
RDELRGFLKRWLGGAVLAQGR

SEQ ID NO: 852251 - protein, 29 aa, Mycobacterium
RDELRSLLRFILDLLGDYGLTDFYLELST

SEQ ID NO: 852252 - protein, 28 aa, Mycobacterium
RDELRSLLRFVLDLLSDYGLTDFYLELS

SEQ ID NO: 852253 - protein, 28 aa, Mycobacterium
RDELTRLLEFVLSLLKDYGLDDYYLELS

SEQ ID NO: 852254 - protein, 18 aa, Mycobacterium
RDEMMGRTKFWEEPLNVI

SEQ ID NO: 852255 - protein, 23 aa, Mycobacterium
RDENKVIWLSQTTLSVDETMETV

SEQ ID NO: 852256 - protein, 27 aa, Mycobacterium
RDEPPLAPFVIVLFGATGDLAKRKLLP

SEQ ID NO: 852257 - protein, 21 aa, Mycobacterium
RDEPRWPRYAPAAVERGVLSS

SEQ ID NO: 852258 - protein, 20 aa, Mycobacterium
RDEQGLAQLTWFLGGCTASL

SEQ ID NO: 852259 - protein, 19 aa, Mycobacterium
RDEQQSQFRHRCVGFVFQF

SEQ ID NO: 852260 - protein, 22 aa, Mycobacterium
RDERSVIFAAELRELAARHAGR

SEQ ID NO: 852261 - protein, 24 aa, Mycobacterium
RDESAYVPALQNLGYRLTVREPGW

SEQ ID NO: 852262 - protein, 25 aa, Mycobacterium
RDESIRLGQFLKLAALIDTGADAKA

SEQ ID NO: 852263 - protein, 31 aa, Mycobacterium
RDESQALVLRFFFAPRPSIRSRRRALQGVRT

SEQ ID NO: 852264 - protein, 27 aa, Mycobacterium
RDESTRPLVICDLGMPRDVDPAVAGLP

SEQ ID NO: 852265 - protein, 35 aa, Mycobacterium
RDESWKIRNLFNIPFNFMLAAGFEWGIALQHLELR

SEQ ID NO: 852266 - protein, 28 aa, Mycobacterium
RDETAPLLATRWATAFLTGARPAELLGL

SEQ ID NO: 852267 - protein, 27 aa, Mycobacterium
RDETTRPLVICDLGMPRDVDPAVAGLP

SEQ ID NO: 852268 - protein, 26 aa, Mycobacterium
RDEVALLMPGVWIERPRFSDEALVRG

SEQ ID NO: 852269 - protein, 22 aa, Mycobacterium
RDEVLRSLKLLQDSATLVFGDP

SEQ ID NO: 852270 - protein, 22 aa, Mycobacterium
RDEWKPLYVFGTQTVPQIDLRV

SEQ ID NO: 852271 - protein, 19 aa, Mycobacterium
RDEWLHRRFGDLVRFVFAL

SEQ ID NO: 852272 - protein, 20 aa, Mycobacterium
RDEWLHRRFGDLVRLIFALV

SEQ ID NO: 852273 - protein, 21 aa, Mycobacterium
RDEWQALYEFSTLTRPQVDLR

SEQ ID NO: 852274 - protein, 26 aa, Mycobacterium
RDEWWQRAVEAFPPYAEYQTKTARQI

SEQ ID NO: 852275 - protein, 22 aa, Mycobacterium
RDFAADVLGWAPSIIGAVFNNA

SEQ ID NO: 852276 - protein, 18 aa, Mycobacterium
RDFAGLGDRYRAVAERNH

SEQ ID NO: 852277 - protein, 35 aa, Mycobacterium; identical to SEQ ID NO: 122025

SEQ ID NO: 852278 - protein, 27 aa, Mycobacterium
RDFASRWAELIFTGDPGLAIAREHYAD

SEQ ID NO: 852279 - protein, 29 aa, Mycobacterium
RDFAVGHALYLGFLFLDEDDDAFMVALTC

SEQ ID NO: 852280 - protein, 23 aa, Mycobacterium
RDFDGWARWVDVGGALVIHDVFP

SEQ ID NO: 852281 - protein, 25 aa, Mycobacterium
RDFDGWARWVQKGGALVIHDVFPNP

SEQ ID NO: 852282 - protein, 24 aa, Mycobacterium
RDFDPDVVILDLGLPGIDGLEVCR

SEQ ID NO: 852283 - protein, 32 aa, Mycobacterium
RDFEGFLPAVRPTFLVLQSAMCLGLARAAIEQ

SEQ ID NO: 852284 - protein, 21 aa, Mycobacterium
RDFELIAFGGPPFLRDEQKEI

SEQ ID NO: 852285 - protein, 29 aa, Mycobacterium
RDFFDFGHVSALYMDLIKAGKLSEGMQKR

SEQ ID NO: 852286 - protein, 17 aa, Mycobacterium
RDFFGAHTYGRIDDDPD

SEQ ID NO: 852287 - protein, 18 aa, Mycobacterium
RDFFGAHTYGRIDDDPDK

SEQ ID NO: 852288 - protein, 30 aa, Mycobacterium
RDFGLYSEAFLSVRPLLDAVLSEEPVVLLI

SEQ ID NO: 852289 - protein, 17 aa, Mycobacterium
RDFLELETPILQTLAGG

SEQ ID NO: 852290 - protein, 22 aa, Mycobacterium
RDFNALVYVLSGRGTVGPVDHP

SEQ ID NO: 852291 - protein, 29 aa, Mycobacterium
RDFPGLFHGFLTIPSFPPAVSARDLICAD

SEQ ID NO: 852292 - protein, 25 aa, Mycobacterium
RDFPRLIEAACRRLGTVRVSACPQI

SEQ ID NO: 852293 - protein, 17 aa, Mycobacterium
RDFPSATTILLEQNYRS

SEQ ID NO: 852294 - protein, 29 aa, Mycobacterium
RDFQVISIPTMILFKDGQPVKRIVGAKGK

SEQ ID NO: 852295 - protein, 21 aa, Mycobacterium
RDFRKLLDRYDYGSASLYGHF

SEQ ID NO: 852296 - protein, 34 aa, Mycobacterium
RDFRPAFAQAFHTTLYQFVLDQRIKRAKALLAST

SEQ ID NO: 852297 - protein, 31 aa, Mycobacterium
RDFRRHAGMDLLPRLLFRAGELDTSVVRSIL

SEQ ID NO: 852298 - protein, 21 aa, Mycobacterium
RDFRSWAHADLELEPGRTVFV

SEQ ID NO: 852299 - protein, 21 aa, Mycobacterium
RDFRSWERVNLELEPGRTVFV

SEQ ID NO: 852300 - protein, 17 aa, Mycobacterium
RDFWDQWRAVQCPALLL

SEQ ID NO: 852301 - protein, 22 aa, Mycobacterium
RDFYVDLDKIKLAHPLIMSVQP

SEQ ID NO: 852302 - protein, 24 aa, Mycobacterium
RDGAEWIHLVDLDAAFGRGSNRAL

SEQ ID NO: 852303 - protein, 24 aa, Mycobacterium
RDGAEWIHLVDLDAAFGRGSNREL

SEQ ID NO: 852304 - protein, 23 aa, Mycobacterium
RDGAFATLRREAPISFHPAFDTE

SEQ ID NO: 852305 - protein, 33 aa, Mycobacterium
RDGAFATLRREAPISFWPPIELAGLTAGKGHWA

SEQ ID NO: 852306 - protein, 31 aa, Mycobacterium
RDGAFATLRREAPLSFWPAIEMEGFEAGEGY

SEQ ID NO: 852307 - protein, 34 aa, Mycobacterium
RDGAFATLRREAPVSFWPALELPGFTGGAGHWAL

SEQ ID NO: 852308 - protein, 18 aa, Mycobacterium
RDGAFRWYKPEDTVASEL

SEQ ID NO: 852309 - protein, 18 aa, Mycobacterium
RDGAVLRIVLDRPSRRNS

SEQ ID NO: 852310 - protein, 22 aa, Mycobacterium
RDGAYIDITWAQFGARNRAVAA

SEQ ID NO: 852311 - protein, 30 aa, Mycobacterium
RDGDDYVINGRKWWITGAADPRCKILIVMG

SEQ ID NO: 852312 - protein, 36 aa, Mycobacterium
RDGDFDEACWLVFLATHFGFHRHNRWALSGNFYRRL

SEQ ID NO: 852313 - protein, 26 aa, Mycobacterium
RDGDSWRLNGFKWFASNCAGQAFVVL

SEQ ID NO: 852314 - protein, 18 aa, Mycobacterium
RDGEGRWGLGPAVTELAA

SEQ ID NO: 852315 - protein, 29 aa, Mycobacterium
RDGEIGFVLALTPRRNLTADAALARLAEG

SEQ ID NO: 852316 - protein, 31 aa, Mycobacterium
RDGENRMVLTSTHWPWIGDRTRHLDGPHVEL

SEQ ID NO: 852317 - protein, 26 aa, Mycobacterium
RDGGRFHKLLRIFANPKLPTIDEYYE

SEQ ID NO: 852318 - protein, 19 aa, Mycobacterium
RDGGRFMVVALTKRHFRDL

SEQ ID NO: 852319 - protein, 27 aa, Mycobacterium
RDGGRIQKLLRIFANPQLPIIDDYYEP

SEQ ID NO: 852320 - protein, 20 aa, Mycobacterium
RDGGYLPLSFAASNIAWSEV

SEQ ID NO: 852321 - protein, 27 aa, Mycobacterium
RDGGYRTNEILRWLFTPDESLTITRDG

SEQ ID NO: 852322 - protein, 17 aa, Mycobacterium
RDGHLVDRAFAADLPLL

SEQ ID NO: 852323 - protein, 27 aa, Mycobacterium
RDGHPCGVFSWRPPPSLITALSDLLDA

SEQ ID NO: 852324 - protein, 29 aa, Mycobacterium
RDGIFVGYQLDRVFALRLGKDLAQPRSNG

SEQ ID NO: 852325 - protein, 17 aa, Mycobacterium
RDGKAYRYRPTLTREEH

SEQ ID NO: 852326 - protein, 18 aa, Mycobacterium
RDGKAYRYRPTLTREEHS

SEQ ID NO: 852327 - protein, 31 aa, Mycobacterium
RDGLELNSWLYWPHTEPIGAMLFLHGGPEGQ

SEQ ID NO: 852328 - protein, 17 aa, Mycobacterium
RDGLKGLQLAFREASAA

SEQ ID NO: 852329 - protein, 19 aa, Mycobacterium
RDGLLNRLDLAFSRDQKAR

SEQ ID NO: 852330 - protein, 23 aa, Mycobacterium
RDGLLYIFIPPTEALEDFVDLVT

SEQ ID NO: 852331 - protein, 29 aa, Mycobacterium
RDGLQIEAPIPLSAKLELLAAIAATGVRE

SEQ ID NO: 852332 - protein, 26 aa, Mycobacterium
RDGLQIEAPIPLSAKLELLAAVAATG

SEQ ID NO: 852333 - protein, 25 aa, Mycobacterium
RDGLQIEQPIPLSAKLEILEAIAAT

SEQ ID NO: 852334 - protein, 18 aa, Mycobacterium
RDGLQRLLPGPNAAVKAA

SEQ ID NO: 852335 - protein, 26 aa, Mycobacterium
RDGLSDRLPKMLGAQAAGAAPLVNGA

SEQ ID NO: 852336 - protein, 18 aa, Mycobacterium
RDGLTMARPFAAPRTVFN

SEQ ID NO: 852337 - protein, 22 aa, Mycobacterium
RDGNCLAFLLAWDSFDYDPETD

SEQ ID NO: 852338 - protein, 18 aa, Mycobacterium
RDGPRPWLVWVHGAGQGG

SEQ ID NO: 852339 - protein, 24 aa, Mycobacterium
RDGQTLFEICARLLTNHGLSSTRQ

SEQ ID NO: 852340 - protein, 18 aa, Mycobacterium
RDGRALKFWTPGGSSTPL

SEQ ID NO: 852341 - protein, 25 aa, Mycobacterium
RDGRIEQVFYPIFPPDTHAQQVLEW

SEQ ID NO: 852342 - protein, 22 aa, Mycobacterium
RDGRIWLERGCPTHGLVRTLYD

SEQ ID NO: 852343 - protein, 30 aa, Mycobacterium
RDGRKRGHWMWFVFPQLRGLGSSPTADRYG

SEQ ID NO: 852344 - protein, 24 aa, Mycobacterium
RDGRLIDRAFADDLALLPVDSIPV

SEQ ID NO: 852345 - protein, 18 aa, Mycobacterium
RDGRLLVCDSPRGLLALD

SEQ ID NO: 852346 - protein, 17 aa, Mycobacterium
RDGRLVHFLPGDNEIRP

SEQ ID NO: 852347 - protein, 17 aa, Mycobacterium
RDGRVEQLGWPQVTIRY

SEQ ID NO: 852348 - protein, 20 aa, Mycobacterium
RDGRVYLDIMRNAYAQTAVA

SEQ ID NO: 852349 - protein, 30 aa, Mycobacterium
RDGRWIINGAKTWSTWAFAADYGLCLARTN

SEQ ID NO: 852350 - protein, 18 aa, Mycobacterium
RDGRWLHFRDFMNSALTL

SEQ ID NO: 852351 - protein, 23 aa, Mycobacterium
RDGSGVKRIPLARALQTAQRHDY

SEQ ID NO: 852352 - protein, 24 aa, Mycobacterium
RDGSLALPYWMIYDDREGEVPPVK

SEQ ID NO: 852353 - protein, 28 aa, Mycobacterium
RDGTFATLRREAPISFWPAVEYEGFEPG

SEQ ID NO: 852354 - protein, 21 aa, Mycobacterium
RDGVGIFAELLTPLATGVPVL

SEQ ID NO: 852355 - protein, 17 aa, Mycobacterium
RDGVGLVGPLVIPGTTS

SEQ ID NO: 852356 - protein, 23 aa, Mycobacterium
RDGVIVRPPVIDYKLIDVPELGY

SEQ ID NO: 852357 - protein, 24 aa, Mycobacterium
RDGVLQELRALLRPGGVFAAHEYS

SEQ ID NO: 852358 - protein, 27 aa, Mycobacterium
RDGVVLVTVTYRLGITGFLDIAGAPRN

SEQ ID NO: 852359 - protein, 23 aa, Mycobacterium
RDGYEWFQYYDRSVPGKLKQGGE

SEQ ID NO: 852360 - protein, 23 aa, Mycobacterium
RDGYGWLQPRLSPVARPALPPHL

SEQ ID NO: 852361 - protein, 28 aa, Mycobacterium
RDHDGVLWISPLAGPPGFLRGDEGLLRV

SEQ ID NO: 852362 - protein, 40 aa, Mycobacterium; identical to SEQ ID NO: 131015

SEQ ID NO: 852363 - protein, 24 aa, Mycobacterium
RDHDLPLLVVDRLGRRLAGDIGDD

SEQ ID NO: 852364 - protein, 18 aa, Mycobacterium
RDHDMQWDFFTLTPESAH

SEQ ID NO: 852365 - protein, 26 aa, Mycobacterium
RDHLAPYLKVRRLEFADLPKTISGKI

SEQ ID NO: 852366 - protein, 18 aa, Mycobacterium
RDHLAPYLKVRRVEFFDL

SEQ ID NO: 852367 - protein, 26 aa, Mycobacterium
RDHLDFHPDMQDYFATKARLFRRDSP

SEQ ID NO: 852368 - protein, 28 aa, Mycobacterium
RDHLERLWTPYRMNYLAEAPMKRPESER

SEQ ID NO: 852369 - protein, 26 aa, Mycobacterium
RDHLGRIDRPRWVASLPWEQLEDEHH

SEQ ID NO: 852370 - protein, 26 aa, Mycobacterium
RDHPEPLAFHAQLSALRPPAVTAPDG

SEQ ID NO: 852371 - protein, 22 aa, Mycobacterium
RDHQKIFHWTNVILGFGDPDIA

SEQ ID NO: 852372 - protein, 25 aa, Mycobacterium
RDHQPKMIIAGWSAYPRQLDFARFR

SEQ ID NO: 852373 - protein, 24 aa, Mycobacterium
RDHRDRHQGALWHALALGRVNGRA

SEQ ID NO: 852374 - protein, 24 aa, Mycobacterium
RDHRPWYDRQRPDPFMAALRAAKT

SEQ ID NO: 852375 - protein, 29 aa, Mycobacterium
RDHSWAARDWWAMDWVWSAFHLEDGTHIH

SEQ ID NO: 852376 - protein, 30 aa, Mycobacterium
RDHSWGVRDWWSMDWMWSALHLDDGTHLHG

SEQ ID NO: 852377 - protein, 22 aa, Mycobacterium
RDHTYFLNFDTIGSPELIMLEG

SEQ ID NO: 852378 - protein, 22 aa, Mycobacterium
RDHTYFLNFDTVGSPELIMLEG

SEQ ID NO: 852379 - protein, 22 aa, Mycobacterium
RDHVTSVFRHDSLASALAATEL

SEQ ID NO: 852380 - protein, 19 aa, Mycobacterium
RDHYTINAFIPLPRGEGDP

SEQ ID NO: 852381 - protein, 18 aa, Mycobacterium
RDIAAAFLLALEAPAKKV

SEQ ID NO: 852382 - protein, 30 aa, Mycobacterium
RDIAMVFQNYALYPHLTVRENIAFPLRATK

SEQ ID NO: 852383 - protein, 20 aa, Mycobacterium
RDIAMVFQNYALYPTKTVAE

SEQ ID NO: 852384 - protein, 20 aa, Mycobacterium
RDIAMVFQSYALYPHMTVRQ

SEQ ID NO: 852385 - protein, 17 aa, Mycobacterium
RDIDVAAFLPHSPLRVY

SEQ ID NO: 852386 - protein, 21 aa, Mycobacterium
RDIDVAAYLPHSPLRVYVMGQ

SEQ ID NO: 852387 - protein, 26 aa, Mycobacterium
RDIFAALPDKRWPRLRAEQGEVLKAW

SEQ ID NO: 852388 - protein, 33 aa, Mycobacterium
RDIGFVFQHYAAFKHLTVWENVAFGLKIRKKPK

SEQ ID NO: 852389 - protein, 18 aa, Mycobacterium
RDIGRPIKTLQVPAGIVQ

SEQ ID NO: 852390 - protein, 25 aa, Mycobacterium
RDIHLTREWILRNSPVPVGTVPMYQ

SEQ ID NO: 852391 - protein, 23 aa, Mycobacterium
RDIQAPLRWFREAYPGLDIDQAT

SEQ ID NO: 852392 - protein, 23 aa, Mycobacterium
RDIRLRLLDRMKDKWRSDLAGDG

SEQ ID NO: 852393 - protein, 20 aa, Mycobacterium
RDIVAYLRVLTNPGDAVSLR

SEQ ID NO: 852394 - protein, 26 aa, Mycobacterium
RDIVDVNLIGVWHTIAATAPSMIRRG

SEQ ID NO: 852395 - protein, 20 aa, Mycobacterium
RDIVPRGMRALRAPTIVAAL

SEQ ID NO: 852396 - protein, 25 aa, Mycobacterium
RDIWDLGYHCFPAPGLLGGFGHMGA

SEQ ID NO: 852397 - protein, 31 aa, Mycobacterium
RDIYRDSQLGLFPFRRNLSLFAVDLGLLTFS

SEQ ID NO: 852398 - protein, 25 aa, Mycobacterium
RDIYRVTILHWVRRACALSMRKVRM

SEQ ID NO: 852399 - protein, 19 aa, Mycobacterium
RDKCRVPIPWSGDEPPFGF

SEQ ID NO: 852400 - protein, 17 aa, Mycobacterium
RDKFGIGAQLLLPSTVN

SEQ ID NO: 852401 - protein, 19 aa, Mycobacterium
RDKIERRYANAIGAAELAQ

SEQ ID NO: 852402 - protein, 18 aa, Mycobacterium
RDKLFPTGIRRWGGGRSI

SEQ ID NO: 852403 - protein, 17 aa, Mycobacterium
RDKNRYIGIPAAFSKLF

SEQ ID NO: 852404 - protein, 23 aa, Mycobacterium
RDKPLIMNVTMVGEGTISCSITV

SEQ ID NO: 852405 - protein, 18 aa, Mycobacterium
RDKPSLMERLYKASWRFT

SEQ ID NO: 852406 - protein, 25 aa, Mycobacterium
RDKRLPRIAGPCSLVIFGVTGDLAR

SEQ ID NO: 852407 - protein, 26 aa, Mycobacterium
RDKRMEVALTYIYGIGRTRSNEILAA

SEQ ID NO: 852408 - protein, 22 aa, Mycobacterium
RDKWYRAGWYSDRTCLDAFEAG

SEQ ID NO: 852409 - protein, 30 aa, Mycobacterium
RDLACRWAREWVDRLSALNRPQALLRARRL

SEQ ID NO: 852410 - protein, 18 aa, Mycobacterium
RDLADIWPVIDRDPAVRV

SEQ ID NO: 852411 - protein, 18 aa, Mycobacterium
RDLARLMTPFAERYGVVA

SEQ ID NO: 852412 - protein, 20 aa, Mycobacterium
RDLCNTLGWEKSRVSHQVRR

SEQ ID NO: 852413 - protein, 22 aa, Mycobacterium
RDLDLIVAMDRLGFHEAWVGEH

SEQ ID NO: 852414 - protein, 17 aa, Mycobacterium
RDLDPDVVILDIGLPGI

SEQ ID NO: 852415 - protein, 21 aa, Mycobacterium
RDLEDLVRIDSVWADPARHDQ

SEQ ID NO: 852416 - protein, 24 aa, Mycobacterium
RDLEFNLFELFKIQQVFGGEEFPE

SEQ ID NO: 852417 - protein, 22 aa, Mycobacterium
RDLEGRMFACFAAGALAAGCEY

SEQ ID NO: 852418 - protein, 20 aa, Mycobacterium
RDLFLTLLGVSGVGPKIALA

SEQ ID NO: 852419 - protein, 29 aa, Mycobacterium
RDLGADLVRFLPWFSHPRLSVAQLSPPTA

SEQ ID NO: 852420 - protein, 18 aa, Mycobacterium
RDLGCEYAICYFPEAAYD

SEQ ID NO: 852421 - protein, 19 aa, Mycobacterium
RDLGCEYAILYFPEAAYDR

SEQ ID NO: 852422 - protein, 18 aa, Mycobacterium
RDLGLSRYYGLRQTVIDP

SEQ ID NO: 852423 - protein, 25 aa, Mycobacterium
RDLGPWWGQQAEFAEPFPVAGDDLG

SEQ ID NO: 852424 - protein, 25 aa, Mycobacterium
RDLGSLGIRALAIAPSLFATGLTEG

SEQ ID NO: 852425 - protein, 18 aa, Mycobacterium
RDLGTASNRIRLARLSID

SEQ ID NO: 852426 - protein, 19 aa, Mycobacterium
RDLGVIDYEMAWELQRDIV

SEQ ID NO: 852427 - protein, 26 aa, Mycobacterium
RDLHDRPLDWRFKGVPADWWGRTEAQ

SEQ ID NO: 852428 - protein, 21 aa, Mycobacterium
RDLLEYRYHVCKRCGGFRYGL

SEQ ID NO: 852429 - protein, 17 aa, Mycobacterium
RDLLFAYVGARMAELMS

SEQ ID NO: 852430 - protein, 18 aa, Mycobacterium
RDLLGMDIVFDQLISGEP

SEQ ID NO: 852431 - protein, 20 aa, Mycobacterium
RDLLPPVVGALLDRHDRRRA

SEQ ID NO: 852432 - protein, 20 aa, Mycobacterium
RDLLRPGTEDLFWLGTAEAI

SEQ ID NO: 852433 - protein, 17 aa, Mycobacterium
RDLLRRMQPTEFNDIVA

SEQ ID NO: 852434 - protein, 17 aa, Mycobacterium
RDLLRRMQPTGFNDIVA

SEQ ID NO: 852435 - protein, 22 aa, Mycobacterium
RDLLVNVLRHPAFLDGATDTAF

SEQ ID NO: 852436 - protein, 22 aa, Mycobacterium
RDLMTSTPFMGGLGIVFERYEP

SEQ ID NO: 852437 - protein, 23 aa, Mycobacterium
RDLNPVSRLTTALALAEWIEQHA

SEQ ID NO: 852438 - protein, 30 aa, Mycobacterium
RDLPAAPARWLLLRIPFATVGPEELAYRAV

SEQ ID NO: 852439 - protein, 18 aa, Mycobacterium
RDLPIHGVQFHPESILTQ

SEQ ID NO: 852440 - protein, 25 aa, Mycobacterium
RDLPITLMHAVPPVVVGWPVGQLYA

SEQ ID NO: 852441 - protein, 23 aa, Mycobacterium
RDLPPAFENFLSTKFFTAVQDHP

SEQ ID NO: 852442 - protein, 30 aa, Mycobacterium
RDLPWRRPEATPWHILISEVMLQQTPVSRV

SEQ ID NO: 852443 - protein, 26 aa, Mycobacterium
RDLRARVWIAQVGRIPLLLLDSDIPE

SEQ ID NO: 852444 - protein, 17 aa, Mycobacterium
RDLRKSFRVAGKNRLVA

SEQ ID NO: 852445 - protein, 18 aa, Mycobacterium
RDLRLRDHPALLAAAEAH

SEQ ID NO: 852446 - protein, 31 aa, Mycobacterium
RDLSIELFGIRLPSPVFMAPIGVIGVCAQDG

SEQ ID NO: 852447 - protein, 17 aa, Mycobacterium
RDLSSIDFILQGAAVMP

SEQ ID NO: 852448 - protein, 23 aa, Mycobacterium
RDLSSIVFILQGAAVMPPSLLHT

SEQ ID NO: 852449 - protein, 32 aa, Mycobacterium
RDLTFVGTRRYVRRQRSWFGRDHRVVWLAGES

SEQ ID NO: 852450 - protein, 17 aa, Mycobacterium
RDLTVERLLGSLSAWRA

SEQ ID NO: 852451 - protein, 19 aa, Mycobacterium
RDLVGLYLNPPERAMVLCV

SEQ ID NO: 852452 - protein, 17 aa, Mycobacterium
RDLYAWAERFRTGVIAT

SEQ ID NO: 852453 - protein, 20 aa, Mycobacterium
RDMAPRITAMTVRDGKVCAI

SEQ ID NO: 852454 - protein, 23 aa, Mycobacterium
RDMGLMLGEYWDLTALSADCAAD

SEQ ID NO: 852455 - protein, 19 aa, Mycobacterium
RDMGMGMPGLGGLGGGPGM

SEQ ID NO: 852456 - protein, 19 aa, Mycobacterium
RDMGMVFQAYSLFPHLTVL

SEQ ID NO: 852457 - protein, 22 aa, Mycobacterium
RDMLDELCLTVAPYLVGGLARR

SEQ ID NO: 852458 - protein, 19 aa, Mycobacterium
RDMQWICRDGDRAKNHLLE

SEQ ID NO: 852459 - protein, 31 aa, Mycobacterium
RDMSVELFGIRFPSPIFMAPIGVIGVCAQDG

SEQ ID NO: 852460 - protein, 31 aa, Mycobacterium
RDMSVELFGMRFPSPIFMAPIGVIGVCDPEG

SEQ ID NO: 852461 - protein, 17 aa, Mycobacterium
RDNCDPELCRYDRILFA

SEQ ID NO: 852462 - protein, 20 aa, Mycobacterium
RDNCHYCTFVTVPGKLRAQG

SEQ ID NO: 852463 - protein, 19 aa, Mycobacterium
RDNDAWRLSDVSAIAVPWQ

SEQ ID NO: 852464 - protein, 25 aa, Mycobacterium
RDNFTGFWNLWKYGVVKRDYDLLDQ

SEQ ID NO: 852465 - protein, 26 aa, Mycobacterium
RDNLLDIWRRDDLAPGCRAPVLIQVP

SEQ ID NO: 852466 - protein, 24 aa, Mycobacterium
RDNPKIPAILIPALVGHGGWERLQ

SEQ ID NO: 852467 - protein, 22 aa, Mycobacterium
RDNPMLPLAKSASGGELSRVML

SEQ ID NO: 852468 - protein, 24 aa, Mycobacterium
RDNVSLFDYWRNGYQTLHGMTSRG

SEQ ID NO: 852469 - protein, 17 aa, Mycobacterium
RDPAARDWKIEAVRQHF

SEQ ID NO: 852470 - protein, 24 aa, Mycobacterium
RDPDLLATSNPRRLRPHPIFRPVR

SEQ ID NO: 852471 - protein, 24 aa, Mycobacterium
RDPDYKFVLAEVDYLKPYWDTHPE

SEQ ID NO: 852472 - protein, 24 aa, Mycobacterium
RDPDYKFVLAEVDYLKPYWDTHPQ

SEQ ID NO: 852473 - protein, 27 aa, Mycobacterium
RDPDYPAALYADYLPRYLRGISDDADA

SEQ ID NO: 852474 - protein, 26 aa, Mycobacterium
RDPEHQFTVWLAIRLDLLDEVHSAVE

SEQ ID NO: 852475 - protein, 22 aa, Mycobacterium
RDPELHRRWLRDTGATPPGGES

SEQ ID NO: 852476 - protein, 26 aa, Mycobacterium
RDPERLARFWCEVLDFVVLSREEDGS

SEQ ID NO: 852477 - protein, 23 aa, Mycobacterium
RDPESVKLIYGLQTIIDRDKGRA

SEQ ID NO: 852478 - protein, 24 aa, Mycobacterium
RDPETLARQFAVPGTPGLAHRIGG

SEQ ID NO: 852479 - protein, 25 aa, Mycobacterium
RDPGPLRRLIATLPALEVTRPDWPA

SEQ ID NO: 852480 - protein, 18 aa, Mycobacterium
RDPLLDIPNLVRSGAKWA

SEQ ID NO: 852481 - protein, 20 aa, Mycobacterium
RDPLLRLNTFFDDGSVELLH

SEQ ID NO: 852482 - protein, 23 aa, Mycobacterium
RDPLLRLSNFFDDDSVELLHERD

SEQ ID NO: 852483 - protein, 31 aa, Mycobacterium; identical to SEQ ID NO: 122037

SEQ ID NO: 852484 - protein, 25 aa, Mycobacterium
RDPMGWQSSRLEFLRAWLAGSDNAA

SEQ ID NO: 852485 - protein, 24 aa, Mycobacterium
RDPNNLLAMLWTWQNGNVGNTPGR

SEQ ID NO: 852486 - protein, 18 aa, Mycobacterium
RDPPAKPTLPLPIPQDLT

SEQ ID NO: 852487 - protein, 26 aa, Mycobacterium
RDPPTRLLNLALEIGCLFSIDTDAHA

SEQ ID NO: 852488 - protein, 19 aa, Mycobacterium
RDPQGRWTFYATTPGPQSC

SEQ ID NO: 852489 - protein, 20 aa, Mycobacterium
RDPRNWPRLRDPRKPSWGEP

SEQ ID NO: 852490 - protein, 24 aa, Mycobacterium
RDPRNWWHLRNPRTPSWGEPYSHI

SEQ ID NO: 852491 - protein, 24 aa, Mycobacterium
RDPRNWWKLRDPFTPSWGEPYRDI

SEQ ID NO: 852492 - protein, 50 aa, Mycobacterium
RDPRQAKFLTLASLKWVLANRAYTPWYLVRYWRLLKFKLANPHIITRGMV

SEQ ID NO: 852493 - protein, 51 aa, Mycobacterium
RDPRQARFLTLASLKWVLKNRAFTPWYLVRYFRLLKFKLANPHIITRGMVF

SEQ ID NO: 852494 - protein, 18 aa, Mycobacterium
RDPRRPLLIGSAKTNLGH

SEQ ID NO: 852495 - protein, 23 aa, Mycobacterium
RDPSIVDVLAAAGVRHVFTSAGD

SEQ ID NO: 852496 - protein, 27 aa, Mycobacterium
RDPSTHTIFVLGRPITAGAFGAVARAV

SEQ ID NO: 852497 - protein, 24 aa, Mycobacterium
RDPTWADETYVFGYPHVPMTAESV

SEQ ID NO: 852498 - protein, 18 aa, Mycobacterium
RDPVGYLARRVPGVRVKE

SEQ ID NO: 852499 - protein, 23 aa, Mycobacterium
RDPVKLRLGIGYVIQHAGLMPHQ

SEQ ID NO: 852500 - protein, 17 aa, Mycobacterium
RDPVLDRSTLVIAISQS

SEQ ID NO: 852501 - protein, 17 aa, Mycobacterium
RDPVLLNSFHSISADPK

SEQ ID NO: 852502 - protein, 20 aa, Mycobacterium
RDPYPPPWHAGREAWRPVIG

SEQ ID NO: 852503 - protein, 18 aa, Mycobacterium
RDPYPYFARKRSEGGVFH

SEQ ID NO: 852504 - protein, 25 aa, Mycobacterium
RDQANVWMFSPNRLLAHGKPADLVR

SEQ ID NO: 852505 - protein, 26 aa, Mycobacterium
RDQGYALLATLLRYQVPIWPERLLTR

SEQ ID NO: 852506 - protein, 17 aa, Mycobacterium
RDQIAALRWVRDNIAAF

SEQ ID NO: 852507 - protein, 20 aa, Mycobacterium
RDQLAAMRSLPPIGKKPAGK

SEQ ID NO: 852508 - protein, 21 aa, Mycobacterium
RDQLILAGVYAFSGITATSTD

SEQ ID NO: 852509 - protein, 22 aa, Mycobacterium
RDQMRLWDSADLTTAANLILSI

SEQ ID NO: 852510 - protein, 17 aa, Mycobacterium
RDQPAAPPPPPPPPESP

SEQ ID NO: 852511 - protein, 22 aa, Mycobacterium
RDQVLRVLQLPDDRLDDLLALA

SEQ ID NO: 852512 - protein, 28 aa, Mycobacterium
RDQVSAFAEMFFAYLDLISAAGVAGHAQ

SEQ ID NO: 852513 - protein, 23 aa, Mycobacterium
RDQYAPLPRMTDVEPLPVDVHRD

SEQ ID NO: 852514 - protein, 17 aa, Mycobacterium
RDRAFYAPAQSRYRVFI

SEQ ID NO: 852515 - protein, 23 aa, Mycobacterium
RDRAIRRYGQLEERFVALGGYGA

SEQ ID NO: 852516 - protein, 17 aa, Mycobacterium
RDRAKMLSLLWQSLRRQ

SEQ ID NO: 852517 - protein, 19 aa, Mycobacterium
RDRALLSKDATIREIHHRV

SEQ ID NO: 852518 - protein, 22 aa, Mycobacterium
RDRARRMFADYDALFDSRERAS

SEQ ID NO: 852519 - protein, 20 aa, Mycobacterium
RDRASLAAALRAGLDEFGRV

SEQ ID NO: 852520 - protein, 18 aa, Mycobacterium
RDRAVYTPRLARRSAPPS

SEQ ID NO: 852521 - protein, 22 aa, Mycobacterium
RDRDDFYWGAGVHPDEWSLVRQ

SEQ ID NO: 852522 - protein, 21 aa, Mycobacterium
RDRFGFTAHMDFYEPAELELV

SEQ ID NO: 852523 - protein, 19 aa, Mycobacterium
RDRFGFTAHMDFYEPVELE

SEQ ID NO: 852524 - protein, 23 aa, Mycobacterium
RDRFGRLFGGQLLAQAVYAAART

SEQ ID NO: 852525 - protein, 20 aa, Mycobacterium
RDRFLFKINVGYPSPEEERE

SEQ ID NO: 852526 - protein, 31 aa, Mycobacterium
RDRGFIPEGLLNYLALLGWAIADDHDLFSLD

SEQ ID NO: 852527 - protein, 26 aa, Mycobacterium
RDRGFIPEGLLNYLALLGWGIADDHD

SEQ ID NO: 852528 - protein, 30 aa, Mycobacterium
RDRGFIPEGLLNYLALLGWSIADDHDIFSL

SEQ ID NO: 852529 - protein, 32 aa, Mycobacterium
RDRGFIPEGLLNYLALLGWSIADDRDLFSLDE

SEQ ID NO: 852530 - protein, 24 aa, Mycobacterium
RDRGLFGTSILWFEMTEEGRQPLP

SEQ ID NO: 852531 - protein, 23 aa, Mycobacterium
RDRGWDIGALFDGSRRDGFKPIN

SEQ ID NO: 852532 - protein, 17 aa, Mycobacterium
RDRHDVIVLGLARGGIP

SEQ ID NO: 852533 - protein, 23 aa, Mycobacterium
RDRIKPAPLRAAVPGGFTIDNFT

SEQ ID NO: 852534 - protein, 27 aa, Mycobacterium
RDRILDDVTLYWLTRTGASAARIYYES

SEQ ID NO: 852535 - protein, 24 aa, Mycobacterium
RDRIPLGPFTIKVAYRARLRVPAV

SEQ ID NO: 852536 - protein, 17 aa, Mycobacterium
RDRIPSVWRTSPNTAGF

SEQ ID NO: 852537 - protein, 18 aa, Mycobacterium
RDRLGFKPVVSYHEGMAR

SEQ ID NO: 852538 - protein, 36 aa, Mycobacterium
RDRLGIKPLYLTLTPDRIRFASSLPALLAGGGVDTR

SEQ ID NO: 852539 - protein, 23 aa, Mycobacterium
RDRLPKVGALFLAGLLSELLVRA

SEQ ID NO: 852540 - protein, 22 aa, Mycobacterium
RDRLRPRIRAVMDRLDAAIPRG

SEQ ID NO: 852541 - protein, 28 aa, Mycobacterium
RDRLTVPDAALPLPARLAATARAKAFLS

SEQ ID NO: 852542 - protein, 20 aa, Mycobacterium
RDRLVVIVAGYRAELDQFLD

SEQ ID NO: 852543 - protein, 22 aa, Mycobacterium
RDRLVVIVAGYRKDLDAFLDTN

SEQ ID NO: 852544 - protein, 21 aa, Mycobacterium
RDRLVVIVAGYRKDLDTFLDA

SEQ ID NO: 852545 - protein, 36 aa, Mycobacterium
RDRNLAMVFQNYALYPHLTVFENIAFPLRLAGKLSD

SEQ ID NO: 852546 - protein, 23 aa, Mycobacterium
RDRPIPPGPIGLPFIGSAIPMAR

SEQ ID NO: 852547 - protein, 24 aa, Mycobacterium
RDRPLWECYLIEGLSDDRWAVLTK

SEQ ID NO: 852548 - protein, 23 aa, Mycobacterium
RDRPRSAYLPFGGGRRICIGQSF

SEQ ID NO: 852549 - protein, 29 aa, Mycobacterium
RDRPTAWLAEGLLPYLPGDAQDRLFEMIT

SEQ ID NO: 852550 - protein, 22 aa, Mycobacterium
RDRQHLASRLAYSETVFVDLPA

SEQ ID NO: 852551 - protein, 19 aa, Mycobacterium
RDRRAVYVPEGVGHGFLAL

SEQ ID NO: 852552 - protein, 18 aa, Mycobacterium
RDRRKLLEMLAAGSRLIV

SEQ ID NO: 852553 - protein, 25 aa, Mycobacterium
RDRRLDAAIIDRLAPGGLVALVALS

SEQ ID NO: 852554 - protein, 30 aa, Mycobacterium
RDRRLHNRFRNLLGRRLRGARLGTGLLRRS

SEQ ID NO: 852555 - protein, 21 aa, Mycobacterium
RDRRLLRYDTLILDEAHERSL

SEQ ID NO: 852556 - protein, 19 aa, Mycobacterium
RDRRQLRLSVALRNPGVGD

SEQ ID NO: 852557 - protein, 25 aa, Mycobacterium
RDRRRLMLPPFHRDAVARQAGLMAE

SEQ ID NO: 852558 - protein, 24 aa, Mycobacterium
RDRRRMMLPPFHRDAVTRQARLMA

SEQ ID NO: 852559 - protein, 17 aa, Mycobacterium
RDRRRVMLAPFTRDAVA

SEQ ID NO: 852560 - protein, 25 aa, Mycobacterium
RDRSDPLYAMDWVTVYALAVNEENA

SEQ ID NO: 852561 - protein, 17 aa, Mycobacterium
RDRTSPPLAFGYGTHHC

SEQ ID NO: 852562 - protein, 26 aa, Mycobacterium
RDRVAGLLVLLYSQPAARLVTLKVAD

SEQ ID NO: 852563 - protein, 24 aa, Mycobacterium
RDRVAPRVFGLPAVQRWTTYTASQ

SEQ ID NO: 852564 - protein, 19 aa, Mycobacterium
RDRVARWIEGTLAQVADPH

SEQ ID NO: 852565 - protein, 20 aa, Mycobacterium
RDRVLVHPRPRLSVISVGGE

SEQ ID NO: 852566 - protein, 24 aa, Mycobacterium
RDRWHTLARLTLREDLYRSVRLLT

SEQ ID NO: 852567 - protein, 25 aa, Mycobacterium
RDRYGWQWNIVPLIKVPGVTNVHQD

SEQ ID NO: 852568 - protein, 23 aa, Mycobacterium
RDRYRVRWIPQRAVKGVYYGTPI

SEQ ID NO: 852569 - protein, 23 aa, Mycobacterium
RDRYWPSLIRMYPPYRKYREVTD

SEQ ID NO: 852570 - protein, 26 aa, Mycobacterium
RDSAWLLVSILRQLGFAARFVSGYLV

SEQ ID NO: 852571 - protein, 25 aa, Mycobacterium
RDSDGWIYLAGRTADWMRVDGENLA

SEQ ID NO: 852572 - protein, 26 aa, Mycobacterium
RDSGGKFLWPGFGENARVLKWALDRL

SEQ ID NO: 852573 - protein, 23 aa, Mycobacterium
RDSGGTLLRWLARKHASAVVLRP

SEQ ID NO: 852574 - protein, 26 aa, Mycobacterium
RDSGPNQWLLRMLATQTERAELVPLL

SEQ ID NO: 852575 - protein, 25 aa, Mycobacterium
RDSGTAILFVSHFLDQIYAISDRMT

SEQ ID NO: 852576 - protein, 17 aa, Mycobacterium
RDSIWYDPYTVTDDPHA

SEQ ID NO: 852577 - protein, 18 aa, Mycobacterium
RDSLFSHPPMVLTPSVRP

SEQ ID NO: 852578 - protein, 24 aa, Mycobacterium
RDSLGPITILVNNAAFTAPGRPPV

SEQ ID NO: 852579 - protein, 24 aa, Mycobacterium
RDSLLTAWMSLPLDVGLSVGTLQR

SEQ ID NO: 852580 - protein, 40 aa, Mycobacterium
RDSLRWVIANKAYTPWYLVRYWRLLKFKLANPHIVTRGML

SEQ ID NO: 852581 - protein, 25 aa, Mycobacterium
RDSMPPLRLAIIDYLAKHPHSSTAD

SEQ ID NO: 852582 - protein, 25 aa, Mycobacterium
RDSQGWIYLAGRTADWMRVDGENLA

SEQ ID NO: 852583 - protein, 23 aa, Mycobacterium
RDSRLRASAARLATAGAAVHVWG

SEQ ID NO: 852584 - protein, 29 aa, Mycobacterium
RDSRWDMPYLGMQVLIEGLALAAFGVLRD

SEQ ID NO: 852585 - protein, 24 aa, Mycobacterium
RDSSELIRDLGFDSLAFASTVSEI

SEQ ID NO: 852586 - protein, 32 aa, Mycobacterium
RDSTRLRYVEPYRAELHRLGRPVFGHTFEVEV

SEQ ID NO: 852587 - protein, 21 aa, Mycobacterium
RDSVYLPSAIGMPGVLAAARQ

SEQ ID NO: 852588 - protein, 22 aa, Mycobacterium
RDSWPPFFDFLAGGAQFELVEL

SEQ ID NO: 852589 - protein, 17 aa, Mycobacterium
RDSWYAGSLPDTITIYR

SEQ ID NO: 852590 - protein, 30 aa, Mycobacterium
RDSYLVDWSGLPYLRFLMANTGRGQPVLRR

SEQ ID NO: 852591 - protein, 26 aa, Mycobacterium
RDTADYLWNVKQIVPFLKVDKGLAEE

SEQ ID NO: 852592 - protein, 17 aa, Mycobacterium
RDTAFFWEGVKAHELRI

SEQ ID NO: 852593 - protein, 21 aa, Mycobacterium
RDTDLMIEALQTLGLRVDGTG

SEQ ID NO: 852594 - protein, 19 aa, Mycobacterium
RDTHPLKVIELELDPPGPG

SEQ ID NO: 852595 - protein, 25 aa, Mycobacterium
RDTKEVFWQLPPVQQLALSAFNIGG

SEQ ID NO: 852596 - protein, 24 aa, Mycobacterium
RDTLRKLLRRMAAGAGLIPGVHPR

SEQ ID NO: 852597 - protein, 24 aa, Mycobacterium
RDTQGWIYLAGRTSDWLRVDGENL

SEQ ID NO: 852598 - protein, 27 aa, Mycobacterium
RDTRKTLPGLRLLQKYAVRAGGGVNHR

SEQ ID NO: 852599 - protein, 17 aa, Mycobacterium
RDTVQAGAPGWDVSPEE

SEQ ID NO: 852600 - protein, 17 aa, Mycobacterium
RDTVRDYWRGEPATLGE

SEQ ID NO: 852601 - protein, 32 aa, Mycobacterium
RDVAEIELLPVIKFFPASDVLALYRLGCDAFA

SEQ ID NO: 852602 - protein, 20 aa, Mycobacterium
RDVAGLYLDPPEKALVLCVD

SEQ ID NO: 852603 - protein, 20 aa, Mycobacterium
RDVAMLDEDGYLFIGGRSDD

SEQ ID NO: 852604 - protein, 21 aa, Mycobacterium
RDVARLEDRVDLFLALEADAL

SEQ ID NO: 852605 - protein, 27 aa, Mycobacterium
RDVCVDMLEMLPTPWGLVRSGVAPDHP

SEQ ID NO: 852606 - protein, 25 aa, Mycobacterium
RDVDDALWRRFKAAQDVFFTARNAA

SEQ ID NO: 852607 - protein, 26 aa, Mycobacterium
RDVELAFLGLIPQPIKAVQLLYRTMD

SEQ ID NO: 852608 - protein, 25 aa, Mycobacterium
RDVELAFLGLIPQPVRAVQLLYRTM

SEQ ID NO: 852609 - protein, 24 aa, Mycobacterium
RDVELAFLGLVPQALHATQLLYRT

SEQ ID NO: 852610 - protein, 19 aa, Mycobacterium
RDVELLAIAQLVGAAATLV

SEQ ID NO: 852611 - protein, 20 aa, Mycobacterium
RDVELLAIGQLIGAAGSLVS

SEQ ID NO: 852612 - protein, 19 aa, Mycobacterium
RDVELLALAQLIGAAGTLV

SEQ ID NO: 852613 - protein, 20 aa, Mycobacterium
RDVELLALAQLIGAAGTLVA

SEQ ID NO: 852614 - protein, 22 aa, Mycobacterium
RDVELLLVIGRLIAGAMHQARL

SEQ ID NO: 852615 - protein, 21 aa, Mycobacterium
RDVFERVSRFVAAPGGRSGWS

SEQ ID NO: 852616 - protein, 19 aa, Mycobacterium
RDVFFAMTADVLGAAVPGA

SEQ ID NO: 852617 - protein, 22 aa, Mycobacterium
RDVFFAMTAELLGAVIPGAIAE

SEQ ID NO: 852618 - protein, 23 aa, Mycobacterium
RDVFLIQQGLPAWDRTLAHELGH

SEQ ID NO: 852619 - protein, 25 aa, Mycobacterium
RDVFTEAGALGLLGFAAPEQYGGVG

SEQ ID NO: 852620 - protein, 27 aa, Mycobacterium
RDVGGAIMDMLFPPGTQARVPIAALTG

SEQ ID NO: 852621 - protein, 26 aa, Mycobacterium
RDVGWTALRMWRFGLDDREFGGFAGR

SEQ ID NO: 852622 - protein, 20 aa, Mycobacterium
RDVIGLYLNPTEKAVVLCVD

SEQ ID NO: 852623 - protein, 21 aa, Mycobacterium
RDVLCPLIEAALKAKGADHWY

SEQ ID NO: 852624 - protein, 17 aa, Mycobacterium
RDVLNFVRSIPKSAGRD

SEQ ID NO: 852625 - protein, 22 aa, Mycobacterium
RDVMAALRQPGIGVIAEVKRAS

SEQ ID NO: 852626 - protein, 23 aa, Mycobacterium
RDVMPRLLSVGPWDSLALVKPDL

SEQ ID NO: 852627 - protein, 26 aa, Mycobacterium
RDVNKAQIYAWRKGIKTLYYIRLRQL

SEQ ID NO: 852628 - protein, 36 aa, Mycobacterium
RDVNKAQIYAWRKGIKTLYYIRLRQMALEGTEVAGC

SEQ ID NO: 852629 - protein, 17 aa, Mycobacterium
RDVPRFTQLVHKHAFDL

SEQ ID NO: 852630 - protein, 26 aa, Mycobacterium
RDVPSNVVVPYFWSDQYDVKIQCLGE

SEQ ID NO: 852631 - protein, 23 aa, Mycobacterium
RDVRFEQMLLLDDETPLSAVGSV

SEQ ID NO: 852632 - protein, 20 aa, Mycobacterium
RDVVRPPVRLIKTIGDAVML

SEQ ID NO: 852633 - protein, 24 aa, Mycobacterium
RDVYKLRQRVLLIWGREDRVNPLD

SEQ ID NO: 852634 - protein, 17 aa, Mycobacterium
RDWAAKGTLLLGVRVVI

SEQ ID NO: 852635 - protein, 17 aa, Mycobacterium
RDWAAKGTVLLGVKAVI

SEQ ID NO: 852636 - protein, 19 aa, Mycobacterium
RDWAARCIPSPTGYLYTQV

SEQ ID NO: 852637 - protein, 17 aa, Mycobacterium
RDWAPKVYGAWNLHTAT

SEQ ID NO: 852638 - protein, 22 aa, Mycobacterium
RDWLTERFGERVGWLAGAHVAA

SEQ ID NO: 852639 - protein, 17 aa, Mycobacterium
RDWLVTRVAVRTHRRLG

SEQ ID NO: 852640 - protein, 22 aa, Mycobacterium
RDWMLDHRDDLLTPLQLETGKS

SEQ ID NO: 852641 - protein, 25 aa, Mycobacterium
RDWPAEAMWPPRGIPRSVLVEQDAL

SEQ ID NO: 852642 - protein, 18 aa, Mycobacterium
RDWSRIPPRQLRLDELVT

SEQ ID NO: 852643 - protein, 21 aa, Mycobacterium
RDWTEITPQWLTAALATHHPG

SEQ ID NO: 852644 - protein, 21 aa, Mycobacterium
RDWWPDQIDVSMLHPNPPAAS

SEQ ID NO: 852645 - protein, 23 aa, Mycobacterium
RDYCRELIRQLAFGIPGEALSPV

SEQ ID NO: 852646 - protein, 26 aa, Mycobacterium
RDYHIPQFVDVPLTEVYFADTFDELG

SEQ ID NO: 852647 - protein, 19 aa, Mycobacterium
RDYIRRAIAFQRCLEVAAR

SEQ ID NO: 852648 - protein, 22 aa, Mycobacterium
RDYLVELARWSGRYGSRAGVPA

SEQ ID NO: 852649 - protein, 21 aa, Mycobacterium
RDYNHWATVGVLNELLPLPDN

SEQ ID NO: 852650 - protein, 18 aa, Mycobacterium
RDYRLATVPPTAGGLYIQ

SEQ ID NO: 852651 - protein, 28 aa, Mycobacterium
RDYTAIYDKWLTLGPLVEKFGLTTKGVT

SEQ ID NO: 852652 - protein, 22 aa, Mycobacterium
RDYTQKYYLPAATALRAVIEPG

SEQ ID NO: 852653 - protein, 26 aa, Mycobacterium
RDYVGQQLMIFPSTAGTWRDPNNFGK

SEQ ID NO: 852654 - protein, 17 aa, Mycobacterium
RDYVKASRRRWLREEQY

SEQ ID NO: 852655 - protein, 21 aa, Mycobacterium
RDYVMALGYLQAPVVVAGDDH

SEQ ID NO: 852656 - protein, 23 aa, Mycobacterium
RDYWAQWRAVRAPSLLIEAGNSV

SEQ ID NO: 852657 - protein, 19 aa, Mycobacterium
RDYWAQWRAVRQPALLIEA

SEQ ID NO: 852658 - protein, 23 aa, Mycobacterium
RDYWQQWRAVRAPALLIEAGNSV

SEQ ID NO: 852659 - protein, 28 aa, Mycobacterium
REAAHHRLFGHVPWLAGQLLGAVEAYAK

SEQ ID NO: 852660 - protein, 29 aa, Mycobacterium
REAAHHRLFSHVPWLSSQLLGAVEAFAKG

SEQ ID NO: 852661 - protein, 29 aa, Mycobacterium
REAAHHRLFSHVPWLSSQLLGAVEAYAAG

SEQ ID NO: 852662 - protein, 29 aa, Mycobacterium
REAAHHRLFSHVPWLSSQLLGAVEAYAMG

SEQ ID NO: 852663 - protein, 28 aa, Mycobacterium
REAAHHRLFSHVPWLSSQLLNAVEAFAK

SEQ ID NO: 852664 - protein, 27 aa, Mycobacterium
REAAHHRLFSHVPWLSSQVLGAVEAYA

SEQ ID NO: 852665 - protein, 17 aa, Mycobacterium
REAALAGDWIRANAPGI

SEQ ID NO: 852666 - protein, 18 aa, Mycobacterium
REAALRLDRHFAISVIDC

SEQ ID NO: 852667 - protein, 18 aa, Mycobacterium
REAAVRFIIGGPSNPHGA

SEQ ID NO: 852668 - protein, 18 aa, Mycobacterium
REAAVRFITGGPGNPRGG

SEQ ID NO: 852669 - protein, 18 aa, Mycobacterium
REAAVRFVTGGPASPRGG

SEQ ID NO: 852670 - protein, 26 aa, Mycobacterium
REACDRLAFDLRWKAAAGLTVGAGAF

SEQ ID NO: 852671 - protein, 19 aa, Mycobacterium
READAEVLDVLRAEGAPET

SEQ ID NO: 852672 - protein, 22 aa, Mycobacterium
READRLMDWQPRGRGRGGRPQF

SEQ ID NO: 852673 - protein, 22 aa, Mycobacterium
REAERPILLLAGGTGLAPVLSM

SEQ ID NO: 852674 - protein, 22 aa, Mycobacterium
REAFDRWGLIPRMFVGAADRDL

SEQ ID NO: 852675 - protein, 18 aa, Mycobacterium
REAFGRPVFGFQNTKFTL

SEQ ID NO: 852676 - protein, 18 aa, Mycobacterium
REAFRRLALLGVGATAAG

SEQ ID NO: 852677 - protein, 24 aa, Mycobacterium
REAGATPSFLGYHGFPASICASVN

SEQ ID NO: 852678 - protein, 34 aa, Mycobacterium
REAGMTEPLYLMPWSTMFPLGISSATIGIAEGAL

SEQ ID NO: 852679 - protein, 24 aa, Mycobacterium
REAGPTLLDLPTAVWHLLCEDAES

SEQ ID NO: 852680 - protein, 17 aa, Mycobacterium
REAGWWCDTTLSDAVRR

SEQ ID NO: 852681 - protein, 24 aa, Mycobacterium
REAGYQVPPSQANFVWLPLGERST

SEQ ID NO: 852682 - protein, 18 aa, Mycobacterium
REAHDLCALPVGVFRCDM

SEQ ID NO: 852683 - protein, 27 aa, Mycobacterium
REAIAIDPQHRLLLQTSWEAVEHAGMP

SEQ ID NO: 852684 - protein, 18 aa, Mycobacterium
REAIKIIRELFGGHLVNF

SEQ ID NO: 852685 - protein, 17 aa, Mycobacterium
REALAQQGFGVLTEIDV

SEQ ID NO: 852686 - protein, 23 aa, Mycobacterium
REALEIMLRIWTEDQPWEHRGKY

SEQ ID NO: 852687 - protein, 18 aa, Mycobacterium
REALFDAFRRGEIATLVV

SEQ ID NO: 852688 - protein, 21 aa, Mycobacterium
REALGLLRRAGQPVVSPLAAP

SEQ ID NO: 852689 - protein, 17 aa, Mycobacterium
REALKDLLVLLESGRPA

SEQ ID NO: 852690 - protein, 18 aa, Mycobacterium
REALLGETGQAFRYAQLR

SEQ ID NO: 852691 - protein, 23 aa, Mycobacterium
REALLLTQLLGLSYTDAAAVCGC

SEQ ID NO: 852692 - protein, 22 aa, Mycobacterium
REALLTILPSLDDSGWAQASGC

SEQ ID NO: 852693 - protein, 26 aa, Mycobacterium
REALPHAILIADRFHLVKKANDMVDA

SEQ ID NO: 852694 - protein, 17 aa, Mycobacterium
REALQADPLAPGALARL

SEQ ID NO: 852695 - protein, 25 aa, Mycobacterium
REALRMGLVWRVCEPAALLPEARRH

SEQ ID NO: 852696 - protein, 17 aa, Mycobacterium
REALTHRLARKIIPDLI

SEQ ID NO: 852697 - protein, 18 aa, Mycobacterium
REAMARLDRHFTITVVDC

SEQ ID NO: 852698 - protein, 20 aa, Mycobacterium
REAMGELPFGFNVFVPTPDQ

SEQ ID NO: 852699 - protein, 20 aa, Mycobacterium
REAMPKLLAMYEAGLIKLDE

SEQ ID NO: 852700 - protein, 24 aa, Mycobacterium
REAMRRRAARLRAQRAHVISARLR

SEQ ID NO: 852701 - protein, 21 aa, Mycobacterium
REARLGSVGKLLPGLEGKIAD

SEQ ID NO: 852702 - protein, 40 aa, Mycobacterium
REARLQQPLYVMPTKGIFTSNFGYRWGVLHAGIDLANSIG

SEQ ID NO: 852703 - protein, 41 aa, Mycobacterium; identical to SEQ ID NO: 117055

SEQ ID NO: 852704 - protein, 36 aa, Mycobacterium
REARLREAPILALGIWRWGLGEIPYRQLEHRLGPWV

SEQ ID NO: 852705 - protein, 23 aa, Mycobacterium
REARLWFSVWDDRAGDPSRLRAA

SEQ ID NO: 852706 - protein, 23 aa, Mycobacterium
REARWLMVVVNYRAARWSDVVKL

SEQ ID NO: 852707 - protein, 21 aa, Mycobacterium
REASFFVDRLSQEDMPLAGLV

SEQ ID NO: 852708 - protein, 21 aa, Mycobacterium
REASFFVDRLSQEGMPLAGLV

SEQ ID NO: 852709 - protein, 20 aa, Mycobacterium
REASFFVDRLTQEGMPLAGL

SEQ ID NO: 852710 - protein, 20 aa, Mycobacterium
REATFFVERLTQEGMPLAGL

SEQ ID NO: 852711 - protein, 24 aa, Mycobacterium
REATMPVLAPGSTPLRVLHISDLH

SEQ ID NO: 852712 - protein, 20 aa, Mycobacterium
REATRQAWFAGRRPQRRGIM

SEQ ID NO: 852713 - protein, 18 aa, Mycobacterium
REAVLRLDRHFAISVIDC

SEQ ID NO: 852714 - protein, 20 aa, Mycobacterium
REAVRLIAAAKRPVLYVGGG

SEQ ID NO: 852715 - protein, 29 aa, Mycobacterium
REAVSRYWAIDEIRPAFIHVHLAEVLSRI

SEQ ID NO: 852716 - protein, 19 aa, Mycobacterium
REAWAVIAPMLAGATPVGP

SEQ ID NO: 852717 - protein, 27 aa, Mycobacterium
RECAARALLLPRRTPGRRSPLWQQRQR

SEQ ID NO: 852718 - protein, 20 aa, Mycobacterium
RECHGLQCGFCTPGFVMSIT

SEQ ID NO: 852719 - protein, 20 aa, Mycobacterium
RECHGLQCGFCTPGFVMSLT

SEQ ID NO: 852720 - protein, 19 aa, Mycobacterium
RECHHDHVGLAVFPELTLS

SEQ ID NO: 852721 - protein, 23 aa, Mycobacterium
RECIATWTGIPIGYVAVYVVSEI

SEQ ID NO: 852722 - protein, 19 aa, Mycobacterium
RECLTVGSSWRFVEEQFGG

SEQ ID NO: 852723 - protein, 22 aa, Mycobacterium
RECTGFIFNRVWAAIKRESLAV

SEQ ID NO: 852724 - protein, 18 aa, Mycobacterium
RECVDARRLAPTGVGIPA

SEQ ID NO: 852725 - protein, 25 aa, Mycobacterium
REDAAVLYWAFVNAGKPVPLAAAQM

SEQ ID NO: 852726 - protein, 18 aa, Mycobacterium
REDALQDVWLALRQYRTR

SEQ ID NO: 852727 - protein, 17 aa, Mycobacterium
REDFADAVAWVARNLPS

SEQ ID NO: 852728 - protein, 17 aa, Mycobacterium
REDFADAVAWVARSLPT

SEQ ID NO: 852729 - protein, 32 aa, Mycobacterium
REDGEPLFMAGLWSVWKPAKDASPLLSCTIIT

SEQ ID NO: 852730 - protein, 32 aa, Mycobacterium
REDGEPLFMAGLWSVWKPAKEGSPLLSCTIIT

SEQ ID NO: 852731 - protein, 37 aa, Mycobacterium
REDGRTWWEWHQIALDRVGWPFSLAYPNLATHNHFAL

SEQ ID NO: 852732 - protein, 19 aa, Mycobacterium
REDGSWVNSNSLFINVTCW

SEQ ID NO: 852733 - protein, 18 aa, Mycobacterium
REDHLAFFVLDVVAELER

SEQ ID NO: 852734 - protein, 21 aa, Mycobacterium
REDILRVYPALDPGAVHVIRN

SEQ ID NO: 852735 - protein, 27 aa, Mycobacterium
REDLTGYLPALWDLTPDVRVYVEAVHR

SEQ ID NO: 852736 - protein, 17 aa, Mycobacterium
REDLVKLWLAEEGDIDA

SEQ ID NO: 852737 - protein, 25 aa, Mycobacterium
REDMAALRVLPPREYVAATQAIPEV

SEQ ID NO: 852738 - protein, 20 aa, Mycobacterium
REDPIYRRITQRWLEHPEEL

SEQ ID NO: 852739 - protein, 25 aa, Mycobacterium
REDRGFFCFPEVDIHIPFTPGMAAL

SEQ ID NO: 852740 - protein, 20 aa, Mycobacterium
REDVLALLGALLRELHRIGV

SEQ ID NO: 852741 - protein, 19 aa, Mycobacterium
REDWAVHVALWQTDELVAG

SEQ ID NO: 852742 - protein, 23 aa, Mycobacterium
REDWELFSTWAQDIFKIVSFDID

SEQ ID NO: 852743 - protein, 19 aa, Mycobacterium
REDWPSALRQRGFDAGQPT

SEQ ID NO: 852744 - protein, 17 aa, Mycobacterium
REDWSVARRLTGNFLST

SEQ ID NO: 852745 - protein, 31 aa, Mycobacterium
REEAAYPLGKGWRPKVWPPVRRIDGAYGDRN

SEQ ID NO: 852746 - protein, 29 aa, Mycobacterium
REEEAVLLHGLPVRKLWGIGPVAEDRLHR

SEQ ID NO: 852747 - protein, 27 aa, Mycobacterium
REEEQRLLHGLPVRRLWGIGPVAEEKL

SEQ ID NO: 852748 - protein, 23 aa, Mycobacterium
REEGWPQFADRLLELARAAQPGS

SEQ ID NO: 852749 - protein, 17 aa, Mycobacterium
REEIFGPVLTVLRYRDE

SEQ ID NO: 852750 - protein, 17 aa, Mycobacterium
REEIVSGRWAIGARIPT

SEQ ID NO: 852751 - protein, 32 aa, Mycobacterium
REELDAFVVRRLNLPFRDVDWTEWDDLLRRVH

SEQ ID NO: 852752 - protein, 21 aa, Mycobacterium
REELFDAFRRGEVSTLVVSKV

SEQ ID NO: 852753 - protein, 19 aa, Mycobacterium
REELFDGFRRGEVNTLVVS

SEQ ID NO: 852754 - protein, 26 aa, Mycobacterium
REELGALLLQVLFQARIAQDAPRRPF

SEQ ID NO: 852755 - protein, 18 aa, Mycobacterium
REELGDVLLQVLFHARIA

SEQ ID NO: 852756 - protein, 29 aa, Mycobacterium
REELGLPEMGLVGRQLWAQSGLTPQDIQT

SEQ ID NO: 852757 - protein, 17 aa, Mycobacterium
REELIREVGAPAPSPTA

SEQ ID NO: 852758 - protein, 22 aa, Mycobacterium
REELPVQLVVRSVGYRGVPTPG

SEQ ID NO: 852759 - protein, 24 aa, Mycobacterium
REELRMMPAFLLAMGLKVGRGMGV

SEQ ID NO: 852760 - protein, 27 aa, Mycobacterium
REELRRFIRRWLGGALLAQPRATAAPS

SEQ ID NO: 852761 - protein, 25 aa, Mycobacterium
REELRRFLRRWLGSAILAQASPSRI

SEQ ID NO: 852762 - protein, 23 aa, Mycobacterium
REELVKIGLAQRTLIGIPGERKA

SEQ ID NO: 852763 - protein, 23 aa, Mycobacterium
REERDLIYPVIVERAPGFGEYQQ

SEQ ID NO: 852764 - protein, 23 aa, Mycobacterium
REERFPVPEWIVVGAGTGGTSAT

SEQ ID NO: 852765 - protein, 23 aa, Mycobacterium
REETPWPVIQEAAKVGLYSPDLF

SEQ ID NO: 852766 - protein, 23 aa, Mycobacterium
REETPWPVIQEAAKVGLYSPELF

SEQ ID NO: 852767 - protein, 25 aa, Mycobacterium
REEVEPLEVLFPGCEFLPLNDERRK

SEQ ID NO: 852768 - protein, 25 aa, Mycobacterium
REEVEPLEVLFPGCEFLPLSDERRR

SEQ ID NO: 852769 - protein, 20 aa, Mycobacterium
REEVEPLEVVFPGCEFLPLN

SEQ ID NO: 852770 - protein, 20 aa, Mycobacterium
REEWLAARRDLIDRTNRVRE

SEQ ID NO: 852771 - protein, 22 aa, Mycobacterium
REEWPSAIRRLVSGQISLLLRR

SEQ ID NO: 852772 - protein, 20 aa, Mycobacterium
REEYLIASVARRLQAKSKEM

SEQ ID NO: 852773 - protein, 20 aa, Mycobacterium
REEYLLASVARRLQAKSKEM

SEQ ID NO: 852774 - protein, 25 aa, Mycobacterium
REFADARRYLSRLSAEDYESLSALM

SEQ ID NO: 852775 - protein, 24 aa, Mycobacterium
REFAHPFIAMCPVSLRADDDTTIG

SEQ ID NO: 852776 - protein, 18 aa, Mycobacterium
REFARLFREARALEYEKF

SEQ ID NO: 852777 - protein, 17 aa, Mycobacterium
REFATPARKVRATPTRR

SEQ ID NO: 852778 - protein, 23 aa, Mycobacterium
REFAVPPLLGALPLAYTAPQGLT

SEQ ID NO: 852779 - protein, 18 aa, Mycobacterium
REFCSTTYGVTFPLLAKT

SEQ ID NO: 852780 - protein, 19 aa, Mycobacterium
REFDILVCTTIVETGLDIS

SEQ ID NO: 852781 - protein, 18 aa, Mycobacterium
REFFWRGEHALASSGIDL

SEQ ID NO: 852782 - protein, 22 aa, Mycobacterium
REFGPRGITINNVQPGPIGTDM

SEQ ID NO: 852783 - protein, 17 aa, Mycobacterium
REFGVAMPALAVLPRSV

SEQ ID NO: 852784 - protein, 17 aa, Mycobacterium
REFIGNQAMFFVATAPS

SEQ ID NO: 852785 - protein, 17 aa, Mycobacterium
REFIQGQLYPQLAKPLR

SEQ ID NO: 852786 - protein, 18 aa, Mycobacterium
REFIYWQHVGQLTADALS

SEQ ID NO: 852787 - protein, 17 aa, Mycobacterium
REFKPLVLVAGYSAYPR

SEQ ID NO: 852788 - protein, 18 aa, Mycobacterium
REFPSFQAMLDLTIAAAP

SEQ ID NO: 852789 - protein, 17 aa, Mycobacterium
REFPSFQAMLDVTTAAA

SEQ ID NO: 852790 - protein, 27 aa, Mycobacterium
REFPVKFDVWWFRLPHKEDTEYSFLPR

SEQ ID NO: 852791 - protein, 21 aa, Mycobacterium
REFQIVFSSLFPGGEGRLRLT

SEQ ID NO: 852792 - protein, 22 aa, Mycobacterium
REFREVFTVLFPGGEGRLRLTD

SEQ ID NO: 852793 - protein, 28 aa, Mycobacterium
REFSVGTDIWWFRAPRVPGIGEELVPRF

SEQ ID NO: 852794 - protein, 17 aa, Mycobacterium
REFTHMITALFLDGVKA

SEQ ID NO: 852795 - protein, 19 aa, Mycobacterium
REFVGQFLISGAGALHIPS

SEQ ID NO: 852796 - protein, 17 aa, Mycobacterium
REFVGTTLNLPTPEQAA

SEQ ID NO: 852797 - protein, 23 aa, Mycobacterium
REGEKIMLLFESGNFDESVFEDP

SEQ ID NO: 852798 - protein, 17 aa, Mycobacterium
REGFRRMIAARHPEIPL

SEQ ID NO: 852799 - protein, 19 aa, Mycobacterium
REGFTPPSPRYQTGVLAKY

SEQ ID NO: 852800 - protein, 17 aa, Mycobacterium
REGGLVLSEDYTRFLRP

SEQ ID NO: 852801 - protein, 19 aa, Mycobacterium
REGGPSAWLLRLIETQRER

SEQ ID NO: 852802 - protein, 25 aa, Mycobacterium
REGGRLLEFDLAGGPPRVLLENVPS

SEQ ID NO: 852803 - protein, 25 aa, Mycobacterium
REGGRLLELDLAGGPPRVLLDNVPS

SEQ ID NO: 852804 - protein, 23 aa, Mycobacterium
REGIGRFGMGLPSASISQCKRVE

SEQ ID NO: 852805 - protein, 23 aa, Mycobacterium
REGKTVLFLGRYDEPRKGMDVLM

SEQ ID NO: 852806 - protein, 17 aa, Mycobacterium
REGLDTVFQVLRAPHTE

SEQ ID NO: 852807 - protein, 18 aa, Mycobacterium
REGLIRLLTEGGHEVAAA

SEQ ID NO: 852808 - protein, 18 aa, Mycobacterium
REGLQRLLPGPNAAVKAA

SEQ ID NO: 852809 - protein, 22 aa, Mycobacterium
REGLRQLFSLPEGYEVILGNGG

SEQ ID NO: 852810 - protein, 26 aa, Mycobacterium
REGPDALVVVLLPDGGRGYLSKIFND

SEQ ID NO: 852811 - protein, 28 aa, Mycobacterium
REGPLNFYSLYRAHDLHFIVYSAMFEGQ

SEQ ID NO: 852812 - protein, 34 aa, Mycobacterium
REGPLNFYSLYRAHDLHFIVYSAMLEGRLQVALQ

SEQ ID NO: 852813 - protein, 27 aa, Mycobacterium
REGQKLRIVKYLAYGWSSMRSRPALRD

SEQ ID NO: 852814 - protein, 19 aa, Mycobacterium
REGRKPGASVWFKSRPRPA

SEQ ID NO: 852815 - protein, 17 aa, Mycobacterium
REGRPEKAFLAVRTPEG

SEQ ID NO: 852816 - protein, 18 aa, Mycobacterium
REGRTVLFLGRYDEPRKG

SEQ ID NO: 852817 - protein, 20 aa, Mycobacterium
REGRWTLLDYIDVVVHIQHQ

SEQ ID NO: 852818 - protein, 20 aa, Mycobacterium
REGRWTLLDYVDIVVHVQHQ

SEQ ID NO: 852819 - protein, 24 aa, Mycobacterium
REGRYKFHYVNTAPLRAIVDRWLT

SEQ ID NO: 852820 - protein, 19 aa, Mycobacterium
REGSPVKRVPLARSLRAAQ

SEQ ID NO: 852821 - protein, 17 aa, Mycobacterium
REGSWNQARIDPALPDR

SEQ ID NO: 852822 - protein, 26 aa, Mycobacterium
REGVHTLPVLYALRETGPDADRLREL

SEQ ID NO: 852823 - protein, 26 aa, Mycobacterium
REGVKVASFALAPKPDLIARLKEAGV

SEQ ID NO: 852824 - protein, 36 aa, Mycobacterium
REGVRQVILPLWNAWSFLQLYAPKPGTWRTDSKQVL

SEQ ID NO: 852825 - protein, 32 aa, Mycobacterium
REGVRQVLLPFWNAYSFLALYAPKVGSWRTDS

SEQ ID NO: 852826 - protein, 32 aa, Mycobacterium
REGVRQVLLPFWNAYSFLALYAPKVGTWRTDS

SEQ ID NO: 852827 - protein, 34 aa, Mycobacterium
REGVRQVLLPLWNAYSFLALYAPEKGTWRTDSKN

SEQ ID NO: 852828 - protein, 32 aa, Mycobacterium
REGVRQVLLPLWNAYSFLALYAPKVGSWRTDS

SEQ ID NO: 852829 - protein, 35 aa, Mycobacterium
REGVRQVLLPLWNAYTFLALYAPEKGTWRTDSTHV

SEQ ID NO: 852830 - protein, 18 aa, Mycobacterium
REGWLYCCAVLDAFSRRI

SEQ ID NO: 852831 - protein, 22 aa, Mycobacterium
REGYDMFVGMLEALKEESVGFL

SEQ ID NO: 852832 - protein, 20 aa, Mycobacterium
REGYECGLTLTYNDIKEGDV

SEQ ID NO: 852833 - protein, 27 aa, Mycobacterium
REHAVWALMDFGFRVVISSRFGDIFRG

SEQ ID NO: 852834 - protein, 27 aa, Mycobacterium
REHAVWALMDYGFRVVISSRFGDIFRG

SEQ ID NO: 852835 - protein, 18 aa, Mycobacterium
REHAWGFIDSVPATGLDA

SEQ ID NO: 852836 - protein, 18 aa, Mycobacterium
REHDSAMDAFFYGDDPPS

SEQ ID NO: 852837 - protein, 24 aa, Mycobacterium
REHGIASNTLWPRTLVATAAVQNL

SEQ ID NO: 852838 - protein, 17 aa, Mycobacterium
REHGVRVLVIRPGQVRT

SEQ ID NO: 852839 - protein, 21 aa, Mycobacterium
REHLQSWFHLADVPAAVVAAD

SEQ ID NO: 852840 - protein, 18 aa, Mycobacterium
REHLYEMDYLKEGIGLRA

SEQ ID NO: 852841 - protein, 17 aa, Mycobacterium
REHPGILHLYLHTMEMS

SEQ ID NO: 852842 - protein, 17 aa, Mycobacterium
REHVFKKTWLYVGRVER

SEQ ID NO: 852843 - protein, 18 aa, Mycobacterium
REHWFDSGDLVEPVLASC

SEQ ID NO: 852844 - protein, 25 aa, Mycobacterium
REHYGLPALRDWLRRQRDERGGAPE

SEQ ID NO: 852845 - protein, 26 aa, Mycobacterium
REIAELLAEPLWKIVQQQPSAARFPD

SEQ ID NO: 852846 - protein, 18 aa, Mycobacterium
REIAGELVALYAARQAAP

SEQ ID NO: 852847 - protein, 25 aa, Mycobacterium
REIARILIQQLLESGWRPDDSVILA

SEQ ID NO: 852848 - protein, 28 aa, Mycobacterium
REIATALNAPLAVLVVRKLGVPGHEEYA

SEQ ID NO: 852849 - protein, 29 aa, Mycobacterium
REICEFPFSRLYEKLGLPAAAQDNDNELF

SEQ ID NO: 852850 - protein, 25 aa, Mycobacterium
REIDATVCWFTNGPLRAGDRLALKQ

SEQ ID NO: 852851 - protein, 19 aa, Mycobacterium
REIDFVLARGARLVHVRPA

SEQ ID NO: 852852 - protein, 20 aa, Mycobacterium
REIDLRANWMKHLHHANWKM

SEQ ID NO: 852853 - protein, 27 aa, Mycobacterium
REIEKPLHIHRILLQRSWIAIMRGDFA

SEQ ID NO: 852854 - protein, 17 aa, Mycobacterium
REIERFPFVPADPQRLE

SEQ ID NO: 852855 - protein, 18 aa, Mycobacterium
REIEVLRLLAAGLSNNKI

SEQ ID NO: 852856 - protein, 27 aa, Mycobacterium
REIGAKGWFGLNWPREYGGLGLGAIHL

SEQ ID NO: 852857 - protein, 17 aa, Mycobacterium
REIGKAVGMLMLLHDMT

SEQ ID NO: 852858 - protein, 17 aa, Mycobacterium
REIGRMAGLSEKAVRDL

SEQ ID NO: 852859 - protein, 17 aa, Mycobacterium
REIGVDLMFSHIKESLH

SEQ ID NO: 852860 - protein, 17 aa, Mycobacterium
REIGVDLMFTHIKESLH

SEQ ID NO: 852861 - protein, 18 aa, Mycobacterium
REIGYMFGQYKRITNRYE

SEQ ID NO: 852862 - protein, 27 aa, Mycobacterium
REIGYNVVIYPVTTLRLAMYAVEAGLR

SEQ ID NO: 852863 - protein, 18 aa, Mycobacterium
REILAKVPTPNDAVLIAV

SEQ ID NO: 852864 - protein, 18 aa, Mycobacterium
REILQRPLVKSLVLQLTA

SEQ ID NO: 852865 - protein, 19 aa, Mycobacterium
REILVPFVSAIVTSISLAD

SEQ ID NO: 852866 - protein, 24 aa, Mycobacterium
REIPQPVRSLVMLALITPERPSQL

SEQ ID NO: 852867 - protein, 28 aa, Mycobacterium
REIRAGCVWINDHIPIISEMPHGGFGAS

SEQ ID NO: 852868 - protein, 23 aa, Mycobacterium
REIRDIVAYLRVLDNPGDAVSMR

SEQ ID NO: 852869 - protein, 32 aa, Mycobacterium
REIRDLLDYVRPRGIIYHRSLGARFADVLPPA

SEQ ID NO: 852870 - protein, 19 aa, Mycobacterium
REIRLLSRFTGANPHVPII

SEQ ID NO: 852871 - protein, 20 aa, Mycobacterium
REIRLLSRFTSANPTVPIVG

SEQ ID NO: 852872 - protein, 17 aa, Mycobacterium
REIVLTLFESITGLRMN

SEQ ID NO: 852873 - protein, 25 aa, Mycobacterium
REIYRNPWMVLREDDIRRPDGSTGL

SEQ ID NO: 852874 - protein, 19 aa, Mycobacterium
REKDFWDRVVVITSKDANL

SEQ ID NO: 852875 - protein, 17 aa, Mycobacterium
REKLCWRNAAGLYGIEI

SEQ ID NO: 852876 - protein, 24 aa, Mycobacterium
REKLTPRYALGCKRPSFHNEYLKT

SEQ ID NO: 852877 - protein, 19 aa, Mycobacterium
REKNLLEELWSSGKAPWKC

SEQ ID NO: 852878 - protein, 40 aa, Mycobacterium
REKPALMQRFYTTSWRFAPFLWQEIEDGILPALYAAVTPQ

SEQ ID NO: 852879 - protein, 36 aa, Mycobacterium
REKPALMQRLYQASWRLTPFFWQEIDEGILPALYAA

SEQ ID NO: 852880 - protein, 21 aa, Mycobacterium
REKVVLMSFPDEAAFRDWAQS

SEQ ID NO: 852881 - protein, 24 aa, Mycobacterium
RELADPISYISLWLADAGETPQQA

SEQ ID NO: 852882 - protein, 28 aa, Mycobacterium
RELAEFKALFQMKFYAVALLRSREVMPS

SEQ ID NO: 852883 - protein, 17 aa, Mycobacterium
RELALRQALFRDVLGVR

SEQ ID NO: 852884 - protein, 17 aa, Mycobacterium
RELAPSAFVFMAEEAAK

SEQ ID NO: 852885 - protein, 20 aa, Mycobacterium
RELAVFWTARTVGCSWCVDF

SEQ ID NO: 852886 - protein, 20 aa, Mycobacterium
RELDLWLHRASVALVAVDAD

SEQ ID NO: 852887 - protein, 27 aa, Mycobacterium
RELDVTPGALYWHFANKQELLGAVADH

SEQ ID NO: 852888 - protein, 23 aa, Mycobacterium
RELEERLRYLRELDERRAAVLSS

SEQ ID NO: 852889 - protein, 21 aa, Mycobacterium
RELEICYAAIALVTDLDAGVE

SEQ ID NO: 852890 - protein, 21 aa, Mycobacterium
RELEICYAAIALVTDLDAGVS

SEQ ID NO: 852891 - protein, 18 aa, Mycobacterium
RELELCYAAIALVTDVDA

SEQ ID NO: 852892 - protein, 19 aa, Mycobacterium
RELELRWAGLRAHNRWLSD

SEQ ID NO: 852893 - protein, 24 aa, Mycobacterium
RELFAAIVVLMRWGDEHLPHPDGP

SEQ ID NO: 852894 - protein, 17 aa, Mycobacterium
RELFADFRHPTLVGLPD

SEQ ID NO: 852895 - protein, 17 aa, Mycobacterium
RELFARNLETMFFMSQA

SEQ ID NO: 852896 - protein, 21 aa, Mycobacterium
RELFLDPRSPQLYRDWKLLTA

SEQ ID NO: 852897 - protein, 17 aa, Mycobacterium
RELGILTDRDRIARDLH

SEQ ID NO: 852898 - protein, 18 aa, Mycobacterium
RELGITEFMLLQTAVAVV

SEQ ID NO: 852899 - protein, 32 aa, Mycobacterium
RELGKPLYIHRILLQRSWLSIFRGAFDEATQL

SEQ ID NO: 852900 - protein, 20 aa, Mycobacterium
RELGLPLPDAATRKALLESL

SEQ ID NO: 852901 - protein, 32 aa, Mycobacterium
RELGQPIKPMRWLVRGIWPERSAGVLGGDKKA

SEQ ID NO: 852902 - protein, 27 aa, Mycobacterium
RELGQSVLWHRLLITGDPITDELVTQL

SEQ ID NO: 852903 - protein, 25 aa, Mycobacterium
RELHIVDELPRRGIGKIDRAALVRR

SEQ ID NO: 852904 - protein, 23 aa, Mycobacterium
RELHVLVAALQQWGDRHLPRPAG

SEQ ID NO: 852905 - protein, 20 aa, Mycobacterium
RELHVVDELPRRGIGKIDRR

SEQ ID NO: 852906 - protein, 20 aa, Mycobacterium
RELIARIRAVLRRGGDDDAE

SEQ ID NO: 852907 - protein, 19 aa, Mycobacterium
RELIARIRAVLRRGGDDDS

SEQ ID NO: 852908 - protein, 20 aa, Mycobacterium
RELIGRNVLPGRWSFQVVED

SEQ ID NO: 852909 - protein, 17 aa, Mycobacterium
RELIPLRAPVTPAARSL

SEQ ID NO: 852910 - protein, 17 aa, Mycobacterium
RELKYSSPQTDFQRLQR

SEQ ID NO: 852911 - protein, 17 aa, Mycobacterium
RELLAGVARDRGFIRGE

SEQ ID NO: 852912 - protein, 17 aa, Mycobacterium
RELLALAALKNGLTRRD

SEQ ID NO: 852913 - protein, 24 aa, Mycobacterium
RELLDVALSHPIKLIANALGVPPD

SEQ ID NO: 852914 - protein, 19 aa, Mycobacterium
RELLKTYARIRGRWHAALP

SEQ ID NO: 852915 - protein, 21 aa, Mycobacterium
RELLQMQRPLADLPPQTTAQR

SEQ ID NO: 852916 - protein, 25 aa, Mycobacterium
RELLQPLPSLRLQIGAPSVLRKVDR

SEQ ID NO: 852917 - protein, 23 aa, Mycobacterium
RELLRLAMTAHRKTFHLVSSTFI

SEQ ID NO: 852918 - protein, 28 aa, Mycobacterium
RELNFGCVWVNCHIPLVAEMPHGGFKYS

SEQ ID NO: 852919 - protein, 24 aa, Mycobacterium
RELNPVSRLTTALALAEWIEEHEP

SEQ ID NO: 852920 - protein, 17 aa, Mycobacterium
RELPHSPYLAAVAGRKP

SEQ ID NO: 852921 - protein, 25 aa, Mycobacterium
RELPKRRPVPLRLRDWREVYEDFDN

SEQ ID NO: 852922 - protein, 18 aa, Mycobacterium
RELPQIPVATRLSGLEPL

SEQ ID NO: 852923 - protein, 24 aa, Mycobacterium
RELPQVIDVYFLAGADDYILHVAA

SEQ ID NO: 852924 - protein, 18 aa, Mycobacterium
RELRDKKFMKIVSLAPEV

SEQ ID NO: 852925 - protein, 17 aa, Mycobacterium
RELRDRLSAPRVVWVMV

SEQ ID NO: 852926 - protein, 25 aa, Mycobacterium
RELRDWLLIRAWEAGVTPIGVQPVP

SEQ ID NO: 852927 - protein, 25 aa, Mycobacterium
RELRDWLLMRAWEAGVTPIGVQPVA

SEQ ID NO: 852928 - protein, 25 aa, Mycobacterium
RELRLERIFVLTFEVDFFAKHGFVE

SEQ ID NO: 852929 - protein, 26 aa, Mycobacterium
RELRRQVLTLWQTALIRLSRLQITDE

SEQ ID NO: 852930 - protein, 33 aa, Mycobacterium
RELSGAIRLIYPRESLWRPPVLTMSAVEGTGLP

SEQ ID NO: 852931 - protein, 35 aa, Mycobacterium
RELSGAIRLIYPRETIWWPPVLTMSAVEGTGLTQL

SEQ ID NO: 852932 - protein, 33 aa, Mycobacterium
RELSGAIRLIYPRETLWRPPVLTMSAAEGTGLD

SEQ ID NO: 852933 - protein, 33 aa, Mycobacterium
RELSGAIRLIYPRETLWRPPVLTMSALTGAGLS

SEQ ID NO: 852934 - protein, 24 aa, Mycobacterium
RELTDLIRDVPLPQTPDTLRMQPW

SEQ ID NO: 852935 - protein, 18 aa, Mycobacterium
RELTSDWDYAVVGGLTLG

SEQ ID NO: 852936 - protein, 26 aa, Mycobacterium
RELVARIRAMLRRPRLLQSPPTGADR

SEQ ID NO: 852937 - protein, 25 aa, Mycobacterium
RELVARIRAMLRRPRTVATPTSAAT

SEQ ID NO: 852938 - protein, 19 aa, Mycobacterium
RELVEHFILEEQWGRFLGR

SEQ ID NO: 852939 - protein, 20 aa, Mycobacterium
RELVKQYSDFIAWPVRMDVE

SEQ ID NO: 852940 - protein, 21 aa, Mycobacterium
RELVKRHLPIFLRAAGRNYIG

SEQ ID NO: 852941 - protein, 25 aa, Mycobacterium
RELVLDSYLLRAMAIAGWAPALTEC

SEQ ID NO: 852942 - protein, 21 aa, Mycobacterium
RELVVLHELAHHLCPSDPPHG

SEQ ID NO: 852943 - protein, 18 aa, Mycobacterium
RELVYRHKLVVLKGVHPT

SEQ ID NO: 852944 - protein, 19 aa, Mycobacterium
RELWQLEFDALRRVGGCWV

SEQ ID NO: 852945 - protein, 26 aa, Mycobacterium
RELYGKPQFWPLWEAAVEAGLPVAVH

SEQ ID NO: 852946 - protein, 24 aa, Mycobacterium
RELYRRGAYLPPYYRDMLRQRVAP

SEQ ID NO: 852947 - protein, 30 aa, Mycobacterium
REMAYEGRIDWAFAELLALGSLIAEGKLVR

SEQ ID NO: 852948 - protein, 34 aa, Mycobacterium
REMDGHFPKPWALGIHNVWLRIVPTTITGRRLGG

SEQ ID NO: 852949 - protein, 18 aa, Mycobacterium
REMFPGTLIMYGAHERHL

SEQ ID NO: 852950 - protein, 23 aa, Mycobacterium
REMGLTLVGFLRGATMNIYAGAE

SEQ ID NO: 852951 - protein, 18 aa, Mycobacterium
REMIRYVRPPWLRRWVRD

SEQ ID NO: 852952 - protein, 19 aa, Mycobacterium
REMLRPTYVFAAVDHTGAD

SEQ ID NO: 852953 - protein, 25 aa, Mycobacterium
RENLEAFLRIMVFDQKLITPELVEE

SEQ ID NO: 852954 - protein, 23 aa, Mycobacterium
RENQDVLNSWIAEGAPRKLELEA

SEQ ID NO: 852955 - protein, 18 aa, Mycobacterium
RENRALLPTFLEEALRLE

SEQ ID NO: 852956 - protein, 17 aa, Mycobacterium
RENRHLGFGAGVHRCLG

SEQ ID NO: 852957 - protein, 24 aa, Mycobacterium
RENVLIVHWHDLGRYLGAYGHRDV

SEQ ID NO: 852958 - protein, 25 aa, Mycobacterium
RENVQFHWIRIEDVPEIWDRLASVG

SEQ ID NO: 852959 - protein, 23 aa, Mycobacterium
RENVQFHWLRIEDVPEIWRRLES

SEQ ID NO: 852960 - protein, 17 aa, Mycobacterium
REPAQVLHARWGGELYW

SEQ ID NO: 852961 - protein, 26 aa, Mycobacterium
REPDDGFVNVIYRWAKSGDLSAALAA

SEQ ID NO: 852962 - protein, 24 aa, Mycobacterium
REPDEVPELLRDALIAEGVAPDAI

SEQ ID NO: 852963 - protein, 23 aa, Mycobacterium
REPDEWLAAIAALPLVYPPGERF

SEQ ID NO: 852964 - protein, 17 aa, Mycobacterium
REPGCLAVAALLEAYRV

SEQ ID NO: 852965 - protein, 22 aa, Mycobacterium
REPGDVLQPQWLARAVRAYIRD

SEQ ID NO: 852966 - protein, 24 aa, Mycobacterium
REPGRLRIALSTKIPTPLPVRVGQ

SEQ ID NO: 852967 - protein, 18 aa, Mycobacterium
REPGYHFLAVLTLSGHRG

SEQ ID NO: 852968 - protein, 32 aa, Mycobacterium
REPHPVWDFLFTYYSLRPRQLRRWHPGYGIVL

SEQ ID NO: 852969 - protein, 18 aa, Mycobacterium
REPLEVPGLLDVQTDSFE

SEQ ID NO: 852970 - protein, 25 aa, Mycobacterium
REPLVPPAPQLPYQVAAAQAAVMTV

SEQ ID NO: 852971 - protein, 27 aa, Mycobacterium
REPPRQVLIVPLLQQGAAPTGFLVAGL

SEQ ID NO: 852972 - protein, 18 aa, Mycobacterium
REPRLCISSGPLGGGVGA

SEQ ID NO: 852973 - protein, 20 aa, Mycobacterium
REPRPMVYSGLYPVDGSDYP

SEQ ID NO: 852974 - protein, 27 aa, Mycobacterium
REPRRAELAFLYSTPAYRRQLEYFGLE

SEQ ID NO: 852975 - protein, 27 aa, Mycobacterium
REPSTHTIFVLGRPITAGAFGAVAREV

SEQ ID NO: 852976 - protein, 31 aa, Mycobacterium; identical to SEQ ID NO: 122062

SEQ ID NO: 852977 - protein, 31 aa, Mycobacterium
REQAAYPLGKGFRPKVWPPVRRIDGAYGDRN

SEQ ID NO: 852978 - protein, 18 aa, Mycobacterium
REQAHFEGPPPWNIGEPQ

SEQ ID NO: 852979 - protein, 17 aa, Mycobacterium
REQAHFLSPIRTAIDMG

SEQ ID NO: 852980 - protein, 32 aa, Mycobacterium
REQDALERLRRLGLPFLFYVDAAQGRASVLYR

SEQ ID NO: 852981 - protein, 17 aa, Mycobacterium
REQFQLNVVPTPAVPEA

SEQ ID NO: 852982 - protein, 26 aa, Mycobacterium
REQFVEDLLSILPPGLAADGRVHLCS

SEQ ID NO: 852983 - protein, 17 aa, Mycobacterium
REQITFNDGWFVQGLKG

SEQ ID NO: 852984 - protein, 23 aa, Mycobacterium
REQKTRLKRLLAEAELETDALRE

SEQ ID NO: 852985 - protein, 23 aa, Mycobacterium
REQLFYDDLYSYNRFRPSRLGAG

SEQ ID NO: 852986 - protein, 31 aa, Mycobacterium
REQLHAELASLLRFILELLGDYGLEDFYLEL

SEQ ID NO: 852987 - protein, 22 aa, Mycobacterium
REQLIELLSRQAALFNDAPLHV

SEQ ID NO: 852988 - protein, 24 aa, Mycobacterium
REQNLRFNWLKDVDKKRPFYFGAL

SEQ ID NO: 852989 - protein, 17 aa, Mycobacterium
REQPWCDGTLATAGPSY

SEQ ID NO: 852990 - protein, 25 aa, Mycobacterium
REQQVDWTWQLVRDAVLDRVLSHPE

SEQ ID NO: 852991 - protein, 23 aa, Mycobacterium
REQRRMRRCQRRAPGQRQLRLLR

SEQ ID NO: 852992 - protein, 23 aa, Mycobacterium
REQRYGRVLNTCSAAGILGAERM

SEQ ID NO: 852993 - protein, 20 aa, Mycobacterium
REQSRPELGYRLLQRLGADV

SEQ ID NO: 852994 - protein, 31 aa, Mycobacterium
REQSRPELGYRLLQRLGADVADYGFVETSAK

SEQ ID NO: 852995 - protein, 31 aa, Mycobacterium
REQSRPELGYRLLQRLGADVAEYGFVETAPK

SEQ ID NO: 852996 - protein, 18 aa, Mycobacterium
REQWLPRMATGEVIGCFG

SEQ ID NO: 852997 - protein, 24 aa, Mycobacterium
RERANSIVKLWTSSETIAPIAGTR

SEQ ID NO: 852998 - protein, 26 aa, Mycobacterium
RERAQAIGLFRYQLICPALEQGLSTK

SEQ ID NO: 852999 - protein, 26 aa, Mycobacterium
RERDRQWWQRRLPEMAGAPQLPTVAV

SEQ ID NO: 853000 - protein, 23 aa, Mycobacterium
RERERIWMRVWQIAGRVDELPNV

SEQ ID NO: 853001 - protein, 18 aa, Mycobacterium
REREVAELLLLGMPYRDI

SEQ ID NO: 853002 - protein, 30 aa, Mycobacterium
REREVAELLLLGMPYRDIGAQLFISAKTVE

SEQ ID NO: 853003 - protein, 26 aa, Mycobacterium
RERFGYDAWVLVYDLETVRAIVDAYP

SEQ ID NO: 853004 - protein, 18 aa, Mycobacterium
RERFLAAVDALADLPAGG

SEQ ID NO: 853005 - protein, 30 aa, Mycobacterium
RERGFIPEGLLNYLALLGWSIADDRDIFSV

SEQ ID NO: 853006 - protein, 21 aa, Mycobacterium
RERGITIKAQNVRLPWQLDGT

SEQ ID NO: 853007 - protein, 21 aa, Mycobacterium
RERGITIKAQNVRLPWQLNGQ

SEQ ID NO: 853008 - protein, 22 aa, Mycobacterium
RERGITIKAQNVRLPWQVTGGT

SEQ ID NO: 853009 - protein, 23 aa, Mycobacterium
RERGITIKAQNVRLPWTLKDGQD

SEQ ID NO: 853010 - protein, 17 aa, Mycobacterium
RERGLLDAPRRVGRAAL

SEQ ID NO: 853011 - protein, 25 aa, Mycobacterium
RERGQWYFQRYIQHLPTSGEIVLFD

SEQ ID NO: 853012 - protein, 23 aa, Mycobacterium
RERGQWYYQRYIAHLPAKGEIVF

SEQ ID NO: 853013 - protein, 24 aa, Mycobacterium
RERGQWYYQRYIAHLPAKGEIVLF

SEQ ID NO: 853014 - protein, 20 aa, Mycobacterium
RERHLLGAIERVTRQKLVES

SEQ ID NO: 853015 - protein, 23 aa, Mycobacterium
RERHQRLWPLVALAAARADISTF

SEQ ID NO: 853016 - protein, 27 aa, Mycobacterium
RERIHRVAHWLYAGAPRTLDPVFAAAF

SEQ ID NO: 853017 - protein, 22 aa, Mycobacterium
RERILDRAEAFFRLSEFSDIEK

SEQ ID NO: 853018 - protein, 21 aa, Mycobacterium
RERIPLPLRMALGTGNLEIRT

SEQ ID NO: 853019 - protein, 18 aa, Mycobacterium
RERLDVWSLTDIVAFSRG

SEQ ID NO: 853020 - protein, 26 aa, Mycobacterium
RERLDWINALFPRLAERRHQPGGTLS

SEQ ID NO: 853021 - protein, 17 aa, Mycobacterium
RERLFQASRTAAAAIGY

SEQ ID NO: 853022 - protein, 18 aa, Mycobacterium
RERLLAIVVEWAESIAEA

SEQ ID NO: 853023 - protein, 26 aa, Mycobacterium
RERLLALTRTLVSPQYWMLERAMREW

SEQ ID NO: 853024 - protein, 26 aa, Mycobacterium
RERLPRLRLWNFYGQTEMAPLASALG

SEQ ID NO: 853025 - protein, 22 aa, Mycobacterium
RERLRGWRFYDGFRVDAGAPAR

SEQ ID NO: 853026 - protein, 30 aa, Mycobacterium
RERMAFPRSLLERLPRLKLITIVGMNLPNL

SEQ ID NO: 853027 - protein, 29 aa, Mycobacterium
RERMPAAAPYRRYLTWLADRDVPAARAAW

SEQ ID NO: 853028 - protein, 25 aa, Mycobacterium
RERPLWQAWIIEGLADDRWAILMKV

SEQ ID NO: 853029 - protein, 42 aa, Mycobacterium
RERPRELARTVFIELLAWQFASPVRWIETQDLLFIEEAAGGL

SEQ ID NO: 853030 - protein, 24 aa, Mycobacterium
RERPVSAALRAYAALALSADKGAV

SEQ ID NO: 853031 - protein, 17 aa, Mycobacterium
RERRILGVRGSDGRVHV

SEQ ID NO: 853032 - protein, 23 aa, Mycobacterium
RERRLRASNLASALPRPGTSEGR

SEQ ID NO: 853033 - protein, 27 aa, Mycobacterium
RERRRIRDWLAFLYAEPLAPLMLGGPL

SEQ ID NO: 853034 - protein, 18 aa, Mycobacterium
RERRRLIKVLRKRGRILQ

SEQ ID NO: 853035 - protein, 19 aa, Mycobacterium
RERRRLIKVLRKRGRILQS

SEQ ID NO: 853036 - protein, 35 aa, Mycobacterium
RERSPNVALMIPFVRTRWELEECLSLVDASPLGRQ

SEQ ID NO: 853037 - protein, 17 aa, Mycobacterium
RERSRLAHLLPSGYTRL

SEQ ID NO: 853038 - protein, 20 aa, Mycobacterium
RERSTTVAMHLLRRLLADAD

SEQ ID NO: 853039 - protein, 22 aa, Mycobacterium
RERTQWYFQRYVEHLPAAGELV

SEQ ID NO: 853040 - protein, 26 aa, Mycobacterium
RERTTAEWLALFDELGIPASPLRSTG

SEQ ID NO: 853041 - protein, 25 aa, Mycobacterium
RERVILDQALLVPAPVMTGLIRDRL

SEQ ID NO: 853042 - protein, 19 aa, Mycobacterium
RERVLRAGRWDAGRGASLG

SEQ ID NO: 853043 - protein, 26 aa, Mycobacterium
RERVRAPLGSAFPIAVLNLKGGVGKT

SEQ ID NO: 853044 - protein, 25 aa, Mycobacterium
RERVWNPPMPLLFQRAIGNEHRPFT

SEQ ID NO: 853045 - protein, 17 aa, Mycobacterium
RERWGTRPCAYLGITVP

SEQ ID NO: 853046 - protein, 18 aa, Mycobacterium
RERWLEQHTERQADLRAG

SEQ ID NO: 853047 - protein, 17 aa, Mycobacterium
RERWLSYPGNRRVYGLM

SEQ ID NO: 853048 - protein, 17 aa, Mycobacterium
RERYFQIAYLGPKGTDA

SEQ ID NO: 853049 - protein, 23 aa, Mycobacterium
RERYRWRHGAAVSVGLVFAAELG

SEQ ID NO: 853050 - protein, 28 aa, Mycobacterium
RESAEFLTELFGLPSPKPFGHFMVVELE

SEQ ID NO: 853051 - protein, 24 aa, Mycobacterium
RESDERMAPIPALLAVAGVHHHLV

SEQ ID NO: 853052 - protein, 17 aa, Mycobacterium
RESIHLRALGRQNPIDE

SEQ ID NO: 853053 - protein, 26 aa, Mycobacterium
RESNGDRYLPIWIGQSEAAAIALEQQ

SEQ ID NO: 853054 - protein, 18 aa, Mycobacterium
RESNLPYDKPPLSKQFLA

SEQ ID NO: 853055 - protein, 32 aa, Mycobacterium
RESPYFPLRNALFDLPPYKGKWPEIWVAAHGP

SEQ ID NO: 853056 - protein, 18 aa, Mycobacterium
RESRAAIWAVLVRDFFQA

SEQ ID NO: 853057 - protein, 23 aa, Mycobacterium
RESRAVIALLLASSGASAHFLDN

SEQ ID NO: 853058 - protein, 23 aa, Mycobacterium
RESRTLACLPGEYGPNLAVMAAH

SEQ ID NO: 853059 - protein, 22 aa, Mycobacterium
RESSRWIFTNPDMIHVSLLHNH

SEQ ID NO: 853060 - protein, 21 aa, Mycobacterium
RESTITWARLADEGPFSTISS

SEQ ID NO: 853061 - protein, 24 aa, Mycobacterium
RESVFDPVLHVADLSFREVRVPEN

SEQ ID NO: 853062 - protein, 22 aa, Mycobacterium
RETCWRDYRLGVLQAPLISALG

SEQ ID NO: 853063 - protein, 25 aa, Mycobacterium
RETDGDWPSFPLPLGDTWASCKGDL

SEQ ID NO: 853064 - protein, 24 aa, Mycobacterium
RETDTVLLNRLTKPGLRALRSART

SEQ ID NO: 853065 - protein, 24 aa, Mycobacterium
RETELGPLVPCRFGDIPVATQDSI

SEQ ID NO: 853066 - protein, 28 aa, Mycobacterium
RETHPLAPALPVIRRLLVEDAIGSGVVV

SEQ ID NO: 853067 - protein, 19 aa, Mycobacterium
RETLARSILADGFDFVLDL

SEQ ID NO: 853068 - protein, 18 aa, Mycobacterium
RETLDLLTRVFPARTCST

SEQ ID NO: 853069 - protein, 40 aa, Mycobacterium
RETLGMSFVNLIWRNIASIPGGLRWTWETMKPLYTNGAVY

SEQ ID NO: 853070 - protein, 17 aa, Mycobacterium
RETLLIGLLTGGHILLE

SEQ ID NO: 853071 - protein, 31 aa, Mycobacterium
RETMLHLAENDYFFLRLSMAAAKASADAMVT

SEQ ID NO: 853072 - protein, 25 aa, Mycobacterium
RETMRALLVTIPDDALRLPRQDAVD

SEQ ID NO: 853073 - protein, 19 aa, Mycobacterium
RETPLPGALLVRVARSHLR

SEQ ID NO: 853074 - protein, 25 aa, Mycobacterium
RETPLRNAVLAYLAILRGRATEAEV

SEQ ID NO: 853075 - protein, 30 aa, Mycobacterium
RETPNIPVPYVYPVDLRYLLSPPVSATECT

SEQ ID NO: 853076 - protein, 25 aa, Mycobacterium
RETRARGWTFTWEGYDPPNEKLREA

SEQ ID NO: 853077 - protein, 21 aa, Mycobacterium
RETRRRLIWVEDRQEHLVASA

SEQ ID NO: 853078 - protein, 17 aa, Mycobacterium
RETYTGHWLPEPVVTGL

SEQ ID NO: 853079 - protein, 19 aa, Mycobacterium
REVAELLDHLRPSAAVYHR

SEQ ID NO: 853080 - protein, 25 aa, Mycobacterium
REVDDALWRRFKAAQDVFFTARNAA

SEQ ID NO: 853081 - protein, 18 aa, Mycobacterium
REVDGVVIPPPFDLRTLL

SEQ ID NO: 853082 - protein, 27 aa, Mycobacterium
REVDQWLETFRRNWVPRLDALATEIAR

SEQ ID NO: 853083 - protein, 24 aa, Mycobacterium
REVEETMHFAVVAGVRARVEERPL

SEQ ID NO: 853084 - protein, 30 aa, Mycobacterium
REVFDHEKSIWWERAVGVWPDYAEYQKKTD

SEQ ID NO: 853085 - protein, 20 aa, Mycobacterium
REVFLKVPTPDEAVLIAVSP

SEQ ID NO: 853086 - protein, 23 aa, Mycobacterium
REVGIFAGHLEQLGGALALVPQR

SEQ ID NO: 853087 - protein, 25 aa, Mycobacterium
REVGYNVVIYPVTTLRLAMYAVEQG

SEQ ID NO: 853088 - protein, 18 aa, Mycobacterium
REVIDVDFPFLGCCYGVG

SEQ ID NO: 853089 - protein, 39 aa, Mycobacterium
REVIELRPDLDWDKGKTLRWVIDHLHRAGSGSLTPVYLG

SEQ ID NO: 853090 - protein, 18 aa, Mycobacterium
REVIGVLRAVLFAPEDLA

SEQ ID NO: 853091 - protein, 23 aa, Mycobacterium
REVILRLFSDLLDTAPTLGAGLD

SEQ ID NO: 853092 - protein, 24 aa, Mycobacterium
REVLDDLLVVLLAGPTAVVTIEAL

SEQ ID NO: 853093 - protein, 18 aa, Mycobacterium
REVLFCPDQFLGAHVRRI

SEQ ID NO: 853094 - protein, 20 aa, Mycobacterium
REVLGRREVPTPPIAPAPEA

SEQ ID NO: 853095 - protein, 19 aa, Mycobacterium
REVLRLEYSAHPSAGQVLA

SEQ ID NO: 853096 - protein, 19 aa, Mycobacterium
REVLRMRFFESMTQSQIAE

SEQ ID NO: 853097 - protein, 19 aa, Mycobacterium
REVMEALLLGAFISDGFVS

SEQ ID NO: 853098 - protein, 19 aa, Mycobacterium
REVMLPGSSPRPYGRYFDD

SEQ ID NO: 853099 - protein, 25 aa, Mycobacterium
REVMPSRLRLLYLADKQVLDYSPAH

SEQ ID NO: 853100 - protein, 35 aa, Mycobacterium
REVNKAQIYAWRKGIKTLYYIRLRQMALEGTEVEG

SEQ ID NO: 853101 - protein, 23 aa, Mycobacterium
REVPLDWLTSIQSAPGLGDAKIS

SEQ ID NO: 853102 - protein, 24 aa, Mycobacterium
REVQADIRRKIEIGCYQGLRHRRG

SEQ ID NO: 853103 - protein, 26 aa, Mycobacterium
REVQNFLRLAQPPAATSRFLDLGTDS

SEQ ID NO: 853104 - protein, 19 aa, Mycobacterium
REVRFYGDIAPRLGGPIAP

SEQ ID NO: 853105 - protein, 19 aa, Mycobacterium
REVRLLAPGSLPKTTSGKL

SEQ ID NO: 853106 - protein, 20 aa, Mycobacterium
REVRLLSRFTGANPHVAIVG

SEQ ID NO: 853107 - protein, 29 aa, Mycobacterium
REVRNFLVANALFWLEEFHIDGLRVDAVA

SEQ ID NO: 853108 - protein, 18 aa, Mycobacterium
REVVAAGAPGWDVSPEEL

SEQ ID NO: 853109 - protein, 19 aa, Mycobacterium
REVVFAPFVYGVNEPADSS

SEQ ID NO: 853110 - protein, 24 aa, Mycobacterium
REVVYLAHHIAAERQLWVGHEDGG

SEQ ID NO: 853111 - protein, 17 aa, Mycobacterium
REWILRNSPVPVGTVPI

SEQ ID NO: 853112 - protein, 19 aa, Mycobacterium
REWMTLWTMGLNQSTHGTW

SEQ ID NO: 853113 - protein, 17 aa, Mycobacterium
REWPIRAAVLHTGDEHV

SEQ ID NO: 853114 - protein, 24 aa, Mycobacterium
REWPSPMLPALQALPADGPDIHVV

SEQ ID NO: 853115 - protein, 25 aa, Mycobacterium
REWPSPMLPALRQLPADGPDIHVVA

SEQ ID NO: 853116 - protein, 19 aa, Mycobacterium
REWQTLGLVPPPEKRGRVG

SEQ ID NO: 853117 - protein, 26 aa, Mycobacterium
REWYAAHGLPVFAWSSLARGFFSPHY

SEQ ID NO: 853118 - protein, 22 aa, Mycobacterium
REYALLLRHPEPRPWLVCVHGT

SEQ ID NO: 853119 - protein, 22 aa, Mycobacterium
REYALLLRHREPRPWLVCVHGT

SEQ ID NO: 853120 - protein, 21 aa, Mycobacterium
REYAYFSHAWLRQAAGVGEMF

SEQ ID NO: 853121 - protein, 17 aa, Mycobacterium
REYGKKAWRELFDPAVN

SEQ ID NO: 853122 - protein, 17 aa, Mycobacterium
REYGLTAEQLAWIGYKN

SEQ ID NO: 853123 - protein, 17 aa, Mycobacterium
REYGVRVLVIRPGQVRT

SEQ ID NO: 853124 - protein, 18 aa, Mycobacterium
REYIEAMRRLWEEEEASY

SEQ ID NO: 853125 - protein, 17 aa, Mycobacterium
REYLIKHTTRTTRAKVV

SEQ ID NO: 853126 - protein, 17 aa, Mycobacterium
REYLLSHDALPDRPLRA

SEQ ID NO: 853127 - protein, 24 aa, Mycobacterium
REYMRDYNHWATIGVLNELLPRPG

SEQ ID NO: 853128 - protein, 24 aa, Mycobacterium
REYRPDAAPGILIPFFASHTAKVQ

SEQ ID NO: 853129 - protein, 18 aa, Mycobacterium
REYTVPTPGLKHRGARRI

SEQ ID NO: 853130 - protein, 19 aa, Mycobacterium
REYVLPTFRMFGMTKFYKH

SEQ ID NO: 853131 - protein, 24 aa, Mycobacterium
REYVRHFWDHWSGPGFRLAEDELD

SEQ ID NO: 853132 - protein, 20 aa, Mycobacterium
REYYFNDHGAQIDRFVNSLI

SEQ ID NO: 853133 - protein, 18 aa, Mycobacterium
RFAAAYGYRGRIVGAVTF

SEQ ID NO: 853134 - protein, 23 aa, Mycobacterium
RFAAFNLHEQALRPSYGLAEATL

SEQ ID NO: 853135 - protein, 19 aa, Mycobacterium
RFAAILGARRRDAAAVLLT

SEQ ID NO: 853136 - protein, 18 aa, Mycobacterium
RFAALFLLELTTGIRRGQ

SEQ ID NO: 853137 - protein, 19 aa, Mycobacterium
RFAASSWLGSLRSRGGTVM

SEQ ID NO: 853138 - protein, 21 aa, Mycobacterium
RFAAWPQISVLVAALFAGQTM

SEQ ID NO: 853139 - protein, 18 aa, Mycobacterium
RFADEFNIPFVPLDELTT

SEQ ID NO: 853140 - protein, 25 aa, Mycobacterium
RFAEYDRDLPLYIPVEQIREEMPEE

SEQ ID NO: 853141 - protein, 26 aa, Mycobacterium
RFAFADHYVPFLWNEKNPAFSSMANA

SEQ ID NO: 853142 - protein, 19 aa, Mycobacterium
RFAGYEGGVADPLIVSWPA

SEQ ID NO: 853143 - protein, 21 aa, Mycobacterium
RFAHGLAIMCGASLIFQYDVT

SEQ ID NO: 853144 - protein, 17 aa, Mycobacterium
RFAHPMLSIHQRPFDPV

SEQ ID NO: 853145 - protein, 18 aa, Mycobacterium
RFAHPVLLERARAAELAT

SEQ ID NO: 853146 - protein, 25 aa, Mycobacterium
RFALGLGLSHDWIINGQLGLPYQRP

SEQ ID NO: 853147 - protein, 20 aa, Mycobacterium
RFAMKMARPPERFTDGLLRA

SEQ ID NO: 853148 - protein, 18 aa, Mycobacterium
RFAMSNYQRLTFQQMTHM

SEQ ID NO: 853149 - protein, 22 aa, Mycobacterium
RFANPYRVVSNLGVFDFGGPDH

SEQ ID NO: 853150 - protein, 18 aa, Mycobacterium
RFAPFNLPEAVIRPTYGL

SEQ ID NO: 853151 - protein, 22 aa, Mycobacterium
RFAPINSWPDNVSLDKARRLLW

SEQ ID NO: 853152 - protein, 22 aa, Mycobacterium
RFAPLNSWPDNASLDKARRLLW

SEQ ID NO: 853153 - protein, 23 aa, Mycobacterium
RFAPLNSWPDNASLDKARRLLWP

SEQ ID NO: 853154 - protein, 19 aa, Mycobacterium
RFARERSRWIFSNPDMIHL

SEQ ID NO: 853155 - protein, 33 aa, Mycobacterium
RFARERSRWIFSNPDMIHLSLLRNHSRWAVFLR

SEQ ID NO: 853156 - protein, 18 aa, Mycobacterium
RFARFIGQEIFPGGQLPA

SEQ ID NO: 853157 - protein, 18 aa, Mycobacterium
RFARFIGTEIFPGGQLPA

SEQ ID NO: 853158 - protein, 25 aa, Mycobacterium
RFARNQFWPALKNMSMYSLRVSESG

SEQ ID NO: 853159 - protein, 17 aa, Mycobacterium
RFAVLGRALPLEPGYRQ

SEQ ID NO: 853160 - protein, 17 aa, Mycobacterium
RFAVRISNNGEFIHCNP

SEQ ID NO: 853161 - protein, 17 aa, Mycobacterium
RFCAFAQRKGDADAFSL

SEQ ID NO: 853162 - protein, 21 aa, Mycobacterium
RFCVQTGRLPEAGPWLRRAEA

SEQ ID NO: 853163 - protein, 19 aa, Mycobacterium
RFDAALGGLGGCPFAPGAA

SEQ ID NO: 853164 - protein, 19 aa, Mycobacterium
RFDAGTYVLLTDALSSHDV

SEQ ID NO: 853165 - protein, 19 aa, Mycobacterium
RFDAIVVGAGFSGLYALHH

SEQ ID NO: 853166 - protein, 25 aa, Mycobacterium
RFDDTVPMFITPYGAPPGSIDSPFP

SEQ ID NO: 853167 - protein, 18 aa, Mycobacterium
RFDDVRGYGFIAPDSGGE

SEQ ID NO: 853168 - protein, 27 aa, Mycobacterium
RFDEAMKWFHYIFDPTDTEQLAAPQRF

SEQ ID NO: 853169 - protein, 19 aa, Mycobacterium
RFDEVLAPTHYTPCSKRIE

SEQ ID NO: 853170 - protein, 25 aa, Mycobacterium
RFDEVLRPTWYTPTSKRIAAVGRRI

SEQ ID NO: 853171 - protein, 27 aa, Mycobacterium
RFDHADSLLYMRLRRDQFVLDLSEHHG

SEQ ID NO: 853172 - protein, 21 aa, Mycobacterium
RFDHGMLSPMATIVNAAAWTA

SEQ ID NO: 853173 - protein, 22 aa, Mycobacterium
RFDHVDIQLLRYDTPDPVSMEQ

SEQ ID NO: 853174 - protein, 17 aa, Mycobacterium
RFDIFRQARAHLGWGHG

SEQ ID NO: 853175 - protein, 18 aa, Mycobacterium
RFDIRRKPGGHLTFGRGA

SEQ ID NO: 853176 - protein, 26 aa, Mycobacterium
RFDKLIPTPVRTIPILIGGTGPKRTL

SEQ ID NO: 853177 - protein, 23 aa, Mycobacterium
RFDLPTHYFAPDSDARLVSDLRE

SEQ ID NO: 853178 - protein, 23 aa, Mycobacterium
RFDLPTHYFTPDSDARLVSDLRD

SEQ ID NO: 853179 - protein, 20 aa, Mycobacterium
RFDPALWRELAASDLLGIAL

SEQ ID NO: 853180 - protein, 24 aa, Mycobacterium
RFDPAVWARLGAELGVLGLAVPEA

SEQ ID NO: 853181 - protein, 25 aa, Mycobacterium
RFDPDATLRYAGYIGWRGTVALSAL

SEQ ID NO: 853182 - protein, 30 aa, Mycobacterium
RFDPQRFVGNRPGLGWLPYGGGTRRCVGAV

SEQ ID NO: 853183 - protein, 20 aa, Mycobacterium
RFDRDLWAKLVEADILSAAA

SEQ ID NO: 853184 - protein, 20 aa, Mycobacterium
RFDRDLWDKLAGADILTSAA

SEQ ID NO: 853185 - protein, 24 aa, Mycobacterium
RFDRLGEQLAIVTGLWTTRPGATY

SEQ ID NO: 853186 - protein, 21 aa, Mycobacterium
RFDRMYSGPLPYISALHQYRD

SEQ ID NO: 853187 - protein, 21 aa, Mycobacterium
RFDRMYSSPLPYISALHQYAD

SEQ ID NO: 853188 - protein, 19 aa, Mycobacterium
RFDVTLVHTVCLAGAFMVP

SEQ ID NO: 853189 - protein, 17 aa, Mycobacterium
RFEAYTYFHPARSVRER

SEQ ID NO: 853190 - protein, 19 aa, Mycobacterium
RFEDLHAALDHLDRGPFGK

SEQ ID NO: 853191 - protein, 18 aa, Mycobacterium
RFEHITYSWIPREQNSYA

SEQ ID NO: 853192 - protein, 18 aa, Mycobacterium
RFEILHSHIVVRKLVMSA

SEQ ID NO: 853193 - protein, 19 aa, Mycobacterium
RFESGVVRVYLAAPDLQAG

SEQ ID NO: 853194 - protein, 25 aa, Mycobacterium
RFEVAAGEFLLFPTVAHSHAQRVRP

SEQ ID NO: 853195 - protein, 18 aa, Mycobacterium
RFEVGFASLAPDLKVLAP

SEQ ID NO: 853196 - protein, 18 aa, Mycobacterium
RFEVGFASLAPDLQVLAP

SEQ ID NO: 853197 - protein, 26 aa, Mycobacterium
RFEYAQSILYMRLRRDRFVLDLSEHH

SEQ ID NO: 853198 - protein, 18 aa, Mycobacterium
RFFDDFFLDATRAGLEQV

SEQ ID NO: 853199 - protein, 20 aa, Mycobacterium
RFFEAFAASGIRREAFCPCY

SEQ ID NO: 853200 - protein, 17 aa, Mycobacterium
RFFEVAVTPDRVAAAFA

SEQ ID NO: 853201 - protein, 21 aa, Mycobacterium
RFFGSYRRQLSLGEGIDTSAI

SEQ ID NO: 853202 - protein, 20 aa, Mycobacterium
RFFLIGPMHSVSRMVDFLEA

SEQ ID NO: 853203 - protein, 17 aa, Mycobacterium
RFFRELPEMAVRRQAET

SEQ ID NO: 853204 - protein, 21 aa, Mycobacterium
RFFSSMFPARRTGGGALTVYL

SEQ ID NO: 853205 - protein, 21 aa, Mycobacterium
RFGAERYAALIRAAVERVLKA

SEQ ID NO: 853206 - protein, 18 aa, Mycobacterium
RFGASTMVLLPLVAAHAG

SEQ ID NO: 853207 - protein, 19 aa, Mycobacterium
RFGASTMVLLPLVAAHVDV

SEQ ID NO: 853208 - protein, 25 aa, Mycobacterium
RFGCDFAVLALPYLTLRRLAERDCV

SEQ ID NO: 853209 - protein, 33 aa, Mycobacterium
RFGDAVPLTYPFTLTFPAVMSLVTGLDFPFAAM

SEQ ID NO: 853210 - protein, 17 aa, Mycobacterium
RFGFTAHMDFYEPDELE

SEQ ID NO: 853211 - protein, 28 aa, Mycobacterium
RFGIPLAALHFFPAAALELGWLQSQVTS

SEQ ID NO: 853212 - protein, 26 aa, Mycobacterium
RFGKREVLPGVGLYLDGGFGVGKTHL

SEQ ID NO: 853213 - protein, 20 aa, Mycobacterium
RFGLGFLPMVPDLVDVYLEE

SEQ ID NO: 853214 - protein, 19 aa, Mycobacterium
RFGLPYTTGPLTRQYRHTL

SEQ ID NO: 853215 - protein, 25 aa, Mycobacterium
RFGNLVRLIFAFVPPRYRKHPRARA

SEQ ID NO: 853216 - protein, 18 aa, Mycobacterium
RFGPRYLSDLHGPYPDVE

SEQ ID NO: 853217 - protein, 22 aa, Mycobacterium
RFGPVYSARLPLFGPAIVISDP

SEQ ID NO: 853218 - protein, 29 aa, Mycobacterium
RFGQFTRQISGYALHRLLPENGYDVAGLL

SEQ ID NO: 853219 - protein, 19 aa, Mycobacterium
RFGQLQRHELGWETTYPAC

SEQ ID NO: 853220 - protein, 23 aa, Mycobacterium
RFGQPLFDRLFYHRYRRAALSNA

SEQ ID NO: 853221 - protein, 31 aa, Mycobacterium
RFGQTTFLETFRFLRQFSVDPALIRCPALAL

SEQ ID NO: 853222 - protein, 20 aa, Mycobacterium
RFGRMFIAGARLTVPLGMII

SEQ ID NO: 853223 - protein, 21 aa, Mycobacterium
RFGRPWHRHRDPLARRGAATN

SEQ ID NO: 853224 - protein, 20 aa, Mycobacterium
RFGRWLREPVGPIHWAGTET

SEQ ID NO: 853225 - protein, 34 aa, Mycobacterium
RFGSPAAQFRAFIDSLGGLWAQGRLADKVYAAFT

SEQ ID NO: 853226 - protein, 19 aa, Mycobacterium
RFGYGRPLYTLAHYGVFFT

SEQ ID NO: 853227 - protein, 17 aa, Mycobacterium
RFGYRTSILKGTSARVV

SEQ ID NO: 853228 - protein, 19 aa, Mycobacterium
RFHANLGRGLFGRRIQRSR

SEQ ID NO: 853229 - protein, 17 aa, Mycobacterium
RFHLGRNGAVHGGALGL

SEQ ID NO: 853230 - protein, 24 aa, Mycobacterium
RFHLVEQYRYPLGLRRWEFPQGTA

SEQ ID NO: 853231 - protein, 20 aa, Mycobacterium
RFHPFDVFRREITIKGSFAE

SEQ ID NO: 853232 - protein, 43 aa, Mycobacterium
RFHQTIYRLSGSRKIRWLIKATLPYAPRKFFAAVEGWPEASAH

SEQ ID NO: 853233 - protein, 25 aa, Mycobacterium
RFHRNLGCGLLGRRIERSPLPFARD

SEQ ID NO: 853234 - protein, 18 aa, Mycobacterium
RFHTERMAQLAPAGFTLA

SEQ ID NO: 853235 - protein, 24 aa, Mycobacterium
RFHTFAFHGPITRTVADAALMLTT

SEQ ID NO: 853236 - protein, 24 aa, Mycobacterium
RFHTVPVYDYVLATEPLTPEQLDR

SEQ ID NO: 853237 - protein, 30 aa, Mycobacterium
RFIAAQFEAMLRDDLWLRNAAHANAMAARL

SEQ ID NO: 853238 - protein, 17 aa, Mycobacterium
RFIAELPFSLDDFQRRA

SEQ ID NO: 853239 - protein, 20 aa, Mycobacterium
RFIEELRICLHCCGATDLNA

SEQ ID NO: 853240 - protein, 19 aa, Mycobacterium
RFIGLAERWPAELSLAEHM

SEQ ID NO: 853241 - protein, 27 aa, Mycobacterium
RFIRDTTWVSVRWYKPGGALTAQQVGQ

SEQ ID NO: 853242 - protein, 27 aa, Mycobacterium
RFIRDTTWVSVRWYKPGGPLSAEQVGQ

SEQ ID NO: 853243 - protein, 27 aa, Mycobacterium
RFIRDTTWVSVRWYQPGGPLTAEQVGR

SEQ ID NO: 853244 - protein, 25 aa, Mycobacterium
RFISNADWGDWFAVLARSGEENEFG

SEQ ID NO: 853245 - protein, 18 aa, Mycobacterium
RFKDYIAQPRFGVYQSLH

SEQ ID NO: 853246 - protein, 17 aa, Mycobacterium
RFKIYDAGYQKSVAALH

SEQ ID NO: 853247 - protein, 26 aa, Mycobacterium
RFKQYERLWLSWAMANRDPAVFDEPN

SEQ ID NO: 853248 - protein, 33 aa, Mycobacterium
RFKRRLTAMIVKLAARFLALREQGKAGYLLTYD

SEQ ID NO: 853249 - protein, 18 aa, Mycobacterium
RFLADYEAGLDAALCVAA

SEQ ID NO: 853250 - protein, 17 aa, Mycobacterium
RFLAPVPLEPWEGVRDA

SEQ ID NO: 853251 - protein, 31 aa, Mycobacterium
RFLAQHRWRDGVMKLVFMGVPLRGVSGLRSR

SEQ ID NO: 853252 - protein, 18 aa, Mycobacterium
RFLARNPAKLQTTVAKLG

SEQ ID NO: 853253 - protein, 18 aa, Mycobacterium
RFLAYFADRDWDATAQLF

SEQ ID NO: 853254 - protein, 17 aa, Mycobacterium
RFLDRILDVTGTFEHLV

SEQ ID NO: 853255 - protein, 17 aa, Mycobacterium
RFLDTQTLDYLRDFRFC

SEQ ID NO: 853256 - protein, 26 aa, Mycobacterium
RFLEHSRIIHFNAIDEFWIGSADMMH

SEQ ID NO: 853257 - protein, 25 aa, Mycobacterium
RFLEHSRILHFRAIDEFWIGSADMM

SEQ ID NO: 853258 - protein, 26 aa, Mycobacterium
RFLEHSRILHFRAIDEFWIGSADMMH

SEQ ID NO: 853259 - protein, 22 aa, Mycobacterium
RFLERRLREAFGFEGSPIRINV

SEQ ID NO: 853260 - protein, 21 aa, Mycobacterium
RFLEVAMRYVSLLEPAQRVPT

SEQ ID NO: 853261 - protein, 19 aa, Mycobacterium
RFLFFTGKGGVGKTSIACA

SEQ ID NO: 853262 - protein, 26 aa, Mycobacterium
RFLGDLEKCWSLLLTGILQPDRIDYF

SEQ ID NO: 853263 - protein, 19 aa, Mycobacterium
RFLGGYLTARLAQNPSIDH

SEQ ID NO: 853264 - protein, 18 aa, Mycobacterium
RFLKVAFVPNFNVQNAHL

SEQ ID NO: 853265 - protein, 19 aa, Mycobacterium
RFLLGIQQLFGLGQFHTQG

SEQ ID NO: 853266 - protein, 17 aa, Mycobacterium
RFLLVDHGGLLGVGEKK

SEQ ID NO: 853267 - protein, 17 aa, Mycobacterium
RFLMCTPLSHAGAAFFT

SEQ ID NO: 853268 - protein, 17 aa, Mycobacterium
RFLMCTPLSHAGAAFFV

SEQ ID NO: 853269 - protein, 17 aa, Mycobacterium
RFLNGIAPTAQLPASAT

SEQ ID NO: 853270 - protein, 18 aa, Mycobacterium
RFLPPLTIEEADISAALT

SEQ ID NO: 853271 - protein, 20 aa, Mycobacterium
RFLQPGTIGLIVDRLLPGGV

SEQ ID NO: 853272 - protein, 20 aa, Mycobacterium
RFLRAELAAGRRYLPAGPNV

SEQ ID NO: 853273 - protein, 19 aa, Mycobacterium
RFLTPVKPGDALTVTLTAK

SEQ ID NO: 853274 - protein, 19 aa, Mycobacterium
RFLVYERIQRLLESAPRLL

SEQ ID NO: 853275 - protein, 18 aa, Mycobacterium
RFMADQDLDLIITSGGLG

SEQ ID NO: 853276 - protein, 18 aa, Mycobacterium
RFMAFAVPTIRGEVRRHF

SEQ ID NO: 853277 - protein, 17 aa, Mycobacterium
RFMESPPVVLPINAETD

SEQ ID NO: 853278 - protein, 19 aa, Mycobacterium
RFNAVAVANPYAWIRTPMT

SEQ ID NO: 853279 - protein, 18 aa, Mycobacterium
RFNDDIIVMPLQAATQWD

SEQ ID NO: 853280 - protein, 18 aa, Mycobacterium
RFNDDMIIMPLQAATQWD

SEQ ID NO: 853281 - protein, 19 aa, Mycobacterium
RFNDDMIVMPLQAATQWDA

SEQ ID NO: 853282 - protein, 18 aa, Mycobacterium
RFNEDMIIMPLQAATQWD

SEQ ID NO: 853283 - protein, 18 aa, Mycobacterium
RFNEFYEKIWRGIGQKPG

SEQ ID NO: 853284 - protein, 25 aa, Mycobacterium
RFNGTVLLEWLNVSGGIDAPAVWMM

SEQ ID NO: 853285 - protein, 25 aa, Mycobacterium
RFNGTVLVEWLNVSGGIDAPAVWMM

SEQ ID NO: 853286 - protein, 23 aa, Mycobacterium
RFNHAIVRQSLLAELPSVRRMRL

SEQ ID NO: 853287 - protein, 24 aa, Mycobacterium
RFNQPELLVPTFPKPETLPEPELK

SEQ ID NO: 853288 - protein, 18 aa, Mycobacterium
RFNWHTMYFRYKTVDPYY

SEQ ID NO: 853289 - protein, 23 aa, Mycobacterium
RFPDTFVVPDLLIPKATAKIYDL

SEQ ID NO: 853290 - protein, 19 aa, Mycobacterium
RFPELPGTLVALKAVVDQL

SEQ ID NO: 853291 - protein, 17 aa, Mycobacterium
RFPGKFSEHLLAEHLQK

SEQ ID NO: 853292 - protein, 22 aa, Mycobacterium
RFPGRVLNSHPALLPAFPGAHA

SEQ ID NO: 853293 - protein, 20 aa, Mycobacterium
RFPHSFITATRTRAGWTFSG

SEQ ID NO: 853294 - protein, 25 aa, Mycobacterium
RFPKRQGMRIDFILGSPALARRVVD

SEQ ID NO: 853295 - protein, 18 aa, Mycobacterium
RFPRLQMILGHLGEMLPF

SEQ ID NO: 853296 - protein, 18 aa, Mycobacterium
RFPRPDVVLGQHVGPLPA

SEQ ID NO: 853297 - protein, 22 aa, Mycobacterium
RFPTEPPGAPLPPLAGGTSPRA

SEQ ID NO: 853298 - protein, 20 aa, Mycobacterium
RFPTWEVDWPNAVPSQTTAV

SEQ ID NO: 853299 - protein, 31 aa, Mycobacterium
RFQAELLGPVELPPGVRRPAGIPAGAPVTRM

SEQ ID NO: 853300 - protein, 20 aa, Mycobacterium
RFQHLPVPFELYSDGIDLPV

SEQ ID NO: 853301 - protein, 25 aa, Mycobacterium
RFQHLPVPFEVYADGIDLVIFEEFG

SEQ ID NO: 853302 - protein, 18 aa, Mycobacterium
RFQIGRWEYRDLIRESIG

SEQ ID NO: 853303 - protein, 20 aa, Mycobacterium
RFQIGRWEYRDLIRESIRPW

SEQ ID NO: 853304 - protein, 39 aa, Mycobacterium
RFQRNLGHGLLGRRIERSPLPFARHRWISPGVSPDIDIA

SEQ ID NO: 853305 - protein, 28 aa, Mycobacterium
RFRAETGLSPMQWLTEQRLHRACELLEQ

SEQ ID NO: 853306 - protein, 17 aa, Mycobacterium
RFRARPFDLVSNPSVCE

SEQ ID NO: 853307 - protein, 17 aa, Mycobacterium
RFRARPFDLVSSPSVCE

SEQ ID NO: 853308 - protein, 17 aa, Mycobacterium
RFRAWRVGGYNEYLYTF

SEQ ID NO: 853309 - protein, 24 aa, Mycobacterium
RFRDDLGITYFSFLKTDATSWDTF

SEQ ID NO: 853310 - protein, 18 aa, Mycobacterium
RFREELIPLLDDAYPPRP

SEQ ID NO: 853311 - protein, 24 aa, Mycobacterium
RFRELDMPIPDIKALLAAGDGATR

SEQ ID NO: 853312 - protein, 20 aa, Mycobacterium
RFRFITRSPAQTRILDAALQ

SEQ ID NO: 853313 - protein, 18 aa, Mycobacterium
RFRGAPYLTALRFTRELR

SEQ ID NO: 853314 - protein, 17 aa, Mycobacterium
RFRGLLAGVLRSARLCD

SEQ ID NO: 853315 - protein, 20 aa, Mycobacterium
RFRHDLLREATRQSLPKSLR

SEQ ID NO: 853316 - protein, 31 aa, Mycobacterium
RFRHRRVGFIFQFFNLLPTLSAWENVAIPKL

SEQ ID NO: 853317 - protein, 30 aa, Mycobacterium
RFRLKSEPHWYPYVPRMSRLQKRLIRLTGA

SEQ ID NO: 853318 - protein, 22 aa, Mycobacterium
RFRLVEQFRYPLGERRWEFPQG

SEQ ID NO: 853319 - protein, 21 aa, Mycobacterium
RFRNEYLAFQPFGSWVDAYQQ

SEQ ID NO: 853320 - protein, 21 aa, Mycobacterium
RFRPERFLGTRPQTYAWVPFG

SEQ ID NO: 853321 - protein, 28 aa, Mycobacterium
RFRPGTNLRAWLFRIMHNRWISTHRMTQ

SEQ ID NO: 853322 - protein, 20 aa, Mycobacterium
RFRRMLSKPFTFKRVEALRP

SEQ ID NO: 853323 - protein, 20 aa, Mycobacterium
RFRRMLSKPFTFKRVEGLRP

SEQ ID NO: 853324 - protein, 17 aa, Mycobacterium
RFRRPELAALQLRSLPF

SEQ ID NO: 853325 - protein, 20 aa, Mycobacterium
RFRVTRWTIEPGGAIPMHRH

SEQ ID NO: 853326 - protein, 19 aa, Mycobacterium
RFSALRRHYTYRLSTAPYG

SEQ ID NO: 853327 - protein, 20 aa, Mycobacterium
RFSALRRHYVYRLTTAPYGV

SEQ ID NO: 853328 - protein, 21 aa, Mycobacterium
RFSEHLLAEHLQKVSLSFLVD

SEQ ID NO: 853329 - protein, 17 aa, Mycobacterium
RFSEIVVQFKPVPLPMF

SEQ ID NO: 853330 - protein, 25 aa, Mycobacterium
RFSEQLLPEHLHKVSLSFLVDDLVV

SEQ ID NO: 853331 - protein, 22 aa, Mycobacterium
RFSILPLSARTPAALMRLADEY

SEQ ID NO: 853332 - protein, 28 aa, Mycobacterium
RFSKVRWRASTIGGLPILYEDAHAIAEC

SEQ ID NO: 853333 - protein, 25 aa, Mycobacterium
RFSRAGRPYVLRRGPRHLRPRSNSV

SEQ ID NO: 853334 - protein, 25 aa, Mycobacterium
RFSRAGRPYVLRRGPRHLRPRSNTV

SEQ ID NO: 853335 - protein, 21 aa, Mycobacterium
RFSSFRLLMRAEVTKLIEEPN

SEQ ID NO: 853336 - protein, 23 aa, Mycobacterium
RFSTAAGSFPRRCPSRRPNLMGC

SEQ ID NO: 853337 - protein, 37 aa, Mycobacterium
RFSVIGESILRLKARLWFVHRGVEKLFEGRNALGARE

SEQ ID NO: 853338 - protein, 17 aa, Mycobacterium
RFSVWVWESAERERRIV

SEQ ID NO: 853339 - protein, 26 aa, Mycobacterium
RFTAVPSQELILPYVRRHIAAESVRK

SEQ ID NO: 853340 - protein, 19 aa, Mycobacterium
RFTDPFNWPKAFGGGGVFA

SEQ ID NO: 853341 - protein, 19 aa, Mycobacterium
RFTEDMLVGFLDANSRYVV

SEQ ID NO: 853342 - protein, 19 aa, Mycobacterium
RFTEGLDLMKLAWSDEERI

SEQ ID NO: 853343 - protein, 18 aa, Mycobacterium
RFTHDLRMTLRELASRRV

SEQ ID NO: 853344 - protein, 24 aa, Mycobacterium
RFTILKSLTVLRQMALHPGLVDAA

SEQ ID NO: 853345 - protein, 25 aa, Mycobacterium
RFTLGIGPSHHWIVNGQLGLAYDRP

SEQ ID NO: 853346 - protein, 22 aa, Mycobacterium
RFTRNHLIPITTEHGLALFDAA

SEQ ID NO: 853347 - protein, 18 aa, Mycobacterium
RFTRSGRTYVLRRGPRHL

SEQ ID NO: 853348 - protein, 18 aa, Mycobacterium
RFTTDFPLSDGTPAPILE

SEQ ID NO: 853349 - protein, 18 aa, Mycobacterium
RFTTIKPGPYPWKNHRNA

SEQ ID NO: 853350 - protein, 22 aa, Mycobacterium
RFTTWVYKFVVFEVLNKLKRWR

SEQ ID NO: 853351 - protein, 18 aa, Mycobacterium
RFVANALSPAKVVSVSII

SEQ ID NO: 853352 - protein, 18 aa, Mycobacterium
RFVDAIPSHILVALDEAY

SEQ ID NO: 853353 - protein, 25 aa, Mycobacterium
RFVDTFAARALFYDDYFAAAGQAGL

SEQ ID NO: 853354 - protein, 25 aa, Mycobacterium
RFVEELLSILPVRLATDASIHLCSP

SEQ ID NO: 853355 - protein, 22 aa, Mycobacterium
RFVEHQGIRWYKTGDMARYWPD

SEQ ID NO: 853356 - protein, 17 aa, Mycobacterium
RFVEYLTTVLSGLAASI

SEQ ID NO: 853357 - protein, 18 aa, Mycobacterium
RFVFHHHPEYGAALETYL

SEQ ID NO: 853358 - protein, 37 aa, Mycobacterium
RFVGFGIMGLPFASGHYLALRQFPATTFAPAYTSVWH

SEQ ID NO: 853359 - protein, 18 aa, Mycobacterium
RFVGVPDLSSLGRDVVFI

SEQ ID NO: 853360 - protein, 19 aa, Mycobacterium
RFVLQAILGHPLKKWPELG

SEQ ID NO: 853361 - protein, 17 aa, Mycobacterium
RFVPHKTVLYGTGYIRK

SEQ ID NO: 853362 - protein, 19 aa, Mycobacterium
RFVPHKTVLYGTGYIRKGI

SEQ ID NO: 853363 - protein, 18 aa, Mycobacterium
RFVPPVAALSRSSVTFDG

SEQ ID NO: 853364 - protein, 32 aa, Mycobacterium
RFVQLSMLQPTRYWPEFCRLMGLHEVAEDPRF

SEQ ID NO: 853365 - protein, 18 aa, Mycobacterium
RFVRAIGNYYRPGFHPSQ

SEQ ID NO: 853366 - protein, 24 aa, Mycobacterium
RFVRALSDPYPRAFSYYRGERIEV

SEQ ID NO: 853367 - protein, 19 aa, Mycobacterium
RFVRLNYLNPLTRRQMLAV

SEQ ID NO: 853368 - protein, 19 aa, Mycobacterium
RFVRLRAPLILDLRRVEYL

SEQ ID NO: 853369 - protein, 20 aa, Mycobacterium
RFVRSLVDVPTPAGPFGRDE

SEQ ID NO: 853370 - protein, 18 aa, Mycobacterium
RFVSGPGDRPAWSMIFED

SEQ ID NO: 853371 - protein, 24 aa, Mycobacterium
RFVSQLGFTVAPRVRRALEEMSSQ

SEQ ID NO: 853372 - protein, 23 aa, Mycobacterium
RFVTRWLGPAILYPRITVLAGAR

SEQ ID NO: 853373 - protein, 17 aa, Mycobacterium
RFVTVHKVALQGAEPKI

SEQ ID NO: 853374 - protein, 17 aa, Mycobacterium
RFVYKAHMLEGVPNLFW

SEQ ID NO: 853375 - protein, 29 aa, Mycobacterium
RFWDELYRINLQHVFLVTRAFLPAMVARR

SEQ ID NO: 853376 - protein, 21 aa, Mycobacterium
RFWRAEYLMNGQIGRFSKPYV

SEQ ID NO: 853377 - protein, 19 aa, Mycobacterium
RFWSTPVDLPPIPREPERF

SEQ ID NO: 853378 - protein, 18 aa, Mycobacterium
RFYDALDGYSGCLLVVSH

SEQ ID NO: 853379 - protein, 19 aa, Mycobacterium
RFYLYVNQVTNNVPFDVSS

SEQ ID NO: 853380 - protein, 21 aa, Mycobacterium
RFYRELVGLPLFETFGDSFGS

SEQ ID NO: 853381 - protein, 17 aa, Mycobacterium
RFYVWFADFAVPESLHE

SEQ ID NO: 853382 - protein, 24 aa, Mycobacterium
RGAAAAFEMAFTATVPPPIVAANR

SEQ ID NO: 853383 - protein, 23 aa, Mycobacterium
RGAAALWGLAQKAALSYPDAVRR

SEQ ID NO: 853384 - protein, 24 aa, Mycobacterium
RGAALPAAPLYAPSAGDDPLALLI

SEQ ID NO: 853385 - protein, 27 aa, Mycobacterium
RGAARYTGGLWVGKYLKTVTYQEVRSA

SEQ ID NO: 853386 - protein, 23 aa, Mycobacterium
RGACLGVKLILFTGDSKPTVSQV

SEQ ID NO: 853387 - protein, 30 aa, Mycobacterium
RGADPVFMLTGPIPATRYALEKTGLSIDDI

SEQ ID NO: 853388 - protein, 24 aa, Mycobacterium
RGADPVMMLTGPIPATEYALKKTG

SEQ ID NO: 853389 - protein, 24 aa, Mycobacterium
RGADRDLLADLYRAWAHGGQIPDE

SEQ ID NO: 853390 - protein, 21 aa, Mycobacterium
RGAEALGFAGTAPAKSATTPA

SEQ ID NO: 853391 - protein, 18 aa, Mycobacterium
RGAELIVVSASWGSGPGK

SEQ ID NO: 853392 - protein, 23 aa, Mycobacterium
RGAFDIEALGYEAAIALLAAGVI

SEQ ID NO: 853393 - protein, 23 aa, Mycobacterium
RGAFDIEGLGYEAAIALLKAEVI

SEQ ID NO: 853394 - protein, 24 aa, Mycobacterium
RGAFYHHFKDKAELFRAVFEDVEN

SEQ ID NO: 853395 - protein, 35 aa, Mycobacterium
RGAGATPYMTFLAAYATLLHRYTGQDDLLVGSPFA

SEQ ID NO: 853396 - protein, 21 aa, Mycobacterium
RGAGEVHLGLTILAEAIAEAG

SEQ ID NO: 853397 - protein, 20 aa, Mycobacterium
RGAGLFLMGHSGGCELVMRM

SEQ ID NO: 853398 - protein, 17 aa, Mycobacterium
RGAGLGSRILRHLETLA

SEQ ID NO: 853399 - protein, 20 aa, Mycobacterium
RGAGWLKVKPVHTLDLVVLA

SEQ ID NO: 853400 - protein, 23 aa, Mycobacterium
RGAGWLKVKPVHTLDLVVLAVEW

SEQ ID NO: 853401 - protein, 18 aa, Mycobacterium
RGAGWNVIKVVWGREWDA

SEQ ID NO: 853402 - protein, 41 aa, Mycobacterium
RGAHLRGRREPVLVRHRLLQSPNRVPRTKVEKWQRIGRGRR

SEQ ID NO: 853403 - protein, 23 aa, Mycobacterium
RGAIDILIAVLTPIAGSELLDKY

SEQ ID NO: 853404 - protein, 24 aa, Mycobacterium
RGAIELAWSLLTNGVAAGGYGLDP

SEQ ID NO: 853405 - protein, 21 aa, Mycobacterium
RGAILVLINRGDYWQCGFVIA

SEQ ID NO: 853406 - protein, 23 aa, Mycobacterium
RGAKPFAMLVRDLKIARRYAHVD

SEQ ID NO: 853407 - protein, 17 aa, Mycobacterium
RGALGRLLLGSVSSSVV

SEQ ID NO: 853408 - protein, 17 aa, Mycobacterium
RGALLELNRLFMAWTET

SEQ ID NO: 853409 - protein, 25 aa, Mycobacterium
RGALVKLAGLWFDALAAISAHVDAG

SEQ ID NO: 853410 - protein, 21 aa, Mycobacterium
RGAMFDPSAVFYMNKIAGGPD

SEQ ID NO: 853411 - protein, 17 aa, Mycobacterium
RGAMYHQFADKAALFRE

SEQ ID NO: 853412 - protein, 23 aa, Mycobacterium
RGANHPLLRRSVGRRQAVRGAVL

SEQ ID NO: 853413 - protein, 23 aa, Mycobacterium
RGAPPLITPSLRYIVGSTDEEAR

SEQ ID NO: 853414 - protein, 19 aa, Mycobacterium
RGAQLWQWLQDGAQVYVCG

SEQ ID NO: 853415 - protein, 18 aa, Mycobacterium
RGARLSRSWAPYASGHIA

SEQ ID NO: 853416 - protein, 18 aa, Mycobacterium
RGARVPSPGRRRGYRQTT

SEQ ID NO: 853417 - protein, 30 aa, Mycobacterium
RGATDIVVAPWFLSPGLLLDRVRAEAAQLD

SEQ ID NO: 853418 - protein, 31 aa, Mycobacterium
RGATGFLVSRALKKMGWLCSDTAELGFTDVR

SEQ ID NO: 853419 - protein, 21 aa, Mycobacterium
RGATWSFLPAFWVALSSAKAP

SEQ ID NO: 853420 - protein, 33 aa, Mycobacterium
RGAVGQRWVLKSPAHLGYLDLLRARFPDLHIVH

SEQ ID NO: 853421 - protein, 25 aa, Mycobacterium
RGAVNAVVAFWGTDWAREISVVAAG

SEQ ID NO: 853422 - protein, 23 aa, Mycobacterium
RGAVSCYWDYSPSFGRGPFRNVI

SEQ ID NO: 853423 - protein, 19 aa, Mycobacterium
RGAVVVRLIALDPILIRDA

SEQ ID NO: 853424 - protein, 18 aa, Mycobacterium
RGAVWEEVILHLPEEVRL

SEQ ID NO: 853425 - protein, 20 aa, Mycobacterium
RGAWLVCQAAGRVLLDQGGG

SEQ ID NO: 853426 - protein, 23 aa, Mycobacterium
RGCALAVLPTLTQRSRCSLLCGE

SEQ ID NO: 853427 - protein, 19 aa, Mycobacterium
RGCEGDALLMLLDANGIEC

SEQ ID NO: 853428 - protein, 21 aa, Mycobacterium
RGCMRGRTMYVVPFCMGPLGA

SEQ ID NO: 853429 - protein, 19 aa, Mycobacterium
RGCRAIAPAWGAWTDDRTT

SEQ ID NO: 853430 - protein, 26 aa, Mycobacterium
RGCSPTPPFNYVPELLVRGAPHFREV

SEQ ID NO: 853431 - protein, 17 aa, Mycobacterium
RGCTALWRRDQELFAEV

SEQ ID NO: 853432 - protein, 27 aa, Mycobacterium
RGCVDPDALFDLLEDPPARVFRLKGVV

SEQ ID NO: 853433 - protein, 19 aa, Mycobacterium
RGCVSREFTVLATGKTSSV

SEQ ID NO: 853434 - protein, 30 aa, Mycobacterium
RGDAEYLLTRFIAWWVNQLEAHDFDTGCPH

SEQ ID NO: 853435 - protein, 23 aa, Mycobacterium
RGDAREPIIPFAQPNSLTRVYAV

SEQ ID NO: 853436 - protein, 25 aa, Mycobacterium
RGDDGRFLWPGFGENSRVLKWIVDR

SEQ ID NO: 853437 - protein, 40 aa, Mycobacterium
RGDDHPAHHLVLLGEQLGGRGFGPQPLRPTGYRVDGHDSR

SEQ ID NO: 853438 - protein, 25 aa, Mycobacterium
RGDDPFLDYVLPMTAMQFAQGFGRL

SEQ ID NO: 853439 - protein, 20 aa, Mycobacterium
RGDEPWLIGDGWKNTPVVDD

SEQ ID NO: 853440 - protein, 20 aa, Mycobacterium
RGDFCINILAAYDAFDELRG

SEQ ID NO: 853441 - protein, 25 aa, Mycobacterium
RGDFYRIHDFTLKPKPLHTPELFQG

SEQ ID NO: 853442 - protein, 21 aa, Mycobacterium
RGDGLLVYSVDPLILRQRSPV

SEQ ID NO: 853443 - protein, 19 aa, Mycobacterium
RGDGLYWSLPVVGETYDGL

SEQ ID NO: 853444 - protein, 19 aa, Mycobacterium
RGDGRVVIWAATQFDVLAC

SEQ ID NO: 853445 - protein, 19 aa, Mycobacterium
RGDHQGLVGFSYAINIPET

SEQ ID NO: 853446 - protein, 26 aa, Mycobacterium
RGDHRDVLLAEFRRAVGALQRVAHPP

SEQ ID NO: 853447 - protein, 39 aa, Mycobacterium
RGDIHEAARWLGDINLLGTPLFPHALVRLILAAQVASAA

SEQ ID NO: 853448 - protein, 18 aa, Mycobacterium
RGDLAAAIDALRRPERRR

SEQ ID NO: 853449 - protein, 31 aa, Mycobacterium
RGDLGRRWAGPAFLLNEMLVWGFTGQVISAL

SEQ ID NO: 853450 - protein, 17 aa, Mycobacterium
RGDLNIAQGWMNRARRL

SEQ ID NO: 853451 - protein, 24 aa, Mycobacterium
RGDLRFVVRVKADPARMLLSVRPL

SEQ ID NO: 853452 - protein, 27 aa, Mycobacterium
RGDLTSPVAFLQRPARWIHAMANGSPV

SEQ ID NO: 853453 - protein, 23 aa, Mycobacterium
RGDPRLSAIRAWVALNVGLFDDA

SEQ ID NO: 853454 - protein, 19 aa, Mycobacterium
RGDQLWIGAGTTEAVVGAD

SEQ ID NO: 853455 - protein, 25 aa, Mycobacterium
RGDQQIVRVAAPDLQKARKVCARIR

SEQ ID NO: 853456 - protein, 27 aa, Mycobacterium
RGDRDAWEFALLRGALDRGLPVLGICR

SEQ ID NO: 853457 - protein, 18 aa, Mycobacterium
RGDRLFMTMLHRHCEHVL

SEQ ID NO: 853458 - protein, 32 aa, Mycobacterium
RGDRMWEFLDRLISIALPRIRDFRGLSPKQFD

SEQ ID NO: 853459 - protein, 31 aa, Mycobacterium
RGDRMWEFLDRLISISLPRIRDFRGLSGKQF

SEQ ID NO: 853460 - protein, 32 aa, Mycobacterium; identical to SEQ ID NO: 226809

SEQ ID NO: 853461 - protein, 32 aa, Mycobacterium
RGDRMWEFLDRLVSIALPRIRDFRGLSPKQFD

SEQ ID NO: 853462 - protein, 24 aa, Mycobacterium
RGDRNLWLHIPKGAGKLFDSERHM

SEQ ID NO: 853463 - protein, 21 aa, Mycobacterium
RGDRRFGSPLKRFSSPINPSA

SEQ ID NO: 853464 - protein, 23 aa, Mycobacterium
RGDSHFICVVAEGAKPVAGSIQL

SEQ ID NO: 853465 - protein, 23 aa, Mycobacterium
RGDSHFICVVAEGAKPVAGSISL

SEQ ID NO: 853466 - protein, 22 aa, Mycobacterium
RGDVDWAALAAAPGPLILHATP

SEQ ID NO: 853467 - protein, 27 aa, Mycobacterium
RGDVIRRKAGLPPATYFSGGKIQWILD

SEQ ID NO: 853468 - protein, 37 aa, Mycobacterium
RGDVIRRKAGLPPATYFSGGKLQWLLENVDGLRADAA

SEQ ID NO: 853469 - protein, 20 aa, Mycobacterium
RGDVLELLDDIKDAIPGELD

SEQ ID NO: 853470 - protein, 27 aa, Mycobacterium
RGDVLMVWRLDRLGRSLPHLLTVASDL

SEQ ID NO: 853471 - protein, 22 aa, Mycobacterium
RGDVRRAKLYYLRDLRGKKAKI

SEQ ID NO: 853472 - protein, 20 aa, Mycobacterium
RGDWRKIFADNLETAFFMSQ

SEQ ID NO: 853473 - protein, 28 aa, Mycobacterium
RGDYLATRVAFQLGLRGPAINVQTACSS

SEQ ID NO: 853474 - protein, 29 aa, Mycobacterium
RGDYLNVFTTYDLTLRRIGETFFTTAYFD

SEQ ID NO: 853475 - protein, 25 aa, Mycobacterium
RGEADVYNMGWQKYLDARATDEQRR

SEQ ID NO: 853476 - protein, 25 aa, Mycobacterium
RGEAPPPPEPLLPLVTASDPEQRLQ

SEQ ID NO: 853477 - protein, 28 aa, Mycobacterium
RGEAQPACIALFSPWLNMAVDHELSQVI

SEQ ID NO: 853478 - protein, 38 aa, Mycobacterium
RGEDVTPFVLSLRFVVIALTHNIILNSTWVDSASGPQV

SEQ ID NO: 853479 - protein, 25 aa, Mycobacterium
RGEDYTLVLTTKNGAQFNKDIARYI

SEQ ID NO: 853480 - protein, 18 aa, Mycobacterium
RGEFEERLKAVLDDIKNS

SEQ ID NO: 853481 - protein, 18 aa, Mycobacterium
RGEFEERLKAVLDEIKNS

SEQ ID NO: 853482 - protein, 25 aa, Mycobacterium
RGEFPAVVTLDLCRLDQLFSLDEVS

SEQ ID NO: 853483 - protein, 24 aa, Mycobacterium
RGEFRPRVRFLAPGKKILHDERLD

SEQ ID NO: 853484 - protein, 25 aa, Mycobacterium
RGEFRPRVRFLSPGKKILRDDHLDL

SEQ ID NO: 853485 - protein, 39 aa, Mycobacterium
RGEFYRHTLMTPTFTPRAPFDPIPIYVGALGPRLTRMTA

SEQ ID NO: 853486 - protein, 26 aa, Mycobacterium
RGEGDIVVELFKPLPSMVVAHYLGVP

SEQ ID NO: 853487 - protein, 23 aa, Mycobacterium
RGEGFLYPRITGYLAQRLQVEDW

SEQ ID NO: 853488 - protein, 25 aa, Mycobacterium
RGEGMKLRPGLVIAIEPMLIADGTE

SEQ ID NO: 853489 - protein, 25 aa, Mycobacterium
RGEIARRVFATCRRLGLGTVAVYTE

SEQ ID NO: 853490 - protein, 25 aa, Mycobacterium
RGEKFKALMAERVPLYRQVATMRVN

SEQ ID NO: 853491 - protein, 23 aa, Mycobacterium
RGEKLPLEYVIRKQARDTAHLFG

SEQ ID NO: 853492 - protein, 19 aa, Mycobacterium
RGELLELALEEWPGRLRRL

SEQ ID NO: 853493 - protein, 19 aa, Mycobacterium
RGELPPALALQIVERHGYD

SEQ ID NO: 853494 - protein, 18 aa, Mycobacterium
RGELRPDADPRHLAVSLV

SEQ ID NO: 853495 - protein, 22 aa, Mycobacterium
RGEMMWCQLFSEPGAGSDLAGL

SEQ ID NO: 853496 - protein, 20 aa, Mycobacterium
RGEMWRPYTVKDRNLFTGQN

SEQ ID NO: 853497 - protein, 25 aa, Mycobacterium
RGEPHLITSFWFAFGSPEAARAQVH

SEQ ID NO: 853498 - protein, 17 aa, Mycobacterium
RGEPVLAPVVFTSALDL

SEQ ID NO: 853499 - protein, 23 aa, Mycobacterium
RGERLVNSMFTLSTLVGLSVAQL

SEQ ID NO: 853500 - protein, 22 aa, Mycobacterium
RGERLVNSMFTLSTLVGLSVSQ

SEQ ID NO: 853501 - protein, 26 aa, Mycobacterium
RGERWAFAHLPFAKKIYRTRLWLRSE

SEQ ID NO: 853502 - protein, 26 aa, Mycobacterium
RGESYQDLLRRRGWPALESEHTWTPD

SEQ ID NO: 853503 - protein, 20 aa, Mycobacterium
RGETKQFLTVPLGAETCGPV

SEQ ID NO: 853504 - protein, 21 aa, Mycobacterium
RGETVALLIADYRMPQMSGIE

SEQ ID NO: 853505 - protein, 27 aa, Mycobacterium
RGEVDLLVAAWLPWSHGRYFDPIADHV

SEQ ID NO: 853506 - protein, 25 aa, Mycobacterium
RGEVNVRIWIHPDYRKRGYGTAALR

SEQ ID NO: 853507 - protein, 34 aa, Mycobacterium
RGEVWAWFSRPGAMPRLVPPWQPMTALVEAASLA

SEQ ID NO: 853508 - protein, 17 aa, Mycobacterium
RGEWYLRQMLGAANFKA

SEQ ID NO: 853509 - protein, 19 aa, Mycobacterium
RGFAFYALDLHKCGRSHRD

SEQ ID NO: 853510 - protein, 17 aa, Mycobacterium
RGFDPVPAALSAAAAAG

SEQ ID NO: 853511 - protein, 28 aa, Mycobacterium
RGFERFPAWMWRNTVVRDFVAWLRACNA

SEQ ID NO: 853512 - protein, 26 aa, Mycobacterium
RGFERFPAWMWRNTVVRDFVDWLRER

SEQ ID NO: 853513 - protein, 24 aa, Mycobacterium
RGFFSLVAVLERGAMLPTAEIRDL

SEQ ID NO: 853514 - protein, 19 aa, Mycobacterium
RGFFTSRVIGTFVNEALAM

SEQ ID NO: 853515 - protein, 20 aa, Mycobacterium
RGFGFANYLEANGGLQVAEA

SEQ ID NO: 853516 - protein, 25 aa, Mycobacterium
RGFLCQYHLWSYDLEGTLKGLLREN

SEQ ID NO: 853517 - protein, 19 aa, Mycobacterium
RGFLKFRWQRTNRPILDED

SEQ ID NO: 853518 - protein, 17 aa, Mycobacterium
RGFLPTGGRALRVFEPS

SEQ ID NO: 853519 - protein, 18 aa, Mycobacterium
RGFLRAVAALARAAKLIG

SEQ ID NO: 853520 - protein, 17 aa, Mycobacterium
RGFRRPDEKLRRLRRNQ

SEQ ID NO: 853521 - protein, 18 aa, Mycobacterium
RGFSAIEQFIFSEEARRV

SEQ ID NO: 853522 - protein, 22 aa, Mycobacterium
RGFSLGHFPQSFEYATIGGFAA

SEQ ID NO: 853523 - protein, 18 aa, Mycobacterium
RGFVLTGPDLRNVCGWTL

SEQ ID NO: 853524 - protein, 19 aa, Mycobacterium
RGFWAKLEGFNPGGMKDRP

SEQ ID NO: 853525 - protein, 34 aa, Mycobacterium
RGGAGGTGLPGVPPPFGSGDYLAGSGGNGGNAGA

SEQ ID NO: 853526 - protein, 21 aa, Mycobacterium
RGGALYYHIGSKEELLWEILR

SEQ ID NO: 853527 - protein, 38 aa, Mycobacterium
RGGAPLIEYLEADPLLKFVPLPWPDYYGKAPKARLDGR

SEQ ID NO: 853528 - protein, 39 aa, Mycobacterium
RGGAPLIEYLEADPNLKFVPLPWPDYYGKAPKARLDGQR

SEQ ID NO: 853529 - protein, 21 aa, Mycobacterium
RGGAYRRSLRLPFGGAVVSLT

SEQ ID NO: 853530 - protein, 17 aa, Mycobacterium
RGGEWLEWFTEQDIAGI

SEQ ID NO: 853531 - protein, 17 aa, Mycobacterium
RGGFLPGTDPDRGDYAS

SEQ ID NO: 853532 - protein, 18 aa, Mycobacterium
RGGFPEGCFQTLLVSSGA

SEQ ID NO: 853533 - protein, 17 aa, Mycobacterium
RGGFTGMLLGSVSSAVA

SEQ ID NO: 853534 - protein, 28 aa, Mycobacterium
RGGGPYTVYIWAGLAMVLARIGLGPLRR

SEQ ID NO: 853535 - protein, 23 aa, Mycobacterium
RGGIPGLLRRAIQRFPQTFYPTN

SEQ ID NO: 853536 - protein, 21 aa, Mycobacterium
RGGITVLPQDLPVQAVAQTVE

SEQ ID NO: 853537 - protein, 26 aa, Mycobacterium
RGGLGGFAGLFALKRDYREPVLASST

SEQ ID NO: 853538 - protein, 27 aa, Mycobacterium
RGGLGGFAGLFALRNDYREPLLAASTD

SEQ ID NO: 853539 - protein, 27 aa, Mycobacterium
RGGLGGFAGLFALRNDYREPVLAASTD

SEQ ID NO: 853540 - protein, 17 aa, Mycobacterium
RGGLLLNWDVRESAFPH

SEQ ID NO: 853541 - protein, 18 aa, Mycobacterium
RGGLLLYGPPGCGKTYIA

SEQ ID NO: 853542 - protein, 19 aa, Mycobacterium
RGGLLRLGLTGTAAFSHLP

SEQ ID NO: 853543 - protein, 19 aa, Mycobacterium
RGGLPLQRLVNGETLSAVA

SEQ ID NO: 853544 - protein, 21 aa, Mycobacterium
RGGLTRFLATRYDLEKSRTAA

SEQ ID NO: 853545 - protein, 24 aa, Mycobacterium
RGGMFAQLCADLPWAQQLSEVWRM

SEQ ID NO: 853546 - protein, 19 aa, Mycobacterium
RGGMFEQLCADLPWSQRLS

SEQ ID NO: 853547 - protein, 24 aa, Mycobacterium
RGGMHAVVGPFWKTNPWSAAYRQE

SEQ ID NO: 853548 - protein, 29 aa, Mycobacterium
RGGNGGSGGLLFGGGGIGGTGGTGAAGAG

SEQ ID NO: 853549 - protein, 21 aa, Mycobacterium
RGGPDFILHQYRKYGPVYYSG

SEQ ID NO: 853550 - protein, 25 aa, Mycobacterium
RGGPDYLMFLYRTKGPVVFGDSPVL

SEQ ID NO: 853551 - protein, 23 aa, Mycobacterium
RGGPGMQEMLYPTSFLKGRGLGK

SEQ ID NO: 853552 - protein, 25 aa, Mycobacterium
RGGPGTVFAASFVAALNGAGLGGHV

SEQ ID NO: 853553 - protein, 19 aa, Mycobacterium
RGGTHLAFGFGMHRCLGAF

SEQ ID NO: 853554 - protein, 24 aa, Mycobacterium
RGGTPLEFTSLAGSALLSFGASRE

SEQ ID NO: 853555 - protein, 25 aa, Mycobacterium
RGGTRHYRLLAEILTMAFATERDPG

SEQ ID NO: 853556 - protein, 22 aa, Mycobacterium
RGGTSWVQAGYGPTTGGKASGT

SEQ ID NO: 853557 - protein, 18 aa, Mycobacterium
RGGYLTDIKGFDSEFFAL

SEQ ID NO: 853558 - protein, 23 aa, Mycobacterium
RGHAVAFVRRVLGPLAANDEGTY

SEQ ID NO: 853559 - protein, 17 aa, Mycobacterium
RGHGMSVDLGRLGLPHE

SEQ ID NO: 853560 - protein, 17 aa, Mycobacterium
RGHLDGIIRMVESDAYC

SEQ ID NO: 853561 - protein, 23 aa, Mycobacterium
RGHLDNHILPALGDLGLAEITPE

SEQ ID NO: 853562 - protein, 17 aa, Mycobacterium
RGHLRIAMTPTFTAYFI

SEQ ID NO: 853563 - protein, 17 aa, Mycobacterium
RGHRYLDDLPPRTRLPA

SEQ ID NO: 853564 - protein, 21 aa, Mycobacterium
RGHSVLVQVPRRGYVPALACT

SEQ ID NO: 853565 - protein, 23 aa, Mycobacterium
RGHTAFLISARRLAPGTVTPVPL

SEQ ID NO: 853566 - protein, 19 aa, Mycobacterium
RGHTDTRLILLDSLPTLDT

SEQ ID NO: 853567 - protein, 24 aa, Mycobacterium
RGHTDTRLILLDSLPTLDTNTDPT

SEQ ID NO: 853568 - protein, 23 aa, Mycobacterium
RGHTDTRLILLDSLPTLDTNTNP

SEQ ID NO: 853569 - protein, 21 aa, Mycobacterium
RGHVDILVAIPSPGRLLVHVQ

SEQ ID NO: 853570 - protein, 19 aa, Mycobacterium
RGHYFGDRMPYIPEDQLAA

SEQ ID NO: 853571 - protein, 18 aa, Mycobacterium
RGIARVLAFEHPELATTI

SEQ ID NO: 853572 - protein, 20 aa, Mycobacterium
RGIARYSLGLPGWRDDQRQA

SEQ ID NO: 853573 - protein, 27 aa, Mycobacterium
RGIAVADVPNLFFLLGPNTGLGHNSVV

SEQ ID NO: 853574 - protein, 25 aa, Mycobacterium
RGICGYRRFFSITSLAALRQEDHAV

SEQ ID NO: 853575 - protein, 17 aa, Mycobacterium
RGIDTFVELAVHPSLQL

SEQ ID NO: 853576 - protein, 18 aa, Mycobacterium
RGIEGKLGAIRYARKRRV

SEQ ID NO: 853577 - protein, 26 aa, Mycobacterium
RGIEPTAMLQFWRGSTQSGWNPRDHN

SEQ ID NO: 853578 - protein, 17 aa, Mycobacterium
RGIGYFILDMRSPGIEI

SEQ ID NO: 853579 - protein, 21 aa, Mycobacterium
RGIHPAILSQAGLEPALRALA

SEQ ID NO: 853580 - protein, 19 aa, Mycobacterium
RGILDRFTPQGFSAPVAHF

SEQ ID NO: 853581 - protein, 18 aa, Mycobacterium
RGILRAQLDRLDALGLDA

SEQ ID NO: 853582 - protein, 23 aa, Mycobacterium
RGILRDPRFVFPPGMHMTARGIT

SEQ ID NO: 853583 - protein, 18 aa, Mycobacterium
RGINDRCRALRPHAATLV

SEQ ID NO: 853584 - protein, 24 aa, Mycobacterium
RGINVNMLGCYYCNLFAAECMERN

SEQ ID NO: 853585 - protein, 17 aa, Mycobacterium
RGIPIITVINKWDRPGR

SEQ ID NO: 853586 - protein, 19 aa, Mycobacterium
RGIPLMRSLMHDVDIRPAH

SEQ ID NO: 853587 - protein, 24 aa, Mycobacterium
RGIRQVVILASGLDTRAHRLPWPT

SEQ ID NO: 853588 - protein, 21 aa, Mycobacterium
RGIRRFGDAFIPMDETLAHAA

SEQ ID NO: 853589 - protein, 22 aa, Mycobacterium
RGIRRFGDAFIPMDETLAHAAV

SEQ ID NO: 853590 - protein, 17 aa, Mycobacterium
RGIRSFGPLRASLGRDT

SEQ ID NO: 853591 - protein, 20 aa, Mycobacterium
RGISTLLGSLGIDGSHSYHH

SEQ ID NO: 853592 - protein, 39 aa, Mycobacterium
RGITAFLVPCDSPGFTVPYYWWTFNMPTDHGEVLLENVR

SEQ ID NO: 853593 - protein, 17 aa, Mycobacterium
RGITIKAQNVRLPWKVD

SEQ ID NO: 853594 - protein, 18 aa, Mycobacterium
RGITIKAQNVRLPWKVGD

SEQ ID NO: 853595 - protein, 27 aa, Mycobacterium
RGITVADVPNLFFLLGPNTGLGHNSVV

SEQ ID NO: 853596 - protein, 27 aa, Mycobacterium
RGITVAGMPNLFFLLGPNTALGHNSVV

SEQ ID NO: 853597 - protein, 18 aa, Mycobacterium
RGITVLGDRPPMVSVTNA

SEQ ID NO: 853598 - protein, 18 aa, Mycobacterium
RGIVEAVYALVYGLVELA

SEQ ID NO: 853599 - protein, 17 aa, Mycobacterium
RGIVPVVLGGDHSITWP

SEQ ID NO: 853600 - protein, 20 aa, Mycobacterium
RGIYPFGGATIRLPGEAGWG

SEQ ID NO: 853601 - protein, 29 aa, Mycobacterium
RGKAALRRYWIAALERIPDLRFTVEGVYQ

SEQ ID NO: 853602 - protein, 25 aa, Mycobacterium
RGKIEALLRVLEPFGIREIVQSGVV

SEQ ID NO: 853603 - protein, 24 aa, Mycobacterium
RGKKLTFELARFVKFMITEIFPGG

SEQ ID NO: 853604 - protein, 18 aa, Mycobacterium
RGKPIFEYLADEGELARV

SEQ ID NO: 853605 - protein, 27 aa, Mycobacterium
RGKRIRQPVPLTLSLRPPTVTPAAPPA

SEQ ID NO: 853606 - protein, 17 aa, Mycobacterium
RGKRQFRRAILDIGTGQ

SEQ ID NO: 853607 - protein, 18 aa, Mycobacterium
RGKRRLADAMPYAPGVYL

SEQ ID NO: 853608 - protein, 22 aa, Mycobacterium
RGKWAYYRLDAAAFGQLAQLIT

SEQ ID NO: 853609 - protein, 23 aa, Mycobacterium
RGKWAYYRLVPATLDALAGVFAR

SEQ ID NO: 853610 - protein, 18 aa, Mycobacterium
RGKWHGGLSFTGKCVAPI

SEQ ID NO: 853611 - protein, 34 aa, Mycobacterium
RGLAADHTLFQWLTALYPVWQGIDADSLHVAAQG

SEQ ID NO: 853612 - protein, 25 aa, Mycobacterium
RGLAGRLCVPDRLRALPPGRDAQYT

SEQ ID NO: 853613 - protein, 22 aa, Mycobacterium
RGLALFDMFTYFNELTASRRAQ

SEQ ID NO: 853614 - protein, 17 aa, Mycobacterium
RGLALFVSGDNLRKGAA

SEQ ID NO: 853615 - protein, 20 aa, Mycobacterium
RGLALFVSGDNLRKGAALNT

SEQ ID NO: 853616 - protein, 17 aa, Mycobacterium
RGLATILVGEALQATRD

SEQ ID NO: 853617 - protein, 29 aa, Mycobacterium
RGLCGKGTPGWRWLDVRALATRLVTAHSV

SEQ ID NO: 853618 - protein, 18 aa, Mycobacterium
RGLDFDRVAQRRPGPVGF

SEQ ID NO: 853619 - protein, 23 aa, Mycobacterium
RGLDFFVRRGEIFGFLGPSGAGK

SEQ ID NO: 853620 - protein, 17 aa, Mycobacterium
RGLDLSAGTRVAACLTT

SEQ ID NO: 853621 - protein, 17 aa, Mycobacterium
RGLDLVLGHGLHRVDQA

SEQ ID NO: 853622 - protein, 29 aa, Mycobacterium
RGLDPLTTVPLLAPVLSIAPEYGYQPAPA

SEQ ID NO: 853623 - protein, 24 aa, Mycobacterium
RGLDRGVGIADRGGRRGVIAGAVS

SEQ ID NO: 853624 - protein, 39 aa, Mycobacterium
RGLETLTLDIYRIGQYIAWRLWINIAFDLTSDPQELREL

SEQ ID NO: 853625 - protein, 17 aa, Mycobacterium
RGLFLQRIDKDPNWFRY

SEQ ID NO: 853626 - protein, 19 aa, Mycobacterium
RGLFPVLVALRQWSGEFCF

SEQ ID NO: 853627 - protein, 23 aa, Mycobacterium
RGLGERGLACPLLVISDGAPGLI

SEQ ID NO: 853628 - protein, 20 aa, Mycobacterium
RGLGFTERPPAKPLIAAVEG

SEQ ID NO: 853629 - protein, 24 aa, Mycobacterium
RGLGFTNVPPRKPIIAAVEGFALA

SEQ ID NO: 853630 - protein, 29 aa, Mycobacterium
RGLGGDATRLLYTLGWHEVAVPPVAGEGE

SEQ ID NO: 853631 - protein, 30 aa, Mycobacterium
RGLGGDATRLLYTLGWHEVPPPASEEAGEP

SEQ ID NO: 853632 - protein, 31 aa, Mycobacterium
RGLGGDATRLLYTLGWHEVPPPPSADDAVGT

SEQ ID NO: 853633 - protein, 28 aa, Mycobacterium
RGLGGDATRLLYTLGWHEVPVPESGDGA

SEQ ID NO: 853634 - protein, 29 aa, Mycobacterium
RGLGGDVARLLYTLGWHEVPAPSGDAGAD

SEQ ID NO: 853635 - protein, 26 aa, Mycobacterium
RGLGKALTLIGLSSLARRLAGVNPAE

SEQ ID NO: 853636 - protein, 23 aa, Mycobacterium
RGLGRLVDERLVLTDQGRLLADG

SEQ ID NO: 853637 - protein, 21 aa, Mycobacterium
RGLGRLYALDLARRGAAVVVN

SEQ ID NO: 853638 - protein, 22 aa, Mycobacterium
RGLGRLYALDLARRGATVVVND

SEQ ID NO: 853639 - protein, 23 aa, Mycobacterium
RGLGRRFRAARQAGLRDGARRCA

SEQ ID NO: 853640 - protein, 19 aa, Mycobacterium
RGLGTGHFFDRSGLLLATV

SEQ ID NO: 853641 - protein, 24 aa, Mycobacterium
RGLGVLVCFAGTVRAPLGLHKRHT

SEQ ID NO: 853642 - protein, 19 aa, Mycobacterium
RGLHALRARGALIRIGHDA

SEQ ID NO: 853643 - protein, 20 aa, Mycobacterium
RGLHVFVPIDDSAPVDDVAA

SEQ ID NO: 853644 - protein, 33 aa, Mycobacterium
RGLIAEFGISWILPRLTSWAVALDLLLSGRTFL

SEQ ID NO: 853645 - protein, 17 aa, Mycobacterium
RGLIAQSTDLDALAAEL

SEQ ID NO: 853646 - protein, 20 aa, Mycobacterium
RGLIDSQLYRQQPRGLLVGY

SEQ ID NO: 853647 - protein, 19 aa, Mycobacterium
RGLILLPAVDVVNGQAVRL

SEQ ID NO: 853648 - protein, 23 aa, Mycobacterium
RGLITPDLIPDEAQPWFAASDEH

SEQ ID NO: 853649 - protein, 27 aa, Mycobacterium
RGLLAADHRVFYGIPYAAPPQGRARFT

SEQ ID NO: 853650 - protein, 33 aa, Mycobacterium
RGLLDNYLRLKDQGLLPFWCVNHGPTLSMYYRD

SEQ ID NO: 853651 - protein, 17 aa, Mycobacterium
RGLLDRTGLAPAAVGDV

SEQ ID NO: 853652 - protein, 37 aa, Mycobacterium
RGLLLRIRFELDHHINLRPGRLYPGVQSPLAGNPEID

SEQ ID NO: 853653 - protein, 27 aa, Mycobacterium
RGLLLRLRFELDHHINLRPGRLYPGVN

SEQ ID NO: 853654 - protein, 17 aa, Mycobacterium
RGLLRRARLAMRCAPAG

SEQ ID NO: 853655 - protein, 19 aa, Mycobacterium
RGLLVLLDALRSTITGAAP

SEQ ID NO: 853656 - protein, 18 aa, Mycobacterium
RGLLWLESDLPPDPDVLL

SEQ ID NO: 853657 - protein, 20 aa, Mycobacterium
RGLLYGEELLGQPVRQLADN

SEQ ID NO: 853658 - protein, 19 aa, Mycobacterium
RGLLYHRYRIDDAGLVSAA

SEQ ID NO: 853659 - protein, 21 aa, Mycobacterium
RGLNVVLLARRQPVLDTVAAQ

SEQ ID NO: 853660 - protein, 19 aa, Mycobacterium
RGLPAVGINWGPWAEVGRA

SEQ ID NO: 853661 - protein, 29 aa, Mycobacterium
RGLPITMTKLRFMKFIMDEIFPGGDLPAA

SEQ ID NO: 853662 - protein, 17 aa, Mycobacterium
RGLPLWQKLTVYTSESA

SEQ ID NO: 853663 - protein, 23 aa, Mycobacterium
RGLPVLGICRGAQVLNVAFGGTL

SEQ ID NO: 853664 - protein, 28 aa, Mycobacterium
RGLQAAWELFVPYLQPLIANLVTEAIPR

SEQ ID NO: 853665 - protein, 23 aa, Mycobacterium
RGLQWSWSRYLAGAAVRAAALIA

SEQ ID NO: 853666 - protein, 18 aa, Mycobacterium
RGLQYRVIADATPPDYRI

SEQ ID NO: 853667 - protein, 19 aa, Mycobacterium
RGLRFGFITGSAPSTVIAV

SEQ ID NO: 853668 - protein, 26 aa, Mycobacterium
RGLRFLADQVLRRYPVRVSRDLRDEF

SEQ ID NO: 853669 - protein, 24 aa, Mycobacterium
RGLRGRLFGILGSSLALGDHLIAH

SEQ ID NO: 853670 - protein, 18 aa, Mycobacterium
RGLRITPQQLRDTAEREA

SEQ ID NO: 853671 - protein, 21 aa, Mycobacterium
RGLRLGGYVFNRLYTDLYQLG

SEQ ID NO: 853672 - protein, 29 aa, Mycobacterium
RGLRQLSSLARWGFTLQGGYAAAAARAPK

SEQ ID NO: 853673 - protein, 34 aa, Mycobacterium
RGLRRDRVLALGLRLLDLGYFRAGGEKYAEENNS

SEQ ID NO: 853674 - protein, 17 aa, Mycobacterium
RGLRRRGGTIVKSAGIV

SEQ ID NO: 853675 - protein, 23 aa, Mycobacterium
RGLSFMARYVLHNGFLESDKLAE

SEQ ID NO: 853676 - protein, 23 aa, Mycobacterium
RGLSGLGRLLLGSTTAAMLHHAR

SEQ ID NO: 853677 - protein, 20 aa, Mycobacterium
RGLTLTGGLPYFGGPGNNYS

SEQ ID NO: 853678 - protein, 19 aa, Mycobacterium
RGLTPIIDPRWIHAVENRA

SEQ ID NO: 853679 - protein, 22 aa, Mycobacterium
RGLTSVWVAVLQAALDAIVRAN

SEQ ID NO: 853680 - protein, 30 aa, Mycobacterium
RGLTTGVGFAYFQMDWPAVTQWLAEARNLL

SEQ ID NO: 853681 - protein, 18 aa, Mycobacterium
RGLVDVVIPRGGAGLIDA

SEQ ID NO: 853682 - protein, 26 aa, Mycobacterium
RGLVKKYSDFIAWPIRMQVERREPAS

SEQ ID NO: 853683 - protein, 17 aa, Mycobacterium
RGLVPEISLIFGKCAGG

SEQ ID NO: 853684 - protein, 20 aa, Mycobacterium
RGLVSRMFTPRSIAALRITL

SEQ ID NO: 853685 - protein, 17 aa, Mycobacterium
RGLVYVVVDNREFLRAR

SEQ ID NO: 853686 - protein, 21 aa, Mycobacterium
RGLWQALSRRDWEAIPTFLSD

SEQ ID NO: 853687 - protein, 17 aa, Mycobacterium
RGMAFAHPELRIDHTNR

SEQ ID NO: 853688 - protein, 30 aa, Mycobacterium
RGMALAAELCLPLVLVIDTAGPALSAEAEE

SEQ ID NO: 853689 - protein, 33 aa, Mycobacterium
RGMAVIISDFLGPINWMRPLRAIAARHEVLAIE

SEQ ID NO: 853690 - protein, 33 aa, Mycobacterium
RGMAVIISDFLGPINWMRPLRAIGGRHEVLGIE

SEQ ID NO: 853691 - protein, 33 aa, Mycobacterium
RGMAVIISDFLGPINWMRPLRAISARHEVLAIE

SEQ ID NO: 853692 - protein, 33 aa, Mycobacterium
RGMAVIISDFLGPINWMRPLRAVAARHEVLAIE

SEQ ID NO: 853693 - protein, 17 aa, Mycobacterium
RGMEALRKGGASAATVK

SEQ ID NO: 853694 - protein, 17 aa, Mycobacterium
RGMKMGLYYSGGYDWTF

SEQ ID NO: 853695 - protein, 19 aa, Mycobacterium
RGMLVDHFDERLGRNVLGP

SEQ ID NO: 853696 - protein, 28 aa, Mycobacterium
RGMRIASVILFGELILQTALSMAADKAS

SEQ ID NO: 853697 - protein, 28 aa, Mycobacterium
RGMRIASVILFGELILQTALSMAADRAS

SEQ ID NO: 853698 - protein, 26 aa, Mycobacterium
RGMSKLIEPLGLTTPLAAFNGGLFVR

SEQ ID NO: 853699 - protein, 18 aa, Mycobacterium
RGMTDFPMALSYVLDPTA

SEQ ID NO: 853700 - protein, 22 aa, Mycobacterium
RGMTFREYISAYGLTRSEGAVL

SEQ ID NO: 853701 - protein, 17 aa, Mycobacterium
RGMTGHEIARWTAAMIA

SEQ ID NO: 853702 - protein, 20 aa, Mycobacterium
RGMTLAELRDRVRGEFVGTS

SEQ ID NO: 853703 - protein, 23 aa, Mycobacterium
RGMTLRDILVSPPIWFDDDSNVI

SEQ ID NO: 853704 - protein, 24 aa, Mycobacterium
RGMTVADWRGHWGRRPNALIGMEV

SEQ ID NO: 853705 - protein, 21 aa, Mycobacterium
RGMWHALSRRDWDGVKTFLSP

SEQ ID NO: 853706 - protein, 18 aa, Mycobacterium
RGNDYTDLALVTDGLRAE

SEQ ID NO: 853707 - protein, 17 aa, Mycobacterium
RGNHTQLPLGFMVEWEA

SEQ ID NO: 853708 - protein, 23 aa, Mycobacterium
RGNIRALLQMAVVLTYGASMPVV

SEQ ID NO: 853709 - protein, 30 aa, Mycobacterium
RGNLAAAMQGLIALPLLAGYDIHAADPQTA

SEQ ID NO: 853710 - protein, 21 aa, Mycobacterium
RGNLLYPRYDGNLGLIAPFQR

SEQ ID NO: 853711 - protein, 38 aa, Mycobacterium
RGNMFRQVQQRWLEWQKLFLSIIPFPEISAARAMPMAI

SEQ ID NO: 853712 - protein, 20 aa, Mycobacterium
RGNMPPPLAPPSPGAPAVGV

SEQ ID NO: 853713 - protein, 29 aa, Mycobacterium
RGNPDYGLRLSWDFLARSTAGLWEWAECL

SEQ ID NO: 853714 - protein, 24 aa, Mycobacterium
RGNRFGLFVMIEGQRLLLSTAGAG

SEQ ID NO: 853715 - protein, 18 aa, Mycobacterium
RGNRHFSFGIGVHRCIGS

SEQ ID NO: 853716 - protein, 22 aa, Mycobacterium
RGNRKAWWRRSTTPPPNAGGAP

SEQ ID NO: 853717 - protein, 22 aa, Mycobacterium
RGNWSLDLGYFLQGALTVEDRR

SEQ ID NO: 853718 - protein, 18 aa, Mycobacterium
RGPACWYFDEGELDVWEV

SEQ ID NO: 853719 - protein, 17 aa, Mycobacterium
RGPAERITLIPLGGEPV

SEQ ID NO: 853720 - protein, 27 aa, Mycobacterium
RGPAWPVVYPHARPVPLPTYPFQHHRY

SEQ ID NO: 853721 - protein, 24 aa, Mycobacterium
RGPAYWLKYNPYAEWYQNTIAIPG

SEQ ID NO: 853722 - protein, 27 aa, Mycobacterium
RGPDAIIPPTFLTTAGRWAPAGVRVDV

SEQ ID NO: 853723 - protein, 22 aa, Mycobacterium
RGPDHSEKLAAWLLERQPKVVT

SEQ ID NO: 853724 - protein, 17 aa, Mycobacterium
RGPEVVDLLSALNTGHD

SEQ ID NO: 853725 - protein, 18 aa, Mycobacterium
RGPFLNRRAMIAEAKETL

SEQ ID NO: 853726 - protein, 21 aa, Mycobacterium
RGPHRVLRGDLAFAGLPGVIY

SEQ ID NO: 853727 - protein, 20 aa, Mycobacterium
RGPHRVLRGDLAFAGLPGVV

SEQ ID NO: 853728 - protein, 22 aa, Mycobacterium
RGPHRVLRGDLAFAGLPGVVYT

SEQ ID NO: 853729 - protein, 19 aa, Mycobacterium
RGPIGLGFRTPCIVISPYS

SEQ ID NO: 853730 - protein, 18 aa, Mycobacterium
RGPIRAVVRIRPGSAAVR

SEQ ID NO: 853731 - protein, 29 aa, Mycobacterium
RGPKGRAKVLARYALWLGEHRAEIERLLI

SEQ ID NO: 853732 - protein, 18 aa, Mycobacterium
RGPKRYVCGGVMLSFDEM

SEQ ID NO: 853733 - protein, 25 aa, Mycobacterium
RGPLRDWVERIWSLSWAEPVPADFS

SEQ ID NO: 853734 - protein, 18 aa, Mycobacterium
RGPLTRQLALLPKQLRNS

SEQ ID NO: 853735 - protein, 26 aa, Mycobacterium
RGPLTVPIWYQYSPGGELWFTTGAGS

SEQ ID NO: 853736 - protein, 22 aa, Mycobacterium
RGPMAFNIPRSCSPTMPTTGSR

SEQ ID NO: 853737 - protein, 28 aa, Mycobacterium
RGPMDRFHRRLLWPIRASSGEVIGFGAR

SEQ ID NO: 853738 - protein, 29 aa, Mycobacterium
RGPMDRFHRRLLWPIRVSSGETIGFGARR

SEQ ID NO: 853739 - protein, 23 aa, Mycobacterium
RGPQALSLKLIDAPPSVQKTRRE

SEQ ID NO: 853740 - protein, 25 aa, Mycobacterium
RGPQALSLKLLDPPPSLTRTRREAV

SEQ ID NO: 853741 - protein, 24 aa, Mycobacterium
RGPQLFAYDVWWHRDFDTVITSEW

SEQ ID NO: 853742 - protein, 18 aa, Mycobacterium
RGPQLLDYLRGYRERAQI

SEQ ID NO: 853743 - protein, 28 aa, Mycobacterium
RGPRFAVPMGLLNAAIPVIEPIGKLLKN

SEQ ID NO: 853744 - protein, 26 aa, Mycobacterium
RGPRLPRWVQALLMLTHGSHFVAACH

SEQ ID NO: 853745 - protein, 23 aa, Mycobacterium
RGPRRFHLDNPHPALGDAGHQRH

SEQ ID NO: 853746 - protein, 20 aa, Mycobacterium
RGPRRYMVGGHRIPVAELAE

SEQ ID NO: 853747 - protein, 18 aa, Mycobacterium
RGPRSFALPEFDPFWQRC

SEQ ID NO: 853748 - protein, 24 aa, Mycobacterium
RGPTPPKVKSPFGMPGMPGMPGMP

SEQ ID NO: 853749 - protein, 18 aa, Mycobacterium
RGPVLDDLRDFTFLDAFA

SEQ ID NO: 853750 - protein, 18 aa, Mycobacterium
RGPVWEEVILHLPDEVRV

SEQ ID NO: 853751 - protein, 19 aa, Mycobacterium
RGPVWEEVILHLPDEVRVV

SEQ ID NO: 853752 - protein, 17 aa, Mycobacterium
RGPVWFRHLVSERPIGD

SEQ ID NO: 853753 - protein, 17 aa, Mycobacterium
RGPVYSGLRIGTLAAHP

SEQ ID NO: 853754 - protein, 21 aa, Mycobacterium
RGQAILDRFMTLGLPVRHKAL

SEQ ID NO: 853755 - protein, 33 aa, Mycobacterium
RGQDKTHWIIVSTGMFTSFLFEPAFGVVDLQSN

SEQ ID NO: 853756 - protein, 19 aa, Mycobacterium
RGQFLPAGTVTLTIYYHAN

SEQ ID NO: 853757 - protein, 18 aa, Mycobacterium
RGQGLLHEVGLAGAPDIV

SEQ ID NO: 853758 - protein, 24 aa, Mycobacterium
RGQGMTMALLEAAALRDCLFEGDA

SEQ ID NO: 853759 - protein, 29 aa, Mycobacterium
RGQGRRCRRHLGPALRLIDDVGAVRMLGE

SEQ ID NO: 853760 - protein, 25 aa, Mycobacterium
RGQIHVFQALFRLLPEARHALRLSG

SEQ ID NO: 853761 - protein, 20 aa, Mycobacterium
RGQIHVFQAMFRILPEAREA

SEQ ID NO: 853762 - protein, 27 aa, Mycobacterium
RGQILYDAPEIVIPFLVPDGAHDYPDD

SEQ ID NO: 853763 - protein, 19 aa, Mycobacterium
RGQLFPLATLVTPNLDEVR

SEQ ID NO: 853764 - protein, 35 aa, Mycobacterium
RGQLHVLPQVDAKILWLFKRAVPATYTRALGLVER

SEQ ID NO: 853765 - protein, 25 aa, Mycobacterium
RGQMRTEILRLQRKLGVTTVYVTHD

SEQ ID NO: 853766 - protein, 23 aa, Mycobacterium
RGQPLAHRMAVLATLFANARGHI

SEQ ID NO: 853767 - protein, 24 aa, Mycobacterium
RGQPLVHRLSTMATLFINARGHIS

SEQ ID NO: 853768 - protein, 21 aa, Mycobacterium
RGQPVLRRLSVLATLLADARG

SEQ ID NO: 853769 - protein, 29 aa, Mycobacterium
RGQQHVQPKNRLPGPPLQQQTRGEQAHHP

SEQ ID NO: 853770 - protein, 24 aa, Mycobacterium
RGQRAYLGYGLWSKRRRAPGLTPE

SEQ ID NO: 853771 - protein, 21 aa, Mycobacterium
RGQRVSDDSFLLCFNAHDEPL

SEQ ID NO: 853772 - protein, 25 aa, Mycobacterium
RGQSKYLVYQYLPSRYGMNPDDLRK

SEQ ID NO: 853773 - protein, 19 aa, Mycobacterium
RGQTWTWRAHLAAAARHAA

SEQ ID NO: 853774 - protein, 24 aa, Mycobacterium
RGQVDVLPFQLVTMGQPIADFANE

SEQ ID NO: 853775 - protein, 31 aa, Mycobacterium
RGQVGACPMTWPWNVLGWPSINVPAGFTADG

SEQ ID NO: 853776 - protein, 24 aa, Mycobacterium
RGQVYGLVAPLWEQARVLADHLTG

SEQ ID NO: 853777 - protein, 28 aa, Mycobacterium
RGQWGFRGTVVSDYWSVPFLAMMHRVAA

SEQ ID NO: 853778 - protein, 17 aa, Mycobacterium
RGQYRKALKADKSKILD

SEQ ID NO: 853779 - protein, 17 aa, Mycobacterium
RGRAAISAFWDKAIEPT

SEQ ID NO: 853780 - protein, 17 aa, Mycobacterium
RGRAALIDLKQAKPASA

SEQ ID NO: 853781 - protein, 21 aa, Mycobacterium
RGRAHWPLGTLQLEALAACNT

SEQ ID NO: 853782 - protein, 20 aa, Mycobacterium
RGRALTLLLPALRALVTTQS

SEQ ID NO: 853783 - protein, 34 aa, Mycobacterium
RGRARIEFKLRDWLFARQRYWGEPFPIVYDSDGR

SEQ ID NO: 853784 - protein, 19 aa, Mycobacterium
RGRDLAARKPITSQDVERA

SEQ ID NO: 853785 - protein, 17 aa, Mycobacterium
RGRELSQPPARFGPISG

SEQ ID NO: 853786 - protein, 24 aa, Mycobacterium
RGREPLRFIVLDELNKYAPRQGTS

SEQ ID NO: 853787 - protein, 23 aa, Mycobacterium
RGRFAMGMARPPERFTDGLVKAL

SEQ ID NO: 853788 - protein, 24 aa, Mycobacterium
RGRFGDTLPFLVKVLAADEPLSLQ

SEQ ID NO: 853789 - protein, 17 aa, Mycobacterium
RGRFPIERLVTEFSHRD

SEQ ID NO: 853790 - protein, 18 aa, Mycobacterium
RGRFYEGMRALHGAPDEV

SEQ ID NO: 853791 - protein, 21 aa, Mycobacterium
RGRGGFPGMLLGSVGSAVAHS

SEQ ID NO: 853792 - protein, 17 aa, Mycobacterium
RGRGGIVLFGSGAGLAG

SEQ ID NO: 853793 - protein, 25 aa, Mycobacterium
RGRGIPLMHALTDRAVIDATPTGTK

SEQ ID NO: 853794 - protein, 29 aa, Mycobacterium
RGRGMVLTPSIFWAGPPLVGELDEQPVVL

SEQ ID NO: 853795 - protein, 25 aa, Mycobacterium
RGRGPVATVLIQRGTLRVGDSVVAG

SEQ ID NO: 853796 - protein, 34 aa, Mycobacterium
RGRGSRVEFWAFDLLYLDGRSLLRARYQDRRKLL

SEQ ID NO: 853797 - protein, 24 aa, Mycobacterium
RGRGYAGFLRILDEGRIAIAAVAT

SEQ ID NO: 853798 - protein, 23 aa, Mycobacterium
RGRHAEWPMVLAASPHIADPGRI

SEQ ID NO: 853799 - protein, 22 aa, Mycobacterium
RGRHLYFAWDHTAQRIGNVPKA

SEQ ID NO: 853800 - protein, 17 aa, Mycobacterium
RGRHPFAVYRWVFELEE

SEQ ID NO: 853801 - protein, 25 aa, Mycobacterium
RGRHPSLCLFASWSAPDSPAGRRLA

SEQ ID NO: 853802 - protein, 18 aa, Mycobacterium
RGRIAQLQRWPDGLQAAV

SEQ ID NO: 853803 - protein, 21 aa, Mycobacterium
RGRIAQLQRWPDGLQAAVEAK

SEQ ID NO: 853804 - protein, 21 aa, Mycobacterium
RGRIATLQRWPDGLQAAVEAK

SEQ ID NO: 853805 - protein, 26 aa, Mycobacterium
RGRICHWILEIHLVDRPRGFGGFYEQ

SEQ ID NO: 853806 - protein, 26 aa, Mycobacterium
RGRIKQMLLKIGWPAEDLAGYVDGEA

SEQ ID NO: 853807 - protein, 18 aa, Mycobacterium
RGRILGVVPKSYLPTYRE

SEQ ID NO: 853808 - protein, 21 aa, Mycobacterium
RGRISTWPFAEAFNGITVHGP

SEQ ID NO: 853809 - protein, 24 aa, Mycobacterium
RGRKLVGFFCQQGVFDRGRAEADH

SEQ ID NO: 853810 - protein, 34 aa, Mycobacterium
RGRLEWLLLADGMPIAWRGKLLTGEPWPRIAGAD

SEQ ID NO: 853811 - protein, 26 aa, Mycobacterium
RGRLGRSPRYLPVYGRLGRAFFADPA

SEQ ID NO: 853812 - protein, 23 aa, Mycobacterium
RGRLHPVDAFLDLVLEHGSQLRW

SEQ ID NO: 853813 - protein, 21 aa, Mycobacterium
RGRLLAGWAEKLRRAADLEHW

SEQ ID NO: 853814 - protein, 18 aa, Mycobacterium
RGRLPQVIQFGDLMLDTD

SEQ ID NO: 853815 - protein, 22 aa, Mycobacterium
RGRLQLHHVRAKFLGAEPAEPE

SEQ ID NO: 853816 - protein, 20 aa, Mycobacterium
RGRLQLHHVRAKFLGATPVD

SEQ ID NO: 853817 - protein, 17 aa, Mycobacterium
RGRLTVPPSAPGSKSGE

SEQ ID NO: 853818 - protein, 34 aa, Mycobacterium
RGRLVVLQSQPRRRPIWFRRSGFQPAAVGARPVD

SEQ ID NO: 853819 - protein, 23 aa, Mycobacterium
RGRPAIARRYLALEGHRVLAELA

SEQ ID NO: 853820 - protein, 21 aa, Mycobacterium
RGRPAKRYRLTAAGRAKLGHS

SEQ ID NO: 853821 - protein, 20 aa, Mycobacterium
RGRPAKRYRLTPGGRAKLEH

SEQ ID NO: 853822 - protein, 23 aa, Mycobacterium
RGRQRPGRLHRLGGMLASVGGLA

SEQ ID NO: 853823 - protein, 18 aa, Mycobacterium
RGRRDLVLLRIDPARLDA

SEQ ID NO: 853824 - protein, 17 aa, Mycobacterium
RGRRHRQPQPGPQRDQS

SEQ ID NO: 853825 - protein, 18 aa, Mycobacterium
RGRRLGWSDTWVRAADGA

SEQ ID NO: 853826 - protein, 19 aa, Mycobacterium
RGRRLMQPHFTPKQMRTLA

SEQ ID NO: 853827 - protein, 18 aa, Mycobacterium
RGRRWLGAVDRDGLQRAH

SEQ ID NO: 853828 - protein, 19 aa, Mycobacterium
RGRRYLRQLGSIEDLLSLS

SEQ ID NO: 853829 - protein, 25 aa, Mycobacterium
RGRSGPCRPAPSSMLLAILSGYERR

SEQ ID NO: 853830 - protein, 19 aa, Mycobacterium
RGRSMACDWLVAAASAPET

SEQ ID NO: 853831 - protein, 17 aa, Mycobacterium
RGRSRIGGFRAIIGSEP

SEQ ID NO: 853832 - protein, 25 aa, Mycobacterium
RGRSVPAFRQLWTSNLPALDDTRLV

SEQ ID NO: 853833 - protein, 30 aa, Mycobacterium
RGRTGRVIGVLILLWPTPRQFDAAELDMFT

SEQ ID NO: 853834 - protein, 17 aa, Mycobacterium
RGRTIITMFYENSTRTR

SEQ ID NO: 853835 - protein, 26 aa, Mycobacterium
RGRTLIARALIAEPRLLLLDEPSTGL

SEQ ID NO: 853836 - protein, 21 aa, Mycobacterium
RGRTLIARALISDPRLLLLDE

SEQ ID NO: 853837 - protein, 26 aa, Mycobacterium
RGRTPVGLCAKVIRRDPRPHRGCTRG

SEQ ID NO: 853838 - protein, 26 aa, Mycobacterium
RGRVKQLLLKIGWPAEDLAGYVDGEA

SEQ ID NO: 853839 - protein, 26 aa, Mycobacterium
RGRVKQLLLKIGWPAEDLAGYVNGEA

SEQ ID NO: 853840 - protein, 26 aa, Mycobacterium
RGRVKQMLLKIGWPAEDLAGYVDGEA

SEQ ID NO: 853841 - protein, 31 aa, Mycobacterium
RGRVQSVLLPRLLDWLSYAPDPDRGLLAYRR

SEQ ID NO: 853842 - protein, 20 aa, Mycobacterium
RGRVRRRIDMGWPDRMVGAE

SEQ ID NO: 853843 - protein, 19 aa, Mycobacterium
RGRVVRRIDLGWPCYRVGV

SEQ ID NO: 853844 - protein, 17 aa, Mycobacterium
RGRWGCVLGGDPTRRVT

SEQ ID NO: 853845 - protein, 19 aa, Mycobacterium
RGRWHAALPVGRLDTAVAS

SEQ ID NO: 853846 - protein, 34 aa, Mycobacterium
RGRWHEVDLLVLARDTLYLIELKHYRGILTGNDH

SEQ ID NO: 853847 - protein, 28 aa, Mycobacterium
RGRWNVPKKLTTFTLWGSGVVDLRYADF

SEQ ID NO: 853848 - protein, 29 aa, Mycobacterium
RGRWNVPKKLTTLTLWGSGVLDLRYADFT

SEQ ID NO: 853849 - protein, 19 aa, Mycobacterium
RGRYRALASTLLGKSMSPF

SEQ ID NO: 853850 - protein, 23 aa, Mycobacterium
RGRYRRRRDLLVQRLAGYNVGVR

SEQ ID NO: 853851 - protein, 21 aa, Mycobacterium
RGRYRVRWIPQRAAKGVYYGT

SEQ ID NO: 853852 - protein, 18 aa, Mycobacterium
RGRYWLDYPDGTLRERMF

SEQ ID NO: 853853 - protein, 41 aa, Mycobacterium
RGSAGAYLIGWDPLLQPGLPEPTLAWLDDIAPNGPLVIIHN

SEQ ID NO: 853854 - protein, 25 aa, Mycobacterium
RGSALSLFPRFGVAAPPPQPSAAQR

SEQ ID NO: 853855 - protein, 18 aa, Mycobacterium
RGSALVERSNALLRAIQL

SEQ ID NO: 853856 - protein, 24 aa, Mycobacterium
RGSAPAQRWLVNGGPATVGIIASV

SEQ ID NO: 853857 - protein, 21 aa, Mycobacterium
RGSARTTFGLVGLHCRPDPAG

SEQ ID NO: 853858 - protein, 24 aa, Mycobacterium
RGSDGQWRLSPKAMRQLGQAALRD

SEQ ID NO: 853859 - protein, 23 aa, Mycobacterium
RGSDLWHQLAELGLLRLTGATGH

SEQ ID NO: 853860 - protein, 23 aa, Mycobacterium
RGSDPIELWAWIGAYDHVVLCQL

SEQ ID NO: 853861 - protein, 19 aa, Mycobacterium
RGSGHFRGPFDDLPRTRRG

SEQ ID NO: 853862 - protein, 18 aa, Mycobacterium
RGSGIFAGGWGAKRAAVY

SEQ ID NO: 853863 - protein, 32 aa, Mycobacterium
RGSHPVRLFIGAGMPAGLWKRVVDVFAPANVV

SEQ ID NO: 853864 - protein, 25 aa, Mycobacterium
RGSLAGPRRRFAATVLAVGGSGPRG

SEQ ID NO: 853865 - protein, 23 aa, Mycobacterium
RGSLYFGVPTVWLRVAGDESCAR

SEQ ID NO: 853866 - protein, 22 aa, Mycobacterium
RGSRLPVWLEEWGFERPREDSV

SEQ ID NO: 853867 - protein, 34 aa, Mycobacterium
RGSTRDWFLSWLGRAYPELVGRYRELYGRGAYLP

SEQ ID NO: 853868 - protein, 19 aa, Mycobacterium
RGSVYYHFPDGRNQILTEA

SEQ ID NO: 853869 - protein, 24 aa, Mycobacterium
RGSWTPFRPPAVLRPLFPGSSKTA

SEQ ID NO: 853870 - protein, 23 aa, Mycobacterium
RGSYLQMHFALDEAPAFAAPYEA

SEQ ID NO: 853871 - protein, 24 aa, Mycobacterium
RGSYLQMHFALDETPSFAAPYQAL

SEQ ID NO: 853872 - protein, 23 aa, Mycobacterium
RGSYLQMHFALEEAPAFAAPYEA

SEQ ID NO: 853873 - protein, 29 aa, Mycobacterium
RGSYLQMHFALEEAPVFAPPYEALNDPAM

SEQ ID NO: 853874 - protein, 23 aa, Mycobacterium
RGSYVQMHFALDGPPTFAEPYEV

SEQ ID NO: 853875 - protein, 24 aa, Mycobacterium
RGTAGLVPFSSRLAAEEWRSLRLA

SEQ ID NO: 853876 - protein, 24 aa, Mycobacterium
RGTALELLILGGRPIREPVVHYGP

SEQ ID NO: 853877 - protein, 20 aa, Mycobacterium
RGTARFLNFTVQGPRPEKDV

SEQ ID NO: 853878 - protein, 19 aa, Mycobacterium
RGTDPRPLPSLPGTAEKPL

SEQ ID NO: 853879 - protein, 28 aa, Mycobacterium
RGTEQLSHTFALIDLLPWGRQEEWLDSP

SEQ ID NO: 853880 - protein, 27 aa, Mycobacterium
RGTEQLSHTFALIDLLPYGRQEQWQDS

SEQ ID NO: 853881 - protein, 27 aa, Mycobacterium
RGTEQLSHTFALIDVLPWGRQEEWLDS

SEQ ID NO: 853882 - protein, 29 aa, Mycobacterium
RGTEQLSHTFPLIDILPWGRQEVWQDSPD

SEQ ID NO: 853883 - protein, 29 aa, Mycobacterium
RGTFLKLATPLFYNLPLSDRIRPAMTVVE

SEQ ID NO: 853884 - protein, 26 aa, Mycobacterium
RGTFNLVTEFAYPLPVAVICRMLGVP

SEQ ID NO: 853885 - protein, 31 aa, Mycobacterium; identical to SEQ ID NO: 131197

SEQ ID NO: 853886 - protein, 23 aa, Mycobacterium
RGTHVFCEKPFVLDVRDGERLVT

SEQ ID NO: 853887 - protein, 25 aa, Mycobacterium
RGTIAGIHLEGPWLSRARCGAHDRT

SEQ ID NO: 853888 - protein, 22 aa, Mycobacterium
RGTPFAAHYAASKGALLTLTKS

SEQ ID NO: 853889 - protein, 23 aa, Mycobacterium
RGTPTRLLLLRHGQTELSVQRRY

SEQ ID NO: 853890 - protein, 18 aa, Mycobacterium
RGTQIRLITAMIVREDSM

SEQ ID NO: 853891 - protein, 17 aa, Mycobacterium
RGTQVLAPVVFTSALGL

SEQ ID NO: 853892 - protein, 19 aa, Mycobacterium
RGTRVDPTFWTTAKVRGAK

SEQ ID NO: 853893 - protein, 20 aa, Mycobacterium
RGTRYWDPLATFGYLAARTR

SEQ ID NO: 853894 - protein, 29 aa, Mycobacterium
RGTTWSRQLPWLRRLGVVYTYDAPWHRGR

SEQ ID NO: 853895 - protein, 24 aa, Mycobacterium
RGTTWSRQLPWLTGLGEVYTYDAP

SEQ ID NO: 853896 - protein, 26 aa, Mycobacterium
RGTVAGIHLEGPWLSRARCGAHDPAR

SEQ ID NO: 853897 - protein, 24 aa, Mycobacterium
RGTVEWVEPPGGPALGLHGSDWAP

SEQ ID NO: 853898 - protein, 20 aa, Mycobacterium
RGTVMPPPVGMFDLVHCVNA

SEQ ID NO: 853899 - protein, 17 aa, Mycobacterium
RGTVVAADWPRLAAAYH

SEQ ID NO: 853900 - protein, 17 aa, Mycobacterium
RGTVYLSTAGGYFALDI

SEQ ID NO: 853901 - protein, 24 aa, Mycobacterium
RGTWNDVALQWFRGINSVLGVQRT

SEQ ID NO: 853902 - protein, 23 aa, Mycobacterium
RGVARLRVLLPLLDGGAESPQES

SEQ ID NO: 853903 - protein, 21 aa, Mycobacterium
RGVASINWGAVPPGIFDAAED

SEQ ID NO: 853904 - protein, 20 aa, Mycobacterium
RGVASINWGGVPPAIFDAAE

SEQ ID NO: 853905 - protein, 17 aa, Mycobacterium
RGVAVGQILAITFTNKA

SEQ ID NO: 853906 - protein, 28 aa, Mycobacterium
RGVCQDFVHLTLILLRSMGIPGRYVSGY

SEQ ID NO: 853907 - protein, 17 aa, Mycobacterium
RGVDFSGCRLREASLVE

SEQ ID NO: 853908 - protein, 19 aa, Mycobacterium
RGVDKFICAMGVGDGQLVG

SEQ ID NO: 853909 - protein, 17 aa, Mycobacterium
RGVDLSGCRLREASLVE

SEQ ID NO: 853910 - protein, 21 aa, Mycobacterium
RGVEALLTLVPGLADVVPDLA

SEQ ID NO: 853911 - protein, 19 aa, Mycobacterium
RGVELLAQAWHTVTGALPL

SEQ ID NO: 853912 - protein, 21 aa, Mycobacterium
RGVENRWRPGPFGVQVRPGAG

SEQ ID NO: 853913 - protein, 21 aa, Mycobacterium
RGVERLPVILGYPHDIASTMR

SEQ ID NO: 853914 - protein, 24 aa, Mycobacterium
RGVEVLLLADLLAEALTHSGAARM

SEQ ID NO: 853915 - protein, 18 aa, Mycobacterium
RGVEWLGVVHRWSRSPQA

SEQ ID NO: 853916 - protein, 26 aa, Mycobacterium
RGVFGRPMILKRFVKGIATEAIFQKR

SEQ ID NO: 853917 - protein, 17 aa, Mycobacterium
RGVFRHLAESDEPLFVA

SEQ ID NO: 853918 - protein, 18 aa, Mycobacterium
RGVGASRPAIALAGDELV

SEQ ID NO: 853919 - protein, 17 aa, Mycobacterium
RGVGVGQILAITFTNKA

SEQ ID NO: 853920 - protein, 18 aa, Mycobacterium
RGVIAPWPRISTSSAYGS

SEQ ID NO: 853921 - protein, 29 aa, Mycobacterium
RGVLGRGMPLVWRNFLSWGTSSAGKHRCG

SEQ ID NO: 853922 - protein, 18 aa, Mycobacterium
RGVLHGIAAATPVFTCQG

SEQ ID NO: 853923 - protein, 20 aa, Mycobacterium
RGVLHRAAPYDPASQREMLR

SEQ ID NO: 853924 - protein, 22 aa, Mycobacterium
RGVMLSALWAAGTGQLVLIIHH

SEQ ID NO: 853925 - protein, 19 aa, Mycobacterium
RGVPLRLISVVKPAHESPE

SEQ ID NO: 853926 - protein, 25 aa, Mycobacterium
RGVRDRPMILKRFVKGIAQEAVFQK

SEQ ID NO: 853927 - protein, 24 aa, Mycobacterium
RGVRIVMMGGLGPAPFCGMLLGDL

SEQ ID NO: 853928 - protein, 27 aa, Mycobacterium
RGVRLELPTYPFQRRRFWPKSAGMAID

SEQ ID NO: 853929 - protein, 18 aa, Mycobacterium
RGVRPDEILAIGGALIDA

SEQ ID NO: 853930 - protein, 30 aa, Mycobacterium
RGVRRHWITMPYAVAWLWCYSMETIAKLRR

SEQ ID NO: 853931 - protein, 25 aa, Mycobacterium
RGVSFLVGLYALLITMPESREIRAP

SEQ ID NO: 853932 - protein, 23 aa, Mycobacterium
RGVTVLLLSELLTEALASGAARM

SEQ ID NO: 853933 - protein, 17 aa, Mycobacterium
RGVVNIRELLPLASPLA

SEQ ID NO: 853934 - protein, 24 aa, Mycobacterium
RGVVSEWMRLLPSATYHADPDCRR

SEQ ID NO: 853935 - protein, 20 aa, Mycobacterium
RGWASVWALHDDAQVNRVIH

SEQ ID NO: 853936 - protein, 18 aa, Mycobacterium
RGWGPPFIEPTGAEREST

SEQ ID NO: 853937 - protein, 22 aa, Mycobacterium
RGWGRIIQIGGGLALQPAADQP

SEQ ID NO: 853938 - protein, 17 aa, Mycobacterium
RGWHCLGVAKDFMDGKP

SEQ ID NO: 853939 - protein, 20 aa, Mycobacterium
RGWHLLAVLERLSRVAGREL

SEQ ID NO: 853940 - protein, 17 aa, Mycobacterium
RGWIEYEPYGTVLIIGA

SEQ ID NO: 853941 - protein, 21 aa, Mycobacterium
RGWMRALRAYNYSDQYARAVR

SEQ ID NO: 853942 - protein, 29 aa, Mycobacterium
RGWQTPNPHIPFDKLRLRVIDEHTDWAPA

SEQ ID NO: 853943 - protein, 22 aa, Mycobacterium
RGWRDFLMRYSVNELQVLTKVL

SEQ ID NO: 853944 - protein, 20 aa, Mycobacterium
RGWSAGRFSFNVAEGRCATC

SEQ ID NO: 853945 - protein, 17 aa, Mycobacterium
RGWTAQQLTAVTPEQAG

SEQ ID NO: 853946 - protein, 23 aa, Mycobacterium
RGYADYLLRLRIVYQALEDAVRC

SEQ ID NO: 853947 - protein, 21 aa, Mycobacterium
RGYALMLRHPEPRPWLMCIHG

SEQ ID NO: 853948 - protein, 24 aa, Mycobacterium
RGYANFLSILDEGRIAIAALATGA

SEQ ID NO: 853949 - protein, 21 aa, Mycobacterium
RGYAVGLHLLPDVRLQELALI

SEQ ID NO: 853950 - protein, 18 aa, Mycobacterium
RGYEHREEPFRLASGQLS

SEQ ID NO: 853951 - protein, 25 aa, Mycobacterium
RGYFEPLVHCRIGQALYPTPPFARL

SEQ ID NO: 853952 - protein, 34 aa, Mycobacterium
RGYGAREVLDYRDPLWPHHAKALTTTPIRAVANA

SEQ ID NO: 853953 - protein, 23 aa, Mycobacterium
RGYGPEVYRIMHAHISSVKRRAL

SEQ ID NO: 853954 - protein, 32 aa, Mycobacterium
RGYGQPAGGYPPAGPPAGPPPGGQPGYGGADY

SEQ ID NO: 853955 - protein, 20 aa, Mycobacterium
RGYGRGQQHLWHLHPRLHPQ

SEQ ID NO: 853956 - protein, 30 aa, Mycobacterium
RGYHRREDKPFWWAHFDRLNFPLEEWADNT

SEQ ID NO: 853957 - protein, 29 aa, Mycobacterium
RGYHRREDKPFWWAHFDRLNFPVDEWADN

SEQ ID NO: 853958 - protein, 30 aa, Mycobacterium
RGYHRREDKPFWWGHFDRLNYPLDEWSDST

SEQ ID NO: 853959 - protein, 25 aa, Mycobacterium
RGYHRREDKPFWWSHFDRLNHPVEE

SEQ ID NO: 853960 - protein, 29 aa, Mycobacterium
RGYHRREDKPFWWSHFDRLNYPIDEWSDS

SEQ ID NO: 853961 - protein, 21 aa, Mycobacterium
RGYIATWLRRWQERGELAADL

SEQ ID NO: 853962 - protein, 41 aa, Mycobacterium
RGYKCSIRTPWWTTPSLWTPDLFLLRQIHLAPRLTVNAAAA

SEQ ID NO: 853963 - protein, 17 aa, Mycobacterium
RGYLANYGAVLYPELHD

SEQ ID NO: 853964 - protein, 18 aa, Mycobacterium
RGYLANYGAVLYPQLHDC

SEQ ID NO: 853965 - protein, 25 aa, Mycobacterium
RGYLGMLTGYGRELFRELAFGATNR

SEQ ID NO: 853966 - protein, 24 aa, Mycobacterium
RGYLQMERVIPSGTPRRAEPGTLA

SEQ ID NO: 853967 - protein, 22 aa, Mycobacterium
RGYMEFWDQVLNTLTGSPLAGT

SEQ ID NO: 853968 - protein, 17 aa, Mycobacterium
RGYMHRHQGTRWNTVEH

SEQ ID NO: 853969 - protein, 22 aa, Mycobacterium
RGYRAMTHIPRLQFAHIDRLVR

SEQ ID NO: 853970 - protein, 30 aa, Mycobacterium
RGYRELIMLWGQREIALLPYDPGSTTDYGV

SEQ ID NO: 853971 - protein, 22 aa, Mycobacterium
RGYTYGPAFRGLQAMWQRGEEI

SEQ ID NO: 853972 - protein, 19 aa, Mycobacterium
RGYVANALRLLERKIVQMP

SEQ ID NO: 853973 - protein, 18 aa, Mycobacterium
RHAAAELLPKLEPVDRMV

SEQ ID NO: 853974 - protein, 22 aa, Mycobacterium
RHAAFARLHHAGHQEHLVVGGQ

SEQ ID NO: 853975 - protein, 31 aa, Mycobacterium
RHAANLLRLKAFFARQWRQMPAAHFMAVFGP

SEQ ID NO: 853976 - protein, 19 aa, Mycobacterium
RHADILVLLSRHPEGLSAD

SEQ ID NO: 853977 - protein, 18 aa, Mycobacterium
RHADIWHSFLDIESFRKK

SEQ ID NO: 853978 - protein, 17 aa, Mycobacterium
RHAEILLVLATARQGRS

SEQ ID NO: 853979 - protein, 25 aa, Mycobacterium
RHAFAADMAFLRNCGIHPVVVHGGG

SEQ ID NO: 853980 - protein, 24 aa, Mycobacterium
RHAFAADMAFLRNCGVHPVVVHGG

SEQ ID NO: 853981 - protein, 18 aa, Mycobacterium
RHAGLSYLLVPLDQPGVQ

SEQ ID NO: 853982 - protein, 20 aa, Mycobacterium
RHAGRIPRRFWAQASSPAPD

SEQ ID NO: 853983 - protein, 25 aa, Mycobacterium
RHAHHYLAIFDKGKALALYHTKRLA

SEQ ID NO: 853984 - protein, 26 aa, Mycobacterium
RHAHHYLAIFDKGKALALYHTKRLAS

SEQ ID NO: 853985 - protein, 26 aa, Mycobacterium
RHALRLGHNYIGTEHLLLALYEEEDA

SEQ ID NO: 853986 - protein, 20 aa, Mycobacterium
RHALVTQRFLDAGLVIFGMT

SEQ ID NO: 853987 - protein, 19 aa, Mycobacterium
RHAMFPIGDTPKPQIREEA

SEQ ID NO: 853988 - protein, 29 aa, Mycobacterium
RHAPTEEPLWSESWYFDFAAPSQDIGGWI

SEQ ID NO: 853989 - protein, 17 aa, Mycobacterium
RHAQIRRLVSSGLTPRM

SEQ ID NO: 853990 - protein, 24 aa, Mycobacterium
RHARAWFACYDLLHRLGGSYAIQI

SEQ ID NO: 853991 - protein, 20 aa, Mycobacterium
RHARRGTGDLPRRGRRRRPG

SEQ ID NO: 853992 - protein, 34 aa, Mycobacterium
RHARTYTGYIPIIGAPWLADLVRRSPWAEMFQSS

SEQ ID NO: 853993 - protein, 28 aa, Mycobacterium
RHATRPFDAVLDYLWGSPAEQTLSALAA

SEQ ID NO: 853994 - protein, 20 aa, Mycobacterium
RHATWWSRLGAPLTSAIQRA

SEQ ID NO: 853995 - protein, 17 aa, Mycobacterium
RHAVLGHLPPARYAAAC

SEQ ID NO: 853996 - protein, 18 aa, Mycobacterium
RHAVRGFRLYREEVSIRA

SEQ ID NO: 853997 - protein, 20 aa, Mycobacterium
RHAWLDLHESWLMAKAAEIG

SEQ ID NO: 853998 - protein, 31 aa, Mycobacterium
RHCRGTYALTVPFLQRFFALAKSTAAGSGWV

SEQ ID NO: 853999 - protein, 25 aa, Mycobacterium
RHDDPRLAIAWPLPPRDLSPRDLAH

SEQ ID NO: 854000 - protein, 17 aa, Mycobacterium
RHDHSHYYDMGSESLRS

SEQ ID NO: 854001 - protein, 24 aa, Mycobacterium
RHDIVIVRRAIRRVLLRGDSPETA

SEQ ID NO: 854002 - protein, 24 aa, Mycobacterium
RHDLNSFLGLHYPSTDIPAQARAL

SEQ ID NO: 854003 - protein, 24 aa, Mycobacterium
RHDPDTLRRLAAQLPLPINAIALP

SEQ ID NO: 854004 - protein, 24 aa, Mycobacterium
RHDPSDTHWLGRDRFILSCGHSSL

SEQ ID NO: 854005 - protein, 24 aa, Mycobacterium
RHDPSDVHWLGRDRFVLSCGHSSL

SEQ ID NO: 854006 - protein, 21 aa, Mycobacterium
RHDTFALACTAKYYADLGYLG

SEQ ID NO: 854007 - protein, 22 aa, Mycobacterium
RHDTFRSWFEDTGDGEFIRHTI

SEQ ID NO: 854008 - protein, 17 aa, Mycobacterium
RHEAKLSLVPNYLGQFH

SEQ ID NO: 854009 - protein, 23 aa, Mycobacterium
RHEALRTIFPYQQGQPVQVVLAP

SEQ ID NO: 854010 - protein, 26 aa, Mycobacterium
RHECLEYALAHDERFGIWGGLSERER

SEQ ID NO: 854011 - protein, 27 aa, Mycobacterium
RHEKRPRGPLLVRRGSGTGPWGVDVGG

SEQ ID NO: 854012 - protein, 27 aa, Mycobacterium
RHELQRFYRPIFRGVYLPKSAEPTLRD

SEQ ID NO: 854013 - protein, 25 aa, Mycobacterium
RHELRDLLLRFPVSVDVHLLTPDEA

SEQ ID NO: 854014 - protein, 17 aa, Mycobacterium
RHELRSYRIIDGVVTEE

SEQ ID NO: 854015 - protein, 27 aa, Mycobacterium
RHEMLGPASVLPWSWITDCSAVGTVSE

SEQ ID NO: 854016 - protein, 21 aa, Mycobacterium
RHERLWEVLGAHPRSFTTADG

SEQ ID NO: 854017 - protein, 18 aa, Mycobacterium
RHEYTRELLAARPRVDDA

SEQ ID NO: 854018 - protein, 23 aa, Mycobacterium
RHFELSWAIPGIAAVMLQMNLRL

SEQ ID NO: 854019 - protein, 19 aa, Mycobacterium
RHFESKDDLFLALLEQECS

SEQ ID NO: 854020 - protein, 28 aa, Mycobacterium
RHFHRRIDPLWRRTSYSGLIRAAEQESG

SEQ ID NO: 854021 - protein, 20 aa, Mycobacterium
RHFHTGISELDRVLGGGLVP

SEQ ID NO: 854022 - protein, 17 aa, Mycobacterium
RHFITNVRTFLTDDADY

SEQ ID NO: 854023 - protein, 24 aa, Mycobacterium
RHFNNPSAFTRLMEDHFPTGLVSP

SEQ ID NO: 854024 - protein, 19 aa, Mycobacterium
RHFNWVRAWYDFAVPDIGR

SEQ ID NO: 854025 - protein, 19 aa, Mycobacterium
RHFNWVRSWYDFAVPDIGR

SEQ ID NO: 854026 - protein, 17 aa, Mycobacterium
RHFPMTSFSPGYRSVWH

SEQ ID NO: 854027 - protein, 29 aa, Mycobacterium
RHFPNKEALLVELLVGISTRLLAGATDVV

SEQ ID NO: 854028 - protein, 17 aa, Mycobacterium
RHFRIPLTIIRICSTYG

SEQ ID NO: 854029 - protein, 17 aa, Mycobacterium
RHFRLDWASPHQIGRKA

SEQ ID NO: 854030 - protein, 18 aa, Mycobacterium
RHFRLDWSRPHDVGRKAI

SEQ ID NO: 854031 - protein, 23 aa, Mycobacterium
RHFTTPLMRLQDPDLTKVIIVTL

SEQ ID NO: 854032 - protein, 19 aa, Mycobacterium
RHFVKVMPRDYKKVLQAIA

SEQ ID NO: 854033 - protein, 18 aa, Mycobacterium
RHGAAIAAALRERLDPGR

SEQ ID NO: 854034 - protein, 26 aa, Mycobacterium
RHGDVVLIRTGWAQLWHNPDAYIGTD

SEQ ID NO: 854035 - protein, 18 aa, Mycobacterium
RHGEWLAPGGFDFGAWHF

SEQ ID NO: 854036 - protein, 33 aa, Mycobacterium
RHGIKPLFVLFDSCWDPFPRPGPQPAPRPGIHN

SEQ ID NO: 854037 - protein, 17 aa, Mycobacterium
RHGKAEFLDFLKTVARA

SEQ ID NO: 854038 - protein, 19 aa, Mycobacterium
RHGLADMYGFIPVDRAPGL

SEQ ID NO: 854039 - protein, 28 aa, Mycobacterium
RHGLDGIHRPLIVFTPKSMLRNKAAVSD

SEQ ID NO: 854040 - protein, 20 aa, Mycobacterium
RHGLWAADVRFLPAGAIPRT

SEQ ID NO: 854041 - protein, 21 aa, Mycobacterium
RHGPEWIACKLMAADRLLVEG

SEQ ID NO: 854042 - protein, 29 aa, Mycobacterium
RHGPMDRFHRRLLWPIRSSAGEVIGFGAR

SEQ ID NO: 854043 - protein, 19 aa, Mycobacterium
RHGRPLELYVCDGKGCIGR

SEQ ID NO: 854044 - protein, 17 aa, Mycobacterium
RHGRTRAARLRRPRRRH

SEQ ID NO: 854045 - protein, 19 aa, Mycobacterium
RHGRTWSAPPRSQISMSFG

SEQ ID NO: 854046 - protein, 17 aa, Mycobacterium
RHGYCNKHYSRKIRNGD

SEQ ID NO: 854047 - protein, 26 aa, Mycobacterium
RHHALRSLKRRLARVVFNRLRADQSR

SEQ ID NO: 854048 - protein, 17 aa, Mycobacterium
RHHELLEAFTTWRASTR

SEQ ID NO: 854049 - protein, 25 aa, Mycobacterium
RHHEQYVPKIIDLQLRGCFAMTETG

SEQ ID NO: 854050 - protein, 22 aa, Mycobacterium
RHHFRRGVGITPTDYRKAFAVA

SEQ ID NO: 854051 - protein, 20 aa, Mycobacterium
RHHHQLLAQLDRAEAAAALA

SEQ ID NO: 854052 - protein, 24 aa, Mycobacterium
RHHIKPLFVFFDSCWDPQPRAGRQ

SEQ ID NO: 854053 - protein, 25 aa, Mycobacterium
RHHMPITTLPISRLLTFTPGSAEVR

SEQ ID NO: 854054 - protein, 24 aa, Mycobacterium
RHHQAYVRRIIDLDLLGCFAMTET

SEQ ID NO: 854055 - protein, 20 aa, Mycobacterium
RHHRLVTRSLERGLYQGWDM

SEQ ID NO: 854056 - protein, 23 aa, Mycobacterium
RHHSLALCPAPHGGAPGLVHVMV

SEQ ID NO: 854057 - protein, 17 aa, Mycobacterium
RHHVEWTSYLTPQALID

SEQ ID NO: 854058 - protein, 19 aa, Mycobacterium
RHIAELRRLATDDTAWDIP

SEQ ID NO: 854059 - protein, 21 aa, Mycobacterium
RHIDVYLQMTPPPAEMLKSFE

SEQ ID NO: 854060 - protein, 30 aa, Mycobacterium
RHITAVLPHRPPLATYFLPNNRGKKSVSVD

SEQ ID NO: 854061 - protein, 24 aa, Mycobacterium
RHKDRPVLFLGDTTLTGGELADRI

SEQ ID NO: 854062 - protein, 24 aa, Mycobacterium
RHKGLTYFMFDLKADGVTVRPIAQ

SEQ ID NO: 854063 - protein, 24 aa, Mycobacterium
RHKGLTYFMFDLKAQGVTVRPIAQ

SEQ ID NO: 854064 - protein, 18 aa, Mycobacterium
RHKNKPVLFLGDTTLTGG

SEQ ID NO: 854065 - protein, 24 aa, Mycobacterium
RHKNRPVLFLGDTTLTGGQLAERI

SEQ ID NO: 854066 - protein, 23 aa, Mycobacterium
RHKSKPVLFLGDTTLTGGQLADR

SEQ ID NO: 854067 - protein, 23 aa, Mycobacterium
RHKTPDLLTFTRADLLRTDDNAG

SEQ ID NO: 854068 - protein, 20 aa, Mycobacterium
RHKVAILHQPTLTQTAEAIR

SEQ ID NO: 854069 - protein, 17 aa, Mycobacterium
RHLARCVRAVKAAVPAL

SEQ ID NO: 854070 - protein, 17 aa, Mycobacterium
RHLARPKRYIPGFAIEL

SEQ ID NO: 854071 - protein, 17 aa, Mycobacterium
RHLARPKRYLPGVPIDI

SEQ ID NO: 854072 - protein, 17 aa, Mycobacterium
RHLASPGRPGRRVAVVG

SEQ ID NO: 854073 - protein, 24 aa, Mycobacterium
RHLCERLLSFASPLQLYAEEIDPA

SEQ ID NO: 854074 - protein, 31 aa, Mycobacterium
RHLDDVVLDYLFLDASFFRMHPGSPAEPVLA

SEQ ID NO: 854075 - protein, 17 aa, Mycobacterium
RHLDKTRELLLAGLESV

SEQ ID NO: 854076 - protein, 17 aa, Mycobacterium
RHLHLAADRLRDGAVRL

SEQ ID NO: 854077 - protein, 25 aa, Mycobacterium
RHLKTMKGQWAPFQSLVDLATDEQA

SEQ ID NO: 854078 - protein, 25 aa, Mycobacterium
RHLKTMKGQWAPFQSLVDLGTDEQA

SEQ ID NO: 854079 - protein, 26 aa, Mycobacterium
RHLLESWIRLVALTAHRPGTDWTAVC

SEQ ID NO: 854080 - protein, 17 aa, Mycobacterium
RHLLGLFIEALREGKDV

SEQ ID NO: 854081 - protein, 25 aa, Mycobacterium
RHLLQALNFLQRTKDRFPWADLVAD

SEQ ID NO: 854082 - protein, 20 aa, Mycobacterium
RHLPGALERLVTPLAQDAAL

SEQ ID NO: 854083 - protein, 18 aa, Mycobacterium
RHLPGGIDEYLRLAADHP

SEQ ID NO: 854084 - protein, 19 aa, Mycobacterium
RHLQWIHPRIGHRTVLEHF

SEQ ID NO: 854085 - protein, 25 aa, Mycobacterium
RHLSPLWHLPGMQLGVVTWPPAPGA

SEQ ID NO: 854086 - protein, 17 aa, Mycobacterium
RHLTAPRTVVLSGVTAG

SEQ ID NO: 854087 - protein, 21 aa, Mycobacterium
RHLVELGHRRICGVFGPATLD

SEQ ID NO: 854088 - protein, 17 aa, Mycobacterium
RHLYDVVSAWQRTLLVV

SEQ ID NO: 854089 - protein, 21 aa, Mycobacterium
RHMSELPDALQALGRPDGLTV

SEQ ID NO: 854090 - protein, 21 aa, Mycobacterium
RHNFGVAYDRSLLFGYALDEV

SEQ ID NO: 854091 - protein, 25 aa, Mycobacterium
RHNFLGAPFWVGRGFGLNLSVVTDP

SEQ ID NO: 854092 - protein, 18 aa, Mycobacterium
RHNLGFMVADLLAAKDGA

SEQ ID NO: 854093 - protein, 26 aa, Mycobacterium
RHNTPVRSFLLRLGGIRAVGYSPELV

SEQ ID NO: 854094 - protein, 26 aa, Mycobacterium
RHNTPVRSFLLSLGGIRAVGYSPELV

SEQ ID NO: 854095 - protein, 28 aa, Mycobacterium
RHPAGHRWRWEFESLSPTLTRVTETFDY

SEQ ID NO: 854096 - protein, 25 aa, Mycobacterium
RHPAPARWPTTLLGGGLPVVVDVQN

SEQ ID NO: 854097 - protein, 23 aa, Mycobacterium
RHPDGLVWGHGWDESGWPERTPP

SEQ ID NO: 854098 - protein, 23 aa, Mycobacterium
RHPDRYPHHLPSARYLAAESQRL

SEQ ID NO: 854099 - protein, 25 aa, Mycobacterium
RHPDWPRRRAAGMATLIVAFMDGLV

SEQ ID NO: 854100 - protein, 20 aa, Mycobacterium
RHPFAVYRWVFELEEEPGGR

SEQ ID NO: 854101 - protein, 19 aa, Mycobacterium
RHPFGAHSYYVPAQLFSTA

SEQ ID NO: 854102 - protein, 18 aa, Mycobacterium
RHPFTAYLPSRPHLEWQL

SEQ ID NO: 854103 - protein, 22 aa, Mycobacterium
RHPGWACYHTEMWVVEVDGLEI

SEQ ID NO: 854104 - protein, 26 aa, Mycobacterium
RHPHTLQLIMDSLRYWVLDMHVDGFR

SEQ ID NO: 854105 - protein, 27 aa, Mycobacterium
RHPHTLQLIMDSLRYWVLDMHVDGFRF

SEQ ID NO: 854106 - protein, 24 aa, Mycobacterium
RHPHVLQLIMDSLRYWVLEMHVDG

SEQ ID NO: 854107 - protein, 23 aa, Mycobacterium
RHPMLRVEFLPDGTQRIGAPANE

SEQ ID NO: 854108 - protein, 18 aa, Mycobacterium
RHPMLRVEILPDGMQRIS

SEQ ID NO: 854109 - protein, 35 aa, Mycobacterium
RHPNLRIVFVEHAFTWILPLMWRMDALYEARKSWV

SEQ ID NO: 854110 - protein, 19 aa, Mycobacterium
RHPQRIALRFDDLQFTFGE

SEQ ID NO: 854111 - protein, 25 aa, Mycobacterium
RHPQVRLRPLQFPRVFRAAEAVSLV

SEQ ID NO: 854112 - protein, 23 aa, Mycobacterium
RHPRGVLRSLRVGVRTFWAQGTG

SEQ ID NO: 854113 - protein, 18 aa, Mycobacterium
RHPRLRVAFLEAGVGWVP

SEQ ID NO: 854114 - protein, 27 aa, Mycobacterium
RHPTADVLPLTPLQQGLLFHANTGRDP

SEQ ID NO: 854115 - protein, 30 aa, Mycobacterium
RHPTLAWLEPFEPWDGMQWAPLPAALERLG

SEQ ID NO: 854116 - protein, 24 aa, Mycobacterium
RHQDALLELLPQITLINGYGSSET

SEQ ID NO: 854117 - protein, 17 aa, Mycobacterium
RHQDLYFAGARISRFYP

SEQ ID NO: 854118 - protein, 25 aa, Mycobacterium
RHQFPPFPHRVPPEPVWWAACGARC

SEQ ID NO: 854119 - protein, 19 aa, Mycobacterium
RHQHDTLRLLRATGSTVIA

SEQ ID NO: 854120 - protein, 24 aa, Mycobacterium
RHQKVIELAPAPNLPEELRQQICA

SEQ ID NO: 854121 - protein, 18 aa, Mycobacterium
RHQLNRYADGLEKCIGCE

SEQ ID NO: 854122 - protein, 26 aa, Mycobacterium
RHQLQRWYRPIFTNIHAPRGPAPTLG

SEQ ID NO: 854123 - protein, 19 aa, Mycobacterium
RHQLRLMGQTMERLLPIPP

SEQ ID NO: 854124 - protein, 23 aa, Mycobacterium
RHQLRWPRDKTLVEIMLDAGIAV

SEQ ID NO: 854125 - protein, 18 aa, Mycobacterium
RHQRDPLAFLTPDYFVEI

SEQ ID NO: 854126 - protein, 18 aa, Mycobacterium
RHQRFPMHILESGAYQQF

SEQ ID NO: 854127 - protein, 21 aa, Mycobacterium
RHQRTAYLHVNYRKIAPIEKE

SEQ ID NO: 854128 - protein, 19 aa, Mycobacterium
RHRAMIQSFVEWRARTRGE

SEQ ID NO: 854129 - protein, 18 aa, Mycobacterium
RHRCHLLDLVSPTPGRRL

SEQ ID NO: 854130 - protein, 18 aa, Mycobacterium
RHRDRLAVHAALGRWRHG

SEQ ID NO: 854131 - protein, 24 aa, Mycobacterium
RHRESFPFAPAGAALLCKWTDDVG

SEQ ID NO: 854132 - protein, 26 aa, Mycobacterium
RHREYREQAAQYPRIRVFRGGDQGTE

SEQ ID NO: 854133 - protein, 17 aa, Mycobacterium
RHRFGDGFRWVVLADPE

SEQ ID NO: 854134 - protein, 17 aa, Mycobacterium
RHRFPLVLTEAVTQFLG

SEQ ID NO: 854135 - protein, 25 aa, Mycobacterium
RHRGFFQPVHHPVLGDAAYPTVPYT

SEQ ID NO: 854136 - protein, 25 aa, Mycobacterium
RHRGLTYFMFDLKAKGITVRPIVQL

SEQ ID NO: 854137 - protein, 26 aa, Mycobacterium
RHRGLTYFMFDLKAPGVTVRPIVQLG

SEQ ID NO: 854138 - protein, 24 aa, Mycobacterium
RHRGWASVWALHDNPQINRVVHSL

SEQ ID NO: 854139 - protein, 18 aa, Mycobacterium
RHRHLISTRSQHPGRRGR

SEQ ID NO: 854140 - protein, 17 aa, Mycobacterium
RHRLLSDITRVLADEKV

SEQ ID NO: 854141 - protein, 28 aa, Mycobacterium
RHRLSKLLLRHGIVYYGRAAWTGAHDQW

SEQ ID NO: 854142 - protein, 21 aa, Mycobacterium
RHRLWQLDPNIAYLSGDTLPE

SEQ ID NO: 854143 - protein, 26 aa, Mycobacterium
RHRMGYLQMMSTVLGRRVWENAGSPE

SEQ ID NO: 854144 - protein, 26 aa, Mycobacterium
RHRPRTLVLCAGAAPRMAPLQDQTWE

SEQ ID NO: 854145 - protein, 20 aa, Mycobacterium
RHRQGPGPTLLGGYGGFEVS

SEQ ID NO: 854146 - protein, 29 aa, Mycobacterium
RHRRLARARALILSLAHTRLRAHADLDRL

SEQ ID NO: 854147 - protein, 20 aa, Mycobacterium
RHRRWVSPAARRLAQSLHVD

SEQ ID NO: 854148 - protein, 21 aa, Mycobacterium
RHRTILSALGLPVSYDADALP

SEQ ID NO: 854149 - protein, 20 aa, Mycobacterium
RHRTILSSLGLPVSYDPDAL

SEQ ID NO: 854150 - protein, 19 aa, Mycobacterium
RHRTIPLTLHVNEPTPYVD

SEQ ID NO: 854151 - protein, 20 aa, Mycobacterium
RHRVLRIAAQPGTPVICTQG

SEQ ID NO: 854152 - protein, 24 aa, Mycobacterium
RHRVTYLNYVGKPLALILSTPERP

SEQ ID NO: 854153 - protein, 17 aa, Mycobacterium
RHRWPVYSDPDDIRYVY

SEQ ID NO: 854154 - protein, 18 aa, Mycobacterium
RHRYHVLYRGVYVPNGHA

SEQ ID NO: 854155 - protein, 20 aa, Mycobacterium
RHSMVLVPMDTPGITVERML

SEQ ID NO: 854156 - protein, 18 aa, Mycobacterium
RHSNWLSKFLLYDRRAEE

SEQ ID NO: 854157 - protein, 20 aa, Mycobacterium
RHSQIDRPCLLGYIDKCSAP

SEQ ID NO: 854158 - protein, 19 aa, Mycobacterium
RHSSRLFLPDPVPRHLVEE

SEQ ID NO: 854159 - protein, 17 aa, Mycobacterium
RHTAPATPGDLLFHIRA

SEQ ID NO: 854160 - protein, 24 aa, Mycobacterium
RHTEATVLAGYLRAVLYGSGGSDA

SEQ ID NO: 854161 - protein, 26 aa, Mycobacterium
RHTEDVMLRLRLRRGLALDDLAADER

SEQ ID NO: 854162 - protein, 17 aa, Mycobacterium
RHTEEVLLAVRLNTGIA

SEQ ID NO: 854163 - protein, 19 aa, Mycobacterium
RHTEVLPLYARLPTAEQQK

SEQ ID NO: 854164 - protein, 22 aa, Mycobacterium
RHTKIRRLLASAFTPKQMRLIH

SEQ ID NO: 854165 - protein, 22 aa, Mycobacterium
RHTKIRRLLASAFTPKQMRLTS

SEQ ID NO: 854166 - protein, 19 aa, Mycobacterium
RHTKLRKLAHAALSPRQVR

SEQ ID NO: 854167 - protein, 21 aa, Mycobacterium
RHTMAALRFAIQGGPGLVTVV

SEQ ID NO: 854168 - protein, 25 aa, Mycobacterium
RHTRRAIVRLLLESGTITAGEIGDR

SEQ ID NO: 854169 - protein, 17 aa, Mycobacterium
RHTVAPLIIRTFERGIC

SEQ ID NO: 854170 - protein, 27 aa, Mycobacterium
RHVADLPPRRATSHPWPPWADPDVVQA

SEQ ID NO: 854171 - protein, 18 aa, Mycobacterium
RHVEQTAFKLLALQQPVA

SEQ ID NO: 854172 - protein, 17 aa, Mycobacterium
RHVETLTGFKWLARADE

SEQ ID NO: 854173 - protein, 17 aa, Mycobacterium
RHVIIYLANPTIGVRGM

SEQ ID NO: 854174 - protein, 20 aa, Mycobacterium
RHVLRRQLAKASDLGFSCYV

SEQ ID NO: 854175 - protein, 32 aa, Mycobacterium
RHVNVNLRAPYILVQQLVPVMIERGGGAVVNV

SEQ ID NO: 854176 - protein, 26 aa, Mycobacterium
RHVPAGRVIVLPWDKHIAAGTEIQLG

SEQ ID NO: 854177 - protein, 19 aa, Mycobacterium
RHVPLTLVHMVNQAVPMWP

SEQ ID NO: 854178 - protein, 25 aa, Mycobacterium
RHVPPGRVIVLPYDKHIAAGTEIQL

SEQ ID NO: 854179 - protein, 29 aa, Mycobacterium
RHVRRRLHLLEPLRYKLVDIPWHLHHPMW

SEQ ID NO: 854180 - protein, 24 aa, Mycobacterium
RHVRVYQPRRLLFSDGQQTLGVAL

SEQ ID NO: 854181 - protein, 35 aa, Mycobacterium
RHVSRGKLLPRERVYRLLDPGSPFLELAALAANGM

SEQ ID NO: 854182 - protein, 18 aa, Mycobacterium
RHVVPKGWYYNVMITGIK

SEQ ID NO: 854183 - protein, 19 aa, Mycobacterium
RHVVYRWLGRRMHPAPPAA

SEQ ID NO: 854184 - protein, 17 aa, Mycobacterium
RHWAFRAVAGTNASAVL

SEQ ID NO: 854185 - protein, 18 aa, Mycobacterium
RHWDMLTPYHRLGGPRFV

SEQ ID NO: 854186 - protein, 17 aa, Mycobacterium
RHWLEVVGLQEFADHRP

SEQ ID NO: 854187 - protein, 18 aa, Mycobacterium
RHWRRFDRFTTVSIYAVF

SEQ ID NO: 854188 - protein, 20 aa, Mycobacterium
RHWRVYIDPVLLGTDEGWSI

SEQ ID NO: 854189 - protein, 34 aa, Mycobacterium
RHWVQTPYRYFPVEPHWLFPGMQFMPVAARTQVA

SEQ ID NO: 854190 - protein, 18 aa, Mycobacterium
RHWYSFGDAIAGYQPYDD

SEQ ID NO: 854191 - protein, 26 aa, Mycobacterium
RHYRDILRTGWSDVFFLHLSGNRSLV

SEQ ID NO: 854192 - protein, 25 aa, Mycobacterium
RHYRDRLPHYYGADAPAIAGLLDIY

SEQ ID NO: 854193 - protein, 19 aa, Mycobacterium
RHYRTALNPYLSPAAVKRW

SEQ ID NO: 854194 - protein, 22 aa, Mycobacterium
RHYRYLPTFILRGLSRLHIRFE

SEQ ID NO: 854195 - protein, 20 aa, Mycobacterium
RHYYRIGPDILDWLYEEHVV

SEQ ID NO: 854196 - protein, 24 aa, Mycobacterium
RIAAAAPGPPPRPPDRDYPDCTVV

SEQ ID NO: 854197 - protein, 31 aa, Mycobacterium
RIAADIGYPVLVRPSYVLGGRGMEIVYDEET

SEQ ID NO: 854198 - protein, 31 aa, Mycobacterium
RIAAEIGYPVLVRPSYVLGGRGMEIVYDEDT

SEQ ID NO: 854199 - protein, 19 aa, Mycobacterium
RIAAIFPDGPMRYHGTIYD

SEQ ID NO: 854200 - protein, 18 aa, Mycobacterium
RIAALAKLPVPSGPTRRA

SEQ ID NO: 854201 - protein, 20 aa, Mycobacterium
RIAALLLEINRRFGTPIPPE

SEQ ID NO: 854202 - protein, 27 aa, Mycobacterium
RIAALPVNQLVMIKLALNSALLQQGVA

SEQ ID NO: 854203 - protein, 24 aa, Mycobacterium
RIAAMGFDVVYLPPIHPIGKIHRK

SEQ ID NO: 854204 - protein, 18 aa, Mycobacterium
RIAARADGWLPLLTEPGQ

SEQ ID NO: 854205 - protein, 25 aa, Mycobacterium
RIADACGFAVPYYDLIDERPVLDAH

SEQ ID NO: 854206 - protein, 31 aa, Mycobacterium
RIADEIGYPVLVRPSYVLGGRGMEIVYDEAT

SEQ ID NO: 854207 - protein, 31 aa, Mycobacterium
RIADEIGYPVLVRPSYVLGGRGMEIVYDEET

SEQ ID NO: 854208 - protein, 27 aa, Mycobacterium
RIADKWSLLIIALLDDGSMRFTELKRM

SEQ ID NO: 854209 - protein, 32 aa, Mycobacterium
RIADLLRRAAPDPELVAILVAWLSGELPQRHI

SEQ ID NO: 854210 - protein, 26 aa, Mycobacterium
RIADPPAWFGVIRPAQLLASSDSGAA

SEQ ID NO: 854211 - protein, 20 aa, Mycobacterium
RIADRFLVQGVLPDRRARAG

SEQ ID NO: 854212 - protein, 18 aa, Mycobacterium
RIAEGDVIVSRRNEPGIA

SEQ ID NO: 854213 - protein, 23 aa, Mycobacterium
RIAEGMPCYGSCAGMILLATEIA

SEQ ID NO: 854214 - protein, 17 aa, Mycobacterium
RIAELFAARFHVAIEPS

SEQ ID NO: 854215 - protein, 27 aa, Mycobacterium
RIAELQAYWELPAMVFQFVRNGTRAVP

SEQ ID NO: 854216 - protein, 23 aa, Mycobacterium
RIAEMLAELMTLFAGGALAPLPV

SEQ ID NO: 854217 - protein, 34 aa, Mycobacterium
RIAEQHRILAPDALLQWLLAARRDLLAALSEDDP

SEQ ID NO: 854218 - protein, 37 aa, Mycobacterium
RIAFLPNYDMSMARFLYWGCDIWLNNPLRPLEACGTS

SEQ ID NO: 854219 - protein, 18 aa, Mycobacterium
RIAFRALTFAGVHGVELM

SEQ ID NO: 854220 - protein, 18 aa, Mycobacterium
RIAGILAAKRTSDLVPLC

SEQ ID NO: 854221 - protein, 17 aa, Mycobacterium
RIAGRLGLRPDVRRMPL

SEQ ID NO: 854222 - protein, 18 aa, Mycobacterium
RIAGSGPVLLLIHGIGDN

SEQ ID NO: 854223 - protein, 19 aa, Mycobacterium
RIALHVRVLYGRDPHHITE

SEQ ID NO: 854224 - protein, 17 aa, Mycobacterium
RIALLDAMKDKWRHDLA

SEQ ID NO: 854225 - protein, 18 aa, Mycobacterium
RIALTTTIKPYVYVSTIG

SEQ ID NO: 854226 - protein, 22 aa, Mycobacterium
RIAMLIYPRFTTLDLIGPQQVL

SEQ ID NO: 854227 - protein, 18 aa, Mycobacterium
RIANFEGLQPYSYADRDD

SEQ ID NO: 854228 - protein, 21 aa, Mycobacterium
RIANLTAKLHRLRQPVIAAVN

SEQ ID NO: 854229 - protein, 18 aa, Mycobacterium
RIAPAFQPNPAAGRAAPS

SEQ ID NO: 854230 - protein, 18 aa, Mycobacterium
RIAPALAHRERQIHSGGA

SEQ ID NO: 854231 - protein, 17 aa, Mycobacterium
RIAPGWHADLVLFDPAT

SEQ ID NO: 854232 - protein, 22 aa, Mycobacterium
RIAPLRAPDLSALPPAIVVAAE

SEQ ID NO: 854233 - protein, 22 aa, Mycobacterium
RIAPRKLIPLRALDVVSPRLLN

SEQ ID NO: 854234 - protein, 28 aa, Mycobacterium
RIAQAQLVGWLEGLFHGIQTALFAQQMA

SEQ ID NO: 854235 - protein, 30 aa, Mycobacterium
RIAQAQLVGWLEGLFHGIQTALFAQQMAAR

SEQ ID NO: 854236 - protein, 22 aa, Mycobacterium
RIAQMLTELMTMFAAGALQPLP

SEQ ID NO: 854237 - protein, 26 aa, Mycobacterium
RIARAGDLNWLFLPGGPGIGSESLHE

SEQ ID NO: 854238 - protein, 28 aa, Mycobacterium
RIARALPRMMWTTWSDQLLVGLPSTTEM

SEQ ID NO: 854239 - protein, 21 aa, Mycobacterium
RIARATKILDLARAYGIEASD

SEQ ID NO: 854240 - protein, 21 aa, Mycobacterium
RIARATKILDLARAYGIEVSE

SEQ ID NO: 854241 - protein, 22 aa, Mycobacterium
RIARATKILELARAYGIEALDI

SEQ ID NO: 854242 - protein, 24 aa, Mycobacterium
RIARFKIPRYVRIVDEFPMTVTGK

SEQ ID NO: 854243 - protein, 17 aa, Mycobacterium
RIARIWLNRPEAHNAQN

SEQ ID NO: 854244 - protein, 19 aa, Mycobacterium
RIARIWLNRPEAHNAQNRT

SEQ ID NO: 854245 - protein, 25 aa, Mycobacterium
RIARLKSVPILLAPPWGLAVSDMIP

SEQ ID NO: 854246 - protein, 25 aa, Mycobacterium
RIARLRWLDRATGRVVRRMESAACG

SEQ ID NO: 854247 - protein, 23 aa, Mycobacterium
RIARMGFDVVYLPPIHPIGKVHR

SEQ ID NO: 854248 - protein, 20 aa, Mycobacterium
RIARPVIWGKRKAAAVQEFC

SEQ ID NO: 854249 - protein, 32 aa, Mycobacterium
RIARQGIVLLTNRGLLPLAPESTARIAVIGGH

SEQ ID NO: 854250 - protein, 22 aa, Mycobacterium
RIARQILAFDPGRASLVELHGD

SEQ ID NO: 854251 - protein, 24 aa, Mycobacterium
RIARVRHYMRLDPDFRHNFGVAYD

SEQ ID NO: 854252 - protein, 27 aa, Mycobacterium
RIASGPPLLSPFKLLDPLVNVAEMFIH

SEQ ID NO: 854253 - protein, 28 aa, Mycobacterium
RIASPPVKWPCFYGIDFATPAELIANAA

SEQ ID NO: 854254 - protein, 28 aa, Mycobacterium
RIASPPVRWPCFYGIDFATPAELIANAA

SEQ ID NO: 854255 - protein, 25 aa, Mycobacterium
RIASYISEFIPLSAGDMILSGTPAG

SEQ ID NO: 854256 - protein, 28 aa, Mycobacterium
RIATGALWRDFGLPSFERLRVIGCGTSL

SEQ ID NO: 854257 - protein, 17 aa, Mycobacterium
RIATLPQVFALADSYRA

SEQ ID NO: 854258 - protein, 17 aa, Mycobacterium
RIAVALRDRLPLVAAQF

SEQ ID NO: 854259 - protein, 22 aa, Mycobacterium
RIAVKAALTRLGCPYVWGAKGP

SEQ ID NO: 854260 - protein, 22 aa, Mycobacterium
RIAVLLSPWMEPEPVCVALTRS

SEQ ID NO: 854261 - protein, 24 aa, Mycobacterium
RIAVNPVHRIAPDGAWQVFEDRTA

SEQ ID NO: 854262 - protein, 20 aa, Mycobacterium
RIAVWKDYWDFNSLVSFAPP

SEQ ID NO: 854263 - protein, 35 aa, Mycobacterium
RIAYVPGDVMLWPNLTGMQAIDFLCGLRGDGVDVR

SEQ ID NO: 854264 - protein, 21 aa, Mycobacterium
RICAAVNDWLLDRWLEPDSTD

SEQ ID NO: 854265 - protein, 17 aa, Mycobacterium
RICLCGNTFGPVFGHVP

SEQ ID NO: 854266 - protein, 23 aa, Mycobacterium
RIDAEGFVWIVGRADQAIIRGGF

SEQ ID NO: 854267 - protein, 26 aa, Mycobacterium
RIDALAIGLERKDGSAWLAENRSGAG

SEQ ID NO: 854268 - protein, 21 aa, Mycobacterium
RIDCRAPIAMYNIGIRTSGRL

SEQ ID NO: 854269 - protein, 24 aa, Mycobacterium
RIDDETVLLPRFVAQLLRGEEPDR

SEQ ID NO: 854270 - protein, 20 aa, Mycobacterium
RIDDPRRWVLGWANERKIAA

SEQ ID NO: 854271 - protein, 25 aa, Mycobacterium
RIDEDGFLWILGRADQAIIRGGFKV

SEQ ID NO: 854272 - protein, 17 aa, Mycobacterium
RIDGIAAGLRQVAGLPD

SEQ ID NO: 854273 - protein, 17 aa, Mycobacterium
RIDGLGLGAPLLVTSRA

SEQ ID NO: 854274 - protein, 17 aa, Mycobacterium
RIDGLLREIRLVRALSG

SEQ ID NO: 854275 - protein, 21 aa, Mycobacterium
RIDHIVTRRRQAGLPELVDGE

SEQ ID NO: 854276 - protein, 19 aa, Mycobacterium
RIDHLRVIRGKRPALHDLS

SEQ ID NO: 854277 - protein, 17 aa, Mycobacterium
RIDHQGEFFSVAGPLPV

SEQ ID NO: 854278 - protein, 25 aa, Mycobacterium
RIDKQANLHFVIGKASFDEKALAEN

SEQ ID NO: 854279 - protein, 25 aa, Mycobacterium
RIDKQANLHFVIGKASFDEKSLAEN

SEQ ID NO: 854280 - protein, 18 aa, Mycobacterium
RIDLYFPGERPLTAYHPR

SEQ ID NO: 854281 - protein, 29 aa, Mycobacterium
RIDMLQQWRKARALLMNRPLQNIVARMVL

SEQ ID NO: 854282 - protein, 20 aa, Mycobacterium
RIDMRFWHASPMPGGLLLGV

SEQ ID NO: 854283 - protein, 21 aa, Mycobacterium
RIDPRFPIFSAGNLSGALPGP

SEQ ID NO: 854284 - protein, 17 aa, Mycobacterium
RIDPRFPVFSATGLTEA

SEQ ID NO: 854285 - protein, 20 aa, Mycobacterium
RIDPRNCTVLVWGAVNAGVA

SEQ ID NO: 854286 - protein, 17 aa, Mycobacterium
RIDRFDVRDIRPGPHGL

SEQ ID NO: 854287 - protein, 18 aa, Mycobacterium
RIDRFELMDLRRGADVID

SEQ ID NO: 854288 - protein, 23 aa, Mycobacterium
RIDRRGRMLWSLPKGHIEMGETA

SEQ ID NO: 854289 - protein, 28 aa, Mycobacterium
RIDSLAPFRWRLAPVPLNLDHPYWFDDP

SEQ ID NO: 854290 - protein, 17 aa, Mycobacterium
RIDTDVLAALRSAERSP

SEQ ID NO: 854291 - protein, 28 aa, Mycobacterium
RIDVDYNGWWMCMIPRQVAEELGQPLPL

SEQ ID NO: 854292 - protein, 28 aa, Mycobacterium
RIDVFGLGALAFFILTGGTAPATERGEL

SEQ ID NO: 854293 - protein, 22 aa, Mycobacterium
RIDVRPILPTIAAPTLVIHARD

SEQ ID NO: 854294 - protein, 26 aa, Mycobacterium
RIDVTVRISGFFRDAFPHVVAMLDDA

SEQ ID NO: 854295 - protein, 23 aa, Mycobacterium
RIDYFRQFLRRRATLAINTSSTD

SEQ ID NO: 854296 - protein, 20 aa, Mycobacterium
RIEAAYPGRFLLGIGVGHPE

SEQ ID NO: 854297 - protein, 21 aa, Mycobacterium
RIEATPWQWVGQELPQYSTAP

SEQ ID NO: 854298 - protein, 27 aa, Mycobacterium
RIEEAALWPVKPLLNLSGLETQISAPG

SEQ ID NO: 854299 - protein, 25 aa, Mycobacterium
RIEEIVELLVQLPSDFTEDLAALLE

SEQ ID NO: 854300 - protein, 17 aa, Mycobacterium
RIEIDPGSWWFGRDHSW

SEQ ID NO: 854301 - protein, 33 aa, Mycobacterium
RIEIYVPQPKRRYGYYVWPFLLDGDLVGRVDLK

SEQ ID NO: 854302 - protein, 25 aa, Mycobacterium
RIEKMPWQWIGQELPQFSSAPTDHA

SEQ ID NO: 854303 - protein, 17 aa, Mycobacterium
RIELDRGELARISAADA

SEQ ID NO: 854304 - protein, 24 aa, Mycobacterium
RIELLTAVGWYRTISTLCNALALP

SEQ ID NO: 854305 - protein, 19 aa, Mycobacterium
RIEPLCPIAHSAVGSGCCD

SEQ ID NO: 854306 - protein, 20 aa, Mycobacterium
RIEQDAHLPSLPVERARTQR

SEQ ID NO: 854307 - protein, 26 aa, Mycobacterium
RIERELPDWLDADLAILGEPTAGLIE

SEQ ID NO: 854308 - protein, 24 aa, Mycobacterium
RIERGLHLTALLRATLAQVHSPAA

SEQ ID NO: 854309 - protein, 23 aa, Mycobacterium
RIERGWRHFLMSTSGRCYLDMVN

SEQ ID NO: 854310 - protein, 22 aa, Mycobacterium
RIERKGLAIAALELRNVTEELA

SEQ ID NO: 854311 - protein, 19 aa, Mycobacterium
RIESAHPGRFLLGIGVGHP

SEQ ID NO: 854312 - protein, 25 aa, Mycobacterium
RIESLGTRLIAVGMLPTLSADHMTA

SEQ ID NO: 854313 - protein, 30 aa, Mycobacterium
RIESRLGQLLPQPVRPIPILIGGGGEKRTI

SEQ ID NO: 854314 - protein, 18 aa, Mycobacterium
RIESVLPSFLEFCRGAVL

SEQ ID NO: 854315 - protein, 29 aa, Mycobacterium
RIFAFDVHSIFIPVSRWQYDIVGADGGCR

SEQ ID NO: 854316 - protein, 19 aa, Mycobacterium
RIFAGAGSAPMLEAAVAWD

SEQ ID NO: 854317 - protein, 18 aa, Mycobacterium
RIFAGPADQLWLIDRCAP

SEQ ID NO: 854318 - protein, 18 aa, Mycobacterium
RIFATPVICLPLVDEAIK

SEQ ID NO: 854319 - protein, 22 aa, Mycobacterium
RIFDNVPALLVGLEGPDHRFVA

SEQ ID NO: 854320 - protein, 20 aa, Mycobacterium
RIFELPFDRHLHEGKEITLE

SEQ ID NO: 854321 - protein, 19 aa, Mycobacterium
RIFNFQTRNYPPIYTLAVT

SEQ ID NO: 854322 - protein, 20 aa, Mycobacterium
RIFNTYGPGMRADDGRMVPT

SEQ ID NO: 854323 - protein, 19 aa, Mycobacterium
RIFTAVRDSIWYDPYSVSD

SEQ ID NO: 854324 - protein, 20 aa, Mycobacterium
RIFTAVRDSIWYDPYSVSDD

SEQ ID NO: 854325 - protein, 17 aa, Mycobacterium
RIFVDDYFQTKVPHIYA

SEQ ID NO: 854326 - protein, 19 aa, Mycobacterium
RIFYRIGFTPWDGHPLARS

SEQ ID NO: 854327 - protein, 18 aa, Mycobacterium
RIGAACRAVWNTGLEQRR

SEQ ID NO: 854328 - protein, 33 aa, Mycobacterium
RIGAALAHLFRENPHLPLLLLEAGSVDSELRER

SEQ ID NO: 854329 - protein, 23 aa, Mycobacterium
RIGAALGPGWPRSVKSTLQMTFS

SEQ ID NO: 854330 - protein, 24 aa, Mycobacterium
RIGADILLLNTAFAGPALADVVAR

SEQ ID NO: 854331 - protein, 24 aa, Mycobacterium
RIGAPFTPRMFADLVIRSSAGGDR

SEQ ID NO: 854332 - protein, 26 aa, Mycobacterium
RIGDLLRARGLRRMSSRIQVLAVLEP

SEQ ID NO: 854333 - protein, 27 aa, Mycobacterium
RIGDWVVSPEWWAERRRLALAAVEQWA

SEQ ID NO: 854334 - protein, 17 aa, Mycobacterium
RIGERVGVGFLGGQCGH

SEQ ID NO: 854335 - protein, 22 aa, Mycobacterium
RIGETFFTTAYFDPNMAHMNEI

SEQ ID NO: 854336 - protein, 23 aa, Mycobacterium
RIGEYYHDVLTQLGFNATLKVIA

SEQ ID NO: 854337 - protein, 23 aa, Mycobacterium
RIGGDMALFAGLGRLLLEAEERA

SEQ ID NO: 854338 - protein, 30 aa, Mycobacterium
RIGGEGPVILFWPSLLMTGSMWAAQAEYFA

SEQ ID NO: 854339 - protein, 19 aa, Mycobacterium
RIGGLLRYGIPEFKMEKRV

SEQ ID NO: 854340 - protein, 20 aa, Mycobacterium
RIGHFGNVLPLRMRPRADES

SEQ ID NO: 854341 - protein, 17 aa, Mycobacterium
RIGILGAARIAPQALVK

SEQ ID NO: 854342 - protein, 27 aa, Mycobacterium
RIGKSFLLLFGFLPFGFDDITITRIEP

SEQ ID NO: 854343 - protein, 25 aa, Mycobacterium
RIGKSFLLLFGVLPFGFDDITVARL

SEQ ID NO: 854344 - protein, 30 aa, Mycobacterium
RIGLANYFAGALLLPYLRFLEAAEDVRYDI

SEQ ID NO: 854345 - protein, 18 aa, Mycobacterium
RIGLGFMAFRARPEGDEL

SEQ ID NO: 854346 - protein, 17 aa, Mycobacterium
RIGLLVFLAHGDIADEV

SEQ ID NO: 854347 - protein, 24 aa, Mycobacterium
RIGLNVWREWWNGLPIFDEHVDQI

SEQ ID NO: 854348 - protein, 19 aa, Mycobacterium
RIGLRQAGVPVLLNTALTD

SEQ ID NO: 854349 - protein, 17 aa, Mycobacterium
RIGLSSSALAQRVPIDE

SEQ ID NO: 854350 - protein, 31 aa, Mycobacterium
RIGLTLASLGVPAFFVVAVPSIPRKPNGKVD

SEQ ID NO: 854351 - protein, 23 aa, Mycobacterium
RIGLTLPPQRTYFFDAESGDALT

SEQ ID NO: 854352 - protein, 26 aa, Mycobacterium
RIGMVFQHFNLFPHLSVLKNVAMAPR

SEQ ID NO: 854353 - protein, 40 aa, Mycobacterium
RIGMVFQHFNLFPHMTVIDNITLAPLLTKKMDKPAAEKRA

SEQ ID NO: 854354 - protein, 44 aa, Mycobacterium
RIGMVFQHFNLFPHRSVLANVALAPRRLRGLSGDAARDMALGHL

SEQ ID NO: 854355 - protein, 22 aa, Mycobacterium
RIGNGWFRFNGPVIAKGDSGGP

SEQ ID NO: 854356 - protein, 19 aa, Mycobacterium
RIGPAWVFQAGASGHMAGA

SEQ ID NO: 854357 - protein, 19 aa, Mycobacterium
RIGRIVGEAARWGVRELFL

SEQ ID NO: 854358 - protein, 19 aa, Mycobacterium
RIGRNFYRALLAQQERGTA

SEQ ID NO: 854359 - protein, 18 aa, Mycobacterium
RIGRPMKIPTPAARWAFC

SEQ ID NO: 854360 - protein, 27 aa, Mycobacterium
RIGRQFYDIWALLGHDLVTELLADSAM

SEQ ID NO: 854361 - protein, 24 aa, Mycobacterium
RIGRRIMARLNWRKNGPGPTTPPH

SEQ ID NO: 854362 - protein, 25 aa, Mycobacterium
RIGRRIMARLNWRKSGPGPTTPPHP

SEQ ID NO: 854363 - protein, 21 aa, Mycobacterium
RIGRRIVARLNWRKEGPAPGP

SEQ ID NO: 854364 - protein, 24 aa, Mycobacterium
RIGRRLMVPPLSLTIEAAEQAVAD

SEQ ID NO: 854365 - protein, 34 aa, Mycobacterium; identical to SEQ ID NO: 117184

SEQ ID NO: 854366 - protein, 35 aa, Mycobacterium
RIGRSRPLITNMIRLLRLPIPVQRRVAAGVLSAGH

SEQ ID NO: 854367 - protein, 18 aa, Mycobacterium
RIGRWRTAYLVLSGRTID

SEQ ID NO: 854368 - protein, 25 aa, Mycobacterium
RIGSDILLLNTSFAGPALADVVTRE

SEQ ID NO: 854369 - protein, 19 aa, Mycobacterium
RIGSFADLAGPGLSVVVCQ

SEQ ID NO: 854370 - protein, 19 aa, Mycobacterium
RIGSPRPYVESRPIGVADL

SEQ ID NO: 854371 - protein, 45 aa, Mycobacterium
RIGTAASWLGTALALKPLLQLDIDGRLVLSQRIRTASKAHSALVE

SEQ ID NO: 854372 - protein, 17 aa, Mycobacterium
RIGTLSFPLGKQQRPAP

SEQ ID NO: 854373 - protein, 17 aa, Mycobacterium
RIGVPGIWYAGSHGFEL

SEQ ID NO: 854374 - protein, 22 aa, Mycobacterium
RIGWDKLPAWLGISVLVGIRDA

SEQ ID NO: 854375 - protein, 17 aa, Mycobacterium
RIHANLPPEVSGMPAFD

SEQ ID NO: 854376 - protein, 18 aa, Mycobacterium
RIHRPGREPALLTGHSEL

SEQ ID NO: 854377 - protein, 28 aa, Mycobacterium
RIHRRKKALLQRLPFVDAPYDGPFANAF

SEQ ID NO: 854378 - protein, 26 aa, Mycobacterium
RIHSDINAIWPRRLGTTPAGMARALS

SEQ ID NO: 854379 - protein, 19 aa, Mycobacterium
RIHWQNLANFGVLALEFVD

SEQ ID NO: 854380 - protein, 17 aa, Mycobacterium
RIIALLSTQSVRSQSEL

SEQ ID NO: 854381 - protein, 20 aa, Mycobacterium
RIIDLTAFWAGPAATHLLAA

SEQ ID NO: 854382 - protein, 18 aa, Mycobacterium
RIIEQLLPCLDQPQTIYV

SEQ ID NO: 854383 - protein, 19 aa, Mycobacterium
RIIGELLPEISVPYGVNVL

SEQ ID NO: 854384 - protein, 18 aa, Mycobacterium
RIIHFRNINEFWIGSADM

SEQ ID NO: 854385 - protein, 17 aa, Mycobacterium
RIILTRPAVEAGERLGF

SEQ ID NO: 854386 - protein, 18 aa, Mycobacterium
RIIPATAGPLDALITAGR

SEQ ID NO: 854387 - protein, 32 aa, Mycobacterium
RIIPGPSSMWFDALGRRLPAPYLPGYDTLGTL

SEQ ID NO: 854388 - protein, 21 aa, Mycobacterium
RIIPGSPQWSALLAKIAAGAR

SEQ ID NO: 854389 - protein, 17 aa, Mycobacterium
RIIPQIISGFDAEGLRV

SEQ ID NO: 854390 - protein, 18 aa, Mycobacterium
RIIQSFVLDPGRPPRRGD

SEQ ID NO: 854391 - protein, 23 aa, Mycobacterium
RIIRAGRHLAKPKRYIPGLPIDI

SEQ ID NO: 854392 - protein, 23 aa, Mycobacterium
RIIRYAFELAASAGFRVCSATKS

SEQ ID NO: 854393 - protein, 26 aa, Mycobacterium
RIISAVAATWRRLELGVPLVVDPVCV

SEQ ID NO: 854394 - protein, 17 aa, Mycobacterium
RIISLAVLGLDADGEVE

SEQ ID NO: 854395 - protein, 20 aa, Mycobacterium
RIITQRMPGARRTGAAPWKS

SEQ ID NO: 854396 - protein, 18 aa, Mycobacterium
RIITVPFSFKEIDGDGLI

SEQ ID NO: 854397 - protein, 27 aa, Mycobacterium
RIIVRTSMIVAFPRSPMLTAYAAWDLA

SEQ ID NO: 854398 - protein, 26 aa, Mycobacterium
RIKGINPFLGPFGALFIVLSGGYFAD

SEQ ID NO: 854399 - protein, 24 aa, Mycobacterium
RIKGINPFLGPFGALFVALSLGHF

SEQ ID NO: 854400 - protein, 18 aa, Mycobacterium
RIKLSTEMRLLESSAARM

SEQ ID NO: 854401 - protein, 20 aa, Mycobacterium
RIKPPYVAAYVLLDGADIPF

SEQ ID NO: 854402 - protein, 20 aa, Mycobacterium
RIKRSFDPAGILNPDVLFAG

SEQ ID NO: 854403 - protein, 19 aa, Mycobacterium
RIKSRLAKLNPAPTREIPI

SEQ ID NO: 854404 - protein, 24 aa, Mycobacterium
RIKTRMGWQIPWYTMVPESSFDRD

SEQ ID NO: 854405 - protein, 20 aa, Mycobacterium
RIKVLWALSQGESSVACLAE

SEQ ID NO: 854406 - protein, 17 aa, Mycobacterium
RILALFVSATSAPGHIR

SEQ ID NO: 854407 - protein, 17 aa, Mycobacterium
RILAPKATHPPTAVDIL

SEQ ID NO: 854408 - protein, 18 aa, Mycobacterium
RILDGGLAAWRSAEEPLE

SEQ ID NO: 854409 - protein, 21 aa, Mycobacterium
RILDGYRRVVARTATYEYVDE

SEQ ID NO: 854410 - protein, 17 aa, Mycobacterium
RILDINVYGVILGSKLA

SEQ ID NO: 854411 - protein, 25 aa, Mycobacterium
RILEVAMYGFVPSAGAVLGEWGADV

SEQ ID NO: 854412 - protein, 20 aa, Mycobacterium
RILFRRLGVFMGGFDLDACR

SEQ ID NO: 854413 - protein, 18 aa, Mycobacterium
RILGHVIFAIFPDNPDDP

SEQ ID NO: 854414 - protein, 22 aa, Mycobacterium
RILHQLYLGYPDSAAARGLPSA

SEQ ID NO: 854415 - protein, 19 aa, Mycobacterium
RILKAAGRLLRRGVADLTI

SEQ ID NO: 854416 - protein, 17 aa, Mycobacterium
RILLPELGEPIASDQPF

SEQ ID NO: 854417 - protein, 24 aa, Mycobacterium
RILNNLCRYGLWDVSFESRVDVVL

SEQ ID NO: 854418 - protein, 20 aa, Mycobacterium
RILNYFRIAAEEGAIAALGG

SEQ ID NO: 854419 - protein, 19 aa, Mycobacterium
RILRALGDTPVRVPRALWL

SEQ ID NO: 854420 - protein, 17 aa, Mycobacterium
RILRRRSLAALRAQIEP

SEQ ID NO: 854421 - protein, 20 aa, Mycobacterium
RILRVLRGFDPDVVHLASPA

SEQ ID NO: 854422 - protein, 17 aa, Mycobacterium
RILSRANDFGRLALQNP

SEQ ID NO: 854423 - protein, 18 aa, Mycobacterium
RILTPDSSLGRLLTAALT

SEQ ID NO: 854424 - protein, 17 aa, Mycobacterium
RILVQRSVFDRFMELLE

SEQ ID NO: 854425 - protein, 26 aa, Mycobacterium
RIMDRLYGYEVSPVLWKKVAPKLSAG

SEQ ID NO: 854426 - protein, 17 aa, Mycobacterium
RIMKFRPGAKKAADVPQ

SEQ ID NO: 854427 - protein, 20 aa, Mycobacterium
RIMNHVYITQTLDAAVWGAE

SEQ ID NO: 854428 - protein, 19 aa, Mycobacterium
RIMRELVPHGLPHAGFRTE

SEQ ID NO: 854429 - protein, 27 aa, Mycobacterium
RIMTSSGTFFTLRCYLDDEPIFLGRNG

SEQ ID NO: 854430 - protein, 24 aa, Mycobacterium
RIMTTLLYHMRDKGIRYGLQTMCE

SEQ ID NO: 854431 - protein, 18 aa, Mycobacterium
RIMVDEFIRLHLDKQLTA

SEQ ID NO: 854432 - protein, 26 aa, Mycobacterium
RINCPGWVGITRWLKPVLSTRLGEIP

SEQ ID NO: 854433 - protein, 17 aa, Mycobacterium
RINDLWIAAIAASRGLP

SEQ ID NO: 854434 - protein, 28 aa, Mycobacterium
RINEKTWHGRRFYFTFSAYAQSKMGNLM

SEQ ID NO: 854435 - protein, 17 aa, Mycobacterium
RINFKAHNLDQVLDGDL

SEQ ID NO: 854436 - protein, 24 aa, Mycobacterium
RINGGPRGWFTPPPDTGWSPVNAG

SEQ ID NO: 854437 - protein, 21 aa, Mycobacterium
RINLLVIPYATNSALALMVLR

SEQ ID NO: 854438 - protein, 32 aa, Mycobacterium
RINLNDLNWKSRPYLAWPAYGQSKLANLLFTS

SEQ ID NO: 854439 - protein, 32 aa, Mycobacterium
RINLRDLNWKARPYSAWLAYGQSKLANLMFTS

SEQ ID NO: 854440 - protein, 24 aa, Mycobacterium
RINPFDLTKVWPHADYPLVTVGRL

SEQ ID NO: 854441 - protein, 38 aa, Mycobacterium
RINRRLQRPLVRLRPKLTSRQRWLLSAATLSVIGSITD

SEQ ID NO: 854442 - protein, 21 aa, Mycobacterium
RINVTFPDRLDVWPAYALKIT

SEQ ID NO: 854443 - protein, 24 aa, Mycobacterium
RIPAAEFFTGLWETALASDEILTA

SEQ ID NO: 854444 - protein, 26 aa, Mycobacterium
RIPAAWTHLIGIKPQRGRISTWPFAE

SEQ ID NO: 854445 - protein, 18 aa, Mycobacterium
RIPAFMTIDAPVNIPITG

SEQ ID NO: 854446 - protein, 19 aa, Mycobacterium
RIPARFPMYLPGPDKVMIV

SEQ ID NO: 854447 - protein, 25 aa, Mycobacterium
RIPDYAAWLQRFDTALHALPDAQRQ

SEQ ID NO: 854448 - protein, 21 aa, Mycobacterium
RIPEDFPYPDAFDPDRYEKPR

SEQ ID NO: 854449 - protein, 18 aa, Mycobacterium
RIPFRYAWSEVRAALDTH

SEQ ID NO: 854450 - protein, 19 aa, Mycobacterium
RIPGLNVASLGLPFYGATP

SEQ ID NO: 854451 - protein, 18 aa, Mycobacterium
RIPGWREALMRMGVVEGT

SEQ ID NO: 854452 - protein, 27 aa, Mycobacterium
RIPKPRFVLMPTPIWDQIFKPLVAGQR

SEQ ID NO: 854453 - protein, 17 aa, Mycobacterium
RIPLEGWNFCENASTLA

SEQ ID NO: 854454 - protein, 21 aa, Mycobacterium
RIPLQHLVGTAAFGPLTLEVG

SEQ ID NO: 854455 - protein, 17 aa, Mycobacterium
RIPMLAGRRSLNLSNAA

SEQ ID NO: 854456 - protein, 18 aa, Mycobacterium
RIPMLAGRRSLNLSNAAA

SEQ ID NO: 854457 - protein, 18 aa, Mycobacterium
RIPQLADALIRNPDVSHA

SEQ ID NO: 854458 - protein, 19 aa, Mycobacterium
RIPTIIDKLRREPGMNLGR

SEQ ID NO: 854459 - protein, 18 aa, Mycobacterium
RIPTQYLIAMMAVGADAH

SEQ ID NO: 854460 - protein, 29 aa, Mycobacterium
RIPVRELRRTGLLDKLLLLAGVPETPDGD

SEQ ID NO: 854461 - protein, 23 aa, Mycobacterium
RIPVSIVHRAGIEFPAPALLYGY

SEQ ID NO: 854462 - protein, 24 aa, Mycobacterium
RIQDLNGPWLADQLLELGVELAHI

SEQ ID NO: 854463 - protein, 17 aa, Mycobacterium
RIQEIVTLARGADATVE

SEQ ID NO: 854464 - protein, 18 aa, Mycobacterium
RIQFGRPLAKFQAIQHMI

SEQ ID NO: 854465 - protein, 27 aa, Mycobacterium
RIQHRSGALWILNSEALGRVGLADHPD

SEQ ID NO: 854466 - protein, 28 aa, Mycobacterium
RIQLADRLPAYMVPAAVVVLDALPLTVN

SEQ ID NO: 854467 - protein, 21 aa, Mycobacterium
RIQLKLFLDYSTNPKIYPALH

SEQ ID NO: 854468 - protein, 21 aa, Mycobacterium
RIQMDYVGLNHLGWMRRVLVD

SEQ ID NO: 854469 - protein, 22 aa, Mycobacterium
RIQMGIGGGWYEHEWRAYGYGF

SEQ ID NO: 854470 - protein, 27 aa, Mycobacterium
RIQRRGMADNYWSMGIPGPCGPSSEIY

SEQ ID NO: 854471 - protein, 18 aa, Mycobacterium
RIQRRPDGSLQHPPVPAV

SEQ ID NO: 854472 - protein, 18 aa, Mycobacterium
RIQRRPDGTLQHPPVPAV

SEQ ID NO: 854473 - protein, 19 aa, Mycobacterium
RIQYRFDRTRLVLPDDPSV

SEQ ID NO: 854474 - protein, 17 aa, Mycobacterium
RIRADLPDRVAGVAYPP

SEQ ID NO: 854475 - protein, 18 aa, Mycobacterium
RIRAGETIALIALASGLE

SEQ ID NO: 854476 - protein, 23 aa, Mycobacterium
RIRAIYLYVRDLPYDIAESFRYL

SEQ ID NO: 854477 - protein, 17 aa, Mycobacterium
RIRAVLRRGADADDLGV

SEQ ID NO: 854478 - protein, 20 aa, Mycobacterium
RIRDFMFSGLEGFESLEEAA

SEQ ID NO: 854479 - protein, 28 aa, Mycobacterium
RIRDGRTRMILPDNGLWIISRAAGRNAA

SEQ ID NO: 854480 - protein, 17 aa, Mycobacterium
RIREAFAAIVPPDADAS

SEQ ID NO: 854481 - protein, 19 aa, Mycobacterium
RIRELRQRADADRPYLIAV

SEQ ID NO: 854482 - protein, 26 aa, Mycobacterium
RIRFLHNVMGLWLLSETLRQYERDGH

SEQ ID NO: 854483 - protein, 23 aa, Mycobacterium
RIRGEAPLVIDGHTADVVLAPAI

SEQ ID NO: 854484 - protein, 17 aa, Mycobacterium
RIRGVATNIPFLQAVLD

SEQ ID NO: 854485 - protein, 19 aa, Mycobacterium
RIRHVARRLTPPVARPALG

SEQ ID NO: 854486 - protein, 24 aa, Mycobacterium
RIRIDLGALRILGDGFAWAPGSFY

SEQ ID NO: 854487 - protein, 17 aa, Mycobacterium
RIRIEAAWTKLCGVCPI

SEQ ID NO: 854488 - protein, 22 aa, Mycobacterium
RIRLDRYLYTPMAYPADYGFIE

SEQ ID NO: 854489 - protein, 41 aa, Mycobacterium
RIRLPAAEAIGFMLEILPALGYLHSLGLVYNDLKPENIMVT

SEQ ID NO: 854490 - protein, 27 aa, Mycobacterium
RIRLSMYVLNAAFYKPALLGREVEALD

SEQ ID NO: 854491 - protein, 20 aa, Mycobacterium
RIRLTPYQKLVILDVPDDKL

SEQ ID NO: 854492 - protein, 17 aa, Mycobacterium
RIRNGWYWTGDLGYRDE

SEQ ID NO: 854493 - protein, 18 aa, Mycobacterium
RIRQQYSDLMVRAAAAPG

SEQ ID NO: 854494 - protein, 32 aa, Mycobacterium
RIRRLAAIWLAAQDAHWAVLRIDVIGVRVGRS

SEQ ID NO: 854495 - protein, 24 aa, Mycobacterium
RIRRRTARFFGTYDAVLTPTVADE

SEQ ID NO: 854496 - protein, 30 aa, Mycobacterium
RIRRSARRPVASWAACFWVLADHEDPGYAA

SEQ ID NO: 854497 - protein, 24 aa, Mycobacterium
RIRRVLPELGGLLRRPLITLERVR

SEQ ID NO: 854498 - protein, 25 aa, Mycobacterium
RIRSAGAIFVGPYSPVSLGDYCAGS

SEQ ID NO: 854499 - protein, 18 aa, Mycobacterium
RIRSALAAVPPQPVTVPR

SEQ ID NO: 854500 - protein, 18 aa, Mycobacterium
RIRSRVGPETLGRVRRLL

SEQ ID NO: 854501 - protein, 27 aa, Mycobacterium
RIRSYPSMEWYGFILVWHERHGRAPYW

SEQ ID NO: 854502 - protein, 18 aa, Mycobacterium
RIRVPDLVDYQSLGYARE

SEQ ID NO: 854503 - protein, 23 aa, Mycobacterium
RISAELIRVTPPDWMGSIMARIH

SEQ ID NO: 854504 - protein, 18 aa, Mycobacterium
RISAFAEIVGFYGLNYWY

SEQ ID NO: 854505 - protein, 26 aa, Mycobacterium
RISAQRRFAFGSLPLDQIKAAKFAVP

SEQ ID NO: 854506 - protein, 18 aa, Mycobacterium
RISDLGFAVEIWSFADKD

SEQ ID NO: 854507 - protein, 30 aa, Mycobacterium
RISDPRIRLLVEVLIRTGLRIGDATRLALD

SEQ ID NO: 854508 - protein, 21 aa, Mycobacterium
RISFGPFFQRALSARAEEILG

SEQ ID NO: 854509 - protein, 22 aa, Mycobacterium
RISGVLINLRRDGPVKASRYDR

SEQ ID NO: 854510 - protein, 37 aa, Mycobacterium
RISLERWVEVCATTPARMFGLYPRKGVISPGADADVV

SEQ ID NO: 854511 - protein, 18 aa, Mycobacterium
RISLLFEDDYDRTALVRA

SEQ ID NO: 854512 - protein, 21 aa, Mycobacterium
RISLQVLHYAPLDLVTPTRDK

SEQ ID NO: 854513 - protein, 26 aa, Mycobacterium
RISLRSQVPLLLDEYSRNAATGSFIL

SEQ ID NO: 854514 - protein, 26 aa, Mycobacterium
RISLRTQMPLLLDEYTRNAATGSFIL

SEQ ID NO: 854515 - protein, 26 aa, Mycobacterium
RISLRTQVPLLLDEYTRNASTGSFIL

SEQ ID NO: 854516 - protein, 26 aa, Mycobacterium
RISLRTQVPLLLDEYTRNPSTGSFIL

SEQ ID NO: 854517 - protein, 25 aa, Mycobacterium
RISLRTQVPLLLDEYTRNSSTGSFI

SEQ ID NO: 854518 - protein, 20 aa, Mycobacterium
RISMVTPPLIKALSAVRRQI

SEQ ID NO: 854519 - protein, 22 aa, Mycobacterium
RISPLVAELAQTLGRTIDVALQ

SEQ ID NO: 854520 - protein, 23 aa, Mycobacterium
RISQLWAALIEMISAGVLRPLPT

SEQ ID NO: 854521 - protein, 27 aa, Mycobacterium
RISRGMRTPFVAPIGRDYVAWWSPDAQ

SEQ ID NO: 854522 - protein, 18 aa, Mycobacterium
RISRITPELIRALGAVRR

SEQ ID NO: 854523 - protein, 18 aa, Mycobacterium
RISTWPLPEAFNGITVNG

SEQ ID NO: 854524 - protein, 27 aa, Mycobacterium
RISVPYFFNPRLDAAIPVLALPDELAA

SEQ ID NO: 854525 - protein, 19 aa, Mycobacterium
RISVRDRIVVLRNAPSPAA

SEQ ID NO: 854526 - protein, 22 aa, Mycobacterium
RITALLALGRVSTALAAVTQLR

SEQ ID NO: 854527 - protein, 25 aa, Mycobacterium
RITAPKGWELVRHAGPLPTHPDEDD

SEQ ID NO: 854528 - protein, 25 aa, Mycobacterium
RITAPRGWDLVRHAGPLFSEPTHPD

SEQ ID NO: 854529 - protein, 20 aa, Mycobacterium
RITAPRGWELVRHAGPLPTH

SEQ ID NO: 854530 - protein, 24 aa, Mycobacterium
RITAPRGWELVRHAGPLPTNPDED

SEQ ID NO: 854531 - protein, 24 aa, Mycobacterium
RITAPWCDVWPALRAPEPGFTEDT

SEQ ID NO: 854532 - protein, 20 aa, Mycobacterium
RITATFLVPSMLYALMDHPD

SEQ ID NO: 854533 - protein, 19 aa, Mycobacterium
RITAWALEELARVRAAGFS

SEQ ID NO: 854534 - protein, 17 aa, Mycobacterium
RITDYLSQNLRITQGNG

SEQ ID NO: 854535 - protein, 27 aa, Mycobacterium
RITEAVYFVERLVDCLAFELKMDPAEL

SEQ ID NO: 854536 - protein, 18 aa, Mycobacterium
RITFLAKSEYFTGTGLKG

SEQ ID NO: 854537 - protein, 23 aa, Mycobacterium
RITGQKVWTSYALMASWCVLAAC

SEQ ID NO: 854538 - protein, 23 aa, Mycobacterium
RITGRYALIRTNGKQWLVHRMKD

SEQ ID NO: 854539 - protein, 40 aa, Mycobacterium
RITLGEDLVLYLFGTPGQRRFWFMWDDLVRGAIGAIVLVD

SEQ ID NO: 854540 - protein, 23 aa, Mycobacterium
RITLWRDYFDFYDMTKALLRGVA

SEQ ID NO: 854541 - protein, 26 aa, Mycobacterium
RITLWRDYFDYLDIFKATVRGLLGMV

SEQ ID NO: 854542 - protein, 25 aa, Mycobacterium
RITMPENTIRWAWAPGDVAMWDNRA

SEQ ID NO: 854543 - protein, 18 aa, Mycobacterium
RITQDLLDRTRKPFQSVI

SEQ ID NO: 854544 - protein, 19 aa, Mycobacterium
RITSDADAFVRWVTQRGSW

SEQ ID NO: 854545 - protein, 19 aa, Mycobacterium
RITTFSTVPTVYASLPPLP

SEQ ID NO: 854546 - protein, 20 aa, Mycobacterium
RIVAALRRALGPVPVAVEPL

SEQ ID NO: 854547 - protein, 19 aa, Mycobacterium
RIVADSWRRSLATGVDPDR

SEQ ID NO: 854548 - protein, 29 aa, Mycobacterium
RIVAGGHSLLPMMKLRIANPEYLVDINDL

SEQ ID NO: 854549 - protein, 19 aa, Mycobacterium
RIVAGLAEIIEEVTGIEPS

SEQ ID NO: 854550 - protein, 26 aa, Mycobacterium
RIVALGRELTMLRAHLGHPLPELVAE

SEQ ID NO: 854551 - protein, 17 aa, Mycobacterium
RIVANRVQSMWVSTFHS

SEQ ID NO: 854552 - protein, 19 aa, Mycobacterium
RIVAWIMRTDSADLPWHRV

SEQ ID NO: 854553 - protein, 19 aa, Mycobacterium
RIVCPFHGWEWNRDGRNVC

SEQ ID NO: 854554 - protein, 17 aa, Mycobacterium
RIVDGRPYVMFGPYATF

SEQ ID NO: 854555 - protein, 18 aa, Mycobacterium
RIVDIDGCQYREGLSAVR

SEQ ID NO: 854556 - protein, 18 aa, Mycobacterium
RIVDLTAFWAGPAATHLL

SEQ ID NO: 854557 - protein, 20 aa, Mycobacterium
RIVEAVDYLTFRLTGRWVGS

SEQ ID NO: 854558 - protein, 18 aa, Mycobacterium
RIVEYLAVRARRAHRGLQ

SEQ ID NO: 854559 - protein, 17 aa, Mycobacterium
RIVEYLAVRARRAQRGM

SEQ ID NO: 854560 - protein, 18 aa, Mycobacterium
RIVEYLAVRARRAQRGMA

SEQ ID NO: 854561 - protein, 20 aa, Mycobacterium
RIVFLDFGIVGFIDPRTRWL

SEQ ID NO: 854562 - protein, 20 aa, Mycobacterium
RIVGAVTFDHGKWLPYYASL

SEQ ID NO: 854563 - protein, 20 aa, Mycobacterium
RIVGPLARAALENALQRGQA

SEQ ID NO: 854564 - protein, 19 aa, Mycobacterium
RIVGRLTEPLLSPTEDERD

SEQ ID NO: 854565 - protein, 17 aa, Mycobacterium
RIVGSVWPRTSPEAWSE

SEQ ID NO: 854566 - protein, 19 aa, Mycobacterium
RIVGWIMRTDSADLPWHRV

SEQ ID NO: 854567 - protein, 18 aa, Mycobacterium
RIVGWIMRTDSSDLPWHR

SEQ ID NO: 854568 - protein, 23 aa, Mycobacterium
RIVGWIMRTDSVDLPWHRVITAS

SEQ ID NO: 854569 - protein, 18 aa, Mycobacterium
RIVLAGGGVREDLLRLLP

SEQ ID NO: 854570 - protein, 17 aa, Mycobacterium
RIVLLDAGSIRAEWTVR

SEQ ID NO: 854571 - protein, 24 aa, Mycobacterium
RIVLTTSRWHVGGAKLSAVATAAG

SEQ ID NO: 854572 - protein, 21 aa, Mycobacterium
RIVMMGGLGPGPFCGMLLGDL

SEQ ID NO: 854573 - protein, 22 aa, Mycobacterium
RIVRALLGFDAKLSQYTRGKAF

SEQ ID NO: 854574 - protein, 17 aa, Mycobacterium
RIVRLFDFAGEHRAMYR

SEQ ID NO: 854575 - protein, 17 aa, Mycobacterium
RIVRLPKSHIKAVGTHP

SEQ ID NO: 854576 - protein, 19 aa, Mycobacterium
RIVRNPARALRMAKRLLQE

SEQ ID NO: 854577 - protein, 17 aa, Mycobacterium
RIVRRKLRSPRDLRFVP

SEQ ID NO: 854578 - protein, 26 aa, Mycobacterium
RIVRRSNALLDWAYGRRFQYTEHMSL

SEQ ID NO: 854579 - protein, 27 aa, Mycobacterium
RIVRRSNALLDWAYGRRFRYSEHMSLG

SEQ ID NO: 854580 - protein, 26 aa, Mycobacterium
RIVRRSNALLDWAYGTRMRYREAMSL

SEQ ID NO: 854581 - protein, 17 aa, Mycobacterium
RIVSFRELSAPAAIRTE

SEQ ID NO: 854582 - protein, 20 aa, Mycobacterium
RIVSLPGYPFARQRHWVEPK

SEQ ID NO: 854583 - protein, 17 aa, Mycobacterium
RIVSPLFTPKAVNGLHA

SEQ ID NO: 854584 - protein, 19 aa, Mycobacterium
RIVTDGAVLILRPEPDELR

SEQ ID NO: 854585 - protein, 17 aa, Mycobacterium
RIVTLLMRNARATFAEI

SEQ ID NO: 854586 - protein, 19 aa, Mycobacterium
RIVTQLWNTADAYRPLYAH

SEQ ID NO: 854587 - protein, 19 aa, Mycobacterium
RIVTWLFVNAAGAETLSAP

SEQ ID NO: 854588 - protein, 27 aa, Mycobacterium
RIVVQMMPWLEPEPVRWAIDNVHVRVG

SEQ ID NO: 854589 - protein, 27 aa, Mycobacterium
RIVVTGNYRAWRHFIAMRASEHADVEI

SEQ ID NO: 854590 - protein, 19 aa, Mycobacterium
RIVVWELIDALRRDGVTVV

SEQ ID NO: 854591 - protein, 19 aa, Mycobacterium
RIVWSGGSYVRRPLSLPFE

SEQ ID NO: 854592 - protein, 17 aa, Mycobacterium
RIWDSKVAEVPLGRAGE

SEQ ID NO: 854593 - protein, 18 aa, Mycobacterium
RIWEHNHIYKPFIESLPS

SEQ ID NO: 854594 - protein, 30 aa, Mycobacterium
RIWHAVCWGIIIPAGWWRTRDAALYRYLWR

SEQ ID NO: 854595 - protein, 18 aa, Mycobacterium
RIWLSKATINGVLTDPAK

SEQ ID NO: 854596 - protein, 17 aa, Mycobacterium
RIWYEDGAYLLGRPGQS

SEQ ID NO: 854597 - protein, 20 aa, Mycobacterium
RIYHLIPEPFEQIAQWTESF

SEQ ID NO: 854598 - protein, 17 aa, Mycobacterium
RIYRMYADGAGLRYIAQ

SEQ ID NO: 854599 - protein, 20 aa, Mycobacterium
RIYRMYADGAGLRYIAQELT

SEQ ID NO: 854600 - protein, 18 aa, Mycobacterium
RIYVQHKMLDYGADVWRW

SEQ ID NO: 854601 - protein, 21 aa, Mycobacterium
RKADDALWKRYSAARETFNRR

SEQ ID NO: 854602 - protein, 26 aa, Mycobacterium
RKAGPDAVVVVLLPDGGRGYLSKIFN

SEQ ID NO: 854603 - protein, 30 aa, Mycobacterium
RKAGRRFARLAPIVGTYRKLMAAREDLEAA

SEQ ID NO: 854604 - protein, 19 aa, Mycobacterium
RKAIGAAAFAIYRRRRIRK

SEQ ID NO: 854605 - protein, 25 aa, Mycobacterium
RKAKKLRVRLPLPKLTVAVADPERL

SEQ ID NO: 854606 - protein, 24 aa, Mycobacterium
RKAKKLRVRLPLPKLTVAVDDPRR

SEQ ID NO: 854607 - protein, 24 aa, Mycobacterium
RKAKKLRVRLPLPKLTVAVENPHL

SEQ ID NO: 854608 - protein, 24 aa, Mycobacterium
RKAKKLRVRLPLPKLTVAVENPQA

SEQ ID NO: 854609 - protein, 24 aa, Mycobacterium
RKAKKLRVRLPLPKLTVAVQDPDS

SEQ ID NO: 854610 - protein, 17 aa, Mycobacterium
RKALADHGFGVLTEIDV

SEQ ID NO: 854611 - protein, 17 aa, Mycobacterium
RKARATVPAWEDVLLGV

SEQ ID NO: 854612 - protein, 31 aa, Mycobacterium
RKATLAFAFSHRSYLDGLLLPESIQANRLSP

SEQ ID NO: 854613 - protein, 26 aa, Mycobacterium
RKATLAFAFSHRSYLDGLLLPEVILA

SEQ ID NO: 854614 - protein, 28 aa, Mycobacterium
RKATLAFAFSHRSYLDGLLLPEVIQANR

SEQ ID NO: 854615 - protein, 19 aa, Mycobacterium
RKAVMKSQPWILAYEDHNV

SEQ ID NO: 854616 - protein, 17 aa, Mycobacterium
RKAVRYQIKHGAQLIKV

SEQ ID NO: 854617 - protein, 20 aa, Mycobacterium
RKDFRVVLGADRMGRVGALD

SEQ ID NO: 854618 - protein, 18 aa, Mycobacterium
RKDHPTMPKPTRIARTDN

SEQ ID NO: 854619 - protein, 21 aa, Mycobacterium
RKDIALWRALEFPGTNAHVSA

SEQ ID NO: 854620 - protein, 24 aa, Mycobacterium
RKDVGYEGMRWITVGPAGRPDMNI

SEQ ID NO: 854621 - protein, 21 aa, Mycobacterium
RKEHWLPAHFTGDSSAVMPGN

SEQ ID NO: 854622 - protein, 21 aa, Mycobacterium
RKEIMRGLTAVLIDYARTVHD

SEQ ID NO: 854623 - protein, 24 aa, Mycobacterium
RKEIRDIIAYLRVLDNPGDAVSMR

SEQ ID NO: 854624 - protein, 26 aa, Mycobacterium
RKEKPLDYLVERWEWWSRTAPDVGVQ

SEQ ID NO: 854625 - protein, 18 aa, Mycobacterium
RKELAHILSTAKPKVFLT

SEQ ID NO: 854626 - protein, 25 aa, Mycobacterium
RKELIAECDVILLPKVHAEDLAECR

SEQ ID NO: 854627 - protein, 21 aa, Mycobacterium
RKFFDFISSREDLLPEFANVD

SEQ ID NO: 854628 - protein, 25 aa, Mycobacterium
RKFLDRNLIGRVPLIGGALSLLTSD

SEQ ID NO: 854629 - protein, 25 aa, Mycobacterium
RKFNDAFGPYGLPPTTIKPSYGMAE

SEQ ID NO: 854630 - protein, 20 aa, Mycobacterium
RKFREALERKKAKAAGGADH

SEQ ID NO: 854631 - protein, 28 aa, Mycobacterium
RKFRRERALGRYLLNPAVKGMGKLGLRT

SEQ ID NO: 854632 - protein, 19 aa, Mycobacterium
RKFRTLLRPGGTLAVHEYS

SEQ ID NO: 854633 - protein, 22 aa, Mycobacterium
RKFVLQLVGGSLRFERRRWDRG

SEQ ID NO: 854634 - protein, 26 aa, Mycobacterium
RKGIKTLYYIRLRQLALEGTEVEGCV

SEQ ID NO: 854635 - protein, 17 aa, Mycobacterium
RKGLAAFRRAGGRIVES

SEQ ID NO: 854636 - protein, 17 aa, Mycobacterium
RKGLDAPTLWDPDDVAA

SEQ ID NO: 854637 - protein, 21 aa, Mycobacterium
RKGLDVRIYRPSLISPTRAGF

SEQ ID NO: 854638 - protein, 27 aa, Mycobacterium
RKGVDRLVAAWRLLLAEGIEGRCRIIG

SEQ ID NO: 854639 - protein, 17 aa, Mycobacterium
RKGYLRRDPNRPRAVDV

SEQ ID NO: 854640 - protein, 20 aa, Mycobacterium
RKHELLLLADEIYDKILYDD

SEQ ID NO: 854641 - protein, 21 aa, Mycobacterium
RKHELLLLADEIYDKILYDDA

SEQ ID NO: 854642 - protein, 22 aa, Mycobacterium
RKHELLLLADEIYDKILYGDAK

SEQ ID NO: 854643 - protein, 25 aa, Mycobacterium
RKHKDACIFLNRPGFAGGTGCALHS

SEQ ID NO: 854644 - protein, 25 aa, Mycobacterium
RKHKDACIFLNRPGFAGGVGCALHS

SEQ ID NO: 854645 - protein, 26 aa, Mycobacterium
RKHKSLTMFLVPLDSPGIEIRGIRTV

SEQ ID NO: 854646 - protein, 20 aa, Mycobacterium
RKHLTLVHKTNVLTFAGKLW

SEQ ID NO: 854647 - protein, 33 aa, Mycobacterium
RKHLTLVHKTNVLTFAGRLWSRIVAEVGRDYPD

SEQ ID NO: 854648 - protein, 22 aa, Mycobacterium
RKHQLLLLADEIYDKILYDDAE

SEQ ID NO: 854649 - protein, 22 aa, Mycobacterium
RKHQLLLLADEIYDKILYDDAK

SEQ ID NO: 854650 - protein, 26 aa, Mycobacterium
RKHRNLTMFLVPLDSPGIEIQGIRTV

SEQ ID NO: 854651 - protein, 25 aa, Mycobacterium
RKHVAWYMHGFPAGADLRRSMALVK

SEQ ID NO: 854652 - protein, 26 aa, Mycobacterium
RKIAPDILLGIPYAREELDLEVAPQR

SEQ ID NO: 854653 - protein, 26 aa, Mycobacterium
RKIDSAEIWRWLRGGGITHFSAAPTV

SEQ ID NO: 854654 - protein, 21 aa, Mycobacterium
RKIEEIGGLITRLSIGGNGER

SEQ ID NO: 854655 - protein, 24 aa, Mycobacterium
RKIHNRFMAVNEMLRSGGATYHNS

SEQ ID NO: 854656 - protein, 31 aa, Mycobacterium
RKIIAERGIDTVWFGAAAPLALMAPLARAAG

SEQ ID NO: 854657 - protein, 33 aa, Mycobacterium
RKIKFVGPVKVAMANMAVLGAGLRLLGQVDGLV

SEQ ID NO: 854658 - protein, 20 aa, Mycobacterium
RKIVEFMLANARRLLDAGAD

SEQ ID NO: 854659 - protein, 21 aa, Mycobacterium
RKIVEIPRPAGVVLALTPTTN

SEQ ID NO: 854660 - protein, 20 aa, Mycobacterium
RKIVPVCPYVKKFVGKHHEF

SEQ ID NO: 854661 - protein, 18 aa, Mycobacterium
RKIWSGEATFLFTRTTVG

SEQ ID NO: 854662 - protein, 23 aa, Mycobacterium
RKKARARRAVWFSAIGALSNGKV

SEQ ID NO: 854663 - protein, 25 aa, Mycobacterium
RKLAAHFFLTFPQLDDVRFTHRWAG

SEQ ID NO: 854664 - protein, 23 aa, Mycobacterium
RKLDDIEICGFATLLGGAGAETV

SEQ ID NO: 854665 - protein, 22 aa, Mycobacterium
RKLDLPTYPFEHRQFWFSDNRA

SEQ ID NO: 854666 - protein, 18 aa, Mycobacterium
RKLEIDPAHPKHLLTEAG

SEQ ID NO: 854667 - protein, 20 aa, Mycobacterium
RKLFRPHPHLDPDTLAPMTP

SEQ ID NO: 854668 - protein, 18 aa, Mycobacterium
RKLGAEIGYPLLVKASAG

SEQ ID NO: 854669 - protein, 18 aa, Mycobacterium
RKLGELRPLYPPGLVHIY

SEQ ID NO: 854670 - protein, 36 aa, Mycobacterium
RKLGPEFLVELFEIRAALGPLIGRSAARRGAPEDAG

SEQ ID NO: 854671 - protein, 18 aa, Mycobacterium
RKLGVGWPKEFGGLGFGP

SEQ ID NO: 854672 - protein, 17 aa, Mycobacterium
RKLIMCRPAEAVYDEAK

SEQ ID NO: 854673 - protein, 17 aa, Mycobacterium
RKLMATDIGYDEASWRQ

SEQ ID NO: 854674 - protein, 17 aa, Mycobacterium
RKLQLPRDTSLVTILRG

SEQ ID NO: 854675 - protein, 23 aa, Mycobacterium
RKLRDWLLVRAFEHGITHLSSSS

SEQ ID NO: 854676 - protein, 22 aa, Mycobacterium
RKLRNTLLNLITDIAQRHTGRT

SEQ ID NO: 854677 - protein, 18 aa, Mycobacterium
RKLRRDSDIVNYACIEWA

SEQ ID NO: 854678 - protein, 18 aa, Mycobacterium
RKLRTLLRPGATLAVHEY

SEQ ID NO: 854679 - protein, 21 aa, Mycobacterium
RKLSEVAGPLTRLTLSRDGRR

SEQ ID NO: 854680 - protein, 17 aa, Mycobacterium
RKLWLDLDDAGFGLLDA

SEQ ID NO: 854681 - protein, 26 aa, Mycobacterium
RKLYAPLAKAALALGVRFWPHTTVTK

SEQ ID NO: 854682 - protein, 18 aa, Mycobacterium
RKLYHGCDVWLNNPLRPL

SEQ ID NO: 854683 - protein, 20 aa, Mycobacterium
RKMHIPISAGYYEDTYFRPG

SEQ ID NO: 854684 - protein, 17 aa, Mycobacterium
RKMVYLPNFDAQEWIRL

SEQ ID NO: 854685 - protein, 21 aa, Mycobacterium
RKNARQHLAFGRGIHSCPGAP

SEQ ID NO: 854686 - protein, 22 aa, Mycobacterium
RKNARQHLAFGRGIHSCPGAPL

SEQ ID NO: 854687 - protein, 29 aa, Mycobacterium
RKNERYKLVWKNRLGFARLAIQHAYPIVP

SEQ ID NO: 854688 - protein, 23 aa, Mycobacterium
RKNGLPVYALAPFATRGLQKMSG

SEQ ID NO: 854689 - protein, 22 aa, Mycobacterium
RKNKARILIGNDAKMFEIAIRA

SEQ ID NO: 854690 - protein, 21 aa, Mycobacterium
RKNVREHIAFGRGVHSCPGGP

SEQ ID NO: 854691 - protein, 19 aa, Mycobacterium
RKNVREHMAFARGVHSCPG

SEQ ID NO: 854692 - protein, 20 aa, Mycobacterium
RKPEAYARLEAARTALAALS

SEQ ID NO: 854693 - protein, 22 aa, Mycobacterium
RKPEFAEDWVNLVALAVNEENA

SEQ ID NO: 854694 - protein, 22 aa, Mycobacterium
RKPQVMDVYFLAGADDFILHVA

SEQ ID NO: 854695 - protein, 27 aa, Mycobacterium
RKPRRIPVWFMRQAGRSLPEYRALRAQ

SEQ ID NO: 854696 - protein, 25 aa, Mycobacterium
RKPRSEVTVPRWLAPFGTIEEVTPE

SEQ ID NO: 854697 - protein, 25 aa, Mycobacterium
RKPRTWQDMLLPDGPADAGPDGASP

SEQ ID NO: 854698 - protein, 26 aa, Mycobacterium
RKPVPGHGWRLALLKATFGLVNVGPS

SEQ ID NO: 854699 - protein, 21 aa, Mycobacterium
RKPVTLRELAITPLLMREPGS

SEQ ID NO: 854700 - protein, 20 aa, Mycobacterium
RKPWPPRRPVPSVRIPSAVK

SEQ ID NO: 854701 - protein, 23 aa, Mycobacterium
RKQFVGMIEGRPYRFGDAVAVDV

SEQ ID NO: 854702 - protein, 18 aa, Mycobacterium
RKQLLVVIGRDDETAAKS

SEQ ID NO: 854703 - protein, 20 aa, Mycobacterium
RKQLPTVIDASALTWERILC

SEQ ID NO: 854704 - protein, 27 aa, Mycobacterium
RKQPPLQRLLRILLGVDAKMSQYTKGK

SEQ ID NO: 854705 - protein, 25 aa, Mycobacterium
RKQPVLIHRALFGSIERFFGVLTEH

SEQ ID NO: 854706 - protein, 17 aa, Mycobacterium
RKRADAILARRTDRLPM

SEQ ID NO: 854707 - protein, 17 aa, Mycobacterium
RKRAKALRYTAAATAAS

SEQ ID NO: 854708 - protein, 21 aa, Mycobacterium
RKRFLGTLLAAADGTPRPPDG

SEQ ID NO: 854709 - protein, 23 aa, Mycobacterium
RKRGERFLAYQDSADWVEVHADD

SEQ ID NO: 854710 - protein, 17 aa, Mycobacterium
RKRGFDLCIYMLGADHH

SEQ ID NO: 854711 - protein, 20 aa, Mycobacterium
RKRGGRLVVIDPARTRTAEL

SEQ ID NO: 854712 - protein, 17 aa, Mycobacterium
RKRGLILRTVQADWREL

SEQ ID NO: 854713 - protein, 30 aa, Mycobacterium
RKRGPGVLRCDLLVINKVDLAPHVGVDLDL

SEQ ID NO: 854714 - protein, 21 aa, Mycobacterium
RKRILTLRRAELDEAFPGLLD

SEQ ID NO: 854715 - protein, 19 aa, Mycobacterium
RKRLARNVILAAGALNTPL

SEQ ID NO: 854716 - protein, 18 aa, Mycobacterium
RKRLDERRFLTRYVEIRA

SEQ ID NO: 854717 - protein, 39 aa, Mycobacterium
RKRLRFDGIAQPWLRDLAKRFARWRLSIGRSPNQTYIDV

SEQ ID NO: 854718 - protein, 25 aa, Mycobacterium
RKRLRQWMMRITAYADRLLDDLELL

SEQ ID NO: 854719 - protein, 25 aa, Mycobacterium
RKRLRQWMMRITAYSDRLLDDLDVL

SEQ ID NO: 854720 - protein, 25 aa, Mycobacterium
RKRLRQWMMRITAYSDRLLDDLELL

SEQ ID NO: 854721 - protein, 17 aa, Mycobacterium
RKRLSRIGLGPKALRRR

SEQ ID NO: 854722 - protein, 23 aa, Mycobacterium
RKRLSTALVITEWCQLPSGTTRQ

SEQ ID NO: 854723 - protein, 17 aa, Mycobacterium
RKRMGDRAPIWTQIGVP

SEQ ID NO: 854724 - protein, 18 aa, Mycobacterium
RKRPAHTLMPALTTRDGA

SEQ ID NO: 854725 - protein, 18 aa, Mycobacterium
RKRRGAWVGWPGVPDADV

SEQ ID NO: 854726 - protein, 25 aa, Mycobacterium
RKRRQPVTVLLKALGWTNEQIHERF

SEQ ID NO: 854727 - protein, 26 aa, Mycobacterium
RKRRQPVTVLLKALGWTNEQITERFG

SEQ ID NO: 854728 - protein, 24 aa, Mycobacterium
RKRRRGILGYDDLLLRLADALASE

SEQ ID NO: 854729 - protein, 20 aa, Mycobacterium
RKRSFYRMFFDSGYTPLPGE

SEQ ID NO: 854730 - protein, 20 aa, Mycobacterium
RKRVEGIGFFAGLLGQHTVD

SEQ ID NO: 854731 - protein, 19 aa, Mycobacterium
RKRVLIARALMTDPELLLL

SEQ ID NO: 854732 - protein, 18 aa, Mycobacterium
RKRWDRYAAFAQKTFNVE

SEQ ID NO: 854733 - protein, 28 aa, Mycobacterium
RKRYPAIIVKAPLWVQRTPKRHNAMFAE

SEQ ID NO: 854734 - protein, 20 aa, Mycobacterium
RKRYQLGERPTVVCVSRLVP

SEQ ID NO: 854735 - protein, 22 aa, Mycobacterium
RKRYRLDERPVVVCVSRLVPRK

SEQ ID NO: 854736 - protein, 23 aa, Mycobacterium
RKSDGGWVWKFDPAIYGGEYLDP

SEQ ID NO: 854737 - protein, 22 aa, Mycobacterium
RKSEPIFWVDVPGGTGGFGDKG

SEQ ID NO: 854738 - protein, 28 aa, Mycobacterium
RKSKTWVSHRRALLKLAPDLQEATRRGD

SEQ ID NO: 854739 - protein, 25 aa, Mycobacterium
RKSKTYPLCDTSHRRRQRAGGGAQS

SEQ ID NO: 854740 - protein, 30 aa, Mycobacterium
RKSPPTAGWRRWLYLASFKQVNVGESPKVT

SEQ ID NO: 854741 - protein, 18 aa, Mycobacterium
RKSYADQPYWGRPAPGFG

SEQ ID NO: 854742 - protein, 19 aa, Mycobacterium
RKTFGFYHNFMGFPKVTVG

SEQ ID NO: 854743 - protein, 27 aa, Mycobacterium
RKTLKKWINFLEDCKPYAKALYNAIVT

SEQ ID NO: 854744 - protein, 25 aa, Mycobacterium
RKVADGVRMLIVPGSMRVRAQAESE

SEQ ID NO: 854745 - protein, 36 aa, Mycobacterium
RKVAEAVLMLAKLDDPPLRLLLGRDVLKAMRDKIAA

SEQ ID NO: 854746 - protein, 34 aa, Mycobacterium
RKVAPVYLYRFDYSTPLLKLLLVNAAHATELPYV

SEQ ID NO: 854747 - protein, 24 aa, Mycobacterium
RKVARLMEWCAMVACPIIGIQDSG

SEQ ID NO: 854748 - protein, 19 aa, Mycobacterium
RKVARLMEWVAMVGCPIIG

SEQ ID NO: 854749 - protein, 24 aa, Mycobacterium
RKVAVVACMDARLNPYGLLGLHEG

SEQ ID NO: 854750 - protein, 31 aa, Mycobacterium
RKVFIPVTRLCRDTCHYCTFVTVPGKLRASG

SEQ ID NO: 854751 - protein, 17 aa, Mycobacterium
RKVFPLSIVQHFARIWL

SEQ ID NO: 854752 - protein, 24 aa, Mycobacterium
RKVGHINFLGFDPAAVAGLRERAE

SEQ ID NO: 854753 - protein, 22 aa, Mycobacterium
RKVHDFPIIWVKSRGNDGKMHR

SEQ ID NO: 854754 - protein, 18 aa, Mycobacterium
RKVHFLEEWTLRRRLRAS

SEQ ID NO: 854755 - protein, 33 aa, Mycobacterium
RKVLQRIDDLVIPPAWKTVWICPHASGHIQAVG

SEQ ID NO: 854756 - protein, 26 aa, Mycobacterium
RKVMPRLLNVGPWETLALAKPDLLSR

SEQ ID NO: 854757 - protein, 24 aa, Mycobacterium
RKVNATAAILPLSARTGAGMAAWF

SEQ ID NO: 854758 - protein, 21 aa, Mycobacterium
RKVNLLFFTGDAMARPLLDAL

SEQ ID NO: 854759 - protein, 22 aa, Mycobacterium
RKVNLLFFTGDAMARPLLDALD

SEQ ID NO: 854760 - protein, 18 aa, Mycobacterium
RKVQFYCIDLGGGGLIYL

SEQ ID NO: 854761 - protein, 20 aa, Mycobacterium
RKVQLRRWVPTALIQRIQRA

SEQ ID NO: 854762 - protein, 18 aa, Mycobacterium
RKVVLRYSEPGLATARSF

SEQ ID NO: 854763 - protein, 18 aa, Mycobacterium
RKVVPLRQALSNFSAWVT

SEQ ID NO: 854764 - protein, 30 aa, Mycobacterium
RKVVRLRQKVVMPTLPTAAPRWVVDPDFNL

SEQ ID NO: 854765 - protein, 27 aa, Mycobacterium
RKVVVFRPLYAVGGQDLGYLPGSESEK

SEQ ID NO: 854766 - protein, 18 aa, Mycobacterium
RKWGIPSRRIVELDWHEG

SEQ ID NO: 854767 - protein, 20 aa, Mycobacterium
RKWREHLYEMDYLREGIGLR

SEQ ID NO: 854768 - protein, 20 aa, Mycobacterium
RKWTAQFEHTLLVTGTGVEI

SEQ ID NO: 854769 - protein, 32 aa, Mycobacterium
RKWYSRLAITELLIEALKRLNMSWPPPDFDVE

SEQ ID NO: 854770 - protein, 21 aa, Mycobacterium
RKWYSRLAVTALLDETLDGLN

SEQ ID NO: 854771 - protein, 21 aa, Mycobacterium
RKYCRQQALLISRFHARRDVH

SEQ ID NO: 854772 - protein, 38 aa, Mycobacterium
RKYFDVNVLAAVRLIRSYLPGMIEKGWGRAIQIASDSA

SEQ ID NO: 854773 - protein, 18 aa, Mycobacterium
RKYNRVAAYGQSKLANLM

SEQ ID NO: 854774 - protein, 23 aa, Mycobacterium
RLAAAAPFYGPLPDNPDFSRSKA

SEQ ID NO: 854775 - protein, 19 aa, Mycobacterium
RLAAALKPALAARGVPASI

SEQ ID NO: 854776 - protein, 37 aa, Mycobacterium
RLAAAPASWLVGRPAYHAFTFGWLLSGLARSVTGTGM

SEQ ID NO: 854777 - protein, 28 aa, Mycobacterium
RLAADELGLPTAPFWFAGSVGELEAVGA

SEQ ID NO: 854778 - protein, 18 aa, Mycobacterium
RLAADPRLPLDRAALDAA

SEQ ID NO: 854779 - protein, 25 aa, Mycobacterium
RLAAEQWLCDVGFGTSPLAPIRLVD

SEQ ID NO: 854780 - protein, 17 aa, Mycobacterium
RLAAETLGLPTSPYQFC

SEQ ID NO: 854781 - protein, 20 aa, Mycobacterium
RLAAGGLKLNRFHTTALCSP

SEQ ID NO: 854782 - protein, 18 aa, Mycobacterium
RLAAGLPAYGACAGMIML

SEQ ID NO: 854783 - protein, 17 aa, Mycobacterium
RLAAGTWLREYLRGLIA

SEQ ID NO: 854784 - protein, 35 aa, Mycobacterium
RLAALRAVMPRLLDLRPWETLALAKPNLLQRGPWR

SEQ ID NO: 854785 - protein, 28 aa, Mycobacterium
RLAALRTAVPRLLSMGPWGTLALANPKL

SEQ ID NO: 854786 - protein, 18 aa, Mycobacterium
RLAAMPKPKRNYGRYSPW

SEQ ID NO: 854787 - protein, 24 aa, Mycobacterium
RLAAMPSISLQLLGGRVRGVTQAA

SEQ ID NO: 854788 - protein, 24 aa, Mycobacterium
RLAAPLLPLATEVIWRGLTGERSV

SEQ ID NO: 854789 - protein, 19 aa, Mycobacterium
RLAAQLGVRLPPRRLFGRR

SEQ ID NO: 854790 - protein, 21 aa, Mycobacterium
RLAARAFPRQVGLPRTLSILR

SEQ ID NO: 854791 - protein, 20 aa, Mycobacterium
RLAARATLSFAILARRDSVH

SEQ ID NO: 854792 - protein, 30 aa, Mycobacterium
RLAARITTPLLPDDYLQLANPLWSARELRG

SEQ ID NO: 854793 - protein, 20 aa, Mycobacterium
RLAARPIGLPKPSDWEVADE

SEQ ID NO: 854794 - protein, 25 aa, Mycobacterium
RLACGDLAMFKDHYVPVLSSVKAFV

SEQ ID NO: 854795 - protein, 30 aa, Mycobacterium
RLADEGFGLDKFPLWTGQPYDIDNLSADQA

SEQ ID NO: 854796 - protein, 20 aa, Mycobacterium
RLADENMLPLRPANFVSGLE

SEQ ID NO: 854797 - protein, 29 aa, Mycobacterium
RLADEQTLFRLLMGLREPAISAVLVRGRD

SEQ ID NO: 854798 - protein, 20 aa, Mycobacterium
RLADGWLGSFLTPVEAGAAR

SEQ ID NO: 854799 - protein, 29 aa, Mycobacterium
RLADGYIDIKGLRLTVTQAAWRVSEDLPA

SEQ ID NO: 854800 - protein, 21 aa, Mycobacterium
RLADHIVAAWPRALCVPSWLR

SEQ ID NO: 854801 - protein, 18 aa, Mycobacterium
RLADKQGIQWMLVDSEVD

SEQ ID NO: 854802 - protein, 20 aa, Mycobacterium
RLADLWFDVGAAAAAARYAA

SEQ ID NO: 854803 - protein, 27 aa, Mycobacterium
RLADLYVRLYELPIPVIAAVNGAAVGG

SEQ ID NO: 854804 - protein, 29 aa, Mycobacterium
RLADPAHAVPWLIDNDLLSPGSTPTRDEM

SEQ ID NO: 854805 - protein, 34 aa, Mycobacterium
RLADSALYCGPLMRHFGWIFERNPDLIGAALTVG

SEQ ID NO: 854806 - protein, 26 aa, Mycobacterium
RLADSPALWLGDRGKNLAYFGLRNAL

SEQ ID NO: 854807 - protein, 20 aa, Mycobacterium
RLADVGILVAPPRVLNIDVG

SEQ ID NO: 854808 - protein, 27 aa, Mycobacterium
RLAEAGFLAPHWPAPYGLGAGAAQQLL

SEQ ID NO: 854809 - protein, 25 aa, Mycobacterium
RLAECLLVDIIGLPWEDVHAEACRW

SEQ ID NO: 854810 - protein, 18 aa, Mycobacterium
RLAEKFDAVLLASSLINY

SEQ ID NO: 854811 - protein, 18 aa, Mycobacterium
RLAELDAAFLDFLTTWNQ

SEQ ID NO: 854812 - protein, 18 aa, Mycobacterium
RLAELGIFGVALPEAHGG

SEQ ID NO: 854813 - protein, 25 aa, Mycobacterium
RLAERFDAVLLISNLINYPDTQLLR

SEQ ID NO: 854814 - protein, 19 aa, Mycobacterium
RLAERLLVDVIGLPWEDVH

SEQ ID NO: 854815 - protein, 18 aa, Mycobacterium
RLAERLLVDVIGLPWEEV

SEQ ID NO: 854816 - protein, 19 aa, Mycobacterium
RLAERLLVDVIGLPWEEVH

SEQ ID NO: 854817 - protein, 19 aa, Mycobacterium
RLAFWEKQAKRLSWQTPFT

SEQ ID NO: 854818 - protein, 17 aa, Mycobacterium
RLAGGPPGPDRVDAARS

SEQ ID NO: 854819 - protein, 17 aa, Mycobacterium
RLAGIMSALSIADYAGS

SEQ ID NO: 854820 - protein, 37 aa, Mycobacterium
RLAGLFAEFSRVLADPGWLLLGFQTDAPPLVFDEAFG

SEQ ID NO: 854821 - protein, 17 aa, Mycobacterium
RLAGVVSVIELLQAEPG

SEQ ID NO: 854822 - protein, 17 aa, Mycobacterium
RLAHLLAGHGVGPGGCV

SEQ ID NO: 854823 - protein, 17 aa, Mycobacterium
RLAIRRAAFELFDTQGY

SEQ ID NO: 854824 - protein, 25 aa, Mycobacterium
RLAIVASTWHTKICDALLAGARNTA

SEQ ID NO: 854825 - protein, 21 aa, Mycobacterium
RLAKLLKIFANPKMPSLADYY

SEQ ID NO: 854826 - protein, 21 aa, Mycobacterium
RLALAAIYPRNRECLLRLAAM

SEQ ID NO: 854827 - protein, 19 aa, Mycobacterium
RLALCQATRQVIANGLAIL

SEQ ID NO: 854828 - protein, 17 aa, Mycobacterium
RLALGMRSFVRTGQMGD

SEQ ID NO: 854829 - protein, 18 aa, Mycobacterium
RLALLPPDERAAALRLIA

SEQ ID NO: 854830 - protein, 22 aa, Mycobacterium
RLALQKMSFEVAWRILRATPMT

SEQ ID NO: 854831 - protein, 19 aa, Mycobacterium
RLALVASTWHSEICDALLA

SEQ ID NO: 854832 - protein, 31 aa, Mycobacterium
RLAMDLLPYERSSCFWQRIAYLYSRFDDLIA

SEQ ID NO: 854833 - protein, 19 aa, Mycobacterium
RLAMTECGIPLWLDSPMTG

SEQ ID NO: 854834 - protein, 17 aa, Mycobacterium
RLAMYVVGPLLNLGLRR

SEQ ID NO: 854835 - protein, 26 aa, Mycobacterium
RLAPETPLARVFWPRGRIVVSREAIR

SEQ ID NO: 854836 - protein, 17 aa, Mycobacterium
RLAPGQLADIIAVPGNP

SEQ ID NO: 854837 - protein, 25 aa, Mycobacterium
RLAPIARLAMPIIAPGYRGLRKVGR

SEQ ID NO: 854838 - protein, 35 aa, Mycobacterium
RLAPLLPVQMRMSWYILFQQIPWLSERNLGRVIPK

SEQ ID NO: 854839 - protein, 19 aa, Mycobacterium
RLAPPLLGEHSREILREFG

SEQ ID NO: 854840 - protein, 17 aa, Mycobacterium
RLAPPPDCAHDARWIYY

SEQ ID NO: 854841 - protein, 30 aa, Mycobacterium
RLAQAQLSRRLARWTRLYPDVKVESTIIRG

SEQ ID NO: 854842 - protein, 20 aa, Mycobacterium
RLAQLTAIGGFRRWDRMVKR

SEQ ID NO: 854843 - protein, 31 aa, Mycobacterium
RLARAGWRIVILEAGPFWHPDEDWVSDEAGS

SEQ ID NO: 854844 - protein, 17 aa, Mycobacterium
RLARDVLPHMRPGSAII

SEQ ID NO: 854845 - protein, 18 aa, Mycobacterium
RLARFAYRRFGSGAGVPL

SEQ ID NO: 854846 - protein, 22 aa, Mycobacterium
RLARFYMIRPQHPDGLDALDYS

SEQ ID NO: 854847 - protein, 24 aa, Mycobacterium
RLARGPLHRYLGSSVDLFSAVTGS

SEQ ID NO: 854848 - protein, 19 aa, Mycobacterium
RLARLLGELLVSSDASANL

SEQ ID NO: 854849 - protein, 24 aa, Mycobacterium
RLARLRGATLLAHNYQLPAIQDVA

SEQ ID NO: 854850 - protein, 20 aa, Mycobacterium
RLARLSPRTVYRRFMGVPGK

SEQ ID NO: 854851 - protein, 34 aa, Mycobacterium
RLARMVAVEAMPYFARALFALSPVAAPGLKTFAV

SEQ ID NO: 854852 - protein, 17 aa, Mycobacterium
RLARRIFNFQTRNYPPI

SEQ ID NO: 854853 - protein, 18 aa, Mycobacterium
RLARSFVGLPSRAPYRLE

SEQ ID NO: 854854 - protein, 19 aa, Mycobacterium
RLARTQTWPTLEQDGMLFV

SEQ ID NO: 854855 - protein, 27 aa, Mycobacterium
RLARYKLPKRLIFTATLPRNPAGKVLK

SEQ ID NO: 854856 - protein, 19 aa, Mycobacterium
RLASILRDKRIPLELCPSS

SEQ ID NO: 854857 - protein, 17 aa, Mycobacterium
RLASRAWMPVGRRVAIV

SEQ ID NO: 854858 - protein, 17 aa, Mycobacterium
RLASRRVVLDHAVVGTH

SEQ ID NO: 854859 - protein, 19 aa, Mycobacterium
RLASVLRRCIVVDASLRGS

SEQ ID NO: 854860 - protein, 18 aa, Mycobacterium
RLATKLHPWEPKDGIRYG

SEQ ID NO: 854861 - protein, 24 aa, Mycobacterium
RLATQRIQMPLPAAQARLLASIEA

SEQ ID NO: 854862 - protein, 24 aa, Mycobacterium
RLATQRIQMPLPAAQARLLATIEV

SEQ ID NO: 854863 - protein, 25 aa, Mycobacterium
RLATQRIQMPLPSAQARLLATIEAK

SEQ ID NO: 854864 - protein, 31 aa, Mycobacterium
RLAVDNGFIPMIPPVLVRPEVMAGTGFLGAH

SEQ ID NO: 854865 - protein, 31 aa, Mycobacterium
RLAVENGFIPMIPPVLVRPEVMAGTGFLGAH

SEQ ID NO: 854866 - protein, 17 aa, Mycobacterium
RLAVLDALLVLHADTAA

SEQ ID NO: 854867 - protein, 18 aa, Mycobacterium
RLAVRLDVSRLVVVGSGR

SEQ ID NO: 854868 - protein, 19 aa, Mycobacterium
RLAVTPLHRSGGQAQFIIR

SEQ ID NO: 854869 - protein, 23 aa, Mycobacterium
RLAVTYRPGPAGPATLFVKAVDP

SEQ ID NO: 854870 - protein, 21 aa, Mycobacterium
RLAVWLVTDPLAVPQIASLGP

SEQ ID NO: 854871 - protein, 21 aa, Mycobacterium
RLAVWLVTDPQTVPGIAALGP

SEQ ID NO: 854872 - protein, 32 aa, Mycobacterium
RLCCSLTGPRNLLLMVWLRSLDALPQLEGTLY

SEQ ID NO: 854873 - protein, 18 aa, Mycobacterium
RLCDAFGIPLVVVVDVPG

SEQ ID NO: 854874 - protein, 24 aa, Mycobacterium
RLCDHRARPLERLAELVVRAGRSV

SEQ ID NO: 854875 - protein, 22 aa, Mycobacterium
RLCEKLLSYASPLHLYAEEIEP

SEQ ID NO: 854876 - protein, 20 aa, Mycobacterium
RLCFVTRQSLQDVLRGLRNG

SEQ ID NO: 854877 - protein, 21 aa, Mycobacterium
RLCGTINVLLPVPGDVRGLAP

SEQ ID NO: 854878 - protein, 32 aa, Mycobacterium
RLCLSPRTVGAHLYRLFPKLGVTNRAGLHDAL

SEQ ID NO: 854879 - protein, 21 aa, Mycobacterium
RLCPAPCEAACVLGINQDPVT

SEQ ID NO: 854880 - protein, 21 aa, Mycobacterium
RLCPAPCEASCVLGINQDPVT

SEQ ID NO: 854881 - protein, 21 aa, Mycobacterium
RLCPAPCEGSCVLGINQDPVT

SEQ ID NO: 854882 - protein, 20 aa, Mycobacterium
RLCSACFDGKYPIELPGETA

SEQ ID NO: 854883 - protein, 26 aa, Mycobacterium
RLCSETLELLLRSTGYNDDITLLAVQ

SEQ ID NO: 854884 - protein, 25 aa, Mycobacterium
RLCSETLELLLRSTGYNDDVTLLAA

SEQ ID NO: 854885 - protein, 19 aa, Mycobacterium
RLCTACFDGKYPIELPGET

SEQ ID NO: 854886 - protein, 18 aa, Mycobacterium
RLCTACFDGQYPIELPEE

SEQ ID NO: 854887 - protein, 17 aa, Mycobacterium
RLCVMAPRQWRGLRRWL

SEQ ID NO: 854888 - protein, 24 aa, Mycobacterium
RLDAATIVAYVLRGALSITVDGET

SEQ ID NO: 854889 - protein, 20 aa, Mycobacterium
RLDAAYAVPQQFWAKVLPRV

SEQ ID NO: 854890 - protein, 25 aa, Mycobacterium
RLDAESAFQVLAKWSQKSNTKLRLL

SEQ ID NO: 854891 - protein, 17 aa, Mycobacterium
RLDAFVEPDLCVAHLAS

SEQ ID NO: 854892 - protein, 19 aa, Mycobacterium
RLDALGIDYEIVPGVPAFA

SEQ ID NO: 854893 - protein, 28 aa, Mycobacterium
RLDAPQGTRLIPIPGAPPALTAIPHGCP

SEQ ID NO: 854894 - protein, 25 aa, Mycobacterium
RLDAQLELLGPAWYVALGSNYGRAA

SEQ ID NO: 854895 - protein, 23 aa, Mycobacterium
RLDDAEPRWSWFPSDQTVGFTRR

SEQ ID NO: 854896 - protein, 18 aa, Mycobacterium
RLDDLLKQGHLTLDGIEI

SEQ ID NO: 854897 - protein, 23 aa, Mycobacterium
RLDDPVTRWLPDFTPRLPDGSTP

SEQ ID NO: 854898 - protein, 28 aa, Mycobacterium
RLDELDFEQLWLMAVDVGTGLTAAECAA

SEQ ID NO: 854899 - protein, 27 aa, Mycobacterium
RLDEPALDTLLITSLSPGLGTADVAAA

SEQ ID NO: 854900 - protein, 25 aa, Mycobacterium
RLDEPQLLRLYAKLLTEGRVKRDND

SEQ ID NO: 854901 - protein, 27 aa, Mycobacterium
RLDEPTLDALLLMSLSLGLGVTDVAAA

SEQ ID NO: 854902 - protein, 18 aa, Mycobacterium
RLDEVSGIRLERERIQRR

SEQ ID NO: 854903 - protein, 25 aa, Mycobacterium
RLDFEGIAVLDLFAGSGALGLEALS

SEQ ID NO: 854904 - protein, 26 aa, Mycobacterium
RLDGGLQIDWWYDAQRFDPYSIEEMA

SEQ ID NO: 854905 - protein, 26 aa, Mycobacterium
RLDGHLLDTLLVMTLSPGLGPDDVAA

SEQ ID NO: 854906 - protein, 19 aa, Mycobacterium
RLDGLPLAIELAAARLRAL

SEQ ID NO: 854907 - protein, 20 aa, Mycobacterium
RLDGPSPVNNIPFAAKLTGP

SEQ ID NO: 854908 - protein, 24 aa, Mycobacterium
RLDGPVLLVLEDVDLWCRDRSTGD

SEQ ID NO: 854909 - protein, 21 aa, Mycobacterium
RLDGSPLRYNEPHPYLPDLIM

SEQ ID NO: 854910 - protein, 26 aa, Mycobacterium
RLDGVRIFEQLATACPTIAAFLSIHN

SEQ ID NO: 854911 - protein, 20 aa, Mycobacterium
RLDHNIIRCPNQVYHAVALQ

SEQ ID NO: 854912 - protein, 25 aa, Mycobacterium
RLDHQRIRVLLQQLVPIAAVDHVWL

SEQ ID NO: 854913 - protein, 17 aa, Mycobacterium
RLDIVNFAMSCRVLGRG

SEQ ID NO: 854914 - protein, 20 aa, Mycobacterium
RLDIVVANAGVLNWGRLWEI

SEQ ID NO: 854915 - protein, 22 aa, Mycobacterium
RLDIVVANAGVLNWGRLWEISA

SEQ ID NO: 854916 - protein, 23 aa, Mycobacterium
RLDKPLQRYWRDAHTGLAHAIHV

SEQ ID NO: 854917 - protein, 24 aa, Mycobacterium
RLDKTRFRSHPDLDVLSHGLTLWD

SEQ ID NO: 854918 - protein, 21 aa, Mycobacterium
RLDLCDLYVFQSPDEPDRTTL

SEQ ID NO: 854919 - protein, 21 aa, Mycobacterium
RLDLFGHLIGHLLPSASAKPR

SEQ ID NO: 854920 - protein, 17 aa, Mycobacterium
RLDLPAELTWIEADLPL

SEQ ID NO: 854921 - protein, 24 aa, Mycobacterium
RLDLRRMSYVQRLAKLLSTQLWET

SEQ ID NO: 854922 - protein, 27 aa, Mycobacterium
RLDMSSLFRVLRRGELLTILGRHVGYS

SEQ ID NO: 854923 - protein, 26 aa, Mycobacterium
RLDNTRAREVLGWQPQVALAEGIAKT

SEQ ID NO: 854924 - protein, 26 aa, Mycobacterium
RLDPAKPPHVGVLLENTPFFSAMLTA

SEQ ID NO: 854925 - protein, 22 aa, Mycobacterium
RLDPDTYHWASDKLGIPVIDHW

SEQ ID NO: 854926 - protein, 32 aa, Mycobacterium
RLDPGRPPHVGVLLQNTPFFSAMLVAAGMSGI

SEQ ID NO: 854927 - protein, 19 aa, Mycobacterium
RLDPKDLFGWQANASPDRL

SEQ ID NO: 854928 - protein, 32 aa, Mycobacterium
RLDPTRPPHVGVLLQNTPFFSAMLAAAGMSGI

SEQ ID NO: 854929 - protein, 22 aa, Mycobacterium
RLDPWHGNWFHPYSFTRLEVLS

SEQ ID NO: 854930 - protein, 23 aa, Mycobacterium
RLDRFAGQLLPRRTARAFADVAN

SEQ ID NO: 854931 - protein, 23 aa, Mycobacterium
RLDRLTAGVLLFTARREVRGAYQ

SEQ ID NO: 854932 - protein, 25 aa, Mycobacterium
RLDRLTAGVLLFTVRRELRGAYQTM

SEQ ID NO: 854933 - protein, 19 aa, Mycobacterium
RLDRLVGQALPNPLARWVA

SEQ ID NO: 854934 - protein, 34 aa, Mycobacterium
RLDRWWRAANYLSVGQIYLLDNPLLRTPLTREDV

SEQ ID NO: 854935 - protein, 17 aa, Mycobacterium
RLDSAPFTDRLVRKFRL

SEQ ID NO: 854936 - protein, 27 aa, Mycobacterium
RLDSPILSPQIYLSAYGLLAALAERLS

SEQ ID NO: 854937 - protein, 18 aa, Mycobacterium
RLDSSLPAPRHVVERVAT

SEQ ID NO: 854938 - protein, 17 aa, Mycobacterium
RLDTDVLAALRAAERDP

SEQ ID NO: 854939 - protein, 17 aa, Mycobacterium
RLDTDVLAALRSAERDP

SEQ ID NO: 854940 - protein, 36 aa, Mycobacterium
RLDTTEVGPFKKGPFRLAMAAGIPIVPIVIRNAELV

SEQ ID NO: 854941 - protein, 17 aa, Mycobacterium
RLDVAKLGMGRLHVACG

SEQ ID NO: 854942 - protein, 17 aa, Mycobacterium
RLDVIRLPIDVMLDANT

SEQ ID NO: 854943 - protein, 24 aa, Mycobacterium
RLDVPVPPAALPAESRLGPDDVFL

SEQ ID NO: 854944 - protein, 29 aa, Mycobacterium
RLDVYQRTPIWIFPKFDPTTPRAVKTFFR

SEQ ID NO: 854945 - protein, 18 aa, Mycobacterium
RLEALDVPVPRYAEIATL

SEQ ID NO: 854946 - protein, 17 aa, Mycobacterium
RLEAQIVLRLLLERTTV

SEQ ID NO: 854947 - protein, 19 aa, Mycobacterium
RLEATGCVAVMPLGSPIGT

SEQ ID NO: 854948 - protein, 19 aa, Mycobacterium
RLEDCVLRAAHWRSARDGL

SEQ ID NO: 854949 - protein, 24 aa, Mycobacterium
RLEDLMKQRLISLDAIEITVIDEA

SEQ ID NO: 854950 - protein, 29 aa, Mycobacterium
RLEEELRVPRFLWEVGFAAFEIARRHRFH

SEQ ID NO: 854951 - protein, 18 aa, Mycobacterium
RLEELKALWFSEADKYNG

SEQ ID NO: 854952 - protein, 18 aa, Mycobacterium
RLEGFENVLGRRVTGETS

SEQ ID NO: 854953 - protein, 27 aa, Mycobacterium
RLEKICRQIMLYHLDRGWADHLAYLAD

SEQ ID NO: 854954 - protein, 25 aa, Mycobacterium
RLELEQTFMFYLPRICEHCLNPSCV

SEQ ID NO: 854955 - protein, 18 aa, Mycobacterium
RLELGGHQFAMLAGLVAS

SEQ ID NO: 854956 - protein, 20 aa, Mycobacterium
RLELLPLDPAYRAMFADGSA

SEQ ID NO: 854957 - protein, 23 aa, Mycobacterium
RLELRVLYEELFSRFGAVRVVRP

SEQ ID NO: 854958 - protein, 24 aa, Mycobacterium
RLELSMMLERLLKRLPDMELVSQD

SEQ ID NO: 854959 - protein, 30 aa, Mycobacterium
RLELTVVNPLVDATWRFMTLDHDGKIRMDC

SEQ ID NO: 854960 - protein, 19 aa, Mycobacterium
RLEMLEGMGWLIVRVVAED

SEQ ID NO: 854961 - protein, 23 aa, Mycobacterium
RLENLAILRTLVGAIGTFEDLDF

SEQ ID NO: 854962 - protein, 26 aa, Mycobacterium
RLENNIGVPFAPYLYTVSAMHCMSVS

SEQ ID NO: 854963 - protein, 25 aa, Mycobacterium
RLEPEWLKPTAYMMAKFGMTLCALG

SEQ ID NO: 854964 - protein, 20 aa, Mycobacterium
RLEPGQALVLDIAPPDTRYW

SEQ ID NO: 854965 - protein, 22 aa, Mycobacterium
RLEPRQLPFVEINAAFYPKREG

SEQ ID NO: 854966 - protein, 33 aa, Mycobacterium
RLEPYQLVTTGRRWYLMAYDRDREDWRSLRLDR

SEQ ID NO: 854967 - protein, 21 aa, Mycobacterium
RLEQLDLFPANRNAAGQIVAA

SEQ ID NO: 854968 - protein, 26 aa, Mycobacterium
RLEQLDVYMIHPFQLSFSTLISAFYE

SEQ ID NO: 854969 - protein, 27 aa, Mycobacterium
RLEQRFDRELWRKLIDSDILSSAAATQ

SEQ ID NO: 854970 - protein, 24 aa, Mycobacterium
RLEQSAFEVLLDQGALFLADRTVV

SEQ ID NO: 854971 - protein, 24 aa, Mycobacterium
RLERFDRSIYLFDVELKHAPNRRQ

SEQ ID NO: 854972 - protein, 19 aa, Mycobacterium
RLERLVFVEPPDAAARREI

SEQ ID NO: 854973 - protein, 17 aa, Mycobacterium
RLERRIADFLGFSTVLT

SEQ ID NO: 854974 - protein, 26 aa, Mycobacterium
RLESAHAVGPWFRWASVGLDCAEHIA

SEQ ID NO: 854975 - protein, 20 aa, Mycobacterium
RLETMLALIEGWVQTVVTDA

SEQ ID NO: 854976 - protein, 18 aa, Mycobacterium
RLETTGVILGYRAVLAAE

SEQ ID NO: 854977 - protein, 32 aa, Mycobacterium
RLETVVKQLLGVYIWYGDMAALLMTVKKRICM

SEQ ID NO: 854978 - protein, 29 aa, Mycobacterium
RLEYRPLEGFVYAITPFNFTAIAGNLPTA

SEQ ID NO: 854979 - protein, 19 aa, Mycobacterium
RLFAELMWEYRFGDRHTAM

SEQ ID NO: 854980 - protein, 21 aa, Mycobacterium
RLFAGGFGRRFNQGGGGFGGG

SEQ ID NO: 854981 - protein, 19 aa, Mycobacterium
RLFAIWESTPYNGRWPEVT

SEQ ID NO: 854982 - protein, 18 aa, Mycobacterium
RLFAVLVLTIRDGRILKI

SEQ ID NO: 854983 - protein, 30 aa, Mycobacterium
RLFDAFDQVWKRFFPVPPPRTTVGVGAEEM

SEQ ID NO: 854984 - protein, 18 aa, Mycobacterium
RLFEFEERFDFGLGLLVG

SEQ ID NO: 854985 - protein, 17 aa, Mycobacterium
RLFEGFDPAKLDRLTLG

SEQ ID NO: 854986 - protein, 17 aa, Mycobacterium
RLFELVTELSAPGSRIA

SEQ ID NO: 854987 - protein, 27 aa, Mycobacterium
RLFGFHYRIEIYTPAPKRQYGYYVWPL

SEQ ID NO: 854988 - protein, 17 aa, Mycobacterium
RLFGLAQFMGDVYGGAL

SEQ ID NO: 854989 - protein, 20 aa, Mycobacterium
RLFGPAVTISYFPACSAALP

SEQ ID NO: 854990 - protein, 18 aa, Mycobacterium
RLFHWDSSGPRPDRHPGL

SEQ ID NO: 854991 - protein, 17 aa, Mycobacterium
RLFISARTVQYHLGKVF

SEQ ID NO: 854992 - protein, 17 aa, Mycobacterium
RLFLDALLRGRYPADLS

SEQ ID NO: 854993 - protein, 18 aa, Mycobacterium
RLFLPDPVPRHLVEESLE

SEQ ID NO: 854994 - protein, 17 aa, Mycobacterium
RLFLVVQDLFLTETAQL

SEQ ID NO: 854995 - protein, 18 aa, Mycobacterium
RLFNLLITNVPGPQKQMY

SEQ ID NO: 854996 - protein, 19 aa, Mycobacterium
RLFRDVLALHFSQTRPPGF

SEQ ID NO: 854997 - protein, 19 aa, Mycobacterium
RLFSRWDAKTILASGAVDI

SEQ ID NO: 854998 - protein, 20 aa, Mycobacterium
RLFVPLDNIAWPSDSGPRRA

SEQ ID NO: 854999 - protein, 25 aa, Mycobacterium
RLGAPSVPLAPWTTWESPDGLAITA

SEQ ID NO: 855000 - protein, 25 aa, Mycobacterium
RLGAQITIFRLGSDPGLARFIDQVA

SEQ ID NO: 855001 - protein, 19 aa, Mycobacterium
RLGARPLVIQLPIGAENDF

SEQ ID NO: 855002 - protein, 21 aa, Mycobacterium
RLGASLLIPPHSFASVLIATS

SEQ ID NO: 855003 - protein, 24 aa, Mycobacterium
RLGASQHFLLEGLAARLQVAQGTG

SEQ ID NO: 855004 - protein, 17 aa, Mycobacterium
RLGATSRAPRWAVAYKY

SEQ ID NO: 855005 - protein, 17 aa, Mycobacterium
RLGAVAVLLPPDADLEV

SEQ ID NO: 855006 - protein, 27 aa, Mycobacterium
RLGAVQNPVLPIWRESELRFVTAQLGT

SEQ ID NO: 855007 - protein, 25 aa, Mycobacterium
RLGDAKFFALLRDWTTRYRHGTVIT

SEQ ID NO: 855008 - protein, 18 aa, Mycobacterium
RLGDALSLLVIAEESLHK

SEQ ID NO: 855009 - protein, 26 aa, Mycobacterium
RLGDPSLIQNVCFLYHVLGGGTGDWD

SEQ ID NO: 855010 - protein, 18 aa, Mycobacterium
RLGDTLSLLVIAEEALHK

SEQ ID NO: 855011 - protein, 17 aa, Mycobacterium
RLGEWVIPEGDTIMAST

SEQ ID NO: 855012 - protein, 17 aa, Mycobacterium
RLGFCDGLLHVTDADTP

SEQ ID NO: 855013 - protein, 17 aa, Mycobacterium
RLGFRDAVAWTIDWERQ

SEQ ID NO: 855014 - protein, 17 aa, Mycobacterium
RLGFVHSALIYQSRQEY

SEQ ID NO: 855015 - protein, 23 aa, Mycobacterium
RLGGACLLGPLNGQLWSFVHAAG

SEQ ID NO: 855016 - protein, 18 aa, Mycobacterium
RLGGLLRYGIPEYKLEKA

SEQ ID NO: 855017 - protein, 20 aa, Mycobacterium
RLGHVLGQAILRTARRHEAA

SEQ ID NO: 855018 - protein, 17 aa, Mycobacterium
RLGIARALALDPDVIIC

SEQ ID NO: 855019 - protein, 18 aa, Mycobacterium
RLGIKPLYLSETGDRIRF

SEQ ID NO: 855020 - protein, 31 aa, Mycobacterium
RLGIPTIATVPWTTDRLLNALLRDTETAKWR

SEQ ID NO: 855021 - protein, 30 aa, Mycobacterium
RLGIPTIATVPWTTDRLLNALLRETETAKW

SEQ ID NO: 855022 - protein, 18 aa, Mycobacterium
RLGIPTVATVPWTTDRLL

SEQ ID NO: 855023 - protein, 30 aa, Mycobacterium
RLGLDYVDLYLIHWPAPSLGNYVNSFGGMI

SEQ ID NO: 855024 - protein, 28 aa, Mycobacterium
RLGLDYVDLYLIHWPGGDTSKYVDSWGG

SEQ ID NO: 855025 - protein, 31 aa, Mycobacterium
RLGLHVPDPFWLPTPKMLSDWRRNGMGNFIR

SEQ ID NO: 855026 - protein, 21 aa, Mycobacterium
RLGLLELRGFEMPPHFQMAMV

SEQ ID NO: 855027 - protein, 23 aa, Mycobacterium
RLGLLELRGFEMPPHPQMAMVQS

SEQ ID NO: 855028 - protein, 18 aa, Mycobacterium
RLGLLKRREEVLPQLTHN

SEQ ID NO: 855029 - protein, 19 aa, Mycobacterium
RLGLRLYRGGSGSTAPIVI

SEQ ID NO: 855030 - protein, 18 aa, Mycobacterium
RLGLRPDVRRVPLFGLGC

SEQ ID NO: 855031 - protein, 20 aa, Mycobacterium
RLGLRVVLVERAGAGLSSAH

SEQ ID NO: 855032 - protein, 28 aa, Mycobacterium
RLGLTKGDLYTLWAPRWRDAGDEWEAFL

SEQ ID NO: 855033 - protein, 18 aa, Mycobacterium
RLGLWTPTRWCRLRRRVG

SEQ ID NO: 855034 - protein, 28 aa, Mycobacterium
RLGNGRWYMPWISLEDHIRALEFALAEP

SEQ ID NO: 855035 - protein, 17 aa, Mycobacterium
RLGPIFDVCRDDGRAAL

SEQ ID NO: 855036 - protein, 18 aa, Mycobacterium
RLGPLTLKNRFIKAATFE

SEQ ID NO: 855037 - protein, 22 aa, Mycobacterium
RLGPRLYSRQVAYAASLVAAAA

SEQ ID NO: 855038 - protein, 21 aa, Mycobacterium
RLGPVLARRLLLTGDIIEAGE

SEQ ID NO: 855039 - protein, 17 aa, Mycobacterium
RLGPVVAFPAQQTRRGA

SEQ ID NO: 855040 - protein, 24 aa, Mycobacterium
RLGPVVMVGYRRNGWQETPALVQV

SEQ ID NO: 855041 - protein, 20 aa, Mycobacterium
RLGPWVLPKGHMIVGDVWAA

SEQ ID NO: 855042 - protein, 22 aa, Mycobacterium
RLGQRLMNELIFDELRATDIPE

SEQ ID NO: 855043 - protein, 22 aa, Mycobacterium
RLGRAFFADPALAQRFRAVEAQ

SEQ ID NO: 855044 - protein, 17 aa, Mycobacterium
RLGRAIGVIYLPATERQ

SEQ ID NO: 855045 - protein, 18 aa, Mycobacterium
RLGRAIGVIYLPATERQS

SEQ ID NO: 855046 - protein, 20 aa, Mycobacterium
RLGRFAGLVAIDRGHPAIAD

SEQ ID NO: 855047 - protein, 19 aa, Mycobacterium
RLGRFLPTDVRVLGIARAP

SEQ ID NO: 855048 - protein, 24 aa, Mycobacterium
RLGRHEFPLVLSPAVEEFLTAVAE

SEQ ID NO: 855049 - protein, 18 aa, Mycobacterium
RLGRIRLLDRQRVNLDGF

SEQ ID NO: 855050 - protein, 26 aa, Mycobacterium
RLGRNIVSPFWAVLGFGRASAGPGQH

SEQ ID NO: 855051 - protein, 19 aa, Mycobacterium
RLGRRPGAMVTLRETVPSP

SEQ ID NO: 855052 - protein, 21 aa, Mycobacterium
RLGRRSARLQPLTLLNHRPQL

SEQ ID NO: 855053 - protein, 27 aa, Mycobacterium
RLGRRVTEIALIFKRAPHLPFDATMTD

SEQ ID NO: 855054 - protein, 25 aa, Mycobacterium
RLGRVNFAKLLERAAGYLRGESLAD

SEQ ID NO: 855055 - protein, 22 aa, Mycobacterium
RLGRWLDNHPGLPRLINMYGTT

SEQ ID NO: 855056 - protein, 17 aa, Mycobacterium
RLGRWRSATGLPAGPDA

SEQ ID NO: 855057 - protein, 17 aa, Mycobacterium
RLGSHRPFSQDPAAHEL

SEQ ID NO: 855058 - protein, 20 aa, Mycobacterium
RLGSKFTLLDWDCDHMVAQA

SEQ ID NO: 855059 - protein, 20 aa, Mycobacterium
RLGTLPLLDAVLEAVSVPVL

SEQ ID NO: 855060 - protein, 22 aa, Mycobacterium
RLGTRLLAVGMLPTLSAEQLTV

SEQ ID NO: 855061 - protein, 25 aa, Mycobacterium
RLGTSQHMLIDALAARLREAQRNGS

SEQ ID NO: 855062 - protein, 25 aa, Mycobacterium
RLGTSQRMLIDALAARLRVAQRHGS

SEQ ID NO: 855063 - protein, 17 aa, Mycobacterium
RLGVDGHRWGGLPLRSA

SEQ ID NO: 855064 - protein, 30 aa, Mycobacterium
RLGVDYLDLYLIHWPVPENNKFVDTFKAFA

SEQ ID NO: 855065 - protein, 29 aa, Mycobacterium
RLGVERAIIGDSWQLMSNPNLNFPKTDTK

SEQ ID NO: 855066 - protein, 30 aa, Mycobacterium
RLGVHVSLAPFQYYYWGDLLDGAIFDHEHG

SEQ ID NO: 855067 - protein, 17 aa, Mycobacterium
RLGVLQAPLISALGFAF

SEQ ID NO: 855068 - protein, 32 aa, Mycobacterium
RLGVPMSTIALAWLLRRSPVIVPIPGTKSVAH

SEQ ID NO: 855069 - protein, 19 aa, Mycobacterium
RLGVQLPPRRTFGDGLRSA

SEQ ID NO: 855070 - protein, 26 aa, Mycobacterium
RLGVSGRAYWLGRWRDWMLDHRDDLL

SEQ ID NO: 855071 - protein, 18 aa, Mycobacterium
RLGWQPRVDYRTGLATTV

SEQ ID NO: 855072 - protein, 18 aa, Mycobacterium
RLGWRAATLSGFRRDPDA

SEQ ID NO: 855073 - protein, 25 aa, Mycobacterium
RLGYHLSAMLWLTVAPRHTHRVGER

SEQ ID NO: 855074 - protein, 25 aa, Mycobacterium
RLGYRYRFTVYPLEDHIAWVLQDKF

SEQ ID NO: 855075 - protein, 24 aa, Mycobacterium
RLGYTRYWVAEHHNMPAVAATSPP

SEQ ID NO: 855076 - protein, 21 aa, Mycobacterium
RLHAHLLDRHRPLWETHVIEG

SEQ ID NO: 855077 - protein, 24 aa, Mycobacterium
RLHAKLFYQPLLESVGHTALGIGE

SEQ ID NO: 855078 - protein, 19 aa, Mycobacterium
RLHAVISAQLRVMAQRPAV

SEQ ID NO: 855079 - protein, 17 aa, Mycobacterium
RLHDARHSCATLMHLSG

SEQ ID NO: 855080 - protein, 21 aa, Mycobacterium
RLHDDGLLGAPFRQIQGVANY

SEQ ID NO: 855081 - protein, 18 aa, Mycobacterium
RLHDYPHQFSGGMRQRLL

SEQ ID NO: 855082 - protein, 22 aa, Mycobacterium
RLHEHGLLHRLANGYYVVIPQE

SEQ ID NO: 855083 - protein, 17 aa, Mycobacterium
RLHEYFRASGVPLLAVW

SEQ ID NO: 855084 - protein, 27 aa, Mycobacterium
RLHGATDEYLRLLPKWMDASEFGNGGR

SEQ ID NO: 855085 - protein, 19 aa, Mycobacterium
RLHGLLATLGPADHPDPEG

SEQ ID NO: 855086 - protein, 17 aa, Mycobacterium
RLHGPLLGDAALADAPW

SEQ ID NO: 855087 - protein, 18 aa, Mycobacterium
RLHGPLLGDAALAEAPWL

SEQ ID NO: 855088 - protein, 17 aa, Mycobacterium
RLHGRWVGFLERRKRPV

SEQ ID NO: 855089 - protein, 24 aa, Mycobacterium
RLHGSLLDRHRPLWEAHLVEGLND

SEQ ID NO: 855090 - protein, 18 aa, Mycobacterium
RLHGYPLGILANARGVLF

SEQ ID NO: 855091 - protein, 17 aa, Mycobacterium
RLHKPVIAYDLPAGGRR

SEQ ID NO: 855092 - protein, 18 aa, Mycobacterium
RLHKPVITYDLPAGGRRL

SEQ ID NO: 855093 - protein, 26 aa, Mycobacterium
RLHKQAHLPYLVYLRNPTTGGVFASW

SEQ ID NO: 855094 - protein, 19 aa, Mycobacterium
RLHLGGRSEAILFALRASL

SEQ ID NO: 855095 - protein, 18 aa, Mycobacterium
RLHLPPLPTTTIGSYPQT

SEQ ID NO: 855096 - protein, 21 aa, Mycobacterium
RLHLPSRIDAIRYALRAQIEV

SEQ ID NO: 855097 - protein, 17 aa, Mycobacterium
RLHLRDRPVAGIDPRAI

SEQ ID NO: 855098 - protein, 20 aa, Mycobacterium
RLHLRFMSHHGRMHAQPEVG

SEQ ID NO: 855099 - protein, 19 aa, Mycobacterium
RLHNGTVWQWNRPVYDVQG

SEQ ID NO: 855100 - protein, 18 aa, Mycobacterium
RLHNQIEAFKQVFGREPT

SEQ ID NO: 855101 - protein, 20 aa, Mycobacterium
RLHPRLLRRQRRQRLRLRSG

SEQ ID NO: 855102 - protein, 26 aa, Mycobacterium
RLHQMQAPWLPQESWRAGLSTWRGAI

SEQ ID NO: 855103 - protein, 27 aa, Mycobacterium
RLHRRDALWAAALHTGIARRSGDTGAM

SEQ ID NO: 855104 - protein, 23 aa, Mycobacterium
RLHWDEPFGQVLDWSDAPFAKWF

SEQ ID NO: 855105 - protein, 20 aa, Mycobacterium
RLHWYVPKSIRLIDFFKGLS

SEQ ID NO: 855106 - protein, 19 aa, Mycobacterium
RLIAATAAALAFPAYVRNA

SEQ ID NO: 855107 - protein, 26 aa, Mycobacterium
RLIADDGIETVWFGAAAPLALLARRA

SEQ ID NO: 855108 - protein, 20 aa, Mycobacterium
RLIAELCELKLPIVGRDLDP

SEQ ID NO: 855109 - protein, 31 aa, Mycobacterium
RLIAEYGIDTVWFGAAAPLALLAPRARRAGA

SEQ ID NO: 855110 - protein, 17 aa, Mycobacterium
RLIAGLDDAVVGLSVDE

SEQ ID NO: 855111 - protein, 18 aa, Mycobacterium
RLIAQLRPPPTFADVSFA

SEQ ID NO: 855112 - protein, 21 aa, Mycobacterium
RLIDDVGLDSVAFAIGMIAIQ

SEQ ID NO: 855113 - protein, 19 aa, Mycobacterium
RLIDKVFTQWNVDYTPVAL

SEQ ID NO: 855114 - protein, 20 aa, Mycobacterium
RLIDKVFTRWNVEYTPVALS

SEQ ID NO: 855115 - protein, 19 aa, Mycobacterium
RLIDNIAIDIGASAGIDGH

SEQ ID NO: 855116 - protein, 18 aa, Mycobacterium
RLIELHRVLDATLIPVIG

SEQ ID NO: 855117 - protein, 17 aa, Mycobacterium
RLIERSPLPFGRHRWVA

SEQ ID NO: 855118 - protein, 18 aa, Mycobacterium
RLIETLTRLRDLGNTLIV

SEQ ID NO: 855119 - protein, 17 aa, Mycobacterium
RLIGNLTGLLATLKAQP

SEQ ID NO: 855120 - protein, 19 aa, Mycobacterium
RLIIFSYATVRSGALRRRP

SEQ ID NO: 855121 - protein, 20 aa, Mycobacterium
RLIKVLRKRGRILQSAPNVA

SEQ ID NO: 855122 - protein, 19 aa, Mycobacterium
RLILDGAPIDRRRASERLG

SEQ ID NO: 855123 - protein, 17 aa, Mycobacterium
RLILDPLCESAPKLLRD

SEQ ID NO: 855124 - protein, 20 aa, Mycobacterium
RLILSKYDPVIRKHVPFREE

SEQ ID NO: 855125 - protein, 20 aa, Mycobacterium
RLIMQYASENLIPVTLELGG

SEQ ID NO: 855126 - protein, 20 aa, Mycobacterium
RLIMQYATENIIPVTLELGG

SEQ ID NO: 855127 - protein, 18 aa, Mycobacterium
RLINASYPPAWQATALFG

SEQ ID NO: 855128 - protein, 26 aa, Mycobacterium
RLIPNIVVLPYRNPFVVAKSAATLDL

SEQ ID NO: 855129 - protein, 26 aa, Mycobacterium
RLIPNIVVLPYRNPFVVAKSGATLDL

SEQ ID NO: 855130 - protein, 19 aa, Mycobacterium
RLIQRPFVVTAKGTRMARP

SEQ ID NO: 855131 - protein, 18 aa, Mycobacterium
RLISPFVGGAFGSAGRMW

SEQ ID NO: 855132 - protein, 24 aa, Mycobacterium
RLISPQQYAAWIDFQRITDGLDTA

SEQ ID NO: 855133 - protein, 17 aa, Mycobacterium
RLITALAGLVTASAEYL

SEQ ID NO: 855134 - protein, 19 aa, Mycobacterium
RLITDHRVTFLTTVPTIMQ

SEQ ID NO: 855135 - protein, 20 aa, Mycobacterium
RLITLLELRPDLAQPPPGSI

SEQ ID NO: 855136 - protein, 17 aa, Mycobacterium
RLIVATAYFPQSEDARA

SEQ ID NO: 855137 - protein, 26 aa, Mycobacterium
RLIVSRERLQLAIAWANILLQRKVPA

SEQ ID NO: 855138 - protein, 19 aa, Mycobacterium
RLIYLEDQYLWSKQVSRLF

SEQ ID NO: 855139 - protein, 18 aa, Mycobacterium
RLKALLDGGELGNPLMMH

SEQ ID NO: 855140 - protein, 17 aa, Mycobacterium
RLKAPLDVCLVRKLGAP

SEQ ID NO: 855141 - protein, 19 aa, Mycobacterium
RLKCPSHVLWLDALDAVFP

SEQ ID NO: 855142 - protein, 25 aa, Mycobacterium
RLKERMDWKMPWYTITDGFDADFGV

SEQ ID NO: 855143 - protein, 20 aa, Mycobacterium
RLKFVVLVPHRGARIRLRAL

SEQ ID NO: 855144 - protein, 17 aa, Mycobacterium
RLKHVIFVPHRGARIRV

SEQ ID NO: 855145 - protein, 23 aa, Mycobacterium
RLKLEETFMFYLPRICEHCLNPS

SEQ ID NO: 855146 - protein, 17 aa, Mycobacterium
RLKLLDDLEPLRIGDDL

SEQ ID NO: 855147 - protein, 19 aa, Mycobacterium
RLKLNPLKEVIRGKRLIVV

SEQ ID NO: 855148 - protein, 25 aa, Mycobacterium
RLKPRVFYDLVVEVALIRPGPIQGG

SEQ ID NO: 855149 - protein, 27 aa, Mycobacterium
RLKPRVFYDLVVEVALIRPGPIQGGSV

SEQ ID NO: 855150 - protein, 20 aa, Mycobacterium
RLKQQFAAEASFLGAGAAAV

SEQ ID NO: 855151 - protein, 19 aa, Mycobacterium
RLKRLLAEAELVKDALREV

SEQ ID NO: 855152 - protein, 18 aa, Mycobacterium
RLKRMYPGGHYRATTSTV

SEQ ID NO: 855153 - protein, 26 aa, Mycobacterium
RLKVFPLAISLPWGIAPAALPQLPLP

SEQ ID NO: 855154 - protein, 26 aa, Mycobacterium
RLLADGGILDPLPMAPIAGVNADLTI

SEQ ID NO: 855155 - protein, 27 aa, Mycobacterium
RLLADGGILDPLPMAPLSAVNADLTIA

SEQ ID NO: 855156 - protein, 27 aa, Mycobacterium
RLLADGGILDPLPMAPLSAVNADVTIA

SEQ ID NO: 855157 - protein, 21 aa, Mycobacterium
RLLAFAHLEPGMRLPTAAVST

SEQ ID NO: 855158 - protein, 27 aa, Mycobacterium
RLLAGELAIDLARRDQMRLWDSADLTT

SEQ ID NO: 855159 - protein, 19 aa, Mycobacterium
RLLAGLRDGALDAAMVALP

SEQ ID NO: 855160 - protein, 17 aa, Mycobacterium
RLLALIATNFFGQNTPS

SEQ ID NO: 855161 - protein, 21 aa, Mycobacterium
RLLAMARMRGAHGVVGELGFF

SEQ ID NO: 855162 - protein, 28 aa, Mycobacterium
RLLAQHQPFQHFIARLYGVLVDDAAEDA

SEQ ID NO: 855163 - protein, 22 aa, Mycobacterium
RLLARDGDGLWRLGPALTELAG

SEQ ID NO: 855164 - protein, 17 aa, Mycobacterium
RLLARIYSESDLLVAEC

SEQ ID NO: 855165 - protein, 18 aa, Mycobacterium
RLLARIYSESDLLVAECL

SEQ ID NO: 855166 - protein, 18 aa, Mycobacterium
RLLATYLTHTFGVDDVQG

SEQ ID NO: 855167 - protein, 18 aa, Mycobacterium
RLLAYALDIFDLTFQVVP

SEQ ID NO: 855168 - protein, 18 aa, Mycobacterium
RLLDAAVTLLRAGGPSAV

SEQ ID NO: 855169 - protein, 17 aa, Mycobacterium
RLLDAMLADLYGARSLL

SEQ ID NO: 855170 - protein, 26 aa, Mycobacterium
RLLDEGATVPFIARYRKEVTGSLDDG

SEQ ID NO: 855171 - protein, 27 aa, Mycobacterium
RLLDEGATVPFIARYRKEVTGSLDDGQ

SEQ ID NO: 855172 - protein, 17 aa, Mycobacterium
RLLDFYEHQMRLHAIDV

SEQ ID NO: 855173 - protein, 33 aa, Mycobacterium
RLLDRQLDLLLDGHTLLWRTLGRLGRVSTRKAP

SEQ ID NO: 855174 - protein, 20 aa, Mycobacterium
RLLDVHANTWRYNQLIAQQR

SEQ ID NO: 855175 - protein, 21 aa, Mycobacterium
RLLDVHANTWRYNQLIAQQRA

SEQ ID NO: 855176 - protein, 22 aa, Mycobacterium
RLLEHAGFYLEGRLARHAVYPT

SEQ ID NO: 855177 - protein, 17 aa, Mycobacterium
RLLELVWGNSHFAADTR

SEQ ID NO: 855178 - protein, 17 aa, Mycobacterium
RLLEQENEVLRRASAYL

SEQ ID NO: 855179 - protein, 18 aa, Mycobacterium
RLLEQTLLGYDQLGLVPE

SEQ ID NO: 855180 - protein, 18 aa, Mycobacterium
RLLEQTLLGYDQLGLVPM

SEQ ID NO: 855181 - protein, 17 aa, Mycobacterium
RLLERKIAQQPPKKHGN

SEQ ID NO: 855182 - protein, 37 aa, Mycobacterium
RLLERQLDLLLCGRMILWHVLFRFSAMYARKVPYRYE

SEQ ID NO: 855183 - protein, 17 aa, Mycobacterium
RLLETWHPLGVVGVITA

SEQ ID NO: 855184 - protein, 22 aa, Mycobacterium
RLLGADPWRDAVALHRRIAYVP

SEQ ID NO: 855185 - protein, 17 aa, Mycobacterium
RLLGARPSEIIFTTGGT

SEQ ID NO: 855186 - protein, 22 aa, Mycobacterium
RLLGHLPEQGLAARAAEAVALL

SEQ ID NO: 855187 - protein, 17 aa, Mycobacterium
RLLGPLCQMPRQLRGQP

SEQ ID NO: 855188 - protein, 20 aa, Mycobacterium
RLLGRSGLRVSPLALGSATF

SEQ ID NO: 855189 - protein, 17 aa, Mycobacterium
RLLGVTFGIGLRAKLAQ

SEQ ID NO: 855190 - protein, 30 aa, Mycobacterium
RLLGWQREMLARIGVPYRVIDVAAGDLGSS

SEQ ID NO: 855191 - protein, 23 aa, Mycobacterium
RLLHDAQIAVTAWSAARTGFEAL

SEQ ID NO: 855192 - protein, 17 aa, Mycobacterium
RLLHLYHDRLRAAGVDD

SEQ ID NO: 855193 - protein, 19 aa, Mycobacterium
RLLHPPPRPWPHGASRQHQ

SEQ ID NO: 855194 - protein, 20 aa, Mycobacterium
RLLHRHDGPIFPLIEDLFGL

SEQ ID NO: 855195 - protein, 27 aa, Mycobacterium
RLLHRHTGPIFPLIEDLFGVSIAELHQ

SEQ ID NO: 855196 - protein, 25 aa, Mycobacterium
RLLHSCPVPLVVSPRGYRRPRSGGL

SEQ ID NO: 855197 - protein, 17 aa, Mycobacterium
RLLIGSMAAGAAAAAAH

SEQ ID NO: 855198 - protein, 17 aa, Mycobacterium
RLLIKVADSLRARGIDI

SEQ ID NO: 855199 - protein, 18 aa, Mycobacterium
RLLLGVAATVLEETRKLP

SEQ ID NO: 855200 - protein, 26 aa, Mycobacterium
RLLLNALRDRGLLQRFVPFDVDESVL

SEQ ID NO: 855201 - protein, 18 aa, Mycobacterium
RLLLTDLLTRHPEIEEIE

SEQ ID NO: 855202 - protein, 19 aa, Mycobacterium
RLLLVVAELPMPMQNVNDE

SEQ ID NO: 855203 - protein, 21 aa, Mycobacterium
RLLNGYLFSRLTMPGADDPAG

SEQ ID NO: 855204 - protein, 17 aa, Mycobacterium
RLLNINLFPTLAAEDRA

SEQ ID NO: 855205 - protein, 21 aa, Mycobacterium
RLLNLKPPTYFDDFLASDGIS

SEQ ID NO: 855206 - protein, 17 aa, Mycobacterium
RLLQEKAGLVYPINKHL

SEQ ID NO: 855207 - protein, 18 aa, Mycobacterium
RLLQPDTMALIADRLRPG

SEQ ID NO: 855208 - protein, 24 aa, Mycobacterium
RLLQRHTGPIFPLIEDLFGVSVVE

SEQ ID NO: 855209 - protein, 20 aa, Mycobacterium
RLLQRLTVAEFFRLMRQFGE

SEQ ID NO: 855210 - protein, 28 aa, Mycobacterium
RLLQSPQPLWALWRFGTDPAFTRISMEF

SEQ ID NO: 855211 - protein, 20 aa, Mycobacterium
RLLQVMRERLTALGVSRFDS

SEQ ID NO: 855212 - protein, 17 aa, Mycobacterium
RLLRDNVVVAQNLTVSS

SEQ ID NO: 855213 - protein, 30 aa, Mycobacterium
RLLRDRIHQGWILTALWVIDTGVTAATLEH

SEQ ID NO: 855214 - protein, 17 aa, Mycobacterium
RLLRDWARPLREISVLF

SEQ ID NO: 855215 - protein, 18 aa, Mycobacterium
RLLRFWFEKGSDLSVHTR

SEQ ID NO: 855216 - protein, 19 aa, Mycobacterium
RLLRFWFEKGSDLSVHTRD

SEQ ID NO: 855217 - protein, 20 aa, Mycobacterium
RLLRIGVTRLGITSIRFTGG

SEQ ID NO: 855218 - protein, 17 aa, Mycobacterium
RLLRLGLESLRLWHDGG

SEQ ID NO: 855219 - protein, 21 aa, Mycobacterium
RLLRLVHLPRADSDSLHAALV

SEQ ID NO: 855220 - protein, 17 aa, Mycobacterium
RLLRTLPADGGRFELSE

SEQ ID NO: 855221 - protein, 17 aa, Mycobacterium
RLLRYDTLIIDEAHERS

SEQ ID NO: 855222 - protein, 17 aa, Mycobacterium
RLLSIPLRHVYAALWRV

SEQ ID NO: 855223 - protein, 17 aa, Mycobacterium
RLLTRAQRAVIDSGIRS

SEQ ID NO: 855224 - protein, 25 aa, Mycobacterium
RLLVVDEEFARRLGLIRPSVGIAEW

SEQ ID NO: 855225 - protein, 17 aa, Mycobacterium
RLLVVPIGENRTIVENL

SEQ ID NO: 855226 - protein, 18 aa, Mycobacterium
RLLWEMLQGDVVADGWRS

SEQ ID NO: 855227 - protein, 19 aa, Mycobacterium
RLLYVSPERLARDPVLRGA

SEQ ID NO: 855228 - protein, 18 aa, Mycobacterium
RLMAQLPPGGVMMAVTAT

SEQ ID NO: 855229 - protein, 19 aa, Mycobacterium
RLMEVYAGFLAHTDAQIGR

SEQ ID NO: 855230 - protein, 28 aa, Mycobacterium
RLMGQTMERLLPIPPIALQLSTGVAMLS

SEQ ID NO: 855231 - protein, 20 aa, Mycobacterium
RLMIERNVSFVFTPSVTEQP

SEQ ID NO: 855232 - protein, 18 aa, Mycobacterium
RLMILASEDIGMADPSAL

SEQ ID NO: 855233 - protein, 19 aa, Mycobacterium
RLMIYDALEMTYRTIRIRK

SEQ ID NO: 855234 - protein, 20 aa, Mycobacterium
RLMIYDALEMTYRTIRIRKD

SEQ ID NO: 855235 - protein, 19 aa, Mycobacterium
RLMNQLPEQCPPLSAVIHA

SEQ ID NO: 855236 - protein, 20 aa, Mycobacterium
RLMQILGTSAYVPDLVMRAP

SEQ ID NO: 855237 - protein, 31 aa, Mycobacterium
RLMRSRTLMRAPIWIYRARAGAVFGSRMLML

SEQ ID NO: 855238 - protein, 18 aa, Mycobacterium
RLMVLVATNFFGQNTPLI

SEQ ID NO: 855239 - protein, 21 aa, Mycobacterium
RLNAFPQFRDTIDGLGIHFLH

SEQ ID NO: 855240 - protein, 18 aa, Mycobacterium
RLNAPALGLAAALGLDEL

SEQ ID NO: 855241 - protein, 18 aa, Mycobacterium
RLNDRYFYESFRSTDELV

SEQ ID NO: 855242 - protein, 21 aa, Mycobacterium
RLNEVCCIYPITPSSPMAELA

SEQ ID NO: 855243 - protein, 28 aa, Mycobacterium
RLNHGGVRPFGWLYAASRDPSVPLVPTM

SEQ ID NO: 855244 - protein, 18 aa, Mycobacterium
RLNHRYFVVSALGQPPVG

SEQ ID NO: 855245 - protein, 19 aa, Mycobacterium
RLNKLLAPFGVRRTVQAGR

SEQ ID NO: 855246 - protein, 25 aa, Mycobacterium
RLNKPTRLLPLFSGPATRPMDGVTV

SEQ ID NO: 855247 - protein, 27 aa, Mycobacterium
RLNRDQLNEFFLLLAIAGNETTRNTLS

SEQ ID NO: 855248 - protein, 17 aa, Mycobacterium
RLNRLGINTIGQFAALQ

SEQ ID NO: 855249 - protein, 24 aa, Mycobacterium
RLNRNRWSFKILVPPGYTGSFGPI

SEQ ID NO: 855250 - protein, 23 aa, Mycobacterium
RLNRPSRVLLAGHLDTVPVADNL

SEQ ID NO: 855251 - protein, 30 aa, Mycobacterium
RLNRWLPENLAYFAVRWKNVLRQAAVYGAC

SEQ ID NO: 855252 - protein, 20 aa, Mycobacterium
RLPAERRFYFHTTDGLPIAP

SEQ ID NO: 855253 - protein, 28 aa, Mycobacterium
RLPATEFAGFLWVALDPGATLDIATHLG

SEQ ID NO: 855254 - protein, 17 aa, Mycobacterium
RLPAVPCHVGDPDLWFA

SEQ ID NO: 855255 - protein, 25 aa, Mycobacterium
RLPDGVWLADLGSYPLRDLPRPERV

SEQ ID NO: 855256 - protein, 22 aa, Mycobacterium
RLPDLRCLMLTSFTSDEATLDA

SEQ ID NO: 855257 - protein, 18 aa, Mycobacterium
RLPDSPFRLWAFGDAHVG

SEQ ID NO: 855258 - protein, 23 aa, Mycobacterium
RLPEALSRFPITRVISSPQRRAV

SEQ ID NO: 855259 - protein, 25 aa, Mycobacterium
RLPEIPQLRWRVTGAPLGLDRPWFV

SEQ ID NO: 855260 - protein, 25 aa, Mycobacterium
RLPELPQLRWRVTGAPLGLDRPWFV

SEQ ID NO: 855261 - protein, 33 aa, Mycobacterium
RLPESGAICFLIRTYMLPFADIATVGPWRDRLA

SEQ ID NO: 855262 - protein, 17 aa, Mycobacterium
RLPESLLHYMRTRGKNK

SEQ ID NO: 855263 - protein, 20 aa, Mycobacterium
RLPEYMVPAAVMVIDALPLT

SEQ ID NO: 855264 - protein, 18 aa, Mycobacterium
RLPGIVSQFHRGDLSLVR

SEQ ID NO: 855265 - protein, 19 aa, Mycobacterium
RLPGLVAIAYQHETSRCGD

SEQ ID NO: 855266 - protein, 28 aa, Mycobacterium
RLPGNDHHFLINPYGLLFEEITASSLVR

SEQ ID NO: 855267 - protein, 32 aa, Mycobacterium
RLPHGVTFIGQPLWGSIGYTLPAALGAAVAHP

SEQ ID NO: 855268 - protein, 17 aa, Mycobacterium
RLPHHHATVLGDRLRRL

SEQ ID NO: 855269 - protein, 18 aa, Mycobacterium
RLPIVDTWWQTETGAAMI

SEQ ID NO: 855270 - protein, 20 aa, Mycobacterium
RLPKGLARFPISRVVSSPQR

SEQ ID NO: 855271 - protein, 20 aa, Mycobacterium
RLPLDPTLRRMPVGIVANGV

SEQ ID NO: 855272 - protein, 18 aa, Mycobacterium
RLPLDRFVSERIGIESIE

SEQ ID NO: 855273 - protein, 19 aa, Mycobacterium
RLPMVRLPDYTLVGADGPI

SEQ ID NO: 855274 - protein, 18 aa, Mycobacterium
RLPPLGELGDEFGVGVPV

SEQ ID NO: 855275 - protein, 25 aa, Mycobacterium
RLPQDKYFRAMPLRIVSDGVVTRSV

SEQ ID NO: 855276 - protein, 17 aa, Mycobacterium
RLPQRLFIKTQLGTVHD

SEQ ID NO: 855277 - protein, 20 aa, Mycobacterium
RLPQYFPTPLRERFTPEIRS

SEQ ID NO: 855278 - protein, 18 aa, Mycobacterium
RLPRSSRLLGRVMSLIPA

SEQ ID NO: 855279 - protein, 26 aa, Mycobacterium
RLPRTALVDVLLRHPPRTRLPRGTDI

SEQ ID NO: 855280 - protein, 18 aa, Mycobacterium
RLPRTANGKLLRSALRAE

SEQ ID NO: 855281 - protein, 23 aa, Mycobacterium
RLPSAVTVWTTGFGVPGLAAASG

SEQ ID NO: 855282 - protein, 27 aa, Mycobacterium
RLPSIDRKVIPLVVPKPIGIAVIENKI

SEQ ID NO: 855283 - protein, 19 aa, Mycobacterium
RLPVFDILAEPLQDNGFDK

SEQ ID NO: 855284 - protein, 19 aa, Mycobacterium
RLPVPLYPGFDTLGTLEYI

SEQ ID NO: 855285 - protein, 19 aa, Mycobacterium
RLPVWLAQWGFARPVEQAV

SEQ ID NO: 855286 - protein, 19 aa, Mycobacterium
RLQAELGLAYLFISHDLAV

SEQ ID NO: 855287 - protein, 22 aa, Mycobacterium
RLQDAYFKRFPGYPKGITVPAI

SEQ ID NO: 855288 - protein, 17 aa, Mycobacterium
RLQFLGDSLRRLRADLD

SEQ ID NO: 855289 - protein, 17 aa, Mycobacterium
RLQFWVCGVFEVHDGKI

SEQ ID NO: 855290 - protein, 18 aa, Mycobacterium
RLQLLGHARKRLGAAVAP

SEQ ID NO: 855291 - protein, 17 aa, Mycobacterium
RLQLLGHARKRLGATVA

SEQ ID NO: 855292 - protein, 19 aa, Mycobacterium
RLQNRLGAHDLLNEYIRHI

SEQ ID NO: 855293 - protein, 25 aa, Mycobacterium
RLQPGDRLCIPVPFYHCFGMVMGNL

SEQ ID NO: 855294 - protein, 17 aa, Mycobacterium
RLQPGRMFLVDTAQGRI

SEQ ID NO: 855295 - protein, 17 aa, Mycobacterium
RLQPLATHRVTQTALLR

SEQ ID NO: 855296 - protein, 36 aa, Mycobacterium
RLQQPLTALGTKCQLPVTLPQLLGLVQAAQQQGTAA

SEQ ID NO: 855297 - protein, 31 aa, Mycobacterium
RLQRLLTFVARQEPRLNWAVGQRADGLTVLV

SEQ ID NO: 855298 - protein, 17 aa, Mycobacterium
RLQRRLNSPGWRSAMAA

SEQ ID NO: 855299 - protein, 19 aa, Mycobacterium
RLQRWRTATALPAGPDAAD

SEQ ID NO: 855300 - protein, 23 aa, Mycobacterium
RLQRYEKAFAALDAPFAFIDLDA

SEQ ID NO: 855301 - protein, 22 aa, Mycobacterium
RLQTHYAGRPSPLYEATRLSEH

SEQ ID NO: 855302 - protein, 21 aa, Mycobacterium
RLQTHYVGRPSPLYEAERLSA

SEQ ID NO: 855303 - protein, 17 aa, Mycobacterium
RLQVFFESQGMPMPFSA

SEQ ID NO: 855304 - protein, 20 aa, Mycobacterium
RLQVINWGVFDGYHDIPFSE

SEQ ID NO: 855305 - protein, 23 aa, Mycobacterium
RLQVINWGVFDGYHSIPFSVGGA

SEQ ID NO: 855306 - protein, 30 aa, Mycobacterium
RLQVLHDLYQRWPFFRSVLSNMAQVMAKSD

SEQ ID NO: 855307 - protein, 29 aa, Mycobacterium
RLQVSFLPELLRWIPFTKGDYWVLKIDDA

SEQ ID NO: 855308 - protein, 17 aa, Mycobacterium
RLQWATAKLQRYERLRA

SEQ ID NO: 855309 - protein, 20 aa, Mycobacterium
RLRADDRLWRRGTALGDVGP

SEQ ID NO: 855310 - protein, 17 aa, Mycobacterium
RLRADGVRLLYDAPKRG

SEQ ID NO: 855311 - protein, 19 aa, Mycobacterium
RLRAELPALDEFREALSGR

SEQ ID NO: 855312 - protein, 28 aa, Mycobacterium
RLRAEQGRPLWYLMPDGVVQYVSKRRLY

SEQ ID NO: 855313 - protein, 20 aa, Mycobacterium
RLRALLDTRELIVAPGVFDG

SEQ ID NO: 855314 - protein, 33 aa, Mycobacterium
RLRARGATRLVIAPWFLAHGRITDRVAEYARRE

SEQ ID NO: 855315 - protein, 30 aa, Mycobacterium
RLRARRHRAALRALWYRMSRYGNRATGARA

SEQ ID NO: 855316 - protein, 34 aa, Mycobacterium
RLRATLACVLFSEPAPHLLLLDEPTNNLDLAGIA

SEQ ID NO: 855317 - protein, 20 aa, Mycobacterium
RLRATMVPGVKRMPIRLGAG

SEQ ID NO: 855318 - protein, 27 aa, Mycobacterium
RLRAVTTWMRTMFAIVPLAVGTRTDDE

SEQ ID NO: 855319 - protein, 17 aa, Mycobacterium
RLRAYMFADGHLNTDVV

SEQ ID NO: 855320 - protein, 23 aa, Mycobacterium
RLRCAHPFLLGTRRPPFEQLHET

SEQ ID NO: 855321 - protein, 17 aa, Mycobacterium
RLRDDYFWQRDELMIGV

SEQ ID NO: 855322 - protein, 33 aa, Mycobacterium
RLRDEAPVYYNAKWDFWALTRYDDVAPATKDYE

SEQ ID NO: 855323 - protein, 22 aa, Mycobacterium
RLRDELLNSWRFDSLLEARVII

SEQ ID NO: 855324 - protein, 25 aa, Mycobacterium
RLRDGRWYWHWDPAFLGKPHDDPFV

SEQ ID NO: 855325 - protein, 20 aa, Mycobacterium
RLRDIRLRRGRLYELTRTGR

SEQ ID NO: 855326 - protein, 17 aa, Mycobacterium
RLRDITVPNRIWMSPMC

SEQ ID NO: 855327 - protein, 31 aa, Mycobacterium
RLRDLTGTACAHLLLWRADAPWERLNVADTV

SEQ ID NO: 855328 - protein, 18 aa, Mycobacterium
RLRDNRWWRPGRTPTGAP

SEQ ID NO: 855329 - protein, 20 aa, Mycobacterium
RLRDTPPDRLAGFPATVTDI

SEQ ID NO: 855330 - protein, 20 aa, Mycobacterium
RLRDVPANLRRGSVVDFDQF

SEQ ID NO: 855331 - protein, 24 aa, Mycobacterium
RLREAVRVFGFHLSGLDMRQNSDV

SEQ ID NO: 855332 - protein, 21 aa, Mycobacterium
RLREDIFNPIFSVRISPRLRD

SEQ ID NO: 855333 - protein, 29 aa, Mycobacterium
RLREDIVTPLFSIYVSPRIRTAIAKIAGR

SEQ ID NO: 855334 - protein, 17 aa, Mycobacterium
RLRELFAANKSITTFGP

SEQ ID NO: 855335 - protein, 18 aa, Mycobacterium
RLRELFAQKKSITTFGPY

SEQ ID NO: 855336 - protein, 25 aa, Mycobacterium
RLRELLKFEFLFSARAQFEKELADE

SEQ ID NO: 855337 - protein, 25 aa, Mycobacterium
RLRELLKFEFLFSARAQFEKELTDE

SEQ ID NO: 855338 - protein, 20 aa, Mycobacterium
RLRELVIMRIGWLTACDYEW

SEQ ID NO: 855339 - protein, 20 aa, Mycobacterium
RLREMAGRWADAIFTVQRDI

SEQ ID NO: 855340 - protein, 17 aa, Mycobacterium
RLREPGDPFYRAGAALA

SEQ ID NO: 855341 - protein, 29 aa, Mycobacterium
RLREQAPLYYNQRYDFWAISRHADVEKAL

SEQ ID NO: 855342 - protein, 17 aa, Mycobacterium
RLRETAPVWPVGDSGFY

SEQ ID NO: 855343 - protein, 18 aa, Mycobacterium
RLRETLDRYPNAKEFFWV

SEQ ID NO: 855344 - protein, 20 aa, Mycobacterium
RLRETPLQWPCPPTDVSGGG

SEQ ID NO: 855345 - protein, 21 aa, Mycobacterium
RLREWLTRLYRIEFDGFIAAN

SEQ ID NO: 855346 - protein, 17 aa, Mycobacterium
RLRFLSVEGFRALLFVN

SEQ ID NO: 855347 - protein, 17 aa, Mycobacterium
RLRFMIKAEMQEVRSVN

SEQ ID NO: 855348 - protein, 17 aa, Mycobacterium
RLRFVEEFNLVDAPEIE

SEQ ID NO: 855349 - protein, 35 aa, Mycobacterium
RLRGITPDWLREGLRFWLRSALTYDLLTWSSVVDR

SEQ ID NO: 855350 - protein, 23 aa, Mycobacterium
RLRGMFAFALWDTVEQELFCARD

SEQ ID NO: 855351 - protein, 19 aa, Mycobacterium
RLRGQATPPPLLALETHGR

SEQ ID NO: 855352 - protein, 29 aa, Mycobacterium
RLRGRHHRFRLFGPGPVLVRRGGHQAASL

SEQ ID NO: 855353 - protein, 17 aa, Mycobacterium
RLRGRPVGRACRGLHRV

SEQ ID NO: 855354 - protein, 18 aa, Mycobacterium
RLRGVALRALSARMPDTA

SEQ ID NO: 855355 - protein, 20 aa, Mycobacterium
RLRHVARPLLGNLHPCDQVV

SEQ ID NO: 855356 - protein, 19 aa, Mycobacterium
RLRIALSTKVPTPLPVRVG

SEQ ID NO: 855357 - protein, 20 aa, Mycobacterium
RLRILVRDLWKLVVSRIAEL

SEQ ID NO: 855358 - protein, 22 aa, Mycobacterium
RLRKDIFELYGYTAVVHVLSAS

SEQ ID NO: 855359 - protein, 20 aa, Mycobacterium
RLRKDIYDLYGYSAVVHVLS

SEQ ID NO: 855360 - protein, 17 aa, Mycobacterium
RLRKQFVGMIEGRPYRF

SEQ ID NO: 855361 - protein, 17 aa, Mycobacterium
RLRKRLDEVSGIRLERE

SEQ ID NO: 855362 - protein, 20 aa, Mycobacterium
RLRLEAYRRLAAASSDNEVA

SEQ ID NO: 855363 - protein, 17 aa, Mycobacterium
RLRLEHAPMLRPDQLRR

SEQ ID NO: 855364 - protein, 22 aa, Mycobacterium
RLRLEHVGAIRPEQLRRAADLG

SEQ ID NO: 855365 - protein, 20 aa, Mycobacterium
RLRLEHVGAIRPEQLRRAHD

SEQ ID NO: 855366 - protein, 20 aa, Mycobacterium
RLRLLGFERVELEPGQSCAV

SEQ ID NO: 855367 - protein, 17 aa, Mycobacterium
RLRLSKPVIAAISGHAV

SEQ ID NO: 855368 - protein, 17 aa, Mycobacterium
RLRLVGVAGYEAAVAQS

SEQ ID NO: 855369 - protein, 18 aa, Mycobacterium
RLRMGAVGLPLQHHLGAR

SEQ ID NO: 855370 - protein, 17 aa, Mycobacterium
RLRMICHGLGHTEGFRP

SEQ ID NO: 855371 - protein, 17 aa, Mycobacterium
RLRMICHGLGHVESSGG

SEQ ID NO: 855372 - protein, 22 aa, Mycobacterium
RLRNHYFINGKFQDAVIFGLLA

SEQ ID NO: 855373 - protein, 21 aa, Mycobacterium
RLRPFVAEWFESGSVPVRELA

SEQ ID NO: 855374 - protein, 17 aa, Mycobacterium
RLRPHYVRTLDTWAANL

SEQ ID NO: 855375 - protein, 17 aa, Mycobacterium
RLRPPGRPAAHRAGSRA

SEQ ID NO: 855376 - protein, 23 aa, Mycobacterium
RLRPQTRRALIELAAVVAQGFTG

SEQ ID NO: 855377 - protein, 22 aa, Mycobacterium
RLRQALEVFGPIFIQTYAGTEP

SEQ ID NO: 855378 - protein, 17 aa, Mycobacterium
RLRQALIQTSRLSVALR

SEQ ID NO: 855379 - protein, 24 aa, Mycobacterium
RLRQGQTLIGFLAPRNAENSIGAL

SEQ ID NO: 855380 - protein, 17 aa, Mycobacterium
RLRQKRLARTTLTEALT

SEQ ID NO: 855381 - protein, 21 aa, Mycobacterium
RLRQKVVVPTLPTASPRWVVD

SEQ ID NO: 855382 - protein, 24 aa, Mycobacterium
RLRQKVVVPTLPTASPRWVVDPDF

SEQ ID NO: 855383 - protein, 21 aa, Mycobacterium
RLRQVLAAYRVLRDPQLRDDY

SEQ ID NO: 855384 - protein, 19 aa, Mycobacterium
RLRRALEHRDQTCAVPGCG

SEQ ID NO: 855385 - protein, 18 aa, Mycobacterium
RLRRDGEPVFHHLGVSGF

SEQ ID NO: 855386 - protein, 19 aa, Mycobacterium
RLRRHGPVTVYGIDKFPRM

SEQ ID NO: 855387 - protein, 20 aa, Mycobacterium
RLRRLLADAGLDAMLVSDLV

SEQ ID NO: 855388 - protein, 17 aa, Mycobacterium
RLRRLVSKAFAPRGAER

SEQ ID NO: 855389 - protein, 26 aa, Mycobacterium
RLRRMAMRHFGPPHRAGWIDGMRDKF

SEQ ID NO: 855390 - protein, 32 aa, Mycobacterium
RLRRRGAHRVVVAPWFLAHGRLPDRVQRFAAD

SEQ ID NO: 855391 - protein, 26 aa, Mycobacterium
RLRRRIPVIEHPLLNSLARQAPSQDL

SEQ ID NO: 855392 - protein, 17 aa, Mycobacterium
RLRRRLNDIYAGELGEP

SEQ ID NO: 855393 - protein, 19 aa, Mycobacterium
RLRRRMNRAATDIEAVAAW

SEQ ID NO: 855394 - protein, 22 aa, Mycobacterium
RLRRRTVLPVSLVTRSSCAMPG

SEQ ID NO: 855395 - protein, 26 aa, Mycobacterium
RLRRSTRMFLPRPVPRRLVQEALELA

SEQ ID NO: 855396 - protein, 31 aa, Mycobacterium
RLRRTSIDAGWLLDYWSDRVYRLLRACVRDR

SEQ ID NO: 855397 - protein, 17 aa, Mycobacterium
RLRRWRLAGGADAGLAT

SEQ ID NO: 855398 - protein, 17 aa, Mycobacterium
RLRRWSVVLRGRGACAT

SEQ ID NO: 855399 - protein, 24 aa, Mycobacterium
RLRRWWPRRYRRSSVYWKLVAVDQ

SEQ ID NO: 855400 - protein, 19 aa, Mycobacterium
RLRRYGQYAFRDGAMRPQP

SEQ ID NO: 855401 - protein, 17 aa, Mycobacterium
RLRSAMFTCEPFDIAEL

SEQ ID NO: 855402 - protein, 17 aa, Mycobacterium
RLRSAMHAWARVVSRPE

SEQ ID NO: 855403 - protein, 20 aa, Mycobacterium
RLRSIAHLGVRTRDFAFAVN

SEQ ID NO: 855404 - protein, 17 aa, Mycobacterium
RLRSIGVGKLRSSLLNA

SEQ ID NO: 855405 - protein, 20 aa, Mycobacterium
RLRSPEVWVERLERGWRALG

SEQ ID NO: 855406 - protein, 17 aa, Mycobacterium
RLRSQGVRLVYEAPRRG

SEQ ID NO: 855407 - protein, 20 aa, Mycobacterium
RLRSRFYDGMRERHGITGVV

SEQ ID NO: 855408 - protein, 21 aa, Mycobacterium
RLRSSFINGIKHWPVDYRGGH

SEQ ID NO: 855409 - protein, 21 aa, Mycobacterium
RLRSVIAGVPWPSEWSRAYFT

SEQ ID NO: 855410 - protein, 17 aa, Mycobacterium
RLRTLVSKGFTPRRIRE

SEQ ID NO: 855411 - protein, 24 aa, Mycobacterium
RLRTYVRVPYRARVPMTRAALMHR

SEQ ID NO: 855412 - protein, 21 aa, Mycobacterium
RLRVAGAGLIRAWRARTSDAI

SEQ ID NO: 855413 - protein, 18 aa, Mycobacterium
RLRVFDLILTHGMATATT

SEQ ID NO: 855414 - protein, 18 aa, Mycobacterium
RLRVHSLARTLGTTSKRV

SEQ ID NO: 855415 - protein, 17 aa, Mycobacterium
RLRVIGVTWNDDAAAQA

SEQ ID NO: 855416 - protein, 21 aa, Mycobacterium
RLRVKLADRALTQTNPLLGVA

SEQ ID NO: 855417 - protein, 19 aa, Mycobacterium
RLRVLLRDVFVAAGGTHDN

SEQ ID NO: 855418 - protein, 21 aa, Mycobacterium
RLRVRLADRALTQTNPLLGVA

SEQ ID NO: 855419 - protein, 25 aa, Mycobacterium
RLRVRLADRSLLQTNPLLGVASQLL

SEQ ID NO: 855420 - protein, 22 aa, Mycobacterium
RLRVRLADRSPLQTNPLLGVAA

SEQ ID NO: 855421 - protein, 21 aa, Mycobacterium
RLRYAPGQFLTLRVPSDRTGS

SEQ ID NO: 855422 - protein, 21 aa, Mycobacterium
RLRYAPGQFLTLRVPSERTGS

SEQ ID NO: 855423 - protein, 33 aa, Mycobacterium
RLSADGIAALIRRLPRPLVVVDERYRDTIAADQ

SEQ ID NO: 855424 - protein, 17 aa, Mycobacterium
RLSADGIRALIRRLPEP

SEQ ID NO: 855425 - protein, 18 aa, Mycobacterium
RLSAFFDLVQQDPVVSQV

SEQ ID NO: 855426 - protein, 27 aa, Mycobacterium
RLSAFSVLLEMLVKPPLKSASREERTR

SEQ ID NO: 855427 - protein, 29 aa, Mycobacterium
RLSALAGYRWITPMSYTLPFRTPTGVREL

SEQ ID NO: 855428 - protein, 19 aa, Mycobacterium
RLSALDLAPRIRVNAIAPG

SEQ ID NO: 855429 - protein, 25 aa, Mycobacterium
RLSAPWVDLLTPLPRQLAISLMESL

SEQ ID NO: 855430 - protein, 17 aa, Mycobacterium
RLSAVERGPYARPPVVP

SEQ ID NO: 855431 - protein, 21 aa, Mycobacterium
RLSDEGLLRRTSFRGVEVKQL

SEQ ID NO: 855432 - protein, 26 aa, Mycobacterium
RLSDERGRRFLIHTSKIAYVEIGVAD

SEQ ID NO: 855433 - protein, 20 aa, Mycobacterium
RLSEALYSYSLLDIIDIAHA

SEQ ID NO: 855434 - protein, 20 aa, Mycobacterium
RLSELDALRDAVQTARAALA

SEQ ID NO: 855435 - protein, 18 aa, Mycobacterium
RLSFRGSGGPFRSFAGLA

SEQ ID NO: 855436 - protein, 22 aa, Mycobacterium
RLSGLALVASIARSWGCTPTTT

SEQ ID NO: 855437 - protein, 21 aa, Mycobacterium
RLSGLFRTRRFRVYTTDDVIG

SEQ ID NO: 855438 - protein, 17 aa, Mycobacterium
RLSGSLAGPVRRVAGRR

SEQ ID NO: 855439 - protein, 23 aa, Mycobacterium
RLSGWCEFVWKPGYADYYPELPG

SEQ ID NO: 855440 - protein, 17 aa, Mycobacterium
RLSIPGADLPGVCYLRT

SEQ ID NO: 855441 - protein, 30 aa, Mycobacterium
RLSNFEGPFDLLLQLIFGHRLDVTEVALHQ

SEQ ID NO: 855442 - protein, 35 aa, Mycobacterium
RLSNGFLWESAYSELLFLDELWPDFTREHLENALI

SEQ ID NO: 855443 - protein, 18 aa, Mycobacterium
RLSPAERAYLYDLARQRP

SEQ ID NO: 855444 - protein, 19 aa, Mycobacterium
RLSPRRVAAYLAKYVTKSL

SEQ ID NO: 855445 - protein, 19 aa, Mycobacterium
RLSQLLVARGVPRATITGS

SEQ ID NO: 855446 - protein, 24 aa, Mycobacterium
RLSQLWFEALAGICAYVRGGGGGL

SEQ ID NO: 855447 - protein, 19 aa, Mycobacterium
RLSRLLGELLVSADASANL

SEQ ID NO: 855448 - protein, 18 aa, Mycobacterium
RLSRLLGELLVSADSSAN

SEQ ID NO: 855449 - protein, 26 aa, Mycobacterium
RLSRPQRIAVWKLIEAFRRRSQMDES

SEQ ID NO: 855450 - protein, 28 aa, Mycobacterium
RLSSAQLAGYRLLAESTLPYVDGDRFVD

SEQ ID NO: 855451 - protein, 28 aa, Mycobacterium
RLSSRAPLLAEERRLLIAAMGRARSRVL

SEQ ID NO: 855452 - protein, 28 aa, Mycobacterium
RLSTAQLAGYRLLAESTLPYVDGDRFVD

SEQ ID NO: 855453 - protein, 30 aa, Mycobacterium
RLSTRPEHAIPIYLAALSPAMLRLTGQIAD

SEQ ID NO: 855454 - protein, 40 aa, Mycobacterium
RLSTRPEYDIPIYLAALSPAMLRLTGRIADGWLGTSFVPE

SEQ ID NO: 855455 - protein, 31 aa, Mycobacterium
RLSTRVIDLIMPIGKGQRALIVSPPKAGKTT

SEQ ID NO: 855456 - protein, 27 aa, Mycobacterium
RLSVTTPVRHFVLFSSISGLTGSRWLA

SEQ ID NO: 855457 - protein, 19 aa, Mycobacterium
RLSVVADLHPFLTQLSREL

SEQ ID NO: 855458 - protein, 17 aa, Mycobacterium
RLSVVVDAPWRAAALAD

SEQ ID NO: 855459 - protein, 19 aa, Mycobacterium
RLSWAAGLRDDGSTTLLVT

SEQ ID NO: 855460 - protein, 18 aa, Mycobacterium
RLSWARRTYRRWAAKHLH

SEQ ID NO: 855461 - protein, 21 aa, Mycobacterium
RLSWATPFTEVLDWSDAPFAK

SEQ ID NO: 855462 - protein, 20 aa, Mycobacterium
RLSWAVLNWNSNAIAVYDAV

SEQ ID NO: 855463 - protein, 17 aa, Mycobacterium
RLSWLGEQGVTVSAVPL

SEQ ID NO: 855464 - protein, 22 aa, Mycobacterium
RLSWQTPFTDVLDWSDAPFAKW

SEQ ID NO: 855465 - protein, 29 aa, Mycobacterium
RLTADAILANRLYILPHAAARASIRRRFE

SEQ ID NO: 855466 - protein, 21 aa, Mycobacterium
RLTADAILANRLYVLPHEAAR

SEQ ID NO: 855467 - protein, 18 aa, Mycobacterium
RLTALDLCPRIRVNAIAP

SEQ ID NO: 855468 - protein, 20 aa, Mycobacterium
RLTALFSNVLNLPDSAKVKL

SEQ ID NO: 855469 - protein, 17 aa, Mycobacterium
RLTAWLSSLTGLPVFSV

SEQ ID NO: 855470 - protein, 18 aa, Mycobacterium
RLTAYRWSGESTIKAENY

SEQ ID NO: 855471 - protein, 27 aa, Mycobacterium
RLTDADLLNFSFLLLVAGNETTRNLIA

SEQ ID NO: 855472 - protein, 25 aa, Mycobacterium
RLTDCGFQIPRWQRLVPVDFEAGAC

SEQ ID NO: 855473 - protein, 26 aa, Mycobacterium
RLTDEDLLNFAYLLLVAGNETTRNLI

SEQ ID NO: 855474 - protein, 23 aa, Mycobacterium
RLTDLPLTLFSDPMAPGLACAPF

SEQ ID NO: 855475 - protein, 23 aa, Mycobacterium
RLTDLPLTLFSDPMAPGLACTPF

SEQ ID NO: 855476 - protein, 18 aa, Mycobacterium
RLTDPALLHYRSGGFYAA

SEQ ID NO: 855477 - protein, 21 aa, Mycobacterium
RLTDRFDAVIIPGVTSFSAAS

SEQ ID NO: 855478 - protein, 25 aa, Mycobacterium
RLTEALEIIPPMLRGERPTFEGKYY

SEQ ID NO: 855479 - protein, 21 aa, Mycobacterium
RLTELPLTLFSDPMAPGLACR

SEQ ID NO: 855480 - protein, 23 aa, Mycobacterium
RLTEQLQILTGMWGTPVGDTFDF

SEQ ID NO: 855481 - protein, 19 aa, Mycobacterium
RLTFRATVQVRVPIIGGKL

SEQ ID NO: 855482 - protein, 22 aa, Mycobacterium
RLTGIVIGRLADDGRRFLASTE

SEQ ID NO: 855483 - protein, 20 aa, Mycobacterium
RLTGRLFRRRGLETDILLAT

SEQ ID NO: 855484 - protein, 27 aa, Mycobacterium
RLTGRRVYGTLPWHPDIWLDSEDALEL

SEQ ID NO: 855485 - protein, 20 aa, Mycobacterium
RLTIAMRSWEATVFWEGDGA

SEQ ID NO: 855486 - protein, 17 aa, Mycobacterium
RLTIPVAEKAKPRRIEI

SEQ ID NO: 855487 - protein, 24 aa, Mycobacterium
RLTNAWVPFVVAATLLVRDGGRVG

SEQ ID NO: 855488 - protein, 22 aa, Mycobacterium
RLTPPPLRIAGTPKHNLMPGSP

SEQ ID NO: 855489 - protein, 17 aa, Mycobacterium
RLTPSAYQQAAGLAKTF

SEQ ID NO: 855490 - protein, 26 aa, Mycobacterium
RLTQLTWRVMPFMWLDVDEGIKPTLY

SEQ ID NO: 855491 - protein, 18 aa, Mycobacterium
RLTRAGEALLPHARAALA

SEQ ID NO: 855492 - protein, 20 aa, Mycobacterium
RLTRLLGMVRDCFALAPDAE

SEQ ID NO: 855493 - protein, 27 aa, Mycobacterium
RLTRMRAHWPVGTLPLTAIAACCTPEA

SEQ ID NO: 855494 - protein, 24 aa, Mycobacterium
RLTRRRHKLAPDPGIRRAILVAAS

SEQ ID NO: 855495 - protein, 25 aa, Mycobacterium
RLTRRRHKLAPDPGIRRAILVAASM

SEQ ID NO: 855496 - protein, 29 aa, Mycobacterium
RLTRRRMRLTHYMALMLGAARAEFDPEAD

SEQ ID NO: 855497 - protein, 24 aa, Mycobacterium
RLTRWTDYFDLNLTMKLLQGEDIS

SEQ ID NO: 855498 - protein, 17 aa, Mycobacterium
RLTSRAAGRYFVTGEKF

SEQ ID NO: 855499 - protein, 22 aa, Mycobacterium
RLTTPLIRRDGQLRPCDWDTAM

SEQ ID NO: 855500 - protein, 30 aa, Mycobacterium; identical to SEQ ID NO: 131395

SEQ ID NO: 855501 - protein, 17 aa, Mycobacterium
RLTVAQATVRFLANQYV

SEQ ID NO: 855502 - protein, 27 aa, Mycobacterium
RLTVDLPPDFALNQPLSTFALAAVDVL

SEQ ID NO: 855503 - protein, 21 aa, Mycobacterium
RLTVFQRTPPWMVPKDDRRYT

SEQ ID NO: 855504 - protein, 17 aa, Mycobacterium
RLTVGPVPVDGFWSVTV

SEQ ID NO: 855505 - protein, 29 aa, Mycobacterium
RLTVHDYFWRWDTDWFWCSRAFGAQNPKI

SEQ ID NO: 855506 - protein, 18 aa, Mycobacterium
RLTVLVVRAYPLVAPVRI

SEQ ID NO: 855507 - protein, 25 aa, Mycobacterium
RLTVPVGMIILRKGYGLGAMAMAGG

SEQ ID NO: 855508 - protein, 26 aa, Mycobacterium
RLTVTLRHDLALPLLLAAARSLSETD

SEQ ID NO: 855509 - protein, 21 aa, Mycobacterium
RLVAGLVRRGVPALGVDQSVA

SEQ ID NO: 855510 - protein, 24 aa, Mycobacterium
RLVAGVPERLSLTTLAALCDILSC

SEQ ID NO: 855511 - protein, 23 aa, Mycobacterium
RLVAGWQVVALQPYGGAWLNSWL

SEQ ID NO: 855512 - protein, 17 aa, Mycobacterium
RLVALFPAAPADARIAA

SEQ ID NO: 855513 - protein, 18 aa, Mycobacterium
RLVAPVPLVMRKTVTDTL

SEQ ID NO: 855514 - protein, 26 aa, Mycobacterium
RLVAVLQRLLPMWDRPLRDVSMLLDG

SEQ ID NO: 855515 - protein, 32 aa, Mycobacterium
RLVDDDLAELFLPRPLRWLVSATRPTTLRRLF

SEQ ID NO: 855516 - protein, 19 aa, Mycobacterium
RLVDDLAAQLAAGGLVPGD

SEQ ID NO: 855517 - protein, 24 aa, Mycobacterium
RLVDGDIIWAPAIDGAFVLSTRGG

SEQ ID NO: 855518 - protein, 21 aa, Mycobacterium
RLVDGDIIWAPAIDGAFVLTT

SEQ ID NO: 855519 - protein, 21 aa, Mycobacterium
RLVDGEIIWAPAIDGAFVLST

SEQ ID NO: 855520 - protein, 17 aa, Mycobacterium
RLVDLFIDALTKDTRPD

SEQ ID NO: 855521 - protein, 17 aa, Mycobacterium
RLVDLYAKRPQVQERLT

SEQ ID NO: 855522 - protein, 24 aa, Mycobacterium
RLVDTPFLGPVLADDLARHIGEDA

SEQ ID NO: 855523 - protein, 32 aa, Mycobacterium
RLVEIFTAEAIWEMPPYAGWYQGARDIITLIH

SEQ ID NO: 855524 - protein, 17 aa, Mycobacterium
RLVEIQRQLAAAAGNVV

SEQ ID NO: 855525 - protein, 17 aa, Mycobacterium
RLVELPGGDALYWVGDT

SEQ ID NO: 855526 - protein, 20 aa, Mycobacterium
RLVELPGSDSLYWVGDTAAL

SEQ ID NO: 855527 - protein, 19 aa, Mycobacterium
RLVEQLAQAGLLKVICGTD

SEQ ID NO: 855528 - protein, 17 aa, Mycobacterium
RLVFEALDSVHWVEPAR

SEQ ID NO: 855529 - protein, 19 aa, Mycobacterium
RLVFLGVAGKQRGNRRRYF

SEQ ID NO: 855530 - protein, 20 aa, Mycobacterium
RLVGAEGLVYSLEPLRFAHA

SEQ ID NO: 855531 - protein, 24 aa, Mycobacterium
RLVGPRTLPVIRALIALTSRGTPG

SEQ ID NO: 855532 - protein, 17 aa, Mycobacterium
RLVGRFRALRQATIALV

SEQ ID NO: 855533 - protein, 19 aa, Mycobacterium
RLVGSYDWVLMALGAAPHV

SEQ ID NO: 855534 - protein, 17 aa, Mycobacterium
RLVLAFVGIHHAASTLL

SEQ ID NO: 855535 - protein, 25 aa, Mycobacterium
RLVLDFYRCAMLPAGPDWRPDRPEA

SEQ ID NO: 855536 - protein, 22 aa, Mycobacterium
RLVLDFYRCGMLPAGPDWRPER

SEQ ID NO: 855537 - protein, 23 aa, Mycobacterium
RLVLEHLVDRRQVFDRLIAALRP

SEQ ID NO: 855538 - protein, 17 aa, Mycobacterium
RLVLGFGSAVRVLEPES

SEQ ID NO: 855539 - protein, 21 aa, Mycobacterium
RLVLIVHHLAVDAVSWRILLE

SEQ ID NO: 855540 - protein, 18 aa, Mycobacterium
RLVLNNPAPLPCTPRGIV

SEQ ID NO: 855541 - protein, 20 aa, Mycobacterium
RLVLPTLVARRITALEPVMA

SEQ ID NO: 855542 - protein, 27 aa, Mycobacterium
RLVLSHPITWYCSPPAKPAPSAALAQA

SEQ ID NO: 855543 - protein, 20 aa, Mycobacterium
RLVLTEGNYLLLDQPAWRRV

SEQ ID NO: 855544 - protein, 27 aa, Mycobacterium
RLVLVEAVLPRLEIPHLLSDLVAPTSS

SEQ ID NO: 855545 - protein, 18 aa, Mycobacterium
RLVMQSLIGRVRLPSPMA

SEQ ID NO: 855546 - protein, 28 aa, Mycobacterium
RLVNLSSAFGLIAVPYQGAYSTAKFAVR

SEQ ID NO: 855547 - protein, 19 aa, Mycobacterium
RLVPADFIGFSQPLDDLPT

SEQ ID NO: 855548 - protein, 23 aa, Mycobacterium
RLVPADFIGFSQPLDDLPTVEGT

SEQ ID NO: 855549 - protein, 33 aa, Mycobacterium
RLVRDLMSAWQWLHFRFGLPKPPLEPLAVERLY

SEQ ID NO: 855550 - protein, 29 aa, Mycobacterium
RLVREWLTAWSQSALIPVALVVVNVFVEN

SEQ ID NO: 855551 - protein, 18 aa, Mycobacterium
RLVRIDEPILRVPQLAIH

SEQ ID NO: 855552 - protein, 20 aa, Mycobacterium
RLVRSWAGLKAMRSYALATM

SEQ ID NO: 855553 - protein, 17 aa, Mycobacterium
RLVSGQISLLLRRTIDP

SEQ ID NO: 855554 - protein, 18 aa, Mycobacterium
RLVSLPRQVGGELYGSFL

SEQ ID NO: 855555 - protein, 30 aa, Mycobacterium
RLVSRLPAQWRRGPIRPLGLDRYGVQFRVE

SEQ ID NO: 855556 - protein, 25 aa, Mycobacterium
RLVSVLRGFDPHVVHLASPALLGYG

SEQ ID NO: 855557 - protein, 18 aa, Mycobacterium
RLVTADWLSAHLGAPGLA

SEQ ID NO: 855558 - protein, 21 aa, Mycobacterium
RLVTAIAIGEYLPGARLPSER

SEQ ID NO: 855559 - protein, 19 aa, Mycobacterium
RLVTDGGRWSEWAKPIVLQ

SEQ ID NO: 855560 - protein, 17 aa, Mycobacterium
RLVTEVLARFRVQRPIR

SEQ ID NO: 855561 - protein, 22 aa, Mycobacterium
RLVVARMPAFGLTGPWRDRVGF

SEQ ID NO: 855562 - protein, 19 aa, Mycobacterium
RLVVGYVTRELGPASPERV

SEQ ID NO: 855563 - protein, 22 aa, Mycobacterium
RLVVIDLQPVTFFGSAGLNAVL

SEQ ID NO: 855564 - protein, 19 aa, Mycobacterium
RLVVWELIDALRRDGVTVV

SEQ ID NO: 855565 - protein, 17 aa, Mycobacterium
RLVWSYLQDAANPHRRS

SEQ ID NO: 855566 - protein, 17 aa, Mycobacterium
RLVYPPYSRLALNIMRR

SEQ ID NO: 855567 - protein, 22 aa, Mycobacterium
RLWATILQHRFGGDGALAGHPI

SEQ ID NO: 855568 - protein, 25 aa, Mycobacterium
RLWEHWGKPEIVWYRGGHTGFFRAR

SEQ ID NO: 855569 - protein, 17 aa, Mycobacterium
RLWEILGAHRRTFTTAD

SEQ ID NO: 855570 - protein, 18 aa, Mycobacterium
RLWEILGAHRRTFTTADG

SEQ ID NO: 855571 - protein, 18 aa, Mycobacterium
RLWHVPVSTPSRAGRLRR

SEQ ID NO: 855572 - protein, 19 aa, Mycobacterium
RLWIPVHRDWRLNERHYGA

SEQ ID NO: 855573 - protein, 17 aa, Mycobacterium
RLWIVTRGAQQVDPTDS

SEQ ID NO: 855574 - protein, 18 aa, Mycobacterium
RLWLARSADFDMLAAAPV

SEQ ID NO: 855575 - protein, 17 aa, Mycobacterium
RLWLDERRQAVANRRQA

SEQ ID NO: 855576 - protein, 19 aa, Mycobacterium
RLWPGLQETFKSGSAEIPL

SEQ ID NO: 855577 - protein, 20 aa, Mycobacterium
RLWRPRLRRTLEGMEVTFVK

SEQ ID NO: 855578 - protein, 19 aa, Mycobacterium
RLYDIELALRLGASVERVA

SEQ ID NO: 855579 - protein, 18 aa, Mycobacterium
RLYDIEYALRIGATVEEV

SEQ ID NO: 855580 - protein, 18 aa, Mycobacterium
RLYDLELALRLGASVDRV

SEQ ID NO: 855581 - protein, 18 aa, Mycobacterium
RLYDLELALRLGASVEQA

SEQ ID NO: 855582 - protein, 25 aa, Mycobacterium
RLYEALRARLAPGGLLAICVLSEVG

SEQ ID NO: 855583 - protein, 17 aa, Mycobacterium
RLYEGTSEIQRLIIGGG

SEQ ID NO: 855584 - protein, 18 aa, Mycobacterium
RLYFQWASFEILPRQLQK

SEQ ID NO: 855585 - protein, 18 aa, Mycobacterium
RLYGFARPMGSRMMCGET

SEQ ID NO: 855586 - protein, 18 aa, Mycobacterium
RLYGLVNIAGGAAPATWM

SEQ ID NO: 855587 - protein, 19 aa, Mycobacterium
RLYLIETAEKGLSWMRLTA

SEQ ID NO: 855588 - protein, 24 aa, Mycobacterium
RLYPESLHIMGWNVGSAGIQLVMS

SEQ ID NO: 855589 - protein, 25 aa, Mycobacterium
RLYPLRLQEELAEHLPGCTALQVVD

SEQ ID NO: 855590 - protein, 25 aa, Mycobacterium
RLYPRTAAELASWKHRWARACQQAF

SEQ ID NO: 855591 - protein, 19 aa, Mycobacterium
RLYRGPILRGVIPELRQYL

SEQ ID NO: 855592 - protein, 17 aa, Mycobacterium
RLYRRSVAEGQIRVPAV

SEQ ID NO: 855593 - protein, 25 aa, Mycobacterium
RLYSFKDILVLKIVKRLLDTGISLH

SEQ ID NO: 855594 - protein, 18 aa, Mycobacterium
RLYTYRSHGIHVCANVVC

SEQ ID NO: 855595 - protein, 25 aa, Mycobacterium
RLYVADGTYFYRVGPDGALETVGML

SEQ ID NO: 855596 - protein, 17 aa, Mycobacterium
RLYWESFANFRDKVTAP

SEQ ID NO: 855597 - protein, 17 aa, Mycobacterium
RMAAFWDQAMRLRDLLK

SEQ ID NO: 855598 - protein, 29 aa, Mycobacterium
RMAARGRKPGWSLLLNPTPALVEELGYPS

SEQ ID NO: 855599 - protein, 28 aa, Mycobacterium
RMAAVDAQFYWMSAKIPSDEFLLYAFAG

SEQ ID NO: 855600 - protein, 22 aa, Mycobacterium
RMAHERVVLRQLVFGYTYEELN

SEQ ID NO: 855601 - protein, 18 aa, Mycobacterium
RMAKFLSGQLWESAGSPE

SEQ ID NO: 855602 - protein, 17 aa, Mycobacterium
RMAKLLSVLPEKQREIL

SEQ ID NO: 855603 - protein, 24 aa, Mycobacterium
RMALEWSIVVLGPDTAAALVAREL

SEQ ID NO: 855604 - protein, 33 aa, Mycobacterium
RMAMVQSLLVRSLVAWFWDEPLRAPLIRHGANL

SEQ ID NO: 855605 - protein, 34 aa, Mycobacterium
RMAMVQSLLVRSLVAWFWEQPLRAPLIRHGANLH

SEQ ID NO: 855606 - protein, 24 aa, Mycobacterium
RMASLRGLLKFKTGVRPPVPLDEV

SEQ ID NO: 855607 - protein, 17 aa, Mycobacterium
RMAVPPWVQGALQADAG

SEQ ID NO: 855608 - protein, 18 aa, Mycobacterium
RMCFGEIPDPVIVKAFEQ

SEQ ID NO: 855609 - protein, 26 aa, Mycobacterium
RMCRNDFLHYLRIREWQDLVGQLRSI

SEQ ID NO: 855610 - protein, 19 aa, Mycobacterium
RMCRNEFLHYLRIREWQDL

SEQ ID NO: 855611 - protein, 19 aa, Mycobacterium
RMCRSEFLHYLRIREWQDL

SEQ ID NO: 855612 - protein, 28 aa, Mycobacterium
RMDDLVEFLLRMIQSMVIAPPDPPRDPV

SEQ ID NO: 855613 - protein, 19 aa, Mycobacterium
RMDGFELLQIGLNGAAPVV

SEQ ID NO: 855614 - protein, 23 aa, Mycobacterium
RMDKPLQRYWRDVHVGQLHAIHM

SEQ ID NO: 855615 - protein, 21 aa, Mycobacterium
RMDLALFLEENFTASGAPAGI

SEQ ID NO: 855616 - protein, 26 aa, Mycobacterium
RMDNVSAWRFITPPSAFIGAVIVDRG

SEQ ID NO: 855617 - protein, 17 aa, Mycobacterium
RMDQIAELYRGEVVFYG

SEQ ID NO: 855618 - protein, 23 aa, Mycobacterium
RMDSPTWPPAPDVAYARIVAANG

SEQ ID NO: 855619 - protein, 19 aa, Mycobacterium
RMDTLVAVGGFVELITAWH

SEQ ID NO: 855620 - protein, 23 aa, Mycobacterium
RMEELVMLLRRIWNLHEGPIHHE

SEQ ID NO: 855621 - protein, 23 aa, Mycobacterium
RMESRIALGALLDLLPEYEVDRS

SEQ ID NO: 855622 - protein, 19 aa, Mycobacterium
RMESVAALIAIFRGGRTLV

SEQ ID NO: 855623 - protein, 19 aa, Mycobacterium
RMEVDIDGDWRFFDQTDGD

SEQ ID NO: 855624 - protein, 19 aa, Mycobacterium
RMFEVVPNPAWVARPGTAA

SEQ ID NO: 855625 - protein, 22 aa, Mycobacterium
RMFHGKPIPPPLRTAIGRALDP

SEQ ID NO: 855626 - protein, 17 aa, Mycobacterium
RMFIFIGAEPRTEWLDG

SEQ ID NO: 855627 - protein, 17 aa, Mycobacterium
RMFLVDTAQGRIVDDEE

SEQ ID NO: 855628 - protein, 17 aa, Mycobacterium
RMFLVDTAQGRIVSDEE

SEQ ID NO: 855629 - protein, 17 aa, Mycobacterium
RMFNGAGSTPMLQASAA

SEQ ID NO: 855630 - protein, 19 aa, Mycobacterium
RMGALALHVAKIARRRHPQ

SEQ ID NO: 855631 - protein, 34 aa, Mycobacterium
RMGFDALYDTDAPPFLLSLIDSSAVRVACGVEVT

SEQ ID NO: 855632 - protein, 23 aa, Mycobacterium
RMGFWVCDWCGHGSPRLSNPQKP

SEQ ID NO: 855633 - protein, 21 aa, Mycobacterium
RMGKFFREVGRLAGSPAPTAQ

SEQ ID NO: 855634 - protein, 17 aa, Mycobacterium
RMGRDGMLGVGWPKEFG

SEQ ID NO: 855635 - protein, 33 aa, Mycobacterium
RMGRFHQTYDLLLTPTLPLPAFPAGQDVPDGWH

SEQ ID NO: 855636 - protein, 18 aa, Mycobacterium
RMGRRPGARWAADLLAAA

SEQ ID NO: 855637 - protein, 18 aa, Mycobacterium
RMGRRPGARWAADLVAAS

SEQ ID NO: 855638 - protein, 24 aa, Mycobacterium
RMGSFAEPGLGASPVWHVFAIDQT

SEQ ID NO: 855639 - protein, 24 aa, Mycobacterium
RMGYSQMHVSRLLAKALATLRDQA

SEQ ID NO: 855640 - protein, 18 aa, Mycobacterium
RMHAAVDAILRAGVPMLL

SEQ ID NO: 855641 - protein, 18 aa, Mycobacterium
RMHAAVEAILRGGVPMLL

SEQ ID NO: 855642 - protein, 20 aa, Mycobacterium
RMHDYLRAFPDHTAALLAVE

SEQ ID NO: 855643 - protein, 18 aa, Mycobacterium
RMHLAGEPVLTIANTLGV

SEQ ID NO: 855644 - protein, 22 aa, Mycobacterium
RMHPDVCRAVSRLSYDGRLLSY

SEQ ID NO: 855645 - protein, 18 aa, Mycobacterium
RMHPLPPMRARVETVFVR

SEQ ID NO: 855646 - protein, 18 aa, Mycobacterium
RMHRLLHMLEAAWNVTEP

SEQ ID NO: 855647 - protein, 20 aa, Mycobacterium
RMIEAYHRLSKLNEYSAINF

SEQ ID NO: 855648 - protein, 18 aa, Mycobacterium
RMIKAGLIAPRFTMRQGR

SEQ ID NO: 855649 - protein, 33 aa, Mycobacterium
RMINPVLGIPFRPLLKFLTAGFLAPVFRDALGL

SEQ ID NO: 855650 - protein, 26 aa, Mycobacterium
RMISEYVHYLATELTPLGIRANVIHP

SEQ ID NO: 855651 - protein, 26 aa, Mycobacterium
RMITYLFEVDYLEHFAWALTDEPDGL

SEQ ID NO: 855652 - protein, 24 aa, Mycobacterium
RMKLARNMLTFIGFAASCEAMKLA

SEQ ID NO: 855653 - protein, 17 aa, Mycobacterium
RMKPLGFTLDEMGRLLD

SEQ ID NO: 855654 - protein, 18 aa, Mycobacterium
RMLAERGPADPIRVWSAG

SEQ ID NO: 855655 - protein, 30 aa, Mycobacterium
RMLATIRPYRPSLSAALPPSALWGREAYAR

SEQ ID NO: 855656 - protein, 20 aa, Mycobacterium
RMLERLAFPAMLRAFSQPVG

SEQ ID NO: 855657 - protein, 17 aa, Mycobacterium
RMLFSRAGTYPPGATER

SEQ ID NO: 855658 - protein, 35 aa, Mycobacterium
RMLGGYFRFDPANAALLVALLPPVIHVRGGDPDAP

SEQ ID NO: 855659 - protein, 19 aa, Mycobacterium
RMLGVILGPTGWLPFGGGS

SEQ ID NO: 855660 - protein, 22 aa, Mycobacterium
RMLLHSLFTYDRRWLHEQGIAL

SEQ ID NO: 855661 - protein, 27 aa, Mycobacterium
RMLLNALRDRGSLRRFVPFDVDAGVLS

SEQ ID NO: 855662 - protein, 19 aa, Mycobacterium
RMLLQVHDELLFEIAPGER

SEQ ID NO: 855663 - protein, 20 aa, Mycobacterium
RMLPGVRALAAGSALLTGAR

SEQ ID NO: 855664 - protein, 25 aa, Mycobacterium
RMLRAAEGFPMNFGFIANGSASSTA

SEQ ID NO: 855665 - protein, 17 aa, Mycobacterium
RMLRAARFVSQLGFAVA

SEQ ID NO: 855666 - protein, 24 aa, Mycobacterium
RMLRATGRYADGWFPVAIVSPERY

SEQ ID NO: 855667 - protein, 19 aa, Mycobacterium
RMLRDFPGLTVTRLASGLP

SEQ ID NO: 855668 - protein, 18 aa, Mycobacterium
RMLRVHLGGLFNAARACL

SEQ ID NO: 855669 - protein, 17 aa, Mycobacterium
RMLSMFPGMSSAELSRQ

SEQ ID NO: 855670 - protein, 17 aa, Mycobacterium
RMLTHCRRARLMAYRVV

SEQ ID NO: 855671 - protein, 26 aa, Mycobacterium
RMLVDNGISLTKFWFSVSPAEQRTRF

SEQ ID NO: 855672 - protein, 17 aa, Mycobacterium
RMLVNAGLLDRVPYSQD

SEQ ID NO: 855673 - protein, 17 aa, Mycobacterium
RMLVVPGSMRVRAQAEA

SEQ ID NO: 855674 - protein, 31 aa, Mycobacterium
RMMAAGKLKWEFMITHELGLSELPRMMQQLG

SEQ ID NO: 855675 - protein, 17 aa, Mycobacterium
RMMQGFGVHTFRLVNDR

SEQ ID NO: 855676 - protein, 18 aa, Mycobacterium
RMMRLVTEQAPDAILTLH

SEQ ID NO: 855677 - protein, 17 aa, Mycobacterium
RMMVRANRYALAASLEG

SEQ ID NO: 855678 - protein, 25 aa, Mycobacterium
RMNCRPLPVFLFDGAVLSERVIAPT

SEQ ID NO: 855679 - protein, 17 aa, Mycobacterium
RMNGQLEQAGWFGKTFS

SEQ ID NO: 855680 - protein, 21 aa, Mycobacterium
RMNIGQILETHLGWCAHSGWQ

SEQ ID NO: 855681 - protein, 19 aa, Mycobacterium
RMPARDLCNTLGWEKSRVS

SEQ ID NO: 855682 - protein, 21 aa, Mycobacterium
RMPDTDLAWHDLVRGPTTFAA

SEQ ID NO: 855683 - protein, 25 aa, Mycobacterium
RMPFRVHIAYYRYFVRYPGAGKPGH

SEQ ID NO: 855684 - protein, 22 aa, Mycobacterium
RMPHDRLVKRQLTFGYTYEELN

SEQ ID NO: 855685 - protein, 23 aa, Mycobacterium
RMPNGRMPLALWVVGERSLAEVT

SEQ ID NO: 855686 - protein, 17 aa, Mycobacterium
RMPNLLVSQRRPGFYLR

SEQ ID NO: 855687 - protein, 18 aa, Mycobacterium
RMPNLPVSRRRVLVFSGD

SEQ ID NO: 855688 - protein, 22 aa, Mycobacterium
RMPRWYRPVGGLYDQFLGAAET

SEQ ID NO: 855689 - protein, 19 aa, Mycobacterium
RMPVELYDLPPYGTLNFHD

SEQ ID NO: 855690 - protein, 20 aa, Mycobacterium
RMQKRWMATTQDWLDLSAKV

SEQ ID NO: 855691 - protein, 20 aa, Mycobacterium
RMQLRNTTIPLWQPHAPEIT

SEQ ID NO: 855692 - protein, 18 aa, Mycobacterium
RMQRLPGLPVRPAVAASL

SEQ ID NO: 855693 - protein, 23 aa, Mycobacterium
RMQRLRGRFYDGMRALHGTRDEV

SEQ ID NO: 855694 - protein, 18 aa, Mycobacterium
RMRAICDQLAAFPAPVIA

SEQ ID NO: 855695 - protein, 18 aa, Mycobacterium
RMRDEAPLYYNDKYNFFA

SEQ ID NO: 855696 - protein, 21 aa, Mycobacterium
RMREVIILRVAHLQDSPYELA

SEQ ID NO: 855697 - protein, 20 aa, Mycobacterium
RMRGFSRPGIELTKRTLWSG

SEQ ID NO: 855698 - protein, 25 aa, Mycobacterium
RMRHMPFRITPIERDAWLRCMHTAV

SEQ ID NO: 855699 - protein, 26 aa, Mycobacterium
RMRHVPFRITPLARDAWLRCMHTAVA

SEQ ID NO: 855700 - protein, 25 aa, Mycobacterium
RMRINGLLDRIPLLPRNIAHSDDQH

SEQ ID NO: 855701 - protein, 17 aa, Mycobacterium
RMRRRRGVGRHRGEPRT

SEQ ID NO: 855702 - protein, 20 aa, Mycobacterium
RMRTRWINFATQDNPAGPAG

SEQ ID NO: 855703 - protein, 29 aa, Mycobacterium
RMRVGTLVLNAPWWNPALLARDIATTDVL

SEQ ID NO: 855704 - protein, 19 aa, Mycobacterium
RMRWTVVHYRPPESMTLNG

SEQ ID NO: 855705 - protein, 17 aa, Mycobacterium
RMSALRTTPPKPGLTRS

SEQ ID NO: 855706 - protein, 21 aa, Mycobacterium
RMSARRFWVRYAAEAAGALTL

SEQ ID NO: 855707 - protein, 22 aa, Mycobacterium
RMSARRFWVRYAAEASGTLTLD

SEQ ID NO: 855708 - protein, 23 aa, Mycobacterium
RMSARRFWVRYAAESAGWLTLDA

SEQ ID NO: 855709 - protein, 21 aa, Mycobacterium
RMSELGFEIDFNDLVYHGQRS

SEQ ID NO: 855710 - protein, 17 aa, Mycobacterium
RMSLAMAGWPKSDRKRR

SEQ ID NO: 855711 - protein, 19 aa, Mycobacterium
RMSPASVYLSPAPLYHAAG

SEQ ID NO: 855712 - protein, 20 aa, Mycobacterium
RMSQLPDALTALDDLAARRP

SEQ ID NO: 855713 - protein, 22 aa, Mycobacterium
RMSYIQKMATVLGRRVWENAGA

SEQ ID NO: 855714 - protein, 30 aa, Mycobacterium
RMTESGLAEEIFVIADLARQKARAAQHTFM

SEQ ID NO: 855715 - protein, 35 aa, Mycobacterium
RMTLDLRRLIDRATRWLLNYRPLPLAVGAEINRFA

SEQ ID NO: 855716 - protein, 29 aa, Mycobacterium
RMTLLETVLRWPFLDFNKILDRPLEEVMD

SEQ ID NO: 855717 - protein, 17 aa, Mycobacterium
RMTLRELASRRVTADLM

SEQ ID NO: 855718 - protein, 17 aa, Mycobacterium
RMTLRELGSRRVTADAI

SEQ ID NO: 855719 - protein, 21 aa, Mycobacterium
RMTTPVPKREWKEVVLLAGGR

SEQ ID NO: 855720 - protein, 20 aa, Mycobacterium
RMTVRGLLDESLMAGSRIVA

SEQ ID NO: 855721 - protein, 20 aa, Mycobacterium
RMVARLRAQHRYIARSKARA

SEQ ID NO: 855722 - protein, 19 aa, Mycobacterium
RMVDALLTAFSRRTGRTTS

SEQ ID NO: 855723 - protein, 30 aa, Mycobacterium
RMVDTFAARALFFDKFFADAIAAGLRQVVI

SEQ ID NO: 855724 - protein, 24 aa, Mycobacterium
RMVGVLRGFDPDVVHLASPALLGW

SEQ ID NO: 855725 - protein, 17 aa, Mycobacterium
RMVLSKPVIAAVSGYAV

SEQ ID NO: 855726 - protein, 20 aa, Mycobacterium
RMVNLSPLTILLPGARDRSP

SEQ ID NO: 855727 - protein, 21 aa, Mycobacterium
RMVPTFCRQALRNEPLTVSGT

SEQ ID NO: 855728 - protein, 25 aa, Mycobacterium
RMVSVLRGFDPHVVHLASPALLGYG

SEQ ID NO: 855729 - protein, 18 aa, Mycobacterium
RMVSWPYTKLMNSNNMVD

SEQ ID NO: 855730 - protein, 18 aa, Mycobacterium
RMWLGPDVYLYRDDPVYH

SEQ ID NO: 855731 - protein, 17 aa, Mycobacterium
RMYAGVGSGPLLAAAAA

SEQ ID NO: 855732 - protein, 17 aa, Mycobacterium
RMYIGPGSGPMLAAAAA

SEQ ID NO: 855733 - protein, 20 aa, Mycobacterium
RMYRTGDLVRWRADGQLDYL

SEQ ID NO: 855734 - protein, 19 aa, Mycobacterium
RMYSGAGSGPLLAAAAAWD

SEQ ID NO: 855735 - protein, 19 aa, Mycobacterium
RMYSGPGSGPLLAAASAWD

SEQ ID NO: 855736 - protein, 18 aa, Mycobacterium
RMYSGPGSGPMLAAAAAW

SEQ ID NO: 855737 - protein, 17 aa, Mycobacterium
RMYTGAGAAPMMAAAAA

SEQ ID NO: 855738 - protein, 18 aa, Mycobacterium
RMYTRAQYAPYVEKLLLD

SEQ ID NO: 855739 - protein, 24 aa, Mycobacterium
RMYTRARFAPYVEKLLLDGARSKL

SEQ ID NO: 855740 - protein, 22 aa, Mycobacterium
RNAADLRPFRAAASLFEDLQRV

SEQ ID NO: 855741 - protein, 26 aa, Mycobacterium
RNADRVVQLYRYLLEQSLLAAGQAEH

SEQ ID NO: 855742 - protein, 18 aa, Mycobacterium
RNAELAHIFTKEAKTFGI

SEQ ID NO: 855743 - protein, 27 aa, Mycobacterium
RNAFVKLVLSNVFGQNAPLIAAAEGIY

SEQ ID NO: 855744 - protein, 17 aa, Mycobacterium
RNAFWSITGELFGFDAA

SEQ ID NO: 855745 - protein, 24 aa, Mycobacterium
RNAGTAILFLLMPGQQSAWHTVRS

SEQ ID NO: 855746 - protein, 17 aa, Mycobacterium
RNAILFRPSPYAVRCCE

SEQ ID NO: 855747 - protein, 22 aa, Mycobacterium
RNAIYKTIFDARRKIREFLVTN

SEQ ID NO: 855748 - protein, 26 aa, Mycobacterium
RNALSPAMYFGIRYAVGRLNEDPDLA

SEQ ID NO: 855749 - protein, 26 aa, Mycobacterium
RNALVQLVLTNLFGQNAPAIAAAEGS

SEQ ID NO: 855750 - protein, 31 aa, Mycobacterium
RNAPHLVRAMPQLVPLLPSMSPGTRALVRGG

SEQ ID NO: 855751 - protein, 21 aa, Mycobacterium
RNAPLAFALHDADKAGRLRLH

SEQ ID NO: 855752 - protein, 24 aa, Mycobacterium
RNAPLTLVHAISPDVATWLNKPLP

SEQ ID NO: 855753 - protein, 26 aa, Mycobacterium
RNAQALIVLAVPVPALSPLLNRIAEL

SEQ ID NO: 855754 - protein, 28 aa, Mycobacterium
RNARLFHRRWGEWPMEGWLSTFEDRGLI

SEQ ID NO: 855755 - protein, 20 aa, Mycobacterium
RNATLAYLAILRGRATEAEV

SEQ ID NO: 855756 - protein, 23 aa, Mycobacterium
RNATLSTLLEFLSGARLNAREPG

SEQ ID NO: 855757 - protein, 29 aa, Mycobacterium
RNCTFRRTSLWHSTFRHCSFLGSTFTECR

SEQ ID NO: 855758 - protein, 26 aa, Mycobacterium
RNDDGDIVVDPPDRWIEPEEHQTLDE

SEQ ID NO: 855759 - protein, 19 aa, Mycobacterium
RNDGHGFSPLFLDPNYSFV

SEQ ID NO: 855760 - protein, 21 aa, Mycobacterium
RNDGLACVVLRVARFFAEFDD

SEQ ID NO: 855761 - protein, 24 aa, Mycobacterium
RNDGRLIGLPFHKEAYGGEDGFRK

SEQ ID NO: 855762 - protein, 23 aa, Mycobacterium
RNDIGAMNECWVRHLGAHADADV

SEQ ID NO: 855763 - protein, 27 aa, Mycobacterium
RNDLVRRFYTNWFALDASVRDLFPPEM

SEQ ID NO: 855764 - protein, 25 aa, Mycobacterium
RNDTTYMSELRWWTSPFSSNADHAP

SEQ ID NO: 855765 - protein, 29 aa, Mycobacterium
RNEDDPRLWYYRFQTDAIGWNPGVNVLLP

SEQ ID NO: 855766 - protein, 17 aa, Mycobacterium
RNEDPACPAGSYVDAKA

SEQ ID NO: 855767 - protein, 23 aa, Mycobacterium
RNEDPACPVGSYVGPNAIRNPDG

SEQ ID NO: 855768 - protein, 22 aa, Mycobacterium
RNEGLVLLDFDDLLLHTAAAIE

SEQ ID NO: 855769 - protein, 23 aa, Mycobacterium
RNERAQRFYAKHGFAVAGTKTFR

SEQ ID NO: 855770 - protein, 21 aa, Mycobacterium
RNEVTEILPLDGFNFDDLDWR

SEQ ID NO: 855771 - protein, 21 aa, Mycobacterium
RNEWTVAYLLEELAGRPDDGL

SEQ ID NO: 855772 - protein, 17 aa, Mycobacterium
RNFCIIAHIDHGKSTLA

SEQ ID NO: 855773 - protein, 25 aa, Mycobacterium
RNFEKAFAPFGLPSTAFKPSYGIAE

SEQ ID NO: 855774 - protein, 17 aa, Mycobacterium
RNFGLVWVSGRSALELK

SEQ ID NO: 855775 - protein, 18 aa, Mycobacterium
RNFLPDLGLRRENIVFIS

SEQ ID NO: 855776 - protein, 19 aa, Mycobacterium
RNFLPELGLRRENIAFVSG

SEQ ID NO: 855777 - protein, 19 aa, Mycobacterium
RNFMFWPTTCHILEVIPQQ

SEQ ID NO: 855778 - protein, 22 aa, Mycobacterium
RNFRRLVAEAKVLWRNEHHRGR

SEQ ID NO: 855779 - protein, 20 aa, Mycobacterium
RNFRWDPLDSVYFAGYAMWN

SEQ ID NO: 855780 - protein, 40 aa, Mycobacterium
RNFVKGLLDRAYAKKFRFPTFVGAFKYYTSYTLKTFDGKR

SEQ ID NO: 855781 - protein, 24 aa, Mycobacterium
RNGALNPCAFRRKPIPEDDILNSA

SEQ ID NO: 855782 - protein, 24 aa, Mycobacterium
RNGALNPNAFRRKPIPEEEILNST

SEQ ID NO: 855783 - protein, 32 aa, Mycobacterium
RNGAVVLLMWAGILAYLDRCDYTYVTGCVSVP

SEQ ID NO: 855784 - protein, 31 aa, Mycobacterium
RNGFRQSMFGSYMRPLLRRSNLTILTGATVT

SEQ ID NO: 855785 - protein, 18 aa, Mycobacterium
RNGHCDIALVVGAGSYNE

SEQ ID NO: 855786 - protein, 25 aa, Mycobacterium
RNGIDAARWPFAARREHTGPPELLY

SEQ ID NO: 855787 - protein, 25 aa, Mycobacterium
RNGIINIGGPEKFSFADMAGAVLAA

SEQ ID NO: 855788 - protein, 23 aa, Mycobacterium
RNGIRVFPITYPAVSKDATRLRF

SEQ ID NO: 855789 - protein, 24 aa, Mycobacterium
RNGITKWVLGWERNGWMTAAKQPV

SEQ ID NO: 855790 - protein, 25 aa, Mycobacterium
RNGITKWVLGWERNGWMTAAKQPVK

SEQ ID NO: 855791 - protein, 27 aa, Mycobacterium
RNGLRPGRWWRTLDDRLILASESGVLD

SEQ ID NO: 855792 - protein, 25 aa, Mycobacterium
RNGLRPGRWWRTVDDRVILASEAGV

SEQ ID NO: 855793 - protein, 21 aa, Mycobacterium
RNGNRWRIYAVDPGNNRVAAR

SEQ ID NO: 855794 - protein, 20 aa, Mycobacterium
RNGPWIADQLLELGVELAHI

SEQ ID NO: 855795 - protein, 20 aa, Mycobacterium
RNGPWIADRLLELGVELAHI

SEQ ID NO: 855796 - protein, 23 aa, Mycobacterium
RNGQLALGLFPAMPPICRVCQMP

SEQ ID NO: 855797 - protein, 18 aa, Mycobacterium
RNGRISFFGGLPKTDPTI

SEQ ID NO: 855798 - protein, 26 aa, Mycobacterium
RNGSGPVIWLRADFDALPVQEQTGLP

SEQ ID NO: 855799 - protein, 25 aa, Mycobacterium
RNGSLDRWIAFGRSMIDDAYKLRLS

SEQ ID NO: 855800 - protein, 27 aa, Mycobacterium
RNGVRTLPEILTGAGWYSALFGMQHET

SEQ ID NO: 855801 - protein, 18 aa, Mycobacterium
RNGWYWSGDLGYVDRDGF

SEQ ID NO: 855802 - protein, 21 aa, Mycobacterium
RNGWYWTGDLGYRDEAGFLYF

SEQ ID NO: 855803 - protein, 18 aa, Mycobacterium
RNGYVPNVVYSCGALVHA

SEQ ID NO: 855804 - protein, 26 aa, Mycobacterium
RNHLRMLQHMGVPAERLRMLRSFDPR

SEQ ID NO: 855805 - protein, 23 aa, Mycobacterium
RNHMENTVLARWIPKDDPAQVAK

SEQ ID NO: 855806 - protein, 29 aa, Mycobacterium
RNHSPGAVAFIRRARRMLPGDPEFGDPLS

SEQ ID NO: 855807 - protein, 18 aa, Mycobacterium
RNHTFIRYDERGCGLSDW

SEQ ID NO: 855808 - protein, 30 aa, Mycobacterium; identical to SEQ ID NO: 117272

SEQ ID NO: 855809 - protein, 17 aa, Mycobacterium
RNIFRDGLRRMQSLGRL

SEQ ID NO: 855810 - protein, 24 aa, Mycobacterium
RNIGAQPARLLLLGGTPFAEELVM

SEQ ID NO: 855811 - protein, 17 aa, Mycobacterium
RNILGERVLGLPGEPRV

SEQ ID NO: 855812 - protein, 18 aa, Mycobacterium
RNIVTMLNGVRDGLIRDA

SEQ ID NO: 855813 - protein, 34 aa, Mycobacterium
RNKALLVKPRRAHASWLLARLAPGLMQRLSVRFV

SEQ ID NO: 855814 - protein, 18 aa, Mycobacterium
RNLAEWRHHLISRLRREV

SEQ ID NO: 855815 - protein, 27 aa, Mycobacterium
RNLALTAKLRSHWARRLPATIVGRTGE

SEQ ID NO: 855816 - protein, 33 aa, Mycobacterium
RNLAQFLMRHRITMLCIPPSLLALMDAERPELR

SEQ ID NO: 855817 - protein, 23 aa, Mycobacterium
RNLCFLSTLRRSGAPRISPMEPR

SEQ ID NO: 855818 - protein, 28 aa, Mycobacterium
RNLDKARRLLWPVKKKYGRKISWSDLMI

SEQ ID NO: 855819 - protein, 21 aa, Mycobacterium
RNLEIAARRWGVQQDELVVVY

SEQ ID NO: 855820 - protein, 17 aa, Mycobacterium
RNLLDSLGLRTVDYKDT

SEQ ID NO: 855821 - protein, 17 aa, Mycobacterium
RNLLRREHAAPGRYTVR

SEQ ID NO: 855822 - protein, 30 aa, Mycobacterium
RNLLTSDDLPYPRPIPYRDGVPIEYDGGDY

SEQ ID NO: 855823 - protein, 17 aa, Mycobacterium
RNLLWRAASALDANHPD

SEQ ID NO: 855824 - protein, 27 aa, Mycobacterium
RNLPRPVERAFLAAAPVLFAQTADRGA

SEQ ID NO: 855825 - protein, 19 aa, Mycobacterium
RNLRYLIVDECHYYRGVFG

SEQ ID NO: 855826 - protein, 17 aa, Mycobacterium
RNLTADAALARLAEGLR

SEQ ID NO: 855827 - protein, 17 aa, Mycobacterium
RNLWSHHEVAHAPVSPV

SEQ ID NO: 855828 - protein, 21 aa, Mycobacterium
RNMAFYNFPVKLLKRVRDAQR

SEQ ID NO: 855829 - protein, 22 aa, Mycobacterium
RNMPRLIALWPAHDTYVKRTGT

SEQ ID NO: 855830 - protein, 22 aa, Mycobacterium
RNMTMVLAPHRGAKTRARARHP

SEQ ID NO: 855831 - protein, 19 aa, Mycobacterium
RNMVPLSTFLRRNRNLGLL

SEQ ID NO: 855832 - protein, 22 aa, Mycobacterium
RNNDQLLFDGLPWVARAQEEHD

SEQ ID NO: 855833 - protein, 27 aa, Mycobacterium
RNNGAEVTVFWKSHPKLATPDLQICVA

SEQ ID NO: 855834 - protein, 29 aa, Mycobacterium
RNNTPARSFLLRLSGIRALGFSPELVAAV

SEQ ID NO: 855835 - protein, 28 aa, Mycobacterium
RNPAALCYALLAYGFTFRDTNPASALAA

SEQ ID NO: 855836 - protein, 18 aa, Mycobacterium
RNPALLLLHGFPTSSHMF

SEQ ID NO: 855837 - protein, 17 aa, Mycobacterium
RNPAYAAVLRRLSEAGA

SEQ ID NO: 855838 - protein, 18 aa, Mycobacterium
RNPDRVNRMVLLCTAAEL

SEQ ID NO: 855839 - protein, 26 aa, Mycobacterium
RNPDSVTVFALTKLSPGSPAKVADEM

SEQ ID NO: 855840 - protein, 25 aa, Mycobacterium
RNPELMKAFKMSARGGLLLYGPPGC

SEQ ID NO: 855841 - protein, 22 aa, Mycobacterium
RNPFRVFTSMLTVADGRFFSAD

SEQ ID NO: 855842 - protein, 17 aa, Mycobacterium
RNPIGIIIPCHRVIGTN

SEQ ID NO: 855843 - protein, 24 aa, Mycobacterium
RNPKQYLPPNLARLIEYGASPRAT

SEQ ID NO: 855844 - protein, 18 aa, Mycobacterium
RNPKVVWVHNDSGDSARI

SEQ ID NO: 855845 - protein, 21 aa, Mycobacterium
RNPLFQSHMWDGSAVPIDENL

SEQ ID NO: 855846 - protein, 17 aa, Mycobacterium
RNPRFVVDVNLGRLARL

SEQ ID NO: 855847 - protein, 18 aa, Mycobacterium
RNPRLVYARLSAYGGNGP

SEQ ID NO: 855848 - protein, 24 aa, Mycobacterium
RNPSQFLPPQLARVIEYGASPRAT

SEQ ID NO: 855849 - protein, 18 aa, Mycobacterium
RNPVLMNMIGEELPSVPL

SEQ ID NO: 855850 - protein, 19 aa, Mycobacterium
RNPWSLDRIPGGSSGGTGA

SEQ ID NO: 855851 - protein, 20 aa, Mycobacterium
RNQLPAYIRAGWDIGQNITT

SEQ ID NO: 855852 - protein, 22 aa, Mycobacterium
RNQLRIGMFPAVDPDDVSALTQ

SEQ ID NO: 855853 - protein, 23 aa, Mycobacterium
RNQLRVGMFPAIDPDDVSALTQC

SEQ ID NO: 855854 - protein, 23 aa, Mycobacterium
RNQLSFLFGGVIYDLGGTLLGLR

SEQ ID NO: 855855 - protein, 24 aa, Mycobacterium
RNQLSFLFGGVIYDLGGTLLGLRP

SEQ ID NO: 855856 - protein, 22 aa, Mycobacterium
RNQLVSLVLSNLFGQNAPAIAA

SEQ ID NO: 855857 - protein, 21 aa, Mycobacterium
RNQVYVMGRFDLGPDEAFVVD

SEQ ID NO: 855858 - protein, 22 aa, Mycobacterium
RNRALLLDAARRLVAERGADAV

SEQ ID NO: 855859 - protein, 22 aa, Mycobacterium
RNRALLLDAARRLVAQRGADAI

SEQ ID NO: 855860 - protein, 25 aa, Mycobacterium
RNRCYFCKSHLYTAIRELPTCDGAT

SEQ ID NO: 855861 - protein, 23 aa, Mycobacterium
RNRDKPVLFLGDTTLTGGELADR

SEQ ID NO: 855862 - protein, 20 aa, Mycobacterium
RNREPVLTLELPGGEPIPGV

SEQ ID NO: 855863 - protein, 25 aa, Mycobacterium
RNRGAELWRWLQDGAQLYVCGTADP

SEQ ID NO: 855864 - protein, 25 aa, Mycobacterium
RNRGAQLWSWLQDGAQLYVCGTADP

SEQ ID NO: 855865 - protein, 25 aa, Mycobacterium
RNRGLLDVLGALRWVRDNIAAFGGD

SEQ ID NO: 855866 - protein, 21 aa, Mycobacterium
RNRHSLYGKIIRTTSKVKAHD

SEQ ID NO: 855867 - protein, 17 aa, Mycobacterium
RNRIARIAALLDCDLHS

SEQ ID NO: 855868 - protein, 24 aa, Mycobacterium
RNRIDRLMALLLDNSDAFIDAMAA

SEQ ID NO: 855869 - protein, 19 aa, Mycobacterium
RNRIELVAFGGAKLGRNGQ

SEQ ID NO: 855870 - protein, 26 aa, Mycobacterium
RNRIGELIFRFYIGSLFQDNDFCGDP

SEQ ID NO: 855871 - protein, 25 aa, Mycobacterium
RNRIVRRLLAAVDFPVQELVRTEIG

SEQ ID NO: 855872 - protein, 30 aa, Mycobacterium
RNRKQPPLQRLLRALLGLDAKLSQYTRGKA

SEQ ID NO: 855873 - protein, 26 aa, Mycobacterium
RNRPHAVLDGLRLAALMVGAHRAVLY

SEQ ID NO: 855874 - protein, 25 aa, Mycobacterium
RNRSSWNTMFLYGSPSNILSIAVPE

SEQ ID NO: 855875 - protein, 17 aa, Mycobacterium
RNRTAQRWPAGTPVLFP

SEQ ID NO: 855876 - protein, 19 aa, Mycobacterium
RNRVKAAPVLWSQQVLSTG

SEQ ID NO: 855877 - protein, 21 aa, Mycobacterium
RNRVLSERLLTLAWQQRNLPE

SEQ ID NO: 855878 - protein, 24 aa, Mycobacterium
RNRVQALGYLFFVGDRNRTDLPYR

SEQ ID NO: 855879 - protein, 28 aa, Mycobacterium
RNRWGGEDFVRVLSPINFRSLIRADDEV

SEQ ID NO: 855880 - protein, 18 aa, Mycobacterium
RNRWTPLGAYGRAKLAVM

SEQ ID NO: 855881 - protein, 23 aa, Mycobacterium
RNRYWGTPIPVWKSDDPSYPRID

SEQ ID NO: 855882 - protein, 26 aa, Mycobacterium
RNSAKPYLALGLSFRDGGLAPETREL

SEQ ID NO: 855883 - protein, 18 aa, Mycobacterium
RNSPYYPHDGLFAQTGPF

SEQ ID NO: 855884 - protein, 30 aa, Mycobacterium
RNTALFTGFVYLYHPAFVALRRAVATESIA

SEQ ID NO: 855885 - protein, 18 aa, Mycobacterium
RNTALRLPRYRELSGFTE

SEQ ID NO: 855886 - protein, 21 aa, Mycobacterium
RNTDQLLFDGLPWVSRAQEEH

SEQ ID NO: 855887 - protein, 25 aa, Mycobacterium
RNTGLWNSGFGNTGLFNSGSAGVNS

SEQ ID NO: 855888 - protein, 23 aa, Mycobacterium
RNTIDRLLILQDEKVRHRNLIPD

SEQ ID NO: 855889 - protein, 25 aa, Mycobacterium
RNTLTWVQKYIFPGGLLPSTQAIAD

SEQ ID NO: 855890 - protein, 34 aa, Mycobacterium
RNTPHVPIPYVYPVDLRFLLAPPVAPTESTNLLG

SEQ ID NO: 855891 - protein, 25 aa, Mycobacterium
RNTRFGTEVKALWWDEGRRQWQIHA

SEQ ID NO: 855892 - protein, 17 aa, Mycobacterium
RNTVYPSGTPVGNTSGF

SEQ ID NO: 855893 - protein, 18 aa, Mycobacterium
RNVFMWTNQYYDDMAWLA

SEQ ID NO: 855894 - protein, 26 aa, Mycobacterium
RNVGEIELLPITKFFPATDVVILCRL

SEQ ID NO: 855895 - protein, 24 aa, Mycobacterium
RNVHAFLHRALVDAVAWKYITDNP

SEQ ID NO: 855896 - protein, 17 aa, Mycobacterium
RNVIPKPLQQPHPPVWV

SEQ ID NO: 855897 - protein, 26 aa, Mycobacterium
RNVISRLHFALGAQGTLFLGHAEMLL

SEQ ID NO: 855898 - protein, 21 aa, Mycobacterium
RNVLGWSPRWSSEAALADLVD

SEQ ID NO: 855899 - protein, 24 aa, Mycobacterium
RNVLNPLPVVRWNIDKRYLNDLAA

SEQ ID NO: 855900 - protein, 19 aa, Mycobacterium
RNVMPVHGTWRHLRANAAL

SEQ ID NO: 855901 - protein, 19 aa, Mycobacterium
RNVMPVHGTWRHLRANAGL

SEQ ID NO: 855902 - protein, 27 aa, Mycobacterium
RNVMPVHGTWRMLRANAKLAASTGVPE

SEQ ID NO: 855903 - protein, 24 aa, Mycobacterium
RNVNVPLMIIAIGSVPQVSAAAVD

SEQ ID NO: 855904 - protein, 19 aa, Mycobacterium
RNVSRSLIGPVLRAASYSD

SEQ ID NO: 855905 - protein, 19 aa, Mycobacterium
RNVTAVYEVALRRARLSLA

SEQ ID NO: 855906 - protein, 20 aa, Mycobacterium
RNVTQLLEPLDAGLPRAGVW

SEQ ID NO: 855907 - protein, 24 aa, Mycobacterium
RNVVDAYRYWTRPAIVADIDTRRH

SEQ ID NO: 855908 - protein, 17 aa, Mycobacterium
RNVVRPGDRLIDAHEPE

SEQ ID NO: 855909 - protein, 17 aa, Mycobacterium
RNWNHQFDGIRTDTGAE

SEQ ID NO: 855910 - protein, 25 aa, Mycobacterium
RNWSALPLEWPLRGWINGALGVIRP

SEQ ID NO: 855911 - protein, 20 aa, Mycobacterium
RNYDLTSLRFAVTGAATVPV

SEQ ID NO: 855912 - protein, 26 aa, Mycobacterium
RNYLMAKLTKLMRTAFDLNAPALERL

SEQ ID NO: 855913 - protein, 18 aa, Mycobacterium
RNYPPIYTLAVTAALEHY

SEQ ID NO: 855914 - protein, 27 aa, Mycobacterium
RPAALIAALPAILGFVPEKSLVLVSLD

SEQ ID NO: 855915 - protein, 19 aa, Mycobacterium
RPAALPFLSIKKITVHYRP

SEQ ID NO: 855916 - protein, 17 aa, Mycobacterium
RPAALRDVLALPADVNF

SEQ ID NO: 855917 - protein, 18 aa, Mycobacterium
RPAALYRFTEAAYRVTDE

SEQ ID NO: 855918 - protein, 24 aa, Mycobacterium
RPAAPQWFTTVGPDTLLIIDEAGK

SEQ ID NO: 855919 - protein, 18 aa, Mycobacterium
RPAARKRVIGMRKTFQRY

SEQ ID NO: 855920 - protein, 18 aa, Mycobacterium
RPAARRRAGLFLAEGPNL

SEQ ID NO: 855921 - protein, 19 aa, Mycobacterium
RPAATPPHRAPWRRPTHLS

SEQ ID NO: 855922 - protein, 20 aa, Mycobacterium
RPACDIVVDALRRMEYRGYD

SEQ ID NO: 855923 - protein, 30 aa, Mycobacterium
RPADVARIVGLPVLTAMRPQPGIESALERG

SEQ ID NO: 855924 - protein, 25 aa, Mycobacterium
RPAFAVPFKAFAPVLKAAFGRLATD

SEQ ID NO: 855925 - protein, 23 aa, Mycobacterium
RPAFAYWGWRAITDDPDPWNPEV

SEQ ID NO: 855926 - protein, 17 aa, Mycobacterium
RPAFRRRGIARKLLATL

SEQ ID NO: 855927 - protein, 17 aa, Mycobacterium
RPAFVSRSVLVTGGNRG

SEQ ID NO: 855928 - protein, 21 aa, Mycobacterium
RPAGDALILDLPIAPTRSLDA

SEQ ID NO: 855929 - protein, 18 aa, Mycobacterium
RPAGDALILDLPVAPTRS

SEQ ID NO: 855930 - protein, 19 aa, Mycobacterium
RPAGDALILDLPVAPTRSL

SEQ ID NO: 855931 - protein, 24 aa, Mycobacterium
RPAGSFYHPGAKLDWMIATTLLTG

SEQ ID NO: 855932 - protein, 24 aa, Mycobacterium
RPAHLAKGFFYEPTLFVNARNDMR

SEQ ID NO: 855933 - protein, 19 aa, Mycobacterium
RPAINHYFASKGVLWAEVV

SEQ ID NO: 855934 - protein, 18 aa, Mycobacterium
RPAINHYFSSKRALYREV

SEQ ID NO: 855935 - protein, 25 aa, Mycobacterium
RPAKEYRYLLIASPAGAYFKGGVNP

SEQ ID NO: 855936 - protein, 24 aa, Mycobacterium
RPALEPMFNDLRARRFRYNDCDID

SEQ ID NO: 855937 - protein, 25 aa, Mycobacterium
RPALPSPTLNPVRWARAGWNATTAV

SEQ ID NO: 855938 - protein, 21 aa, Mycobacterium
RPALYYYVKSKDDLLARLIAE

SEQ ID NO: 855939 - protein, 29 aa, Mycobacterium
RPANSFVMSFLGPVAKLNGILVRPHDIRV

SEQ ID NO: 855940 - protein, 23 aa, Mycobacterium
RPAPEFETWLRKVGMVDDAGRLT

SEQ ID NO: 855941 - protein, 28 aa, Mycobacterium
RPAPHNMVYVTLLMPLAQGIGMYAALRR

SEQ ID NO: 855942 - protein, 28 aa, Mycobacterium
RPAPNGMVYFTVLLPLAQGIGMYAALKH

SEQ ID NO: 855943 - protein, 28 aa, Mycobacterium
RPAQLERILTITGLLDFLTATPAEASDE

SEQ ID NO: 855944 - protein, 25 aa, Mycobacterium
RPAQMAAFLGVLLSGATVVTINPSR

SEQ ID NO: 855945 - protein, 30 aa, Mycobacterium
RPAQTAGISDFLWLRIMNVPDVLGKRIYSA

SEQ ID NO: 855946 - protein, 19 aa, Mycobacterium
RPARPHLTFSVGAHFCLGS

SEQ ID NO: 855947 - protein, 23 aa, Mycobacterium
RPARSWCWVEYAGNMLTPELLDA

SEQ ID NO: 855948 - protein, 24 aa, Mycobacterium
RPATVFVASFIGQANLWAGRQTGR

SEQ ID NO: 855949 - protein, 25 aa, Mycobacterium
RPAVEDWLYWRYVTGLLDSALTAAS

SEQ ID NO: 855950 - protein, 32 aa, Mycobacterium
RPAVLPLSFAQSRLWFIDQLHGPSPVYNMAAA

SEQ ID NO: 855951 - protein, 19 aa, Mycobacterium
RPAVRLWVDGVLAGRYSRT

SEQ ID NO: 855952 - protein, 34 aa, Mycobacterium
RPAVVPLSFAQSRLWFLHQLSGPSPVYNMAVALR

SEQ ID NO: 855953 - protein, 23 aa, Mycobacterium
RPAWDLSCLTFILNGGEPIIADQ

SEQ ID NO: 855954 - protein, 18 aa, Mycobacterium
RPAWDTDRWLRDFFGPAA

SEQ ID NO: 855955 - protein, 19 aa, Mycobacterium
RPAWDTDRWLRDFFGPAAA

SEQ ID NO: 855956 - protein, 30 aa, Mycobacterium
RPAWGTWDPDRLLRDFFGPAAATDWYKPAT

SEQ ID NO: 855957 - protein, 21 aa, Mycobacterium
RPAWSTDRWLRDFFGPAAASD

SEQ ID NO: 855958 - protein, 27 aa, Mycobacterium
RPAYRELLQEFLFGLSLDDETRRRAEI

SEQ ID NO: 855959 - protein, 26 aa, Mycobacterium
RPAYRELLQEFLFKLDLDEETRRRAE

SEQ ID NO: 855960 - protein, 19 aa, Mycobacterium
RPCLLGYIDKCSAPCVGRV

SEQ ID NO: 855961 - protein, 29 aa, Mycobacterium
RPDAAYALHVFSTLGPAGTFFSRPGVALA

SEQ ID NO: 855962 - protein, 28 aa, Mycobacterium
RPDADLPGHWLLARLGKRVLRPGGVELT

SEQ ID NO: 855963 - protein, 25 aa, Mycobacterium
RPDAFPLLLTHGWPGSIVEFHKVIE

SEQ ID NO: 855964 - protein, 24 aa, Mycobacterium
RPDARILLCSSVSGVWGGYGHAGY

SEQ ID NO: 855965 - protein, 22 aa, Mycobacterium
RPDDEDFWATKWARAYVEFAAG

SEQ ID NO: 855966 - protein, 21 aa, Mycobacterium
RPDEILAIGGALIDAGFTAIE

SEQ ID NO: 855967 - protein, 20 aa, Mycobacterium
RPDEWLQWLHAEHYPALLAT

SEQ ID NO: 855968 - protein, 24 aa, Mycobacterium
RPDGFAHRLLSFDVKVTVLVGGVG

SEQ ID NO: 855969 - protein, 25 aa, Mycobacterium
RPDGKPLHPSWLPRQRRGTTPQMIG

SEQ ID NO: 855970 - protein, 22 aa, Mycobacterium
RPDGKWVLNGTKYYATGALGAA

SEQ ID NO: 855971 - protein, 25 aa, Mycobacterium
RPDGLRDIGYLTDLLYREGITSMHF

SEQ ID NO: 855972 - protein, 26 aa, Mycobacterium
RPDGLTVPRPAVFFDFDGTLSEIVDD

SEQ ID NO: 855973 - protein, 27 aa, Mycobacterium
RPDGQIMMGPYTLPPYNVGEPVTIQRQ

SEQ ID NO: 855974 - protein, 19 aa, Mycobacterium
RPDGWWAKCSRHGLVDSTD

SEQ ID NO: 855975 - protein, 25 aa, Mycobacterium
RPDHATLYVARWLHPGQRAFQIATQ

SEQ ID NO: 855976 - protein, 24 aa, Mycobacterium
RPDHGITIGFVFRALTGESELLPE

SEQ ID NO: 855977 - protein, 21 aa, Mycobacterium
RPDIIHVALRRAGVGSTRAVF

SEQ ID NO: 855978 - protein, 25 aa, Mycobacterium
RPDIIKVVPNLPLSASYRPSTTHLR

SEQ ID NO: 855979 - protein, 30 aa, Mycobacterium
RPDIMAWKHRKLIMNLGNGVTAIFRPGPAA

SEQ ID NO: 855980 - protein, 19 aa, Mycobacterium
RPDIWHRYELRAANHNDSR

SEQ ID NO: 855981 - protein, 34 aa, Mycobacterium
RPDLDGNQIMRLLDIPAGPLVGEAWRYLKELRLD

SEQ ID NO: 855982 - protein, 18 aa, Mycobacterium
RPDLIAALVLLDPAVGLD

SEQ ID NO: 855983 - protein, 26 aa, Mycobacterium
RPDLIDPALLRPGRLEKLVFVEPPDA

SEQ ID NO: 855984 - protein, 32 aa, Mycobacterium
RPDLIDPALLRPGRLERLVFVEPPDAAARRDI

SEQ ID NO: 855985 - protein, 26 aa, Mycobacterium
RPDLLAFTNFPKQIWRQIWSNNPQER

SEQ ID NO: 855986 - protein, 24 aa, Mycobacterium
RPDLRVPLITIITETDLFGGVRQG

SEQ ID NO: 855987 - protein, 19 aa, Mycobacterium
RPDLVKSLVLLDPAIGLDG

SEQ ID NO: 855988 - protein, 28 aa, Mycobacterium
RPDLVPGGPWFQWHHDRWTLPPGATEIA

SEQ ID NO: 855989 - protein, 26 aa, Mycobacterium
RPDLVSHITYLAAALPREGRTYPEAM

SEQ ID NO: 855990 - protein, 18 aa, Mycobacterium
RPDPSNPGLVLGYGQLKP

SEQ ID NO: 855991 - protein, 25 aa, Mycobacterium
RPDREPPHPSWLPKQRRGITPQMIG

SEQ ID NO: 855992 - protein, 25 aa, Mycobacterium
RPDRHRIHQPRLQPLPAVAASRAGR

SEQ ID NO: 855993 - protein, 24 aa, Mycobacterium
RPDRPGVGFLLRHGATDQVLLSGT

SEQ ID NO: 855994 - protein, 25 aa, Mycobacterium
RPDRPVEPLPLPAAMADARALRNEF

SEQ ID NO: 855995 - protein, 20 aa, Mycobacterium
RPDRRLLKRSEIAQLTVVGS

SEQ ID NO: 855996 - protein, 29 aa, Mycobacterium
RPDRTFSLGSWWSGVAWSTIKVPLAVAAL

SEQ ID NO: 855997 - protein, 24 aa, Mycobacterium
RPDRTYSLGRWWSGVAWSTIKVPL

SEQ ID NO: 855998 - protein, 19 aa, Mycobacterium
RPDRWLEWLHAEHYPALLA

SEQ ID NO: 855999 - protein, 29 aa, Mycobacterium
RPDRWPLPAAITPRQLWLRAVAAGGQGRY

SEQ ID NO: 856000 - protein, 19 aa, Mycobacterium
RPDSKTVFMVLRDPAADMS

SEQ ID NO: 856001 - protein, 20 aa, Mycobacterium
RPDSSIFGLSWAMAAPAWVA

SEQ ID NO: 856002 - protein, 25 aa, Mycobacterium
RPDTHPFRWIAAAVRSLIPAGEPVG

SEQ ID NO: 856003 - protein, 41 aa, Mycobacterium
RPDTKVWTFTGPRPGGWWLRRRLHEVVVHRADAALALGADL

SEQ ID NO: 856004 - protein, 22 aa, Mycobacterium
RPDTPVWHRLQTDYLDNLAAAG

SEQ ID NO: 856005 - protein, 22 aa, Mycobacterium
RPDTWLQWLHAEHYPALLASPG

SEQ ID NO: 856006 - protein, 29 aa, Mycobacterium
RPDVATGLMPLRWGTGYMLGSTRFGPFGR

SEQ ID NO: 856007 - protein, 17 aa, Mycobacterium
RPDVAVTILRLANLIGP

SEQ ID NO: 856008 - protein, 26 aa, Mycobacterium
RPDVIVLGLARGGIPVAWEVAAALHA

SEQ ID NO: 856009 - protein, 22 aa, Mycobacterium
RPDVLCTALIRGAFDYQGQKCS

SEQ ID NO: 856010 - protein, 20 aa, Mycobacterium
RPDVRRMPLFGLGCAAGAAG

SEQ ID NO: 856011 - protein, 29 aa, Mycobacterium
RPDVVIGIGIPIRNPLPAPPRAAFQPGVH

SEQ ID NO: 856012 - protein, 22 aa, Mycobacterium
RPDVVMLRMPGFGLDGPWRDNP

SEQ ID NO: 856013 - protein, 21 aa, Mycobacterium
RPEAPRRPGPPPPATTWRSPS

SEQ ID NO: 856014 - protein, 20 aa, Mycobacterium
RPEAYALRWSDHAPVTVEFS

SEQ ID NO: 856015 - protein, 20 aa, Mycobacterium
RPEDIDPYIPFGNAPNFAAG

SEQ ID NO: 856016 - protein, 31 aa, Mycobacterium
RPEDPVLAGGYFYRPTIFDRCDRSMRIVQEE

SEQ ID NO: 856017 - protein, 26 aa, Mycobacterium
RPEECQRLGLPVFVKPARGGSSIGVS

SEQ ID NO: 856018 - protein, 26 aa, Mycobacterium
RPEETRYWYYALRGCGLNRYRAGSGQ

SEQ ID NO: 856019 - protein, 18 aa, Mycobacterium
RPEFADRAQILAIATDWL

SEQ ID NO: 856020 - protein, 23 aa, Mycobacterium
RPEFLNRIDDIIVFHQLTRDEII

SEQ ID NO: 856021 - protein, 22 aa, Mycobacterium
RPEFLNRIDDIIVFHQLTREEI

SEQ ID NO: 856022 - protein, 33 aa, Mycobacterium
RPEFRVLRQAATAVRYWLIQLAKAVTALSQSLA

SEQ ID NO: 856023 - protein, 26 aa, Mycobacterium
RPEGFQWRGLYVERLCLAVPRGHRLA

SEQ ID NO: 856024 - protein, 27 aa, Mycobacterium
RPEIAEQLLRVLARRLRRTNDNLSDLI

SEQ ID NO: 856025 - protein, 21 aa, Mycobacterium
RPEILLSFGFVPKMESRVGLI

SEQ ID NO: 856026 - protein, 19 aa, Mycobacterium
RPEIWDEFTKRFGIARVCE

SEQ ID NO: 856027 - protein, 25 aa, Mycobacterium
RPEKYRTFWTQFGRVLKEGLLSDTD

SEQ ID NO: 856028 - protein, 21 aa, Mycobacterium
RPELDLARIGIATQAFIGLEV

SEQ ID NO: 856029 - protein, 18 aa, Mycobacterium
RPELFTLSAERLLEMAKA

SEQ ID NO: 856030 - protein, 19 aa, Mycobacterium
RPELLAELSRQFGSQCIVL

SEQ ID NO: 856031 - protein, 25 aa, Mycobacterium
RPELQSLARLWPEGLVALLEPRIGR

SEQ ID NO: 856032 - protein, 21 aa, Mycobacterium
RPELRQLERLFFECYSRAAQG

SEQ ID NO: 856033 - protein, 17 aa, Mycobacterium
RPELVTAAVFMGTRGRE

SEQ ID NO: 856034 - protein, 24 aa, Mycobacterium
RPEMLLHAILKLHEKIAHMPLGAN

SEQ ID NO: 856035 - protein, 24 aa, Mycobacterium
RPEMLLHAILKLHEKIQEMPLGVN

SEQ ID NO: 856036 - protein, 25 aa, Mycobacterium
RPEMLLHAILKLHEKIQEMPLGVNR

SEQ ID NO: 856037 - protein, 20 aa, Mycobacterium
RPEPALLLLADLRRVHRIAA

SEQ ID NO: 856038 - protein, 19 aa, Mycobacterium
RPEPFGALLYHFGTRKLSF

SEQ ID NO: 856039 - protein, 23 aa, Mycobacterium
RPEPVLVPALLDTNALRAQAHAG

SEQ ID NO: 856040 - protein, 20 aa, Mycobacterium
RPEQPVPIYVSAFGPQAVEV

SEQ ID NO: 856041 - protein, 21 aa, Mycobacterium
RPEQPVPIYVSGFGPKGVELA

SEQ ID NO: 856042 - protein, 24 aa, Mycobacterium
RPETAQFPTGLRIASRLSRRVPSI

SEQ ID NO: 856043 - protein, 25 aa, Mycobacterium
RPETESLLEWALAQPLSGSARIVDL

SEQ ID NO: 856044 - protein, 27 aa, Mycobacterium
RPEVVPLSFAQSRLWFLDQLHGCSPVH

SEQ ID NO: 856045 - protein, 20 aa, Mycobacterium
RPEWLVRAVRAYVRDDRTGP

SEQ ID NO: 856046 - protein, 19 aa, Mycobacterium
RPFAKAAYRINRVEDIGLG

SEQ ID NO: 856047 - protein, 18 aa, Mycobacterium
RPFAKAAYRINRVEDVGL

SEQ ID NO: 856048 - protein, 18 aa, Mycobacterium
RPFDLAADRPLRVTLLRL

SEQ ID NO: 856049 - protein, 29 aa, Mycobacterium
RPFDLTRELPLRISLIRTGADEFVLLLVV

SEQ ID NO: 856050 - protein, 17 aa, Mycobacterium
RPFDPGLDPQRLAEQAS

SEQ ID NO: 856051 - protein, 17 aa, Mycobacterium
RPFFADPLRRHDIAPIT

SEQ ID NO: 856052 - protein, 19 aa, Mycobacterium
RPFFELLARVQAVDPRTVV

SEQ ID NO: 856053 - protein, 21 aa, Mycobacterium
RPFGVYIHVPFCITRCGYCDF

SEQ ID NO: 856054 - protein, 29 aa, Mycobacterium
RPFHGAEVSLRWIYLHMIGEYARHNGHAD

SEQ ID NO: 856055 - protein, 21 aa, Mycobacterium
RPFHMTAFTIFQKPKGQHSSF

SEQ ID NO: 856056 - protein, 21 aa, Mycobacterium
RPFHPQRLHAALDLLLDGVIR

SEQ ID NO: 856057 - protein, 20 aa, Mycobacterium
RPFHPVRLHAAIDLLLDGVV

SEQ ID NO: 856058 - protein, 27 aa, Mycobacterium
RPFIDQTTILLAPYFRQLLTEEQLASI

SEQ ID NO: 856059 - protein, 18 aa, Mycobacterium
RPFSHWYVAKYDRCILSP

SEQ ID NO: 856060 - protein, 18 aa, Mycobacterium
RPFSPFLSDRSATLPGVW

SEQ ID NO: 856061 - protein, 33 aa, Mycobacterium
RPFTVTRPDGLPVWIYQFKVSPHRGIPQAPPGP

SEQ ID NO: 856062 - protein, 26 aa, Mycobacterium
RPGAPAMIHVDMYRLLDTDGADLLGE

SEQ ID NO: 856063 - protein, 20 aa, Mycobacterium
RPGDPPLVGSLLIGGDGRVV

SEQ ID NO: 856064 - protein, 19 aa, Mycobacterium
RPGDTIDLPSASYLHLFVA

SEQ ID NO: 856065 - protein, 26 aa, Mycobacterium
RPGDWARHNWIPFSRFRGLDRVRTVH

SEQ ID NO: 856066 - protein, 25 aa, Mycobacterium
RPGEGADLPLWLFGSSKGESAQVAA

SEQ ID NO: 856067 - protein, 21 aa, Mycobacterium
RPGFEVVLPPPAPLDPIDEPE

SEQ ID NO: 856068 - protein, 21 aa, Mycobacterium
RPGFGFGPGPAQRRALHSARR

SEQ ID NO: 856069 - protein, 17 aa, Mycobacterium
RPGGRLGLVWNTRDERL

SEQ ID NO: 856070 - protein, 19 aa, Mycobacterium
RPGGRLGLVWNTRDERLGW

SEQ ID NO: 856071 - protein, 22 aa, Mycobacterium
RPGGRLGLVWNTRDERLGWVRE

SEQ ID NO: 856072 - protein, 22 aa, Mycobacterium
RPGGRLGLVWNVRDERLGWVKD

SEQ ID NO: 856073 - protein, 24 aa, Mycobacterium
RPGGRLGLVWNVRDERLGWVSDLG

SEQ ID NO: 856074 - protein, 22 aa, Mycobacterium
RPGHRRIVLRFLTSPIEIKGDG

SEQ ID NO: 856075 - protein, 28 aa, Mycobacterium
RPGLDLPDLELIFAPAPFYDEGLPAHPP

SEQ ID NO: 856076 - protein, 24 aa, Mycobacterium
RPGLELVAAPWFSKAPTTDLVAGA

SEQ ID NO: 856077 - protein, 19 aa, Mycobacterium
RPGLITKVGLGTFCDPRQG

SEQ ID NO: 856078 - protein, 18 aa, Mycobacterium
RPGLLRVATRRPLASSDS

SEQ ID NO: 856079 - protein, 30 aa, Mycobacterium
RPGMELACWDLLIYYLRDLAQSYPDLLHLD

SEQ ID NO: 856080 - protein, 29 aa, Mycobacterium
RPGMFTHWGAGFKFGASLLGLPVGDHPAR

SEQ ID NO: 856081 - protein, 20 aa, Mycobacterium
RPGNIWQTVEIPRLMDNPNV

SEQ ID NO: 856082 - protein, 17 aa, Mycobacterium
RPGPAPAAPVVGTMQSL

SEQ ID NO: 856083 - protein, 31 aa, Mycobacterium
RPGPFNSMASFLWWKLEPAIAELERLDGTVV

SEQ ID NO: 856084 - protein, 18 aa, Mycobacterium
RPGPIFTNLLLADEINRT

SEQ ID NO: 856085 - protein, 27 aa, Mycobacterium
RPGPKGFLDFPIPIGGLYLGGAGCHGG

SEQ ID NO: 856086 - protein, 21 aa, Mycobacterium
RPGPLSNVLIRRDGTVAVVAA

SEQ ID NO: 856087 - protein, 17 aa, Mycobacterium
RPGPPPPATTWRSPSPP

SEQ ID NO: 856088 - protein, 20 aa, Mycobacterium
RPGPVLIDLPLDVQLAEIEF

SEQ ID NO: 856089 - protein, 20 aa, Mycobacterium
RPGQDWALLLAMVAVILGEG

SEQ ID NO: 856090 - protein, 25 aa, Mycobacterium
RPGQRSFALDDLSLRYLRRELRAED

SEQ ID NO: 856091 - protein, 20 aa, Mycobacterium
RPGRLVGPDPGLLVSAYAGV

SEQ ID NO: 856092 - protein, 18 aa, Mycobacterium
RPGRRDICIYARESHVLV

SEQ ID NO: 856093 - protein, 20 aa, Mycobacterium
RPGRWRRWDWASDAPDGWHV

SEQ ID NO: 856094 - protein, 21 aa, Mycobacterium
RPGSDSLLRMRLDLAECATGV

SEQ ID NO: 856095 - protein, 25 aa, Mycobacterium
RPGVGKALALDTPLPTPSGWTTMGD

SEQ ID NO: 856096 - protein, 26 aa, Mycobacterium
RPGVGKALALETPLPTPAGWTTMGDV

SEQ ID NO: 856097 - protein, 21 aa, Mycobacterium
RPGVGLLLRHGATDQVLLSGT

SEQ ID NO: 856098 - protein, 19 aa, Mycobacterium
RPGVLFRSSELSGLTPAGA

SEQ ID NO: 856099 - protein, 21 aa, Mycobacterium
RPGVREQLLAAVLLEALAAGG

SEQ ID NO: 856100 - protein, 25 aa, Mycobacterium
RPGWRGRIGLHQLYPLLAHVVLFGG

SEQ ID NO: 856101 - protein, 24 aa, Mycobacterium
RPGYEWPGHKPGQYVRLGVVIDGV

SEQ ID NO: 856102 - protein, 24 aa, Mycobacterium
RPGYEWPGHQPGQYVRLGVVIDGV

SEQ ID NO: 856103 - protein, 25 aa, Mycobacterium
RPHDDLIVITPFVPEAAIALPQEDW

SEQ ID NO: 856104 - protein, 24 aa, Mycobacterium
RPHDPPWCRPLLGVRRGVTHDACR

SEQ ID NO: 856105 - protein, 21 aa, Mycobacterium
RPHEAMADLIRFLSAGTNVVG

SEQ ID NO: 856106 - protein, 22 aa, Mycobacterium
RPHLATTLLPALLEALVRNVSR

SEQ ID NO: 856107 - protein, 22 aa, Mycobacterium
RPHLATTLLPGLLEALSRNVSR

SEQ ID NO: 856108 - protein, 17 aa, Mycobacterium
RPHLAVAAGRVGAVSGL

SEQ ID NO: 856109 - protein, 17 aa, Mycobacterium
RPHLCFDTFNAAQKMTL

SEQ ID NO: 856110 - protein, 24 aa, Mycobacterium
RPHLGDPLPFGEPALAGGALGSIA

SEQ ID NO: 856111 - protein, 19 aa, Mycobacterium
RPHPDDPMYLVFTSGSTGK

SEQ ID NO: 856112 - protein, 18 aa, Mycobacterium
RPHPLFVAFVGAAVEYNN

SEQ ID NO: 856113 - protein, 34 aa, Mycobacterium
RPHRYTYAETGKPGWFLFDGLVKHDLHTGTEQRF

SEQ ID NO: 856114 - protein, 27 aa, Mycobacterium
RPHTKLDLIRYYLSVAEGALRGVAGRP

SEQ ID NO: 856115 - protein, 20 aa, Mycobacterium
RPHVHLAARPGVLTAAELAA

SEQ ID NO: 856116 - protein, 25 aa, Mycobacterium
RPHVVLLDLHLPDMALPEAAAALRG

SEQ ID NO: 856117 - protein, 21 aa, Mycobacterium
RPHVWMRRQINPFDALAAATK

SEQ ID NO: 856118 - protein, 18 aa, Mycobacterium
RPHWDNLLLLVTSDHDQE

SEQ ID NO: 856119 - protein, 22 aa, Mycobacterium
RPIALLLKYFARAHIWVYRRTD

SEQ ID NO: 856120 - protein, 20 aa, Mycobacterium
RPIDFWPANTTVNIDASGTK

SEQ ID NO: 856121 - protein, 17 aa, Mycobacterium
RPIDPWGGSYYVEWLTY

SEQ ID NO: 856122 - protein, 19 aa, Mycobacterium
RPIEIYRGKPILYGCGDVI

SEQ ID NO: 856123 - protein, 24 aa, Mycobacterium
RPIELWRSAGWLTPYGARAVSAAT

SEQ ID NO: 856124 - protein, 20 aa, Mycobacterium
RPIEQWVLGSPVTVDLGGAV

SEQ ID NO: 856125 - protein, 20 aa, Mycobacterium
RPIFVTGLPRTGTTAVHRLL

SEQ ID NO: 856126 - protein, 17 aa, Mycobacterium
RPIGGKARFGKPHGWNC

SEQ ID NO: 856127 - protein, 20 aa, Mycobacterium
RPIGRIEGWGHRTVGLGLRQ

SEQ ID NO: 856128 - protein, 22 aa, Mycobacterium
RPIGWDEAYRLIAEHLKALGSP

SEQ ID NO: 856129 - protein, 21 aa, Mycobacterium
RPIKLMGIDSVLALYSSLDGA

SEQ ID NO: 856130 - protein, 17 aa, Mycobacterium
RPILLWHALEESEHKAV

SEQ ID NO: 856131 - protein, 17 aa, Mycobacterium
RPIVERPDLRVILTGAG

SEQ ID NO: 856132 - protein, 17 aa, Mycobacterium
RPKIELPDLGALKISVD

SEQ ID NO: 856133 - protein, 27 aa, Mycobacterium
RPKINTQVYLLDNALRLVPAGVIGEIY

SEQ ID NO: 856134 - protein, 21 aa, Mycobacterium
RPKTTLGFLKPQVAIIGHGDV

SEQ ID NO: 856135 - protein, 23 aa, Mycobacterium
RPKVLLLDEPSMGLAPMVISQIF

SEQ ID NO: 856136 - protein, 26 aa, Mycobacterium
RPKVTATFFNPKWLKKTLVEGTKVML

SEQ ID NO: 856137 - protein, 25 aa, Mycobacterium
RPLAEWVSRFAGMDGQWAIAQDPWE

SEQ ID NO: 856138 - protein, 24 aa, Mycobacterium
RPLATLEKMFIPPSGFHVVPVLAY

SEQ ID NO: 856139 - protein, 24 aa, Mycobacterium
RPLDGFVYAITPFNFTSIAGNLPT

SEQ ID NO: 856140 - protein, 25 aa, Mycobacterium
RPLEGFVYAITPFNFTAIAANLPTA

SEQ ID NO: 856141 - protein, 20 aa, Mycobacterium
RPLEPAGVWQAIKALFETFA

SEQ ID NO: 856142 - protein, 21 aa, Mycobacterium
RPLGKALLYGPGDTWSRLGAA

SEQ ID NO: 856143 - protein, 25 aa, Mycobacterium
RPLGQVMMGPWTLPPYNTGEPVVIE

SEQ ID NO: 856144 - protein, 17 aa, Mycobacterium
RPLIVANRSRRQSLAAG

SEQ ID NO: 856145 - protein, 19 aa, Mycobacterium
RPLKLTSPEATGLLVALRA

SEQ ID NO: 856146 - protein, 17 aa, Mycobacterium
RPLLAHPGGPLMIKDGT

SEQ ID NO: 856147 - protein, 21 aa, Mycobacterium
RPLLDFTPGYVLRALDHLPKA

SEQ ID NO: 856148 - protein, 17 aa, Mycobacterium
RPLLPRPDAASGRIACA

SEQ ID NO: 856149 - protein, 21 aa, Mycobacterium
RPLNRLRTVPEGTLRMVLDNP

SEQ ID NO: 856150 - protein, 19 aa, Mycobacterium
RPLPAHRWLGVRCPDDPCP

SEQ ID NO: 856151 - protein, 20 aa, Mycobacterium
RPLPGRRNVVLSRQPGFVAE

SEQ ID NO: 856152 - protein, 34 aa, Mycobacterium
RPLPTLMVKGLLGMFNYSYLWLTLDGPESPEDIA

SEQ ID NO: 856153 - protein, 21 aa, Mycobacterium
RPLREWLAALTDGIALLTRVD

SEQ ID NO: 856154 - protein, 24 aa, Mycobacterium
RPLRGSYRVAFLSLKGGVGKTTIA

SEQ ID NO: 856155 - protein, 20 aa, Mycobacterium
RPLRPSFVNGLRNEIQVVVT

SEQ ID NO: 856156 - protein, 18 aa, Mycobacterium
RPLRPSFVSGLRNEIQVV

SEQ ID NO: 856157 - protein, 19 aa, Mycobacterium
RPLRPSFVSGLRNEIQVVV

SEQ ID NO: 856158 - protein, 18 aa, Mycobacterium
RPLRPTFISGLRNEIQVV

SEQ ID NO: 856159 - protein, 36 aa, Mycobacterium
RPLRVLEIGAGRGYLTWPVIHALRGLPPGAVEYHVT

SEQ ID NO: 856160 - protein, 18 aa, Mycobacterium
RPLSSPHPPIWIGGNTTA

SEQ ID NO: 856161 - protein, 28 aa, Mycobacterium
RPLTAAELRLLPHLATHLSLQRIAEELV

SEQ ID NO: 856162 - protein, 27 aa, Mycobacterium
RPLTARHDVLWPMIADMPALGTGEQRG

SEQ ID NO: 856163 - protein, 24 aa, Mycobacterium
RPLTDACEIMLLLKDNLAAHHREL

SEQ ID NO: 856164 - protein, 36 aa, Mycobacterium; identical to SEQ ID NO: 222451

SEQ ID NO: 856165 - protein, 18 aa, Mycobacterium
RPLTVAVLLRITEVFGVD

SEQ ID NO: 856166 - protein, 19 aa, Mycobacterium
RPLTVAVLLRITEVFGVDA

SEQ ID NO: 856167 - protein, 28 aa, Mycobacterium
RPLTVAVLLRITEVFGVDATFFSSQDDS

SEQ ID NO: 856168 - protein, 21 aa, Mycobacterium
RPLTVPLVRDGGVVAKPSVAA

SEQ ID NO: 856169 - protein, 17 aa, Mycobacterium
RPLVDLLVAAGADVRAV

SEQ ID NO: 856170 - protein, 17 aa, Mycobacterium
RPLVRPQAPARYLPDRH

SEQ ID NO: 856171 - protein, 18 aa, Mycobacterium
RPLWDAWVVQGLADGRLV

SEQ ID NO: 856172 - protein, 20 aa, Mycobacterium
RPLWEMWVIETGDTNRLVVM

SEQ ID NO: 856173 - protein, 31 aa, Mycobacterium
RPMADTVLRYELMGRLLPNSMFLQAAERDLI

SEQ ID NO: 856174 - protein, 17 aa, Mycobacterium
RPMELLGLTATPERGDG

SEQ ID NO: 856175 - protein, 27 aa, Mycobacterium
RPMKIPTPAARWAFCNGMTPAQRRLTM

SEQ ID NO: 856176 - protein, 19 aa, Mycobacterium
RPMRGCYRIALVSLKGGVG

SEQ ID NO: 856177 - protein, 20 aa, Mycobacterium
RPMSAMLHGAVMEGSWGSEA

SEQ ID NO: 856178 - protein, 23 aa, Mycobacterium
RPMTRYFPELVAAALTELPDRCV

SEQ ID NO: 856179 - protein, 17 aa, Mycobacterium
RPMTRYFPELVAAVRAE

SEQ ID NO: 856180 - protein, 23 aa, Mycobacterium
RPNARNLIFRPLGNTSPQARKHG

SEQ ID NO: 856181 - protein, 27 aa, Mycobacterium
RPNGLRLRQIRVPLGVVGMVYEGRPNV

SEQ ID NO: 856182 - protein, 18 aa, Mycobacterium
RPNGPLPNLLTRLEPLLA

SEQ ID NO: 856183 - protein, 18 aa, Mycobacterium
RPNGQVVSILPPPLARSA

SEQ ID NO: 856184 - protein, 17 aa, Mycobacterium
RPNIVITTPPDYPAYSE

SEQ ID NO: 856185 - protein, 18 aa, Mycobacterium
RPNPFPTMSIRDNVVAGL

SEQ ID NO: 856186 - protein, 21 aa, Mycobacterium
RPNRPGWFLSPAVVAATNDME

SEQ ID NO: 856187 - protein, 20 aa, Mycobacterium
RPNVREHIAFGRGIHTCAGA

SEQ ID NO: 856188 - protein, 23 aa, Mycobacterium
RPPDWDQWWEWGPVFLCSNNNKR

SEQ ID NO: 856189 - protein, 21 aa, Mycobacterium
RPPEILQRRILRKDPSRARVV

SEQ ID NO: 856190 - protein, 29 aa, Mycobacterium
RPPGAPRYVALPYLDRMDLAYAAADIAVC

SEQ ID NO: 856191 - protein, 24 aa, Mycobacterium
RPPHERIMWLSVPLCGPSRTGDLP

SEQ ID NO: 856192 - protein, 24 aa, Mycobacterium
RPPHVGVLLENTPFFSAMLVAAGM

SEQ ID NO: 856193 - protein, 21 aa, Mycobacterium
RPPIGLVVLDRAPASIVAAAL

SEQ ID NO: 856194 - protein, 20 aa, Mycobacterium
RPPNWIPWEERIRPGDLGPG

SEQ ID NO: 856195 - protein, 19 aa, Mycobacterium
RPPQPGAPRIDIAAIPDLS

SEQ ID NO: 856196 - protein, 20 aa, Mycobacterium
RPPRLVRLAHRGGGRKGKKV

SEQ ID NO: 856197 - protein, 21 aa, Mycobacterium
RPPRVAPTAAPPPPPVAPTQA

SEQ ID NO: 856198 - protein, 18 aa, Mycobacterium
RPPSLLAVEPPDHTRYRK

SEQ ID NO: 856199 - protein, 18 aa, Mycobacterium
RPPVPPPTDLDEDDFYQF

SEQ ID NO: 856200 - protein, 18 aa, Mycobacterium
RPPVPYVLGNPSAAARRA

SEQ ID NO: 856201 - protein, 25 aa, Mycobacterium
RPQAMALGMMLLSPVVFGGVTGMSA

SEQ ID NO: 856202 - protein, 23 aa, Mycobacterium
RPQEWLDQRFVPPPAVGERMAHD

SEQ ID NO: 856203 - protein, 24 aa, Mycobacterium
RPQFRRRGLARRLLATLAAECLDN

SEQ ID NO: 856204 - protein, 25 aa, Mycobacterium
RPQGILYAGFSPLYYSPYGDHGRTG

SEQ ID NO: 856205 - protein, 17 aa, Mycobacterium
RPQISLGPLPVADQLRD

SEQ ID NO: 856206 - protein, 24 aa, Mycobacterium
RPQLAEDVARFVRRRIFDGTYPAG

SEQ ID NO: 856207 - protein, 17 aa, Mycobacterium
RPQLAEDVARLIRRRIF

SEQ ID NO: 856208 - protein, 23 aa, Mycobacterium
RPQLATTLLPALLEALGRNVSRG

SEQ ID NO: 856209 - protein, 25 aa, Mycobacterium
RPQLATTLLPALLEALGRNVSRGLA

SEQ ID NO: 856210 - protein, 17 aa, Mycobacterium
RPQLSDDVARYVRKRIY

SEQ ID NO: 856211 - protein, 26 aa, Mycobacterium
RPQMRQRCVQSRLLRIGPWFSQNLRC

SEQ ID NO: 856212 - protein, 31 aa, Mycobacterium
RPQRDRFANLLLRWLPRTVALPVIRAKNISL

SEQ ID NO: 856213 - protein, 17 aa, Mycobacterium
RPQRFQVTASRFGRSVD

SEQ ID NO: 856214 - protein, 24 aa, Mycobacterium
RPQRWRWRAINGGNHRVLAVSSEA

SEQ ID NO: 856215 - protein, 20 aa, Mycobacterium
RPQVHLAARPGVLTAAALAD

SEQ ID NO: 856216 - protein, 20 aa, Mycobacterium
RPQVHLAARPGVLTAAELAE

SEQ ID NO: 856217 - protein, 17 aa, Mycobacterium
RPQWRRRVLGPDSPVSG

SEQ ID NO: 856218 - protein, 27 aa, Mycobacterium
RPQYRELLQEFLFGLDLDDDTRRRAAL

SEQ ID NO: 856219 - protein, 26 aa, Mycobacterium
RPQYRELLQEFLFGLDLDDETRRRAE

SEQ ID NO: 856220 - protein, 25 aa, Mycobacterium
RPQYRELLQEFLFGLDLDEATRERA

SEQ ID NO: 856221 - protein, 27 aa, Mycobacterium
RPQYRELLQEFLFGLDLDEETRRRAQL

SEQ ID NO: 856222 - protein, 22 aa, Mycobacterium
RPRDLKHGYLPMLHGHCLANYT

SEQ ID NO: 856223 - protein, 22 aa, Mycobacterium
RPRDLKLRVISWGAAPAPDALL

SEQ ID NO: 856224 - protein, 25 aa, Mycobacterium
RPREISLPVMGLIEAGARTPSRLQP

SEQ ID NO: 856225 - protein, 35 aa, Mycobacterium
RPRELMRKIVIELLAWQFASPVRWIETQDLLFIEE

SEQ ID NO: 856226 - protein, 34 aa, Mycobacterium
RPREYWRGPVWPVMTWLFSWCFARRGWAERARLL

SEQ ID NO: 856227 - protein, 20 aa, Mycobacterium
RPRFMVFGEIALRAHALAAK

SEQ ID NO: 856228 - protein, 22 aa, Mycobacterium
RPRFSPPEAALGLPAQDATPAP

SEQ ID NO: 856229 - protein, 24 aa, Mycobacterium
RPRGAPRGLLLDAARARFARQDYR

SEQ ID NO: 856230 - protein, 23 aa, Mycobacterium
RPRGPALLEYVADYRRRAGVTAE

SEQ ID NO: 856231 - protein, 18 aa, Mycobacterium
RPRHLHWPVLRHSHGHSP

SEQ ID NO: 856232 - protein, 20 aa, Mycobacterium
RPRIEELLKPDRVALRKLIT

SEQ ID NO: 856233 - protein, 21 aa, Mycobacterium
RPRIEELLTADRVALRQLITK

SEQ ID NO: 856234 - protein, 17 aa, Mycobacterium
RPRITALIAERISTRTA

SEQ ID NO: 856235 - protein, 21 aa, Mycobacterium
RPRKRALQPVFTPQNVRRFGG

SEQ ID NO: 856236 - protein, 21 aa, Mycobacterium
RPRKRFGWDSPAQVLNRLLSN

SEQ ID NO: 856237 - protein, 18 aa, Mycobacterium
RPRKTLDWKTPAEALDEL

SEQ ID NO: 856238 - protein, 19 aa, Mycobacterium
RPRKTLGWKTPAEAFHEQL

SEQ ID NO: 856239 - protein, 19 aa, Mycobacterium
RPRLLDDHVTLAHGAGGKA

SEQ ID NO: 856240 - protein, 19 aa, Mycobacterium
RPRLLDEHVTLAHGAGGKA

SEQ ID NO: 856241 - protein, 17 aa, Mycobacterium
RPRMQVLMYPVVDAVGE

SEQ ID NO: 856242 - protein, 25 aa, Mycobacterium
RPRPDRSIIPLIRQTRRVPTSHSLP

SEQ ID NO: 856243 - protein, 30 aa, Mycobacterium
RPRQFGVPIDIWWFRLPKHPDDPQGPRARV

SEQ ID NO: 856244 - protein, 20 aa, Mycobacterium
RPRQLIEDSWKRLLGKGIHP

SEQ ID NO: 856245 - protein, 18 aa, Mycobacterium
RPRRILFVSGGSGITPVL

SEQ ID NO: 856246 - protein, 22 aa, Mycobacterium
RPRSIKFVCLLTCPEGIAAVQE

SEQ ID NO: 856247 - protein, 31 aa, Mycobacterium
RPRSLFPDFSELLAGFPSFAGPRVAAESRLM

SEQ ID NO: 856248 - protein, 30 aa, Mycobacterium
RPRSLRLRKRDAAGAAWRPYQGRPGGRVRD

SEQ ID NO: 856249 - protein, 17 aa, Mycobacterium
RPRSRRRPGGLGRGVRR

SEQ ID NO: 856250 - protein, 31 aa, Mycobacterium
RPRTIDEMPLDWFLRPAVKLDFRHLDDGYVA

SEQ ID NO: 856251 - protein, 20 aa, Mycobacterium
RPRTRQHYESMLGRLILPDL

SEQ ID NO: 856252 - protein, 18 aa, Mycobacterium
RPRVSALIAIDRVHGWGA

SEQ ID NO: 856253 - protein, 24 aa, Mycobacterium
RPSFISLRTIIGYPAPNLMNTGKA

SEQ ID NO: 856254 - protein, 24 aa, Mycobacterium
RPSGLLMMSTPNRITFSPGRDTPI

SEQ ID NO: 856255 - protein, 19 aa, Mycobacterium
RPSGRIGLLAFVANREIPR

SEQ ID NO: 856256 - protein, 23 aa, Mycobacterium
RPSGTAIYFLLTPGDESRWHVVR

SEQ ID NO: 856257 - protein, 25 aa, Mycobacterium
RPSHWRKNLLACTGIEYCKLSFTET

SEQ ID NO: 856258 - protein, 28 aa, Mycobacterium
RPSLGISEWILPTLISSAPREIQQRFIP

SEQ ID NO: 856259 - protein, 23 aa, Mycobacterium
RPSLPADLIGSVLVLKELYDLSD

SEQ ID NO: 856260 - protein, 17 aa, Mycobacterium
RPSMTMEAWNDPTLLKF

SEQ ID NO: 856261 - protein, 28 aa, Mycobacterium
RPSNEPLPVMFFIYGGGYLLGSSATPLY

SEQ ID NO: 856262 - protein, 32 aa, Mycobacterium
RPSPLSLDDVVKFLLPQAPAKKPAKGAASADA

SEQ ID NO: 856263 - protein, 20 aa, Mycobacterium
RPSRIWVTEDGLVVMASEAG

SEQ ID NO: 856264 - protein, 31 aa, Mycobacterium; identical to SEQ ID NO: 131513

SEQ ID NO: 856265 - protein, 19 aa, Mycobacterium
RPSRSFRPGCSPDRRCAGI

SEQ ID NO: 856266 - protein, 25 aa, Mycobacterium
RPSSGWVATRWFTRSSTSWRPRNPT

SEQ ID NO: 856267 - protein, 18 aa, Mycobacterium
RPSSIRRLGLTYEALRRF

SEQ ID NO: 856268 - protein, 32 aa, Mycobacterium
RPSYDYLIHRKLAVFWRHLPPGPLAEDLARFL

SEQ ID NO: 856269 - protein, 18 aa, Mycobacterium
RPTAFKPSYGIAEATLFV

SEQ ID NO: 856270 - protein, 19 aa, Mycobacterium
RPTALWAPVLETQIADHVT

SEQ ID NO: 856271 - protein, 24 aa, Mycobacterium
RPTAQRARKLVYAPSLDGRADPGE

SEQ ID NO: 856272 - protein, 18 aa, Mycobacterium
RPTDAFFTMLRGKELLEK

SEQ ID NO: 856273 - protein, 39 aa, Mycobacterium
RPTDLEAFLDGARRWRNLDGLLITVPHKAAAMRFATELS

SEQ ID NO: 856274 - protein, 18 aa, Mycobacterium
RPTFDQFIDRGAYAGELA

SEQ ID NO: 856275 - protein, 18 aa, Mycobacterium
RPTGSFMFLGPTGVGKTE

SEQ ID NO: 856276 - protein, 18 aa, Mycobacterium
RPTGWFQVAWSAQITVGA

SEQ ID NO: 856277 - protein, 17 aa, Mycobacterium
RPTIAGFADALLDDIAA

SEQ ID NO: 856278 - protein, 25 aa, Mycobacterium
RPTKFYAMLLARLHDHRSMDDGALW

SEQ ID NO: 856279 - protein, 19 aa, Mycobacterium
RPTLFDWCRDLSSLSPYRQ

SEQ ID NO: 856280 - protein, 20 aa, Mycobacterium
RPTLFVFTSIGRLGHDRQGN

SEQ ID NO: 856281 - protein, 19 aa, Mycobacterium
RPTLHRPVSTLLADPSVPV

SEQ ID NO: 856282 - protein, 25 aa, Mycobacterium
RPTLMRCALLACELAEDGAARRQAA

SEQ ID NO: 856283 - protein, 26 aa, Mycobacterium
RPTLYDLTVAAWLWSGRRGVIAGAAA

SEQ ID NO: 856284 - protein, 22 aa, Mycobacterium
RPTPAYWLHEGNMLVDSGVLRS

SEQ ID NO: 856285 - protein, 27 aa, Mycobacterium
RPTPEANSIAWLLWHSARVQDVQVAHI

SEQ ID NO: 856286 - protein, 23 aa, Mycobacterium
RPTPGPLKWDLTMGVATDTRESL

SEQ ID NO: 856287 - protein, 17 aa, Mycobacterium
RPTQRCHASLIPLLRRV

SEQ ID NO: 856288 - protein, 26 aa, Mycobacterium
RPTRPHPLFVAFVGAALDYQSGELLP

SEQ ID NO: 856289 - protein, 31 aa, Mycobacterium
RPTRPHPLFVAFVGAALEYKAGERLPVEIPE

SEQ ID NO: 856290 - protein, 19 aa, Mycobacterium
RPTTFELFARRLPEGRRYG

SEQ ID NO: 856291 - protein, 19 aa, Mycobacterium
RPTTLEVIFCYPGVHAVWG

SEQ ID NO: 856292 - protein, 17 aa, Mycobacterium
RPTTLLVTIRRYGCASC

SEQ ID NO: 856293 - protein, 22 aa, Mycobacterium
RPTVLLWHGMQTDARAAFGPLA

SEQ ID NO: 856294 - protein, 27 aa, Mycobacterium
RPTVTMKVGFLPPPDFEATTLEEFMVL

SEQ ID NO: 856295 - protein, 17 aa, Mycobacterium
RPTVVTLVPRVCDMLFQ

SEQ ID NO: 856296 - protein, 19 aa, Mycobacterium
RPTVYRRFPDTRSIVAALL

SEQ ID NO: 856297 - protein, 19 aa, Mycobacterium
RPTVYRRWPDTHSVVAALL

SEQ ID NO: 856298 - protein, 19 aa, Mycobacterium
RPTYVFASIDRAGADISLH

SEQ ID NO: 856299 - protein, 19 aa, Mycobacterium
RPVAGCPVRILNKSDRPVG

SEQ ID NO: 856300 - protein, 18 aa, Mycobacterium
RPVAGELALVLGCGPIGL

SEQ ID NO: 856301 - protein, 27 aa, Mycobacterium
RPVALPRLAALAQWLEAHLPGITPAER

SEQ ID NO: 856302 - protein, 24 aa, Mycobacterium
RPVDALERLFYRYSDRNPVHFMLV

SEQ ID NO: 856303 - protein, 25 aa, Mycobacterium
RPVDFGSFLIPRTEYRIDDVWNVVG

SEQ ID NO: 856304 - protein, 22 aa, Mycobacterium
RPVEWVRVPWVDMIPAVQRGDA

SEQ ID NO: 856305 - protein, 22 aa, Mycobacterium
RPVFMVGVRDDLPMGRLTVIAT

SEQ ID NO: 856306 - protein, 18 aa, Mycobacterium
RPVGVDALITALWEEWPP

SEQ ID NO: 856307 - protein, 20 aa, Mycobacterium
RPVIDLVAGIAPRGYGQGNH

SEQ ID NO: 856308 - protein, 23 aa, Mycobacterium
RPVILAGGGVRRSPGGPAALVEF

SEQ ID NO: 856309 - protein, 22 aa, Mycobacterium
RPVIPIFVNAIGVPLGPMHRCR

SEQ ID NO: 856310 - protein, 17 aa, Mycobacterium
RPVIPPAILDCGVAYHT

SEQ ID NO: 856311 - protein, 27 aa, Mycobacterium
RPVKLALTRQQMFSLVGYRTPTIQRIR

SEQ ID NO: 856312 - protein, 27 aa, Mycobacterium
RPVKLALTRQQMFSLVGYRTPTIQRVR

SEQ ID NO: 856313 - protein, 20 aa, Mycobacterium
RPVLFVGLRVGDPAPCAALR

SEQ ID NO: 856314 - protein, 19 aa, Mycobacterium
RPVLPDLPGIDEARPWTNR

SEQ ID NO: 856315 - protein, 33 aa, Mycobacterium
RPVLSARWDRAAVEPLFAAPFFAVIPYEWDRYV

SEQ ID NO: 856316 - protein, 18 aa, Mycobacterium
RPVNDTLLSLSLGLVATA

SEQ ID NO: 856317 - protein, 19 aa, Mycobacterium
RPVNGTAFALTPMLREAYA

SEQ ID NO: 856318 - protein, 31 aa, Mycobacterium
RPVPLPTYPFQHHRYWLTTGPGNDAAGLGLD

SEQ ID NO: 856319 - protein, 21 aa, Mycobacterium
RPVPPPRVRGNLPAPLSEFVG

SEQ ID NO: 856320 - protein, 17 aa, Mycobacterium
RPVPQLLTMGLLRRIDA

SEQ ID NO: 856321 - protein, 22 aa, Mycobacterium
RPVQRETLLPGALLVRVASSHL

SEQ ID NO: 856322 - protein, 18 aa, Mycobacterium
RPVQTLLEAARSAVLLCL

SEQ ID NO: 856323 - protein, 25 aa, Mycobacterium
RPVRADYGYIPERKLAVIEMATASG

SEQ ID NO: 856324 - protein, 17 aa, Mycobacterium
RPVRGLISICAAGGQGV

SEQ ID NO: 856325 - protein, 21 aa, Mycobacterium
RPVSEHIDGAWWPRSRSLADE

SEQ ID NO: 856326 - protein, 19 aa, Mycobacterium
RPVSGYLRLLYIRAQDFES

SEQ ID NO: 856327 - protein, 19 aa, Mycobacterium
RPVSYTLPALPTAAAAGVV

SEQ ID NO: 856328 - protein, 19 aa, Mycobacterium
RPVTAMPRRALARRVALVG

SEQ ID NO: 856329 - protein, 17 aa, Mycobacterium
RPVTFVECDFTLAVLGG

SEQ ID NO: 856330 - protein, 29 aa, Mycobacterium
RPVTLMHVVSPIVVTWPIDTVVANFYEWQ

SEQ ID NO: 856331 - protein, 21 aa, Mycobacterium
RPVVAELQRKFSVSAAETGSH

SEQ ID NO: 856332 - protein, 21 aa, Mycobacterium
RPVVELYMIDFGTVGWSAIIN

SEQ ID NO: 856333 - protein, 18 aa, Mycobacterium
RPVVFVHGYMMGGQLWRG

SEQ ID NO: 856334 - protein, 18 aa, Mycobacterium
RPVVFVHGYMMGGQLWRQ

SEQ ID NO: 856335 - protein, 28 aa, Mycobacterium
RPVVLRAWDYHTFWVNSAALQRAGIAAD

SEQ ID NO: 856336 - protein, 19 aa, Mycobacterium
RPVVLVHGWPLTGESWGAQ

SEQ ID NO: 856337 - protein, 28 aa, Mycobacterium
RPVVRGLLHAWHEPAWLSVLSRGQVLTV

SEQ ID NO: 856338 - protein, 17 aa, Mycobacterium
RPVWAGSTLWCDEMSES

SEQ ID NO: 856339 - protein, 25 aa, Mycobacterium
RPVYTLGHYGIFMGPLDGWLRRLGV

SEQ ID NO: 856340 - protein, 22 aa, Mycobacterium
RPVYTLSHDMLMVGPTGAFFKK

SEQ ID NO: 856341 - protein, 17 aa, Mycobacterium
RPWFAPGCWLRPAPGRG

SEQ ID NO: 856342 - protein, 17 aa, Mycobacterium
RPWPIRALNRVGNPLTG

SEQ ID NO: 856343 - protein, 17 aa, Mycobacterium
RPWRACDPIVLFSALSQ

SEQ ID NO: 856344 - protein, 17 aa, Mycobacterium
RPWRLYEAESQLVGLPL

SEQ ID NO: 856345 - protein, 19 aa, Mycobacterium
RPWSERKKLIWWDETKGAK

SEQ ID NO: 856346 - protein, 18 aa, Mycobacterium
RPYDINAISPFVLGSEEQ

SEQ ID NO: 856347 - protein, 23 aa, Mycobacterium
RPYLALFEEVVAVQAALLARWML

SEQ ID NO: 856348 - protein, 20 aa, Mycobacterium
RPYLVEGVGEDFWPSAYDPS

SEQ ID NO: 856349 - protein, 21 aa, Mycobacterium
RPYLVEGVGEDFWPSAYDPSV

SEQ ID NO: 856350 - protein, 21 aa, Mycobacterium
RPYLVEGVGEDFWPTAYDPSV

SEQ ID NO: 856351 - protein, 20 aa, Mycobacterium
RPYMPAARMRGLVPVVRRSA

SEQ ID NO: 856352 - protein, 25 aa, Mycobacterium
RPYPRGELLVKTRTLFSGYYRDPED

SEQ ID NO: 856353 - protein, 27 aa, Mycobacterium
RPYRECGYLPMVELLQYLAGNGFTNYI

SEQ ID NO: 856354 - protein, 37 aa, Mycobacterium
RPYSRWERWVFAHVPFAARLYRTRLWLRSESNISVIE

SEQ ID NO: 856355 - protein, 18 aa, Mycobacterium
RQAAFGEVLGIIEASVRY

SEQ ID NO: 856356 - protein, 23 aa, Mycobacterium
RQAAITMDWLRQNGYQDLLGRSC

SEQ ID NO: 856357 - protein, 27 aa, Mycobacterium
RQAAQIPVADPLLLVSAMALVTEHLGF

SEQ ID NO: 856358 - protein, 27 aa, Mycobacterium
RQAAVQLAVYRLAWAALLGCSESSVRT

SEQ ID NO: 856359 - protein, 25 aa, Mycobacterium
RQAAVQLAVYRLAWAALSGMPESSV

SEQ ID NO: 856360 - protein, 26 aa, Mycobacterium
RQAAVQLAVYRMAWAALAGVAESSVR

SEQ ID NO: 856361 - protein, 23 aa, Mycobacterium
RQAAYLQPALVAAAIALAQTLIT

SEQ ID NO: 856362 - protein, 25 aa, Mycobacterium
RQADDPYLFYVDGLDLYGPGDEAAH

SEQ ID NO: 856363 - protein, 27 aa, Mycobacterium
RQAEKLAYFPLWSYATEPAIELADRLA

SEQ ID NO: 856364 - protein, 20 aa, Mycobacterium
RQAFGPIGIVVTSAAMGGFT

SEQ ID NO: 856365 - protein, 18 aa, Mycobacterium
RQAGISMLLIDLDTPGIT

SEQ ID NO: 856366 - protein, 28 aa, Mycobacterium
RQAGTLSYFPLWGYATQPAIELAERLAR

SEQ ID NO: 856367 - protein, 31 aa, Mycobacterium
RQAGYVQFWAKWMPTLRKPLIDTLNTVGVEK

SEQ ID NO: 856368 - protein, 17 aa, Mycobacterium
RQALAPASTWWSWRGHD

SEQ ID NO: 856369 - protein, 21 aa, Mycobacterium
RQALQWAMSVAAKRAAALVAS

SEQ ID NO: 856370 - protein, 17 aa, Mycobacterium
RQALRILGLGADAVIEV

SEQ ID NO: 856371 - protein, 25 aa, Mycobacterium
RQALRLGHNYIGTEHILLALVDAED

SEQ ID NO: 856372 - protein, 17 aa, Mycobacterium
RQALRMFDDMRLEHGRL

SEQ ID NO: 856373 - protein, 18 aa, Mycobacterium
RQALVPDGWTLEVVARVP

SEQ ID NO: 856374 - protein, 18 aa, Mycobacterium
RQAMLKALRDMWVQTTGQ

SEQ ID NO: 856375 - protein, 25 aa, Mycobacterium
RQAPAPLMNRRRALTALAVGMGAGV

SEQ ID NO: 856376 - protein, 17 aa, Mycobacterium
RQAQLRTLTRKYAADID

SEQ ID NO: 856377 - protein, 34 aa, Mycobacterium
RQARDWLSRFDLGPGFDVILPTPSLLDPIGAPER

SEQ ID NO: 856378 - protein, 26 aa, Mycobacterium
RQAREKNFSLLRRRGAARVEAEGARG

SEQ ID NO: 856379 - protein, 24 aa, Mycobacterium
RQARFSAAFTFQYSKRPGTPAAEL

SEQ ID NO: 856380 - protein, 17 aa, Mycobacterium
RQARIYPLPSRAVDDQG

SEQ ID NO: 856381 - protein, 18 aa, Mycobacterium
RQARYQMPPFCSSGWAMT

SEQ ID NO: 856382 - protein, 34 aa, Mycobacterium
RQATAYVRLLRFLPGDALMQRGYLRPSTVAELGA

SEQ ID NO: 856383 - protein, 18 aa, Mycobacterium
RQAVALVAAARWVTAASL

SEQ ID NO: 856384 - protein, 27 aa, Mycobacterium
RQAVNGLINVWFKTPYRITRLLEQTVR

SEQ ID NO: 856385 - protein, 24 aa, Mycobacterium
RQAVPPLVDLGGIGVRRGYLERGA

SEQ ID NO: 856386 - protein, 26 aa, Mycobacterium
RQAVWPERMFSLLAGFVEAGESFEAC

SEQ ID NO: 856387 - protein, 25 aa, Mycobacterium
RQAVWPERMFSLLAGFVEAGESFEG

SEQ ID NO: 856388 - protein, 19 aa, Mycobacterium
RQAWLDLHESWLTAKAAEI

SEQ ID NO: 856389 - protein, 20 aa, Mycobacterium
RQCHQVLRALVLLASNDFIA

SEQ ID NO: 856390 - protein, 19 aa, Mycobacterium
RQCLNAGLGFGGGCLPKDI

SEQ ID NO: 856391 - protein, 18 aa, Mycobacterium
RQCRSRFVFFASGYYNYD

SEQ ID NO: 856392 - protein, 26 aa, Mycobacterium
RQDFTEWLRRFFDVDDVRRSDVVLAI

SEQ ID NO: 856393 - protein, 22 aa, Mycobacterium
RQDIDDIFWLQATIARELAAAA

SEQ ID NO: 856394 - protein, 22 aa, Mycobacterium
RQDIDDIFWLQATIARELAVTA

SEQ ID NO: 856395 - protein, 21 aa, Mycobacterium
RQDIEDIFWLQASIAKELAAA

SEQ ID NO: 856396 - protein, 22 aa, Mycobacterium
RQDIEDIFWLQATIARELAAAA

SEQ ID NO: 856397 - protein, 19 aa, Mycobacterium
RQDLPVWTVQHHHAHAASL

SEQ ID NO: 856398 - protein, 18 aa, Mycobacterium
RQDPGLLIICAHDPSLYA

SEQ ID NO: 856399 - protein, 18 aa, Mycobacterium
RQDPLVMSVLHSELATTY

SEQ ID NO: 856400 - protein, 22 aa, Mycobacterium
RQDWLAALWRVGFDADQPTAWI

SEQ ID NO: 856401 - protein, 29 aa, Mycobacterium
RQEALMSLRRLGLDQIDLFQLHRIDPKVP

SEQ ID NO: 856402 - protein, 27 aa, Mycobacterium
RQEDIYNPLRFLRAGLKWCRKAAELGT

SEQ ID NO: 856403 - protein, 26 aa, Mycobacterium
RQEEQLLLGGLPVRRLWGIGPVAEEK

SEQ ID NO: 856404 - protein, 25 aa, Mycobacterium
RQEFEYLRTFEGSPTRRDRWRRTSG

SEQ ID NO: 856405 - protein, 20 aa, Mycobacterium
RQELDVVWRNGLRLNKLVNT

SEQ ID NO: 856406 - protein, 26 aa, Mycobacterium
RQELPLIEEWFEFVGDKLPTGVKDEF

SEQ ID NO: 856407 - protein, 31 aa, Mycobacterium
RQEPDETLQLLPLTPFIPQRAVARGSQVVLN

SEQ ID NO: 856408 - protein, 25 aa, Mycobacterium
RQEPGLSWAAGLRDDGRTTLLVTDL

SEQ ID NO: 856409 - protein, 24 aa, Mycobacterium
RQEPRLSWAAGLRDDGTTTLLVTD

SEQ ID NO: 856410 - protein, 26 aa, Mycobacterium
RQERIPAALLAPFITRGAFIATFTNT

SEQ ID NO: 856411 - protein, 36 aa, Mycobacterium
RQEWRIFVDLALAMGKPLFRAKGLNAFITATRRVAR

SEQ ID NO: 856412 - protein, 22 aa, Mycobacterium
RQFDVFDPVVLTIGVLRAGTRS

SEQ ID NO: 856413 - protein, 18 aa, Mycobacterium
RQFERLLAKVLRKVTTKL

SEQ ID NO: 856414 - protein, 21 aa, Mycobacterium
RQFETTNGALRFPELSTSPPK

SEQ ID NO: 856415 - protein, 23 aa, Mycobacterium
RQFNPGWHLAIDMRNMLLVSECV

SEQ ID NO: 856416 - protein, 23 aa, Mycobacterium
RQFQVFLDDVRLPSDALVGAEDA

SEQ ID NO: 856417 - protein, 21 aa, Mycobacterium
RQFRASVCVLGPLVGRCKRAR

SEQ ID NO: 856418 - protein, 21 aa, Mycobacterium
RQGAQLAKLTRWFTPAEVLQQ

SEQ ID NO: 856419 - protein, 18 aa, Mycobacterium
RQGDSWLLSGHKNPVLAG

SEQ ID NO: 856420 - protein, 24 aa, Mycobacterium
RQGEFAATQGCPWYWDAEYGATEL

SEQ ID NO: 856421 - protein, 17 aa, Mycobacterium
RQGFSIALIPDGDDPRR

SEQ ID NO: 856422 - protein, 23 aa, Mycobacterium
RQGKFPFDKLITTMPLAQINEAV

SEQ ID NO: 856423 - protein, 18 aa, Mycobacterium
RQGLGTWVYTAPEQWQRA

SEQ ID NO: 856424 - protein, 18 aa, Mycobacterium
RQGPASCRCAGGGRPRSL

SEQ ID NO: 856425 - protein, 33 aa, Mycobacterium
RQGPLPDELPAAALWWRISGALSPTATLATTHS

SEQ ID NO: 856426 - protein, 18 aa, Mycobacterium
RQGPQVCTLILPADASWS

SEQ ID NO: 856427 - protein, 18 aa, Mycobacterium
RQGRFESPILDAGCGIGS

SEQ ID NO: 856428 - protein, 25 aa, Mycobacterium
RQGRNWAVRQIPLAQVLKAVVQVEF

SEQ ID NO: 856429 - protein, 18 aa, Mycobacterium
RQGSFLGYRVTVCDARAV

SEQ ID NO: 856430 - protein, 28 aa, Mycobacterium
RQGSLNFYSLYRAHNLHFVVYSAMFEGN

SEQ ID NO: 856431 - protein, 22 aa, Mycobacterium
RQGVLDPWLSTLPAEEQRTLAE

SEQ ID NO: 856432 - protein, 27 aa, Mycobacterium
RQGVRRLAQFWGHAWQSAVFPSGKAFG

SEQ ID NO: 856433 - protein, 17 aa, Mycobacterium
RQGVVERGLVVSGEYIS

SEQ ID NO: 856434 - protein, 20 aa, Mycobacterium
RQGWRMLYDRSPAGSPRRAQ

SEQ ID NO: 856435 - protein, 25 aa, Mycobacterium
RQHDWSLEVIDLRSLVPLDFDTVAA

SEQ ID NO: 856436 - protein, 28 aa, Mycobacterium
RQHGDGENWWRVLRLWEKVKSPLLDAMM

SEQ ID NO: 856437 - protein, 19 aa, Mycobacterium
RQHGVWAHVDACVGGCLAF

SEQ ID NO: 856438 - protein, 21 aa, Mycobacterium
RQHHKWTAWVDGRPLIVFHEI

SEQ ID NO: 856439 - protein, 21 aa, Mycobacterium
RQHHKWTAWVEGRPLIVFHEI

SEQ ID NO: 856440 - protein, 19 aa, Mycobacterium
RQHIAFCRAGDGVRLAYAV

SEQ ID NO: 856441 - protein, 28 aa, Mycobacterium
RQHLKTMKGQWAPFQSLLDLVDDEQARA

SEQ ID NO: 856442 - protein, 21 aa, Mycobacterium
RQHVKGLIRSYPGLKGTLDKV

SEQ ID NO: 856443 - protein, 22 aa, Mycobacterium
RQHVLPKLPALSSPLWRSRGQI

SEQ ID NO: 856444 - protein, 20 aa, Mycobacterium
RQIAELLVRAVGRSHQVRVA

SEQ ID NO: 856445 - protein, 20 aa, Mycobacterium
RQIALYRALMRIGVAEFVPE

SEQ ID NO: 856446 - protein, 24 aa, Mycobacterium
RQIAPLRRALGLTPVRTAGDLLLR

SEQ ID NO: 856447 - protein, 26 aa, Mycobacterium
RQIAYVPGDVTLWPSLTGGETIDLLA

SEQ ID NO: 856448 - protein, 17 aa, Mycobacterium
RQIEFLTRATAQRPDAV

SEQ ID NO: 856449 - protein, 25 aa, Mycobacterium
RQIGLRDRLCELDFEFPMAGGDLRG

SEQ ID NO: 856450 - protein, 19 aa, Mycobacterium
RQIHLILDLHEDDGQVAID

SEQ ID NO: 856451 - protein, 17 aa, Mycobacterium
RQIPQPRTLRDARIGYI

SEQ ID NO: 856452 - protein, 22 aa, Mycobacterium
RQIPRPLWKVLSAPLNAFIRTV

SEQ ID NO: 856453 - protein, 17 aa, Mycobacterium
RQISFRFAADDDQFMTI

SEQ ID NO: 856454 - protein, 23 aa, Mycobacterium
RQIVLPQPILRNADLSKLICVDP

SEQ ID NO: 856455 - protein, 24 aa, Mycobacterium
RQIVLPQPILRNAELSKLICVDPD

SEQ ID NO: 856456 - protein, 20 aa, Mycobacterium
RQIVSRLNWVKKGPKPAAVI

SEQ ID NO: 856457 - protein, 25 aa, Mycobacterium
RQKADLRLVVVDYLQLMSSGKKVES

SEQ ID NO: 856458 - protein, 21 aa, Mycobacterium
RQKFNPLVRLDTVNGKPVEEA

SEQ ID NO: 856459 - protein, 24 aa, Mycobacterium
RQKLTPRYALGCKRPSFHNEYLAT

SEQ ID NO: 856460 - protein, 21 aa, Mycobacterium
RQKVLGLIKSGIDSGARLVTG

SEQ ID NO: 856461 - protein, 21 aa, Mycobacterium
RQKVLGLIRSGIDSGARLVTG

SEQ ID NO: 856462 - protein, 24 aa, Mycobacterium
RQLAFLYGGVIYDLGGALLGLRPV

SEQ ID NO: 856463 - protein, 21 aa, Mycobacterium
RQLAKLPWPGNIAQLRHVLTE

SEQ ID NO: 856464 - protein, 19 aa, Mycobacterium
RQLALYQALIRIGVAERTP

SEQ ID NO: 856465 - protein, 17 aa, Mycobacterium
RQLAMSERTLRRRLAEE

SEQ ID NO: 856466 - protein, 17 aa, Mycobacterium
RQLARLTQTLRPDELGK

SEQ ID NO: 856467 - protein, 18 aa, Mycobacterium
RQLATMVLLIAQSTIQSV

SEQ ID NO: 856468 - protein, 27 aa, Mycobacterium
RQLAVNLSAAFFLSQAALAHMTQQRFG

SEQ ID NO: 856469 - protein, 20 aa, Mycobacterium
RQLDIVLDFHRQPALGGLDT

SEQ ID NO: 856470 - protein, 20 aa, Mycobacterium
RQLEEWLRSYRPDELFDDNG

SEQ ID NO: 856471 - protein, 25 aa, Mycobacterium
RQLERNILLSVIDRKWREHLYEMDY

SEQ ID NO: 856472 - protein, 23 aa, Mycobacterium
RQLGFLFGGVIYDLGGALLGLRP

SEQ ID NO: 856473 - protein, 31 aa, Mycobacterium
RQLHGDVPGPYSWWSWRGKAFDNDAGWRIDY

SEQ ID NO: 856474 - protein, 22 aa, Mycobacterium
RQLMVDLYKRVIEGVAELGFPL

SEQ ID NO: 856475 - protein, 19 aa, Mycobacterium
RQLPGQILVLGGGEARDLD

SEQ ID NO: 856476 - protein, 18 aa, Mycobacterium
RQLPGQVLVLGGGESRDL

SEQ ID NO: 856477 - protein, 18 aa, Mycobacterium
RQLRAIWVGGRVPPAGAI

SEQ ID NO: 856478 - protein, 18 aa, Mycobacterium
RQLRLLRCAHHQGGGRLQ

SEQ ID NO: 856479 - protein, 18 aa, Mycobacterium
RQLRRWLTQLAVAERVVA

SEQ ID NO: 856480 - protein, 26 aa, Mycobacterium
RQLRRWLTQVLVAERIVAASPGADPA

SEQ ID NO: 856481 - protein, 26 aa, Mycobacterium
RQLRSELKMLPALPVAELRAQADELA

SEQ ID NO: 856482 - protein, 20 aa, Mycobacterium
RQLTADFNFAWPTARIAVIG

SEQ ID NO: 856483 - protein, 24 aa, Mycobacterium
RQLTEALLPMMGPGSAIVSVSSLA

SEQ ID NO: 856484 - protein, 18 aa, Mycobacterium
RQLTILENKLRDGRIRQN

SEQ ID NO: 856485 - protein, 26 aa, Mycobacterium
RQLVDEKWVWLPAVLAGRVFTHRLCA

SEQ ID NO: 856486 - protein, 32 aa, Mycobacterium
RQLVEICRAVRRQPRVLILDEPTSALAATEVS

SEQ ID NO: 856487 - protein, 18 aa, Mycobacterium
RQLWDDDIPGACDSTLLI

SEQ ID NO: 856488 - protein, 18 aa, Mycobacterium
RQLWEDRGSPRLPPRSRD

SEQ ID NO: 856489 - protein, 29 aa, Mycobacterium
RQMDLPAKLAIPMRVIASVAAILCQLDAH

SEQ ID NO: 856490 - protein, 20 aa, Mycobacterium
RQMIADGRLTGYRSGKRLVR

SEQ ID NO: 856491 - protein, 21 aa, Mycobacterium
RQMIWIMNWVEIKRGLEAVRT

SEQ ID NO: 856492 - protein, 19 aa, Mycobacterium
RQMLRRVTIIDSGSTEFLP

SEQ ID NO: 856493 - protein, 21 aa, Mycobacterium
RQMMVDLYKRVIDGVADLGFP

SEQ ID NO: 856494 - protein, 22 aa, Mycobacterium
RQMRNFWATLMLSQGTPMIAHG

SEQ ID NO: 856495 - protein, 18 aa, Mycobacterium
RQMRNFWATLMVSQGTPM

SEQ ID NO: 856496 - protein, 19 aa, Mycobacterium
RQMSLILGAPLARRGYETV

SEQ ID NO: 856497 - protein, 29 aa, Mycobacterium
RQNAIVLRDWQVLRFTWLDLTEYPERVIA

SEQ ID NO: 856498 - protein, 23 aa, Mycobacterium
RQNIAFPLTLAKMPKPEIAQKVA

SEQ ID NO: 856499 - protein, 20 aa, Mycobacterium
RQNICFLYHVLGGGTGDWDV

SEQ ID NO: 856500 - protein, 17 aa, Mycobacterium
RQNVEWFARLYGVPRAE

SEQ ID NO: 856501 - protein, 31 aa, Mycobacterium
RQNWRGKAVLLKLIWRMFRARVFGDRMAAIG

SEQ ID NO: 856502 - protein, 26 aa, Mycobacterium
RQPARIALDLLHRAGIEWDPALPCVA

SEQ ID NO: 856503 - protein, 18 aa, Mycobacterium
RQPGYDPARHLGGVLYLF

SEQ ID NO: 856504 - protein, 27 aa, Mycobacterium
RQPGYSARRHIAGVLYLFVRGMCGPDT

SEQ ID NO: 856505 - protein, 21 aa, Mycobacterium
RQPHLITAAHWQAIDRFEREA

SEQ ID NO: 856506 - protein, 23 aa, Mycobacterium
RQPHPYIAMVPQWDLLNLLADAG

SEQ ID NO: 856507 - protein, 17 aa, Mycobacterium
RQPICGLVQVAVGERPP

SEQ ID NO: 856508 - protein, 27 aa, Mycobacterium
RQPILADAPALPRRIGRCALASQVIEG

SEQ ID NO: 856509 - protein, 20 aa, Mycobacterium
RQPLLGCCGSLRCQQRGGAE

SEQ ID NO: 856510 - protein, 28 aa, Mycobacterium
RQPLRHSGQGLFPVRQLGGDAAVAVVEI

SEQ ID NO: 856511 - protein, 29 aa, Mycobacterium
RQPPITHFAAIPLMYQRIADLPGFSSANL

SEQ ID NO: 856512 - protein, 25 aa, Mycobacterium
RQPQMMKLFIKQFGPYPFAAGYTVV

SEQ ID NO: 856513 - protein, 23 aa, Mycobacterium
RQPQVGWWMLDLAGPALKKMMNK

SEQ ID NO: 856514 - protein, 18 aa, Mycobacterium
RQPWWAPIVDVGPGPAVL

SEQ ID NO: 856515 - protein, 26 aa, Mycobacterium
RQQAGLTRPLFWNADGTRTRFGHVED

SEQ ID NO: 856516 - protein, 25 aa, Mycobacterium
RQQAQFDRWFEIMSAVLGVAKAGVT

SEQ ID NO: 856517 - protein, 25 aa, Mycobacterium
RQQAQFDTWFEIMTAVLGVAKAGAT

SEQ ID NO: 856518 - protein, 25 aa, Mycobacterium
RQQEPTLVIWLAYSEELCEQAASEF

SEQ ID NO: 856519 - protein, 27 aa, Mycobacterium
RQQERYEFFFVAPPLPITAAVGSPVNP

SEQ ID NO: 856520 - protein, 24 aa, Mycobacterium
RQQFSLLFATTVLGGTLAIDHEST

SEQ ID NO: 856521 - protein, 20 aa, Mycobacterium
RQQGFVRTAAIDRLIVTTDV

SEQ ID NO: 856522 - protein, 18 aa, Mycobacterium
RQQKALMPDKPFFMYFAP

SEQ ID NO: 856523 - protein, 26 aa, Mycobacterium
RQQKFRKVLNPYFSPARMKALRHEIA

SEQ ID NO: 856524 - protein, 38 aa, Mycobacterium
RQQLAALKPVYRPGLIHIYHGLTWGPLIREIVSAATGR

SEQ ID NO: 856525 - protein, 17 aa, Mycobacterium
RQQLCDLGAAIFAAGEL

SEQ ID NO: 856526 - protein, 18 aa, Mycobacterium
RQQLWLITITDEAGKTVA

SEQ ID NO: 856527 - protein, 34 aa, Mycobacterium
RQQPRGLLVGYSDAFFLLPNNHGRIFGPDPVETS

SEQ ID NO: 856528 - protein, 25 aa, Mycobacterium
RQQQLRKVLNPYFSPGRMKDLEPQV

SEQ ID NO: 856529 - protein, 17 aa, Mycobacterium
RQQRVPLGVVGIVYEGR

SEQ ID NO: 856530 - protein, 25 aa, Mycobacterium
RQQTAAAFWIRANTWFAQCGINQRS

SEQ ID NO: 856531 - protein, 17 aa, Mycobacterium
RQQWTLVTPPDPDPRML

SEQ ID NO: 856532 - protein, 17 aa, Mycobacterium
RQRAAGGLGLLIAHPFY

SEQ ID NO: 856533 - protein, 18 aa, Mycobacterium
RQRAAISALLENIDDFRS

SEQ ID NO: 856534 - protein, 19 aa, Mycobacterium
RQRALLRLADLIEDNAEEL

SEQ ID NO: 856535 - protein, 24 aa, Mycobacterium
RQRAMIAQALALDPGLLIADEPTT

SEQ ID NO: 856536 - protein, 25 aa, Mycobacterium
RQRDRAKMFALLRASLRQQARLARK

SEQ ID NO: 856537 - protein, 30 aa, Mycobacterium
RQRDRARMFELLRGSLRRNLQLMRSFNKMR

SEQ ID NO: 856538 - protein, 18 aa, Mycobacterium
RQRFMAEHPDQIGNLNGV

SEQ ID NO: 856539 - protein, 17 aa, Mycobacterium
RQRFPLSARVGDRYPAS

SEQ ID NO: 856540 - protein, 21 aa, Mycobacterium
RQRFRAALAAKLGVPPAHLVV

SEQ ID NO: 856541 - protein, 17 aa, Mycobacterium
RQRGYAVGLHLLPDVRL

SEQ ID NO: 856542 - protein, 17 aa, Mycobacterium
RQRHSSLLPLLHNYRQP

SEQ ID NO: 856543 - protein, 20 aa, Mycobacterium
RQRHWVEPKHMAWAQIPTAS

SEQ ID NO: 856544 - protein, 33 aa, Mycobacterium
RQRIGMVFQQFNLFPHRSVLDNVTLGPRRLKGL

SEQ ID NO: 856545 - protein, 23 aa, Mycobacterium
RQRITLLSWEWGISLAYIARSLT

SEQ ID NO: 856546 - protein, 18 aa, Mycobacterium
RQRIVGIAGIDTRAVVRH

SEQ ID NO: 856547 - protein, 29 aa, Mycobacterium
RQRKQPPLQRLLRALLGFDAKLNQYTRGK

SEQ ID NO: 856548 - protein, 30 aa, Mycobacterium
RQRKQPPLQRLLRALLGFDAKLSQYTRGKA

SEQ ID NO: 856549 - protein, 24 aa, Mycobacterium
RQRLAALVCLFLLGTEEPRDAVEA

SEQ ID NO: 856550 - protein, 20 aa, Mycobacterium
RQRLATRLGYSETVFVDLPA

SEQ ID NO: 856551 - protein, 32 aa, Mycobacterium
RQRLMRPGVVLAPRKQWPTGLAKLGIDLSGKI

SEQ ID NO: 856552 - protein, 19 aa, Mycobacterium
RQRLQPAAALTDPGGQLGD

SEQ ID NO: 856553 - protein, 17 aa, Mycobacterium
RQRLRGVGGHREQHALQ

SEQ ID NO: 856554 - protein, 29 aa, Mycobacterium
RQRLWARSGYLQPHWPAPYGRAADSVEQL

SEQ ID NO: 856555 - protein, 19 aa, Mycobacterium
RQRMALARALAVDPQVLLL

SEQ ID NO: 856556 - protein, 29 aa, Mycobacterium
RQRMHVLFDVCTSTIWARRVLAGGPFPDV

SEQ ID NO: 856557 - protein, 22 aa, Mycobacterium
RQRPHGVAALITILASAMVTGR

SEQ ID NO: 856558 - protein, 29 aa, Mycobacterium
RQRQNSVLQMLLLLLRDPKNLQPAEPARG

SEQ ID NO: 856559 - protein, 26 aa, Mycobacterium
RQRRAFGGALIDKPLMRRKLAEMIVD

SEQ ID NO: 856560 - protein, 28 aa, Mycobacterium
RQRRDIGMVFQRFNLFGHRTALENIIEG

SEQ ID NO: 856561 - protein, 23 aa, Mycobacterium
RQRRKLMVPPFSGRRIDAYVKIV

SEQ ID NO: 856562 - protein, 27 aa, Mycobacterium
RQRRQRLRLRSGRIADRFLVQGVLPDR

SEQ ID NO: 856563 - protein, 24 aa, Mycobacterium
RQRRRADAILKRRTDRLPFLAPID

SEQ ID NO: 856564 - protein, 19 aa, Mycobacterium
RQRRRDGRDAGRRRPPILT

SEQ ID NO: 856565 - protein, 21 aa, Mycobacterium
RQRRVAGRAAQLPRVAPAGQQ

SEQ ID NO: 856566 - protein, 20 aa, Mycobacterium
RQRSDFFQTLRDIAGEDAPC

SEQ ID NO: 856567 - protein, 24 aa, Mycobacterium
RQRTLLAQAFAQQAPILLLDEPTA

SEQ ID NO: 856568 - protein, 33 aa, Mycobacterium
RQRVALARALVGRPRVLLLDEPLGALDLKLREQ

SEQ ID NO: 856569 - protein, 20 aa, Mycobacterium
RQRVALFADIQLIALIAQNP

SEQ ID NO: 856570 - protein, 24 aa, Mycobacterium
RQRVGIARALALEPTLLIADEPTS

SEQ ID NO: 856571 - protein, 29 aa, Mycobacterium
RQRVHQLRRTAMFPAPLADLRGGAVWDAA

SEQ ID NO: 856572 - protein, 20 aa, Mycobacterium
RQRVQRLGNVKFLDGHDVIE

SEQ ID NO: 856573 - protein, 20 aa, Mycobacterium
RQRVTLRPDPRGRQAGVQGS

SEQ ID NO: 856574 - protein, 24 aa, Mycobacterium
RQRYANRRAALLPALRSAGFAVDH

SEQ ID NO: 856575 - protein, 38 aa, Mycobacterium
RQRYEAGLRRALAAMRSHRYFRLLDSLDELVASAGPAS

SEQ ID NO: 856576 - protein, 24 aa, Mycobacterium
RQRYGRFFKMAYNALPPGGIMLLH

SEQ ID NO: 856577 - protein, 27 aa, Mycobacterium
RQRYVEPYRMELQRLGRPVFGPTFEVD

SEQ ID NO: 856578 - protein, 21 aa, Mycobacterium
RQSILDLLQRLSHAAAIVVSA

SEQ ID NO: 856579 - protein, 17 aa, Mycobacterium
RQSLQLHYARTLDMWAA

SEQ ID NO: 856580 - protein, 19 aa, Mycobacterium
RQSNWLPAPLGPLGVTMRL

SEQ ID NO: 856581 - protein, 25 aa, Mycobacterium
RQSPRIRNFLLRTSVMRRFNGALCD

SEQ ID NO: 856582 - protein, 17 aa, Mycobacterium
RQSVSWTLVSSSLLRSL

SEQ ID NO: 856583 - protein, 25 aa, Mycobacterium
RQSWAGKAVLLKLIARMVRARVFGE

SEQ ID NO: 856584 - protein, 18 aa, Mycobacterium
RQSYLSIDALLAAITRTG

SEQ ID NO: 856585 - protein, 25 aa, Mycobacterium
RQTHFSVQQALRLLGLGTSAIIEVP

SEQ ID NO: 856586 - protein, 19 aa, Mycobacterium
RQTIPTNRRYKVVSLTDAG

SEQ ID NO: 856587 - protein, 23 aa, Mycobacterium
RQTRLIRLMHLPTRDADSLRIAI

SEQ ID NO: 856588 - protein, 22 aa, Mycobacterium
RQTRRHARIAKLLGIKHFVAAV

SEQ ID NO: 856589 - protein, 25 aa, Mycobacterium
RQTRTLRRVLSTSLPVLVDADALTM

SEQ ID NO: 856590 - protein, 20 aa, Mycobacterium
RQTVIDRGLIGDKLSLEELD

SEQ ID NO: 856591 - protein, 21 aa, Mycobacterium
RQTVYRYFPTADALMHAASLA

SEQ ID NO: 856592 - protein, 23 aa, Mycobacterium
RQTYQAQWVTARTMEFVQGWEQD

SEQ ID NO: 856593 - protein, 24 aa, Mycobacterium
RQVAPLAKFYSVPPADLIVIHDEL

SEQ ID NO: 856594 - protein, 30 aa, Mycobacterium
RQVDDLDYYLVLAKWKLAIVLEQGFQRAGD

SEQ ID NO: 856595 - protein, 33 aa, Mycobacterium
RQVDDLDYYLVLAKWKLAIVLEQGFQRAGDDEK

SEQ ID NO: 856596 - protein, 23 aa, Mycobacterium
RQVFKDYVAFPALTSLSPGATYM

SEQ ID NO: 856597 - protein, 36 aa, Mycobacterium
RQVGIKIWVDGSPWIGNIDLTFPYLDTDATRTIGVV

SEQ ID NO: 856598 - protein, 24 aa, Mycobacterium
RQVGPLAKFYSVPPADIVVVHDDL

SEQ ID NO: 856599 - protein, 19 aa, Mycobacterium
RQVGPLATFYSVAPADIVV

SEQ ID NO: 856600 - protein, 20 aa, Mycobacterium
RQVIALLDAGLLRERADLAV

SEQ ID NO: 856601 - protein, 19 aa, Mycobacterium
RQVLAAWIGIPTELGPAED

SEQ ID NO: 856602 - protein, 24 aa, Mycobacterium
RQVLDYLLRRRGMLTSNVGEAYGF

SEQ ID NO: 856603 - protein, 20 aa, Mycobacterium
RQVLPMLIAKAVPGELKIVH

SEQ ID NO: 856604 - protein, 20 aa, Mycobacterium
RQVLRHQSGLPEYFDSVTDV

SEQ ID NO: 856605 - protein, 24 aa, Mycobacterium
RQVNVIFTRALRPGPPNPAPLVRH

SEQ ID NO: 856606 - protein, 23 aa, Mycobacterium
RQVPGLWTIPHTAPGKSQIGGAS

SEQ ID NO: 856607 - protein, 32 aa, Mycobacterium
RQVQRLLFDAGWMRWGWPTRIGGLGGSPMLRA

SEQ ID NO: 856608 - protein, 23 aa, Mycobacterium
RQVVSIPPGLLKYGRHALSDPQL

SEQ ID NO: 856609 - protein, 19 aa, Mycobacterium
RQVVSLLAAGRPVIAHCFA

SEQ ID NO: 856610 - protein, 21 aa, Mycobacterium
RQVWPEIWTAIGPMLAGVVAT

SEQ ID NO: 856611 - protein, 18 aa, Mycobacterium
RQWIREYQDRLEILGQRA

SEQ ID NO: 856612 - protein, 37 aa, Mycobacterium
RQWLEIRYLDSLSDVFWPAVVFTLVTLLDDPGAAELA

SEQ ID NO: 856613 - protein, 22 aa, Mycobacterium
RQWLEIRYLDSVPDALWPAVVF

SEQ ID NO: 856614 - protein, 17 aa, Mycobacterium
RQWPVDRFAAVAAALSD

SEQ ID NO: 856615 - protein, 22 aa, Mycobacterium
RQWRDRFVLAQRIGPTMAALSA

SEQ ID NO: 856616 - protein, 17 aa, Mycobacterium
RQWVLGGGEDHALVATF

SEQ ID NO: 856617 - protein, 18 aa, Mycobacterium
RQWWGGMWADRILQSDLS

SEQ ID NO: 856618 - protein, 19 aa, Mycobacterium
RQYLPILEKDWSFGNPAAT

SEQ ID NO: 856619 - protein, 23 aa, Mycobacterium
RQYRDMRILGIGGGTTEILTALS

SEQ ID NO: 856620 - protein, 22 aa, Mycobacterium
RQYRDMRILGIGGGTTEILTSL

SEQ ID NO: 856621 - protein, 23 aa, Mycobacterium
RQYRDMRILGIGGGTTEILTSLA

SEQ ID NO: 856622 - protein, 18 aa, Mycobacterium
RQYRYAYAATGKPGWFLF

SEQ ID NO: 856623 - protein, 17 aa, Mycobacterium
RRAAELGWTSLLIPEQL

SEQ ID NO: 856624 - protein, 18 aa, Mycobacterium
RRAAEMLKPCTLELGGKS

SEQ ID NO: 856625 - protein, 21 aa, Mycobacterium
RRAAHAFGLSATWLQMELGLI

SEQ ID NO: 856626 - protein, 32 aa, Mycobacterium
RRAALAMVRRHRLMETFLVQELGYGWDEVHDE

SEQ ID NO: 856627 - protein, 19 aa, Mycobacterium
RRAAPLGDPRLDLCDLYVF

SEQ ID NO: 856628 - protein, 26 aa, Mycobacterium
RRAAPLLPTVLLGKTARYLVSGAATA

SEQ ID NO: 856629 - protein, 18 aa, Mycobacterium
RRAAPMLPTVLLGETSRY

SEQ ID NO: 856630 - protein, 21 aa, Mycobacterium
RRAAVIPAHYPGHGGATVVAR

SEQ ID NO: 856631 - protein, 21 aa, Mycobacterium
RRACLPVWRAAAARARVTPGG

SEQ ID NO: 856632 - protein, 25 aa, Mycobacterium
RRADELLLAALRPVDTATAPIPPAY

SEQ ID NO: 856633 - protein, 17 aa, Mycobacterium
RRADTMWAFLRSKANTI

SEQ ID NO: 856634 - protein, 21 aa, Mycobacterium
RRAEATLFTKAESWYMGANVP

SEQ ID NO: 856635 - protein, 27 aa, Mycobacterium
RRAEEHRPLWYLMPDGVVQYVSKRRLY

SEQ ID NO: 856636 - protein, 23 aa, Mycobacterium
RRAEVTSLLRFAGGLHIVAGRVV

SEQ ID NO: 856637 - protein, 20 aa, Mycobacterium
RRAFADLMWDYQFGDRHNAM

SEQ ID NO: 856638 - protein, 21 aa, Mycobacterium
RRAFSWLPAQFASQSDAPVGA

SEQ ID NO: 856639 - protein, 25 aa, Mycobacterium
RRAFYRYHASLMEPWDGPASITFTD

SEQ ID NO: 856640 - protein, 20 aa, Mycobacterium
RRAGAPLTRLAGRELTTPAW

SEQ ID NO: 856641 - protein, 25 aa, Mycobacterium
RRAGEFLAVARLFWDSWAEDAVLAD

SEQ ID NO: 856642 - protein, 26 aa, Mycobacterium
RRAGLTAARFVACPFGGAGTRMYRTG

SEQ ID NO: 856643 - protein, 18 aa, Mycobacterium
RRAHARLSADYRARSLTI

SEQ ID NO: 856644 - protein, 18 aa, Mycobacterium
RRAHPFTIADLAAAVLVI

SEQ ID NO: 856645 - protein, 21 aa, Mycobacterium
RRAIMKPWMGEVFDTAYIPER

SEQ ID NO: 856646 - protein, 19 aa, Mycobacterium
RRALGKKTWPGVWTNSFCG

SEQ ID NO: 856647 - protein, 18 aa, Mycobacterium
RRALLAHKVIFFRHQHHL

SEQ ID NO: 856648 - protein, 18 aa, Mycobacterium
RRALPGDPEFGDPLSVAG

SEQ ID NO: 856649 - protein, 21 aa, Mycobacterium
RRALRALVPLSPDHPVRRMSL

SEQ ID NO: 856650 - protein, 30 aa, Mycobacterium
RRALTYNVSLLLVLLRKRLVEFETTGSEGR

SEQ ID NO: 856651 - protein, 27 aa, Mycobacterium
RRALVKYLTARPRDFLAVATPGAGKTT

SEQ ID NO: 856652 - protein, 17 aa, Mycobacterium
RRAPAPAPPEVLRTWMS

SEQ ID NO: 856653 - protein, 31 aa, Mycobacterium
RRAPRSRVLFVDYLTLLPPAGVPAPPLSAAH

SEQ ID NO: 856654 - protein, 20 aa, Mycobacterium
RRAPVLVTDLAEPAGRRWPL

SEQ ID NO: 856655 - protein, 31 aa, Mycobacterium
RRAQPWLADHVIGGLVLLPGTGFVELVIRAG

SEQ ID NO: 856656 - protein, 21 aa, Mycobacterium
RRARAAYLVDELLGAYARAVD

SEQ ID NO: 856657 - protein, 27 aa, Mycobacterium
RRARAMAMVILALPGAVFLYNGQELGL

SEQ ID NO: 856658 - protein, 22 aa, Mycobacterium
RRARAVPVYAALRSLGRAGLAD

SEQ ID NO: 856659 - protein, 20 aa, Mycobacterium
RRARAWLADNLPRLDSGDAM

SEQ ID NO: 856660 - protein, 21 aa, Mycobacterium
RRARDCLRYARMLDLVVEDEG

SEQ ID NO: 856661 - protein, 20 aa, Mycobacterium
RRAREIAPAAPAPAAVSCAR

SEQ ID NO: 856662 - protein, 22 aa, Mycobacterium
RRARFRLIAVDRPGYGRSTFQE

SEQ ID NO: 856663 - protein, 18 aa, Mycobacterium
RRARLTLDHLDGYEVHDC

SEQ ID NO: 856664 - protein, 18 aa, Mycobacterium
RRARRDIAVSLPQREYEL

SEQ ID NO: 856665 - protein, 31 aa, Mycobacterium
RRARVQSVLLPRLLDWLSYAPDPDGGLLAYR

SEQ ID NO: 856666 - protein, 23 aa, Mycobacterium
RRASWVYYAVVPEALNALSRLLS

SEQ ID NO: 856667 - protein, 20 aa, Mycobacterium
RRATQLRARAARRAAAQPGL

SEQ ID NO: 856668 - protein, 18 aa, Mycobacterium
RRAVLREFHVSPTPIHSV

SEQ ID NO: 856669 - protein, 23 aa, Mycobacterium
RRAVLRVLRALGHPLSIVAIAEH

SEQ ID NO: 856670 - protein, 20 aa, Mycobacterium
RRAVMKPWMGEVFDTAYIPD

SEQ ID NO: 856671 - protein, 22 aa, Mycobacterium
RRAWEALGRWEKPFLAIFGARD

SEQ ID NO: 856672 - protein, 30 aa, Mycobacterium
RRAWEFLDVVTRLWDSWEPGWLVADKQSGR

SEQ ID NO: 856673 - protein, 17 aa, Mycobacterium
RRAYFMIKAEMADVKAV

SEQ ID NO: 856674 - protein, 17 aa, Mycobacterium
RRAYLPAVFSTGGDTDN

SEQ ID NO: 856675 - protein, 18 aa, Mycobacterium
RRAYLQFRWQRADRQLTP

SEQ ID NO: 856676 - protein, 30 aa, Mycobacterium
RRCATGYFLTRAAMRWYWAQYVGAQTVFDP

SEQ ID NO: 856677 - protein, 31 aa, Mycobacterium
RRCEDLGIDSLWLYDHLYGPGMPDYPSMEAW

SEQ ID NO: 856678 - protein, 17 aa, Mycobacterium
RRCFASLFTDRAIHYRI

SEQ ID NO: 856679 - protein, 18 aa, Mycobacterium
RRCFASLFTDRAIHYRID

SEQ ID NO: 856680 - protein, 19 aa, Mycobacterium
RRCFASLFTDRAIHYRVDQ

SEQ ID NO: 856681 - protein, 18 aa, Mycobacterium
RRCIQVVYQNPYSSFDPR

SEQ ID NO: 856682 - protein, 18 aa, Mycobacterium
RRCRAVQLVPFDPHLEEG

SEQ ID NO: 856683 - protein, 23 aa, Mycobacterium
RRCRDHLPATSLAWGYWQNSGIA

SEQ ID NO: 856684 - protein, 21 aa, Mycobacterium
RRCVGSLKTRYGDSPAMRRIV

SEQ ID NO: 856685 - protein, 17 aa, Mycobacterium
RRDALWAAALETAIARR

SEQ ID NO: 856686 - protein, 21 aa, Mycobacterium
RRDALWAAALHIAIARRTGDT

SEQ ID NO: 856687 - protein, 18 aa, Mycobacterium
RRDALWAAALRTAIARRS

SEQ ID NO: 856688 - protein, 28 aa, Mycobacterium
RRDDAVHLRYISEGALIMFAGGDPWKIN

SEQ ID NO: 856689 - protein, 17 aa, Mycobacterium
RRDDLLAVRYCRGATED

SEQ ID NO: 856690 - protein, 23 aa, Mycobacterium
RRDDWLKVMGIPMPSSSIVIGRA

SEQ ID NO: 856691 - protein, 23 aa, Mycobacterium
RRDEAIIRLMAETGIRAGELYDL

SEQ ID NO: 856692 - protein, 22 aa, Mycobacterium
RRDEALHWFLRSAAADSEGVTD

SEQ ID NO: 856693 - protein, 18 aa, Mycobacterium
RRDEALRWFLRAADADLE

SEQ ID NO: 856694 - protein, 17 aa, Mycobacterium
RRDEFLDMVTAWTRSRT

SEQ ID NO: 856695 - protein, 25 aa, Mycobacterium
RRDEPWFDPAGLFLAFDDSAGDQGG

SEQ ID NO: 856696 - protein, 26 aa, Mycobacterium
RRDEPWFDPAGLFLALDESEADEPGR

SEQ ID NO: 856697 - protein, 21 aa, Mycobacterium
RRDEWLHRRFGDLVRLVFAVV

SEQ ID NO: 856698 - protein, 17 aa, Mycobacterium
RRDFGDKLPSDVFREHS

SEQ ID NO: 856699 - protein, 20 aa, Mycobacterium
RRDGFQTLQPRLPLPGISTV

SEQ ID NO: 856700 - protein, 26 aa, Mycobacterium
RRDGMSLLPLAALNSVTLLGAETVGR

SEQ ID NO: 856701 - protein, 23 aa, Mycobacterium
RRDGWGRVSALAEALLIAQEAPE

SEQ ID NO: 856702 - protein, 25 aa, Mycobacterium
RRDGYVLVIGLNRPAKRNAFDKTML

SEQ ID NO: 856703 - protein, 24 aa, Mycobacterium
RRDIAPRRILPDSAIIDAALANPT

SEQ ID NO: 856704 - protein, 18 aa, Mycobacterium
RRDIDVAAYLPHSPLRVY

SEQ ID NO: 856705 - protein, 17 aa, Mycobacterium
RRDIDVAVYLPHSPLRV

SEQ ID NO: 856706 - protein, 27 aa, Mycobacterium
RRDLAPLANLELFSVAPLLTAKMYREL

SEQ ID NO: 856707 - protein, 24 aa, Mycobacterium
RRDLEHFAWDPPVVKVNYALREPV

SEQ ID NO: 856708 - protein, 23 aa, Mycobacterium
RRDLSDPEWLPAASVYCSHECSD

SEQ ID NO: 856709 - protein, 24 aa, Mycobacterium
RRDLSSIVFILQGAAVMPPSLMHT

SEQ ID NO: 856710 - protein, 18 aa, Mycobacterium
RRDPAAAAVILPTDGRRT

SEQ ID NO: 856711 - protein, 24 aa, Mycobacterium
RRDPALWQRLEQLGLARLTGAEDS

SEQ ID NO: 856712 - protein, 27 aa, Mycobacterium
RRDPPRRLLDLALNIGCDFSIDTDAHA

SEQ ID NO: 856713 - protein, 18 aa, Mycobacterium
RRDRADAILRRRTDRRPF

SEQ ID NO: 856714 - protein, 18 aa, Mycobacterium
RRDRKTVIEDLSFTVNRG

SEQ ID NO: 856715 - protein, 18 aa, Mycobacterium
RRDRLRPSVPVDGAVLLL

SEQ ID NO: 856716 - protein, 29 aa, Mycobacterium
RRDRRTFTASYLILAAGTWGTQHLLFKMR

SEQ ID NO: 856717 - protein, 30 aa, Mycobacterium
RRDRRTFTATYLILAAGTWGTQHLLFKMRD

SEQ ID NO: 856718 - protein, 20 aa, Mycobacterium
RRDRTLIITINRPEARNAFN

SEQ ID NO: 856719 - protein, 18 aa, Mycobacterium
RRDRVLIITINRPEARNA

SEQ ID NO: 856720 - protein, 24 aa, Mycobacterium
RRDTATRLLLLRHGQTELSVQRRY

SEQ ID NO: 856721 - protein, 27 aa, Mycobacterium
RRDTLGQKYPWALGRPAREVWAEIWDD

SEQ ID NO: 856722 - protein, 17 aa, Mycobacterium
RRDTRQVLHRLIDGMLA

SEQ ID NO: 856723 - protein, 27 aa, Mycobacterium
RRDTSQWGWTWPLNRRVLYNRASADPR

SEQ ID NO: 856724 - protein, 17 aa, Mycobacterium
RRDVKIFAPTDMSAFAV

SEQ ID NO: 856725 - protein, 24 aa, Mycobacterium
RRDVTLLWPPAEPGGYSLIVDGAA

SEQ ID NO: 856726 - protein, 18 aa, Mycobacterium
RRDWACLYCFFGRVGCMI

SEQ ID NO: 856727 - protein, 23 aa, Mycobacterium
RREALTWLCNAVSRMANNPTAAH

SEQ ID NO: 856728 - protein, 26 aa, Mycobacterium
RREDQAHRFAWLPFGGGAHKCIGMHF

SEQ ID NO: 856729 - protein, 17 aa, Mycobacterium
RREEFRASRIMLERARA

SEQ ID NO: 856730 - protein, 20 aa, Mycobacterium
RREFTHMITALFLDGVKAPT

SEQ ID NO: 856731 - protein, 19 aa, Mycobacterium
RREGYPQPAPAWALRGGVL

SEQ ID NO: 856732 - protein, 24 aa, Mycobacterium
RREIDRVRLFYYHAERPMADTVLR

SEQ ID NO: 856733 - protein, 20 aa, Mycobacterium
RREIEILRMLEAGRTNREIA

SEQ ID NO: 856734 - protein, 23 aa, Mycobacterium
RREIRDIVAYLRVLDNPGDSVSM

SEQ ID NO: 856735 - protein, 17 aa, Mycobacterium
RRELGLPRATYPSPRRV

SEQ ID NO: 856736 - protein, 19 aa, Mycobacterium
RRELLPRTVEVEPGVFVWC

SEQ ID NO: 856737 - protein, 27 aa, Mycobacterium
RRELMESLRPRLAAPQWARASGSPTVA

SEQ ID NO: 856738 - protein, 22 aa, Mycobacterium
RRENPRLPVLLLTAKDAVEDRI

SEQ ID NO: 856739 - protein, 19 aa, Mycobacterium
RREPPTEDLLSIVTHALID

SEQ ID NO: 856740 - protein, 19 aa, Mycobacterium
RREQPLPLGLRGLLTDLHS

SEQ ID NO: 856741 - protein, 17 aa, Mycobacterium
RRERLHYAGKHYQIPLP

SEQ ID NO: 856742 - protein, 23 aa, Mycobacterium
RRESVFDPVLHVADLSFDRIRVP

SEQ ID NO: 856743 - protein, 29 aa, Mycobacterium
RREVPIDLRLDWPAALRAAGFDPTARTAW

SEQ ID NO: 856744 - protein, 29 aa, Mycobacterium
RREVPVDLRFDWPTALHDAGFDASLPTAW

SEQ ID NO: 856745 - protein, 17 aa, Mycobacterium
RREVPWLEPLPDLANDP

SEQ ID NO: 856746 - protein, 19 aa, Mycobacterium
RREWDKIGTSVPFALVLGA

SEQ ID NO: 856747 - protein, 18 aa, Mycobacterium
RRFAAMMSGLDIRYDLGD

SEQ ID NO: 856748 - protein, 18 aa, Mycobacterium
RRFARERSRWLFSNPDMV

SEQ ID NO: 856749 - protein, 18 aa, Mycobacterium
RRFARESSRWIFTNPDMI

SEQ ID NO: 856750 - protein, 17 aa, Mycobacterium
RRFAYMVAELRPHRLWP

SEQ ID NO: 856751 - protein, 19 aa, Mycobacterium
RRFDVELTVPSLVRAEVVL

SEQ ID NO: 856752 - protein, 17 aa, Mycobacterium
RRFELRAADGRLLAPED

SEQ ID NO: 856753 - protein, 17 aa, Mycobacterium
RRFETALRALPDRQRRH

SEQ ID NO: 856754 - protein, 17 aa, Mycobacterium
RRFETSLRALPDRQRQY

SEQ ID NO: 856755 - protein, 18 aa, Mycobacterium
RRFGDAFIPMDETLAHAA

SEQ ID NO: 856756 - protein, 19 aa, Mycobacterium
RRFGIPVVAHLPGVGRNYQ

SEQ ID NO: 856757 - protein, 27 aa, Mycobacterium
RRFGTWHYWWQAHLLDNLVDAQLRDPA

SEQ ID NO: 856758 - protein, 18 aa, Mycobacterium
RRFLDYRETLGFEVLALT

SEQ ID NO: 856759 - protein, 23 aa, Mycobacterium
RRFLEAFAVTGLRPEAFCPAYGL

SEQ ID NO: 856760 - protein, 17 aa, Mycobacterium
RRFPSMFEPVHGSAPDI

SEQ ID NO: 856761 - protein, 31 aa, Mycobacterium
RRFRDGDVPLALMIAYLPPGLGKAVEPLLSS

SEQ ID NO: 856762 - protein, 23 aa, Mycobacterium
RRFRELWAVLPELADVTHSFRNV

SEQ ID NO: 856763 - protein, 23 aa, Mycobacterium
RRFRGDRPVLRKAGYAALVANLV

SEQ ID NO: 856764 - protein, 17 aa, Mycobacterium
RRFRHAVKFLRWRPDRD

SEQ ID NO: 856765 - protein, 24 aa, Mycobacterium
RRFRRAHHRPLGQQVPRSLALRGV

SEQ ID NO: 856766 - protein, 19 aa, Mycobacterium
RRFRSLGMSIPDIKALLSA

SEQ ID NO: 856767 - protein, 25 aa, Mycobacterium
RRFTPILSELRRPLAALAAGLLPLV

SEQ ID NO: 856768 - protein, 17 aa, Mycobacterium
RRFTRCYSPANAEGARH

SEQ ID NO: 856769 - protein, 29 aa, Mycobacterium
RRFVEATGIPFLPMSMAKGLLPDSHPQSA

SEQ ID NO: 856770 - protein, 17 aa, Mycobacterium
RRFVRYRESLGFQVLPL

SEQ ID NO: 856771 - protein, 22 aa, Mycobacterium
RRFWRDEYLMNGQIGRFSKPYV

SEQ ID NO: 856772 - protein, 24 aa, Mycobacterium
RRFYESVFEWPVLIELPANADEAT

SEQ ID NO: 856773 - protein, 24 aa, Mycobacterium
RRGAATRLLLLRHGQTELSVQRRY

SEQ ID NO: 856774 - protein, 25 aa, Mycobacterium
RRGAGWLKVKPVHTLDLVVLAVEWG

SEQ ID NO: 856775 - protein, 25 aa, Mycobacterium
RRGALSATRFVACPFGAGGSRMYRT

SEQ ID NO: 856776 - protein, 18 aa, Mycobacterium
RRGAPLLAVHAWSDANVA

SEQ ID NO: 856777 - protein, 26 aa, Mycobacterium
RRGARELLGRYLINKARNIRGSGDVL

SEQ ID NO: 856778 - protein, 18 aa, Mycobacterium
RRGARINSISPGIISTPM

SEQ ID NO: 856779 - protein, 24 aa, Mycobacterium
RRGARIVVVAPYEGPLRDATAGRS

SEQ ID NO: 856780 - protein, 24 aa, Mycobacterium
RRGDGWIKLVGDWIDRGAGDLAPL

SEQ ID NO: 856781 - protein, 23 aa, Mycobacterium
RRGDGWVKLVGDWIDRQVGDLAP

SEQ ID NO: 856782 - protein, 23 aa, Mycobacterium
RRGDRLPLEYVIRKQSRDTAQLF

SEQ ID NO: 856783 - protein, 26 aa, Mycobacterium
RRGEDHRFLWPGFGENSRVMKWIVDR

SEQ ID NO: 856784 - protein, 25 aa, Mycobacterium
RRGEFRPRPSFLSPGKKILHDDRLD

SEQ ID NO: 856785 - protein, 26 aa, Mycobacterium
RRGEPWFDPAGFFLAFDEDTGALLGF

SEQ ID NO: 856786 - protein, 26 aa, Mycobacterium
RRGEPWFDPAGLILAFDASPGHEAKL

SEQ ID NO: 856787 - protein, 19 aa, Mycobacterium
RRGFFRSEPERILIGDWRY

SEQ ID NO: 856788 - protein, 29 aa, Mycobacterium
RRGFTAFGQTPWRLDRQALFAAGLPGVAD

SEQ ID NO: 856789 - protein, 24 aa, Mycobacterium
RRGGFSATRFVACPFGAAGSRMYR

SEQ ID NO: 856790 - protein, 19 aa, Mycobacterium
RRGHAMLKTLMAASLEHED

SEQ ID NO: 856791 - protein, 19 aa, Mycobacterium
RRGHRRPPRRPGRAAPTRR

SEQ ID NO: 856792 - protein, 21 aa, Mycobacterium
RRGKPAIPAWEDVLLGVRSGG

SEQ ID NO: 856793 - protein, 24 aa, Mycobacterium
RRGLARPYRPVQFARAVNLASRFS

SEQ ID NO: 856794 - protein, 26 aa, Mycobacterium
RRGLCGYRRFFSITSLAGLRQEDRAV

SEQ ID NO: 856795 - protein, 20 aa, Mycobacterium
RRGLDICCRLVLRGCEHAKK

SEQ ID NO: 856796 - protein, 35 aa, Mycobacterium
RRGLDPFTFRIAQTVGWRLWMGVAFGLTSDPDELR

SEQ ID NO: 856797 - protein, 20 aa, Mycobacterium
RRGLDPGLAPLYAQALVGSV

SEQ ID NO: 856798 - protein, 34 aa, Mycobacterium
RRGLIAEFGISWILPRLTSWAVALDLLLSGRTFL

SEQ ID NO: 856799 - protein, 34 aa, Mycobacterium
RRGLIAEFGISWILPRLTTWGVALDLLLSGRTFL

SEQ ID NO: 856800 - protein, 18 aa, Mycobacterium
RRGLIAEYGISWILPRLA

SEQ ID NO: 856801 - protein, 18 aa, Mycobacterium
RRGLIYGRVKTLTGFGLG

SEQ ID NO: 856802 - protein, 18 aa, Mycobacterium
RRGLKAAITAVRAWRRAK

SEQ ID NO: 856803 - protein, 31 aa, Mycobacterium
RRGLLLLTCGAWGQVVRFIPALVVSADEVEE

SEQ ID NO: 856804 - protein, 19 aa, Mycobacterium
RRGLPLITDSFQYPIEGFT

SEQ ID NO: 856805 - protein, 23 aa, Mycobacterium
RRGLPMHYFPPRARGFAPFPLEP

SEQ ID NO: 856806 - protein, 24 aa, Mycobacterium
RRGLTIDLGFAWTELDGRQLAFVD

SEQ ID NO: 856807 - protein, 35 aa, Mycobacterium
RRGLVNGLVYPVPDPRYPFLGVHLTPRVDGEVLIG

SEQ ID NO: 856808 - protein, 19 aa, Mycobacterium
RRGLWATHLGADLGGQGYG

SEQ ID NO: 856809 - protein, 22 aa, Mycobacterium
RRGMNVFHRPVPDALTALCTVL

SEQ ID NO: 856810 - protein, 22 aa, Mycobacterium
RRGMQLPVYFGNRNWEPFVEDT

SEQ ID NO: 856811 - protein, 19 aa, Mycobacterium
RRGNALPSHTHRSLANIFS

SEQ ID NO: 856812 - protein, 28 aa, Mycobacterium
RRGNSPLWHYNFLRRPPIPPDSDLIEKS

SEQ ID NO: 856813 - protein, 18 aa, Mycobacterium
RRGNVLLITINRPEARNA

SEQ ID NO: 856814 - protein, 22 aa, Mycobacterium
RRGPDFSAMLEPVFGRDALRGL

SEQ ID NO: 856815 - protein, 29 aa, Mycobacterium
RRGPIDRFHRRLLWPIRSSAGEVIGFGAR

SEQ ID NO: 856816 - protein, 30 aa, Mycobacterium
RRGPIDRFHRRLLWPIRTAAGEVIGFGARR

SEQ ID NO: 856817 - protein, 29 aa, Mycobacterium
RRGPMDRFHRRLLWPIRASGGEVIGFGAR

SEQ ID NO: 856818 - protein, 29 aa, Mycobacterium
RRGPMDRFHRRLLWPIRSSAGEVIGFGAR

SEQ ID NO: 856819 - protein, 23 aa, Mycobacterium
RRGPTGRGRRRDAGRRGRRVGGR

SEQ ID NO: 856820 - protein, 25 aa, Mycobacterium
RRGQERLWLDHIVAGDLFGNANTEL

SEQ ID NO: 856821 - protein, 34 aa, Mycobacterium
RRGQLLTPVTRAVAAWLWSRRTATLAGLSAAALH

SEQ ID NO: 856822 - protein, 25 aa, Mycobacterium
RRGQPRLRPPFPAVAGLYASPTVVN

SEQ ID NO: 856823 - protein, 24 aa, Mycobacterium
RRGREHLRRYYGFKPDYAALNVAD

SEQ ID NO: 856824 - protein, 25 aa, Mycobacterium
RRGRPVLTTPAWPVTIKDGAGLNAP

SEQ ID NO: 856825 - protein, 20 aa, Mycobacterium
RRGRSTLPFVPAVVDLASPT

SEQ ID NO: 856826 - protein, 18 aa, Mycobacterium
RRGRVISIHPQEAALQHA

SEQ ID NO: 856827 - protein, 31 aa, Mycobacterium
RRGRVQSVLLPRLLHWMSYAPDPDGGLLAYR

SEQ ID NO: 856828 - protein, 29 aa, Mycobacterium
RRGRVQSVLLPRLLNWMSYTPDPDGGLLA

SEQ ID NO: 856829 - protein, 31 aa, Mycobacterium
RRGRWNVPKKLTTFALFGGGVIDLRYADFTS

SEQ ID NO: 856830 - protein, 19 aa, Mycobacterium
RRGSQPTLWRALNPGTEAT

SEQ ID NO: 856831 - protein, 17 aa, Mycobacterium
RRGSTVALVYLAPDAKP

SEQ ID NO: 856832 - protein, 25 aa, Mycobacterium
RRGTRYWDPLATLGYLAARTRRIRL

SEQ ID NO: 856833 - protein, 21 aa, Mycobacterium
RRGVALTRVIDWMAAKPAELA

SEQ ID NO: 856834 - protein, 17 aa, Mycobacterium
RRGVFHNSRRLENGNWA

SEQ ID NO: 856835 - protein, 20 aa, Mycobacterium
RRGWRLVRVGADLLRHRPDV

SEQ ID NO: 856836 - protein, 22 aa, Mycobacterium
RRGYGGKFFVSPDLVTPPISAL

SEQ ID NO: 856837 - protein, 28 aa, Mycobacterium
RRHCHIDPHTIVFAPPRSIPKTTSGKIR

SEQ ID NO: 856838 - protein, 23 aa, Mycobacterium
RRHDAMLTAMRLLLAHKDLGQIN

SEQ ID NO: 856839 - protein, 26 aa, Mycobacterium
RRHDAMLTAMRLLLAHKDLGQINGLP

SEQ ID NO: 856840 - protein, 20 aa, Mycobacterium
RRHDHVHRWAEILSIAGLVE

SEQ ID NO: 856841 - protein, 21 aa, Mycobacterium
RRHDMLFDHVAGLAATVMGMP

SEQ ID NO: 856842 - protein, 24 aa, Mycobacterium
RRHDTFRSWFEDAGDGKFIRHSIE

SEQ ID NO: 856843 - protein, 32 aa, Mycobacterium
RRHDVFGVRHRLLAAWIAMLSGDLSGAVQWLP

SEQ ID NO: 856844 - protein, 19 aa, Mycobacterium
RRHELLRGLVPEISLIFGK

SEQ ID NO: 856845 - protein, 25 aa, Mycobacterium
RRHFDWVRSWYDFAVPGIGNSALIE

SEQ ID NO: 856846 - protein, 29 aa, Mycobacterium
RRHGMVSPTVFWPIPRVYSGLVRIDRYET

SEQ ID NO: 856847 - protein, 20 aa, Mycobacterium
RRHGRVHRGLGGAVLIDHHP

SEQ ID NO: 856848 - protein, 20 aa, Mycobacterium
RRHHRQLYHLARLTSQTPED

SEQ ID NO: 856849 - protein, 31 aa, Mycobacterium
RRHIDDGKWPVWLSEDLATSVRRLLSVDKIV

SEQ ID NO: 856850 - protein, 17 aa, Mycobacterium
RRHIHRYPELGRQEYAT

SEQ ID NO: 856851 - protein, 21 aa, Mycobacterium
RRHLDGGMRHDPGWALVASLE

SEQ ID NO: 856852 - protein, 17 aa, Mycobacterium
RRHLEVRFDGHAALLSD

SEQ ID NO: 856853 - protein, 20 aa, Mycobacterium
RRHLFAVAGLTPRARLAPVP

SEQ ID NO: 856854 - protein, 18 aa, Mycobacterium
RRHLLDMNAAIGQLGRLI

SEQ ID NO: 856855 - protein, 21 aa, Mycobacterium
RRHRAVLSALGLPVSYEPDAL

SEQ ID NO: 856856 - protein, 18 aa, Mycobacterium
RRHRQIFVVAVNCTEPGG

SEQ ID NO: 856857 - protein, 27 aa, Mycobacterium
RRHRVRALFQHRLVAPRGQLGMLVVIE

SEQ ID NO: 856858 - protein, 21 aa, Mycobacterium
RRHSRRTRDAELKISSWHCDV

SEQ ID NO: 856859 - protein, 25 aa, Mycobacterium
RRHSVLQMLPLRDSERLRPLEPTRG

SEQ ID NO: 856860 - protein, 17 aa, Mycobacterium
RRHTALVLWAEPRGEIQ

SEQ ID NO: 856861 - protein, 25 aa, Mycobacterium
RRHTILRNYPIIGHLRYLLEAVGPE

SEQ ID NO: 856862 - protein, 19 aa, Mycobacterium
RRHVFYPRTLAPGTLADDL

SEQ ID NO: 856863 - protein, 35 aa, Mycobacterium
RRHVRRRLHLLEPLRYQLVDIPWQLHHPMWQEGCE

SEQ ID NO: 856864 - protein, 17 aa, Mycobacterium
RRHVVPEPPYGQGAAAA

SEQ ID NO: 856865 - protein, 23 aa, Mycobacterium
RRHVYPWVGWLVCHGVVPGDVLV

SEQ ID NO: 856866 - protein, 29 aa, Mycobacterium
RRHWPEPESLLLHALALRPGDDGSLPDTG

SEQ ID NO: 856867 - protein, 18 aa, Mycobacterium
RRIALRHSVDMVRVTMDI

SEQ ID NO: 856868 - protein, 27 aa, Mycobacterium
RRIARFGSGWIPWGSAFADLPAAIKAM

SEQ ID NO: 856869 - protein, 17 aa, Mycobacterium
RRIARNTQLLLLEESHV

SEQ ID NO: 856870 - protein, 23 aa, Mycobacterium
RRIDDAFLDPLQFRADSVLGVAG

SEQ ID NO: 856871 - protein, 32 aa, Mycobacterium
RRIDDQWFRYHQLFRDFLRHRLSRERVCDLHR

SEQ ID NO: 856872 - protein, 25 aa, Mycobacterium
RRIDLRDTALSAARLRTALPRGGVD

SEQ ID NO: 856873 - protein, 24 aa, Mycobacterium
RRIDPAALGFPLTGYIMVVVTQRK

SEQ ID NO: 856874 - protein, 26 aa, Mycobacterium
RRIEFRLDPPGGDIGLWREIERFPFV

SEQ ID NO: 856875 - protein, 33 aa, Mycobacterium
RRIEMARTVLIELLAWQFASPVRWIETQDLLFT

SEQ ID NO: 856876 - protein, 18 aa, Mycobacterium
RRIERAMMLLRRGDMSVT

SEQ ID NO: 856877 - protein, 17 aa, Mycobacterium
RRIERLTRELGGYGQSL

SEQ ID NO: 856878 - protein, 21 aa, Mycobacterium
RRIFELGVRAYLDGLWEHRRV

SEQ ID NO: 856879 - protein, 24 aa, Mycobacterium
RRIFPHTEVLPQYRGRGLATIMIA

SEQ ID NO: 856880 - protein, 19 aa, Mycobacterium
RRIGPPWRDGQSVIWQSVN

SEQ ID NO: 856881 - protein, 19 aa, Mycobacterium
RRIGRWRTAYLVLSGHTVD

SEQ ID NO: 856882 - protein, 23 aa, Mycobacterium
RRIGVEPFWPKGRHARLVNAMPF

SEQ ID NO: 856883 - protein, 29 aa, Mycobacterium
RRIIADEGLLGALRFAKNLLTQPAARKRV

SEQ ID NO: 856884 - protein, 18 aa, Mycobacterium
RRILATASALRDSAELYR

SEQ ID NO: 856885 - protein, 21 aa, Mycobacterium
RRILHQLYLGYPDSAAAQGIS

SEQ ID NO: 856886 - protein, 22 aa, Mycobacterium
RRILHQLYLGYPDSAAARGLAP

SEQ ID NO: 856887 - protein, 17 aa, Mycobacterium
RRILLKRVPELPASLAE

SEQ ID NO: 856888 - protein, 17 aa, Mycobacterium
RRILSQDRLFLVVQDLF

SEQ ID NO: 856889 - protein, 22 aa, Mycobacterium
RRILTTFVGVQRAPLELPGPLL

SEQ ID NO: 856890 - protein, 17 aa, Mycobacterium
RRINDQIVMLHITGYGL

SEQ ID NO: 856891 - protein, 18 aa, Mycobacterium
RRINPAIIYVVGSGFGLK

SEQ ID NO: 856892 - protein, 17 aa, Mycobacterium
RRIPIVVVAPTTRAKWA

SEQ ID NO: 856893 - protein, 18 aa, Mycobacterium
RRIPYTVVINNWDPRDGA

SEQ ID NO: 856894 - protein, 20 aa, Mycobacterium
RRIRSDLLALYGIHGPAVGE

SEQ ID NO: 856895 - protein, 27 aa, Mycobacterium
RRIRWRRRLPRKRAVPPAPAASYGCRT

SEQ ID NO: 856896 - protein, 25 aa, Mycobacterium
RRISQAPFTLLNISVRPSLLNPTPM

SEQ ID NO: 856897 - protein, 18 aa, Mycobacterium
RRITADSPFTLTGPAAGT

SEQ ID NO: 856898 - protein, 22 aa, Mycobacterium
RRITLATLRRELARAGLVLTTA

SEQ ID NO: 856899 - protein, 20 aa, Mycobacterium
RRIVKWMRFSKDKLRDRLDQ

SEQ ID NO: 856900 - protein, 18 aa, Mycobacterium
RRIWELEKRRAHVPWVTS

SEQ ID NO: 856901 - protein, 17 aa, Mycobacterium
RRKFDPEATLELVDKFR

SEQ ID NO: 856902 - protein, 26 aa, Mycobacterium
RRKGAEIVDRFFKELRIKAASAAMPV

SEQ ID NO: 856903 - protein, 23 aa, Mycobacterium
RRKHLTLVHKTNVLAFAGSLWSR

SEQ ID NO: 856904 - protein, 22 aa, Mycobacterium
RRKMFQLLFASLRRQRRLASRF

SEQ ID NO: 856905 - protein, 21 aa, Mycobacterium
RRKNVREHMAFARGVHSCPGG

SEQ ID NO: 856906 - protein, 20 aa, Mycobacterium
RRKPRDPWPEFPHLRTARGA

SEQ ID NO: 856907 - protein, 17 aa, Mycobacterium
RRKRKRGMLPPRRTRVV

SEQ ID NO: 856908 - protein, 25 aa, Mycobacterium
RRKSRKPAAKAAPAVLVARPVKAAP

SEQ ID NO: 856909 - protein, 18 aa, Mycobacterium
RRKWLPVHPVGRRTWPNG

SEQ ID NO: 856910 - protein, 18 aa, Mycobacterium
RRLAAETLGLPTSPYRFC

SEQ ID NO: 856911 - protein, 24 aa, Mycobacterium
RRLAARWRADPDTPPWARMYTTGS

SEQ ID NO: 856912 - protein, 20 aa, Mycobacterium
RRLAAWHPRLRFLEQTPALA

SEQ ID NO: 856913 - protein, 19 aa, Mycobacterium
RRLAGRLRFACLPTPATLA

SEQ ID NO: 856914 - protein, 18 aa, Mycobacterium
RRLAPFDVNLHYTDTRRL

SEQ ID NO: 856915 - protein, 31 aa, Mycobacterium
RRLASICTGTFILATAGLLAGRRATTHWRHA

SEQ ID NO: 856916 - protein, 18 aa, Mycobacterium
RRLATLGPLLQDLEARII

SEQ ID NO: 856917 - protein, 18 aa, Mycobacterium
RRLDGLYRRALWSATQSY

SEQ ID NO: 856918 - protein, 21 aa, Mycobacterium
RRLDMFLRRRGLARVANDGDL

SEQ ID NO: 856919 - protein, 22 aa, Mycobacterium
RRLDPRLVWQRPAEHRGGHHQP

SEQ ID NO: 856920 - protein, 25 aa, Mycobacterium
RRLDRAIIERLAPGGLLAIAALSEV

SEQ ID NO: 856921 - protein, 27 aa, Mycobacterium
RRLDRDHPLWECWIIEGLPVGRWATLV

SEQ ID NO: 856922 - protein, 27 aa, Mycobacterium
RRLDRDRPLWECWIIEGLAGGRWATLI

SEQ ID NO: 856923 - protein, 22 aa, Mycobacterium
RRLDSWVRRYPDVPVQVVASGT

SEQ ID NO: 856924 - protein, 35 aa, Mycobacterium
RRLEAGMVWVNNWHIIHPAYPFGGYKESGLGREGG

SEQ ID NO: 856925 - protein, 18 aa, Mycobacterium
RRLELLAELGWIVIRVVA

SEQ ID NO: 856926 - protein, 22 aa, Mycobacterium
RRLELLRRRLAGSGLREQDPAE

SEQ ID NO: 856927 - protein, 17 aa, Mycobacterium
RRLFRQLPESVDLDTRE

SEQ ID NO: 856928 - protein, 19 aa, Mycobacterium
RRLFYQAIERGGEGCVLVL

SEQ ID NO: 856929 - protein, 19 aa, Mycobacterium
RRLGLLRRPSRADRDIVDF

SEQ ID NO: 856930 - protein, 19 aa, Mycobacterium
RRLHVIIGDANLAETSTFL

SEQ ID NO: 856931 - protein, 19 aa, Mycobacterium
RRLHVIIGDANLAETSTYL

SEQ ID NO: 856932 - protein, 19 aa, Mycobacterium
RRLHVIIGDANLSETSTYL

SEQ ID NO: 856933 - protein, 18 aa, Mycobacterium
RRLKKPLIAAVEGAAIAG

SEQ ID NO: 856934 - protein, 17 aa, Mycobacterium
RRLKKPLIAAVEGPAIA

SEQ ID NO: 856935 - protein, 21 aa, Mycobacterium
RRLLDTYVDVLRLPVDIVVAD

SEQ ID NO: 856936 - protein, 17 aa, Mycobacterium
RRLLELPAGLRDAAGEP

SEQ ID NO: 856937 - protein, 27 aa, Mycobacterium
RRLLGQRYGAAVLGPYAAKRSLPQQLR

SEQ ID NO: 856938 - protein, 31 aa, Mycobacterium
RRLLPDIPHIAVFDTGFFHDLPPAAATYAID

SEQ ID NO: 856939 - protein, 17 aa, Mycobacterium
RRLLTTVYQRTAAGELP

SEQ ID NO: 856940 - protein, 18 aa, Mycobacterium
RRLMESEPRFDPAVWARL

SEQ ID NO: 856941 - protein, 18 aa, Mycobacterium
RRLMEVTVLGRPAASPDA

SEQ ID NO: 856942 - protein, 24 aa, Mycobacterium
RRLNSWVRRYPDVPVQIVAAGTGA

SEQ ID NO: 856943 - protein, 27 aa, Mycobacterium
RRLPDGEPVEWWIVGGRLSADPVAGAE

SEQ ID NO: 856944 - protein, 22 aa, Mycobacterium
RRLPKNLPWDIPGRDQLEQALQ

SEQ ID NO: 856945 - protein, 27 aa, Mycobacterium
RRLPLVMRPLAWLPQPDPRRPGGRAWS

SEQ ID NO: 856946 - protein, 25 aa, Mycobacterium
RRLQALDVPVPRYLGIHQLEELGEL

SEQ ID NO: 856947 - protein, 18 aa, Mycobacterium
RRLQFIGCTTLVSQLPLL

SEQ ID NO: 856948 - protein, 18 aa, Mycobacterium
RRLQPEPISDLLAESEAL

SEQ ID NO: 856949 - protein, 29 aa, Mycobacterium
RRLQTDYLDVYWLHNWDRNTPIEETMRTL

SEQ ID NO: 856950 - protein, 19 aa, Mycobacterium
RRLRATPAIRRLVAETTLA

SEQ ID NO: 856951 - protein, 20 aa, Mycobacterium
RRLRDAFPHAALIEIPDCSA

SEQ ID NO: 856952 - protein, 25 aa, Mycobacterium
RRLRELAAAFRIFGTFGFSEGVAGH

SEQ ID NO: 856953 - protein, 25 aa, Mycobacterium
RRLRKDIFELYGYNAVVHVLSASGI

SEQ ID NO: 856954 - protein, 18 aa, Mycobacterium
RRLRMICHGLGHTQGFRP

SEQ ID NO: 856955 - protein, 18 aa, Mycobacterium
RRLRPTIAGFADALLDDI

SEQ ID NO: 856956 - protein, 17 aa, Mycobacterium
RRLRRALEYRDRTCVVP

SEQ ID NO: 856957 - protein, 27 aa, Mycobacterium
RRLRRNQLHPRTLRRRGQPRNPSPDRE

SEQ ID NO: 856958 - protein, 23 aa, Mycobacterium
RRLRRPVRWTATRSESFLSDTQG

SEQ ID NO: 856959 - protein, 21 aa, Mycobacterium
RRLRRTTWNSGCSSWYLTEDG

SEQ ID NO: 856960 - protein, 23 aa, Mycobacterium
RRLRSTPALRRLVAQTSLEPRHL

SEQ ID NO: 856961 - protein, 19 aa, Mycobacterium
RRLSRLWCDALAGICARVR

SEQ ID NO: 856962 - protein, 31 aa, Mycobacterium
RRLTRFFESYDLLLTPTLATPPPRIGEFDMP

SEQ ID NO: 856963 - protein, 19 aa, Mycobacterium
RRLTRWTRLYPDVRVESAI

SEQ ID NO: 856964 - protein, 37 aa, Mycobacterium
RRLTSTPFAHAGYMFKLWDQLVWGSTLVVPPTPWSAQ

SEQ ID NO: 856965 - protein, 20 aa, Mycobacterium
RRLTSWLSSLTGLPVFCVNY

SEQ ID NO: 856966 - protein, 27 aa, Mycobacterium
RRLVADEGLLGALRFARNVLVHRDARK

SEQ ID NO: 856967 - protein, 31 aa, Mycobacterium
RRLVEVPVGFKWFVDGLINGTIGFGGEESAG

SEQ ID NO: 856968 - protein, 21 aa, Mycobacterium
RRLVEYYRAVAGGPMLDTLRD

SEQ ID NO: 856969 - protein, 18 aa, Mycobacterium
RRLVGINAVVLPPRGSVY

SEQ ID NO: 856970 - protein, 26 aa, Mycobacterium
RRLVGPRTLPLMRAGIALRGRLGRPV

SEQ ID NO: 856971 - protein, 21 aa, Mycobacterium
RRLVRHAHWPQDWHPMRRDAG

SEQ ID NO: 856972 - protein, 28 aa, Mycobacterium
RRLVSDEGLFGALRFARNVLLHRDARKR

SEQ ID NO: 856973 - protein, 18 aa, Mycobacterium
RRLVSGQISLLLRRTIDP

SEQ ID NO: 856974 - protein, 25 aa, Mycobacterium
RRLVVRGFFQDIIGRIGIESVRDRL

SEQ ID NO: 856975 - protein, 25 aa, Mycobacterium
RRMAAEELGLPTPTYWFANSVEELR

SEQ ID NO: 856976 - protein, 17 aa, Mycobacterium
RRMFASYDAGRIVNPML

SEQ ID NO: 856977 - protein, 18 aa, Mycobacterium
RRMGIDEATLREIPTVIA

SEQ ID NO: 856978 - protein, 17 aa, Mycobacterium
RRMIVQVRPDGWHAKCS

SEQ ID NO: 856979 - protein, 17 aa, Mycobacterium
RRMLLDMPESDWQTMLD

SEQ ID NO: 856980 - protein, 17 aa, Mycobacterium
RRMLLRAFGAQIVLTPG

SEQ ID NO: 856981 - protein, 28 aa, Mycobacterium
RRMPPAVRRFWLGRAELDAIFAKPLAAE

SEQ ID NO: 856982 - protein, 23 aa, Mycobacterium
RRMPWRVHLFTPVDGIPGVDGPG

SEQ ID NO: 856983 - protein, 19 aa, Mycobacterium
RRMPYTVGLLGSVPRLNAA

SEQ ID NO: 856984 - protein, 22 aa, Mycobacterium
RRMREYIAALQAIWTCWRDGTS

SEQ ID NO: 856985 - protein, 21 aa, Mycobacterium
RRMRMVYSLAFSLPGTPVLFY

SEQ ID NO: 856986 - protein, 18 aa, Mycobacterium
RRMRVVLAELRKIGVTGV

SEQ ID NO: 856987 - protein, 23 aa, Mycobacterium
RRMSLVFFHQPNYDAVIETLPTC

SEQ ID NO: 856988 - protein, 19 aa, Mycobacterium
RRMVRALQRMGAPAACIEF

SEQ ID NO: 856989 - protein, 20 aa, Mycobacterium
RRMYRSGDLVRWLPDGQLEY

SEQ ID NO: 856990 - protein, 28 aa, Mycobacterium
RRNDLGRLAILDWLLSGPGDRWQNMSND

SEQ ID NO: 856991 - protein, 23 aa, Mycobacterium
RRNEGWFDPEGLFQAFDEQTGSL

SEQ ID NO: 856992 - protein, 18 aa, Mycobacterium
RRNFIRRIGIPPDQYRKS

SEQ ID NO: 856993 - protein, 17 aa, Mycobacterium
RRNFIRRLGVSPDQYRK

SEQ ID NO: 856994 - protein, 19 aa, Mycobacterium
RRNFLRRVGIPPDQYRKAF

SEQ ID NO: 856995 - protein, 22 aa, Mycobacterium
RRNGGLYADWYFSNGKDFDGFT

SEQ ID NO: 856996 - protein, 23 aa, Mycobacterium
RRNGGLYSDWYFSNGKDFAGITD

SEQ ID NO: 856997 - protein, 25 aa, Mycobacterium
RRNLETTAWFRKMTYRGALERYAQP

SEQ ID NO: 856998 - protein, 23 aa, Mycobacterium
RRNRKVLTFVLDSGMPGLTQGKA

SEQ ID NO: 856999 - protein, 21 aa, Mycobacterium
RRNRLLAAGLDLLGDQRPDIS

SEQ ID NO: 857000 - protein, 23 aa, Mycobacterium
RRNRMRELALESDRLTFALNEID

SEQ ID NO: 857001 - protein, 22 aa, Mycobacterium
RRNTRQWIWDNLDPRRCAPVEI

SEQ ID NO: 857002 - protein, 21 aa, Mycobacterium
RRNVFDLLSPRDIRLFTHAYS

SEQ ID NO: 857003 - protein, 17 aa, Mycobacterium
RRNVGAYCWGFVAGKTQ

SEQ ID NO: 857004 - protein, 27 aa, Mycobacterium
RRPAGLRDLLWQPESLYPPEVLNGATV

SEQ ID NO: 857005 - protein, 17 aa, Mycobacterium
RRPALVPVDAVEFLTGD

SEQ ID NO: 857006 - protein, 21 aa, Mycobacterium
RRPDWATDLIAESVGKLVNAI

SEQ ID NO: 857007 - protein, 26 aa, Mycobacterium
RRPEIDPRWLAGRPDAVLVAARVAPL

SEQ ID NO: 857008 - protein, 17 aa, Mycobacterium
RRPELAALQLRSLPFQP

SEQ ID NO: 857009 - protein, 17 aa, Mycobacterium
RRPELAALQLRSLPFRP

SEQ ID NO: 857010 - protein, 20 aa, Mycobacterium
RRPELDTLLLKHAESAGVEV

SEQ ID NO: 857011 - protein, 26 aa, Mycobacterium
RRPELVPLIVEVPLAQAPLTSGMYQR

SEQ ID NO: 857012 - protein, 22 aa, Mycobacterium
RRPEVGWWMLDFAGPGLKKMMN

SEQ ID NO: 857013 - protein, 20 aa, Mycobacterium
RRPFRAPSEWASLESVLRSS

SEQ ID NO: 857014 - protein, 17 aa, Mycobacterium
RRPFWTYAHVPSGSTVD

SEQ ID NO: 857015 - protein, 17 aa, Mycobacterium
RRPGQLEQALGPGAGHR

SEQ ID NO: 857016 - protein, 24 aa, Mycobacterium
RRPGRPRAAPPVRKLAKELMVDLA

SEQ ID NO: 857017 - protein, 23 aa, Mycobacterium
RRPGRWIRAMARKPDDTGGVISV

SEQ ID NO: 857018 - protein, 21 aa, Mycobacterium
RRPHLPLPSFWSGQFGVNIKS

SEQ ID NO: 857019 - protein, 30 aa, Mycobacterium
RRPHPRAPFRYLGMLPWVGAVADYLGEYGA

SEQ ID NO: 857020 - protein, 17 aa, Mycobacterium
RRPIGLQVRWPGADLAG

SEQ ID NO: 857021 - protein, 25 aa, Mycobacterium
RRPILHLPAHWPWATHWLRLWRNTI

SEQ ID NO: 857022 - protein, 17 aa, Mycobacterium
RRPLGGRQRLQPAAALT

SEQ ID NO: 857023 - protein, 34 aa, Mycobacterium
RRPLGVCGIITPFNHPMLILARSLSAALANGNTV

SEQ ID NO: 857024 - protein, 17 aa, Mycobacterium
RRPLSDVVNLDRWDRPA

SEQ ID NO: 857025 - protein, 29 aa, Mycobacterium
RRPLTVLDLDYRPMFWATPAAATEQVRKA

SEQ ID NO: 857026 - protein, 21 aa, Mycobacterium
RRPMVPIRLPGKVFGGIRGGG

SEQ ID NO: 857027 - protein, 18 aa, Mycobacterium
RRPQESRILLANGLELLS

SEQ ID NO: 857028 - protein, 31 aa, Mycobacterium
RRPQGRPPLVLWVLGPLLLCDVAERSAAIVG

SEQ ID NO: 857029 - protein, 22 aa, Mycobacterium
RRPQRDIITGLRQPGQRGRYPG

SEQ ID NO: 857030 - protein, 22 aa, Mycobacterium
RRPQRLQVPVLGVALGRRAVDV

SEQ ID NO: 857031 - protein, 27 aa, Mycobacterium
RRPRELKQKFYELLASRLADRCGLDPA

SEQ ID NO: 857032 - protein, 18 aa, Mycobacterium
RRPRGIPTLASLATVSAA

SEQ ID NO: 857033 - protein, 24 aa, Mycobacterium
RRPRGPALLDYIAEYRRRAGITTE

SEQ ID NO: 857034 - protein, 18 aa, Mycobacterium
RRPRLGRRSARLQPLTLL

SEQ ID NO: 857035 - protein, 20 aa, Mycobacterium
RRPRLLDDHVTLAHGAGGKA

SEQ ID NO: 857036 - protein, 22 aa, Mycobacterium
RRPRLRLVALMSYEGHIAGFGD

SEQ ID NO: 857037 - protein, 19 aa, Mycobacterium
RRPRPFAPDDFEAAQLRTA

SEQ ID NO: 857038 - protein, 26 aa, Mycobacterium
RRPRRRHVPVVLRSRADWLRGPRRAD

SEQ ID NO: 857039 - protein, 20 aa, Mycobacterium
RRPRRRPRSRRRSAGAAAVT

SEQ ID NO: 857040 - protein, 28 aa, Mycobacterium
RRPSGMRDLLWSPEHLYPPEVLGGATVS

SEQ ID NO: 857041 - protein, 17 aa, Mycobacterium
RRPSLVPVEAIEHLGGE

SEQ ID NO: 857042 - protein, 17 aa, Mycobacterium
RRPSLVPVEAIELLGGP

SEQ ID NO: 857043 - protein, 17 aa, Mycobacterium
RRPSLVPVEAIELLGGT

SEQ ID NO: 857044 - protein, 17 aa, Mycobacterium
RRPSLVPVEAIELLSGD

SEQ ID NO: 857045 - protein, 31 aa, Mycobacterium
RRPSMTMEAWNDPTLLKFLATPALAREYLFC

SEQ ID NO: 857046 - protein, 17 aa, Mycobacterium
RRPSWNAAAPGPVAEPL

SEQ ID NO: 857047 - protein, 26 aa, Mycobacterium
RRPTGPPLFTLDQYAVLAKAVIEDAG

SEQ ID NO: 857048 - protein, 22 aa, Mycobacterium
RRPTLPLAGRLPRLAVRRSPLS

SEQ ID NO: 857049 - protein, 21 aa, Mycobacterium
RRPTLSWPRDVPLAGEPAEVV

SEQ ID NO: 857050 - protein, 17 aa, Mycobacterium
RRPTWNAAAPGPVAEPL

SEQ ID NO: 857051 - protein, 27 aa, Mycobacterium
RRPVELPTYPFQRRRFWPKASSIAVDG

SEQ ID NO: 857052 - protein, 19 aa, Mycobacterium
RRPVIFYTNGFEHWIWDDT

SEQ ID NO: 857053 - protein, 21 aa, Mycobacterium
RRPWLVWVHGAGQGQPIDLLF

SEQ ID NO: 857054 - protein, 19 aa, Mycobacterium
RRPYREYLIKFLGDQRLVD

SEQ ID NO: 857055 - protein, 17 aa, Mycobacterium
RRQARGLKLNHPEAVAI

SEQ ID NO: 857056 - protein, 22 aa, Mycobacterium
RRQARGLRLNHPEAVALITDHV

SEQ ID NO: 857057 - protein, 21 aa, Mycobacterium
RRQHHGLVELLDGAVHVAQPT

SEQ ID NO: 857058 - protein, 18 aa, Mycobacterium
RRQIHNHGLLHDLAAMPD

SEQ ID NO: 857059 - protein, 26 aa, Mycobacterium
RRQKVTLYVRPAAWGMWTFYELSEED

SEQ ID NO: 857060 - protein, 26 aa, Mycobacterium
RRQKYPREQYLSYVRCCAAILRHINR

SEQ ID NO: 857061 - protein, 18 aa, Mycobacterium
RRQLLRPLATTEHIWCQL

SEQ ID NO: 857062 - protein, 18 aa, Mycobacterium
RRQPWPLSLLATHPIDVS

SEQ ID NO: 857063 - protein, 25 aa, Mycobacterium
RRQQVDWMWAMVRDAVLDRVLNAPD

SEQ ID NO: 857064 - protein, 27 aa, Mycobacterium
RRQREAIIARCLPLADHIARRFRGRGE

SEQ ID NO: 857065 - protein, 24 aa, Mycobacterium
RRQRLTVTYQRRGYTPARAARNIL

SEQ ID NO: 857066 - protein, 20 aa, Mycobacterium
RRQRTAYLKIDYRNIVPIEK

SEQ ID NO: 857067 - protein, 17 aa, Mycobacterium
RRQSALVLADALARTRL

SEQ ID NO: 857068 - protein, 36 aa, Mycobacterium
RRQVFDRLIAALRPGGWLVVEDFNWSTFAFEGFDGD

SEQ ID NO: 857069 - protein, 27 aa, Mycobacterium
RRQVKDPWLRRQLTPHFRPGCKRMLMT

SEQ ID NO: 857070 - protein, 21 aa, Mycobacterium
RRQYLATAEEFLRLVVARGDD

SEQ ID NO: 857071 - protein, 28 aa, Mycobacterium
RRRAAHGRPLWYLMPDGVVQYVSKRRLY

SEQ ID NO: 857072 - protein, 29 aa, Mycobacterium
RRRAAQALQAVFRYLDLPAITDAEIEAAV

SEQ ID NO: 857073 - protein, 27 aa, Mycobacterium
RRRADKAGWLRYGLPASLGGRDGSNVD

SEQ ID NO: 857074 - protein, 27 aa, Mycobacterium
RRRADKAGWLRYGLPASLGGRDGTNVD

SEQ ID NO: 857075 - protein, 25 aa, Mycobacterium
RRRADVAGHFRYPFPAEFGGRDGSN

SEQ ID NO: 857076 - protein, 27 aa, Mycobacterium
RRRALAEFYAALRHDGILILDQRNYDE

SEQ ID NO: 857077 - protein, 18 aa, Mycobacterium
RRRALLRRLIHQALGVGT

SEQ ID NO: 857078 - protein, 30 aa, Mycobacterium
RRRALTYNVSLLLVLLRKRLVEFETSGGDG

SEQ ID NO: 857079 - protein, 17 aa, Mycobacterium
RRRALWAGVAIGGTVDG

SEQ ID NO: 857080 - protein, 25 aa, Mycobacterium
RRRARDWYQRLLTDDPGRDPVYAED

SEQ ID NO: 857081 - protein, 20 aa, Mycobacterium
RRRAVLFVHPAGCGAESSLI

SEQ ID NO: 857082 - protein, 22 aa, Mycobacterium
RRRCLYHWIEYPQRAQAVAIVR

SEQ ID NO: 857083 - protein, 21 aa, Mycobacterium
RRRDGAPPPGPLKPIVDRESG

SEQ ID NO: 857084 - protein, 19 aa, Mycobacterium
RRRDLLFALADVVRDHFAE

SEQ ID NO: 857085 - protein, 24 aa, Mycobacterium
RRRDVTLLWPPTEPGGYSLIVDGT

SEQ ID NO: 857086 - protein, 18 aa, Mycobacterium
RRREELAALGERVARRVA

SEQ ID NO: 857087 - protein, 27 aa, Mycobacterium
RRREEYVGPWLPEPLLLDESDPSADLV

SEQ ID NO: 857088 - protein, 22 aa, Mycobacterium
RRREEYVGPWLPEPVRVAYDDS

SEQ ID NO: 857089 - protein, 22 aa, Mycobacterium
RRRELLGRRDQLSATLAGLCGD

SEQ ID NO: 857090 - protein, 21 aa, Mycobacterium
RRRETRLSPLTVRLMHVMSPM

SEQ ID NO: 857091 - protein, 17 aa, Mycobacterium
RRRFFNGRPVRRPGEPR

SEQ ID NO: 857092 - protein, 18 aa, Mycobacterium
RRRFQPDRAQWRRLVERF

SEQ ID NO: 857093 - protein, 34 aa, Mycobacterium
RRRFQRYWRATGPFIGWIRPAVMRALDRQLGRSP

SEQ ID NO: 857094 - protein, 20 aa, Mycobacterium
RRRFRKDYDNKFGPRAWHRD

SEQ ID NO: 857095 - protein, 29 aa, Mycobacterium
RRRFRLDDYRPALGAVLDAYRGRDIVVKC

SEQ ID NO: 857096 - protein, 25 aa, Mycobacterium
RRRFRRSIQEIVLAALGRTIGKAVG

SEQ ID NO: 857097 - protein, 20 aa, Mycobacterium
RRRFSWLSQGTTPTSARRAV

SEQ ID NO: 857098 - protein, 18 aa, Mycobacterium
RRRGAVVLEPAFGRLTGT

SEQ ID NO: 857099 - protein, 26 aa, Mycobacterium
RRRGDYLYDFWRDANNPRGLWRRTTL

SEQ ID NO: 857100 - protein, 22 aa, Mycobacterium
RRRGEGIGLTTVYRTLQQMATT

SEQ ID NO: 857101 - protein, 25 aa, Mycobacterium
RRRGENIGLTTVYRTLQSMAAAGMI

SEQ ID NO: 857102 - protein, 18 aa, Mycobacterium
RRRGEYLYNFWRDATNSR

SEQ ID NO: 857103 - protein, 24 aa, Mycobacterium
RRRGEYLYNFWRDEANPKGVWRRT

SEQ ID NO: 857104 - protein, 18 aa, Mycobacterium
RRRGRPRRIDRDQIVAAA

SEQ ID NO: 857105 - protein, 19 aa, Mycobacterium
RRRGSAPPGPLRPIVDLES

SEQ ID NO: 857106 - protein, 28 aa, Mycobacterium
RRRGSGPLVAYLIATVDLPEPAVRTGEH

SEQ ID NO: 857107 - protein, 21 aa, Mycobacterium
RRRHAFGGALIDKPLIRRKLA

SEQ ID NO: 857108 - protein, 24 aa, Mycobacterium
RRRHAQAPLPVDHPGIVGPPQRGD

SEQ ID NO: 857109 - protein, 17 aa, Mycobacterium
RRRHAVLGHLPPARYAA

SEQ ID NO: 857110 - protein, 18 aa, Mycobacterium
RRRHGAWIGWPGVPEDAD

SEQ ID NO: 857111 - protein, 31 aa, Mycobacterium
RRRHGNPPLFHLTLFYRHPVAGYKFADAARR

SEQ ID NO: 857112 - protein, 18 aa, Mycobacterium
RRRHLAVGPGARASLDDG

SEQ ID NO: 857113 - protein, 24 aa, Mycobacterium
RRRHRWPFVIGRVFADPQDPGLGT

SEQ ID NO: 857114 - protein, 26 aa, Mycobacterium
RRRHTLAFLRAIRPTAPVYLSTDVDV

SEQ ID NO: 857115 - protein, 20 aa, Mycobacterium
RRRIALTDLAGVPLITLPRG

SEQ ID NO: 857116 - protein, 18 aa, Mycobacterium
RRRIFQLEIARAHTPWYH

SEQ ID NO: 857117 - protein, 17 aa, Mycobacterium
RRRIGRDRLPAAESLIA

SEQ ID NO: 857118 - protein, 23 aa, Mycobacterium
RRRIPVIEHPLLNSLARQVPSQE

SEQ ID NO: 857119 - protein, 19 aa, Mycobacterium
RRRLADLGAPIPQFAEVTA

SEQ ID NO: 857120 - protein, 22 aa, Mycobacterium
RRRLDLTRPVPLGLIRECLEIA

SEQ ID NO: 857121 - protein, 18 aa, Mycobacterium
RRRLDVAISLLARPQVLF

SEQ ID NO: 857122 - protein, 25 aa, Mycobacterium
RRRLEALGVPVPRYAEIRSVDELDE

SEQ ID NO: 857123 - protein, 19 aa, Mycobacterium
RRRLHLRRLRHLELGTHHR

SEQ ID NO: 857124 - protein, 22 aa, Mycobacterium
RRRLLGPHPLPLSCGWPTARRR

SEQ ID NO: 857125 - protein, 22 aa, Mycobacterium
RRRLLMPLFHGNLMKSYESIIE

SEQ ID NO: 857126 - protein, 20 aa, Mycobacterium
RRRLPVAEHALINHLARQAG

SEQ ID NO: 857127 - protein, 21 aa, Mycobacterium
RRRLRAERLVFLGVAGKQRGN

SEQ ID NO: 857128 - protein, 25 aa, Mycobacterium
RRRLREHLIGFAYQSGYLARPAGSA

SEQ ID NO: 857129 - protein, 19 aa, Mycobacterium
RRRLRGRLAVNSRPHAARP

SEQ ID NO: 857130 - protein, 24 aa, Mycobacterium
RRRLRLSAEEILLAALGRAVAVTV

SEQ ID NO: 857131 - protein, 33 aa, Mycobacterium
RRRLTEFINFKTFFPTRLEFHDYLSWAADKVGA

SEQ ID NO: 857132 - protein, 17 aa, Mycobacterium
RRRPVFARRRPYFIPGT

SEQ ID NO: 857133 - protein, 24 aa, Mycobacterium
RRRPVRGLHWPWVARVGTVVMSWR

SEQ ID NO: 857134 - protein, 26 aa, Mycobacterium
RRRPYRWLRQILPDPKYPAGYLNEFG

SEQ ID NO: 857135 - protein, 25 aa, Mycobacterium
RRRQRLQRLWSAALAAFLTPRAHRH

SEQ ID NO: 857136 - protein, 23 aa, Mycobacterium
RRRRARGLRLNHPEAVAIITDHI

SEQ ID NO: 857137 - protein, 19 aa, Mycobacterium
RRRRCLRANGSNFGTNAPG

SEQ ID NO: 857138 - protein, 23 aa, Mycobacterium
RRRREIGFVFQHFNLFPHMTAAE

SEQ ID NO: 857139 - protein, 18 aa, Mycobacterium
RRRRGAWVGWAGIAEEET

SEQ ID NO: 857140 - protein, 23 aa, Mycobacterium
RRRRGRGLRLNHPEAVAVITDHI

SEQ ID NO: 857141 - protein, 20 aa, Mycobacterium
RRRRGVISAVLLTGIGGLDL

SEQ ID NO: 857142 - protein, 24 aa, Mycobacterium
RRRRKHLTLVHKTNVLTFAGSLWW

SEQ ID NO: 857143 - protein, 19 aa, Mycobacterium
RRRRPAHAIDLLRAALGDV

SEQ ID NO: 857144 - protein, 23 aa, Mycobacterium
RRRRPRIAFVYTGQGSQYREMGL

SEQ ID NO: 857145 - protein, 20 aa, Mycobacterium
RRRRRDELAALGEKVARRVL

SEQ ID NO: 857146 - protein, 25 aa, Mycobacterium
RRRRRRGHIPFTKPAKKALELALRE

SEQ ID NO: 857147 - protein, 17 aa, Mycobacterium
RRRRRRKSGAGDDGDEG

SEQ ID NO: 857148 - protein, 19 aa, Mycobacterium
RRRRRRRKSGSGEDGDEGP

SEQ ID NO: 857149 - protein, 19 aa, Mycobacterium
RRRRTRELAQEADRLHFAL

SEQ ID NO: 857150 - protein, 29 aa, Mycobacterium
RRRRVRLGLFGLIPLKLHAWQVLYRSTDL

SEQ ID NO: 857151 - protein, 24 aa, Mycobacterium
RRRSTLDTLLYLGTSIFNGRASFS

SEQ ID NO: 857152 - protein, 26 aa, Mycobacterium
RRRTAALAYYRAALRPWRRGSHAELD

SEQ ID NO: 857153 - protein, 18 aa, Mycobacterium
RRRTLITAAQYLALGIDP

SEQ ID NO: 857154 - protein, 31 aa, Mycobacterium
RRRTLLFMRADPLAHFVSCLVYLPRDRYTTV

SEQ ID NO: 857155 - protein, 21 aa, Mycobacterium
RRRTLRDQQVIADRAKASVIT

SEQ ID NO: 857156 - protein, 31 aa, Mycobacterium
RRRVCEGFLGLRVVPWLWNAPPTDRRYYPLF

SEQ ID NO: 857157 - protein, 19 aa, Mycobacterium
RRRVLGWAADTRTLVVPAH

SEQ ID NO: 857158 - protein, 18 aa, Mycobacterium
RRRVLLCDELGLGKTLQA

SEQ ID NO: 857159 - protein, 20 aa, Mycobacterium
RRRVPRSPILVLSQYVEVSY

SEQ ID NO: 857160 - protein, 21 aa, Mycobacterium
RRRVQLARLLIGEWDVIALDE

SEQ ID NO: 857161 - protein, 17 aa, Mycobacterium
RRRVQLARLLVGDWDVI

SEQ ID NO: 857162 - protein, 19 aa, Mycobacterium
RRRVQLARLLVGEWDVIAL

SEQ ID NO: 857163 - protein, 20 aa, Mycobacterium
RRRVRDLVAARKPRRWTARR

SEQ ID NO: 857164 - protein, 17 aa, Mycobacterium
RRRVRLASVLRRCIVLD

SEQ ID NO: 857165 - protein, 22 aa, Mycobacterium
RRRVRLASVLRRCTVIGAQLRG

SEQ ID NO: 857166 - protein, 20 aa, Mycobacterium
RRRVVRLIDAQVVRVGAVVR

SEQ ID NO: 857167 - protein, 24 aa, Mycobacterium
RRSADTHLLRYPLPEAWAGNGSDV

SEQ ID NO: 857168 - protein, 25 aa, Mycobacterium
RRSADTHLLRYPLPSAWSNDANVEL

SEQ ID NO: 857169 - protein, 27 aa, Mycobacterium
RRSADTHLLRYPLPSAWSTDVDVALYL

SEQ ID NO: 857170 - protein, 24 aa, Mycobacterium
RRSAHTLPVLLAGADFIFSGFGSI

SEQ ID NO: 857171 - protein, 18 aa, Mycobacterium
RRSAWWAGALTLGVAKIV

SEQ ID NO: 857172 - protein, 27 aa, Mycobacterium
RRSCARYFKINPYRRWFDVLDRTLRAG

SEQ ID NO: 857173 - protein, 23 aa, Mycobacterium
RRSDVFLTNYLPSTRKKLSIDVD

SEQ ID NO: 857174 - protein, 25 aa, Mycobacterium
RRSDVFLTSFLPGARRKFGIDLEDI

SEQ ID NO: 857175 - protein, 26 aa, Mycobacterium
RRSERRGLLMTHMLPTDLTTTTNRIS

SEQ ID NO: 857176 - protein, 21 aa, Mycobacterium
RRSFILVPGIDVPFHSRVLRV

SEQ ID NO: 857177 - protein, 17 aa, Mycobacterium
RRSGAIELTGAWPGLRC

SEQ ID NO: 857178 - protein, 20 aa, Mycobacterium
RRSGWDLIVAVDIPTLDAYE

SEQ ID NO: 857179 - protein, 25 aa, Mycobacterium
RRSHAPLLPLVPGALGKLPLGDDVD

SEQ ID NO: 857180 - protein, 22 aa, Mycobacterium
RRSHVVLMGRPWGQVSSSDWLE

SEQ ID NO: 857181 - protein, 21 aa, Mycobacterium
RRSIARLLGVTPREVVLTSGG

SEQ ID NO: 857182 - protein, 21 aa, Mycobacterium
RRSLPELTAPCLWAAPTLSGS

SEQ ID NO: 857183 - protein, 17 aa, Mycobacterium
RRSLPELVAPWEEPFEP

SEQ ID NO: 857184 - protein, 18 aa, Mycobacterium
RRSMMPPRSYAFIDGTGD

SEQ ID NO: 857185 - protein, 34 aa, Mycobacterium
RRSPVRIHLSRRGWLNLPDWPPAMPSLVLHPQPG

SEQ ID NO: 857186 - protein, 17 aa, Mycobacterium
RRSRAGVIDLRKTLRKS

SEQ ID NO: 857187 - protein, 17 aa, Mycobacterium
RRSREAIEVIRQAAGAS

SEQ ID NO: 857188 - protein, 21 aa, Mycobacterium
RRSRIIGIIAARLGAYFDEPD

SEQ ID NO: 857189 - protein, 35 aa, Mycobacterium
RRSRVYCPGWVALFRWIKPVLSTPVGELPLHKPTA

SEQ ID NO: 857190 - protein, 25 aa, Mycobacterium
RRSTIWHSTFTNCSLLGSVFTECRI

SEQ ID NO: 857191 - protein, 24 aa, Mycobacterium
RRSVAKWLRRLGVTVLESVAVAEV

SEQ ID NO: 857192 - protein, 19 aa, Mycobacterium
RRSVAVRPLLPRPDAASGR

SEQ ID NO: 857193 - protein, 18 aa, Mycobacterium
RRSWIDAGLALLAQEGPD

SEQ ID NO: 857194 - protein, 18 aa, Mycobacterium
RRTAAPRRYSYVTYMVAA

SEQ ID NO: 857195 - protein, 19 aa, Mycobacterium
RRTAAVPVLLLSARAGQEA

SEQ ID NO: 857196 - protein, 25 aa, Mycobacterium
RRTAEQVFIPLTVGGGVRSVDDVDV

SEQ ID NO: 857197 - protein, 25 aa, Mycobacterium
RRTAEQVFIPLTVGGGVRSVDDVNV

SEQ ID NO: 857198 - protein, 20 aa, Mycobacterium
RRTALLELTERLKPGEISQH

SEQ ID NO: 857199 - protein, 17 aa, Mycobacterium
RRTARLLPQMLPGTDFV

SEQ ID NO: 857200 - protein, 26 aa, Mycobacterium
RRTDEVQTVLRWATANRVPVVTRGAG

SEQ ID NO: 857201 - protein, 29 aa, Mycobacterium
RRTDPAGRACHWILEVHLADRARGFGGFY

SEQ ID NO: 857202 - protein, 25 aa, Mycobacterium
RRTDRLPFLAPIDWESFEPLLRGGF

SEQ ID NO: 857203 - protein, 26 aa, Mycobacterium
RRTDRLPFLAPIDWESFEPLLRGRVG

SEQ ID NO: 857204 - protein, 21 aa, Mycobacterium
RRTEEVQTVLRWAGTHRIAVV

SEQ ID NO: 857205 - protein, 26 aa, Mycobacterium
RRTEEVQTVLRWATANRVPVVPRGAG

SEQ ID NO: 857206 - protein, 34 aa, Mycobacterium
RRTGIADILPLTPLQEGLLFHATTTRGGQDSGDL

SEQ ID NO: 857207 - protein, 24 aa, Mycobacterium
RRTIRFRHNTLDPNNLRDVLFDGW

SEQ ID NO: 857208 - protein, 23 aa, Mycobacterium
RRTLRGLRAVGRGVLRADLSVLT

SEQ ID NO: 857209 - protein, 18 aa, Mycobacterium
RRTLTMLMADIRGFTRLS

SEQ ID NO: 857210 - protein, 25 aa, Mycobacterium
RRTMARVFPDLFATHRVRAVDDYSS

SEQ ID NO: 857211 - protein, 25 aa, Mycobacterium
RRTMARVFPNLFATHRVRAVDDYAS

SEQ ID NO: 857212 - protein, 25 aa, Mycobacterium
RRTMARVFPNLFATHRVRAVDDYPA

SEQ ID NO: 857213 - protein, 25 aa, Mycobacterium
RRTMARVFPNLFATHRVRAVDDYPS

SEQ ID NO: 857214 - protein, 25 aa, Mycobacterium
RRTMARVFPNLFATHRVRSVDDYAS

SEQ ID NO: 857215 - protein, 17 aa, Mycobacterium
RRTPKLARTQAWTTLQQ

SEQ ID NO: 857216 - protein, 23 aa, Mycobacterium
RRTPLLLDGMAVTAAALVAERLA

SEQ ID NO: 857217 - protein, 25 aa, Mycobacterium
RRTPPAPLHMTLDATLHAARAVRTR

SEQ ID NO: 857218 - protein, 18 aa, Mycobacterium
RRTPRPIPIFALTPARQT

SEQ ID NO: 857219 - protein, 24 aa, Mycobacterium
RRTQAWVSQRRALLGLAPELQAAL

SEQ ID NO: 857220 - protein, 22 aa, Mycobacterium
RRTQIPFRLFDGTSIPVQGKSF

SEQ ID NO: 857221 - protein, 18 aa, Mycobacterium
RRTRATRVYRLPAGRRAA

SEQ ID NO: 857222 - protein, 20 aa, Mycobacterium
RRTRLLELQERLSPAFVSEP

SEQ ID NO: 857223 - protein, 24 aa, Mycobacterium
RRTSAVKAFTAWAARRGLLAADPG

SEQ ID NO: 857224 - protein, 17 aa, Mycobacterium
RRTSVMTDLRFSIARND

SEQ ID NO: 857225 - protein, 17 aa, Mycobacterium
RRTVALEMAYRPGGVLA

SEQ ID NO: 857226 - protein, 26 aa, Mycobacterium
RRTVELPTYPFQRRRFWPKSSGTAIE

SEQ ID NO: 857227 - protein, 19 aa, Mycobacterium
RRTVFVTQHRINELMRLHA

SEQ ID NO: 857228 - protein, 17 aa, Mycobacterium
RRTVFVTQHRITQLMRL

SEQ ID NO: 857229 - protein, 27 aa, Mycobacterium
RRTVLKALGPVIRPAIRALLDVQRRLE

SEQ ID NO: 857230 - protein, 17 aa, Mycobacterium
RRTVTVTALPQVPRSVP

SEQ ID NO: 857231 - protein, 52 aa, Mycobacterium
RRTWDADNAFYQFLGPPGSMWSQWLTLPAAAGPIVLAFNAGRRGRHVESYSP

SEQ ID NO: 857232 - protein, 23 aa, Mycobacterium
RRTYSVILGVFRNHGHDETVTLA

SEQ ID NO: 857233 - protein, 17 aa, Mycobacterium
RRVAMARERAARAGLSA

SEQ ID NO: 857234 - protein, 21 aa, Mycobacterium
RRVAMLRDWLTNELSDAAAAV

SEQ ID NO: 857235 - protein, 26 aa, Mycobacterium
RRVARAPFTLLNISVRPSLLNPTPML

SEQ ID NO: 857236 - protein, 26 aa, Mycobacterium
RRVCRPTQWLELRFVGSRGAVLRGVL

SEQ ID NO: 857237 - protein, 21 aa, Mycobacterium
RRVCSPYYRLGQWVLPQGYSV

SEQ ID NO: 857238 - protein, 29 aa, Mycobacterium
RRVDDHRFLIARRFILLDQNILQAKNICT

SEQ ID NO: 857239 - protein, 24 aa, Mycobacterium
RRVDLPTYAFQRQRYWLDARTTGA

SEQ ID NO: 857240 - protein, 18 aa, Mycobacterium
RRVEPLLQTLRDVATTVG

SEQ ID NO: 857241 - protein, 33 aa, Mycobacterium
RRVERRAVPLPLPQKIFDAEWIEGPIAVEAGPG

SEQ ID NO: 857242 - protein, 22 aa, Mycobacterium
RRVEVSLPADLALSGGGGCDPV

SEQ ID NO: 857243 - protein, 31 aa, Mycobacterium
RRVEYKLRDWLFARQRYWGEPFPIVYDADGR

SEQ ID NO: 857244 - protein, 24 aa, Mycobacterium
RRVFRAAVAAELRGPIWIVTRGAQ

SEQ ID NO: 857245 - protein, 20 aa, Mycobacterium
RRVFTPPDDMTRLVPGPLEV

SEQ ID NO: 857246 - protein, 27 aa, Mycobacterium
RRVGLLLQEPLLFPHLSVAANVVFGPF

SEQ ID NO: 857247 - protein, 24 aa, Mycobacterium
RRVHPLRDQWWQSLVPDLGRIEVP

SEQ ID NO: 857248 - protein, 17 aa, Mycobacterium
RRVIDTLVLPAIYASRP

SEQ ID NO: 857249 - protein, 20 aa, Mycobacterium
RRVILDLRGLKFIGTAGFST

SEQ ID NO: 857250 - protein, 17 aa, Mycobacterium
RRVIRRKSFTMAPCTLD

SEQ ID NO: 857251 - protein, 31 aa, Mycobacterium
RRVKFVHSAYDPAWHRPCAKRVARQYLVGFI

SEQ ID NO: 857252 - protein, 22 aa, Mycobacterium
RRVLDAAGLTRLALRSLRDVPP

SEQ ID NO: 857253 - protein, 24 aa, Mycobacterium
RRVLDINVYGVILGSKLAAQRMVP

SEQ ID NO: 857254 - protein, 17 aa, Mycobacterium
RRVLGERAVPRVATPPG

SEQ ID NO: 857255 - protein, 19 aa, Mycobacterium
RRVLHQMYLAYPDSKAARG

SEQ ID NO: 857256 - protein, 18 aa, Mycobacterium
RRVLLLNSTYEPLTALPL

SEQ ID NO: 857257 - protein, 18 aa, Mycobacterium
RRVLRAMRLRRPDGGDVL

SEQ ID NO: 857258 - protein, 17 aa, Mycobacterium
RRVLYYKFAEEKTFHFV

SEQ ID NO: 857259 - protein, 20 aa, Mycobacterium
RRVMLAPFTRDAVAGQTGLM

SEQ ID NO: 857260 - protein, 18 aa, Mycobacterium
RRVPAGEPGLLLSPVNRL

SEQ ID NO: 857261 - protein, 20 aa, Mycobacterium
RRVPIVFTPDDIHLFVAGGS

SEQ ID NO: 857262 - protein, 18 aa, Mycobacterium
RRVPPGEAGLLLSPVNRL

SEQ ID NO: 857263 - protein, 25 aa, Mycobacterium
RRVRPVSSAQFPRPAPRPSYSALGG

SEQ ID NO: 857264 - protein, 18 aa, Mycobacterium
RRVRQPGEPLRIGIGGPV

SEQ ID NO: 857265 - protein, 25 aa, Mycobacterium
RRVRRGRIQFVRQEPLFAPSVKYSA

SEQ ID NO: 857266 - protein, 21 aa, Mycobacterium
RRVRRLWRSLVNTSALWPDPD

SEQ ID NO: 857267 - protein, 31 aa, Mycobacterium
RRVSDRILTYALYIDPPLGRAGMTVAQVRAS

SEQ ID NO: 857268 - protein, 33 aa, Mycobacterium
RRVSLPTYAFMRQRFWLTPHLAGSVGAAELGSG

SEQ ID NO: 857269 - protein, 22 aa, Mycobacterium
RRVTLRRRTGGTDAGWHLKLPA

SEQ ID NO: 857270 - protein, 28 aa, Mycobacterium
RRVTVKLFSWTWWRSGRGRRLGGRGSPM

SEQ ID NO: 857271 - protein, 31 aa, Mycobacterium
RRVVLIHWDDFFRPLHRPLRALPYVADDLDA

SEQ ID NO: 857272 - protein, 18 aa, Mycobacterium
RRVWMTPRVPVHVANIRA

SEQ ID NO: 857273 - protein, 32 aa, Mycobacterium
RRVYNAVLKRYWYHAWWFYAHTIVRGGIDKVH

SEQ ID NO: 857274 - protein, 20 aa, Mycobacterium
RRWAEFTDNLSWPQLIELAK

SEQ ID NO: 857275 - protein, 19 aa, Mycobacterium
RRWATAWSPEQISHRLKVD

SEQ ID NO: 857276 - protein, 29 aa, Mycobacterium
RRWFREDYDKRFGPRVWHRDFFDAEIVAC

SEQ ID NO: 857277 - protein, 18 aa, Mycobacterium
RRWGSQWDLVKRDDDPSD

SEQ ID NO: 857278 - protein, 23 aa, Mycobacterium
RRWLEIRYLDSVPDALWPAAVFT

SEQ ID NO: 857279 - protein, 23 aa, Mycobacterium
RRWLEIRYLDSVPEDFWPALVFT

SEQ ID NO: 857280 - protein, 35 aa, Mycobacterium
RRWLELRYLDAAPDWWWPALAFTAVAALDDPQVAD

SEQ ID NO: 857281 - protein, 17 aa, Mycobacterium
RRWLEMVINRRRLSPAH

SEQ ID NO: 857282 - protein, 19 aa, Mycobacterium
RRWLGRPTVEHGASADLVC

SEQ ID NO: 857283 - protein, 19 aa, Mycobacterium
RRWLLAPEYMYPIERATQS

SEQ ID NO: 857284 - protein, 23 aa, Mycobacterium
RRWLPLDIRRPLRSTLITLDVPG

SEQ ID NO: 857285 - protein, 21 aa, Mycobacterium
RRWLRYRRMALEQTPIRSILS

SEQ ID NO: 857286 - protein, 19 aa, Mycobacterium
RRWNPNIQSVRAVSSPGGN

SEQ ID NO: 857287 - protein, 21 aa, Mycobacterium
RRWQPFTDWPDPWVLAGALAQ

SEQ ID NO: 857288 - protein, 25 aa, Mycobacterium
RRWSMADAFLHPVAHRPNLTIYTQT

SEQ ID NO: 857289 - protein, 24 aa, Mycobacterium
RRWSMADAFLHPVAHRPNLTVYTQ

SEQ ID NO: 857290 - protein, 19 aa, Mycobacterium
RRWTRLGQQVFRAVAELPQ

SEQ ID NO: 857291 - protein, 20 aa, Mycobacterium
RRWTVHQELIRGDDLCWTLI

SEQ ID NO: 857292 - protein, 20 aa, Mycobacterium
RRWYLISMEFTLYAIREPSA

SEQ ID NO: 857293 - protein, 25 aa, Mycobacterium
RRWYRRMYRDIYIPAGYTPTLIDHI

SEQ ID NO: 857294 - protein, 27 aa, Mycobacterium
RRYADTRRRLCAALANRGVLAYGRSGL

SEQ ID NO: 857295 - protein, 21 aa, Mycobacterium
RRYADWLAGPGVERGLLGPRE

SEQ ID NO: 857296 - protein, 19 aa, Mycobacterium
RRYDCYPHQLSGGQKQRVV

SEQ ID NO: 857297 - protein, 26 aa, Mycobacterium
RRYDGVLDHIMLYSPSVGIAAERVQQ

SEQ ID NO: 857298 - protein, 30 aa, Mycobacterium
RRYDLITFVASLHHLPLRDALHKARQMLRP

SEQ ID NO: 857299 - protein, 21 aa, Mycobacterium
RRYDTWLECLPRGKARRSVAV

SEQ ID NO: 857300 - protein, 26 aa, Mycobacterium
RRYEGVLDHIMLYPPSVGTAPERVGQ

SEQ ID NO: 857301 - protein, 18 aa, Mycobacterium
RRYGLDDTHLRAIAALNY

SEQ ID NO: 857302 - protein, 20 aa, Mycobacterium
RRYHRQKLHLVLSALRHAAH

SEQ ID NO: 857303 - protein, 23 aa, Mycobacterium
RRYKAPTLFLTKRDARSWLSLRQ

SEQ ID NO: 857304 - protein, 20 aa, Mycobacterium
RRYLEEVTMPGLLRGLQRSG

SEQ ID NO: 857305 - protein, 17 aa, Mycobacterium
RRYLLGRYTGVNRIIGT

SEQ ID NO: 857306 - protein, 20 aa, Mycobacterium
RRYPTPVICALLGAPPEDWQ

SEQ ID NO: 857307 - protein, 18 aa, Mycobacterium
RRYRLGILPPHQAAALQG

SEQ ID NO: 857308 - protein, 36 aa, Mycobacterium
RRYRLTVDLPRDFALNQPLSTFALAAIGLLDAESDQ

SEQ ID NO: 857309 - protein, 18 aa, Mycobacterium
RRYRPGDPPLAGSLLIGG

SEQ ID NO: 857310 - protein, 26 aa, Mycobacterium
RRYVEPYRAELQRLGRPVFGPSFEVD

SEQ ID NO: 857311 - protein, 17 aa, Mycobacterium
RRYVLGSGLFGLVHGLR

SEQ ID NO: 857312 - protein, 25 aa, Mycobacterium
RRYVRRQRSWFRRDRRVRWLDATVS

SEQ ID NO: 857313 - protein, 21 aa, Mycobacterium
RSAAYAMRWVAKNIVAAGLAE

SEQ ID NO: 857314 - protein, 23 aa, Mycobacterium
RSAAYAMRWVAKNVVAAGLADRA

SEQ ID NO: 857315 - protein, 22 aa, Mycobacterium
RSAAYAMRWVAKNVVAAGLAER

SEQ ID NO: 857316 - protein, 23 aa, Mycobacterium
RSAAYAMRWVAKNVVAAGLAERV

SEQ ID NO: 857317 - protein, 18 aa, Mycobacterium
RSACRALLLEHLSPGVAL

SEQ ID NO: 857318 - protein, 26 aa, Mycobacterium
RSACRALLLEHPSPAAALSALDRFAA

SEQ ID NO: 857319 - protein, 17 aa, Mycobacterium
RSACTDFARWRALGIGK

SEQ ID NO: 857320 - protein, 17 aa, Mycobacterium
RSADDIYLLYTGGTTGF

SEQ ID NO: 857321 - protein, 24 aa, Mycobacterium
RSADLFLGVPFNIASYALLTHMMA

SEQ ID NO: 857322 - protein, 23 aa, Mycobacterium
RSADTWILDQLFPADRATPMVTV

SEQ ID NO: 857323 - protein, 24 aa, Mycobacterium
RSAELLDVLKTEIWPLLDDRSPIT

SEQ ID NO: 857324 - protein, 25 aa, Mycobacterium
RSAELLVIGPPWPTTTPPPEVLRIR

SEQ ID NO: 857325 - protein, 26 aa, Mycobacterium
RSAERFIEVLRRWPHELSLSEHLAVN

SEQ ID NO: 857326 - protein, 42 aa, Mycobacterium
RSAETELPITPFVLTLRLLTVALRRHVVLNATWMETTGGPQI

SEQ ID NO: 857327 - protein, 24 aa, Mycobacterium
RSAFYDYIDSLFELMLAGGTEGAA

SEQ ID NO: 857328 - protein, 24 aa, Mycobacterium
RSAGDFRRLFPHIELDPNVLFTDC

SEQ ID NO: 857329 - protein, 31 aa, Mycobacterium
RSAGQGRLLAPNEFFVLLSTADHEKAADDRD

SEQ ID NO: 857330 - protein, 27 aa, Mycobacterium
RSAHFDHWTRKFLAAHPRSVVLHVGCG

SEQ ID NO: 857331 - protein, 17 aa, Mycobacterium
RSAILPLSFGFPFGFSA

SEQ ID NO: 857332 - protein, 18 aa, Mycobacterium
RSAIRVVLREVPDTHWAA

SEQ ID NO: 857333 - protein, 18 aa, Mycobacterium
RSALAALARAVPSAAGVH

SEQ ID NO: 857334 - protein, 33 aa, Mycobacterium
RSALEAWQVAERGWFALATVAGVRYSGLGALAL

SEQ ID NO: 857335 - protein, 18 aa, Mycobacterium
RSALFLLVQGQSADVRDA

SEQ ID NO: 857336 - protein, 24 aa, Mycobacterium
RSALITLNVPFFLSASDGADIRDR

SEQ ID NO: 857337 - protein, 18 aa, Mycobacterium
RSALLGRMYGDDGVALLA

SEQ ID NO: 857338 - protein, 24 aa, Mycobacterium
RSALLSLNVPYFFMASDGVEAHDF

SEQ ID NO: 857339 - protein, 17 aa, Mycobacterium
RSALPRPGRVRELLELT

SEQ ID NO: 857340 - protein, 25 aa, Mycobacterium
RSALREFLAFHQSAYFAVSYGLTDE

SEQ ID NO: 857341 - protein, 18 aa, Mycobacterium
RSALWRLRPMGADALLEV

SEQ ID NO: 857342 - protein, 20 aa, Mycobacterium
RSALYLPGNKPRALEKAKSL

SEQ ID NO: 857343 - protein, 20 aa, Mycobacterium
RSALYLPGNKPRALEKGKSL

SEQ ID NO: 857344 - protein, 18 aa, Mycobacterium
RSAMFTCEPFDIAELHSY

SEQ ID NO: 857345 - protein, 25 aa, Mycobacterium
RSAMTAIEWLFWRSTMKVDNAQRQE

SEQ ID NO: 857346 - protein, 23 aa, Mycobacterium
RSAMVHPLAVAANRNVFVQLVMS

SEQ ID NO: 857347 - protein, 17 aa, Mycobacterium
RSANRYGAKVKWAEVDI

SEQ ID NO: 857348 - protein, 21 aa, Mycobacterium
RSAPDRFGFWATLTLPDVDSA

SEQ ID NO: 857349 - protein, 42 aa, Mycobacterium
RSAPERPAGQPLFPLAFCRECGQEFLVVNLDRGRKSFSPRIL

SEQ ID NO: 857350 - protein, 21 aa, Mycobacterium
RSAPFATLPRSVYEATLDLLS

SEQ ID NO: 857351 - protein, 23 aa, Mycobacterium
RSAPPPWFTNVGRDTLIIIDEAG

SEQ ID NO: 857352 - protein, 19 aa, Mycobacterium
RSAPVRLRALERLELEALP

SEQ ID NO: 857353 - protein, 17 aa, Mycobacterium
RSAQNFRFFADHARLSA

SEQ ID NO: 857354 - protein, 30 aa, Mycobacterium
RSAQVAGALGLPFVASYHLTPATALEAIET

SEQ ID NO: 857355 - protein, 19 aa, Mycobacterium
RSARIPLVQLSRRIQRVDA

SEQ ID NO: 857356 - protein, 18 aa, Mycobacterium
RSARLLICVDDGPGPDLP

SEQ ID NO: 857357 - protein, 23 aa, Mycobacterium
RSARSHLRWIAAANRIPASRVDE

SEQ ID NO: 857358 - protein, 19 aa, Mycobacterium
RSATDLDVTLSWGAAAAGP

SEQ ID NO: 857359 - protein, 20 aa, Mycobacterium
RSATFPGGHFYLAAERDAVL

SEQ ID NO: 857360 - protein, 17 aa, Mycobacterium
RSAVAVALTSRFPIVLW

SEQ ID NO: 857361 - protein, 19 aa, Mycobacterium
RSAVVAAVIARLGARHLFI

SEQ ID NO: 857362 - protein, 23 aa, Mycobacterium
RSAVYAMYPGRDALLAELSKRTS

SEQ ID NO: 857363 - protein, 23 aa, Mycobacterium
RSAYATFDLLGRALGSLAGSALE

SEQ ID NO: 857364 - protein, 24 aa, Mycobacterium
RSAYPRIDLLINNAGVMWTPKQVT

SEQ ID NO: 857365 - protein, 17 aa, Mycobacterium
RSCDLQFRQFGGRAEFA

SEQ ID NO: 857366 - protein, 21 aa, Mycobacterium
RSDAAWCFRRSREAIEVIRQA

SEQ ID NO: 857367 - protein, 29 aa, Mycobacterium
RSDADLPGHWLLARLGKRVLRPGGLELTT

SEQ ID NO: 857368 - protein, 17 aa, Mycobacterium
RSDAGALFKFLNAGKRS

SEQ ID NO: 857369 - protein, 23 aa, Mycobacterium
RSDALYCSSACRQKAHRARSARR

SEQ ID NO: 857370 - protein, 25 aa, Mycobacterium
RSDAMGVMASVGIGWRACAPVPTAR

SEQ ID NO: 857371 - protein, 29 aa, Mycobacterium
RSDDHLQGHWLLARLGKRVLRPGGVELTR

SEQ ID NO: 857372 - protein, 28 aa, Mycobacterium
RSDESLDLRWWPLDKLPEGVDFGLTQLA

SEQ ID NO: 857373 - protein, 25 aa, Mycobacterium
RSDEVEFLIKKYPGGKFSALLDGHI

SEQ ID NO: 857374 - protein, 25 aa, Mycobacterium
RSDEVPVVVLLWSPRSDVCVDLLDT

SEQ ID NO: 857375 - protein, 20 aa, Mycobacterium
RSDILAFTLPGFATGDRTKR

SEQ ID NO: 857376 - protein, 28 aa, Mycobacterium
RSDILPLSFGFPFGFSAAIPPNLPLPTK

SEQ ID NO: 857377 - protein, 29 aa, Mycobacterium
RSDIRWQPQVWKSFAEELGILAAPLPEDR

SEQ ID NO: 857378 - protein, 25 aa, Mycobacterium
RSDLEVFLPPIGGQTLYIFGNARDL

SEQ ID NO: 857379 - protein, 17 aa, Mycobacterium
RSDLLRPWANWVTPEAE

SEQ ID NO: 857380 - protein, 19 aa, Mycobacterium
RSDPIGHAAFVHAHPRWIA

SEQ ID NO: 857381 - protein, 18 aa, Mycobacterium
RSDPIRQMMVGLGAGRDL

SEQ ID NO: 857382 - protein, 24 aa, Mycobacterium
RSDQFTIAPCRHPMRVNVTAAADG

SEQ ID NO: 857383 - protein, 20 aa, Mycobacterium
RSDRFFRVAQHLLDQHSRRS

SEQ ID NO: 857384 - protein, 25 aa, Mycobacterium
RSDRGFLCFPEVDIHIPFTPGMASL

SEQ ID NO: 857385 - protein, 27 aa, Mycobacterium
RSDRGPGRFFTMRLALSDIGISDITVT

SEQ ID NO: 857386 - protein, 26 aa, Mycobacterium
RSDRRRAPCVPALRAQRRLSRVALAA

SEQ ID NO: 857387 - protein, 29 aa, Mycobacterium
RSDSDMFTLGFRFKPWPSARSIADGPSIW

SEQ ID NO: 857388 - protein, 26 aa, Mycobacterium
RSDSDMFTLGFRFKPWRSAKSIADGA

SEQ ID NO: 857389 - protein, 27 aa, Mycobacterium
RSDSDMFTLGFRFKPWRSAKSIADGAD

SEQ ID NO: 857390 - protein, 28 aa, Mycobacterium
RSDSDMFTLGFRFKPWTSAKSIADGPSI

SEQ ID NO: 857391 - protein, 19 aa, Mycobacterium
RSDSLAQKLLALTAPGVPD

SEQ ID NO: 857392 - protein, 26 aa, Mycobacterium
RSDSPVEYRWYAGGTWRPADEDWFDD

SEQ ID NO: 857393 - protein, 24 aa, Mycobacterium
RSDSSIFTLSFPFEPWTREEGVAD

SEQ ID NO: 857394 - protein, 23 aa, Mycobacterium
RSDSSIFTLSFPFEPWTRKEGVA

SEQ ID NO: 857395 - protein, 23 aa, Mycobacterium
RSDTPLLFLHNTTGYMVGKAYEE

SEQ ID NO: 857396 - protein, 25 aa, Mycobacterium
RSDTSYLTELRWWTSPFEANADHVP

SEQ ID NO: 857397 - protein, 22 aa, Mycobacterium
RSDTVVAVLPRDEAKALDVRTA

SEQ ID NO: 857398 - protein, 17 aa, Mycobacterium
RSDVDRAWPAIAAQLRG

SEQ ID NO: 857399 - protein, 24 aa, Mycobacterium
RSDVFLTSFLPAHRKKFGIDIEDI

SEQ ID NO: 857400 - protein, 18 aa, Mycobacterium
RSDWFFGGTTYGAGSLLA

SEQ ID NO: 857401 - protein, 27 aa, Mycobacterium
RSDYDAFTLAGIPAGGLFSGAEEKMSP

SEQ ID NO: 857402 - protein, 21 aa, Mycobacterium
RSEAAYARHAGLAPVPHSSGS

SEQ ID NO: 857403 - protein, 18 aa, Mycobacterium
RSEDGILGFVVPTDTPGF

SEQ ID NO: 857404 - protein, 19 aa, Mycobacterium
RSEGCAMLVLKRLPDAVRD

SEQ ID NO: 857405 - protein, 28 aa, Mycobacterium
RSEGDRRRWYLRLIPQVLDSMCTTSPTS

SEQ ID NO: 857406 - protein, 26 aa, Mycobacterium
RSEGGGLVLLKPLRAALEDGNRIRAV

SEQ ID NO: 857407 - protein, 23 aa, Mycobacterium
RSEILRRAYELILADIDRLSALV

SEQ ID NO: 857408 - protein, 22 aa, Mycobacterium
RSEIYRIITEFAAQGMAVVMAS

SEQ ID NO: 857409 - protein, 24 aa, Mycobacterium
RSELDVIPPGDLRMALAALASDSP

SEQ ID NO: 857410 - protein, 28 aa, Mycobacterium
RSEMEMKVLLWAVQRLIGGLSTIGAERD

SEQ ID NO: 857411 - protein, 19 aa, Mycobacterium
RSEPGLRYRIYRPAVVVGD

SEQ ID NO: 857412 - protein, 17 aa, Mycobacterium
RSEPPHEGARYTQIAVL

SEQ ID NO: 857413 - protein, 23 aa, Mycobacterium
RSEQDTFYIAPDDSRQLLRTHTS

SEQ ID NO: 857414 - protein, 23 aa, Mycobacterium
RSEQDTFYIAPEDSRQLLRTHTS

SEQ ID NO: 857415 - protein, 24 aa, Mycobacterium
RSERLRLVELPPDQARPILRAFPA

SEQ ID NO: 857416 - protein, 32 aa, Mycobacterium
RSERSLPYTQLIAGLLNLAPRWYIGSVLRHVD

SEQ ID NO: 857417 - protein, 25 aa, Mycobacterium
RSESQYLAQLYSIIGIRASEAAQQL

SEQ ID NO: 857418 - protein, 17 aa, Mycobacterium
RSEYRVHAVSTGGFRAE

SEQ ID NO: 857419 - protein, 19 aa, Mycobacterium
RSFAVLRAERPVSWHPPVE

SEQ ID NO: 857420 - protein, 19 aa, Mycobacterium
RSFCYVDDMTRGILDFARL

SEQ ID NO: 857421 - protein, 20 aa, Mycobacterium
RSFEPLARELASAAAATVVA

SEQ ID NO: 857422 - protein, 18 aa, Mycobacterium
RSFFPPMAGLWADDKTLA

SEQ ID NO: 857423 - protein, 20 aa, Mycobacterium
RSFGLAFEGCTLPGATEPLF

SEQ ID NO: 857424 - protein, 17 aa, Mycobacterium
RSFGTLQNVLAASASDL

SEQ ID NO: 857425 - protein, 19 aa, Mycobacterium
RSFLADQLAAHRFEPGIDG

SEQ ID NO: 857426 - protein, 17 aa, Mycobacterium
RSFLALGIPAKHAPWIA

SEQ ID NO: 857427 - protein, 20 aa, Mycobacterium
RSFLLAVVVPTPEALEQYDP

SEQ ID NO: 857428 - protein, 22 aa, Mycobacterium
RSFLLESAMLDRFTAEHLDAVL

SEQ ID NO: 857429 - protein, 32 aa, Mycobacterium
RSFREGTNLKAWLYRILTNTYINSYRKKQRQP

SEQ ID NO: 857430 - protein, 20 aa, Mycobacterium
RSFSDFPTILESISGRLGTL

SEQ ID NO: 857431 - protein, 17 aa, Mycobacterium
RSFTIVGDLAQRRSPAG

SEQ ID NO: 857432 - protein, 20 aa, Mycobacterium
RSFYARWRDLMNTKAWHEEH

SEQ ID NO: 857433 - protein, 30 aa, Mycobacterium
RSGAALTGPATFAALTAGAAVAAIHSRVGS

SEQ ID NO: 857434 - protein, 23 aa, Mycobacterium
RSGASYRLTWRHRRQNVSLPAAV

SEQ ID NO: 857435 - protein, 24 aa, Mycobacterium
RSGCNQVHFWWYRTSRRTQTAALG

SEQ ID NO: 857436 - protein, 26 aa, Mycobacterium
RSGDFLFAALHRAGLANQAVCVDAAD

SEQ ID NO: 857437 - protein, 24 aa, Mycobacterium
RSGDIRAMKFGDDTFSWVPADAAV

SEQ ID NO: 857438 - protein, 19 aa, Mycobacterium
RSGFDPAQPTAWIAEGLFG

SEQ ID NO: 857439 - protein, 28 aa, Mycobacterium
RSGFGPFTPGFRSVPFGDAAALAAAIDE

SEQ ID NO: 857440 - protein, 30 aa, Mycobacterium
RSGFVVNALLVPYLLAAIRMVEAGFATVED

SEQ ID NO: 857441 - protein, 30 aa, Mycobacterium
RSGFVVNALLVPYLLSAIRMVEAGFASVED

SEQ ID NO: 857442 - protein, 23 aa, Mycobacterium
RSGGALWLPASPVLGAAGAGDSV

SEQ ID NO: 857443 - protein, 17 aa, Mycobacterium
RSGGQLKRVGWVLDQTR

SEQ ID NO: 857444 - protein, 26 aa, Mycobacterium
RSGKGVFRCRPGSRKWLRGTAKLEQA

SEQ ID NO: 857445 - protein, 23 aa, Mycobacterium
RSGKIMRRLLRDIAEKRELGDTS

SEQ ID NO: 857446 - protein, 23 aa, Mycobacterium
RSGKIMRRLLRDIAENRELGDTS

SEQ ID NO: 857447 - protein, 23 aa, Mycobacterium
RSGKIMRRLLRDVADKRELGDTS

SEQ ID NO: 857448 - protein, 23 aa, Mycobacterium
RSGKIMRRLLRDVAEGRELGDTS

SEQ ID NO: 857449 - protein, 23 aa, Mycobacterium
RSGKIMRRLLRDVAENRELGDTS

SEQ ID NO: 857450 - protein, 17 aa, Mycobacterium
RSGLAELFSVPDGYEVI

SEQ ID NO: 857451 - protein, 30 aa, Mycobacterium
RSGLGMALLPIIGWLPDGIAPVDAMPAANL

SEQ ID NO: 857452 - protein, 29 aa, Mycobacterium
RSGLPFSRIRVLRRLARRPMSVKEVAHAA

SEQ ID NO: 857453 - protein, 19 aa, Mycobacterium
RSGLPVVELLATELIRGRT

SEQ ID NO: 857454 - protein, 25 aa, Mycobacterium
RSGLTASRFVACPFAGAGAPARRMY

SEQ ID NO: 857455 - protein, 25 aa, Mycobacterium
RSGLVPLQWAVACLLADIGSQAYPA

SEQ ID NO: 857456 - protein, 20 aa, Mycobacterium
RSGLYYVPISTHLTAAEAAY

SEQ ID NO: 857457 - protein, 28 aa, Mycobacterium
RSGPERFLSTFPLLAELAALMNDGLPRH

SEQ ID NO: 857458 - protein, 28 aa, Mycobacterium
RSGPPLLRGTSMLPPARPGLAGTSVLVP

SEQ ID NO: 857459 - protein, 29 aa, Mycobacterium
RSGPPPDRFLIGLAVLSLLAAAAEHQPVL

SEQ ID NO: 857460 - protein, 24 aa, Mycobacterium
RSGPQTPYLLIRGTARVEEGGAPE

SEQ ID NO: 857461 - protein, 39 aa, Mycobacterium
RSGQEFSPMIFYGREFWTEKLPVLPVLEGLFVGNAKLTP

SEQ ID NO: 857462 - protein, 23 aa, Mycobacterium
RSGQNPRPQWPASAALFVGRDGA

SEQ ID NO: 857463 - protein, 38 aa, Mycobacterium
RSGRIRTTASWLGTALALKPLLCLDVDGRLVLDQRIRT

SEQ ID NO: 857464 - protein, 30 aa, Mycobacterium
RSGRKRTHWIWFVFPQLRGLGRSPTAHHYG

SEQ ID NO: 857465 - protein, 30 aa, Mycobacterium
RSGRKRTHWMWFVFPQLRGLGHSPMADYYG

SEQ ID NO: 857466 - protein, 25 aa, Mycobacterium
RSGRLLIFSAYVTHRLPEIWPAPRE

SEQ ID NO: 857467 - protein, 19 aa, Mycobacterium
RSGRVWARLPRANSTDIDR

SEQ ID NO: 857468 - protein, 24 aa, Mycobacterium
RSGSAHLVVWPIDSVSGTGAGHVE

SEQ ID NO: 857469 - protein, 23 aa, Mycobacterium
RSGTAHVVVWPIELPGAADDRRH

SEQ ID NO: 857470 - protein, 17 aa, Mycobacterium
RSGTKRPWHVRHNYLLD

SEQ ID NO: 857471 - protein, 23 aa, Mycobacterium
RSGTTLLQRLLAADPRFVCAYGW

SEQ ID NO: 857472 - protein, 26 aa, Mycobacterium
RSGVAFDILRRWLIARGCDVAFIRNV

SEQ ID NO: 857473 - protein, 18 aa, Mycobacterium
RSGWLNGVKHWEVDFCPA

SEQ ID NO: 857474 - protein, 17 aa, Mycobacterium
RSGYLKVRDRTSYEFAI

SEQ ID NO: 857475 - protein, 24 aa, Mycobacterium
RSGYPLELLVRAGAAGWRVVELDV

SEQ ID NO: 857476 - protein, 22 aa, Mycobacterium
RSGYVITPVVIWGGGRLDPHPV

SEQ ID NO: 857477 - protein, 19 aa, Mycobacterium
RSGYVITPVVIWGGGRLEL

SEQ ID NO: 857478 - protein, 23 aa, Mycobacterium
RSGYVITPVVIWGGGRLQPRPAP

SEQ ID NO: 857479 - protein, 24 aa, Mycobacterium
RSGYVITPVVLWGGGRLDPRPAPD

SEQ ID NO: 857480 - protein, 22 aa, Mycobacterium
RSGYVVTPVVIWGGGRLDPRPS

SEQ ID NO: 857481 - protein, 17 aa, Mycobacterium
RSHAYGLLRTILATAVS

SEQ ID NO: 857482 - protein, 25 aa, Mycobacterium
RSHGRHRFYRVNGAALRPVHDWVAA

SEQ ID NO: 857483 - protein, 19 aa, Mycobacterium
RSHGSLSMNRALMAAGLVD

SEQ ID NO: 857484 - protein, 17 aa, Mycobacterium
RSHLHIEIVPGLAPTNA

SEQ ID NO: 857485 - protein, 19 aa, Mycobacterium
RSHPMTVDWISYAQSLTAK

SEQ ID NO: 857486 - protein, 20 aa, Mycobacterium
RSHQAMYLDRLLADGLAMDW

SEQ ID NO: 857487 - protein, 17 aa, Mycobacterium
RSHRALGPLFTRLAAVS

SEQ ID NO: 857488 - protein, 23 aa, Mycobacterium
RSHTLPWATASTQPILAAARRLV

SEQ ID NO: 857489 - protein, 21 aa, Mycobacterium
RSIAALRQRPADEPLWTSITH

SEQ ID NO: 857490 - protein, 26 aa, Mycobacterium
RSIADPIFDPLYAELNRRRAVLFVHP

SEQ ID NO: 857491 - protein, 17 aa, Mycobacterium
RSIAFYRQAFGFDELAV

SEQ ID NO: 857492 - protein, 19 aa, Mycobacterium
RSIALRMALMGKHERMSAG

SEQ ID NO: 857493 - protein, 18 aa, Mycobacterium
RSIAPGVRLLVTPASQAV

SEQ ID NO: 857494 - protein, 23 aa, Mycobacterium
RSIAPIMPILTEQDGRWFVQFDD

SEQ ID NO: 857495 - protein, 25 aa, Mycobacterium
RSIAPLMRAVLLTNAGRSALILTFD

SEQ ID NO: 857496 - protein, 23 aa, Mycobacterium
RSIATPVLVIGFSDDVLTPPYLG

SEQ ID NO: 857497 - protein, 20 aa, Mycobacterium
RSICRIWGTSSTETPRRWRG

SEQ ID NO: 857498 - protein, 26 aa, Mycobacterium
RSIDERVLPAVLLLKAVGVAAQRFGE

SEQ ID NO: 857499 - protein, 23 aa, Mycobacterium
RSIELRLLEIEPALKALEGVVME

SEQ ID NO: 857500 - protein, 32 aa, Mycobacterium
RSIENTDVVLWYVFGIHHITRPEDWPIMPVDT

SEQ ID NO: 857501 - protein, 19 aa, Mycobacterium
RSIFEPHLLSDLVAQVVRL

SEQ ID NO: 857502 - protein, 17 aa, Mycobacterium
RSIGVGKLRSSLLNAFS

SEQ ID NO: 857503 - protein, 17 aa, Mycobacterium
RSIIGFGARIGPRALVR

SEQ ID NO: 857504 - protein, 18 aa, Mycobacterium
RSILGRFLEHSRIIHFNA

SEQ ID NO: 857505 - protein, 17 aa, Mycobacterium
RSINAAAKLPFIEVYIA

SEQ ID NO: 857506 - protein, 28 aa, Mycobacterium
RSINLGDHTIRLLLAKNPAGWQEALSMV

SEQ ID NO: 857507 - protein, 27 aa, Mycobacterium
RSIPGVTEKWDLYVRKFELATGYSELI

SEQ ID NO: 857508 - protein, 17 aa, Mycobacterium
RSIPLLMVPPVINKFYI

SEQ ID NO: 857509 - protein, 20 aa, Mycobacterium
RSIPPSIPAALRVAPRLLAQ

SEQ ID NO: 857510 - protein, 23 aa, Mycobacterium
RSIPRTLVPPPCTPHLQGFATLV

SEQ ID NO: 857511 - protein, 19 aa, Mycobacterium
RSIPTLMAFKKGKLLFNQP

SEQ ID NO: 857512 - protein, 28 aa, Mycobacterium
RSIQVLVQELPYVTLLLRIRGNTAAERR

SEQ ID NO: 857513 - protein, 20 aa, Mycobacterium
RSIRGFLHRAEIAHISADGQ

SEQ ID NO: 857514 - protein, 17 aa, Mycobacterium
RSIRLHSCPVRDLARDH

SEQ ID NO: 857515 - protein, 19 aa, Mycobacterium
RSITARRILVATGLTDVLP

SEQ ID NO: 857516 - protein, 27 aa, Mycobacterium
RSITERVLPAVLLLKAVGLAAQRYGEF

SEQ ID NO: 857517 - protein, 22 aa, Mycobacterium
RSITTAIRRLPCGTPASTSGAS

SEQ ID NO: 857518 - protein, 24 aa, Mycobacterium
RSIVPVQVFWQPPADRSRLAKVAG

SEQ ID NO: 857519 - protein, 20 aa, Mycobacterium
RSIYHPGAKLDWMTATTLLT

SEQ ID NO: 857520 - protein, 18 aa, Mycobacterium
RSIYQDGWWACARLDKAP

SEQ ID NO: 857521 - protein, 20 aa, Mycobacterium
RSKLGFLPNMYRNMANVPGL

SEQ ID NO: 857522 - protein, 24 aa, Mycobacterium
RSKLPALRALFNDGLAPGEFLQLK

SEQ ID NO: 857523 - protein, 23 aa, Mycobacterium
RSKPGEWYVVHSYAGYENKVKAN

SEQ ID NO: 857524 - protein, 24 aa, Mycobacterium
RSKTKFWQMIGRGTRLRPDLLGPG

SEQ ID NO: 857525 - protein, 22 aa, Mycobacterium
RSKTYPLCDTSHRKRVRPDKAA

SEQ ID NO: 857526 - protein, 26 aa, Mycobacterium
RSKVPVLVDLWATWCGPCRMVSPALE

SEQ ID NO: 857527 - protein, 26 aa, Mycobacterium
RSLAALGIPVLFPRNAREIVTLFLHG

SEQ ID NO: 857528 - protein, 26 aa, Mycobacterium
RSLAALSMPILFPRNAEEVIRFGMYG

SEQ ID NO: 857529 - protein, 17 aa, Mycobacterium
RSLANYNFGLRALTIAK

SEQ ID NO: 857530 - protein, 23 aa, Mycobacterium
RSLAPVPWIDHVCATRLLARLGM

SEQ ID NO: 857531 - protein, 18 aa, Mycobacterium
RSLARLTGAAPSAAGPRV

SEQ ID NO: 857532 - protein, 25 aa, Mycobacterium
RSLASLRAWSAAVRGYRAALRHRRD

SEQ ID NO: 857533 - protein, 17 aa, Mycobacterium
RSLATDLIAALLKQGRL

SEQ ID NO: 857534 - protein, 25 aa, Mycobacterium
RSLDDEFPLALHFTMIAGGPIRARV

SEQ ID NO: 857535 - protein, 23 aa, Mycobacterium
RSLDMPLAVFAAMRRQQEMPHGL

SEQ ID NO: 857536 - protein, 17 aa, Mycobacterium
RSLDVYPVNYPASDNWD

SEQ ID NO: 857537 - protein, 18 aa, Mycobacterium
RSLEEVGIGFCFAPQFHP

SEQ ID NO: 857538 - protein, 25 aa, Mycobacterium
RSLEGNRLLAPNEYIITLSVHDSEK

SEQ ID NO: 857539 - protein, 19 aa, Mycobacterium
RSLEWSRHDVAGIGIAVGG

SEQ ID NO: 857540 - protein, 17 aa, Mycobacterium
RSLFPEFSELFAAFPSF

SEQ ID NO: 857541 - protein, 17 aa, Mycobacterium
RSLGHPFLEQWRGREAE

SEQ ID NO: 857542 - protein, 23 aa, Mycobacterium
RSLGLPLVLLHRQTRFVEITEAV

SEQ ID NO: 857543 - protein, 18 aa, Mycobacterium
RSLGLTGFRLEISSLGDA

SEQ ID NO: 857544 - protein, 17 aa, Mycobacterium
RSLGPWGRRHGVSTVMI

SEQ ID NO: 857545 - protein, 18 aa, Mycobacterium
RSLGSLLLALLSDPVQLD

SEQ ID NO: 857546 - protein, 28 aa, Mycobacterium
RSLHDNIRAAWLWSGRRAIIAGRAAAAL

SEQ ID NO: 857547 - protein, 20 aa, Mycobacterium
RSLIGAWCFVDHYGPVSAHM

SEQ ID NO: 857548 - protein, 20 aa, Mycobacterium
RSLIRHLGVLEVPRLQLREA

SEQ ID NO: 857549 - protein, 18 aa, Mycobacterium
RSLITVSTYLRTPAERED

SEQ ID NO: 857550 - protein, 18 aa, Mycobacterium
RSLKQKRSLIRPVIAELR

SEQ ID NO: 857551 - protein, 22 aa, Mycobacterium
RSLLFVPGDRPERFEKALNSGA

SEQ ID NO: 857552 - protein, 27 aa, Mycobacterium
RSLLGFDFCGVLLPDEQSRHLRVRGAS

SEQ ID NO: 857553 - protein, 23 aa, Mycobacterium
RSLLNFQTLHQMSIPSDLVFLAR

SEQ ID NO: 857554 - protein, 27 aa, Mycobacterium
RSLLQPMTPQLGLIEPVTLSVGAEVEF

SEQ ID NO: 857555 - protein, 21 aa, Mycobacterium
RSLLRDYQEAFGLPDDGWVLD

SEQ ID NO: 857556 - protein, 18 aa, Mycobacterium
RSLLVDDVRRRLRKSWLE

SEQ ID NO: 857557 - protein, 20 aa, Mycobacterium
RSLLWRWAGDMRIAFTGGTA

SEQ ID NO: 857558 - protein, 18 aa, Mycobacterium
RSLMWQYISSIVAGSMSG

SEQ ID NO: 857559 - protein, 20 aa, Mycobacterium
RSLPHAVLMMIPEAWERHES

SEQ ID NO: 857560 - protein, 18 aa, Mycobacterium
RSLPKLSMHLLDAIAAGP

SEQ ID NO: 857561 - protein, 17 aa, Mycobacterium
RSLPLAPRNPLPYWQQL

SEQ ID NO: 857562 - protein, 20 aa, Mycobacterium
RSLPPIPCYPGDLNQVWTNI

SEQ ID NO: 857563 - protein, 18 aa, Mycobacterium
RSLPWKRRPEASRLLIDV

SEQ ID NO: 857564 - protein, 25 aa, Mycobacterium
RSLRLRADIPLPGRLWLELSASPDG

SEQ ID NO: 857565 - protein, 19 aa, Mycobacterium
RSLRQLPEPVIPNGLQIRT

SEQ ID NO: 857566 - protein, 28 aa, Mycobacterium
RSLSLFARGFLLTKRDIDWFQAKYLRGS

SEQ ID NO: 857567 - protein, 18 aa, Mycobacterium
RSLSRQDVFPTRPIVGLL

SEQ ID NO: 857568 - protein, 17 aa, Mycobacterium
RSLSWNPLFQTMVNFRG

SEQ ID NO: 857569 - protein, 21 aa, Mycobacterium
RSLTARPACTAADAAGAAVSA

SEQ ID NO: 857570 - protein, 22 aa, Mycobacterium
RSLTHHPLIQVLLGWENFPGYD

SEQ ID NO: 857571 - protein, 22 aa, Mycobacterium
RSLTHHPLIQVMLAWQNFGGQD

SEQ ID NO: 857572 - protein, 25 aa, Mycobacterium
RSLTKRLHLPVEGILFAVEWNRFWH

SEQ ID NO: 857573 - protein, 22 aa, Mycobacterium
RSLVLAKLWMRGYRRMLRVRVD

SEQ ID NO: 857574 - protein, 23 aa, Mycobacterium
RSLVPSDGFLPAAPMPAGPDPER

SEQ ID NO: 857575 - protein, 21 aa, Mycobacterium
RSLVRKTLGIEFPGCTSATVG

SEQ ID NO: 857576 - protein, 21 aa, Mycobacterium
RSLVRSWCERVWTPKHVRQIA

SEQ ID NO: 857577 - protein, 20 aa, Mycobacterium
RSLVVYLKRAGGQSQFSVFV

SEQ ID NO: 857578 - protein, 17 aa, Mycobacterium
RSLVYLPCVQRLTPEVL

SEQ ID NO: 857579 - protein, 20 aa, Mycobacterium
RSLWRATDPVLYAMCGALSR

SEQ ID NO: 857580 - protein, 26 aa, Mycobacterium
RSMDRPGLLALLTRALERAGADIVWA

SEQ ID NO: 857581 - protein, 28 aa, Mycobacterium
RSMELLDEVILMLRRLHQPVIAAVNGPA

SEQ ID NO: 857582 - protein, 22 aa, Mycobacterium
RSMFEHRAVVFGAGREELLSGL

SEQ ID NO: 857583 - protein, 19 aa, Mycobacterium
RSMIKDGLAMRHGKELTWS

SEQ ID NO: 857584 - protein, 18 aa, Mycobacterium
RSMLSLLAKLPDTCHPMD

SEQ ID NO: 857585 - protein, 19 aa, Mycobacterium
RSMPIITEPGGLGPPGTIG

SEQ ID NO: 857586 - protein, 21 aa, Mycobacterium
RSMPMHYLPPRKTLLDRVGSL

SEQ ID NO: 857587 - protein, 28 aa, Mycobacterium
RSMQRKKFGRLIFIGSVSGSWGIGNQAN

SEQ ID NO: 857588 - protein, 39 aa, Mycobacterium
RSNAPFRVVTGHGAFILPVFRKARFLTLAMCEAEVAEKC

SEQ ID NO: 857589 - protein, 23 aa, Mycobacterium
RSNEFFRLWLDPSMTYSCAYFER

SEQ ID NO: 857590 - protein, 26 aa, Mycobacterium
RSNERAGFWSGLLHADAAGAPLLRHR

SEQ ID NO: 857591 - protein, 26 aa, Mycobacterium
RSNERLSRAILRRAGIGPRLTRLERH

SEQ ID NO: 857592 - protein, 27 aa, Mycobacterium
RSNLIGMGVIPLQFPKGQSASSLGLDG

SEQ ID NO: 857593 - protein, 21 aa, Mycobacterium
RSNLYTPLQAAKLAKETSSTK

SEQ ID NO: 857594 - protein, 18 aa, Mycobacterium
RSNNIWRPSPGSVYPTLQ

SEQ ID NO: 857595 - protein, 19 aa, Mycobacterium
RSNRIRAWSSHLCTRPSVV

SEQ ID NO: 857596 - protein, 20 aa, Mycobacterium
RSNRLAAYLHSQGLGCHTER

SEQ ID NO: 857597 - protein, 17 aa, Mycobacterium
RSNSMRTVLLRHCPSLA

SEQ ID NO: 857598 - protein, 23 aa, Mycobacterium
RSNTPLLFLHNTTGYMVGKDYEE

SEQ ID NO: 857599 - protein, 20 aa, Mycobacterium
RSNVMLLHTLGAEVVLVAPP

SEQ ID NO: 857600 - protein, 21 aa, Mycobacterium
RSNVMLLHTLGAEVVLVAPPT

SEQ ID NO: 857601 - protein, 22 aa, Mycobacterium
RSNVMLLHTLGAEVVLVAPPTL

SEQ ID NO: 857602 - protein, 26 aa, Mycobacterium
RSNYTKSLRMFAVLPTIVAADMRRRR

SEQ ID NO: 857603 - protein, 25 aa, Mycobacterium
RSPAEVLCLPYFLGEKSPLHDPDLR

SEQ ID NO: 857604 - protein, 17 aa, Mycobacterium
RSPAFDVQRERIIGVWE

SEQ ID NO: 857605 - protein, 27 aa, Mycobacterium
RSPAPHCVEWILAHPTGITEILEGILE

SEQ ID NO: 857606 - protein, 22 aa, Mycobacterium
RSPECFSLARVFDRLVQGQFHG

SEQ ID NO: 857607 - protein, 23 aa, Mycobacterium
RSPGRLRIALSTKVPTPLPVRVG

SEQ ID NO: 857608 - protein, 26 aa, Mycobacterium
RSPHRVPVWFMRQAGRSLPEYRELRA

SEQ ID NO: 857609 - protein, 19 aa, Mycobacterium
RSPIPITELQRHATGRGWV

SEQ ID NO: 857610 - protein, 25 aa, Mycobacterium
RSPLKYAVYFEDWILFDDTGLKGQA

SEQ ID NO: 857611 - protein, 17 aa, Mycobacterium
RSPLSYLLDDQLPTNDS

SEQ ID NO: 857612 - protein, 17 aa, Mycobacterium
RSPLVGPQFVDLVDAYS

SEQ ID NO: 857613 - protein, 20 aa, Mycobacterium
RSPLYHELQVPEFAFRAVDG

SEQ ID NO: 857614 - protein, 18 aa, Mycobacterium
RSPMEKATPMRRLGDPVD

SEQ ID NO: 857615 - protein, 18 aa, Mycobacterium
RSPMPLPELQRRAADRGL

SEQ ID NO: 857616 - protein, 24 aa, Mycobacterium
RSPQLLKALLGLNRSFIGRLRTEE

SEQ ID NO: 857617 - protein, 27 aa, Mycobacterium
RSPQLYRDWKLLTAWAVRLLRATYGQR

SEQ ID NO: 857618 - protein, 26 aa, Mycobacterium
RSPRARVIFVDYLSLLPPEGQPAPPY

SEQ ID NO: 857619 - protein, 19 aa, Mycobacterium
RSPRFVIVAVDISEPGNAG

SEQ ID NO: 857620 - protein, 25 aa, Mycobacterium
RSPRPATVWIAQDGSHRLVRANVDL

SEQ ID NO: 857621 - protein, 29 aa, Mycobacterium
RSPSARVLFVDYLTLLPPAGVGAPPLSEA

SEQ ID NO: 857622 - protein, 20 aa, Mycobacterium
RSPTFYRFDSGEQLKVWRAM

SEQ ID NO: 857623 - protein, 21 aa, Mycobacterium
RSPTFYRFDSGEQLRVWREMD

SEQ ID NO: 857624 - protein, 24 aa, Mycobacterium
RSPTPAPRRGPAPSPAPRPRSRRA

SEQ ID NO: 857625 - protein, 21 aa, Mycobacterium
RSPTWILPKPDRRYTRGERWA

SEQ ID NO: 857626 - protein, 31 aa, Mycobacterium
RSPVVARGWRTPLRFLFIDGGHTEDAANRDF

SEQ ID NO: 857627 - protein, 19 aa, Mycobacterium
RSPWARGFERSFALLPAGA

SEQ ID NO: 857628 - protein, 17 aa, Mycobacterium
RSQERAAAAWSGGYFAK

SEQ ID NO: 857629 - protein, 19 aa, Mycobacterium
RSQFGVELVWAIEDCRHLS

SEQ ID NO: 857630 - protein, 18 aa, Mycobacterium
RSQGCGMSYVIAGPAAIA

SEQ ID NO: 857631 - protein, 31 aa, Mycobacterium
RSQGFIPHCFAAVKHWPIAPYVVEGNPRQAV

SEQ ID NO: 857632 - protein, 20 aa, Mycobacterium
RSQHPGWPAPVGPLRVSAGL

SEQ ID NO: 857633 - protein, 17 aa, Mycobacterium
RSQLALRQEWEAQHVTV

SEQ ID NO: 857634 - protein, 29 aa, Mycobacterium
RSQLFPGEMFADLFPSRRGRPSVPAEVMA

SEQ ID NO: 857635 - protein, 24 aa, Mycobacterium
RSQLIVYHHMWSDGAEWQCSGCTG

SEQ ID NO: 857636 - protein, 33 aa, Mycobacterium
RSQLQHALPITFGYRVACWTAPLLRHLDRLAEL

SEQ ID NO: 857637 - protein, 24 aa, Mycobacterium
RSQLRIAYDMFAQMGAAGFAERAR

SEQ ID NO: 857638 - protein, 27 aa, Mycobacterium
RSQLRVREPRWLPRGLSREESAALLGS

SEQ ID NO: 857639 - protein, 24 aa, Mycobacterium
RSQMAMGFFRHLAADRATVYSAGS

SEQ ID NO: 857640 - protein, 18 aa, Mycobacterium
RSQRAIHFQEWWVRYRAQ

SEQ ID NO: 857641 - protein, 21 aa, Mycobacterium
RSQRLSVFELQARAILGFAVD

SEQ ID NO: 857642 - protein, 18 aa, Mycobacterium
RSQVDLSQKHRIAAAATE

SEQ ID NO: 857643 - protein, 27 aa, Mycobacterium
RSQVGFVFQNFNLFPHLTVLENVIEAP

SEQ ID NO: 857644 - protein, 28 aa, Mycobacterium
RSQVLWTQNMLLPWAWRHLRGRSSGDGR

SEQ ID NO: 857645 - protein, 22 aa, Mycobacterium
RSQWAMGWSQDPTQSALRALIA

SEQ ID NO: 857646 - protein, 21 aa, Mycobacterium
RSRALPSTFASWRERRRLIKV

SEQ ID NO: 857647 - protein, 21 aa, Mycobacterium
RSRALPSTFATWRERRRLIKV

SEQ ID NO: 857648 - protein, 35 aa, Mycobacterium
RSRALPSTYAWWHERWRLINVLRKRDRILQSAPNI

SEQ ID NO: 857649 - protein, 21 aa, Mycobacterium
RSRANFGYYARRALARHPDAL

SEQ ID NO: 857650 - protein, 19 aa, Mycobacterium
RSRARLLEAAAALLRSGGP

SEQ ID NO: 857651 - protein, 20 aa, Mycobacterium
RSRAYLGGRSVPAKSLASFT

SEQ ID NO: 857652 - protein, 17 aa, Mycobacterium
RSRCRARWLDGSLEAQA

SEQ ID NO: 857653 - protein, 23 aa, Mycobacterium
RSRDLHDALRRRCLYHWIDYPEA

SEQ ID NO: 857654 - protein, 23 aa, Mycobacterium
RSRDLHDALRRRCLYHWIEYPQR

SEQ ID NO: 857655 - protein, 27 aa, Mycobacterium
RSRELILDAYLLRAMSIAGWAPAIGEC

SEQ ID NO: 857656 - protein, 27 aa, Mycobacterium
RSRERGYAYFLYPPEVPLTETAYDRLA

SEQ ID NO: 857657 - protein, 28 aa, Mycobacterium
RSRERGYAYFLYPPHAPLTETAYDRLAT

SEQ ID NO: 857658 - protein, 18 aa, Mycobacterium
RSRFGAALPVRVCTIRTD

SEQ ID NO: 857659 - protein, 17 aa, Mycobacterium
RSRFYRPLPRPEVIAKL

SEQ ID NO: 857660 - protein, 26 aa, Mycobacterium
RSRGAFRVPLPKEFGPVRVRFLGINE

SEQ ID NO: 857661 - protein, 20 aa, Mycobacterium
RSRGITMYRADPDKVFNRGS

SEQ ID NO: 857662 - protein, 25 aa, Mycobacterium
RSRGVEVLLLSDLLREALASGAARV

SEQ ID NO: 857663 - protein, 28 aa, Mycobacterium
RSRGYAPLPVALPVPVVPTLAVGADLKN

SEQ ID NO: 857664 - protein, 28 aa, Mycobacterium
RSRIFPKGLATFIGLRDQTCRTPYCDAL

SEQ ID NO: 857665 - protein, 18 aa, Mycobacterium
RSRILIDPSALSGPPLTT

SEQ ID NO: 857666 - protein, 20 aa, Mycobacterium
RSRILVQRSVYDRFMEMLEP

SEQ ID NO: 857667 - protein, 34 aa, Mycobacterium
RSRIQLMIDFMATRTAFFDEFFLGAADSGVRQVV

SEQ ID NO: 857668 - protein, 19 aa, Mycobacterium
RSRITLRWGPRYDAHLLVP

SEQ ID NO: 857669 - protein, 19 aa, Mycobacterium
RSRLFPRGLAELIDLRDQT

SEQ ID NO: 857670 - protein, 21 aa, Mycobacterium
RSRLGLAQFAAPRPGRRIGLV

SEQ ID NO: 857671 - protein, 19 aa, Mycobacterium
RSRLLDAVLADLYGPRRLL

SEQ ID NO: 857672 - protein, 24 aa, Mycobacterium
RSRLLMMTNFLHLWRTSDTTAVLG

SEQ ID NO: 857673 - protein, 19 aa, Mycobacterium
RSRLPSLVDAESLATAARA

SEQ ID NO: 857674 - protein, 22 aa, Mycobacterium
RSRPRIALAAPTGKAAARLAEA

SEQ ID NO: 857675 - protein, 27 aa, Mycobacterium
RSRQAIWDLVASFKKLGVATLLTTQYL

SEQ ID NO: 857676 - protein, 23 aa, Mycobacterium
RSRQLAGTLCPNPLLPEGQRLDA

SEQ ID NO: 857677 - protein, 18 aa, Mycobacterium
RSRRAHAGKSKRALAAEL

SEQ ID NO: 857678 - protein, 20 aa, Mycobacterium
RSRRALAEFTVEGLATVIPF

SEQ ID NO: 857679 - protein, 20 aa, Mycobacterium
RSRRFALLDLLTGPHGVDRY

SEQ ID NO: 857680 - protein, 26 aa, Mycobacterium
RSRRFYEGLLGFEFWWELDAPDAGTD

SEQ ID NO: 857681 - protein, 32 aa, Mycobacterium
RSRRFYENVLGFRFWWELDPPDGPTAKLVQLP

SEQ ID NO: 857682 - protein, 24 aa, Mycobacterium
RSRRFYESVFSWPVLIEVPDNADD

SEQ ID NO: 857683 - protein, 23 aa, Mycobacterium
RSRRPYPHWHLSASDRLRVVSPG

SEQ ID NO: 857684 - protein, 19 aa, Mycobacterium
RSRRRGRGLTLIGGLADHV

SEQ ID NO: 857685 - protein, 23 aa, Mycobacterium
RSRRRWHILDVAARDALFAAAQR

SEQ ID NO: 857686 - protein, 17 aa, Mycobacterium
RSRRVILDLRGLKFIGT

SEQ ID NO: 857687 - protein, 26 aa, Mycobacterium
RSRSCGPTRRSCWCWSTRAPPARTTP

SEQ ID NO: 857688 - protein, 23 aa, Mycobacterium
RSRSDLLAALPERLHDRAVALEV

SEQ ID NO: 857689 - protein, 21 aa, Mycobacterium
RSRSRLYLVRDERDATILQLG

SEQ ID NO: 857690 - protein, 17 aa, Mycobacterium
RSRTIACALVVASDADP

SEQ ID NO: 857691 - protein, 19 aa, Mycobacterium
RSRVFFEWFDAAGVADIPA

SEQ ID NO: 857692 - protein, 20 aa, Mycobacterium
RSRVPALPRLADDAALPRCR

SEQ ID NO: 857693 - protein, 30 aa, Mycobacterium
RSSAHRMLERLVQLRWLRRNGRDYELGMRL

SEQ ID NO: 857694 - protein, 30 aa, Mycobacterium
RSSAHRMLERLVQLRWLRRTGRDYELGMRL

SEQ ID NO: 857695 - protein, 18 aa, Mycobacterium
RSSAYFINIARGGLVDQP

SEQ ID NO: 857696 - protein, 24 aa, Mycobacterium
RSSDRSCDLLYDGAAWHEFDSERL

SEQ ID NO: 857697 - protein, 19 aa, Mycobacterium
RSSFAPGVLLAVRDIAKRP

SEQ ID NO: 857698 - protein, 22 aa, Mycobacterium
RSSGAIELTGAWPGLRCDVDTP

SEQ ID NO: 857699 - protein, 25 aa, Mycobacterium
RSSGGWPWLAPGDDPGALLTLLQRA

SEQ ID NO: 857700 - protein, 26 aa, Mycobacterium
RSSGNLLYLLLAHPDQFMAVRAHREL

SEQ ID NO: 857701 - protein, 24 aa, Mycobacterium
RSSGNLLYLLLTHPDQFAAVQNDH

SEQ ID NO: 857702 - protein, 25 aa, Mycobacterium
RSSGNLLYLLLTHPDQFAAVRADRE

SEQ ID NO: 857703 - protein, 22 aa, Mycobacterium
RSSGNLLYLLLTHPEQLAMVQR

SEQ ID NO: 857704 - protein, 22 aa, Mycobacterium
RSSGNLLYLLLTHPEQLAMVRQ

SEQ ID NO: 857705 - protein, 22 aa, Mycobacterium
RSSGNLLYLLLTHPEQLAMVRR

SEQ ID NO: 857706 - protein, 20 aa, Mycobacterium
RSSGRAYRWANPARLSDLEL

SEQ ID NO: 857707 - protein, 22 aa, Mycobacterium
RSSHTWFVLHELLGHKNVKNYD

SEQ ID NO: 857708 - protein, 24 aa, Mycobacterium
RSSHTWFVLTHLLGKPGVRNYDGS

SEQ ID NO: 857709 - protein, 24 aa, Mycobacterium
RSSIRPRLVLDPYGQGLLLRLPPV

SEQ ID NO: 857710 - protein, 23 aa, Mycobacterium
RSSKLFHGGLRYLEQFNFSLVFE

SEQ ID NO: 857711 - protein, 20 aa, Mycobacterium
RSSMELGGNAPFVVFDDADV

SEQ ID NO: 857712 - protein, 26 aa, Mycobacterium
RSSMKTVEWLFWRSTKRVENEQRREL

SEQ ID NO: 857713 - protein, 23 aa, Mycobacterium
RSSNFMLWQSAYAEYIFQDKLWP

SEQ ID NO: 857714 - protein, 28 aa, Mycobacterium
RSSRFTMLIHLPREAGYGLIPRTKNGPA

SEQ ID NO: 857715 - protein, 23 aa, Mycobacterium
RSSRHIHVQLVDDLAGVTLAAAS

SEQ ID NO: 857716 - protein, 20 aa, Mycobacterium
RSSRLLGRVMSLIPAAANMS

SEQ ID NO: 857717 - protein, 28 aa, Mycobacterium
RSSRTMALGLLLPGFTSPVYSAIVHGVE

SEQ ID NO: 857718 - protein, 25 aa, Mycobacterium
RSSRVLRLTEFGKALLPLAGAALRT

SEQ ID NO: 857719 - protein, 18 aa, Mycobacterium
RSSTGLRYRIYRPAVVVG

SEQ ID NO: 857720 - protein, 21 aa, Mycobacterium
RSSVMDLWRVAKLDLERAGAE

SEQ ID NO: 857721 - protein, 28 aa, Mycobacterium
RSTAEEQAWPLIFLNSPRSSYINGEALV

SEQ ID NO: 857722 - protein, 28 aa, Mycobacterium
RSTALIRKFLEIPGFHGVLAFTPAEAVH

SEQ ID NO: 857723 - protein, 25 aa, Mycobacterium
RSTEVPVVVLLWSPRSDASVQLGEA

SEQ ID NO: 857724 - protein, 26 aa, Mycobacterium
RSTLDQLLTIPLATELAWAPEEIREE

SEQ ID NO: 857725 - protein, 18 aa, Mycobacterium
RSTLLRRLGGTRQALDAA

SEQ ID NO: 857726 - protein, 23 aa, Mycobacterium
RSTMDTLLRYIRERQLLIVLDNC

SEQ ID NO: 857727 - protein, 27 aa, Mycobacterium
RSTRDKLIVLLMARGGLRRGEVCGLRR

SEQ ID NO: 857728 - protein, 22 aa, Mycobacterium
RSTRLATVLGRCSYLRDGIAVR

SEQ ID NO: 857729 - protein, 25 aa, Mycobacterium
RSTRRFPLILTTGRILSQYNVGAQT

SEQ ID NO: 857730 - protein, 17 aa, Mycobacterium
RSTTMDPAPPPMDYIRG

SEQ ID NO: 857731 - protein, 27 aa, Mycobacterium
RSTVFCAAGSKPWLLKTAYDRAVVGDD

SEQ ID NO: 857732 - protein, 24 aa, Mycobacterium
RSTVLTQEQLWGTLLASAAATRNT

SEQ ID NO: 857733 - protein, 25 aa, Mycobacterium
RSTVVASRLALPHMIAEGGGSIINT

SEQ ID NO: 857734 - protein, 25 aa, Mycobacterium
RSTVVAVIWLDRSPTWEVLADRVDR

SEQ ID NO: 857735 - protein, 22 aa, Mycobacterium
RSTVYRYFPGRDEVLLGLILSR

SEQ ID NO: 857736 - protein, 23 aa, Mycobacterium
RSTYAALRRDAARWLRRGRGVAV

SEQ ID NO: 857737 - protein, 23 aa, Mycobacterium
RSTYPRIDLLINNAGVMWTPKQT

SEQ ID NO: 857738 - protein, 18 aa, Mycobacterium
RSVAALVAWKLGCSPANA

SEQ ID NO: 857739 - protein, 20 aa, Mycobacterium
RSVAIAEALMRLLKDQKFDA

SEQ ID NO: 857740 - protein, 21 aa, Mycobacterium
RSVALLRERPADEPLWTAIAH

SEQ ID NO: 857741 - protein, 25 aa, Mycobacterium
RSVDDYRRLLTRAGLRFVRSASATA

SEQ ID NO: 857742 - protein, 25 aa, Mycobacterium
RSVDFYRMSVLPEMRDLDGFCSASL

SEQ ID NO: 857743 - protein, 29 aa, Mycobacterium
RSVDKGEKAIWIYAPMVKKVEVEDANGSR

SEQ ID NO: 857744 - protein, 26 aa, Mycobacterium
RSVDLALAALPVAAAYVLVHDAARAL

SEQ ID NO: 857745 - protein, 24 aa, Mycobacterium
RSVFEHRAVVVGGDRAQLLQGLAG

SEQ ID NO: 857746 - protein, 20 aa, Mycobacterium
RSVFLVGPVSGRRSPASSAV

SEQ ID NO: 857747 - protein, 25 aa, Mycobacterium
RSVFSPYLVPPIRHAKYMNDRNREP

SEQ ID NO: 857748 - protein, 25 aa, Mycobacterium
RSVGALSEWLFWRSTKEVEDAQRRE

SEQ ID NO: 857749 - protein, 20 aa, Mycobacterium
RSVGAQWLNIGIDAAGEGGY

SEQ ID NO: 857750 - protein, 17 aa, Mycobacterium
RSVGFEQIGLRRRYYRA

SEQ ID NO: 857751 - protein, 17 aa, Mycobacterium
RSVGFEQIGLRRRYYRV

SEQ ID NO: 857752 - protein, 24 aa, Mycobacterium
RSVHSYAYAVLRRAAERTGDAPPR

SEQ ID NO: 857753 - protein, 27 aa, Mycobacterium
RSVIAGLTSGRWLGPASLSMASALGPY

SEQ ID NO: 857754 - protein, 20 aa, Mycobacterium
RSVIFVARTLGRFDVLATVR

SEQ ID NO: 857755 - protein, 23 aa, Mycobacterium
RSVKLDGAYWRRHARQPVEFAKS

SEQ ID NO: 857756 - protein, 23 aa, Mycobacterium
RSVKLDGAYWRRHARQPVQFAKS

SEQ ID NO: 857757 - protein, 32 aa, Mycobacterium
RSVLLGRFRCRSRLFFRRLPGDAGSMPVGRFY

SEQ ID NO: 857758 - protein, 18 aa, Mycobacterium
RSVLRLEYSAHPTAQRTL

SEQ ID NO: 857759 - protein, 17 aa, Mycobacterium
RSVLRQLAVGRRTVVVT

SEQ ID NO: 857760 - protein, 18 aa, Mycobacterium
RSVLRRTSGLTTPAPAEL

SEQ ID NO: 857761 - protein, 17 aa, Mycobacterium
RSVMELGGYNPLIILED

SEQ ID NO: 857762 - protein, 26 aa, Mycobacterium
RSVPHRVVCLLGLDDGIFPRHSAPDG

SEQ ID NO: 857763 - protein, 21 aa, Mycobacterium
RSVPLGVFYSMIEIIAPVLEE

SEQ ID NO: 857764 - protein, 23 aa, Mycobacterium
RSVPTALRPAMHLGLRVLAQGTP

SEQ ID NO: 857765 - protein, 27 aa, Mycobacterium
RSVRLKFLEEPLWPPENFDGLAALRRT

SEQ ID NO: 857766 - protein, 29 aa, Mycobacterium
RSVRYRIPMILAIIGGNPMRFEPYVDLYR

SEQ ID NO: 857767 - protein, 27 aa, Mycobacterium
RSVSGGPTLAFGWTKRALAAATLAELE

SEQ ID NO: 857768 - protein, 38 aa, Mycobacterium; identical to SEQ ID NO: 131687

SEQ ID NO: 857769 - protein, 34 aa, Mycobacterium
RSVTDLWYDGLGFWLHRYYRLRYGWWEHPSPVSC

SEQ ID NO: 857770 - protein, 17 aa, Mycobacterium
RSVTFYRDVIGLQVRIE

SEQ ID NO: 857771 - protein, 20 aa, Mycobacterium
RSVTLALTPNDTFLATHTVR

SEQ ID NO: 857772 - protein, 22 aa, Mycobacterium
RSVTLDAAYWRRHARQPVEFAK

SEQ ID NO: 857773 - protein, 23 aa, Mycobacterium
RSVVDLNLIATFNISRLAAAHMA

SEQ ID NO: 857774 - protein, 22 aa, Mycobacterium
RSVVPVRVFWVPGGLPTRSKVV

SEQ ID NO: 857775 - protein, 29 aa, Mycobacterium
RSVVQWLHATTLFLLAPSWRYRSAADKRE

SEQ ID NO: 857776 - protein, 23 aa, Mycobacterium
RSWDHRKLGLPHMPVGGSTAPAV

SEQ ID NO: 857777 - protein, 19 aa, Mycobacterium
RSWDIDRIALLEEAGWVVV

SEQ ID NO: 857778 - protein, 19 aa, Mycobacterium
RSWPTYFATLDQLVRPGGR

SEQ ID NO: 857779 - protein, 25 aa, Mycobacterium
RSWRDHGFHLDIWSLNYSGARSDVS

SEQ ID NO: 857780 - protein, 17 aa, Mycobacterium
RSWRRARELQKRLHDGG

SEQ ID NO: 857781 - protein, 23 aa, Mycobacterium
RSWRVIATIQRDGDRFKLSRADL

SEQ ID NO: 857782 - protein, 17 aa, Mycobacterium
RSWRWDSLVANGPAWHD

SEQ ID NO: 857783 - protein, 21 aa, Mycobacterium
RSWTTDVRGGLLFVWHDHEGN

SEQ ID NO: 857784 - protein, 24 aa, Mycobacterium
RSWTTDVRGGLLFVWHDHENNPPD

SEQ ID NO: 857785 - protein, 26 aa, Mycobacterium
RSWTTDVRGGLLFVWHDHEQNPPDPA

SEQ ID NO: 857786 - protein, 21 aa, Mycobacterium
RSWWGNFLVQKANEAGIGLDE

SEQ ID NO: 857787 - protein, 20 aa, Mycobacterium
RSWWSGPDVVLLVDDWHMVT

SEQ ID NO: 857788 - protein, 18 aa, Mycobacterium
RSYARAFGMSEERVRLIS

SEQ ID NO: 857789 - protein, 22 aa, Mycobacterium
RSYATLLTKLTGEAPTLVLSDD

SEQ ID NO: 857790 - protein, 19 aa, Mycobacterium
RSYELWERLAIDAQSDIYR

SEQ ID NO: 857791 - protein, 18 aa, Mycobacterium
RSYFTKLMTPERAEALAA

SEQ ID NO: 857792 - protein, 19 aa, Mycobacterium
RSYGYVHRALVESGVVLRG

SEQ ID NO: 857793 - protein, 18 aa, Mycobacterium
RSYLLDLVDLRMINPVLG

SEQ ID NO: 857794 - protein, 20 aa, Mycobacterium
RSYLVPTINAFTAQLSAGVR

SEQ ID NO: 857795 - protein, 17 aa, Mycobacterium
RSYQNYFRELPVLKYGK

SEQ ID NO: 857796 - protein, 23 aa, Mycobacterium
RSYRDIDILLVDDIQFIEGKEGI

SEQ ID NO: 857797 - protein, 20 aa, Mycobacterium
RSYREIFAGLYTDPDEVLTT

SEQ ID NO: 857798 - protein, 22 aa, Mycobacterium
RSYRYIDYWGTAVTAFDLHAPH

SEQ ID NO: 857799 - protein, 23 aa, Mycobacterium
RSYSDFPTILDSIKNRLGLLPAE

SEQ ID NO: 857800 - protein, 18 aa, Mycobacterium
RSYSFSNPPDEALLTFLV

SEQ ID NO: 857801 - protein, 23 aa, Mycobacterium
RTAAAFGVAYRTAYHTLRSVARV

SEQ ID NO: 857802 - protein, 25 aa, Mycobacterium
RTAAGIGFPGWDPTTSYLIAEVEMT

SEQ ID NO: 857803 - protein, 25 aa, Mycobacterium
RTAAKLGPFLVPASLGPPDGSIPAG

SEQ ID NO: 857804 - protein, 25 aa, Mycobacterium
RTAAKLGPFLVPATLGAPDGTVPDS

SEQ ID NO: 857805 - protein, 18 aa, Mycobacterium
RTAARMMAAGKLKWEFMI

SEQ ID NO: 857806 - protein, 18 aa, Mycobacterium
RTAAWPGSPPRLLRESRE

SEQ ID NO: 857807 - protein, 27 aa, Mycobacterium
RTADNRWLVLAMLQPGRYWPEFCRHID

SEQ ID NO: 857808 - protein, 34 aa, Mycobacterium
RTAEDIVAWFTARDYRMSVWSAESWRPVDKVTET

SEQ ID NO: 857809 - protein, 24 aa, Mycobacterium
RTAELGIRVLRYGSGASLPGEPLA

SEQ ID NO: 857810 - protein, 28 aa, Mycobacterium
RTAEQMAQFYEQLIGAYPLVSIEDPLSE

SEQ ID NO: 857811 - protein, 26 aa, Mycobacterium
RTAEQMGAFYAELLDAYPLVSIEDPL

SEQ ID NO: 857812 - protein, 24 aa, Mycobacterium
RTAEQVFIPLTVGGGVRSIADVDV

SEQ ID NO: 857813 - protein, 23 aa, Mycobacterium
RTAEQYRRLLDRAGLRMTRILPT

SEQ ID NO: 857814 - protein, 28 aa, Mycobacterium
RTAERGLFDFFFLAEGLRLREHRERIYD

SEQ ID NO: 857815 - protein, 29 aa, Mycobacterium
RTAERGLFDFFFLAEGLRLREHRGRIYDL

SEQ ID NO: 857816 - protein, 24 aa, Mycobacterium
RTAFGKPLLAFQNTKFVLAECKAE

SEQ ID NO: 857817 - protein, 18 aa, Mycobacterium
RTAFKPSYGIAEGTLLVA

SEQ ID NO: 857818 - protein, 17 aa, Mycobacterium
RTAFVARPLEFGAGGNA

SEQ ID NO: 857819 - protein, 23 aa, Mycobacterium
RTAGALRDAGVRRGECVAFLDKN

SEQ ID NO: 857820 - protein, 24 aa, Mycobacterium
RTAGPVLLDPWVRAAALDGAYLGQ

SEQ ID NO: 857821 - protein, 22 aa, Mycobacterium
RTAGYLAIGLAVAERAPVCIAM

SEQ ID NO: 857822 - protein, 22 aa, Mycobacterium
RTAHFFFLVDQQVDGAAPQGSK

SEQ ID NO: 857823 - protein, 21 aa, Mycobacterium
RTAHRIMTGAPLPAGATAVVP

SEQ ID NO: 857824 - protein, 19 aa, Mycobacterium
RTAIHLAAVAPQRVLAAIL

SEQ ID NO: 857825 - protein, 29 aa, Mycobacterium
RTALAGRLPVYMVPAAVLGLDALPLTPNG

SEQ ID NO: 857826 - protein, 18 aa, Mycobacterium
RTALDLACWHPMTTAVAA

SEQ ID NO: 857827 - protein, 18 aa, Mycobacterium
RTALHYYVGDRDGLLELV

SEQ ID NO: 857828 - protein, 18 aa, Mycobacterium
RTALLPDTRHRFLVDVAD

SEQ ID NO: 857829 - protein, 19 aa, Mycobacterium
RTALLTAGWPETVPGVTVD

SEQ ID NO: 857830 - protein, 20 aa, Mycobacterium
RTALNWLRNSAGAALLIQMA

SEQ ID NO: 857831 - protein, 17 aa, Mycobacterium
RTALRVLADLGADIREV

SEQ ID NO: 857832 - protein, 24 aa, Mycobacterium
RTANAYSRILLGVDIHDITAGYRA

SEQ ID NO: 857833 - protein, 25 aa, Mycobacterium
RTANRNALTALLRTIDLGIDARKPL

SEQ ID NO: 857834 - protein, 24 aa, Mycobacterium
RTAPHLIHPLAQVVPLHPAVSMFS

SEQ ID NO: 857835 - protein, 27 aa, Mycobacterium
RTAPPFAVHRFWLDRPVSARRPAFLGT

SEQ ID NO: 857836 - protein, 26 aa, Mycobacterium
RTAPPFAVHRLWLDRPVSAERPAFLG

SEQ ID NO: 857837 - protein, 25 aa, Mycobacterium
RTAPTLPALRRYTGVLYDALDVDSL

SEQ ID NO: 857838 - protein, 17 aa, Mycobacterium
RTARALGPLPLAMDSDH

SEQ ID NO: 857839 - protein, 20 aa, Mycobacterium
RTARFYGTYDAVLTPTLADE

SEQ ID NO: 857840 - protein, 22 aa, Mycobacterium
RTARLNVDLAERTRLAVGEDKP

SEQ ID NO: 857841 - protein, 24 aa, Mycobacterium
RTARLQYWPALKDLSMYSLRIRED

SEQ ID NO: 857842 - protein, 20 aa, Mycobacterium
RTARQRLAAFITPIPIRVRD

SEQ ID NO: 857843 - protein, 29 aa, Mycobacterium
RTASLALRNGGPKPLRRAIAWYRDHDRLR

SEQ ID NO: 857844 - protein, 22 aa, Mycobacterium
RTATALWNLVSSAVIIPAGRLR

SEQ ID NO: 857845 - protein, 25 aa, Mycobacterium
RTATINALTALLRIAALGIDARKPL

SEQ ID NO: 857846 - protein, 19 aa, Mycobacterium
RTATLRMVLAAIQTEEVSG

SEQ ID NO: 857847 - protein, 40 aa, Mycobacterium
RTAVAVALTSRFPIVLWLDPTELFLMYNDAYAHILGDKHP

SEQ ID NO: 857848 - protein, 24 aa, Mycobacterium
RTAVAWAREQFGDELLWGIEDCRN

SEQ ID NO: 857849 - protein, 26 aa, Mycobacterium
RTAVDTLYRQGQLLSWGLPATHALVE

SEQ ID NO: 857850 - protein, 23 aa, Mycobacterium
RTAVNLLLDRLPGLRLDPDGDDP

SEQ ID NO: 857851 - protein, 20 aa, Mycobacterium
RTAVTTPASYAASLAGLAVI

SEQ ID NO: 857852 - protein, 25 aa, Mycobacterium
RTAVVAADWPLLAAAYRTRGSLRIV

SEQ ID NO: 857853 - protein, 17 aa, Mycobacterium
RTAVVAASLPELVEGLQ

SEQ ID NO: 857854 - protein, 19 aa, Mycobacterium
RTCIDAGWVLSLSGTVSFK

SEQ ID NO: 857855 - protein, 21 aa, Mycobacterium
RTDATFLRLAAMTPDAVADMV

SEQ ID NO: 857856 - protein, 22 aa, Mycobacterium
RTDDIAHRRLAITGVNEFPNLD

SEQ ID NO: 857857 - protein, 23 aa, Mycobacterium
RTDEAKLILGHKAMIVAGGANRT

SEQ ID NO: 857858 - protein, 27 aa, Mycobacterium
RTDEEYRWLAHALTVDALRELLPETEH

SEQ ID NO: 857859 - protein, 19 aa, Mycobacterium
RTDFGGTLFFGVPTVWSRV

SEQ ID NO: 857860 - protein, 19 aa, Mycobacterium
RTDFLTLTRGTGIANAVFE

SEQ ID NO: 857861 - protein, 18 aa, Mycobacterium
RTDIRWHPSALDREYRWD

SEQ ID NO: 857862 - protein, 17 aa, Mycobacterium
RTDLAIARDQIKTLRAE

SEQ ID NO: 857863 - protein, 17 aa, Mycobacterium
RTDLHILEGQWAEKSQV

SEQ ID NO: 857864 - protein, 21 aa, Mycobacterium
RTDLRYLLVLHIHRHGLTTVS

SEQ ID NO: 857865 - protein, 22 aa, Mycobacterium
RTDLVEHYIARAAGIRRCAGSV

SEQ ID NO: 857866 - protein, 24 aa, Mycobacterium
RTDRALIMAIVNRTPDSFYDRGAT

SEQ ID NO: 857867 - protein, 28 aa, Mycobacterium
RTDRDAWEFALLRAALDRGLPVLGICRG

SEQ ID NO: 857868 - protein, 25 aa, Mycobacterium
RTDRGDEIICRYLIMATGCLSVPKD

SEQ ID NO: 857869 - protein, 25 aa, Mycobacterium
RTDRLPFVAPMNWEAFEPSLRGAID

SEQ ID NO: 857870 - protein, 25 aa, Mycobacterium
RTDRLPLGAPTAWPTLRSALGRAVT

SEQ ID NO: 857871 - protein, 20 aa, Mycobacterium
RTDRLPLHPPAHWDTVAPLV

SEQ ID NO: 857872 - protein, 26 aa, Mycobacterium
RTDRLPVAILAILKTGAAYVPIDPSW

SEQ ID NO: 857873 - protein, 24 aa, Mycobacterium
RTDRRGRMLWSLPKGHIEQGETAE

SEQ ID NO: 857874 - protein, 27 aa, Mycobacterium
RTDRRHYSFWPVPVSDIALMAARAARN

SEQ ID NO: 857875 - protein, 27 aa, Mycobacterium
RTDRRHYSFWPVPVSDVALMAARAARC

SEQ ID NO: 857876 - protein, 18 aa, Mycobacterium
RTDRRPFRAPSEWASLES

SEQ ID NO: 857877 - protein, 27 aa, Mycobacterium
RTDSPFPGLTTHSYLWKPNGHSSSPGV

SEQ ID NO: 857878 - protein, 28 aa, Mycobacterium
RTDVDAWILARCSVPLRLATIAEFISRA

SEQ ID NO: 857879 - protein, 24 aa, Mycobacterium
RTDVDDWWEYGWVFHAMNTNKRSI

SEQ ID NO: 857880 - protein, 24 aa, Mycobacterium
RTDVGALVAFLLGSDATFITGQTI

SEQ ID NO: 857881 - protein, 27 aa, Mycobacterium
RTDVTAGDVLLFMGGIAYAAQHGTRDQ

SEQ ID NO: 857882 - protein, 17 aa, Mycobacterium
RTDVVGIFPDRDALIRL

SEQ ID NO: 857883 - protein, 23 aa, Mycobacterium
RTDVVGIFPDRNALIRLVGAVLA

SEQ ID NO: 857884 - protein, 17 aa, Mycobacterium
RTDYRVFFICEGVTQYL

SEQ ID NO: 857885 - protein, 24 aa, Mycobacterium
RTDYTDRLRTFPRPALIVHGGRDT

SEQ ID NO: 857886 - protein, 18 aa, Mycobacterium
RTEALRQLGLTPGHEHDT

SEQ ID NO: 857887 - protein, 21 aa, Mycobacterium
RTEEMPFFVRYVDGDLLSFVH

SEQ ID NO: 857888 - protein, 17 aa, Mycobacterium
RTEFALLEMLIANPRRV

SEQ ID NO: 857889 - protein, 18 aa, Mycobacterium
RTEFALLEMLIANPRRVL

SEQ ID NO: 857890 - protein, 21 aa, Mycobacterium
RTEFALLEMLMANPRRVLTRS

SEQ ID NO: 857891 - protein, 22 aa, Mycobacterium
RTEGIFLLGSECDDLIVASLSE

SEQ ID NO: 857892 - protein, 19 aa, Mycobacterium
RTEGLLAQQPRRGFIVLPV

SEQ ID NO: 857893 - protein, 23 aa, Mycobacterium
RTEGPWRLIIAQHFASADELIAT

SEQ ID NO: 857894 - protein, 18 aa, Mycobacterium
RTEIPVEWTEGRDLWWHE

SEQ ID NO: 857895 - protein, 19 aa, Mycobacterium
RTELAPRGIHVAALHVGYM

SEQ ID NO: 857896 - protein, 22 aa, Mycobacterium
RTELRPPPWTGPGVRYRDAMAV

SEQ ID NO: 857897 - protein, 25 aa, Mycobacterium
RTELVEHLLALGYSKELLPERLVVV

SEQ ID NO: 857898 - protein, 23 aa, Mycobacterium
RTELVPLIDALHQRMRAEKVMDF

SEQ ID NO: 857899 - protein, 29 aa, Mycobacterium
RTEPELPKLLKRLVIMGGSFDYPGNTTPV

SEQ ID NO: 857900 - protein, 20 aa, Mycobacterium
RTEPLRLSRLTDHPSAVGFP

SEQ ID NO: 857901 - protein, 30 aa, Mycobacterium
RTERIRLGTNILLAALRPAAVLAKTLATMD

SEQ ID NO: 857902 - protein, 25 aa, Mycobacterium
RTETLKFLVALRPGLTSPTLAAQMA

SEQ ID NO: 857903 - protein, 20 aa, Mycobacterium
RTETSMMRYLRSLADKDIAL

SEQ ID NO: 857904 - protein, 20 aa, Mycobacterium
RTETVLASLPTPLASLEVAT

SEQ ID NO: 857905 - protein, 20 aa, Mycobacterium
RTETVVLPRDAFLGATEILP

SEQ ID NO: 857906 - protein, 17 aa, Mycobacterium
RTFAEPELAYVYYAEQL

SEQ ID NO: 857907 - protein, 18 aa, Mycobacterium
RTFALMGPTYVKLGQLIA

SEQ ID NO: 857908 - protein, 30 aa, Mycobacterium
RTFDTNVRGTYFLVAQLAPGMFARGRGSIV

SEQ ID NO: 857909 - protein, 20 aa, Mycobacterium
RTFELFTRQPYRGSSPAARM

SEQ ID NO: 857910 - protein, 19 aa, Mycobacterium
RTFGAAPNFAFELAAERGL

SEQ ID NO: 857911 - protein, 28 aa, Mycobacterium
RTFGDFRALKWLGYKQPYIAFIPQWDFL

SEQ ID NO: 857912 - protein, 26 aa, Mycobacterium
RTFHQLRRLVVALAATPDAPRLFVVT

SEQ ID NO: 857913 - protein, 17 aa, Mycobacterium
RTFLRDHGHFEVKKGCD

SEQ ID NO: 857914 - protein, 18 aa, Mycobacterium
RTFLRQLEECVGLAADRG

SEQ ID NO: 857915 - protein, 19 aa, Mycobacterium
RTFLRRWPDPQAWAGEPLE

SEQ ID NO: 857916 - protein, 23 aa, Mycobacterium
RTFNDLLATMLWHGALDPRLREL

SEQ ID NO: 857917 - protein, 17 aa, Mycobacterium
RTFNVEIPAIPYEELEK

SEQ ID NO: 857918 - protein, 20 aa, Mycobacterium
RTFQHLWRQVGTNIDRYNTY

SEQ ID NO: 857919 - protein, 17 aa, Mycobacterium
RTFQIPALFTNMTVREN

SEQ ID NO: 857920 - protein, 20 aa, Mycobacterium
RTFREWSPRIAGDKSVLDAL

SEQ ID NO: 857921 - protein, 20 aa, Mycobacterium
RTFTRPVLVVWAREDRMMPL

SEQ ID NO: 857922 - protein, 25 aa, Mycobacterium
RTFTVSALVVGWLTRGDVEHADSAL

SEQ ID NO: 857923 - protein, 17 aa, Mycobacterium
RTFVLDKAADWQLEIYE

SEQ ID NO: 857924 - protein, 17 aa, Mycobacterium
RTFWSSNFPIDKPNVAL

SEQ ID NO: 857925 - protein, 17 aa, Mycobacterium
RTFYDFVASSKAFSKLS

SEQ ID NO: 857926 - protein, 21 aa, Mycobacterium
RTFYRHFHSKHDLLFADYTGL

SEQ ID NO: 857927 - protein, 21 aa, Mycobacterium
RTFYRHFKSKHDLLFADYTGL

SEQ ID NO: 857928 - protein, 27 aa, Mycobacterium
RTFYRHFRSKHDLLFADYTGLHWFRAA

SEQ ID NO: 857929 - protein, 23 aa, Mycobacterium
RTGADLIVFRLVDTPDIGGDVIA

SEQ ID NO: 857930 - protein, 23 aa, Mycobacterium
RTGAKLGPFLVPATLGAPEGSVG

SEQ ID NO: 857931 - protein, 22 aa, Mycobacterium
RTGAPVLFGMGTFLGHDRVADL

SEQ ID NO: 857932 - protein, 25 aa, Mycobacterium
RTGDLDAYLLADKLFHQTMLEASGN

SEQ ID NO: 857933 - protein, 20 aa, Mycobacterium
RTGDLVCWAPDGQLQYLGRA

SEQ ID NO: 857934 - protein, 18 aa, Mycobacterium
RTGDLVCWGPDGQLQYLG

SEQ ID NO: 857935 - protein, 18 aa, Mycobacterium
RTGDLVCWGTDGQLRYLG

SEQ ID NO: 857936 - protein, 17 aa, Mycobacterium
RTGDLVCWTTDGQLQYL

SEQ ID NO: 857937 - protein, 22 aa, Mycobacterium
RTGEFLQIVRDIWRGSPVDFSG

SEQ ID NO: 857938 - protein, 17 aa, Mycobacterium
RTGELLEWAYELVASSQ

SEQ ID NO: 857939 - protein, 23 aa, Mycobacterium
RTGELLFFNYGKQAPYMHFGVVD

SEQ ID NO: 857940 - protein, 26 aa, Mycobacterium
RTGEWFAINHFNVVPDLLTFAKGVNS

SEQ ID NO: 857941 - protein, 25 aa, Mycobacterium
RTGFDAMYDADAPQFLLSLIDSSAA

SEQ ID NO: 857942 - protein, 20 aa, Mycobacterium
RTGFTGGLNWYRNFDRNWET

SEQ ID NO: 857943 - protein, 28 aa, Mycobacterium
RTGGELHLDWWYDIRRLGPTDVESFSRQ

SEQ ID NO: 857944 - protein, 17 aa, Mycobacterium
RTGGFEALVPEPRRLGT

SEQ ID NO: 857945 - protein, 17 aa, Mycobacterium
RTGIFLSYAGGFLEAVD

SEQ ID NO: 857946 - protein, 22 aa, Mycobacterium
RTGILRVFGRQFLPSSSGPREP

SEQ ID NO: 857947 - protein, 19 aa, Mycobacterium
RTGLLLDVDGFECALPAAV

SEQ ID NO: 857948 - protein, 29 aa, Mycobacterium
RTGLPVPTIHRLIRTLLNNGYVRQLPSRR

SEQ ID NO: 857949 - protein, 23 aa, Mycobacterium
RTGQLFPSPVPPGTGWPGDPATP

SEQ ID NO: 857950 - protein, 17 aa, Mycobacterium
RTGQWPSPLATAARLRW

SEQ ID NO: 857951 - protein, 26 aa, Mycobacterium
RTGRAVTGLVLKWLAAEKTSDPGSRY

SEQ ID NO: 857952 - protein, 25 aa, Mycobacterium
RTGRGYLDMFTFFASSALGMNHPAL

SEQ ID NO: 857953 - protein, 25 aa, Mycobacterium
RTGRGYRFYRLVVVADRGATVDLGD

SEQ ID NO: 857954 - protein, 17 aa, Mycobacterium
RTGRHRGLPPASHAAHR

SEQ ID NO: 857955 - protein, 18 aa, Mycobacterium
RTGRPRTYVYRRAGEPCR

SEQ ID NO: 857956 - protein, 18 aa, Mycobacterium
RTGRQLWVYGRAGQRCRR

SEQ ID NO: 857957 - protein, 24 aa, Mycobacterium
RTGRVTPFAYMTPVKVAGSTVSLA

SEQ ID NO: 857958 - protein, 23 aa, Mycobacterium
RTGSGAVVLVAPVAFEADDADDA

SEQ ID NO: 857959 - protein, 29 aa, Mycobacterium
RTGSGKTYAFLLPLVARLATSGTPRDAGK

SEQ ID NO: 857960 - protein, 39 aa, Mycobacterium
RTGTETPVWTFLGARPAGWWIRRRLHEVAVHRVDAAIAI

SEQ ID NO: 857961 - protein, 24 aa, Mycobacterium
RTGVRRIVYLSGLHPEGGKLSPHL

SEQ ID NO: 857962 - protein, 43 aa, Mycobacterium
RTGWFDIAAGDWWDDALAWSGATRSLMPPVVPAGAPVGMITSD

SEQ ID NO: 857963 - protein, 27 aa, Mycobacterium
RTGYSWGPLSLMLLATAIAQQGNIAET

SEQ ID NO: 857964 - protein, 27 aa, Mycobacterium
RTGYSWGPLSLMLLATAIAQQGRIAES

SEQ ID NO: 857965 - protein, 30 aa, Mycobacterium
RTHCTTSDWFDRTTLFASGLVSTGILTLTA

SEQ ID NO: 857966 - protein, 20 aa, Mycobacterium
RTHDMLLNSGIFVMHMLSAG

SEQ ID NO: 857967 - protein, 18 aa, Mycobacterium
RTHEALAAVRSWLSERDS

SEQ ID NO: 857968 - protein, 18 aa, Mycobacterium
RTHGFRLRMRTRAGRAII

SEQ ID NO: 857969 - protein, 18 aa, Mycobacterium
RTHGRTWDLLRLTRMPTV

SEQ ID NO: 857970 - protein, 23 aa, Mycobacterium
RTHHGVTYWPLTRQGPAGGLHAF

SEQ ID NO: 857971 - protein, 20 aa, Mycobacterium
RTHHLIKSFCGWAEKQLADG

SEQ ID NO: 857972 - protein, 25 aa, Mycobacterium
RTHHLIKTFYGGPSGWRDAQSPDGT

SEQ ID NO: 857973 - protein, 24 aa, Mycobacterium
RTHHPLIQVILAFQNHPWTQHDTT

SEQ ID NO: 857974 - protein, 28 aa, Mycobacterium
RTHITTRQWQLPPGALLIVEDAATADPA

SEQ ID NO: 857975 - protein, 20 aa, Mycobacterium
RTHLLYGEWLRRGRRRTEAR

SEQ ID NO: 857976 - protein, 21 aa, Mycobacterium
RTHLMDAVPITLGQEFSGYAR

SEQ ID NO: 857977 - protein, 25 aa, Mycobacterium
RTHLRYGEWLRRVNRRPDARRHLGV

SEQ ID NO: 857978 - protein, 19 aa, Mycobacterium
RTHLTLKELSFVVDVGPIV

SEQ ID NO: 857979 - protein, 21 aa, Mycobacterium
RTHPNLVRKLFSLEVPEIADG

SEQ ID NO: 857980 - protein, 20 aa, Mycobacterium
RTHQVIVVTHLPQVAAYADV

SEQ ID NO: 857981 - protein, 18 aa, Mycobacterium
RTHREWFRATVAALLREA

SEQ ID NO: 857982 - protein, 23 aa, Mycobacterium
RTHRGGGSFWTWREDMYAVAECL

SEQ ID NO: 857983 - protein, 17 aa, Mycobacterium
RTIADLVALPLTTLAEV

SEQ ID NO: 857984 - protein, 25 aa, Mycobacterium
RTIASTFLGLVPFPATPALPDDTQW

SEQ ID NO: 857985 - protein, 34 aa, Mycobacterium
RTIDESVYRLLAEKLRMFELLFGQVTTILGELDD

SEQ ID NO: 857986 - protein, 24 aa, Mycobacterium
RTIDSPVGTLLLAATPAGLVRVAF

SEQ ID NO: 857987 - protein, 19 aa, Mycobacterium
RTIGELITKPLPPGLTQRL

SEQ ID NO: 857988 - protein, 20 aa, Mycobacterium
RTIGTDWLRAYLALPNYANN

SEQ ID NO: 857989 - protein, 17 aa, Mycobacterium
RTILLAAPLGRMISPLS

SEQ ID NO: 857990 - protein, 26 aa, Mycobacterium
RTINLNRRGPLFWPTTCRITEFVPEQ

SEQ ID NO: 857991 - protein, 19 aa, Mycobacterium
RTIRLPVHLVEQVNKLARI

SEQ ID NO: 857992 - protein, 32 aa, Mycobacterium
RTISLEANAFHQQFWRSLSGAAASYSGAEAAN

SEQ ID NO: 857993 - protein, 20 aa, Mycobacterium
RTITFPGFLSAYVETVDELS

SEQ ID NO: 857994 - protein, 21 aa, Mycobacterium
RTITTPFGLYDCDVPCDGAVA

SEQ ID NO: 857995 - protein, 18 aa, Mycobacterium
RTIVALGGFAWQIALRLP

SEQ ID NO: 857996 - protein, 17 aa, Mycobacterium
RTIWGFPKIMADFNVRE

SEQ ID NO: 857997 - protein, 20 aa, Mycobacterium
RTIWGFPKIMADFNVREGKK

SEQ ID NO: 857998 - protein, 18 aa, Mycobacterium
RTIWLLSDPDRNVRRDQR

SEQ ID NO: 857999 - protein, 20 aa, Mycobacterium
RTIWTQCQSYFRSPSGRIVT

SEQ ID NO: 858000 - protein, 20 aa, Mycobacterium
RTIYQFAVREVYKGDVGPTT

SEQ ID NO: 858001 - protein, 23 aa, Mycobacterium
RTKDRFPWADLVADPVPLDRIAG

SEQ ID NO: 858002 - protein, 27 aa, Mycobacterium
RTKEQADYNLKYLSAVALLDGGVGPEQ

SEQ ID NO: 858003 - protein, 25 aa, Mycobacterium
RTKGRWIMAGPLKGLRVVELAGIGP

SEQ ID NO: 858004 - protein, 17 aa, Mycobacterium
RTKHHFFRDNARLREEL

SEQ ID NO: 858005 - protein, 20 aa, Mycobacterium
RTKLPIPQRSFGGTIGRTMA

SEQ ID NO: 858006 - protein, 21 aa, Mycobacterium
RTKLPIPQRSFGGTIGRTMAE

SEQ ID NO: 858007 - protein, 19 aa, Mycobacterium
RTKLVRLFPTVMKGTHVDL

SEQ ID NO: 858008 - protein, 20 aa, Mycobacterium
RTKLVRLFPTVMKGTHVDLD

SEQ ID NO: 858009 - protein, 19 aa, Mycobacterium
RTKLYRHFTDAADLQRAVA

SEQ ID NO: 858010 - protein, 19 aa, Mycobacterium
RTKMVLGGYSQGAAVAGFV

SEQ ID NO: 858011 - protein, 24 aa, Mycobacterium
RTKQVIGIIIGHNDLIEEGKAQQD

SEQ ID NO: 858012 - protein, 25 aa, Mycobacterium
RTKRMQVAFTPILARRWADRRIRVY

SEQ ID NO: 858013 - protein, 23 aa, Mycobacterium
RTLAALEMTFFGALVNAGSGAFT

SEQ ID NO: 858014 - protein, 19 aa, Mycobacterium
RTLAEAAAILERLTRRMAA

SEQ ID NO: 858015 - protein, 19 aa, Mycobacterium
RTLALADLPRSAPLPRRLV

SEQ ID NO: 858016 - protein, 17 aa, Mycobacterium
RTLALVNPAALVIAVVR

SEQ ID NO: 858017 - protein, 17 aa, Mycobacterium
RTLAPPTGRGWEVLAGD

SEQ ID NO: 858018 - protein, 24 aa, Mycobacterium
RTLARRPAWLAACAEVGAGAAPGS

SEQ ID NO: 858019 - protein, 17 aa, Mycobacterium
RTLATRLAARRRRARAG

SEQ ID NO: 858020 - protein, 18 aa, Mycobacterium
RTLATRLAARRRRARAGS

SEQ ID NO: 858021 - protein, 18 aa, Mycobacterium
RTLATRLAARRRRSRAGE

SEQ ID NO: 858022 - protein, 20 aa, Mycobacterium
RTLATRLAARRRRSRAGVID

SEQ ID NO: 858023 - protein, 18 aa, Mycobacterium
RTLAVTALSLRPGGSVPS

SEQ ID NO: 858024 - protein, 17 aa, Mycobacterium
RTLCRELELATTGTVSG

SEQ ID NO: 858025 - protein, 24 aa, Mycobacterium
RTLDDLHIVLWTPTAIDDDRTKAR

SEQ ID NO: 858026 - protein, 23 aa, Mycobacterium
RTLDPIFAAAFNAAGDDGARMRV

SEQ ID NO: 858027 - protein, 23 aa, Mycobacterium
RTLEERLRYLRELDERRAAVLAS

SEQ ID NO: 858028 - protein, 17 aa, Mycobacterium
RTLEIWAAALEAKKEEA

SEQ ID NO: 858029 - protein, 20 aa, Mycobacterium
RTLELNPTHPLVIGLRQAQA

SEQ ID NO: 858030 - protein, 22 aa, Mycobacterium
RTLEPMMRITLNVILRAVFGAD

SEQ ID NO: 858031 - protein, 17 aa, Mycobacterium
RTLFHQFSAPMYGDDVA

SEQ ID NO: 858032 - protein, 22 aa, Mycobacterium
RTLFRFVQQLYFRRRKTVILKN

SEQ ID NO: 858033 - protein, 23 aa, Mycobacterium
RTLGPFTWLKKPAVDGPPAQRDP

SEQ ID NO: 858034 - protein, 25 aa, Mycobacterium
RTLGRFDVLATVRAFSAAQLLEILD

SEQ ID NO: 858035 - protein, 17 aa, Mycobacterium
RTLIHMDDPLHRDIRKV

SEQ ID NO: 858036 - protein, 20 aa, Mycobacterium
RTLLDRVPPASSQLIRQTVR

SEQ ID NO: 858037 - protein, 31 aa, Mycobacterium
RTLLDTHPFAWLPMLSRVLATARLLPDALDG

SEQ ID NO: 858038 - protein, 29 aa, Mycobacterium
RTLLFLRADHLAHFVSCLVYLPRDRYTTA

SEQ ID NO: 858039 - protein, 38 aa, Mycobacterium
RTLLGEAAFASWKALGARFFALRPVTQLHWTGHDDPDV

SEQ ID NO: 858040 - protein, 18 aa, Mycobacterium
RTLLGEFFTLPGVAEHMA

SEQ ID NO: 858041 - protein, 17 aa, Mycobacterium
RTLLGKRLNDLVRATYA

SEQ ID NO: 858042 - protein, 21 aa, Mycobacterium
RTLLIFCDSLSYYGPTGGLPS

SEQ ID NO: 858043 - protein, 19 aa, Mycobacterium
RTLLLEHKVLFLRDQNITR

SEQ ID NO: 858044 - protein, 20 aa, Mycobacterium
RTLLQELLLAYGPCGQEDAV

SEQ ID NO: 858045 - protein, 29 aa, Mycobacterium
RTLLRAVPLAWPFIPTSWRWHPASHDGWR

SEQ ID NO: 858046 - protein, 18 aa, Mycobacterium
RTLLSRLIDHLRPALESL

SEQ ID NO: 858047 - protein, 29 aa, Mycobacterium
RTLMDTHPFAWLPMLSRVLGSAELVADAV

SEQ ID NO: 858048 - protein, 32 aa, Mycobacterium
RTLMDTHPFEWLPMLSRVLGSAQLVPGAVAGR

SEQ ID NO: 858049 - protein, 18 aa, Mycobacterium
RTLMESTLARHTGKDPSV

SEQ ID NO: 858050 - protein, 18 aa, Mycobacterium
RTLMETTLARHTGKDAAV

SEQ ID NO: 858051 - protein, 29 aa, Mycobacterium
RTLMGHARLTVEFTWYGPDGDSITSVAAA

SEQ ID NO: 858052 - protein, 19 aa, Mycobacterium
RTLMTVLKSVYPTNGTTAP

SEQ ID NO: 858053 - protein, 17 aa, Mycobacterium
RTLRPHAETLIDGFGIP

SEQ ID NO: 858054 - protein, 18 aa, Mycobacterium
RTLRSMWQDSGGARYRYF

SEQ ID NO: 858055 - protein, 30 aa, Mycobacterium
RTLSRRWAGPAFLLNHMLVWGFTGQVISAV

SEQ ID NO: 858056 - protein, 29 aa, Mycobacterium
RTLSYEAFIYFYPLVMMDVTRLQALNAAP

SEQ ID NO: 858057 - protein, 20 aa, Mycobacterium
RTLTADRIILSAGAIESAKL

SEQ ID NO: 858058 - protein, 19 aa, Mycobacterium
RTLTRCDVRVPRYATVDLT

SEQ ID NO: 858059 - protein, 23 aa, Mycobacterium
RTLVAHNVAFDYAFLAAEAEMAG

SEQ ID NO: 858060 - protein, 23 aa, Mycobacterium
RTLVGPLDWAVELDERWVILGPN

SEQ ID NO: 858061 - protein, 18 aa, Mycobacterium
RTLVLGSAAPWQQEIHEL

SEQ ID NO: 858062 - protein, 21 aa, Mycobacterium
RTLVPVLLTGLHRHSQDPEHA

SEQ ID NO: 858063 - protein, 29 aa, Mycobacterium
RTLWGKEIAQFQLIQLKLAKMEVARLNVR

SEQ ID NO: 858064 - protein, 19 aa, Mycobacterium
RTLYSYFGSVKPLLAHWST

SEQ ID NO: 858065 - protein, 17 aa, Mycobacterium
RTMEGFGVHTFRLVNRK

SEQ ID NO: 858066 - protein, 17 aa, Mycobacterium
RTMGRVYGWLLICDPPQ

SEQ ID NO: 858067 - protein, 24 aa, Mycobacterium
RTMHDIDWFEAWAALRGAILLLRV

SEQ ID NO: 858068 - protein, 18 aa, Mycobacterium
RTMIPWPDALEKADFCER

SEQ ID NO: 858069 - protein, 19 aa, Mycobacterium
RTMLAPFHRDAVARQAGLM

SEQ ID NO: 858070 - protein, 17 aa, Mycobacterium
RTMLLNCVLWSNDLLSL

SEQ ID NO: 858071 - protein, 20 aa, Mycobacterium
RTMLNLICHMSGIASVTAAW

SEQ ID NO: 858072 - protein, 24 aa, Mycobacterium
RTMPASLPEQAPAAAPPPAASSTT

SEQ ID NO: 858073 - protein, 21 aa, Mycobacterium
RTMRVPLAKVIRPSQFGIDVA

SEQ ID NO: 858074 - protein, 18 aa, Mycobacterium
RTMWRQMWELSDECWAQM

SEQ ID NO: 858075 - protein, 21 aa, Mycobacterium
RTNARAAFFGRSGLRRNIRWD

SEQ ID NO: 858076 - protein, 25 aa, Mycobacterium
RTNEPPWLWPAEIASVLLAGPAERA

SEQ ID NO: 858077 - protein, 26 aa, Mycobacterium
RTNEPPWLWPAELASVLLAGPAEQAA

SEQ ID NO: 858078 - protein, 25 aa, Mycobacterium
RTNIDELLTIPLAKELAWAPEEIRE

SEQ ID NO: 858079 - protein, 17 aa, Mycobacterium
RTNLAAVILQMSALGLG

SEQ ID NO: 858080 - protein, 18 aa, Mycobacterium
RTNLVGVLVPRLTDVVLA

SEQ ID NO: 858081 - protein, 22 aa, Mycobacterium
RTNRALRNMLGYGRKALAGLTF

SEQ ID NO: 858082 - protein, 25 aa, Mycobacterium
RTPEALVRLAGEYRDWLRAHPQARL

SEQ ID NO: 858083 - protein, 31 aa, Mycobacterium
RTPEGGLIKAAWIEDWRLPAAPPGAVKIVVG

SEQ ID NO: 858084 - protein, 20 aa, Mycobacterium
RTPFAYEGVFGHLAAGAVPG

SEQ ID NO: 858085 - protein, 17 aa, Mycobacterium
RTPFHPYSDALLSAVPI

SEQ ID NO: 858086 - protein, 39 aa, Mycobacterium
RTPGADIRFWAFDLLYLDGKSLLRTKYRDRRRLLEVLVT

SEQ ID NO: 858087 - protein, 26 aa, Mycobacterium
RTPGAKFDVLKLPPRNAPTAALTALV

SEQ ID NO: 858088 - protein, 18 aa, Mycobacterium
RTPGLHPRLGELLTGMLC

SEQ ID NO: 858089 - protein, 24 aa, Mycobacterium
RTPGRGWEHRWALSVLHTALGGGL

SEQ ID NO: 858090 - protein, 29 aa, Mycobacterium
RTPGYDGVLGRLWLSRGGTYVLANIRGGG

SEQ ID NO: 858091 - protein, 21 aa, Mycobacterium
RTPHLQIAAAPYLRSIAITGH

SEQ ID NO: 858092 - protein, 27 aa, Mycobacterium
RTPHVLACIYSVFTEGYWSTAGPSAIR

SEQ ID NO: 858093 - protein, 26 aa, Mycobacterium
RTPHVLGCIYSVFTEGYWATGGPSAI

SEQ ID NO: 858094 - protein, 18 aa, Mycobacterium
RTPITAALSRRLGQQIQL

SEQ ID NO: 858095 - protein, 24 aa, Mycobacterium
RTPITLMHGVAPVVVGWPVGQLYA

SEQ ID NO: 858096 - protein, 17 aa, Mycobacterium
RTPKHCQRLLFSATLDA

SEQ ID NO: 858097 - protein, 31 aa, Mycobacterium
RTPMALNGQLFRFVLFQTQAEEFYLFGCCHH

SEQ ID NO: 858098 - protein, 25 aa, Mycobacterium
RTPMTQWVPEDLFQTALGRAGEPQE

SEQ ID NO: 858099 - protein, 28 aa, Mycobacterium
RTPNYRRRMVRWPRQVLAEFGLYLPDDV

SEQ ID NO: 858100 - protein, 30 aa, Mycobacterium
RTPNYRRRMVRWPRQVLSEFGLSLPEGVDV

SEQ ID NO: 858101 - protein, 25 aa, Mycobacterium
RTPSDHPLAHRLLAISNAVEHWLDT

SEQ ID NO: 858102 - protein, 21 aa, Mycobacterium
RTPVLMFDYARGAADRGIEII

SEQ ID NO: 858103 - protein, 35 aa, Mycobacterium
RTPVREAFLRLEAEGLLRLYPQRGALVVPVSPDEV

SEQ ID NO: 858104 - protein, 26 aa, Mycobacterium
RTPVRSIMSFRLFGSDKALAALNFYA

SEQ ID NO: 858105 - protein, 34 aa, Mycobacterium
RTPVWSLPKPDLTLGPFLRPLYAAPGVQSALNGA

SEQ ID NO: 858106 - protein, 37 aa, Mycobacterium
RTPWRAEEPIVIVAPMFHAWGFSQLLLAASFACPVIT

SEQ ID NO: 858107 - protein, 34 aa, Mycobacterium
RTPWRAEQPIVIVAPMFHAWGFSQLVLAASLACT

SEQ ID NO: 858108 - protein, 20 aa, Mycobacterium
RTPYVLGALEHARAAGALTV

SEQ ID NO: 858109 - protein, 18 aa, Mycobacterium
RTQAFSGLSLRDVARGAG

SEQ ID NO: 858110 - protein, 18 aa, Mycobacterium
RTQFGRPLAKFQSVQNLV

SEQ ID NO: 858111 - protein, 20 aa, Mycobacterium
RTQIRALGLLKAACAQVNKD

SEQ ID NO: 858112 - protein, 28 aa, Mycobacterium
RTQLGKRLPAYMVPAAVVVLEALPLTVN

SEQ ID NO: 858113 - protein, 23 aa, Mycobacterium
RTQLKALIASNFFGQNTAAIAAT

SEQ ID NO: 858114 - protein, 20 aa, Mycobacterium
RTQLMAIVEQLIALMRTRGV

SEQ ID NO: 858115 - protein, 31 aa, Mycobacterium
RTQPWLADHRIAGVMLFPGAGFVELAIRAGD

SEQ ID NO: 858116 - protein, 26 aa, Mycobacterium
RTQRSVRALLTGYLLYTLGGDKRYRD

SEQ ID NO: 858117 - protein, 29 aa, Mycobacterium
RTRAARLRRPRRRHPLRLQRPGPARLRRR

SEQ ID NO: 858118 - protein, 26 aa, Mycobacterium
RTRAKARLVWGDHTLVGVGLARLDPA

SEQ ID NO: 858119 - protein, 25 aa, Mycobacterium
RTRAKARLVWGDQTLVGIGLARLDP

SEQ ID NO: 858120 - protein, 26 aa, Mycobacterium
RTRAPLPTLVDDLGGWLTAAMDAHGA

SEQ ID NO: 858121 - protein, 25 aa, Mycobacterium
RTRARLEEILQWPPGTIAALRRGEP

SEQ ID NO: 858122 - protein, 24 aa, Mycobacterium
RTRARLELTLLSRNDPVISANFQQ

SEQ ID NO: 858123 - protein, 22 aa, Mycobacterium
RTRAWENQIYLAYINHDGVENA

SEQ ID NO: 858124 - protein, 23 aa, Mycobacterium
RTRDDLLHPLRAPSLLAVEPPDH

SEQ ID NO: 858125 - protein, 21 aa, Mycobacterium
RTRDLPLIGAPANPGPAAGPG

SEQ ID NO: 858126 - protein, 23 aa, Mycobacterium
RTRDWMVTRVAVRSPRRLGRRGP

SEQ ID NO: 858127 - protein, 21 aa, Mycobacterium
RTRFFDDFFRAATAAGARQAV

SEQ ID NO: 858128 - protein, 23 aa, Mycobacterium
RTRFGDVLPFLVKVLAADEPLSL

SEQ ID NO: 858129 - protein, 20 aa, Mycobacterium
RTRFVLIGRPARPPARTGAD

SEQ ID NO: 858130 - protein, 19 aa, Mycobacterium
RTRGALRVAELVQRSLIPD

SEQ ID NO: 858131 - protein, 25 aa, Mycobacterium
RTRGDAPVFDLLRDAAATARAAGAR

SEQ ID NO: 858132 - protein, 17 aa, Mycobacterium
RTRHGRSLPARHADSVT

SEQ ID NO: 858133 - protein, 21 aa, Mycobacterium
RTRKPFQSVIKDAGISVGEID

SEQ ID NO: 858134 - protein, 17 aa, Mycobacterium
RTRLAQLLATNRFGQNT

SEQ ID NO: 858135 - protein, 21 aa, Mycobacterium
RTRLFAAEDLDLPMYAPHELE

SEQ ID NO: 858136 - protein, 17 aa, Mycobacterium
RTRLFAAPGWNVSQGTL

SEQ ID NO: 858137 - protein, 23 aa, Mycobacterium
RTRLKLEEVLRWPPGTIARLRQG

SEQ ID NO: 858138 - protein, 31 aa, Mycobacterium
RTRLQPIDRGWLDLMFSVPLLDTQRARTVLD

SEQ ID NO: 858139 - protein, 18 aa, Mycobacterium
RTRLRGILARELGMPEDA

SEQ ID NO: 858140 - protein, 20 aa, Mycobacterium
RTRLRIFFEFTRGADESGPA

SEQ ID NO: 858141 - protein, 18 aa, Mycobacterium
RTRLRQEVLPLLEDVLGG

SEQ ID NO: 858142 - protein, 17 aa, Mycobacterium
RTRLRQEVLPLLEEVLG

SEQ ID NO: 858143 - protein, 20 aa, Mycobacterium
RTRLVRFFPTAMKGTHVELD

SEQ ID NO: 858144 - protein, 35 aa, Mycobacterium
RTRLVSDLLRELGRRIVAWRAARGADWALAADYRA

SEQ ID NO: 858145 - protein, 22 aa, Mycobacterium
RTRNLPLVGAPSNPVATLRSPV

SEQ ID NO: 858146 - protein, 29 aa, Mycobacterium
RTRSWDHRKLGLPPMPVGGSTAPAVLGTG

SEQ ID NO: 858147 - protein, 25 aa, Mycobacterium
RTRSWDHRKLGMPAMPLGGSTAQYL

SEQ ID NO: 858148 - protein, 17 aa, Mycobacterium
RTRTVLLKGWEQFDEPV

SEQ ID NO: 858149 - protein, 17 aa, Mycobacterium
RTRVFLKAPITTPQSGG

SEQ ID NO: 858150 - protein, 33 aa, Mycobacterium
RTRVRFTITVEPWAPLPEFWVARARKKILHSAL

SEQ ID NO: 858151 - protein, 27 aa, Mycobacterium
RTRVRTRLIELFELFDPADPEVIAGRR

SEQ ID NO: 858152 - protein, 28 aa, Mycobacterium
RTRVYCPRWVALFRWVKPVLSSAVGEAP

SEQ ID NO: 858153 - protein, 20 aa, Mycobacterium
RTRYFDDYFMDAVGAGVRQV

SEQ ID NO: 858154 - protein, 19 aa, Mycobacterium
RTRYGILETLRAFGREHLR

SEQ ID NO: 858155 - protein, 17 aa, Mycobacterium
RTRYLHAGNPQAPALLF

SEQ ID NO: 858156 - protein, 24 aa, Mycobacterium
RTRYPNLEIPFHSRWRHFDAGGVD

SEQ ID NO: 858157 - protein, 21 aa, Mycobacterium
RTRYRLLETVRQYALEKVGAS

SEQ ID NO: 858158 - protein, 17 aa, Mycobacterium
RTRYRLRKANERAHILR

SEQ ID NO: 858159 - protein, 23 aa, Mycobacterium
RTSALAALYPPPSAAELANLMTP

SEQ ID NO: 858160 - protein, 24 aa, Mycobacterium
RTSAPILRRVFGDRIPASVPSKAE

SEQ ID NO: 858161 - protein, 23 aa, Mycobacterium
RTSAVKIFTAWATRRGLLPTDPA

SEQ ID NO: 858162 - protein, 24 aa, Mycobacterium
RTSDVFLTNFLPAARRRLGIELDD

SEQ ID NO: 858163 - protein, 24 aa, Mycobacterium
RTSGTRLLPYRPITITATDGQPVI

SEQ ID NO: 858164 - protein, 17 aa, Mycobacterium
RTSLAPHPHIYPATGAP

SEQ ID NO: 858165 - protein, 19 aa, Mycobacterium
RTSLHLYTDPGMQLPNTDP

SEQ ID NO: 858166 - protein, 25 aa, Mycobacterium
RTSLLDMLRERAGLPGTKKGCDQGA

SEQ ID NO: 858167 - protein, 21 aa, Mycobacterium
RTSLLDMLRERVGLTGTKKGC

SEQ ID NO: 858168 - protein, 18 aa, Mycobacterium
RTSLLTAGWPETVPGVTV

SEQ ID NO: 858169 - protein, 25 aa, Mycobacterium
RTSLSQVLPPYMVPAAFMVIDELPL

SEQ ID NO: 858170 - protein, 22 aa, Mycobacterium
RTSLWHSAFEQCSMLGSVFVQC

SEQ ID NO: 858171 - protein, 22 aa, Mycobacterium
RTSLWHSSFAQCSMLGSVFVQC

SEQ ID NO: 858172 - protein, 17 aa, Mycobacterium
RTSPFAFTGNRFEFRAP

SEQ ID NO: 858173 - protein, 20 aa, Mycobacterium
RTSPFAFTGNRFEFRAPGSG

SEQ ID NO: 858174 - protein, 26 aa, Mycobacterium
RTSQQAFLFGPPPLGPDAPPLDRLIA

SEQ ID NO: 858175 - protein, 21 aa, Mycobacterium
RTSRDLALIRLKLNAPMPYHC

SEQ ID NO: 858176 - protein, 18 aa, Mycobacterium
RTSRFLAEGPNLVEAAAA

SEQ ID NO: 858177 - protein, 19 aa, Mycobacterium
RTSTFALTNATLPYVLKLA

SEQ ID NO: 858178 - protein, 29 aa, Mycobacterium
RTSTQVPFLVRDELCRIFRLDRDVVRVFA

SEQ ID NO: 858179 - protein, 36 aa, Mycobacterium
RTSTYALTNATLPYVLKLAGRGWRDACRADPALAKG

SEQ ID NO: 858180 - protein, 25 aa, Mycobacterium
RTTDLLWTSIFLGGDRGRGFEEDLG

SEQ ID NO: 858181 - protein, 26 aa, Mycobacterium
RTTEEWLNLFRELEIPAAPLNTPDAL

SEQ ID NO: 858182 - protein, 22 aa, Mycobacterium
RTTFELFARRLPEGRRYGVVAG

SEQ ID NO: 858183 - protein, 29 aa, Mycobacterium
RTTGLERLDLPYMALPNSSLAGVDLSTEF

SEQ ID NO: 858184 - protein, 26 aa, Mycobacterium
RTTGLRPFDVQLLAALRMLAGDVVEM

SEQ ID NO: 858185 - protein, 24 aa, Mycobacterium
RTTGPWEPWLHALPVEFASAEQVF

SEQ ID NO: 858186 - protein, 25 aa, Mycobacterium
RTTGPWEPWLHALPVEFDSADQVFA

SEQ ID NO: 858187 - protein, 24 aa, Mycobacterium
RTTGPWEPWLHALPVEFDSAEQVF

SEQ ID NO: 858188 - protein, 23 aa, Mycobacterium
RTTGPWEPWLHALPVEFDSEAKV

SEQ ID NO: 858189 - protein, 19 aa, Mycobacterium
RTTGPWEPWVHALPVEFTS

SEQ ID NO: 858190 - protein, 18 aa, Mycobacterium
RTTHWPPQLATIGGLRFA

SEQ ID NO: 858191 - protein, 26 aa, Mycobacterium
RTTIDELLTIPLAKELAWAPEEIREE

SEQ ID NO: 858192 - protein, 26 aa, Mycobacterium
RTTIDQLLTIPLAKELAWAPEEIREE

SEQ ID NO: 858193 - protein, 22 aa, Mycobacterium
RTTLEGWLDFYRATLAAKCEGL

SEQ ID NO: 858194 - protein, 20 aa, Mycobacterium
RTTLGLDPGFRTGVKVAVVD

SEQ ID NO: 858195 - protein, 32 aa, Mycobacterium
RTTLLLATRTSPPYVLPKLLDALQATLGSQFE

SEQ ID NO: 858196 - protein, 23 aa, Mycobacterium
RTTLPPLYGIPYSVKEVCAVAAT

SEQ ID NO: 858197 - protein, 41 aa, Mycobacterium
RTTLTLLETAALPGLPPLSSGLVGFFAYDLVRRLERLPELT

SEQ ID NO: 858198 - protein, 22 aa, Mycobacterium
RTTLWHSTFAQCSMLGSVFVSC

SEQ ID NO: 858199 - protein, 20 aa, Mycobacterium
RTTNPPLLLATRHVIGDDGT

SEQ ID NO: 858200 - protein, 24 aa, Mycobacterium
RTTPMELMTTGWFTGLVPVTAGVE

SEQ ID NO: 858201 - protein, 30 aa, Mycobacterium
RTTQRVFRRYVGVPVKWVLCRYRLQNAALE

SEQ ID NO: 858202 - protein, 30 aa, Mycobacterium
RTTQRVFRRYVGVPVKWVLCRYRLQQAALE

SEQ ID NO: 858203 - protein, 27 aa, Mycobacterium
RTTREWLDLFRELEIPASPLSSPASLF

SEQ ID NO: 858204 - protein, 23 aa, Mycobacterium
RTTRGAYPVLYEPATVFTIGGSH

SEQ ID NO: 858205 - protein, 24 aa, Mycobacterium
RTTYPPITPIPPPPPGVSTLPADF

SEQ ID NO: 858206 - protein, 28 aa, Mycobacterium
RTVAAAPYLYLRHRRPYLLPAGGSSPLG

SEQ ID NO: 858207 - protein, 18 aa, Mycobacterium
RTVAFYRDSLGLAIAREY

SEQ ID NO: 858208 - protein, 33 aa, Mycobacterium
RTVANRAKLNWWESRALYGWTVLVPRTKDQAGE

SEQ ID NO: 858209 - protein, 19 aa, Mycobacterium
RTVAVGPMLHALRDRPAHL

SEQ ID NO: 858210 - protein, 25 aa, Mycobacterium
RTVDEIHADLFWHGPGKLTVGDCLP

SEQ ID NO: 858211 - protein, 27 aa, Mycobacterium
RTVDFYTNILGMPLIKSLDLPGGAGQH

SEQ ID NO: 858212 - protein, 18 aa, Mycobacterium
RTVDVQALYVAAHRMRRL

SEQ ID NO: 858213 - protein, 20 aa, Mycobacterium
RTVEEWLAAEPFRAPEADEL

SEQ ID NO: 858214 - protein, 29 aa, Mycobacterium
RTVELLVDYLYGVLALPIPYKNDLAAKIN

SEQ ID NO: 858215 - protein, 17 aa, Mycobacterium
RTVFTDDCAIDYGEIGA

SEQ ID NO: 858216 - protein, 23 aa, Mycobacterium
RTVGAWLWSGRRAVIAGPAAAAL

SEQ ID NO: 858217 - protein, 18 aa, Mycobacterium
RTVGDQLQFLVASREFVR

SEQ ID NO: 858218 - protein, 22 aa, Mycobacterium
RTVGPAVLLRQTSFRALAEPRR

SEQ ID NO: 858219 - protein, 18 aa, Mycobacterium
RTVGWFTTKYPVAVTVGG

SEQ ID NO: 858220 - protein, 24 aa, Mycobacterium
RTVHGYAYALLRRNAERTGEGPPR

SEQ ID NO: 858221 - protein, 24 aa, Mycobacterium
RTVHSYAFGVLRLAAQRNGSPPPR

SEQ ID NO: 858222 - protein, 18 aa, Mycobacterium
RTVLAAVGPDRIALVTDA

SEQ ID NO: 858223 - protein, 31 aa, Mycobacterium
RTVLDALPHPHWWFDLLTTEPLAFASLDRWS

SEQ ID NO: 858224 - protein, 17 aa, Mycobacterium
RTVLLKGWEQFDEPVDR

SEQ ID NO: 858225 - protein, 20 aa, Mycobacterium
RTVLLRHCPSLAPALDGVTN

SEQ ID NO: 858226 - protein, 22 aa, Mycobacterium
RTVNPNIIYARGSALGPRGGEA

SEQ ID NO: 858227 - protein, 17 aa, Mycobacterium
RTVQPPALSIRNGRRSV

SEQ ID NO: 858228 - protein, 20 aa, Mycobacterium
RTVRMFGIQNAFMNILSQGT

SEQ ID NO: 858229 - protein, 23 aa, Mycobacterium
RTVRQRLAAFITPIPIRVRDGTH

SEQ ID NO: 858230 - protein, 30 aa, Mycobacterium
RTVSDLTHKLYFFELSTSPSVIWVEFDHLE

SEQ ID NO: 858231 - protein, 18 aa, Mycobacterium
RTVTLDEIGADPAALGAA

SEQ ID NO: 858232 - protein, 22 aa, Mycobacterium
RTVTWLARDVSSLGWRCYRLDA

SEQ ID NO: 858233 - protein, 28 aa, Mycobacterium
RTVYDRPQRRLLMLTVAGLGHGPDVFAH

SEQ ID NO: 858234 - protein, 36 aa, Mycobacterium
RTVYTLSDLGWRRVLPVLQSLAWFGLDRVDPIDSGP

SEQ ID NO: 858235 - protein, 20 aa, Mycobacterium
RTWAHFLESTTLILDELNRQ

SEQ ID NO: 858236 - protein, 18 aa, Mycobacterium
RTWEFIRDLRSGTAVFAM

SEQ ID NO: 858237 - protein, 17 aa, Mycobacterium
RTWHGTVLAAAAFADAD

SEQ ID NO: 858238 - protein, 17 aa, Mycobacterium
RTWIVGRDPAPRQQAQF

SEQ ID NO: 858239 - protein, 20 aa, Mycobacterium
RTWNDPILAALNPGVALPNI

SEQ ID NO: 858240 - protein, 21 aa, Mycobacterium
RTWPAICDELLEHYAAAAGTT

SEQ ID NO: 858241 - protein, 21 aa, Mycobacterium
RTWPDRVITSAPLWCAVDLRD

SEQ ID NO: 858242 - protein, 19 aa, Mycobacterium
RTWPPQPSQRLLGLLHTEL

SEQ ID NO: 858243 - protein, 20 aa, Mycobacterium
RTWRYLLDMDLVRKIKYHGA

SEQ ID NO: 858244 - protein, 22 aa, Mycobacterium
RTWVDVMGLPEVDYRLHYPEHE

SEQ ID NO: 858245 - protein, 18 aa, Mycobacterium
RTYALLLPDVEWAEHGAR

SEQ ID NO: 858246 - protein, 23 aa, Mycobacterium
RTYAPFHQHFLVARLDMDIDGTD

SEQ ID NO: 858247 - protein, 25 aa, Mycobacterium
RTYAPYHQHFLVARLDLDVDGTENT

SEQ ID NO: 858248 - protein, 20 aa, Mycobacterium
RTYDGFLVHSRFGSAAPLDG

SEQ ID NO: 858249 - protein, 26 aa, Mycobacterium
RTYDVIDPLEQLLGKPVLTANQLTIW

SEQ ID NO: 858250 - protein, 21 aa, Mycobacterium
RTYFQAYAAACALHFAEKALA

SEQ ID NO: 858251 - protein, 20 aa, Mycobacterium
RTYFWVARTSSTSTGGFLST

SEQ ID NO: 858252 - protein, 18 aa, Mycobacterium
RTYGLLALQAPVARDLRT

SEQ ID NO: 858253 - protein, 19 aa, Mycobacterium
RTYGMRASLSPVPFAGSVG

SEQ ID NO: 858254 - protein, 19 aa, Mycobacterium
RTYLAVRGGICVTPVLGSR

SEQ ID NO: 858255 - protein, 17 aa, Mycobacterium
RTYLCSSATPPGGGVHG

SEQ ID NO: 858256 - protein, 18 aa, Mycobacterium
RTYLPAADQCPLCPGPTG

SEQ ID NO: 858257 - protein, 25 aa, Mycobacterium
RTYQVNYLAPFLLTTQLLDVLLESR

SEQ ID NO: 858258 - protein, 26 aa, Mycobacterium
RTYRTVLNPYLSPAAIKRWEPFIDDV

SEQ ID NO: 858259 - protein, 28 aa, Mycobacterium
RVAADKVPLPLLWGEYRPGELVRGRWGL

SEQ ID NO: 858260 - protein, 17 aa, Mycobacterium
RVAADLQILKRGARLVE

SEQ ID NO: 858261 - protein, 22 aa, Mycobacterium
RVAAFAFVHLLNGVVKDREHTR

SEQ ID NO: 858262 - protein, 18 aa, Mycobacterium
RVAAKLAAAGWPLTGVDP

SEQ ID NO: 858263 - protein, 21 aa, Mycobacterium
RVAALFSRRGFNIASLAVGPT

SEQ ID NO: 858264 - protein, 21 aa, Mycobacterium
RVAALFSRRGFNIESLAVGAT

SEQ ID NO: 858265 - protein, 27 aa, Mycobacterium
RVAALRRCVPMLARIKDPTLRDEYARQ

SEQ ID NO: 858266 - protein, 19 aa, Mycobacterium
RVAAPHRILDPKAGPLIAT

SEQ ID NO: 858267 - protein, 23 aa, Mycobacterium
RVAARLLAVLPRTVKDRALHAAA

SEQ ID NO: 858268 - protein, 23 aa, Mycobacterium
RVAASIAAGLIWVNTTRTINHLV

SEQ ID NO: 858269 - protein, 25 aa, Mycobacterium
RVAATARLLALQALADVDGVLALPG

SEQ ID NO: 858270 - protein, 17 aa, Mycobacterium
RVAAVDWVFNGWGARDW

SEQ ID NO: 858271 - protein, 24 aa, Mycobacterium
RVAAVLPDRFTAGLLAAMLERSPT

SEQ ID NO: 858272 - protein, 19 aa, Mycobacterium
RVACRAWNGLWRVAPQLVG

SEQ ID NO: 858273 - protein, 19 aa, Mycobacterium
RVADDLLALCAHALGLSVN

SEQ ID NO: 858274 - protein, 23 aa, Mycobacterium
RVADGVAILLPYGEDRDWVRNLF

SEQ ID NO: 858275 - protein, 23 aa, Mycobacterium
RVADILFVMCTNGMFVVPRRTPG

SEQ ID NO: 858276 - protein, 25 aa, Mycobacterium
RVAEFHAQFERVLAAGAQAYSGAEA

SEQ ID NO: 858277 - protein, 24 aa, Mycobacterium
RVAELLEIVGLRRADAIRYPAEFS

SEQ ID NO: 858278 - protein, 29 aa, Mycobacterium
RVAEPLAAYKSQLQRCASFTFSGPDQIQS

SEQ ID NO: 858279 - protein, 26 aa, Mycobacterium
RVAESGLLGIVVPAAHGGPGLPASTK

SEQ ID NO: 858280 - protein, 18 aa, Mycobacterium
RVAFFADVQLIALITQNR

SEQ ID NO: 858281 - protein, 22 aa, Mycobacterium
RVAFVLHDGFAVPFSAIAEVLG

SEQ ID NO: 858282 - protein, 17 aa, Mycobacterium
RVAFVLHDVFAVPFEEI

SEQ ID NO: 858283 - protein, 23 aa, Mycobacterium
RVAFVVDDIFSRDPWRVRCLEIR

SEQ ID NO: 858284 - protein, 22 aa, Mycobacterium
RVAGIALRHAKLRSIPPGERRI

SEQ ID NO: 858285 - protein, 31 aa, Mycobacterium
RVAGIGGLYGDFFNFYACDVTLKVDGLQPGG

SEQ ID NO: 858286 - protein, 18 aa, Mycobacterium
RVAGILAAKRTSDLIPLC

SEQ ID NO: 858287 - protein, 21 aa, Mycobacterium
RVAGLIARVQLAASPPAAVQE

SEQ ID NO: 858288 - protein, 23 aa, Mycobacterium
RVAGLIARVQLPAAAPGPVQELR

SEQ ID NO: 858289 - protein, 19 aa, Mycobacterium
RVAGLIARVQLTASPSAAV

SEQ ID NO: 858290 - protein, 17 aa, Mycobacterium
RVAGLIEAGRAWARFED

SEQ ID NO: 858291 - protein, 17 aa, Mycobacterium
RVAGLPGPLVNLVEETA

SEQ ID NO: 858292 - protein, 31 aa, Mycobacterium
RVAGRSWRVPATAFWQAHRAAPELYSALVTR

SEQ ID NO: 858293 - protein, 24 aa, Mycobacterium
RVAGSLLLLYGQQLARIVAITHDQ

SEQ ID NO: 858294 - protein, 22 aa, Mycobacterium
RVAGVHFLMKKNKITEIHGYGR

SEQ ID NO: 858295 - protein, 22 aa, Mycobacterium
RVAGVHFLMKKNKITEVHGYGR

SEQ ID NO: 858296 - protein, 18 aa, Mycobacterium
RVAHLLLETLRAAAPPHT

SEQ ID NO: 858297 - protein, 24 aa, Mycobacterium
RVAIARAFVNRPLVLIADEPTGNL

SEQ ID NO: 858298 - protein, 33 aa, Mycobacterium
RVAIYMPMLPEAIVAMLACARLGLMHSVVFAGF

SEQ ID NO: 858299 - protein, 17 aa, Mycobacterium
RVAKALPAAWQVAGPDA

SEQ ID NO: 858300 - protein, 38 aa, Mycobacterium
RVAKLSEILGFYGLNYWYPWQVTVLGLGPVWQSANTDP

SEQ ID NO: 858301 - protein, 17 aa, Mycobacterium
RVALARALAAEPRVLLL

SEQ ID NO: 858302 - protein, 19 aa, Mycobacterium
RVALDMFAQSFLKRVGCRP

SEQ ID NO: 858303 - protein, 20 aa, Mycobacterium
RVALDRMLIDQLPDIVEKAA

SEQ ID NO: 858304 - protein, 17 aa, Mycobacterium
RVALIDGTWVAFPTVEQ

SEQ ID NO: 858305 - protein, 20 aa, Mycobacterium
RVALIEGQWVAFPTVEQLEK

SEQ ID NO: 858306 - protein, 19 aa, Mycobacterium
RVALPHKPFSELVKRRPER

SEQ ID NO: 858307 - protein, 18 aa, Mycobacterium
RVALPWRHGTDAVIAELV

SEQ ID NO: 858308 - protein, 18 aa, Mycobacterium
RVALTRNVLLPVGTDYTP

SEQ ID NO: 858309 - protein, 22 aa, Mycobacterium
RVALVSSAPIFLCLREVREWAQ

SEQ ID NO: 858310 - protein, 20 aa, Mycobacterium
RVALVYQYRHPLGHRLWELP

SEQ ID NO: 858311 - protein, 19 aa, Mycobacterium
RVALWNIVATVDAFLSSGF

SEQ ID NO: 858312 - protein, 25 aa, Mycobacterium
RVAMKKELLWYPYSRKKGSFAEKVV

SEQ ID NO: 858313 - protein, 19 aa, Mycobacterium
RVANLACDWFLDHLSRAVT

SEQ ID NO: 858314 - protein, 27 aa, Mycobacterium
RVAPAHRDRLWLGLTQCGSPRLIRTID

SEQ ID NO: 858315 - protein, 22 aa, Mycobacterium
RVAPDPLPSWGPFIPIAFEKWL

SEQ ID NO: 858316 - protein, 17 aa, Mycobacterium
RVAPHALSMLRGFNLMK

SEQ ID NO: 858317 - protein, 20 aa, Mycobacterium
RVAPMITPFMRHAANRLWRD

SEQ ID NO: 858318 - protein, 20 aa, Mycobacterium
RVAPSILMGRRDGLKRVDEF

SEQ ID NO: 858319 - protein, 35 aa, Mycobacterium
RVAPTKAWRKMFGENFFYILYFQEPGVADAELNAD

SEQ ID NO: 858320 - protein, 18 aa, Mycobacterium
RVARAWREMLWGYHEVPE

SEQ ID NO: 858321 - protein, 18 aa, Mycobacterium
RVARELSNWGRWGDADEL

SEQ ID NO: 858322 - protein, 23 aa, Mycobacterium
RVARIYESVLLLEPGAIGPDMDF

SEQ ID NO: 858323 - protein, 17 aa, Mycobacterium
RVARLRFAGTSVVGVDA

SEQ ID NO: 858324 - protein, 17 aa, Mycobacterium
RVARRPILVAAHSKFGE

SEQ ID NO: 858325 - protein, 19 aa, Mycobacterium
RVARVLYDFITNEALPGTG

SEQ ID NO: 858326 - protein, 24 aa, Mycobacterium
RVASHDRFRFYLNVEIGKHLTHAD

SEQ ID NO: 858327 - protein, 18 aa, Mycobacterium
RVASPFALLVIADLLGVP

SEQ ID NO: 858328 - protein, 22 aa, Mycobacterium
RVATALAWTHLGMSPPAGVSGL

SEQ ID NO: 858329 - protein, 26 aa, Mycobacterium
RVATPLAWTHLGLTPPPQLLGQTGLF

SEQ ID NO: 858330 - protein, 19 aa, Mycobacterium
RVATRPWQLTRVVPVATSL

SEQ ID NO: 858331 - protein, 19 aa, Mycobacterium
RVAVAYHRGGVRGAGRLGG

SEQ ID NO: 858332 - protein, 17 aa, Mycobacterium
RVAVLGGNRIPFARSDG

SEQ ID NO: 858333 - protein, 17 aa, Mycobacterium
RVAWARADFPRAKSLAS

SEQ ID NO: 858334 - protein, 19 aa, Mycobacterium
RVAWLDPACLGPCDPAIIA

SEQ ID NO: 858335 - protein, 29 aa, Mycobacterium
RVCAAEGIAWVPYFPLGSSFPGFPKVADH

SEQ ID NO: 858336 - protein, 19 aa, Mycobacterium
RVCDWLPDDPYPRATVQIW

SEQ ID NO: 858337 - protein, 21 aa, Mycobacterium
RVCIESVISGQRRYQILSPGS

SEQ ID NO: 858338 - protein, 25 aa, Mycobacterium
RVCRDCGFYLPLGGALGRMFGVCAN

SEQ ID NO: 858339 - protein, 25 aa, Mycobacterium
RVDAAIVRALPRWARWSHKRITAAL

SEQ ID NO: 858340 - protein, 28 aa, Mycobacterium
RVDAHDVGRWRFVTLRWSVDNARDIADL

SEQ ID NO: 858341 - protein, 25 aa, Mycobacterium
RVDAMYPLGPLIAGAGLNITVMSLN

SEQ ID NO: 858342 - protein, 19 aa, Mycobacterium
RVDAPPAHLAVLGGGYIAA

SEQ ID NO: 858343 - protein, 18 aa, Mycobacterium
RVDAQAKYPAAPRQRKGA

SEQ ID NO: 858344 - protein, 25 aa, Mycobacterium
RVDAVVFLLRTLNAADIALLKQIGE

SEQ ID NO: 858345 - protein, 25 aa, Mycobacterium
RVDAVVFLLRTLNAADIALLKQIGG

SEQ ID NO: 858346 - protein, 21 aa, Mycobacterium
RVDAVVFLLRTLNAADVALLK

SEQ ID NO: 858347 - protein, 18 aa, Mycobacterium
RVDAVVLLVPRSAGATQI

SEQ ID NO: 858348 - protein, 26 aa, Mycobacterium
RVDDDGTVWLISAAGERVVGSWQAGD

SEQ ID NO: 858349 - protein, 25 aa, Mycobacterium
RVDDDGTVWLITSAGERVVGTWQAG

SEQ ID NO: 858350 - protein, 19 aa, Mycobacterium
RVDDDGTVWLITTAGERIV

SEQ ID NO: 858351 - protein, 23 aa, Mycobacterium
RVDDRHLLFVATDRISAYDFILD

SEQ ID NO: 858352 - protein, 18 aa, Mycobacterium
RVDFAANTLTWTGVGNVT

SEQ ID NO: 858353 - protein, 17 aa, Mycobacterium
RVDGIAAGLRQVAGLPD

SEQ ID NO: 858354 - protein, 23 aa, Mycobacterium
RVDGIEATRRLGGRPPVLALTTF

SEQ ID NO: 858355 - protein, 19 aa, Mycobacterium
RVDGLLDPGSPFLELAALA

SEQ ID NO: 858356 - protein, 20 aa, Mycobacterium
RVDGLLDPGSPFLELAPLAA

SEQ ID NO: 858357 - protein, 26 aa, Mycobacterium
RVDGLVAALRERLPFELTAGQREVLD

SEQ ID NO: 858358 - protein, 25 aa, Mycobacterium
RVDGPSWVNNIPFAAKLSGPWDVDA

SEQ ID NO: 858359 - protein, 21 aa, Mycobacterium
RVDGRPLFAANRALPWPEDPV

SEQ ID NO: 858360 - protein, 18 aa, Mycobacterium
RVDGVRVILDDSLVYLAL

SEQ ID NO: 858361 - protein, 29 aa, Mycobacterium
RVDGWPGQRFALIFRDWLRSDHQACAEYL

SEQ ID NO: 858362 - protein, 30 aa, Mycobacterium
RVDGWPNQQFALLFVDWLRANPGARADYLA

SEQ ID NO: 858363 - protein, 30 aa, Mycobacterium
RVDGWPNQQFALLFVDWLRANSGVRADYLS

SEQ ID NO: 858364 - protein, 31 aa, Mycobacterium
RVDGWPNQQFALLFVDWLTDNPAVRTEYADL

SEQ ID NO: 858365 - protein, 25 aa, Mycobacterium
RVDKQANLHFVIGKASFDEKALAEN

SEQ ID NO: 858366 - protein, 25 aa, Mycobacterium
RVDKQANLHFVIGKASFDEKRLAEN

SEQ ID NO: 858367 - protein, 26 aa, Mycobacterium
RVDKQANLHFVIGKASFEENKLAENY

SEQ ID NO: 858368 - protein, 18 aa, Mycobacterium
RVDKYRMSGFWDTALDSI

SEQ ID NO: 858369 - protein, 18 aa, Mycobacterium
RVDLDPMPGVGWRQILDV

SEQ ID NO: 858370 - protein, 21 aa, Mycobacterium
RVDLIALHAWSDVGVFSALGM

SEQ ID NO: 858371 - protein, 26 aa, Mycobacterium
RVDLSRTVGWFTTKYPAALSITGGLS

SEQ ID NO: 858372 - protein, 17 aa, Mycobacterium
RVDLYFEAAVAGAIPVI

SEQ ID NO: 858373 - protein, 21 aa, Mycobacterium
RVDMSLFDLTLYEKQVRGSLF

SEQ ID NO: 858374 - protein, 22 aa, Mycobacterium
RVDPALMRLMATWPDNPALVYN

SEQ ID NO: 858375 - protein, 35 aa, Mycobacterium
RVDPARALQILAERKLFRVLTEGGPSLLGLLIEHD

SEQ ID NO: 858376 - protein, 23 aa, Mycobacterium
RVDPHPEWFRTGDLGRLDADQNL

SEQ ID NO: 858377 - protein, 28 aa, Mycobacterium
RVDPRRVPIWLPYIRGERTPFHDPDRRA

SEQ ID NO: 858378 - protein, 17 aa, Mycobacterium
RVDPTAYGAYYNGPPEP

SEQ ID NO: 858379 - protein, 17 aa, Mycobacterium
RVDPTAYGAYYTGPADA

SEQ ID NO: 858380 - protein, 18 aa, Mycobacterium
RVDPVTLRQLRRALRRAD

SEQ ID NO: 858381 - protein, 20 aa, Mycobacterium
RVDQLPEIWRRLVEGGMESG

SEQ ID NO: 858382 - protein, 18 aa, Mycobacterium
RVDRFDVLAARRGGDGVV

SEQ ID NO: 858383 - protein, 25 aa, Mycobacterium
RVDRFFGDIWWRREFYEARNANGAS

SEQ ID NO: 858384 - protein, 21 aa, Mycobacterium
RVDSTYLDSTPVRRIVADSWR

SEQ ID NO: 858385 - protein, 27 aa, Mycobacterium
RVDTTFGVVLVLRQLFEELLTVAAITD

SEQ ID NO: 858386 - protein, 28 aa, Mycobacterium
RVDVDFNGWWMCMIPRQIAEELGQPLPL

SEQ ID NO: 858387 - protein, 17 aa, Mycobacterium
RVDVVQPVLFAVMVSLA

SEQ ID NO: 858388 - protein, 18 aa, Mycobacterium
RVDVVQPVLFAVMVSLAR

SEQ ID NO: 858389 - protein, 25 aa, Mycobacterium
RVDYFCVGPCWPTPTKPGRPAPGLD

SEQ ID NO: 858390 - protein, 18 aa, Mycobacterium
RVEALRAAIGPLTPDGVK

SEQ ID NO: 858391 - protein, 25 aa, Mycobacterium
RVEELRRRLEDLPVLYELAAEEEGA

SEQ ID NO: 858392 - protein, 25 aa, Mycobacterium
RVEETAFGLLALQAPVATDLRAVVS

SEQ ID NO: 858393 - protein, 24 aa, Mycobacterium
RVEFDFDLPPIQLQAVRDANLLDV

SEQ ID NO: 858394 - protein, 26 aa, Mycobacterium
RVEFGAWLNRYFSPCADRFSDLLLAV

SEQ ID NO: 858395 - protein, 20 aa, Mycobacterium
RVEGPHLSFPSPQRTPVLFQ

SEQ ID NO: 858396 - protein, 30 aa, Mycobacterium
RVEGWPNQQFALLFPDWLTADPDARAEYLS

SEQ ID NO: 858397 - protein, 20 aa, Mycobacterium
RVEILPVPGLPEFRPGDDLV

SEQ ID NO: 858398 - protein, 23 aa, Mycobacterium
RVELDLFASVFRYAMELTAEKRR

SEQ ID NO: 858399 - protein, 19 aa, Mycobacterium
RVELEPFVEPELCLARVIA

SEQ ID NO: 858400 - protein, 21 aa, Mycobacterium
RVELLLDPDSPFLELSPLAAW

SEQ ID NO: 858401 - protein, 18 aa, Mycobacterium
RVELLLDPDTAFLELCPF

SEQ ID NO: 858402 - protein, 18 aa, Mycobacterium
RVELRLLGPEYKSPQLIK

SEQ ID NO: 858403 - protein, 23 aa, Mycobacterium
RVENFDIFALLHGGGPSGQAGAL

SEQ ID NO: 858404 - protein, 21 aa, Mycobacterium
RVEPRMTLADFLRERCGLTGT

SEQ ID NO: 858405 - protein, 24 aa, Mycobacterium
RVEPSLHRVVLDDKPYRPGRALEL

SEQ ID NO: 858406 - protein, 25 aa, Mycobacterium
RVEQIKRFIIIGTAWDPGGDELTPT

SEQ ID NO: 858407 - protein, 25 aa, Mycobacterium
RVEQIKRFVVLTTQWLPGSDELTPT

SEQ ID NO: 858408 - protein, 26 aa, Mycobacterium
RVERAAMAACCWVTAGKAGRAERRAS

SEQ ID NO: 858409 - protein, 20 aa, Mycobacterium
RVERAIARMSEAAAAGADSL

SEQ ID NO: 858410 - protein, 23 aa, Mycobacterium
RVERFYVWFADFAAPDSLAEFGE

SEQ ID NO: 858411 - protein, 25 aa, Mycobacterium
RVERIRMIGAATLDLAFVAEGALDA

SEQ ID NO: 858412 - protein, 24 aa, Mycobacterium
RVERKLLDVCQELGRWRAIAESTD

SEQ ID NO: 858413 - protein, 24 aa, Mycobacterium
RVESLFAAILLSRPLRSLHSAQLY

SEQ ID NO: 858414 - protein, 18 aa, Mycobacterium
RVETSMCFPLPKFSDIRY

SEQ ID NO: 858415 - protein, 20 aa, Mycobacterium
RVEVLPVPGLPEFRPGDDLA

SEQ ID NO: 858416 - protein, 25 aa, Mycobacterium
RVEVRTVLAPAWTSDWITDDGRRKL

SEQ ID NO: 858417 - protein, 24 aa, Mycobacterium
RVEWAGDIYCVVLNLCHKLADHPR

SEQ ID NO: 858418 - protein, 21 aa, Mycobacterium
RVEWDRVIGINLTGTFLVAKA

SEQ ID NO: 858419 - protein, 26 aa, Mycobacterium
RVFAELAPHPLLTRALEQTARGREMP

SEQ ID NO: 858420 - protein, 21 aa, Mycobacterium
RVFARRATLARALRLLSEFRF

SEQ ID NO: 858421 - protein, 24 aa, Mycobacterium
RVFDTLLDEQTILGLALGAGVSGL

SEQ ID NO: 858422 - protein, 29 aa, Mycobacterium
RVFDVADGLPWPQRFPSRVLTNDFVARWN

SEQ ID NO: 858423 - protein, 33 aa, Mycobacterium
RVFEVQFACMRLGALFVPLNWRLHTTEIQEICR

SEQ ID NO: 858424 - protein, 18 aa, Mycobacterium
RVFFICEGVTQYLTEETV

SEQ ID NO: 858425 - protein, 20 aa, Mycobacterium
RVFGLAARKRIPVVLFAEGG

SEQ ID NO: 858426 - protein, 17 aa, Mycobacterium
RVFIIDEAHMVTTAGFN

SEQ ID NO: 858427 - protein, 18 aa, Mycobacterium
RVFKLPDAVPFDAGAGIL

SEQ ID NO: 858428 - protein, 19 aa, Mycobacterium
RVFKLPDNVSFEAGAGLLF

SEQ ID NO: 858429 - protein, 17 aa, Mycobacterium
RVFLDYCIDLHLAGQLD

SEQ ID NO: 858430 - protein, 17 aa, Mycobacterium
RVFPVPDFQPHIAKLKL

SEQ ID NO: 858431 - protein, 22 aa, Mycobacterium
RVFRLSRISGEITPIGPAGAIA

SEQ ID NO: 858432 - protein, 22 aa, Mycobacterium
RVGAALLRPTAHHLDRLITTVT

SEQ ID NO: 858433 - protein, 30 aa, Mycobacterium
RVGADPVAQLPLIAGPRPALVPLSFAQSRL

SEQ ID NO: 858434 - protein, 17 aa, Mycobacterium
RVGALSFPLGKQQRPAP

SEQ ID NO: 858435 - protein, 17 aa, Mycobacterium
RVGDKRVLALVKSFLKA

SEQ ID NO: 858436 - protein, 32 aa, Mycobacterium
RVGEIAARLFYAYADILLALDRKAEAVQWFLH

SEQ ID NO: 858437 - protein, 18 aa, Mycobacterium
RVGEWAPATFRLHAGDRT

SEQ ID NO: 858438 - protein, 17 aa, Mycobacterium
RVGFGAMQLPGPGVFGP

SEQ ID NO: 858439 - protein, 19 aa, Mycobacterium
RVGFRAIYPDVYLGEAATP

SEQ ID NO: 858440 - protein, 18 aa, Mycobacterium
RVGFSMALGEHLAYGPQA

SEQ ID NO: 858441 - protein, 19 aa, Mycobacterium
RVGGDWYLVTPLDGDGTIG

SEQ ID NO: 858442 - protein, 24 aa, Mycobacterium
RVGGSRQIILDRDLQLVVNSLWAS

SEQ ID NO: 858443 - protein, 29 aa, Mycobacterium
RVGHHCALPLHRRFGLAATARASFAVYNT

SEQ ID NO: 858444 - protein, 29 aa, Mycobacterium
RVGHHCAMPLHRRFGLAATARASFAVYNT

SEQ ID NO: 858445 - protein, 17 aa, Mycobacterium
RVGHSYIKALMADTGAI

SEQ ID NO: 858446 - protein, 22 aa, Mycobacterium
RVGIATVYRHFPTREVLARAVY

SEQ ID NO: 858447 - protein, 22 aa, Mycobacterium
RVGINFIPMRLTLDLAGSPATA

SEQ ID NO: 858448 - protein, 23 aa, Mycobacterium
RVGISQMHVSRLLAKSLARLRDQ

SEQ ID NO: 858449 - protein, 18 aa, Mycobacterium
RVGKAFRYWPTMTREEHS

SEQ ID NO: 858450 - protein, 29 aa, Mycobacterium
RVGLARALFRSPELLLLDEPFGALDAFTR

SEQ ID NO: 858451 - protein, 34 aa, Mycobacterium
RVGLFFANGIEWITWWLAVSRIGAVAVPLSTLYT

SEQ ID NO: 858452 - protein, 20 aa, Mycobacterium
RVGLKWPNDVLAGPGDSPGK

SEQ ID NO: 858453 - protein, 19 aa, Mycobacterium
RVGLPWQTIGAFLRIATHP

SEQ ID NO: 858454 - protein, 23 aa, Mycobacterium
RVGLRIVVVLKRDAVAKVVLNNL

SEQ ID NO: 858455 - protein, 19 aa, Mycobacterium
RVGLRPDVRRVPIFGLGCV

SEQ ID NO: 858456 - protein, 18 aa, Mycobacterium
RVGMFPAVDPEDVSALTA

SEQ ID NO: 858457 - protein, 18 aa, Mycobacterium
RVGMLIDYDKTFPEAART

SEQ ID NO: 858458 - protein, 21 aa, Mycobacterium
RVGNYGMLLLSRIPLSQVTYT

SEQ ID NO: 858459 - protein, 25 aa, Mycobacterium
RVGPRNRMISWPYTKLMNSNNMVDQ

SEQ ID NO: 858460 - protein, 19 aa, Mycobacterium
RVGPWGDDLGRRPGGLTLD

SEQ ID NO: 858461 - protein, 33 aa, Mycobacterium
RVGQSYPFAPPVGLMYVLWDDDALRAWLDKSPT

SEQ ID NO: 858462 - protein, 17 aa, Mycobacterium
RVGRRTRQWIKTPHRCS

SEQ ID NO: 858463 - protein, 30 aa, Mycobacterium
RVGSDRARFSPFQKLIILDVPDDKVDELVT

SEQ ID NO: 858464 - protein, 33 aa, Mycobacterium
RVGTASVRFLMSVGDLLIGWLLQRQAAVAIEAL

SEQ ID NO: 858465 - protein, 22 aa, Mycobacterium
RVGTFQFAPLLMRASGNTDLLR

SEQ ID NO: 858466 - protein, 17 aa, Mycobacterium
RVGTIGSPAPLPRQVFA

SEQ ID NO: 858467 - protein, 20 aa, Mycobacterium
RVGVADFRRSLERVMPRDKD

SEQ ID NO: 858468 - protein, 20 aa, Mycobacterium
RVGVFAACNKLAFAPDTLAD

SEQ ID NO: 858469 - protein, 17 aa, Mycobacterium
RVGVFRPITRGDGAPRD

SEQ ID NO: 858470 - protein, 33 aa, Mycobacterium
RVGVMLPNVPYFAVAYYGVLRAGGVVVPMNVLL

SEQ ID NO: 858471 - protein, 19 aa, Mycobacterium
RVGVWRFMSLRHAVDDNRD

SEQ ID NO: 858472 - protein, 17 aa, Mycobacterium
RVGWIRRLFELSCAQYD

SEQ ID NO: 858473 - protein, 26 aa, Mycobacterium
RVHAAILDLLSRICDPLTGIKEVWDL

SEQ ID NO: 858474 - protein, 19 aa, Mycobacterium
RVHAPWFRGDAVRAVAIEQ

SEQ ID NO: 858475 - protein, 18 aa, Mycobacterium
RVHAVSTGGFRAERVDDG

SEQ ID NO: 858476 - protein, 20 aa, Mycobacterium
RVHDLAGPLDWLPSQSVDAV

SEQ ID NO: 858477 - protein, 19 aa, Mycobacterium
RVHETFTDLSMKRASLSGI

SEQ ID NO: 858478 - protein, 24 aa, Mycobacterium
RVHFAALRHPCCGDLVYGADPKLA

SEQ ID NO: 858479 - protein, 27 aa, Mycobacterium
RVHGALYEAGWMRYGWPTEVGGLGGPA

SEQ ID NO: 858480 - protein, 20 aa, Mycobacterium
RVHGPLALAVGRRLRDRYGL

SEQ ID NO: 858481 - protein, 19 aa, Mycobacterium
RVHGPLALAVGRRLRERYG

SEQ ID NO: 858482 - protein, 17 aa, Mycobacterium
RVHGPLTGLYARHALAV

SEQ ID NO: 858483 - protein, 21 aa, Mycobacterium
RVHIAPLLHDFRRRHRSVEIS

SEQ ID NO: 858484 - protein, 26 aa, Mycobacterium
RVHLKGHFAPLRHAAAYWRDEFKAGN

SEQ ID NO: 858485 - protein, 21 aa, Mycobacterium
RVHLLAHDWGSIQGWAAVTAD

SEQ ID NO: 858486 - protein, 19 aa, Mycobacterium
RVHLLGHDWGAIQGWTAVT

SEQ ID NO: 858487 - protein, 20 aa, Mycobacterium
RVHLLGHDWGSIQAWAAVTD

SEQ ID NO: 858488 - protein, 17 aa, Mycobacterium
RVHLRHAARIRQAGTVL

SEQ ID NO: 858489 - protein, 26 aa, Mycobacterium
RVHNLGKPPRMLVLLHLDGSGDRPST

SEQ ID NO: 858490 - protein, 25 aa, Mycobacterium
RVHNLGKPPRMLVLLHLDGSTDRPS

SEQ ID NO: 858491 - protein, 26 aa, Mycobacterium
RVHNLGKPPRMLVLLHLDGSVDRPST

SEQ ID NO: 858492 - protein, 25 aa, Mycobacterium
RVHNLGKPPRMLVLVHLDGDGDRPS

SEQ ID NO: 858493 - protein, 26 aa, Mycobacterium
RVHNLGRPPRMLVLLHLDGSSDRPAT

SEQ ID NO: 858494 - protein, 26 aa, Mycobacterium
RVHNLGRPPRMLVLLHLDGSVERPST

SEQ ID NO: 858495 - protein, 29 aa, Mycobacterium
RVHNPLARGVPVLLTHGFGATAGMWEPNV

SEQ ID NO: 858496 - protein, 19 aa, Mycobacterium
RVHNPLDLAAVAPLPVLVA

SEQ ID NO: 858497 - protein, 22 aa, Mycobacterium
RVHQLNPFALLASEGVPLAFGS

SEQ ID NO: 858498 - protein, 20 aa, Mycobacterium
RVHQVAVLPGAAYCEMALAA

SEQ ID NO: 858499 - protein, 17 aa, Mycobacterium
RVHRLLRRVVHCPSCGR

SEQ ID NO: 858500 - protein, 18 aa, Mycobacterium
RVHRPDTVALWRKVSTVE

SEQ ID NO: 858501 - protein, 19 aa, Mycobacterium
RVHRSYLVALKLVTGLRTS

SEQ ID NO: 858502 - protein, 25 aa, Mycobacterium
RVHRVPARMFPKVTTLPLGVPTPRL

SEQ ID NO: 858503 - protein, 32 aa, Mycobacterium
RVHRVPSRMFPKITSLPLGVPRPRMIGVLRGF

SEQ ID NO: 858504 - protein, 22 aa, Mycobacterium
RVHSLHGYFLRPGDAKERTVFL

SEQ ID NO: 858505 - protein, 21 aa, Mycobacterium
RVHTALPHPAGVQPTGVAVDH

SEQ ID NO: 858506 - protein, 23 aa, Mycobacterium
RVHTLNGRRLPPAPIAAAFAELV

SEQ ID NO: 858507 - protein, 27 aa, Mycobacterium
RVHTTSRVWAFQLQSILARLGHYATVE

SEQ ID NO: 858508 - protein, 18 aa, Mycobacterium
RVHVWPDCDRAWATPWPG

SEQ ID NO: 858509 - protein, 18 aa, Mycobacterium
RVHWRSREYFPAGTKVHV

SEQ ID NO: 858510 - protein, 17 aa, Mycobacterium
RVIAEAFHIARSGRPGA

SEQ ID NO: 858511 - protein, 20 aa, Mycobacterium
RVIAQRLPSHAWPDRVLRIT

SEQ ID NO: 858512 - protein, 17 aa, Mycobacterium
RVIAVDLVPERLGRAAQ

SEQ ID NO: 858513 - protein, 17 aa, Mycobacterium
RVICFNPMVLPGDQQQV

SEQ ID NO: 858514 - protein, 19 aa, Mycobacterium
RVIDLTAFWAGPAATHLLA

SEQ ID NO: 858515 - protein, 18 aa, Mycobacterium
RVIDSWTPIPGRFPSYLV

SEQ ID NO: 858516 - protein, 25 aa, Mycobacterium
RVIDSYLPGCWLDSGPFGCLGSGPG

SEQ ID NO: 858517 - protein, 17 aa, Mycobacterium
RVIGMLLGIPEEDQRRV

SEQ ID NO: 858518 - protein, 24 aa, Mycobacterium
RVIGRLTDLGWGARLRRLLDAEDA

SEQ ID NO: 858519 - protein, 19 aa, Mycobacterium
RVIHGPDKVARFLLGLMER

SEQ ID NO: 858520 - protein, 19 aa, Mycobacterium
RVIHGPEKVARFLFGLARR

SEQ ID NO: 858521 - protein, 18 aa, Mycobacterium
RVILRFGAAYGSSVLADH

SEQ ID NO: 858522 - protein, 18 aa, Mycobacterium
RVIPLASMDIAKGGLLGG

SEQ ID NO: 858523 - protein, 18 aa, Mycobacterium
RVIPLLALEGRAWDTGPE

SEQ ID NO: 858524 - protein, 19 aa, Mycobacterium
RVIQWATGGVGKAAIQCVL

SEQ ID NO: 858525 - protein, 19 aa, Mycobacterium
RVIRDVVIPPKSTVSFGEP

SEQ ID NO: 858526 - protein, 19 aa, Mycobacterium
RVIRGSDKVARFLLGLGAK

SEQ ID NO: 858527 - protein, 18 aa, Mycobacterium
RVIRYIFEGLRGRGTLID

SEQ ID NO: 858528 - protein, 22 aa, Mycobacterium
RVISRLLGLPEDDLPWFRKRAV

SEQ ID NO: 858529 - protein, 20 aa, Mycobacterium
RVIVLPTYTYGTWSEKVVAA

SEQ ID NO: 858530 - protein, 17 aa, Mycobacterium
RVIVTLHGPDFPEFARS

SEQ ID NO: 858531 - protein, 30 aa, Mycobacterium
RVKAQLRELLLLVADMPYLADACTTAIMAD

SEQ ID NO: 858532 - protein, 27 aa, Mycobacterium
RVKASRYLWPRVEVEVGFLLNADLPGA

SEQ ID NO: 858533 - protein, 20 aa, Mycobacterium
RVKATLPRLGELPIGGTAVG

SEQ ID NO: 858534 - protein, 18 aa, Mycobacterium
RVKIMSLLFGSPAGEEIS

SEQ ID NO: 858535 - protein, 31 aa, Mycobacterium
RVKLELAVDAVVPLPGFVLKRAVKGTVESGL

SEQ ID NO: 858536 - protein, 17 aa, Mycobacterium
RVKLFEWSNQMTGYDEA

SEQ ID NO: 858537 - protein, 18 aa, Mycobacterium
RVKMLRSFDPRTGAHTPD

SEQ ID NO: 858538 - protein, 23 aa, Mycobacterium
RVKPLLFPMTMGEEPFVFHGQFT

SEQ ID NO: 858539 - protein, 23 aa, Mycobacterium
RVKPLLFPMTMGQEPYVFHGQFT

SEQ ID NO: 858540 - protein, 23 aa, Mycobacterium
RVKRPQLGIANWVVPSIVAFGTE

SEQ ID NO: 858541 - protein, 25 aa, Mycobacterium
RVKRPQMGIAAWIIPSIVAFGTDEQ

SEQ ID NO: 858542 - protein, 24 aa, Mycobacterium
RVKRPQMGIASWIIPSIVAFGTDE

SEQ ID NO: 858543 - protein, 27 aa, Mycobacterium
RVKRPQVGIAAWILPSIVAFGTEEQKQ

SEQ ID NO: 858544 - protein, 22 aa, Mycobacterium
RVKRRAFADQPYWGRPVPSWGA

SEQ ID NO: 858545 - protein, 29 aa, Mycobacterium
RVKSYKEFWQQWIWEDWAGSYIERLEPFG

SEQ ID NO: 858546 - protein, 18 aa, Mycobacterium
RVLAAILFEQTMDRQIAG

SEQ ID NO: 858547 - protein, 29 aa, Mycobacterium
RVLAAPVVMVAPVVWVPKGLQVQVLSVVV

SEQ ID NO: 858548 - protein, 18 aa, Mycobacterium
RVLADDQLCGFFTGTNMN

SEQ ID NO: 858549 - protein, 17 aa, Mycobacterium
RVLADMERAGIAVDLRL

SEQ ID NO: 858550 - protein, 27 aa, Mycobacterium
RVLAGSRIPLCLDTGHLLIGGTDPLAL

SEQ ID NO: 858551 - protein, 20 aa, Mycobacterium
RVLAHLAATLPLAADLRPAD

SEQ ID NO: 858552 - protein, 28 aa, Mycobacterium
RVLALLDRLFLPNYLLSMLQVINILPGE

SEQ ID NO: 858553 - protein, 17 aa, Mycobacterium
RVLAPLGLVFDENSPWL

SEQ ID NO: 858554 - protein, 18 aa, Mycobacterium
RVLARNWRCRYGELDVVV

SEQ ID NO: 858555 - protein, 24 aa, Mycobacterium
RVLARVKRIEALLAAVPVSGESAR

SEQ ID NO: 858556 - protein, 17 aa, Mycobacterium
RVLAVCLCAPGVDMITM

SEQ ID NO: 858557 - protein, 19 aa, Mycobacterium
RVLAVLMLMRYEDTDLGQY

SEQ ID NO: 858558 - protein, 20 aa, Mycobacterium
RVLDAIGRPVTIIGASMGGL

SEQ ID NO: 858559 - protein, 22 aa, Mycobacterium
RVLDMTTFWAGPCCTHFLAMLG

SEQ ID NO: 858560 - protein, 21 aa, Mycobacterium
RVLDWLVYGTPLPRLPRLDVV

SEQ ID NO: 858561 - protein, 23 aa, Mycobacterium
RVLDYGRFIAAPWCSAILADMGA

SEQ ID NO: 858562 - protein, 18 aa, Mycobacterium
RVLELCRSWAADLVVVGT

SEQ ID NO: 858563 - protein, 24 aa, Mycobacterium
RVLENIYRALRPGGVLLMVDVKAS

SEQ ID NO: 858564 - protein, 24 aa, Mycobacterium
RVLEVAQFTFVPAAGAILADWGAD

SEQ ID NO: 858565 - protein, 22 aa, Mycobacterium
RVLEVAQFTFVPSAGAVLADWG

SEQ ID NO: 858566 - protein, 18 aa, Mycobacterium
RVLFATQATSRPPTFVLF

SEQ ID NO: 858567 - protein, 18 aa, Mycobacterium
RVLFPADGITKRDLAAYY

SEQ ID NO: 858568 - protein, 33 aa, Mycobacterium
RVLGLVIELLSRRRIFVPILRVTAIEPGAVTLS

SEQ ID NO: 858569 - protein, 17 aa, Mycobacterium
RVLGSRAVGGLLTPPEQ

SEQ ID NO: 858570 - protein, 22 aa, Mycobacterium
RVLGTFLRDVIRRNPDRFRLMG

SEQ ID NO: 858571 - protein, 20 aa, Mycobacterium
RVLHHFLGAGYRPVSVHLPH

SEQ ID NO: 858572 - protein, 18 aa, Mycobacterium
RVLHLDDLMRFLVLAMDT

SEQ ID NO: 858573 - protein, 18 aa, Mycobacterium
RVLHLDDLVRFLVLALDT

SEQ ID NO: 858574 - protein, 21 aa, Mycobacterium
RVLHSAALRRLADKTQVVGPR

SEQ ID NO: 858575 - protein, 21 aa, Mycobacterium
RVLIAAARLIAEGLPVAVAAQ

SEQ ID NO: 858576 - protein, 17 aa, Mycobacterium
RVLIDWTGAHLAEVEVN

SEQ ID NO: 858577 - protein, 18 aa, Mycobacterium
RVLIGPDARVFDAIPRIL

SEQ ID NO: 858578 - protein, 19 aa, Mycobacterium
RVLIGSTADWLLHSSPVPV

SEQ ID NO: 858579 - protein, 18 aa, Mycobacterium
RVLKDNGLTVFHVVPTLA

SEQ ID NO: 858580 - protein, 26 aa, Mycobacterium
RVLKLARQPYYRWLADPVTDAEYVAA

SEQ ID NO: 858581 - protein, 28 aa, Mycobacterium
RVLKLSRQPYYRWLADPITEAELIEAYR

SEQ ID NO: 858582 - protein, 28 aa, Mycobacterium
RVLLGKFVEFWERKLTEGGFNAGCPVVA

SEQ ID NO: 858583 - protein, 19 aa, Mycobacterium
RVLLLEYGRSAACWADRLV

SEQ ID NO: 858584 - protein, 17 aa, Mycobacterium
RVLLMCAEMLKHLDLAG

SEQ ID NO: 858585 - protein, 18 aa, Mycobacterium
RVLLNSKTRRPSVCNAAE

SEQ ID NO: 858586 - protein, 17 aa, Mycobacterium
RVLLPGFVDLHTHLREP

SEQ ID NO: 858587 - protein, 32 aa, Mycobacterium; identical to SEQ ID NO: 131770

SEQ ID NO: 858588 - protein, 17 aa, Mycobacterium
RVLLRYPGVVEVAVYPV

SEQ ID NO: 858589 - protein, 17 aa, Mycobacterium
RVLLTLHRRLGRWVQLG

SEQ ID NO: 858590 - protein, 17 aa, Mycobacterium
RVLLVTLADDDHYLAWV

SEQ ID NO: 858591 - protein, 31 aa, Mycobacterium
RVLMDTWYRIPAFYFACPATVLGPYDDAPMA

SEQ ID NO: 858592 - protein, 19 aa, Mycobacterium
RVLNHLTELRPGSYHVASE

SEQ ID NO: 858593 - protein, 17 aa, Mycobacterium
RVLPIAQERYPERGPHA

SEQ ID NO: 858594 - protein, 25 aa, Mycobacterium
RVLPVSTAEFPRPAPRPAYSALSGR

SEQ ID NO: 858595 - protein, 26 aa, Mycobacterium
RVLQRSWVHVLPSRKEGWGLAVTEAA

SEQ ID NO: 858596 - protein, 17 aa, Mycobacterium
RVLQRTSAWGKHLFHHY

SEQ ID NO: 858597 - protein, 23 aa, Mycobacterium
RVLREWFGQLIQYSMTITLAGKY

SEQ ID NO: 858598 - protein, 17 aa, Mycobacterium
RVLREYALLADGERGAL

SEQ ID NO: 858599 - protein, 17 aa, Mycobacterium
RVLRLAARRSAGAHPYL

SEQ ID NO: 858600 - protein, 17 aa, Mycobacterium
RVLRPGGSLLISTPNRI

SEQ ID NO: 858601 - protein, 31 aa, Mycobacterium
RVLRPGGVLLMSTPNRITFSPGLDAPVNPFH

SEQ ID NO: 858602 - protein, 22 aa, Mycobacterium
RVLRPGGYFLYTDARPRYDIPE

SEQ ID NO: 858603 - protein, 17 aa, Mycobacterium
RVLRRADTFAREHPHLL

SEQ ID NO: 858604 - protein, 17 aa, Mycobacterium
RVLRRRSLAALRAQVEP

SEQ ID NO: 858605 - protein, 18 aa, Mycobacterium
RVLRSSMELGGNAPFVVF

SEQ ID NO: 858606 - protein, 19 aa, Mycobacterium
RVLRTLDIGQACRVTLPGR

SEQ ID NO: 858607 - protein, 18 aa, Mycobacterium
RVLRVAVSPYFYVQERRL

SEQ ID NO: 858608 - protein, 18 aa, Mycobacterium
RVLRVGVADFRRSLDRVM

SEQ ID NO: 858609 - protein, 18 aa, Mycobacterium
RVLRVGVAEFRRSLERVM

SEQ ID NO: 858610 - protein, 18 aa, Mycobacterium
RVLSFLLTSPESVFEDCL

SEQ ID NO: 858611 - protein, 23 aa, Mycobacterium
RVLTGVGAFDPGLGRKAPIYVLE

SEQ ID NO: 858612 - protein, 18 aa, Mycobacterium
RVLTVPLVRGGELVSKPN

SEQ ID NO: 858613 - protein, 31 aa, Mycobacterium
RVLVAIENAIWPDLFIVGGGISRKADKWVHL

SEQ ID NO: 858614 - protein, 17 aa, Mycobacterium
RVLVAVPRTEESRFRAM

SEQ ID NO: 858615 - protein, 20 aa, Mycobacterium
RVLVDLWRVVLKVPRIGVDD

SEQ ID NO: 858616 - protein, 18 aa, Mycobacterium
RVLVDVPCTGLGALRRRP

SEQ ID NO: 858617 - protein, 20 aa, Mycobacterium
RVLVGPAVTISFLPVRKDLM

SEQ ID NO: 858618 - protein, 21 aa, Mycobacterium
RVLVGPAVTISFLPVRKDLMD

SEQ ID NO: 858619 - protein, 29 aa, Mycobacterium
RVLVILVDGLGWHLLPELACDAPLLAAVL

SEQ ID NO: 858620 - protein, 17 aa, Mycobacterium
RVLVLGGGESRDLDVPD

SEQ ID NO: 858621 - protein, 17 aa, Mycobacterium
RVLVMRNTFRKHRERLA

SEQ ID NO: 858622 - protein, 18 aa, Mycobacterium
RVLVTKYGTPAPGPAPDG

SEQ ID NO: 858623 - protein, 18 aa, Mycobacterium
RVLVTKYGTPAPGPAPEG

SEQ ID NO: 858624 - protein, 28 aa, Mycobacterium
RVLYGANRSLPWPTEPLARLWHASTLLR

SEQ ID NO: 858625 - protein, 17 aa, Mycobacterium
RVLYLSPTKALGHDQLR

SEQ ID NO: 858626 - protein, 18 aa, Mycobacterium
RVLYLVDGRFRIGTVEQV

SEQ ID NO: 858627 - protein, 19 aa, Mycobacterium
RVMDATTMPTLLLGGDPTD

SEQ ID NO: 858628 - protein, 17 aa, Mycobacterium
RVMHAAAPCPVDIKKQM

SEQ ID NO: 858629 - protein, 26 aa, Mycobacterium
RVMKKAVAYLLPFIEAEKAQSGSTEQ

SEQ ID NO: 858630 - protein, 25 aa, Mycobacterium
RVMKKAVAYLLPYIEAEKADAGTTG

SEQ ID NO: 858631 - protein, 25 aa, Mycobacterium
RVMKKAVAYLLPYIEAEKKPGDAER

SEQ ID NO: 858632 - protein, 19 aa, Mycobacterium
RVMKLTQYPNQQAGARGCR

SEQ ID NO: 858633 - protein, 18 aa, Mycobacterium
RVMLAEFMSMVRADSVGL

SEQ ID NO: 858634 - protein, 18 aa, Mycobacterium
RVMLALEVVLATSRKEAA

SEQ ID NO: 858635 - protein, 19 aa, Mycobacterium
RVMLGKRRVWISAIVQPSE

SEQ ID NO: 858636 - protein, 17 aa, Mycobacterium
RVMSRFTDLFVAVRARL

SEQ ID NO: 858637 - protein, 32 aa, Mycobacterium
RVMVSDLNFMLIGAAFYRDTYRRTEAGWKISG

SEQ ID NO: 858638 - protein, 24 aa, Mycobacterium
RVNAPLPFVTLNTVGPTLIQYGTE

SEQ ID NO: 858639 - protein, 25 aa, Mycobacterium
RVNASGMVPLKWISARNFGCDGEPL

SEQ ID NO: 858640 - protein, 18 aa, Mycobacterium
RVNFAYGQTLRRAGKRRD

SEQ ID NO: 858641 - protein, 19 aa, Mycobacterium
RVNFRHPAWARSTFTHLPV

SEQ ID NO: 858642 - protein, 40 aa, Mycobacterium
RVNGQLLPILPARLNRALVSALWWVQWRITKSPEDAQRRE

SEQ ID NO: 858643 - protein, 25 aa, Mycobacterium
RVNHNYLNDLWLIRHRKITDEGLRF

SEQ ID NO: 858644 - protein, 37 aa, Mycobacterium
RVNLGTFVAVAPWWHPIRLAHQMAYLDIISNGRYTTL

SEQ ID NO: 858645 - protein, 25 aa, Mycobacterium
RVNLRALPVLVVVEVLFGVQQRVRG

SEQ ID NO: 858646 - protein, 25 aa, Mycobacterium
RVNPAPPLVPYTRGLHQVADRVWAW

SEQ ID NO: 858647 - protein, 18 aa, Mycobacterium
RVNPPLRESADAAALRQA

SEQ ID NO: 858648 - protein, 17 aa, Mycobacterium
RVNPPLREVSDTLALRQ

SEQ ID NO: 858649 - protein, 23 aa, Mycobacterium
RVNRFIPNPTFDPIIVPGCLDVL

SEQ ID NO: 858650 - protein, 32 aa, Mycobacterium
RVNRVILPHMRRQRQGLLVWVSSSSAAGGTPP

SEQ ID NO: 858651 - protein, 24 aa, Mycobacterium
RVNSRQFVLPLEQYPGLTDFGDAN

SEQ ID NO: 858652 - protein, 17 aa, Mycobacterium
RVNSVAPGYIWGETLQA

SEQ ID NO: 858653 - protein, 17 aa, Mycobacterium
RVNSVAPGYIWGETLQG

SEQ ID NO: 858654 - protein, 20 aa, Mycobacterium
RVNTVLPGPILTASWDGIGE

SEQ ID NO: 858655 - protein, 17 aa, Mycobacterium
RVNVFEKLPTPYGLVRA

SEQ ID NO: 858656 - protein, 18 aa, Mycobacterium
RVPAIPGIDHPMVLSYPE

SEQ ID NO: 858657 - protein, 21 aa, Mycobacterium
RVPAPVIAASLFARFASRQED

SEQ ID NO: 858658 - protein, 22 aa, Mycobacterium
RVPAVMILDLIMTPAPREFVAA

SEQ ID NO: 858659 - protein, 28 aa, Mycobacterium
RVPCRTFAAFLNLKQWIKTFTQAGKPGA

SEQ ID NO: 858660 - protein, 34 aa, Mycobacterium
RVPDRLWALQRKLLAPFFVWVTVGLYDPPVRTLM

SEQ ID NO: 858661 - protein, 18 aa, Mycobacterium
RVPELFRGYADTYYSQML

SEQ ID NO: 858662 - protein, 17 aa, Mycobacterium
RVPFIMPGTDELARAVA

SEQ ID NO: 858663 - protein, 19 aa, Mycobacterium
RVPFLKDAFAADITTTGLL

SEQ ID NO: 858664 - protein, 26 aa, Mycobacterium
RVPGAGVINALRWRPHPWGEDLRSTV

SEQ ID NO: 858665 - protein, 19 aa, Mycobacterium
RVPGIPAFIDPEHDRPRPT

SEQ ID NO: 858666 - protein, 17 aa, Mycobacterium
RVPILGSLVRRGMIVIR

SEQ ID NO: 858667 - protein, 18 aa, Mycobacterium
RVPIWVGGRSRRSLRRAV

SEQ ID NO: 858668 - protein, 17 aa, Mycobacterium
RVPLLGADGYPAAWNAR

SEQ ID NO: 858669 - protein, 20 aa, Mycobacterium
RVPLQHLLGTAAFGPVQLRV

SEQ ID NO: 858670 - protein, 39 aa, Mycobacterium
RVPQWGIDSWLFYPNFMLLIWEPGWYLTYHYWPTAVDKH

SEQ ID NO: 858671 - protein, 24 aa, Mycobacterium
RVPRDGRLYGIERALAAGVPVEQV

SEQ ID NO: 858672 - protein, 21 aa, Mycobacterium
RVPSGWRVGEWAPATFRLHAG

SEQ ID NO: 858673 - protein, 21 aa, Mycobacterium
RVPTGLFIGGDWRTTDSTFTV

SEQ ID NO: 858674 - protein, 21 aa, Mycobacterium
RVPVFALGRYAGARRQAILAM

SEQ ID NO: 858675 - protein, 18 aa, Mycobacterium
RVPVGEYIDVLLYRPMEG

SEQ ID NO: 858676 - protein, 18 aa, Mycobacterium
RVPVKRMVFHEITEPAIR

SEQ ID NO: 858677 - protein, 17 aa, Mycobacterium
RVPVLPVLTDGLPRCRQ

SEQ ID NO: 858678 - protein, 20 aa, Mycobacterium
RVPWGQLAMPGLHKFRLMEL

SEQ ID NO: 858679 - protein, 18 aa, Mycobacterium
RVPYRARVPMTRAALMHR

SEQ ID NO: 858680 - protein, 25 aa, Mycobacterium
RVQEGLLDICNLGARIGSRIGRHGL

SEQ ID NO: 858681 - protein, 17 aa, Mycobacterium
RVQEMFAAGWLSAQVVA

SEQ ID NO: 858682 - protein, 17 aa, Mycobacterium
RVQFTPDLLPADLLGST

SEQ ID NO: 858683 - protein, 18 aa, Mycobacterium
RVQGLVGPGWSGDPAADP

SEQ ID NO: 858684 - protein, 24 aa, Mycobacterium
RVQHRSGVLWVLNSAGLAAINRPD

SEQ ID NO: 858685 - protein, 20 aa, Mycobacterium
RVQIHAGPLRFTATEAEAVT

SEQ ID NO: 858686 - protein, 18 aa, Mycobacterium
RVQLARLLVGDWDVIALD

SEQ ID NO: 858687 - protein, 21 aa, Mycobacterium
RVQLATLIATNFFGQNSAAIA

SEQ ID NO: 858688 - protein, 17 aa, Mycobacterium
RVQLEIFTKFSIPINIA

SEQ ID NO: 858689 - protein, 34 aa, Mycobacterium
RVQLLRDLGPAISPFNAFLIAQGLETLSLRVERH

SEQ ID NO: 858690 - protein, 19 aa, Mycobacterium
RVQLLRDLGSAASPFNAFL

SEQ ID NO: 858691 - protein, 21 aa, Mycobacterium
RVQLQRVQIAGRPPFGSAVFA

SEQ ID NO: 858692 - protein, 19 aa, Mycobacterium
RVQMGIGGGWYEHEWRAYG

SEQ ID NO: 858693 - protein, 23 aa, Mycobacterium
RVQNDYYRWYSSRGQKAGAAPAS

SEQ ID NO: 858694 - protein, 23 aa, Mycobacterium
RVQQFRLFAETQTIWAGGGAYTH

SEQ ID NO: 858695 - protein, 21 aa, Mycobacterium
RVQQLQAMLTPIKDPAGSGKL

SEQ ID NO: 858696 - protein, 17 aa, Mycobacterium
RVQRAIKRRGRPLTDDR

SEQ ID NO: 858697 - protein, 25 aa, Mycobacterium
RVQSDPIPIKSLFTGASSTSAGAFV

SEQ ID NO: 858698 - protein, 22 aa, Mycobacterium
RVQTARLWGAAAISAALVTATV

SEQ ID NO: 858699 - protein, 17 aa, Mycobacterium
RVQYADYAAWQGAFLGD

SEQ ID NO: 858700 - protein, 18 aa, Mycobacterium
RVRADFGAWLETHFALGA

SEQ ID NO: 858701 - protein, 20 aa, Mycobacterium
RVRADYWPDSLIRSVAQEYG

SEQ ID NO: 858702 - protein, 22 aa, Mycobacterium
RVRAERINRWRVATAEASYSVV

SEQ ID NO: 858703 - protein, 26 aa, Mycobacterium
RVRAHALFPGGFLNTGIWESWRHRPQ

SEQ ID NO: 858704 - protein, 25 aa, Mycobacterium
RVRAHVLFPGGFLNTGIWESWRHRP

SEQ ID NO: 858705 - protein, 25 aa, Mycobacterium
RVRAHVLFPSGFLNTGIWESWRHRP

SEQ ID NO: 858706 - protein, 18 aa, Mycobacterium
RVRAIPGKEPWEHGAIST

SEQ ID NO: 858707 - protein, 17 aa, Mycobacterium
RVRAMILDSPLLSRHDI

SEQ ID NO: 858708 - protein, 20 aa, Mycobacterium
RVRAMLRRPRRAPESPAAVT

SEQ ID NO: 858709 - protein, 20 aa, Mycobacterium
RVRAQSLAPELERRLEDVNS

SEQ ID NO: 858710 - protein, 25 aa, Mycobacterium
RVRATREIWVLLGPDLRGAWVHSND

SEQ ID NO: 858711 - protein, 18 aa, Mycobacterium
RVRCAAFVICRADLAGLG

SEQ ID NO: 858712 - protein, 24 aa, Mycobacterium
RVRCSMWSPRLLQISARVIGERGE

SEQ ID NO: 858713 - protein, 29 aa, Mycobacterium
RVRDLPVLLLAQQLMAPMLMHLFVRPTSA

SEQ ID NO: 858714 - protein, 25 aa, Mycobacterium
RVRDPARHVADRRALLLGRRQRGRP

SEQ ID NO: 858715 - protein, 24 aa, Mycobacterium
RVRDWLSVDHALVGDFFATRTVAG

SEQ ID NO: 858716 - protein, 19 aa, Mycobacterium
RVRDYIRLGRDEGARLVTG

SEQ ID NO: 858717 - protein, 23 aa, Mycobacterium
RVRESFDLFEDLLGGVVVESFGK

SEQ ID NO: 858718 - protein, 21 aa, Mycobacterium
RVRFGTAYDIEFQRWVAAVRH

SEQ ID NO: 858719 - protein, 17 aa, Mycobacterium
RVRFGTLNPVERPVAVG

SEQ ID NO: 858720 - protein, 30 aa, Mycobacterium
RVRGEPLPWQDLRAAFTERGWLDLTHTRRE

SEQ ID NO: 858721 - protein, 26 aa, Mycobacterium
RVRGIVLGNTWFWPADTLTMKAFSTV

SEQ ID NO: 858722 - protein, 19 aa, Mycobacterium
RVRGRGIPKRAGGNGDLLV

SEQ ID NO: 858723 - protein, 18 aa, Mycobacterium
RVRGRGVPKRAGGHGDLL

SEQ ID NO: 858724 - protein, 26 aa, Mycobacterium
RVRGVPAIFDPLAKIGGQWMFGRALD

SEQ ID NO: 858725 - protein, 19 aa, Mycobacterium
RVRHLLDRYGSLIDEVLAL

SEQ ID NO: 858726 - protein, 20 aa, Mycobacterium
RVRHPLYGKIIRTTKKVKVH

SEQ ID NO: 858727 - protein, 17 aa, Mycobacterium
RVRIGGQWRTGTAHLLP

SEQ ID NO: 858728 - protein, 17 aa, Mycobacterium
RVRIWNGTTPWLVTGHE

SEQ ID NO: 858729 - protein, 23 aa, Mycobacterium
RVRLDRYLYTAMGYPTDYGYIED

SEQ ID NO: 858730 - protein, 25 aa, Mycobacterium
RVRLEVGPYCRVGFHRYHSSALVTD

SEQ ID NO: 858731 - protein, 33 aa, Mycobacterium
RVRLMMEMHVLAPLHLTQLAIPAMRERRRGWVL

SEQ ID NO: 858732 - protein, 22 aa, Mycobacterium
RVRLNRAVELTDVLLGLCTADS

SEQ ID NO: 858733 - protein, 20 aa, Mycobacterium
RVRLRFINNSMMFHPMHLHG

SEQ ID NO: 858734 - protein, 32 aa, Mycobacterium
RVRLTNFEGPFDLLLQLIFAHRLDVTEVALHQ

SEQ ID NO: 858735 - protein, 19 aa, Mycobacterium
RVRLTPTGLLLARRGREII

SEQ ID NO: 858736 - protein, 20 aa, Mycobacterium
RVRLTRRHDPAVERPVIAQA

SEQ ID NO: 858737 - protein, 18 aa, Mycobacterium
RVRLYTDGSRRVLLRRKK

SEQ ID NO: 858738 - protein, 20 aa, Mycobacterium
RVRMQQRWPIVMVDEFQDTD

SEQ ID NO: 858739 - protein, 21 aa, Mycobacterium
RVRNYYLPIEAYARAFRHAGF

SEQ ID NO: 858740 - protein, 23 aa, Mycobacterium
RVRPGLYQLLESLTGTPAMILGR

SEQ ID NO: 858741 - protein, 21 aa, Mycobacterium
RVRPLADRRFGRRRGFGYDLM

SEQ ID NO: 858742 - protein, 20 aa, Mycobacterium
RVRPLPAGLFSRVEDFARKC

SEQ ID NO: 858743 - protein, 20 aa, Mycobacterium
RVRPPWWLKATNKVMMIVSR

SEQ ID NO: 858744 - protein, 23 aa, Mycobacterium
RVRQPDGFQLPHPPRDAREFPTS

SEQ ID NO: 858745 - protein, 17 aa, Mycobacterium
RVRQQVIQLLSGYQGKE

SEQ ID NO: 858746 - protein, 18 aa, Mycobacterium
RVRQQVIQLLSGYQGKET

SEQ ID NO: 858747 - protein, 29 aa, Mycobacterium
RVRRFWPRRYRRSSFYWKLISLDRRFGIS

SEQ ID NO: 858748 - protein, 20 aa, Mycobacterium
RVRRGPLCLGIDPHPELLRS

SEQ ID NO: 858749 - protein, 25 aa, Mycobacterium
RVRRPFGAPLPEALTSRFVLAPAAR

SEQ ID NO: 858750 - protein, 19 aa, Mycobacterium
RVRRRVRRVRRVQPAPGAA

SEQ ID NO: 858751 - protein, 17 aa, Mycobacterium
RVRSMILDSPLLSRDDI

SEQ ID NO: 858752 - protein, 20 aa, Mycobacterium
RVRSWLVLPEGDHPAPLLLW

SEQ ID NO: 858753 - protein, 38 aa, Mycobacterium
RVRTELGWEFIQIYGLTETAPLITMNRFRSEWAGLDVQ

SEQ ID NO: 858754 - protein, 25 aa, Mycobacterium
RVRTHSVWWPVDVPPDALAAALVPM

SEQ ID NO: 858755 - protein, 21 aa, Mycobacterium
RVRTLLSFLRKQLAQRCIPLP

SEQ ID NO: 858756 - protein, 20 aa, Mycobacterium
RVRTRLARLAGAGLAPGSGA

SEQ ID NO: 858757 - protein, 26 aa, Mycobacterium
RVRTSGLVTVAPYIARMMPELLSIEC

SEQ ID NO: 858758 - protein, 20 aa, Mycobacterium
RVRVELLRELAATGESLVAT

SEQ ID NO: 858759 - protein, 19 aa, Mycobacterium
RVRWQLDGWLARRRCLDGP

SEQ ID NO: 858760 - protein, 25 aa, Mycobacterium
RVRYGDLLVKTGGEWRFQTMVQGGW

SEQ ID NO: 858761 - protein, 18 aa, Mycobacterium
RVRYPAHTSLIHDGADKL

SEQ ID NO: 858762 - protein, 22 aa, Mycobacterium
RVSAFFEFLKTRIATARKYGPA

SEQ ID NO: 858763 - protein, 24 aa, Mycobacterium
RVSALIAQLGPVLGDMPLGAHFHN

SEQ ID NO: 858764 - protein, 19 aa, Mycobacterium
RVSALIGLFVNTVPLRARV

SEQ ID NO: 858765 - protein, 30 aa, Mycobacterium
RVSDRVPTYALYIDPPLGRAGLTEAQVRAS

SEQ ID NO: 858766 - protein, 20 aa, Mycobacterium
RVSEAWALLVSKLRAAHLRE

SEQ ID NO: 858767 - protein, 25 aa, Mycobacterium
RVSELPYLVPILEQSFDHPDYFLVV

SEQ ID NO: 858768 - protein, 25 aa, Mycobacterium
RVSFDALRRALPHRRGLVVLSGDRT

SEQ ID NO: 858769 - protein, 28 aa, Mycobacterium
RVSFGFTTPGKPALLRPALDDDSHPTGP

SEQ ID NO: 858770 - protein, 19 aa, Mycobacterium
RVSFGFTTPGKPALLRPAS

SEQ ID NO: 858771 - protein, 23 aa, Mycobacterium
RVSFGFTTPGKPALLRPASADDS

SEQ ID NO: 858772 - protein, 23 aa, Mycobacterium
RVSFGFTTPGKPALLRPASAEDA

SEQ ID NO: 858773 - protein, 22 aa, Mycobacterium
RVSGFVHFLQASAAFQFHRGPD

SEQ ID NO: 858774 - protein, 24 aa, Mycobacterium
RVSGTILCKVADLMEKVGSERARF

SEQ ID NO: 858775 - protein, 32 aa, Mycobacterium
RVSGYDIPYPAPRLERWYLPSTDRILDAVDRL

SEQ ID NO: 858776 - protein, 24 aa, Mycobacterium
RVSHQVLLWVIRLQHETKVTVLFP

SEQ ID NO: 858777 - protein, 30 aa, Mycobacterium; identical to SEQ ID NO: 131799

SEQ ID NO: 858778 - protein, 18 aa, Mycobacterium
RVSKAGLPPQLIPSGITS

SEQ ID NO: 858779 - protein, 31 aa, Mycobacterium
RVSLGTFVAVVPWWNPIRLATQIAYLDIVSN

SEQ ID NO: 858780 - protein, 37 aa, Mycobacterium
RVSLGTFVVVAPWWHPVRLAHQIAYLDILSNGRYTTI

SEQ ID NO: 858781 - protein, 18 aa, Mycobacterium
RVSLNQWVVQKLAARPMV

SEQ ID NO: 858782 - protein, 22 aa, Mycobacterium
RVSLVLKADIRPGFTGQLTAKV

SEQ ID NO: 858783 - protein, 33 aa, Mycobacterium
RVSMGHALLVPFARLPEWPKSLYRLRDSGFRLL

SEQ ID NO: 858784 - protein, 26 aa, Mycobacterium
RVSMGHALLVPYARAADWPADLLMLQ

SEQ ID NO: 858785 - protein, 26 aa, Mycobacterium
RVSMGHALLVPYARATCWPAELMTLK

SEQ ID NO: 858786 - protein, 20 aa, Mycobacterium
RVSPEGEVPLRRALAYPVSD

SEQ ID NO: 858787 - protein, 18 aa, Mycobacterium
RVSPFPAVFQDLSLVVAA

SEQ ID NO: 858788 - protein, 28 aa, Mycobacterium
RVSRLHAKLFYQPLLESIAPAGLEIAGR

SEQ ID NO: 858789 - protein, 28 aa, Mycobacterium
RVSRLHAKLFYQPLLESIGPAGLEIAGR

SEQ ID NO: 858790 - protein, 25 aa, Mycobacterium
RVSRRLVAMLARRGYSQTVACEVVI

SEQ ID NO: 858791 - protein, 19 aa, Mycobacterium
RVSRSGWYGIDPVAADLFT

SEQ ID NO: 858792 - protein, 23 aa, Mycobacterium
RVSSLCRGGFLTGFEEDHALADN

SEQ ID NO: 858793 - protein, 28 aa, Mycobacterium
RVSSLIAQLRPVLGDLPLGGHFHNTRGS

SEQ ID NO: 858794 - protein, 33 aa, Mycobacterium
RVSVAMPMFHGLGLGMLMLTVALGGTVLTHRHF

SEQ ID NO: 858795 - protein, 24 aa, Mycobacterium
RVSYDANWLGRRFVVQDTGGWEPD

SEQ ID NO: 858796 - protein, 24 aa, Mycobacterium
RVTAGAARWLVLSGPPGIGKTRLA

SEQ ID NO: 858797 - protein, 19 aa, Mycobacterium
RVTAMLEYFSLYEEKNDGP

SEQ ID NO: 858798 - protein, 17 aa, Mycobacterium
RVTDKFGWLAEPFCDDA

SEQ ID NO: 858799 - protein, 21 aa, Mycobacterium
RVTEIALVFKRAPHLPFDATM

SEQ ID NO: 858800 - protein, 24 aa, Mycobacterium
RVTFAAFPWRWKKGDGCIVRLVAI

SEQ ID NO: 858801 - protein, 21 aa, Mycobacterium
RVTFAAFPWRWVGGDGCIVRL

SEQ ID NO: 858802 - protein, 18 aa, Mycobacterium
RVTGFVTWPGFARQQQIG

SEQ ID NO: 858803 - protein, 21 aa, Mycobacterium
RVTGIFLVPAQWQAVCAEQQA

SEQ ID NO: 858804 - protein, 26 aa, Mycobacterium
RVTGIMGMDPFRCDLLASGGLDDRKS

SEQ ID NO: 858805 - protein, 19 aa, Mycobacterium
RVTGPAPGTWYASGSVGRG

SEQ ID NO: 858806 - protein, 31 aa, Mycobacterium
RVTHVLLPVMALLRRGYGAQTIWNALVLRSR

SEQ ID NO: 858807 - protein, 23 aa, Mycobacterium
RVTICCRIPTHGTPPRVGVAFAA

SEQ ID NO: 858808 - protein, 17 aa, Mycobacterium
RVTLVEKHDLAFGTSRF

SEQ ID NO: 858809 - protein, 21 aa, Mycobacterium
RVTLYGLPLVPRRRVNYAQID

SEQ ID NO: 858810 - protein, 22 aa, Mycobacterium
RVTMRLMQAVHPVMVAAGGGSI

SEQ ID NO: 858811 - protein, 26 aa, Mycobacterium
RVTNMLLVPAVIQFLLDTTGLDDTDL

SEQ ID NO: 858812 - protein, 26 aa, Mycobacterium
RVTNPSPYMYLIQVPNDHGSVEFSIV

SEQ ID NO: 858813 - protein, 25 aa, Mycobacterium
RVTNPSPYMYLLNVPDHDGGLDFSI

SEQ ID NO: 858814 - protein, 28 aa, Mycobacterium
RVTPDANSIAWLLWHSARVQDIQLADVA

SEQ ID NO: 858815 - protein, 20 aa, Mycobacterium
RVTPFAYMEPVKVAGSTVGL

SEQ ID NO: 858816 - protein, 21 aa, Mycobacterium
RVTPFAYMEPVKVAGSTVGLA

SEQ ID NO: 858817 - protein, 23 aa, Mycobacterium
RVTPGPPRPGYLPTIIDGAAQHG

SEQ ID NO: 858818 - protein, 20 aa, Mycobacterium
RVTPGPPRPGYLPTIIDGAV

SEQ ID NO: 858819 - protein, 22 aa, Mycobacterium
RVTQFIPLLSEVEQKVIACFRD

SEQ ID NO: 858820 - protein, 20 aa, Mycobacterium
RVTRALLPKLIESGDGLIVT

SEQ ID NO: 858821 - protein, 21 aa, Mycobacterium
RVTRLHATWTGQAAAAHAEAH

SEQ ID NO: 858822 - protein, 26 aa, Mycobacterium
RVTRPGGLAVLSYTVWLGPFGGHEMG

SEQ ID NO: 858823 - protein, 25 aa, Mycobacterium
RVTRRLVGMLARRGYSQNLACEVVF

SEQ ID NO: 858824 - protein, 23 aa, Mycobacterium
RVTRRRACWLNQTFKSALDALED

SEQ ID NO: 858825 - protein, 17 aa, Mycobacterium
RVTTHWAFAERLASEFP

SEQ ID NO: 858826 - protein, 17 aa, Mycobacterium
RVTVNCGIFGWTPTVQL

SEQ ID NO: 858827 - protein, 26 aa, Mycobacterium
RVVAGGIIRSGMWRGPRVRKPWKMYD

SEQ ID NO: 858828 - protein, 36 aa, Mycobacterium
RVVAGWRVVALEPYGGAWLNSWLDRDLGISGRLSVR

SEQ ID NO: 858829 - protein, 19 aa, Mycobacterium
RVVAPHRLTDPKAGPLIAV

SEQ ID NO: 858830 - protein, 18 aa, Mycobacterium
RVVAPHRLTDPKAGPMIA

SEQ ID NO: 858831 - protein, 19 aa, Mycobacterium
RVVAPHRLTDPKAGPMIAV

SEQ ID NO: 858832 - protein, 23 aa, Mycobacterium
RVVASDETLFVRDSRQDNTFAGN

SEQ ID NO: 858833 - protein, 23 aa, Mycobacterium
RVVDKLLHAPTVRVKQLASAPGG

SEQ ID NO: 858834 - protein, 21 aa, Mycobacterium
RVVDYLGGPWKLFGVARIIPA

SEQ ID NO: 858835 - protein, 25 aa, Mycobacterium
RVVELAAWTFVPAAGAVLADWGADV

SEQ ID NO: 858836 - protein, 17 aa, Mycobacterium
RVVELAGIGPGPHAAMI

SEQ ID NO: 858837 - protein, 27 aa, Mycobacterium
RVVELTKVWAGPYAGKLLALLGAEVIK

SEQ ID NO: 858838 - protein, 27 aa, Mycobacterium
RVVEWRLDLPLTMFPRTPHDVWQELAS

SEQ ID NO: 858839 - protein, 17 aa, Mycobacterium
RVVGPPMHITLGSMGLG

SEQ ID NO: 858840 - protein, 31 aa, Mycobacterium
RVVGPRHLRDPLLQFGRPLDVDARAAVVGDR

SEQ ID NO: 858841 - protein, 18 aa, Mycobacterium
RVVHDDLYRGALPTLTAD

SEQ ID NO: 858842 - protein, 17 aa, Mycobacterium
RVVHSLEASQRRVYPDP

SEQ ID NO: 858843 - protein, 24 aa, Mycobacterium
RVVIVRTGLVLSPAGGLFGRSRPL

SEQ ID NO: 858844 - protein, 17 aa, Mycobacterium
RVVIWAATQFDVLACRA

SEQ ID NO: 858845 - protein, 31 aa, Mycobacterium
RVVLARQAIWPHRMFSLLAGFVEAGESFEVC

SEQ ID NO: 858846 - protein, 18 aa, Mycobacterium
RVVLASCPALPEGDGDDD

SEQ ID NO: 858847 - protein, 17 aa, Mycobacterium
RVVLATVLDTLLRLLHP

SEQ ID NO: 858848 - protein, 26 aa, Mycobacterium
RVVLDESLVYLALNKPRGMHSTMADD

SEQ ID NO: 858849 - protein, 26 aa, Mycobacterium
RVVLDESLVYLALNKPRGMHSTMSDD

SEQ ID NO: 858850 - protein, 31 aa, Mycobacterium
RVVLIHWDDFFRPLDKPLRALPFVADNLDVS

SEQ ID NO: 858851 - protein, 22 aa, Mycobacterium
RVVLLPSDHPLAQHDSLTLADI

SEQ ID NO: 858852 - protein, 18 aa, Mycobacterium
RVVLLTGEGRNFCAGGDI

SEQ ID NO: 858853 - protein, 17 aa, Mycobacterium
RVVLPRDAVAGIPADYG

SEQ ID NO: 858854 - protein, 21 aa, Mycobacterium
RVVNAIPAVFAAPPGIRTTLD

SEQ ID NO: 858855 - protein, 25 aa, Mycobacterium
RVVNFLERYFPIPAPWEKVAADINP

SEQ ID NO: 858856 - protein, 19 aa, Mycobacterium
RVVNILSAHYRDPGLLLGQ

SEQ ID NO: 858857 - protein, 28 aa, Mycobacterium
RVVPEDRWWADDFVSPAPPYGTGKVNTR

SEQ ID NO: 858858 - protein, 17 aa, Mycobacterium
RVVQLCHPDLRNDFPPL

SEQ ID NO: 858859 - protein, 24 aa, Mycobacterium
RVVQLLGLLQSRRVWTGEELAERL

SEQ ID NO: 858860 - protein, 20 aa, Mycobacterium
RVVRHWMDHGVKFFRVDNPH

SEQ ID NO: 858861 - protein, 20 aa, Mycobacterium
RVVRPIYGPSLDGTLPGNEV

SEQ ID NO: 858862 - protein, 25 aa, Mycobacterium
RVVSGDRMWSWLPSVWGCRYPLDIT

SEQ ID NO: 858863 - protein, 25 aa, Mycobacterium
RVVSGRPWTMSYLTDPWGTVIELMS

SEQ ID NO: 858864 - protein, 29 aa, Mycobacterium
RVVSSPRVLADLFWLGRYAERAESTARLL

SEQ ID NO: 858865 - protein, 22 aa, Mycobacterium
RVVTEYLPYVRSASVGVWVGVG

SEQ ID NO: 858866 - protein, 33 aa, Mycobacterium
RVVTGHGSFVVPFFRKVRFLTLAMCEAEVAEKC

SEQ ID NO: 858867 - protein, 17 aa, Mycobacterium
RVVVLTAVGASFCAGAD

SEQ ID NO: 858868 - protein, 18 aa, Mycobacterium
RVWALDSGFTFPVLSDFW

SEQ ID NO: 858869 - protein, 19 aa, Mycobacterium
RVWEALLTIPYGETRSYGE

SEQ ID NO: 858870 - protein, 20 aa, Mycobacterium
RVWELETYGALFDRLEDGKI

SEQ ID NO: 858871 - protein, 21 aa, Mycobacterium
RVWRLTHGNVLFMRQVVEQET

SEQ ID NO: 858872 - protein, 23 aa, Mycobacterium
RVWRYWYPLMTRGLGADKIAFLN

SEQ ID NO: 858873 - protein, 22 aa, Mycobacterium
RVWSHFMQKWIDYTAASIRAER

SEQ ID NO: 858874 - protein, 18 aa, Mycobacterium
RVWVNCYHVYPPHAAFGG

SEQ ID NO: 858875 - protein, 18 aa, Mycobacterium
RVYADLYVTFTGVVDERS

SEQ ID NO: 858876 - protein, 17 aa, Mycobacterium
RVYGKPPAAYRASLPPA

SEQ ID NO: 858877 - protein, 21 aa, Mycobacterium
RVYHELNRLWPAERAYAAAAK

SEQ ID NO: 858878 - protein, 18 aa, Mycobacterium
RVYLACGSSYKLAAQRLN

SEQ ID NO: 858879 - protein, 21 aa, Mycobacterium
RVYPIGPGNRPLPAPTLVSMQ

SEQ ID NO: 858880 - protein, 24 aa, Mycobacterium
RVYRDRGLLHPPLRVGRVALFNDT

SEQ ID NO: 858881 - protein, 28 aa, Mycobacterium
RVYRDRGLLPPPLRVGRIALFNDTHLTR

SEQ ID NO: 858882 - protein, 17 aa, Mycobacterium
RVYRPAGPAPLPALVFA

SEQ ID NO: 858883 - protein, 17 aa, Mycobacterium
RVYVPFGYEWYGYFVRR

SEQ ID NO: 858884 - protein, 25 aa, Mycobacterium
RWAAQLRNWEFFGAPLAGVVCMHRD

SEQ ID NO: 858885 - protein, 19 aa, Mycobacterium
RWADALNHVLRLRAPQAGA

SEQ ID NO: 858886 - protein, 19 aa, Mycobacterium
RWADVVASLLRPGGRLFMR

SEQ ID NO: 858887 - protein, 19 aa, Mycobacterium
RWAGFARSSVFSALAQALD

SEQ ID NO: 858888 - protein, 29 aa, Mycobacterium
RWAGHAHHYLAIFDQARPLALYHTKRLAS

SEQ ID NO: 858889 - protein, 24 aa, Mycobacterium
RWAKTWEFQALLKARPAAGDPELG

SEQ ID NO: 858890 - protein, 22 aa, Mycobacterium
RWAKTWEFQALLKARPCAGDME

SEQ ID NO: 858891 - protein, 20 aa, Mycobacterium
RWALDLIEAPPRLRGAITAM

SEQ ID NO: 858892 - protein, 17 aa, Mycobacterium
RWALKYIPGLQSLIRGI

SEQ ID NO: 858893 - protein, 18 aa, Mycobacterium
RWANWLASVRYSGRTHPR

SEQ ID NO: 858894 - protein, 22 aa, Mycobacterium
RWAPTVRPPVGWIPQRDGRVAL

SEQ ID NO: 858895 - protein, 23 aa, Mycobacterium
RWAQLELGMSAWDLYGGAGVFAA

SEQ ID NO: 858896 - protein, 20 aa, Mycobacterium
RWARNTGGLLLVTHDRWFLD

SEQ ID NO: 858897 - protein, 17 aa, Mycobacterium
RWASVITKVTWTSPEPR

SEQ ID NO: 858898 - protein, 25 aa, Mycobacterium
RWAYLPALEQVAAWHWSLNHPDASG

SEQ ID NO: 858899 - protein, 26 aa, Mycobacterium
RWCGGGSWVMVLLPVVRQNPGALETA

SEQ ID NO: 858900 - protein, 19 aa, Mycobacterium
RWCRQVVDLLDQIHKAAPD

SEQ ID NO: 858901 - protein, 20 aa, Mycobacterium
RWDAPWYRRVPRAGADDLAA

SEQ ID NO: 858902 - protein, 21 aa, Mycobacterium
RWDDIVSRVFGRIDPIAMGGE

SEQ ID NO: 858903 - protein, 21 aa, Mycobacterium
RWDDIVSRVFGRIDPIGVSGE

SEQ ID NO: 858904 - protein, 28 aa, Mycobacterium
RWDERFPDHPLTRLRRWVAGVTPTIRVA

SEQ ID NO: 858905 - protein, 17 aa, Mycobacterium
RWDTLAARLAELLRGDD

SEQ ID NO: 858906 - protein, 25 aa, Mycobacterium
RWDVDGWVGYYYYSFSQAIGGGTSE

SEQ ID NO: 858907 - protein, 18 aa, Mycobacterium
RWDYGGMPIPMDGMPIVL

SEQ ID NO: 858908 - protein, 18 aa, Mycobacterium
RWECGQDRIALLMYNDLY

SEQ ID NO: 858909 - protein, 24 aa, Mycobacterium
RWEDTFFQIRNQSYALDWNGAGGA

SEQ ID NO: 858910 - protein, 25 aa, Mycobacterium
RWEGHPGALLTWATHQVPFLAAVED

SEQ ID NO: 858911 - protein, 17 aa, Mycobacterium
RWEKPFLAIFGKRDPIL

SEQ ID NO: 858912 - protein, 19 aa, Mycobacterium
RWERDEALLILLRAGVTNE

SEQ ID NO: 858913 - protein, 19 aa, Mycobacterium
RWERLAEDLLRLLDKWFPG

SEQ ID NO: 858914 - protein, 18 aa, Mycobacterium
RWERPEEFDIFRKRIPHI

SEQ ID NO: 858915 - protein, 21 aa, Mycobacterium
RWEVRWSATGLHPRLGEHQTF

SEQ ID NO: 858916 - protein, 19 aa, Mycobacterium
RWEWDIGLLNLRRRMEEDF

SEQ ID NO: 858917 - protein, 20 aa, Mycobacterium
RWFLPLSVPLGLGPKNCAVG

SEQ ID NO: 858918 - protein, 19 aa, Mycobacterium
RWGAAVPWAAILEPAGWTP

SEQ ID NO: 858919 - protein, 21 aa, Mycobacterium
RWGCVLGGDPTRRVTAMRARE

SEQ ID NO: 858920 - protein, 23 aa, Mycobacterium
RWGDGWVKLVGDWIDRAVGDLAP

SEQ ID NO: 858921 - protein, 17 aa, Mycobacterium
RWGGFLDDVAGFDPEFF

SEQ ID NO: 858922 - protein, 29 aa, Mycobacterium
RWGKYLGLRADPLWLIAHLSRAGWLRWSD

SEQ ID NO: 858923 - protein, 18 aa, Mycobacterium
RWGLGPAITELAAHVDDP

SEQ ID NO: 858924 - protein, 18 aa, Mycobacterium
RWGSLYDALYGTDVIPEA

SEQ ID NO: 858925 - protein, 18 aa, Mycobacterium
RWGSLYDALYGTDVIPES

SEQ ID NO: 858926 - protein, 24 aa, Mycobacterium
RWGTKLIRAFLAQGAAPAGFVVRS

SEQ ID NO: 858927 - protein, 21 aa, Mycobacterium
RWHADAVILAIPAPRLVPLVE

SEQ ID NO: 858928 - protein, 19 aa, Mycobacterium
RWHADAVILAVPAPRAARL

SEQ ID NO: 858929 - protein, 34 aa, Mycobacterium
RWHAESSWAARVSLAHALIGWTRGTGLMGHNDAI

SEQ ID NO: 858930 - protein, 32 aa, Mycobacterium
RWHAESSWATRVSLAHALIGWTRGTGLMGHND

SEQ ID NO: 858931 - protein, 19 aa, Mycobacterium
RWHRGDRVLLRMAWTRDDP

SEQ ID NO: 858932 - protein, 25 aa, Mycobacterium
RWIERYRRHWIDHLDALERHLESTH

SEQ ID NO: 858933 - protein, 19 aa, Mycobacterium
RWIFSNPDMIHLSLLRNHA

SEQ ID NO: 858934 - protein, 18 aa, Mycobacterium
RWIQALAAGSRTGRVVTA

SEQ ID NO: 858935 - protein, 21 aa, Mycobacterium
RWISMSWRRCGVFPPSSAASA

SEQ ID NO: 858936 - protein, 19 aa, Mycobacterium
RWITPRWDAQRHISHPPSP

SEQ ID NO: 858937 - protein, 20 aa, Mycobacterium
RWKAIAFSTFQYQLSRKAPA

SEQ ID NO: 858938 - protein, 27 aa, Mycobacterium
RWLHTQYPDSTRRYLFARRLGNRRGDK

SEQ ID NO: 858939 - protein, 21 aa, Mycobacterium
RWLHTYNYHRGHTALGGQPPA

SEQ ID NO: 858940 - protein, 19 aa, Mycobacterium
RWLQEVLDGLRRTAPPVIT

SEQ ID NO: 858941 - protein, 30 aa, Mycobacterium
RWLREAAGWGDLIWKFVRVADARVVKNRWH

SEQ ID NO: 858942 - protein, 22 aa, Mycobacterium
RWLRSGRLVLADVTVAFQPGST

SEQ ID NO: 858943 - protein, 20 aa, Mycobacterium
RWLSEVEAAQFADRKPRQLS

SEQ ID NO: 858944 - protein, 18 aa, Mycobacterium
RWLVITDADKRAAIAEIY

SEQ ID NO: 858945 - protein, 17 aa, Mycobacterium
RWLVITDPDKRAAIAEI

SEQ ID NO: 858946 - protein, 19 aa, Mycobacterium
RWMDRYASFVAAKRGMAES

SEQ ID NO: 858947 - protein, 25 aa, Mycobacterium
RWNLGALYLLPDLRAERFSAFRRKR

SEQ ID NO: 858948 - protein, 17 aa, Mycobacterium
RWPAMTKPVIGAINGAA

SEQ ID NO: 858949 - protein, 24 aa, Mycobacterium
RWPAYCRQALLETPIRSVVAFQLY

SEQ ID NO: 858950 - protein, 19 aa, Mycobacterium
RWPDGTALLFPRPTKNIDG

SEQ ID NO: 858951 - protein, 19 aa, Mycobacterium
RWPDIVERVFGRIDPIAAG

SEQ ID NO: 858952 - protein, 26 aa, Mycobacterium
RWPETVRPLVRPLAPARYMPDRHRIT

SEQ ID NO: 858953 - protein, 17 aa, Mycobacterium
RWPIIVGGVRDESTLRQ

SEQ ID NO: 858954 - protein, 20 aa, Mycobacterium
RWPKRHALEFATGQARFVDD

SEQ ID NO: 858955 - protein, 18 aa, Mycobacterium
RWPLPSASTPHERWLRAV

SEQ ID NO: 858956 - protein, 21 aa, Mycobacterium
RWPRYRRYALEQTPIRSILSY

SEQ ID NO: 858957 - protein, 18 aa, Mycobacterium
RWQFDGVERCGPDLLLSL

SEQ ID NO: 858958 - protein, 24 aa, Mycobacterium
RWQHLPVPFEVYADGIDLVIFEEF

SEQ ID NO: 858959 - protein, 24 aa, Mycobacterium
RWQHLPVPFEVYADGISLVVFEEF

SEQ ID NO: 858960 - protein, 17 aa, Mycobacterium
RWQLRRLAHDVRGFPWP

SEQ ID NO: 858961 - protein, 23 aa, Mycobacterium
RWQRLLGVLDLFTPRFLTRLGVQ

SEQ ID NO: 858962 - protein, 32 aa, Mycobacterium
RWQSGRRVHLDLDPLLPFPGWHEHAPAVEEPV

SEQ ID NO: 858963 - protein, 19 aa, Mycobacterium
RWRAKIGKDWKGRTPNLVM

SEQ ID NO: 858964 - protein, 19 aa, Mycobacterium
RWRCDTQKYIWWHPIDHVS

SEQ ID NO: 858965 - protein, 26 aa, Mycobacterium
RWRDNVNAPLAFQYLEYPMLDDRGRT

SEQ ID NO: 858966 - protein, 18 aa, Mycobacterium
RWRGLRLPMGLSPTTSAL

SEQ ID NO: 858967 - protein, 20 aa, Mycobacterium
RWRGQWVDLPGLAVSRQRGM

SEQ ID NO: 858968 - protein, 21 aa, Mycobacterium
RWRHLDLGGFKLWLVYEIRRV

SEQ ID NO: 858969 - protein, 20 aa, Mycobacterium
RWRHWASCFEFDFTYVHGGG

SEQ ID NO: 858970 - protein, 27 aa, Mycobacterium
RWRIDPQPIPAHQWVIEPDLSNALAFI

SEQ ID NO: 858971 - protein, 19 aa, Mycobacterium
RWRLIAPDLPGFGYSATPS

SEQ ID NO: 858972 - protein, 22 aa, Mycobacterium
RWRSPVRRVLTADLGDEPAVLA

SEQ ID NO: 858973 - protein, 17 aa, Mycobacterium
RWRTAYLVLSGHTVDAE

SEQ ID NO: 858974 - protein, 18 aa, Mycobacterium
RWRTAYLVLSGRTIDAET

SEQ ID NO: 858975 - protein, 27 aa, Mycobacterium
RWSAWLVGPWWPAPPGSPAAGVSYWRQ

SEQ ID NO: 858976 - protein, 19 aa, Mycobacterium
RWSKLHSQYEYWSQIDTDS

SEQ ID NO: 858977 - protein, 33 aa, Mycobacterium
RWSLELTVVNPLVDATWRFMTLDHDGKIRMDCS

SEQ ID NO: 858978 - protein, 24 aa, Mycobacterium
RWSMADAFLHPVAHRRNLTVYTQT

SEQ ID NO: 858979 - protein, 20 aa, Mycobacterium
RWSRDWPVRELAPAPAGSGL

SEQ ID NO: 858980 - protein, 27 aa, Mycobacterium
RWSTSSRFLLNVPLFGRQPLHPDVDSL

SEQ ID NO: 858981 - protein, 27 aa, Mycobacterium
RWSTTSRFLLNVPLFGRQALHPDVDSL

SEQ ID NO: 858982 - protein, 21 aa, Mycobacterium
RWSVREVLESPLRAYHLDNRD

SEQ ID NO: 858983 - protein, 26 aa, Mycobacterium
RWTARALIFVINLYRHMVSPLRPASC

SEQ ID NO: 858984 - protein, 18 aa, Mycobacterium
RWTDLPGQHRGPVGTPVP

SEQ ID NO: 858985 - protein, 26 aa, Mycobacterium
RWTDPDGGFFLWVTLDGDVDATALFD

SEQ ID NO: 858986 - protein, 19 aa, Mycobacterium
RWTIGPKVHGGAMLALCAN

SEQ ID NO: 858987 - protein, 29 aa, Mycobacterium
RWTKHSLNYWYRMFAPAFDTSLGLEFLSF

SEQ ID NO: 858988 - protein, 20 aa, Mycobacterium
RWTRLYPDVRAEPVIVRGSV

SEQ ID NO: 858989 - protein, 19 aa, Mycobacterium
RWVAEADTLQLWADRARSM

SEQ ID NO: 858990 - protein, 18 aa, Mycobacterium
RWVAEGGALRLFVDRHRA

SEQ ID NO: 858991 - protein, 29 aa, Mycobacterium
RWVEPVLRGQVMWCQLFSEPGAGSDAAAV

SEQ ID NO: 858992 - protein, 19 aa, Mycobacterium
RWVGQYRDLHVQPAAARHG

SEQ ID NO: 858993 - protein, 20 aa, Mycobacterium
RWVLTKGKLPTSLWVEIVTT

SEQ ID NO: 858994 - protein, 18 aa, Mycobacterium
RWVRALAENPQAFSAAPN

SEQ ID NO: 858995 - protein, 26 aa, Mycobacterium
RWVRTDSFIDPFPLYREDGTRDLRAS

SEQ ID NO: 858996 - protein, 18 aa, Mycobacterium
RWVTECIRSAYPLGQGHG

SEQ ID NO: 858997 - protein, 21 aa, Mycobacterium
RWWERPYIAAGIFLYDRLGGA

SEQ ID NO: 858998 - protein, 19 aa, Mycobacterium
RWYQQLTRLWASLAGDPHP

SEQ ID NO: 858999 - protein, 18 aa, Mycobacterium
RWYSFDPFSHITREQATV

SEQ ID NO: 859000 - protein, 25 aa, Mycobacterium
RYADAWVPIVLVRPGDYSTALEAVR

SEQ ID NO: 859001 - protein, 22 aa, Mycobacterium
RYADRVTSFLPTAHIADRVMGL

SEQ ID NO: 859002 - protein, 25 aa, Mycobacterium
RYALSLKVWLDFLHAVDVRWDHASR

SEQ ID NO: 859003 - protein, 19 aa, Mycobacterium
RYAMAMRDRLPLVGKVFES

SEQ ID NO: 859004 - protein, 19 aa, Mycobacterium
RYAPFFKMCSSVLPEGGRF

SEQ ID NO: 859005 - protein, 19 aa, Mycobacterium
RYAPGQFLTLRVPSERTGS

SEQ ID NO: 859006 - protein, 18 aa, Mycobacterium
RYAQRYRTPRPNPRRVVI

SEQ ID NO: 859007 - protein, 29 aa, Mycobacterium
RYATGIDRRDWRLFRTVFTDDCAIDYGEI

SEQ ID NO: 859008 - protein, 28 aa, Mycobacterium
RYATLVMDFYAMRLLGSATLAKAARGEE

SEQ ID NO: 859009 - protein, 18 aa, Mycobacterium
RYATYFAQGIISSQQREI

SEQ ID NO: 859010 - protein, 18 aa, Mycobacterium
RYAVLPHMRVACWDAMLT

SEQ ID NO: 859011 - protein, 25 aa, Mycobacterium
RYAVNPRIHLFFGARYRCELYDLPT

SEQ ID NO: 859012 - protein, 22 aa, Mycobacterium
RYAVQSYLEYQGRKLLARFDAG

SEQ ID NO: 859013 - protein, 17 aa, Mycobacterium
RYAWRLWHLAQHTRLRQ

SEQ ID NO: 859014 - protein, 18 aa, Mycobacterium
RYCLDPAHLRVIAAVNFA

SEQ ID NO: 859015 - protein, 26 aa, Mycobacterium
RYCVTADALVRLPFGQSVRIGDVVPG

SEQ ID NO: 859016 - protein, 22 aa, Mycobacterium
RYDAEWIVVLDDWTDGVGKSPQ

SEQ ID NO: 859017 - protein, 23 aa, Mycobacterium
RYDAEWIVVLDDWTDGVGKSPQQ

SEQ ID NO: 859018 - protein, 23 aa, Mycobacterium
RYDAEWIVVLDDWTDGVGKTPRQ

SEQ ID NO: 859019 - protein, 20 aa, Mycobacterium
RYDDWWRSLVPALDRIEVPA

SEQ ID NO: 859020 - protein, 21 aa, Mycobacterium
RYDIEIFPTAALIAAGHRLRL

SEQ ID NO: 859021 - protein, 20 aa, Mycobacterium
RYDLAQLPPAPPTTVAVIEG

SEQ ID NO: 859022 - protein, 17 aa, Mycobacterium
RYDLNAGFPLITTKKVH

SEQ ID NO: 859023 - protein, 22 aa, Mycobacterium
RYDTFFKKYYSLTPDDGRMLLH

SEQ ID NO: 859024 - protein, 19 aa, Mycobacterium
RYDTYFFVGALPEGQRADG

SEQ ID NO: 859025 - protein, 19 aa, Mycobacterium
RYDTYFFVGALPKGQRADG

SEQ ID NO: 859026 - protein, 18 aa, Mycobacterium
RYDTYFFVGALPQGQRAD

SEQ ID NO: 859027 - protein, 24 aa, Mycobacterium
RYDVDVRSILIEAGRRRLVGGQED

SEQ ID NO: 859028 - protein, 17 aa, Mycobacterium
RYEAFTYFHPARTVRER

SEQ ID NO: 859029 - protein, 19 aa, Mycobacterium
RYEAWSFPDFATGADALRA

SEQ ID NO: 859030 - protein, 22 aa, Mycobacterium
RYEAWSFPDFATGADALRAVVQ

SEQ ID NO: 859031 - protein, 23 aa, Mycobacterium
RYEAWSFPDFSTGVAALRAITQT

SEQ ID NO: 859032 - protein, 26 aa, Mycobacterium
RYEGVLDHIMLYPPSVGIAPERVGQN

SEQ ID NO: 859033 - protein, 19 aa, Mycobacterium
RYELADVRLAHALGALLEL

SEQ ID NO: 859034 - protein, 18 aa, Mycobacterium
RYELTPRDVCYLSMPLFH

SEQ ID NO: 859035 - protein, 18 aa, Mycobacterium
RYERMRARIAAYVRGRQV

SEQ ID NO: 859036 - protein, 25 aa, Mycobacterium
RYERPLPVMVFIHGGAYFLGSSATP

SEQ ID NO: 859037 - protein, 21 aa, Mycobacterium
RYERRRSALLPALRAAGFTVD

SEQ ID NO: 859038 - protein, 20 aa, Mycobacterium
RYEWVLVDFAVMCAGAATTT

SEQ ID NO: 859039 - protein, 17 aa, Mycobacterium
RYFDLPSIVMPKPGDEA

SEQ ID NO: 859040 - protein, 18 aa, Mycobacterium
RYFDVEPRYLPMAKGRYV

SEQ ID NO: 859041 - protein, 21 aa, Mycobacterium
RYFLAAKEAEFALGGATGQLR

SEQ ID NO: 859042 - protein, 20 aa, Mycobacterium
RYFLAAKEAEFALGGATTAL

SEQ ID NO: 859043 - protein, 17 aa, Mycobacterium
RYFLDNVAEWILELDRG

SEQ ID NO: 859044 - protein, 17 aa, Mycobacterium
RYFLPGADEWRTAHSWP

SEQ ID NO: 859045 - protein, 18 aa, Mycobacterium
RYFTVRAGSLVAWDSGGV

SEQ ID NO: 859046 - protein, 18 aa, Mycobacterium
RYFVAVADELHFKRAADK

SEQ ID NO: 859047 - protein, 19 aa, Mycobacterium
RYFVAVAEELHFKRAADRL

SEQ ID NO: 859048 - protein, 19 aa, Mycobacterium
RYGATLRITRLRPSGRGAD

SEQ ID NO: 859049 - protein, 22 aa, Mycobacterium
RYGCRIVTMYGLTEAFPIALKA

SEQ ID NO: 859050 - protein, 29 aa, Mycobacterium
RYGDKPIILWHRSFHELFLNDAALNWTGV

SEQ ID NO: 859051 - protein, 18 aa, Mycobacterium
RYGDLLSALSPIATDVLA

SEQ ID NO: 859052 - protein, 23 aa, Mycobacterium
RYGEERFARRIAARIIRRRADKP

SEQ ID NO: 859053 - protein, 26 aa, Mycobacterium
RYGGDLLNVVYAAWVAGIRAPLKEPA

SEQ ID NO: 859054 - protein, 29 aa, Mycobacterium
RYGGRDAPLLHWVVFEEEYFRAGAPGRAS

SEQ ID NO: 859055 - protein, 17 aa, Mycobacterium
RYGLDESHLRAIADLNF

SEQ ID NO: 859056 - protein, 24 aa, Mycobacterium
RYGLMGKAFNLFSKLRRGMERNIG

SEQ ID NO: 859057 - protein, 18 aa, Mycobacterium
RYGLPAHGWTMCVGVVRP

SEQ ID NO: 859058 - protein, 18 aa, Mycobacterium
RYGLPESGWTLFSAIAHP

SEQ ID NO: 859059 - protein, 20 aa, Mycobacterium
RYGNMLSVSLIFVLEMMVQQ

SEQ ID NO: 859060 - protein, 18 aa, Mycobacterium
RYGPAFFTANQLALVNGE

SEQ ID NO: 859061 - protein, 21 aa, Mycobacterium
RYGRDLPAETLSWLYELMVIT

SEQ ID NO: 859062 - protein, 20 aa, Mycobacterium
RYGRIDVLVNNAGIIAYQGL

SEQ ID NO: 859063 - protein, 21 aa, Mycobacterium
RYGRLQLVKHPAHGLTLISLD

SEQ ID NO: 859064 - protein, 20 aa, Mycobacterium
RYGRLQLVKNPAHGLTLLSL

SEQ ID NO: 859065 - protein, 20 aa, Mycobacterium
RYGRLQLVKNPAHGLTLVSL

SEQ ID NO: 859066 - protein, 17 aa, Mycobacterium
RYGSFRRSFRLPAQVTS

SEQ ID NO: 859067 - protein, 27 aa, Mycobacterium
RYGSLYRPYHMIGLELAVSIASAVLRN

SEQ ID NO: 859068 - protein, 23 aa, Mycobacterium
RYGSPPVPLVPLILDHNVRNTRQ

SEQ ID NO: 859069 - protein, 20 aa, Mycobacterium
RYGTAARFTRAEPTPLWEGV

SEQ ID NO: 859070 - protein, 21 aa, Mycobacterium
RYGVAYVVLASRAGAAAAGVA

SEQ ID NO: 859071 - protein, 19 aa, Mycobacterium
RYGVPAHQLLHRAGERKLI

SEQ ID NO: 859072 - protein, 20 aa, Mycobacterium
RYGVPPHELLHRAGQRKLIG

SEQ ID NO: 859073 - protein, 17 aa, Mycobacterium
RYGVVAGTGRLLELLPR

SEQ ID NO: 859074 - protein, 17 aa, Mycobacterium
RYHAALGFVLQPGDKEV

SEQ ID NO: 859075 - protein, 18 aa, Mycobacterium
RYHAFLHVAADEALGAAA

SEQ ID NO: 859076 - protein, 19 aa, Mycobacterium
RYHAFLHVAADEALGAAAV

SEQ ID NO: 859077 - protein, 24 aa, Mycobacterium
RYHALNPELFYWAHASFVDQVIYN

SEQ ID NO: 859078 - protein, 26 aa, Mycobacterium
RYHATYMNYVGKPLAYILATPQREDD

SEQ ID NO: 859079 - protein, 19 aa, Mycobacterium
RYHFDPRTLVFQVSITEPR

SEQ ID NO: 859080 - protein, 29 aa, Mycobacterium
RYIARFNGANIIVSLLRDTIDLTNVKDVA

SEQ ID NO: 859081 - protein, 32 aa, Mycobacterium
RYIARSKARARLHALRLRRLHYVRTARRRHYE

SEQ ID NO: 859082 - protein, 25 aa, Mycobacterium
RYIEEMGGMNLFFVFGRDGEARLVT

SEQ ID NO: 859083 - protein, 17 aa, Mycobacterium
RYIFNTPSKYTGPHDVS

SEQ ID NO: 859084 - protein, 17 aa, Mycobacterium
RYIGFRHESDAGHAAAA

SEQ ID NO: 859085 - protein, 18 aa, Mycobacterium
RYILGVALSLLMNVIPGS

SEQ ID NO: 859086 - protein, 25 aa, Mycobacterium
RYIPNLVPRLFTLDRDFIQEIRDLV

SEQ ID NO: 859087 - protein, 28 aa, Mycobacterium
RYIQADACDGFILVPHLTPGGLDDFVDT

SEQ ID NO: 859088 - protein, 25 aa, Mycobacterium
RYIQFAVANQFYLLSREAGLDFDRV

SEQ ID NO: 859089 - protein, 18 aa, Mycobacterium
RYIRPEFVHVFVGGRIAE

SEQ ID NO: 859090 - protein, 20 aa, Mycobacterium
RYISGAPQLWVVGTRPFGPI

SEQ ID NO: 859091 - protein, 23 aa, Mycobacterium
RYITARFLPDKAIDLVDEAASRL

SEQ ID NO: 859092 - protein, 23 aa, Mycobacterium
RYITSRFLPDKAIDLVDEAASRL

SEQ ID NO: 859093 - protein, 19 aa, Mycobacterium
RYIVCDDRRTLLWLANQRA

SEQ ID NO: 859094 - protein, 26 aa, Mycobacterium
RYKGWEETAFQYAWLLATADGDRYGG

SEQ ID NO: 859095 - protein, 23 aa, Mycobacterium
RYKLKHVILVPHRDARIRVRAIT

SEQ ID NO: 859096 - protein, 18 aa, Mycobacterium
RYKLPKRLSVVDQLPRNV

SEQ ID NO: 859097 - protein, 25 aa, Mycobacterium
RYLAASMLAAFPHTGADRPPGETDN

SEQ ID NO: 859098 - protein, 21 aa, Mycobacterium
RYLARAMTRHLRRRGPAPIRV

SEQ ID NO: 859099 - protein, 17 aa, Mycobacterium
RYLDDTFFWPVFESAEK

SEQ ID NO: 859100 - protein, 20 aa, Mycobacterium
RYLDEVTVPALLRGMRRAGR

SEQ ID NO: 859101 - protein, 20 aa, Mycobacterium
RYLDIYRRAVRHKSALWRAQ

SEQ ID NO: 859102 - protein, 33 aa, Mycobacterium
RYLDRLERRDGVWKIALRRCTIEWMISGDSSIL

SEQ ID NO: 859103 - protein, 32 aa, Mycobacterium
RYLDRLERRDGVWKIALRRCTLEWMMSGDSSV

SEQ ID NO: 859104 - protein, 18 aa, Mycobacterium
RYLDRLERRDGVWKIAVR

SEQ ID NO: 859105 - protein, 20 aa, Mycobacterium
RYLDRLERRNGVWKIALRRC

SEQ ID NO: 859106 - protein, 19 aa, Mycobacterium
RYLDRYEKRDGTWKFVARA

SEQ ID NO: 859107 - protein, 20 aa, Mycobacterium
RYLEAHGYRRIGENTLLPPS

SEQ ID NO: 859108 - protein, 17 aa, Mycobacterium
RYLEIAAALSDLYPRTV

SEQ ID NO: 859109 - protein, 19 aa, Mycobacterium
RYLEQLEFGLVREALYERE

SEQ ID NO: 859110 - protein, 19 aa, Mycobacterium
RYLFTGDTLFRSAEGHWYA

SEQ ID NO: 859111 - protein, 26 aa, Mycobacterium
RYLGCVHLQRLLREPPYAMVGGILDT

SEQ ID NO: 859112 - protein, 18 aa, Mycobacterium
RYLLDREIDLQLAQLQWA

SEQ ID NO: 859113 - protein, 17 aa, Mycobacterium
RYLLEQFPLVRPTTRRR

SEQ ID NO: 859114 - protein, 29 aa, Mycobacterium
RYLLQHGYVADFHILGEPTGLVPHVGHMG

SEQ ID NO: 859115 - protein, 23 aa, Mycobacterium
RYLNRELSWLDFNARVLALAADN

SEQ ID NO: 859116 - protein, 23 aa, Mycobacterium
RYLNRELSWLEFNARVLALAADD

SEQ ID NO: 859117 - protein, 18 aa, Mycobacterium
RYLPKVGDVLVVPMGSRA

SEQ ID NO: 859118 - protein, 20 aa, Mycobacterium
RYLQCLAAHDWDGLAATIAD

SEQ ID NO: 859119 - protein, 18 aa, Mycobacterium
RYLRALDTKHWDDFADTL

SEQ ID NO: 859120 - protein, 18 aa, Mycobacterium
RYLRICVLTQYKSHSLDR

SEQ ID NO: 859121 - protein, 21 aa, Mycobacterium
RYLRRWHRRRALWAGVAIGGT

SEQ ID NO: 859122 - protein, 18 aa, Mycobacterium
RYLRSLYRAMKPQGRLFL

SEQ ID NO: 859123 - protein, 18 aa, Mycobacterium
RYLSLFDSSGDSTRHTDS

SEQ ID NO: 859124 - protein, 17 aa, Mycobacterium
RYLTGCADAFRAGYIDV

SEQ ID NO: 859125 - protein, 20 aa, Mycobacterium
RYLTTLGIGPYTPTGVIGYP

SEQ ID NO: 859126 - protein, 17 aa, Mycobacterium
RYLVNDAAILAGKPYVW

SEQ ID NO: 859127 - protein, 18 aa, Mycobacterium
RYMDFIPVALEQPTSREV

SEQ ID NO: 859128 - protein, 24 aa, Mycobacterium
RYMEGVVYSSLAYAALAGGDIDAA

SEQ ID NO: 859129 - protein, 17 aa, Mycobacterium
RYMKYLTGCAKLFRQGY

SEQ ID NO: 859130 - protein, 26 aa, Mycobacterium
RYMQSSKTFVLVDRPFWKDVDPVTGR

SEQ ID NO: 859131 - protein, 21 aa, Mycobacterium
RYNFQFTGQRFFRIRDGRLDG

SEQ ID NO: 859132 - protein, 18 aa, Mycobacterium
RYNLRLPSIDRKVIPLVV

SEQ ID NO: 859133 - protein, 21 aa, Mycobacterium
RYNMICRPAVVAVRDGRSRLI

SEQ ID NO: 859134 - protein, 19 aa, Mycobacterium
RYNPWSAYGESKLANLLFV

SEQ ID NO: 859135 - protein, 17 aa, Mycobacterium
RYPARLIDEYAWETDLG

SEQ ID NO: 859136 - protein, 27 aa, Mycobacterium
RYPARYLFVFLEHHGMLSVFGSPTWRT

SEQ ID NO: 859137 - protein, 17 aa, Mycobacterium
RYPAYGVLASIVQIGRL

SEQ ID NO: 859138 - protein, 25 aa, Mycobacterium
RYPDYVFYPCMPYAHKYANAVTEFG

SEQ ID NO: 859139 - protein, 18 aa, Mycobacterium
RYPGGLALRFARVVRYRD

SEQ ID NO: 859140 - protein, 19 aa, Mycobacterium
RYPIAMWWGVGCRGSVLAE

SEQ ID NO: 859141 - protein, 17 aa, Mycobacterium
RYPLNILSDLNTLMSLG

SEQ ID NO: 859142 - protein, 23 aa, Mycobacterium
RYPNTWALARRYGLQTFLREPML

SEQ ID NO: 859143 - protein, 18 aa, Mycobacterium
RYPQYADVPFYRASAEVM

SEQ ID NO: 859144 - protein, 23 aa, Mycobacterium
RYPRRDMVLRLRPRPPALLEPYD

SEQ ID NO: 859145 - protein, 19 aa, Mycobacterium
RYPRVDIRHGNLAELPLPD

SEQ ID NO: 859146 - protein, 24 aa, Mycobacterium
RYPRVDVMQANLARLPLPDSSVDI

SEQ ID NO: 859147 - protein, 23 aa, Mycobacterium
RYPRYRWDIALRRDYQRAAFEAG

SEQ ID NO: 859148 - protein, 23 aa, Mycobacterium
RYPTLRFVPTEQGTLWVPGQLAV

SEQ ID NO: 859149 - protein, 36 aa, Mycobacterium; identical to SEQ ID NO: 122363

SEQ ID NO: 859150 - protein, 36 aa, Mycobacterium
RYPVASWQVVRLPRIPMRFPMYLPGPNRVMVVDEEP

SEQ ID NO: 859151 - protein, 21 aa, Mycobacterium
RYQARFMEVFRRHPGTLLAAD

SEQ ID NO: 859152 - protein, 20 aa, Mycobacterium
RYQDQNWYRTGDLVRYRTGG

SEQ ID NO: 859153 - protein, 18 aa, Mycobacterium
RYQGMVDGVPRVETHLEW

SEQ ID NO: 859154 - protein, 25 aa, Mycobacterium
RYQRFAAFWRSRPVNWVWDHLPMSV

SEQ ID NO: 859155 - protein, 26 aa, Mycobacterium
RYQRFAAFWRSRPVNWVWDRLPMTVR

SEQ ID NO: 859156 - protein, 35 aa, Mycobacterium
RYQTGLRRSLIAMRSKRYFRLLDALDAMVAEYPVT

SEQ ID NO: 859157 - protein, 35 aa, Mycobacterium
RYQTGLRRSLIAMRSQRYFRLLDALEAIAAQPPGS

SEQ ID NO: 859158 - protein, 35 aa, Mycobacterium
RYQTGLRRSLIAMRSQRYFRLLDSLEAIAAASPGA

SEQ ID NO: 859159 - protein, 36 aa, Mycobacterium
RYQTGWKRSLTAMRSQRYFRLLDALDELVASDPPES

SEQ ID NO: 859160 - protein, 26 aa, Mycobacterium
RYQVHSLHGYFLRPGDANEPTVFIVE

SEQ ID NO: 859161 - protein, 17 aa, Mycobacterium
RYRAAYFEMFPGVWRHG

SEQ ID NO: 859162 - protein, 29 aa, Mycobacterium
RYRAVPDRYLAFPDFALDRPTWEALQIPV

SEQ ID NO: 859163 - protein, 18 aa, Mycobacterium
RYRAVPDRYLTFPQFALD

SEQ ID NO: 859164 - protein, 24 aa, Mycobacterium
RYRDVLVPEGGTWLIKHRRVSTDW

SEQ ID NO: 859165 - protein, 25 aa, Mycobacterium
RYREGDWIYIPKACTWRQIPDDEST

SEQ ID NO: 859166 - protein, 25 aa, Mycobacterium
RYREGDWLYIPKACTWRQLPDTATT

SEQ ID NO: 859167 - protein, 21 aa, Mycobacterium
RYREWLSIHRVWRSKLPEVIE

SEQ ID NO: 859168 - protein, 22 aa, Mycobacterium
RYRFSVTLPRTMPAPGAGIVER

SEQ ID NO: 859169 - protein, 19 aa, Mycobacterium
RYRHILELRFLQGHSIKDS

SEQ ID NO: 859170 - protein, 31 aa, Mycobacterium
RYRHPLCLCVHFPAGTLLAETGCVIHIEARE

SEQ ID NO: 859171 - protein, 20 aa, Mycobacterium
RYRIFIVDEAHMVTTAGFNA

SEQ ID NO: 859172 - protein, 20 aa, Mycobacterium
RYRKSAPLEGARLGQHERIG

SEQ ID NO: 859173 - protein, 18 aa, Mycobacterium
RYRLVPFEVRRESVGFIF

SEQ ID NO: 859174 - protein, 25 aa, Mycobacterium
RYRLVVARACPWANRAIIVRRLLGL

SEQ ID NO: 859175 - protein, 19 aa, Mycobacterium
RYRLVVARACPWANRTIIV

SEQ ID NO: 859176 - protein, 17 aa, Mycobacterium
RYRNIQRLDRILEAEDD

SEQ ID NO: 859177 - protein, 32 aa, Mycobacterium
RYRNSYLLATELFPRMPIPQTWYDAGIAHRSD

SEQ ID NO: 859178 - protein, 18 aa, Mycobacterium
RYRQYRWDIRLRREYQRA

SEQ ID NO: 859179 - protein, 20 aa, Mycobacterium
RYRRGALKHTPIRSVLSFKL

SEQ ID NO: 859180 - protein, 17 aa, Mycobacterium
RYRRPAGSVPPLTDAVG

SEQ ID NO: 859181 - protein, 20 aa, Mycobacterium
RYRSDYGDWPRSVGLSIWGT

SEQ ID NO: 859182 - protein, 20 aa, Mycobacterium
RYRTLIVIIGERPGLSVVDS

SEQ ID NO: 859183 - protein, 21 aa, Mycobacterium
RYRVIPQAYQLPPSRNRQPGT

SEQ ID NO: 859184 - protein, 21 aa, Mycobacterium
RYRVLAPDMLGFGGSAKVVDF

SEQ ID NO: 859185 - protein, 21 aa, Mycobacterium
RYRVLAPDMLGYGSSAKVIDF

SEQ ID NO: 859186 - protein, 17 aa, Mycobacterium
RYRVLDDAYRGFVALVA

SEQ ID NO: 859187 - protein, 18 aa, Mycobacterium
RYSAFTRMPLGGDDPDYA

SEQ ID NO: 859188 - protein, 17 aa, Mycobacterium
RYSAFTRMPLGGDDPEY

SEQ ID NO: 859189 - protein, 26 aa, Mycobacterium
RYSAGDWVYLPKACTWRQVPDGPTTM

SEQ ID NO: 859190 - protein, 27 aa, Mycobacterium
RYSCELYDLPMLWQIAAHNPWLSVSPV

SEQ ID NO: 859191 - protein, 17 aa, Mycobacterium
RYSCKSLRFAAASGSRM

SEQ ID NO: 859192 - protein, 17 aa, Mycobacterium
RYSFVPFGGGRRICVGA

SEQ ID NO: 859193 - protein, 20 aa, Mycobacterium
RYSMNNQLLILAQRPDAQQV

SEQ ID NO: 859194 - protein, 19 aa, Mycobacterium
RYSPGQFLTLRVPSDRTGS

SEQ ID NO: 859195 - protein, 26 aa, Mycobacterium
RYSRRLRRVMYMSALTAIRCDPASRA

SEQ ID NO: 859196 - protein, 19 aa, Mycobacterium
RYSVLVNKGDEAGVEVGMI

SEQ ID NO: 859197 - protein, 17 aa, Mycobacterium
RYTALSAIMRPGATELE

SEQ ID NO: 859198 - protein, 26 aa, Mycobacterium
RYTEAASLAWLFYTSGTTGRSKGAML

SEQ ID NO: 859199 - protein, 17 aa, Mycobacterium
RYTFLPTTGKTPSLPLA

SEQ ID NO: 859200 - protein, 19 aa, Mycobacterium
RYTLWAPRWRDSGDEWEAF

SEQ ID NO: 859201 - protein, 17 aa, Mycobacterium
RYTPTVFRPLVNVFFSV

SEQ ID NO: 859202 - protein, 22 aa, Mycobacterium
RYTQTLTLWRGVARVDCRTTID

SEQ ID NO: 859203 - protein, 26 aa, Mycobacterium
RYVADRFLLLPMPEWSVNPIDPIAIS

SEQ ID NO: 859204 - protein, 19 aa, Mycobacterium
RYVAKYTICPAVAHGLDGE

SEQ ID NO: 859205 - protein, 23 aa, Mycobacterium
RYVARQPLFRNALMRTLAMDPRQ

SEQ ID NO: 859206 - protein, 26 aa, Mycobacterium
RYVARSVLAFFRAARRQPTLTVELPG

SEQ ID NO: 859207 - protein, 22 aa, Mycobacterium
RYVDLVCSWGPLILGHAHPAVV

SEQ ID NO: 859208 - protein, 19 aa, Mycobacterium
RYVDYWGTAVTAFDLHAPH

SEQ ID NO: 859209 - protein, 25 aa, Mycobacterium
RYVGDRFPVIPIPSWMDNPIDPISI

SEQ ID NO: 859210 - protein, 19 aa, Mycobacterium
RYVIDRATPAPLRGIVRRF

SEQ ID NO: 859211 - protein, 21 aa, Mycobacterium
RYVIWLHDYGSQFGFQLALAK

SEQ ID NO: 859212 - protein, 20 aa, Mycobacterium
RYVMMVLRHIPRSIFRKLPI

SEQ ID NO: 859213 - protein, 30 aa, Mycobacterium
RYVPGGTVRNWPWRRLALSKTANTYSRLAL

SEQ ID NO: 859214 - protein, 17 aa, Mycobacterium
RYVPMLAGVGRRPRRDR

SEQ ID NO: 859215 - protein, 24 aa, Mycobacterium
RYVPVLTELRMRYLDDATWDGDIV

SEQ ID NO: 859216 - protein, 26 aa, Mycobacterium
RYVRPPWLRRWVRDGYAWVQPRLSPV

SEQ ID NO: 859217 - protein, 30 aa, Mycobacterium
RYVRPPWLRRWVRDGYGWVQPRLSPIARSA

SEQ ID NO: 859218 - protein, 19 aa, Mycobacterium
RYVSYPLIDTSVALAWIAQ

SEQ ID NO: 859219 - protein, 18 aa, Mycobacterium
RYVYRVRCEVEVDGVVRL

SEQ ID NO: 859220 - protein, 29 aa, Mycobacterium
RYWETAAGLIAPVLDLLLEAPDGTVLSLN

SEQ ID NO: 859221 - protein, 20 aa, Mycobacterium
RYWGSPIPVWKSDDPAYPRI

SEQ ID NO: 859222 - protein, 22 aa, Mycobacterium
RYWREAFRLPSMDHAELGRKLW

SEQ ID NO: 859223 - protein, 20 aa, Mycobacterium
RYWRRYFDNFAEVMSSASRV

SEQ ID NO: 859224 - protein, 18 aa, Mycobacterium
RYYILEAGRITSSGTGGS

SEQ ID NO: 859225 - protein, 25 aa, Mycobacterium
RYYKQASHLLRPLPGARALLQRVAG

SEQ ID NO: 859226 - protein, 20 aa, Mycobacterium
RYYPALVEASGYRKKFDTAS

SEQ ID NO: 859227 - protein, 20 aa, Mycobacterium
RYYSVIYQAIDEIEKALRGM

SEQ ID NO: 859228 - protein, 22 aa, Mycobacterium
SAAAAALSPWGAGPQGNSAGSG

SEQ ID NO: 859229 - protein, 32 aa, Mycobacterium
SAAAAGLAPWQQLLQNIPGLSALSAVGNIGAG

SEQ ID NO: 859230 - protein, 35 aa, Mycobacterium
SAAAAQLAPWQQWLQSLPGLPGQLAGSATAAAAAN

SEQ ID NO: 859231 - protein, 18 aa, Mycobacterium
SAAAAWDGLAAELQAAAT

SEQ ID NO: 859232 - protein, 28 aa, Mycobacterium
SAAAEQLTPFHRMLAGLSGRSVSSAVAG

SEQ ID NO: 859233 - protein, 29 aa, Mycobacterium
SAAAGLRPLRPWRAALVAALAASAGARPL

SEQ ID NO: 859234 - protein, 24 aa, Mycobacterium
SAAALHRTGWIDDWLPAELNRRGR

SEQ ID NO: 859235 - protein, 21 aa, Mycobacterium
SAAALWDGCGAWSAPRRGGGR

SEQ ID NO: 859236 - protein, 23 aa, Mycobacterium
SAAAMHGALWIDPPPAGRTEPAQ

SEQ ID NO: 859237 - protein, 25 aa, Mycobacterium
SAAAMTAAITPYLEWMRTTGAQAEE

SEQ ID NO: 859238 - protein, 26 aa, Mycobacterium
SAAANMRMYLLLKQRAEAFRADPAVR

SEQ ID NO: 859239 - protein, 25 aa, Mycobacterium
SAAAPFNAFLIAQGLETLSLRVERH

SEQ ID NO: 859240 - protein, 24 aa, Mycobacterium
SAAAPVMLPAYRVLGDDGTLVSAR

SEQ ID NO: 859241 - protein, 29 aa, Mycobacterium
SAAAREVGSVRLVLGWLPAPIDGLDADAF

SEQ ID NO: 859242 - protein, 23 aa, Mycobacterium
SAAAVDLWADRLGGAVLAIGNAP

SEQ ID NO: 859243 - protein, 24 aa, Mycobacterium
SAAAVVDWLQPFIDELRVCLHGCG

SEQ ID NO: 859244 - protein, 27 aa, Mycobacterium
SAAAYLGAHAPYLDWLTRSSAASAAMA

SEQ ID NO: 859245 - protein, 23 aa, Mycobacterium
SAADILRAWGKLGYPRRAKRLHE

SEQ ID NO: 859246 - protein, 18 aa, Mycobacterium
SAADLIMLGGCAAVEHAA

SEQ ID NO: 859247 - protein, 24 aa, Mycobacterium
SAADMHTWLLAHLGAVRGPEHLMQ

SEQ ID NO: 859248 - protein, 18 aa, Mycobacterium
SAADPLVISLLTGAAKPD

SEQ ID NO: 859249 - protein, 22 aa, Mycobacterium
SAAEIGLVKRLLRQSQKTTRLI

SEQ ID NO: 859250 - protein, 24 aa, Mycobacterium
SAAELAGLLIDPDGTRCDPRRPSI

SEQ ID NO: 859251 - protein, 36 aa, Mycobacterium
SAAELRKFLADRVVRWWLPERWAFADQVPRTSVGKY

SEQ ID NO: 859252 - protein, 25 aa, Mycobacterium
SAAELRRFLLQQLPAAMVPAVFAVT

SEQ ID NO: 859253 - protein, 19 aa, Mycobacterium
SAAERSLFASLCSFAGIAL

SEQ ID NO: 859254 - protein, 22 aa, Mycobacterium
SAAFELLRWLSQEANVKLRTLA

SEQ ID NO: 859255 - protein, 22 aa, Mycobacterium
SAAFMRGGAVGAPLLRIEAAEV

SEQ ID NO: 859256 - protein, 20 aa, Mycobacterium
SAAFRDLLAEWKAAGRAAKD

SEQ ID NO: 859257 - protein, 23 aa, Mycobacterium
SAAFTALAHYLAELTALAQELSM

SEQ ID NO: 859258 - protein, 24 aa, Mycobacterium
SAAGFDVWLLNWRGSIDVEPTSYT

SEQ ID NO: 859259 - protein, 22 aa, Mycobacterium
SAAGLLDGAWALGSATGASSSG

SEQ ID NO: 859260 - protein, 34 aa, Mycobacterium
SAAGLRRLAVGHWLRRWWPASQRDDIAGLDRALL

SEQ ID NO: 859261 - protein, 22 aa, Mycobacterium
SAAGLVGLALTSGYGASKWGVR

SEQ ID NO: 859262 - protein, 25 aa, Mycobacterium
SAAGNFRLERAASVAAGATVAAVAT

SEQ ID NO: 859263 - protein, 29 aa, Mycobacterium
SAAGRFGVPMVWVPPLRERVSDIGVLWNS

SEQ ID NO: 859264 - protein, 26 aa, Mycobacterium
SAAGRRRLILIYAPSGYGKSTLAAQW

SEQ ID NO: 859265 - protein, 25 aa, Mycobacterium
SAAGRYRVQPIGSGGLRPGVDLSSN

SEQ ID NO: 859266 - protein, 30 aa, Mycobacterium
SAAGVLELAWTTGLIRWEDAPHPGWYDTES

SEQ ID NO: 859267 - protein, 29 aa, Mycobacterium
SAAGVLELAWTTGLIRWEDDPQPGWYDTE

SEQ ID NO: 859268 - protein, 28 aa, Mycobacterium
SAAGVLELAWTTGLVKWEDDPQPGWYDT

SEQ ID NO: 859269 - protein, 28 aa, Mycobacterium
SAAGVLELAWTTGLVKWENDPEAGWYDT

SEQ ID NO: 859270 - protein, 19 aa, Mycobacterium
SAAGWRTAWNRPEGPPEPQ

SEQ ID NO: 859271 - protein, 21 aa, Mycobacterium
SAAIAVCLFRLETEVTAVPGA

SEQ ID NO: 859272 - protein, 29 aa, Mycobacterium
SAAIPPLRDLYRDRLLVLAALDVASTVEN

SEQ ID NO: 859273 - protein, 33 aa, Mycobacterium
SAAISPKAPPPPPPPPPPPTTRMRWPLGSVQVN

SEQ ID NO: 859274 - protein, 27 aa, Mycobacterium
SAAISRVPLMPAMLEWLHTARTSMVMD

SEQ ID NO: 859275 - protein, 28 aa, Mycobacterium
SAAKGLALAWGVPFYGVNHLGGHIAADV

SEQ ID NO: 859276 - protein, 27 aa, Mycobacterium
SAAKMFNATGWKIGWACGAPELIAGVR

SEQ ID NO: 859277 - protein, 27 aa, Mycobacterium
SAAKTMGLPILYPWANRLGANSYTAEG

SEQ ID NO: 859278 - protein, 19 aa, Mycobacterium
SAALDRWGRIDFLVNNAGI

SEQ ID NO: 859279 - protein, 20 aa, Mycobacterium
SAALHGVQLWVALPGSDRDT

SEQ ID NO: 859280 - protein, 20 aa, Mycobacterium
SAALIAKRRLRFPVGHSVDA

SEQ ID NO: 859281 - protein, 23 aa, Mycobacterium
SAALIFLDIHLTYQRLALGAHGA

SEQ ID NO: 859282 - protein, 30 aa, Mycobacterium
SAALPPSALWGRENYFRGLLGDRVTDVKTR

SEQ ID NO: 859283 - protein, 19 aa, Mycobacterium
SAALTPAFPGLDTFAGEVY

SEQ ID NO: 859284 - protein, 29 aa, Mycobacterium
SAAMAAAVAPYTSWLSAAAAQAVGAAGAA

SEQ ID NO: 859285 - protein, 25 aa, Mycobacterium
SAAPKLYPHMWSWDAAFVAVGLAPL

SEQ ID NO: 859286 - protein, 26 aa, Mycobacterium
SAAPMTAAILRRALAVLPDAGFLNLY

SEQ ID NO: 859287 - protein, 28 aa, Mycobacterium
SAAPNRATMLLFMQGRRGAAPEVRYISA

SEQ ID NO: 859288 - protein, 30 aa, Mycobacterium
SAARDAARFLLLTPPLPLPARAPYGVLATT

SEQ ID NO: 859289 - protein, 26 aa, Mycobacterium
SAASFPGWDSFGAMVTHLRFIRDHQK

SEQ ID NO: 859290 - protein, 24 aa, Mycobacterium
SAASPAAMYSPPPAALEALDDKHR

SEQ ID NO: 859291 - protein, 26 aa, Mycobacterium
SAASPVLLGVLPMGGDPDSAMFAAAL

SEQ ID NO: 859292 - protein, 24 aa, Mycobacterium
SAASVRLHPDIRLYCAIPQERSLT

SEQ ID NO: 859293 - protein, 25 aa, Mycobacterium
SAATALVQSLVTLGLRTAKHGEYAS

SEQ ID NO: 859294 - protein, 24 aa, Mycobacterium
SAATHWATALAPYGLRWYEEPGDP

SEQ ID NO: 859295 - protein, 27 aa, Mycobacterium
SAATPSRLVLLAPWLDVSMSDPRSAEI

SEQ ID NO: 859296 - protein, 25 aa, Mycobacterium
SAATSLTPFTPPPPTANPAGLVSQA

SEQ ID NO: 859297 - protein, 20 aa, Mycobacterium
SAATVLDTDCRVYRVAGLRV

SEQ ID NO: 859298 - protein, 44 aa, Mycobacterium
SAAVATLFACYGQTYQTLGIAAARFHDEFVGNLRAAATSYASAE

SEQ ID NO: 859299 - protein, 23 aa, Mycobacterium
SAAVATLFSQHAHAYQAASAQAA

SEQ ID NO: 859300 - protein, 25 aa, Mycobacterium
SAAVEGLILGAYRFSDFRSEKTAPK

SEQ ID NO: 859301 - protein, 26 aa, Mycobacterium
SAAVEGLILGSYRFTEFRSGKTAPKD

SEQ ID NO: 859302 - protein, 23 aa, Mycobacterium
SAAVGLPAPKLVVEPGRAIAGPG

SEQ ID NO: 859303 - protein, 25 aa, Mycobacterium
SAAVSLRVPTFIRYDLRADGDDLQV

SEQ ID NO: 859304 - protein, 25 aa, Mycobacterium
SAAWLPTLLWRRWSPGYYAEEDLRH

SEQ ID NO: 859305 - protein, 24 aa, Mycobacterium
SAAWRAWAAAPDGWIAIPHGEILC

SEQ ID NO: 859306 - protein, 23 aa, Mycobacterium
SAAYLLPHLKPGQSVLDIGCGPG

SEQ ID NO: 859307 - protein, 22 aa, Mycobacterium
SAAYLRATFDWHIDGCTPIGDE

SEQ ID NO: 859308 - protein, 24 aa, Mycobacterium
SACATRGGLLPSGPRRRYAAQTSD

SEQ ID NO: 859309 - protein, 24 aa, Mycobacterium
SACDRAVAAWLWSGRRATVAGLSA

SEQ ID NO: 859310 - protein, 20 aa, Mycobacterium
SACHISILPTLLTANDAIIL

SEQ ID NO: 859311 - protein, 17 aa, Mycobacterium
SACLYLLEHFDGPKPVN

SEQ ID NO: 859312 - protein, 26 aa, Mycobacterium
SACNPYLTFAVLLAAGLRGIEKNYVL

SEQ ID NO: 859313 - protein, 26 aa, Mycobacterium
SACNPYLTYAVLLAAGLRGVEQGYTL

SEQ ID NO: 859314 - protein, 31 aa, Mycobacterium
SACQIAGITYRQLDYWARTSLVVPSIRGAAG

SEQ ID NO: 859315 - protein, 20 aa, Mycobacterium
SACRALLLENPSPGAALSGM

SEQ ID NO: 859316 - protein, 20 aa, Mycobacterium
SACRLSWPEYSGNLMYMTLG

SEQ ID NO: 859317 - protein, 25 aa, Mycobacterium
SADAAAVLVAMNELWHAGVPRRDLH

SEQ ID NO: 859318 - protein, 23 aa, Mycobacterium
SADAAIAAKPKRNPLCCMAHPFS

SEQ ID NO: 859319 - protein, 25 aa, Mycobacterium
SADAGVADIAFAFGSGSSASATGGV

SEQ ID NO: 859320 - protein, 29 aa, Mycobacterium
SADALRPDLILLDVYLPDMTGLEVLKRLR

SEQ ID NO: 859321 - protein, 19 aa, Mycobacterium
SADALRWGLINQVVPDGTV

SEQ ID NO: 859322 - protein, 23 aa, Mycobacterium
SADATLTLALPKIGMRNAPQVGS

SEQ ID NO: 859323 - protein, 24 aa, Mycobacterium
SADAYSLAHLGAVDAALAASDAML

SEQ ID NO: 859324 - protein, 24 aa, Mycobacterium
SADDLWIRIMNVPAALEARRYQAD

SEQ ID NO: 859325 - protein, 24 aa, Mycobacterium
SADDRRYLLFNPVTKMKATTEAEK

SEQ ID NO: 859326 - protein, 28 aa, Mycobacterium
SADEFRVQIYARLVMIWTSAAANDAHTA

SEQ ID NO: 859327 - protein, 24 aa, Mycobacterium
SADENLHMIFYRDVSEAAFDLAPN

SEQ ID NO: 859328 - protein, 24 aa, Mycobacterium
SADENLHMIFYRDVSEAGFEIAPN

SEQ ID NO: 859329 - protein, 21 aa, Mycobacterium
SADERAAFLATLSPETVDAMV

SEQ ID NO: 859330 - protein, 26 aa, Mycobacterium
SADERLRAVTPLLTTPPPGGTAEQHL

SEQ ID NO: 859331 - protein, 26 aa, Mycobacterium
SADERRLALRRACAAGALATLVPGAG

SEQ ID NO: 859332 - protein, 31 aa, Mycobacterium
SADGRTCLLTPPPWYPILRGTTQQALFEVAR

SEQ ID NO: 859333 - protein, 28 aa, Mycobacterium
SADKAVPEWLWQAPACVKRAFLQALFEG

SEQ ID NO: 859334 - protein, 29 aa, Mycobacterium
SADKHVPEWLWQSPAAVKRAFLQALFEGD

SEQ ID NO: 859335 - protein, 17 aa, Mycobacterium
SADLGDPDRWQPWREFI

SEQ ID NO: 859336 - protein, 22 aa, Mycobacterium
SADLPGVRLPGAPFMGVMGVAP

SEQ ID NO: 859337 - protein, 22 aa, Mycobacterium
SADLPWHRVIGASGRPAPHIRT

SEQ ID NO: 859338 - protein, 17 aa, Mycobacterium
SADLRAILTYYLEAQAK

SEQ ID NO: 859339 - protein, 21 aa, Mycobacterium
SADLTTAANLILSIAANAVAE

SEQ ID NO: 859340 - protein, 24 aa, Mycobacterium
SADPDALRLLIYTSGSTGTPKGAM

SEQ ID NO: 859341 - protein, 25 aa, Mycobacterium
SADPFGDVFLVIDGWPAFAAEFDAL

SEQ ID NO: 859342 - protein, 19 aa, Mycobacterium
SADPRFRFFGNVVIGEHVH

SEQ ID NO: 859343 - protein, 17 aa, Mycobacterium
SADRGFWAKLEGFNPGG

SEQ ID NO: 859344 - protein, 27 aa, Mycobacterium
SADSAHAAILPLYYLRRADIAETDLHV

SEQ ID NO: 859345 - protein, 31 aa, Mycobacterium
SADSTPLFVMLLAECWRWGADEGAVRALLPA

SEQ ID NO: 859346 - protein, 24 aa, Mycobacterium
SADTHLLRYPLPAAWADTVDVQLY

SEQ ID NO: 859347 - protein, 22 aa, Mycobacterium
SADTHLLRYPLPSRWCSEVDVA

SEQ ID NO: 859348 - protein, 24 aa, Mycobacterium
SADTLLVLALPPGDSAEPALYLVD

SEQ ID NO: 859349 - protein, 25 aa, Mycobacterium
SADTRPMFAQLMLDEAFSKSDPQFA

SEQ ID NO: 859350 - protein, 27 aa, Mycobacterium
SADTYVPEWMWHSPAAVKRVFLQALFE

SEQ ID NO: 859351 - protein, 21 aa, Mycobacterium
SADVYQLFTYAYALGAGAEEK

SEQ ID NO: 859352 - protein, 18 aa, Mycobacterium
SADWLHRLRIVGIDLRDP

SEQ ID NO: 859353 - protein, 17 aa, Mycobacterium
SADYFDVEKFPVATFVS

SEQ ID NO: 859354 - protein, 33 aa, Mycobacterium
SADYRWMNLMARLPRKALPLIVKRIAQGVGGAV

SEQ ID NO: 859355 - protein, 39 aa, Mycobacterium
SAEAANAAPFQGLLGAVNAPVQTLTGRPLIGNGANGAPG

SEQ ID NO: 859356 - protein, 48 aa, Mycobacterium
SAEAANVTPLQTIEQDLLGAVNAPTQVLFGRGLIGDGANGTAPGQAGG

SEQ ID NO: 859357 - protein, 27 aa, Mycobacterium
SAEAHLISPWGTWEWMWPAAAGVDLPA

SEQ ID NO: 859358 - protein, 29 aa, Mycobacterium
SAEALGNGWFWPAAAAHPSLPRGALLQVA

SEQ ID NO: 859359 - protein, 27 aa, Mycobacterium
SAEALIYRTPIMAPQNIFLSVHREYGY

SEQ ID NO: 859360 - protein, 27 aa, Mycobacterium
SAEAQLWFDRGLVWAYAFNHEEAIRCF

SEQ ID NO: 859361 - protein, 21 aa, Mycobacterium
SAEAQYEQMWAQDVVAMLGYH

SEQ ID NO: 859362 - protein, 26 aa, Mycobacterium
SAEDHAWSYVFLASHRARGITGDVIH

SEQ ID NO: 859363 - protein, 24 aa, Mycobacterium
SAEDRRYLLYSPLTKAKVTSEGER

SEQ ID NO: 859364 - protein, 20 aa, Mycobacterium
SAEEIAWAKEFFVEFERDGG

SEQ ID NO: 859365 - protein, 24 aa, Mycobacterium
SAEFRKLLTEWKAAGRAARDVDDA

SEQ ID NO: 859366 - protein, 23 aa, Mycobacterium
SAEFRKLLTEWKAAGRATREVDD

SEQ ID NO: 859367 - protein, 25 aa, Mycobacterium
SAEGKSRRFAYPPNLYVVDGGAPQV

SEQ ID NO: 859368 - protein, 17 aa, Mycobacterium
SAEGLLGYLPPEAQDRL

SEQ ID NO: 859369 - protein, 22 aa, Mycobacterium
SAEHWAAWLDKYGDDYATDDER

SEQ ID NO: 859370 - protein, 30 aa, Mycobacterium
SAEISDGTLRFLLWAAALLSPQPPSLMVLN

SEQ ID NO: 859371 - protein, 29 aa, Mycobacterium
SAEISTGPYRFLYRKRFHKRAETQLTILS

SEQ ID NO: 859372 - protein, 25 aa, Mycobacterium
SAEKPQLNVLLWQRAQDPQKGAWSL

SEQ ID NO: 859373 - protein, 20 aa, Mycobacterium
SAELLARWNAREGALIATDP

SEQ ID NO: 859374 - protein, 21 aa, Mycobacterium
SAELMARLPFELTAGQREVLE

SEQ ID NO: 859375 - protein, 30 aa, Mycobacterium
SAELYVAAHVPYLMWLMRASATSAQAAAQH

SEQ ID NO: 859376 - protein, 22 aa, Mycobacterium
SAENPFPVRAVAIRVAGWIDRL

SEQ ID NO: 859377 - protein, 21 aa, Mycobacterium
SAENPFPVRAVAIRVASWIDR

SEQ ID NO: 859378 - protein, 22 aa, Mycobacterium
SAEQCLMVARQLAAVLGGDRNH

SEQ ID NO: 859379 - protein, 24 aa, Mycobacterium
SAEQHMVLARLLPPGYRAMAMING

SEQ ID NO: 859380 - protein, 17 aa, Mycobacterium
SAEQVRWVLQDSGAVLA

SEQ ID NO: 859381 - protein, 25 aa, Mycobacterium
SAERWKVRFNARLEEAIKSKSAPAA

SEQ ID NO: 859382 - protein, 24 aa, Mycobacterium
SAESAARPLLFYRGQYTGIEPDKN

SEQ ID NO: 859383 - protein, 31 aa, Mycobacterium
SAESPLPPPTIHRLLRTLVGLGYVRQLPNRR

SEQ ID NO: 859384 - protein, 21 aa, Mycobacterium
SAESYLVFEKILDAAEKSGAN

SEQ ID NO: 859385 - protein, 28 aa, Mycobacterium
SAEVGWCDHLILAVPLTDATRGLVDAAV

SEQ ID NO: 859386 - protein, 24 aa, Mycobacterium
SAEVRRRVSVMSSPRTQLARQLTV

SEQ ID NO: 859387 - protein, 23 aa, Mycobacterium
SAEWQRVITPSKVAAILGVSRWE

SEQ ID NO: 859388 - protein, 22 aa, Mycobacterium
SAEYAYRFAPLVGIYGGTLEVF

SEQ ID NO: 859389 - protein, 27 aa, Mycobacterium
SAEYGLLPQWGLARLLQIAPVSREMIL

SEQ ID NO: 859390 - protein, 20 aa, Mycobacterium
SAEYYAYSPGFYKEAGEWFA

SEQ ID NO: 859391 - protein, 21 aa, Mycobacterium
SAEYYAYSPGFYKEAGEWFAA

SEQ ID NO: 859392 - protein, 52 aa, Mycobacterium
SAFAALYRFQFDQVRRLLAWATPYREMMGPFVSVYARCYLGLAAKFALDIAT

SEQ ID NO: 859393 - protein, 24 aa, Mycobacterium
SAFAELYLDVLQRFARRFDNPMPY

SEQ ID NO: 859394 - protein, 26 aa, Mycobacterium
SAFAPVLRARRHLLVAAGIGITPMVS

SEQ ID NO: 859395 - protein, 25 aa, Mycobacterium
SAFARFLPDWQYLDSNLRGIDGVAT

SEQ ID NO: 859396 - protein, 22 aa, Mycobacterium
SAFASAWELWRRGAGEVQLGLS

SEQ ID NO: 859397 - protein, 26 aa, Mycobacterium
SAFDLSVWDIWGALLRGRRLLVVPEA

SEQ ID NO: 859398 - protein, 17 aa, Mycobacterium
SAFEAARAAMIHPLAVA

SEQ ID NO: 859399 - protein, 17 aa, Mycobacterium
SAFFADNPFRFNDDIIV

SEQ ID NO: 859400 - protein, 20 aa, Mycobacterium
SAFFDEAARRGLRTVAEAFA

SEQ ID NO: 859401 - protein, 21 aa, Mycobacterium
SAFGPPPIWLAGVGTGMTEVA

SEQ ID NO: 859402 - protein, 29 aa, Mycobacterium
SAFIHGTVFPNLSFLNVLIGRDKKSMPVP

SEQ ID NO: 859403 - protein, 26 aa, Mycobacterium
SAFYATSLDYLLTRLDTRRIILTGQV

SEQ ID NO: 859404 - protein, 24 aa, Mycobacterium
SAGAGNFNLALARAYKAVADATGG

SEQ ID NO: 859405 - protein, 23 aa, Mycobacterium
SAGAIKGFPLQTPYTAAKHGVVG

SEQ ID NO: 859406 - protein, 23 aa, Mycobacterium
SAGAQLAVWAGTRHKLRDDEVGS

SEQ ID NO: 859407 - protein, 23 aa, Mycobacterium
SAGARPWLAGAAEPAIFAIQVGL

SEQ ID NO: 859408 - protein, 25 aa, Mycobacterium
SAGDDPLALLIYTSGSTGAPKGAMH

SEQ ID NO: 859409 - protein, 25 aa, Mycobacterium
SAGDGGTGGLGGHGGAGADNTTTVS

SEQ ID NO: 859410 - protein, 24 aa, Mycobacterium
SAGDRRYLLYSPLTKAKVTSEGER

SEQ ID NO: 859411 - protein, 17 aa, Mycobacterium
SAGDWIATRKNARWLRT

SEQ ID NO: 859412 - protein, 24 aa, Mycobacterium
SAGEAIALIHKRSHGAAVVLEHGK

SEQ ID NO: 859413 - protein, 24 aa, Mycobacterium
SAGELPLVLYYHGGGFALGSIDTH

SEQ ID NO: 859414 - protein, 30 aa, Mycobacterium
SAGERQLLAVALLWGLAQAAGQPLPMVIDT

SEQ ID NO: 859415 - protein, 30 aa, Mycobacterium
SAGERQLLAVALLWGLARAAGQPLPVVIDT

SEQ ID NO: 859416 - protein, 26 aa, Mycobacterium
SAGGLPPVPVVLPKPVRQLQQTVTEI

SEQ ID NO: 859417 - protein, 17 aa, Mycobacterium
SAGGWLYDRAMAGWEVT

SEQ ID NO: 859418 - protein, 26 aa, Mycobacterium
SAGHEYLLHHVPRPPALQVGTCTALP

SEQ ID NO: 859419 - protein, 20 aa, Mycobacterium
SAGHIYAVIGLKDTTTGDTL

SEQ ID NO: 859420 - protein, 25 aa, Mycobacterium
SAGHPLPVFFGNRNWHPMVEDTVAE

SEQ ID NO: 859421 - protein, 25 aa, Mycobacterium
SAGIDDAWIFARTAIRTRRWADPEQ

SEQ ID NO: 859422 - protein, 18 aa, Mycobacterium
SAGIIDAGLSRGLAGVSG

SEQ ID NO: 859423 - protein, 31 aa, Mycobacterium
SAGKWASIVPHTWLWTSPLGPEVRAVEMVDP

SEQ ID NO: 859424 - protein, 26 aa, Mycobacterium
SAGLARHVLCFRTLWEATFGQLVKEG

SEQ ID NO: 859425 - protein, 18 aa, Mycobacterium
SAGLLAKWNAREAALIAT

SEQ ID NO: 859426 - protein, 19 aa, Mycobacterium
SAGLLFSNGGAGGAGGAGT

SEQ ID NO: 859427 - protein, 26 aa, Mycobacterium
SAGLQSMLPAITPLANIFAKLTVEGS

SEQ ID NO: 859428 - protein, 19 aa, Mycobacterium
SAGLRRDPRTWARGLWRAS

SEQ ID NO: 859429 - protein, 23 aa, Mycobacterium
SAGLRRVIVIQAVRLADLAAARL

SEQ ID NO: 859430 - protein, 34 aa, Mycobacterium
SAGLVDFAPFLDISPQLWQRLIDVNLNGTFHCAQ

SEQ ID NO: 859431 - protein, 17 aa, Mycobacterium
SAGLWGNGGTGGAGGGP

SEQ ID NO: 859432 - protein, 24 aa, Mycobacterium
SAGNDFVLCRAHANRFSRGYFDQS

SEQ ID NO: 859433 - protein, 23 aa, Mycobacterium
SAGNVQWVLGNLGAIPTVTIDYK

SEQ ID NO: 859434 - protein, 23 aa, Mycobacterium
SAGQHRMWFVQSVDPDSALLNIC

SEQ ID NO: 859435 - protein, 23 aa, Mycobacterium
SAGRMWPHQLLTAFAARRMQLPV

SEQ ID NO: 859436 - protein, 17 aa, Mycobacterium
SAGSLARVPDRPPPRVP

SEQ ID NO: 859437 - protein, 28 aa, Mycobacterium
SAGTASTPLPQKAALAAGPANSAGPANT

SEQ ID NO: 859438 - protein, 25 aa, Mycobacterium
SAGTPPYLDPFLGSGTRLHWDSAAE

SEQ ID NO: 859439 - protein, 23 aa, Mycobacterium
SAGTRIVPIVPPLLAMLEQHRSD

SEQ ID NO: 859440 - protein, 26 aa, Mycobacterium
SAGVERTLAGFLNLQGVRPADMPLSA

SEQ ID NO: 859441 - protein, 24 aa, Mycobacterium
SAGVIEVAPLAYMRGRTLNDAFIV

SEQ ID NO: 859442 - protein, 24 aa, Mycobacterium
SAGVIGMIVADLWGGSVSNWLTAQ

SEQ ID NO: 859443 - protein, 25 aa, Mycobacterium
SAGVLDLWALWRRAGNESAVITSRV

SEQ ID NO: 859444 - protein, 32 aa, Mycobacterium
SAGVVRPDLVIGWWAVPTILEHGSPELIEQFV

SEQ ID NO: 859445 - protein, 33 aa, Mycobacterium
SAGYKARNPFAPLLLVLLQFQAGIKIDFRSEVT

SEQ ID NO: 859446 - protein, 23 aa, Mycobacterium
SAGYLRDILAKYTGLDCYDDFDR

SEQ ID NO: 859447 - protein, 17 aa, Mycobacterium
SAGYRILALFVSATSAP

SEQ ID NO: 859448 - protein, 18 aa, Mycobacterium
SAGYRYLGGAPPLPSTED

SEQ ID NO: 859449 - protein, 21 aa, Mycobacterium
SAHDPLSYLPIGISVEDWEDY

SEQ ID NO: 859450 - protein, 24 aa, Mycobacterium
SAHEVRTWIAAFAALAAQGEYVTE

SEQ ID NO: 859451 - protein, 25 aa, Mycobacterium
SAHFDSMLIKLSCRGRDFPTAVRRA

SEQ ID NO: 859452 - protein, 33 aa, Mycobacterium
SAHFVWPRETLRLGEKYPLKAGLITSLGFGHVS

SEQ ID NO: 859453 - protein, 33 aa, Mycobacterium
SAHGFLCFASPLGQWRWLTASDGKPREVTWDGL

SEQ ID NO: 859454 - protein, 19 aa, Mycobacterium
SAHGLERTGAGARAAYELG

SEQ ID NO: 859455 - protein, 30 aa, Mycobacterium
SAHGLPTPAQLRLWQALDAIAPVHGAFNLD

SEQ ID NO: 859456 - protein, 17 aa, Mycobacterium
SAHGQVPRRWRSQAPLW

SEQ ID NO: 859457 - protein, 17 aa, Mycobacterium
SAHGWALNEVSLEKGPR

SEQ ID NO: 859458 - protein, 21 aa, Mycobacterium
SAHIFVLPSYNEGLPVALLEA

SEQ ID NO: 859459 - protein, 35 aa, Mycobacterium
SAHKVMPIMTSLLKYYPHLLALSASSPWWTGVDTG

SEQ ID NO: 859460 - protein, 25 aa, Mycobacterium
SAHNLWTRPPTDFTANFLGGANLIP

SEQ ID NO: 859461 - protein, 23 aa, Mycobacterium
SAHPIDLVLLDIGLPDANGIALA

SEQ ID NO: 859462 - protein, 22 aa, Mycobacterium
SAHPRIDLLINNAGVMYPPKQV

SEQ ID NO: 859463 - protein, 20 aa, Mycobacterium
SAHPVFRRRRFFNGRPVRRP

SEQ ID NO: 859464 - protein, 25 aa, Mycobacterium
SAHRKTLLPQLAAKRIRAFEPFIAD

SEQ ID NO: 859465 - protein, 18 aa, Mycobacterium
SAHRWLAGHQLGDTVVLP

SEQ ID NO: 859466 - protein, 22 aa, Mycobacterium
SAHTLPVLLAGADFIFSGFGSI

SEQ ID NO: 859467 - protein, 20 aa, Mycobacterium
SAHVDLYFEAAVAGAIPVIR

SEQ ID NO: 859468 - protein, 19 aa, Mycobacterium
SAHWGVLNVLVNAAGPMGA

SEQ ID NO: 859469 - protein, 22 aa, Mycobacterium
SAIAGHWAMTPALSRMAHDGDI

SEQ ID NO: 859470 - protein, 23 aa, Mycobacterium
SAIATYLVTLYTSLAVLTDDALA

SEQ ID NO: 859471 - protein, 26 aa, Mycobacterium
SAIAVLRFDGPWDELALGGAQLVTFH

SEQ ID NO: 859472 - protein, 17 aa, Mycobacterium
SAIAVPWQFGPVIETRK

SEQ ID NO: 859473 - protein, 39 aa, Mycobacterium
SAIDTALWDLKGKLLGLPVCRLLGMAHPAVPIYGSGGFT

SEQ ID NO: 859474 - protein, 34 aa, Mycobacterium
SAIDVLVGLNWLAPSRLDIWRQGRVAALEQLMQV

SEQ ID NO: 859475 - protein, 17 aa, Mycobacterium
SAIEASINLILYYQQMI

SEQ ID NO: 859476 - protein, 21 aa, Mycobacterium
SAIEFARRIAKLPTMAALLIK

SEQ ID NO: 859477 - protein, 23 aa, Mycobacterium
SAIELLVSGRWPFDELSRDVAGF

SEQ ID NO: 859478 - protein, 26 aa, Mycobacterium
SAIGDDWFEISLIPTTRELTTLGTAP

SEQ ID NO: 859479 - protein, 19 aa, Mycobacterium
SAIGRRLMVAPLSLTVDAC

SEQ ID NO: 859480 - protein, 24 aa, Mycobacterium
SAIHEMFVNTLGISSGSYAATEAA

SEQ ID NO: 859481 - protein, 18 aa, Mycobacterium
SAILDWAVRCSAELGIDA

SEQ ID NO: 859482 - protein, 18 aa, Mycobacterium
SAIPRFKQILRTHPLDLG

SEQ ID NO: 859483 - protein, 21 aa, Mycobacterium
SAIPVVAFRLAGDRGYTEFDV

SEQ ID NO: 859484 - protein, 23 aa, Mycobacterium
SAIQPEAMTPHWGRGTLVGKLTV

SEQ ID NO: 859485 - protein, 28 aa, Mycobacterium
SAIRAAQLPPVLPLPKTVQGLAFSVARR

SEQ ID NO: 859486 - protein, 18 aa, Mycobacterium
SAIRAILDNPAYRGIRVW

SEQ ID NO: 859487 - protein, 25 aa, Mycobacterium
SAIRQDIDWLDYLENPTGPRPFLRL

SEQ ID NO: 859488 - protein, 22 aa, Mycobacterium
SAIRWAVDLGLIPSADQIDSAA

SEQ ID NO: 859489 - protein, 21 aa, Mycobacterium
SAITAQLAYWLDALAGMPERL

SEQ ID NO: 859490 - protein, 27 aa, Mycobacterium
SAITPKTRLIWVETPTNPLLNVADIAG

SEQ ID NO: 859491 - protein, 25 aa, Mycobacterium
SAITREWFTNTFAAPTPAQASAWAA

SEQ ID NO: 859492 - protein, 26 aa, Mycobacterium
SAIVRHLREAFKKPIPPRVVDSGPVK

SEQ ID NO: 859493 - protein, 26 aa, Mycobacterium
SAIVRPLLRVFFRSWFRVEVSGIENL

SEQ ID NO: 859494 - protein, 25 aa, Mycobacterium
SAKDYRRWFATLPSELTDAVTQHWG

SEQ ID NO: 859495 - protein, 25 aa, Mycobacterium
SAKFSTKIVALNLLGALSVSTHANS

SEQ ID NO: 859496 - protein, 23 aa, Mycobacterium
SAKGKELVWAPGAFRYVMMVLRH

SEQ ID NO: 859497 - protein, 24 aa, Mycobacterium
SAKGLGILIERGYPIVFGVPTQTA

SEQ ID NO: 859498 - protein, 23 aa, Mycobacterium
SAKHWRRWRLTGDRSSYRSTKIP

SEQ ID NO: 859499 - protein, 23 aa, Mycobacterium
SAKIAFFFTRRKLAQMTGLQTAG

SEQ ID NO: 859500 - protein, 17 aa, Mycobacterium
SAKLEILEAIAATGVRE

SEQ ID NO: 859501 - protein, 25 aa, Mycobacterium
SAKLRDYLRWRDLTCRFPGCDAPVE

SEQ ID NO: 859502 - protein, 20 aa, Mycobacterium
SAKMCGWIDGAIRSGERAAS

SEQ ID NO: 859503 - protein, 24 aa, Mycobacterium
SAKMQSWDIYRCIRQVLAVLDPIP

SEQ ID NO: 859504 - protein, 17 aa, Mycobacterium
SAKQQLDHWARVGRAVS

SEQ ID NO: 859505 - protein, 23 aa, Mycobacterium
SAKRAYDVHPIVNALLDGDDPFE

SEQ ID NO: 859506 - protein, 24 aa, Mycobacterium
SAKRPLFTDFAPRLLVSHPSEVKV

SEQ ID NO: 859507 - protein, 18 aa, Mycobacterium
SAKRVAGIGGLYGDFFNF

SEQ ID NO: 859508 - protein, 26 aa, Mycobacterium
SAKTIRFYENAGLLPPPARTASGYRD

SEQ ID NO: 859509 - protein, 21 aa, Mycobacterium
SAKTYFGAIIGRYGNRIAGGV

SEQ ID NO: 859510 - protein, 18 aa, Mycobacterium
SAKVAELARLFSAPIRSG

SEQ ID NO: 859511 - protein, 18 aa, Mycobacterium
SALAARLFGRRAPIPSAE

SEQ ID NO: 859512 - protein, 28 aa, Mycobacterium
SALALKLINNLLFAANAQLLCAATHLGV

SEQ ID NO: 859513 - protein, 25 aa, Mycobacterium
SALALTLGGLLPPRDGRLSAEAAFA

SEQ ID NO: 859514 - protein, 26 aa, Mycobacterium
SALARQFRAAMSMPLILLGGINRLDT

SEQ ID NO: 859515 - protein, 27 aa, Mycobacterium
SALARRKVWTLIPHLQEFLANWFVSVD

SEQ ID NO: 859516 - protein, 23 aa, Mycobacterium
SALAWLCNAVSRFGRNPSAPHVR

SEQ ID NO: 859517 - protein, 23 aa, Mycobacterium
SALCDYFAPILAARRAKPKDDLI

SEQ ID NO: 859518 - protein, 22 aa, Mycobacterium
SALDGVLFIDEAYTLVQERDGR

SEQ ID NO: 859519 - protein, 19 aa, Mycobacterium
SALDIEVLGYEAAVALLQA

SEQ ID NO: 859520 - protein, 20 aa, Mycobacterium
SALDLNWLRRVALANLHRPS

SEQ ID NO: 859521 - protein, 30 aa, Mycobacterium
SALDLPEAPAPFMPVGTDPLSVAIIGQIPA

SEQ ID NO: 859522 - protein, 25 aa, Mycobacterium
SALDPRLWNWIAVSGLLLVMNSFTP

SEQ ID NO: 859523 - protein, 20 aa, Mycobacterium
SALEDVSIPTLLLSLVHITG

SEQ ID NO: 859524 - protein, 20 aa, Mycobacterium
SALFPVEVITTMLGVPEEDR

SEQ ID NO: 859525 - protein, 21 aa, Mycobacterium
SALHGLLKDGITIAAGGFGLC

SEQ ID NO: 859526 - protein, 23 aa, Mycobacterium
SALHRASLRPLRPPQRTPVRETP

SEQ ID NO: 859527 - protein, 32 aa, Mycobacterium
SALIASQLIGFALLRYVWKIEPIASMPDDEAV

SEQ ID NO: 859528 - protein, 18 aa, Mycobacterium
SALISTLPDQVTVKAGIS

SEQ ID NO: 859529 - protein, 36 aa, Mycobacterium
SALKGAHFIELCDKRKIPLLFLQNIAGFMVGRDYEA

SEQ ID NO: 859530 - protein, 28 aa, Mycobacterium
SALLADGPVVLFFYPAANTPGCTAEACH

SEQ ID NO: 859531 - protein, 17 aa, Mycobacterium
SALLDYEIPGLADAIRR

SEQ ID NO: 859532 - protein, 17 aa, Mycobacterium
SALLERFAGVIGGGLGD

SEQ ID NO: 859533 - protein, 22 aa, Mycobacterium
SALLISSFISLYRYGDVTATHR

SEQ ID NO: 859534 - protein, 24 aa, Mycobacterium
SALLKGMTAHYLLKSTYPVQPSDT

SEQ ID NO: 859535 - protein, 24 aa, Mycobacterium
SALLKGMTAHYLLKSTYPVQQGDA

SEQ ID NO: 859536 - protein, 18 aa, Mycobacterium
SALLLDRLVHQAGVPEGV

SEQ ID NO: 859537 - protein, 35 aa, Mycobacterium
SALLNALEISWGDVALLLSVPRQGLGNAAISSVAT

SEQ ID NO: 859538 - protein, 21 aa, Mycobacterium
SALLRLLDMLVSDALTVTLHL

SEQ ID NO: 859539 - protein, 20 aa, Mycobacterium
SALLRSARLLAPGGAIVVGG

SEQ ID NO: 859540 - protein, 18 aa, Mycobacterium
SALLVTRTLFVTRSLPAI

SEQ ID NO: 859541 - protein, 18 aa, Mycobacterium
SALMIMTLGAEKGAQVTV

SEQ ID NO: 859542 - protein, 27 aa, Mycobacterium
SALMISALVAMRRLSVASASRLVDELR

SEQ ID NO: 859543 - protein, 21 aa, Mycobacterium
SALPDLTTFALPARVALTAHT

SEQ ID NO: 859544 - protein, 18 aa, Mycobacterium
SALPFRFTVNGYRGCTHA

SEQ ID NO: 859545 - protein, 18 aa, Mycobacterium
SALPFRYTVNGYRGCSHA

SEQ ID NO: 859546 - protein, 26 aa, Mycobacterium
SALPGKKFRWLTVDLPPIIDIRKRLL

SEQ ID NO: 859547 - protein, 28 aa, Mycobacterium
SALPTGDFSGWIDPPGLAGTPAAPPAPG

SEQ ID NO: 859548 - protein, 23 aa, Mycobacterium
SALQASLFTAYGTLYQQVSAEAA

SEQ ID NO: 859549 - protein, 19 aa, Mycobacterium
SALQILDRALADTAVLGVT

SEQ ID NO: 859550 - protein, 17 aa, Mycobacterium
SALRDAYRDRLLVLAAL

SEQ ID NO: 859551 - protein, 20 aa, Mycobacterium
SALRLAPRFVDPSTLNPPGS

SEQ ID NO: 859552 - protein, 21 aa, Mycobacterium
SALRLAPRFVDPSTLNPPGSL

SEQ ID NO: 859553 - protein, 31 aa, Mycobacterium
SALRTRYHRLFPDVYIRCDAELSPQARARAG

SEQ ID NO: 859554 - protein, 18 aa, Mycobacterium
SALTALFAPFTSREAFIC

SEQ ID NO: 859555 - protein, 35 aa, Mycobacterium
SALTDVRPTLFLGVPRVWVKAKMGLDAALQEAGPL

SEQ ID NO: 859556 - protein, 39 aa, Mycobacterium
SALTEAVFFALSRKAPGLVRWLLRRKAISSLPEGYDVDT

SEQ ID NO: 859557 - protein, 27 aa, Mycobacterium
SALTGPLGPVSLFGIGGSPYLLGVENY

SEQ ID NO: 859558 - protein, 28 aa, Mycobacterium
SALTLDDVVKFLLPRGAAKKTAKAASTA

SEQ ID NO: 859559 - protein, 28 aa, Mycobacterium
SALTMLRQLLRLPHNPHPWDELWLDAAV

SEQ ID NO: 859560 - protein, 21 aa, Mycobacterium
SALTPFIQFVQNPVAAGEALV

SEQ ID NO: 859561 - protein, 25 aa, Mycobacterium
SALTRQRFDWKPTGPSLLDDLETGD

SEQ ID NO: 859562 - protein, 18 aa, Mycobacterium
SALTRRGPHRVLRGDLAF

SEQ ID NO: 859563 - protein, 24 aa, Mycobacterium
SALTYANLTRWLRGTERMHDGAMA

SEQ ID NO: 859564 - protein, 26 aa, Mycobacterium
SALVAAVYLRLLRDLPLHTDVNDTTK

SEQ ID NO: 859565 - protein, 19 aa, Mycobacterium
SALVEFGLPGLAVDETLGG

SEQ ID NO: 859566 - protein, 23 aa, Mycobacterium
SALVGDWQASIARLQQLLDEQRA

SEQ ID NO: 859567 - protein, 17 aa, Mycobacterium
SALVRACLAAEDPVFGV

SEQ ID NO: 859568 - protein, 20 aa, Mycobacterium
SALWEAGLFEEHGFGDIKIS

SEQ ID NO: 859569 - protein, 21 aa, Mycobacterium
SALWFDANLLHGSGSNITPLP

SEQ ID NO: 859570 - protein, 39 aa, Mycobacterium
SALWGRGLIGTTIFLVDYLINFFQYHLPGVQAYHLDVVP

SEQ ID NO: 859571 - protein, 20 aa, Mycobacterium
SALYLAGEGAFPADRVKILS

SEQ ID NO: 859572 - protein, 19 aa, Mycobacterium
SALYLAGEGAFPPDRVKIL

SEQ ID NO: 859573 - protein, 17 aa, Mycobacterium
SAMAQLYVHGHDLDFRT

SEQ ID NO: 859574 - protein, 20 aa, Mycobacterium
SAMCLGLARAAIEQARLGLG

SEQ ID NO: 859575 - protein, 21 aa, Mycobacterium
SAMDTLLHHLGDRQMLLLVDN

SEQ ID NO: 859576 - protein, 19 aa, Mycobacterium
SAMETSARTIWLLSDPDRN

SEQ ID NO: 859577 - protein, 17 aa, Mycobacterium
SAMLKRLGIEGDFKGGF

SEQ ID NO: 859578 - protein, 18 aa, Mycobacterium
SAMLLLFGAANRDPRRYT

SEQ ID NO: 859579 - protein, 19 aa, Mycobacterium
SAMLLMREAYYGTTRFDDF

SEQ ID NO: 859580 - protein, 25 aa, Mycobacterium
SAMPWSEFAAIVYGLVMEGRETESG

SEQ ID NO: 859581 - protein, 23 aa, Mycobacterium
SAMSAFKGLFPAAAAVGAQVAAA

SEQ ID NO: 859582 - protein, 21 aa, Mycobacterium
SAMSFAFFYLGTHASERDRLV

SEQ ID NO: 859583 - protein, 17 aa, Mycobacterium
SAMSLREQIIPPTLNFS

SEQ ID NO: 859584 - protein, 22 aa, Mycobacterium
SAMVHPLEVAANRNAFVKLVLS

SEQ ID NO: 859585 - protein, 23 aa, Mycobacterium
SAMVQPFLLAANRSSLVSLVLSN

SEQ ID NO: 859586 - protein, 27 aa, Mycobacterium
SAMVRLRTLYRDQLLVLAALDLAATVE

SEQ ID NO: 859587 - protein, 27 aa, Mycobacterium
SANARSINLLRRLGFESISTFIQFDAE

SEQ ID NO: 859588 - protein, 33 aa, Mycobacterium
SANCKCYCRLHHLIKTFWPGFSDAQHPDGTVVV

SEQ ID NO: 859589 - protein, 24 aa, Mycobacterium
SANEYVVGWIKRGPSGVIGSNKKD

SEQ ID NO: 859590 - protein, 26 aa, Mycobacterium
SANFAAGRLAYILGARGPAVVIDTAC

SEQ ID NO: 859591 - protein, 24 aa, Mycobacterium
SANGPPLPARWSRRKPEAAARLEA

SEQ ID NO: 859592 - protein, 17 aa, Mycobacterium
SANIGSHNFGFANTGPA

SEQ ID NO: 859593 - protein, 17 aa, Mycobacterium
SANLAVLRTPPGAAHYL

SEQ ID NO: 859594 - protein, 21 aa, Mycobacterium
SANPFVLYPSYQEIAGLPLPE

SEQ ID NO: 859595 - protein, 25 aa, Mycobacterium
SANPFVLYPSYREIMHLPLAERVAE

SEQ ID NO: 859596 - protein, 29 aa, Mycobacterium
SANPLDPQWLLDTLGLTDAARTPYRRLSG

SEQ ID NO: 859597 - protein, 25 aa, Mycobacterium
SANPYLASAAILGLALDGIKSGAPL

SEQ ID NO: 859598 - protein, 21 aa, Mycobacterium
SANPYLASATILGLALDGMTR

SEQ ID NO: 859599 - protein, 17 aa, Mycobacterium
SANQFHYYRLTADNRIV

SEQ ID NO: 859600 - protein, 17 aa, Mycobacterium
SANWYARNLRFRGNMRG

SEQ ID NO: 859601 - protein, 18 aa, Mycobacterium
SANYLYPRVEVEVGFILA

SEQ ID NO: 859602 - protein, 25 aa, Mycobacterium
SAPALYRHYAGKYELFRGAVLALSQ

SEQ ID NO: 859603 - protein, 25 aa, Mycobacterium
SAPDGVVFYQLPGIAMALFGRGDLA

SEQ ID NO: 859604 - protein, 26 aa, Mycobacterium
SAPDTVDFLPLARLVNAAELPAIRAA

SEQ ID NO: 859605 - protein, 24 aa, Mycobacterium
SAPELRTPWPREALKDLLVLLESG

SEQ ID NO: 859606 - protein, 27 aa, Mycobacterium
SAPERLRSGWLNGIKHWQVDYTGKCPV

SEQ ID NO: 859607 - protein, 21 aa, Mycobacterium
SAPFYCVTVIRVAKLGEAPLP

SEQ ID NO: 859608 - protein, 25 aa, Mycobacterium
SAPGARYFVLVFAKGAFPADLEVKP

SEQ ID NO: 859609 - protein, 20 aa, Mycobacterium
SAPGEPLLPPAKWPSRAAAS

SEQ ID NO: 859610 - protein, 47 aa, Mycobacterium
SAPGSPLLALFASDIPPLSWFLGNSPPPFLNLLLGQTVQYTTYNGMS

SEQ ID NO: 859611 - protein, 28 aa, Mycobacterium
SAPHPQLHLGLPRWASHPGMLFRVDDLD

SEQ ID NO: 859612 - protein, 29 aa, Mycobacterium
SAPITRPRIRFAYQLTPRRVLGENQVTAV

SEQ ID NO: 859613 - protein, 20 aa, Mycobacterium
SAPKHNGITYFLLDMRSEGV

SEQ ID NO: 859614 - protein, 17 aa, Mycobacterium
SAPKILRMSGRIADGVI

SEQ ID NO: 859615 - protein, 24 aa, Mycobacterium
SAPLIRQIFVYGNSERPYLLAVVV

SEQ ID NO: 859616 - protein, 19 aa, Mycobacterium
SAPLLLAVALVRLNRRFDI

SEQ ID NO: 859617 - protein, 25 aa, Mycobacterium
SAPMCDIFLVLAQAPGGLSCFLLPR

SEQ ID NO: 859618 - protein, 19 aa, Mycobacterium
SAPMLEAAVAWDGLSAELG

SEQ ID NO: 859619 - protein, 24 aa, Mycobacterium
SAPMLEAAVAWDSLAAELGSAAES

SEQ ID NO: 859620 - protein, 31 aa, Mycobacterium
SAPMWTSRAGWLDGLSRWVHSPAFGALCAEA

SEQ ID NO: 859621 - protein, 27 aa, Mycobacterium
SAPPAFVAPLYAYLVSDLARDVTGQIF

SEQ ID NO: 859622 - protein, 39 aa, Mycobacterium
SAPPKPVEKIGALLPPALKWRLFFASQGKNPKYLHDGDV

SEQ ID NO: 859623 - protein, 32 aa, Mycobacterium
SAPPLDGYPRPGKTVLFLGRYDEPRKGMSVLL

SEQ ID NO: 859624 - protein, 18 aa, Mycobacterium
SAPPSNMFRTRALTVPGV

SEQ ID NO: 859625 - protein, 17 aa, Mycobacterium
SAPPVVLYFHGGGFVMG

SEQ ID NO: 859626 - protein, 33 aa, Mycobacterium
SAPQMLEFLEGLSAWLEFVWKPGYADYYPELPG

SEQ ID NO: 859627 - protein, 26 aa, Mycobacterium
SAPQRLRSGWLNGIKHWQVDYAGKCP

SEQ ID NO: 859628 - protein, 24 aa, Mycobacterium
SAPRCWSMMELSWPSSGLICADSH

SEQ ID NO: 859629 - protein, 34 aa, Mycobacterium
SAPRMLEFLEGLSPWLEFVWKPGYADYYPNLPGG

SEQ ID NO: 859630 - protein, 17 aa, Mycobacterium
SAPRRTALTRLAEDHGA

SEQ ID NO: 859631 - protein, 29 aa, Mycobacterium
SAPSITLSWIRELPALGPAARPLQRDAMG

SEQ ID NO: 859632 - protein, 25 aa, Mycobacterium
SAPSRYRHWITHKLGTWHDQFGTTG

SEQ ID NO: 859633 - protein, 26 aa, Mycobacterium
SAPVWAPAYLPVLSLALRRIDEMAAQ

SEQ ID NO: 859634 - protein, 22 aa, Mycobacterium
SAPYMATDLPGLQPFMPPYVPG

SEQ ID NO: 859635 - protein, 21 aa, Mycobacterium
SAQAALLLEALTDAGFDNVVP

SEQ ID NO: 859636 - protein, 30 aa, Mycobacterium
SAQAATFHAQFVQLMATSAGRYATAEAAAA

SEQ ID NO: 859637 - protein, 28 aa, Mycobacterium
SAQAATFQQRFVQALTAGASAYAGAESA

SEQ ID NO: 859638 - protein, 24 aa, Mycobacterium
SAQAILAVDLLGVALMLQEFGEVV

SEQ ID NO: 859639 - protein, 24 aa, Mycobacterium
SAQATAFHQQFLQALTAGAAAYAG

SEQ ID NO: 859640 - protein, 26 aa, Mycobacterium
SAQDYTPVDQLPYVGPILPGDEKVLV

SEQ ID NO: 859641 - protein, 26 aa, Mycobacterium
SAQEPPRRLIGWKKVALEPGESKAVT

SEQ ID NO: 859642 - protein, 21 aa, Mycobacterium
SAQFSHPLLAAARSAGGLPAS

SEQ ID NO: 859643 - protein, 26 aa, Mycobacterium
SAQIIIPAILNLVAPFLGGLAGLGNP

SEQ ID NO: 859644 - protein, 23 aa, Mycobacterium
SAQLGWNIVPYTVIRDGPAGPGM

SEQ ID NO: 859645 - protein, 17 aa, Mycobacterium
SAQMAGVHQRFVQALTA

SEQ ID NO: 859646 - protein, 22 aa, Mycobacterium
SAQNGVKLPGGLWIVTERAVAT

SEQ ID NO: 859647 - protein, 24 aa, Mycobacterium
SAQPAADLSAWPPAGAIAVDVADG

SEQ ID NO: 859648 - protein, 27 aa, Mycobacterium
SAQPTAWLAEGLLPYLPADAQDNLFRD

SEQ ID NO: 859649 - protein, 23 aa, Mycobacterium
SAQRIAVLPVWQEAELFSDVERA

SEQ ID NO: 859650 - protein, 27 aa, Mycobacterium
SAQRLHYALADLPLPAPVTVVGGGLTG

SEQ ID NO: 859651 - protein, 22 aa, Mycobacterium
SAQRYLARWHRRRPLWVGVATG

SEQ ID NO: 859652 - protein, 25 aa, Mycobacterium
SAQTQLRYTLLRKLADDPGRHLLLL

SEQ ID NO: 859653 - protein, 19 aa, Mycobacterium
SAQVALAWLLARGDDIVPI

SEQ ID NO: 859654 - protein, 32 aa, Mycobacterium
SAQWAERFATLLRNLEFLPNSPTLMNAGTDLG

SEQ ID NO: 859655 - protein, 32 aa, Mycobacterium
SAQWAQRFSALLRGLEFLPNSPTLMNAGTELG

SEQ ID NO: 859656 - protein, 17 aa, Mycobacterium
SAQWLANERFFGSYRRQ

SEQ ID NO: 859657 - protein, 17 aa, Mycobacterium
SAQWVPQVWRDMDTTLA

SEQ ID NO: 859658 - protein, 17 aa, Mycobacterium
SARAAFAAATRGAWRAG

SEQ ID NO: 859659 - protein, 21 aa, Mycobacterium
SARALAPLVRRPPQLVAAAVN

SEQ ID NO: 859660 - protein, 21 aa, Mycobacterium
SARAQLSRRLARWTRLYPDVR

SEQ ID NO: 859661 - protein, 23 aa, Mycobacterium
SARARMHLGWRPVWDLEKAIHHT

SEQ ID NO: 859662 - protein, 26 aa, Mycobacterium
SARARREVYPGPWLPEPVLTDDRTLG

SEQ ID NO: 859663 - protein, 36 aa, Mycobacterium
SARASQTWRYPPFFHALLDAGIYPPCSAFEAWFVST

SEQ ID NO: 859664 - protein, 17 aa, Mycobacterium
SARATCHRAGGADLALA

SEQ ID NO: 859665 - protein, 19 aa, Mycobacterium
SARAVVRLLDYMDRHGYTH

SEQ ID NO: 859666 - protein, 34 aa, Mycobacterium
SARDAFIGDPDPWNRYRVIGKSTPPFHVATDLSE

SEQ ID NO: 859667 - protein, 28 aa, Mycobacterium
SARDLQAWEYVPLGPFLGKSFATTISAW

SEQ ID NO: 859668 - protein, 24 aa, Mycobacterium
SARDNEYLTHWLDQGYAVVGSDYA

SEQ ID NO: 859669 - protein, 27 aa, Mycobacterium
SAREHGGRLLVRLAGISDRDAADALRG

SEQ ID NO: 859670 - protein, 24 aa, Mycobacterium
SARELAVFWTARTIGCSWCVDFGA

SEQ ID NO: 859671 - protein, 18 aa, Mycobacterium
SARFGIRALTAYCVAKGG

SEQ ID NO: 859672 - protein, 25 aa, Mycobacterium
SARGPVHLVALPRFPEPGSAVERGS

SEQ ID NO: 859673 - protein, 22 aa, Mycobacterium
SARIDLAFFVGERWSEAGEPAG

SEQ ID NO: 859674 - protein, 17 aa, Mycobacterium
SARLFNLLITNVPGPQK

SEQ ID NO: 859675 - protein, 20 aa, Mycobacterium
SARLNLLADLLPPLSHKPRV

SEQ ID NO: 859676 - protein, 21 aa, Mycobacterium
SARLNLLAELLPPLSHKPRVR

SEQ ID NO: 859677 - protein, 21 aa, Mycobacterium
SARLWDVPDVPVGIGVAIGGT

SEQ ID NO: 859678 - protein, 24 aa, Mycobacterium
SARNMAHYWSLRQTDLRDLQRRLA

SEQ ID NO: 859679 - protein, 20 aa, Mycobacterium
SARPDCVLLDLHLPDANGID

SEQ ID NO: 859680 - protein, 22 aa, Mycobacterium
SARPRAVPSARKLAKELGVDLA

SEQ ID NO: 859681 - protein, 24 aa, Mycobacterium
SARPRRYLMTAPQFFAVDYVINPW

SEQ ID NO: 859682 - protein, 23 aa, Mycobacterium
SARQAAHFALIERLARLDGHLLD

SEQ ID NO: 859683 - protein, 18 aa, Mycobacterium
SARQIALLDLRSPLERSN

SEQ ID NO: 859684 - protein, 24 aa, Mycobacterium
SARRETLSAALDPALSALYERQRA

SEQ ID NO: 859685 - protein, 22 aa, Mycobacterium
SARRRAEMFTWQVAAAGMLTAL

SEQ ID NO: 859686 - protein, 24 aa, Mycobacterium
SARRRAMTAPIWMASPPEVHSTLL

SEQ ID NO: 859687 - protein, 23 aa, Mycobacterium
SARRTRILGRLVGRLYRGVRGTD

SEQ ID NO: 859688 - protein, 22 aa, Mycobacterium
SARRYLEHFLSTGALELRLQYG

SEQ ID NO: 859689 - protein, 18 aa, Mycobacterium
SARRYLEHYLGTGTLELR

SEQ ID NO: 859690 - protein, 28 aa, Mycobacterium
SARSASATLDWLMQHGYSSLVREAHVVL

SEQ ID NO: 859691 - protein, 21 aa, Mycobacterium
SARTFRNYFTSKEDAVLFSLR

SEQ ID NO: 859692 - protein, 26 aa, Mycobacterium
SARTHLLYGVWLRRRRRIVDARVHLS

SEQ ID NO: 859693 - protein, 18 aa, Mycobacterium
SARYHLFLRATEGAFTCL

SEQ ID NO: 859694 - protein, 24 aa, Mycobacterium
SARYIAVALGMLDIPGLAVNRQCA

SEQ ID NO: 859695 - protein, 23 aa, Mycobacterium
SASAALGLLRRHKIEKLPVVDGR

SEQ ID NO: 859696 - protein, 24 aa, Mycobacterium
SASAALGLLRRHKIEKLPVVDGSG

SEQ ID NO: 859697 - protein, 41 aa, Mycobacterium
SASAPVVLVLDDLHWAAKPTLLLLRHLLRFGEHARMQIIGT

SEQ ID NO: 859698 - protein, 31 aa, Mycobacterium
SASDSMAAAVAPYLRWLTGTAAQAEQIAGQA

SEQ ID NO: 859699 - protein, 29 aa, Mycobacterium
SASEIDWPARWSAWKARRYGDTRLEMASV

SEQ ID NO: 859700 - protein, 23 aa, Mycobacterium
SASELATAIAFDEASRRGVELKA

SEQ ID NO: 859701 - protein, 23 aa, Mycobacterium
SASGFLPDIRRYGATYMNYVGKP

SEQ ID NO: 859702 - protein, 21 aa, Mycobacterium
SASGLPPAGIGAPGGAGGAGG

SEQ ID NO: 859703 - protein, 25 aa, Mycobacterium
SASGRTITFPGFLKAYVETVDELAG

SEQ ID NO: 859704 - protein, 22 aa, Mycobacterium
SASILCTAGHALFLDAETGAHT

SEQ ID NO: 859705 - protein, 23 aa, Mycobacterium
SASKAFDMVLAEALWSELHTKGV

SEQ ID NO: 859706 - protein, 26 aa, Mycobacterium
SASKFLFPRVEVEVGFILAADLPGED

SEQ ID NO: 859707 - protein, 20 aa, Mycobacterium
SASKWAVRGLTKAAAMELAS

SEQ ID NO: 859708 - protein, 22 aa, Mycobacterium
SASLGWNIVPYTVIRDGPAGPG

SEQ ID NO: 859709 - protein, 17 aa, Mycobacterium
SASLMIRMRRLSDRFVR

SEQ ID NO: 859710 - protein, 21 aa, Mycobacterium
SASLRRLVVFDYSPQIDDQRE

SEQ ID NO: 859711 - protein, 22 aa, Mycobacterium
SASLSRLLPMLQSMGVVVLEER

SEQ ID NO: 859712 - protein, 25 aa, Mycobacterium
SASMVTIMTSLWFQQLQAGDRVSVK

SEQ ID NO: 859713 - protein, 32 aa, Mycobacterium
SASNFSRRRSLRRLPRLTRLAVRCTSDGMSCE

SEQ ID NO: 859714 - protein, 17 aa, Mycobacterium
SASPDALWAIISDVANW

SEQ ID NO: 859715 - protein, 34 aa, Mycobacterium
SASPGFRIDPVLARSWLLVNGAQYERFAPASRSR

SEQ ID NO: 859716 - protein, 23 aa, Mycobacterium
SASQFIPDIRRFGATYANYVGKP

SEQ ID NO: 859717 - protein, 29 aa, Mycobacterium
SASRDKFPRAILPRTFDYGFATGLMVKDV

SEQ ID NO: 859718 - protein, 26 aa, Mycobacterium
SASRSRLIRLFPTVFKGTHVNLDTVT

SEQ ID NO: 859719 - protein, 26 aa, Mycobacterium
SASRTRLIRLFPTVFKGTHVNLDEVS

SEQ ID NO: 859720 - protein, 24 aa, Mycobacterium
SASSDLLALAGGGLLPAAVQAAEG

SEQ ID NO: 859721 - protein, 22 aa, Mycobacterium
SASVAKEPCRIAATAAGSAAVT

SEQ ID NO: 859722 - protein, 17 aa, Mycobacterium
SASVVEAYFPQELRWEH

SEQ ID NO: 859723 - protein, 26 aa, Mycobacterium
SASYGTLWIKSPANMLGYWGSPERTG

SEQ ID NO: 859724 - protein, 22 aa, Mycobacterium
SASYSFNIEWALTGTPEVAPPL

SEQ ID NO: 859725 - protein, 19 aa, Mycobacterium
SASYYFPMSAALSPEFNVY

SEQ ID NO: 859726 - protein, 17 aa, Mycobacterium
SATAACELSWRTLRNAH

SEQ ID NO: 859727 - protein, 24 aa, Mycobacterium
SATAKARFVRVSPRKARRVIDLVR

SEQ ID NO: 859728 - protein, 31 aa, Mycobacterium
SATAMLQSVQPYLLWLRETALQSAQMATSAE

SEQ ID NO: 859729 - protein, 26 aa, Mycobacterium
SATASDLVLLLWGRRRPDRVDVDGAA

SEQ ID NO: 859730 - protein, 25 aa, Mycobacterium
SATATLAGQSWLGRAATAMAAGAAP

SEQ ID NO: 859731 - protein, 17 aa, Mycobacterium
SATAWVRAAHAFPGELI

SEQ ID NO: 859732 - protein, 26 aa, Mycobacterium
SATDVGPRFEQWGRLVVPYAPADATR

SEQ ID NO: 859733 - protein, 23 aa, Mycobacterium
SATDYRAWFATLPAEFTDAVVQH

SEQ ID NO: 859734 - protein, 33 aa, Mycobacterium
SATDYVRALNILERFYSMVLTDCGTGMLHSAMS

SEQ ID NO: 859735 - protein, 25 aa, Mycobacterium
SATEEFLRFFTPAPGDGRTIAADLE

SEQ ID NO: 859736 - protein, 28 aa, Mycobacterium
SATEWFARMLFSLFTTPSPYLDMGDDDV

SEQ ID NO: 859737 - protein, 17 aa, Mycobacterium
SATFDRPALGPSAFPAI

SEQ ID NO: 859738 - protein, 17 aa, Mycobacterium
SATFDRPALGPSAFPTI

SEQ ID NO: 859739 - protein, 18 aa, Mycobacterium
SATKFAVRALTQAAAKEH

SEQ ID NO: 859740 - protein, 22 aa, Mycobacterium
SATLGALLRLVEPDLSITLIER

SEQ ID NO: 859741 - protein, 22 aa, Mycobacterium
SATLPAIHRYTGVLYDALDVES

SEQ ID NO: 859742 - protein, 17 aa, Mycobacterium
SATLPKELGKRFGELGL

SEQ ID NO: 859743 - protein, 17 aa, Mycobacterium
SATLRRLACDHGHGMVV

SEQ ID NO: 859744 - protein, 18 aa, Mycobacterium
SATLRVAPSASWMLEYYP

SEQ ID NO: 859745 - protein, 19 aa, Mycobacterium
SATLWDPRERPSFSAGYWA

SEQ ID NO: 859746 - protein, 26 aa, Mycobacterium
SATMAALANFFRIRAAYFTDDDYYAK

SEQ ID NO: 859747 - protein, 26 aa, Mycobacterium
SATQGKFLYLLATIAKARRVLEIGTL

SEQ ID NO: 859748 - protein, 22 aa, Mycobacterium
SATRLLAKALPGQSIRTATIGR

SEQ ID NO: 859749 - protein, 28 aa, Mycobacterium
SATRYEWPILDFAILSIGAVTVPIYETS

SEQ ID NO: 859750 - protein, 22 aa, Mycobacterium
SATTAWLIERLQRPTLVMEPNK

SEQ ID NO: 859751 - protein, 25 aa, Mycobacterium
SATTKSIELLPKKAKDRLLELSIDM

SEQ ID NO: 859752 - protein, 25 aa, Mycobacterium
SATTRSIELLPKQAKDRLLELSIAM

SEQ ID NO: 859753 - protein, 24 aa, Mycobacterium
SATVDWLTTVLAEDALGGPAALRR

SEQ ID NO: 859754 - protein, 25 aa, Mycobacterium
SATVGLFTYPVLQAADVLAYDAELV

SEQ ID NO: 859755 - protein, 17 aa, Mycobacterium
SATWLQVELGLITPEDV

SEQ ID NO: 859756 - protein, 24 aa, Mycobacterium
SATYSLLPQLVRALGESLPGIEVT

SEQ ID NO: 859757 - protein, 37 aa, Mycobacterium
SAVAAALSPWEQLLQNVPALSPLAAIGNLGAGNLGFG

SEQ ID NO: 859758 - protein, 19 aa, Mycobacterium
SAVAAVVYGLVLEGRETES

SEQ ID NO: 859759 - protein, 23 aa, Mycobacterium
SAVAKARFVRVSPRKARRVIDLV

SEQ ID NO: 859760 - protein, 17 aa, Mycobacterium
SAVALIVALAERLRDRP

SEQ ID NO: 859761 - protein, 20 aa, Mycobacterium
SAVALPVPSLVISQLLGVPY

SEQ ID NO: 859762 - protein, 30 aa, Mycobacterium
SAVAPVYLYRFDYSTPLLKVLLVRAAHATE

SEQ ID NO: 859763 - protein, 27 aa, Mycobacterium
SAVARLQTLYRDQLLVLAALDLAATVE

SEQ ID NO: 859764 - protein, 22 aa, Mycobacterium
SAVCKLGEQPVFRAALIRTADN

SEQ ID NO: 859765 - protein, 29 aa, Mycobacterium
SAVDNPPMIRLPIPPMIHGATQSATWMAL

SEQ ID NO: 859766 - protein, 18 aa, Mycobacterium
SAVDSWFEEGRELVHYPP

SEQ ID NO: 859767 - protein, 18 aa, Mycobacterium
SAVFDPVLHVADLSFCEV

SEQ ID NO: 859768 - protein, 26 aa, Mycobacterium
SAVFLQHPWQVLPAELISPIEDAAKA

SEQ ID NO: 859769 - protein, 18 aa, Mycobacterium
SAVFYQVYPRSFADSDGD

SEQ ID NO: 859770 - protein, 20 aa, Mycobacterium
SAVFYRYFTDKEDLLAALAQ

SEQ ID NO: 859771 - protein, 22 aa, Mycobacterium
SAVGEFAVIDRLLNGRVQPPSV

SEQ ID NO: 859772 - protein, 22 aa, Mycobacterium
SAVGPKLPELWGGSADLAGSNN

SEQ ID NO: 859773 - protein, 20 aa, Mycobacterium
SAVGVWVTILDRTGLRTGSR

SEQ ID NO: 859774 - protein, 30 aa, Mycobacterium
SAVHGGMIPLCYDWLCGMVVSTAGIPPTRT

SEQ ID NO: 859775 - protein, 27 aa, Mycobacterium
SAVHNLPMTRWTGLMVAAITLTTGGIA

SEQ ID NO: 859776 - protein, 24 aa, Mycobacterium
SAVKAFTAWAVRRGLLATDPAARL

SEQ ID NO: 859777 - protein, 24 aa, Mycobacterium
SAVKKLVLTSFKTGLEEQMELEGR

SEQ ID NO: 859778 - protein, 18 aa, Mycobacterium
SAVLDHSPVITPFGAKFV

SEQ ID NO: 859779 - protein, 23 aa, Mycobacterium
SAVLDRLARYPARSVDIDGCTYR

SEQ ID NO: 859780 - protein, 20 aa, Mycobacterium
SAVLERVQDMLWSASMDRIN

SEQ ID NO: 859781 - protein, 34 aa, Mycobacterium
SAVLFSPMSFLRRPACWMQLLATSGRCFSAAPNF

SEQ ID NO: 859782 - protein, 21 aa, Mycobacterium
SAVLHIYLDVVLDGLVARLAS

SEQ ID NO: 859783 - protein, 27 aa, Mycobacterium
SAVLLGRELLRDPYWPRRAARELGADL

SEQ ID NO: 859784 - protein, 36 aa, Mycobacterium
SAVLNIIEVSWGDVALVLSIPYQGLGNAAISGVATD

SEQ ID NO: 859785 - protein, 22 aa, Mycobacterium
SAVLPQLAAMLDQLGTTAPPGS

SEQ ID NO: 859786 - protein, 19 aa, Mycobacterium
SAVLVVTRGPNTGSRFALT

SEQ ID NO: 859787 - protein, 25 aa, Mycobacterium
SAVMGYLLIMMAQDGGWPVPVGGAG

SEQ ID NO: 859788 - protein, 17 aa, Mycobacterium
SAVMPWRAAEECEQWLG

SEQ ID NO: 859789 - protein, 18 aa, Mycobacterium
SAVPFPRGMTGPRDARHS

SEQ ID NO: 859790 - protein, 21 aa, Mycobacterium
SAVPFVRDFVTSGKPVAAICH

SEQ ID NO: 859791 - protein, 23 aa, Mycobacterium
SAVPSLKRYVLEMRFKPMPRYQQ

SEQ ID NO: 859792 - protein, 31 aa, Mycobacterium
SAVPSRDIPRFVELWRAGRLPVESLVSSTIA

SEQ ID NO: 859793 - protein, 25 aa, Mycobacterium
SAVQKLVLDPLQLAHTHYFSDQIIG

SEQ ID NO: 859794 - protein, 24 aa, Mycobacterium
SAVQLLTNSLPWNNALTTTPSTPE

SEQ ID NO: 859795 - protein, 24 aa, Mycobacterium
SAVQRSLLPLLTPLAPDELVQMVI

SEQ ID NO: 859796 - protein, 28 aa, Mycobacterium
SAVRASMAIPFIYPPVTLTSSDGLRSTL

SEQ ID NO: 859797 - protein, 23 aa, Mycobacterium
SAVRKFLFDRFASVELVMFDEQV

SEQ ID NO: 859798 - protein, 25 aa, Mycobacterium
SAVSIRRLLVELGVSSFVVVAVPSI

SEQ ID NO: 859799 - protein, 22 aa, Mycobacterium
SAVSNFLVGKFMGGVPSFEQEL

SEQ ID NO: 859800 - protein, 33 aa, Mycobacterium
SAVSTASRAAAGPTLGLLAAGADEVSVGIAALF

SEQ ID NO: 859801 - protein, 25 aa, Mycobacterium
SAVTFKVKNMWGLLAVKGEFTKFVG

SEQ ID NO: 859802 - protein, 19 aa, Mycobacterium
SAVTIPVMAKARIGHFVEA

SEQ ID NO: 859803 - protein, 28 aa, Mycobacterium
SAVVERFVPLRLLYLPIAARGFEREGID

SEQ ID NO: 859804 - protein, 20 aa, Mycobacterium
SAVVPPVRWYCDDTAVLGGE

SEQ ID NO: 859805 - protein, 19 aa, Mycobacterium
SAVVRDLLRLNVLPQSQYV

SEQ ID NO: 859806 - protein, 18 aa, Mycobacterium
SAVWRPNLAVYSGTRVLR

SEQ ID NO: 859807 - protein, 21 aa, Mycobacterium
SAWDDTFYPDGVGAWMIKLDA

SEQ ID NO: 859808 - protein, 19 aa, Mycobacterium
SAWDLYGGAGVFAAALAAG

SEQ ID NO: 859809 - protein, 33 aa, Mycobacterium
SAWFLAEELGAGSYPWVLAITPPYSDVSARGPF

SEQ ID NO: 859810 - protein, 19 aa, Mycobacterium
SAWGKHLFHHYAGGPIVHV

SEQ ID NO: 859811 - protein, 24 aa, Mycobacterium
SAWIAEGLLIYLPAAAQEQLFTGI

SEQ ID NO: 859812 - protein, 17 aa, Mycobacterium
SAWKAITSAHWHVRRWP

SEQ ID NO: 859813 - protein, 21 aa, Mycobacterium
SAWLEQQLRSGLRRAFESAGA

SEQ ID NO: 859814 - protein, 43 aa, Mycobacterium
SAWRAAAEDFPRPRPLYLPPPQQLQLESVMLPRDAFFGPTDTV

SEQ ID NO: 859815 - protein, 21 aa, Mycobacterium
SAWYGAILRAEVEVIDIGAGT

SEQ ID NO: 859816 - protein, 24 aa, Mycobacterium
SAYASAWELWHRGAREVQVGLSML

SEQ ID NO: 859817 - protein, 21 aa, Mycobacterium
SAYATLLPTADMLSAILVSLP

SEQ ID NO: 859818 - protein, 17 aa, Mycobacterium
SAYEVLRKAVGTAPVHR

SEQ ID NO: 859819 - protein, 18 aa, Mycobacterium
SAYFPVEVITQMLGVPER

SEQ ID NO: 859820 - protein, 25 aa, Mycobacterium
SAYFTEQVFPVLTPLAVDPAHPFPF

SEQ ID NO: 859821 - protein, 24 aa, Mycobacterium
SAYGTLRPMLGRELPADPASLIAP

SEQ ID NO: 859822 - protein, 18 aa, Mycobacterium
SAYLRGLDPVRLSHVLTA

SEQ ID NO: 859823 - protein, 28 aa, Mycobacterium
SAYLSALFDYLLTSLRSLPTLTVIGSPE

SEQ ID NO: 859824 - protein, 18 aa, Mycobacterium
SAYLSLLDALAQRSDAVH

SEQ ID NO: 859825 - protein, 18 aa, Mycobacterium
SAYPQMLLRVGWAPINAD

SEQ ID NO: 859826 - protein, 18 aa, Mycobacterium
SAYPRVLDFAAFRSIADE

SEQ ID NO: 859827 - protein, 23 aa, Mycobacterium
SAYQPPWQEWYSGAATAAAILEE

SEQ ID NO: 859828 - protein, 28 aa, Mycobacterium
SAYRAYTTFLLGQLLLEVSARGASLSSV

SEQ ID NO: 859829 - protein, 26 aa, Mycobacterium
SAYRTALDEWRLLTAAALVGLVEETM

SEQ ID NO: 859830 - protein, 19 aa, Mycobacterium
SCADAIQSLFLTLKGPRAQ

SEQ ID NO: 859831 - protein, 24 aa, Mycobacterium
SCAVDVALLSRYYERFADHAVEIG

SEQ ID NO: 859832 - protein, 30 aa, Mycobacterium
SCDAFEHFPPPILKPVILAAKSKATFRGVA

SEQ ID NO: 859833 - protein, 24 aa, Mycobacterium
SCDAFEHFPPPILKPVILAAKSKT

SEQ ID NO: 859834 - protein, 23 aa, Mycobacterium
SCDRVFNDASGWYGKTHDAAKIK

SEQ ID NO: 859835 - protein, 22 aa, Mycobacterium
SCEDPRFSIARLSLLDRGMVFA

SEQ ID NO: 859836 - protein, 22 aa, Mycobacterium
SCEGLIGLLSQTRYRYADGKRT

SEQ ID NO: 859837 - protein, 26 aa, Mycobacterium
SCERGPIFWQRGAWLSHHLGLLLDAT

SEQ ID NO: 859838 - protein, 25 aa, Mycobacterium
SCFLALVRRFYELGVKDLNGHLLYA

SEQ ID NO: 859839 - protein, 21 aa, Mycobacterium
SCFVVCNEILPRWGVETVFVD

SEQ ID NO: 859840 - protein, 17 aa, Mycobacterium
SCGALLDHFQVAMAAAG

SEQ ID NO: 859841 - protein, 22 aa, Mycobacterium
SCGALLDHFQVAMAAAGWDSNV

SEQ ID NO: 859842 - protein, 17 aa, Mycobacterium
SCGFYRQQRPCGVFGFG

SEQ ID NO: 859843 - protein, 22 aa, Mycobacterium
SCGREDLLRWCDDRWKLARRRI

SEQ ID NO: 859844 - protein, 17 aa, Mycobacterium
SCGWFFCASGYYRYDAG

SEQ ID NO: 859845 - protein, 21 aa, Mycobacterium
SCGYFNGRFPAILPPGEVNTY

SEQ ID NO: 859846 - protein, 27 aa, Mycobacterium
SCHFMPPEAFIERPMRWLEALSRYGGT

SEQ ID NO: 859847 - protein, 27 aa, Mycobacterium
SCHQIVLPQPILRNYELAKLINLDPDT

SEQ ID NO: 859848 - protein, 21 aa, Mycobacterium
SCIDTFAEVLWLAQRARESWP

SEQ ID NO: 859849 - protein, 19 aa, Mycobacterium
SCIDTLPEVLWLAQRVRET

SEQ ID NO: 859850 - protein, 20 aa, Mycobacterium
SCIYPKYAPQPISENALLTG

SEQ ID NO: 859851 - protein, 19 aa, Mycobacterium
SCKRWFGTTPSAYRSDRRR

SEQ ID NO: 859852 - protein, 18 aa, Mycobacterium
SCLGLLSDRILSAELGLA

SEQ ID NO: 859853 - protein, 17 aa, Mycobacterium
SCMLFFADFGLGARLEN

SEQ ID NO: 859854 - protein, 21 aa, Mycobacterium
SCMVALPAQLFRSTGIPVCLW

SEQ ID NO: 859855 - protein, 19 aa, Mycobacterium
SCMWTLHQLPDFDTLRGAL

SEQ ID NO: 859856 - protein, 17 aa, Mycobacterium
SCPGPEAALALVGAARR

SEQ ID NO: 859857 - protein, 26 aa, Mycobacterium
SCPPQTRIWWGAYLGTADELLMAGTV

SEQ ID NO: 859858 - protein, 23 aa, Mycobacterium
SCQGHCPPRQFERARVVVFAGDH

SEQ ID NO: 859859 - protein, 24 aa, Mycobacterium
SCQGQCPPRQFQRARVVVFAGDHG

SEQ ID NO: 859860 - protein, 19 aa, Mycobacterium
SCQLPAVGHRLLARLQAEG

SEQ ID NO: 859861 - protein, 18 aa, Mycobacterium
SCQLPAVGHRLLARLQVE

SEQ ID NO: 859862 - protein, 18 aa, Mycobacterium
SCRAAECGVGRLGFESHV

SEQ ID NO: 859863 - protein, 17 aa, Mycobacterium
SCRQIKLPWPVLDNDEL

SEQ ID NO: 859864 - protein, 23 aa, Mycobacterium
SCRRCFVTLPTSAAGPLCDDCDG

SEQ ID NO: 859865 - protein, 18 aa, Mycobacterium
SCSGHRALYELGHTGIPI

SEQ ID NO: 859866 - protein, 20 aa, Mycobacterium
SCSIALTRNYPYNGSLMVIP

SEQ ID NO: 859867 - protein, 27 aa, Mycobacterium
SCTIRNDLLILLRRLHRRDGVDRIVVH

SEQ ID NO: 859868 - protein, 17 aa, Mycobacterium
SCTKMYTAILILAQIDA

SEQ ID NO: 859869 - protein, 20 aa, Mycobacterium
SCTLGYVDPALRVGITAGHC

SEQ ID NO: 859870 - protein, 17 aa, Mycobacterium
SCVHWGDAVAPFPHQEA

SEQ ID NO: 859871 - protein, 19 aa, Mycobacterium
SCVNLADFLRLQAIANMVG

SEQ ID NO: 859872 - protein, 19 aa, Mycobacterium
SCVPLLKQLLEAQGVEQSK

SEQ ID NO: 859873 - protein, 18 aa, Mycobacterium
SCVRILRNQASLLPGLNS

SEQ ID NO: 859874 - protein, 19 aa, Mycobacterium
SCYLAMMRRFYDKGVTELN

SEQ ID NO: 859875 - protein, 28 aa, Mycobacterium
SCYVHPEIEFFLLKNLPDDGTAPIPADD

SEQ ID NO: 859876 - protein, 26 aa, Mycobacterium
SCYVHPEIEFFLLKPGDNDGSPPTPA

SEQ ID NO: 859877 - protein, 27 aa, Mycobacterium
SCYVHPEIEFFLLKPGPEDGSEPVPID

SEQ ID NO: 859878 - protein, 27 aa, Mycobacterium
SCYVHPEIEFFLLKPGPNDGSVPVPVD

SEQ ID NO: 859879 - protein, 19 aa, Mycobacterium
SDAADFIEAVRRALYASKI

SEQ ID NO: 859880 - protein, 24 aa, Mycobacterium
SDAAEWFAGRLPDGWFSGAPEVIV

SEQ ID NO: 859881 - protein, 19 aa, Mycobacterium
SDAAGVVGWWVNPQAPGLD

SEQ ID NO: 859882 - protein, 17 aa, Mycobacterium
SDAAIDWVIQAFTDGRV

SEQ ID NO: 859883 - protein, 24 aa, Mycobacterium
SDAALICVPPYHIAGVSAVLSNLY

SEQ ID NO: 859884 - protein, 17 aa, Mycobacterium
SDAAMRRVAAWADGWYG

SEQ ID NO: 859885 - protein, 21 aa, Mycobacterium
SDAAWLQAMLDAEAALAAAQA

SEQ ID NO: 859886 - protein, 36 aa, Mycobacterium
SDADDRLWDILLAIGADRRPAWASTLVAESAGKLAA

SEQ ID NO: 859887 - protein, 24 aa, Mycobacterium
SDADDWLIARWGCLRAANLAWGCG

SEQ ID NO: 859888 - protein, 28 aa, Mycobacterium
SDADIARAMPIFDTLRPPGPQEDGFVHV

SEQ ID NO: 859889 - protein, 24 aa, Mycobacterium
SDAIKLSVPFLTLEGNPPADNSEL

SEQ ID NO: 859890 - protein, 31 aa, Mycobacterium
SDALGFGRPLDYQPWISFPGAIAGEWQGQIR

SEQ ID NO: 859891 - protein, 24 aa, Mycobacterium
SDALLGIFAAIYPAASTALQELDA

SEQ ID NO: 859892 - protein, 18 aa, Mycobacterium
SDALNPWITTIGSAVFAI

SEQ ID NO: 859893 - protein, 25 aa, Mycobacterium
SDAPDLVLPVHFDLSDPTTATAAVD

SEQ ID NO: 859894 - protein, 32 aa, Mycobacterium
SDAPIAFGNDLRRVLLGLRRAKSNVDRLKLVG

SEQ ID NO: 859895 - protein, 20 aa, Mycobacterium
SDAPLFDETYAFGGLPTGRG

SEQ ID NO: 859896 - protein, 22 aa, Mycobacterium
SDAPPLLLAAAQRMQRLDPSES

SEQ ID NO: 859897 - protein, 31 aa, Mycobacterium
SDAPYQGFQLGSLWYISLDYINHQTSLNSSQ

SEQ ID NO: 859898 - protein, 24 aa, Mycobacterium
SDAQDRLFEMLTALSAPGSQVAIE

SEQ ID NO: 859899 - protein, 23 aa, Mycobacterium
SDAQVWVLVRRQSLGRFERLAAE

SEQ ID NO: 859900 - protein, 25 aa, Mycobacterium
SDARHPFLVMELIEGGTLRELLGER

SEQ ID NO: 859901 - protein, 22 aa, Mycobacterium
SDASMQYCWVMRVAGDQIVDVI

SEQ ID NO: 859902 - protein, 29 aa, Mycobacterium
SDAVACAVRLQRAPLAPIRLRIGVHTGEV

SEQ ID NO: 859903 - protein, 28 aa, Mycobacterium
SDAVTALWKEHLLVRLDVEPFSRAQTAE

SEQ ID NO: 859904 - protein, 21 aa, Mycobacterium
SDAVYYPLYAKCAELDLPLCV

SEQ ID NO: 859905 - protein, 21 aa, Mycobacterium
SDAVYYPLYTKCAELELPLCI

SEQ ID NO: 859906 - protein, 21 aa, Mycobacterium
SDAWDRLFSGPRPAELHRFIE

SEQ ID NO: 859907 - protein, 21 aa, Mycobacterium
SDCGFFIRYCLDVGLDKYGQG

SEQ ID NO: 859908 - protein, 23 aa, Mycobacterium
SDDAASITLFPQANSWYVGANIP

SEQ ID NO: 859909 - protein, 26 aa, Mycobacterium
SDDAENYLITPYVDVLAALAESATSA

SEQ ID NO: 859910 - protein, 17 aa, Mycobacterium
SDDARWITGQWLDASGG

SEQ ID NO: 859911 - protein, 24 aa, Mycobacterium
SDDATLLLHRQFDPSHPDFHLYSE

SEQ ID NO: 859912 - protein, 24 aa, Mycobacterium
SDDDALQLLGWTEATATPQVEVAL

SEQ ID NO: 859913 - protein, 24 aa, Mycobacterium
SDDDKIWSVLRTIPVRELRRSGML

SEQ ID NO: 859914 - protein, 25 aa, Mycobacterium
SDDDPYLPVLQQRQLPMVVVDQPKD

SEQ ID NO: 859915 - protein, 21 aa, Mycobacterium
SDDEFGFFVLMLAVAGNETTR

SEQ ID NO: 859916 - protein, 24 aa, Mycobacterium
SDDEFGFFVVLLAVAGNETTRNSI

SEQ ID NO: 859917 - protein, 24 aa, Mycobacterium
SDDEIVAMVFLLITGDYQTTPNVI

SEQ ID NO: 859918 - protein, 22 aa, Mycobacterium
SDDELLAWALGDVATVFGLDVD

SEQ ID NO: 859919 - protein, 22 aa, Mycobacterium
SDDERPLVHLAARPGRIDAEAL

SEQ ID NO: 859920 - protein, 25 aa, Mycobacterium
SDDFFRLFLDPTMTYSCAYWDRGRD

SEQ ID NO: 859921 - protein, 21 aa, Mycobacterium
SDDFFRLFLDPTQTYSCAYFA

SEQ ID NO: 859922 - protein, 21 aa, Mycobacterium
SDDFFRLFLDPTQTYSCAYFE

SEQ ID NO: 859923 - protein, 26 aa, Mycobacterium
SDDGSPPFVVRWLSDGHEATVYPGPD

SEQ ID NO: 859924 - protein, 18 aa, Mycobacterium
SDDHFWFSFFHEAGHIVL

SEQ ID NO: 859925 - protein, 24 aa, Mycobacterium
SDDHWRHWLPENARKLRAALLKHP

SEQ ID NO: 859926 - protein, 23 aa, Mycobacterium
SDDKFPAMPFVELGYEVAYHGLN

SEQ ID NO: 859927 - protein, 26 aa, Mycobacterium
SDDLIDYLTMLSWSALCGIVEVNGSL

SEQ ID NO: 859928 - protein, 24 aa, Mycobacterium
SDDLPRLIAMLFSVLSTMDSDSDG

SEQ ID NO: 859929 - protein, 23 aa, Mycobacterium
SDDLPTLIRTLAGTTALMLTGDP

SEQ ID NO: 859930 - protein, 23 aa, Mycobacterium
SDDLPTLIRTLAGTTALVLTGDP

SEQ ID NO: 859931 - protein, 25 aa, Mycobacterium
SDDMPGFGLVMFGAIREAGAAAGPA

SEQ ID NO: 859932 - protein, 34 aa, Mycobacterium
SDDPALTWLQLRDWLRTRLPEHLVPPTGTILDTL

SEQ ID NO: 859933 - protein, 23 aa, Mycobacterium
SDDPLIRDPFAQIFLDAAGDGVW

SEQ ID NO: 859934 - protein, 26 aa, Mycobacterium
SDDPVPVRVLYLGRGLSKATLFGPAE

SEQ ID NO: 859935 - protein, 24 aa, Mycobacterium
SDDQGPLWTIRRSIFARGEGGFGG

SEQ ID NO: 859936 - protein, 23 aa, Mycobacterium
SDDSLLVAALDEVIYLLDTTGQA

SEQ ID NO: 859937 - protein, 22 aa, Mycobacterium
SDDTVRRWINQGSLTVGHDAAG

SEQ ID NO: 859938 - protein, 18 aa, Mycobacterium
SDDVANFVRKRIYEGSYA

SEQ ID NO: 859939 - protein, 19 aa, Mycobacterium
SDDVARYVRKRIYEGNYAA

SEQ ID NO: 859940 - protein, 23 aa, Mycobacterium
SDDVTLLAAQRRTPPAPLHMTLD

SEQ ID NO: 859941 - protein, 25 aa, Mycobacterium
SDEAIIAILAILKTGASYLPIDPSV

SEQ ID NO: 859942 - protein, 24 aa, Mycobacterium
SDEELRKLRYLLNFARLADFEPGA

SEQ ID NO: 859943 - protein, 25 aa, Mycobacterium
SDEFRIQLAWMRQSPPDTPNPGWLY

SEQ ID NO: 859944 - protein, 26 aa, Mycobacterium
SDEFRIQLAWMRQSPPDTPNPGWLYA

SEQ ID NO: 859945 - protein, 25 aa, Mycobacterium
SDEKPRPLPVWKRRINDYAENAALS

SEQ ID NO: 859946 - protein, 23 aa, Mycobacterium
SDELIDRCWAPKVYGAWNLHRVL

SEQ ID NO: 859947 - protein, 26 aa, Mycobacterium
SDELIDYLTMIAWNALLGIVDVGGSR

SEQ ID NO: 859948 - protein, 20 aa, Mycobacterium
SDELLARMLFESCLLHAGQA

SEQ ID NO: 859949 - protein, 20 aa, Mycobacterium
SDELLDRDWAPKVYGAWHLH

SEQ ID NO: 859950 - protein, 28 aa, Mycobacterium
SDERLAQMLFFSLFPDGGGFDSTAAGLA

SEQ ID NO: 859951 - protein, 21 aa, Mycobacterium
SDERLAVLRGLETAALDGNLG

SEQ ID NO: 859952 - protein, 31 aa, Mycobacterium
SDERLEKICRLIMLYHLDRGWADHLAYLADI

SEQ ID NO: 859953 - protein, 25 aa, Mycobacterium
SDERMLILLGRIHAYEGHDLRHVVH

SEQ ID NO: 859954 - protein, 25 aa, Mycobacterium
SDERYISFVMMQPTKFWADVCRHVD

SEQ ID NO: 859955 - protein, 27 aa, Mycobacterium
SDESLILILRVFRGPRPSAPSRRRKIP

SEQ ID NO: 859956 - protein, 26 aa, Mycobacterium
SDETQLDLVLAILRARQLFGGEQTVP

SEQ ID NO: 859957 - protein, 19 aa, Mycobacterium
SDEVLPISYLAAPIFDGAE

SEQ ID NO: 859958 - protein, 18 aa, Mycobacterium
SDEVPVVVVLWSPRSDVC

SEQ ID NO: 859959 - protein, 25 aa, Mycobacterium
SDEVVDVVLLWWRDNDGDLVDRLMD

SEQ ID NO: 859960 - protein, 23 aa, Mycobacterium
SDEYDWVPLRLPPDVTRVSASLR

SEQ ID NO: 859961 - protein, 24 aa, Mycobacterium
SDEYRYLVIASPAGAYFPRGIKPV

SEQ ID NO: 859962 - protein, 21 aa, Mycobacterium
SDFDAIRWRLDVWNASAQVAN

SEQ ID NO: 859963 - protein, 19 aa, Mycobacterium
SDFDITVPTIEWDGRPWTY

SEQ ID NO: 859964 - protein, 31 aa, Mycobacterium
SDFEDMITRYAWGSVWTRPGLDRRSRSMITL

SEQ ID NO: 859965 - protein, 23 aa, Mycobacterium
SDFELHLRTVFTRLFDMLDNSPE

SEQ ID NO: 859966 - protein, 22 aa, Mycobacterium
SDFLDLPRHALADAALSAATAA

SEQ ID NO: 859967 - protein, 19 aa, Mycobacterium
SDFLHGRWLVLRRGKRNIA

SEQ ID NO: 859968 - protein, 20 aa, Mycobacterium
SDFLVALRRGDPDAGVTALS

SEQ ID NO: 859969 - protein, 17 aa, Mycobacterium
SDFLVALRRGDPDSGAT

SEQ ID NO: 859970 - protein, 33 aa, Mycobacterium
SDFPGDPWTVPKVYWTVFGLSAFRAAKQDLAAE

SEQ ID NO: 859971 - protein, 19 aa, Mycobacterium
SDFPLIPARVETWAGLVFV

SEQ ID NO: 859972 - protein, 29 aa, Mycobacterium
SDFTAAKFLTTPGLRTPVFVRFSTVAGSR

SEQ ID NO: 859973 - protein, 24 aa, Mycobacterium
SDGAEWIHLVDLDAAFGRGSNREL

SEQ ID NO: 859974 - protein, 24 aa, Mycobacterium
SDGDSLQLLGWTEATATPQVEVAL

SEQ ID NO: 859975 - protein, 23 aa, Mycobacterium
SDGFRVPGLPMPSLPVVGGDAAA

SEQ ID NO: 859976 - protein, 17 aa, Mycobacterium
SDGFRVPGLPVPSLPVI

SEQ ID NO: 859977 - protein, 25 aa, Mycobacterium
SDGGDFFQGLQHGGAAVLVQLADTG

SEQ ID NO: 859978 - protein, 31 aa, Mycobacterium
SDGGWRRVLPVLQTLAWFGLDLIDPIDDSSV

SEQ ID NO: 859979 - protein, 26 aa, Mycobacterium
SDGKTMGIPILYPWANRLGANTYTAQ

SEQ ID NO: 859980 - protein, 25 aa, Mycobacterium
SDGLAATLRLAPTPPWHTTRWQVTR

SEQ ID NO: 859981 - protein, 18 aa, Mycobacterium
SDGLLISFERMNAVLEVD

SEQ ID NO: 859982 - protein, 22 aa, Mycobacterium
SDGLQFWLDQLGGPDPALGARR

SEQ ID NO: 859983 - protein, 22 aa, Mycobacterium
SDGPAPTLLYGYGGFESSNTPG

SEQ ID NO: 859984 - protein, 19 aa, Mycobacterium
SDGPPPDWHSFGRVLNKNG

SEQ ID NO: 859985 - protein, 23 aa, Mycobacterium
SDGQRRMWFLQTMDPDDVTLNIC

SEQ ID NO: 859986 - protein, 25 aa, Mycobacterium
SDGQRRMWFVQGFDPSGVLLNVSLS

SEQ ID NO: 859987 - protein, 26 aa, Mycobacterium
SDGRTPIYGLLWRPHDLDPDRTYPII

SEQ ID NO: 859988 - protein, 25 aa, Mycobacterium
SDGRYISFVMMQPTKFWADVCRHID

SEQ ID NO: 859989 - protein, 25 aa, Mycobacterium
SDGRYISFVMMQPTKFWADVCRHVD

SEQ ID NO: 859990 - protein, 25 aa, Mycobacterium
SDGRYISLVMMQPTKFWADVCRHID

SEQ ID NO: 859991 - protein, 25 aa, Mycobacterium
SDGSNAGFFTLGGYNSGVLNIGSLN

SEQ ID NO: 859992 - protein, 23 aa, Mycobacterium
SDGSPYVTPLVRKLAAENGIDLS

SEQ ID NO: 859993 - protein, 24 aa, Mycobacterium
SDGSYWTGLVFADGKRWPEERTTW

SEQ ID NO: 859994 - protein, 24 aa, Mycobacterium
SDGTASGFAIYRPKPGWGDAGPNA

SEQ ID NO: 859995 - protein, 20 aa, Mycobacterium
SDGTPWRPLVHARDIAAAFL

SEQ ID NO: 859996 - protein, 17 aa, Mycobacterium
SDGVKFWKSFAPKEYDK

SEQ ID NO: 859997 - protein, 20 aa, Mycobacterium
SDGVKYWKSFAPKEYEKAVG

SEQ ID NO: 859998 - protein, 33 aa, Mycobacterium
SDGVRFLPMEELIAAFLPVLFPGLEVVEHHAFR

SEQ ID NO: 859999 - protein, 17 aa, Mycobacterium
SDHEVNLKILLAGRIRG

SEQ ID NO: 860000 - protein, 23 aa, Mycobacterium
SDHFQPWRYNGGHAPFSLAWMTA

SEQ ID NO: 860001 - protein, 19 aa, Mycobacterium
SDHHLPLHPLNSDDLAALA

SEQ ID NO: 860002 - protein, 23 aa, Mycobacterium
SDHPLNWQKPWTKEEISTVLDSS

SEQ ID NO: 860003 - protein, 30 aa, Mycobacterium
SDHSRRLWTLLIFMLWHAIFVDHSVVPEIS

SEQ ID NO: 860004 - protein, 23 aa, Mycobacterium
SDHVKFAYWVPNVSGGLVTSTIE

SEQ ID NO: 860005 - protein, 24 aa, Mycobacterium
SDHVLDRYILAKLAVLRDDLTQAM

SEQ ID NO: 860006 - protein, 21 aa, Mycobacterium
SDHWSGFRPDRIKALAGAVTA

SEQ ID NO: 860007 - protein, 20 aa, Mycobacterium
SDIAAGWWQAALDAYDRLPA

SEQ ID NO: 860008 - protein, 17 aa, Mycobacterium
SDIALRRPSLDEVFLAL

SEQ ID NO: 860009 - protein, 20 aa, Mycobacterium
SDIFSSWLNGAIPTWPPEMK

SEQ ID NO: 860010 - protein, 37 aa, Mycobacterium
SDIGRDDVFFWYTSPSWMMWNFQVAGLLVGATIVCYD

SEQ ID NO: 860011 - protein, 21 aa, Mycobacterium
SDIGYIYRGYKGYRGIDGPAY

SEQ ID NO: 860012 - protein, 25 aa, Mycobacterium
SDIGYNVVIYPVTTLRLAMHAVEAG

SEQ ID NO: 860013 - protein, 17 aa, Mycobacterium
SDIILLFQDGVEPQINT

SEQ ID NO: 860014 - protein, 26 aa, Mycobacterium
SDIKNLVPMFAVFQPTLVVSVPRVFE

SEQ ID NO: 860015 - protein, 27 aa, Mycobacterium
SDIKNLVPMFGVFKPTLVISVPRVFEK

SEQ ID NO: 860016 - protein, 17 aa, Mycobacterium
SDIKTIVHIHATALIRL

SEQ ID NO: 860017 - protein, 18 aa, Mycobacterium
SDILAFTLPGFATGDRTK

SEQ ID NO: 860018 - protein, 27 aa, Mycobacterium
SDILPLSFGFPFGFSAAIPPNLPLPTK

SEQ ID NO: 860019 - protein, 22 aa, Mycobacterium
SDIPARMRWVGDAAPLSFSIVR

SEQ ID NO: 860020 - protein, 22 aa, Mycobacterium
SDITFRRWCAALSTRWCNMRVQ

SEQ ID NO: 860021 - protein, 26 aa, Mycobacterium
SDITRTLRVYRANALPAMLHPQDRHT

SEQ ID NO: 860022 - protein, 42 aa, Mycobacterium
SDIVNSVINFAWAEARYFLPPLPPLPGLALQTTTDANGAAPT

SEQ ID NO: 860023 - protein, 17 aa, Mycobacterium
SDIVTSVFPEWTDTRAW

SEQ ID NO: 860024 - protein, 17 aa, Mycobacterium
SDIYLPLHGEHQAHNAV

SEQ ID NO: 860025 - protein, 18 aa, Mycobacterium
SDIYLPLHGEHQAHNAVV

SEQ ID NO: 860026 - protein, 35 aa, Mycobacterium
SDKAADFLTLCESFRLPVISLCDTPGFMVGPDSEK

SEQ ID NO: 860027 - protein, 31 aa, Mycobacterium
SDKAEPLVLKPWTMPEPLLPVAIQAHAKTDE

SEQ ID NO: 860028 - protein, 24 aa, Mycobacterium
SDKDSLQLLGWTEATATPQVEVAL

SEQ ID NO: 860029 - protein, 26 aa, Mycobacterium
SDKELRDAILLLIFGGFDTTRNQLGL

SEQ ID NO: 860030 - protein, 23 aa, Mycobacterium
SDKGPDLHIYLTKGADQNAVSTG

SEQ ID NO: 860031 - protein, 22 aa, Mycobacterium
SDKPWSGFNYYEGNYRSTVAVN

SEQ ID NO: 860032 - protein, 32 aa, Mycobacterium
SDKSEPLVLKPWTMPEPLLPIAIQAHAKTDED

SEQ ID NO: 860033 - protein, 31 aa, Mycobacterium
SDKSEPLVLKPWTMPEPLLPVAIAAHAKTDE

SEQ ID NO: 860034 - protein, 17 aa, Mycobacterium
SDKTWKPTWAAINQAFD

SEQ ID NO: 860035 - protein, 35 aa, Mycobacterium
SDKVTDFLMLCESFRLPVISLCDTPGFMVGPDAET

SEQ ID NO: 860036 - protein, 27 aa, Mycobacterium
SDLAAPRRRPVWVVLPQLRGQVGALVD

SEQ ID NO: 860037 - protein, 23 aa, Mycobacterium
SDLAARLKAAWAPGGLIQRGQGR

SEQ ID NO: 860038 - protein, 24 aa, Mycobacterium
SDLALAKLRHALPGAVFVSARTGD

SEQ ID NO: 860039 - protein, 24 aa, Mycobacterium
SDLALAKLRHALPGAVFVSARTGE

SEQ ID NO: 860040 - protein, 17 aa, Mycobacterium
SDLAYTLARRRGHRPVR

SEQ ID NO: 860041 - protein, 22 aa, Mycobacterium
SDLCAPALYALFDSVRELATPD

SEQ ID NO: 860042 - protein, 42 aa, Mycobacterium
SDLDWSAAFTGLSARRIPLPTYAFVRRRFWLSSDSVGSANIA

SEQ ID NO: 860043 - protein, 21 aa, Mycobacterium
SDLFYSIWWPRIPGDDSPVPE

SEQ ID NO: 860044 - protein, 23 aa, Mycobacterium
SDLGAIAIRAALEKAFPGVENPA

SEQ ID NO: 860045 - protein, 24 aa, Mycobacterium
SDLGLPLIAVGLLYRSGYFRQSLS

SEQ ID NO: 860046 - protein, 37 aa, Mycobacterium
SDLGPGDRFFWFTTTGWMMWNYLVGGLLVGATIVLFD

SEQ ID NO: 860047 - protein, 26 aa, Mycobacterium
SDLHTVLAHIAAVRPALVIVDSVQTM

SEQ ID NO: 860048 - protein, 41 aa, Mycobacterium
SDLIEEWRFFLGLTKRMGLELWFVNFFGGGGGRFMESPPVV

SEQ ID NO: 860049 - protein, 28 aa, Mycobacterium
SDLINPHPMFVPWLVGPLLTGDGIHLVK

SEQ ID NO: 860050 - protein, 21 aa, Mycobacterium
SDLIPIFVNAMPTPAVEPADV

SEQ ID NO: 860051 - protein, 26 aa, Mycobacterium
SDLKRFGEWLTIFAGWKSEVPAEIEV

SEQ ID NO: 860052 - protein, 18 aa, Mycobacterium
SDLLAFQIGIRNSDVGAV

SEQ ID NO: 860053 - protein, 23 aa, Mycobacterium
SDLNGMWRTKPPGIRLIVAGYGR

SEQ ID NO: 860054 - protein, 25 aa, Mycobacterium
SDLNNVRYLSGFTGSNGALLVFADD

SEQ ID NO: 860055 - protein, 22 aa, Mycobacterium
SDLPDDLLQFLPDTMTASLAEY

SEQ ID NO: 860056 - protein, 25 aa, Mycobacterium
SDLRGRFRWMGLYTQREQGYDGTWT

SEQ ID NO: 860057 - protein, 17 aa, Mycobacterium
SDLRMDPAVLAHQAVIA

SEQ ID NO: 860058 - protein, 24 aa, Mycobacterium
SDLRMRFKWMGLYTQREEGYDGSW

SEQ ID NO: 860059 - protein, 20 aa, Mycobacterium
SDLSALIEVQLGRAAQGDAA

SEQ ID NO: 860060 - protein, 24 aa, Mycobacterium
SDLTAIHLVTLLEALPIQETLEAI

SEQ ID NO: 860061 - protein, 24 aa, Mycobacterium
SDLTLAKLRHALPGAVFVSARTGD

SEQ ID NO: 860062 - protein, 19 aa, Mycobacterium
SDLVAWSGGLYDPPARFRD

SEQ ID NO: 860063 - protein, 33 aa, Mycobacterium
SDLVPPKRQPPSGGWRLLVYRATFGLVNPGPSA

SEQ ID NO: 860064 - protein, 24 aa, Mycobacterium
SDLVPVYRLQRVRLQRLLDDHHAS

SEQ ID NO: 860065 - protein, 24 aa, Mycobacterium
SDLVTWPDGWTALSARRYGDTRVE

SEQ ID NO: 860066 - protein, 24 aa, Mycobacterium
SDMAMPLMRGMGPTLIPRPQRMYL

SEQ ID NO: 860067 - protein, 27 aa, Mycobacterium
SDMDDMLWQVPYLPIDPKDVGRTYEAV

SEQ ID NO: 860068 - protein, 17 aa, Mycobacterium
SDMLRMRRWCSGTSNRW

SEQ ID NO: 860069 - protein, 27 aa, Mycobacterium
SDMPEVAMPLVFRLLGETGSHASVLND

SEQ ID NO: 860070 - protein, 23 aa, Mycobacterium
SDMPSFGYGFKPWIHRKAIADGH

SEQ ID NO: 860071 - protein, 34 aa, Mycobacterium
SDMTRTFILGRAEQWQLDLYELVAASQAAGREAL

SEQ ID NO: 860072 - protein, 26 aa, Mycobacterium
SDMTRTFVLAPVADWQREIYSLVAAS

SEQ ID NO: 860073 - protein, 30 aa, Mycobacterium
SDMTRTFVLGRAADWQLEIYQLVADAQRAG

SEQ ID NO: 860074 - protein, 30 aa, Mycobacterium
SDNEPGGFWTAFLIALRTALPEFGGGLLRE

SEQ ID NO: 860075 - protein, 25 aa, Mycobacterium
SDNKKVFAQLPRIQQLALSGLLTGG

SEQ ID NO: 860076 - protein, 20 aa, Mycobacterium
SDNMGFFNSGDFNTGDFNSG

SEQ ID NO: 860077 - protein, 24 aa, Mycobacterium
SDNQLAWRWYLNGADPEQAAPARR

SEQ ID NO: 860078 - protein, 18 aa, Mycobacterium
SDNTPFETMTLPATVTAT

SEQ ID NO: 860079 - protein, 25 aa, Mycobacterium
SDNVPEVFVVYWAALRSGLYITSVN

SEQ ID NO: 860080 - protein, 23 aa, Mycobacterium
SDPAAWPATLQRVVDAGGESGIY

SEQ ID NO: 860081 - protein, 27 aa, Mycobacterium
SDPAEQLYTLDYYLRLAEQIVEAGAHV

SEQ ID NO: 860082 - protein, 22 aa, Mycobacterium
SDPAFRQRYWARNHVGWRHMDD

SEQ ID NO: 860083 - protein, 22 aa, Mycobacterium
SDPAYFPYYAKCVELGIPLSIH

SEQ ID NO: 860084 - protein, 32 aa, Mycobacterium
SDPDLDGILRRLRLMDLSPPRPGLPADTGSVI

SEQ ID NO: 860085 - protein, 28 aa, Mycobacterium
SDPDLLPKIFYVNWFRRDSGGKFLWPGF

SEQ ID NO: 860086 - protein, 25 aa, Mycobacterium
SDPDVVARLLVSLYLGVRQTSELED

SEQ ID NO: 860087 - protein, 22 aa, Mycobacterium
SDPLDALLWRAERPEEPSWPSP

SEQ ID NO: 860088 - protein, 24 aa, Mycobacterium
SDPNAPRRFVTAMAPRPTAQATTA

SEQ ID NO: 860089 - protein, 24 aa, Mycobacterium
SDPPRKWWQPGPGEGYIGFTESKI

SEQ ID NO: 860090 - protein, 17 aa, Mycobacterium
SDPRGWMRALRAYNYSD

SEQ ID NO: 860091 - protein, 26 aa, Mycobacterium
SDPRLPALLRWRQQLISSGAVSPHTF

SEQ ID NO: 860092 - protein, 25 aa, Mycobacterium
SDPRLQRVFTFQSLYAGVAPRNALA

SEQ ID NO: 860093 - protein, 25 aa, Mycobacterium
SDPTGAVFGLWQPLEHRGFEVIGEA

SEQ ID NO: 860094 - protein, 25 aa, Mycobacterium
SDPTIYRFHEALAVYGPALKELIHE

SEQ ID NO: 860095 - protein, 23 aa, Mycobacterium
SDPVFRQRYWARNHVGWRHMDDT

SEQ ID NO: 860096 - protein, 23 aa, Mycobacterium
SDPVFRQRYWARNHVGWRHMDET

SEQ ID NO: 860097 - protein, 23 aa, Mycobacterium
SDPYQRLAFTYPMPRTPDLDDPG

SEQ ID NO: 860098 - protein, 17 aa, Mycobacterium
SDQEACFVTWTASFDVI

SEQ ID NO: 860099 - protein, 23 aa, Mycobacterium
SDQLDALLWRAERPGEPSWPSPF

SEQ ID NO: 860100 - protein, 25 aa, Mycobacterium
SDQLPCRTTVFVGLPHEVMLVEIDA

SEQ ID NO: 860101 - protein, 24 aa, Mycobacterium
SDQQWPVRVAALAEYRGRGLDFDR

SEQ ID NO: 860102 - protein, 26 aa, Mycobacterium
SDQVRQYVPLLTRVTPFVGHFQIRNR

SEQ ID NO: 860103 - protein, 24 aa, Mycobacterium
SDQVYLDLLTGWRDAWELGRTARD

SEQ ID NO: 860104 - protein, 24 aa, Mycobacterium
SDQVYLDLLTGWRDAWELGTTARS

SEQ ID NO: 860105 - protein, 23 aa, Mycobacterium
SDQVYLDLLTGWRDAWQLGTTAR

SEQ ID NO: 860106 - protein, 25 aa, Mycobacterium
SDQWMTRFVLGFGAAVRVLEPPDLA

SEQ ID NO: 860107 - protein, 21 aa, Mycobacterium
SDRAEFGWQPGVDSWLAGWDE

SEQ ID NO: 860108 - protein, 23 aa, Mycobacterium
SDRFPPLPEYPAGPTPQAFGFEG

SEQ ID NO: 860109 - protein, 23 aa, Mycobacterium
SDRHLVFEMVTSRGMYFGRSDSV

SEQ ID NO: 860110 - protein, 25 aa, Mycobacterium
SDRIRLMMGPWYHVSDHGGLHLQAL

SEQ ID NO: 860111 - protein, 26 aa, Mycobacterium
SDRLGRFCRDLARLCGKGMVLPMNTG

SEQ ID NO: 860112 - protein, 24 aa, Mycobacterium
SDRLKPWDVIAARLTAAAAADLVL

SEQ ID NO: 860113 - protein, 22 aa, Mycobacterium
SDRLKPWDVIVERLKAAAKADL

SEQ ID NO: 860114 - protein, 25 aa, Mycobacterium
SDRLKPWEVIAARLGAAAAADLVLA

SEQ ID NO: 860115 - protein, 17 aa, Mycobacterium
SDRLRLEAYRRLAAAAD

SEQ ID NO: 860116 - protein, 27 aa, Mycobacterium
SDRLRRNSIDPQWLLEYWSDRVHRLLS

SEQ ID NO: 860117 - protein, 24 aa, Mycobacterium
SDRPERYIPMVNAERSPTFYRFDS

SEQ ID NO: 860118 - protein, 23 aa, Mycobacterium
SDRPGTSYLMRRRTERARVAQRR

SEQ ID NO: 860119 - protein, 29 aa, Mycobacterium
SDRPLPWAAMHKLTAPTLLTWGRDDRVSP

SEQ ID NO: 860120 - protein, 37 aa, Mycobacterium
SDRPLVILLHGFGSFWWSWRHQLTGLRDARVVAVDLR

SEQ ID NO: 860121 - protein, 22 aa, Mycobacterium
SDRPPPDINWIVVRMTDAPGND

SEQ ID NO: 860122 - protein, 23 aa, Mycobacterium
SDRRLIHSYATWQVLRRLRVTAT

SEQ ID NO: 860123 - protein, 27 aa, Mycobacterium
SDRSGAITPFALLQLADRGQFFVEPGE

SEQ ID NO: 860124 - protein, 20 aa, Mycobacterium
SDRVGMRLVGRPLQCLHPDR

SEQ ID NO: 860125 - protein, 19 aa, Mycobacterium
SDRVGMRLVGRPLQHCYPD

SEQ ID NO: 860126 - protein, 21 aa, Mycobacterium
SDRVNFRIALWAARNMGMREQ

SEQ ID NO: 860127 - protein, 23 aa, Mycobacterium
SDRVQWLRGPAEQLPFDDGALDA

SEQ ID NO: 860128 - protein, 24 aa, Mycobacterium
SDRVRWLRGPAEQLPFDDGALDAV

SEQ ID NO: 860129 - protein, 25 aa, Mycobacterium
SDRWRAHGFDLDFTELVFLGDRADV

SEQ ID NO: 860130 - protein, 19 aa, Mycobacterium
SDRYKAPFSFTGGTIAQVT

SEQ ID NO: 860131 - protein, 17 aa, Mycobacterium
SDRYPLVTGYVVDMGGR

SEQ ID NO: 860132 - protein, 24 aa, Mycobacterium
SDRYVRARRWVTEGNYPLAHKVSG

SEQ ID NO: 860133 - protein, 19 aa, Mycobacterium
SDSAFLFHIAELETAARQN

SEQ ID NO: 860134 - protein, 20 aa, Mycobacterium
SDSAFLFHIAELETAVRENL

SEQ ID NO: 860135 - protein, 18 aa, Mycobacterium
SDSALLYHRHIPAAIVDA

SEQ ID NO: 860136 - protein, 22 aa, Mycobacterium
SDSALRYLWPNRSVLSQRIDFQ

SEQ ID NO: 860137 - protein, 20 aa, Mycobacterium
SDSALTWRPVLARLASAGRA

SEQ ID NO: 860138 - protein, 23 aa, Mycobacterium
SDSDIFTLSYPYEPWTRPENVAD

SEQ ID NO: 860139 - protein, 19 aa, Mycobacterium
SDSDMFTLGFRFKPWTSEK

SEQ ID NO: 860140 - protein, 27 aa, Mycobacterium
SDSDMFTLGYRFRPWTDPKAIADGPTI

SEQ ID NO: 860141 - protein, 22 aa, Mycobacterium
SDSDRLRPLRPGHLAYVIYTSG

SEQ ID NO: 860142 - protein, 32 aa, Mycobacterium
SDSGYATFRSVLWARWPSAGPPPFFDSEAQYD

SEQ ID NO: 860143 - protein, 21 aa, Mycobacterium
SDSPKFFHYVKKDKIAESAVM

SEQ ID NO: 860144 - protein, 30 aa, Mycobacterium
SDSQDRWQIRWRLGWSFACLEHNVLLLDAC

SEQ ID NO: 860145 - protein, 22 aa, Mycobacterium
SDSSIFTLSFPFEPWTRREGVA

SEQ ID NO: 860146 - protein, 24 aa, Mycobacterium
SDSWQGFAWFVEQQCQLTVTDRGL

SEQ ID NO: 860147 - protein, 25 aa, Mycobacterium
SDSYFKVPHIPFFTAGATGAPLGMA

SEQ ID NO: 860148 - protein, 28 aa, Mycobacterium
SDTAYLSMPLFHSNAIMAGWSVAVAAGA

SEQ ID NO: 860149 - protein, 33 aa, Mycobacterium
SDTDALLSLLLMIFPHLALAPYMRGLDPILGLD

SEQ ID NO: 860150 - protein, 25 aa, Mycobacterium
SDTEYPLLGPWGAARVFGPQKGADT

SEQ ID NO: 860151 - protein, 26 aa, Mycobacterium
SDTEYPLLGPWGAARVFGPQKGADTA

SEQ ID NO: 860152 - protein, 23 aa, Mycobacterium
SDTLYSCLPLYHNNALTVAVSSV

SEQ ID NO: 860153 - protein, 30 aa, Mycobacterium
SDTPGLRRLIADLESWLVAITGYDAVSLQP

SEQ ID NO: 860154 - protein, 24 aa, Mycobacterium
SDTPGLRRLIADLETWLVHITGYD

SEQ ID NO: 860155 - protein, 26 aa, Mycobacterium
SDTPGLRRLIADLQSWLTGITGYDEI

SEQ ID NO: 860156 - protein, 24 aa, Mycobacterium
SDTPGLRRLISDLESWLVQITGYD

SEQ ID NO: 860157 - protein, 26 aa, Mycobacterium
SDTPGLRRLITELQGWLAAITGYDEV

SEQ ID NO: 860158 - protein, 24 aa, Mycobacterium
SDTPLDLWLADHTLSLDAQLDLIA

SEQ ID NO: 860159 - protein, 22 aa, Mycobacterium
SDTPNPTLAPYAATKAAIANFS

SEQ ID NO: 860160 - protein, 29 aa, Mycobacterium
SDTSTDPVLAWLYVLDAWEGGLPSARYLG

SEQ ID NO: 860161 - protein, 30 aa, Mycobacterium
SDTTSISWLPLYHDMGLMLGLCAPVLGGWH

SEQ ID NO: 860162 - protein, 27 aa, Mycobacterium
SDTTTDPVLAWLYVLDAWEGGIPSARY

SEQ ID NO: 860163 - protein, 20 aa, Mycobacterium
SDTTWIGRDRFVLSCGHSSL

SEQ ID NO: 860164 - protein, 23 aa, Mycobacterium
SDTVLVFMHPIGGGAYLPMINAL

SEQ ID NO: 860165 - protein, 34 aa, Mycobacterium
SDTVSLPFVTATRAPVWVGPLDVMVIAGDDAGDP

SEQ ID NO: 860166 - protein, 29 aa, Mycobacterium
SDTVYQNLPAYALPLFIRIVDTLEHTTTF

SEQ ID NO: 860167 - protein, 24 aa, Mycobacterium
SDTYGARFGLLRRDDPFGEIRWFD

SEQ ID NO: 860168 - protein, 20 aa, Mycobacterium
SDTYKGPWVYAPGAVFADLA

SEQ ID NO: 860169 - protein, 22 aa, Mycobacterium
SDVAALWRRAVALVGGPQVGAS

SEQ ID NO: 860170 - protein, 18 aa, Mycobacterium
SDVADYLLRDVLELGDPG

SEQ ID NO: 860171 - protein, 24 aa, Mycobacterium
SDVAPLEMTKWFDTNYHYIVPEIA

SEQ ID NO: 860172 - protein, 34 aa, Mycobacterium
SDVEDPVWALIYGPPAPLRLLLVGGNTVVEDGEL

SEQ ID NO: 860173 - protein, 19 aa, Mycobacterium
SDVELLSKIVRYHLLLPNT

SEQ ID NO: 860174 - protein, 25 aa, Mycobacterium
SDVGFVGVPLFHIAGVAGSVLSGVT

SEQ ID NO: 860175 - protein, 19 aa, Mycobacterium
SDVGGTWFFNRYPGARCDV

SEQ ID NO: 860176 - protein, 20 aa, Mycobacterium
SDVLLKTRTAGLLRFTKILD

SEQ ID NO: 860177 - protein, 19 aa, Mycobacterium
SDVLYKGALQGDPDSRKPD

SEQ ID NO: 860178 - protein, 27 aa, Mycobacterium
SDVQPEIFFAPPRIWEKLRAITASDLE

SEQ ID NO: 860179 - protein, 53 aa, Mycobacterium
SDVRAFFHNNKLPLYFISPTPFNLLGIDRWVRNFFYLTYFDSFEGAHSRVFVP

SEQ ID NO: 860180 - protein, 22 aa, Mycobacterium
SDVRLWVDRSFTVRGAGTVVTG

SEQ ID NO: 860181 - protein, 20 aa, Mycobacterium
SDVTAPLLGPGGASAVFGPQ

SEQ ID NO: 860182 - protein, 20 aa, Mycobacterium
SDVTFDLISVQYHSLKAGHD

SEQ ID NO: 860183 - protein, 31 aa, Mycobacterium
SDVTPTLPLTLFTLFQKRLLGSLYGEANPRA

SEQ ID NO: 860184 - protein, 28 aa, Mycobacterium
SDVTRAITLWYTHYYRMGRMIELIQCWK

SEQ ID NO: 860185 - protein, 26 aa, Mycobacterium
SDVVDQYLITPFVDVLAGLAESSAPA

SEQ ID NO: 860186 - protein, 26 aa, Mycobacterium
SDVVDQYLITPYVDVLAALAESSAPA

SEQ ID NO: 860187 - protein, 20 aa, Mycobacterium
SDVVQSLWVDFIRGGEPWVR

SEQ ID NO: 860188 - protein, 32 aa, Mycobacterium
SDVVRTRIFVTDISRWREVGLVHGAFFGDIRP

SEQ ID NO: 860189 - protein, 23 aa, Mycobacterium
SDVWAMFDTLRFDLNVVAAGDEH

SEQ ID NO: 860190 - protein, 26 aa, Mycobacterium
SDWDLGVYYRGSFDAALLARLGYPGH

SEQ ID NO: 860191 - protein, 19 aa, Mycobacterium
SDWLNYAALDVELLIELRS

SEQ ID NO: 860192 - protein, 17 aa, Mycobacterium
SDWPRRSAQFTKIMPRD

SEQ ID NO: 860193 - protein, 19 aa, Mycobacterium
SDWSAQNLDFLVAVARSCA

SEQ ID NO: 860194 - protein, 26 aa, Mycobacterium
SDYDAWEALWTDDALYWVPVASTDDP

SEQ ID NO: 860195 - protein, 26 aa, Mycobacterium
SDYKGRKVIVYFYPAASTPGCTKQAC

SEQ ID NO: 860196 - protein, 20 aa, Mycobacterium
SDYMRPAVRLAALMDIDPIY

SEQ ID NO: 860197 - protein, 27 aa, Mycobacterium
SDYRGRKVIVYFYPAASTPGCTKQACD

SEQ ID NO: 860198 - protein, 21 aa, Mycobacterium
SDYWKPFYYLLDDELNMMLIN

SEQ ID NO: 860199 - protein, 23 aa, Mycobacterium
SEAAVEHLFAVASGLDSAVIGEQ

SEQ ID NO: 860200 - protein, 18 aa, Mycobacterium
SEAEFLARREAVERTMIV

SEQ ID NO: 860201 - protein, 19 aa, Mycobacterium
SEAFAFASSFGAPVVFFCQ

SEQ ID NO: 860202 - protein, 17 aa, Mycobacterium
SEAFIREKFARKPDVAE

SEQ ID NO: 860203 - protein, 20 aa, Mycobacterium
SEAFKAKLGESVLYPRRLGK

SEQ ID NO: 860204 - protein, 22 aa, Mycobacterium
SEAFRLELRPHGIGVTAICPGA

SEQ ID NO: 860205 - protein, 19 aa, Mycobacterium
SEAGLLEDALAAGPALLSV

SEQ ID NO: 860206 - protein, 20 aa, Mycobacterium
SEAILLSQQVWVMSYRPGSI

SEQ ID NO: 860207 - protein, 22 aa, Mycobacterium
SEAKILGIFVDGKRVPVVTHGA

SEQ ID NO: 860208 - protein, 23 aa, Mycobacterium
SEAKLLGIFVDGKRVPVVTHGTE

SEQ ID NO: 860209 - protein, 19 aa, Mycobacterium
SEALGQITPLVDARAALAI

SEQ ID NO: 860210 - protein, 18 aa, Mycobacterium
SEALPQVLAIELPQPECF

SEQ ID NO: 860211 - protein, 23 aa, Mycobacterium
SEANALALWGTFAAHGFTGHLVT

SEQ ID NO: 860212 - protein, 28 aa, Mycobacterium
SEASKMLVLWAVVVLRSPVGTHIAVANN

SEQ ID NO: 860213 - protein, 29 aa, Mycobacterium
SEASLVERLVPDFLWISTEHTAQVSLDAL

SEQ ID NO: 860214 - protein, 18 aa, Mycobacterium
SEAVAKDLDLPFTDAAQF

SEQ ID NO: 860215 - protein, 26 aa, Mycobacterium
SEAVDPLLPEVAWSWLVDAINSRTAD

SEQ ID NO: 860216 - protein, 26 aa, Mycobacterium
SEAVDPLLPEVAWSWLVDALDARANQ

SEQ ID NO: 860217 - protein, 31 aa, Mycobacterium; identical to SEQ ID NO: 117534

SEQ ID NO: 860218 - protein, 20 aa, Mycobacterium
SECVPYLAAFRYKESGMRKR

SEQ ID NO: 860219 - protein, 22 aa, Mycobacterium
SEDFARAIALECAKPIKTARAE

SEQ ID NO: 860220 - protein, 18 aa, Mycobacterium
SEDFVPLEDLLQPTMDEI

SEQ ID NO: 860221 - protein, 23 aa, Mycobacterium
SEDGPWRILGSSPSGMFVDGRRK

SEQ ID NO: 860222 - protein, 26 aa, Mycobacterium
SEDGVPLDAWFIPCKGSNKIAIANHP

SEQ ID NO: 860223 - protein, 24 aa, Mycobacterium
SEDLPTLIRTLTATTALMLTGDAL

SEQ ID NO: 860224 - protein, 24 aa, Mycobacterium
SEDSRLLTRELFYTAVTRAKQRVR

SEQ ID NO: 860225 - protein, 25 aa, Mycobacterium
SEDSTFYGDLFPHAVKWRGVTYLED

SEQ ID NO: 860226 - protein, 29 aa, Mycobacterium
SEDSTFYGDLFPHAVRWKGTTYLEDGLHR

SEQ ID NO: 860227 - protein, 25 aa, Mycobacterium
SEDSTFYGDLFPHAVRWKGVVYLED

SEQ ID NO: 860228 - protein, 24 aa, Mycobacterium
SEDVLLLHEPGRYPVAYFPSGDIE

SEQ ID NO: 860229 - protein, 24 aa, Mycobacterium
SEDWMARLILGFGSAIRVLAPESL

SEQ ID NO: 860230 - protein, 24 aa, Mycobacterium
SEDWMTRLVLGLGPAVRVLAPESL

SEQ ID NO: 860231 - protein, 17 aa, Mycobacterium
SEEALLRDVGIRFNGAE

SEQ ID NO: 860232 - protein, 27 aa, Mycobacterium
SEEILSALWALIGYQIPTPIPRISYAE

SEQ ID NO: 860233 - protein, 31 aa, Mycobacterium
SEELQLPVLRAQLRWMEAVLATWRGDFDEAQ

SEQ ID NO: 860234 - protein, 20 aa, Mycobacterium
SEEMPLAKMFLYSEVMGLVD

SEQ ID NO: 860235 - protein, 26 aa, Mycobacterium
SEESYLAILDALRWLGLDWDEGPEVG

SEQ ID NO: 860236 - protein, 26 aa, Mycobacterium
SEESYLALLDALRWLGLDWDEGPEVD

SEQ ID NO: 860237 - protein, 26 aa, Mycobacterium
SEESYLALLDALRWLGLDWDEGPEVG

SEQ ID NO: 860238 - protein, 27 aa, Mycobacterium
SEESYLALLDALRWLGLNWDEGPEVGG

SEQ ID NO: 860239 - protein, 25 aa, Mycobacterium
SEEVEVLRLSALRGLFSAVIEDQVT

SEQ ID NO: 860240 - protein, 23 aa, Mycobacterium
SEEVRQWLVSHVPLGRAGRPEEV

SEQ ID NO: 860241 - protein, 41 aa, Mycobacterium
SEFARRQWGGLLAPPALLMGWLITPPWQPGGRRSGSLIALR

SEQ ID NO: 860242 - protein, 18 aa, Mycobacterium
SEFGGIDYLVNNAAIFGG

SEQ ID NO: 860243 - protein, 22 aa, Mycobacterium
SEFGGIDYLVNNAAIYGGMKLD

SEQ ID NO: 860244 - protein, 19 aa, Mycobacterium
SEFGKILARLIPAGATIAT

SEQ ID NO: 860245 - protein, 23 aa, Mycobacterium
SEFHYRHHVEAVWIVEGTGTLTN

SEQ ID NO: 860246 - protein, 24 aa, Mycobacterium
SEFLHYLRIREWQDLVGQLRSIAG

SEQ ID NO: 860247 - protein, 17 aa, Mycobacterium
SEFLVALRRGDPDAGTA

SEQ ID NO: 860248 - protein, 17 aa, Mycobacterium
SEFLVALRRGDPESGVL

SEQ ID NO: 860249 - protein, 31 aa, Mycobacterium
SEFPAYGTLDIPVYIPFTGAIGPITIQEFTI

SEQ ID NO: 860250 - protein, 33 aa, Mycobacterium
SEFQGGRVFISMKQPLYIAISPDNMGWAGPDPA

SEQ ID NO: 860251 - protein, 17 aa, Mycobacterium
SEFRSTTGDFVKLSKDA

SEQ ID NO: 860252 - protein, 24 aa, Mycobacterium
SEGAGWLHLGLTPFASIDQQCPDG

SEQ ID NO: 860253 - protein, 18 aa, Mycobacterium
SEGCGILVLKRLSDAVRD

SEQ ID NO: 860254 - protein, 19 aa, Mycobacterium
SEGDAFGRLILLYDPDGSD

SEQ ID NO: 860255 - protein, 32 aa, Mycobacterium
SEGDRLIRSGQPWSWDIGFMLGTGLQGKQLGI

SEQ ID NO: 860256 - protein, 24 aa, Mycobacterium
SEGDSVILTFLPSCGRCSYCARGM

SEQ ID NO: 860257 - protein, 23 aa, Mycobacterium
SEGDWDAWLNPDAPLDPALLSHP

SEQ ID NO: 860258 - protein, 23 aa, Mycobacterium
SEGEKIMLLFESANFDEAVFTDP

SEQ ID NO: 860259 - protein, 22 aa, Mycobacterium
SEGELFIIGRIEDLLIVDGSNH

SEQ ID NO: 860260 - protein, 24 aa, Mycobacterium
SEGESLDKKLWAERPDVDRETAED

SEQ ID NO: 860261 - protein, 24 aa, Mycobacterium
SEGHKWAMLTAYDYSTAAVFDEAQ

SEQ ID NO: 860262 - protein, 25 aa, Mycobacterium
SEGHQDQLWRYIRTGDVAGVATDHC

SEQ ID NO: 860263 - protein, 19 aa, Mycobacterium
SEGIGTIAAAFWPKPVVVR

SEQ ID NO: 860264 - protein, 24 aa, Mycobacterium
SEGKRFMFDYIPDVFKGQYAESEE

SEQ ID NO: 860265 - protein, 23 aa, Mycobacterium
SEGLDQIFTAAGAQWRQAGCSMC

SEQ ID NO: 860266 - protein, 25 aa, Mycobacterium
SEGLSVPDLGWAPPAAPSGGDRAGD

SEQ ID NO: 860267 - protein, 26 aa, Mycobacterium
SEGNFTWALSRPLPFSAQLGAGAGGH

SEQ ID NO: 860268 - protein, 21 aa, Mycobacterium
SEGRLLVVGFAAGGIPTIKVN

SEQ ID NO: 860269 - protein, 26 aa, Mycobacterium
SEGVKVASFALAPKPDLIAKLKEAGV

SEQ ID NO: 860270 - protein, 23 aa, Mycobacterium
SEGVPRYWFKDNDTLEQFIADEL

SEQ ID NO: 860271 - protein, 24 aa, Mycobacterium
SEGWDIMDFVEQLQKLAAGNVAFA

SEQ ID NO: 860272 - protein, 24 aa, Mycobacterium
SEGYMWEHDLADWHWGIDVNVVGV

SEQ ID NO: 860273 - protein, 23 aa, Mycobacterium
SEHAFQVITVGTAVLGADGMSAG

SEQ ID NO: 860274 - protein, 32 aa, Mycobacterium
SEHCDAKTLSLCRYLRRWYPKAEVIRSNVPYR

SEQ ID NO: 860275 - protein, 26 aa, Mycobacterium
SEHERAHRLLNERLLTIEWEPRQLPD

SEQ ID NO: 860276 - protein, 17 aa, Mycobacterium
SEHFLVLQRFMVAQAEA

SEQ ID NO: 860277 - protein, 24 aa, Mycobacterium
SEHFSRHFGVFREAQAGADVVFDP

SEQ ID NO: 860278 - protein, 35 aa, Mycobacterium
SEHGGILLITHYTRILRYIRPQFVHVFVGGRIVES

SEQ ID NO: 860279 - protein, 19 aa, Mycobacterium
SEHLLAEHLQKVSLSFLVD

SEQ ID NO: 860280 - protein, 18 aa, Mycobacterium
SEHLLREAELWAATAAVR

SEQ ID NO: 860281 - protein, 23 aa, Mycobacterium
SEHPLIHDPFARVFLDAAGDGVW

SEQ ID NO: 860282 - protein, 24 aa, Mycobacterium
SEHYEGFWALVDYASVFEAARDDD

SEQ ID NO: 860283 - protein, 23 aa, Mycobacterium
SEIDGLVLCARHFRTTRAVTAEG

SEQ ID NO: 860284 - protein, 18 aa, Mycobacterium
SEIGFSQVLYDDHIGKVS

SEQ ID NO: 860285 - protein, 23 aa, Mycobacterium
SEIGLAIVERYLKNAKARVILAD

SEQ ID NO: 860286 - protein, 18 aa, Mycobacterium
SEIGLQQAVRLPDALKRF

SEQ ID NO: 860287 - protein, 32 aa, Mycobacterium
SEIGTKYWMDLGMGWQFFAQEDYIRRLTSALE

SEQ ID NO: 860288 - protein, 19 aa, Mycobacterium
SEIKRAYRKLARELHPDVN

SEQ ID NO: 860289 - protein, 19 aa, Mycobacterium
SEIKRAYRRLARELHPDVN

SEQ ID NO: 860290 - protein, 19 aa, Mycobacterium
SEILSPERALQVLNAYLER

SEQ ID NO: 860291 - protein, 18 aa, Mycobacterium
SEIRIKLDRPAYVYPIFE

SEQ ID NO: 860292 - protein, 19 aa, Mycobacterium
SEIVAYLAALGDALALPRN

SEQ ID NO: 860293 - protein, 36 aa, Mycobacterium
SEKAARFIRTCDCFNIPIVLLVDVPGFLPGTDQEYN

SEQ ID NO: 860294 - protein, 37 aa, Mycobacterium
SEKAARFIRTCDCYNIPIVLLVDVPGFLPGTDQEYNG

SEQ ID NO: 860295 - protein, 28 aa, Mycobacterium
SEKALAAALPMVTWLQTASTQAKTRGLQ

SEQ ID NO: 860296 - protein, 24 aa, Mycobacterium
SEKDVKRQLLLDALADELKVQVGQ

SEQ ID NO: 860297 - protein, 18 aa, Mycobacterium
SEKFFALCEVFGAVNVGM

SEQ ID NO: 860298 - protein, 24 aa, Mycobacterium
SEKGWDALYRSNLGHVLLCTQRVA

SEQ ID NO: 860299 - protein, 21 aa, Mycobacterium
SEKLLKLSFPFDVHADRSASE

SEQ ID NO: 860300 - protein, 22 aa, Mycobacterium
SEKLMLRADLLRPWANWVTPKE

SEQ ID NO: 860301 - protein, 22 aa, Mycobacterium
SEKRGHWTAAQLLTAATADGHR

SEQ ID NO: 860302 - protein, 18 aa, Mycobacterium
SEKRPAMTVALDFAMLPP

SEQ ID NO: 860303 - protein, 19 aa, Mycobacterium
SEKVAIDAAQVWLGVVEDQ

SEQ ID NO: 860304 - protein, 25 aa, Mycobacterium
SEKVGRWRFVTLRRSVDTDRDIADL

SEQ ID NO: 860305 - protein, 30 aa, Mycobacterium
SEKYGFDSFQFFPNFVLIFGSSGFSTHTHW

SEQ ID NO: 860306 - protein, 30 aa, Mycobacterium
SELAGFFRDAAGQAPFNLGLGNIGFGNVGS

SEQ ID NO: 860307 - protein, 29 aa, Mycobacterium
SELAGRWALLWPRDAPAPGASLLARLGDF

SEQ ID NO: 860308 - protein, 29 aa, Mycobacterium
SELAHIPLRRFGSVSEIAPTIAFLCTEQS

SEQ ID NO: 860309 - protein, 19 aa, Mycobacterium
SELAPLAALRFGELCLEAG

SEQ ID NO: 860310 - protein, 17 aa, Mycobacterium
SELARRLGLSKPTCLGI

SEQ ID NO: 860311 - protein, 18 aa, Mycobacterium
SELEERIAAIWRRFFGYD

SEQ ID NO: 860312 - protein, 22 aa, Mycobacterium
SELEFYLSCTPPRQAWDLGYQN

SEQ ID NO: 860313 - protein, 25 aa, Mycobacterium
SELELLDAYWRAANYLSVGQIYLLD

SEQ ID NO: 860314 - protein, 33 aa, Mycobacterium
SELENGRRTARLDTLFALTKALGAPLSAAVGVS

SEQ ID NO: 860315 - protein, 22 aa, Mycobacterium
SELFIDGKLLPGGAGRFPTVNP

SEQ ID NO: 860316 - protein, 22 aa, Mycobacterium
SELHLTRWKVGRLLDEARSAGL

SEQ ID NO: 860317 - protein, 17 aa, Mycobacterium
SELLGVLDDLDRARSHG

SEQ ID NO: 860318 - protein, 26 aa, Mycobacterium
SELLLADLGLPILYPSDPQQALDFGR

SEQ ID NO: 860319 - protein, 26 aa, Mycobacterium
SELNRIIFAVEQVLQRVTLAVVDELK

SEQ ID NO: 860320 - protein, 25 aa, Mycobacterium
SELPDKACWALQNLVARRYLSKDGQ

SEQ ID NO: 860321 - protein, 25 aa, Mycobacterium
SELPDRACWALQHLLSRRYISKHNH

SEQ ID NO: 860322 - protein, 25 aa, Mycobacterium
SELPDRACWALQHLLTRRYISAEAD

SEQ ID NO: 860323 - protein, 23 aa, Mycobacterium
SELPELLGLCDRIYTLSAGRLTG

SEQ ID NO: 860324 - protein, 24 aa, Mycobacterium
SELPGDPLALIAPAQSGGGEALGI

SEQ ID NO: 860325 - protein, 25 aa, Mycobacterium
SELPYSIVRATQFAEFTDAIAASMT

SEQ ID NO: 860326 - protein, 18 aa, Mycobacterium
SELQRRLDAAGSSLRALA

SEQ ID NO: 860327 - protein, 18 aa, Mycobacterium
SELRAERPVSWHPPVEDA

SEQ ID NO: 860328 - protein, 24 aa, Mycobacterium
SELRTALLRWFSISAADWDAWVEA

SEQ ID NO: 860329 - protein, 32 aa, Mycobacterium
SELSFIDLDTGRWWSDVRWFKAPPDVSNIGES

SEQ ID NO: 860330 - protein, 33 aa, Mycobacterium
SELSGVTRWRDGLPRIVHLLAQAAAAGGGVGED

SEQ ID NO: 860331 - protein, 20 aa, Mycobacterium
SELSPLNRSLLGDGLREIAA

SEQ ID NO: 860332 - protein, 23 aa, Mycobacterium
SELTFHAVPGHDWSYRAAHAGHT

SEQ ID NO: 860333 - protein, 28 aa, Mycobacterium
SELTMMSPLSFIQRPALWFDVMNRVRAT

SEQ ID NO: 860334 - protein, 23 aa, Mycobacterium
SELTPLTTLTLARLAAEAGLPDG

SEQ ID NO: 860335 - protein, 24 aa, Mycobacterium
SELTPLTTLTLARLAAEAGLPEGV

SEQ ID NO: 860336 - protein, 27 aa, Mycobacterium
SELVSYVRGVLYFRTKRWPDVLNQFPE

SEQ ID NO: 860337 - protein, 17 aa, Mycobacterium
SELYDRVGFAAVGRFNE

SEQ ID NO: 860338 - protein, 28 aa, Mycobacterium
SEMIITGTDLLWRHLVDRTALSSSATLL

SEQ ID NO: 860339 - protein, 19 aa, Mycobacterium
SEMLTRLPPPLRTVTSVQA

SEQ ID NO: 860340 - protein, 23 aa, Mycobacterium
SEMLWEHWDRCALHWFPGNHILH

SEQ ID NO: 860341 - protein, 24 aa, Mycobacterium
SEMRSRFWMGGRHIAVRNVPGVAS

SEQ ID NO: 860342 - protein, 28 aa, Mycobacterium
SEMVDAAWHAFILFTDQYADYGRRFFGR

SEQ ID NO: 860343 - protein, 25 aa, Mycobacterium
SENAAELWAWLQDGAYVYVCGDAEH

SEQ ID NO: 860344 - protein, 18 aa, Mycobacterium
SENPVYYVQYAHARLCAL

SEQ ID NO: 860345 - protein, 24 aa, Mycobacterium
SENRFKVELLKRVVEKQLTVVAAM

SEQ ID NO: 860346 - protein, 18 aa, Mycobacterium
SENTPWYSGPTLLEYLEN

SEQ ID NO: 860347 - protein, 26 aa, Mycobacterium
SENYFQAYDYRILPPDADPATAAAGE

SEQ ID NO: 860348 - protein, 20 aa, Mycobacterium
SEPAAKVVEFPPAPEVIKYP

SEQ ID NO: 860349 - protein, 23 aa, Mycobacterium
SEPAAWWEVVETNLRGTVALTRA

SEQ ID NO: 860350 - protein, 18 aa, Mycobacterium
SEPALDGLPLAGVRIIDL

SEQ ID NO: 860351 - protein, 26 aa, Mycobacterium
SEPALRALRRGGRFVTIGFASGAIPR

SEQ ID NO: 860352 - protein, 18 aa, Mycobacterium
SEPAPKVLALAGGVPGVA

SEQ ID NO: 860353 - protein, 22 aa, Mycobacterium
SEPAVVAPYLDLPAELIGGGTT

SEQ ID NO: 860354 - protein, 23 aa, Mycobacterium
SEPGAYWLPRRLGGTAPTVEEAA

SEQ ID NO: 860355 - protein, 18 aa, Mycobacterium
SEPGWLTSACDLLDTALA

SEQ ID NO: 860356 - protein, 24 aa, Mycobacterium
SEPLTDAIPLWKRAQDGAIITGWD

SEQ ID NO: 860357 - protein, 19 aa, Mycobacterium
SEPLWKVVQAHPSAAVFPG

SEQ ID NO: 860358 - protein, 26 aa, Mycobacterium
SEPPSPLPELYFGGSSPAALPIAADH

SEQ ID NO: 860359 - protein, 18 aa, Mycobacterium
SEPRFDPAVWARLGAELG

SEQ ID NO: 860360 - protein, 26 aa, Mycobacterium
SEPRRLARRYLLQGPIALLRAARAQL

SEQ ID NO: 860361 - protein, 30 aa, Mycobacterium
SEPRRLARRYLLQGPIALLRTARAQLICYP

SEQ ID NO: 860362 - protein, 19 aa, Mycobacterium
SEPTGYRIALVAPSLAGEV

SEQ ID NO: 860363 - protein, 25 aa, Mycobacterium
SEPVDVVLTSLPWSVSETTMSSAAS

SEQ ID NO: 860364 - protein, 20 aa, Mycobacterium
SEPWQQLLTHYDIAARAIRS

SEQ ID NO: 860365 - protein, 24 aa, Mycobacterium
SEPYDLVAEMPRFGWPTVVVSGGH

SEQ ID NO: 860366 - protein, 19 aa, Mycobacterium
SEQAKLQLAVLAARLRAAG

SEQ ID NO: 860367 - protein, 22 aa, Mycobacterium
SEQAWSMLGVTPLIGINDDPSE

SEQ ID NO: 860368 - protein, 22 aa, Mycobacterium
SEQDTFYIAPENSRQLLRTHTS

SEQ ID NO: 860369 - protein, 26 aa, Mycobacterium
SEQDVYLRWAVAAFRLATSGVADSTQ

SEQ ID NO: 860370 - protein, 34 aa, Mycobacterium
SEQFRAAVPPATPFALALRMLVIALKNNEILNST

SEQ ID NO: 860371 - protein, 24 aa, Mycobacterium
SEQLGLHFLTVRRDARATLRAVYE

SEQ ID NO: 860372 - protein, 21 aa, Mycobacterium
SEQPFLLAVIVPNVDAVGGGD

SEQ ID NO: 860373 - protein, 24 aa, Mycobacterium
SEQTAIHLVTLLEALPIQETLEAI

SEQ ID NO: 860374 - protein, 24 aa, Mycobacterium
SEQTKLIFPKVWGGGPSPMLDEPG

SEQ ID NO: 860375 - protein, 24 aa, Mycobacterium
SEQTWHRWRNQYGGMKAEDTKRLK

SEQ ID NO: 860376 - protein, 25 aa, Mycobacterium
SEQVTGIFLVPAQWQAVCAAQRARP

SEQ ID NO: 860377 - protein, 23 aa, Mycobacterium
SEQWDKWHNGAGQVIRGLQAMSE

SEQ ID NO: 860378 - protein, 29 aa, Mycobacterium
SEQWRTVVDVNLIGTWNTCAAALPHLVER

SEQ ID NO: 860379 - protein, 33 aa, Mycobacterium
SERAVTAAMPMVLWLRMLSLQAHKRALQASAQA

SEQ ID NO: 860380 - protein, 23 aa, Mycobacterium
SERDTAFLFITHDLGVVSSIAQR

SEQ ID NO: 860381 - protein, 29 aa, Mycobacterium
SEREARLLQTIPLRRLGAPREIAHAICAL

SEQ ID NO: 860382 - protein, 24 aa, Mycobacterium
SERELLEGLRLIARVSSLCAQMSV

SEQ ID NO: 860383 - protein, 33 aa, Mycobacterium
SERGNFPVFRKRLRQWMMRITAYSDRLIDDLDV

SEQ ID NO: 860384 - protein, 24 aa, Mycobacterium
SERITKWLLPVVADNLRSGGPVRL

SEQ ID NO: 860385 - protein, 24 aa, Mycobacterium
SERIVEFLSLQRDLYAYLHDQTLR

SEQ ID NO: 860386 - protein, 17 aa, Mycobacterium
SERLREMAGRWADAIFT

SEQ ID NO: 860387 - protein, 21 aa, Mycobacterium
SERLYELIEKERPRFVVPLVE

SEQ ID NO: 860388 - protein, 17 aa, Mycobacterium
SERPAIHRFPGSMAKRI

SEQ ID NO: 860389 - protein, 24 aa, Mycobacterium
SERQLKTLLPLIAVFGGAASGRIM

SEQ ID NO: 860390 - protein, 26 aa, Mycobacterium
SERQNESGFAWAFLGAALATTKLPFG

SEQ ID NO: 860391 - protein, 17 aa, Mycobacterium
SERRRPFDLSRGPALRV

SEQ ID NO: 860392 - protein, 23 aa, Mycobacterium
SERRRPFDLSRGPALRVVVLSVP

SEQ ID NO: 860393 - protein, 17 aa, Mycobacterium
SERTLVIIPTYNERENL

SEQ ID NO: 860394 - protein, 29 aa, Mycobacterium
SERTRVWGMRIASLLLFTELVIQTTRSLA

SEQ ID NO: 860395 - protein, 19 aa, Mycobacterium
SERWRAHGFDLDMAGLVYF

SEQ ID NO: 860396 - protein, 26 aa, Mycobacterium
SERYGVPASALLYRAGQRKLIGGQED

SEQ ID NO: 860397 - protein, 19 aa, Mycobacterium
SERYVFYTGAREAVRASKI

SEQ ID NO: 860398 - protein, 24 aa, Mycobacterium
SESAAVRLPFVLSGVTLHATAATR

SEQ ID NO: 860399 - protein, 17 aa, Mycobacterium
SESELITLVFMITDMFD

SEQ ID NO: 860400 - protein, 24 aa, Mycobacterium
SESGVHYWGRFGSAGLLLRAPRPD

SEQ ID NO: 860401 - protein, 20 aa, Mycobacterium
SESKRRVAVLGGNRIPFARS

SEQ ID NO: 860402 - protein, 27 aa, Mycobacterium
SESMEAAVFPYLAWMNITGMQAEQTAR

SEQ ID NO: 860403 - protein, 30 aa, Mycobacterium; identical to SEQ ID NO: 222873

SEQ ID NO: 860404 - protein, 25 aa, Mycobacterium
SESQALFRMFQDRVTWLENTIRWSW

SEQ ID NO: 860405 - protein, 23 aa, Mycobacterium
SESSPMDVLWFRLNRRPGDPNES

SEQ ID NO: 860406 - protein, 19 aa, Mycobacterium
SESTRFFPMLTTAAGTVKP

SEQ ID NO: 860407 - protein, 20 aa, Mycobacterium
SETAVYNVLPQWAKLAGKPK

SEQ ID NO: 860408 - protein, 22 aa, Mycobacterium
SETCVGRLRYLGLVLYDVDRVL

SEQ ID NO: 860409 - protein, 18 aa, Mycobacterium
SETDYFTRMWNQAAAAMD

SEQ ID NO: 860410 - protein, 25 aa, Mycobacterium
SETELRAWAVPRAANQFWMLGEPER

SEQ ID NO: 860411 - protein, 22 aa, Mycobacterium
SETLKKVFLELGGKSAAIILDD

SEQ ID NO: 860412 - protein, 22 aa, Mycobacterium
SETPRLVVLSRLVPHKQIEDAL

SEQ ID NO: 860413 - protein, 20 aa, Mycobacterium
SETRAAHWLLLLGADRVDAI

SEQ ID NO: 860414 - protein, 23 aa, Mycobacterium
SETVADLMRRGLGAGGAAAISTD

SEQ ID NO: 860415 - protein, 23 aa, Mycobacterium
SETVLVFMHPIGGGAYLPMINAL

SEQ ID NO: 860416 - protein, 24 aa, Mycobacterium
SETVTIPLTPLTPPIVVGANTPVL

SEQ ID NO: 860417 - protein, 18 aa, Mycobacterium
SETVTWMLRDLGVYAIKL

SEQ ID NO: 860418 - protein, 18 aa, Mycobacterium
SEVAAREPVLLWGDARVG

SEQ ID NO: 860419 - protein, 19 aa, Mycobacterium
SEVAAVVYGLVLEGRETES

SEQ ID NO: 860420 - protein, 26 aa, Mycobacterium
SEVAEMLRRPAPWRGAMEIDRLNVAI

SEQ ID NO: 860421 - protein, 25 aa, Mycobacterium
SEVAIVCQLARTLLGPDHPVPWETF

SEQ ID NO: 860422 - protein, 30 aa, Mycobacterium; identical to SEQ ID NO: 117541

SEQ ID NO: 860423 - protein, 30 aa, Mycobacterium
SEVEHVLATQTLPLRPFKTMAVNVDGELPP

SEQ ID NO: 860424 - protein, 35 aa, Mycobacterium
SEVEHVLATQTLPLRPFRTMAINIDGSLPTGVTSK

SEQ ID NO: 860425 - protein, 28 aa, Mycobacterium
SEVEYRQLRLERVVLVGVWTDGTAADSE

SEQ ID NO: 860426 - protein, 27 aa, Mycobacterium
SEVEYRQLRLERVVLVGVWTEGSAADA

SEQ ID NO: 860427 - protein, 25 aa, Mycobacterium
SEVFREHFLTCFIADPVGVATRHQI

SEQ ID NO: 860428 - protein, 22 aa, Mycobacterium
SEVILGYLDLVLDGLVARLAAG

SEQ ID NO: 860429 - protein, 21 aa, Mycobacterium
SEVKVAHAPLLALLTELMEEA

SEQ ID NO: 860430 - protein, 18 aa, Mycobacterium
SEVKWSLYPMGGSAVRLP

SEQ ID NO: 860431 - protein, 22 aa, Mycobacterium
SEVLLIEPFYDSYAPVIAMAGA

SEQ ID NO: 860432 - protein, 22 aa, Mycobacterium
SEVLLIEPFYDSYSPVIAMAGC

SEQ ID NO: 860433 - protein, 22 aa, Mycobacterium
SEVLLIEPFYDSYSPVVAMASA

SEQ ID NO: 860434 - protein, 18 aa, Mycobacterium
SEVLPPYMVPAAFVVIDE

SEQ ID NO: 860435 - protein, 26 aa, Mycobacterium
SEVMRFLSHIGLFIRGDRTDTGHATA

SEQ ID NO: 860436 - protein, 20 aa, Mycobacterium
SEVQVFGQLLVLERQDDLDD

SEQ ID NO: 860437 - protein, 17 aa, Mycobacterium
SEVSFPKPVFHGDTLYA

SEQ ID NO: 860438 - protein, 17 aa, Mycobacterium
SEVSFPKPVYHGDTLYA

SEQ ID NO: 860439 - protein, 19 aa, Mycobacterium
SEVSITRRMFRDGAGEYEI

SEQ ID NO: 860440 - protein, 23 aa, Mycobacterium
SEVSMLFVLYQMASGGGPGFVLG

SEQ ID NO: 860441 - protein, 24 aa, Mycobacterium
SEVSMLFVLYQMASGGGPGFVLGS

SEQ ID NO: 860442 - protein, 23 aa, Mycobacterium
SEVVTKLIRWTGFSPDKVARICL

SEQ ID NO: 860443 - protein, 20 aa, Mycobacterium
SEVYDRVGFAAVGKFNEFDR

SEQ ID NO: 860444 - protein, 22 aa, Mycobacterium
SEWFTVDWHREIVDKWRAAGVR

SEQ ID NO: 860445 - protein, 23 aa, Mycobacterium
SEWFTVDWHREIVEKWRAAGVRM

SEQ ID NO: 860446 - protein, 17 aa, Mycobacterium
SEWGICGVGLLANDRRM

SEQ ID NO: 860447 - protein, 18 aa, Mycobacterium
SEWPSDIIRRAAGVAARS

SEQ ID NO: 860448 - protein, 17 aa, Mycobacterium
SEYAIIRDDLFSTPIPG

SEQ ID NO: 860449 - protein, 28 aa, Mycobacterium
SEYGRLRRGQTLFTYLHLAASRPCTDAL

SEQ ID NO: 860450 - protein, 17 aa, Mycobacterium
SEYLVVPEVWRGFEHGD

SEQ ID NO: 860451 - protein, 20 aa, Mycobacterium
SFAALSLDPPLVLFCPTKQS

SEQ ID NO: 860452 - protein, 20 aa, Mycobacterium
SFAALSLDPPLVLFCPTKVS

SEQ ID NO: 860453 - protein, 23 aa, Mycobacterium
SFAAVDFFEARKLPFIVAVNEFD

SEQ ID NO: 860454 - protein, 18 aa, Mycobacterium
SFAAVDFFEARKLPFLIA

SEQ ID NO: 860455 - protein, 22 aa, Mycobacterium
SFACAPLLDGYPRPGKTVLFLG

SEQ ID NO: 860456 - protein, 19 aa, Mycobacterium
SFADRPAGWRVVYGEATRA

SEQ ID NO: 860457 - protein, 29 aa, Mycobacterium
SFAEAAAVPVVFLTALFGLSDLAEIKGGE

SEQ ID NO: 860458 - protein, 21 aa, Mycobacterium
SFAELRAERPVSWHPPVEDAL

SEQ ID NO: 860459 - protein, 32 aa, Mycobacterium
SFAEREGVNLTFLPFIARAVIDALKIHPNINA

SEQ ID NO: 860460 - protein, 19 aa, Mycobacterium
SFAGMAAAVPLPLAHTVEL

SEQ ID NO: 860461 - protein, 23 aa, Mycobacterium
SFAPVQEFYYRTPPQIERGRRHY

SEQ ID NO: 860462 - protein, 28 aa, Mycobacterium
SFAPYSFTDFHLTKLPTLNGRHGFMVVD

SEQ ID NO: 860463 - protein, 25 aa, Mycobacterium
SFAQQRLWFIDQLQGPSAVYNMAWS

SEQ ID NO: 860464 - protein, 35 aa, Mycobacterium
SFATAPLLPGYPRTGPTVLFLGRFDEPRKGMAVLL

SEQ ID NO: 860465 - protein, 34 aa, Mycobacterium
SFATTDVDFYKWTQWIFLQIYNAWYDEQARRARP

SEQ ID NO: 860466 - protein, 34 aa, Mycobacterium
SFATTDVDYYKWTQWIFLQIFNAWFDTDQNRARP

SEQ ID NO: 860467 - protein, 25 aa, Mycobacterium
SFATYFNAFPASYWRRWSICASVVL

SEQ ID NO: 860468 - protein, 24 aa, Mycobacterium
SFATYFNAFPASYWRRWSICSSVV

SEQ ID NO: 860469 - protein, 24 aa, Mycobacterium
SFATYFNAFPASYWRRWSICTSVV

SEQ ID NO: 860470 - protein, 24 aa, Mycobacterium
SFATYFNAFPASYWRRWSTLENVV

SEQ ID NO: 860471 - protein, 27 aa, Mycobacterium
SFATYFNAFPASYWRRWSTLESVVLRV

SEQ ID NO: 860472 - protein, 24 aa, Mycobacterium
SFDDDPVMEFFTTSTTNLVAAARA

SEQ ID NO: 860473 - protein, 24 aa, Mycobacterium
SFDDHFTQPAMFYRSLTPIEQDHI

SEQ ID NO: 860474 - protein, 24 aa, Mycobacterium
SFDKPVVYWLVALPLDREKGSWDR

SEQ ID NO: 860475 - protein, 28 aa, Mycobacterium
SFDLASRLPLLVRLYRRADDQYLLVLVL

SEQ ID NO: 860476 - protein, 26 aa, Mycobacterium
SFDLATQVMLPFPLILSEATGELIGA

SEQ ID NO: 860477 - protein, 19 aa, Mycobacterium
SFDLLSGGRFTLGTGAGYL

SEQ ID NO: 860478 - protein, 17 aa, Mycobacterium
SFDMTLKQQFLGAFAAV

SEQ ID NO: 860479 - protein, 17 aa, Mycobacterium
SFDMWVYGHQLPDAITL

SEQ ID NO: 860480 - protein, 20 aa, Mycobacterium
SFDSMRTLAPPTGRGWEVLA

SEQ ID NO: 860481 - protein, 24 aa, Mycobacterium
SFDSMRTLIPPMGRGWEVLTGDEV

SEQ ID NO: 860482 - protein, 22 aa, Mycobacterium
SFDVRDWARLGFCDGLLHVTDA

SEQ ID NO: 860483 - protein, 36 aa, Mycobacterium
SFDWRTLPLVHRAEPSIPLVALYDEQTPGDPLIGAL

SEQ ID NO: 860484 - protein, 20 aa, Mycobacterium
SFEDGPVMDFFTASARNLVD

SEQ ID NO: 860485 - protein, 20 aa, Mycobacterium
SFEGWVAVLVPTLAPDHADG

SEQ ID NO: 860486 - protein, 28 aa, Mycobacterium
SFENFARTWLDYRLKLLEATDRFGPFQR

SEQ ID NO: 860487 - protein, 22 aa, Mycobacterium
SFENWDAVLKVHLYGGYNVIRA

SEQ ID NO: 860488 - protein, 19 aa, Mycobacterium
SFEPLARELAAASAATVVA

SEQ ID NO: 860489 - protein, 18 aa, Mycobacterium
SFEQVAYLLWHGELPTDQ

SEQ ID NO: 860490 - protein, 19 aa, Mycobacterium
SFETARFIKFIITEIFPGG

SEQ ID NO: 860491 - protein, 29 aa, Mycobacterium
SFFACADGFVYLYMTSRAHWLGVKQLMGC

SEQ ID NO: 860492 - protein, 19 aa, Mycobacterium
SFFAMTAEVLGAVLPGAIA

SEQ ID NO: 860493 - protein, 23 aa, Mycobacterium
SFFDQLASFCRVAIFDKAGTGLS

SEQ ID NO: 860494 - protein, 17 aa, Mycobacterium
SFFHGIWVDGDGALVST

SEQ ID NO: 860495 - protein, 25 aa, Mycobacterium
SFFRGELIYVFDGDAAGRAAALKAL

SEQ ID NO: 860496 - protein, 19 aa, Mycobacterium
SFFTEVPDLTHAGFPLAEV

SEQ ID NO: 860497 - protein, 20 aa, Mycobacterium
SFGAFVPRGITLRLFGDAND

SEQ ID NO: 860498 - protein, 25 aa, Mycobacterium
SFGAQWAGFARAALFPTLAAALDCG

SEQ ID NO: 860499 - protein, 21 aa, Mycobacterium
SFGFTLMGLIPGFADPRDGRM

SEQ ID NO: 860500 - protein, 18 aa, Mycobacterium
SFGGTPPPYPGWPQVLDD

SEQ ID NO: 860501 - protein, 18 aa, Mycobacterium
SFGHHPLLAFLDRPEIAG

SEQ ID NO: 860502 - protein, 23 aa, Mycobacterium
SFGIPLLGIDFSVTNLLQSTYVG

SEQ ID NO: 860503 - protein, 19 aa, Mycobacterium
SFGLPGLAAFCRDAIHANA

SEQ ID NO: 860504 - protein, 19 aa, Mycobacterium
SFGLPGLAAYCREAIHANA

SEQ ID NO: 860505 - protein, 23 aa, Mycobacterium
SFGMLDAFYPGRIDLGLGRSAQR

SEQ ID NO: 860506 - protein, 21 aa, Mycobacterium
SFGMSMGQQLTFGPGGATAGA

SEQ ID NO: 860507 - protein, 27 aa, Mycobacterium
SFGRTYAFSLMLTFLKGRLQVVDHLKR

SEQ ID NO: 860508 - protein, 17 aa, Mycobacterium
SFGTDVPRPLWPGSDEP

SEQ ID NO: 860509 - protein, 24 aa, Mycobacterium
SFGVIQRPDRFTFYASIDHLHADG

SEQ ID NO: 860510 - protein, 23 aa, Mycobacterium
SFHAPEFTVAWPTGEIGGMGLEG

SEQ ID NO: 860511 - protein, 19 aa, Mycobacterium
SFHDVLVARRTLGLRPAPE

SEQ ID NO: 860512 - protein, 23 aa, Mycobacterium
SFHELFIGGRWCKPTIAEPITVI

SEQ ID NO: 860513 - protein, 21 aa, Mycobacterium
SFICGPEPFMAVVRAALTEAG

SEQ ID NO: 860514 - protein, 21 aa, Mycobacterium
SFIDFTKWLMDAMHAHYLEMN

SEQ ID NO: 860515 - protein, 18 aa, Mycobacterium
SFIELRTIIGYPAPKLMN

SEQ ID NO: 860516 - protein, 20 aa, Mycobacterium
SFIGKIFSPPEFKLIPVDES

SEQ ID NO: 860517 - protein, 19 aa, Mycobacterium
SFIPSCGRCPTCQAGLRNL

SEQ ID NO: 860518 - protein, 26 aa, Mycobacterium
SFIRTPQWVLWAPMSLRQPKFVAKLL

SEQ ID NO: 860519 - protein, 41 aa, Mycobacterium
SFITDQGEAWWGPYLHKDAGPSWSFLTWAKPGSDWERRYAE

SEQ ID NO: 860520 - protein, 25 aa, Mycobacterium
SFIWDRRIERLLAFGRGQHFCLGVH

SEQ ID NO: 860521 - protein, 18 aa, Mycobacterium
SFIYGVGFPTLWSHHHLD

SEQ ID NO: 860522 - protein, 17 aa, Mycobacterium
SFIYPPYTERAFKMARR

SEQ ID NO: 860523 - protein, 19 aa, Mycobacterium
SFKFDDMSPIPYAKSMDIP

SEQ ID NO: 860524 - protein, 21 aa, Mycobacterium
SFKLGPRWLMPPMVLATSPEA

SEQ ID NO: 860525 - protein, 28 aa, Mycobacterium
SFKVNRIQPLRLHYARTLQIWAASLESR

SEQ ID NO: 860526 - protein, 19 aa, Mycobacterium
SFLAKQLGVPQPEPLRRYK

SEQ ID NO: 860527 - protein, 17 aa, Mycobacterium
SFLALPPADADEAARGM

SEQ ID NO: 860528 - protein, 31 aa, Mycobacterium
SFLARTRSRPQVLLLPLGPLAEHNTRTTFAA

SEQ ID NO: 860529 - protein, 34 aa, Mycobacterium
SFLCTGMPFAFLDRPRRWIRRVPPLYGQHTQEVL

SEQ ID NO: 860530 - protein, 38 aa, Mycobacterium
SFLDALAAHRRAHGLPAISLGWGLWDQASAMTGGLDAA

SEQ ID NO: 860531 - protein, 17 aa, Mycobacterium
SFLDGLAAHRRAHGLPG

SEQ ID NO: 860532 - protein, 38 aa, Mycobacterium
SFLDGLAVHRRMRGLPAMSLAWGLWDQASAMTGALGAA

SEQ ID NO: 860533 - protein, 23 aa, Mycobacterium
SFLDKVHFQPLPADVAKLSDAQI

SEQ ID NO: 860534 - protein, 20 aa, Mycobacterium
SFLIAAPDPLLAAAGDLMGI

SEQ ID NO: 860535 - protein, 25 aa, Mycobacterium
SFLLDHALVDIGVGVRWLREVQGIE

SEQ ID NO: 860536 - protein, 24 aa, Mycobacterium
SFLLDHALVDIGVGVRWLREVQGV

SEQ ID NO: 860537 - protein, 18 aa, Mycobacterium
SFLPELPTFTVTSQSFED

SEQ ID NO: 860538 - protein, 24 aa, Mycobacterium
SFLTEPWWCRMVVLSAERIARRGG

SEQ ID NO: 860539 - protein, 30 aa, Mycobacterium
SFLVKDLHLPWQWGAAWFLDQLTDGDLASN

SEQ ID NO: 860540 - protein, 19 aa, Mycobacterium
SFLWGTIIEEYLQRCERAG

SEQ ID NO: 860541 - protein, 24 aa, Mycobacterium
SFMADHVFNRLAIPSWMARTGFQM

SEQ ID NO: 860542 - protein, 17 aa, Mycobacterium
SFMAIGETYYRLGGTYA

SEQ ID NO: 860543 - protein, 18 aa, Mycobacterium
SFMEGIVLHWMHTDGVSR

SEQ ID NO: 860544 - protein, 17 aa, Mycobacterium
SFMVGKLNRAMQRNPLL

SEQ ID NO: 860545 - protein, 19 aa, Mycobacterium
SFNLFSHKTILDNVTLAPI

SEQ ID NO: 860546 - protein, 22 aa, Mycobacterium
SFNLHNLLTWSSSIGSPETSQL

SEQ ID NO: 860547 - protein, 21 aa, Mycobacterium
SFNRDLFRQFAEWDIRIVPDE

SEQ ID NO: 860548 - protein, 20 aa, Mycobacterium
SFNRPKLPGIPGIKDFGGHI

SEQ ID NO: 860549 - protein, 26 aa, Mycobacterium
SFNSLFLRNCINYGLPILAVPGISSA

SEQ ID NO: 860550 - protein, 34 aa, Mycobacterium
SFNVSRAALLIVALTERPDLLLAATEDALHQSQR

SEQ ID NO: 860551 - protein, 25 aa, Mycobacterium
SFNYKDRIFATPVITLPIVDRALEE

SEQ ID NO: 860552 - protein, 25 aa, Mycobacterium
SFPAIALCRRFLAAGDIPTLLTGVE

SEQ ID NO: 860553 - protein, 27 aa, Mycobacterium
SFPKKRGMRIDFVLGSPEFAKRVGNAH

SEQ ID NO: 860554 - protein, 18 aa, Mycobacterium
SFPLGKQQRPAPTVVAGD

SEQ ID NO: 860555 - protein, 19 aa, Mycobacterium
SFPSLLREGFAAVAAGLPE

SEQ ID NO: 860556 - protein, 18 aa, Mycobacterium
SFQLGQWTIPRGYSIMVA

SEQ ID NO: 860557 - protein, 34 aa, Mycobacterium
SFQRLGIRCFGFAPLRLPPDLDFAALFHGVDERV

SEQ ID NO: 860558 - protein, 25 aa, Mycobacterium
SFQTPVGFPLLSVWENLMTAGADRS

SEQ ID NO: 860559 - protein, 32 aa, Mycobacterium
SFRLLHPDVDGPYSWWSWRGKAFDNDAGWRID

SEQ ID NO: 860560 - protein, 33 aa, Mycobacterium
SFRLTPSVFTTVYYWAFGGWLRKRRNIRDMTKT

SEQ ID NO: 860561 - protein, 17 aa, Mycobacterium
SFRRFAHAGDPLADAVV

SEQ ID NO: 860562 - protein, 18 aa, Mycobacterium
SFRRGATLGQWYANPNSG

SEQ ID NO: 860563 - protein, 37 aa, Mycobacterium
SFSAAAVWRIRRAAPLLPTVLLGKTARYLASGAASAV

SEQ ID NO: 860564 - protein, 24 aa, Mycobacterium
SFSALPNFAFEHCALRGVPKEGEP

SEQ ID NO: 860565 - protein, 18 aa, Mycobacterium
SFSAPVSGVGRFGPPRAA

SEQ ID NO: 860566 - protein, 36 aa, Mycobacterium
SFSASAIWRIRRAAPLLPTVLLGKTARYLTSGAPTA

SEQ ID NO: 860567 - protein, 17 aa, Mycobacterium
SFSDLLRDIFAVEVPVG

SEQ ID NO: 860568 - protein, 25 aa, Mycobacterium
SFSGTGTWLPLLRSGPDGQAESLID

SEQ ID NO: 860569 - protein, 21 aa, Mycobacterium
SFSHALARWSTSSRFLLNVPL

SEQ ID NO: 860570 - protein, 28 aa, Mycobacterium
SFSMVMENRWLPMKQTALALNHLVCTRF

SEQ ID NO: 860571 - protein, 28 aa, Mycobacterium
SFSMVMENRWLPMKRTALALNHLVCTRF

SEQ ID NO: 860572 - protein, 27 aa, Mycobacterium
SFSRGTTYALLWALAHRDRVRSVSIGD

SEQ ID NO: 860573 - protein, 25 aa, Mycobacterium
SFSRPATWWSKAGGPFVALTQRIIA

SEQ ID NO: 860574 - protein, 19 aa, Mycobacterium
SFSTNPTWTASGGSITARW

SEQ ID NO: 860575 - protein, 34 aa, Mycobacterium
SFSTTDVDYYKWTQWIFLQIYNAWFDRDQNKARR

SEQ ID NO: 860576 - protein, 34 aa, Mycobacterium
SFSTTDVEFYKWTQWIFLQIYNAWFDAAANKARP

SEQ ID NO: 860577 - protein, 34 aa, Mycobacterium
SFSTTDVEFYKWTQWIFLQIYNAWFDTAAGKARP

SEQ ID NO: 860578 - protein, 26 aa, Mycobacterium
SFTDDFVLYWGLMALAQVRSGRLTFG

SEQ ID NO: 860579 - protein, 19 aa, Mycobacterium
SFTDRIAVAAILLIDGRVG

SEQ ID NO: 860580 - protein, 18 aa, Mycobacterium
SFTGIGQAWLAQSVKRWA

SEQ ID NO: 860581 - protein, 21 aa, Mycobacterium
SFTHDIAMPTFLPNVAPTGRA

SEQ ID NO: 860582 - protein, 22 aa, Mycobacterium
SFTHLLGYAIVQAVKKFPNMNR

SEQ ID NO: 860583 - protein, 17 aa, Mycobacterium
SFTILGVLTGQAAAWAA

SEQ ID NO: 860584 - protein, 18 aa, Mycobacterium
SFTILGVLTGQAAAWAAE

SEQ ID NO: 860585 - protein, 18 aa, Mycobacterium
SFTLDDLAVRYLHRELRA

SEQ ID NO: 860586 - protein, 24 aa, Mycobacterium
SFTLVYDAVVSRAGQGGALPFATA

SEQ ID NO: 860587 - protein, 17 aa, Mycobacterium
SFTTRIRQMKSLLSEGI

SEQ ID NO: 860588 - protein, 18 aa, Mycobacterium
SFVAALNGAGLGGHVAVV

SEQ ID NO: 860589 - protein, 26 aa, Mycobacterium
SFVDDFVLYWGFLALAQVRGGRHMFG

SEQ ID NO: 860590 - protein, 28 aa, Mycobacterium
SFVNQLQMALFAWIKRNPAGDRPLGGLL

SEQ ID NO: 860591 - protein, 21 aa, Mycobacterium
SFVPGWNRWQLRRLAHDVRGF

SEQ ID NO: 860592 - protein, 32 aa, Mycobacterium
SFVPITEQHLDVPLYWQCWKLDSAVVAQVTAA

SEQ ID NO: 860593 - protein, 21 aa, Mycobacterium
SFVPPYMMARQLSTLDHLTGG

SEQ ID NO: 860594 - protein, 18 aa, Mycobacterium
SFVSWLAARDRDAARAAW

SEQ ID NO: 860595 - protein, 20 aa, Mycobacterium
SFVVTQPERLAAAAGSLQEV

SEQ ID NO: 860596 - protein, 18 aa, Mycobacterium
SFWSGDNLPLAPGYSLSR

SEQ ID NO: 860597 - protein, 18 aa, Mycobacterium
SFWSGDQLPLTAGYQLGD

SEQ ID NO: 860598 - protein, 17 aa, Mycobacterium
SFYDWYADLPVASPQVF

SEQ ID NO: 860599 - protein, 32 aa, Mycobacterium
SFYERFGFDRPLYTLAHYGVFMGPLGDLLRRA

SEQ ID NO: 860600 - protein, 19 aa, Mycobacterium
SFYFRTRSALLRAVAERLA

SEQ ID NO: 860601 - protein, 17 aa, Mycobacterium
SFYPMTIASPAIAALQL

SEQ ID NO: 860602 - protein, 17 aa, Mycobacterium
SFYRIRQSWAGKAVLLK

SEQ ID NO: 860603 - protein, 25 aa, Mycobacterium
SGAAAKIWRGALKLGIEMRVGPVGI

SEQ ID NO: 860604 - protein, 25 aa, Mycobacterium
SGAAAKLWRGAMQLGIEMRVGPVGI

SEQ ID NO: 860605 - protein, 24 aa, Mycobacterium
SGAAALWGLAQKAALTYPKAVHRA

SEQ ID NO: 860606 - protein, 20 aa, Mycobacterium
SGAALHQYVVLRGGIRAEES

SEQ ID NO: 860607 - protein, 18 aa, Mycobacterium
SGAAPLVGLGPDGGPGVA

SEQ ID NO: 860608 - protein, 26 aa, Mycobacterium
SGAATAAFDAFPAHVPVHEPTGAAGQ

SEQ ID NO: 860609 - protein, 23 aa, Mycobacterium
SGAATLLDWMTEDTQRPIGDPIG

SEQ ID NO: 860610 - protein, 26 aa, Mycobacterium
SGAAWLLPRLIGLVRTRQLLMLGREI

SEQ ID NO: 860611 - protein, 25 aa, Mycobacterium
SGADALWFLPLLGQDARDLIELGLG

SEQ ID NO: 860612 - protein, 26 aa, Mycobacterium
SGADGLLLLPPYLVEMPQAGLVGYTR

SEQ ID NO: 860613 - protein, 27 aa, Mycobacterium
SGADLRRYLTRWIGPAIAYPQLVRTMD

SEQ ID NO: 860614 - protein, 26 aa, Mycobacterium
SGADLRRYLTRWLGPAIAYPQLVRAM

SEQ ID NO: 860615 - protein, 35 aa, Mycobacterium
SGADNPWIPFTPLTDKVFLKYWKVDPVRGEIIVSM

SEQ ID NO: 860616 - protein, 24 aa, Mycobacterium
SGADPVIMLTGPTPASLKVLDRAG

SEQ ID NO: 860617 - protein, 18 aa, Mycobacterium
SGAGIFGSIAQLVKVRPG

SEQ ID NO: 860618 - protein, 29 aa, Mycobacterium
SGAGILNFVFGEMWLRPGLGMKERRLITV

SEQ ID NO: 860619 - protein, 25 aa, Mycobacterium
SGAGVFVLDGWLRPVPPGTVGELYV

SEQ ID NO: 860620 - protein, 33 aa, Mycobacterium
SGAGWILARLDTRRPARFFGLIKSRSGHAARDW

SEQ ID NO: 860621 - protein, 24 aa, Mycobacterium
SGAHGGALMAPPARRPETNGRRRG

SEQ ID NO: 860622 - protein, 24 aa, Mycobacterium
SGAHGLHLFATLLSAAERAGAGPL

SEQ ID NO: 860623 - protein, 36 aa, Mycobacterium
SGAIPRIPLNLVLVKGVQILGFAFQDVPPEEFARNE

SEQ ID NO: 860624 - protein, 25 aa, Mycobacterium
SGALALLPEALAFRAGLHLQCGEFS

SEQ ID NO: 860625 - protein, 23 aa, Mycobacterium
SGALDGLPLTWASRTEQPGGKTS

SEQ ID NO: 860626 - protein, 17 aa, Mycobacterium
SGALDLALVFNEGPDHN

SEQ ID NO: 860627 - protein, 19 aa, Mycobacterium
SGALGLRKFFEDAGHELVV

SEQ ID NO: 860628 - protein, 26 aa, Mycobacterium
SGALKHFFDTVYYPSLDHVAARPYGV

SEQ ID NO: 860629 - protein, 28 aa, Mycobacterium
SGALLLRGSPFALGWVAGWVSAEFPPHV

SEQ ID NO: 860630 - protein, 21 aa, Mycobacterium
SGALLTALRHLDVSSIAAVTP

SEQ ID NO: 860631 - protein, 23 aa, Mycobacterium
SGALSFALYYLTRDPQVLARAQA

SEQ ID NO: 860632 - protein, 26 aa, Mycobacterium
SGAMFGLENLSIYGAAKGGIFGLTRG

SEQ ID NO: 860633 - protein, 25 aa, Mycobacterium
SGANVLRAFTYPLADVRVLIVGQDP

SEQ ID NO: 860634 - protein, 27 aa, Mycobacterium
SGAPGTFLRFGRFIRQGWMGSDYLVAR

SEQ ID NO: 860635 - protein, 18 aa, Mycobacterium
SGAPLRRKAAGDGRQRGG

SEQ ID NO: 860636 - protein, 18 aa, Mycobacterium
SGAPQTMLATFYAKALDA

SEQ ID NO: 860637 - protein, 24 aa, Mycobacterium
SGAPQTMLATFYAKALDAGLPEPI

SEQ ID NO: 860638 - protein, 18 aa, Mycobacterium
SGAPVLRIVASGGGTCVQ

SEQ ID NO: 860639 - protein, 23 aa, Mycobacterium
SGAQAWLGPVPAETEGLPHIPVR

SEQ ID NO: 860640 - protein, 17 aa, Mycobacterium
SGAQLEYDYLIYAVGST

SEQ ID NO: 860641 - protein, 24 aa, Mycobacterium
SGAQPYKVVFKDPTDAGYLVTLES

SEQ ID NO: 860642 - protein, 29 aa, Mycobacterium
SGARGFHVYARIAPRWPFSKVRLAAQTVA

SEQ ID NO: 860643 - protein, 24 aa, Mycobacterium
SGARGLPDIVRFIDRVRAVLETPA

SEQ ID NO: 860644 - protein, 21 aa, Mycobacterium
SGARILAERLLGDDVAKAGVS

SEQ ID NO: 860645 - protein, 23 aa, Mycobacterium
SGARITLHAALELARRGSGYAVA

SEQ ID NO: 860646 - protein, 23 aa, Mycobacterium
SGARITLHAALELARRGSGYGVA

SEQ ID NO: 860647 - protein, 23 aa, Mycobacterium
SGARITLHVALELARRGSGYGVA

SEQ ID NO: 860648 - protein, 22 aa, Mycobacterium
SGARLAVVIDAVVATPPMPGRV

SEQ ID NO: 860649 - protein, 20 aa, Mycobacterium
SGARPQWLSAGFVIEEGFPI

SEQ ID NO: 860650 - protein, 25 aa, Mycobacterium
SGARQWDGAWDPTLPMVPSANIPGD

SEQ ID NO: 860651 - protein, 25 aa, Mycobacterium
SGARRVIAIDPVPWKREQALKFGAT

SEQ ID NO: 860652 - protein, 20 aa, Mycobacterium
SGARWILDLGPGDILTRLTA

SEQ ID NO: 860653 - protein, 23 aa, Mycobacterium
SGARWMPNFIELLQHNLTRITDT

SEQ ID NO: 860654 - protein, 26 aa, Mycobacterium
SGASGSPGGWLLGDGGAGGSGAAGSG

SEQ ID NO: 860655 - protein, 26 aa, Mycobacterium
SGASKMTIYKWWPSKGALALDGYFRK

SEQ ID NO: 860656 - protein, 24 aa, Mycobacterium
SGASNLLFRRNSLSGAVEVVKRDG

SEQ ID NO: 860657 - protein, 24 aa, Mycobacterium
SGASQLHLSLPTSGDFLGAQLSGA

SEQ ID NO: 860658 - protein, 26 aa, Mycobacterium
SGASRYRHWLTHKLATWHDQFGMSGC

SEQ ID NO: 860659 - protein, 29 aa, Mycobacterium
SGASYPTVYLTFIGIRTGTRRQPATSIGG

SEQ ID NO: 860660 - protein, 22 aa, Mycobacterium
SGATLDPAFADGTLMGKRYVDD

SEQ ID NO: 860661 - protein, 37 aa, Mycobacterium
SGATQLLVVDQLPDGAWLADLGLHPLRDLPRPERVMQ

SEQ ID NO: 860662 - protein, 20 aa, Mycobacterium
SGATVLRAIWGFRAPGRPHG

SEQ ID NO: 860663 - protein, 23 aa, Mycobacterium
SGAVAALGGVLHAAARNGVVVQV

SEQ ID NO: 860664 - protein, 20 aa, Mycobacterium
SGAVGILHRAGIDPWVIDFG

SEQ ID NO: 860665 - protein, 17 aa, Mycobacterium
SGAVLKVIVESAALLGL

SEQ ID NO: 860666 - protein, 26 aa, Mycobacterium
SGAVRFIGVDGYRWMIRCVINGPHET

SEQ ID NO: 860667 - protein, 17 aa, Mycobacterium
SGAYDCALVVGLELEKT

SEQ ID NO: 860668 - protein, 25 aa, Mycobacterium
SGAYRALVIMFPRDQVRLSSAELTR

SEQ ID NO: 860669 - protein, 20 aa, Mycobacterium
SGCLLLPGIPHLGLDHRAAW

SEQ ID NO: 860670 - protein, 19 aa, Mycobacterium
SGCRLGVIGAGFVGLEIAA

SEQ ID NO: 860671 - protein, 18 aa, Mycobacterium
SGCSFHTRCPWATEICKE

SEQ ID NO: 860672 - protein, 27 aa, Mycobacterium
SGCVPAVRDKLWARLRITPHEITRRFR

SEQ ID NO: 860673 - protein, 26 aa, Mycobacterium
SGDAALICVPPYHIAGVGAALSNLYA

SEQ ID NO: 860674 - protein, 22 aa, Mycobacterium
SGDAVVTPLLLANGYHAGIDIP

SEQ ID NO: 860675 - protein, 27 aa, Mycobacterium
SGDDALNLPWLAMGAIGFISVIGHLAA

SEQ ID NO: 860676 - protein, 28 aa, Mycobacterium
SGDDALNLPWLAMGALGFISVWGHLAAG

SEQ ID NO: 860677 - protein, 27 aa, Mycobacterium
SGDDALNLPWLAMGAVGFISVWGHLAA

SEQ ID NO: 860678 - protein, 24 aa, Mycobacterium
SGDDGLLDLLDFYACYRAYVRGKV

SEQ ID NO: 860679 - protein, 23 aa, Mycobacterium
SGDFLFASLHRSGLANQSTCTDS

SEQ ID NO: 860680 - protein, 39 aa, Mycobacterium
SGDFSMLTYNIAGLPFPLSSAMLPRFLYTKEIGKRLNNF

SEQ ID NO: 860681 - protein, 24 aa, Mycobacterium
SGDGGTGGLGGHGGAGADNTTTVS

SEQ ID NO: 860682 - protein, 17 aa, Mycobacterium
SGDGTQVAWGRGGDGGD

SEQ ID NO: 860683 - protein, 37 aa, Mycobacterium
SGDIAWLTRPLIDSYHTVWFELHEELILAVGLTREEA

SEQ ID NO: 860684 - protein, 25 aa, Mycobacterium
SGDIDSLLFPLTHGTLWYTGVGSFD

SEQ ID NO: 860685 - protein, 26 aa, Mycobacterium
SGDIDYRSFQTIVFRTDLIADADVLA

SEQ ID NO: 860686 - protein, 27 aa, Mycobacterium
SGDIMALPPEWVYHRSPPLDAITQRAP

SEQ ID NO: 860687 - protein, 25 aa, Mycobacterium
SGDIVLIRTGWWTRFLMTANKTEPY

SEQ ID NO: 860688 - protein, 24 aa, Mycobacterium
SGDIVLIRTGWWTRFLQTGNKTEP

SEQ ID NO: 860689 - protein, 19 aa, Mycobacterium
SGDLHLRPALYDDELVRAD

SEQ ID NO: 860690 - protein, 25 aa, Mycobacterium
SGDLPEPTFVPVLGRIAAGGPILAE

SEQ ID NO: 860691 - protein, 29 aa, Mycobacterium
SGDPLLDSLLFDDPGLVAEAPLPQGAAPS

SEQ ID NO: 860692 - protein, 21 aa, Mycobacterium
SGDPPRPAWPRLRSPRCLTSG

SEQ ID NO: 860693 - protein, 27 aa, Mycobacterium
SGDQQVLLTQWRALPDILSEPELTALQ

SEQ ID NO: 860694 - protein, 28 aa, Mycobacterium
SGDQVMDYIRPLWPYVDPLRAGEFHFTR

SEQ ID NO: 860695 - protein, 23 aa, Mycobacterium
SGDRLDFRDLPLPTVDKHSTGGV

SEQ ID NO: 860696 - protein, 24 aa, Mycobacterium
SGDRPTLFTGVEWLGTASAVGIDA

SEQ ID NO: 860697 - protein, 22 aa, Mycobacterium
SGDSFLLCFNAYDEPLDFVTPD

SEQ ID NO: 860698 - protein, 24 aa, Mycobacterium
SGDSPYVTPLVRKLAGEHGVDLAS

SEQ ID NO: 860699 - protein, 18 aa, Mycobacterium
SGDTFLHLLRRVRQDNPG

SEQ ID NO: 860700 - protein, 23 aa, Mycobacterium
SGDTKAFLGARIGVRRGNVVDAA

SEQ ID NO: 860701 - protein, 36 aa, Mycobacterium
SGDTVKRLARLHTPLPLLAFTAWPEVRSQLAMTWGT

SEQ ID NO: 860702 - protein, 36 aa, Mycobacterium; identical to SEQ ID NO: 225605

SEQ ID NO: 860703 - protein, 37 aa, Mycobacterium; identical to SEQ ID NO: 226905

SEQ ID NO: 860704 - protein, 35 aa, Mycobacterium
SGDTVRRLARLHTPLPVLAFTSLPEVRSQLALTWG

SEQ ID NO: 860705 - protein, 24 aa, Mycobacterium
SGDVGLIIAVKRLAAAKTRLAPVF

SEQ ID NO: 860706 - protein, 25 aa, Mycobacterium
SGDVLGWAVFWLVHAPTGAMAAEST

SEQ ID NO: 860707 - protein, 28 aa, Mycobacterium
SGDWSGLFNSFFWIDRTAGIGGVIATQL

SEQ ID NO: 860708 - protein, 28 aa, Mycobacterium
SGDWWDAAYLMMWGSNVPITRTPDAHWM

SEQ ID NO: 860709 - protein, 26 aa, Mycobacterium
SGEAIIGLLAILKTGAAYLPIDPAHP

SEQ ID NO: 860710 - protein, 28 aa, Mycobacterium
SGEARPALMLSWIRDVPSLGAVARGLQR

SEQ ID NO: 860711 - protein, 23 aa, Mycobacterium
SGEERILAFAPLPAAVRPERVSD

SEQ ID NO: 860712 - protein, 28 aa, Mycobacterium
SGEFRRDLPTLWLNQAFFSLVAGAGRSA

SEQ ID NO: 860713 - protein, 27 aa, Mycobacterium
SGEFVNFGPSWAWPKTVQKHVPVIVGA

SEQ ID NO: 860714 - protein, 26 aa, Mycobacterium
SGELEGAYLLVWTTTPWTLPSNQAVA

SEQ ID NO: 860715 - protein, 24 aa, Mycobacterium
SGELQFDVFNWLGIKSQWLNSVVR

SEQ ID NO: 860716 - protein, 31 aa, Mycobacterium
SGELQMEAFERAFFPIYPATTKVQSWDIFRC

SEQ ID NO: 860717 - protein, 24 aa, Mycobacterium
SGELRQRQIGVGWASLRSRPPPAS

SEQ ID NO: 860718 - protein, 25 aa, Mycobacterium
SGELTQRQIGVGWASLRSVPAAAAE

SEQ ID NO: 860719 - protein, 24 aa, Mycobacterium
SGELVEHLFLPAFGSAAEAGLADS

SEQ ID NO: 860720 - protein, 19 aa, Mycobacterium
SGELWVLIGPEARGAWVES

SEQ ID NO: 860721 - protein, 49 aa, Mycobacterium
SGEQRLSGFLLWQSAYSEMWFTDAYWPEFRRVDFLRALRDYAARNRRFG

SEQ ID NO: 860722 - protein, 32 aa, Mycobacterium; identical to SEQ ID NO: 132038

SEQ ID NO: 860723 - protein, 48 aa, Mycobacterium
SGEQRLSGFLLWQSAYSEMWFTEAYWPAFRRVDFLRALRDYTARHRRF

SEQ ID NO: 860724 - protein, 22 aa, Mycobacterium
SGERLYWKWYHPYQPPPTATAN

SEQ ID NO: 860725 - protein, 20 aa, Mycobacterium
SGERPLWQGLAQLAVGITHV

SEQ ID NO: 860726 - protein, 33 aa, Mycobacterium
SGETPLFMAHYAPFGLLTPAAWVALHAQRYMST

SEQ ID NO: 860727 - protein, 28 aa, Mycobacterium
SGETVGFATIFWTWQTLYAARVGVLNDL

SEQ ID NO: 860728 - protein, 23 aa, Mycobacterium
SGETVLGPFRPPGGGPSYIQVAE

SEQ ID NO: 860729 - protein, 18 aa, Mycobacterium
SGFAFGMGLERTLQFRNG

SEQ ID NO: 860730 - protein, 22 aa, Mycobacterium
SGFDAPFFGMSTREVRLMDPQH

SEQ ID NO: 860731 - protein, 21 aa, Mycobacterium
SGFDEFGRLDIVVANAGIAPM

SEQ ID NO: 860732 - protein, 25 aa, Mycobacterium
SGFERFPAWMWRNTVVRDFVEWLRT

SEQ ID NO: 860733 - protein, 23 aa, Mycobacterium
SGFGVVPLREALSRWAWSYLDQL

SEQ ID NO: 860734 - protein, 17 aa, Mycobacterium
SGFLEAGYRRFLERRLR

SEQ ID NO: 860735 - protein, 30 aa, Mycobacterium
SGFMQAIRPELVVPLVIFLASRACTFSHRN

SEQ ID NO: 860736 - protein, 17 aa, Mycobacterium
SGFNYYKGDYQSTVAVN

SEQ ID NO: 860737 - protein, 17 aa, Mycobacterium
SGFRPDRIKALAGAVAV

SEQ ID NO: 860738 - protein, 23 aa, Mycobacterium
SGFSLLGAWAERVALPVGSVVPT

SEQ ID NO: 860739 - protein, 26 aa, Mycobacterium
SGFTALEWNSITRKFVLPGSSDNKIG

SEQ ID NO: 860740 - protein, 28 aa, Mycobacterium
SGFTEILPTPFLPAGVFDLWGLAADDPR

SEQ ID NO: 860741 - protein, 17 aa, Mycobacterium
SGFTVLTRALTPAQLSA

SEQ ID NO: 860742 - protein, 23 aa, Mycobacterium
SGFTVNFPYLIDTQSRHVAWVIA

SEQ ID NO: 860743 - protein, 27 aa, Mycobacterium
SGFVGLRVVPWLWEAPPTDRRYYPLFA

SEQ ID NO: 860744 - protein, 17 aa, Mycobacterium
SGFYNSALVVGLELEKT

SEQ ID NO: 860745 - protein, 24 aa, Mycobacterium
SGGADDFLAWFFKAERGELEPFVL

SEQ ID NO: 860746 - protein, 21 aa, Mycobacterium
SGGAGGLLYGNGGAGGIGGTS

SEQ ID NO: 860747 - protein, 21 aa, Mycobacterium
SGGAGGVIGWAGSTGATGAGG

SEQ ID NO: 860748 - protein, 22 aa, Mycobacterium
SGGALWLPASPVLRAAGTGDSV

SEQ ID NO: 860749 - protein, 22 aa, Mycobacterium
SGGALWLPVSPVLREAGAEDSP

SEQ ID NO: 860750 - protein, 23 aa, Mycobacterium
SGGDAGMFGFGGAGGDGGIGDDT

SEQ ID NO: 860751 - protein, 26 aa, Mycobacterium
SGGDGGDGFGLWNPGEGGRGGSGGDG

SEQ ID NO: 860752 - protein, 25 aa, Mycobacterium
SGGDGGLAPGAMFGNGGHGGTGGAG

SEQ ID NO: 860753 - protein, 23 aa, Mycobacterium
SGGDGGWLWGSGGNGGSGGAGRD

SEQ ID NO: 860754 - protein, 18 aa, Mycobacterium
SGGFTRIAPALAHRERQI

SEQ ID NO: 860755 - protein, 27 aa, Mycobacterium
SGGFVVPFLHPDLKWDFRLPRVVSINV

SEQ ID NO: 860756 - protein, 27 aa, Mycobacterium
SGGFVVPFLHPDLQWDFRLPRVVSINV

SEQ ID NO: 860757 - protein, 27 aa, Mycobacterium
SGGFVVPFLHPELHWDFRLPRVVSINV

SEQ ID NO: 860758 - protein, 27 aa, Mycobacterium
SGGFVVPFLHPELKWDFRLPRVVSINV

SEQ ID NO: 860759 - protein, 23 aa, Mycobacterium
SGGGGTLPFMGQGGPQAAPFALN

SEQ ID NO: 860760 - protein, 30 aa, Mycobacterium
SGGGRIVTAFPFRLIDVWQSHRAPIEEDLT

SEQ ID NO: 860761 - protein, 22 aa, Mycobacterium
SGGHAGLLFGNGGSGGLGGVGG

SEQ ID NO: 860762 - protein, 19 aa, Mycobacterium
SGGHLFSIYDGCRDEGIRL

SEQ ID NO: 860763 - protein, 19 aa, Mycobacterium
SGGHLFSLYDGCRDEGVRL

SEQ ID NO: 860764 - protein, 17 aa, Mycobacterium
SGGHVIGLAPTADAAIV

SEQ ID NO: 860765 - protein, 22 aa, Mycobacterium
SGGIEVLFFPQTYSMFGAEIAD

SEQ ID NO: 860766 - protein, 23 aa, Mycobacterium
SGGKTVFVFPGQGAQILGMGMGL

SEQ ID NO: 860767 - protein, 20 aa, Mycobacterium
SGGLYHHFKSKEALLEAGID

SEQ ID NO: 860768 - protein, 18 aa, Mycobacterium
SGGLYRWQSRYLRAEDQA

SEQ ID NO: 860769 - protein, 23 aa, Mycobacterium
SGGNNLLFRRNSLSGAVEVVARG

SEQ ID NO: 860770 - protein, 21 aa, Mycobacterium
SGGPFLGWSAEDLKSVTPEQA

SEQ ID NO: 860771 - protein, 25 aa, Mycobacterium
SGGPHDIAAGRLTLFVGGADDAVQR

SEQ ID NO: 860772 - protein, 24 aa, Mycobacterium
SGGPLMFGGPMQPPMLGALRGSAL

SEQ ID NO: 860773 - protein, 22 aa, Mycobacterium
SGGPRLPTLTDLLYQLASGSVT

SEQ ID NO: 860774 - protein, 20 aa, Mycobacterium
SGGPTDRPSGTYRGDESVPD

SEQ ID NO: 860775 - protein, 23 aa, Mycobacterium
SGGQGGWLYGNGGVGGAGGAAST

SEQ ID NO: 860776 - protein, 24 aa, Mycobacterium
SGGQRLPTLTDLLYQLASRSVTSV

SEQ ID NO: 860777 - protein, 29 aa, Mycobacterium
SGGQRQCVAIARAIFFGARVLILDEPTAA

SEQ ID NO: 860778 - protein, 25 aa, Mycobacterium
SGGRAALLYGVGGDGGAGGAGGDVV

SEQ ID NO: 860779 - protein, 31 aa, Mycobacterium
SGGRGIHVFLRIATDWDFIEVRRAGIALARE

SEQ ID NO: 860780 - protein, 30 aa, Mycobacterium
SGGRGIHVYLRIAARWDFIEVRRAGIALAR

SEQ ID NO: 860781 - protein, 34 aa, Mycobacterium
SGGRGVHVFFRIATDWDFIQVRRAGIALARELER

SEQ ID NO: 860782 - protein, 23 aa, Mycobacterium
SGGRIMLPRTTYEQIKVGRQVPM

SEQ ID NO: 860783 - protein, 31 aa, Mycobacterium
SGGSFIYVPKGVHVDIPLQAYFRINTENMGQ

SEQ ID NO: 860784 - protein, 20 aa, Mycobacterium
SGGSPGWWRGRRADFRAVDG

SEQ ID NO: 860785 - protein, 19 aa, Mycobacterium
SGGTIFAYWVANPTAYGVV

SEQ ID NO: 860786 - protein, 32 aa, Mycobacterium
SGGTSFIPGLQDRTFPYLFSPAANEAVEQSDL

SEQ ID NO: 860787 - protein, 33 aa, Mycobacterium
SGGTSFIPGLQERTFPYLFSPAANRAVEESDLC

SEQ ID NO: 860788 - protein, 29 aa, Mycobacterium
SGGVDSTALYPPKRFLGAARNIEEGGSLT

SEQ ID NO: 860789 - protein, 28 aa, Mycobacterium
SGGVDSTALYPPKRFLGAARNIEHGGSL

SEQ ID NO: 860790 - protein, 29 aa, Mycobacterium
SGGVDSTALYPPKRFLGAARNIENGGSLT

SEQ ID NO: 860791 - protein, 23 aa, Mycobacterium
SGGVLFADLLTAYRARHSRQQPS

SEQ ID NO: 860792 - protein, 25 aa, Mycobacterium
SGGVMPRFPLPLGKSGPHPERVEVR

SEQ ID NO: 860793 - protein, 19 aa, Mycobacterium
SGGWLVGNGGAGGIGGIGA

SEQ ID NO: 860794 - protein, 23 aa, Mycobacterium
SGGWSVGAVALVAGWAARTLPSD

SEQ ID NO: 860795 - protein, 26 aa, Mycobacterium
SGGWSVGAVALVAGWVARTSEPGTRV

SEQ ID NO: 860796 - protein, 23 aa, Mycobacterium
SGGYHRFAWTGPDADMRAWFSDQ

SEQ ID NO: 860797 - protein, 22 aa, Mycobacterium
SGHDQFLFDVTHNRWDDGGKGI

SEQ ID NO: 860798 - protein, 18 aa, Mycobacterium
SGHFLLGAFARLHQRWQR

SEQ ID NO: 860799 - protein, 20 aa, Mycobacterium
SGHFNFPALASTSAPAPAPA

SEQ ID NO: 860800 - protein, 24 aa, Mycobacterium
SGHLSSRFWRLLGATTEKNQNRSL

SEQ ID NO: 860801 - protein, 18 aa, Mycobacterium
SGHNAVVPALPLHDTIKA

SEQ ID NO: 860802 - protein, 25 aa, Mycobacterium
SGHPPPPPRPAAFAPPARGATPNRH

SEQ ID NO: 860803 - protein, 21 aa, Mycobacterium
SGHQPAPWRVRAPLVLTDFSC

SEQ ID NO: 860804 - protein, 24 aa, Mycobacterium
SGHRRPDCRWPGPRPPRCQRWAVR

SEQ ID NO: 860805 - protein, 18 aa, Mycobacterium
SGHTYPDQSLYPANSVPA

SEQ ID NO: 860806 - protein, 25 aa, Mycobacterium
SGHYSFLNVFKLFGAGNQAPLSFPI

SEQ ID NO: 860807 - protein, 26 aa, Mycobacterium
SGHYSFLNVFKLFGPGNRAPLSFPIP

SEQ ID NO: 860808 - protein, 28 aa, Mycobacterium
SGIDANLVAFWAILATRVEAPELANFGA

SEQ ID NO: 860809 - protein, 29 aa, Mycobacterium
SGIDANLVAYWAILATRVEAPALADKGVR

SEQ ID NO: 860810 - protein, 27 aa, Mycobacterium
SGIDANLVAYWAILATRVEAPGLAEMG

SEQ ID NO: 860811 - protein, 34 aa, Mycobacterium
SGIDNPWIPFTPLTDQVFLKYWKVDPVRAEIIVS

SEQ ID NO: 860812 - protein, 24 aa, Mycobacterium
SGIDVALALLTPLVGQEFLDKYHL

SEQ ID NO: 860813 - protein, 33 aa, Mycobacterium
SGIEWELYYEPTAPMWELLPMKVVGNDGRMLAD

SEQ ID NO: 860814 - protein, 27 aa, Mycobacterium
SGIGGGGVLLYYDARTRSVQAYDGREV

SEQ ID NO: 860815 - protein, 22 aa, Mycobacterium
SGIGLCEVTAPSVFEIGDDGQA

SEQ ID NO: 860816 - protein, 24 aa, Mycobacterium
SGIGSLLMGIPVDGGLHFAGRVGT

SEQ ID NO: 860817 - protein, 24 aa, Mycobacterium
SGIGSLLMGIPVEGGLRYAGRVGT

SEQ ID NO: 860818 - protein, 21 aa, Mycobacterium
SGILALIKLLLAGQHGQIPPT

SEQ ID NO: 860819 - protein, 20 aa, Mycobacterium
SGIRALLDATPTPDGFEVVL

SEQ ID NO: 860820 - protein, 21 aa, Mycobacterium
SGIVAHYILHYAREDLKRQWL

SEQ ID NO: 860821 - protein, 24 aa, Mycobacterium
SGIVAVVGRRRVFIGSPSISQYAP

SEQ ID NO: 860822 - protein, 25 aa, Mycobacterium
SGIVGHRFIYTYANGWQYEMYVKNA

SEQ ID NO: 860823 - protein, 25 aa, Mycobacterium
SGIVHFNGPFLYRSSFYAETEEQES

SEQ ID NO: 860824 - protein, 19 aa, Mycobacterium
SGIVPPRDLVWAFVSDEEN

SEQ ID NO: 860825 - protein, 27 aa, Mycobacterium
SGIVQNSIDIGTYAVDRTREMFSGRDE

SEQ ID NO: 860826 - protein, 21 aa, Mycobacterium
SGIVSVLRDNGFDGWFVMEQD

SEQ ID NO: 860827 - protein, 22 aa, Mycobacterium
SGIWAMEDMLFFPDGSELHGAG

SEQ ID NO: 860828 - protein, 22 aa, Mycobacterium
SGKARRVRPVGEPAVAAGATST

SEQ ID NO: 860829 - protein, 25 aa, Mycobacterium
SGKGSPEWWVVNVKPGRVLFELSYP

SEQ ID NO: 860830 - protein, 24 aa, Mycobacterium
SGKIRYGGFSNFPAWRIAGAAARA

SEQ ID NO: 860831 - protein, 25 aa, Mycobacterium
SGKKEFVFLGLLSLPHNDDGLWFFL

SEQ ID NO: 860832 - protein, 23 aa, Mycobacterium
SGKPDLALIFNEGPDYAAAGVFT

SEQ ID NO: 860833 - protein, 27 aa, Mycobacterium
SGKPLAMPRLDMVTGLYYLTTLVEGAT

SEQ ID NO: 860834 - protein, 20 aa, Mycobacterium
SGKPLRALISICAAGGQGVA

SEQ ID NO: 860835 - protein, 22 aa, Mycobacterium
SGKPQIIPFQLVDAASGHVLAQ

SEQ ID NO: 860836 - protein, 29 aa, Mycobacterium
SGKQRIAPLVPLLDGDRIYIFGSKGGADS

SEQ ID NO: 860837 - protein, 27 aa, Mycobacterium
SGKQRSRLALWSRRLLGEAITQAQFLL

SEQ ID NO: 860838 - protein, 28 aa, Mycobacterium
SGKQRSRLALWSRRLLGEAITQAQLLLA

SEQ ID NO: 860839 - protein, 22 aa, Mycobacterium
SGKRPLPRRTPYTASKMAVIGL

SEQ ID NO: 860840 - protein, 20 aa, Mycobacterium
SGKSIILLSEGRLLNLGNAT

SEQ ID NO: 860841 - protein, 19 aa, Mycobacterium
SGKSTFMRLLLAAETPTSG

SEQ ID NO: 860842 - protein, 23 aa, Mycobacterium
SGKSTFMRLLLAAETPTSGDVRV

SEQ ID NO: 860843 - protein, 24 aa, Mycobacterium
SGKSTFMRLLLAEELPTKGDVQVS

SEQ ID NO: 860844 - protein, 18 aa, Mycobacterium
SGKSTFMRLLLGADTPTS

SEQ ID NO: 860845 - protein, 23 aa, Mycobacterium
SGKSVLLNIFPSVDTPVCATSVR

SEQ ID NO: 860846 - protein, 23 aa, Mycobacterium
SGKTESFLLPILDSLVREREQGG

SEQ ID NO: 860847 - protein, 22 aa, Mycobacterium
SGKTFFARWLGDRAMKKGFAVA

SEQ ID NO: 860848 - protein, 26 aa, Mycobacterium
SGKTSLLNVLLGQLPLSAGVGLVEGR

SEQ ID NO: 860849 - protein, 24 aa, Mycobacterium
SGKTTLLMTLAGLLPPLQGRVTLD

SEQ ID NO: 860850 - protein, 25 aa, Mycobacterium
SGKTTLLRVLAGAVPLAAGHRKEGK

SEQ ID NO: 860851 - protein, 17 aa, Mycobacterium
SGKTTTTYLVEAGLRAA

SEQ ID NO: 860852 - protein, 17 aa, Mycobacterium
SGKTTTTYLVEAGLRSA

SEQ ID NO: 860853 - protein, 21 aa, Mycobacterium
SGKVIYPGRKQVLRSLEHGVF

SEQ ID NO: 860854 - protein, 21 aa, Mycobacterium
SGKVVLIAPAALDPAGTVLIT

SEQ ID NO: 860855 - protein, 21 aa, Mycobacterium
SGKWPHIWRIVGEYANFSIFD

SEQ ID NO: 860856 - protein, 21 aa, Mycobacterium
SGLAHATIPADNIWASGAAVS

SEQ ID NO: 860857 - protein, 18 aa, Mycobacterium
SGLANNLISAAGAYLNSD

SEQ ID NO: 860858 - protein, 24 aa, Mycobacterium
SGLAPYILEYIDNLTMAALVHTQN

SEQ ID NO: 860859 - protein, 20 aa, Mycobacterium
SGLAPYILEYIDNVTMAALV

SEQ ID NO: 860860 - protein, 24 aa, Mycobacterium
SGLAWITILRKREGFRRAFDGFRP

SEQ ID NO: 860861 - protein, 25 aa, Mycobacterium
SGLDARAYRLPWPAGSVVFEIDQPD

SEQ ID NO: 860862 - protein, 25 aa, Mycobacterium
SGLDARGYRLSWPPGMTVYEIDQPD

SEQ ID NO: 860863 - protein, 21 aa, Mycobacterium
SGLDLPLWVITQGGAQVNPDE

SEQ ID NO: 860864 - protein, 29 aa, Mycobacterium
SGLDRLKRAIRRRWLQGILHTRAQELVAT

SEQ ID NO: 860865 - protein, 25 aa, Mycobacterium
SGLDSRAYRLPWPAGTTVYEIDQPE

SEQ ID NO: 860866 - protein, 25 aa, Mycobacterium
SGLDTRAHRLPWPTGTVVYEIDQPQ

SEQ ID NO: 860867 - protein, 25 aa, Mycobacterium
SGLDTRAYRLRWPAGTVVYEIDQPD

SEQ ID NO: 860868 - protein, 25 aa, Mycobacterium
SGLDTRAYRLRWPAGTVVYEIDQPQ

SEQ ID NO: 860869 - protein, 24 aa, Mycobacterium
SGLDTRGYRLSWADGTTVFEIDVP

SEQ ID NO: 860870 - protein, 26 aa, Mycobacterium
SGLDWTNVHVFWGDDRYVPKTDPERN

SEQ ID NO: 860871 - protein, 26 aa, Mycobacterium
SGLELPAFQQMFWRGGPTPTADFNVT

SEQ ID NO: 860872 - protein, 27 aa, Mycobacterium
SGLEQRLRALNYPKIVLGVSGGLDSTH

SEQ ID NO: 860873 - protein, 24 aa, Mycobacterium
SGLGAYGRWLRRPGRFPAHAQKLK

SEQ ID NO: 860874 - protein, 20 aa, Mycobacterium
SGLGLALAGLVSGLGNIGSQ

SEQ ID NO: 860875 - protein, 22 aa, Mycobacterium
SGLGLLLNPVATVPVIASLLGG

SEQ ID NO: 860876 - protein, 27 aa, Mycobacterium
SGLGMIVAFEEMFWGDAGIALAILGTG

SEQ ID NO: 860877 - protein, 27 aa, Mycobacterium
SGLGPDWFEVSLIPTTLDLTTLGAAAV

SEQ ID NO: 860878 - protein, 26 aa, Mycobacterium
SGLGPDWFEVSLIPTTLDMTTLGRAA

SEQ ID NO: 860879 - protein, 20 aa, Mycobacterium
SGLGSLPWEGLKLAPGEPAI

SEQ ID NO: 860880 - protein, 25 aa, Mycobacterium
SGLGWHPLVPFADGAARTIEYFRGV

SEQ ID NO: 860881 - protein, 28 aa, Mycobacterium
SGLHEPEAWWWQKWVDPLGQHTEFSGVD

SEQ ID NO: 860882 - protein, 21 aa, Mycobacterium
SGLHGVLMFFATCSVARRTGH

SEQ ID NO: 860883 - protein, 20 aa, Mycobacterium
SGLHLRCRYPDTAEARTNVG

SEQ ID NO: 860884 - protein, 26 aa, Mycobacterium
SGLIAAHLQWHLERQLRTLPLVERGY

SEQ ID NO: 860885 - protein, 22 aa, Mycobacterium
SGLIAPMRPDRYLKIAAAMRRE

SEQ ID NO: 860886 - protein, 32 aa, Mycobacterium
SGLIATQLIGFALLRYVWKIEPIASMPADQVV

SEQ ID NO: 860887 - protein, 31 aa, Mycobacterium
SGLIIATHAALMWSLMRRDEQFRSALASRDL

SEQ ID NO: 860888 - protein, 28 aa, Mycobacterium
SGLKVLDLTTFWAGAYLTCYLGAFGADV

SEQ ID NO: 860889 - protein, 18 aa, Mycobacterium
SGLLGRPGPHRRYAAQTS

SEQ ID NO: 860890 - protein, 18 aa, Mycobacterium
SGLLPIPEIQYLAYLHNA

SEQ ID NO: 860891 - protein, 27 aa, Mycobacterium
SGLLTDLSTLRAYLVRRIRSHGLVAAS

SEQ ID NO: 860892 - protein, 23 aa, Mycobacterium
SGLPALPPAPQFADAASMPVNAA

SEQ ID NO: 860893 - protein, 17 aa, Mycobacterium
SGLPSRFPELKICLSEG

SEQ ID NO: 860894 - protein, 20 aa, Mycobacterium
SGLPVGLQLISAPGNEGMLF

SEQ ID NO: 860895 - protein, 20 aa, Mycobacterium
SGLPWIERLIGDPQNYVALP

SEQ ID NO: 860896 - protein, 26 aa, Mycobacterium
SGLQDGLALLPFAWSTVDGSYYFDSF

SEQ ID NO: 860897 - protein, 28 aa, Mycobacterium
SGLQPDLAWTYHYPLPAVGQIAGLVAFY

SEQ ID NO: 860898 - protein, 20 aa, Mycobacterium
SGLQTLLPGLFPSSVDTTTT

SEQ ID NO: 860899 - protein, 18 aa, Mycobacterium
SGLQVGILGLGRIGSAIA

SEQ ID NO: 860900 - protein, 25 aa, Mycobacterium
SGLRHLNGFPGGPPPRLALSLGDTL

SEQ ID NO: 860901 - protein, 26 aa, Mycobacterium
SGLRHLNGFPGGPPPRLALSLGDTLA

SEQ ID NO: 860902 - protein, 17 aa, Mycobacterium
SGLRRKLEAHGPRILHT

SEQ ID NO: 860903 - protein, 20 aa, Mycobacterium
SGLRSLPWEGLKLAPGEPAI

SEQ ID NO: 860904 - protein, 19 aa, Mycobacterium
SGLRSLPWEGLNLSQGEPA

SEQ ID NO: 860905 - protein, 18 aa, Mycobacterium
SGLSFKLYTSEQAAGALN

SEQ ID NO: 860906 - protein, 19 aa, Mycobacterium
SGLSVLRYAIRTEIRLITS

SEQ ID NO: 860907 - protein, 17 aa, Mycobacterium
SGLSWLTILRKRENFRC

SEQ ID NO: 860908 - protein, 23 aa, Mycobacterium
SGLTRLAGRLLGWLLVCDPERQS

SEQ ID NO: 860909 - protein, 21 aa, Mycobacterium
SGLTSGPWLGPASTSMTAASA

SEQ ID NO: 860910 - protein, 21 aa, Mycobacterium
SGLVGQAWQGPASAAMAAAVA

SEQ ID NO: 860911 - protein, 22 aa, Mycobacterium
SGLVGSSWQGAAAAAMSAAAAP

SEQ ID NO: 860912 - protein, 20 aa, Mycobacterium
SGLVTAPLSFASQALGAFSS

SEQ ID NO: 860913 - protein, 17 aa, Mycobacterium
SGLWNAPAAIASGVVRL

SEQ ID NO: 860914 - protein, 26 aa, Mycobacterium
SGLYTSGPALLPWEAARPSGMQGALA

SEQ ID NO: 860915 - protein, 19 aa, Mycobacterium
SGMAALDWVQWRVTKRAED

SEQ ID NO: 860916 - protein, 24 aa, Mycobacterium
SGMAYVFSVLGPLASAYGKISQRQ

SEQ ID NO: 860917 - protein, 24 aa, Mycobacterium
SGMGGSPMFMPPMGGMGAGAGAAK

SEQ ID NO: 860918 - protein, 28 aa, Mycobacterium
SGMLLGVPTVIYPLGAFNPGQLLDVLEA

SEQ ID NO: 860919 - protein, 27 aa, Mycobacterium
SGMMLGRPTVIYPLGAFDPNELLDVLE

SEQ ID NO: 860920 - protein, 17 aa, Mycobacterium
SGMPRLFREAPLMGIWE

SEQ ID NO: 860921 - protein, 33 aa, Mycobacterium
SGMPVAPPPLGPPPTPPPAAPVAAPPPAAAPPP

SEQ ID NO: 860922 - protein, 19 aa, Mycobacterium
SGMPYGPKVLARYDDFSFN

SEQ ID NO: 860923 - protein, 22 aa, Mycobacterium
SGMSFVIAVPEVVGSAASEVAG

SEQ ID NO: 860924 - protein, 25 aa, Mycobacterium
SGNDQLVRLRWPCPVPGAMAVSEVG

SEQ ID NO: 860925 - protein, 26 aa, Mycobacterium
SGNETPPYFVLIERALRDEGTSAHYV

SEQ ID NO: 860926 - protein, 24 aa, Mycobacterium
SGNLLPVPFVEPADVTAAVMYLVS

SEQ ID NO: 860927 - protein, 24 aa, Mycobacterium
SGNLRKVIRLMKYLRDHKNSFTGT

SEQ ID NO: 860928 - protein, 24 aa, Mycobacterium
SGNPFVMYPSYREIAALPLAERVA

SEQ ID NO: 860929 - protein, 23 aa, Mycobacterium
SGNPYLAFAAMLMAGLDGIKNKI

SEQ ID NO: 860930 - protein, 17 aa, Mycobacterium
SGNPYLEGLLAPVRNEV

SEQ ID NO: 860931 - protein, 25 aa, Mycobacterium
SGNQRLPTLTDLLYQLASRSVTSTT

SEQ ID NO: 860932 - protein, 23 aa, Mycobacterium
SGNQVVVLCNLYTRSRVTGRSIN

SEQ ID NO: 860933 - protein, 28 aa, Mycobacterium
SGNRKINAALYWIALCQIKHGAPGEAYY

SEQ ID NO: 860934 - protein, 25 aa, Mycobacterium
SGNSGLLNFGALQSGIRNLGSTISG

SEQ ID NO: 860935 - protein, 22 aa, Mycobacterium
SGNYTVRRPLEIGAAMAGCGAH

SEQ ID NO: 860936 - protein, 19 aa, Mycobacterium
SGPAPNLTVRGVCKHAGVV

SEQ ID NO: 860937 - protein, 26 aa, Mycobacterium
SGPDLLISPTIAMTAPPYGSTHVDLG

SEQ ID NO: 860938 - protein, 20 aa, Mycobacterium
SGPDRLFEVVWTPMTVAATD

SEQ ID NO: 860939 - protein, 19 aa, Mycobacterium
SGPDSLWGIAWRTADIEAS

SEQ ID NO: 860940 - protein, 24 aa, Mycobacterium
SGPERFLSTFVLLAACADRMAANA

SEQ ID NO: 860941 - protein, 21 aa, Mycobacterium
SGPERFLSTFVLLAATAESMA

SEQ ID NO: 860942 - protein, 25 aa, Mycobacterium
SGPERFLSTFVLLESCADRMASNAI

SEQ ID NO: 860943 - protein, 21 aa, Mycobacterium
SGPERLLSTFVLLAQTTDSMA

SEQ ID NO: 860944 - protein, 31 aa, Mycobacterium
SGPFDNWPLGWGFDHFWGFPSGAAGQYDPII

SEQ ID NO: 860945 - protein, 25 aa, Mycobacterium
SGPGKLDQWTLLARARALDSASYVA

SEQ ID NO: 860946 - protein, 25 aa, Mycobacterium
SGPGKLDQWTLLARARALDSTSYVA

SEQ ID NO: 860947 - protein, 25 aa, Mycobacterium
SGPGKLDQWTLLARARALDTTGYIA

SEQ ID NO: 860948 - protein, 24 aa, Mycobacterium
SGPHLQYAGAFLRSARTPRAVAQV

SEQ ID NO: 860949 - protein, 24 aa, Mycobacterium
SGPHLQYAGAFLRSGRTPRSVAQV

SEQ ID NO: 860950 - protein, 24 aa, Mycobacterium
SGPISYIFRPDGTLSARWGPYQRV

SEQ ID NO: 860951 - protein, 19 aa, Mycobacterium
SGPLFIGRDTHALSEPAWT

SEQ ID NO: 860952 - protein, 18 aa, Mycobacterium
SGPLPMPPAKHVAVVACM

SEQ ID NO: 860953 - protein, 27 aa, Mycobacterium
SGPLRLAARLIGPKPPVVVGVDFAGVV

SEQ ID NO: 860954 - protein, 17 aa, Mycobacterium
SGPLTGLAEIRLPDLQP

SEQ ID NO: 860955 - protein, 22 aa, Mycobacterium
SGPNMTRWARRQGWQAPADADA

SEQ ID NO: 860956 - protein, 17 aa, Mycobacterium
SGPPPDDPRYDPALLRD

SEQ ID NO: 860957 - protein, 18 aa, Mycobacterium
SGPPQTMLATLYAKALDA

SEQ ID NO: 860958 - protein, 22 aa, Mycobacterium
SGPPQVPWLEPDIVDHLAALKD

SEQ ID NO: 860959 - protein, 25 aa, Mycobacterium
SGPQVHVYRRVHLGFAVATERGLLV

SEQ ID NO: 860960 - protein, 24 aa, Mycobacterium
SGPRMMELVRRYADWWNLPAHQLD

SEQ ID NO: 860961 - protein, 36 aa, Mycobacterium
SGPRPRWVPMLDGLDVLLQWFLADVRPKFPNSPVLF

SEQ ID NO: 860962 - protein, 25 aa, Mycobacterium
SGPRYRPMQLAWAREIRDACVQADV

SEQ ID NO: 860963 - protein, 22 aa, Mycobacterium
SGPSFLGWEHPPAAAATAPAKP

SEQ ID NO: 860964 - protein, 23 aa, Mycobacterium
SGPTDVFKRHFYTCFISDKVGVH

SEQ ID NO: 860965 - protein, 26 aa, Mycobacterium
SGPTFIECVTFRFRGHYFGDRMAYIP

SEQ ID NO: 860966 - protein, 21 aa, Mycobacterium
SGPTMLLPHSQRFTGGYIAFN

SEQ ID NO: 860967 - protein, 33 aa, Mycobacterium
SGPVGGARIALIDGTWVAFPTVEQLERAVFDMV

SEQ ID NO: 860968 - protein, 17 aa, Mycobacterium
SGPVVWVKDASRSVPVA

SEQ ID NO: 860969 - protein, 20 aa, Mycobacterium
SGPVVWVKDASRSVPVAAAL

SEQ ID NO: 860970 - protein, 26 aa, Mycobacterium
SGPYQMLTRFYAAVPEWIAGFAVSTA

SEQ ID NO: 860971 - protein, 25 aa, Mycobacterium
SGQAGALRLAIARALIIVEPEDRPV

SEQ ID NO: 860972 - protein, 25 aa, Mycobacterium
SGQAGALRLGIARALILANPEDRPP

SEQ ID NO: 860973 - protein, 25 aa, Mycobacterium
SGQAGALRLGIARALILAQPEDRPA

SEQ ID NO: 860974 - protein, 24 aa, Mycobacterium
SGQAGALRLGIARALIVANPEDRP

SEQ ID NO: 860975 - protein, 25 aa, Mycobacterium
SGQAGALRLGIARALIVASPDDRPA

SEQ ID NO: 860976 - protein, 19 aa, Mycobacterium
SGQAYRRTFDDWLARSHTS

SEQ ID NO: 860977 - protein, 24 aa, Mycobacterium
SGQDLLLITVLKGAVMFVTDLARA

SEQ ID NO: 860978 - protein, 23 aa, Mycobacterium
SGQERPFPLDLVPRVISAAEWSR

SEQ ID NO: 860979 - protein, 24 aa, Mycobacterium
SGQERPFPLDLVPRVISAAEWSRL

SEQ ID NO: 860980 - protein, 23 aa, Mycobacterium
SGQERPFPLDLVPRVISAAEWTR

SEQ ID NO: 860981 - protein, 27 aa, Mycobacterium
SGQERRTDWLNRFYFGGDHGVADSVAR

SEQ ID NO: 860982 - protein, 20 aa, Mycobacterium
SGQEWWRIRDMAIREHWTRQ

SEQ ID NO: 860983 - protein, 17 aa, Mycobacterium
SGQGLLVDFVRERGLNA

SEQ ID NO: 860984 - protein, 23 aa, Mycobacterium
SGQGWIYSITPNQPGIDPRVVSI

SEQ ID NO: 860985 - protein, 24 aa, Mycobacterium
SGQLAIKAALVLGSPYTAMLFMGE

SEQ ID NO: 860986 - protein, 23 aa, Mycobacterium
SGQLYLFSGRLNGKVFISVSSYQ

SEQ ID NO: 860987 - protein, 21 aa, Mycobacterium
SGQMLLGPIRDTRHLRIAAVL

SEQ ID NO: 860988 - protein, 24 aa, Mycobacterium
SGQRILAFAHLEPGVRDAAATPTV

SEQ ID NO: 860989 - protein, 24 aa, Mycobacterium
SGQRLLAFAHLEPGQRRPSAELTT

SEQ ID NO: 860990 - protein, 29 aa, Mycobacterium
SGQTTKLLNNLLFTANLATAATALSLADA

SEQ ID NO: 860991 - protein, 25 aa, Mycobacterium
SGQVLTHQLPIAPKPLPELMVREVD

SEQ ID NO: 860992 - protein, 22 aa, Mycobacterium
SGQVPVVVVLWSPRSDASAQLT

SEQ ID NO: 860993 - protein, 33 aa, Mycobacterium
SGQVQALSQFVAWPGLLVFQNKAKLLYDGAELN

SEQ ID NO: 860994 - protein, 17 aa, Mycobacterium
SGQVVRDALLWNDTRSA

SEQ ID NO: 860995 - protein, 21 aa, Mycobacterium
SGQWVALCPLEVEALTWQSTA

SEQ ID NO: 860996 - protein, 37 aa, Mycobacterium
SGRALDFPALAAISDIFYPRVFLRRGAMSPAGTISLT

SEQ ID NO: 860997 - protein, 19 aa, Mycobacterium
SGRALEVLRALSGMPDTVH

SEQ ID NO: 860998 - protein, 25 aa, Mycobacterium
SGRARILNMTLSQRWGRLFVSVGYA

SEQ ID NO: 860999 - protein, 23 aa, Mycobacterium
SGRDLEVAARRWGVRQDALVVTY

SEQ ID NO: 861000 - protein, 26 aa, Mycobacterium
SGRDRRIWVWWKVLAGGPRVWEPGAA

SEQ ID NO: 861001 - protein, 23 aa, Mycobacterium
SGRFAFRPGPIFTNLLLADEINR

SEQ ID NO: 861002 - protein, 19 aa, Mycobacterium
SGRFEFRPGPIFTNLLLAD

SEQ ID NO: 861003 - protein, 18 aa, Mycobacterium
SGRFEFRPGPIFTNLLMA

SEQ ID NO: 861004 - protein, 29 aa, Mycobacterium
SGRFGKQWFTVHRTIFRLALPGGTPRPKP

SEQ ID NO: 861005 - protein, 30 aa, Mycobacterium
SGRGGALITLLLHEIASFTALPLHVDIPWS

SEQ ID NO: 861006 - protein, 28 aa, Mycobacterium
SGRGPTVPMLPNGWAPETGGSAAGGPVT

SEQ ID NO: 861007 - protein, 23 aa, Mycobacterium
SGRGRIMFIGLDGDWTVHFECMM

SEQ ID NO: 861008 - protein, 25 aa, Mycobacterium
SGRGTFRVRDFLRHANYSLAVADYE

SEQ ID NO: 861009 - protein, 22 aa, Mycobacterium
SGRGWVYIVANNFDRSSPAVLY

SEQ ID NO: 861010 - protein, 25 aa, Mycobacterium
SGRHAEILALLLRHPEGLSADHLAM

SEQ ID NO: 861011 - protein, 28 aa, Mycobacterium
SGRILEGTPPGLPPFVLCTNVSTLPPIR

SEQ ID NO: 861012 - protein, 21 aa, Mycobacterium
SGRINHAYLFSGPRGCGKTSS

SEQ ID NO: 861013 - protein, 19 aa, Mycobacterium
SGRLAGHPVLVAKPRCYMN

SEQ ID NO: 861014 - protein, 24 aa, Mycobacterium
SGRLPESIFAGPVPPILITSAQGA

SEQ ID NO: 861015 - protein, 29 aa, Mycobacterium
SGRLQRFPGAFSPLVAKLVAELGFDGVYV

SEQ ID NO: 861016 - protein, 24 aa, Mycobacterium
SGRLRVAGTFYSLGAQLLYEVTAT

SEQ ID NO: 861017 - protein, 21 aa, Mycobacterium
SGRLSLLWRGKGATLEAVAFA

SEQ ID NO: 861018 - protein, 23 aa, Mycobacterium
SGRLTPALLARLAARRDGRIRGI

SEQ ID NO: 861019 - protein, 24 aa, Mycobacterium
SGRPGRFLLTDTVGFVRHLPTQLV

SEQ ID NO: 861020 - protein, 21 aa, Mycobacterium
SGRPGTPLSLTKPLGIGVLNS

SEQ ID NO: 861021 - protein, 23 aa, Mycobacterium
SGRPLAAPPVRKLAKELMVDLAS

SEQ ID NO: 861022 - protein, 28 aa, Mycobacterium
SGRPLAMPRLDMVTGLYFLTTEIEGDKG

SEQ ID NO: 861023 - protein, 31 aa, Mycobacterium
SGRPLAMPRLDMVTGLYFLTTEIPGDIGAHA

SEQ ID NO: 861024 - protein, 26 aa, Mycobacterium
SGRPLAMPRLDMVTGLYYLTTEVDGD

SEQ ID NO: 861025 - protein, 26 aa, Mycobacterium
SGRPLAMPRLDMVTGLYYLTTEVEGD

SEQ ID NO: 861026 - protein, 22 aa, Mycobacterium
SGRPLLATFFTASVYKDDIFAQ

SEQ ID NO: 861027 - protein, 22 aa, Mycobacterium
SGRPLYLGRSRRIATPDQRIVL

SEQ ID NO: 861028 - protein, 25 aa, Mycobacterium
SGRPQVLLMLERLLDRWAGFDGVEF

SEQ ID NO: 861029 - protein, 20 aa, Mycobacterium
SGRPWPLDRYVTEALEAVRS

SEQ ID NO: 861030 - protein, 23 aa, Mycobacterium
SGRQAVLAAIRKALDIKGIHDPA

SEQ ID NO: 861031 - protein, 21 aa, Mycobacterium
SGRQFFARLHHACIFHDRANV

SEQ ID NO: 861032 - protein, 24 aa, Mycobacterium
SGRQYMAWISLEDEVRALLFAISN

SEQ ID NO: 861033 - protein, 25 aa, Mycobacterium
SGRRLPAWKPFIIRLSNSVTRDSAH

SEQ ID NO: 861034 - protein, 23 aa, Mycobacterium
SGRRMMELVRKYADWWNLQANHL

SEQ ID NO: 861035 - protein, 22 aa, Mycobacterium
SGRRYRLRFRNATDDIHPMHLH

SEQ ID NO: 861036 - protein, 26 aa, Mycobacterium
SGRSIGVPGILRMLYDVHAEHGAAPW

SEQ ID NO: 861037 - protein, 24 aa, Mycobacterium
SGRSLPSVRRLVSGGGPLPESLSR

SEQ ID NO: 861038 - protein, 31 aa, Mycobacterium
SGRSSVGAFLFSDAWFLIRVVEPMSADELPE

SEQ ID NO: 861039 - protein, 17 aa, Mycobacterium
SGRTITFPGFLSAYVET

SEQ ID NO: 861040 - protein, 24 aa, Mycobacterium
SGRTRYRLLETVRQYALEKLSESE

SEQ ID NO: 861041 - protein, 26 aa, Mycobacterium
SGRVAGVLGLLWSAPRRFDAAELDTF

SEQ ID NO: 861042 - protein, 22 aa, Mycobacterium
SGRVAMWSLIEHLGRRSGTVYR

SEQ ID NO: 861043 - protein, 19 aa, Mycobacterium
SGRVSYALGLRGPAMTVDT

SEQ ID NO: 861044 - protein, 28 aa, Mycobacterium
SGRWAQAYGFPLMPIDGILVGTAAMAAK

SEQ ID NO: 861045 - protein, 28 aa, Mycobacterium
SGRWAQAYGFPLMPIDGILVGTAAMAAL

SEQ ID NO: 861046 - protein, 20 aa, Mycobacterium
SGRWVPDFLSLPIAVENSMK

SEQ ID NO: 861047 - protein, 20 aa, Mycobacterium
SGRYRLGPATLRLGNVYLDT

SEQ ID NO: 861048 - protein, 23 aa, Mycobacterium
SGSAPQRLWAKPAITVIGIDTTP

SEQ ID NO: 861049 - protein, 29 aa, Mycobacterium
SGSDGRLAMITYLGGPFPQVHDPVTAVAA

SEQ ID NO: 861050 - protein, 23 aa, Mycobacterium
SGSEPLIMLTGPTPATKKVLDRA

SEQ ID NO: 861051 - protein, 20 aa, Mycobacterium
SGSGRLLVAVRFGTTRLLDN

SEQ ID NO: 861052 - protein, 24 aa, Mycobacterium
SGSKGLHLYVPLAEPISSRGASVL

SEQ ID NO: 861053 - protein, 25 aa, Mycobacterium
SGSLDILLAAYSLAATLWQVANPPA

SEQ ID NO: 861054 - protein, 25 aa, Mycobacterium
SGSLDILLAAYSLAATLWQVANPPE

SEQ ID NO: 861055 - protein, 18 aa, Mycobacterium
SGSLERYLEPFSHTVAVM

SEQ ID NO: 861056 - protein, 17 aa, Mycobacterium
SGSLLEMTLYEKQIRGA

SEQ ID NO: 861057 - protein, 18 aa, Mycobacterium
SGSLRGSIIAILDFWKVI

SEQ ID NO: 861058 - protein, 27 aa, Mycobacterium
SGSNIREALFKVTRWGVKGRFAGSEGG

SEQ ID NO: 861059 - protein, 24 aa, Mycobacterium
SGSNLEFVVALLAASRANLIVVPL

SEQ ID NO: 861060 - protein, 18 aa, Mycobacterium
SGSPGLMLAMGPGFCAEL

SEQ ID NO: 861061 - protein, 26 aa, Mycobacterium
SGSPRLRRAMRTLLLETRMLLGELQG

SEQ ID NO: 861062 - protein, 25 aa, Mycobacterium
SGSQFQRFRPLLQQLSTTTPTIDQA

SEQ ID NO: 861063 - protein, 25 aa, Mycobacterium
SGSRALAFMKYHVPLVARLTSTAEQ

SEQ ID NO: 861064 - protein, 26 aa, Mycobacterium
SGSRFAGMLVAGTYLREFVADGVEWA

SEQ ID NO: 861065 - protein, 25 aa, Mycobacterium
SGSRFAGMLVAGTYLREFVAEGVQW

SEQ ID NO: 861066 - protein, 28 aa, Mycobacterium
SGSRGFHIYARIAPRWEFRQVRLAAQTV

SEQ ID NO: 861067 - protein, 32 aa, Mycobacterium
SGSRGFHIYARIHPRWPFKQVRLAAEAVAREV

SEQ ID NO: 861068 - protein, 23 aa, Mycobacterium
SGSRMRPDIVIKFMDRFGDVIYN

SEQ ID NO: 861069 - protein, 24 aa, Mycobacterium
SGSSQFVSGLLLSGAAFTDGLTIV

SEQ ID NO: 861070 - protein, 17 aa, Mycobacterium
SGSSRDWAAKGTVLLGV

SEQ ID NO: 861071 - protein, 23 aa, Mycobacterium
SGSVAQRLWAKPAITVVGIDTTP

SEQ ID NO: 861072 - protein, 24 aa, Mycobacterium
SGSVPQRLWAKPAITVIGIDTTPI

SEQ ID NO: 861073 - protein, 25 aa, Mycobacterium
SGSVPQRLWAKPAITVIGIDTTSIA

SEQ ID NO: 861074 - protein, 25 aa, Mycobacterium
SGSWVLDFVGSWEWTIPGGASEIQR

SEQ ID NO: 861075 - protein, 19 aa, Mycobacterium
SGSYSNGLFWQDDYQGLID

SEQ ID NO: 861076 - protein, 25 aa, Mycobacterium
SGTATYGTTWRGAGASASAVAQAAL

SEQ ID NO: 861077 - protein, 27 aa, Mycobacterium
SGTAVFETFFRKLPPSRSYIVAAGLSD

SEQ ID NO: 861078 - protein, 22 aa, Mycobacterium
SGTDYVYLWVDGIHLKVRLDQE

SEQ ID NO: 861079 - protein, 27 aa, Mycobacterium
SGTGDLALWLELRTPRWVSGEDRLLVT

SEQ ID NO: 861080 - protein, 25 aa, Mycobacterium
SGTIAGIHLEGPWLSPARCGAHDHT

SEQ ID NO: 861081 - protein, 26 aa, Mycobacterium
SGTLGPYTFGFAYQQSPGFFNSTTDP

SEQ ID NO: 861082 - protein, 22 aa, Mycobacterium
SGTLKKVFLELGGKSAAIVLDD

SEQ ID NO: 861083 - protein, 17 aa, Mycobacterium
SGTLKQGIDSEHAKKIT

SEQ ID NO: 861084 - protein, 26 aa, Mycobacterium
SGTLLLTEFFGTRTSAMRGLAVRPSA

SEQ ID NO: 861085 - protein, 21 aa, Mycobacterium
SGTLLRRKFRPSKAAMEPLQR

SEQ ID NO: 861086 - protein, 24 aa, Mycobacterium
SGTMDWILPDFAAVFCAAGLAVLT

SEQ ID NO: 861087 - protein, 24 aa, Mycobacterium
SGTNFNTGFFNSGGLNSGFANFGG

SEQ ID NO: 861088 - protein, 23 aa, Mycobacterium
SGTPLVVWNRTLERCLPVEAAGA

SEQ ID NO: 861089 - protein, 25 aa, Mycobacterium
SGTPVLVDFWATWCGPCKMVAPVLE

SEQ ID NO: 861090 - protein, 26 aa, Mycobacterium
SGTQWDALCHFFWRGKMYNGHRVADA

SEQ ID NO: 861091 - protein, 22 aa, Mycobacterium
SGTRAWLNRQLRPIGKAKAARR

SEQ ID NO: 861092 - protein, 23 aa, Mycobacterium
SGTRLYPITMGISKQLLPVYDKP

SEQ ID NO: 861093 - protein, 24 aa, Mycobacterium
SGTSLAQWYAAHGLGPQALADAYA

SEQ ID NO: 861094 - protein, 28 aa, Mycobacterium
SGTTDGLTAWLLLSCEALHAGAREALQI

SEQ ID NO: 861095 - protein, 22 aa, Mycobacterium
SGTTVHWKLNPNGTINTGGASL

SEQ ID NO: 861096 - protein, 17 aa, Mycobacterium
SGTVLFTDLLTAYHARH

SEQ ID NO: 861097 - protein, 32 aa, Mycobacterium
SGTWAVALDRGGQVRWFGLDGVEHTGGPLVDF

SEQ ID NO: 861098 - protein, 22 aa, Mycobacterium
SGTYIRALARDAGAALGVGGHL

SEQ ID NO: 861099 - protein, 24 aa, Mycobacterium
SGVAAFMPVYPTEKGAIKAVGRLA

SEQ ID NO: 861100 - protein, 27 aa, Mycobacterium
SGVAFDILRRWLMARGFDVAFIRNVTD

SEQ ID NO: 861101 - protein, 24 aa, Mycobacterium
SGVDLLPTLLELLGLDVPPDVDGV

SEQ ID NO: 861102 - protein, 22 aa, Mycobacterium
SGVFITAVYYPAENQIFTMLQQ

SEQ ID NO: 861103 - protein, 23 aa, Mycobacterium
SGVGDIFAWFTKNCVPKEVAIEA

SEQ ID NO: 861104 - protein, 26 aa, Mycobacterium
SGVGGPSCQWLLKSPAHLWQLEALLA

SEQ ID NO: 861105 - protein, 21 aa, Mycobacterium
SGVGKLLRPSLKARYGERLDA

SEQ ID NO: 861106 - protein, 31 aa, Mycobacterium
SGVGSNPIDILAWLLGYNGQASGGLGGIFGL

SEQ ID NO: 861107 - protein, 25 aa, Mycobacterium
SGVGTLELLDIISRGFPAPPEHQLP

SEQ ID NO: 861108 - protein, 29 aa, Mycobacterium
SGVGVLYGRRALLEAMPPFITGGSMIETV

SEQ ID NO: 861109 - protein, 22 aa, Mycobacterium
SGVIPLPGQVVYVGAKYAVVGL

SEQ ID NO: 861110 - protein, 23 aa, Mycobacterium
SGVIPLPGQVVYVGAKYAVVGLT

SEQ ID NO: 861111 - protein, 17 aa, Mycobacterium
SGVIPQISLIMGPAAGG

SEQ ID NO: 861112 - protein, 18 aa, Mycobacterium
SGVKDFLGATPFGGPDPT

SEQ ID NO: 861113 - protein, 27 aa, Mycobacterium
SGVLAPGSHLALITRRGRVLRIDPAAV

SEQ ID NO: 861114 - protein, 25 aa, Mycobacterium
SGVLPAQLLFSHPGYLRAAHGITVP

SEQ ID NO: 861115 - protein, 17 aa, Mycobacterium
SGVLRQYLADRNALPGS

SEQ ID NO: 861116 - protein, 19 aa, Mycobacterium
SGVLRVTPRPYVMPRTPAA

SEQ ID NO: 861117 - protein, 17 aa, Mycobacterium
SGVMWRRADDATPLTVY

SEQ ID NO: 861118 - protein, 19 aa, Mycobacterium
SGVMYPVVPPGVVQLRLVS

SEQ ID NO: 861119 - protein, 27 aa, Mycobacterium
SGVNWNFFGSFVFGTPGFPLSDVPLGD

SEQ ID NO: 861120 - protein, 26 aa, Mycobacterium
SGVNWNFFGSFVFGTPGFPLSDVPLQ

SEQ ID NO: 861121 - protein, 27 aa, Mycobacterium
SGVPGPDRVPLLALLRATPLTEDQIKE

SEQ ID NO: 861122 - protein, 24 aa, Mycobacterium
SGVPRVPFKPPVSAGGRGLAGLTP

SEQ ID NO: 861123 - protein, 19 aa, Mycobacterium
SGVRVFFPDPWPKARHHKR

SEQ ID NO: 861124 - protein, 30 aa, Mycobacterium
SGVTFIGQPLWASIGYTLPAALGAGLADRD

SEQ ID NO: 861125 - protein, 19 aa, Mycobacterium
SGVTHIPCWLLTDHRSWTR

SEQ ID NO: 861126 - protein, 25 aa, Mycobacterium
SGVTPTGFYFEKFGLTRAGAPDAPA

SEQ ID NO: 861127 - protein, 22 aa, Mycobacterium
SGVVAPLTFTSTPAMACNRRMF

SEQ ID NO: 861128 - protein, 17 aa, Mycobacterium
SGVVLITVRPEGRPFTG

SEQ ID NO: 861129 - protein, 22 aa, Mycobacterium
SGVVLYLRPPGPPRACGLFASD

SEQ ID NO: 861130 - protein, 18 aa, Mycobacterium
SGVVPDMTRFMHPDMPGN

SEQ ID NO: 861131 - protein, 26 aa, Mycobacterium
SGVVRFIGVDGYRWMIRCVVNGPHET

SEQ ID NO: 861132 - protein, 18 aa, Mycobacterium
SGWAALGWDTLGNKLLIF

SEQ ID NO: 861133 - protein, 17 aa, Mycobacterium
SGWGALAWDPIGRRLVV

SEQ ID NO: 861134 - protein, 23 aa, Mycobacterium
SGWGNTVLPLPDGTWKDALTGAV

SEQ ID NO: 861135 - protein, 18 aa, Mycobacterium
SGWIRPPFNVTISNIPGS

SEQ ID NO: 861136 - protein, 23 aa, Mycobacterium
SGWTFDHFYPIFSDPTGPCLEGW

SEQ ID NO: 861137 - protein, 23 aa, Mycobacterium
SGWTFDHFYPIFSDSAGPCLEGW

SEQ ID NO: 861138 - protein, 22 aa, Mycobacterium
SGWTFDHFYPIFSDSDGPCLEG

SEQ ID NO: 861139 - protein, 44 aa, Mycobacterium
SGYAAELAALTGLAWSGPSALLMTAAATPYVEWLTTAAAEAAQT

SEQ ID NO: 861140 - protein, 29 aa, Mycobacterium
SGYASWRSVLWRRWPAAGAPPFFASPGEY

SEQ ID NO: 861141 - protein, 35 aa, Mycobacterium
SGYASWRSVLWRRWPVAGPPPFFLSPDDYDRTVRM

SEQ ID NO: 861142 - protein, 25 aa, Mycobacterium
SGYDALPRRLADGLPIVFGTKVDSI

SEQ ID NO: 861143 - protein, 29 aa, Mycobacterium
SGYDIRKWIGWTMRFYYGSPAYSQIYSEL

SEQ ID NO: 861144 - protein, 26 aa, Mycobacterium
SGYDRPPALMQPYNPRYYPALVEASG

SEQ ID NO: 861145 - protein, 25 aa, Mycobacterium
SGYDWLPRFVALLQGKLSTNLADEV

SEQ ID NO: 861146 - protein, 26 aa, Mycobacterium
SGYENIIIRGLFLGQTRKQMLAKVDE

SEQ ID NO: 861147 - protein, 25 aa, Mycobacterium
SGYENIIIRGLFLGQTRKQMMAKVD

SEQ ID NO: 861148 - protein, 21 aa, Mycobacterium
SGYENIIIRGLFLGQTRKQMQ

SEQ ID NO: 861149 - protein, 23 aa, Mycobacterium
SGYENIIIRGLFLGQTRKQMQAK

SEQ ID NO: 861150 - protein, 34 aa, Mycobacterium
SGYERRGRWNVPRKLTTFALWGGGVVDLRYADFT

SEQ ID NO: 861151 - protein, 21 aa, Mycobacterium
SGYFAWEAAGLRWLAGVDGGV

SEQ ID NO: 861152 - protein, 20 aa, Mycobacterium
SGYKISVPHAVRISPDGIYL

SEQ ID NO: 861153 - protein, 24 aa, Mycobacterium
SGYLDALAYARHALGLPATTVNWG

SEQ ID NO: 861154 - protein, 31 aa, Mycobacterium
SGYLDALAYARRVMGLPATTVNWGLWKSLAD

SEQ ID NO: 861155 - protein, 27 aa, Mycobacterium
SGYLDALAYARRVMGLPATVVDWGLWK

SEQ ID NO: 861156 - protein, 19 aa, Mycobacterium
SGYPHLEEAYWFAEGVLPL

SEQ ID NO: 861157 - protein, 19 aa, Mycobacterium
SGYPHLEEAYWFGEGVLPL

SEQ ID NO: 861158 - protein, 26 aa, Mycobacterium
SGYPHLEELYWLGEGVVPLLRERGLF

SEQ ID NO: 861159 - protein, 22 aa, Mycobacterium
SGYPLELLVRAAAAGWRVAEFD

SEQ ID NO: 861160 - protein, 23 aa, Mycobacterium
SGYPLELLVRAAQAGWRVVEHDV

SEQ ID NO: 861161 - protein, 24 aa, Mycobacterium
SGYPTRLIYYKGGKLDFTLIPAED

SEQ ID NO: 861162 - protein, 33 aa, Mycobacterium
SGYRRFSAYDAERLRFILTAQRDHYLPLKVIKE

SEQ ID NO: 861163 - protein, 23 aa, Mycobacterium
SGYRRFTAYDCARLRFILTAQRD

SEQ ID NO: 861164 - protein, 34 aa, Mycobacterium; identical to SEQ ID NO: 117584

SEQ ID NO: 861165 - protein, 35 aa, Mycobacterium
SGYRRFTAYDCARLRFILTAQRDHYLPLKVIRAQL

SEQ ID NO: 861166 - protein, 35 aa, Mycobacterium
SGYRRFTAYDCARLRFILTAQRDHYLPLKVIRSEL

SEQ ID NO: 861167 - protein, 33 aa, Mycobacterium
SGYRRFTAYDCARLRFILTAQRDNYLPLKVIKS

SEQ ID NO: 861168 - protein, 33 aa, Mycobacterium
SGYRRFTAYDCARLRFILTAQRDQYLPLKVIKA

SEQ ID NO: 861169 - protein, 19 aa, Mycobacterium
SGYSLNLPKYGPTLVISDP

SEQ ID NO: 861170 - protein, 27 aa, Mycobacterium
SGYTTAPPLLCALQVFGADRIMFAADY

SEQ ID NO: 861171 - protein, 17 aa, Mycobacterium
SGYVITPVVIWGGGRLD

SEQ ID NO: 861172 - protein, 17 aa, Mycobacterium
SGYYPGQFQVGQTGKTV

SEQ ID NO: 861173 - protein, 25 aa, Mycobacterium
SHAGAAFFMPTLMKGGSMVVLPKFD

SEQ ID NO: 861174 - protein, 24 aa, Mycobacterium
SHAGYPWVLDACLIAWKHPNVYLE

SEQ ID NO: 861175 - protein, 19 aa, Mycobacterium
SHALAQITAALPLIGLPRT

SEQ ID NO: 861176 - protein, 38 aa, Mycobacterium; identical to SEQ ID NO: 222956

SEQ ID NO: 861177 - protein, 23 aa, Mycobacterium
SHAPGQLEFLGYGAQRAVDAGVP

SEQ ID NO: 861178 - protein, 21 aa, Mycobacterium
SHAPLTNRDWWPEQVDVSVLH

SEQ ID NO: 861179 - protein, 34 aa, Mycobacterium
SHAPPWARRFTPTSWAAMLAAPAAAGWTPRDLNQ

SEQ ID NO: 861180 - protein, 38 aa, Mycobacterium
SHAQSFASLVFYSSWFKLHHPAAFCAALLRAQPMGFYS

SEQ ID NO: 861181 - protein, 23 aa, Mycobacterium
SHARLLLLDEPSSGLDPLMENVF

SEQ ID NO: 861182 - protein, 33 aa, Mycobacterium
SHAVDLLPETLWIEPLWKTLLSNKAILAILWEM

SEQ ID NO: 861183 - protein, 18 aa, Mycobacterium
SHAWAIRETVDLLTRVFP

SEQ ID NO: 861184 - protein, 19 aa, Mycobacterium
SHAWAIRETVDLLTRVFPA

SEQ ID NO: 861185 - protein, 27 aa, Mycobacterium
SHCGNEPMILLIGSLQVIWSAHESSVW

SEQ ID NO: 861186 - protein, 24 aa, Mycobacterium
SHCGWPSFFDPAKSDAVILRPDHS

SEQ ID NO: 861187 - protein, 17 aa, Mycobacterium
SHCMLLAEGRVVAAGLL

SEQ ID NO: 861188 - protein, 17 aa, Mycobacterium
SHCYPHFRRFLAEVVRV

SEQ ID NO: 861189 - protein, 23 aa, Mycobacterium
SHDENLHMIFYRDVSAAGLDIAP

SEQ ID NO: 861190 - protein, 19 aa, Mycobacterium
SHDGLCRRLAAGIPAVVVS

SEQ ID NO: 861191 - protein, 27 aa, Mycobacterium
SHDGSAAFRFLLSPIRIVCANTQSAAI

SEQ ID NO: 861192 - protein, 22 aa, Mycobacterium
SHDLVILDRWVASNAAYGAARL

SEQ ID NO: 861193 - protein, 18 aa, Mycobacterium
SHDPPVPTLATAPPAALD

SEQ ID NO: 861194 - protein, 25 aa, Mycobacterium
SHEALRRGLVWRGVGTRLVEAVAEN

SEQ ID NO: 861195 - protein, 25 aa, Mycobacterium
SHEFRTPLTLLLGPLDDALAEAAPA

SEQ ID NO: 861196 - protein, 23 aa, Mycobacterium
SHFDHRAVVVGADRDQLLAGLDE

SEQ ID NO: 861197 - protein, 18 aa, Mycobacterium
SHFPYAAQIWKSMWTQQT

SEQ ID NO: 861198 - protein, 23 aa, Mycobacterium
SHFTTMIDALIDLPKPLICAVNG

SEQ ID NO: 861199 - protein, 22 aa, Mycobacterium
SHGFRLRDAPPDTRIALGAFGP

SEQ ID NO: 861200 - protein, 18 aa, Mycobacterium
SHGFRLRNPQPEARIALG

SEQ ID NO: 861201 - protein, 23 aa, Mycobacterium
SHGGLLMTLLGEAQVPFRQIPIA

SEQ ID NO: 861202 - protein, 26 aa, Mycobacterium
SHGGLPHPTILAAARLLGVDEVWAVG

SEQ ID NO: 861203 - protein, 18 aa, Mycobacterium
SHGLVAMLEPFLSRRVDG

SEQ ID NO: 861204 - protein, 37 aa, Mycobacterium
SHGQGYQVLSARALEFHTRLAQALSAGAGAYSGAEAS

SEQ ID NO: 861205 - protein, 25 aa, Mycobacterium
SHGSDAPPLLLKAARRLGGIDPDRA

SEQ ID NO: 861206 - protein, 24 aa, Mycobacterium
SHGTYFLCADPRPLGYDDSTAFCA

SEQ ID NO: 861207 - protein, 29 aa, Mycobacterium
SHGVYKMPANQFNLAWSADRIGAMRNQVY

SEQ ID NO: 861208 - protein, 19 aa, Mycobacterium
SHGWGVPGLSWLPGEGPDP

SEQ ID NO: 861209 - protein, 21 aa, Mycobacterium
SHGYCFQIDLTLRTIAHGFEV

SEQ ID NO: 861210 - protein, 23 aa, Mycobacterium
SHHPIIDPILPELRSELADLAPQ

SEQ ID NO: 861211 - protein, 23 aa, Mycobacterium
SHHSWTCAGAPIRDPRTGHVIGI

SEQ ID NO: 861212 - protein, 18 aa, Mycobacterium
SHIAWLRTIKDKISFRDM

SEQ ID NO: 861213 - protein, 18 aa, Mycobacterium
SHIAWLRTVKDKISFRGM

SEQ ID NO: 861214 - protein, 18 aa, Mycobacterium
SHIDGEDLYRPYLQLVMS

SEQ ID NO: 861215 - protein, 28 aa, Mycobacterium
SHIGEPYGPGFYAFGDLLAQWRSKGDLT

SEQ ID NO: 861216 - protein, 20 aa, Mycobacterium
SHIINLMMTGKLRTGDRIDR

SEQ ID NO: 861217 - protein, 27 aa, Mycobacterium
SHIVVNYDLPWAIIRIIQRAGRVDRVG

SEQ ID NO: 861218 - protein, 18 aa, Mycobacterium
SHLAAFLPGHPHAPELPH

SEQ ID NO: 861219 - protein, 18 aa, Mycobacterium
SHLALRRAGDPREIVGAA

SEQ ID NO: 861220 - protein, 19 aa, Mycobacterium
SHLGADNTSLFLKDESFRA

SEQ ID NO: 861221 - protein, 20 aa, Mycobacterium
SHLGADNTSLFLKDESFREV

SEQ ID NO: 861222 - protein, 25 aa, Mycobacterium
SHLGYSANFLRMCFGEIPDPVIVKA

SEQ ID NO: 861223 - protein, 18 aa, Mycobacterium
SHLKMDGSWRVGDRPPRV

SEQ ID NO: 861224 - protein, 19 aa, Mycobacterium
SHLLANLPSLLIRSTVGRK

SEQ ID NO: 861225 - protein, 17 aa, Mycobacterium
SHLLDPCGLPPKMLRST

SEQ ID NO: 861226 - protein, 19 aa, Mycobacterium
SHLLLMWGAANRDPVQFDA

SEQ ID NO: 861227 - protein, 27 aa, Mycobacterium
SHLLRDFELLAPLRARLSDGLPAYGAC

SEQ ID NO: 861228 - protein, 19 aa, Mycobacterium
SHLPKIARIVRQELPAVAL

SEQ ID NO: 861229 - protein, 18 aa, Mycobacterium
SHLQGWTLDRLPAVDRAI

SEQ ID NO: 861230 - protein, 19 aa, Mycobacterium
SHLQLVLHKLHDAGATVTQ

SEQ ID NO: 861231 - protein, 27 aa, Mycobacterium
SHLSIGSFRFWFIGQRWEWSDEVARMH

SEQ ID NO: 861232 - protein, 25 aa, Mycobacterium
SHLSLLRRLMMDDNWYRGELIFVFD

SEQ ID NO: 861233 - protein, 25 aa, Mycobacterium
SHNAALAMLAEAFYGPTLVSLRHVQ

SEQ ID NO: 861234 - protein, 30 aa, Mycobacterium
SHPAPLNQWLMEQLIMIDALKRGSAKRITA

SEQ ID NO: 861235 - protein, 30 aa, Mycobacterium
SHPAPLNTWLMEQLIMIDALKRGSAKRITA

SEQ ID NO: 861236 - protein, 27 aa, Mycobacterium
SHPDVRILILSMYDNEQYFFEALKAGA

SEQ ID NO: 861237 - protein, 21 aa, Mycobacterium
SHPKLTTVLFAAMSRDLHRAR

SEQ ID NO: 861238 - protein, 17 aa, Mycobacterium
SHPLIAVTPRKSAARLP

SEQ ID NO: 861239 - protein, 20 aa, Mycobacterium
SHPLLAEKLMPVLGVVRARG

SEQ ID NO: 861240 - protein, 17 aa, Mycobacterium
SHPLLAFGTDEQKQRWL

SEQ ID NO: 861241 - protein, 17 aa, Mycobacterium
SHPPAFLQAVHDAIALI

SEQ ID NO: 861242 - protein, 27 aa, Mycobacterium
SHPTRSFVTFLMLAGHLRPSYDYLIHR

SEQ ID NO: 861243 - protein, 17 aa, Mycobacterium
SHPVCEALLLTVAPVVR

SEQ ID NO: 861244 - protein, 25 aa, Mycobacterium
SHQGSRVFVRYPLLTLLCAVTKSHR

SEQ ID NO: 861245 - protein, 18 aa, Mycobacterium
SHQLLGALGFCDESDISV

SEQ ID NO: 861246 - protein, 23 aa, Mycobacterium
SHQMRNRLLPSIDGPGLPPDSNI

SEQ ID NO: 861247 - protein, 30 aa, Mycobacterium
SHQYVDLVSMFAPITRWAAGVPTARAIPEM

SEQ ID NO: 861248 - protein, 24 aa, Mycobacterium
SHRAFCNQLLWRRDEFGLGGDDAL

SEQ ID NO: 861249 - protein, 19 aa, Mycobacterium
SHRAGHFMPTSLLDSQFDI

SEQ ID NO: 861250 - protein, 29 aa, Mycobacterium
SHRDRGFGYLAYLHDPLAAAIALDPQLVT

SEQ ID NO: 861251 - protein, 22 aa, Mycobacterium
SHRERYTLPALRDWLRGQREDR

SEQ ID NO: 861252 - protein, 17 aa, Mycobacterium
SHRGRALTLLVPALRAL

SEQ ID NO: 861253 - protein, 20 aa, Mycobacterium
SHRILWPDRAYQPDLDILIA

SEQ ID NO: 861254 - protein, 17 aa, Mycobacterium
SHRMFVPFHNGVISQFE

SEQ ID NO: 861255 - protein, 20 aa, Mycobacterium
SHRMLLHHFGSREGLLVAIV

SEQ ID NO: 861256 - protein, 19 aa, Mycobacterium
SHRPRRVRQPGEPLRIGIG

SEQ ID NO: 861257 - protein, 29 aa, Mycobacterium
SHRVSRLHAKLFYQPLLESVGQASVGLSD

SEQ ID NO: 861258 - protein, 24 aa, Mycobacterium
SHSGNPIFELALKTGNLFAQNAAH

SEQ ID NO: 861259 - protein, 25 aa, Mycobacterium
SHSTGLLWLSLGLPADLPGTLRRSH

SEQ ID NO: 861260 - protein, 25 aa, Mycobacterium
SHTAGGFELFLYDGGHFYLDEHIDA

SEQ ID NO: 861261 - protein, 25 aa, Mycobacterium
SHTLRALTDFPAEKAWLVVDFDNRI

SEQ ID NO: 861262 - protein, 20 aa, Mycobacterium
SHTRGYIGTALRLLERKIAH

SEQ ID NO: 861263 - protein, 24 aa, Mycobacterium
SHTRLWAPAYLPRKTHRSRELTWY

SEQ ID NO: 861264 - protein, 21 aa, Mycobacterium
SHTVEILGNCDTLTVSGVENT

SEQ ID NO: 861265 - protein, 28 aa, Mycobacterium
SHTVEWHLRKVFAKLGITSRRQLRGLAK

SEQ ID NO: 861266 - protein, 23 aa, Mycobacterium
SHTYRLRFTGKKKASPPPPLGVT

SEQ ID NO: 861267 - protein, 22 aa, Mycobacterium
SHVAPPKRYLSRFGQLLEHAPY

SEQ ID NO: 861268 - protein, 24 aa, Mycobacterium
SHVAYQLSFHEGSRYPLTRGAAGI

SEQ ID NO: 861269 - protein, 23 aa, Mycobacterium
SHVEVALKHPIKLIANALGSPPK

SEQ ID NO: 861270 - protein, 26 aa, Mycobacterium
SHVINDTIWVLPDPAAATSALDQRKN

SEQ ID NO: 861271 - protein, 27 aa, Mycobacterium
SHVNPLRYLANLGLRPWPPPGRLRAVS

SEQ ID NO: 861272 - protein, 18 aa, Mycobacterium
SHWAGMGRELLMTEPAFA

SEQ ID NO: 861273 - protein, 38 aa, Mycobacterium
SHYRTALTILERYADRLPFDRLITGHYPLRDIDSVMGR

SEQ ID NO: 861274 - protein, 30 aa, Mycobacterium
SIAALRERPAGEPLWTAIAHAVLEPLQADL

SEQ ID NO: 861275 - protein, 29 aa, Mycobacterium
SIAATVVFPLLPFTPKIRTGYNLPISHVG

SEQ ID NO: 861276 - protein, 30 aa, Mycobacterium
SIADFWFDPLCPWCWITSRWILEVEKVRDI

SEQ ID NO: 861277 - protein, 18 aa, Mycobacterium
SIADHPFDLLARTRFRVT

SEQ ID NO: 861278 - protein, 37 aa, Mycobacterium
SIADLRAIPWVLAWSQSRVMLPGWYGAGTAFERWIAA

SEQ ID NO: 861279 - protein, 38 aa, Mycobacterium
SIADLRAIPWVLAWSQSRVMLPGWYGTGSAFENWIGTD

SEQ ID NO: 861280 - protein, 40 aa, Mycobacterium
SIADLRAIPWVLAWSQSRVMLPGWYGTGSAFEQWLAAGPE

SEQ ID NO: 861281 - protein, 23 aa, Mycobacterium
SIAEHPFDLLARARFRVTVNTDN

SEQ ID NO: 861282 - protein, 17 aa, Mycobacterium
SIAELLLEPPRRESVNE

SEQ ID NO: 861283 - protein, 20 aa, Mycobacterium
SIAETLLGLGFGEHAVLPVL

SEQ ID NO: 861284 - protein, 21 aa, Mycobacterium
SIAGFQPVPYMAVYSATKAFV

SEQ ID NO: 861285 - protein, 25 aa, Mycobacterium
SIAKVAMNVLLRRTFQATLQLTGQV

SEQ ID NO: 861286 - protein, 20 aa, Mycobacterium
SIALLAYEISLGGGAGPVID

SEQ ID NO: 861287 - protein, 23 aa, Mycobacterium
SIALQEDVALVGLSILSGAHVTL

SEQ ID NO: 861288 - protein, 25 aa, Mycobacterium
SIAMAAAVAPYLAWINSTGAQAEQA

SEQ ID NO: 861289 - protein, 33 aa, Mycobacterium
SIARFRRRHLAALEALFLQALTLCQQAGMVTMG

SEQ ID NO: 861290 - protein, 18 aa, Mycobacterium
SIATLLIGSSVRAVEAGD

SEQ ID NO: 861291 - protein, 18 aa, Mycobacterium
SIATPVLVIGFSDDVLTP

SEQ ID NO: 861292 - protein, 23 aa, Mycobacterium
SIATRYEWAPYDLGIHAGMADPE

SEQ ID NO: 861293 - protein, 20 aa, Mycobacterium
SICDRLGLLPMFAVNQDKHG

SEQ ID NO: 861294 - protein, 28 aa, Mycobacterium
SIDALTGLLNRRGLYLHFGDLLESNATS

SEQ ID NO: 861295 - protein, 23 aa, Mycobacterium
SIDATAALRRRGIDARLVVVGEG

SEQ ID NO: 861296 - protein, 29 aa, Mycobacterium
SIDDPIGTQYLWPRKYYPQRPWVGTQREH

SEQ ID NO: 861297 - protein, 24 aa, Mycobacterium
SIDELIPLVRGVVRGAPHALVVAD

SEQ ID NO: 861298 - protein, 25 aa, Mycobacterium
SIDGEVLLNCMLLAATASSVSGDAV

SEQ ID NO: 861299 - protein, 18 aa, Mycobacterium
SIDIPAIRRPADPRRQLT

SEQ ID NO: 861300 - protein, 30 aa, Mycobacterium
SIDKSDLRGLFRWWGLYTQREQGYDGSWTG

SEQ ID NO: 861301 - protein, 19 aa, Mycobacterium
SIDLAQHAEQWGYRRYWLA

SEQ ID NO: 861302 - protein, 30 aa, Mycobacterium
SIDLVPEYIGNLLLYFQPDSTATMLDAVEL

SEQ ID NO: 861303 - protein, 27 aa, Mycobacterium
SIDMESWVCPLPLRDAPAIVTGHGGGG

SEQ ID NO: 861304 - protein, 29 aa, Mycobacterium
SIDNADVVLWYVFGIHHITRPEDWPVMPV

SEQ ID NO: 861305 - protein, 28 aa, Mycobacterium
SIDNTQPWRWRVDRTSLHLYTDPGMQLP

SEQ ID NO: 861306 - protein, 29 aa, Mycobacterium
SIDPRIRADGYWPQLAARLTEAAMSRPDL

SEQ ID NO: 861307 - protein, 26 aa, Mycobacterium
SIDQFAPQISFFFYTHGDFFEEIAKY

SEQ ID NO: 861308 - protein, 17 aa, Mycobacterium
SIDRMWSGLLLHPLETA

SEQ ID NO: 861309 - protein, 22 aa, Mycobacterium
SIDRRFAKLRAAPSGRRAREVN

SEQ ID NO: 861310 - protein, 22 aa, Mycobacterium
SIDYTVLDLAIMILGGVAVPLQ

SEQ ID NO: 861311 - protein, 17 aa, Mycobacterium
SIEALLTTYRKLREEWL

SEQ ID NO: 861312 - protein, 20 aa, Mycobacterium
SIEARLYAEDPAREWQPQAG

SEQ ID NO: 861313 - protein, 29 aa, Mycobacterium
SIEDLERIYWAFCTHLGYLVSNNSFGHRM

SEQ ID NO: 861314 - protein, 29 aa, Mycobacterium
SIEDLLSAPAIKLLIRKAGAASADMAAEL

SEQ ID NO: 861315 - protein, 21 aa, Mycobacterium
SIEDWKAAISVNLWGVIYGCE

SEQ ID NO: 861316 - protein, 17 aa, Mycobacterium
SIEEAAEFFAPISSIHR

SEQ ID NO: 861317 - protein, 20 aa, Mycobacterium
SIEFIVAMLAVLKAGAAYLP

SEQ ID NO: 861318 - protein, 24 aa, Mycobacterium
SIEFPLRGLIQGWQDGIPGMRVGG

SEQ ID NO: 861319 - protein, 24 aa, Mycobacterium
SIEGMLNVMEEHQVRRLPVIEDHR

SEQ ID NO: 861320 - protein, 25 aa, Mycobacterium
SIEIATLRFLPDLLEAAFSVGRVDE

SEQ ID NO: 861321 - protein, 29 aa, Mycobacterium
SIELELRRQVLTLWQTALIRLSRLQISDE

SEQ ID NO: 861322 - protein, 23 aa, Mycobacterium
SIELFGRNTTRLAPYKIARAGLG

SEQ ID NO: 861323 - protein, 18 aa, Mycobacterium
SIELLRERPADEPLWTAI

SEQ ID NO: 861324 - protein, 19 aa, Mycobacterium
SIENAMWPDLFIAGGGISR

SEQ ID NO: 861325 - protein, 24 aa, Mycobacterium
SIENGSYFVHRLIKRLKKVANNYP

SEQ ID NO: 861326 - protein, 22 aa, Mycobacterium
SIEQIRLQFGRHGIAEPPAGQP

SEQ ID NO: 861327 - protein, 24 aa, Mycobacterium
SIERFFGVLTEHYAGAFPVWLAPV

SEQ ID NO: 861328 - protein, 24 aa, Mycobacterium
SIERRRLLELYGTEIIFSPAEGGS

SEQ ID NO: 861329 - protein, 26 aa, Mycobacterium
SIETAARLIRDARRPLIMVGGGTRAN

SEQ ID NO: 861330 - protein, 35 aa, Mycobacterium
SIEVGKLADLVLWEPAFFGVRPDLVLKGGAIAWAA

SEQ ID NO: 861331 - protein, 17 aa, Mycobacterium
SIEVPAIRRPVDKKRQI

SEQ ID NO: 861332 - protein, 20 aa, Mycobacterium
SIEVPGFGPLRFGHSRFDRG

SEQ ID NO: 861333 - protein, 20 aa, Mycobacterium
SIEWMHRHLTPRDSIILSLH

SEQ ID NO: 861334 - protein, 18 aa, Mycobacterium
SIEWMSHNLANRDSVILS

SEQ ID NO: 861335 - protein, 21 aa, Mycobacterium
SIEWRRLLLCSYPALNKRAGV

SEQ ID NO: 861336 - protein, 19 aa, Mycobacterium
SIFAIQDPGAYPLVLATYE

SEQ ID NO: 861337 - protein, 17 aa, Mycobacterium
SIFAVMIQNHFFQNVDI

SEQ ID NO: 861338 - protein, 26 aa, Mycobacterium
SIFCATCYEWAILDLAILAVGGVTVP

SEQ ID NO: 861339 - protein, 27 aa, Mycobacterium
SIFFMERIPRLLRSIYPIGGVVFDGDR

SEQ ID NO: 861340 - protein, 26 aa, Mycobacterium
SIFFRERIPRLLRSLYPIGGVVFDGD

SEQ ID NO: 861341 - protein, 19 aa, Mycobacterium
SIFKLYPWEWMIDDDFGSH

SEQ ID NO: 861342 - protein, 20 aa, Mycobacterium
SIFQVLLNHPRLARTFNDLL

SEQ ID NO: 861343 - protein, 20 aa, Mycobacterium
SIFSNEFFENPPGPVERPLP

SEQ ID NO: 861344 - protein, 26 aa, Mycobacterium
SIGHVNPRHRLQYPLTVREVVLTGIT

SEQ ID NO: 861345 - protein, 25 aa, Mycobacterium
SIGIRSVCYLPLTYDHRLIDGADAG

SEQ ID NO: 861346 - protein, 20 aa, Mycobacterium
SIGLMIAMGPAFCSELVLLT

SEQ ID NO: 861347 - protein, 32 aa, Mycobacterium
SIGPDDALFVRPFLKYQIIAVAAPNSPVALGV

SEQ ID NO: 861348 - protein, 17 aa, Mycobacterium
SIGSLLRQAAARWPDRV

SEQ ID NO: 861349 - protein, 24 aa, Mycobacterium
SIGVEHLLPIAPPPQETPPRWRRM

SEQ ID NO: 861350 - protein, 25 aa, Mycobacterium
SIGVRSICYLPLTYDHRLIDGADAG

SEQ ID NO: 861351 - protein, 25 aa, Mycobacterium
SIGVRSVCYLPLTYDHRLVDGADAG

SEQ ID NO: 861352 - protein, 29 aa, Mycobacterium
SIGVRSVSYLPLTYDHRLIDGADAGRFVT

SEQ ID NO: 861353 - protein, 17 aa, Mycobacterium
SIGVSFRYWTESIPNID

SEQ ID NO: 861354 - protein, 23 aa, Mycobacterium
SIHDDYWDPMWRALSDTNTVLSV

SEQ ID NO: 861355 - protein, 20 aa, Mycobacterium
SIHILEPTVFPGGVGKTWKA

SEQ ID NO: 861356 - protein, 25 aa, Mycobacterium
SIHLKRAHLPLHRLPDKWAIQLNDT

SEQ ID NO: 861357 - protein, 18 aa, Mycobacterium
SIHMGFSDAGAHLRNMAF

SEQ ID NO: 861358 - protein, 22 aa, Mycobacterium
SIHREWLLIELKSSWQVGDIEY

SEQ ID NO: 861359 - protein, 17 aa, Mycobacterium
SIIDLGCGYGALLDYLD

SEQ ID NO: 861360 - protein, 25 aa, Mycobacterium
SIIPAGWSFLLALRSRGLGSVWTTM

SEQ ID NO: 861361 - protein, 22 aa, Mycobacterium
SIIQPLIQAMSFGLTALQTARG

SEQ ID NO: 861362 - protein, 21 aa, Mycobacterium
SIKATYRRYLSSLLAVRDPKI

SEQ ID NO: 861363 - protein, 21 aa, Mycobacterium
SIKDVFLTRNWPTLRGSGLID

SEQ ID NO: 861364 - protein, 17 aa, Mycobacterium
SIKEKLLELLPNRVITD

SEQ ID NO: 861365 - protein, 26 aa, Mycobacterium
SIKGWPGWSVYAGSKAALHAFARVWL

SEQ ID NO: 861366 - protein, 18 aa, Mycobacterium
SIKHRMASVIFSLEMSKS

SEQ ID NO: 861367 - protein, 18 aa, Mycobacterium
SIKKLYRPGGDALTALAV

SEQ ID NO: 861368 - protein, 26 aa, Mycobacterium
SIKKVAPLFGFEWRVDDPGGAVSQTY

SEQ ID NO: 861369 - protein, 21 aa, Mycobacterium
SILARQALGLLGPVPLDGELD

SEQ ID NO: 861370 - protein, 19 aa, Mycobacterium
SILDAYLRHQFPDNRGLKG

SEQ ID NO: 861371 - protein, 19 aa, Mycobacterium
SILLGLYRDDGELQMVGGA

SEQ ID NO: 861372 - protein, 17 aa, Mycobacterium
SILLVEPGPGLTISRDL

SEQ ID NO: 861373 - protein, 26 aa, Mycobacterium
SILPGHPRVLSIAQFWHRAAEHERIA

SEQ ID NO: 861374 - protein, 23 aa, Mycobacterium
SILRALALNRFAKVPTLVGGQML

SEQ ID NO: 861375 - protein, 29 aa, Mycobacterium
SILSWENWEQLFTLAKFIGVSRPGYELSS

SEQ ID NO: 861376 - protein, 23 aa, Mycobacterium
SIMGIGFPPWTGGSAQYIVGYEG

SEQ ID NO: 861377 - protein, 23 aa, Mycobacterium
SIMGIGYPPWTGGSAQFIVGYQG

SEQ ID NO: 861378 - protein, 19 aa, Mycobacterium
SIMIGERCADFLLAQSATP

SEQ ID NO: 861379 - protein, 20 aa, Mycobacterium
SIMMPPITAAIPPERAWGIW

SEQ ID NO: 861380 - protein, 18 aa, Mycobacterium
SIMPDDLLALCPPDAKVI

SEQ ID NO: 861381 - protein, 20 aa, Mycobacterium
SIMPDDLLALCPPGAKVVDT

SEQ ID NO: 861382 - protein, 19 aa, Mycobacterium
SINGGGYGGLGGNGGTGGA

SEQ ID NO: 861383 - protein, 21 aa, Mycobacterium
SINLPYITVDADKNPLFLDEQ

SEQ ID NO: 861384 - protein, 23 aa, Mycobacterium
SINNIRTAIRQLSVRAQLAQKEG

SEQ ID NO: 861385 - protein, 21 aa, Mycobacterium
SINRFATWWVVLERHGEMVRL

SEQ ID NO: 861386 - protein, 18 aa, Mycobacterium
SINVMVWARGHRSDWDYF

SEQ ID NO: 861387 - protein, 18 aa, Mycobacterium
SIPDKYLVSVNLSPLALA

SEQ ID NO: 861388 - protein, 24 aa, Mycobacterium
SIPDLLTLSDVMGTGWFAAEAANV

SEQ ID NO: 861389 - protein, 21 aa, Mycobacterium
SIPGVQYKALVGAGRMIPRGL

SEQ ID NO: 861390 - protein, 25 aa, Mycobacterium
SIPSDLSVYALYRRAQEDGTGELLD

SEQ ID NO: 861391 - protein, 18 aa, Mycobacterium
SIPTLMAFKKGKLLFNQP

SEQ ID NO: 861392 - protein, 30 aa, Mycobacterium
SIPTPQPVFPRPMFSAMHAVAAGLAVHFVS

SEQ ID NO: 861393 - protein, 43 aa, Mycobacterium
SIPTVMLRRMAWYWARIWIEVTPVRVLWWRGGDLDQPPQLWEP

SEQ ID NO: 861394 - protein, 17 aa, Mycobacterium
SIPVAYLGLWDTVSAPG

SEQ ID NO: 861395 - protein, 25 aa, Mycobacterium
SIPVKRLRQAGVLELLLALANEADG

SEQ ID NO: 861396 - protein, 24 aa, Mycobacterium
SIPWRLPEDLARFKEMTMGHPVVM

SEQ ID NO: 861397 - protein, 25 aa, Mycobacterium
SIPYPTELRELLAATLPPASTTAHA

SEQ ID NO: 861398 - protein, 27 aa, Mycobacterium
SIQAGIINLLLDLQEQFRLSYLFVSHD

SEQ ID NO: 861399 - protein, 24 aa, Mycobacterium
SIQPADTILKILAGLNGEVRKGSS

SEQ ID NO: 861400 - protein, 22 aa, Mycobacterium
SIQPKVFDYLSSLEWIRTQQNL

SEQ ID NO: 861401 - protein, 18 aa, Mycobacterium
SIQPKVFDYLSSLEWVRT

SEQ ID NO: 861402 - protein, 25 aa, Mycobacterium
SIQQQTWERLWPQLGRQATAHSQPS

SEQ ID NO: 861403 - protein, 26 aa, Mycobacterium
SIQREAFAWHIELAKRTGKPLMIHNR

SEQ ID NO: 861404 - protein, 23 aa, Mycobacterium
SIQRVLHLWPKARCALMGVGAPP

SEQ ID NO: 861405 - protein, 22 aa, Mycobacterium
SIRAIVAGYRLGPQDATVAVMP

SEQ ID NO: 861406 - protein, 24 aa, Mycobacterium
SIRDGAVAAWPGAWQGQNLRDILI

SEQ ID NO: 861407 - protein, 19 aa, Mycobacterium
SIRDGWWDEWFDGENGWEI

SEQ ID NO: 861408 - protein, 25 aa, Mycobacterium
SIRELQFYRRTAFVPPPGPATSEIE

SEQ ID NO: 861409 - protein, 24 aa, Mycobacterium
SIRELQFYRRTAFVSPPGPSTSEI

SEQ ID NO: 861410 - protein, 25 aa, Mycobacterium
SIRELQYYRRTAFVPPPGPSTSEIA

SEQ ID NO: 861411 - protein, 24 aa, Mycobacterium
SIRIGVQLWPGGVADYRTWRDAVL

SEQ ID NO: 861412 - protein, 28 aa, Mycobacterium
SIRIPKPWFVLMPTPIWDQLFKPLVGAQ

SEQ ID NO: 861413 - protein, 20 aa, Mycobacterium
SIRKVLSWLPGRGTNRRVDY

SEQ ID NO: 861414 - protein, 18 aa, Mycobacterium
SIRLGVPCFPDDPLHFTG

SEQ ID NO: 861415 - protein, 22 aa, Mycobacterium
SIRLRGIMSHFAYADQPGHPTV

SEQ ID NO: 861416 - protein, 19 aa, Mycobacterium
SIRNIRRKAMEELARIKKD

SEQ ID NO: 861417 - protein, 26 aa, Mycobacterium
SIRRAEETYLLRQTLEPLATRLAAAN

SEQ ID NO: 861418 - protein, 25 aa, Mycobacterium
SISEGNFRCQVGHAWTADALLAARD

SEQ ID NO: 861419 - protein, 24 aa, Mycobacterium
SISERARQLIAARTPFVHATVVRA

SEQ ID NO: 861420 - protein, 23 aa, Mycobacterium
SISEWRWVGLPEQLDLSNVAVHQ

SEQ ID NO: 861421 - protein, 26 aa, Mycobacterium
SISGVLGSRWLAHYAATTTFLDTFAF

SEQ ID NO: 861422 - protein, 24 aa, Mycobacterium
SISPATLRMALLGKVMTVGDTVSL

SEQ ID NO: 861423 - protein, 20 aa, Mycobacterium
SISPWLALQYEDLGWNGAIP

SEQ ID NO: 861424 - protein, 18 aa, Mycobacterium
SISSAYIWQLRNGIKTNP

SEQ ID NO: 861425 - protein, 26 aa, Mycobacterium
SITAGRISYLLGLRGPAAAIDTACSS

SEQ ID NO: 861426 - protein, 19 aa, Mycobacterium
SITATLRMVRQRPALAAWF

SEQ ID NO: 861427 - protein, 25 aa, Mycobacterium
SITHPRLIRELLTTVYQHTAEGVLP

SEQ ID NO: 861428 - protein, 22 aa, Mycobacterium
SITIQPLAELLARGQILVLKHR

SEQ ID NO: 861429 - protein, 22 aa, Mycobacterium
SITKFRGGLTQWLEPTMSSAIA

SEQ ID NO: 861430 - protein, 27 aa, Mycobacterium
SITQPLVVALTLLAYDELNKRGHLNGK

SEQ ID NO: 861431 - protein, 22 aa, Mycobacterium
SITVGRISYLLGLRGPAVAVDT

SEQ ID NO: 861432 - protein, 17 aa, Mycobacterium
SITVSEFPAYGTLDIPV

SEQ ID NO: 861433 - protein, 19 aa, Mycobacterium
SIVECIRRLRPDLDARIAF

SEQ ID NO: 861434 - protein, 25 aa, Mycobacterium
SIVEPGYFRTSFLTTDSLALPEATS

SEQ ID NO: 861435 - protein, 17 aa, Mycobacterium
SIVFFDVSATRALVDKV

SEQ ID NO: 861436 - protein, 28 aa, Mycobacterium
SIVLGALPFDVEWPAALLTPGAVRHTDG

SEQ ID NO: 861437 - protein, 17 aa, Mycobacterium
SIVLSAGLRRDPRTWAR

SEQ ID NO: 861438 - protein, 17 aa, Mycobacterium
SIVLVQPGPGLTVSRDL

SEQ ID NO: 861439 - protein, 25 aa, Mycobacterium
SIVMLHLALKAFRPGRPPFPVMHVD

SEQ ID NO: 861440 - protein, 17 aa, Mycobacterium
SIVPALKRYVLEMRFKP

SEQ ID NO: 861441 - protein, 24 aa, Mycobacterium
SIVPHTWLWTTPAGGEIRPVQLVS

SEQ ID NO: 861442 - protein, 22 aa, Mycobacterium
SIVPTLKRYVLEMRFKPMPRYH

SEQ ID NO: 861443 - protein, 17 aa, Mycobacterium
SIVRAAETFGFTGALIP

SEQ ID NO: 861444 - protein, 22 aa, Mycobacterium
SIVRRLLGLEPVLSIGFCGPTH

SEQ ID NO: 861445 - protein, 19 aa, Mycobacterium
SIVTAFAALGALAPTGDKP

SEQ ID NO: 861446 - protein, 30 aa, Mycobacterium
SIVTRLRTEPWLGPASLSMAAAAQPLVAWL

SEQ ID NO: 861447 - protein, 27 aa, Mycobacterium
SIVVLDPWGHFDGLRAWLSELADTGYV

SEQ ID NO: 861448 - protein, 32 aa, Mycobacterium
SIVVQTMVIPGLLTWRGLARVMSESPARIVGL

SEQ ID NO: 861449 - protein, 17 aa, Mycobacterium
SIWAFLQSRGVQLATAS

SEQ ID NO: 861450 - protein, 17 aa, Mycobacterium
SIWDGDCDVALAGGVNI

SEQ ID NO: 861451 - protein, 24 aa, Mycobacterium
SIWEPRRVLVTIGIRQARSIREVL

SEQ ID NO: 861452 - protein, 17 aa, Mycobacterium
SIWFDEVLVFSDGRWDR

SEQ ID NO: 861453 - protein, 17 aa, Mycobacterium
SIWKGSIAFGLVNVPVK

SEQ ID NO: 861454 - protein, 19 aa, Mycobacterium
SIWRGPLPFDAAENDHLLT

SEQ ID NO: 861455 - protein, 24 aa, Mycobacterium
SIYAGVPIAFNRPVWRVDLFGSTE

SEQ ID NO: 861456 - protein, 24 aa, Mycobacterium
SIYDDFLAKFTEKLLAAGEGIAPL

SEQ ID NO: 861457 - protein, 24 aa, Mycobacterium
SKAALFREALVLPFTDFVDEFGRT

SEQ ID NO: 861458 - protein, 25 aa, Mycobacterium
SKAALFREALVLPFTDFVEEFRQTW

SEQ ID NO: 861459 - protein, 24 aa, Mycobacterium
SKAAQLGFMRTAAIELAPRGVTVN

SEQ ID NO: 861460 - protein, 25 aa, Mycobacterium
SKADQVMALLPAGYPSQACTAVEPA

SEQ ID NO: 861461 - protein, 29 aa, Mycobacterium
SKAEIIAELRQHLWPLIAEGTVAPVVSAE

SEQ ID NO: 861462 - protein, 24 aa, Mycobacterium
SKAEKILFTYLGVDTPQPPEETSA

SEQ ID NO: 861463 - protein, 24 aa, Mycobacterium
SKAIDGIFDWNQSLFGYPFGDPES

SEQ ID NO: 861464 - protein, 21 aa, Mycobacterium
SKAIRVLMGCPFLNGLRARRL

SEQ ID NO: 861465 - protein, 24 aa, Mycobacterium
SKAQLIFTVSPLLSRALEAAEIAG

SEQ ID NO: 861466 - protein, 30 aa, Mycobacterium
SKAQVLAEALPWLKQLHGRVVVIKYGGNAM

SEQ ID NO: 861467 - protein, 23 aa, Mycobacterium
SKARGMLFYRLLQQSVNTDPHPL

SEQ ID NO: 861468 - protein, 18 aa, Mycobacterium
SKATAIPLAKACARIMLG

SEQ ID NO: 861469 - protein, 22 aa, Mycobacterium
SKATIYRRWPSKAELVLAAFIE

SEQ ID NO: 861470 - protein, 22 aa, Mycobacterium
SKATLYRRWPSKSDLVLAAFVE

SEQ ID NO: 861471 - protein, 22 aa, Mycobacterium
SKATVYRRWPSKAELVLAAFIE

SEQ ID NO: 861472 - protein, 21 aa, Mycobacterium
SKAWVISFSEGLSVGLQGTGV

SEQ ID NO: 861473 - protein, 25 aa, Mycobacterium
SKAYAAYSTPFWRANGFSGQALSDR

SEQ ID NO: 861474 - protein, 22 aa, Mycobacterium
SKCSYLAPVAYPDDLRAGLRVD

SEQ ID NO: 861475 - protein, 17 aa, Mycobacterium
SKDAFLMRMTEERFEEV

SEQ ID NO: 861476 - protein, 21 aa, Mycobacterium
SKDIDFHCWLQWLVDEQLSAA

SEQ ID NO: 861477 - protein, 23 aa, Mycobacterium
SKDIFMTTLLERTFHRNPGMLAA

SEQ ID NO: 861478 - protein, 17 aa, Mycobacterium
SKEACFIELLRANNAAL

SEQ ID NO: 861479 - protein, 18 aa, Mycobacterium
SKEALLDALLTRVMEPVL

SEQ ID NO: 861480 - protein, 23 aa, Mycobacterium
SKEELFNLRFQMATGQLANNRRL

SEQ ID NO: 861481 - protein, 22 aa, Mycobacterium
SKEIERQFKKLGVKIRTGTKVE

SEQ ID NO: 861482 - protein, 23 aa, Mycobacterium
SKELIAWLPTLLGLGPADVVVAP

SEQ ID NO: 861483 - protein, 23 aa, Mycobacterium
SKELIAWLPTLLGLGPGDVIVVP

SEQ ID NO: 861484 - protein, 24 aa, Mycobacterium
SKELLPERLIVLDELPRSSGGKIA

SEQ ID NO: 861485 - protein, 24 aa, Mycobacterium
SKELLPERLIVVDELPRSSGGKVA

SEQ ID NO: 861486 - protein, 24 aa, Mycobacterium
SKELLPERLVVVDELPRSSGGKVA

SEQ ID NO: 861487 - protein, 29 aa, Mycobacterium
SKELVVVRPIGFEPLQWVRALAAEDPVPS

SEQ ID NO: 861488 - protein, 25 aa, Mycobacterium
SKENLCAEVLLRCYMRTFSEVAGRL

SEQ ID NO: 861489 - protein, 21 aa, Mycobacterium
SKEWTTDLVKLLAAGPIGSTE

SEQ ID NO: 861490 - protein, 22 aa, Mycobacterium
SKFFTALRERRILGVRGSDGRV

SEQ ID NO: 861491 - protein, 27 aa, Mycobacterium
SKFGKLPYERLFEPAISYGRNGFLVSP

SEQ ID NO: 861492 - protein, 28 aa, Mycobacterium
SKGHMRLQRFYSVLFVDCGVDLEHEVMK

SEQ ID NO: 861493 - protein, 25 aa, Mycobacterium
SKGNEYFLRHLLGTDSNLQASPTPE

SEQ ID NO: 861494 - protein, 25 aa, Mycobacterium
SKGNEYFLRHLLGTTSNLQAAPNGV

SEQ ID NO: 861495 - protein, 25 aa, Mycobacterium
SKGNFYLRPIVRPVVLVAGGTGLSA

SEQ ID NO: 861496 - protein, 24 aa, Mycobacterium
SKGRINMGPIVNAPLRTTGAKSGK

SEQ ID NO: 861497 - protein, 22 aa, Mycobacterium
SKGWRAVHRLAVDATWSVTREV

SEQ ID NO: 861498 - protein, 27 aa, Mycobacterium
SKGYCFQIDLTWRTVCNGFVIAEVPIT

SEQ ID NO: 861499 - protein, 24 aa, Mycobacterium
SKGYGFQVDLTWRSINAGFTVVEV

SEQ ID NO: 861500 - protein, 23 aa, Mycobacterium
SKHAELMFLSAYTPETIAQQIDS

SEQ ID NO: 861501 - protein, 19 aa, Mycobacterium
SKHDLLFADYTGLNWFRAA

SEQ ID NO: 861502 - protein, 23 aa, Mycobacterium
SKHGVVGLMRVLANSLAPFSIRV

SEQ ID NO: 861503 - protein, 17 aa, Mycobacterium
SKIARLVDLYAKRPQVQ

SEQ ID NO: 861504 - protein, 24 aa, Mycobacterium
SKIFTLALVIEQRGPRELRLKVGA

SEQ ID NO: 861505 - protein, 31 aa, Mycobacterium
SKILGPDLLAWRTEFFPKFPGTPGTEWHQVR

SEQ ID NO: 861506 - protein, 20 aa, Mycobacterium
SKKLPHQTWVFDTIDSELSA

SEQ ID NO: 861507 - protein, 27 aa, Mycobacterium
SKLDDERLAFYRTLYRDHARYGAALWV

SEQ ID NO: 861508 - protein, 32 aa, Mycobacterium
SKLEFYDLSHPWGHGAPAWPYFEDVKIERLHG

SEQ ID NO: 861509 - protein, 20 aa, Mycobacterium
SKLLELPEPVRDQLLADAES

SEQ ID NO: 861510 - protein, 30 aa, Mycobacterium
SKLRERLGFGDLRWAVSGAAPIPKETLAFF

SEQ ID NO: 861511 - protein, 30 aa, Mycobacterium; identical to SEQ ID NO: 132114

SEQ ID NO: 861512 - protein, 30 aa, Mycobacterium
SKLRERLGFGELRWAVSGAAPIPKETLGFF

SEQ ID NO: 861513 - protein, 19 aa, Mycobacterium
SKLRFYTNVLKLGSRNPLL

SEQ ID NO: 861514 - protein, 21 aa, Mycobacterium
SKLSFHHREVFGQVGFGTGGW

SEQ ID NO: 861515 - protein, 23 aa, Mycobacterium
SKLTPEQLPFVELNAAFYPKREG

SEQ ID NO: 861516 - protein, 18 aa, Mycobacterium
SKLYYIANPCDECRLPVA

SEQ ID NO: 861517 - protein, 24 aa, Mycobacterium
SKMTTLLEIVKKLPPRLIVSRERL

SEQ ID NO: 861518 - protein, 25 aa, Mycobacterium
SKNITALLDLLITDGKLAPDFDDEV

SEQ ID NO: 861519 - protein, 21 aa, Mycobacterium
SKNITALLELLVKDGKLAPDF

SEQ ID NO: 861520 - protein, 24 aa, Mycobacterium
SKNQSRWQFGVLGPPGAADAGLGE

SEQ ID NO: 861521 - protein, 34 aa, Mycobacterium
SKNVPLGRLAQPDDIGWAAAFLASDAASYISGAS

SEQ ID NO: 861522 - protein, 25 aa, Mycobacterium
SKNVPLGRLAQPEDIGWATAFLASD

SEQ ID NO: 861523 - protein, 22 aa, Mycobacterium
SKPAIYRRWPSKAHLVHEAVFP

SEQ ID NO: 861524 - protein, 18 aa, Mycobacterium
SKPAVPTWEDVLLGVRSS

SEQ ID NO: 861525 - protein, 19 aa, Mycobacterium
SKPFRKMGIHSSRTGQLFF

SEQ ID NO: 861526 - protein, 17 aa, Mycobacterium
SKPFTFRRVEALRPVIQ

SEQ ID NO: 861527 - protein, 19 aa, Mycobacterium
SKPFTFRRVEGLRPTIQQI

SEQ ID NO: 861528 - protein, 23 aa, Mycobacterium
SKPQEFFDLVGMAEWSALGEKYQ

SEQ ID NO: 861529 - protein, 30 aa, Mycobacterium
SKPTAWLAEGVLIGFLPPDAEVRLLDAIIP

SEQ ID NO: 861530 - protein, 24 aa, Mycobacterium
SKPVLYQHFPSKLELYLAVLHKHA

SEQ ID NO: 861531 - protein, 25 aa, Mycobacterium
SKQADALMLLYLLSADELGELLDRL

SEQ ID NO: 861532 - protein, 26 aa, Mycobacterium
SKQADVLMLFYLLSADEIRELLARLG

SEQ ID NO: 861533 - protein, 38 aa, Mycobacterium
SKQADVLMLFYLLSSDELLALFGRLGYRFAPERIPETV

SEQ ID NO: 861534 - protein, 27 aa, Mycobacterium
SKQADVLMLLYLLSADELRELLDRLDY

SEQ ID NO: 861535 - protein, 35 aa, Mycobacterium
SKQAIAVLVRLMGELFLQPLVDAAWQRLPHSDNDP

SEQ ID NO: 861536 - protein, 19 aa, Mycobacterium
SKQQLCEVLDLFKAAARRA

SEQ ID NO: 861537 - protein, 21 aa, Mycobacterium
SKRFPLDDFRFDRLPEPKSPQ

SEQ ID NO: 861538 - protein, 25 aa, Mycobacterium
SKRGWPLEWAGALAGNFVGAIWPTA

SEQ ID NO: 861539 - protein, 17 aa, Mycobacterium
SKRPRGSQLGAWASHQS

SEQ ID NO: 861540 - protein, 20 aa, Mycobacterium
SKRQWHGMFALMGSPEEFAD

SEQ ID NO: 861541 - protein, 28 aa, Mycobacterium
SKRSRRTVPLPPWLAKRMADYLAEVHPR

SEQ ID NO: 861542 - protein, 28 aa, Mycobacterium
SKSALVAAVYLRFLRELPLHTDVNETTK

SEQ ID NO: 861543 - protein, 23 aa, Mycobacterium
SKSFWGGMRVGWIRADRTTIARL

SEQ ID NO: 861544 - protein, 36 aa, Mycobacterium
SKSIWSRIPVLNRISYLLWRFYFERGVGGSVVIPGA

SEQ ID NO: 861545 - protein, 29 aa, Mycobacterium
SKSLAPGLRLGWLVLPDRLVDAVLRQKGE

SEQ ID NO: 861546 - protein, 25 aa, Mycobacterium
SKSPQLHLAAYRALGLTGWTYDRIE

SEQ ID NO: 861547 - protein, 23 aa, Mycobacterium
SKTLKLDLGALVRTLSPNGDFFG

SEQ ID NO: 861548 - protein, 17 aa, Mycobacterium
SKTRFAIYLGDLGNDTA

SEQ ID NO: 861549 - protein, 21 aa, Mycobacterium
SKTRIWQVGAMRDLLLEHREP

SEQ ID NO: 861550 - protein, 25 aa, Mycobacterium
SKVKHRVFHYPGGLVDYVKHINRTK

SEQ ID NO: 861551 - protein, 23 aa, Mycobacterium
SKVLALLHRYGIASPASADMARA

SEQ ID NO: 861552 - protein, 32 aa, Mycobacterium
SKVLKLFENPLFSSRALMDFLRKLLGEAPSRG

SEQ ID NO: 861553 - protein, 18 aa, Mycobacterium
SKVLLLTATPYNLAFQDV

SEQ ID NO: 861554 - protein, 28 aa, Mycobacterium
SKVRHLEVIALTPARLLMVVITDSGRVD

SEQ ID NO: 861555 - protein, 25 aa, Mycobacterium
SKVRPGVPVIFLDTGYHFAETLGTR

SEQ ID NO: 861556 - protein, 25 aa, Mycobacterium
SKVRPGVPVLFLDTGYHFAETIGSR

SEQ ID NO: 861557 - protein, 20 aa, Mycobacterium
SKVSRVLLTSGKLYYELVAR

SEQ ID NO: 861558 - protein, 18 aa, Mycobacterium
SKVTRILLTSGKIYYELV

SEQ ID NO: 861559 - protein, 37 aa, Mycobacterium
SKYIFGGILDRHPRLRIGWFEGGIAWVPWALQDAEHL

SEQ ID NO: 861560 - protein, 18 aa, Mycobacterium
SLAAARFRRPGLEPPPTP

SEQ ID NO: 861561 - protein, 23 aa, Mycobacterium
SLAALAPRRVLPAFGLHSALTAE

SEQ ID NO: 861562 - protein, 25 aa, Mycobacterium
SLAARLRLALRERGIPLWLDSPMVE

SEQ ID NO: 861563 - protein, 20 aa, Mycobacterium
SLACALVCHPTLLVLDEPTV

SEQ ID NO: 861564 - protein, 18 aa, Mycobacterium
SLADELMRRFNGATLETL

SEQ ID NO: 861565 - protein, 25 aa, Mycobacterium
SLADPLAFLLRKEGFETTVVTDGPS

SEQ ID NO: 861566 - protein, 20 aa, Mycobacterium
SLADSACRYLRRWHRRRALW

SEQ ID NO: 861567 - protein, 22 aa, Mycobacterium
SLAEELVRIIGVLRNMQLKKVP

SEQ ID NO: 861568 - protein, 20 aa, Mycobacterium
SLAEIPHPALPKGSSIYGGT

SEQ ID NO: 861569 - protein, 19 aa, Mycobacterium
SLAELWEPAARMAENGLAC

SEQ ID NO: 861570 - protein, 19 aa, Mycobacterium
SLAFDYSVWEIWGPLLNGG

SEQ ID NO: 861571 - protein, 26 aa, Mycobacterium
SLAGAQLLGTLLRCPGCRTDFDVVQA

SEQ ID NO: 861572 - protein, 20 aa, Mycobacterium
SLAGEFLVHGRIVYAAGPIG

SEQ ID NO: 861573 - protein, 21 aa, Mycobacterium
SLAGLDPLAFPGLDPAGAPAD

SEQ ID NO: 861574 - protein, 18 aa, Mycobacterium
SLAGLPPLSGGMVGFLAY

SEQ ID NO: 861575 - protein, 33 aa, Mycobacterium
SLAGQSRWPEMMWLEFLFDRLGGPEVFEAAYEG

SEQ ID NO: 861576 - protein, 17 aa, Mycobacterium
SLAGRRPVVVFASGSRA

SEQ ID NO: 861577 - protein, 18 aa, Mycobacterium
SLAGVHPVDLGAAAWRGL

SEQ ID NO: 861578 - protein, 29 aa, Mycobacterium
SLAGVHPVDLGALGWRGLLDRVDVDPAAV

SEQ ID NO: 861579 - protein, 24 aa, Mycobacterium
SLAGWTKRLTGLPAVAVGSVGLQT

SEQ ID NO: 861580 - protein, 24 aa, Mycobacterium
SLAHGAASFTRRFARYEPMPESAA

SEQ ID NO: 861581 - protein, 17 aa, Mycobacterium
SLAIRGTLALFGAASGP

SEQ ID NO: 861582 - protein, 20 aa, Mycobacterium
SLAKAVLPIMNPGGGIVGMD

SEQ ID NO: 861583 - protein, 23 aa, Mycobacterium
SLAKAVLPIMNPGGGIVGMDFDP

SEQ ID NO: 861584 - protein, 25 aa, Mycobacterium
SLAKQYLSYFQGALAEWSAPDPRLA

SEQ ID NO: 861585 - protein, 19 aa, Mycobacterium
SLALACDLVLASESAYFLL

SEQ ID NO: 861586 - protein, 28 aa, Mycobacterium
SLALGDHLIAHPASWRLLAGSVTLPDPQ

SEQ ID NO: 861587 - protein, 21 aa, Mycobacterium
SLALLDGLPLRYETARVNFAY

SEQ ID NO: 861588 - protein, 17 aa, Mycobacterium
SLALRGVRRVFLVDGEL

SEQ ID NO: 861589 - protein, 18 aa, Mycobacterium
SLAMLRHPEQWKLLGQNA

SEQ ID NO: 861590 - protein, 19 aa, Mycobacterium
SLAPVAAALSEQLGRHVQL

SEQ ID NO: 861591 - protein, 24 aa, Mycobacterium
SLAPVAYTLFQRQLRHDPSDTTWI

SEQ ID NO: 861592 - protein, 19 aa, Mycobacterium
SLAPVGAALGEKLGRHVQL

SEQ ID NO: 861593 - protein, 29 aa, Mycobacterium
SLAQLWAQATAWEPVLPETLRLLQVGGAK

SEQ ID NO: 861594 - protein, 23 aa, Mycobacterium
SLAQYMLEVLRRWPELRADMDAT

SEQ ID NO: 861595 - protein, 33 aa, Mycobacterium
SLARAVYDQLPAYALPLFVRLVQAMAHTTTFKS

SEQ ID NO: 861596 - protein, 29 aa, Mycobacterium
SLARAVYDQLPAYALPLFVRVVESLEHTT

SEQ ID NO: 861597 - protein, 20 aa, Mycobacterium
SLARLGMFAPAMSYLEDPAG

SEQ ID NO: 861598 - protein, 20 aa, Mycobacterium
SLARYKLPKAIVFRAAIERS

SEQ ID NO: 861599 - protein, 20 aa, Mycobacterium
SLASLPGRHLLVSPDAMRRD

SEQ ID NO: 861600 - protein, 17 aa, Mycobacterium
SLATGWASIHGFPVGIL

SEQ ID NO: 861601 - protein, 19 aa, Mycobacterium
SLATWLNNLNSTPLAKIAA

SEQ ID NO: 861602 - protein, 17 aa, Mycobacterium
SLAVGGFGLCGIPEALI

SEQ ID NO: 861603 - protein, 23 aa, Mycobacterium
SLAVPTWHYGCEPLTPLATHVAK

SEQ ID NO: 861604 - protein, 19 aa, Mycobacterium
SLAWGYWQNSGIAAHLDTL

SEQ ID NO: 861605 - protein, 17 aa, Mycobacterium
SLAWRGRRAAEQLSGAV

SEQ ID NO: 861606 - protein, 20 aa, Mycobacterium
SLAYFNANEGALALLRGELD

SEQ ID NO: 861607 - protein, 18 aa, Mycobacterium
SLAYNDRCAGRRPTWSPL

SEQ ID NO: 861608 - protein, 24 aa, Mycobacterium
SLAYQFGLEWGAQRSRDFRFAVID

SEQ ID NO: 861609 - protein, 20 aa, Mycobacterium
SLCFVGTTIIPLAGGPEATR

SEQ ID NO: 861610 - protein, 27 aa, Mycobacterium
SLCVLDERWPFAYLQVYADAAVEDDRD

SEQ ID NO: 861611 - protein, 28 aa, Mycobacterium
SLCVLDERWPFTYLQVYADAMLDPDREL

SEQ ID NO: 861612 - protein, 26 aa, Mycobacterium
SLCYEMPLILNTPTFTICCATLLDTA

SEQ ID NO: 861613 - protein, 22 aa, Mycobacterium
SLDAEGFFHTGDLGRWVDGQYL

SEQ ID NO: 861614 - protein, 30 aa, Mycobacterium
SLDALALDTLALLAARWLEVARPLAERFPD

SEQ ID NO: 861615 - protein, 25 aa, Mycobacterium
SLDALELEALTWQNARTLATMVGKC

SEQ ID NO: 861616 - protein, 21 aa, Mycobacterium
SLDALPVANPLPAPRISPFPA

SEQ ID NO: 861617 - protein, 19 aa, Mycobacterium
SLDAQYWRRHSRQPVQFAE

SEQ ID NO: 861618 - protein, 23 aa, Mycobacterium
SLDARLRELVILRIGWITGSEYE

SEQ ID NO: 861619 - protein, 18 aa, Mycobacterium
SLDDGAVDRRDGRAMLGR

SEQ ID NO: 861620 - protein, 36 aa, Mycobacterium
SLDDLAERPGLSLTLDEACLLMFPRRELSAEEADAT

SEQ ID NO: 861621 - protein, 39 aa, Mycobacterium
SLDEADLAAWQRAWDLKVWGYLELSQLALKAMRSRRSGV

SEQ ID NO: 861622 - protein, 20 aa, Mycobacterium
SLDFFFRKIVRDHGQALQFV

SEQ ID NO: 861623 - protein, 22 aa, Mycobacterium
SLDFYRMAVLPEMENLDGFCSA

SEQ ID NO: 861624 - protein, 19 aa, Mycobacterium
SLDGAWAANPAPFLHQLIA

SEQ ID NO: 861625 - protein, 46 aa, Mycobacterium
SLDILGPDDLNFLWLPLAHAFGKVMLALPLQIGFPTAIDGRVERII

SEQ ID NO: 861626 - protein, 31 aa, Mycobacterium
SLDISPLQARCGWAIGWKKDAFWGRDALLAE

SEQ ID NO: 861627 - protein, 17 aa, Mycobacterium
SLDLAKHRRLLGEWLAT

SEQ ID NO: 861628 - protein, 23 aa, Mycobacterium
SLDPQGLPLRLLTDAAGDPVLVE

SEQ ID NO: 861629 - protein, 26 aa, Mycobacterium
SLDQQREWILHMAKLSAALAKQAQYI

SEQ ID NO: 861630 - protein, 27 aa, Mycobacterium
SLDREIGLLLPCNVLVRADPGEPGTVI

SEQ ID NO: 861631 - protein, 25 aa, Mycobacterium
SLDRRDFNMKTRAAVLWGLEQKWEV

SEQ ID NO: 861632 - protein, 24 aa, Mycobacterium
SLDRSLDVFLLHRGFRKLHDNGSA

SEQ ID NO: 861633 - protein, 27 aa, Mycobacterium
SLDSLVTALTTLWLITGNGAAEVARHR

SEQ ID NO: 861634 - protein, 30 aa, Mycobacterium
SLDTRWSGPLYSFGLFRTEASQFYLHFCVH

SEQ ID NO: 861635 - protein, 23 aa, Mycobacterium
SLDVEYFGVMWPNNSAVGATYGG

SEQ ID NO: 861636 - protein, 24 aa, Mycobacterium
SLDVQYFGVMWPNNSAVGASYGAI

SEQ ID NO: 861637 - protein, 27 aa, Mycobacterium
SLDVRAFKLWAALSGLVPRIAVVRGRC

SEQ ID NO: 861638 - protein, 20 aa, Mycobacterium
SLDWLVSKFAREVSGVSHAV

SEQ ID NO: 861639 - protein, 19 aa, Mycobacterium
SLDYPFNPVSLALGAEATF

SEQ ID NO: 861640 - protein, 31 aa, Mycobacterium; identical to SEQ ID NO: 132128

SEQ ID NO: 861641 - protein, 20 aa, Mycobacterium
SLEALVRRNGPLDWGEVVRL

SEQ ID NO: 861642 - protein, 26 aa, Mycobacterium
SLEAWFMHIPGMKVIVPSTPRDGKGL

SEQ ID NO: 861643 - protein, 17 aa, Mycobacterium
SLEDAPQAWREQQSGPH

SEQ ID NO: 861644 - protein, 24 aa, Mycobacterium
SLEDGALLMAERGRLFGSLPSGGR

SEQ ID NO: 861645 - protein, 28 aa, Mycobacterium
SLEDLLSFPAVKLLVRKAGARSSEMAEV

SEQ ID NO: 861646 - protein, 20 aa, Mycobacterium
SLEDRGFGYDGLFDDYTVAH

SEQ ID NO: 861647 - protein, 18 aa, Mycobacterium
SLEERAAWLYSKAAQHVS

SEQ ID NO: 861648 - protein, 19 aa, Mycobacterium
SLEHGFAYDWWRDRGRALE

SEQ ID NO: 861649 - protein, 17 aa, Mycobacterium
SLEIARREADLGRPLIQ

SEQ ID NO: 861650 - protein, 17 aa, Mycobacterium
SLELEYFGSMWPNNSAV

SEQ ID NO: 861651 - protein, 32 aa, Mycobacterium
SLELGPWLINWVPFGYLISDQILIWYPNFVLP

SEQ ID NO: 861652 - protein, 25 aa, Mycobacterium
SLEMRDLMNPALNPTPPLPTELGFT

SEQ ID NO: 861653 - protein, 21 aa, Mycobacterium
SLEPELLEFLLATSITERTCG

SEQ ID NO: 861654 - protein, 40 aa, Mycobacterium
SLEPGKLADIVLWEPKFFGIRPEVVFKGGFPAWSVMGEAN

SEQ ID NO: 861655 - protein, 18 aa, Mycobacterium
SLEPGREYLIKHTTRTTR

SEQ ID NO: 861656 - protein, 23 aa, Mycobacterium
SLEPRHLVLPMFVADGLDEPRDI

SEQ ID NO: 861657 - protein, 21 aa, Mycobacterium
SLEPRWFAWVDDMHDWCISRQ

SEQ ID NO: 861658 - protein, 20 aa, Mycobacterium
SLEPRWFAWVDNMHDWCISR

SEQ ID NO: 861659 - protein, 20 aa, Mycobacterium
SLEPRWFTWVDDMHDWCISR

SEQ ID NO: 861660 - protein, 19 aa, Mycobacterium
SLEPVAAALGEQLGRHVQL

SEQ ID NO: 861661 - protein, 24 aa, Mycobacterium
SLEPWYAHVPGIKVLAPATVEDAY

SEQ ID NO: 861662 - protein, 25 aa, Mycobacterium
SLEQIWLRYRASVAHGLMTWLATAS

SEQ ID NO: 861663 - protein, 18 aa, Mycobacterium
SLEQLSRHPLISLPAGTG

SEQ ID NO: 861664 - protein, 21 aa, Mycobacterium
SLEQPWCATLARHLGHFDVGP

SEQ ID NO: 861665 - protein, 18 aa, Mycobacterium
SLEQVIWQNPATGARIGV

SEQ ID NO: 861666 - protein, 17 aa, Mycobacterium
SLERIRAVRRTAKERVF

SEQ ID NO: 861667 - protein, 23 aa, Mycobacterium
SLERNVLLTVLSRLGAGSRVVLT

SEQ ID NO: 861668 - protein, 24 aa, Mycobacterium
SLERNVLLTVLSRLGAGSRVVLTH

SEQ ID NO: 861669 - protein, 20 aa, Mycobacterium
SLESLGPIFAELRGAGRELL

SEQ ID NO: 861670 - protein, 19 aa, Mycobacterium
SLEVIDLRSLIPLDFETIA

SEQ ID NO: 861671 - protein, 21 aa, Mycobacterium
SLEVLDYLLRSGVSGKRIAVQ

SEQ ID NO: 861672 - protein, 23 aa, Mycobacterium
SLEVPFALDFPSTYRLARRHNTP

SEQ ID NO: 861673 - protein, 20 aa, Mycobacterium
SLEVRIRLLRDRIHQGWILT

SEQ ID NO: 861674 - protein, 24 aa, Mycobacterium
SLFARGFLLTKRDIDWFHSQYLKG

SEQ ID NO: 861675 - protein, 19 aa, Mycobacterium
SLFERFPELALAADPTPGK

SEQ ID NO: 861676 - protein, 17 aa, Mycobacterium
SLFGDPFACRFSLRDND

SEQ ID NO: 861677 - protein, 25 aa, Mycobacterium
SLFGHQLRYDLSAGFPLLTTKKVHL

SEQ ID NO: 861678 - protein, 19 aa, Mycobacterium
SLFGHQMRYDLNAGFPLIT

SEQ ID NO: 861679 - protein, 26 aa, Mycobacterium
SLFGQQIRYDLSAGFPLLTTKKVHFK

SEQ ID NO: 861680 - protein, 26 aa, Mycobacterium
SLFGRQLRYDLSAGFPLLTTKKVHLK

SEQ ID NO: 861681 - protein, 17 aa, Mycobacterium
SLFHHFTAKQEIFRTLV

SEQ ID NO: 861682 - protein, 19 aa, Mycobacterium
SLFRLALEQAPPGSVLHAV

SEQ ID NO: 861683 - protein, 19 aa, Mycobacterium
SLFRPRGNLSQALDAALSS

SEQ ID NO: 861684 - protein, 35 aa, Mycobacterium
SLFSDPGLDNAFRRRWFGWINPAQTMVAYAQSVTA

SEQ ID NO: 861685 - protein, 35 aa, Mycobacterium
SLFSDSGLDNAFRRRWFGWINPAQTMVAYAQSVTA

SEQ ID NO: 861686 - protein, 17 aa, Mycobacterium
SLFTRHLSDIPAVAPDL

SEQ ID NO: 861687 - protein, 21 aa, Mycobacterium
SLFVCRKRYIDDQLAASSIDA

SEQ ID NO: 861688 - protein, 25 aa, Mycobacterium
SLGAELWRYLGDATPLKFGSINAPA

SEQ ID NO: 861689 - protein, 23 aa, Mycobacterium
SLGAFAAWLRDLLDELGIRSVTV

SEQ ID NO: 861690 - protein, 24 aa, Mycobacterium
SLGAGLPAPLRWVNRKTHPGLLHP

SEQ ID NO: 861691 - protein, 22 aa, Mycobacterium
SLGARLIVPKPGAFADIPYVAD

SEQ ID NO: 861692 - protein, 20 aa, Mycobacterium
SLGARRGVLLCGPPGTGKSA

SEQ ID NO: 861693 - protein, 19 aa, Mycobacterium
SLGDELMRRFNGAALEAML

SEQ ID NO: 861694 - protein, 24 aa, Mycobacterium
SLGDELMRRFNGAALESLLTRLNL

SEQ ID NO: 861695 - protein, 18 aa, Mycobacterium
SLGDELMRRFNGATLETL

SEQ ID NO: 861696 - protein, 19 aa, Mycobacterium
SLGENLPAPLRWLERRTRD

SEQ ID NO: 861697 - protein, 18 aa, Mycobacterium
SLGEWDAALASVAHGRRL

SEQ ID NO: 861698 - protein, 18 aa, Mycobacterium
SLGGLGAKGTWVPAVDTG

SEQ ID NO: 861699 - protein, 22 aa, Mycobacterium
SLGGSFPQLVAALTGGLNGVIQ

SEQ ID NO: 861700 - protein, 24 aa, Mycobacterium
SLGGWIALGLALRGRARSVTAIAP

SEQ ID NO: 861701 - protein, 24 aa, Mycobacterium
SLGHAQWLIFGPDPKLPAGQQHPP

SEQ ID NO: 861702 - protein, 17 aa, Mycobacterium
SLGHFPQSFEYATIGGF

SEQ ID NO: 861703 - protein, 22 aa, Mycobacterium
SLGIKSIRVWRRLRADRAAQQI

SEQ ID NO: 861704 - protein, 28 aa, Mycobacterium
SLGITLPVALVWAYPTITDLATALCERM

SEQ ID NO: 861705 - protein, 22 aa, Mycobacterium
SLGLCAVAILRALYPDVAVAVV

SEQ ID NO: 861706 - protein, 26 aa, Mycobacterium
SLGLFARGFLLTKRDIDWFESQYLRG

SEQ ID NO: 861707 - protein, 23 aa, Mycobacterium
SLGLGMLYYEDGTWVLTTFGVAN

SEQ ID NO: 861708 - protein, 20 aa, Mycobacterium
SLGLKAFLMPISPGIDDNGH

SEQ ID NO: 861709 - protein, 19 aa, Mycobacterium
SLGLKTFLLPLNPGKDDEG

SEQ ID NO: 861710 - protein, 20 aa, Mycobacterium
SLGLKTFLMPLNPGKDDDGN

SEQ ID NO: 861711 - protein, 19 aa, Mycobacterium
SLGLKTFLMPLNPGKGDDG

SEQ ID NO: 861712 - protein, 19 aa, Mycobacterium
SLGLLDDFPPYDSVFDPVN

SEQ ID NO: 861713 - protein, 23 aa, Mycobacterium
SLGLLDEFPPYDDIFDPVNRVLL

SEQ ID NO: 861714 - protein, 23 aa, Mycobacterium
SLGLPIFGDPLYPNVIPESPHDL

SEQ ID NO: 861715 - protein, 17 aa, Mycobacterium
SLGLRPLDVGGLHMAHW

SEQ ID NO: 861716 - protein, 18 aa, Mycobacterium
SLGLTTFLMPISPGNDRD

SEQ ID NO: 861717 - protein, 27 aa, Mycobacterium
SLGLVQLTRKKLGTGLIEAFSSTCTHC

SEQ ID NO: 861718 - protein, 25 aa, Mycobacterium
SLGLVQLTRKRLGTGLIEAFSTSCT

SEQ ID NO: 861719 - protein, 19 aa, Mycobacterium
SLGNLLFALLSDTAQLDAV

SEQ ID NO: 861720 - protein, 22 aa, Mycobacterium
SLGPAIYRAVAKHDPAGAVLVM

SEQ ID NO: 861721 - protein, 29 aa, Mycobacterium
SLGQRPVAGPVPLWTWSLLHRRDDDRASV

SEQ ID NO: 861722 - protein, 26 aa, Mycobacterium
SLGRNPIPLLVPCHRVLAADRSLHGF

SEQ ID NO: 861723 - protein, 23 aa, Mycobacterium
SLGRSFPLVGVSGGPTTSAVAAV

SEQ ID NO: 861724 - protein, 21 aa, Mycobacterium
SLGRYVFYPRTLAPGTLADDL

SEQ ID NO: 861725 - protein, 32 aa, Mycobacterium
SLGSQMAAFHDDFVRILASGSNLYATAEATNA

SEQ ID NO: 861726 - protein, 26 aa, Mycobacterium
SLGTALARLGMFAPALSYLEEPEGPV

SEQ ID NO: 861727 - protein, 20 aa, Mycobacterium
SLGTGLLRIAAMGLPVVATV

SEQ ID NO: 861728 - protein, 20 aa, Mycobacterium
SLGVIAGRIAYTLDLAGPAV

SEQ ID NO: 861729 - protein, 21 aa, Mycobacterium
SLGVSALPRPGETVLASSMTQ

SEQ ID NO: 861730 - protein, 20 aa, Mycobacterium
SLGVVGVLAVELFETVDGGL

SEQ ID NO: 861731 - protein, 21 aa, Mycobacterium
SLGVYPVDYPATTDFPRAADG

SEQ ID NO: 861732 - protein, 17 aa, Mycobacterium
SLGWGLWDQASNMTGGL

SEQ ID NO: 861733 - protein, 25 aa, Mycobacterium
SLGWSSWAIQWLSRIPAGAPELTDH

SEQ ID NO: 861734 - protein, 36 aa, Mycobacterium
SLGYDAIVMFLDELVLWLAFRVRDAEFFGREAQKIT

SEQ ID NO: 861735 - protein, 22 aa, Mycobacterium
SLHAGHLVPLLALRRFQRAGHR

SEQ ID NO: 861736 - protein, 28 aa, Mycobacterium
SLHAGHLVPLLTLRRFQQAGHRPIVLAG

SEQ ID NO: 861737 - protein, 22 aa, Mycobacterium
SLHAGHLVPLLTLRRFQRAGHR

SEQ ID NO: 861738 - protein, 25 aa, Mycobacterium
SLHALDLLLGAWPTKHRTVACLPGE

SEQ ID NO: 861739 - protein, 25 aa, Mycobacterium
SLHALDLLLGSWPRESRTLACLPGE

SEQ ID NO: 861740 - protein, 19 aa, Mycobacterium
SLHDALLVTYHRARLQATT

SEQ ID NO: 861741 - protein, 19 aa, Mycobacterium
SLHDSAIAVLRRFGKSDYL

SEQ ID NO: 861742 - protein, 26 aa, Mycobacterium
SLHFDTPSPHIPWDSLPVRVVDTAMP

SEQ ID NO: 861743 - protein, 23 aa, Mycobacterium
SLHGQFLSRALLAIMEESSLMVA

SEQ ID NO: 861744 - protein, 18 aa, Mycobacterium
SLHLVHDWNREFVRTSPA

SEQ ID NO: 861745 - protein, 27 aa, Mycobacterium
SLHNSQPWRWIAVGPTLQLWADSSRSM

SEQ ID NO: 861746 - protein, 26 aa, Mycobacterium
SLHNSQPWRWVADGTRLHLWADPRHA

SEQ ID NO: 861747 - protein, 19 aa, Mycobacterium
SLHNSQPWRWVATDHGVDL

SEQ ID NO: 861748 - protein, 23 aa, Mycobacterium
SLHNTQPWRWIVDLGASAGDLHL

SEQ ID NO: 861749 - protein, 24 aa, Mycobacterium
SLHPDLVPPLARLIGEAATRTQLV

SEQ ID NO: 861750 - protein, 22 aa, Mycobacterium
SLHPRWLADLRARAYRQSRDGR

SEQ ID NO: 861751 - protein, 24 aa, Mycobacterium
SLHRPTPCATLAAWLNTQTGILSE

SEQ ID NO: 861752 - protein, 17 aa, Mycobacterium
SLHTAPWLRDHDIAAVA

SEQ ID NO: 861753 - protein, 19 aa, Mycobacterium
SLHVKATMMKISHPIVFGH

SEQ ID NO: 861754 - protein, 20 aa, Mycobacterium
SLIAAGRAWARFEQGQVVFK

SEQ ID NO: 861755 - protein, 17 aa, Mycobacterium
SLIDAFLETSLVELALA

SEQ ID NO: 861756 - protein, 17 aa, Mycobacterium
SLIGAWCFIDHYGPASA

SEQ ID NO: 861757 - protein, 17 aa, Mycobacterium
SLIGIFTVAPRPEQEAQ

SEQ ID NO: 861758 - protein, 18 aa, Mycobacterium
SLIGRLVPRPIRDSLYRL

SEQ ID NO: 861759 - protein, 30 aa, Mycobacterium; identical to SEQ ID NO: 132138

SEQ ID NO: 861760 - protein, 18 aa, Mycobacterium
SLIRAGVITPIFKGAGTT

SEQ ID NO: 861761 - protein, 19 aa, Mycobacterium
SLIVTARREALLTELAARL

SEQ ID NO: 861762 - protein, 33 aa, Mycobacterium
SLKEIRHWLGVFVQRFYSFSQFKRSALPNGPKV

SEQ ID NO: 861763 - protein, 34 aa, Mycobacterium
SLKEIRHWLQVFAQRFYSFSQFKRSALPNGPKVS

SEQ ID NO: 861764 - protein, 30 aa, Mycobacterium
SLKEIRHWLQVFAQRFYSFSQFKRSAMPNG

SEQ ID NO: 861765 - protein, 33 aa, Mycobacterium; identical to SEQ ID NO: 117610

SEQ ID NO: 861766 - protein, 20 aa, Mycobacterium
SLKGFDSILKALAALLRGTP

SEQ ID NO: 861767 - protein, 19 aa, Mycobacterium
SLKGFLISGRWPDSTKEWA

SEQ ID NO: 861768 - protein, 22 aa, Mycobacterium
SLKIVGPVGPSWRKGPYNVRGR

SEQ ID NO: 861769 - protein, 17 aa, Mycobacterium
SLKPFDYLPRPLRRSMG

SEQ ID NO: 861770 - protein, 35 aa, Mycobacterium
SLKPGWRNRIGLHQLFPLLAHVVLFGGGYARQTHA

SEQ ID NO: 861771 - protein, 30 aa, Mycobacterium
SLKRQGEWVVPSRLALHRRMGSVDLDLTRA

SEQ ID NO: 861772 - protein, 26 aa, Mycobacterium
SLLADSRIPVYALTTGPRWPDVSGNS

SEQ ID NO: 861773 - protein, 17 aa, Mycobacterium
SLLAGAIGARRILEIGT

SEQ ID NO: 861774 - protein, 35 aa, Mycobacterium
SLLDEFIDRLWTGVPYQAIWFVQRRRQSAADHEAV

SEQ ID NO: 861775 - protein, 19 aa, Mycobacterium
SLLELGRYKRGELVVIVAG

SEQ ID NO: 861776 - protein, 17 aa, Mycobacterium
SLLEMLITNPRRVLTRS

SEQ ID NO: 861777 - protein, 20 aa, Mycobacterium
SLLEMTLYEKQIRGALYGSS

SEQ ID NO: 861778 - protein, 20 aa, Mycobacterium
SLLGGLPVRRLWGIGPVAEE

SEQ ID NO: 861779 - protein, 28 aa, Mycobacterium
SLLGGSYGWLAAMPTLVVGPVDLGPIGE

SEQ ID NO: 861780 - protein, 31 aa, Mycobacterium
SLLGLLIEHDLLDELCLTIAPVLVGGGAPRI

SEQ ID NO: 861781 - protein, 24 aa, Mycobacterium
SLLGRLMIYDALQMTYRTIAIRRD

SEQ ID NO: 861782 - protein, 21 aa, Mycobacterium
SLLGSLHVELAPPAAAPPQGR

SEQ ID NO: 861783 - protein, 19 aa, Mycobacterium
SLLHNIGYLSLSDLNWQSR

SEQ ID NO: 861784 - protein, 21 aa, Mycobacterium
SLLKVLLGELALSAGVALVDG

SEQ ID NO: 861785 - protein, 17 aa, Mycobacterium
SLLLCFTGITRDSARVI

SEQ ID NO: 861786 - protein, 21 aa, Mycobacterium
SLLLDFLRRSADVPIVLLHCY

SEQ ID NO: 861787 - protein, 18 aa, Mycobacterium
SLLMLDVAAAIAAGRPVF

SEQ ID NO: 861788 - protein, 24 aa, Mycobacterium
SLLNQYPHLLALSASSPFWDGEDT

SEQ ID NO: 861789 - protein, 19 aa, Mycobacterium
SLLPAPKFASYNGLLFVNL

SEQ ID NO: 861790 - protein, 27 aa, Mycobacterium
SLLRDHGLLLPIEPDTRLLSETELWQL

SEQ ID NO: 861791 - protein, 20 aa, Mycobacterium
SLLRGLVTRVPTLELAADVN

SEQ ID NO: 861792 - protein, 19 aa, Mycobacterium
SLLRRLVIMGGSYDHRGNT

SEQ ID NO: 861793 - protein, 17 aa, Mycobacterium
SLLSLIAGMDQPSAGEL

SEQ ID NO: 861794 - protein, 43 aa, Mycobacterium
SLLSQLIALVPQALQVLGIWPILPEEFTLLDAIFAMYATVGMT

SEQ ID NO: 861795 - protein, 24 aa, Mycobacterium
SLLTRLVEALPPDAALLVTADHGG

SEQ ID NO: 861796 - protein, 24 aa, Mycobacterium
SLLVDTLFDLALTREMLDAMKPIT

SEQ ID NO: 861797 - protein, 22 aa, Mycobacterium
SLLVDTLFDLALTREMLDAMRP

SEQ ID NO: 861798 - protein, 18 aa, Mycobacterium
SLLVDTLFDLALTREMLS

SEQ ID NO: 861799 - protein, 22 aa, Mycobacterium
SLLVDTLFDLALTREMLTAMRP

SEQ ID NO: 861800 - protein, 17 aa, Mycobacterium
SLLVRRLRAARPGDAVL

SEQ ID NO: 861801 - protein, 17 aa, Mycobacterium
SLLVTGVTYRYPGLLAK

SEQ ID NO: 861802 - protein, 19 aa, Mycobacterium
SLMEVLTATWPYEPPAITV

SEQ ID NO: 861803 - protein, 19 aa, Mycobacterium
SLMFPTLASLIEERLRDDP

SEQ ID NO: 861804 - protein, 25 aa, Mycobacterium
SLMGAAAAPYVAWLGATATRAELAA

SEQ ID NO: 861805 - protein, 19 aa, Mycobacterium
SLMKWTDDEWHRVLDLNLS

SEQ ID NO: 861806 - protein, 30 aa, Mycobacterium
SLMPYRFDGGLWWLRARLTTPIDGSGLSVD

SEQ ID NO: 861807 - protein, 19 aa, Mycobacterium
SLMSTLLRIADRAGSNLFE

SEQ ID NO: 861808 - protein, 18 aa, Mycobacterium
SLMVKAGVQWGLFGGAIE

SEQ ID NO: 861809 - protein, 19 aa, Mycobacterium
SLMVKAGVQWGLFGGAIEN

SEQ ID NO: 861810 - protein, 18 aa, Mycobacterium
SLMVKAGVQWGLFGGAVE

SEQ ID NO: 861811 - protein, 23 aa, Mycobacterium
SLNAGRFPDIRFTASEIDKTEDG

SEQ ID NO: 861812 - protein, 25 aa, Mycobacterium
SLNDTRVFYVEPAKWVAALRHAQKD

SEQ ID NO: 861813 - protein, 27 aa, Mycobacterium
SLNEGIGPVIYLVPDRYLITQVVDTAE

SEQ ID NO: 861814 - protein, 27 aa, Mycobacterium
SLNELVTRYWTLMSRVYNFPLVQRHIY

SEQ ID NO: 861815 - protein, 23 aa, Mycobacterium
SLNHTSFPYVFCDATFCKVRIGA

SEQ ID NO: 861816 - protein, 23 aa, Mycobacterium
SLNPNDWWIVQTLGSINSAQRVS

SEQ ID NO: 861817 - protein, 26 aa, Mycobacterium
SLNPVPVLVARRLPVPVLTTLHTPPF

SEQ ID NO: 861818 - protein, 19 aa, Mycobacterium
SLPAELLAHYLRAEAAVVD

SEQ ID NO: 861819 - protein, 34 aa, Mycobacterium
SLPAVAHFLDLLRGDPRLPEWRLMAARAVARRDE

SEQ ID NO: 861820 - protein, 24 aa, Mycobacterium
SLPAVLTQFPFLAPEDWNLPTGRF

SEQ ID NO: 861821 - protein, 19 aa, Mycobacterium
SLPEKFRPLPGRRNVVLTR

SEQ ID NO: 861822 - protein, 28 aa, Mycobacterium
SLPENELEFFFFVLAFAGSDTTKNALAI

SEQ ID NO: 861823 - protein, 30 aa, Mycobacterium
SLPFFGDLELELFRYGLKASLNGYLGAHPR

SEQ ID NO: 861824 - protein, 26 aa, Mycobacterium
SLPGEPPFVRGPYPTMYVNQPWTIRQ

SEQ ID NO: 861825 - protein, 17 aa, Mycobacterium
SLPGFRAVTGPLLRTAE

SEQ ID NO: 861826 - protein, 19 aa, Mycobacterium
SLPGLLTILHDGGYHDTEI

SEQ ID NO: 861827 - protein, 22 aa, Mycobacterium
SLPGWLAYRDALAGAGADFPAS

SEQ ID NO: 861828 - protein, 19 aa, Mycobacterium
SLPHAVLMMIPEAWERHED

SEQ ID NO: 861829 - protein, 31 aa, Mycobacterium
SLPHNDDGLWFFLNEVWPLVLARTPDAHLNV

SEQ ID NO: 861830 - protein, 21 aa, Mycobacterium
SLPIVDTWWQTETGATMISPL

SEQ ID NO: 861831 - protein, 27 aa, Mycobacterium
SLPLDQRYPLWGIWVLEGLSDGNVAIF

SEQ ID NO: 861832 - protein, 17 aa, Mycobacterium
SLPLFGADWTRTADLPT

SEQ ID NO: 861833 - protein, 29 aa, Mycobacterium
SLPLHNRILLPERGLPGRAWIPSLGMCDV

SEQ ID NO: 861834 - protein, 27 aa, Mycobacterium
SLPLVLVVHGGPWFRDSWGFDGHVQLL

SEQ ID NO: 861835 - protein, 20 aa, Mycobacterium
SLPPAYDITALLAAHPSSVN

SEQ ID NO: 861836 - protein, 31 aa, Mycobacterium
SLPPGRLGWGWAKFAFTGWKTLSWVDANVWR

SEQ ID NO: 861837 - protein, 17 aa, Mycobacterium
SLPPPVPMSGRFIYAGL

SEQ ID NO: 861838 - protein, 17 aa, Mycobacterium
SLPPQIVRLTGITSAML

SEQ ID NO: 861839 - protein, 20 aa, Mycobacterium
SLPQLVAALNGGLNGLIQTG

SEQ ID NO: 861840 - protein, 27 aa, Mycobacterium
SLPQTMWIEPLWKALLSNKAILAVLWQ

SEQ ID NO: 861841 - protein, 25 aa, Mycobacterium
SLPRGALLQIALGERPPLERVLNGP

SEQ ID NO: 861842 - protein, 22 aa, Mycobacterium
SLPSMPVEDYPALPSLPEETGA

SEQ ID NO: 861843 - protein, 19 aa, Mycobacterium
SLPSVLPTALRELIRYVRP

SEQ ID NO: 861844 - protein, 25 aa, Mycobacterium
SLPTVPAPVPPLYFGGSSAAAGPVA

SEQ ID NO: 861845 - protein, 17 aa, Mycobacterium
SLPVEYYPTGRLNFVDT

SEQ ID NO: 861846 - protein, 21 aa, Mycobacterium
SLPVQYIDYALWQHEYLGDLA

SEQ ID NO: 861847 - protein, 17 aa, Mycobacterium
SLQAAAFHERFVQTLFG

SEQ ID NO: 861848 - protein, 19 aa, Mycobacterium
SLQAEGIEFLFGLPSPEID

SEQ ID NO: 861849 - protein, 20 aa, Mycobacterium
SLQALLPPEQRARPGARAAL

SEQ ID NO: 861850 - protein, 24 aa, Mycobacterium
SLQANAFQAQFIQAINGAGGAYAA

SEQ ID NO: 861851 - protein, 18 aa, Mycobacterium
SLQGWLTDHAVSGAVVFP

SEQ ID NO: 861852 - protein, 26 aa, Mycobacterium
SLQHGAVPPMLHFTQLPDGLAGINTK

SEQ ID NO: 861853 - protein, 25 aa, Mycobacterium
SLQKLRIIKRFSEDLDLLVLGEFPN

SEQ ID NO: 861854 - protein, 28 aa, Mycobacterium
SLQLTVQVRIPLIGGKLERMIGTELSQL

SEQ ID NO: 861855 - protein, 28 aa, Mycobacterium
SLQVTIQVRIPLIGGKLESIIGSELRQL

SEQ ID NO: 861856 - protein, 23 aa, Mycobacterium
SLRAAEAFARMWDMGVAESISLQ

SEQ ID NO: 861857 - protein, 17 aa, Mycobacterium
SLRAAFRRYAETHQGAV

SEQ ID NO: 861858 - protein, 21 aa, Mycobacterium
SLRAFLLEQRLDADQLQVVLT

SEQ ID NO: 861859 - protein, 33 aa, Mycobacterium
SLRAFYQHFASKDELLLALFDRTIAQSVQAWRA

SEQ ID NO: 861860 - protein, 21 aa, Mycobacterium
SLRAFYQHFGSKDELLLALFD

SEQ ID NO: 861861 - protein, 21 aa, Mycobacterium
SLRAFYQHFSSKDELLLALFD

SEQ ID NO: 861862 - protein, 26 aa, Mycobacterium
SLRAFYQHFSSKDELLLALFDRTIAQ

SEQ ID NO: 861863 - protein, 32 aa, Mycobacterium
SLRAQRYYWYDRNAFWRITAALFDFDPASAYD

SEQ ID NO: 861864 - protein, 17 aa, Mycobacterium
SLRARFGTLTGVDRPVA

SEQ ID NO: 861865 - protein, 24 aa, Mycobacterium
SLRARVAQWFPPRRYLPRTSRTTA

SEQ ID NO: 861866 - protein, 26 aa, Mycobacterium
SLRDMVLFIGHPARWADWGSLEYSVR

SEQ ID NO: 861867 - protein, 24 aa, Mycobacterium
SLRERLSLLIRWTCVPDGGTDDIP

SEQ ID NO: 861868 - protein, 17 aa, Mycobacterium
SLRGGGLVAPAIHDVPE

SEQ ID NO: 861869 - protein, 23 aa, Mycobacterium
SLRGHKWFTSAPMCDVFLVLAQA

SEQ ID NO: 861870 - protein, 23 aa, Mycobacterium
SLRGLLKFRAGVREPIPLEEVEP

SEQ ID NO: 861871 - protein, 23 aa, Mycobacterium
SLRGLLKFRAGVRPPIPLDEVEP

SEQ ID NO: 861872 - protein, 23 aa, Mycobacterium
SLRGLLKFRAGVRPPVPLEEVEP

SEQ ID NO: 861873 - protein, 21 aa, Mycobacterium
SLRHAEILVALALSPQGRSAP

SEQ ID NO: 861874 - protein, 17 aa, Mycobacterium
SLRHDWSLTLRTAEAMA

SEQ ID NO: 861875 - protein, 19 aa, Mycobacterium
SLRIPRPRLCTDNGAMIAA

SEQ ID NO: 861876 - protein, 18 aa, Mycobacterium
SLRKASVNRQLAEAAAEH

SEQ ID NO: 861877 - protein, 19 aa, Mycobacterium
SLRLLTQYTSAMDVGYRGS

SEQ ID NO: 861878 - protein, 22 aa, Mycobacterium
SLRMLRRTLSLEMAYRPGGVLA

SEQ ID NO: 861879 - protein, 18 aa, Mycobacterium
SLRPAPDTMTYLTALLPV

SEQ ID NO: 861880 - protein, 25 aa, Mycobacterium
SLRPEPFGALLYHFGTRKLSFLKNR

SEQ ID NO: 861881 - protein, 17 aa, Mycobacterium
SLRPFDYLPRPLRRSMG

SEQ ID NO: 861882 - protein, 19 aa, Mycobacterium
SLRPHLMSVAYRLTGTIAD

SEQ ID NO: 861883 - protein, 21 aa, Mycobacterium
SLRPIQKVLRGPLGPIAARLV

SEQ ID NO: 861884 - protein, 22 aa, Mycobacterium
SLRPTPDIIPYAAAKAGLNAMT

SEQ ID NO: 861885 - protein, 22 aa, Mycobacterium
SLRPTPDIIPYAASKAGLNAMT

SEQ ID NO: 861886 - protein, 17 aa, Mycobacterium
SLRQFVQHNPIYATPYI

SEQ ID NO: 861887 - protein, 20 aa, Mycobacterium
SLRQKDPAVTARRRLRMICH

SEQ ID NO: 861888 - protein, 24 aa, Mycobacterium
SLRQKNPAVTARRKLRMICHGIGR

SEQ ID NO: 861889 - protein, 20 aa, Mycobacterium
SLRQKNPAVTARRRLRMICH

SEQ ID NO: 861890 - protein, 31 aa, Mycobacterium
SLRRDGVTAPVLSWLHPPGTDFTPAVQADIE

SEQ ID NO: 861891 - protein, 31 aa, Mycobacterium
SLRRLQTDYIDLYWLHIWDANTPIEETMAAL

SEQ ID NO: 861892 - protein, 23 aa, Mycobacterium
SLRRQHNWLLEQVSFIAAIEHYT

SEQ ID NO: 861893 - protein, 27 aa, Mycobacterium
SLRRQRDLSVLLLLDISGSAAEPGTVG

SEQ ID NO: 861894 - protein, 25 aa, Mycobacterium
SLRRRRDLSVLLLLDVSGSAGEPGT

SEQ ID NO: 861895 - protein, 24 aa, Mycobacterium
SLRRVVPHALSMLRGFNLMKQLED

SEQ ID NO: 861896 - protein, 31 aa, Mycobacterium
SLRSFYQHFSSKDELLLALIDRIMAESAQRW

SEQ ID NO: 861897 - protein, 20 aa, Mycobacterium
SLRSRLNSYFADISGLAPRT

SEQ ID NO: 861898 - protein, 20 aa, Mycobacterium
SLRSYVLPDEPLLSAPTVAE

SEQ ID NO: 861899 - protein, 21 aa, Mycobacterium
SLRTFYRHFASKHDLLFADYD

SEQ ID NO: 861900 - protein, 22 aa, Mycobacterium
SLRTFYRHFSSKHDLLFADYTG

SEQ ID NO: 861901 - protein, 17 aa, Mycobacterium
SLRTLVPMPVRSALLPY

SEQ ID NO: 861902 - protein, 46 aa, Mycobacterium
SLRTSGISRRGLLELAWPALPPDTFSTAAVLPPLALVSSHSDDLAH

SEQ ID NO: 861903 - protein, 24 aa, Mycobacterium
SLRTWPKDWPLQVIPRVSWADQRP

SEQ ID NO: 861904 - protein, 28 aa, Mycobacterium
SLRVEWWQSCRLPVNWKLATAAFMEGYH

SEQ ID NO: 861905 - protein, 19 aa, Mycobacterium
SLRVLRPTTQDLPALAAAG

SEQ ID NO: 861906 - protein, 20 aa, Mycobacterium
SLRVRAGRLASLLPDAKAVD

SEQ ID NO: 861907 - protein, 24 aa, Mycobacterium
SLRVVVLDARFAGYGASGRNGGWL

SEQ ID NO: 861908 - protein, 22 aa, Mycobacterium
SLSAIRLVGRVKAQLGFDVPVR

SEQ ID NO: 861909 - protein, 18 aa, Mycobacterium
SLSAQIEAARPWALRRPP

SEQ ID NO: 861910 - protein, 17 aa, Mycobacterium
SLSAVRWAATEAGLRHL

SEQ ID NO: 861911 - protein, 25 aa, Mycobacterium
SLSDNELLAFTTLARVFGYPSTAEA

SEQ ID NO: 861912 - protein, 25 aa, Mycobacterium
SLSDSLLALLPLVGVWRGEGEGRDA

SEQ ID NO: 861913 - protein, 33 aa, Mycobacterium
SLSEIRHWLMVFAQRFYSFSQFKRSALPNGPKV

SEQ ID NO: 861914 - protein, 17 aa, Mycobacterium
SLSFIERIPGLSAKYDP

SEQ ID NO: 861915 - protein, 23 aa, Mycobacterium
SLSFKLRHLLILEAKEVLLHDPF

SEQ ID NO: 861916 - protein, 18 aa, Mycobacterium
SLSFYRDQIGLAIFREYG

SEQ ID NO: 861917 - protein, 27 aa, Mycobacterium
SLSIHREWLLIELRTDWFYGANSYPAG

SEQ ID NO: 861918 - protein, 34 aa, Mycobacterium
SLSKLSSLAVPLNFAMYALNFLDKGIGFTKAATG

SEQ ID NO: 861919 - protein, 18 aa, Mycobacterium
SLSLAQGCTTRYSHGALA

SEQ ID NO: 861920 - protein, 18 aa, Mycobacterium
SLSLAVGIQLAPASKPAP

SEQ ID NO: 861921 - protein, 26 aa, Mycobacterium
SLSLFSRGFLLTKRDIDWFESQYLRR

SEQ ID NO: 861922 - protein, 24 aa, Mycobacterium
SLSMTPLTNWRIPGPELKFQEQWM

SEQ ID NO: 861923 - protein, 24 aa, Mycobacterium
SLSPAQVHAILRAQIDDRSAEADR

SEQ ID NO: 861924 - protein, 22 aa, Mycobacterium
SLSQLSLTALQAAVAAAVSSGA

SEQ ID NO: 861925 - protein, 26 aa, Mycobacterium
SLSSRYNLIGRPAVVAVRRGKARLVL

SEQ ID NO: 861926 - protein, 18 aa, Mycobacterium
SLSTGPIMQKRKLFTAGK

SEQ ID NO: 861927 - protein, 35 aa, Mycobacterium
SLSTLAPHLVKPLPFLFPLTSRWWERPYVAAGIFL

SEQ ID NO: 861928 - protein, 18 aa, Mycobacterium
SLSTMRLISAVNAALDTD

SEQ ID NO: 861929 - protein, 21 aa, Mycobacterium
SLSYGFFTPLTGFMGRQEVDG

SEQ ID NO: 861930 - protein, 18 aa, Mycobacterium
SLTASTLVTMSRARTIAA

SEQ ID NO: 861931 - protein, 30 aa, Mycobacterium
SLTAVAMLVAIFRARPSPFYVMDEVEAALD

SEQ ID NO: 861932 - protein, 24 aa, Mycobacterium
SLTDKYVVIYDLPVTFDPVQVMPT

SEQ ID NO: 861933 - protein, 24 aa, Mycobacterium
SLTDSYVVIYDLPVTFDPAQVLPV

SEQ ID NO: 861934 - protein, 26 aa, Mycobacterium
SLTDYLESLHRLRGLGRRAVLPGHGP

SEQ ID NO: 861935 - protein, 24 aa, Mycobacterium
SLTELRRLLDVVPGILIVDEAYGE

SEQ ID NO: 861936 - protein, 18 aa, Mycobacterium
SLTGPPVPPELPALAAAV

SEQ ID NO: 861937 - protein, 17 aa, Mycobacterium
SLTHGFINLFPLGGDSA

SEQ ID NO: 861938 - protein, 25 aa, Mycobacterium
SLTHPQYIRELLSTVYRLTADGTLP

SEQ ID NO: 861939 - protein, 32 aa, Mycobacterium
SLTHTRRMHLLAQFLFRGDRIHLPVGALSGGE

SEQ ID NO: 861940 - protein, 26 aa, Mycobacterium
SLTKDISRFIALEGRVWSVAAAAVLT

SEQ ID NO: 861941 - protein, 24 aa, Mycobacterium
SLTKIANDIRWMGSGPLTGLAEIQ

SEQ ID NO: 861942 - protein, 25 aa, Mycobacterium
SLTKIANDIRWMGSGPLTGLAEIQL

SEQ ID NO: 861943 - protein, 25 aa, Mycobacterium
SLTKIANDIRWMGSGPLTGLAEIRL

SEQ ID NO: 861944 - protein, 25 aa, Mycobacterium
SLTKIANDIRWMGSGPLTGLGEIQL

SEQ ID NO: 861945 - protein, 25 aa, Mycobacterium
SLTKIANDIRWMGSGPLTGLGELQL

SEQ ID NO: 861946 - protein, 25 aa, Mycobacterium
SLTKIGNDIRWMGSGPLTGLAEIQL

SEQ ID NO: 861947 - protein, 18 aa, Mycobacterium
SLTLGMVAAVTAAGGHAV

SEQ ID NO: 861948 - protein, 25 aa, Mycobacterium
SLTLQRAMLPPVKPPPGFAVRYEPA

SEQ ID NO: 861949 - protein, 23 aa, Mycobacterium
SLTLRALARWRKHTVIRKPTVGG

SEQ ID NO: 861950 - protein, 19 aa, Mycobacterium
SLTLSVFQAVLRPWHEKIV

SEQ ID NO: 861951 - protein, 17 aa, Mycobacterium
SLTLVPPAEPSSAPRDV

SEQ ID NO: 861952 - protein, 19 aa, Mycobacterium
SLTMMMYGAHAALEYLLPQ

SEQ ID NO: 861953 - protein, 22 aa, Mycobacterium
SLTMVFLDDELERLWTAPVETP

SEQ ID NO: 861954 - protein, 27 aa, Mycobacterium
SLTNREFDLLLFFLTHAGTVYTREDLL

SEQ ID NO: 861955 - protein, 25 aa, Mycobacterium
SLTPLEFDLLVALARKPRQVFTRDV

SEQ ID NO: 861956 - protein, 28 aa, Mycobacterium
SLTPQQRAWLKLVRPLVITEGFALLSVP

SEQ ID NO: 861957 - protein, 26 aa, Mycobacterium
SLTPRMRRIRFSGPRLQGLTWTPGQH

SEQ ID NO: 861958 - protein, 23 aa, Mycobacterium
SLTQLRVLGIMRDREPTMGELAS

SEQ ID NO: 861959 - protein, 20 aa, Mycobacterium
SLTQVLAWDLPLDSRIRAQV

SEQ ID NO: 861960 - protein, 22 aa, Mycobacterium
SLTQWTDLLRQGGFRLQRVVQT

SEQ ID NO: 861961 - protein, 17 aa, Mycobacterium
SLTRKEVFPTQPVTGLM

SEQ ID NO: 861962 - protein, 36 aa, Mycobacterium
SLTRLAPHLVKPLPFLFPLTKRWWERPYIAAGIFLY

SEQ ID NO: 861963 - protein, 21 aa, Mycobacterium
SLTRLPAPPLPTTRLRPRPVP

SEQ ID NO: 861964 - protein, 28 aa, Mycobacterium
SLTTEIDVPVLWVFTARTGAGGQAVQET

SEQ ID NO: 861965 - protein, 35 aa, Mycobacterium
SLTTLAPHLVKPLPFLFPLTNRVWERPYIAAGIFL

SEQ ID NO: 861966 - protein, 35 aa, Mycobacterium
SLTTLAPHLVKPLPFLFPLTNRWWERPYVAAGIFL

SEQ ID NO: 861967 - protein, 22 aa, Mycobacterium
SLTTLIDLWQPVAESQIGTADS

SEQ ID NO: 861968 - protein, 24 aa, Mycobacterium
SLTVATIVPKPWLTPSRARVDAEF

SEQ ID NO: 861969 - protein, 32 aa, Mycobacterium
SLTVFQRTPIWCFPKLDVPLPAPARWAMRIPG

SEQ ID NO: 861970 - protein, 23 aa, Mycobacterium
SLTVFSGYRFVRHAAALGIPVAI

SEQ ID NO: 861971 - protein, 17 aa, Mycobacterium
SLTVFSGYRFVRHAAAR

SEQ ID NO: 861972 - protein, 19 aa, Mycobacterium
SLTVTIGLGPALFGDRFGL

SEQ ID NO: 861973 - protein, 19 aa, Mycobacterium
SLTVYLRFPREHWPRARHS

SEQ ID NO: 861974 - protein, 24 aa, Mycobacterium
SLVAGLRLRLPIIGTDLGTFDTAS

SEQ ID NO: 861975 - protein, 26 aa, Mycobacterium
SLVAVPRPLWAFRISGAQASVGTQIQ

SEQ ID NO: 861976 - protein, 25 aa, Mycobacterium
SLVCDKPAHWLLEEAQHAQLVIVGN

SEQ ID NO: 861977 - protein, 25 aa, Mycobacterium
SLVCDKPAHWLLEGAQHAQLVVVGS

SEQ ID NO: 861978 - protein, 28 aa, Mycobacterium
SLVDINALPYRWIDVQPEMIRVGSLVRM

SEQ ID NO: 861979 - protein, 27 aa, Mycobacterium
SLVDSNYLHVYTWLRAFDAEGLPVTAW

SEQ ID NO: 861980 - protein, 20 aa, Mycobacterium
SLVDTYQLYIDGRWVEPEDG

SEQ ID NO: 861981 - protein, 20 aa, Mycobacterium
SLVEIPIQWALDDWEQYCFL

SEQ ID NO: 861982 - protein, 21 aa, Mycobacterium
SLVEIPIQWALDDWEQYCFLP

SEQ ID NO: 861983 - protein, 24 aa, Mycobacterium
SLVENFLRMTFGFPAEPYEVDPEI

SEQ ID NO: 861984 - protein, 30 aa, Mycobacterium
SLVERGARWRPWRSYATQYLWTTLEHPVNH

SEQ ID NO: 861985 - protein, 17 aa, Mycobacterium
SLVFELEQSTSASTLLL

SEQ ID NO: 861986 - protein, 20 aa, Mycobacterium
SLVFVVRPPTATPTGHYLGC

SEQ ID NO: 861987 - protein, 28 aa, Mycobacterium
SLVGRAELVLPMWERLQSLWGPARDVRA

SEQ ID NO: 861988 - protein, 33 aa, Mycobacterium
SLVGRAELVLPMWQRLEPVWGPARDVRAHQPLM

SEQ ID NO: 861989 - protein, 18 aa, Mycobacterium
SLVHGFVSLWTTGALADS

SEQ ID NO: 861990 - protein, 20 aa, Mycobacterium
SLVKGTLLHGKVICPGHQWQ

SEQ ID NO: 861991 - protein, 30 aa, Mycobacterium
SLVKIDPDLPLAPSALLSCAIPTGYGSAAN

SEQ ID NO: 861992 - protein, 30 aa, Mycobacterium
SLVKIDPHFPLVPAALLACAVPTGYGSAAR

SEQ ID NO: 861993 - protein, 28 aa, Mycobacterium
SLVKIEQHLPLASSALLSCAIPTGYGSV

SEQ ID NO: 861994 - protein, 24 aa, Mycobacterium
SLVKVHDWIPLEAASLVSCGVTTG

SEQ ID NO: 861995 - protein, 18 aa, Mycobacterium
SLVLEIGGEPFRVREDAR

SEQ ID NO: 861996 - protein, 20 aa, Mycobacterium
SLVLFPEATMVRFGVPLGGV

SEQ ID NO: 861997 - protein, 30 aa, Mycobacterium
SLVLLDPALTFAPLTWKMVLVSLGSVIPGT

SEQ ID NO: 861998 - protein, 17 aa, Mycobacterium
SLVLTKTRAVAAAIDAI

SEQ ID NO: 861999 - protein, 18 aa, Mycobacterium
SLVNGKRGISLLAFNDHT

SEQ ID NO: 862000 - protein, 28 aa, Mycobacterium
SLVNLPNWLALTFRFDDGPWLDVDDTDL

SEQ ID NO: 862001 - protein, 27 aa, Mycobacterium
SLVPDPHPYFDYLRSQNPVLRLPHHGV

SEQ ID NO: 862002 - protein, 23 aa, Mycobacterium
SLVPMLAMRLTHFDNLIDISRVH

SEQ ID NO: 862003 - protein, 18 aa, Mycobacterium
SLVQYRPSSPPPGELWEP

SEQ ID NO: 862004 - protein, 18 aa, Mycobacterium
SLVTGWAQLHGYPIGILA

SEQ ID NO: 862005 - protein, 24 aa, Mycobacterium
SLVTGWARLWGYPVGILANARGVL

SEQ ID NO: 862006 - protein, 18 aa, Mycobacterium
SLVTSLIAQRRGYGAPGA

SEQ ID NO: 862007 - protein, 29 aa, Mycobacterium
SLVVGPAAWWHAWAPADWDRLAGAVVAGH

SEQ ID NO: 862008 - protein, 19 aa, Mycobacterium
SLVVTFRRPTPISTDLRFD

SEQ ID NO: 862009 - protein, 18 aa, Mycobacterium
SLWELNVPRRDLRMLAAR

SEQ ID NO: 862010 - protein, 26 aa, Mycobacterium
SLWMPDHLVSFWPDSIWTPEFTDLAE

SEQ ID NO: 862011 - protein, 18 aa, Mycobacterium
SLWRTRLSRLTPRKGCWI

SEQ ID NO: 862012 - protein, 17 aa, Mycobacterium
SLWSGAMQMGASAVNGL

SEQ ID NO: 862013 - protein, 17 aa, Mycobacterium
SLYAAFVERYGDRITAE

SEQ ID NO: 862014 - protein, 21 aa, Mycobacterium
SLYEWLSPALGPVSPAAVAPC

SEQ ID NO: 862015 - protein, 24 aa, Mycobacterium
SLYHHFGSGAAFYRAVIDYWENDV

SEQ ID NO: 862016 - protein, 18 aa, Mycobacterium
SLYILTFTQDAFPEDPGY

SEQ ID NO: 862017 - protein, 17 aa, Mycobacterium
SLYLRTFTDGPHHDWRA

SEQ ID NO: 862018 - protein, 27 aa, Mycobacterium
SLYNTQPWRWVADGARLDLFLDASRVV

SEQ ID NO: 862019 - protein, 18 aa, Mycobacterium
SLYRLRDSGFRLLAMTPA

SEQ ID NO: 862020 - protein, 22 aa, Mycobacterium
SLYVERAWPRHRRLSLAIEDGR

SEQ ID NO: 862021 - protein, 20 aa, Mycobacterium
SMAFDVMVPLLELLGDLRHD

SEQ ID NO: 862022 - protein, 23 aa, Mycobacterium
SMASSYNLVGRPPVVAVRDGRVR

SEQ ID NO: 862023 - protein, 27 aa, Mycobacterium
SMATWFTEVLTRLPHVLFDVRIEDQDH

SEQ ID NO: 862024 - protein, 18 aa, Mycobacterium
SMCEARGLPAVRIGVVDQ

SEQ ID NO: 862025 - protein, 24 aa, Mycobacterium
SMCGPKFCSMRITADIREFAAENG

SEQ ID NO: 862026 - protein, 19 aa, Mycobacterium
SMCSWFTYSTPDANKDHVL

SEQ ID NO: 862027 - protein, 20 aa, Mycobacterium
SMDQPHLLAMRTTILAENWS

SEQ ID NO: 862028 - protein, 21 aa, Mycobacterium
SMDSSWRKLLLVCEAVAEPGD

SEQ ID NO: 862029 - protein, 18 aa, Mycobacterium
SMEDGEVGLFLLAADARG

SEQ ID NO: 862030 - protein, 26 aa, Mycobacterium
SMEILDEVILGLRRLHQPVIAAVNGP

SEQ ID NO: 862031 - protein, 26 aa, Mycobacterium
SMELLDEVILKLRRLHQPVIAAVNGP

SEQ ID NO: 862032 - protein, 28 aa, Mycobacterium
SMELLDEVILTLRRMHQPVIAAINGAAI

SEQ ID NO: 862033 - protein, 17 aa, Mycobacterium
SMERWCDVHSASPFYRV

SEQ ID NO: 862034 - protein, 18 aa, Mycobacterium
SMESLYEYGSRAGVWRVL

SEQ ID NO: 862035 - protein, 20 aa, Mycobacterium
SMEVLAHYIIECLQLMALRG

SEQ ID NO: 862036 - protein, 25 aa, Mycobacterium
SMEVLDDVILALRKLHQPVIAAVNG

SEQ ID NO: 862037 - protein, 26 aa, Mycobacterium
SMEVLDNVILALRRLHQPVIAAVNGA

SEQ ID NO: 862038 - protein, 19 aa, Mycobacterium
SMEWYGFVLAWHERHGRAP

SEQ ID NO: 862039 - protein, 20 aa, Mycobacterium
SMEWYGFVLAWHERHGRAPY

SEQ ID NO: 862040 - protein, 20 aa, Mycobacterium
SMFEERLRLLEGAPACFGTA

SEQ ID NO: 862041 - protein, 17 aa, Mycobacterium
SMFGLHRRLRGCAVGHF

SEQ ID NO: 862042 - protein, 34 aa, Mycobacterium
SMFPDEREILFPAGTKFYVIDKTLDALTGRTIID

SEQ ID NO: 862043 - protein, 26 aa, Mycobacterium
SMFPGEQEILFPAGSKFYVISKTVDP

SEQ ID NO: 862044 - protein, 26 aa, Mycobacterium
SMFPGEQEILFPAGSKFYVVNKTIDP

SEQ ID NO: 862045 - protein, 18 aa, Mycobacterium
SMFPPKAFHALVELIEEA

SEQ ID NO: 862046 - protein, 25 aa, Mycobacterium
SMGAGLQALAWIARGGSGAGSDLAA

SEQ ID NO: 862047 - protein, 23 aa, Mycobacterium
SMGALHSWCLAAARPDLVTAVVV

SEQ ID NO: 862048 - protein, 36 aa, Mycobacterium
SMGATPLIELYVMYAEFAAILDKAGIRVARSLVGPY

SEQ ID NO: 862049 - protein, 25 aa, Mycobacterium
SMGEIFGTLIMGARLVIPRPDGLRD

SEQ ID NO: 862050 - protein, 27 aa, Mycobacterium
SMGGTADGMPPIARLLGMQLEDIEFGT

SEQ ID NO: 862051 - protein, 28 aa, Mycobacterium
SMGHLDLYPFVLPGPVLEKMRLIHEIVM

SEQ ID NO: 862052 - protein, 24 aa, Mycobacterium
SMGKGVQLFLPDGSTSQAPNAAAA

SEQ ID NO: 862053 - protein, 17 aa, Mycobacterium
SMGMAGMLGSALGSGGP

SEQ ID NO: 862054 - protein, 21 aa, Mycobacterium
SMGNYIFTTKVLIDAIRADAD

SEQ ID NO: 862055 - protein, 22 aa, Mycobacterium
SMGNYIFTTKVLIDAIRADAED

SEQ ID NO: 862056 - protein, 18 aa, Mycobacterium
SMGTGEVAAYCARKGTER

SEQ ID NO: 862057 - protein, 29 aa, Mycobacterium
SMGVGMFLQTLLLALTARGLGTCVQVAIA

SEQ ID NO: 862058 - protein, 27 aa, Mycobacterium
SMHGLAIYRRNVAIQPLFSGAAMGDHS

SEQ ID NO: 862059 - protein, 23 aa, Mycobacterium
SMIGGLIALKLDGSVLAQLGRGR

SEQ ID NO: 862060 - protein, 21 aa, Mycobacterium
SMIGLQLRALGLRVDIRRFDE

SEQ ID NO: 862061 - protein, 17 aa, Mycobacterium
SMIGWPAGTLADFQNAR

SEQ ID NO: 862062 - protein, 18 aa, Mycobacterium
SMISDGLAMRHGKELTWS

SEQ ID NO: 862063 - protein, 19 aa, Mycobacterium
SMITDGLAMRHGKDLTWSQ

SEQ ID NO: 862064 - protein, 18 aa, Mycobacterium
SMIYAFSENFVLPISHDE

SEQ ID NO: 862065 - protein, 22 aa, Mycobacterium
SMKMFGVPYRITSTITALTPNE

SEQ ID NO: 862066 - protein, 35 aa, Mycobacterium
SMLADFLTVMLQTPSLVLFTYRPEYRGALQLVPGA

SEQ ID NO: 862067 - protein, 20 aa, Mycobacterium
SMLDAVWLRHPDAPGGVFIL

SEQ ID NO: 862068 - protein, 23 aa, Mycobacterium
SMLESVLAVLTFQAQNYLSNGTV

SEQ ID NO: 862069 - protein, 24 aa, Mycobacterium
SMLGRLILPDLGAAKIVTLTPAKV

SEQ ID NO: 862070 - protein, 23 aa, Mycobacterium
SMLHLYRAALKLRPSLWRDAGEV

SEQ ID NO: 862071 - protein, 20 aa, Mycobacterium
SMLLAILSGYERRGRWNVPR

SEQ ID NO: 862072 - protein, 24 aa, Mycobacterium
SMLNYYPHLLALSASSPMWEGQDT

SEQ ID NO: 862073 - protein, 19 aa, Mycobacterium
SMLSELLRAGWLLRDPVRK

SEQ ID NO: 862074 - protein, 24 aa, Mycobacterium
SMLTRPPDPLLIPSGSPAADAFSA

SEQ ID NO: 862075 - protein, 23 aa, Mycobacterium
SMMAAAWAWNMLAAELDSAATAY

SEQ ID NO: 862076 - protein, 18 aa, Mycobacterium
SMMHCMTVSLALEGVGLG

SEQ ID NO: 862077 - protein, 21 aa, Mycobacterium
SMNRVYVRCGMVPAPVDVIWR

SEQ ID NO: 862078 - protein, 30 aa, Mycobacterium
SMPAVIKNAIDWLSRPFGNGALKGKPLAVI

SEQ ID NO: 862079 - protein, 24 aa, Mycobacterium
SMPDGMFQVIINEGYHGSPGSQLG

SEQ ID NO: 862080 - protein, 18 aa, Mycobacterium
SMPGFGPVLAATFLAQIG

SEQ ID NO: 862081 - protein, 17 aa, Mycobacterium
SMPIAFWNDPDGSRYRA

SEQ ID NO: 862082 - protein, 18 aa, Mycobacterium
SMPLLKREGRMLAIKGER

SEQ ID NO: 862083 - protein, 19 aa, Mycobacterium
SMPLMYTVDLNAGIVEGGL

SEQ ID NO: 862084 - protein, 18 aa, Mycobacterium
SMQESDLLAFQIGIRNSD

SEQ ID NO: 862085 - protein, 25 aa, Mycobacterium
SMQRKKFGRLIYIGSVSGSWGIGNQ

SEQ ID NO: 862086 - protein, 25 aa, Mycobacterium
SMRAGLQALAWIARGEAESTAASQP

SEQ ID NO: 862087 - protein, 19 aa, Mycobacterium
SMRAVGRLLTLVESDRRGE

SEQ ID NO: 862088 - protein, 17 aa, Mycobacterium
SMRDVFDNSPGLQRLRL

SEQ ID NO: 862089 - protein, 21 aa, Mycobacterium
SMRGRTLWVVPFCMGPLNAED

SEQ ID NO: 862090 - protein, 24 aa, Mycobacterium
SMRGRTMWVVPFCMGPLGADDPKL

SEQ ID NO: 862091 - protein, 18 aa, Mycobacterium
SMRLILDGSVLAAAMTGG

SEQ ID NO: 862092 - protein, 21 aa, Mycobacterium
SMRPDDLAAQMVRAALDKVPA

SEQ ID NO: 862093 - protein, 25 aa, Mycobacterium
SMRRPTFVLRVLRHCWRRHETSTAP

SEQ ID NO: 862094 - protein, 24 aa, Mycobacterium
SMSAADLTAVLLARHLSYDWERPD

SEQ ID NO: 862095 - protein, 23 aa, Mycobacterium
SMSALRAVPLVPGYGAAKAGIIS

SEQ ID NO: 862096 - protein, 25 aa, Mycobacterium
SMSGRLVARYLAKYVTKSLVDLGIS

SEQ ID NO: 862097 - protein, 26 aa, Mycobacterium
SMSKSFWGGLRIGWIRAERSTLATIA

SEQ ID NO: 862098 - protein, 20 aa, Mycobacterium
SMSLQYLAPARATDLIGVGH

SEQ ID NO: 862099 - protein, 24 aa, Mycobacterium
SMSPDRAYDLVLADPPYSVSAEEV

SEQ ID NO: 862100 - protein, 25 aa, Mycobacterium
SMSSRLVARYLAKYVTKSLAALGIS

SEQ ID NO: 862101 - protein, 18 aa, Mycobacterium
SMTAQWWLDTREPKKEVV

SEQ ID NO: 862102 - protein, 24 aa, Mycobacterium
SMTKAAVAGLTRGLAREFGPRGIT

SEQ ID NO: 862103 - protein, 18 aa, Mycobacterium
SMTMTDPIADFLTRLRNA

SEQ ID NO: 862104 - protein, 24 aa, Mycobacterium
SMTNAPHLLPKSRAGFKYGDVTLI

SEQ ID NO: 862105 - protein, 20 aa, Mycobacterium
SMTPFNRELAPRLKAVVATS

SEQ ID NO: 862106 - protein, 19 aa, Mycobacterium
SMTQLPFPDGALDGAITVN

SEQ ID NO: 862107 - protein, 24 aa, Mycobacterium
SMTVLAVNTLYRGPATPGSAAALA

SEQ ID NO: 862108 - protein, 22 aa, Mycobacterium
SMTYKSMLLSDVPTMAFTMGYI

SEQ ID NO: 862109 - protein, 21 aa, Mycobacterium
SMVIDLLLKRAASLGVQIRYE

SEQ ID NO: 862110 - protein, 17 aa, Mycobacterium
SMVKFRSIMFERLIPNL

SEQ ID NO: 862111 - protein, 17 aa, Mycobacterium
SMVLAQIFRGLLLVTAC

SEQ ID NO: 862112 - protein, 23 aa, Mycobacterium
SMVSLTMMARLLEAVRPQTRLVL

SEQ ID NO: 862113 - protein, 17 aa, Mycobacterium
SMWAAQAEYFADRYTVI

SEQ ID NO: 862114 - protein, 24 aa, Mycobacterium
SMWAGPLCGQLLRQAGATVVKVES

SEQ ID NO: 862115 - protein, 18 aa, Mycobacterium
SMWAGPLCGRLLSDAGAT

SEQ ID NO: 862116 - protein, 19 aa, Mycobacterium
SMWANAWLAGKAAPDDLLD

SEQ ID NO: 862117 - protein, 19 aa, Mycobacterium
SMWIEVITTAHEVGLRSSS

SEQ ID NO: 862118 - protein, 37 aa, Mycobacterium
SNAAQAFLDLINAPTQALLGRPLIGNGADGATVGGIG

SEQ ID NO: 862119 - protein, 26 aa, Mycobacterium
SNAELMATFLRFATGIAGPKPQLDHR

SEQ ID NO: 862120 - protein, 25 aa, Mycobacterium
SNAGGLFLGWVDRVLAPGDPADARP

SEQ ID NO: 862121 - protein, 24 aa, Mycobacterium
SNAGPALVPGYNSGFGNIGTNNAG

SEQ ID NO: 862122 - protein, 22 aa, Mycobacterium
SNAIGIFHAFLDDPGVRLVGYE

SEQ ID NO: 862123 - protein, 23 aa, Mycobacterium
SNAIGIFHPFIDDPGVRLIGFEA

SEQ ID NO: 862124 - protein, 24 aa, Mycobacterium
SNAIGIFHPFIDDPGVRLVGFEAA

SEQ ID NO: 862125 - protein, 23 aa, Mycobacterium
SNAIGLFHAFIDDPAVRLVGYEA

SEQ ID NO: 862126 - protein, 22 aa, Mycobacterium
SNAKLIIATAYFPQSEDSRAAD

SEQ ID NO: 862127 - protein, 32 aa, Mycobacterium
SNAKTIFWNGPMGVFEFPAFAAGTKGVAEAII

SEQ ID NO: 862128 - protein, 30 aa, Mycobacterium
SNAKTIFWNGPMGVFEFPGYAAGTRGVAEA

SEQ ID NO: 862129 - protein, 24 aa, Mycobacterium
SNAKWFFDNFGAGDPIIVKNSTGG

SEQ ID NO: 862130 - protein, 17 aa, Mycobacterium
SNALALAEAWKPATLRI

SEQ ID NO: 862131 - protein, 25 aa, Mycobacterium
SNALDADLYLRIAPELFLKRCVVGG

SEQ ID NO: 862132 - protein, 18 aa, Mycobacterium
SNARDHMAFGRGAHSCPG

SEQ ID NO: 862133 - protein, 22 aa, Mycobacterium
SNARMGRLLSQHTLRKARAREA

SEQ ID NO: 862134 - protein, 27 aa, Mycobacterium
SNARTRFLLIGVPGPPPPRTGTDRTSV

SEQ ID NO: 862135 - protein, 23 aa, Mycobacterium
SNARTWLFSIARRVVVDQIRYKT

SEQ ID NO: 862136 - protein, 24 aa, Mycobacterium
SNATAFIYIGEVCRYLLNQPTKPT

SEQ ID NO: 862137 - protein, 22 aa, Mycobacterium
SNATLWPLYHDVIVRPIYHREW

SEQ ID NO: 862138 - protein, 17 aa, Mycobacterium
SNATLYRVQAEYAAVMQ

SEQ ID NO: 862139 - protein, 18 aa, Mycobacterium
SNAVITAFFGGVPNFEGE

SEQ ID NO: 862140 - protein, 24 aa, Mycobacterium
SNCVALGGPFPPLPFAPNGDDVNA

SEQ ID NO: 862141 - protein, 22 aa, Mycobacterium
SNDLWIGCTSLRLGIPILTANV

SEQ ID NO: 862142 - protein, 23 aa, Mycobacterium
SNDTWMVLGGMDRAIAAAAAEYD

SEQ ID NO: 862143 - protein, 23 aa, Mycobacterium
SNEAPIQRFWRDAHAGRVHAAND

SEQ ID NO: 862144 - protein, 32 aa, Mycobacterium
SNEATLLGIKPKAALLLITRVTFDQTGTPYEF

SEQ ID NO: 862145 - protein, 22 aa, Mycobacterium
SNEFFKLWLDPSMTYSCAYFEE

SEQ ID NO: 862146 - protein, 31 aa, Mycobacterium
SNEGFGYIPRGVFLPRTARLLTADKLVDNQF

SEQ ID NO: 862147 - protein, 19 aa, Mycobacterium
SNENLLPLYTDAAGDSLAT

SEQ ID NO: 862148 - protein, 23 aa, Mycobacterium
SNEPPWVLPAELASVLLAGPAER

SEQ ID NO: 862149 - protein, 29 aa, Mycobacterium
SNESFWSILAAFPKPVIAAVETYALGGGC

SEQ ID NO: 862150 - protein, 37 aa, Mycobacterium
SNEVGLAILGPLRDLDEVAYLRFASVYRGFSSAEDFE

SEQ ID NO: 862151 - protein, 26 aa, Mycobacterium
SNFATRWGRFAFFGPLTVTPELWNQG

SEQ ID NO: 862152 - protein, 25 aa, Mycobacterium
SNFDSPLSLLTPQLARLAAAGGFRN

SEQ ID NO: 862153 - protein, 27 aa, Mycobacterium
SNFLLDHALVDIGVGVRWLREVKDVET

SEQ ID NO: 862154 - protein, 18 aa, Mycobacterium
SNFLRKAHALVVAATHNE

SEQ ID NO: 862155 - protein, 19 aa, Mycobacterium
SNFSAWVTGLRRVEAPTRA

SEQ ID NO: 862156 - protein, 18 aa, Mycobacterium
SNGAFWRGDHQGLADISY

SEQ ID NO: 862157 - protein, 21 aa, Mycobacterium
SNGAIFGLPSWNLTMEIVQAA

SEQ ID NO: 862158 - protein, 23 aa, Mycobacterium
SNGLSTMGFALPGALGVKLARPD

SEQ ID NO: 862159 - protein, 22 aa, Mycobacterium
SNGNIHPLWTYAHVPHGFTGDA

SEQ ID NO: 862160 - protein, 23 aa, Mycobacterium
SNGPVWVMAGFGAQHRKMGKSLY

SEQ ID NO: 862161 - protein, 25 aa, Mycobacterium
SNGQPLALMTNYLPAALAPDEDELA

SEQ ID NO: 862162 - protein, 25 aa, Mycobacterium
SNGRLIPLGIIPLWDVELAAKEVER

SEQ ID NO: 862163 - protein, 26 aa, Mycobacterium
SNHKTMGIPILYPWANRLSSMGYGVD

SEQ ID NO: 862164 - protein, 22 aa, Mycobacterium
SNIAFDVRPAFTALGIDADVDE

SEQ ID NO: 862165 - protein, 19 aa, Mycobacterium
SNIIYPPYTERAFKLARRL

SEQ ID NO: 862166 - protein, 24 aa, Mycobacterium
SNIRCPVLVDCLGTWLTALMDREA

SEQ ID NO: 862167 - protein, 25 aa, Mycobacterium
SNIRPGVPVLFLDTGYHFAETLGTR

SEQ ID NO: 862168 - protein, 25 aa, Mycobacterium
SNKTVFSQLPRFQALALSAVNTSAL

SEQ ID NO: 862169 - protein, 27 aa, Mycobacterium
SNKYLLNPLMLRLAGRKNWYAAAIEHT

SEQ ID NO: 862170 - protein, 21 aa, Mycobacterium
SNLAELRRSLGESATYAVAKN

SEQ ID NO: 862171 - protein, 20 aa, Mycobacterium
SNLANFMRTLPPIARPQLAN

SEQ ID NO: 862172 - protein, 17 aa, Mycobacterium
SNLDALVDCLRGGFGTP

SEQ ID NO: 862173 - protein, 18 aa, Mycobacterium
SNLFLRAGTVLRAEDGSP

SEQ ID NO: 862174 - protein, 22 aa, Mycobacterium
SNLIGMGVIPLQFPDGKSAKDL

SEQ ID NO: 862175 - protein, 17 aa, Mycobacterium
SNLKCLCRKHHLLKTFW

SEQ ID NO: 862176 - protein, 22 aa, Mycobacterium
SNLLAARHYGIPAFGTMAHSYV

SEQ ID NO: 862177 - protein, 21 aa, Mycobacterium
SNLLSAAMDLQIEPLSYFLNG

SEQ ID NO: 862178 - protein, 20 aa, Mycobacterium
SNLPVFPGDTYLAGAKVLRQ

SEQ ID NO: 862179 - protein, 17 aa, Mycobacterium
SNLRRLLADSAIMESHR

SEQ ID NO: 862180 - protein, 22 aa, Mycobacterium
SNLRVALDGRFGPIRDAAREYL

SEQ ID NO: 862181 - protein, 19 aa, Mycobacterium
SNLSELGDWLVIHEGWRSE

SEQ ID NO: 862182 - protein, 33 aa, Mycobacterium
SNLTFLVFDDASKWVLRRPPLHGLTPSAHDMAR

SEQ ID NO: 862183 - protein, 28 aa, Mycobacterium
SNNALDILLADWPGERTLACLQGEFGPN

SEQ ID NO: 862184 - protein, 21 aa, Mycobacterium
SNNISRVSWLVAGLPEHVGAM

SEQ ID NO: 862185 - protein, 22 aa, Mycobacterium
SNNISRVSWLVAGLPEHVGAMT

SEQ ID NO: 862186 - protein, 27 aa, Mycobacterium
SNNLGWLNSGVGNWGGWNSGMGSTGFG

SEQ ID NO: 862187 - protein, 25 aa, Mycobacterium
SNNQALLPPPGIRQLLSLITGPPAD

SEQ ID NO: 862188 - protein, 23 aa, Mycobacterium
SNPDMIHLSLLRNHARWAVFLRN

SEQ ID NO: 862189 - protein, 18 aa, Mycobacterium
SNPDYLPGTSLPPGIRAT

SEQ ID NO: 862190 - protein, 27 aa, Mycobacterium
SNPGENLYTLDYYLKLAEQIVDAGAHV

SEQ ID NO: 862191 - protein, 30 aa, Mycobacterium
SNPLEVIEQITYLLFIRRLDDLETLEERKA

SEQ ID NO: 862192 - protein, 25 aa, Mycobacterium
SNPLSVFFFDLLHVDGVDLLDAPAH

SEQ ID NO: 862193 - protein, 27 aa, Mycobacterium
SNPPDEALLTFLVKLVPGGAMSEYLSR

SEQ ID NO: 862194 - protein, 31 aa, Mycobacterium
SNPRFEGLMTFTLAETLWLAGQGFDNLLLAY

SEQ ID NO: 862195 - protein, 24 aa, Mycobacterium
SNPSDRYYILNDPINRAVAALFVG

SEQ ID NO: 862196 - protein, 21 aa, Mycobacterium
SNQLLMEAMGLHLPGSSLVTP

SEQ ID NO: 862197 - protein, 23 aa, Mycobacterium
SNQRKVTRWETVYTIQTGIQGFR

SEQ ID NO: 862198 - protein, 25 aa, Mycobacterium
SNRAWRLYRRLGFTDVIRQHQFAGD

SEQ ID NO: 862199 - protein, 30 aa, Mycobacterium
SNRLFRTDFPINLTAARLMWWTSPADHSKA

SEQ ID NO: 862200 - protein, 19 aa, Mycobacterium
SNRLGIPTVLYGLGRTRVD

SEQ ID NO: 862201 - protein, 23 aa, Mycobacterium
SNRPLYLGRSRRLASADQRLVLY

SEQ ID NO: 862202 - protein, 33 aa, Mycobacterium
SNRSLPYWDYFDNQWRVTIPWRGIGRMIGQTIE

SEQ ID NO: 862203 - protein, 19 aa, Mycobacterium
SNSEFLVFMRTGGTVVSAP

SEQ ID NO: 862204 - protein, 24 aa, Mycobacterium
SNSKVPHISLLLGASYGAGHYGMC

SEQ ID NO: 862205 - protein, 23 aa, Mycobacterium
SNSNYILLGMILEWCDAQYGTGR

SEQ ID NO: 862206 - protein, 22 aa, Mycobacterium
SNSQTVLPFDGLDYPEGVAVDA

SEQ ID NO: 862207 - protein, 17 aa, Mycobacterium
SNSSPWTYANTRPVWTN

SEQ ID NO: 862208 - protein, 27 aa, Mycobacterium
SNTELARNSPLWVRAVFDVVAPVLVQG

SEQ ID NO: 862209 - protein, 18 aa, Mycobacterium
SNTKWNAAKLLRATVREL

SEQ ID NO: 862210 - protein, 28 aa, Mycobacterium
SNTPRQFRWVWRLLFPGYPRPSGCRGEE

SEQ ID NO: 862211 - protein, 30 aa, Mycobacterium
SNTSVIFDRRAIFKVFRRVSSGISPDIELN

SEQ ID NO: 862212 - protein, 17 aa, Mycobacterium
SNVGKIWRRGSRNWFGE

SEQ ID NO: 862213 - protein, 20 aa, Mycobacterium
SNVGKMWRRGSKNWFGESAA

SEQ ID NO: 862214 - protein, 27 aa, Mycobacterium
SNVKFQHMPLPFTLYSDGIDLPVFEEF

SEQ ID NO: 862215 - protein, 23 aa, Mycobacterium
SNVLDALTFCDLTTGPDGAPISP

SEQ ID NO: 862216 - protein, 17 aa, Mycobacterium
SNVMIGSWFAGTYESPG

SEQ ID NO: 862217 - protein, 20 aa, Mycobacterium
SNVMIGSWFAGTYESPGDLL

SEQ ID NO: 862218 - protein, 24 aa, Mycobacterium
SNVPGPPFPLYMAGARLDSLVPLG

SEQ ID NO: 862219 - protein, 40 aa, Mycobacterium
SNVPGPQVPLYFLGAQVIGMYPLGPIFHGAALTVTVMSLD

SEQ ID NO: 862220 - protein, 17 aa, Mycobacterium
SNVQYYFDARKLVVQVS

SEQ ID NO: 862221 - protein, 22 aa, Mycobacterium
SNVTLTFINGLLQRFAHGDRIV

SEQ ID NO: 862222 - protein, 32 aa, Mycobacterium
SNWLNDTAAPGDLLYALPPQGRFVLNDTGRNL

SEQ ID NO: 862223 - protein, 22 aa, Mycobacterium
SNWRNTLLVCRAAGDGDSTVGP

SEQ ID NO: 862224 - protein, 23 aa, Mycobacterium
SNYAPLFGRLLTPLVNGIRVSGP

SEQ ID NO: 862225 - protein, 32 aa, Mycobacterium
SNYARNIDLLAQRFRLIIPDMPGYGRSSKGVD

SEQ ID NO: 862226 - protein, 18 aa, Mycobacterium
SNYEQLMRSFFAVPHIRS

SEQ ID NO: 862227 - protein, 26 aa, Mycobacterium
SNYWGYNTIGFFAPDFKYSSATSPGG

SEQ ID NO: 862228 - protein, 26 aa, Mycobacterium
SNYWGYNTIGFFAPDFKYSSATTPGG

SEQ ID NO: 862229 - protein, 23 aa, Mycobacterium
SPAAAQSFVIDPDGALRDAGLPN

SEQ ID NO: 862230 - protein, 21 aa, Mycobacterium
SPAAFYRYFSDKEDLLAALAE

SEQ ID NO: 862231 - protein, 21 aa, Mycobacterium
SPAAQLRAFLDSLGGLWAQGK

SEQ ID NO: 862232 - protein, 22 aa, Mycobacterium
SPAAWALLAFARREFERAFTPG

SEQ ID NO: 862233 - protein, 24 aa, Mycobacterium
SPAAWRVRARLLAAVPLLRDHSVT

SEQ ID NO: 862234 - protein, 25 aa, Mycobacterium
SPAAWTPEYFGGNAIPLVGWNAVTV

SEQ ID NO: 862235 - protein, 33 aa, Mycobacterium
SPAERLGQLWGLLLPGMTVETSLPYFREFLARE

SEQ ID NO: 862236 - protein, 25 aa, Mycobacterium
SPAFDFSVWELWGALLHGAQAVVVP

SEQ ID NO: 862237 - protein, 18 aa, Mycobacterium
SPAFYPYAIEHMRRGAEK

SEQ ID NO: 862238 - protein, 30 aa, Mycobacterium
SPAGAYFKGGIKPVSVWLSHEYVRASPGGT

SEQ ID NO: 862239 - protein, 25 aa, Mycobacterium
SPAGLEALLGCRVGAGFRAKVGRLF

SEQ ID NO: 862240 - protein, 18 aa, Mycobacterium
SPAHGYQRLVRHLQPLFM

SEQ ID NO: 862241 - protein, 30 aa, Mycobacterium
SPAHTALFDLPVLEQVYPTPAGLVAAVADW

SEQ ID NO: 862242 - protein, 22 aa, Mycobacterium
SPALGHLLPAGALLAELAGRGH

SEQ ID NO: 862243 - protein, 24 aa, Mycobacterium
SPALGHLLPVGALLAELARRGHDV

SEQ ID NO: 862244 - protein, 21 aa, Mycobacterium
SPALGHVYPLAALLTELACRG

SEQ ID NO: 862245 - protein, 25 aa, Mycobacterium
SPALGRSVWLSLCGLPIGEVIRQIS

SEQ ID NO: 862246 - protein, 20 aa, Mycobacterium
SPALLAQLHITADQLYPGLT

SEQ ID NO: 862247 - protein, 18 aa, Mycobacterium
SPALNYPLTQYMFCAPDE

SEQ ID NO: 862248 - protein, 24 aa, Mycobacterium
SPAMNMFILPIVDSSVLLGDWLIQ

SEQ ID NO: 862249 - protein, 20 aa, Mycobacterium
SPAPAKPAWVRGSVASVSGN

SEQ ID NO: 862250 - protein, 23 aa, Mycobacterium
SPAQLRVIALLDPPVETLRLTAA

SEQ ID NO: 862251 - protein, 23 aa, Mycobacterium
SPAQRRFAAAYGHRGRIVGAVTF

SEQ ID NO: 862252 - protein, 25 aa, Mycobacterium
SPARIGLDLIAIRPGAELDLDLRLE

SEQ ID NO: 862253 - protein, 17 aa, Mycobacterium
SPARVTRLLSRDGRVCG

SEQ ID NO: 862254 - protein, 27 aa, Mycobacterium
SPASMRKFYEAFSPYGLRETAIKPSYG

SEQ ID NO: 862255 - protein, 24 aa, Mycobacterium
SPASPPLLIFPHAGAGASAYRALS

SEQ ID NO: 862256 - protein, 27 aa, Mycobacterium
SPATFAVRWLIPRFASFHRLHPDIDVQ

SEQ ID NO: 862257 - protein, 24 aa, Mycobacterium
SPATGFPLMALFSGLHDECEQRSR

SEQ ID NO: 862258 - protein, 25 aa, Mycobacterium
SPATVALMMPLLSELDVRAVLPTIR

SEQ ID NO: 862259 - protein, 18 aa, Mycobacterium
SPAVARLLRICDPDGTLP

SEQ ID NO: 862260 - protein, 21 aa, Mycobacterium
SPAVFYRYFTDKEDLLAALAE

SEQ ID NO: 862261 - protein, 21 aa, Mycobacterium
SPAVFYRYFTDKEDLLAALAK

SEQ ID NO: 862262 - protein, 24 aa, Mycobacterium
SPDALVWPLLTVIDENLHQSWAVP

SEQ ID NO: 862263 - protein, 17 aa, Mycobacterium
SPDAVLTWATHEGPFLA

SEQ ID NO: 862264 - protein, 20 aa, Mycobacterium
SPDAVLTWATHRVPFLAAVE

SEQ ID NO: 862265 - protein, 18 aa, Mycobacterium
SPDDIPSLDMHPSMRLRI

SEQ ID NO: 862266 - protein, 26 aa, Mycobacterium
SPDEFAIVHKLRRVLSGLDSHQAIDL

SEQ ID NO: 862267 - protein, 24 aa, Mycobacterium
SPDEIPPFAAFLGTATETATATDP

SEQ ID NO: 862268 - protein, 25 aa, Mycobacterium
SPDELQLESVELPRDAFFGRVETVS

SEQ ID NO: 862269 - protein, 24 aa, Mycobacterium
SPDGTMIAYLAPRKNRLNVWVQGI

SEQ ID NO: 862270 - protein, 23 aa, Mycobacterium
SPDLERRILLSRVPELPAHLAEE

SEQ ID NO: 862271 - protein, 26 aa, Mycobacterium
SPDLHVDHHMYLPTDGGLVDLGTDLI

SEQ ID NO: 862272 - protein, 41 aa, Mycobacterium
SPDLIQRQLMFVTPSKPLRRSWLDELLARRPTLVVIDGVNE

SEQ ID NO: 862273 - protein, 21 aa, Mycobacterium
SPDLPPLWQAFGAGRRADGHW

SEQ ID NO: 862274 - protein, 18 aa, Mycobacterium
SPDPAWLQRCAHAHHKAL

SEQ ID NO: 862275 - protein, 24 aa, Mycobacterium
SPDQYTMVSYYRPELDGLPEMGLV

SEQ ID NO: 862276 - protein, 25 aa, Mycobacterium
SPDQYTMVSYYRPELDGLPEMGLVG

SEQ ID NO: 862277 - protein, 20 aa, Mycobacterium
SPDRRAIITEALRKIDDLTA

SEQ ID NO: 862278 - protein, 28 aa, Mycobacterium
SPDSGWIRTWLDTVLELPWNITTEDSAD

SEQ ID NO: 862279 - protein, 23 aa, Mycobacterium
SPDSVARFFPARPDIFDIVVFDE

SEQ ID NO: 862280 - protein, 21 aa, Mycobacterium
SPDTEFFWHGLREHKLLIQRC

SEQ ID NO: 862281 - protein, 27 aa, Mycobacterium
SPDTWRDPRGFALKFYTSEGNFDLVGN

SEQ ID NO: 862282 - protein, 27 aa, Mycobacterium
SPDTWRDPRGFALKFYTSEGNFDMVGN

SEQ ID NO: 862283 - protein, 29 aa, Mycobacterium
SPDTWRDPRGFALRFYTSAGNLDIVGNNT

SEQ ID NO: 862284 - protein, 32 aa, Mycobacterium
SPDVATWLNKPLPPGLARWQRDHGHQLVEDAL

SEQ ID NO: 862285 - protein, 20 aa, Mycobacterium
SPDWSKVTVPFLSAANWAGF

SEQ ID NO: 862286 - protein, 25 aa, Mycobacterium
SPDYGALRKLLAVPILLGAESRSGV

SEQ ID NO: 862287 - protein, 28 aa, Mycobacterium
SPEAITRPRWFLQWAKTLHPPELRVPNQ

SEQ ID NO: 862288 - protein, 20 aa, Mycobacterium
SPEAKIVAERRLWIAVLKAQ

SEQ ID NO: 862289 - protein, 25 aa, Mycobacterium
SPEAKVVAERRLWLAVLRAQAELGV

SEQ ID NO: 862290 - protein, 23 aa, Mycobacterium
SPEATVPVWRSTTPVIPAAELPT

SEQ ID NO: 862291 - protein, 23 aa, Mycobacterium
SPEDPGVMWQFAQAVRGLADGCV

SEQ ID NO: 862292 - protein, 31 aa, Mycobacterium
SPEELNDIALYLNFDMLGSPNAGYFVLDGDQ

SEQ ID NO: 862293 - protein, 20 aa, Mycobacterium
SPEFAPVLEPTLSTGIEALT

SEQ ID NO: 862294 - protein, 28 aa, Mycobacterium
SPEGLDAFLRRFLLPALLADTQRCVTAT

SEQ ID NO: 862295 - protein, 28 aa, Mycobacterium
SPEGLDAFLRRFLLPALLTNTQPCVDAT

SEQ ID NO: 862296 - protein, 28 aa, Mycobacterium
SPEGLDAFLRRFLLPPLLTTTRSCADAT

SEQ ID NO: 862297 - protein, 23 aa, Mycobacterium
SPEHQFIGSLMWLTAERARPMLE

SEQ ID NO: 862298 - protein, 27 aa, Mycobacterium
SPEHTALFELPRLAPVYPSAAGLVAAV

SEQ ID NO: 862299 - protein, 24 aa, Mycobacterium
SPEHVVNLVKFLSSPAAAEVNGQV

SEQ ID NO: 862300 - protein, 24 aa, Mycobacterium
SPELFAALRNAGYTRISLGMQSVA

SEQ ID NO: 862301 - protein, 23 aa, Mycobacterium
SPELGLANIYLPNGMTVPLINYT

SEQ ID NO: 862302 - protein, 26 aa, Mycobacterium
SPELRNWVEALLEIPLLDGYGSTEAG

SEQ ID NO: 862303 - protein, 24 aa, Mycobacterium
SPELTDWARRTLAEAGAVVIDIGQ

SEQ ID NO: 862304 - protein, 24 aa, Mycobacterium
SPELVGDAHRFLLEGMTVQVAFNE

SEQ ID NO: 862305 - protein, 17 aa, Mycobacterium
SPENKAYYIAAAFPSAC

SEQ ID NO: 862306 - protein, 23 aa, Mycobacterium
SPENLGMLPWFKETAADVVCLQE

SEQ ID NO: 862307 - protein, 25 aa, Mycobacterium
SPEQKEFFLPRILTGEVFFCQGYSE

SEQ ID NO: 862308 - protein, 28 aa, Mycobacterium
SPESGWIRTWLDTVLDLPWNARTEDSTD

SEQ ID NO: 862309 - protein, 28 aa, Mycobacterium
SPESGWIRTWLDTVLDLPWNVKTEDSTD

SEQ ID NO: 862310 - protein, 17 aa, Mycobacterium
SPESYLGIAQLSDPAGG

SEQ ID NO: 862311 - protein, 18 aa, Mycobacterium
SPETVRARWLAPDRFRAW

SEQ ID NO: 862312 - protein, 26 aa, Mycobacterium
SPETVRRLCWDWQPPADGDATAAVEA

SEQ ID NO: 862313 - protein, 34 aa, Mycobacterium
SPEWYRTPNYRRRLVRWPRQVLAEFGLYLPDDVE

SEQ ID NO: 862314 - protein, 18 aa, Mycobacterium
SPEYKLFAETLAVMTKNT

SEQ ID NO: 862315 - protein, 17 aa, Mycobacterium
SPFAFTGNRFEFRAPGS

SEQ ID NO: 862316 - protein, 25 aa, Mycobacterium
SPFALGCLAGWLSTEFPPHVLTGHA

SEQ ID NO: 862317 - protein, 17 aa, Mycobacterium
SPFFAYLNAGKRSVTYP

SEQ ID NO: 862318 - protein, 24 aa, Mycobacterium
SPFGNPIPGLLDLGVGPDSGADDA

SEQ ID NO: 862319 - protein, 21 aa, Mycobacterium
SPFGNPIPGLLDLGVGPESDS

SEQ ID NO: 862320 - protein, 23 aa, Mycobacterium
SPFGNPIPGLLDLGVGPESGAEE

SEQ ID NO: 862321 - protein, 17 aa, Mycobacterium
SPFGRRAYADEAQLGVA

SEQ ID NO: 862322 - protein, 28 aa, Mycobacterium
SPFGWTFPYAWPHTPILAANAVCTSQPL

SEQ ID NO: 862323 - protein, 30 aa, Mycobacterium
SPFPAYARSKLAVMLWGLELDRRLRAAGSP

SEQ ID NO: 862324 - protein, 32 aa, Mycobacterium
SPFQIIQSVPMFKLRRYFPPDARPGAQIVGPP

SEQ ID NO: 862325 - protein, 20 aa, Mycobacterium
SPFSAFSNHPLAGGSGPSSG

SEQ ID NO: 862326 - protein, 20 aa, Mycobacterium
SPFTAPTHDPSLDAGLHAAT

SEQ ID NO: 862327 - protein, 23 aa, Mycobacterium
SPGAALLCHVLLVEAGNGLVLVD

SEQ ID NO: 862328 - protein, 18 aa, Mycobacterium
SPGALLDGNLLNVNVNVD

SEQ ID NO: 862329 - protein, 18 aa, Mycobacterium
SPGDHVVFSFIPSCGRCP

SEQ ID NO: 862330 - protein, 25 aa, Mycobacterium
SPGDLGYPVFHTRIGRIGLLVCWDI

SEQ ID NO: 862331 - protein, 23 aa, Mycobacterium
SPGDRVAIYLQPSSNFRPPSDPD

SEQ ID NO: 862332 - protein, 22 aa, Mycobacterium
SPGFDWTRWLGGLGADRDKAAD

SEQ ID NO: 862333 - protein, 19 aa, Mycobacterium
SPGFSETVVLRVMVSAAGE

SEQ ID NO: 862334 - protein, 17 aa, Mycobacterium
SPGFYAFDELIAAWRDS

SEQ ID NO: 862335 - protein, 34 aa, Mycobacterium
SPGGVGFDISCGVRLLVSPGLDRDRLRPRIRAVM

SEQ ID NO: 862336 - protein, 17 aa, Mycobacterium
SPGKLFDEWFPASRLVR

SEQ ID NO: 862337 - protein, 23 aa, Mycobacterium
SPGLKRGALIGGIRYYDTVVDDA

SEQ ID NO: 862338 - protein, 19 aa, Mycobacterium
SPGLKRSSLIGGIRYYDTV

SEQ ID NO: 862339 - protein, 22 aa, Mycobacterium
SPGLLQYPWGVMPDKYIARVED

SEQ ID NO: 862340 - protein, 21 aa, Mycobacterium
SPGLLQYPWGVMPDKYIDRVE

SEQ ID NO: 862341 - protein, 19 aa, Mycobacterium
SPGRAASLVRRGAAAAATV

SEQ ID NO: 862342 - protein, 20 aa, Mycobacterium
SPGRRAVIVGGGYIGLEAAA

SEQ ID NO: 862343 - protein, 21 aa, Mycobacterium
SPGRYLYHDVVLVRTPATALH

SEQ ID NO: 862344 - protein, 24 aa, Mycobacterium
SPGSGKTTLLERTIRDLHPTRSVA

SEQ ID NO: 862345 - protein, 17 aa, Mycobacterium
SPGSLAHPPTRPPPAVP

SEQ ID NO: 862346 - protein, 18 aa, Mycobacterium
SPGSLAHPPTRPPPAVPP

SEQ ID NO: 862347 - protein, 29 aa, Mycobacterium
SPGSWVMISRILDLLFIHAVREWSSSSHA

SEQ ID NO: 862348 - protein, 17 aa, Mycobacterium
SPGTGAPVLMWPSLLMT

SEQ ID NO: 862349 - protein, 22 aa, Mycobacterium
SPGTLYPTLHRLEADGLLLSEQ

SEQ ID NO: 862350 - protein, 21 aa, Mycobacterium
SPGTLYPTLHRLEADGLLVSE

SEQ ID NO: 862351 - protein, 17 aa, Mycobacterium
SPGTYGWILHQSAKNID

SEQ ID NO: 862352 - protein, 18 aa, Mycobacterium
SPGVIWEHGRRNFGLRDD

SEQ ID NO: 862353 - protein, 17 aa, Mycobacterium
SPHDAMYPLQRFVHWMG

SEQ ID NO: 862354 - protein, 17 aa, Mycobacterium
SPHFRPPEDPSTPMIMV

SEQ ID NO: 862355 - protein, 21 aa, Mycobacterium
SPHIPWESLPVRVVDKAIPWQ

SEQ ID NO: 862356 - protein, 26 aa, Mycobacterium
SPHLRRYLWCYVAQAAEPGLDLLRGN

SEQ ID NO: 862357 - protein, 23 aa, Mycobacterium
SPHMSWLDVFAIGSVLPGSFVAR

SEQ ID NO: 862358 - protein, 24 aa, Mycobacterium
SPHNDRLFCIPATIDLAGAEIELV

SEQ ID NO: 862359 - protein, 18 aa, Mycobacterium
SPHNERLFCVPATIDLAG

SEQ ID NO: 862360 - protein, 28 aa, Mycobacterium
SPHPMAAELLLDSPLFKSSPPVAVPPFD

SEQ ID NO: 862361 - protein, 24 aa, Mycobacterium
SPHTPDFRINRPGSLIAALPAVLG

SEQ ID NO: 862362 - protein, 21 aa, Mycobacterium
SPIAGQLRYWRDALDGMPERL

SEQ ID NO: 862363 - protein, 17 aa, Mycobacterium
SPIAVNLVLSDQTLLGG

SEQ ID NO: 862364 - protein, 21 aa, Mycobacterium
SPIGKRNGWLSGLHATELLGA

SEQ ID NO: 862365 - protein, 25 aa, Mycobacterium
SPIGRRLMQPPLALTVQACEAAIAD

SEQ ID NO: 862366 - protein, 30 aa, Mycobacterium
SPIGVPLAHLAFFVLDKFLRRVSAGAVGEL

SEQ ID NO: 862367 - protein, 24 aa, Mycobacterium
SPIKGTLPLDAWPSALRASPKEVA

SEQ ID NO: 862368 - protein, 23 aa, Mycobacterium
SPINPLVGLYGTADGRYISFVMM

SEQ ID NO: 862369 - protein, 22 aa, Mycobacterium
SPIPVPPKYKPADFVKVSYWSH

SEQ ID NO: 862370 - protein, 26 aa, Mycobacterium
SPIQPKPGVSVIPLPGSAPAVEDGYT

SEQ ID NO: 862371 - protein, 17 aa, Mycobacterium
SPIRADFAEGLTLATHA

SEQ ID NO: 862372 - protein, 18 aa, Mycobacterium
SPIRAPLVTIEQLSFRGG

SEQ ID NO: 862373 - protein, 18 aa, Mycobacterium
SPIRLVLGDLRVGDTGPR

SEQ ID NO: 862374 - protein, 28 aa, Mycobacterium
SPIYALIHTFGVALPLHPEYRTVPMVWY

SEQ ID NO: 862375 - protein, 18 aa, Mycobacterium
SPIYLVGARMIASYGFTP

SEQ ID NO: 862376 - protein, 30 aa, Mycobacterium
SPKEMWDAFYEEYLAPVTPLERIRQKVDAA

SEQ ID NO: 862377 - protein, 32 aa, Mycobacterium
SPKEMWDAFYEEYLAPVWPLERMKQRVEASEE

SEQ ID NO: 862378 - protein, 23 aa, Mycobacterium
SPKETWLRLGALVLVTAGFPRPQ

SEQ ID NO: 862379 - protein, 25 aa, Mycobacterium
SPKETWLRLLIVRDGLPKPTTQIPV

SEQ ID NO: 862380 - protein, 26 aa, Mycobacterium
SPKETWLRLLLRDAGLPPVSTQILVH

SEQ ID NO: 862381 - protein, 26 aa, Mycobacterium
SPKETWVRLLLIRAGLPRPQTQIPVS

SEQ ID NO: 862382 - protein, 27 aa, Mycobacterium
SPKFVRQFPFNLLLKDVDRRIRTGRPL

SEQ ID NO: 862383 - protein, 19 aa, Mycobacterium
SPKLMLRPATWVADTVADL

SEQ ID NO: 862384 - protein, 23 aa, Mycobacterium
SPKLTLCELLPRGVLDDTMQRRA

SEQ ID NO: 862385 - protein, 18 aa, Mycobacterium
SPKPPTPMDITPAQLKAL

SEQ ID NO: 862386 - protein, 23 aa, Mycobacterium
SPKQLQAVLFDELEMPKTKKTKT

SEQ ID NO: 862387 - protein, 22 aa, Mycobacterium
SPKQLQAVLFDELEMPKTKRTK

SEQ ID NO: 862388 - protein, 22 aa, Mycobacterium
SPKQLQTVLFDELEMPKTKRTK

SEQ ID NO: 862389 - protein, 22 aa, Mycobacterium
SPKQLQVVLFDELEMPKTKRTK

SEQ ID NO: 862390 - protein, 18 aa, Mycobacterium
SPKRLPESLLHYMRTRGK

SEQ ID NO: 862391 - protein, 22 aa, Mycobacterium
SPKRLPESLLHYMRTRGPDKVI

SEQ ID NO: 862392 - protein, 17 aa, Mycobacterium
SPLAFLESPSRWVRALA

SEQ ID NO: 862393 - protein, 17 aa, Mycobacterium
SPLALRMARSFLGKRSP

SEQ ID NO: 862394 - protein, 24 aa, Mycobacterium
SPLASALMRVGIAPTLIGTRGARP

SEQ ID NO: 862395 - protein, 38 aa, Mycobacterium
SPLDVVLRSWRPRTALWGIHLVFRGGLRRAGVPSTQAL

SEQ ID NO: 862396 - protein, 23 aa, Mycobacterium
SPLERAHCDDLYWMYSVASCVKW

SEQ ID NO: 862397 - protein, 17 aa, Mycobacterium
SPLFHNTGLADDRLRVL

SEQ ID NO: 862398 - protein, 19 aa, Mycobacterium
SPLGIRVVTIAPGTINTPA

SEQ ID NO: 862399 - protein, 25 aa, Mycobacterium
SPLGVQRRFQVHRELAALVRFEDLV

SEQ ID NO: 862400 - protein, 27 aa, Mycobacterium
SPLIREMMIYALRWPIDRGPADAASDD

SEQ ID NO: 862401 - protein, 22 aa, Mycobacterium
SPLIRQIYVYGNSSQPYLLAVV

SEQ ID NO: 862402 - protein, 28 aa, Mycobacterium
SPLLAGDFVRWCRQVLDLLDQVRNAAPD

SEQ ID NO: 862403 - protein, 34 aa, Mycobacterium
SPLLDAMMSPFPPLGPMIRLLLKLGTADAVRLAH

SEQ ID NO: 862404 - protein, 18 aa, Mycobacterium
SPLLGVLCSAYWQRPRVS

SEQ ID NO: 862405 - protein, 32 aa, Mycobacterium
SPLNPAQLAANLWPLGVFPNADSIAGNGVWVF

SEQ ID NO: 862406 - protein, 17 aa, Mycobacterium
SPLPYLTGVRDRDWSRT

SEQ ID NO: 862407 - protein, 26 aa, Mycobacterium
SPLQARCGWAIGWKKDAFFGREALLA

SEQ ID NO: 862408 - protein, 25 aa, Mycobacterium
SPLQELLNVINQQSTALLGRPLIGN

SEQ ID NO: 862409 - protein, 19 aa, Mycobacterium
SPLRSLLPALRDSGVPVVW

SEQ ID NO: 862410 - protein, 20 aa, Mycobacterium
SPLSCAIGMAVLDVLHEEGL

SEQ ID NO: 862411 - protein, 18 aa, Mycobacterium
SPLVCRPLTFMRAAPSEH

SEQ ID NO: 862412 - protein, 23 aa, Mycobacterium
SPLVPIDTPPYHAAAFGLSDLGT

SEQ ID NO: 862413 - protein, 22 aa, Mycobacterium
SPLVRQIYIYGNSARAYLLAVI

SEQ ID NO: 862414 - protein, 24 aa, Mycobacterium
SPMAAILLGLMSDGVPVAGLTWLP

SEQ ID NO: 862415 - protein, 24 aa, Mycobacterium
SPMDPKLYVLWAQANATAGYRYSV

SEQ ID NO: 862416 - protein, 19 aa, Mycobacterium
SPMFMKPPDQDGPGWRFGR

SEQ ID NO: 862417 - protein, 35 aa, Mycobacterium
SPMHGYELRKRLTGLLGAFRAFSYGSLYPALRRMQ

SEQ ID NO: 862418 - protein, 19 aa, Mycobacterium
SPMLKRLEALGFISRTRNA

SEQ ID NO: 862419 - protein, 32 aa, Mycobacterium
SPMLSMDPPDWLDFIFVTAVPLILSSVSSCLG

SEQ ID NO: 862420 - protein, 26 aa, Mycobacterium
SPMNSAVFFLLGLYSLLITTNHWPTG

SEQ ID NO: 862421 - protein, 21 aa, Mycobacterium
SPMTIDITRLGRRPGAMVTLR

SEQ ID NO: 862422 - protein, 26 aa, Mycobacterium
SPNEIAHILVLRSKFDGGFTSEVRGV

SEQ ID NO: 862423 - protein, 22 aa, Mycobacterium
SPNLRPLAKGPFYAVKMVLSDL

SEQ ID NO: 862424 - protein, 17 aa, Mycobacterium
SPNLVVVDIRMPPTHTT

SEQ ID NO: 862425 - protein, 19 aa, Mycobacterium
SPNQTLIYVDQYGNPLLNI

SEQ ID NO: 862426 - protein, 23 aa, Mycobacterium
SPNRLLILTRLRESPCSVTELSA

SEQ ID NO: 862427 - protein, 27 aa, Mycobacterium
SPNVLVYAAMDGWRRQMAHRGHELLGA

SEQ ID NO: 862428 - protein, 19 aa, Mycobacterium
SPNVLVYSAIDGWRRQMVE

SEQ ID NO: 862429 - protein, 23 aa, Mycobacterium
SPNVMVYAAMDGWRRQMVEHGHE

SEQ ID NO: 862430 - protein, 20 aa, Mycobacterium
SPPAELAWVEPILEATTNLQ

SEQ ID NO: 862431 - protein, 20 aa, Mycobacterium
SPPAVTDRLAKMLRFAVDEV

SEQ ID NO: 862432 - protein, 17 aa, Mycobacterium
SPPDILITTPESLYLML

SEQ ID NO: 862433 - protein, 18 aa, Mycobacterium
SPPDTPNPGWLYATRLRQ

SEQ ID NO: 862434 - protein, 26 aa, Mycobacterium
SPPERLRSGWLNGIKHWQVDYGGAPG

SEQ ID NO: 862435 - protein, 26 aa, Mycobacterium
SPPKRRTVPTLMPWAAEALLDYVNNI

SEQ ID NO: 862436 - protein, 21 aa, Mycobacterium
SPPLAICRAAHVVEADTRYVA

SEQ ID NO: 862437 - protein, 17 aa, Mycobacterium
SPPLPMIGAGELVSAAG

SEQ ID NO: 862438 - protein, 34 aa, Mycobacterium
SPPMADWLEAFVPLRIHVLVRFGRWDDLIAEPLP

SEQ ID NO: 862439 - protein, 43 aa, Mycobacterium
SPPMADWLEAFVPLRTHVLVRFGRWQELIAQPLPCDRDLYCAT

SEQ ID NO: 862440 - protein, 24 aa, Mycobacterium
SPPMNLMPGIVRQGVLHVGGESVT

SEQ ID NO: 862441 - protein, 21 aa, Mycobacterium
SPPPELLFRDVSNSRDPVGDA

SEQ ID NO: 862442 - protein, 17 aa, Mycobacterium
SPPPLLNLLLGETVQYS

SEQ ID NO: 862443 - protein, 26 aa, Mycobacterium
SPPPVKIAVRLLVACALITTSPRAST

SEQ ID NO: 862444 - protein, 24 aa, Mycobacterium
SPPRSLQDMLLPAGPATAGTDGAS

SEQ ID NO: 862445 - protein, 19 aa, Mycobacterium
SPPSALWATSQSPPMPQTS

SEQ ID NO: 862446 - protein, 18 aa, Mycobacterium
SPPVRLEPEWLKPTAYMM

SEQ ID NO: 862447 - protein, 27 aa, Mycobacterium
SPQAKVVAERRLWLAVLRAQAELEVEV

SEQ ID NO: 862448 - protein, 27 aa, Mycobacterium
SPQAQRMLKFAFNLLDDGLVGQQLFAG

SEQ ID NO: 862449 - protein, 27 aa, Mycobacterium
SPQATADLLYLLDGIRTRYDIPAQSCV

SEQ ID NO: 862450 - protein, 19 aa, Mycobacterium
SPQATLVWVAFESTPDGDE

SEQ ID NO: 862451 - protein, 22 aa, Mycobacterium
SPQAVFFHQRAAAFVSQIDEVE

SEQ ID NO: 862452 - protein, 18 aa, Mycobacterium
SPQDIRIAWRAWLQMRVR

SEQ ID NO: 862453 - protein, 18 aa, Mycobacterium
SPQHIPLSHFWARNQLKG

SEQ ID NO: 862454 - protein, 20 aa, Mycobacterium
SPQLAAAIKAAVGGAAIPDA

SEQ ID NO: 862455 - protein, 22 aa, Mycobacterium
SPQLHLAAYAALGLSSWRYDRI

SEQ ID NO: 862456 - protein, 30 aa, Mycobacterium
SPQSTSLIYDLRIGPAWQGLAFGVGMITEA

SEQ ID NO: 862457 - protein, 25 aa, Mycobacterium
SPQVLFCGLWYDDQFVRTPEGWRMT

SEQ ID NO: 862458 - protein, 17 aa, Mycobacterium
SPRAAFAAATRGGWRAG

SEQ ID NO: 862459 - protein, 18 aa, Mycobacterium
SPRATKVMLLGSGELGRE

SEQ ID NO: 862460 - protein, 19 aa, Mycobacterium
SPRATKVMLLGSGELGREV

SEQ ID NO: 862461 - protein, 25 aa, Mycobacterium
SPRDPYTVALLGAIAGRELAATATS

SEQ ID NO: 862462 - protein, 19 aa, Mycobacterium
SPREPAPARAEPRPAPIRP

SEQ ID NO: 862463 - protein, 18 aa, Mycobacterium
SPRESALRLALIDSGFPK

SEQ ID NO: 862464 - protein, 26 aa, Mycobacterium
SPRGGTLKLMRPLFGAGLGGRLGDGR

SEQ ID NO: 862465 - protein, 22 aa, Mycobacterium
SPRGMVPWTRLGGKLIAIPPNT

SEQ ID NO: 862466 - protein, 22 aa, Mycobacterium
SPRGWVYIVANNFDRSGPVFLY

SEQ ID NO: 862467 - protein, 39 aa, Mycobacterium
SPRGYRAMAVIPRLQFAHADLLVRSFGTLQGLLAASAGD

SEQ ID NO: 862468 - protein, 25 aa, Mycobacterium
SPRHTKLASIRWLSSSPPSSAAPST

SEQ ID NO: 862469 - protein, 34 aa, Mycobacterium
SPRIKAGADVLPWWPVLGVVLLLERETHRNDGLL

SEQ ID NO: 862470 - protein, 29 aa, Mycobacterium
SPRKLAMEFARFLGLPMLNPRMNVTDISD

SEQ ID NO: 862471 - protein, 19 aa, Mycobacterium
SPRLVPYPIEPRAAVGIYD

SEQ ID NO: 862472 - protein, 29 aa, Mycobacterium
SPRLYGGTYNLFHYSLAKLGIDVSFVEDP

SEQ ID NO: 862473 - protein, 30 aa, Mycobacterium
SPRLYGGTYNLFHYSLAKLGIEVSFVEDPD

SEQ ID NO: 862474 - protein, 31 aa, Mycobacterium
SPRLYGGTYNLFHYTLPKLGIEVSFVEDPDD

SEQ ID NO: 862475 - protein, 37 aa, Mycobacterium
SPRNALAEWLLPRSPAIRKVLWRLPDALLPGTDTDPW

SEQ ID NO: 862476 - protein, 17 aa, Mycobacterium
SPRQLSFVMVANPHRQY

SEQ ID NO: 862477 - protein, 21 aa, Mycobacterium
SPRRALSELLRRGTKNMPGAD

SEQ ID NO: 862478 - protein, 19 aa, Mycobacterium
SPRRALSELLRRGTKNMTG

SEQ ID NO: 862479 - protein, 18 aa, Mycobacterium
SPRRKGPVVWVKDASRSV

SEQ ID NO: 862480 - protein, 33 aa, Mycobacterium
SPRTFFRHVPAKEELLLAPVRYGGAAIVNLLEG

SEQ ID NO: 862481 - protein, 23 aa, Mycobacterium
SPRTFFRHVPTKEDLLLAPVRHG

SEQ ID NO: 862482 - protein, 22 aa, Mycobacterium
SPRTSASALRRVLRRARDGVAL

SEQ ID NO: 862483 - protein, 25 aa, Mycobacterium
SPRVSLVLKADIRPGYTGQLTAKVE

SEQ ID NO: 862484 - protein, 25 aa, Mycobacterium
SPRVWRWDDYVLDLGRYELRAGDSV

SEQ ID NO: 862485 - protein, 24 aa, Mycobacterium
SPSAQLRLLDPLVPRGRHYEMRTV

SEQ ID NO: 862486 - protein, 25 aa, Mycobacterium
SPSARIERWWLGSTTFDELELDFHM

SEQ ID NO: 862487 - protein, 21 aa, Mycobacterium
SPSGYTLHFPDHGYVAHANHF

SEQ ID NO: 862488 - protein, 25 aa, Mycobacterium
SPSLALRRKIADRLVLAKVRAALGL

SEQ ID NO: 862489 - protein, 30 aa, Mycobacterium
SPSMLRNVWRFWYQIPISLPVIGPRVISAS

SEQ ID NO: 862490 - protein, 33 aa, Mycobacterium
SPSMNFFPATLTDVGVQLPFGEVTLDAGLYAGI

SEQ ID NO: 862491 - protein, 22 aa, Mycobacterium
SPSMVPAARTALGAGGVRIAAV

SEQ ID NO: 862492 - protein, 24 aa, Mycobacterium
SPSNFVTQIFLRGCKFQSAVEYPP

SEQ ID NO: 862493 - protein, 33 aa, Mycobacterium
SPSRAFWRHQLQGLIPCLFPATRSGTSRLEVIF

SEQ ID NO: 862494 - protein, 25 aa, Mycobacterium
SPSRFRTMRQLQLARSLIVGGAALA

SEQ ID NO: 862495 - protein, 23 aa, Mycobacterium
SPSTIRYRLRQLRDAYGDRLRDP

SEQ ID NO: 862496 - protein, 19 aa, Mycobacterium
SPSVLLYAAMDGWRRQMVQ

SEQ ID NO: 862497 - protein, 19 aa, Mycobacterium
SPSVPLIETCWHAALAAAG

SEQ ID NO: 862498 - protein, 25 aa, Mycobacterium
SPTAALMIRIRRLSDRFVKVKSGPS

SEQ ID NO: 862499 - protein, 23 aa, Mycobacterium
SPTAARLLLGADVLVGTSAGSAV

SEQ ID NO: 862500 - protein, 23 aa, Mycobacterium
SPTAWALPTLPAPTGSPIDGIID

SEQ ID NO: 862501 - protein, 24 aa, Mycobacterium
SPTDKFLGELLAAFADGPVVVGPT

SEQ ID NO: 862502 - protein, 22 aa, Mycobacterium
SPTDLPQRLSLFGHTRLPATEV

SEQ ID NO: 862503 - protein, 25 aa, Mycobacterium
SPTETEVWRWYLIDKNAPDDVRDWL

SEQ ID NO: 862504 - protein, 26 aa, Mycobacterium
SPTETEVWRWYLIDKNAPDDVRDWLR

SEQ ID NO: 862505 - protein, 23 aa, Mycobacterium
SPTFRLRDFLQIDARAAAPLAAV

SEQ ID NO: 862506 - protein, 20 aa, Mycobacterium
SPTFVAAVASLAPAATVASV

SEQ ID NO: 862507 - protein, 17 aa, Mycobacterium
SPTFYRFDSGEQLQVWR

SEQ ID NO: 862508 - protein, 28 aa, Mycobacterium
SPTGPAALLYTALLAWGAGRGATRGYTC

SEQ ID NO: 862509 - protein, 17 aa, Mycobacterium
SPTKVDFRLARKTTTLG

SEQ ID NO: 862510 - protein, 17 aa, Mycobacterium
SPTLLYLAAAGVGTIGI

SEQ ID NO: 862511 - protein, 18 aa, Mycobacterium
SPTLLYLAAAGVGTIGII

SEQ ID NO: 862512 - protein, 17 aa, Mycobacterium
SPTLQAGIALALVDTDA

SEQ ID NO: 862513 - protein, 20 aa, Mycobacterium
SPTLYIFPHAGGTAKDYVAF

SEQ ID NO: 862514 - protein, 17 aa, Mycobacterium
SPTMDFLDDPPALPQSP

SEQ ID NO: 862515 - protein, 25 aa, Mycobacterium
SPTPVAWTRMRVPRSLMASIGNEAI

SEQ ID NO: 862516 - protein, 28 aa, Mycobacterium
SPTQTFAAYLTMQLLEAAGLPPGVINLV

SEQ ID NO: 862517 - protein, 19 aa, Mycobacterium
SPTRRDRWRRTSGIHKVRD

SEQ ID NO: 862518 - protein, 17 aa, Mycobacterium
SPTTIYDKFPTLTPDQA

SEQ ID NO: 862519 - protein, 20 aa, Mycobacterium
SPVFAQLLPTAFPNAQLIDG

SEQ ID NO: 862520 - protein, 26 aa, Mycobacterium
SPVGLARFCSLRSWLSQWSYDDARGD

SEQ ID NO: 862521 - protein, 25 aa, Mycobacterium
SPVGLARFCTLRSWLSQWSYDDANG

SEQ ID NO: 862522 - protein, 25 aa, Mycobacterium
SPVGQLAWIVEKFWAWMDCAGNPEN

SEQ ID NO: 862523 - protein, 25 aa, Mycobacterium
SPVGQLAWIVEKFWAWMDCDGNPEN

SEQ ID NO: 862524 - protein, 25 aa, Mycobacterium
SPVGQLAWIVEKFWSWMDCDGHPEN

SEQ ID NO: 862525 - protein, 21 aa, Mycobacterium
SPVHPVQLPGLPRSWLLTKHA

SEQ ID NO: 862526 - protein, 20 aa, Mycobacterium
SPVIFIKPNTSIIGPGLPIQ

SEQ ID NO: 862527 - protein, 18 aa, Mycobacterium
SPVLAAILHNASSVAVVT

SEQ ID NO: 862528 - protein, 20 aa, Mycobacterium
SPVLAAILHNASSVAVVTNS

SEQ ID NO: 862529 - protein, 24 aa, Mycobacterium
SPVNLAARLVAVAAPGQILAASEL

SEQ ID NO: 862530 - protein, 35 aa, Mycobacterium
SPVPAILTMRLMGLPYDNWHLYANLFHSVMAVPQD

SEQ ID NO: 862531 - protein, 18 aa, Mycobacterium
SPVPLDSAILFAPVGELV

SEQ ID NO: 862532 - protein, 25 aa, Mycobacterium
SPVPRAALFVLDRWLRPAPEGVVGE

SEQ ID NO: 862533 - protein, 19 aa, Mycobacterium
SPVPVAAYQVSGEYAMICA

SEQ ID NO: 862534 - protein, 23 aa, Mycobacterium
SPVQIRALLERDLPVYIISIGRT

SEQ ID NO: 862535 - protein, 21 aa, Mycobacterium
SPVRKLDFVPLASMLTVVLAG

SEQ ID NO: 862536 - protein, 30 aa, Mycobacterium
SPVRLQHPAVGRLVLFGQQLLIAGTDDLSM

SEQ ID NO: 862537 - protein, 28 aa, Mycobacterium
SPVTFNTGFFNWGDRNTGLWNSGFGNTG

SEQ ID NO: 862538 - protein, 23 aa, Mycobacterium
SPVVWAARYLSMNGRRRLLGSFN

SEQ ID NO: 862539 - protein, 24 aa, Mycobacterium
SPVVWAARYLSMNGRRRLLGSFNH

SEQ ID NO: 862540 - protein, 28 aa, Mycobacterium
SPVYDGYPPPGPPLNYAKAALLAATEDD

SEQ ID NO: 862541 - protein, 23 aa, Mycobacterium
SPWALMHFMVRLPEKDDGVSAPG

SEQ ID NO: 862542 - protein, 23 aa, Mycobacterium
SPWALMHFMVRLPQKEDAAAPAD

SEQ ID NO: 862543 - protein, 17 aa, Mycobacterium
SPWRSEYLYSRAATIYG

SEQ ID NO: 862544 - protein, 24 aa, Mycobacterium
SPYFGDRRKAFLQDLAAVTGAEVV

SEQ ID NO: 862545 - protein, 28 aa, Mycobacterium
SPYGATIAHGFLTLSLIPGVSKDNYRVE

SEQ ID NO: 862546 - protein, 32 aa, Mycobacterium
SPYGTPGWVELLPDSGYWLPKDQLPDNAIYQT

SEQ ID NO: 862547 - protein, 20 aa, Mycobacterium
SPYLSLLRKGERSNPAPEIV

SEQ ID NO: 862548 - protein, 19 aa, Mycobacterium
SPYPFFEYMRRTDPVWHGA

SEQ ID NO: 862549 - protein, 18 aa, Mycobacterium
SPYSHWAFQHVEDFMPTA

SEQ ID NO: 862550 - protein, 21 aa, Mycobacterium
SPYYRRLYRDIPSGQVPLASL

SEQ ID NO: 862551 - protein, 23 aa, Mycobacterium
SQAAALFVAPASQVARLAAALQE

SEQ ID NO: 862552 - protein, 27 aa, Mycobacterium
SQAADRPWRFWLASTPEVSAYRRSPRA

SEQ ID NO: 862553 - protein, 30 aa, Mycobacterium
SQAADRPWRLWLAGRPEVSAYRRSPRAPVP

SEQ ID NO: 862554 - protein, 29 aa, Mycobacterium
SQAADRPWRLWLPGRPEVSAYRRSPRAPA

SEQ ID NO: 862555 - protein, 23 aa, Mycobacterium
SQAAHLVMLFQQNLAELVIKGDS

SEQ ID NO: 862556 - protein, 24 aa, Mycobacterium
SQAAPLWAGIAAVMNQYLVANGGR

SEQ ID NO: 862557 - protein, 30 aa, Mycobacterium
SQADFWFDPLCPWCWITSRWILEVEKVRDI

SEQ ID NO: 862558 - protein, 21 aa, Mycobacterium
SQAIAAVFSTHAQAYQAASAQ

SEQ ID NO: 862559 - protein, 19 aa, Mycobacterium
SQAIRRAGRLALPVPRSAL

SEQ ID NO: 862560 - protein, 30 aa, Mycobacterium
SQALPHSLGLLYENLTEHLGFARSSDEYKV

SEQ ID NO: 862561 - protein, 22 aa, Mycobacterium
SQALRDFLLIYIDDQESLANNP

SEQ ID NO: 862562 - protein, 23 aa, Mycobacterium
SQANFVWLPLAERTLDFVARAAD

SEQ ID NO: 862563 - protein, 33 aa, Mycobacterium
SQASELWKIVDRPNLFIKIPATTAGMAAITATV

SEQ ID NO: 862564 - protein, 19 aa, Mycobacterium
SQDAAAMYGYAAASAAAAK

SEQ ID NO: 862565 - protein, 26 aa, Mycobacterium
SQDAAGAVRWLIPRLDLPATQLEQIT

SEQ ID NO: 862566 - protein, 26 aa, Mycobacterium
SQDAGLAMLLLSRPPTNAMTRQVYRE

SEQ ID NO: 862567 - protein, 21 aa, Mycobacterium
SQDFRTFARLLPTDPQAALQF

SEQ ID NO: 862568 - protein, 29 aa, Mycobacterium
SQDGLGVEWRMIQLLILEGDRLTRCELFD

SEQ ID NO: 862569 - protein, 26 aa, Mycobacterium
SQDGSPPYVVRWLVTGHEATVYPGSD

SEQ ID NO: 862570 - protein, 26 aa, Mycobacterium
SQDGWSFLIDAFFHRGLMLMSFDEHL

SEQ ID NO: 862571 - protein, 29 aa, Mycobacterium
SQDPAHFGRFRRLIPTLFMFRQSDEVLAA

SEQ ID NO: 862572 - protein, 28 aa, Mycobacterium
SQDPFGDVFLVIDGWPAFVAEFPDLEPA

SEQ ID NO: 862573 - protein, 23 aa, Mycobacterium
SQDWWPADFGHYGPLFIRMAWHA

SEQ ID NO: 862574 - protein, 27 aa, Mycobacterium
SQEAGFAGTQWQLGLLVKIDGPVHRDQ

SEQ ID NO: 862575 - protein, 24 aa, Mycobacterium
SQEAQVALTLRLLGGLTTPEIAGA

SEQ ID NO: 862576 - protein, 19 aa, Mycobacterium
SQECSLGVWPLSARSSAGL

SEQ ID NO: 862577 - protein, 17 aa, Mycobacterium
SQEFLAELGRRLAEQIS

SEQ ID NO: 862578 - protein, 24 aa, Mycobacterium
SQEIRLHAPLPPAGKLSVVTEVAD

SEQ ID NO: 862579 - protein, 17 aa, Mycobacterium
SQELWMINGLVPPPMNS

SEQ ID NO: 862580 - protein, 26 aa, Mycobacterium
SQEPASILILFTPGAPREGYFEGLPG

SEQ ID NO: 862581 - protein, 23 aa, Mycobacterium
SQFAIVLPRRDGVEYSIEHAIIG

SEQ ID NO: 862582 - protein, 19 aa, Mycobacterium
SQFDFYDGGGLDVACLGFA

SEQ ID NO: 862583 - protein, 23 aa, Mycobacterium
SQFDLFINLLDLPHRNRQTQAIS

SEQ ID NO: 862584 - protein, 17 aa, Mycobacterium
SQFKKYEIIRINGAYQH

SEQ ID NO: 862585 - protein, 21 aa, Mycobacterium
SQFLLDHALVDIGVGVRWLQE

SEQ ID NO: 862586 - protein, 18 aa, Mycobacterium
SQFLYGVDGAPLAEFCDD

SEQ ID NO: 862587 - protein, 33 aa, Mycobacterium
SQFRHRCVGFVFQFFNLLPTLSAWENVAVPKLL

SEQ ID NO: 862588 - protein, 29 aa, Mycobacterium
SQGALFDTPILVPPQAAMLGTGAIVKRPR

SEQ ID NO: 862589 - protein, 22 aa, Mycobacterium
SQGARRFLAHPVMLDVAVQALG

SEQ ID NO: 862590 - protein, 31 aa, Mycobacterium
SQGHARILCAMPFFWIGGLLAATGALHEPVT

SEQ ID NO: 862591 - protein, 24 aa, Mycobacterium
SQGIRLHAPLPPAGKLSVVSEVAD

SEQ ID NO: 862592 - protein, 23 aa, Mycobacterium
SQGRRRVAVLGGNRIPFARSDGA

SEQ ID NO: 862593 - protein, 22 aa, Mycobacterium
SQGRWASLRWFERRIIDTEVAP

SEQ ID NO: 862594 - protein, 20 aa, Mycobacterium
SQGVAIFDALRGGTLDYDED

SEQ ID NO: 862595 - protein, 36 aa, Mycobacterium
SQGVLILTCGTFGNVIRLLPPLVIGDDLLDEGITAL

SEQ ID NO: 862596 - protein, 25 aa, Mycobacterium
SQGVPTVWMMLFAYLDEHPEIDAHE

SEQ ID NO: 862597 - protein, 23 aa, Mycobacterium
SQHEAIEEQFFWPAVRDAMGDGL

SEQ ID NO: 862598 - protein, 35 aa, Mycobacterium
SQHEPAYIVEPWVRATLVGPLTLRHGHFTFVAVLV

SEQ ID NO: 862599 - protein, 28 aa, Mycobacterium
SQHPIPPGSLIWKYWGRLDVSFFGNAAM

SEQ ID NO: 862600 - protein, 25 aa, Mycobacterium
SQICGHIASLPLDRSRPLWEMWVIE

SEQ ID NO: 862601 - protein, 25 aa, Mycobacterium
SQIDRLMVPLLRGDQWWALGMSEPE

SEQ ID NO: 862602 - protein, 24 aa, Mycobacterium
SQIEELILTIPTLAPHFECVIDRP

SEQ ID NO: 862603 - protein, 23 aa, Mycobacterium
SQIFDYWRDPDGYLFEHFTDGDL

SEQ ID NO: 862604 - protein, 24 aa, Mycobacterium
SQITDGSAALLFMSAEKARELGLK

SEQ ID NO: 862605 - protein, 34 aa, Mycobacterium
SQKFAWARIFRPMVHGYPLTPFVRLAFAGDITSS

SEQ ID NO: 862606 - protein, 22 aa, Mycobacterium
SQKFAWARIFRPMVQGHPLTPF

SEQ ID NO: 862607 - protein, 17 aa, Mycobacterium
SQKIFDSRWVPAQATAG

SEQ ID NO: 862608 - protein, 27 aa, Mycobacterium
SQLAEALLLLLCGVGFYAGFVGSYRDM

SEQ ID NO: 862609 - protein, 24 aa, Mycobacterium
SQLAKSAMPLAMGLAPVALSAGMS

SEQ ID NO: 862610 - protein, 17 aa, Mycobacterium
SQLALCTLTADLALRIA

SEQ ID NO: 862611 - protein, 19 aa, Mycobacterium
SQLAPTRNALRKWLARVRV

SEQ ID NO: 862612 - protein, 30 aa, Mycobacterium
SQLEALLSTLPYPMLMAQRMKMLGLPPNLR

SEQ ID NO: 862613 - protein, 17 aa, Mycobacterium
SQLFTNPLLVSNPIGLY

SEQ ID NO: 862614 - protein, 28 aa, Mycobacterium
SQLGANLPKPLRWIADKTNPGLLHPIEP

SEQ ID NO: 862615 - protein, 30 aa, Mycobacterium
SQLLNWPYEHLNEAPAYWQALASKCYDAVG

SEQ ID NO: 862616 - protein, 20 aa, Mycobacterium
SQLLSRLLMATIAESSLMIA

SEQ ID NO: 862617 - protein, 20 aa, Mycobacterium
SQLLTLLHRADVAVLPSHYE

SEQ ID NO: 862618 - protein, 25 aa, Mycobacterium
SQLPKVFFVNWFRRGDDGRFLWPGF

SEQ ID NO: 862619 - protein, 18 aa, Mycobacterium
SQLPYAARAAWWLREVYD

SEQ ID NO: 862620 - protein, 23 aa, Mycobacterium
SQLPYEPDLLTILAIALHEVDTI

SEQ ID NO: 862621 - protein, 18 aa, Mycobacterium
SQLRAEGRRFMRSMRAPL

SEQ ID NO: 862622 - protein, 19 aa, Mycobacterium
SQLRELLGQALVGKKLSAA

SEQ ID NO: 862623 - protein, 31 aa, Mycobacterium
SQLRERLGFGELRWAISGAAPIPKETLGFFA

SEQ ID NO: 862624 - protein, 29 aa, Mycobacterium
SQLSQGFPSPWLLVVAALLAQAEGARGDG

SEQ ID NO: 862625 - protein, 23 aa, Mycobacterium
SQLTCSFLFLCSGYYNYEQGYSP

SEQ ID NO: 862626 - protein, 21 aa, Mycobacterium
SQLVAIGFTRLAHRGSPVACG

SEQ ID NO: 862627 - protein, 22 aa, Mycobacterium
SQLWEFVPIAEADRPPLLAWMV

SEQ ID NO: 862628 - protein, 20 aa, Mycobacterium
SQMAAALLIHQSGGRIEVRS

SEQ ID NO: 862629 - protein, 23 aa, Mycobacterium
SQMAPMFPLVIIVHADPEVRVKR

SEQ ID NO: 862630 - protein, 25 aa, Mycobacterium
SQMDIAPLYDDCAFLPDWPGVPVGN

SEQ ID NO: 862631 - protein, 21 aa, Mycobacterium
SQNEFLLVVAALTKGWVVTIS

SEQ ID NO: 862632 - protein, 18 aa, Mycobacterium
SQPAFGLLPRPGHGTQVS

SEQ ID NO: 862633 - protein, 29 aa, Mycobacterium
SQQFTLHPGDIFLLGTPAYRPAGDESRAV

SEQ ID NO: 862634 - protein, 17 aa, Mycobacterium
SQQLWLVTITDDDDRVV

SEQ ID NO: 862635 - protein, 26 aa, Mycobacterium
SQQRNRLTLWGRRLLGEAITQAQHVL

SEQ ID NO: 862636 - protein, 25 aa, Mycobacterium
SQQTWNQYRIATSVYFVNLSATRPH

SEQ ID NO: 862637 - protein, 17 aa, Mycobacterium
SQQVLTTGNLRAVILNS

SEQ ID NO: 862638 - protein, 22 aa, Mycobacterium
SQRAGMIAALPPTSATRRVLDE

SEQ ID NO: 862639 - protein, 24 aa, Mycobacterium
SQREELINWLLSRGISVDQIGQAI

SEQ ID NO: 862640 - protein, 25 aa, Mycobacterium
SQRFTLSEFLAEEAALLALVDATDP

SEQ ID NO: 862641 - protein, 36 aa, Mycobacterium
SQRGIPLPFAFVFDELWLAFQGLSTFLSTALGADYR

SEQ ID NO: 862642 - protein, 18 aa, Mycobacterium
SQRGIVLRSLREGIDTSN

SEQ ID NO: 862643 - protein, 24 aa, Mycobacterium
SQRILGITLARMMKRRQFGHTLYE

SEQ ID NO: 862644 - protein, 17 aa, Mycobacterium
SQRLGRLATLAPKGSPQ

SEQ ID NO: 862645 - protein, 23 aa, Mycobacterium
SQRLVELARRRGTPAYLIDGPTD

SEQ ID NO: 862646 - protein, 22 aa, Mycobacterium
SQRLVTLSYRLDAAARAADDPR

SEQ ID NO: 862647 - protein, 35 aa, Mycobacterium
SQRRALLFLRADRLQYFVSCLVYLPRDRYTTQVRL

SEQ ID NO: 862648 - protein, 35 aa, Mycobacterium
SQRRALLFLRVDRLQFFVSCLVYLPRDRYTTAVRL

SEQ ID NO: 862649 - protein, 27 aa, Mycobacterium
SQRRALLFLRVDRLQFFVSCLVYVPRD

SEQ ID NO: 862650 - protein, 19 aa, Mycobacterium
SQRRYRAWLLDTFNHQLLG

SEQ ID NO: 862651 - protein, 22 aa, Mycobacterium
SQRTFYTFFDGKDSLLLAVYET

SEQ ID NO: 862652 - protein, 27 aa, Mycobacterium
SQSEPPVLGYVFYAPPRAVPRAQRFPT

SEQ ID NO: 862653 - protein, 20 aa, Mycobacterium
SQSFLAMDPPRHTKLRKLAH

SEQ ID NO: 862654 - protein, 20 aa, Mycobacterium
SQSFLAMDPPRHTKLRKLVS

SEQ ID NO: 862655 - protein, 23 aa, Mycobacterium
SQSFLAMDPPRHTKLRKLVSAAF

SEQ ID NO: 862656 - protein, 27 aa, Mycobacterium
SQSISPVTLRQALLGKVLTVGDAVSLL

SEQ ID NO: 862657 - protein, 30 aa, Mycobacterium
SQSLEAMRAIGVPVYLLPGNHDPLDASSVY

SEQ ID NO: 862658 - protein, 25 aa, Mycobacterium
SQSVPVPRLLRKPAQIVMNSLIGKV

SEQ ID NO: 862659 - protein, 24 aa, Mycobacterium
SQTKQFWPDVVGFKYKMSNIQAAI

SEQ ID NO: 862660 - protein, 19 aa, Mycobacterium
SQTSIVGTGIIAAHRDSAQ

SEQ ID NO: 862661 - protein, 23 aa, Mycobacterium
SQTSLPAMSIPVGFTDSGLPVGL

SEQ ID NO: 862662 - protein, 22 aa, Mycobacterium
SQTVLFLGRHVGYPVALEGALK

SEQ ID NO: 862663 - protein, 24 aa, Mycobacterium
SQTVRLHAPLPPAGKLSVVSEVAD

SEQ ID NO: 862664 - protein, 31 aa, Mycobacterium
SQTYEGFAVRPLYTALDALDEPALPGQWPFI

SEQ ID NO: 862665 - protein, 26 aa, Mycobacterium
SQVAWILANSFPALSTARLSRRLRAA

SEQ ID NO: 862666 - protein, 19 aa, Mycobacterium
SQVDGARWLSLEGSATVVT

SEQ ID NO: 862667 - protein, 21 aa, Mycobacterium
SQVHRFLKMLGGYTFSRHSYS

SEQ ID NO: 862668 - protein, 29 aa, Mycobacterium
SQVLGMALCRYVLAFPPLVDMSRDGVVAW

SEQ ID NO: 862669 - protein, 19 aa, Mycobacterium
SQVLVFKDLGLVSQVFDEQ

SEQ ID NO: 862670 - protein, 24 aa, Mycobacterium
SQVQQYVPGYRLLNEPQFDEPSVV

SEQ ID NO: 862671 - protein, 18 aa, Mycobacterium
SQVRRTTLPGGLRVVTEY

SEQ ID NO: 862672 - protein, 18 aa, Mycobacterium
SQVTARSPRFVIVAVDIS

SEQ ID NO: 862673 - protein, 22 aa, Mycobacterium
SQVTPFLIDLPVGEGNPVVRLS

SEQ ID NO: 862674 - protein, 27 aa, Mycobacterium
SQVVFNEFLPAVARMRALDPVISELVR

SEQ ID NO: 862675 - protein, 21 aa, Mycobacterium
SQWPKFAAALVADTPVRGAMG

SEQ ID NO: 862676 - protein, 20 aa, Mycobacterium
SQWSVQLRDTLCCGALGSVE

SEQ ID NO: 862677 - protein, 20 aa, Mycobacterium
SQWVGPITNFSPLYNDRTIE

SEQ ID NO: 862678 - protein, 23 aa, Mycobacterium
SQYALLIARTDWDVPKHKGITFF

SEQ ID NO: 862679 - protein, 20 aa, Mycobacterium
SQYTCRLLKYMDKEGQTVVW

SEQ ID NO: 862680 - protein, 19 aa, Mycobacterium
SRAAAGEAGGSYVGAAGSD

SEQ ID NO: 862681 - protein, 25 aa, Mycobacterium
SRAAARPRGLRPPAARLRRHRRAGA

SEQ ID NO: 862682 - protein, 26 aa, Mycobacterium
SRAAKDWLCLLEAFDAPQRSGLVRAA

SEQ ID NO: 862683 - protein, 20 aa, Mycobacterium
SRAAMITAVLEKRARLPVGT

SEQ ID NO: 862684 - protein, 26 aa, Mycobacterium
SRAAPLYEALLAWGRRRGATRAHLTM

SEQ ID NO: 862685 - protein, 24 aa, Mycobacterium
SRAARVDLPLLPPTDARNYCATVR

SEQ ID NO: 862686 - protein, 21 aa, Mycobacterium
SRAAWAWFRHLHSLADRTLAP

SEQ ID NO: 862687 - protein, 27 aa, Mycobacterium
SRADRDIVDFWLTELGLDDLRTCRMTE

SEQ ID NO: 862688 - protein, 23 aa, Mycobacterium
SRADTHLVMFDFSMAGVSPDNVE

SEQ ID NO: 862689 - protein, 21 aa, Mycobacterium
SRADWLWRVVGETGHVALASA

SEQ ID NO: 862690 - protein, 25 aa, Mycobacterium
SRAEHHQQHMWQGLRTNDLQVVSTD

SEQ ID NO: 862691 - protein, 28 aa, Mycobacterium
SRAEMEMKVLLWAVQRLISGLSKIGAER

SEQ ID NO: 862692 - protein, 20 aa, Mycobacterium
SRAESVQHTWFGLSALAERV

SEQ ID NO: 862693 - protein, 21 aa, Mycobacterium
SRAFGRGPRPLLVSVRSGATQ

SEQ ID NO: 862694 - protein, 19 aa, Mycobacterium
SRAFIPQSVWRRMGDDFLG

SEQ ID NO: 862695 - protein, 19 aa, Mycobacterium
SRAFRRAFGVPPSRATDVG

SEQ ID NO: 862696 - protein, 24 aa, Mycobacterium
SRAGDLNWLFLPGGPGIGSESLHE

SEQ ID NO: 862697 - protein, 23 aa, Mycobacterium
SRAGVLRFVVLDGLAKPGRLAGP

SEQ ID NO: 862698 - protein, 22 aa, Mycobacterium
SRAGVLRFVVLDGLAKPGRLVG

SEQ ID NO: 862699 - protein, 23 aa, Mycobacterium
SRAGWAAVRWRNLTGGIVALHAG

SEQ ID NO: 862700 - protein, 24 aa, Mycobacterium
SRAGWLRWSDKLAAAPLRPGKGPI

SEQ ID NO: 862701 - protein, 25 aa, Mycobacterium
SRAGWLRWSDKLAAAPLRPGKGPIA

SEQ ID NO: 862702 - protein, 21 aa, Mycobacterium
SRAIRVLMGCPFLNGLRARGV

SEQ ID NO: 862703 - protein, 18 aa, Mycobacterium
SRAIVRIEKPGYTGPTTA

SEQ ID NO: 862704 - protein, 18 aa, Mycobacterium
SRALDLGGLPLDVLRSAL

SEQ ID NO: 862705 - protein, 21 aa, Mycobacterium
SRALIAAQALGLAKGALRTAI

SEQ ID NO: 862706 - protein, 23 aa, Mycobacterium
SRALYEAFGCDLMISFTPTPNGE

SEQ ID NO: 862707 - protein, 24 aa, Mycobacterium
SRAMALMLQDWLPAFDGGPSGAAT

SEQ ID NO: 862708 - protein, 20 aa, Mycobacterium
SRANFAYYARRALARHPDAL

SEQ ID NO: 862709 - protein, 21 aa, Mycobacterium
SRANFAYYARRALARHPDALT

SEQ ID NO: 862710 - protein, 26 aa, Mycobacterium
SRANLPQRPPRVPARIQRLGHVVVQS

SEQ ID NO: 862711 - protein, 23 aa, Mycobacterium
SRANPRPAFFGRSGLRRNFRWDP

SEQ ID NO: 862712 - protein, 17 aa, Mycobacterium
SRAPRWAVAYKYPPQEA

SEQ ID NO: 862713 - protein, 24 aa, Mycobacterium
SRAPWRLKQNYLFDMRTIRRGKVA

SEQ ID NO: 862714 - protein, 27 aa, Mycobacterium
SRAQKLVQSGQWTGAAAAAYSEAHKEW

SEQ ID NO: 862715 - protein, 25 aa, Mycobacterium
SRAQSRFAWERIALDALNVYQSLGA

SEQ ID NO: 862716 - protein, 24 aa, Mycobacterium
SRARAARWLPDTPVLPVDEVARRA

SEQ ID NO: 862717 - protein, 28 aa, Mycobacterium
SRARDFEDAVWLLMGVKPQGGVFYRFAV

SEQ ID NO: 862718 - protein, 19 aa, Mycobacterium
SRARELLNWNPEIGLREGL

SEQ ID NO: 862719 - protein, 22 aa, Mycobacterium
SRASGVLPRYGVRLTVMAHPPA

SEQ ID NO: 862720 - protein, 24 aa, Mycobacterium
SRASRVELPLLSPDRARAYCRTVR

SEQ ID NO: 862721 - protein, 24 aa, Mycobacterium
SRASRVNLPLLPPSDARAYCATVR

SEQ ID NO: 862722 - protein, 28 aa, Mycobacterium
SRASVLDYMRRILYAGVATFQSLGTDRD

SEQ ID NO: 862723 - protein, 30 aa, Mycobacterium
SRATAFIYIGELCRYLLNQPPKPTDRKHRV

SEQ ID NO: 862724 - protein, 21 aa, Mycobacterium
SRATHIVVWATLDKSKGRAAI

SEQ ID NO: 862725 - protein, 17 aa, Mycobacterium
SRATIYRYAGGKAKIRD

SEQ ID NO: 862726 - protein, 24 aa, Mycobacterium
SRATLHRHFAGRPALMAALEELAV

SEQ ID NO: 862727 - protein, 24 aa, Mycobacterium
SRATLHRYFAGRAALIDALEQLAF

SEQ ID NO: 862728 - protein, 18 aa, Mycobacterium
SRATLRRLYAHPRSGALV

SEQ ID NO: 862729 - protein, 19 aa, Mycobacterium
SRATLRRLYTHPQSGALVA

SEQ ID NO: 862730 - protein, 18 aa, Mycobacterium
SRATLYQYFKGKDEIFLE

SEQ ID NO: 862731 - protein, 20 aa, Mycobacterium
SRAVGPGGLFLALPGARADG

SEQ ID NO: 862732 - protein, 24 aa, Mycobacterium
SRAVLDGLIWTPPGQPALRDLGWF

SEQ ID NO: 862733 - protein, 19 aa, Mycobacterium
SRAWRREWAYSRAATIYGG

SEQ ID NO: 862734 - protein, 18 aa, Mycobacterium
SRAWSEHRLSIRERAIMA

SEQ ID NO: 862735 - protein, 20 aa, Mycobacterium
SRCAGHAPPWAPLPVQYIDY

SEQ ID NO: 862736 - protein, 18 aa, Mycobacterium
SRCTSLAGLVLKRPVLPK

SEQ ID NO: 862737 - protein, 24 aa, Mycobacterium
SRCVRPPILYGDVARRKPMTVEWA

SEQ ID NO: 862738 - protein, 30 aa, Mycobacterium
SRDALDRALIDLATYFRDALLAAANGGAVR

SEQ ID NO: 862739 - protein, 29 aa, Mycobacterium
SRDALDRALIDLATYFRDALLVSAGATDV

SEQ ID NO: 862740 - protein, 29 aa, Mycobacterium
SRDALDRALIDLATYFRDALLVSSGANTV

SEQ ID NO: 862741 - protein, 30 aa, Mycobacterium
SRDALDRALIDLATYFRDALMVSAGAASVR

SEQ ID NO: 862742 - protein, 27 aa, Mycobacterium
SRDEGVQLPFMWQQVSLHGVGATRLRV

SEQ ID NO: 862743 - protein, 26 aa, Mycobacterium
SRDELIDYLTMLSWNALKGIVEVGGS

SEQ ID NO: 862744 - protein, 17 aa, Mycobacterium
SRDGIIDGALTFLDREG

SEQ ID NO: 862745 - protein, 26 aa, Mycobacterium
SRDHDFRWWVCGYWRMQPCGPGNIER

SEQ ID NO: 862746 - protein, 25 aa, Mycobacterium
SRDIPLRLIHAIPRGADVPAGDESL

SEQ ID NO: 862747 - protein, 26 aa, Mycobacterium
SRDIPLRLVYVIDPLEPSGGGGRDGR

SEQ ID NO: 862748 - protein, 23 aa, Mycobacterium
SRDIPMRLVYVVDPRDAATPSAC

SEQ ID NO: 862749 - protein, 17 aa, Mycobacterium
SRDLLVQRLAALGDRQT

SEQ ID NO: 862750 - protein, 17 aa, Mycobacterium
SRDLPEETLCWLYEMMV

SEQ ID NO: 862751 - protein, 17 aa, Mycobacterium
SRDLPRPHPDDPMYLVF

SEQ ID NO: 862752 - protein, 22 aa, Mycobacterium
SRDMHADVPWLGPDVDWWAQQF

SEQ ID NO: 862753 - protein, 17 aa, Mycobacterium
SRDNGWLGGVFPGDEAA

SEQ ID NO: 862754 - protein, 24 aa, Mycobacterium
SRDQQALLELLHPNGRALIERAAT

SEQ ID NO: 862755 - protein, 24 aa, Mycobacterium
SRDRDFSCFYFREGELIAADCVNR

SEQ ID NO: 862756 - protein, 26 aa, Mycobacterium
SRDRLLDQVWGWSAGLPSGRRTVDSH

SEQ ID NO: 862757 - protein, 20 aa, Mycobacterium
SRDTAFFWDGVKAHELRIQR

SEQ ID NO: 862758 - protein, 24 aa, Mycobacterium
SRDTDLMIRALRSLGFDIIGDGTD

SEQ ID NO: 862759 - protein, 21 aa, Mycobacterium
SRDTPFWMSADQFEYWSHTHL

SEQ ID NO: 862760 - protein, 32 aa, Mycobacterium
SRDTRRRIVMFEQFRAEWLWHKDLPDPDQAAQ

SEQ ID NO: 862761 - protein, 23 aa, Mycobacterium
SRDWSLFRTVFTEDCELDYGEIG

SEQ ID NO: 862762 - protein, 26 aa, Mycobacterium
SREAAKLMRKGKWGRIVSVSSMAVSL

SEQ ID NO: 862763 - protein, 25 aa, Mycobacterium
SREDWLRRLLDAQAFIRAEGPDYVR

SEQ ID NO: 862764 - protein, 26 aa, Mycobacterium
SREELLDICFLFLIAGLDTVTDSLDC

SEQ ID NO: 862765 - protein, 25 aa, Mycobacterium
SREEYAFHHPLIRTVAYESQLKSDR

SEQ ID NO: 862766 - protein, 22 aa, Mycobacterium
SREGFDAEWRMVLLVAVDGVVN

SEQ ID NO: 862767 - protein, 29 aa, Mycobacterium
SREHAVWALMDFGFRVVISSRFADIFRGN

SEQ ID NO: 862768 - protein, 28 aa, Mycobacterium
SREIEVLEFIPAAELDPLMYDKSYYLEP

SEQ ID NO: 862769 - protein, 20 aa, Mycobacterium
SRELLPERALLGDKAAIAAL

SEQ ID NO: 862770 - protein, 17 aa, Mycobacterium
SRELRIGSLALPSPVVL

SEQ ID NO: 862771 - protein, 27 aa, Mycobacterium
SRELVTDWLLNWSLTKYIPVTCVVTDA

SEQ ID NO: 862772 - protein, 26 aa, Mycobacterium
SRERDRWHFIPFAGGARACIGEHFAR

SEQ ID NO: 862773 - protein, 25 aa, Mycobacterium
SRERGYAYFLYSPEVPLTETAYDRL

SEQ ID NO: 862774 - protein, 18 aa, Mycobacterium
SRERVEMDLVRRPGPTRA

SEQ ID NO: 862775 - protein, 17 aa, Mycobacterium
SREVINLHGTYAQVVCL

SEQ ID NO: 862776 - protein, 24 aa, Mycobacterium
SREVSTFVLFLASDESSYATGSEF

SEQ ID NO: 862777 - protein, 31 aa, Mycobacterium
SREVVGAYTQLPFKLAWAITIHKSQGQTLER

SEQ ID NO: 862778 - protein, 24 aa, Mycobacterium
SREYPWYGSFIIESLPELGVEDAV

SEQ ID NO: 862779 - protein, 28 aa, Mycobacterium
SRFAGPAFLLNEMLVWGFTGQVISAMLD

SEQ ID NO: 862780 - protein, 18 aa, Mycobacterium
SRFAVIPRRGLSGDIRWF

SEQ ID NO: 862781 - protein, 25 aa, Mycobacterium
SRFDEWMTIFAGWRGPVPDKIEEGT

SEQ ID NO: 862782 - protein, 24 aa, Mycobacterium
SRFKRTVFGWSMRVGLRVSAARQA

SEQ ID NO: 862783 - protein, 22 aa, Mycobacterium
SRFMSMCEARQLPAVRIGVVDQ

SEQ ID NO: 862784 - protein, 25 aa, Mycobacterium
SRFRRRVYVYAREWPGESPLQSSFE

SEQ ID NO: 862785 - protein, 18 aa, Mycobacterium
SRFSLLEAQLRQMSLDES

SEQ ID NO: 862786 - protein, 17 aa, Mycobacterium
SRFTPFLTVPGAENAFA

SEQ ID NO: 862787 - protein, 20 aa, Mycobacterium
SRFTTLGHRTGIRLDSGIVA

SEQ ID NO: 862788 - protein, 29 aa, Mycobacterium
SRFVATVYERLWRPAAFYLASGVTTRAEQ

SEQ ID NO: 862789 - protein, 30 aa, Mycobacterium
SRFVATVYERLWRPTSFYLASGITARAEQR

SEQ ID NO: 862790 - protein, 24 aa, Mycobacterium
SRFVRVRLRHEVLPLLEEVLGGGV

SEQ ID NO: 862791 - protein, 18 aa, Mycobacterium
SRFWRVRDISRSGLEIKK

SEQ ID NO: 862792 - protein, 24 aa, Mycobacterium
SRGAIFHHFRDKDTLFFALAREDA

SEQ ID NO: 862793 - protein, 23 aa, Mycobacterium
SRGAWQFIAPTFAAYHQLGTSTN

SEQ ID NO: 862794 - protein, 25 aa, Mycobacterium
SRGEVLAYERVTLYGLPLVARRRVG

SEQ ID NO: 862795 - protein, 26 aa, Mycobacterium
SRGFHIYAPVARRWTYRELRLAAETV

SEQ ID NO: 862796 - protein, 31 aa, Mycobacterium
SRGGLMGQAWLRAGRRFLAVQTALVDDAATG

SEQ ID NO: 862797 - protein, 33 aa, Mycobacterium
SRGHLGGLAAAVPAAIRLLQAICYDEVLLETVG

SEQ ID NO: 862798 - protein, 17 aa, Mycobacterium
SRGHLGGLAASVPAAIR

SEQ ID NO: 862799 - protein, 18 aa, Mycobacterium
SRGKHLFIRVGPASIHSH

SEQ ID NO: 862800 - protein, 18 aa, Mycobacterium
SRGLALRAGIAAGAATDL

SEQ ID NO: 862801 - protein, 29 aa, Mycobacterium
SRGLPLPIIAGNLFRFELLRTRHDLRQRA

SEQ ID NO: 862802 - protein, 18 aa, Mycobacterium
SRGQGLVKRMLLGSVSTG

SEQ ID NO: 862803 - protein, 30 aa, Mycobacterium
SRGQILYDAPELIIPFMVPDGAHSYPDERR

SEQ ID NO: 862804 - protein, 29 aa, Mycobacterium
SRGQTAARLFYVYADLLLAVERTDEALQW

SEQ ID NO: 862805 - protein, 23 aa, Mycobacterium
SRGRIAALQRWPDGLQAAVEAKE

SEQ ID NO: 862806 - protein, 25 aa, Mycobacterium
SRGRTWLTELAGTQPIPVIGSVIRA

SEQ ID NO: 862807 - protein, 19 aa, Mycobacterium
SRGTHLVFDAAMFGNPTAA

SEQ ID NO: 862808 - protein, 24 aa, Mycobacterium
SRGTLFDALSPTAGFARGTLVGSL

SEQ ID NO: 862809 - protein, 25 aa, Mycobacterium
SRGTTFTIRLPWGAGHLPADAVASQ

SEQ ID NO: 862810 - protein, 24 aa, Mycobacterium
SRGVPPFGPGLRPLPGVVGDLRDA

SEQ ID NO: 862811 - protein, 30 aa, Mycobacterium
SRGVPPFGPGLRPWPGLPGRARDALMRRVT

SEQ ID NO: 862812 - protein, 24 aa, Mycobacterium
SRGVPPFGPGMRPLPGIVGEARDA

SEQ ID NO: 862813 - protein, 26 aa, Mycobacterium
SRGYAPLPVALPVALAPTLAVGADIK

SEQ ID NO: 862814 - protein, 38 aa, Mycobacterium
SRGYRAMAAIPRLQFAHVDLLVRSFGSLQNLLAASADD

SEQ ID NO: 862815 - protein, 38 aa, Mycobacterium
SRGYRAMAGIPRLQFAHVDLLVRNFGSLQGLLAASASD

SEQ ID NO: 862816 - protein, 27 aa, Mycobacterium
SRHAPVRWFEIDPCYVFHPLNGYSEMR

SEQ ID NO: 862817 - protein, 18 aa, Mycobacterium
SRHLLYECYCSRKDIAQA

SEQ ID NO: 862818 - protein, 24 aa, Mycobacterium
SRHNAKVYGLPPLGAPPMSVPHLD

SEQ ID NO: 862819 - protein, 18 aa, Mycobacterium
SRHPLAEFLIDAISRAQD

SEQ ID NO: 862820 - protein, 18 aa, Mycobacterium
SRHPLISLPAGTGLRTRL

SEQ ID NO: 862821 - protein, 38 aa, Mycobacterium
SRHRIVIFTWDQAVIDDFWLLREYLPDAARINKALHVP

SEQ ID NO: 862822 - protein, 34 aa, Mycobacterium
SRHRVTVLHMVPSMLSTLLLLPQIDEWRQLRHVP

SEQ ID NO: 862823 - protein, 24 aa, Mycobacterium
SRHSVWIWEIRLFGYHIALTDVRT

SEQ ID NO: 862824 - protein, 24 aa, Mycobacterium
SRHTRFRFFYRVGFTPWEGHPIGQ

SEQ ID NO: 862825 - protein, 17 aa, Mycobacterium
SRIATLSTPMPPGEDLA

SEQ ID NO: 862826 - protein, 33 aa, Mycobacterium
SRIDDLLSGSGWLKRFWNNWGPDANIWNTIFSS

SEQ ID NO: 862827 - protein, 31 aa, Mycobacterium
SRIEYKLRDWLFARQRYWGEPFPIVYDEDGR

SEQ ID NO: 862828 - protein, 19 aa, Mycobacterium
SRIFYPVFVEGAMLSGGDL

SEQ ID NO: 862829 - protein, 24 aa, Mycobacterium
SRIGAYQRRGAVSTLLLVAQRVPY

SEQ ID NO: 862830 - protein, 19 aa, Mycobacterium
SRIGLSSSALAQRVPGDEV

SEQ ID NO: 862831 - protein, 25 aa, Mycobacterium
SRIGYAMRRISPGAVRLFARLDIRQ

SEQ ID NO: 862832 - protein, 26 aa, Mycobacterium
SRIILDDTMVYLAINKPRGMHSTMSD

SEQ ID NO: 862833 - protein, 17 aa, Mycobacterium
SRILGMGDLLSLIEQAE

SEQ ID NO: 862834 - protein, 19 aa, Mycobacterium
SRILLLEHIGRKSGAPRHA

SEQ ID NO: 862835 - protein, 18 aa, Mycobacterium
SRILVQRSVYDRFMELLE

SEQ ID NO: 862836 - protein, 25 aa, Mycobacterium
SRKADKWIPMLKNRTPVVAAALQNT

SEQ ID NO: 862837 - protein, 26 aa, Mycobacterium
SRKADKWVPLLTNRTPVVAAALQNTA

SEQ ID NO: 862838 - protein, 19 aa, Mycobacterium
SRKGLISSWKAYAPAWAGK

SEQ ID NO: 862839 - protein, 32 aa, Mycobacterium
SRKLVREWLTSWSKPGLIPVALVIVNVFVENV

SEQ ID NO: 862840 - protein, 23 aa, Mycobacterium
SRKSLVTDLRRILRPEYAVRARE

SEQ ID NO: 862841 - protein, 24 aa, Mycobacterium
SRLAARFTGVLRALGINKGYRVFT

SEQ ID NO: 862842 - protein, 26 aa, Mycobacterium
SRLAHIIPLMRAQLEKLLPGANGAVK

SEQ ID NO: 862843 - protein, 29 aa, Mycobacterium
SRLAVCLDLDWRPQFRVDLIPSYKAHRVA

SEQ ID NO: 862844 - protein, 30 aa, Mycobacterium
SRLAVTLSWIREFPSLGPISYPVQRHGMNL

SEQ ID NO: 862845 - protein, 27 aa, Mycobacterium
SRLDDLARRLIVLVEPVEAIVSRIDEM

SEQ ID NO: 862846 - protein, 23 aa, Mycobacterium
SRLEAIGMQLQRSHSFFVGDPQI

SEQ ID NO: 862847 - protein, 19 aa, Mycobacterium
SRLFQEIREARGLAYSVCS

SEQ ID NO: 862848 - protein, 17 aa, Mycobacterium
SRLGPEAVRLIAETFAQ

SEQ ID NO: 862849 - protein, 25 aa, Mycobacterium
SRLHAKLFYQPLLESVTEFDKEALG

SEQ ID NO: 862850 - protein, 23 aa, Mycobacterium
SRLHANLLDRHRPLWETHVIEGL

SEQ ID NO: 862851 - protein, 19 aa, Mycobacterium
SRLHELGHAGLAQHISREL

SEQ ID NO: 862852 - protein, 24 aa, Mycobacterium
SRLHTSLLDRHRPLWELHVVEGLS

SEQ ID NO: 862853 - protein, 22 aa, Mycobacterium
SRLIRPGQRVLLWVSAHPLWGF

SEQ ID NO: 862854 - protein, 22 aa, Mycobacterium
SRLKMPMPAGLARWQQDRGRRL

SEQ ID NO: 862855 - protein, 17 aa, Mycobacterium
SRLLAEYWAHEAALMAV

SEQ ID NO: 862856 - protein, 19 aa, Mycobacterium
SRLLAEYWAHEAALMAVED

SEQ ID NO: 862857 - protein, 17 aa, Mycobacterium
SRLLGKHLGIGDATVAR

SEQ ID NO: 862858 - protein, 19 aa, Mycobacterium
SRLLKPYHPALDVSPFAQA

SEQ ID NO: 862859 - protein, 17 aa, Mycobacterium
SRLLLPVGPRDLSANGA

SEQ ID NO: 862860 - protein, 21 aa, Mycobacterium
SRLMHDYTIPLRPSGPRPTEP

SEQ ID NO: 862861 - protein, 32 aa, Mycobacterium
SRLNHQIGWLSPRTRTLVLGLPRDYIAHAGRD

SEQ ID NO: 862862 - protein, 27 aa, Mycobacterium
SRLPELPQLRWRVVGAPLGLDRPYFVE

SEQ ID NO: 862863 - protein, 22 aa, Mycobacterium
SRLPPIYPGTTVSIPPTTTSAG

SEQ ID NO: 862864 - protein, 26 aa, Mycobacterium
SRLQPCLSVDFPRPAPRPAYTALDGD

SEQ ID NO: 862865 - protein, 18 aa, Mycobacterium
SRLRLFEITAGLADKYVP

SEQ ID NO: 862866 - protein, 18 aa, Mycobacterium
SRLRSVLTDLLTISEAAE

SEQ ID NO: 862867 - protein, 18 aa, Mycobacterium
SRLSGLLRHRPEPGLMLL

SEQ ID NO: 862868 - protein, 22 aa, Mycobacterium
SRLSQLWFEALAGICAHVRSGG

SEQ ID NO: 862869 - protein, 22 aa, Mycobacterium
SRLSWAVLDWNVNAIALYDGVG

SEQ ID NO: 862870 - protein, 18 aa, Mycobacterium
SRLTSYFADITGLHPRTR

SEQ ID NO: 862871 - protein, 17 aa, Mycobacterium
SRLTSYFADITSLAPRT

SEQ ID NO: 862872 - protein, 18 aa, Mycobacterium
SRLVAPLRTLTGAATSGV

SEQ ID NO: 862873 - protein, 24 aa, Mycobacterium
SRLVDLLTSIALPPPEILAPPTSI

SEQ ID NO: 862874 - protein, 18 aa, Mycobacterium
SRLWFDSLAGICAHVRGG

SEQ ID NO: 862875 - protein, 17 aa, Mycobacterium
SRLWFEALTGICAHVRA

SEQ ID NO: 862876 - protein, 21 aa, Mycobacterium
SRMDIPRTAAPILRQLVDTLQ

SEQ ID NO: 862877 - protein, 21 aa, Mycobacterium
SRMEETQIFGAEWIHSLGVIP

SEQ ID NO: 862878 - protein, 18 aa, Mycobacterium
SRMGIGPVGAVEKLFGRT

SEQ ID NO: 862879 - protein, 18 aa, Mycobacterium
SRMLGRPGDGWRLAMDLL

SEQ ID NO: 862880 - protein, 18 aa, Mycobacterium
SRMLLQVHDELLFEVAAG

SEQ ID NO: 862881 - protein, 18 aa, Mycobacterium
SRMLVAGAALRVPLVSVI

SEQ ID NO: 862882 - protein, 19 aa, Mycobacterium
SRMMVLGPLGESFGRVRDV

SEQ ID NO: 862883 - protein, 18 aa, Mycobacterium
SRMPNLRCLILTSYTSDE

SEQ ID NO: 862884 - protein, 35 aa, Mycobacterium
SRMYGLLRRLLFLLPPERVHKLVFAVLRGATAATP

SEQ ID NO: 862885 - protein, 22 aa, Mycobacterium
SRNAWYLDPDTHRYKRLTAAVR

SEQ ID NO: 862886 - protein, 24 aa, Mycobacterium
SRNAYRYEFGWRSTAVDGLLGAAH

SEQ ID NO: 862887 - protein, 24 aa, Mycobacterium
SRNEYVAGWIKRGPSGVIGTNKKC

SEQ ID NO: 862888 - protein, 24 aa, Mycobacterium
SRNGVFWIREMLPIGELREILSAA

SEQ ID NO: 862889 - protein, 19 aa, Mycobacterium
SRNLARLRRLGWSDDVTPV

SEQ ID NO: 862890 - protein, 17 aa, Mycobacterium
SRNMRLVLGVYAYKSCC

SEQ ID NO: 862891 - protein, 26 aa, Mycobacterium
SRNRAWLICRLDFKGRRRELMRPGTY

SEQ ID NO: 862892 - protein, 25 aa, Mycobacterium
SRNRPSRVLLAGHLDTVPPAGNLPS

SEQ ID NO: 862893 - protein, 18 aa, Mycobacterium
SRPAGQVERLSWPPKPIT

SEQ ID NO: 862894 - protein, 23 aa, Mycobacterium
SRPARFYYGARTPADLFYLDEIL

SEQ ID NO: 862895 - protein, 20 aa, Mycobacterium
SRPAVYRRWPSKAHLVHEAV

SEQ ID NO: 862896 - protein, 28 aa, Mycobacterium
SRPDGKWRAVAKVSAWLLAASDTSDVTT

SEQ ID NO: 862897 - protein, 23 aa, Mycobacterium
SRPEAQAFINEWPCAALPDEIAA

SEQ ID NO: 862898 - protein, 38 aa, Mycobacterium
SRPGADRAILATASLAGILPWHPDPVYSLGKHGVVGLM

SEQ ID NO: 862899 - protein, 19 aa, Mycobacterium
SRPGHFMPAKLLQSQFQTL

SEQ ID NO: 862900 - protein, 19 aa, Mycobacterium
SRPLLICRGHGIVSASRTV

SEQ ID NO: 862901 - protein, 19 aa, Mycobacterium
SRPNWWHATPMVADAPKSM

SEQ ID NO: 862902 - protein, 17 aa, Mycobacterium
SRPPILDLVLPSAVGEI

SEQ ID NO: 862903 - protein, 21 aa, Mycobacterium
SRPPRLVRLSHLGAKRKGKRV

SEQ ID NO: 862904 - protein, 20 aa, Mycobacterium
SRPPRLVRLTYRGAKGKKAK

SEQ ID NO: 862905 - protein, 21 aa, Mycobacterium
SRPPRLVRLVYRGSRLAKNAK

SEQ ID NO: 862906 - protein, 19 aa, Mycobacterium
SRPPTLYRPPSRPEVITRL

SEQ ID NO: 862907 - protein, 30 aa, Mycobacterium
SRPRRAFRRIKGAALEALLPEDFSPGQTEG

SEQ ID NO: 862908 - protein, 31 aa, Mycobacterium
SRPSPLSLDDVVKFLLPPAAAKKPGKATAAS

SEQ ID NO: 862909 - protein, 30 aa, Mycobacterium; identical to SEQ ID NO: 733924

SEQ ID NO: 862910 - protein, 25 aa, Mycobacterium
SRPSVYRRWPDVRTLVAELLTREMG

SEQ ID NO: 862911 - protein, 21 aa, Mycobacterium
SRPTAPFLIRPAENADDLASY

SEQ ID NO: 862912 - protein, 29 aa, Mycobacterium
SRPTIYRRWPDIRWVIAEVLTVRISDVLA

SEQ ID NO: 862913 - protein, 24 aa, Mycobacterium
SRPTLHYYFATREDLYDALLADVC

SEQ ID NO: 862914 - protein, 22 aa, Mycobacterium
SRPTLNYYFATRDELFHALVHE

SEQ ID NO: 862915 - protein, 29 aa, Mycobacterium
SRPTRTGLGTYRFFLDCVGHIDDIAVGEA

SEQ ID NO: 862916 - protein, 18 aa, Mycobacterium
SRPVDYVESLGWLGSDVW

SEQ ID NO: 862917 - protein, 18 aa, Mycobacterium
SRPVLAEPLTALTARADE

SEQ ID NO: 862918 - protein, 18 aa, Mycobacterium
SRPVLAQPLAAITARGDE

SEQ ID NO: 862919 - protein, 18 aa, Mycobacterium
SRPVNLPQWVPTRGQRKA

SEQ ID NO: 862920 - protein, 21 aa, Mycobacterium
SRPWTILPVEMIRSRQFVLPA

SEQ ID NO: 862921 - protein, 22 aa, Mycobacterium
SRPYSAWLSYSQSKLANLLFTS

SEQ ID NO: 862922 - protein, 27 aa, Mycobacterium
SRQAIWDLVTSFKKLGIATLLTTQYLE

SEQ ID NO: 862923 - protein, 31 aa, Mycobacterium
SRQASEIEMMRGWLALWGVGPAAAQQHHPNQ

SEQ ID NO: 862924 - protein, 21 aa, Mycobacterium
SRQFHAALTRPSRMHRLLHML

SEQ ID NO: 862925 - protein, 22 aa, Mycobacterium
SRQLCERWGIRQVPLHILDGDN

SEQ ID NO: 862926 - protein, 23 aa, Mycobacterium
SRQLEMFLDLVGYLSATSAAFFL

SEQ ID NO: 862927 - protein, 17 aa, Mycobacterium
SRQYGTIDWCVGVFKTP

SEQ ID NO: 862928 - protein, 18 aa, Mycobacterium
SRQYGTIDWCVGVFKTPS

SEQ ID NO: 862929 - protein, 18 aa, Mycobacterium
SRRAEVASLLRFAGGLHI

SEQ ID NO: 862930 - protein, 23 aa, Mycobacterium
SRRDIQLVPYSLSGSGVHGLLVR

SEQ ID NO: 862931 - protein, 28 aa, Mycobacterium
SRRDRNLIRRAFLGPDGPGGRRLYGVSD

SEQ ID NO: 862932 - protein, 30 aa, Mycobacterium
SRRDVLKVCKFALAPALFGLGTLAESVDAP

SEQ ID NO: 862933 - protein, 24 aa, Mycobacterium
SRRFHRALVLPCGMHRLLHMFEAT

SEQ ID NO: 862934 - protein, 27 aa, Mycobacterium
SRRFVRRSYRTPLFLARLAAAARVYER

SEQ ID NO: 862935 - protein, 30 aa, Mycobacterium
SRRFYEGLLGFQFWWELDPPDSATSQLVGL

SEQ ID NO: 862936 - protein, 18 aa, Mycobacterium
SRRGLARHYALRLTDSIV

SEQ ID NO: 862937 - protein, 20 aa, Mycobacterium
SRRHLITATLDHPVTVRSHD

SEQ ID NO: 862938 - protein, 17 aa, Mycobacterium
SRRIPDFVKLAEALGCV

SEQ ID NO: 862939 - protein, 19 aa, Mycobacterium
SRRIVDLTAIPLTELGRPR

SEQ ID NO: 862940 - protein, 17 aa, Mycobacterium
SRRLLLMIGKDMGLDTK

SEQ ID NO: 862941 - protein, 19 aa, Mycobacterium
SRRLSRIAPAFQPNPAAGR

SEQ ID NO: 862942 - protein, 21 aa, Mycobacterium
SRRLVISMICTVGNYEYGFFW

SEQ ID NO: 862943 - protein, 30 aa, Mycobacterium
SRRLVREWLTTWSQAKLIPVALVVVNVFVE

SEQ ID NO: 862944 - protein, 29 aa, Mycobacterium
SRRPTISVAIYEKPLTTPLLNLVMNESRI

SEQ ID NO: 862945 - protein, 19 aa, Mycobacterium
SRRQWLQRGLTGIAKLPSD

SEQ ID NO: 862946 - protein, 32 aa, Mycobacterium
SRRRAAPISIRLIEPIITRTIGKTVYDDIRRM

SEQ ID NO: 862947 - protein, 29 aa, Mycobacterium
SRRREDYVGPWLPEPLLTEADPSADVVLA

SEQ ID NO: 862948 - protein, 28 aa, Mycobacterium
SRRRFDPRAYLPPLDTLLDVLRERDYVV

SEQ ID NO: 862949 - protein, 17 aa, Mycobacterium
SRRRLAMAMGAIRARES

SEQ ID NO: 862950 - protein, 17 aa, Mycobacterium
SRRRLAMAMGAIRARQS

SEQ ID NO: 862951 - protein, 19 aa, Mycobacterium
SRRRYPWGAQPPSADLANL

SEQ ID NO: 862952 - protein, 19 aa, Mycobacterium
SRRSAWWVGAVTLSVAKII

SEQ ID NO: 862953 - protein, 24 aa, Mycobacterium
SRRTALMNRLLWRVHELDPTHAVP

SEQ ID NO: 862954 - protein, 19 aa, Mycobacterium
SRRTLFRYYASKSAIPWGD

SEQ ID NO: 862955 - protein, 23 aa, Mycobacterium
SRRTLYRRFPTKEALFEHLIEAE

SEQ ID NO: 862956 - protein, 23 aa, Mycobacterium
SRRTRLLDLLDNLSPREVGGHTR

SEQ ID NO: 862957 - protein, 17 aa, Mycobacterium
SRRVPLQHLLGTAAFGP

SEQ ID NO: 862958 - protein, 19 aa, Mycobacterium
SRRVVDLTAIPLSELGRPR

SEQ ID NO: 862959 - protein, 28 aa, Mycobacterium
SRRWQRLQFDHGWLLPGNPPEFGGRNAN

SEQ ID NO: 862960 - protein, 25 aa, Mycobacterium
SRRYGNVFTLRLPMWGRVIMVSDPQ

SEQ ID NO: 862961 - protein, 22 aa, Mycobacterium
SRSAKQQLDHWARVGRAVSSQH

SEQ ID NO: 862962 - protein, 20 aa, Mycobacterium
SRSDFHKRLQKMQGAITAVA

SEQ ID NO: 862963 - protein, 20 aa, Mycobacterium
SRSDKYVFIAAGSAVTSEVR

SEQ ID NO: 862964 - protein, 25 aa, Mycobacterium
SRSDPPLFVFASSAAVYGSRNPHRQ

SEQ ID NO: 862965 - protein, 24 aa, Mycobacterium
SRSEMAWCFPAVPMVVRAPAAKPP

SEQ ID NO: 862966 - protein, 25 aa, Mycobacterium
SRSERDPWPTYPTLFRVASAHEEGG

SEQ ID NO: 862967 - protein, 24 aa, Mycobacterium
SRSLMFHMQALRAGARPARVGTDL

SEQ ID NO: 862968 - protein, 25 aa, Mycobacterium
SRSLWPMLTSIWEWERRWVTDHAEP

SEQ ID NO: 862969 - protein, 23 aa, Mycobacterium
SRSPDDLPAFCQALVDNLAAARI

SEQ ID NO: 862970 - protein, 22 aa, Mycobacterium
SRSQLYHYFDNKDALIGEVIKT

SEQ ID NO: 862971 - protein, 26 aa, Mycobacterium
SRSRARASARRWLEAVGAVELADRRP

SEQ ID NO: 862972 - protein, 17 aa, Mycobacterium
SRSTGEIVFWGTGSAAN

SEQ ID NO: 862973 - protein, 24 aa, Mycobacterium
SRSTIYRRFPTKEKLFGQVVRREA

SEQ ID NO: 862974 - protein, 39 aa, Mycobacterium
SRSTLEATWRLNAAMWRAGFPPRLIHSTGFRGLIDSQLY

SEQ ID NO: 862975 - protein, 17 aa, Mycobacterium
SRTAFFDEFFLDATRAG

SEQ ID NO: 862976 - protein, 17 aa, Mycobacterium
SRTAWLRDPYADIGADC

SEQ ID NO: 862977 - protein, 17 aa, Mycobacterium
SRTELYATIVRPGQLTD

SEQ ID NO: 862978 - protein, 23 aa, Mycobacterium
SRTEMAWCFPAVPMVVRAPAARP

SEQ ID NO: 862979 - protein, 20 aa, Mycobacterium
SRTFGRGPRPLLVSVRSGAT

SEQ ID NO: 862980 - protein, 23 aa, Mycobacterium
SRTFGRGPRPMLVSVRSGAALSM

SEQ ID NO: 862981 - protein, 28 aa, Mycobacterium
SRTGLSIAKVIKLLRPLRSATITINGAT

SEQ ID NO: 862982 - protein, 22 aa, Mycobacterium
SRTHAFVVVHRLDNLRRSGRIG

SEQ ID NO: 862983 - protein, 25 aa, Mycobacterium
SRTHPNLVRKLFSLEVPEIADESVE

SEQ ID NO: 862984 - protein, 26 aa, Mycobacterium
SRTIADHRIPLWLTALRARHADVAVS

SEQ ID NO: 862985 - protein, 20 aa, Mycobacterium
SRTLFPTLNYATSAFEACDG

SEQ ID NO: 862986 - protein, 24 aa, Mycobacterium
SRTLFSDGYFLNRQDMDWFAGHYL

SEQ ID NO: 862987 - protein, 34 aa, Mycobacterium
SRTLMDTHPFGWLPLLSRVLASAQLVPGAAGGRG

SEQ ID NO: 862988 - protein, 30 aa, Mycobacterium
SRTLMDTHPFTWLPLLSRVLGSAELLPDAA

SEQ ID NO: 862989 - protein, 30 aa, Mycobacterium
SRTPEFLRWFLDEIPIEPVWVCPLRLRDSE

SEQ ID NO: 862990 - protein, 19 aa, Mycobacterium
SRTPEWWASWTLDSEELQK

SEQ ID NO: 862991 - protein, 33 aa, Mycobacterium
SRTPHEHWEVVRIALPPALSRYVVEKGSITVDG

SEQ ID NO: 862992 - protein, 21 aa, Mycobacterium
SRTPIVVPLVAMVGGGQLARM

SEQ ID NO: 862993 - protein, 23 aa, Mycobacterium
SRTRTWQVAAMRDLLLQHREPGT

SEQ ID NO: 862994 - protein, 28 aa, Mycobacterium
SRTTAWIAEGLFGYLPPEAQDRLLDNIS

SEQ ID NO: 862995 - protein, 24 aa, Mycobacterium
SRTTFLDAMALFDFGFERVAIPYE

SEQ ID NO: 862996 - protein, 23 aa, Mycobacterium
SRTTGWFTTKYPASLAVGELSWA

SEQ ID NO: 862997 - protein, 20 aa, Mycobacterium
SRTVAADRVRGLRFLMRKNK

SEQ ID NO: 862998 - protein, 26 aa, Mycobacterium
SRTVAGNIAYPLRVAGWTADKRNARV

SEQ ID NO: 862999 - protein, 18 aa, Mycobacterium
SRTWLVFEEWNALSSEWL

SEQ ID NO: 863000 - protein, 35 aa, Mycobacterium
SRVAPVYLYRFDYSTPLLKLLLVRAAHATELPYVW

SEQ ID NO: 863001 - protein, 22 aa, Mycobacterium
SRVELGALLLGYYDGRDLVYAG

SEQ ID NO: 863002 - protein, 18 aa, Mycobacterium
SRVFGRIDPIAMGGEQYR

SEQ ID NO: 863003 - protein, 18 aa, Mycobacterium
SRVGHSFIKALMAETGAI

SEQ ID NO: 863004 - protein, 20 aa, Mycobacterium
SRVGLINWLIQDPGNAAVAA

SEQ ID NO: 863005 - protein, 21 aa, Mycobacterium
SRVGLINWLIQDPGNPAVAAE

SEQ ID NO: 863006 - protein, 22 aa, Mycobacterium
SRVLLRDSILDGMREMLLARDW

SEQ ID NO: 863007 - protein, 33 aa, Mycobacterium
SRVLNLDPPLGISGTLWQKAMTPMIRAVQKLPG

SEQ ID NO: 863008 - protein, 32 aa, Mycobacterium
SRVLREEFPWLKSRLPSLWTNSYFVATVGGAP

SEQ ID NO: 863009 - protein, 19 aa, Mycobacterium
SRVLTTYRKAAPGPRGAAI

SEQ ID NO: 863010 - protein, 26 aa, Mycobacterium
SRVPEWFRYNAGLLAAQRTAVLPGDG

SEQ ID NO: 863011 - protein, 20 aa, Mycobacterium
SRVPKWIDHEIVVVPYAMSS

SEQ ID NO: 863012 - protein, 23 aa, Mycobacterium
SRVPSALASLTKGGLNAATRALA

SEQ ID NO: 863013 - protein, 20 aa, Mycobacterium
SRVRQPRPGAPLVVRIDHPR

SEQ ID NO: 863014 - protein, 18 aa, Mycobacterium
SRWASHVSAPILAGAFAV

SEQ ID NO: 863015 - protein, 27 aa, Mycobacterium
SRWESPYRLWHRLKGLTPPEPPKDIFD

SEQ ID NO: 863016 - protein, 20 aa, Mycobacterium
SRWIDPNSVPDWLIPRDLTG

SEQ ID NO: 863017 - protein, 21 aa, Mycobacterium
SRWLVRVMTSLMLFPGHDEAD

SEQ ID NO: 863018 - protein, 19 aa, Mycobacterium
SRWPSLTRSRLSAYIDRVV

SEQ ID NO: 863019 - protein, 17 aa, Mycobacterium
SRWSILCPSCDSGDVAV

SEQ ID NO: 863020 - protein, 17 aa, Mycobacterium
SRWVYRTSPDFYEVKNF

SEQ ID NO: 863021 - protein, 18 aa, Mycobacterium
SRWYRQPPPPPSGSHRLS

SEQ ID NO: 863022 - protein, 21 aa, Mycobacterium
SRYAPEFLKISPLGTVGDDGT

SEQ ID NO: 863023 - protein, 26 aa, Mycobacterium
SRYAVNPRVHLFFGARYRCELYDLPT

SEQ ID NO: 863024 - protein, 25 aa, Mycobacterium
SRYEVWRMYCDPPHWTETVASWAAR

SEQ ID NO: 863025 - protein, 21 aa, Mycobacterium
SRYHEWLSIHRAWRSKLPETL

SEQ ID NO: 863026 - protein, 20 aa, Mycobacterium
SRYHTRSRFLPAGLAPEQGL

SEQ ID NO: 863027 - protein, 17 aa, Mycobacterium
SRYLGPDKSFAIGLGCD

SEQ ID NO: 863028 - protein, 28 aa, Mycobacterium
SRYPLTRGAAGIALLASMPPRPGERDLV

SEQ ID NO: 863029 - protein, 25 aa, Mycobacterium
SRYVEAIVWRTYAQERLTAMASGAS

SEQ ID NO: 863030 - protein, 17 aa, Mycobacterium
SRYYKENSSLLAPLPGA

SEQ ID NO: 863031 - protein, 34 aa, Mycobacterium
SSAAASLIPLPASLQQFLAGLPSVGLGNKGNANL

SEQ ID NO: 863032 - protein, 24 aa, Mycobacterium
SSAAGIVALPWHAAYSASKYGLRG

SEQ ID NO: 863033 - protein, 25 aa, Mycobacterium
SSAAGIVALPWHAAYSASKYGLRGL

SEQ ID NO: 863034 - protein, 24 aa, Mycobacterium
SSAAGLVALPWHAAYSASKYGLRG

SEQ ID NO: 863035 - protein, 26 aa, Mycobacterium
SSAAGLVALPWHAAYSASKYGLRGLS

SEQ ID NO: 863036 - protein, 28 aa, Mycobacterium
SSAAMVGAISPYLTWLRATAQQCQQLAA

SEQ ID NO: 863037 - protein, 20 aa, Mycobacterium
SSAARHLAARWAAKEAVIKA

SEQ ID NO: 863038 - protein, 21 aa, Mycobacterium
SSAARHLAARWAAKEAVIKAW

SEQ ID NO: 863039 - protein, 22 aa, Mycobacterium
SSAARHLAARWAAKEAVIKAWS

SEQ ID NO: 863040 - protein, 18 aa, Mycobacterium
SSAAVELALASYPGFHVT

SEQ ID NO: 863041 - protein, 23 aa, Mycobacterium
SSAERLIILARETGRWADPVIRN

SEQ ID NO: 863042 - protein, 29 aa, Mycobacterium
SSAFGPTGPWAKRLGYGPLVRAAVGFTNL

SEQ ID NO: 863043 - protein, 21 aa, Mycobacterium
SSAGFYWMTAPAEAGQFLAQL

SEQ ID NO: 863044 - protein, 25 aa, Mycobacterium
SSAGILRRTLALQTDPYTVAPLWPD

SEQ ID NO: 863045 - protein, 26 aa, Mycobacterium
SSAGLLAAVNEPIAALTGRPLIGNGA

SEQ ID NO: 863046 - protein, 18 aa, Mycobacterium
SSAHLFEAYAMTNLLLCS

SEQ ID NO: 863047 - protein, 25 aa, Mycobacterium
SSAHRMLERLVQLRWLRRSGRDYEL

SEQ ID NO: 863048 - protein, 26 aa, Mycobacterium
SSAHRMLERLVQLRWLRRSGRDYELG

SEQ ID NO: 863049 - protein, 19 aa, Mycobacterium
SSALLALADERTLARVCRA

SEQ ID NO: 863050 - protein, 27 aa, Mycobacterium
SSALNEALSPDMRDAFNAYTDAARAVA

SEQ ID NO: 863051 - protein, 23 aa, Mycobacterium
SSAMTAWGPLWLCGRKSSNSLSR

SEQ ID NO: 863052 - protein, 24 aa, Mycobacterium
SSANFNVLVFQYPGRQDRAGEPAL

SEQ ID NO: 863053 - protein, 24 aa, Mycobacterium
SSANLAVLRTPPGGANYLASAIDR

SEQ ID NO: 863054 - protein, 24 aa, Mycobacterium
SSANWYARQLKFRDGIRGSLSGNL

SEQ ID NO: 863055 - protein, 23 aa, Mycobacterium
SSAQRFLTLDAFVAAGFQVVALL

SEQ ID NO: 863056 - protein, 24 aa, Mycobacterium
SSAQRFMTLDAFLAAGFHVVAMLN

SEQ ID NO: 863057 - protein, 26 aa, Mycobacterium
SSAQRLLTLDAFVAAGFHVVALLNEP

SEQ ID NO: 863058 - protein, 24 aa, Mycobacterium
SSARELIALLPQISPLISDELAGG

SEQ ID NO: 863059 - protein, 26 aa, Mycobacterium
SSARLYWESFRVWGQLDRVVMPTGVA

SEQ ID NO: 863060 - protein, 26 aa, Mycobacterium
SSASMVTIMTALWFEQLRSGDRVSVK

SEQ ID NO: 863061 - protein, 22 aa, Mycobacterium
SSATKAFVPSGVRPVSVAATAD

SEQ ID NO: 863062 - protein, 18 aa, Mycobacterium
SSATLRMALLGKVMTVGD

SEQ ID NO: 863063 - protein, 27 aa, Mycobacterium
SSATMAALANFFRIKPAYFTDDEYYEK

SEQ ID NO: 863064 - protein, 28 aa, Mycobacterium
SSATMAALANFFRIKPAYFTDDEYYEKL

SEQ ID NO: 863065 - protein, 19 aa, Mycobacterium
SSAVRRLVPQLPAAAGFAA

SEQ ID NO: 863066 - protein, 21 aa, Mycobacterium
SSAWPMLDLAAARGVAARIGL

SEQ ID NO: 863067 - protein, 24 aa, Mycobacterium
SSCETRLLIIDDLHFLRGRRERMT

SEQ ID NO: 863068 - protein, 17 aa, Mycobacterium
SSCISVTGPFPGFPVPL

SEQ ID NO: 863069 - protein, 27 aa, Mycobacterium
SSDAGTFGPPWPGLGAYGVSKAALERL

SEQ ID NO: 863070 - protein, 27 aa, Mycobacterium
SSDAGTFGPPWPGLGAYGVSKAALERM

SEQ ID NO: 863071 - protein, 23 aa, Mycobacterium
SSDAPVVIYFHGSAFIALGINSH

SEQ ID NO: 863072 - protein, 24 aa, Mycobacterium
SSDGQIDFWFTPSTRPNHHRVNMP

SEQ ID NO: 863073 - protein, 17 aa, Mycobacterium
SSDIPAWARRWQRLLFD

SEQ ID NO: 863074 - protein, 21 aa, Mycobacterium
SSDIQLYHLGLGAGADPMDER

SEQ ID NO: 863075 - protein, 21 aa, Mycobacterium
SSDLAVLSLLGPGVADPAVLT

SEQ ID NO: 863076 - protein, 28 aa, Mycobacterium
SSDLRVGQPVLAIGSPLGLAGTVTTGIV

SEQ ID NO: 863077 - protein, 21 aa, Mycobacterium
SSDMPLARRLGDDYKAVIRVS

SEQ ID NO: 863078 - protein, 18 aa, Mycobacterium
SSDPFYRDSLENDPLAFS

SEQ ID NO: 863079 - protein, 24 aa, Mycobacterium
SSDPLAVMFYIHGGAYVLGSSALA

SEQ ID NO: 863080 - protein, 24 aa, Mycobacterium
SSDPTAALAFLRRLHDETSRIDGF

SEQ ID NO: 863081 - protein, 25 aa, Mycobacterium
SSDQLIPLPDGVSARSAVALGMNAL

SEQ ID NO: 863082 - protein, 17 aa, Mycobacterium
SSDRPDCGGVLLPSLPQ

SEQ ID NO: 863083 - protein, 40 aa, Mycobacterium
SSDSYPVYQFGWFPDFPDPDNYLTPFFMPDNMLVNHFQND

SEQ ID NO: 863084 - protein, 24 aa, Mycobacterium
SSDVWDLHPFFDTSDKQRLKRTCN

SEQ ID NO: 863085 - protein, 23 aa, Mycobacterium
SSDVWELYPFFDTSDKKRLKRTC

SEQ ID NO: 863086 - protein, 28 aa, Mycobacterium
SSEAMANSIWPYVAWLRATAAATEQSAS

SEQ ID NO: 863087 - protein, 29 aa, Mycobacterium
SSEARLLHVAPLFHLADLAAWAGQTTLGG

SEQ ID NO: 863088 - protein, 25 aa, Mycobacterium
SSEEAMIFYRDPLQLISHLGEKHGS

SEQ ID NO: 863089 - protein, 27 aa, Mycobacterium
SSEEFFDLVWRLMRFDKHGPLDLVLYH

SEQ ID NO: 863090 - protein, 20 aa, Mycobacterium
SSEFLFRRDEDGDFWMLDGR

SEQ ID NO: 863091 - protein, 23 aa, Mycobacterium
SSEMQLHLACYRAFDDIGSVIHS

SEQ ID NO: 863092 - protein, 26 aa, Mycobacterium
SSERFYGTYRRQLSLGDGIDTGAISA

SEQ ID NO: 863093 - protein, 23 aa, Mycobacterium
SSERRRVAILGGNRIPFARSDGA

SEQ ID NO: 863094 - protein, 27 aa, Mycobacterium
SSETLYRRFMTPRLPTPALMHYLSEVD

SEQ ID NO: 863095 - protein, 27 aa, Mycobacterium
SSETSWEAPDPVWWLAHGYAVVNADIR

SEQ ID NO: 863096 - protein, 25 aa, Mycobacterium
SSEVPWRQPIPSLNYLLTSHVWRQD

SEQ ID NO: 863097 - protein, 24 aa, Mycobacterium
SSEYPGRFGALASLPLPHVPAALE

SEQ ID NO: 863098 - protein, 27 aa, Mycobacterium
SSFDFSVWEIFGALLRGRRLLVVPESV

SEQ ID NO: 863099 - protein, 25 aa, Mycobacterium
SSFDPRWTVRRILADALPAERYPDA

SEQ ID NO: 863100 - protein, 30 aa, Mycobacterium
SSFGDDTLFLERFILRPRHIEVQVLADTHG

SEQ ID NO: 863101 - protein, 26 aa, Mycobacterium
SSFLLDHALVDIGVGVRWLREVQGVE

SEQ ID NO: 863102 - protein, 17 aa, Mycobacterium
SSFQMPGGIYAPMIHPW

SEQ ID NO: 863103 - protein, 19 aa, Mycobacterium
SSFSSVTFGLAGQAWQGPA

SEQ ID NO: 863104 - protein, 28 aa, Mycobacterium
SSFSTPTAPTLPGGWQGSAQTASESGAR

SEQ ID NO: 863105 - protein, 26 aa, Mycobacterium
SSGAIKALWDTILPFADYAFNKSHAA

SEQ ID NO: 863106 - protein, 23 aa, Mycobacterium
SSGALGVPLGGLAAPGLAGTAGI

SEQ ID NO: 863107 - protein, 27 aa, Mycobacterium
SSGARPSALLLPLGPLAEHNVRTTFAS

SEQ ID NO: 863108 - protein, 24 aa, Mycobacterium
SSGERAMRPAFFSDPLPPPLPDDV

SEQ ID NO: 863109 - protein, 17 aa, Mycobacterium
SSGFPINLLSYLAQNTS

SEQ ID NO: 863110 - protein, 17 aa, Mycobacterium
SSGGIVLGLAPTAAAAI

SEQ ID NO: 863111 - protein, 29 aa, Mycobacterium
SSGGYRIGVRLWQVGSLAPQARNLREAAL

SEQ ID NO: 863112 - protein, 25 aa, Mycobacterium
SSGIRTFHGLHVHGFPNCFIESIAQ

SEQ ID NO: 863113 - protein, 30 aa, Mycobacterium
SSGKQRSRLALWSRRLFGEAITQAQYLLAD

SEQ ID NO: 863114 - protein, 23 aa, Mycobacterium
SSGMAVLAYLPDAAIHAYLERAD

SEQ ID NO: 863115 - protein, 17 aa, Mycobacterium
SSGNLLYLLLTHPDQLA

SEQ ID NO: 863116 - protein, 25 aa, Mycobacterium
SSGPHLHFEVLPRTPNFSNGYSGRI

SEQ ID NO: 863117 - protein, 19 aa, Mycobacterium
SSGPLRPTALWAPVLETQI

SEQ ID NO: 863118 - protein, 36 aa, Mycobacterium
SSGRQRAIPLISFISRQMDLRKWFADAGASGAEQDA

SEQ ID NO: 863119 - protein, 20 aa, Mycobacterium
SSGRWYIDCLAAAGAMSLGW

SEQ ID NO: 863120 - protein, 24 aa, Mycobacterium
SSGSPGILVLPPETAAPGADAIAV

SEQ ID NO: 863121 - protein, 25 aa, Mycobacterium
SSGSSAGFGFGGGGGGGGAGGHGGN

SEQ ID NO: 863122 - protein, 33 aa, Mycobacterium
SSGTFYTLRCYLDDRPIFLGRNGRISVFGSERA

SEQ ID NO: 863123 - protein, 26 aa, Mycobacterium
SSGVWELFWPDFPADGLYKFRVHGAD

SEQ ID NO: 863124 - protein, 27 aa, Mycobacterium
SSGVWELFWPGFPADGLYKFRVHGADG

SEQ ID NO: 863125 - protein, 24 aa, Mycobacterium
SSGYLDPGYPMDSAWRGALPPESG

SEQ ID NO: 863126 - protein, 17 aa, Mycobacterium
SSHLHLGGPEFLGGPAA

SEQ ID NO: 863127 - protein, 25 aa, Mycobacterium
SSHLYPHFPVFLTEVARVLRPGGNF

SEQ ID NO: 863128 - protein, 27 aa, Mycobacterium
SSHQTASRRRIEAALAGDLDTGQLSDD

SEQ ID NO: 863129 - protein, 26 aa, Mycobacterium
SSHRLRAVSAIGVRFPLESTANGKAA

SEQ ID NO: 863130 - protein, 25 aa, Mycobacterium
SSHRLRAVSAIGVRFPLNGTANGKA

SEQ ID NO: 863131 - protein, 25 aa, Mycobacterium
SSIEYRGLLRLQYAVRIGRDPNGFP

SEQ ID NO: 863132 - protein, 20 aa, Mycobacterium
SSIIAIYRRHQAVLVALNEM

SEQ ID NO: 863133 - protein, 19 aa, Mycobacterium
SSIIGVHNWHLALFDQQAQ

SEQ ID NO: 863134 - protein, 21 aa, Mycobacterium
SSILAGDFARRGLDSELAPLY

SEQ ID NO: 863135 - protein, 23 aa, Mycobacterium
SSILEAALELPLYRGLVSARGDS

SEQ ID NO: 863136 - protein, 20 aa, Mycobacterium
SSILKLFDNPLFNSQAVGDF

SEQ ID NO: 863137 - protein, 21 aa, Mycobacterium
SSILTITSGDFHRLIDAHLGT

SEQ ID NO: 863138 - protein, 17 aa, Mycobacterium
SSINFADVLIAFGRYPS

SEQ ID NO: 863139 - protein, 34 aa, Mycobacterium
SSIPIAIRSGLGPISIVLLDIPAAPGFGNSTSAP

SEQ ID NO: 863140 - protein, 27 aa, Mycobacterium
SSIRQVFILGRPAPWRQHIPYGGIDAR

SEQ ID NO: 863141 - protein, 40 aa, Mycobacterium
SSISDLRAIPWVLAWSQSRVMLPGWYGTGTAFEQWIAAGP

SEQ ID NO: 863142 - protein, 20 aa, Mycobacterium
SSIVTALREQLRTQKQRYQT

SEQ ID NO: 863143 - protein, 18 aa, Mycobacterium
SSKAWDFANDPQRAAAVR

SEQ ID NO: 863144 - protein, 24 aa, Mycobacterium
SSKDQLFERALAQEMRKFLDELQA

SEQ ID NO: 863145 - protein, 25 aa, Mycobacterium
SSKGGVVGLTLPVARDLAAVGIRVN

SEQ ID NO: 863146 - protein, 17 aa, Mycobacterium
SSKNHLIAEIYLNLMQQ

SEQ ID NO: 863147 - protein, 26 aa, Mycobacterium
SSKNQSRWQFGVLGPPGAADAGLGED

SEQ ID NO: 863148 - protein, 26 aa, Mycobacterium
SSKNQSRWQFGVLGPPGALEAGVGED

SEQ ID NO: 863149 - protein, 23 aa, Mycobacterium
SSKPAYSIVLPPPNVTGSLHMGH

SEQ ID NO: 863150 - protein, 24 aa, Mycobacterium
SSKPDLLQLITTDSAPIINHCSSR

SEQ ID NO: 863151 - protein, 24 aa, Mycobacterium
SSKPVLVDFWATWCGPCKMVAPVL

SEQ ID NO: 863152 - protein, 26 aa, Mycobacterium
SSKQAILDALIRRLDEWRSLECIRAL

SEQ ID NO: 863153 - protein, 29 aa, Mycobacterium
SSKRALDLFLKIAMLRRAHPDRPHACLMT

SEQ ID NO: 863154 - protein, 17 aa, Mycobacterium
SSKWALRGLTQVAAAEL

SEQ ID NO: 863155 - protein, 21 aa, Mycobacterium
SSKWALRGLTQVAAVELAPSG

SEQ ID NO: 863156 - protein, 18 aa, Mycobacterium
SSLAELLVALLYSGRIDL

SEQ ID NO: 863157 - protein, 20 aa, Mycobacterium
SSLAVFLSGLLAASSSPEYK

SEQ ID NO: 863158 - protein, 24 aa, Mycobacterium
SSLELAHKFFMPLGDHMREAMADL

SEQ ID NO: 863159 - protein, 40 aa, Mycobacterium
SSLKHLRRLVLAGRWTMSVLRWLHLLGWVVRRAASGLPDD

SEQ ID NO: 863160 - protein, 31 aa, Mycobacterium
SSLKIDRLFAYWELRAMISQLLGSGGDGLLA

SEQ ID NO: 863161 - protein, 18 aa, Mycobacterium
SSLKYLFQAGERLDPDTY

SEQ ID NO: 863162 - protein, 21 aa, Mycobacterium
SSLLDAISLAFLPSHRRNFNA

SEQ ID NO: 863163 - protein, 26 aa, Mycobacterium
SSLLNYYPHLLALSASSPWWGGEDTG

SEQ ID NO: 863164 - protein, 24 aa, Mycobacterium
SSLLQGITTHYLLTSVYPVAAGDT

SEQ ID NO: 863165 - protein, 21 aa, Mycobacterium
SSLMHHFGYISLKDLNFQSRP

SEQ ID NO: 863166 - protein, 21 aa, Mycobacterium
SSLMHHFGYISLKDLNWRSRP

SEQ ID NO: 863167 - protein, 26 aa, Mycobacterium
SSLRGLIEVRFPDGWSVAPRRLPFDL

SEQ ID NO: 863168 - protein, 24 aa, Mycobacterium
SSLVNWQFAPAEKLPFDDGALDAV

SEQ ID NO: 863169 - protein, 24 aa, Mycobacterium
SSLVQTFHMRYPAVRVRLVGQNSA

SEQ ID NO: 863170 - protein, 18 aa, Mycobacterium
SSLWLDAAGNRLPVPLYP

SEQ ID NO: 863171 - protein, 18 aa, Mycobacterium
SSLWLDATGKRLPVPLYP

SEQ ID NO: 863172 - protein, 18 aa, Mycobacterium
SSLYSAVPFAQDASVLVI

SEQ ID NO: 863173 - protein, 18 aa, Mycobacterium
SSLYYPDFPRFLGEVARV

SEQ ID NO: 863174 - protein, 26 aa, Mycobacterium
SSMGLLDEFPPYDSIFDPVNRVLLPR

SEQ ID NO: 863175 - protein, 25 aa, Mycobacterium
SSMIALPHLLRHPLRKVINFYRSPL

SEQ ID NO: 863176 - protein, 22 aa, Mycobacterium
SSMIALPNLLAGPAAKVINFYR

SEQ ID NO: 863177 - protein, 24 aa, Mycobacterium
SSMIEALDLLLEFKDRSAKKEIKQ

SEQ ID NO: 863178 - protein, 36 aa, Mycobacterium
SSMMSMFTFTELIWAEFWADFPQLKFSLTEGDVGWI

SEQ ID NO: 863179 - protein, 24 aa, Mycobacterium
SSMSIHFDIVAPYLVELTTDEQKQ

SEQ ID NO: 863180 - protein, 23 aa, Mycobacterium
SSMVLLSPWLDVGTGGLGAAWAG

SEQ ID NO: 863181 - protein, 28 aa, Mycobacterium
SSMVSLGWLPPSYIPTGYPYAPSVAPGL

SEQ ID NO: 863182 - protein, 19 aa, Mycobacterium
SSMWAGPLCGHLLARAGAT

SEQ ID NO: 863183 - protein, 19 aa, Mycobacterium
SSMWAGPLCGQLLARAGAT

SEQ ID NO: 863184 - protein, 25 aa, Mycobacterium
SSNALFPIASFLLEKVHRGRNTILE

SEQ ID NO: 863185 - protein, 29 aa, Mycobacterium
SSNGALFLVLRPLLVDYVMSMPRGPQVIY

SEQ ID NO: 863186 - protein, 23 aa, Mycobacterium
SSNGLQFFLRDIPPTWPAHVRPG

SEQ ID NO: 863187 - protein, 23 aa, Mycobacterium
SSNKAFYRYFAGKDDLILAVMER

SEQ ID NO: 863188 - protein, 26 aa, Mycobacterium
SSNKPVLVDFWATWCGPCKMVAPVLE

SEQ ID NO: 863189 - protein, 23 aa, Mycobacterium
SSNLARFDAMRFGLRVGDDGTHS

SEQ ID NO: 863190 - protein, 23 aa, Mycobacterium
SSNLARFDAMRYGLRIGDDGTHS

SEQ ID NO: 863191 - protein, 22 aa, Mycobacterium
SSNLARFDAMRYGLRVGDDGSH

SEQ ID NO: 863192 - protein, 22 aa, Mycobacterium
SSNLARFDAMRYGLRVGDDGTH

SEQ ID NO: 863193 - protein, 22 aa, Mycobacterium
SSNLLAHHLGVLQSAGVVHKRR

SEQ ID NO: 863194 - protein, 17 aa, Mycobacterium
SSNLLFRRNSVTGAVEV

SEQ ID NO: 863195 - protein, 24 aa, Mycobacterium
SSNTHRWFGAYGPSKAALDHLMMV

SEQ ID NO: 863196 - protein, 24 aa, Mycobacterium
SSPDPVIPAKLSLFGGVMVPPKYL

SEQ ID NO: 863197 - protein, 24 aa, Mycobacterium
SSPDRFLVGLAVLNLLADAAADRP

SEQ ID NO: 863198 - protein, 21 aa, Mycobacterium
SSPERIAWLEKVVAAGYGAPT

SEQ ID NO: 863199 - protein, 21 aa, Mycobacterium
SSPGFSWQPLHTMPGISTFYT

SEQ ID NO: 863200 - protein, 22 aa, Mycobacterium
SSPGLLQYPWGVIPDKYIARVQ

SEQ ID NO: 863201 - protein, 21 aa, Mycobacterium
SSPLHSLQQQALTAVNAPIQA

SEQ ID NO: 863202 - protein, 17 aa, Mycobacterium
SSPLLRPGGRMLAIKGE

SEQ ID NO: 863203 - protein, 21 aa, Mycobacterium
SSPLPVYTALAGYVDAGLDVT

SEQ ID NO: 863204 - protein, 18 aa, Mycobacterium
SSPLRKGLFHEDLEEFDR

SEQ ID NO: 863205 - protein, 25 aa, Mycobacterium
SSPPFQGDLYAWLVMQRKPQTVVEF

SEQ ID NO: 863206 - protein, 28 aa, Mycobacterium
SSPQFDQHMYLPTLFGEGPAGGIGGLPS

SEQ ID NO: 863207 - protein, 31 aa, Mycobacterium
SSPRLYGGTYNLLHYTLPKLGIETTFVENPD

SEQ ID NO: 863208 - protein, 23 aa, Mycobacterium
SSPRRVAQLKALGLGLEIRPLRG

SEQ ID NO: 863209 - protein, 21 aa, Mycobacterium
SSPRVLLYLFGSKDGLVRALV

SEQ ID NO: 863210 - protein, 17 aa, Mycobacterium
SSPTEIAYILVLHTRFP

SEQ ID NO: 863211 - protein, 26 aa, Mycobacterium
SSPTQIRTPFGTIPLPHVEVTTPATV

SEQ ID NO: 863212 - protein, 24 aa, Mycobacterium
SSPVLLFETGLPTRYYIDPTDVAF

SEQ ID NO: 863213 - protein, 21 aa, Mycobacterium
SSPYPFFEYMRRTDPVWHGSL

SEQ ID NO: 863214 - protein, 23 aa, Mycobacterium
SSQEAFIMTTRFMTDPHAMRDMA

SEQ ID NO: 863215 - protein, 17 aa, Mycobacterium
SSQFVSGLLLSGASFTD

SEQ ID NO: 863216 - protein, 20 aa, Mycobacterium
SSQMYLHQVALGLAAERRDN

SEQ ID NO: 863217 - protein, 25 aa, Mycobacterium
SSQPDLLAVFPFPHALSMAVTLADR

SEQ ID NO: 863218 - protein, 24 aa, Mycobacterium
SSQPSAIALLAQYPTRLVVSRTMS

SEQ ID NO: 863219 - protein, 30 aa, Mycobacterium
SSQQFKAPLPVRLIRRLPLLARIPARLIGM

SEQ ID NO: 863220 - protein, 22 aa, Mycobacterium
SSQRWVLSNALWVFGVDSAQSL

SEQ ID NO: 863221 - protein, 30 aa, Mycobacterium
SSRAKLNWWESRALYGWTVLVPRTKDQAGE

SEQ ID NO: 863222 - protein, 29 aa, Mycobacterium
SSRAMIEAIGPYLAWLRVTAQQCRQLGSS

SEQ ID NO: 863223 - protein, 25 aa, Mycobacterium
SSRAWLALLSVLYREVSRPESIVQH

SEQ ID NO: 863224 - protein, 23 aa, Mycobacterium
SSRDLDFYLPTAAGYTHIITLTM

SEQ ID NO: 863225 - protein, 24 aa, Mycobacterium
SSRELKHLLINDLPIERQAQDVSW

SEQ ID NO: 863226 - protein, 17 aa, Mycobacterium
SSREPYRRLVNQGYIQA

SEQ ID NO: 863227 - protein, 28 aa, Mycobacterium
SSRHKGLSYLLVPLDQPGVEIRPIIQLT

SEQ ID NO: 863228 - protein, 20 aa, Mycobacterium
SSRLLVEYWAHEAALMAVDD

SEQ ID NO: 863229 - protein, 21 aa, Mycobacterium
SSRLMRGLGSSIFPRNVDYSA

SEQ ID NO: 863230 - protein, 31 aa, Mycobacterium
SSRLSESQSELLWLVGRRPGISVSAAAAELG

SEQ ID NO: 863231 - protein, 18 aa, Mycobacterium
SSRPGIVLSRKQLLDTVW

SEQ ID NO: 863232 - protein, 23 aa, Mycobacterium
SSRPPILDLVLPSAAGEVTGDSE

SEQ ID NO: 863233 - protein, 25 aa, Mycobacterium
SSRPTFVQFGYWDSLKKGLLAGERL

SEQ ID NO: 863234 - protein, 17 aa, Mycobacterium
SSRQKLAARLPGYMLPS

SEQ ID NO: 863235 - protein, 24 aa, Mycobacterium
SSRRAYDVRPIVTAILDDETPFDE

SEQ ID NO: 863236 - protein, 23 aa, Mycobacterium
SSRRGKPAIPAWEDVLLGVRSSG

SEQ ID NO: 863237 - protein, 24 aa, Mycobacterium
SSRTRDGKPWGSRFPRISIRDQVE

SEQ ID NO: 863238 - protein, 22 aa, Mycobacterium
SSRVLQIAFGWRGQDELILLDI

SEQ ID NO: 863239 - protein, 25 aa, Mycobacterium
SSRVQFGRPLAKFQAVQNLIADIAA

SEQ ID NO: 863240 - protein, 20 aa, Mycobacterium
SSRYKAPFAFTGGTIAQVTI

SEQ ID NO: 863241 - protein, 18 aa, Mycobacterium
SSRYLLTATGFLSQPHMP

SEQ ID NO: 863242 - protein, 22 aa, Mycobacterium
SSSFSMNWKFTREFMPVRFEVD

SEQ ID NO: 863243 - protein, 25 aa, Mycobacterium
SSSKGGVVGLTLPVARDLSAVGIRV

SEQ ID NO: 863244 - protein, 21 aa, Mycobacterium
SSSLERILAPGGLADRLLAED

SEQ ID NO: 863245 - protein, 26 aa, Mycobacterium
SSSLNSLIPGPNNWWGFQPNDYKIIF

SEQ ID NO: 863246 - protein, 18 aa, Mycobacterium
SSSLPPNEIGVRLSTSVA

SEQ ID NO: 863247 - protein, 24 aa, Mycobacterium
SSSLVAIHWAMASLRSGECDLALA

SEQ ID NO: 863248 - protein, 18 aa, Mycobacterium
SSSNFRPPSDPDTPMIMI

SEQ ID NO: 863249 - protein, 23 aa, Mycobacterium
SSSPGTTPAVWTGSPAPAEAGTP

SEQ ID NO: 863250 - protein, 40 aa, Mycobacterium
SSSPQCVGVITWMHTFSPAKMWIRGLSALQKPMLHLHTQF

SEQ ID NO: 863251 - protein, 29 aa, Mycobacterium
SSSQSEVLPLRIPLLLAATGPKGAGVAKR

SEQ ID NO: 863252 - protein, 23 aa, Mycobacterium
SSSRLIRLPMWVGLQEADQNRVV

SEQ ID NO: 863253 - protein, 25 aa, Mycobacterium
SSSSRYLAVLPFFHAAGLNSMTNPV

SEQ ID NO: 863254 - protein, 22 aa, Mycobacterium
SSSTMMVALTGLLAEHYGVPMG

SEQ ID NO: 863255 - protein, 23 aa, Mycobacterium
SSSTNFYNRAYGRQGWSEVAAEV

SEQ ID NO: 863256 - protein, 20 aa, Mycobacterium
SSSWTLDPYALGSYSFHAPG

SEQ ID NO: 863257 - protein, 17 aa, Mycobacterium
SSTALRRVLRRARDGVT

SEQ ID NO: 863258 - protein, 23 aa, Mycobacterium
SSTAWNPLPRGWYPGPQYITVVY

SEQ ID NO: 863259 - protein, 17 aa, Mycobacterium
SSTLLLRVRREEVLADD

SEQ ID NO: 863260 - protein, 25 aa, Mycobacterium
SSTLRKHQVLSATFLGVLLTKYESQ

SEQ ID NO: 863261 - protein, 22 aa, Mycobacterium
SSTNWYARCLKFTSTTRGSLSG

SEQ ID NO: 863262 - protein, 27 aa, Mycobacterium
SSTPMDPALYLLWARANVVAGYRYSVE

SEQ ID NO: 863263 - protein, 25 aa, Mycobacterium
SSTPRTLQSFASPSALPAADPSSLA

SEQ ID NO: 863264 - protein, 23 aa, Mycobacterium
SSTTEPLIFPLSSTSADELRRTA

SEQ ID NO: 863265 - protein, 25 aa, Mycobacterium
SSTTWPKLKDLPSLGISVLGEAHDT

SEQ ID NO: 863266 - protein, 21 aa, Mycobacterium
SSTVLFLGRHVGYPVALEGAL

SEQ ID NO: 863267 - protein, 26 aa, Mycobacterium
SSTYVRKPPYFEGMAAAPTPVSDITG

SEQ ID NO: 863268 - protein, 19 aa, Mycobacterium
SSTYYYQFGLDKPLVEQQD

SEQ ID NO: 863269 - protein, 33 aa, Mycobacterium
SSVAAALTPLSWPTQTLAGLAAPAAALGSVARS

SEQ ID NO: 863270 - protein, 26 aa, Mycobacterium
SSVAAALVPFSLPPVDLAGLASQIGT

SEQ ID NO: 863271 - protein, 17 aa, Mycobacterium
SSVAMGWSPYYPQFDRS

SEQ ID NO: 863272 - protein, 30 aa, Mycobacterium
SSVAQALTGLRYLATRRGPLGAPSFDIVGF

SEQ ID NO: 863273 - protein, 24 aa, Mycobacterium
SSVAQAWFQGLNPALGDASPARLL

SEQ ID NO: 863274 - protein, 26 aa, Mycobacterium
SSVDPTPLYPFGYGRSYTTFEVDDLR

SEQ ID NO: 863275 - protein, 21 aa, Mycobacterium
SSVFGLFAVPGQAAYNSAKFA

SEQ ID NO: 863276 - protein, 21 aa, Mycobacterium
SSVFKPMYLFRGDVPVKEFAQ

SEQ ID NO: 863277 - protein, 20 aa, Mycobacterium
SSVHGIASILRRGLLMNPVA

SEQ ID NO: 863278 - protein, 30 aa, Mycobacterium
SSVHRMLERLVQLRWLRRDGRDYELGTRLV

SEQ ID NO: 863279 - protein, 23 aa, Mycobacterium
SSVHYYQPLWTLVGGGQAKAATT

SEQ ID NO: 863280 - protein, 19 aa, Mycobacterium
SSVIPLRTHLLATAPLTEG

SEQ ID NO: 863281 - protein, 25 aa, Mycobacterium
SSVKTFCAWALRRGLIGVDPAARLQ

SEQ ID NO: 863282 - protein, 18 aa, Mycobacterium
SSVLLRIAQQVAAAAWLA

SEQ ID NO: 863283 - protein, 26 aa, Mycobacterium
SSVLTAFSNFNTLTGPAGLASNFSRT

SEQ ID NO: 863284 - protein, 24 aa, Mycobacterium
SSVLVQMMWQMRSSGMWTDARGTN

SEQ ID NO: 863285 - protein, 18 aa, Mycobacterium
SSVLVSLARINGQWLITK

SEQ ID NO: 863286 - protein, 41 aa, Mycobacterium
SSVPAVPGKFYWMTPTQLRWRPLSFWPAHTAVTVDAGGTVS

SEQ ID NO: 863287 - protein, 26 aa, Mycobacterium
SSVPGLFTLVLHTHLPWLAHHGRWPV

SEQ ID NO: 863288 - protein, 28 aa, Mycobacterium
SSVPSSIPTYFMAAATPLYGMSSILGMA

SEQ ID NO: 863289 - protein, 27 aa, Mycobacterium
SSVRHLEVVALTPARLLLVVITDTGRV

SEQ ID NO: 863290 - protein, 33 aa, Mycobacterium
SSVTLAQLVGLRQALRILLTNPTLTADEALDIG

SEQ ID NO: 863291 - protein, 25 aa, Mycobacterium
SSVYFYRYDYAPRPLRRFGLGAAHA

SEQ ID NO: 863292 - protein, 22 aa, Mycobacterium
SSWAAPWSIDANVSALAALLKD

SEQ ID NO: 863293 - protein, 17 aa, Mycobacterium
SSWKAYAPAWAGKVAIE

SEQ ID NO: 863294 - protein, 21 aa, Mycobacterium
SSWLLLELEGGWGPSAFLESP

SEQ ID NO: 863295 - protein, 20 aa, Mycobacterium
SSWQRCRVHFMRNLHTAVAA

SEQ ID NO: 863296 - protein, 25 aa, Mycobacterium
SSYAPSRIPGPWNPAAWGMSLSQRT

SEQ ID NO: 863297 - protein, 38 aa, Mycobacterium
SSYARVQHNLARLAELLLLWRHGAPDHREVVYLAHHIA

SEQ ID NO: 863298 - protein, 37 aa, Mycobacterium
SSYARVQHNLARLAELLLLWRHGTPDHREVVYLAHHI

SEQ ID NO: 863299 - protein, 25 aa, Mycobacterium
SSYEFFCNAGLLLDKRLEELGASRL

SEQ ID NO: 863300 - protein, 30 aa, Mycobacterium
SSYERGAPVVFPLNGVVPGFQKAIAGQKVG

SEQ ID NO: 863301 - protein, 26 aa, Mycobacterium
SSYFNDQVFPVLTPLAVDPAHPFPYI

SEQ ID NO: 863302 - protein, 23 aa, Mycobacterium
SSYFRLWRLRSGGSIVIRGCPAG

SEQ ID NO: 863303 - protein, 28 aa, Mycobacterium
SSYKGRKVIIYFYPAAMTPGCTKQACDF

SEQ ID NO: 863304 - protein, 20 aa, Mycobacterium
SSYQREYGLYPDGICGPETL

SEQ ID NO: 863305 - protein, 25 aa, Mycobacterium
SSYQRGAPVDFPLTGVVPGFQKAIA

SEQ ID NO: 863306 - protein, 30 aa, Mycobacterium
SSYTRGTPAQFPLGGVVPGFKKAIAGQRVG

SEQ ID NO: 863307 - protein, 30 aa, Mycobacterium
SSYVATVYAAPLMLPLGKGLVVFTSSSGAV

SEQ ID NO: 863308 - protein, 30 aa, Mycobacterium
SSYVATVYAAPLMLPQRRGLVAFTSSSGSV

SEQ ID NO: 863309 - protein, 20 aa, Mycobacterium
SSYWVYQHLGNLTPAALAED

SEQ ID NO: 863310 - protein, 29 aa, Mycobacterium
STAAPLDRRLLLGMLAQLPPGAGVDAVEA

SEQ ID NO: 863311 - protein, 28 aa, Mycobacterium
STAAPLDRRLLLGMLSGLPPGAGVDAAE

SEQ ID NO: 863312 - protein, 25 aa, Mycobacterium
STAAPLLRCLLFTELSGGPASAAPW

SEQ ID NO: 863313 - protein, 29 aa, Mycobacterium
STAASTFHTQFVRALNLSGGAYAAADAAN

SEQ ID NO: 863314 - protein, 35 aa, Mycobacterium
STAAVFLPRTPAPPGGWPVLAWAHGTVGLGDACTP

SEQ ID NO: 863315 - protein, 30 aa, Mycobacterium
STADALRMLTLPETFGLYLERAWPRHRRLS

SEQ ID NO: 863316 - protein, 23 aa, Mycobacterium
STADGIALALWAGVAVSDLEFIQ

SEQ ID NO: 863317 - protein, 24 aa, Mycobacterium
STADLVALLYQAIPAPARRTGGHP

SEQ ID NO: 863318 - protein, 24 aa, Mycobacterium
STADPAWAYGLYSTGASVMALGVH

SEQ ID NO: 863319 - protein, 26 aa, Mycobacterium
STAEIAAWLISRFAQELGLPATEIDT

SEQ ID NO: 863320 - protein, 24 aa, Mycobacterium
STAERVVLVWRAGGQYRVTDVAAE

SEQ ID NO: 863321 - protein, 32 aa, Mycobacterium
STAFSIQSLSKLFALCALLRHEPDVWTDVGWV

SEQ ID NO: 863322 - protein, 23 aa, Mycobacterium
STAGFTTYTFSEAAPRQPDVPKP

SEQ ID NO: 863323 - protein, 25 aa, Mycobacterium
STAGRRRWLLPPEYMYPIERATQSG

SEQ ID NO: 863324 - protein, 25 aa, Mycobacterium
STAGRRRWLLPPEYMYPIERATRSG

SEQ ID NO: 863325 - protein, 25 aa, Mycobacterium
STAHHPLFQISFALQNNPLPAIESS

SEQ ID NO: 863326 - protein, 25 aa, Mycobacterium
STAHRLLAMLSYRGLIRQDPKTRAY

SEQ ID NO: 863327 - protein, 25 aa, Mycobacterium
STAISHLLREFDLLEPLRARIAEGM

SEQ ID NO: 863328 - protein, 30 aa, Mycobacterium
STAKEWHQYWIDTRLQWYVDLGIDAENLRL

SEQ ID NO: 863329 - protein, 34 aa, Mycobacterium
STAKEWHQYWIDTRLQWYVELGIDPQNLRLWEHP

SEQ ID NO: 863330 - protein, 26 aa, Mycobacterium
STAKRLADGLYRYSLLDIIEVASETG

SEQ ID NO: 863331 - protein, 27 aa, Mycobacterium
STALDRRYPLWEMYFVEGLANHRVAVV

SEQ ID NO: 863332 - protein, 20 aa, Mycobacterium
STALFGARALVLDGALEPSA

SEQ ID NO: 863333 - protein, 21 aa, Mycobacterium
STALFLAAQAIRGGIADCTIA

SEQ ID NO: 863334 - protein, 21 aa, Mycobacterium
STALFLAAQAIRGGLADCTVA

SEQ ID NO: 863335 - protein, 24 aa, Mycobacterium
STALHRRLVELSGNATLTVIVGML

SEQ ID NO: 863336 - protein, 18 aa, Mycobacterium
STALVYPPVYYSPQWREQ

SEQ ID NO: 863337 - protein, 29 aa, Mycobacterium
STAMTPWVWPTMHLNPPNWIAPITEACEL

SEQ ID NO: 863338 - protein, 27 aa, Mycobacterium
STAMTPWVWPTMHLNPPNWIEPITEAC

SEQ ID NO: 863339 - protein, 20 aa, Mycobacterium
STAMYLGHKYSVVTTLDRTV

SEQ ID NO: 863340 - protein, 17 aa, Mycobacterium
STAPPVVLYFHGGGFVV

SEQ ID NO: 863341 - protein, 25 aa, Mycobacterium
STASPAPFTLEQWAQLSAAALDDAG

SEQ ID NO: 863342 - protein, 20 aa, Mycobacterium
STASVYPLRAEAAFEYAARL

SEQ ID NO: 863343 - protein, 26 aa, Mycobacterium
STATMAALANFFRIKSAYFTDDEYYE

SEQ ID NO: 863344 - protein, 21 aa, Mycobacterium
STATVLPFNGLYQPQGLAVDG

SEQ ID NO: 863345 - protein, 22 aa, Mycobacterium
STAVASLFADHAQDYRTISLEA

SEQ ID NO: 863346 - protein, 25 aa, Mycobacterium
STAWATQLRMVQSQLLAKIAAVVGD

SEQ ID NO: 863347 - protein, 24 aa, Mycobacterium
STAYEIERLMRDAPFLLIGEGTSE

SEQ ID NO: 863348 - protein, 22 aa, Mycobacterium
STCADTWLPMPREWAALTVEKQ

SEQ ID NO: 863349 - protein, 24 aa, Mycobacterium
STCHGRVRRLQEIGVIRGFYTDID

SEQ ID NO: 863350 - protein, 23 aa, Mycobacterium
STCHGRVRRLQELGVIRGFYADI

SEQ ID NO: 863351 - protein, 23 aa, Mycobacterium
STCNEPFLDAPLDDFRKVLDLNV

SEQ ID NO: 863352 - protein, 24 aa, Mycobacterium
STCSEFFRYYAGWCSKINGVAYDV

SEQ ID NO: 863353 - protein, 25 aa, Mycobacterium
STCSEFFRYYAGWCSKLNGVAYDVK

SEQ ID NO: 863354 - protein, 18 aa, Mycobacterium
STCVRVGTALLGRRRLPS

SEQ ID NO: 863355 - protein, 24 aa, Mycobacterium
STDDYTAHWYGRTLHFGVREHAMG

SEQ ID NO: 863356 - protein, 21 aa, Mycobacterium
STDELLRLYTPTLGLARTVSR

SEQ ID NO: 863357 - protein, 20 aa, Mycobacterium
STDELTIWASTQTPHELRAF

SEQ ID NO: 863358 - protein, 35 aa, Mycobacterium
STDEPFSALAFKIAVHPFFGKLTYVRVYSGKIESG

SEQ ID NO: 863359 - protein, 34 aa, Mycobacterium
STDEPFSALAFKIAVHPFFGKLTYVRVYSGTVES

SEQ ID NO: 863360 - protein, 18 aa, Mycobacterium
STDIFYYAETQRGALRKQ

SEQ ID NO: 863361 - protein, 17 aa, Mycobacterium
STDLHVLNPPRHQLRSV

SEQ ID NO: 863362 - protein, 25 aa, Mycobacterium
STDPRARVPALPRLGPDDALPRCRR

SEQ ID NO: 863363 - protein, 25 aa, Mycobacterium
STDPRSRVPALPRLGPQDALPRCRQ

SEQ ID NO: 863364 - protein, 27 aa, Mycobacterium
STDPTLQFTMAYYLRPDELKLAERHLT

SEQ ID NO: 863365 - protein, 23 aa, Mycobacterium
STDRIAVIPAWRETAYFTDEERA

SEQ ID NO: 863366 - protein, 24 aa, Mycobacterium
STDSFVVAPRRFPGGSVGSLAVHG

SEQ ID NO: 863367 - protein, 25 aa, Mycobacterium
STDSFVVQPRRFPGGSIGALAVHGT

SEQ ID NO: 863368 - protein, 22 aa, Mycobacterium
STDSFVVQPRRFPGGSIGELAV

SEQ ID NO: 863369 - protein, 22 aa, Mycobacterium
STDTYINYPAPPVPPTPPNSTG

SEQ ID NO: 863370 - protein, 27 aa, Mycobacterium
STDVATWPPMPYPDTWAVWQEDEGRKI

SEQ ID NO: 863371 - protein, 26 aa, Mycobacterium
STDVPTLFNLLPGYLAMPHAGQATLA

SEQ ID NO: 863372 - protein, 24 aa, Mycobacterium
STDWPALLERIASGPPLLSPFKLL

SEQ ID NO: 863373 - protein, 21 aa, Mycobacterium
STDWTATSAEFRKLLTEWKAA

SEQ ID NO: 863374 - protein, 29 aa, Mycobacterium
STEAKALAALILAVLRGMEALRKGGASAA

SEQ ID NO: 863375 - protein, 27 aa, Mycobacterium
STEDIDYYLVLANWKLGIVLEKTYAAG

SEQ ID NO: 863376 - protein, 25 aa, Mycobacterium
STEDWNATWYGRTLHFGVREHAMGA

SEQ ID NO: 863377 - protein, 25 aa, Mycobacterium
STEEFVFYQGLPRHAYVSGNDARDA

SEQ ID NO: 863378 - protein, 24 aa, Mycobacterium
STEFDVERYFRDAPLMIVGEGTNE

SEQ ID NO: 863379 - protein, 17 aa, Mycobacterium
STEFPPHVLTGHALSRV

SEQ ID NO: 863380 - protein, 21 aa, Mycobacterium
STEFQLLRVLMRHPRKALSRD

SEQ ID NO: 863381 - protein, 29 aa, Mycobacterium
STEHAERFTALRPLLFTIAYEILGTATES

SEQ ID NO: 863382 - protein, 27 aa, Mycobacterium
STEHIDYYLVLANWKLGIVLEKTYAAA

SEQ ID NO: 863383 - protein, 24 aa, Mycobacterium
STEKRQVLCYDGETVELLADLHQV

SEQ ID NO: 863384 - protein, 20 aa, Mycobacterium
STELSPWWLRSQCPCRNCRT

SEQ ID NO: 863385 - protein, 27 aa, Mycobacterium
STENIDYYLVLANWKLGIVLEKTYAAA

SEQ ID NO: 863386 - protein, 24 aa, Mycobacterium
STENLGMLAWLKQTRADVICMQET

SEQ ID NO: 863387 - protein, 24 aa, Mycobacterium
STENLYVAAAYFSSLATAGAMDLM

SEQ ID NO: 863388 - protein, 32 aa, Mycobacterium
STEPAHSLALQRLDLTPLLELDMRLGEGSGAV

SEQ ID NO: 863389 - protein, 32 aa, Mycobacterium
STEPAHSLALQRLRLDPVLDLQMRLGEGSGAL

SEQ ID NO: 863390 - protein, 18 aa, Mycobacterium
STEQFPRPAPRPPYTALS

SEQ ID NO: 863391 - protein, 17 aa, Mycobacterium
STETLRWAMQRGVPHVL

SEQ ID NO: 863392 - protein, 17 aa, Mycobacterium
STETLVYLKLVKQQYNW

SEQ ID NO: 863393 - protein, 18 aa, Mycobacterium
STETLVYLKLVKQQYNWG

SEQ ID NO: 863394 - protein, 32 aa, Mycobacterium
STETPLFMAHYAPFGLLTPAAWVALHAQRYMS

SEQ ID NO: 863395 - protein, 21 aa, Mycobacterium
STEWRDPYAGTPWHKHVPARL

SEQ ID NO: 863396 - protein, 26 aa, Mycobacterium
STFDNPWLFDVARTPNPHFGFGGGGA

SEQ ID NO: 863397 - protein, 21 aa, Mycobacterium
STFLEDLALVRPTQLNFVPRI

SEQ ID NO: 863398 - protein, 38 aa, Mycobacterium
STFPLTIDALGIPTTLNLPMDGILVPAGPYTATIPDLG

SEQ ID NO: 863399 - protein, 21 aa, Mycobacterium
STFPVWMMNAIGDITFHHAGT

SEQ ID NO: 863400 - protein, 30 aa, Mycobacterium
STFRTYTYPLMDRPNLTVLPNALVTRVVVD

SEQ ID NO: 863401 - protein, 30 aa, Mycobacterium
STGAGGISGLLLGLDGFNAPASTSALHNLQ

SEQ ID NO: 863402 - protein, 33 aa, Mycobacterium
STGALAAAFPRYHPRWAWGLTRVPGVREFLVSN

SEQ ID NO: 863403 - protein, 32 aa, Mycobacterium
STGALVAAFPRYHPRWAWRMTSIPGFREFAVS

SEQ ID NO: 863404 - protein, 19 aa, Mycobacterium
STGALYHHFGSKAGLLVVI

SEQ ID NO: 863405 - protein, 24 aa, Mycobacterium
STGAPLPHRYFAVSALGQPPDGNR

SEQ ID NO: 863406 - protein, 26 aa, Mycobacterium
STGATPPWVTQAWQPAPTVYRYAVSD

SEQ ID NO: 863407 - protein, 23 aa, Mycobacterium
STGDGIALALWAGVAVSDIEFVQ

SEQ ID NO: 863408 - protein, 20 aa, Mycobacterium
STGELPFVPGIDAVVRDAEG

SEQ ID NO: 863409 - protein, 30 aa, Mycobacterium
STGELPTLFAWRIADYWKWTRYPDPADYQL

SEQ ID NO: 863410 - protein, 26 aa, Mycobacterium
STGFRIHRVLANRWSLTRADGRWRIS

SEQ ID NO: 863411 - protein, 26 aa, Mycobacterium
STGFSLWAHRMAVEYLLTAATPFGAA

SEQ ID NO: 863412 - protein, 25 aa, Mycobacterium
STGGRFLPRTVLLPAIRIGNRLRGG

SEQ ID NO: 863413 - protein, 25 aa, Mycobacterium
STGIAHRLIRIDEPILRVPQLAIHL

SEQ ID NO: 863414 - protein, 25 aa, Mycobacterium
STGIEAVFRPAPVPRTLETMPELRS

SEQ ID NO: 863415 - protein, 18 aa, Mycobacterium
STGIWFENMLNQGLLRVM

SEQ ID NO: 863416 - protein, 27 aa, Mycobacterium
STGKEHFHLPYLLRALDGLPPVNADDV

SEQ ID NO: 863417 - protein, 23 aa, Mycobacterium
STGKFLTRKLGIQDFMLNAHGSD

SEQ ID NO: 863418 - protein, 18 aa, Mycobacterium
STGLDRYHLPYNALTQTS

SEQ ID NO: 863419 - protein, 22 aa, Mycobacterium
STGLFGFIVDWANDPNVLGGYL

SEQ ID NO: 863420 - protein, 25 aa, Mycobacterium
STGLLARLFAPLRSLAGAAASGIGL

SEQ ID NO: 863421 - protein, 24 aa, Mycobacterium
STGLLGLIVHDIADPYFSSIVRGV

SEQ ID NO: 863422 - protein, 24 aa, Mycobacterium
STGLTDIVTTFLRVLGIGSSAGDG

SEQ ID NO: 863423 - protein, 30 aa, Mycobacterium
STGLYAALSIMALLIGRLRRPENGAAPAVA

SEQ ID NO: 863424 - protein, 26 aa, Mycobacterium
STGQFLLKDVPLLGLSLWTLVDAVKA

SEQ ID NO: 863425 - protein, 26 aa, Mycobacterium
STGQPLDWFCLFSSGAALMGSPGQGA

SEQ ID NO: 863426 - protein, 23 aa, Mycobacterium
STGSFYHYFENWPAYTRELVEHW

SEQ ID NO: 863427 - protein, 22 aa, Mycobacterium
STGTNLWGAFGLLAEMVADGRS

SEQ ID NO: 863428 - protein, 21 aa, Mycobacterium
STGTNLWGAFGLLAEMVAEGR

SEQ ID NO: 863429 - protein, 22 aa, Mycobacterium
STGTNLWGAFGLLAEMVSDGRS

SEQ ID NO: 863430 - protein, 22 aa, Mycobacterium
STGVLLPGGFPEQFTAELSAND

SEQ ID NO: 863431 - protein, 20 aa, Mycobacterium
STGVPVVPMVALLAGVEIDD

SEQ ID NO: 863432 - protein, 26 aa, Mycobacterium
STGVWEVFWPNFPDGGLYKFRVHGAD

SEQ ID NO: 863433 - protein, 30 aa, Mycobacterium
STGVYKPYVDITLWPYPDGSGYNFSDAANA

SEQ ID NO: 863434 - protein, 29 aa, Mycobacterium
STHALMRGGVLQLHRWGLLDAVVASGAPA

SEQ ID NO: 863435 - protein, 26 aa, Mycobacterium
STHASFLRQLGWHTRARRWDGRALAL

SEQ ID NO: 863436 - protein, 29 aa, Mycobacterium
STHDGSGLWWGLYSTLRARRIPIVVVAPT

SEQ ID NO: 863437 - protein, 28 aa, Mycobacterium
STHPRCRFWNLTLWNQYMAALDVEYGRA

SEQ ID NO: 863438 - protein, 31 aa, Mycobacterium
STHTFWDMTIAGYWAWSAWDPQQGEFHSAQG

SEQ ID NO: 863439 - protein, 21 aa, Mycobacterium
STIADFVRCAWLAREAGYDGV

SEQ ID NO: 863440 - protein, 23 aa, Mycobacterium
STIALGILHRLAATVAKVGVFRP

SEQ ID NO: 863441 - protein, 24 aa, Mycobacterium
STIARALRWQFDGIDRVGPDVVLS

SEQ ID NO: 863442 - protein, 26 aa, Mycobacterium
STIEVRPMTDFWPGLAGYMEVDGYAS

SEQ ID NO: 863443 - protein, 34 aa, Mycobacterium
STIGGYAERMLLSAPLLLPIPNGLDFKHAALTEP

SEQ ID NO: 863444 - protein, 19 aa, Mycobacterium
STIGRRLAKALGVNVYDTD

SEQ ID NO: 863445 - protein, 20 aa, Mycobacterium
STIGRRLMVAPLSLTVDACE

SEQ ID NO: 863446 - protein, 21 aa, Mycobacterium
STIKVLLAMTVLDHLRPDSFA

SEQ ID NO: 863447 - protein, 23 aa, Mycobacterium
STILFVHGVYVTGAVWNDVVAEL

SEQ ID NO: 863448 - protein, 21 aa, Mycobacterium
STIRYLMFSVFAVAPGELGED

SEQ ID NO: 863449 - protein, 19 aa, Mycobacterium
STITFKIKNMWGLLTVKGE

SEQ ID NO: 863450 - protein, 17 aa, Mycobacterium
STITPFVAHWTERGVVP

SEQ ID NO: 863451 - protein, 26 aa, Mycobacterium
STITRTLMRELLPPQLQRLDGIELAG

SEQ ID NO: 863452 - protein, 23 aa, Mycobacterium
STKDLVAAVLQPLGVVVAPPGSF

SEQ ID NO: 863453 - protein, 26 aa, Mycobacterium
STKNAADWLAARGFKQGLGSLGQISV

SEQ ID NO: 863454 - protein, 23 aa, Mycobacterium
STKQVLWANLVASSLEAALHLEN

SEQ ID NO: 863455 - protein, 23 aa, Mycobacterium
STKSVSDLYAPLTAKVVAVNGDL

SEQ ID NO: 863456 - protein, 21 aa, Mycobacterium
STLAFYRRAVQLRSARGEFDG

SEQ ID NO: 863457 - protein, 25 aa, Mycobacterium
STLDKLLDMALGACDKLFAAQREAL

SEQ ID NO: 863458 - protein, 26 aa, Mycobacterium
STLDKLLDMALGACDTLFAAQRDALA

SEQ ID NO: 863459 - protein, 24 aa, Mycobacterium
STLEALLLVVDTPISAAAVASVVA

SEQ ID NO: 863460 - protein, 23 aa, Mycobacterium
STLEYLVEQFLTQFYGDQAELGG

SEQ ID NO: 863461 - protein, 20 aa, Mycobacterium
STLFDDIGLVRPTALNLVPR

SEQ ID NO: 863462 - protein, 18 aa, Mycobacterium
STLFLRRGEQPPGPRFTT

SEQ ID NO: 863463 - protein, 31 aa, Mycobacterium
STLGLRLELGGRALFGPLGSAAARAVKGDVE

SEQ ID NO: 863464 - protein, 19 aa, Mycobacterium
STLGRRAIMKPWMGEVFDT

SEQ ID NO: 863465 - protein, 17 aa, Mycobacterium
STLIGLAPTNAELLKTL

SEQ ID NO: 863466 - protein, 17 aa, Mycobacterium
STLILPADASWSEGAAP

SEQ ID NO: 863467 - protein, 22 aa, Mycobacterium
STLITADQWLERPGSVGKPLTG

SEQ ID NO: 863468 - protein, 17 aa, Mycobacterium
STLKMKPFEEISGDEWD

SEQ ID NO: 863469 - protein, 22 aa, Mycobacterium
STLLGFCAAVLFPTSGTVRILG

SEQ ID NO: 863470 - protein, 26 aa, Mycobacterium
STLLNLYVTLMHFGGIIVPPGYTDEV

SEQ ID NO: 863471 - protein, 20 aa, Mycobacterium
STLLRTLGGILRPASGVVSI

SEQ ID NO: 863472 - protein, 31 aa, Mycobacterium
STLMSPAAFVRRPLRWIQALSDGSRQGNVVT

SEQ ID NO: 863473 - protein, 33 aa, Mycobacterium
STLMSPTAFIRRPQRWIQALSDESRFGRVITAA

SEQ ID NO: 863474 - protein, 25 aa, Mycobacterium
STLPEDILLIEDLLADVVVPLAKEP

SEQ ID NO: 863475 - protein, 17 aa, Mycobacterium
STLRRWAHDAVAALISH

SEQ ID NO: 863476 - protein, 27 aa, Mycobacterium
STLTKIDKRLLPPAPAYGGIHAELRSA

SEQ ID NO: 863477 - protein, 22 aa, Mycobacterium
STLTRFPFLAVDGSTFVMLRHQ

SEQ ID NO: 863478 - protein, 25 aa, Mycobacterium
STLTRLREDVFNPLFSVPISPRLRD

SEQ ID NO: 863479 - protein, 18 aa, Mycobacterium
STLVHRLTGMWPDRLAEE

SEQ ID NO: 863480 - protein, 31 aa, Mycobacterium
STLVQYAELGPLHRGRSLHGNWSATDLMVPG

SEQ ID NO: 863481 - protein, 17 aa, Mycobacterium
STMGWPEATPELEKFYP

SEQ ID NO: 863482 - protein, 24 aa, Mycobacterium
STMMHVGALMPFTPPDDAPADFLR

SEQ ID NO: 863483 - protein, 19 aa, Mycobacterium
STMRITLNAILRAVFGAQG

SEQ ID NO: 863484 - protein, 20 aa, Mycobacterium
STMVLLPLVAAHAGVPIVAA

SEQ ID NO: 863485 - protein, 22 aa, Mycobacterium
STMVRLLLQRIGPVTAALHGLR

SEQ ID NO: 863486 - protein, 35 aa, Mycobacterium
STNARAKMSLLRHGFVKIFCRPATGVVIGGVVVAP

SEQ ID NO: 863487 - protein, 17 aa, Mycobacterium
STNFWESAWLRNQIARN

SEQ ID NO: 863488 - protein, 30 aa, Mycobacterium
STNGDQFLVLRPLLLDYVLSMPRGAQVIYP

SEQ ID NO: 863489 - protein, 26 aa, Mycobacterium
STNGMLRQYFPKRTDLPRWSAEEIEA

SEQ ID NO: 863490 - protein, 18 aa, Mycobacterium
STNHILGFPFTEHGLRLG

SEQ ID NO: 863491 - protein, 19 aa, Mycobacterium
STNHILGFPFTEHGLRLGV

SEQ ID NO: 863492 - protein, 24 aa, Mycobacterium
STNNGLIEIMPLGISKATGIEELA

SEQ ID NO: 863493 - protein, 23 aa, Mycobacterium
STNTDTIILIRIPNNGESATAIS

SEQ ID NO: 863494 - protein, 21 aa, Mycobacterium
STNYYNRAYSRQGWADVAAAV

SEQ ID NO: 863495 - protein, 21 aa, Mycobacterium
STPANYFHLLRRHGKDGIQRP

SEQ ID NO: 863496 - protein, 25 aa, Mycobacterium
STPAPHFRFPGLKPGDRWCVTAANW

SEQ ID NO: 863497 - protein, 26 aa, Mycobacterium
STPAWRVFAKYYYPFITRHGADDVAL

SEQ ID NO: 863498 - protein, 24 aa, Mycobacterium
STPEKSLIRPLHGTGGRNAHGRIT

SEQ ID NO: 863499 - protein, 17 aa, Mycobacterium
STPGLRAQPGLPVCQLR

SEQ ID NO: 863500 - protein, 20 aa, Mycobacterium
STPKGALVHRMIRTGRSLFT

SEQ ID NO: 863501 - protein, 24 aa, Mycobacterium
STPLAVLAAFFDRLGRYEAAATIA

SEQ ID NO: 863502 - protein, 27 aa, Mycobacterium
STPLDRRYPLWEMYFVEGLANHRVAVV

SEQ ID NO: 863503 - protein, 19 aa, Mycobacterium
STPLTFFRKASGSISGPFD

SEQ ID NO: 863504 - protein, 25 aa, Mycobacterium
STPPRTLIGWTSRFLGMVQPGDEVD

SEQ ID NO: 863505 - protein, 24 aa, Mycobacterium
STPPVVLFAGTIGRRKGVDTLVAA

SEQ ID NO: 863506 - protein, 35 aa, Mycobacterium
STPSNYFHLLRRHALDGIMRPLIVFTPKSMLRNKA

SEQ ID NO: 863507 - protein, 25 aa, Mycobacterium
STPTDNGFYIVGGRFKHIIMDSSTY

SEQ ID NO: 863508 - protein, 27 aa, Mycobacterium
STPVLSAFSAFNTLTGPASLASNFSRT

SEQ ID NO: 863509 - protein, 27 aa, Mycobacterium
STPVPEYRFPGLLPGDRWCVTAMNWLR

SEQ ID NO: 863510 - protein, 18 aa, Mycobacterium
STPVPTCPGWTLKQLLRH

SEQ ID NO: 863511 - protein, 24 aa, Mycobacterium
STPWSAELGLDVPIVNAPMGGAAG

SEQ ID NO: 863512 - protein, 27 aa, Mycobacterium
STQAQAAFQPYLAWMGTVIAMAQQRAA

SEQ ID NO: 863513 - protein, 22 aa, Mycobacterium
STQLAGLPFSGPVGGARIALID

SEQ ID NO: 863514 - protein, 18 aa, Mycobacterium
STQLLLPGLSVTANVPLN

SEQ ID NO: 863515 - protein, 25 aa, Mycobacterium
STQLPPELLAPVGCAIQTGVGTVLD

SEQ ID NO: 863516 - protein, 26 aa, Mycobacterium
STQPMLLFETGLPTRFYLPYDDVVAP

SEQ ID NO: 863517 - protein, 21 aa, Mycobacterium
STQQVLPFNGLSSVGGLTVDS

SEQ ID NO: 863518 - protein, 22 aa, Mycobacterium
STQRQSVILPAYTAAKAMVTSI

SEQ ID NO: 863519 - protein, 21 aa, Mycobacterium
STQWRDPYAGTPWHKHVPARI

SEQ ID NO: 863520 - protein, 25 aa, Mycobacterium
STRDAVMTWLLSQPAEVFAPPTGGM

SEQ ID NO: 863521 - protein, 24 aa, Mycobacterium
STRGAPPLMRGTINVVLPVPGDVR

SEQ ID NO: 863522 - protein, 24 aa, Mycobacterium
STRHVTNYFLFYGAGRNPFKLVLN

SEQ ID NO: 863523 - protein, 19 aa, Mycobacterium
STRLLILAGVLVAEGLTLR

SEQ ID NO: 863524 - protein, 18 aa, Mycobacterium
STRMAMGRVALIGDAACA

SEQ ID NO: 863525 - protein, 29 aa, Mycobacterium
STRPEFAAAVLGIWRLAATAVLISPAWKR

SEQ ID NO: 863526 - protein, 24 aa, Mycobacterium
STRQPTPWWNAETGTPPVAGAPPP

SEQ ID NO: 863527 - protein, 26 aa, Mycobacterium
STRQRAAITALLKRTDEFKSAQDLHD

SEQ ID NO: 863528 - protein, 26 aa, Mycobacterium
STRRFDTTGYWRLYFQWASFEILPRQ

SEQ ID NO: 863529 - protein, 32 aa, Mycobacterium
STRRFDTVGYWRLYFQWASFEILPRRLQKRRG

SEQ ID NO: 863530 - protein, 26 aa, Mycobacterium
STRRLRSMRWGLIPPWVKATEDGSPE

SEQ ID NO: 863531 - protein, 26 aa, Mycobacterium
STRSGVFWIRDILPVQKLREILSAAT

SEQ ID NO: 863532 - protein, 24 aa, Mycobacterium
STRSSAWIVPKYIAGRPGDTLFRT

SEQ ID NO: 863533 - protein, 24 aa, Mycobacterium
STRSSAWIVPKYLAGQPGDKFFRT

SEQ ID NO: 863534 - protein, 23 aa, Mycobacterium
STRTIWRYFRCKESCVEPVLALS

SEQ ID NO: 863535 - protein, 34 aa, Mycobacterium
STRVRFDLTVDLVAPVPGFLVKRGAKTLMDTATE

SEQ ID NO: 863536 - protein, 34 aa, Mycobacterium
STRVRLELMVDLKAPLPGFLVKKGAKGLMDTATH

SEQ ID NO: 863537 - protein, 17 aa, Mycobacterium
STRVVLATVLDTLLRLL

SEQ ID NO: 863538 - protein, 27 aa, Mycobacterium
STSATHRFLAELPGYRGWQWAVVVAAC

SEQ ID NO: 863539 - protein, 24 aa, Mycobacterium
STSETPLLPVRSLVIICGGGEIQQ

SEQ ID NO: 863540 - protein, 17 aa, Mycobacterium
STSFLALPAFPGPPRTT

SEQ ID NO: 863541 - protein, 25 aa, Mycobacterium
STSIKEKFLELLPNRIITDSIGSSE

SEQ ID NO: 863542 - protein, 17 aa, Mycobacterium
STSMLYRTINRNKKSIV

SEQ ID NO: 863543 - protein, 26 aa, Mycobacterium
STSPGDYVFIPPYLPHREENPDPDTP

SEQ ID NO: 863544 - protein, 24 aa, Mycobacterium
STSRIGLIPRVRFEFDRSAVKGVL

SEQ ID NO: 863545 - protein, 23 aa, Mycobacterium
STSYGCYLSVALTARARVALAQG

SEQ ID NO: 863546 - protein, 25 aa, Mycobacterium
STTAAAILGLLAPGGRITGGRIVFD

SEQ ID NO: 863547 - protein, 25 aa, Mycobacterium
STTAAAILGLLPPGGRMTGGRIVFD

SEQ ID NO: 863548 - protein, 24 aa, Mycobacterium
STTAMAIPALLPPSARVRGSVKLN

SEQ ID NO: 863549 - protein, 27 aa, Mycobacterium
STTDDHRLKWRPWLTEPITAGVDTPFP

SEQ ID NO: 863550 - protein, 21 aa, Mycobacterium
STTDNHRLKWRPWLTEPVTDG

SEQ ID NO: 863551 - protein, 24 aa, Mycobacterium
STTFDPARPAVWLAEGLLQYLDET

SEQ ID NO: 863552 - protein, 24 aa, Mycobacterium
STTIYYPLVATPMIAPTRAYDGLA

SEQ ID NO: 863553 - protein, 21 aa, Mycobacterium
STTLAPMPLAAAYTASKSAIE

SEQ ID NO: 863554 - protein, 22 aa, Mycobacterium
STTLCYSLWALGHHPDIQERVY

SEQ ID NO: 863555 - protein, 19 aa, Mycobacterium
STTLLREPIDLLVHRDHPL

SEQ ID NO: 863556 - protein, 27 aa, Mycobacterium
STTQFVDALKFLPITRPWAASLAEDAA

SEQ ID NO: 863557 - protein, 24 aa, Mycobacterium
STTRFTTFSFLHQVPRTRGVGPGQ

SEQ ID NO: 863558 - protein, 28 aa, Mycobacterium
STTSAPFSEIWYLLTGQTTLPTSLGSFV

SEQ ID NO: 863559 - protein, 23 aa, Mycobacterium
STTTRWPRRRPWRRLSKNAGDQP

SEQ ID NO: 863560 - protein, 27 aa, Mycobacterium
STTTTEHRLKWRPWLKNPADATESMPF

SEQ ID NO: 863561 - protein, 24 aa, Mycobacterium
STTVGLFTYPVLQAADVLAYDAEL

SEQ ID NO: 863562 - protein, 26 aa, Mycobacterium
STTWPKLKDRPMLGISVLGEAHDEAA

SEQ ID NO: 863563 - protein, 20 aa, Mycobacterium
STTWPKLKGAPMLGISVLGE

SEQ ID NO: 863564 - protein, 19 aa, Mycobacterium
STTYGVTFPLLAKTDVNGD

SEQ ID NO: 863565 - protein, 25 aa, Mycobacterium
STTYSYWFEPNPGWSRLFAPGAEVK

SEQ ID NO: 863566 - protein, 30 aa, Mycobacterium
STVADIARKWGFWRLGPFTTVYRETYGQVP

SEQ ID NO: 863567 - protein, 24 aa, Mycobacterium
STVADMMLYLAWSMAGRGAQEGRT

SEQ ID NO: 863568 - protein, 25 aa, Mycobacterium
STVADMMLYLAWSMAGRGAREGRTA

SEQ ID NO: 863569 - protein, 24 aa, Mycobacterium
STVAQDYLKVIWTAQEWSHEKVST

SEQ ID NO: 863570 - protein, 20 aa, Mycobacterium
STVIHLERVLLADGAKLGLE

SEQ ID NO: 863571 - protein, 26 aa, Mycobacterium
STVISVLSLLCFVPGALRDLTMPAGM

SEQ ID NO: 863572 - protein, 23 aa, Mycobacterium
STVLRALAGLLLPDGGRVLADGD

SEQ ID NO: 863573 - protein, 25 aa, Mycobacterium
STVLTGLFAVWDDLDALLAGLSEAQ

SEQ ID NO: 863574 - protein, 26 aa, Mycobacterium
STVMQPGMTFTIEPMINLGGLDYEIW

SEQ ID NO: 863575 - protein, 24 aa, Mycobacterium
STVPGLEEPTLLRPALRGSDAVLS

SEQ ID NO: 863576 - protein, 27 aa, Mycobacterium
STVRFRTRTMWGLVPVNGTFTEVSGSG

SEQ ID NO: 863577 - protein, 26 aa, Mycobacterium
STVRRLEVVALTPARLLLIVITDSGR

SEQ ID NO: 863578 - protein, 26 aa, Mycobacterium
STVRWPDAAQLPLALLSPDMRDRQII

SEQ ID NO: 863579 - protein, 27 aa, Mycobacterium
STVSEGNFRCRVGHAWTADALLRARDQ

SEQ ID NO: 863580 - protein, 27 aa, Mycobacterium
STVVYEPLLKRLPEGTPMFGFERVEGT

SEQ ID NO: 863581 - protein, 25 aa, Mycobacterium
STVYDWYEMTFNNGAIPFGGNTTQV

SEQ ID NO: 863582 - protein, 20 aa, Mycobacterium
STVYRRFPTKDDLFGHVVRR

SEQ ID NO: 863583 - protein, 18 aa, Mycobacterium
STWDLRPWREDSGFLVAV

SEQ ID NO: 863584 - protein, 21 aa, Mycobacterium
STWDLTDWRGKPIRIGFAVRS

SEQ ID NO: 863585 - protein, 25 aa, Mycobacterium
STWEIAADGLWRVATRPWQLTRVVP

SEQ ID NO: 863586 - protein, 19 aa, Mycobacterium
STWFDAWAEQDIKKIDYCI

SEQ ID NO: 863587 - protein, 25 aa, Mycobacterium
STWPEFFDAIRSAGYTRVSLGMQSV

SEQ ID NO: 863588 - protein, 32 aa, Mycobacterium
STWSEHIESFLPRGIAGLFFFDGEQIEALADL

SEQ ID NO: 863589 - protein, 22 aa, Mycobacterium
STWVMISRMIGLLLHKGCYGRL

SEQ ID NO: 863590 - protein, 25 aa, Mycobacterium
STYDRPMHHILLTGGTGYLGAYLIR

SEQ ID NO: 863591 - protein, 35 aa, Mycobacterium
STYHAFAGSLIRDYGLLLPVEPDTRLLGETELWQL

SEQ ID NO: 863592 - protein, 19 aa, Mycobacterium
STYHYFPGGKYDLATEAVR

SEQ ID NO: 863593 - protein, 18 aa, Mycobacterium
STYPLGERILELSDVPLA

SEQ ID NO: 863594 - protein, 18 aa, Mycobacterium
STYSGGMFRRVDLASALV

SEQ ID NO: 863595 - protein, 28 aa, Mycobacterium
SVAAALTPFSIPPLDLAGLAAGINAQVA

SEQ ID NO: 863596 - protein, 29 aa, Mycobacterium
SVAAALTPFSIPPLDLAGLAAGINAQVAG

SEQ ID NO: 863597 - protein, 22 aa, Mycobacterium
SVAAGLALGAKLQDASKFTYAV

SEQ ID NO: 863598 - protein, 33 aa, Mycobacterium
SVAALAERFAPSSTVLFLGRHVGYPVALEGALK

SEQ ID NO: 863599 - protein, 25 aa, Mycobacterium
SVAALHLGPLLPDAERRYLTCDATC

SEQ ID NO: 863600 - protein, 19 aa, Mycobacterium
SVAATAAPAGYALGGGDPI

SEQ ID NO: 863601 - protein, 27 aa, Mycobacterium
SVAAVLAAIVWTKEVWLATIEGRDFPS

SEQ ID NO: 863602 - protein, 22 aa, Mycobacterium
SVADWMALDYYAEELEEIADYY

SEQ ID NO: 863603 - protein, 26 aa, Mycobacterium
SVAETYLFKALGKPGLYALTRLMLAV

SEQ ID NO: 863604 - protein, 25 aa, Mycobacterium
SVAGDAAFRSWWDMAGNRAASPSMA

SEQ ID NO: 863605 - protein, 28 aa, Mycobacterium
SVAGFPNLFLADPPPWQPGRDAVQRIRG

SEQ ID NO: 863606 - protein, 19 aa, Mycobacterium
SVALFPSWETLPHERLSPG

SEQ ID NO: 863607 - protein, 25 aa, Mycobacterium
SVALGFGFRCGFLGLLHMEITRERL

SEQ ID NO: 863608 - protein, 21 aa, Mycobacterium
SVALPAELFDVPANIALMHQV

SEQ ID NO: 863609 - protein, 24 aa, Mycobacterium
SVANRPWYRAFNAYKMAVICLIGA

SEQ ID NO: 863610 - protein, 20 aa, Mycobacterium
SVANWLSRALRFVSIRDKEL

SEQ ID NO: 863611 - protein, 27 aa, Mycobacterium
SVAPTTLAVLMLLPLSAFEAMTPLPGA

SEQ ID NO: 863612 - protein, 22 aa, Mycobacterium
SVAPVPVYATLVLGADTIARHG

SEQ ID NO: 863613 - protein, 20 aa, Mycobacterium
SVAQRRLPLLIASGADVHVI

SEQ ID NO: 863614 - protein, 22 aa, Mycobacterium
SVARLLIPGGVLMIYVATVTQL

SEQ ID NO: 863615 - protein, 25 aa, Mycobacterium
SVARLRFGPATYAKTRRWLVDGDFD

SEQ ID NO: 863616 - protein, 47 aa, Mycobacterium
SVASGLVDGSWRGPASAAMAAAAAPYARWLSAAAGHASGAAAQARAV

SEQ ID NO: 863617 - protein, 18 aa, Mycobacterium
SVASVELLLAQDWRARVA

SEQ ID NO: 863618 - protein, 21 aa, Mycobacterium
SVATAMIPFLEHDDANRALMG

SEQ ID NO: 863619 - protein, 19 aa, Mycobacterium
SVATLAFPRYGVSVPADVA

SEQ ID NO: 863620 - protein, 18 aa, Mycobacterium
SVATVIPQTAFAGAPSAL

SEQ ID NO: 863621 - protein, 25 aa, Mycobacterium
SVAVPELLAVRPAPGVWHLVSTVTA

SEQ ID NO: 863622 - protein, 19 aa, Mycobacterium
SVAYRYPFGETVDAWVPIG

SEQ ID NO: 863623 - protein, 17 aa, Mycobacterium
SVCARRCTVGGVGAIAA

SEQ ID NO: 863624 - protein, 35 aa, Mycobacterium; identical to SEQ ID NO: 122587

SEQ ID NO: 863625 - protein, 36 aa, Mycobacterium
SVCMRMTLSGFYSHPWAWNEIGFGGPAYPRGFMRLG

SEQ ID NO: 863626 - protein, 30 aa, Mycobacterium
SVCRWARILVYEPPRRLVFTWDIGPTWQVE

SEQ ID NO: 863627 - protein, 25 aa, Mycobacterium
SVDDGRFTLLPLSARTPAALMAVAD

SEQ ID NO: 863628 - protein, 26 aa, Mycobacterium
SVDDRGHFSLGERLLGFGNATGAHIA

SEQ ID NO: 863629 - protein, 20 aa, Mycobacterium
SVDEHLLPRRYWAVAQKFHD

SEQ ID NO: 863630 - protein, 24 aa, Mycobacterium
SVDGIFYLTHREDVLAALRDPELF

SEQ ID NO: 863631 - protein, 26 aa, Mycobacterium
SVDGRWTRAGILSAPPPATRCTLRTR

SEQ ID NO: 863632 - protein, 25 aa, Mycobacterium
SVDICPWALREGLILRKLDSEADGS

SEQ ID NO: 863633 - protein, 19 aa, Mycobacterium
SVDILQRLPDGRPHIVRLK

SEQ ID NO: 863634 - protein, 26 aa, Mycobacterium
SVDLAIPMIGMLKRKAERRLIDGALK

SEQ ID NO: 863635 - protein, 30 aa, Mycobacterium
SVDLMSEQILRTCYSFVIYSRDFSSALCDA

SEQ ID NO: 863636 - protein, 17 aa, Mycobacterium
SVDLPDLIAAAVASRSL

SEQ ID NO: 863637 - protein, 19 aa, Mycobacterium
SVDLPLAQLAYERLAAGLG

SEQ ID NO: 863638 - protein, 22 aa, Mycobacterium
SVDLPWHRVITASGRPARHLTN

SEQ ID NO: 863639 - protein, 26 aa, Mycobacterium
SVDLRPAPSWYGFAATLLVGKERDNP

SEQ ID NO: 863640 - protein, 34 aa, Mycobacterium
SVDLVVTILATWRLGAVYVPLFTAFGADAIAERL

SEQ ID NO: 863641 - protein, 25 aa, Mycobacterium
SVDNALRLILLLGDRSEIRLTDASE

SEQ ID NO: 863642 - protein, 18 aa, Mycobacterium
SVDPAMRTWMNAGRSYVA

SEQ ID NO: 863643 - protein, 23 aa, Mycobacterium
SVDRLRWKGYLKPGSRDDAAEIH

SEQ ID NO: 863644 - protein, 23 aa, Mycobacterium
SVDRLRWKGYLKPGSRDDATEIH

SEQ ID NO: 863645 - protein, 23 aa, Mycobacterium
SVDRLRWKSYLKPGSRDDAVEIH

SEQ ID NO: 863646 - protein, 23 aa, Mycobacterium
SVDSDYYPPGSLPSYEELRDLTR

SEQ ID NO: 863647 - protein, 25 aa, Mycobacterium
SVDTLNWLQGYGVPFEGSLAPFKTS

SEQ ID NO: 863648 - protein, 24 aa, Mycobacterium
SVDVALLRLPTETSGLAVIPLYEE

SEQ ID NO: 863649 - protein, 27 aa, Mycobacterium
SVDVALQEFILMNKTLCGTVFGSCNPK

SEQ ID NO: 863650 - protein, 19 aa, Mycobacterium
SVDYPGHTSALRPLRASLA

SEQ ID NO: 863651 - protein, 26 aa, Mycobacterium
SVEADKPFFLYHNHSLMHFPMEVREE

SEQ ID NO: 863652 - protein, 20 aa, Mycobacterium
SVEALRRTLAIAASIGSVCD

SEQ ID NO: 863653 - protein, 26 aa, Mycobacterium
SVEDALDILRWAPQAASEPVAKVIAS

SEQ ID NO: 863654 - protein, 26 aa, Mycobacterium
SVEEARPLLREFPILVPTGVGFMKNA

SEQ ID NO: 863655 - protein, 19 aa, Mycobacterium
SVEERIEMWLRAEGRQRVR

SEQ ID NO: 863656 - protein, 23 aa, Mycobacterium
SVEGLLMYLTGDAQNLLFARIDE

SEQ ID NO: 863657 - protein, 25 aa, Mycobacterium
SVEGRGLFLRLIADADLVIENFSPR

SEQ ID NO: 863658 - protein, 22 aa, Mycobacterium
SVEGRRFRHAVKFLRWRPDREP

SEQ ID NO: 863659 - protein, 24 aa, Mycobacterium
SVEHFNWLEDLGFQFERSYYPGKV

SEQ ID NO: 863660 - protein, 24 aa, Mycobacterium
SVEIDLPPIPEFYGGAVIFDGADA

SEQ ID NO: 863661 - protein, 24 aa, Mycobacterium
SVEIGYCLGRRWWGKGLMSEVLGM

SEQ ID NO: 863662 - protein, 26 aa, Mycobacterium
SVEIGYCLGRRWWGKGLMVEVLDMLL

SEQ ID NO: 863663 - protein, 21 aa, Mycobacterium
SVEKVLCGLPALWLRRLCANM

SEQ ID NO: 863664 - protein, 17 aa, Mycobacterium
SVELYRLDEQVIIDVSA

SEQ ID NO: 863665 - protein, 39 aa, Mycobacterium
SVENAGFDLLFFADVFGLRSPWNGNWRKAVEGGIQIPVN

SEQ ID NO: 863666 - protein, 23 aa, Mycobacterium
SVEQTQWYFQRYTAHLPSGGEIV

SEQ ID NO: 863667 - protein, 28 aa, Mycobacterium
SVEQVAIAWLLRVSPVMLPIPGTSQRKH

SEQ ID NO: 863668 - protein, 22 aa, Mycobacterium
SVERRMLLRALGAEIVLTPGPE

SEQ ID NO: 863669 - protein, 25 aa, Mycobacterium
SVERRQLLELYGARIIFSPAEGGSN

SEQ ID NO: 863670 - protein, 23 aa, Mycobacterium
SVETALRVIRFKTAGYTVQRPLQ

SEQ ID NO: 863671 - protein, 31 aa, Mycobacterium
SVETPPPPPKLPLPPMPIGGPPPAPPEPPPA

SEQ ID NO: 863672 - protein, 30 aa, Mycobacterium
SVEVDPIGNLFGLLEFNPGAPYVLVGSHLD

SEQ ID NO: 863673 - protein, 37 aa, Mycobacterium
SVFDGPVLDRPLYRFPVFGFFALSIGAAALGNARAAI

SEQ ID NO: 863674 - protein, 18 aa, Mycobacterium
SVFEHRAVVVGSGRAQLL

SEQ ID NO: 863675 - protein, 20 aa, Mycobacterium
SVFEPILRPMHEKIVGRIAV

SEQ ID NO: 863676 - protein, 25 aa, Mycobacterium
SVFFDYPPHPRTIAHTVRGFDEVAR

SEQ ID NO: 863677 - protein, 23 aa, Mycobacterium
SVFGDALGVFSPFVCYGPLARSV

SEQ ID NO: 863678 - protein, 20 aa, Mycobacterium
SVFGLFSVPGQGAYNAAKFA

SEQ ID NO: 863679 - protein, 21 aa, Mycobacterium
SVFGLPELQLGLIPGAGGTLS

SEQ ID NO: 863680 - protein, 23 aa, Mycobacterium
SVFGLPELSLGLIPGAGGTVSVT

SEQ ID NO: 863681 - protein, 19 aa, Mycobacterium
SVFLPSVPNLLQLASELEA

SEQ ID NO: 863682 - protein, 17 aa, Mycobacterium
SVFLTRPNLAHHTRTPD

SEQ ID NO: 863683 - protein, 17 aa, Mycobacterium
SVFLTRPTLAHHTRTAD

SEQ ID NO: 863684 - protein, 21 aa, Mycobacterium
SVFQAVLRPWHEKIVGRIAVS

SEQ ID NO: 863685 - protein, 38 aa, Mycobacterium
SVFRDYGYRRLRSKARLKFLIKDWGIEKFREVLETEYL

SEQ ID NO: 863686 - protein, 26 aa, Mycobacterium
SVFRSYVHPYLQQRNLTVLTGATVRR

SEQ ID NO: 863687 - protein, 27 aa, Mycobacterium
SVFTHRLRKYIGAYLAVLGHTDVITFT

SEQ ID NO: 863688 - protein, 24 aa, Mycobacterium
SVGAAVVKLRLAIEALVQLASHVT

SEQ ID NO: 863689 - protein, 26 aa, Mycobacterium
SVGADGEWPLFLDVWVEHVVEDVATD

SEQ ID NO: 863690 - protein, 26 aa, Mycobacterium
SVGAFNFAPALSIYASSKAALMSVTR

SEQ ID NO: 863691 - protein, 17 aa, Mycobacterium
SVGAPRRAAIAELLGAL

SEQ ID NO: 863692 - protein, 20 aa, Mycobacterium
SVGCNNTCTFCIVPSLRGKE

SEQ ID NO: 863693 - protein, 20 aa, Mycobacterium
SVGEAAEFLRWTAAEAPGAT

SEQ ID NO: 863694 - protein, 29 aa, Mycobacterium
SVGGASGPLYGTFFLRMAPALGTDDTVSA

SEQ ID NO: 863695 - protein, 23 aa, Mycobacterium
SVGHDFRWLTVDLPPMIDLRTKL

SEQ ID NO: 863696 - protein, 23 aa, Mycobacterium
SVGIDLRLDWPKALAQAGFDASA

SEQ ID NO: 863697 - protein, 17 aa, Mycobacterium
SVGILSTYVPTACGLAT

SEQ ID NO: 863698 - protein, 28 aa, Mycobacterium
SVGISLDSRLRVVARRDFAGTISVAIED

SEQ ID NO: 863699 - protein, 27 aa, Mycobacterium
SVGITRAALYFYFGSKQEVLTALVART

SEQ ID NO: 863700 - protein, 20 aa, Mycobacterium
SVGLDRKDGAAWLARNHSDA

SEQ ID NO: 863701 - protein, 39 aa, Mycobacterium
SVGLHVRHYIPFASTFAAFLTRAHDFIRMAAVSQANICL

SEQ ID NO: 863702 - protein, 25 aa, Mycobacterium
SVGLMQPWRIIRITDKALRNDIHTL

SEQ ID NO: 863703 - protein, 36 aa, Mycobacterium
SVGPHDRPPRRYRGRDFCWWLGVLGKWDMAAPPRGA

SEQ ID NO: 863704 - protein, 24 aa, Mycobacterium
SVGPIPLGRHLLGVRYARTGTVPN

SEQ ID NO: 863705 - protein, 23 aa, Mycobacterium
SVGQIYLLDNPLLAEPLAAEHVK

SEQ ID NO: 863706 - protein, 24 aa, Mycobacterium
SVGQIYLLDNPLLAKPLSAEHVKP

SEQ ID NO: 863707 - protein, 24 aa, Mycobacterium
SVGQIYLLDNPLLTEPLTIDHVKP

SEQ ID NO: 863708 - protein, 25 aa, Mycobacterium
SVGTVFAARPARMSARRFWVRYAAE

SEQ ID NO: 863709 - protein, 17 aa, Mycobacterium
SVGYLRQADDFKSGSTV

SEQ ID NO: 863710 - protein, 21 aa, Mycobacterium
SVHEALVPFTKAFKDAEAHFA

SEQ ID NO: 863711 - protein, 26 aa, Mycobacterium
SVHKHKPLLPPPPQPPGREPVHRRNM

SEQ ID NO: 863712 - protein, 18 aa, Mycobacterium
SVHMGFSDAGAHLRNMAF

SEQ ID NO: 863713 - protein, 19 aa, Mycobacterium
SVHMHTLKLAVIELDDLGG

SEQ ID NO: 863714 - protein, 27 aa, Mycobacterium
SVHPDLAWTYHYPLPAVASIAGLVAFY

SEQ ID NO: 863715 - protein, 19 aa, Mycobacterium
SVHPGFIRTPLTDAQETTI

SEQ ID NO: 863716 - protein, 20 aa, Mycobacterium
SVHPSLWRQSRLAAKQGLFE

SEQ ID NO: 863717 - protein, 24 aa, Mycobacterium
SVHPVFNLYNKRWPIRGESENLAP

SEQ ID NO: 863718 - protein, 25 aa, Mycobacterium
SVHPVFNLYNRRWPIRGESENLAPA

SEQ ID NO: 863719 - protein, 26 aa, Mycobacterium
SVHPVFNLYNRRWPIRGESENLAPAK

SEQ ID NO: 863720 - protein, 22 aa, Mycobacterium
SVHRVVMPVVVRWGMYRGVRKN

SEQ ID NO: 863721 - protein, 23 aa, Mycobacterium
SVHVPLRWVGPIKISGSEGQFSA

SEQ ID NO: 863722 - protein, 40 aa, Mycobacterium
SVIAGLTTGRWLGPSSLTMASAFAPYMAWTAGAAARAAEA

SEQ ID NO: 863723 - protein, 28 aa, Mycobacterium
SVIAGLTTGRWLGPSSLTMASAYAPYMA

SEQ ID NO: 863724 - protein, 22 aa, Mycobacterium
SVIAIDDRTLARRPAWLAACAE

SEQ ID NO: 863725 - protein, 21 aa, Mycobacterium
SVIAMHEMDLPLSPEWAIVGQ

SEQ ID NO: 863726 - protein, 37 aa, Mycobacterium
SVIDGRPPFFALTVFARGLLNRLFTRAYLPGADPDAD

SEQ ID NO: 863727 - protein, 24 aa, Mycobacterium
SVIFDRAAIFKAFRRVSSGINPDI

SEQ ID NO: 863728 - protein, 19 aa, Mycobacterium
SVIGLRRQLYDDTERYRMI

SEQ ID NO: 863729 - protein, 32 aa, Mycobacterium
SVIKGALAIYHRILPPQGWFDDPNPDIAFDEL

SEQ ID NO: 863730 - protein, 32 aa, Mycobacterium
SVIKPAHQTPLSMLALMDILSEVGVPAGAVNC

SEQ ID NO: 863731 - protein, 17 aa, Mycobacterium
SVILNAPAAFRLTAHTD

SEQ ID NO: 863732 - protein, 21 aa, Mycobacterium
SVIPRAIGVNPFLTISMFAER

SEQ ID NO: 863733 - protein, 17 aa, Mycobacterium
SVIRYTQLRPFVLHVNH

SEQ ID NO: 863734 - protein, 26 aa, Mycobacterium
SVISTLSGMYWWGPASAAMLAATGPF

SEQ ID NO: 863735 - protein, 17 aa, Mycobacterium
SVISWALQEHILGANPA

SEQ ID NO: 863736 - protein, 25 aa, Mycobacterium
SVIWAFKQLWDKGLAYEGYRVLPYC

SEQ ID NO: 863737 - protein, 42 aa, Mycobacterium
SVKDDMAFVVNQLHWLIIILDSYPPVPHRLTGPIKETFIAAA

SEQ ID NO: 863738 - protein, 25 aa, Mycobacterium
SVKKAWPFEVLPRTAWARQSPTVGQ

SEQ ID NO: 863739 - protein, 17 aa, Mycobacterium
SVKLPGGLWIVTEHGVA

SEQ ID NO: 863740 - protein, 17 aa, Mycobacterium
SVKLYGYKWPTLDGMFT

SEQ ID NO: 863741 - protein, 21 aa, Mycobacterium
SVKRFATLLSNAETVFWNGPM

SEQ ID NO: 863742 - protein, 22 aa, Mycobacterium
SVKRFGALLSNAKTVFWNGPMG

SEQ ID NO: 863743 - protein, 23 aa, Mycobacterium
SVKRPNFLVIVADDLGFSDIGAF

SEQ ID NO: 863744 - protein, 19 aa, Mycobacterium
SVKTFTAWAVRRGLIGDDP

SEQ ID NO: 863745 - protein, 23 aa, Mycobacterium
SVLAALGSIDYWFVTEGRRVHKT

SEQ ID NO: 863746 - protein, 23 aa, Mycobacterium
SVLAIEPMLTLGTRKTVVLDDQW

SEQ ID NO: 863747 - protein, 19 aa, Mycobacterium
SVLAIEPMLTLGTTQTRVL

SEQ ID NO: 863748 - protein, 25 aa, Mycobacterium
SVLARDLTWTALVDGGVTALAVPER

SEQ ID NO: 863749 - protein, 25 aa, Mycobacterium
SVLARTIMLPLRTNARAKMSEVRHG

SEQ ID NO: 863750 - protein, 18 aa, Mycobacterium
SVLATTLIARVRDWLQTD

SEQ ID NO: 863751 - protein, 21 aa, Mycobacterium
SVLCPGVVRTPILTGGAFGRN

SEQ ID NO: 863752 - protein, 18 aa, Mycobacterium
SVLDGLRRAILDGAAPPG

SEQ ID NO: 863753 - protein, 20 aa, Mycobacterium
SVLDRMIVPGISAITWRELN

SEQ ID NO: 863754 - protein, 31 aa, Mycobacterium
SVLDVLPTRVVPPSYSFLRQSARNNNASVVP

SEQ ID NO: 863755 - protein, 25 aa, Mycobacterium
SVLEAIAFGFRHHVDVFGEIGIPFT

SEQ ID NO: 863756 - protein, 19 aa, Mycobacterium
SVLEVWPALLRGNALVVWA

SEQ ID NO: 863757 - protein, 31 aa, Mycobacterium
SVLGGGSLLPGLFGFGPFAPTTGSPAVAEGP

SEQ ID NO: 863758 - protein, 19 aa, Mycobacterium
SVLGHLLPTTDVTLRMVPV

SEQ ID NO: 863759 - protein, 29 aa, Mycobacterium
SVLGMFLNTVPLRIRLNAASYAALLDGVF

SEQ ID NO: 863760 - protein, 20 aa, Mycobacterium
SVLGMLEVLGDAPTGHGARE

SEQ ID NO: 863761 - protein, 26 aa, Mycobacterium
SVLGPTLPNRLYWLSASLGADGTQGG

SEQ ID NO: 863762 - protein, 19 aa, Mycobacterium
SVLGTPFLQNAINGAVNTA

SEQ ID NO: 863763 - protein, 21 aa, Mycobacterium
SVLIGFLAPRTQPELASRLRI

SEQ ID NO: 863764 - protein, 23 aa, Mycobacterium
SVLKLVTYTTPPPAPAAPGGGRA

SEQ ID NO: 863765 - protein, 17 aa, Mycobacterium
SVLKTFDPPLGALHGRP

SEQ ID NO: 863766 - protein, 17 aa, Mycobacterium
SVLLKTPQSAPGYEDEW

SEQ ID NO: 863767 - protein, 19 aa, Mycobacterium
SVLLLAAHVLAMDPASWRV

SEQ ID NO: 863768 - protein, 19 aa, Mycobacterium
SVLMMADCFDLALDEVTFS

SEQ ID NO: 863769 - protein, 25 aa, Mycobacterium
SVLNRDLSWDALVSGGVPALPVPER

SEQ ID NO: 863770 - protein, 31 aa, Mycobacterium
SVLPAKYLNRLSDLLFILSRVANPDGDVLWQ

SEQ ID NO: 863771 - protein, 28 aa, Mycobacterium
SVLPAKYLNRLSDLLFILSRVANPEGDV

SEQ ID NO: 863772 - protein, 18 aa, Mycobacterium
SVLPAYLNGIGGKGVHIV

SEQ ID NO: 863773 - protein, 17 aa, Mycobacterium
SVLPCTVWPTRAAAPPH

SEQ ID NO: 863774 - protein, 32 aa, Mycobacterium
SVLPIVPMFHANAWGLPYAALMAGADLVLPDR

SEQ ID NO: 863775 - protein, 21 aa, Mycobacterium
SVLQMLMVLKQHGQLRAPAPT

SEQ ID NO: 863776 - protein, 29 aa, Mycobacterium
SVLRLKARLWFVHRGIEKLFEGRNALGAM

SEQ ID NO: 863777 - protein, 23 aa, Mycobacterium
SVLRVGVADFRRALERVMPTDAD

SEQ ID NO: 863778 - protein, 18 aa, Mycobacterium
SVLRYFGFDPDTEVVVVL

SEQ ID NO: 863779 - protein, 17 aa, Mycobacterium
SVLSDIDRWWLASNSEH

SEQ ID NO: 863780 - protein, 25 aa, Mycobacterium
SVLSRRGRPLGWVSGRAAQLGTPGA

SEQ ID NO: 863781 - protein, 21 aa, Mycobacterium
SVLTEWLRAVPEAPAAARVAS

SEQ ID NO: 863782 - protein, 19 aa, Mycobacterium
SVLTKKPPRWIVVADLVET

SEQ ID NO: 863783 - protein, 29 aa, Mycobacterium
SVLTSPISFLQRPARWMQLLASNCQVFSA

SEQ ID NO: 863784 - protein, 24 aa, Mycobacterium
SVLTSQVFPVWLLSRDPDAEVIVK

SEQ ID NO: 863785 - protein, 19 aa, Mycobacterium
SVLVAEWPVRPGIPDPDPL

SEQ ID NO: 863786 - protein, 23 aa, Mycobacterium
SVLVDQMLVHYLQLVDKALAEPE

SEQ ID NO: 863787 - protein, 18 aa, Mycobacterium
SVLWKQILADVLGTPLIP

SEQ ID NO: 863788 - protein, 18 aa, Mycobacterium
SVMAIVRVKLDGGDQIVT

SEQ ID NO: 863789 - protein, 20 aa, Mycobacterium
SVMGSLPRLAAASGKNLGPR

SEQ ID NO: 863790 - protein, 18 aa, Mycobacterium
SVMLGAALLAKKAVEKGL

SEQ ID NO: 863791 - protein, 51 aa, Mycobacterium
SVMNLMTLFMGHLYGWIITLRPSGAFFPVEQLLVHAQWILDLVDTISNPAD

SEQ ID NO: 863792 - protein, 19 aa, Mycobacterium
SVMYIFAVALQDGVWHHET

SEQ ID NO: 863793 - protein, 21 aa, Mycobacterium
SVNIPIVPIVIRNAEVIAARD

SEQ ID NO: 863794 - protein, 22 aa, Mycobacterium
SVNPFAALASAPTWTMNINHYP

SEQ ID NO: 863795 - protein, 24 aa, Mycobacterium
SVNPFDGYFHWQGTVYDAPEHVRP

SEQ ID NO: 863796 - protein, 37 aa, Mycobacterium
SVNPLQPLLDVINAPTQLLLNRPLIGNGTDGTAANPN

SEQ ID NO: 863797 - protein, 18 aa, Mycobacterium
SVNRQLAEAAAEHAPAGV

SEQ ID NO: 863798 - protein, 30 aa, Mycobacterium
SVNYAGLPSSPWYGLGKKLAPKGTGAVLAF

SEQ ID NO: 863799 - protein, 24 aa, Mycobacterium
SVPAAVRFLSCEPLLGTLKGIDLQ

SEQ ID NO: 863800 - protein, 25 aa, Mycobacterium
SVPARTLMLPLSTNARAKMSLLRHG

SEQ ID NO: 863801 - protein, 20 aa, Mycobacterium
SVPARTLTLPLATNARAKMS

SEQ ID NO: 863802 - protein, 17 aa, Mycobacterium
SVPARTYALLLPDVEWA

SEQ ID NO: 863803 - protein, 23 aa, Mycobacterium
SVPASWTSVIPTANMGAAAALPN

SEQ ID NO: 863804 - protein, 23 aa, Mycobacterium
SVPAVKLVMAKVLGRIAPGLPVE

SEQ ID NO: 863805 - protein, 24 aa, Mycobacterium
SVPDAVWPAVVFTLSTLLDDPVAA

SEQ ID NO: 863806 - protein, 24 aa, Mycobacterium
SVPELPIGVRLLFQAAEELMPGGA

SEQ ID NO: 863807 - protein, 22 aa, Mycobacterium
SVPELPLFRRVTTRIARAFEAM

SEQ ID NO: 863808 - protein, 26 aa, Mycobacterium
SVPGFPNFFTVFGPYGYVGSSYFALI

SEQ ID NO: 863809 - protein, 25 aa, Mycobacterium
SVPGFPNMFSITGPYGFVLGSYLWM

SEQ ID NO: 863810 - protein, 23 aa, Mycobacterium
SVPGPGWTATFSDALIGYARKRR

SEQ ID NO: 863811 - protein, 18 aa, Mycobacterium
SVPGWRSRAERFDMAVLE

SEQ ID NO: 863812 - protein, 25 aa, Mycobacterium
SVPGYPNMFSITGPYGFVLGSYLWM

SEQ ID NO: 863813 - protein, 17 aa, Mycobacterium
SVPIAVNSLWPATTIAS

SEQ ID NO: 863814 - protein, 23 aa, Mycobacterium
SVPKLIPRLSTEYWYNAAQWGDA

SEQ ID NO: 863815 - protein, 31 aa, Mycobacterium
SVPLAQAFDHFGWLGGFFAMDLPATSVLTQE

SEQ ID NO: 863816 - protein, 17 aa, Mycobacterium
SVPLPIARHAETVTAAR

SEQ ID NO: 863817 - protein, 21 aa, Mycobacterium
SVPLSTWRDAAPVPILGSAWG

SEQ ID NO: 863818 - protein, 26 aa, Mycobacterium
SVPNPFAVSYYLLKGSLQAPYGAAVE

SEQ ID NO: 863819 - protein, 20 aa, Mycobacterium
SVPPAYDIAALLAAHPVSVN

SEQ ID NO: 863820 - protein, 18 aa, Mycobacterium
SVPPILLNGVDWFRSMGS

SEQ ID NO: 863821 - protein, 18 aa, Mycobacterium
SVPPSPRRVAGQRRSWSG

SEQ ID NO: 863822 - protein, 20 aa, Mycobacterium
SVPRAMLPAIAPSSSPQPYG

SEQ ID NO: 863823 - protein, 17 aa, Mycobacterium
SVPRRPNETLLESARRA

SEQ ID NO: 863824 - protein, 20 aa, Mycobacterium
SVPSDLSVYALYRAARDDGA

SEQ ID NO: 863825 - protein, 20 aa, Mycobacterium
SVPTAWIAEGLLGYLPPDAQ

SEQ ID NO: 863826 - protein, 24 aa, Mycobacterium
SVPTGLERGWYVAPTVFADVDNSD

SEQ ID NO: 863827 - protein, 28 aa, Mycobacterium
SVPTRQGQWWYYARTFEGKQYRVQCRCP

SEQ ID NO: 863828 - protein, 20 aa, Mycobacterium
SVPVRLAELFIEAGLPPGVF

SEQ ID NO: 863829 - protein, 27 aa, Mycobacterium
SVPVSATWIDIPFTLPPNTIDGGTPVV

SEQ ID NO: 863830 - protein, 29 aa, Mycobacterium
SVPWPLIREQTPSDACYILLRGEAGVYVG

SEQ ID NO: 863831 - protein, 19 aa, Mycobacterium
SVQALINWGVAPDAGPVVV

SEQ ID NO: 863832 - protein, 30 aa, Mycobacterium
SVQCFLRAHPSYWRRLPSRVVWADPDWDAR

SEQ ID NO: 863833 - protein, 18 aa, Mycobacterium
SVQDAYNLGWKLAAVIYG

SEQ ID NO: 863834 - protein, 21 aa, Mycobacterium
SVQDFGAGLVALPAAYQGAFQ

SEQ ID NO: 863835 - protein, 25 aa, Mycobacterium
SVQGSLAMFAIWNFGSEEQKQEWLP

SEQ ID NO: 863836 - protein, 25 aa, Mycobacterium
SVQGSLAMFAIWNFGSEEQKRQWLP

SEQ ID NO: 863837 - protein, 25 aa, Mycobacterium
SVQGSLAMYAIYAYGSDAQKQKWLP

SEQ ID NO: 863838 - protein, 28 aa, Mycobacterium
SVQLAQWLVEWKAPPPPVASLPITTVAP

SEQ ID NO: 863839 - protein, 19 aa, Mycobacterium
SVQPVSPVFLYAHNDGELQ

SEQ ID NO: 863840 - protein, 19 aa, Mycobacterium
SVQTFHALGLIKRLHQGLD

SEQ ID NO: 863841 - protein, 26 aa, Mycobacterium
SVQVGILPFPTSLQGLTLIAMGNGFG

SEQ ID NO: 863842 - protein, 21 aa, Mycobacterium
SVQWLEQHLASYAGAVLAVTH

SEQ ID NO: 863843 - protein, 22 aa, Mycobacterium
SVQYVDFTLWQRAQFGELEDSD

SEQ ID NO: 863844 - protein, 27 aa, Mycobacterium
SVRANGVRLPLLAVGREAFVAARPEAG

SEQ ID NO: 863845 - protein, 20 aa, Mycobacterium
SVRAYLKQIGKVALLNAEEE

SEQ ID NO: 863846 - protein, 26 aa, Mycobacterium
SVREHSGRLLIRFAGVSDRDAADALR

SEQ ID NO: 863847 - protein, 24 aa, Mycobacterium
SVRELAVLWTARQIGCSWCVDFGS

SEQ ID NO: 863848 - protein, 23 aa, Mycobacterium
SVRELAVLWTARSIGCSWCVDFG

SEQ ID NO: 863849 - protein, 18 aa, Mycobacterium
SVREWLREDHLAFFVLDV

SEQ ID NO: 863850 - protein, 24 aa, Mycobacterium
SVRFLMSVGDLVIGWLLQQQAAVA

SEQ ID NO: 863851 - protein, 17 aa, Mycobacterium
SVRFLSRDPGSRRAKEL

SEQ ID NO: 863852 - protein, 17 aa, Mycobacterium
SVRFVDAVLLAGGSAYG

SEQ ID NO: 863853 - protein, 19 aa, Mycobacterium
SVRFVLLMKQLGVTRGSEL

SEQ ID NO: 863854 - protein, 27 aa, Mycobacterium
SVRGGAYFFLPGISALRYLAALKDEVT

SEQ ID NO: 863855 - protein, 25 aa, Mycobacterium
SVRHLEVVSLSPARLLLVVITDTGR

SEQ ID NO: 863856 - protein, 20 aa, Mycobacterium
SVRIALVGKYIDLPDAYLSV

SEQ ID NO: 863857 - protein, 21 aa, Mycobacterium
SVRLMRELWLGDRVDFEGEYY

SEQ ID NO: 863858 - protein, 37 aa, Mycobacterium
SVRMLFADVTLSPGFRERWFSWANPAETMLAYAELAT

SEQ ID NO: 863859 - protein, 24 aa, Mycobacterium
SVRNLPGVHILSPDQLNTYDVLRA

SEQ ID NO: 863860 - protein, 23 aa, Mycobacterium
SVRNLPGVHILTPDQLNTYDVLL

SEQ ID NO: 863861 - protein, 24 aa, Mycobacterium
SVRPTHPHWYLATIGAAVPGRGIG

SEQ ID NO: 863862 - protein, 22 aa, Mycobacterium
SVRPVGPLPVQPGGPPLLVGTI

SEQ ID NO: 863863 - protein, 21 aa, Mycobacterium
SVRPVWCPRLRRVFPVGRRRC

SEQ ID NO: 863864 - protein, 24 aa, Mycobacterium
SVRQDLEKLVRIESVWADPGRRAE

SEQ ID NO: 863865 - protein, 17 aa, Mycobacterium
SVRRACLPVWRAAAARA

SEQ ID NO: 863866 - protein, 25 aa, Mycobacterium
SVRRREDYIGPWLPEPLLLDEHDGS

SEQ ID NO: 863867 - protein, 19 aa, Mycobacterium
SVRVIPKQADEFTCSSCFL

SEQ ID NO: 863868 - protein, 27 aa, Mycobacterium
SVRVTRPSRFFVLDAAAFATFMQREFP

SEQ ID NO: 863869 - protein, 24 aa, Mycobacterium
SVRYGFVPRRFRLLLVAVGARKLA

SEQ ID NO: 863870 - protein, 29 aa, Mycobacterium
SVRYRIGRMPFERLLVRAAGYLRGEALAD

SEQ ID NO: 863871 - protein, 19 aa, Mycobacterium
SVRYTWFRNWVNSPAGTRL

SEQ ID NO: 863872 - protein, 25 aa, Mycobacterium
SVSARTIMLPLRTNARAKMSGLQQG

SEQ ID NO: 863873 - protein, 25 aa, Mycobacterium
SVSARTIMLPLRTNARAKMSGLRQG

SEQ ID NO: 863874 - protein, 23 aa, Mycobacterium
SVSDITVCILDRPRHAKLIADVR

SEQ ID NO: 863875 - protein, 25 aa, Mycobacterium
SVSGDEHLPLWSSVTNPPGTVTVFP

SEQ ID NO: 863876 - protein, 24 aa, Mycobacterium
SVSGFGVHPVLLDAALHAVILSSE

SEQ ID NO: 863877 - protein, 20 aa, Mycobacterium
SVSGRRPTPGTAAYGAAKAG

SEQ ID NO: 863878 - protein, 21 aa, Mycobacterium
SVSMTAQWWLDVREPSKEVVA

SEQ ID NO: 863879 - protein, 24 aa, Mycobacterium
SVSNLPAALAHLPADIQLGTHSLM

SEQ ID NO: 863880 - protein, 26 aa, Mycobacterium
SVSPASLWPTVPMLLEAAVADCWDDD

SEQ ID NO: 863881 - protein, 26 aa, Mycobacterium
SVSPRASLLLRMQRLSDRFAKIAAQR

SEQ ID NO: 863882 - protein, 28 aa, Mycobacterium
SVSQPYLDVVLFILGITRAEIEAADAVD

SEQ ID NO: 863883 - protein, 26 aa, Mycobacterium
SVSRFLPLLAERFARQRLRALARVEG

SEQ ID NO: 863884 - protein, 25 aa, Mycobacterium
SVSRYLLSQTYALLDALRSADAGQL

SEQ ID NO: 863885 - protein, 28 aa, Mycobacterium
SVSSPSMAKLWWQAFMATDVRAVLGSIR

SEQ ID NO: 863886 - protein, 26 aa, Mycobacterium
SVSSSPDFLGWIDPTAAAASPHTGPP

SEQ ID NO: 863887 - protein, 24 aa, Mycobacterium
SVSVAGYPNLFFTFGPNSGPGHNS

SEQ ID NO: 863888 - protein, 27 aa, Mycobacterium
SVSVHRQWLLIELRTDWTLGATTYTAG

SEQ ID NO: 863889 - protein, 22 aa, Mycobacterium
SVSVLFKLYDGDAAGYAVNGSL

SEQ ID NO: 863890 - protein, 20 aa, Mycobacterium
SVSWTLVSSSLLRSLEGSYR

SEQ ID NO: 863891 - protein, 20 aa, Mycobacterium
SVSWTLVSSSLLRSLEGTYR

SEQ ID NO: 863892 - protein, 20 aa, Mycobacterium
SVTALARTLALVSSLGSVCE

SEQ ID NO: 863893 - protein, 28 aa, Mycobacterium
SVTAPAAFVLPLHRRADGLGWASADWRL

SEQ ID NO: 863894 - protein, 25 aa, Mycobacterium
SVTARTIMLPLRTNARAKMSGLRQG

SEQ ID NO: 863895 - protein, 24 aa, Mycobacterium
SVTEQLLTTRPDLTLGGGAETFSQ

SEQ ID NO: 863896 - protein, 21 aa, Mycobacterium
SVTFASYPHFWELKRSRTESP

SEQ ID NO: 863897 - protein, 19 aa, Mycobacterium
SVTFPWYQLGRQVHIRGPV

SEQ ID NO: 863898 - protein, 24 aa, Mycobacterium
SVTGEIFIALAGRVARAVIAETPG

SEQ ID NO: 863899 - protein, 26 aa, Mycobacterium
SVTLRNFKWPLVEVLKTGARTGGDVG

SEQ ID NO: 863900 - protein, 43 aa, Mycobacterium
SVTNRAVLAVYRPLLEPLGLTHPQYLVMLTLWDHQKAATPQQK

SEQ ID NO: 863901 - protein, 23 aa, Mycobacterium
SVTNTFRPWNYYGSDAHGGGSNP

SEQ ID NO: 863902 - protein, 24 aa, Mycobacterium
SVTPDYDPPFAFDGRIHRVIVDVS

SEQ ID NO: 863903 - protein, 24 aa, Mycobacterium
SVTPLPAALDAGAAPAGWGAAPSQ

SEQ ID NO: 863904 - protein, 20 aa, Mycobacterium
SVTPWLLAEYDRFALLHGDY

SEQ ID NO: 863905 - protein, 17 aa, Mycobacterium
SVTPWYGFFVNVGVGSV

SEQ ID NO: 863906 - protein, 19 aa, Mycobacterium
SVTTPQMFEYQLLDRARDN

SEQ ID NO: 863907 - protein, 25 aa, Mycobacterium
SVTVPELLAVKPAPGVWHLVSTVAA

SEQ ID NO: 863908 - protein, 17 aa, Mycobacterium
SVTYRKRDIGVRPSLVS

SEQ ID NO: 863909 - protein, 26 aa, Mycobacterium
SVVAAVPMRPALSLLPVVEAISIPHS

SEQ ID NO: 863910 - protein, 26 aa, Mycobacterium
SVVDVSLLGLAAWNLSPDVAVSQIHG

SEQ ID NO: 863911 - protein, 21 aa, Mycobacterium
SVVEAYFPQELRWEHGRRVVA

SEQ ID NO: 863912 - protein, 25 aa, Mycobacterium
SVVFDYPTVYSLTDYLATILPELET

SEQ ID NO: 863913 - protein, 32 aa, Mycobacterium
SVVGIEKVLPSWRDLEVLLQVLPRSSTGEREN

SEQ ID NO: 863914 - protein, 23 aa, Mycobacterium
SVVIGLISGPWLGASVTMMAAAT

SEQ ID NO: 863915 - protein, 22 aa, Mycobacterium
SVVINPFFQWGSDRAPKTPYHD

SEQ ID NO: 863916 - protein, 25 aa, Mycobacterium
SVVINPYFDWGVDRPPGHEYADTVI

SEQ ID NO: 863917 - protein, 23 aa, Mycobacterium
SVVINPYFDWGVDRPPSHDYADT

SEQ ID NO: 863918 - protein, 24 aa, Mycobacterium
SVVKIDDWLPLTTAVLVGCGVPTG

SEQ ID NO: 863919 - protein, 18 aa, Mycobacterium
SVVKNRVLDRAPASQHRA

SEQ ID NO: 863920 - protein, 21 aa, Mycobacterium
SVVKQFPRDLRIIDTIEIGSS

SEQ ID NO: 863921 - protein, 22 aa, Mycobacterium
SVVKVVKVVGFVASAPGFDGQP

SEQ ID NO: 863922 - protein, 21 aa, Mycobacterium
SVVKVVKVVGFVASAPGFGGQ

SEQ ID NO: 863923 - protein, 21 aa, Mycobacterium
SVVLTKLRRWSAEIPEIHITS

SEQ ID NO: 863924 - protein, 18 aa, Mycobacterium
SVVQRMWAKPAVTVIGID

SEQ ID NO: 863925 - protein, 21 aa, Mycobacterium
SVVRKDLGAWSPGGKFARYRR

SEQ ID NO: 863926 - protein, 17 aa, Mycobacterium
SVVRLHAVLAPIAAAGT

SEQ ID NO: 863927 - protein, 19 aa, Mycobacterium
SVVRPLLAGPDRAEKYHAL

SEQ ID NO: 863928 - protein, 24 aa, Mycobacterium
SVVRRTLIVPFKEVAAAVLECDHL

SEQ ID NO: 863929 - protein, 17 aa, Mycobacterium
SVVSGLTSGPWLGPAST

SEQ ID NO: 863930 - protein, 30 aa, Mycobacterium
SVVVQTMVRPGLLAWRDVARVMSENPARIV

SEQ ID NO: 863931 - protein, 47 aa, Mycobacterium
SVVYRGLLLSGLPNWMMAIGYTKSSWTLKISLLGKSLIELLHHMDTH

SEQ ID NO: 863932 - protein, 20 aa, Mycobacterium
SVWEIWGALLRGGRLAVVPE

SEQ ID NO: 863933 - protein, 20 aa, Mycobacterium
SVWLALRGLHVLGLDISAVA

SEQ ID NO: 863934 - protein, 19 aa, Mycobacterium
SVWLARRGLEVWGVDISTV

SEQ ID NO: 863935 - protein, 19 aa, Mycobacterium
SVWLTLKAKDAPALIEYYV

SEQ ID NO: 863936 - protein, 21 aa, Mycobacterium
SVYAATKAAIRSFGRTWAAEL

SEQ ID NO: 863937 - protein, 25 aa, Mycobacterium
SVYARVNPFGFIETPYRKVENGVVT

SEQ ID NO: 863938 - protein, 28 aa, Mycobacterium
SVYARVNPFGFIETPYRKVIDGLVTDEI

SEQ ID NO: 863939 - protein, 26 aa, Mycobacterium
SVYARVNPFGFIETPYRKVVDGVVTD

SEQ ID NO: 863940 - protein, 20 aa, Mycobacterium
SVYEWLMAMADRILAESGAH

SEQ ID NO: 863941 - protein, 29 aa, Mycobacterium
SVYFAGYAMWNYLTTPYLLTRDGVEVDEA

SEQ ID NO: 863942 - protein, 27 aa, Mycobacterium
SVYFAGYAMWNYLTTPYLLTREGVEVS

SEQ ID NO: 863943 - protein, 20 aa, Mycobacterium
SVYKPMYLFRGDVPVREFAT

SEQ ID NO: 863944 - protein, 17 aa, Mycobacterium
SVYLPQPYVVVSADVVV

SEQ ID NO: 863945 - protein, 19 aa, Mycobacterium
SVYLSPAPLYHAAGVNYAM

SEQ ID NO: 863946 - protein, 24 aa, Mycobacterium
SVYLSPAPLYHTAPSVWSMSAQAG

SEQ ID NO: 863947 - protein, 28 aa, Mycobacterium
SVYLTRPSLFHFIRTAEEFSWRASELFD

SEQ ID NO: 863948 - protein, 19 aa, Mycobacterium
SVYMMADCFDLTLDEVKFS

SEQ ID NO: 863949 - protein, 25 aa, Mycobacterium
SVYNRLMSIPRFTQIVERQPLDLAA

SEQ ID NO: 863950 - protein, 17 aa, Mycobacterium
SVYPTLQLLVDEGLITE

SEQ ID NO: 863951 - protein, 20 aa, Mycobacterium
SVYQGYLFPLQGDFVNELAQ

SEQ ID NO: 863952 - protein, 24 aa, Mycobacterium
SVYRRIGRYLLGRPSPVPYTLLDM

SEQ ID NO: 863953 - protein, 20 aa, Mycobacterium
SVYRTLLLRVAPGTDPDAVA

SEQ ID NO: 863954 - protein, 20 aa, Mycobacterium
SVYTGALFRTECPDNVVVLD

SEQ ID NO: 863955 - protein, 28 aa, Mycobacterium
SVYTGVKAFSRLFAESLWLELREHGVDV

SEQ ID NO: 863956 - protein, 19 aa, Mycobacterium
SVYVLRHPDRYPHHLPSAL

SEQ ID NO: 863957 - protein, 18 aa, Mycobacterium
SVYWFTASATSSARLYWE

SEQ ID NO: 863958 - protein, 20 aa, Mycobacterium
SWAAPWTIDANVAALAALLD

SEQ ID NO: 863959 - protein, 17 aa, Mycobacterium
SWAAPWTIDANVSALAA

SEQ ID NO: 863960 - protein, 19 aa, Mycobacterium
SWAAPWTIDANVSALAALV

SEQ ID NO: 863961 - protein, 23 aa, Mycobacterium
SWAAPWTIEANIAAMAALLDGEA

SEQ ID NO: 863962 - protein, 17 aa, Mycobacterium
SWAATVMRLVPGAQLMT

SEQ ID NO: 863963 - protein, 18 aa, Mycobacterium
SWADPRYLNGREPLAVLF

SEQ ID NO: 863964 - protein, 18 aa, Mycobacterium
SWAPVITKVTWTSPPPFR

SEQ ID NO: 863965 - protein, 26 aa, Mycobacterium
SWASRVSLAHALIGWTRGTGLMGHND

SEQ ID NO: 863966 - protein, 18 aa, Mycobacterium
SWATPFGEVLDWSDAPFA

SEQ ID NO: 863967 - protein, 19 aa, Mycobacterium
SWAWARIAKSRRPIGALLM

SEQ ID NO: 863968 - protein, 25 aa, Mycobacterium
SWAWARIMKSRRPIGALLMDQTVMA

SEQ ID NO: 863969 - protein, 17 aa, Mycobacterium
SWAYARVALRWAERYYA

SEQ ID NO: 863970 - protein, 18 aa, Mycobacterium
SWDLCVGHASRITAPKGW

SEQ ID NO: 863971 - protein, 17 aa, Mycobacterium
SWDLCVSHAGRITAPRG

SEQ ID NO: 863972 - protein, 18 aa, Mycobacterium
SWDLVRDGIFTGYQLDRV

SEQ ID NO: 863973 - protein, 18 aa, Mycobacterium
SWEILDPVLEYWAQHGKP

SEQ ID NO: 863974 - protein, 22 aa, Mycobacterium
SWELDPLVWQRTLDINLTGVWH

SEQ ID NO: 863975 - protein, 17 aa, Mycobacterium
SWEPPAAQRLRAIPPLL

SEQ ID NO: 863976 - protein, 21 aa, Mycobacterium
SWETGPYLRFAPRMLGAVRER

SEQ ID NO: 863977 - protein, 18 aa, Mycobacterium
SWFALACAAAELATGAYV

SEQ ID NO: 863978 - protein, 26 aa, Mycobacterium
SWGNAGWIAPALTLPLQPSGGLRDEL

SEQ ID NO: 863979 - protein, 18 aa, Mycobacterium
SWGSYTKVLLTPGEEPTA

SEQ ID NO: 863980 - protein, 18 aa, Mycobacterium
SWGSYTKVPLTPGEERTA

SEQ ID NO: 863981 - protein, 20 aa, Mycobacterium
SWGTFYSLDDPWITSAMAEM

SEQ ID NO: 863982 - protein, 21 aa, Mycobacterium
SWGVHQLFFRGAGLVVEVVLR

SEQ ID NO: 863983 - protein, 20 aa, Mycobacterium
SWHEGPPTNMFNGVPATSAG

SEQ ID NO: 863984 - protein, 19 aa, Mycobacterium
SWHRRTPGPPGLVLGYASH

SEQ ID NO: 863985 - protein, 27 aa, Mycobacterium
SWIAAGPPPIYFGFGSSARVASPADVI

SEQ ID NO: 863986 - protein, 18 aa, Mycobacterium
SWIDATPLGRLQTPDDVA

SEQ ID NO: 863987 - protein, 28 aa, Mycobacterium
SWINAADEIFWVKYHFITDQGIDFLTQE

SEQ ID NO: 863988 - protein, 31 aa, Mycobacterium
SWITALAAWRSGLVYVPLFGGFGPEPIALRI

SEQ ID NO: 863989 - protein, 17 aa, Mycobacterium
SWIWDDLKVWRRRVDAF

SEQ ID NO: 863990 - protein, 21 aa, Mycobacterium
SWKELLGRTAAFADALVSLGV

SEQ ID NO: 863991 - protein, 19 aa, Mycobacterium
SWLARPLVDSYHTVWFELH

SEQ ID NO: 863992 - protein, 19 aa, Mycobacterium
SWLATLWSEFGPNANIWNT

SEQ ID NO: 863993 - protein, 20 aa, Mycobacterium
SWLDAFTHWRHNQNQPATAI

SEQ ID NO: 863994 - protein, 19 aa, Mycobacterium
SWLDGYRDSWRYGVSMLAR

SEQ ID NO: 863995 - protein, 19 aa, Mycobacterium
SWLRATRISPLYPQRPRES

SEQ ID NO: 863996 - protein, 20 aa, Mycobacterium
SWLTGQILRINGDKLTRIEG

SEQ ID NO: 863997 - protein, 25 aa, Mycobacterium
SWMDANVWRHVAPKGWFYNVMVTGV

SEQ ID NO: 863998 - protein, 17 aa, Mycobacterium
SWMDWELATANADLLQF

SEQ ID NO: 863999 - protein, 28 aa, Mycobacterium
SWMSPAPQLPGWLETHSWNRPEWTVEQL

SEQ ID NO: 864000 - protein, 17 aa, Mycobacterium
SWNQVLAVRWRISTGEA

SEQ ID NO: 864001 - protein, 35 aa, Mycobacterium
SWPDNVLLDRARRLLWPVKKKYGNKLSWADLIVFA

SEQ ID NO: 864002 - protein, 17 aa, Mycobacterium
SWPLERLRRIKAVTGAT

SEQ ID NO: 864003 - protein, 20 aa, Mycobacterium
SWPMSRLTLALSPATLRKVG

SEQ ID NO: 864004 - protein, 19 aa, Mycobacterium
SWPQARLTLALSPATLPKM

SEQ ID NO: 864005 - protein, 26 aa, Mycobacterium
SWPRKAKLLDVLLNKGLDAPFSCREG

SEQ ID NO: 864006 - protein, 26 aa, Mycobacterium
SWPRSAKLLDVLLAAGLDAPFSCREG

SEQ ID NO: 864007 - protein, 26 aa, Mycobacterium
SWPRSTVLLDVLLAKGLDAPFSCREG

SEQ ID NO: 864008 - protein, 27 aa, Mycobacterium
SWPTLRTFLPSLLLDRTFRSFVLANFA

SEQ ID NO: 864009 - protein, 21 aa, Mycobacterium
SWPVVLATRLGISVKEARRRC

SEQ ID NO: 864010 - protein, 17 aa, Mycobacterium
SWPVYRQLTGADALARG

SEQ ID NO: 864011 - protein, 23 aa, Mycobacterium
SWQDTALLRAYGRFLRHTVVPLS

SEQ ID NO: 864012 - protein, 27 aa, Mycobacterium
SWQEDPGLVWAWYQNRRIQLLAVQPND

SEQ ID NO: 864013 - protein, 20 aa, Mycobacterium
SWQIRTLQDLALPLEEQEFE

SEQ ID NO: 864014 - protein, 20 aa, Mycobacterium
SWQIVSKALRPLPVAHKELN

SEQ ID NO: 864015 - protein, 19 aa, Mycobacterium
SWQLEKALPVPVFVQSMAQ

SEQ ID NO: 864016 - protein, 18 aa, Mycobacterium
SWQRCRVHFMRNLHGVVA

SEQ ID NO: 864017 - protein, 18 aa, Mycobacterium
SWQSILDFAGPRLGRTPV

SEQ ID NO: 864018 - protein, 26 aa, Mycobacterium
SWQVRDFLARNGLHYTWFRADDPDGQ

SEQ ID NO: 864019 - protein, 17 aa, Mycobacterium
SWRGLDVPPVLLSGDHA

SEQ ID NO: 864020 - protein, 22 aa, Mycobacterium
SWRPRVADLLLGPAGTHLAAPA

SEQ ID NO: 864021 - protein, 18 aa, Mycobacterium
SWRRGSMVTGIDQPSHGV

SEQ ID NO: 864022 - protein, 28 aa, Mycobacterium
SWRTQRWDSLRLLTPNWMTRLPGHAYRG

SEQ ID NO: 864023 - protein, 17 aa, Mycobacterium
SWRVFFTDLTRAYSGEQ

SEQ ID NO: 864024 - protein, 26 aa, Mycobacterium
SWSAEGLLMYLPPQAQDRLFDNITEL

SEQ ID NO: 864025 - protein, 19 aa, Mycobacterium
SWSAYWRVEPRPDGSLAPD

SEQ ID NO: 864026 - protein, 23 aa, Mycobacterium
SWSDAATVNADRGWQADEADLIE

SEQ ID NO: 864027 - protein, 23 aa, Mycobacterium
SWSGKVVLLKLIARMVRARVLGE

SEQ ID NO: 864028 - protein, 24 aa, Mycobacterium
SWTGRKISDLLKEPLWSVVQAQPS

SEQ ID NO: 864029 - protein, 17 aa, Mycobacterium
SWTIPAGCVAGVYISWQ

SEQ ID NO: 864030 - protein, 25 aa, Mycobacterium
SWTTGYLGLHRKPIVMLDPLGHYEG

SEQ ID NO: 864031 - protein, 23 aa, Mycobacterium
SWVDALVAYRRSRGLPAVGINWG

SEQ ID NO: 864032 - protein, 25 aa, Mycobacterium
SWVDANVWRHLAPKGWFYNVMVTGV

SEQ ID NO: 864033 - protein, 28 aa, Mycobacterium
SWVEAEGYKPFWAITRHADVMDIERQND

SEQ ID NO: 864034 - protein, 26 aa, Mycobacterium
SWVIHGALYRFPRLKVAVIEAGSKWL

SEQ ID NO: 864035 - protein, 22 aa, Mycobacterium
SWVIHGALYRVPRLKVAVIEAG

SEQ ID NO: 864036 - protein, 24 aa, Mycobacterium
SWVPAEAFLPADVITPWSHEQSSR

SEQ ID NO: 864037 - protein, 21 aa, Mycobacterium
SWVPRLLWRRWSPTYYAEEDL

SEQ ID NO: 864038 - protein, 25 aa, Mycobacterium
SWVRKHVLPKLPSPASPLWRSRRTI

SEQ ID NO: 864039 - protein, 20 aa, Mycobacterium
SWWGNFLVQKANEAGIGLDE

SEQ ID NO: 864040 - protein, 19 aa, Mycobacterium
SWWPDYVSWLAERSGPEVD

SEQ ID NO: 864041 - protein, 29 aa, Mycobacterium
SWYDHARRDLPWRRPGVSAWQILVSEFML

SEQ ID NO: 864042 - protein, 17 aa, Mycobacterium
SWYPWAKGVVPHGGEYT

SEQ ID NO: 864043 - protein, 17 aa, Mycobacterium
SWYRRLAADWRRCEGKT

SEQ ID NO: 864044 - protein, 31 aa, Mycobacterium
SWYVPGVPYDKPTLMRHIRDLELHSVSSVFA

SEQ ID NO: 864045 - protein, 19 aa, Mycobacterium
SYAAAAPTTAVISAAADEI

SEQ ID NO: 864046 - protein, 26 aa, Mycobacterium
SYAAIRMLRLLVLETAWKIDNSSTKE

SEQ ID NO: 864047 - protein, 20 aa, Mycobacterium
SYAAKFAGVVFPGETLKTRI

SEQ ID NO: 864048 - protein, 30 aa, Mycobacterium
SYADPPPESLPIKGFLSFDLARVDVVAELP

SEQ ID NO: 864049 - protein, 34 aa, Mycobacterium
SYAGTLARWSTQRRFLLNLPMFGREQFHPDVDKL

SEQ ID NO: 864050 - protein, 17 aa, Mycobacterium
SYALGLRGPAMTVDTAC

SEQ ID NO: 864051 - protein, 18 aa, Mycobacterium
SYALLRPGGRLVGYGVSN

SEQ ID NO: 864052 - protein, 17 aa, Mycobacterium
SYALRRGAKALGAVAQF

SEQ ID NO: 864053 - protein, 17 aa, Mycobacterium
SYALWAYGAPEPVHDVD

SEQ ID NO: 864054 - protein, 18 aa, Mycobacterium
SYALYPHMTVRQNIAFPL

SEQ ID NO: 864055 - protein, 17 aa, Mycobacterium
SYAPLMAYLVRSMQSGG

SEQ ID NO: 864056 - protein, 23 aa, Mycobacterium
SYAPPPRMLVFGAIDFAAALARQ

SEQ ID NO: 864057 - protein, 25 aa, Mycobacterium
SYAPQLFRYWAEHLDPDRARRCDPA

SEQ ID NO: 864058 - protein, 23 aa, Mycobacterium
SYARRPKVLTPQPGLLLAGDAVR

SEQ ID NO: 864059 - protein, 24 aa, Mycobacterium
SYARYWREAFRLPSQNMERLAARL

SEQ ID NO: 864060 - protein, 26 aa, Mycobacterium
SYATMAQWCFLLARTSRLGEGATQKK

SEQ ID NO: 864061 - protein, 17 aa, Mycobacterium
SYAVWDAGALTVSAPRD

SEQ ID NO: 864062 - protein, 29 aa, Mycobacterium
SYDATLPAMRRIVAALFHDARYPADMDYV

SEQ ID NO: 864063 - protein, 17 aa, Mycobacterium
SYDATVYVTKPSRFFVL

SEQ ID NO: 864064 - protein, 29 aa, Mycobacterium
SYDDWPEGWRFDDLLPYFMRSEASRGGNP

SEQ ID NO: 864065 - protein, 23 aa, Mycobacterium
SYDERIMLAGIKLARAIAAQAPL

SEQ ID NO: 864066 - protein, 21 aa, Mycobacterium
SYDKCIIFWGVATDKDFRGGT

SEQ ID NO: 864067 - protein, 24 aa, Mycobacterium
SYDLSSLRFIMWGATPVTASIAET

SEQ ID NO: 864068 - protein, 27 aa, Mycobacterium
SYDPSRIDALLKGRRLKKPLIAAVEGP

SEQ ID NO: 864069 - protein, 30 aa, Mycobacterium
SYDPSRIDALLKGRRLKKPLIAAVEGPAIA

SEQ ID NO: 864070 - protein, 28 aa, Mycobacterium
SYDPSRIDALLKGRRLTKPLIAAVEGPA

SEQ ID NO: 864071 - protein, 30 aa, Mycobacterium; identical to SEQ ID NO: 117740

SEQ ID NO: 864072 - protein, 19 aa, Mycobacterium
SYDQPAWVLTHRPEIAAES

SEQ ID NO: 864073 - protein, 22 aa, Mycobacterium
SYDVPIMGTPIGGIVPGLLTYA

SEQ ID NO: 864074 - protein, 19 aa, Mycobacterium
SYEDVMPYYDIVERTLGVY

SEQ ID NO: 864075 - protein, 25 aa, Mycobacterium
SYEELGTLGLLRRFAKGWIVRANQV

SEQ ID NO: 864076 - protein, 19 aa, Mycobacterium
SYEGVWRRPSDGAAGLPAP

SEQ ID NO: 864077 - protein, 26 aa, Mycobacterium
SYEIYRLDAVPGTEKLPYSLKVLAEN

SEQ ID NO: 864078 - protein, 23 aa, Mycobacterium
SYERGAPVDFPLNGVVAGFQKAI

SEQ ID NO: 864079 - protein, 26 aa, Mycobacterium
SYEYRNLPEHPAFYWYAERISEQRGV

SEQ ID NO: 864080 - protein, 19 aa, Mycobacterium
SYFGGLEPILIGLGGRPHW

SEQ ID NO: 864081 - protein, 23 aa, Mycobacterium
SYFGPSFMINWLHNSYGGYKSES

SEQ ID NO: 864082 - protein, 24 aa, Mycobacterium
SYFGPSFMINWLHNSYSGYKSESI

SEQ ID NO: 864083 - protein, 25 aa, Mycobacterium
SYFGPSFMINWLHNTYGDFKAESIL

SEQ ID NO: 864084 - protein, 24 aa, Mycobacterium
SYFGPSFMINWLHNTYGEFKAESI

SEQ ID NO: 864085 - protein, 19 aa, Mycobacterium
SYFPDWLLERRKRAERALT

SEQ ID NO: 864086 - protein, 25 aa, Mycobacterium
SYFRGELIYVFDGDAAGQAAALKAF

SEQ ID NO: 864087 - protein, 17 aa, Mycobacterium
SYFTWRTSKWELTEFGN

SEQ ID NO: 864088 - protein, 18 aa, Mycobacterium
SYFYKVVALDCDNTLWGG

SEQ ID NO: 864089 - protein, 18 aa, Mycobacterium
SYGALFRHFPTVGDFMAE

SEQ ID NO: 864090 - protein, 26 aa, Mycobacterium
SYGDARVRFPLSPFMGIMGVAFSQDR

SEQ ID NO: 864091 - protein, 22 aa, Mycobacterium
SYGELLGYFRQIEDVTAAWHFV

SEQ ID NO: 864092 - protein, 18 aa, Mycobacterium
SYGFWLGDAFASGGSIGY

SEQ ID NO: 864093 - protein, 20 aa, Mycobacterium
SYGHTWIAPHDTNVALLPIG

SEQ ID NO: 864094 - protein, 34 aa, Mycobacterium
SYGHTWIAPHDTTVALLPIGYADGVFRSLGGRLE

SEQ ID NO: 864095 - protein, 20 aa, Mycobacterium
SYGMLKLLVSTEDLTLLGVH

SEQ ID NO: 864096 - protein, 18 aa, Mycobacterium
SYGPHHRLIFPLNTIMEL

SEQ ID NO: 864097 - protein, 28 aa, Mycobacterium
SYGPPASHHLRWLASANALLDIPEDVVE

SEQ ID NO: 864098 - protein, 28 aa, Mycobacterium
SYGPPASHHLRWLASANALLEIPEDDVE

SEQ ID NO: 864099 - protein, 28 aa, Mycobacterium
SYGPPASHHLRWLASANGLLDIPEDVVE

SEQ ID NO: 864100 - protein, 19 aa, Mycobacterium
SYGSVLPPQGPPPAAPSAG

SEQ ID NO: 864101 - protein, 24 aa, Mycobacterium
SYGTYFVCADPRPLGYHDSAAFCA

SEQ ID NO: 864102 - protein, 26 aa, Mycobacterium
SYGVRRAQLIIGLKFRDKRIPSVEEF

SEQ ID NO: 864103 - protein, 19 aa, Mycobacterium
SYGWIAEQIGAPGSARAVG

SEQ ID NO: 864104 - protein, 25 aa, Mycobacterium
SYHAELDWWTSPFALAEGVPPSALA

SEQ ID NO: 864105 - protein, 18 aa, Mycobacterium
SYHCPLTYRPLLERDRRM

SEQ ID NO: 864106 - protein, 17 aa, Mycobacterium
SYHEFLIKKSRMPSQTP

SEQ ID NO: 864107 - protein, 26 aa, Mycobacterium
SYHHGDLKRALTSAALSLVAEKGPKG

SEQ ID NO: 864108 - protein, 24 aa, Mycobacterium
SYHKLGLLEPGLLGRELWAHYVRN

SEQ ID NO: 864109 - protein, 19 aa, Mycobacterium
SYIVPIVDRVLREGSGKGV

SEQ ID NO: 864110 - protein, 19 aa, Mycobacterium
SYKVTGTAPIYEILHDAKE

SEQ ID NO: 864111 - protein, 17 aa, Mycobacterium
SYLALPPSDADEAAKGM

SEQ ID NO: 864112 - protein, 28 aa, Mycobacterium
SYLANGRFFALPWYYRSGYDVVMYTLPF

SEQ ID NO: 864113 - protein, 27 aa, Mycobacterium
SYLDADPYLPLITPFLDDLRGELDETF

SEQ ID NO: 864114 - protein, 27 aa, Mycobacterium
SYLFTNDYEWDLLLSKTGWTEAEVMAQ

SEQ ID NO: 864115 - protein, 20 aa, Mycobacterium
SYLGDLHSMIGWPAGTLADF

SEQ ID NO: 864116 - protein, 18 aa, Mycobacterium
SYLGQLIHDLPGAGTRSD

SEQ ID NO: 864117 - protein, 18 aa, Mycobacterium
SYLIANVLPHLGVSPSSA

SEQ ID NO: 864118 - protein, 19 aa, Mycobacterium
SYLIATGGFAEWIDRGRPA

SEQ ID NO: 864119 - protein, 17 aa, Mycobacterium
SYLLGLRGPAVAVDTAC

SEQ ID NO: 864120 - protein, 25 aa, Mycobacterium
SYLLPQLIGRQNAAWLLLSSEWVDA

SEQ ID NO: 864121 - protein, 20 aa, Mycobacterium
SYLLVPLDQPGVEVRPIIQL

SEQ ID NO: 864122 - protein, 20 aa, Mycobacterium
SYLLVPLDQPGVQIRPIVQI

SEQ ID NO: 864123 - protein, 20 aa, Mycobacterium
SYLLVPLDQPGVQVRPIIQL

SEQ ID NO: 864124 - protein, 32 aa, Mycobacterium
SYLMPRLIGRQNAAWLLMSSEWISAAEAKEMG

SEQ ID NO: 864125 - protein, 20 aa, Mycobacterium
SYLPSPLTRGPWGAAMGGQN

SEQ ID NO: 864126 - protein, 22 aa, Mycobacterium
SYLVGLMAERWLSAGYCVLVID

SEQ ID NO: 864127 - protein, 18 aa, Mycobacterium
SYLVTLYSSLAVLTDDAL

SEQ ID NO: 864128 - protein, 18 aa, Mycobacterium
SYMLGSYSEWEPVAEMGT

SEQ ID NO: 864129 - protein, 24 aa, Mycobacterium
SYMVPARIVTLPRLPVNANGKLDG

SEQ ID NO: 864130 - protein, 23 aa, Mycobacterium
SYNHWAGVLYPPGLPAARRLARY

SEQ ID NO: 864131 - protein, 26 aa, Mycobacterium
SYNRGDPLMFKLGVGQVIQGWDQGVQ

SEQ ID NO: 864132 - protein, 24 aa, Mycobacterium
SYPPEAIDWLLPAGARDVLDLGAG

SEQ ID NO: 864133 - protein, 25 aa, Mycobacterium
SYPPEAIDWLLPPGAHDVLDLGAGT

SEQ ID NO: 864134 - protein, 24 aa, Mycobacterium
SYPPEAIDWLLPTGARNVLDLGAG

SEQ ID NO: 864135 - protein, 26 aa, Mycobacterium
SYPPEAIDWLLPVGARQVLDLGAGTG

SEQ ID NO: 864136 - protein, 21 aa, Mycobacterium
SYPTEIPLPFVVGRDLVGRVV

SEQ ID NO: 864137 - protein, 22 aa, Mycobacterium
SYQLTIYVFRYEEGTAMAVMYP

SEQ ID NO: 864138 - protein, 18 aa, Mycobacterium
SYQSLTRNIRARDLRPTC

SEQ ID NO: 864139 - protein, 24 aa, Mycobacterium
SYRAERFLGIIDKVRAAIPHAAIT

SEQ ID NO: 864140 - protein, 17 aa, Mycobacterium
SYRDLAGFGRRFIDVAA

SEQ ID NO: 864141 - protein, 29 aa, Mycobacterium
SYREIADRLAYVVRLILTGAKDTSPETEA

SEQ ID NO: 864142 - protein, 28 aa, Mycobacterium
SYRGAKNVLLVFFPLAFTGICQGELDQL

SEQ ID NO: 864143 - protein, 27 aa, Mycobacterium
SYRGAVGLNWYLTDPTLRSTVAYYLQP

SEQ ID NO: 864144 - protein, 28 aa, Mycobacterium
SYRGSKNVLLVFFPLAFTGICQGELDQL

SEQ ID NO: 864145 - protein, 25 aa, Mycobacterium
SYRHGRTIAPALRRAARKKPDAAQN

SEQ ID NO: 864146 - protein, 17 aa, Mycobacterium
SYRLGYDKAVKDGRFTI

SEQ ID NO: 864147 - protein, 17 aa, Mycobacterium
SYRLRMGAVGLPLQHHL

SEQ ID NO: 864148 - protein, 18 aa, Mycobacterium
SYRLTELLARFLEQLKDD

SEQ ID NO: 864149 - protein, 19 aa, Mycobacterium
SYRNFLTWLAERDKSAART

SEQ ID NO: 864150 - protein, 24 aa, Mycobacterium
SYRQDTVRMFGLPESGLAETLREA

SEQ ID NO: 864151 - protein, 17 aa, Mycobacterium
SYRQQRILAVADIGRNM

SEQ ID NO: 864152 - protein, 23 aa, Mycobacterium
SYRRLLKTYARISGRWHTGLPVG

SEQ ID NO: 864153 - protein, 19 aa, Mycobacterium
SYRRRLRPASHYSLGWLPR

SEQ ID NO: 864154 - protein, 25 aa, Mycobacterium
SYRTREPVRIIGELTDWAGHSPAQL

SEQ ID NO: 864155 - protein, 26 aa, Mycobacterium
SYRTREPVWIVGELTDWVGHPPEQLA

SEQ ID NO: 864156 - protein, 17 aa, Mycobacterium
SYRVLVSDLAQLYRGAT

SEQ ID NO: 864157 - protein, 20 aa, Mycobacterium
SYSALFPPPGPVIGPDTPTS

SEQ ID NO: 864158 - protein, 22 aa, Mycobacterium
SYSARLFNLLITNAPGAQSQMY

SEQ ID NO: 864159 - protein, 28 aa, Mycobacterium
SYSTFTLRPAAIFALPVCRRPAGDTVTA

SEQ ID NO: 864160 - protein, 25 aa, Mycobacterium
SYTENQYAPPPPYPASDPYEPYAIA

SEQ ID NO: 864161 - protein, 21 aa, Mycobacterium
SYTGKFLAEVIGRSAPPASAP

SEQ ID NO: 864162 - protein, 20 aa, Mycobacterium
SYTLSKYGMTLLSLGWANEY

SEQ ID NO: 864163 - protein, 22 aa, Mycobacterium
SYTPLVQVSFAWEQARRFQGGA

SEQ ID NO: 864164 - protein, 22 aa, Mycobacterium
SYTSFDAFGAFGGWQVKQTAGG

SEQ ID NO: 864165 - protein, 24 aa, Mycobacterium
SYVATVYAAPLMVPNGRGLVVFTS

SEQ ID NO: 864166 - protein, 26 aa, Mycobacterium
SYVDFLPAGLAVYRRGRRLRFMIKAE

SEQ ID NO: 864167 - protein, 22 aa, Mycobacterium
SYVLNKLGLENLILLNITGGVG

SEQ ID NO: 864168 - protein, 22 aa, Mycobacterium
SYVNIGFWSSVPAGATEGATNR

SEQ ID NO: 864169 - protein, 19 aa, Mycobacterium
SYVRALWRATKPGARLYMY

SEQ ID NO: 864170 - protein, 19 aa, Mycobacterium
SYVYLYRDLPEEVPVPFEM

SEQ ID NO: 864171 - protein, 24 aa, Mycobacterium
SYVYRNLMAALGGRWRLIAPDLPG

SEQ ID NO: 864172 - protein, 25 aa, Mycobacterium
SYYLASAFREVWMQPSGSVGLIGFA

SEQ ID NO: 864173 - protein, 32 aa, Mycobacterium
SYYLIHTERLPLLEPLRFIPVVGNPLADLLQP

SEQ ID NO: 864174 - protein, 25 aa, Mycobacterium
SYYVIPTENLPLLEPLRAIPVIGNP

SEQ ID NO: 864175 - protein, 23 aa, Mycobacterium
TAAAAERVVFLFPGQGAQHVGMA

SEQ ID NO: 864176 - protein, 26 aa, Mycobacterium
TAAAAGLIDLLLAAGGELITVLTGHG

SEQ ID NO: 864177 - protein, 21 aa, Mycobacterium
TAAAAPYLAWLSAAAQHAEQT

SEQ ID NO: 864178 - protein, 29 aa, Mycobacterium
TAAADYIRLFLAVRGPLGFTTGFNDIGLL

SEQ ID NO: 864179 - protein, 20 aa, Mycobacterium
TAAAGGWFRSSRRPDREWTN

SEQ ID NO: 864180 - protein, 17 aa, Mycobacterium
TAAALRELEREGFRGAV

SEQ ID NO: 864181 - protein, 17 aa, Mycobacterium
TAAAVRRARSGRPSGDL

SEQ ID NO: 864182 - protein, 24 aa, Mycobacterium
TAAAYVLKRWLSSGGVLATKIPAT

SEQ ID NO: 864183 - protein, 21 aa, Mycobacterium
TAADLALWAWNRGGSVDTSGE

SEQ ID NO: 864184 - protein, 40 aa, Mycobacterium
TAADPLDVYRILRVTNPSPYMYLLNIPDADGGLDFSIVGS

SEQ ID NO: 864185 - protein, 29 aa, Mycobacterium
TAADRIYSPMPFFWVGGLTMVVLQALSTG

SEQ ID NO: 864186 - protein, 25 aa, Mycobacterium
TAADTVLTKWKYSEFFRSDLLEILH

SEQ ID NO: 864187 - protein, 17 aa, Mycobacterium
TAADWPPHDLLAAAAEH

SEQ ID NO: 864188 - protein, 29 aa, Mycobacterium
TAADYGGELWILDLSPQLAPVGPPRRLVD

SEQ ID NO: 864189 - protein, 23 aa, Mycobacterium
TAAELFIVGAQLGGKPALFIVES

SEQ ID NO: 864190 - protein, 25 aa, Mycobacterium
TAAELNFRPWRAGLTYIATGNGCAL

SEQ ID NO: 864191 - protein, 30 aa, Mycobacterium
TAAEWHQYWIDTRLQWYVDLGIDRDNLRLY

SEQ ID NO: 864192 - protein, 22 aa, Mycobacterium
TAAEWVELLQEAGLMACLPYTW

SEQ ID NO: 864193 - protein, 21 aa, Mycobacterium
TAAEYLAARGWQTDIWTTEQA

SEQ ID NO: 864194 - protein, 25 aa, Mycobacterium
TAAFIDSDAWFLIRAVTAPDGASLP

SEQ ID NO: 864195 - protein, 19 aa, Mycobacterium
TAAFLCRLQEFLGTIDGSV

SEQ ID NO: 864196 - protein, 18 aa, Mycobacterium
TAAFRLRLAVGEDALITL

SEQ ID NO: 864197 - protein, 20 aa, Mycobacterium
TAAFRTTIGLPGRLATRLQP

SEQ ID NO: 864198 - protein, 21 aa, Mycobacterium
TAAFYNFAPARVAKALPAAWD

SEQ ID NO: 864199 - protein, 23 aa, Mycobacterium
TAAFYNFAPERVAKAVPGVWDVA

SEQ ID NO: 864200 - protein, 23 aa, Mycobacterium
TAAGFTITYLGETTYRLSIPSYR

SEQ ID NO: 864201 - protein, 25 aa, Mycobacterium
TAAGGDWFDAIPLGDRLVLVVGDVV

SEQ ID NO: 864202 - protein, 25 aa, Mycobacterium
TAAGGNNLWLIPPGPRRDESIRERE

SEQ ID NO: 864203 - protein, 23 aa, Mycobacterium
TAAGGNNLWLIPPGPRREESVRD

SEQ ID NO: 864204 - protein, 20 aa, Mycobacterium
TAAGLNPMDWIITADADTAA

SEQ ID NO: 864205 - protein, 35 aa, Mycobacterium
TAAGLRAGIPMLIRWLWLDQPIWAAGIEELGVGVG

SEQ ID NO: 864206 - protein, 19 aa, Mycobacterium
TAAGLRWYEVSNWARPGGE

SEQ ID NO: 864207 - protein, 40 aa, Mycobacterium
TAAGMRAGIPTLILWIWIEQPIWLAQIKRLKIGSGRRLAA

SEQ ID NO: 864208 - protein, 40 aa, Mycobacterium
TAAGMRAGIPTLILWIWIEQPIWLAQIKRLKIGSGRRLAS

SEQ ID NO: 864209 - protein, 27 aa, Mycobacterium
TAAGPHPFPLMVRDFQRIIGLEARVQV

SEQ ID NO: 864210 - protein, 21 aa, Mycobacterium
TAAGVRHTIEWYPAGHGFAVP

SEQ ID NO: 864211 - protein, 46 aa, Mycobacterium
TAAGYEAARSASVPPTLVAANRTRLVSLVLTNLFGQHAPAIAATEA

SEQ ID NO: 864212 - protein, 28 aa, Mycobacterium
TAAHRPRFDALGRWLLAYTAELADGVGA

SEQ ID NO: 864213 - protein, 17 aa, Mycobacterium
TAAIGSEPIIMLTAPGP

SEQ ID NO: 864214 - protein, 18 aa, Mycobacterium
TAAILRGVLRVFTDFRYV

SEQ ID NO: 864215 - protein, 19 aa, Mycobacterium
TAAIMSVSLLLAHMAEIDA

SEQ ID NO: 864216 - protein, 31 aa, Mycobacterium
TAAKHGLVGLMRLYANLLAPHNIRVNSVHPS

SEQ ID NO: 864217 - protein, 28 aa, Mycobacterium
TAAKIAVTWRLPVVFVVENIRGGPDARR

SEQ ID NO: 864218 - protein, 22 aa, Mycobacterium
TAAKLGPFLVPATLGAPEGTVA

SEQ ID NO: 864219 - protein, 36 aa, Mycobacterium
TAAKVTLWLDPVCPFSWNTARWLRAVAEKAGFDVDW

SEQ ID NO: 864220 - protein, 24 aa, Mycobacterium
TAAKWRHVLQHWLRHEVRAPEDIR

SEQ ID NO: 864221 - protein, 23 aa, Mycobacterium
TAALELLLVEYGRSASKWTSRIV

SEQ ID NO: 864222 - protein, 20 aa, Mycobacterium
TAALENPQWCARAIAEHGDK

SEQ ID NO: 864223 - protein, 19 aa, Mycobacterium
TAALFAFGVALQPRFGAGS

SEQ ID NO: 864224 - protein, 25 aa, Mycobacterium
TAALHEREWLRSDALRYGADPQEVD

SEQ ID NO: 864225 - protein, 25 aa, Mycobacterium
TAALLDYQVPGLADAIRRSGLPAVP

SEQ ID NO: 864226 - protein, 20 aa, Mycobacterium
TAALLRLADLGVRLPTLQDG

SEQ ID NO: 864227 - protein, 18 aa, Mycobacterium
TAALLRLDVSNWPVLGGM

SEQ ID NO: 864228 - protein, 21 aa, Mycobacterium
TAALQLLGVSGPRYLGGAGRW

SEQ ID NO: 864229 - protein, 18 aa, Mycobacterium
TAALRERIMVIDGAMGTA

SEQ ID NO: 864230 - protein, 17 aa, Mycobacterium
TAALRQRILVIDGAMGT

SEQ ID NO: 864231 - protein, 17 aa, Mycobacterium
TAALWGRLYTHDAAMLD

SEQ ID NO: 864232 - protein, 25 aa, Mycobacterium
TAAMALMFMASGHHYGWPVAAGGSG

SEQ ID NO: 864233 - protein, 27 aa, Mycobacterium
TAAPEEIAQAVLFLASPRASFVTGSTL

SEQ ID NO: 864234 - protein, 25 aa, Mycobacterium
TAAPGKPLLLLSAYDLADVGYRVKE

SEQ ID NO: 864235 - protein, 23 aa, Mycobacterium
TAAPLDRRLLLGMLAELPAGAGV

SEQ ID NO: 864236 - protein, 25 aa, Mycobacterium
TAAPNFAYALFAKRLRRQAKPGEFD

SEQ ID NO: 864237 - protein, 25 aa, Mycobacterium
TAAPNFAYNLLARRLRRQATPGEFD

SEQ ID NO: 864238 - protein, 21 aa, Mycobacterium
TAAPNFAYSLFAKRLRNQAKP

SEQ ID NO: 864239 - protein, 21 aa, Mycobacterium
TAAPNFAYSLLARRLRRAQDH

SEQ ID NO: 864240 - protein, 32 aa, Mycobacterium
TAAPSLPGSIFPLPALPPWLATDIDNWNIIMA

SEQ ID NO: 864241 - protein, 28 aa, Mycobacterium
TAAPTFDIFMWEIFGPLVAGARLVFNPG

SEQ ID NO: 864242 - protein, 25 aa, Mycobacterium
TAAQERIWMAFPPQGASVFENAESA

SEQ ID NO: 864243 - protein, 28 aa, Mycobacterium
TAAQFWALVHGFVMLELAGFYGQDGAAV

SEQ ID NO: 864244 - protein, 24 aa, Mycobacterium
TAAQLTRYGLAPTAARIYTEIVSN

SEQ ID NO: 864245 - protein, 23 aa, Mycobacterium
TAAQRWWRTLADEATVEQAQASL

SEQ ID NO: 864246 - protein, 20 aa, Mycobacterium
TAARAARLKWWTTDLQVRTA

SEQ ID NO: 864247 - protein, 38 aa, Mycobacterium
TAARALLRSRLLAPPSPLATLRLLREARRGGTNPYTLL

SEQ ID NO: 864248 - protein, 20 aa, Mycobacterium
TAARAPFVLLTSNATRELSE

SEQ ID NO: 864249 - protein, 17 aa, Mycobacterium
TAARIRKLVPEARVVVA

SEQ ID NO: 864250 - protein, 21 aa, Mycobacterium
TAARLFYAYADTLLALDRADD

SEQ ID NO: 864251 - protein, 21 aa, Mycobacterium
TAARLFYAYADTLVALDRRDE

SEQ ID NO: 864252 - protein, 23 aa, Mycobacterium
TAARPDVFFTGRDGSLRSNRVLC

SEQ ID NO: 864253 - protein, 25 aa, Mycobacterium
TAARRRVEAALAGDLALRDLTPEEG

SEQ ID NO: 864254 - protein, 18 aa, Mycobacterium
TAARVFFPDPWPKARHHK

SEQ ID NO: 864255 - protein, 30 aa, Mycobacterium
TAARVIARDSLVKTALFGSDPNWGRVLAAV

SEQ ID NO: 864256 - protein, 17 aa, Mycobacterium
TAARWIGTAANWMSCWT

SEQ ID NO: 864257 - protein, 25 aa, Mycobacterium
TAASLHAFNLWLDEDWGFDRPDHRI

SEQ ID NO: 864258 - protein, 25 aa, Mycobacterium
TAASLIEIDRSLSTWPQLASDVIVG

SEQ ID NO: 864259 - protein, 19 aa, Mycobacterium
TAASRVRNRWGGEDFVRVL

SEQ ID NO: 864260 - protein, 20 aa, Mycobacterium
TAASWLGLGSAASALNVTML

SEQ ID NO: 864261 - protein, 25 aa, Mycobacterium
TAASYVLKRWLSSGGLLATKIPATP

SEQ ID NO: 864262 - protein, 24 aa, Mycobacterium
TAATALPYAAPAAAPQQAAVPGSG

SEQ ID NO: 864263 - protein, 33 aa, Mycobacterium
TAATFRFDCAVSSWLYRIVVNACLDRLRRTRTQ

SEQ ID NO: 864264 - protein, 21 aa, Mycobacterium
TAATRALVARDLYDDFVAGVG

SEQ ID NO: 864265 - protein, 26 aa, Mycobacterium
TAATTLKLHLTLRKAYGFGSMVMSLL

SEQ ID NO: 864266 - protein, 25 aa, Mycobacterium
TAATTTLPYSGPFSGAANLAYLYQT

SEQ ID NO: 864267 - protein, 24 aa, Mycobacterium
TAATWLPALKAWRRVRRFRPDIVI

SEQ ID NO: 864268 - protein, 26 aa, Mycobacterium
TAATWSNPWPMYRALRDHDPVHHVVP

SEQ ID NO: 864269 - protein, 18 aa, Mycobacterium
TAAVNALTALLRVAALGI

SEQ ID NO: 864270 - protein, 24 aa, Mycobacterium
TAAVNLVQSLVSMGLRKSGHGEFA

SEQ ID NO: 864271 - protein, 18 aa, Mycobacterium
TAAVWHLCTPISGRLRDT

SEQ ID NO: 864272 - protein, 17 aa, Mycobacterium
TAAVYTLSTGWINDIWA

SEQ ID NO: 864273 - protein, 17 aa, Mycobacterium
TAAWDEPFALPTEESTT

SEQ ID NO: 864274 - protein, 18 aa, Mycobacterium
TAAWLYSNFYGLAKVGVN

SEQ ID NO: 864275 - protein, 17 aa, Mycobacterium
TAAWTPTDWIDNTMSTW

SEQ ID NO: 864276 - protein, 24 aa, Mycobacterium
TAAYGIALLSRFPVENWQVVRLPR

SEQ ID NO: 864277 - protein, 20 aa, Mycobacterium
TACAYDHLIPGRGVGVLLDD

SEQ ID NO: 864278 - protein, 21 aa, Mycobacterium
TACILCECNCGIVVQVADRKL

SEQ ID NO: 864279 - protein, 24 aa, Mycobacterium
TACLRALVRRRVAVAHPGYDSEDG

SEQ ID NO: 864280 - protein, 24 aa, Mycobacterium
TACLVPTLLTRLVSELKLTGTDVP

SEQ ID NO: 864281 - protein, 29 aa, Mycobacterium
TADALRMLTLPGTFAMYLERAWPRHRRLG

SEQ ID NO: 864282 - protein, 24 aa, Mycobacterium
TADAVPPGFELPEGITGPMPAEVA

SEQ ID NO: 864283 - protein, 20 aa, Mycobacterium
TADFPFALITGRTLYHFHTR

SEQ ID NO: 864284 - protein, 21 aa, Mycobacterium
TADGLRRLSGSLAGPVRRVAG

SEQ ID NO: 864285 - protein, 24 aa, Mycobacterium
TADGPARVFTLLHRARPVLLNLAD

SEQ ID NO: 864286 - protein, 18 aa, Mycobacterium
TADGRILRVRGRGVPKRS

SEQ ID NO: 864287 - protein, 24 aa, Mycobacterium
TADGVLLAPVPDGWVLVDCAEAGV

SEQ ID NO: 864288 - protein, 20 aa, Mycobacterium
TADHLYVFQRTPVYSVPANN

SEQ ID NO: 864289 - protein, 23 aa, Mycobacterium
TADLLQHTSFAQPALFAVEMGLA

SEQ ID NO: 864290 - protein, 21 aa, Mycobacterium
TADLLRRMRAVFAESPIAERI

SEQ ID NO: 864291 - protein, 18 aa, Mycobacterium
TADMLDWHVLLAICGPDA

SEQ ID NO: 864292 - protein, 24 aa, Mycobacterium
TADPALTVALIGLGVDLFGAFIID

SEQ ID NO: 864293 - protein, 23 aa, Mycobacterium
TADPRYAPPPLLRQMVAAGRLGN

SEQ ID NO: 864294 - protein, 23 aa, Mycobacterium
TADPTMLRTLLGERLPQYMVPAA

SEQ ID NO: 864295 - protein, 26 aa, Mycobacterium
TADQLVRIRHRLADWLRAAHITGDLA

SEQ ID NO: 864296 - protein, 26 aa, Mycobacterium
TADQPLDWFCSFSSIAALVGSPGQGA

SEQ ID NO: 864297 - protein, 22 aa, Mycobacterium
TADRAWLRTGDLGTYLDGELYV

SEQ ID NO: 864298 - protein, 18 aa, Mycobacterium
TADRFTTMSPAERWQLLA

SEQ ID NO: 864299 - protein, 24 aa, Mycobacterium
TADRLWIPVVRDWRLNERHYGALQ

SEQ ID NO: 864300 - protein, 26 aa, Mycobacterium
TADSGHWVRLLREAGIPTGPVHDMAG

SEQ ID NO: 864301 - protein, 23 aa, Mycobacterium
TADSVFLRPTVVDRVRPGMPLHD

SEQ ID NO: 864302 - protein, 23 aa, Mycobacterium
TADTLLAAAKKLGGLISAAAEAM

SEQ ID NO: 864303 - protein, 33 aa, Mycobacterium
TADVDALVAEALELGTYSVCVSPSMLPVEVPRG

SEQ ID NO: 864304 - protein, 27 aa, Mycobacterium
TADVEPRMLLVHFLRDQLGLTGTHWGC

SEQ ID NO: 864305 - protein, 18 aa, Mycobacterium
TADVFLTNYLPSARQKNK

SEQ ID NO: 864306 - protein, 26 aa, Mycobacterium
TADVSWDGVWWWTRSDGFLQLAPASR

SEQ ID NO: 864307 - protein, 25 aa, Mycobacterium
TADVTGIHVTVRYFAAARAAAGIES

SEQ ID NO: 864308 - protein, 17 aa, Mycobacterium
TADWLSGNLGRPGLAIV

SEQ ID NO: 864309 - protein, 23 aa, Mycobacterium
TADYKRHLAAELTIRTLRSAVGR

SEQ ID NO: 864310 - protein, 25 aa, Mycobacterium
TAEAAGMMLAAILGGSVGAPIVVAA

SEQ ID NO: 864311 - protein, 28 aa, Mycobacterium
TAEADFYICGPAPFMDTVERVLLDAGVP

SEQ ID NO: 864312 - protein, 26 aa, Mycobacterium
TAEALQLDSWWEYLSGIRSTYPLSYG

SEQ ID NO: 864313 - protein, 30 aa, Mycobacterium
TAEALRGPFWRWYPGLYAGSKLMHNSHWPA

SEQ ID NO: 864314 - protein, 30 aa, Mycobacterium
TAEASLVVDLLRRSHLIDGVPWSRMAVIVR

SEQ ID NO: 864315 - protein, 43 aa, Mycobacterium
TAEATNASPLQPLLDLINAPTQAILGRPLIGNGSNGTYPGQDG

SEQ ID NO: 864316 - protein, 19 aa, Mycobacterium
TAEAVFTTLAGLPGADACS

SEQ ID NO: 864317 - protein, 29 aa, Mycobacterium
TAEAVSAGVPLRLISVLKTAHSSPEEYEH

SEQ ID NO: 864318 - protein, 28 aa, Mycobacterium
TAEDGAGWLTFLRSLTARGLSGVKLVTS

SEQ ID NO: 864319 - protein, 33 aa, Mycobacterium
TAEDRALSWLPLYHDMGLILGVLTPIFAGFPVV

SEQ ID NO: 864320 - protein, 24 aa, Mycobacterium
TAEFAGVPLPKYADFVVAGRDLST

SEQ ID NO: 864321 - protein, 32 aa, Mycobacterium
TAEFSRLVALLRFPARFFTSAPISRVSAQDLL

SEQ ID NO: 864322 - protein, 22 aa, Mycobacterium
TAEGALPLLAPMSEVAGRLSAQ

SEQ ID NO: 864323 - protein, 35 aa, Mycobacterium
TAEGLEHTFALYYLSRFVLSHRLVGLLDAAEAPVI

SEQ ID NO: 864324 - protein, 21 aa, Mycobacterium
TAEGLFDYLPPVAQDLLLDNV

SEQ ID NO: 864325 - protein, 23 aa, Mycobacterium
TAEGLLMYLQPAQALGLIAQCAK

SEQ ID NO: 864326 - protein, 26 aa, Mycobacterium
TAEHNWALLHALPDLVATGVPVLVGA

SEQ ID NO: 864327 - protein, 20 aa, Mycobacterium
TAEIGFLTRALKAPTMREAV

SEQ ID NO: 864328 - protein, 17 aa, Mycobacterium
TAEISLLIDPKALHARL

SEQ ID NO: 864329 - protein, 32 aa, Mycobacterium
TAEKFVTWCGRRWYRTGDLARYWPDGTLEFVG

SEQ ID NO: 864330 - protein, 18 aa, Mycobacterium
TAEKIGAPLIIKPSAGGG

SEQ ID NO: 864331 - protein, 17 aa, Mycobacterium
TAELFFDSVAVPRDHLL

SEQ ID NO: 864332 - protein, 17 aa, Mycobacterium
TAELGIRVLRYGSGPGG

SEQ ID NO: 864333 - protein, 19 aa, Mycobacterium
TAELGTALLLITHDLALAA

SEQ ID NO: 864334 - protein, 20 aa, Mycobacterium
TAELIRIALTSRQKPYTYVS

SEQ ID NO: 864335 - protein, 23 aa, Mycobacterium
TAELRALIGLRDAAVALIEAEAD

SEQ ID NO: 864336 - protein, 19 aa, Mycobacterium
TAEMLGLRPVVESALADLD

SEQ ID NO: 864337 - protein, 23 aa, Mycobacterium
TAEPLVKRTWAGEGLGLAQVGEE

SEQ ID NO: 864338 - protein, 29 aa, Mycobacterium
TAEPQVPPPMPPPPATAPQWPQNSMLRAP

SEQ ID NO: 864339 - protein, 30 aa, Mycobacterium; identical to SEQ ID NO: 132405

SEQ ID NO: 864340 - protein, 18 aa, Mycobacterium
TAEQLGFSAFFRSDHYLA

SEQ ID NO: 864341 - protein, 24 aa, Mycobacterium
TAEQMKMFLTRLGFGSKIVVTGDI

SEQ ID NO: 864342 - protein, 25 aa, Mycobacterium
TAEQMKMFLTRLGFGSKIVVTGDIT

SEQ ID NO: 864343 - protein, 25 aa, Mycobacterium
TAEQMKMFLTRLGFGSKIVVTGDVT

SEQ ID NO: 864344 - protein, 26 aa, Mycobacterium
TAEQWRLVVDVNLIGAWNTCAAALPH

SEQ ID NO: 864345 - protein, 32 aa, Mycobacterium
TAERANVTQWLAWVLMILTGAMNRPGGTWFHP

SEQ ID NO: 864346 - protein, 27 aa, Mycobacterium
TAERGKFDFMFLAEGLRLREQGGAIYD

SEQ ID NO: 864347 - protein, 23 aa, Mycobacterium
TAERHLRWLAALGGIDGGRVDAV

SEQ ID NO: 864348 - protein, 18 aa, Mycobacterium
TAERLEQVRAWLAENPQT

SEQ ID NO: 864349 - protein, 18 aa, Mycobacterium
TAERLLKRHPPREALRRW

SEQ ID NO: 864350 - protein, 17 aa, Mycobacterium
TAERLVQLWKEAGAPAA

SEQ ID NO: 864351 - protein, 18 aa, Mycobacterium
TAERPPFVVLTSNATREL

SEQ ID NO: 864352 - protein, 24 aa, Mycobacterium
TAESCHQILLPQPVLHNDELDKLI

SEQ ID NO: 864353 - protein, 25 aa, Mycobacterium
TAESGWTFGFVDLAGFTALTDAHGD

SEQ ID NO: 864354 - protein, 27 aa, Mycobacterium
TAESRAYKMWLPPLTDPTPLDELVARD

SEQ ID NO: 864355 - protein, 25 aa, Mycobacterium
TAESTWHRWIAQYGGMNANEAKQLK

SEQ ID NO: 864356 - protein, 23 aa, Mycobacterium
TAETAALLGRAYLALGRESEADE

SEQ ID NO: 864357 - protein, 24 aa, Mycobacterium
TAETPLDAQYWRRHSRQPVQFTES

SEQ ID NO: 864358 - protein, 18 aa, Mycobacterium
TAEVLAWTDALRAAALPG

SEQ ID NO: 864359 - protein, 19 aa, Mycobacterium
TAEYWRGMTKLQQAAELKV

SEQ ID NO: 864360 - protein, 28 aa, Mycobacterium
TAFAHMRRLLRESWYNDLPAQLAAETQA

SEQ ID NO: 864361 - protein, 21 aa, Mycobacterium
TAFDQAYLAGVLGFPLVESAD

SEQ ID NO: 864362 - protein, 20 aa, Mycobacterium
TAFDQAYLASVLGLPLVESA

SEQ ID NO: 864363 - protein, 17 aa, Mycobacterium
TAFDRWGLMPRMLVGTT

SEQ ID NO: 864364 - protein, 19 aa, Mycobacterium
TAFERPGPRLRDYLLAVKA

SEQ ID NO: 864365 - protein, 19 aa, Mycobacterium
TAFHIWRAFARYSPVLPAG

SEQ ID NO: 864366 - protein, 21 aa, Mycobacterium
TAFLCGPEPMLRFGAEALLAK

SEQ ID NO: 864367 - protein, 17 aa, Mycobacterium
TAFLFRDGTDYLPRAHA

SEQ ID NO: 864368 - protein, 20 aa, Mycobacterium
TAFLISARKLAPGAVAPMPL

SEQ ID NO: 864369 - protein, 20 aa, Mycobacterium
TAFLVAARRLAPGAVAPAPL

SEQ ID NO: 864370 - protein, 20 aa, Mycobacterium
TAFMASAPRPNATGSLPMTL

SEQ ID NO: 864371 - protein, 20 aa, Mycobacterium
TAFPSLWTVIDEPTGRVICE

SEQ ID NO: 864372 - protein, 20 aa, Mycobacterium
TAFQAAHARFVEAAGKVNTL

SEQ ID NO: 864373 - protein, 30 aa, Mycobacterium
TAFRHTLPMPLPTLFSRWYGPISPVKQVRD

SEQ ID NO: 864374 - protein, 24 aa, Mycobacterium
TAFSALIDHTVWFQRPADLSDWVL

SEQ ID NO: 864375 - protein, 26 aa, Mycobacterium
TAFSRPSFWWIRLGNPLAKQLQRIVT

SEQ ID NO: 864376 - protein, 19 aa, Mycobacterium
TAFTPLNYRLSPEGLRELI

SEQ ID NO: 864377 - protein, 28 aa, Mycobacterium
TAFTQVPRFLDPSALKPAGSLTAPMPGS

SEQ ID NO: 864378 - protein, 18 aa, Mycobacterium
TAFVPFAARWPVEVHIYP

SEQ ID NO: 864379 - protein, 22 aa, Mycobacterium
TAGAAVHVWGPPSYPGCRPAPI

SEQ ID NO: 864380 - protein, 26 aa, Mycobacterium
TAGAHADAYLWIKRPGESDGSCGRGE

SEQ ID NO: 864381 - protein, 21 aa, Mycobacterium
TAGALNLFGFSPMNWDEDAVT

SEQ ID NO: 864382 - protein, 22 aa, Mycobacterium
TAGALNLFSFRPDAWDTEAETV

SEQ ID NO: 864383 - protein, 23 aa, Mycobacterium
TAGAWLHVQLPEAPPPPENTPVE

SEQ ID NO: 864384 - protein, 25 aa, Mycobacterium
TAGDGGTGGLGGHGGAGADNTTTVS

SEQ ID NO: 864385 - protein, 18 aa, Mycobacterium
TAGDLLAAAFPPASVTGT

SEQ ID NO: 864386 - protein, 17 aa, Mycobacterium
TAGDLLERLAVSGAALL

SEQ ID NO: 864387 - protein, 25 aa, Mycobacterium
TAGEPLDWFCSFSSAAALVGSPGQG

SEQ ID NO: 864388 - protein, 25 aa, Mycobacterium
TAGEYGYDLAYFHRMLAAGAVDCLQ

SEQ ID NO: 864389 - protein, 20 aa, Mycobacterium
TAGFATRVLLDLTAGVSPST

SEQ ID NO: 864390 - protein, 25 aa, Mycobacterium
TAGGPRPGWPTYFTKRPSGTADTVA

SEQ ID NO: 864391 - protein, 27 aa, Mycobacterium
TAGGTKLSIPDLIRLASQALHYLAVYD

SEQ ID NO: 864392 - protein, 27 aa, Mycobacterium
TAGGTKLSIPDLIRLATQAHHYLAVYD

SEQ ID NO: 864393 - protein, 20 aa, Mycobacterium
TAGGWLLGDGGAGGSSTAGS

SEQ ID NO: 864394 - protein, 22 aa, Mycobacterium
TAGHPLADLAWLLVNWPSSTET

SEQ ID NO: 864395 - protein, 26 aa, Mycobacterium
TAGKELDWWVAFSSVASLLGSPGQSA

SEQ ID NO: 864396 - protein, 26 aa, Mycobacterium
TAGKTMGIPILYPWANRLGANTYTAE

SEQ ID NO: 864397 - protein, 26 aa, Mycobacterium
TAGKTMGIPILYPWANRLSANTYTAE

SEQ ID NO: 864398 - protein, 25 aa, Mycobacterium
TAGLDGWYLMYQVPGLNASMRPSHD

SEQ ID NO: 864399 - protein, 37 aa, Mycobacterium
TAGLDHFGGLLAGLLLDPGQFLVPGGLVLVGRLHRIQ

SEQ ID NO: 864400 - protein, 17 aa, Mycobacterium
TAGLDLRAGIAAQMRGL

SEQ ID NO: 864401 - protein, 24 aa, Mycobacterium
TAGLGRNFLQQLGILKPDDTGITN

SEQ ID NO: 864402 - protein, 22 aa, Mycobacterium
TAGLHTVTWYFLLFSVFDECSE

SEQ ID NO: 864403 - protein, 24 aa, Mycobacterium
TAGLIDILVTHTRFLDGFLADAGR

SEQ ID NO: 864404 - protein, 20 aa, Mycobacterium
TAGLLAAMLERSPTSLLSSL

SEQ ID NO: 864405 - protein, 24 aa, Mycobacterium
TAGLLSMIYPLRVTAGDARGVAEL

SEQ ID NO: 864406 - protein, 20 aa, Mycobacterium
TAGLLTLHGQNDQLRLIRPE

SEQ ID NO: 864407 - protein, 26 aa, Mycobacterium
TAGLVVTPLPLLYDAERHALLGHVAR

SEQ ID NO: 864408 - protein, 21 aa, Mycobacterium
TAGMAFSIEPGIYVPGRWGAR

SEQ ID NO: 864409 - protein, 18 aa, Mycobacterium
TAGMPFTPVIFEGLCVLP

SEQ ID NO: 864410 - protein, 25 aa, Mycobacterium
TAGPELWDQLRALGLARLTGAEESG

SEQ ID NO: 864411 - protein, 35 aa, Mycobacterium
TAGPIERFLEWWAPFANFLYDTAGLPFFGAGIASF

SEQ ID NO: 864412 - protein, 43 aa, Mycobacterium
TAGPIERFLEWYAPFANFFYDTLGLPFFGAGITSFFAATAKTA

SEQ ID NO: 864413 - protein, 22 aa, Mycobacterium
TAGPLIDKLYRWGDSDERLGVF

SEQ ID NO: 864414 - protein, 26 aa, Mycobacterium
TAGPNFAYSLLARRLRKAPDGAYDLS

SEQ ID NO: 864415 - protein, 26 aa, Mycobacterium
TAGPQLVVPILNARFALNAANARWGS

SEQ ID NO: 864416 - protein, 25 aa, Mycobacterium
TAGPTAVLSGAYEAAAAAAKAGEGP

SEQ ID NO: 864417 - protein, 23 aa, Mycobacterium
TAGQITILRGYAKYLRQAGFPYS

SEQ ID NO: 864418 - protein, 39 aa, Mycobacterium
TAGRAAVLAPRLPIPDEFGLCRYLAAGLAVVHAVEQRPG

SEQ ID NO: 864419 - protein, 23 aa, Mycobacterium
TAGRINHAYLFSGPRGCGKTSSA

SEQ ID NO: 864420 - protein, 24 aa, Mycobacterium
TAGRKLPWFGPPMSAASMATARLM

SEQ ID NO: 864421 - protein, 17 aa, Mycobacterium
TAGRLPAAAPRISKLVA

SEQ ID NO: 864422 - protein, 21 aa, Mycobacterium
TAGRNRFWAHGTLGPARATAS

SEQ ID NO: 864423 - protein, 32 aa, Mycobacterium
TAGSAVMRILTGPRWRFGARDIAALWRRAVEL

SEQ ID NO: 864424 - protein, 18 aa, Mycobacterium
TAGSRKLFIRQGFDRWDE

SEQ ID NO: 864425 - protein, 26 aa, Mycobacterium
TAGSRVHLPVWVPGALFSVGDGHFAQ

SEQ ID NO: 864426 - protein, 24 aa, Mycobacterium
TAGSWNAPWSKLTPARQAAVIVAA

SEQ ID NO: 864427 - protein, 19 aa, Mycobacterium
TAGTDRYGGYGGDGGGGGG

SEQ ID NO: 864428 - protein, 19 aa, Mycobacterium
TAGVLGPDSPWLADTWRDR

SEQ ID NO: 864429 - protein, 24 aa, Mycobacterium
TAGVLRIAHWLTPGQRAFQMATQL

SEQ ID NO: 864430 - protein, 17 aa, Mycobacterium
TAGWQGPASITMAAAAA

SEQ ID NO: 864431 - protein, 28 aa, Mycobacterium
TAGYGGFLRASLPPFWSTHDLAVVTAAL

SEQ ID NO: 864432 - protein, 21 aa, Mycobacterium
TAGYHPFPGQAGYAAAKAFVK

SEQ ID NO: 864433 - protein, 43 aa, Mycobacterium
TAGYLGMHDKPLILLDPFGHYDGLLTWLRGLVPTGYVSQRAMD

SEQ ID NO: 864434 - protein, 25 aa, Mycobacterium
TAHAADVLRIAPDPAWRVDVTEKAV

SEQ ID NO: 864435 - protein, 24 aa, Mycobacterium
TAHATAWYGLHDLARIKAGDKVLI

SEQ ID NO: 864436 - protein, 24 aa, Mycobacterium
TAHATAWYGLNDLAGIKAGDRVLI

SEQ ID NO: 864437 - protein, 24 aa, Mycobacterium
TAHGPLTLKGFDAPVTAFELRARD

SEQ ID NO: 864438 - protein, 18 aa, Mycobacterium
TAHHIVIGGWSIALFVDE

SEQ ID NO: 864439 - protein, 20 aa, Mycobacterium
TAHHNAIHPVWVVTGSRLHS

SEQ ID NO: 864440 - protein, 34 aa, Mycobacterium
TAHHRPSIAYVLTKLAIVLFTKELHRRYHGSGLS

SEQ ID NO: 864441 - protein, 18 aa, Mycobacterium
TAHLAPGQLLLIHGGASG

SEQ ID NO: 864442 - protein, 23 aa, Mycobacterium
TAHLLVGSLAHSGKWRAALSPTE

SEQ ID NO: 864443 - protein, 25 aa, Mycobacterium
TAHLSDRDMARIRRIGLAAISPEQA

SEQ ID NO: 864444 - protein, 17 aa, Mycobacterium
TAHPDLDAFYGEAGSMT

SEQ ID NO: 864445 - protein, 30 aa, Mycobacterium
TAHRGITIAGMPNLFFLLGPNTGLGHNSIV

SEQ ID NO: 864446 - protein, 26 aa, Mycobacterium
TAHRKALLPQLAARRIRAFEPFILET

SEQ ID NO: 864447 - protein, 23 aa, Mycobacterium
TAHRLLAMLAYRGFVRQDPVSKA

SEQ ID NO: 864448 - protein, 23 aa, Mycobacterium
TAHRLLSMLQYRGFVRQDPASKA

SEQ ID NO: 864449 - protein, 20 aa, Mycobacterium
TAHRSLLSRLITPKRLKANE

SEQ ID NO: 864450 - protein, 24 aa, Mycobacterium
TAHTSRLQLLAEIGTRTAAVSAAE

SEQ ID NO: 864451 - protein, 23 aa, Mycobacterium
TAIAAAAWTFDLTEREYKELARA

SEQ ID NO: 864452 - protein, 27 aa, Mycobacterium
TAIAGSASRYLSRWHRRRPLWVGVATG

SEQ ID NO: 864453 - protein, 20 aa, Mycobacterium
TAIDVLLLGGRPIREPVFHY

SEQ ID NO: 864454 - protein, 23 aa, Mycobacterium
TAIELMPVHQFFHDSRLIALGLR

SEQ ID NO: 864455 - protein, 19 aa, Mycobacterium
TAIHLLGPYRVPAAEISGR

SEQ ID NO: 864456 - protein, 24 aa, Mycobacterium
TAILHLQNGFILPSFPSVATPEVF

SEQ ID NO: 864457 - protein, 20 aa, Mycobacterium
TAILVRRALMRLPVEQRAAV

SEQ ID NO: 864458 - protein, 20 aa, Mycobacterium
TAINPVHRIADPSEWLVHGD

SEQ ID NO: 864459 - protein, 23 aa, Mycobacterium
TAIPLAKACARIMLGANISQLRT

SEQ ID NO: 864460 - protein, 18 aa, Mycobacterium
TAIPVAVVRGLRLPDDGS

SEQ ID NO: 864461 - protein, 26 aa, Mycobacterium
TAIQAQDFFFRKIIRDKGVALAHVSG

SEQ ID NO: 864462 - protein, 18 aa, Mycobacterium
TAIRYLGHSISWAELHQR

SEQ ID NO: 864463 - protein, 29 aa, Mycobacterium
TAISGSGPAYFFLLVEALVDAGVASGLTR

SEQ ID NO: 864464 - protein, 21 aa, Mycobacterium
TAITMARIIGELLPEISVPYG

SEQ ID NO: 864465 - protein, 25 aa, Mycobacterium
TAIVEFPPAGTLTGIAKRELRGVPT

SEQ ID NO: 864466 - protein, 26 aa, Mycobacterium
TAIVEFPPAGTLTGIAKRELRGVPTH

SEQ ID NO: 864467 - protein, 24 aa, Mycobacterium
TAIVHLAAIVSPPSYRDPRLARKV

SEQ ID NO: 864468 - protein, 23 aa, Mycobacterium
TAKDLLRVLTELDLLRPHPDDPS

SEQ ID NO: 864469 - protein, 23 aa, Mycobacterium
TAKEARIAFLMLPGVGTKDDIKE

SEQ ID NO: 864470 - protein, 21 aa, Mycobacterium
TAKERVFVVNALRALRAIAPA

SEQ ID NO: 864471 - protein, 23 aa, Mycobacterium
TAKLLPRFDTITYRQLAGRIQAV

SEQ ID NO: 864472 - protein, 31 aa, Mycobacterium
TAKLVEELGRRCLPIILDVRAPAQVSAAVEQ

SEQ ID NO: 864473 - protein, 17 aa, Mycobacterium
TAKLVLPPDFPVTSTVA

SEQ ID NO: 864474 - protein, 25 aa, Mycobacterium
TAKNMIQAFFLDLQAINGGASRPDG

SEQ ID NO: 864475 - protein, 24 aa, Mycobacterium
TAKQVYWARGVLELAGRERGVFQF

SEQ ID NO: 864476 - protein, 24 aa, Mycobacterium
TAKRPLFTDFAPRLLVSHPAEVKV

SEQ ID NO: 864477 - protein, 24 aa, Mycobacterium
TAKRPLFTDFAPRLLVTHPAEVKV

SEQ ID NO: 864478 - protein, 25 aa, Mycobacterium
TAKRPLFTDFAPRLLVTHPAEVKVA

SEQ ID NO: 864479 - protein, 18 aa, Mycobacterium
TAKTLASLGFHVICAARR

SEQ ID NO: 864480 - protein, 20 aa, Mycobacterium
TAKVGYPVRWRDYSKLVIDR

SEQ ID NO: 864481 - protein, 21 aa, Mycobacterium
TAKVWGLYIAASRVGFEQNAI

SEQ ID NO: 864482 - protein, 20 aa, Mycobacterium
TAKVWGLYMAASRVAFEQNN

SEQ ID NO: 864483 - protein, 21 aa, Mycobacterium
TAKVWGLYMAASRVAFEQNNL

SEQ ID NO: 864484 - protein, 22 aa, Mycobacterium
TALAALARERAFSDAKTRAEQY

SEQ ID NO: 864485 - protein, 20 aa, Mycobacterium
TALAALIETGGIRPGRTERE

SEQ ID NO: 864486 - protein, 25 aa, Mycobacterium
TALAARVLLVWDAPNLDMGLGSILG

SEQ ID NO: 864487 - protein, 23 aa, Mycobacterium
TALAFLLEERRTWLLGGHATPIE

SEQ ID NO: 864488 - protein, 24 aa, Mycobacterium
TALALQHAILGPADLPSGFAVRYQ

SEQ ID NO: 864489 - protein, 18 aa, Mycobacterium
TALALRPGGSIPTADLTV

SEQ ID NO: 864490 - protein, 22 aa, Mycobacterium
TALARHGIVLSLQFETDDDRNV

SEQ ID NO: 864491 - protein, 17 aa, Mycobacterium
TALATLVSLGASFELWD

SEQ ID NO: 864492 - protein, 23 aa, Mycobacterium
TALATPMRLVIFGGLPPVVRERF

SEQ ID NO: 864493 - protein, 22 aa, Mycobacterium
TALDARFYYSGKAPYTPAFFDE

SEQ ID NO: 864494 - protein, 18 aa, Mycobacterium
TALDELPEPSLPGQWPFV

SEQ ID NO: 864495 - protein, 18 aa, Mycobacterium
TALDPFLRAVIETGYERP

SEQ ID NO: 864496 - protein, 17 aa, Mycobacterium
TALDRMALRAEARAHFG

SEQ ID NO: 864497 - protein, 18 aa, Mycobacterium
TALEFLRDLGKHFSVNVM

SEQ ID NO: 864498 - protein, 19 aa, Mycobacterium
TALELFFGTAQDPAHPRRV

SEQ ID NO: 864499 - protein, 23 aa, Mycobacterium
TALELMPVHQFLHDSRLLDLGLR

SEQ ID NO: 864500 - protein, 23 aa, Mycobacterium
TALFRLLELVDDGVAPPAAVLGG

SEQ ID NO: 864501 - protein, 22 aa, Mycobacterium
TALFRLLELVDEGVSPPAGVLG

SEQ ID NO: 864502 - protein, 22 aa, Mycobacterium
TALGCMPYMAQFFVTAPETGGA

SEQ ID NO: 864503 - protein, 18 aa, Mycobacterium
TALGRQLAAVPYLESVVA

SEQ ID NO: 864504 - protein, 23 aa, Mycobacterium
TALGTGFFLTWLTTYTDQNGEVL

SEQ ID NO: 864505 - protein, 17 aa, Mycobacterium
TALHFVGAGMRILEIVA

SEQ ID NO: 864506 - protein, 29 aa, Mycobacterium
TALHRHFGWLTRWYAFSSADLGSSPLVER

SEQ ID NO: 864507 - protein, 26 aa, Mycobacterium
TALINTAPLQRFWRDAHAGRVHAANE

SEQ ID NO: 864508 - protein, 19 aa, Mycobacterium
TALIYHAAFAPRVAEILPD

SEQ ID NO: 864509 - protein, 22 aa, Mycobacterium
TALIYHATFAPRVAEVLPELPR

SEQ ID NO: 864510 - protein, 23 aa, Mycobacterium
TALKIDVPPIIKQRLKAASLTGD

SEQ ID NO: 864511 - protein, 31 aa, Mycobacterium
TALLAPMIGHYFTFMTPAAFVRRPERWIREL

SEQ ID NO: 864512 - protein, 27 aa, Mycobacterium
TALLCPFDPLIFFRPRVERLFDFHYRI

SEQ ID NO: 864513 - protein, 32 aa, Mycobacterium
TALLCPFDPLIFFRPRVERLFGFHYRIEIYTP

SEQ ID NO: 864514 - protein, 32 aa, Mycobacterium
TALLCPFDPLIFFRPRVKRLFGFHYRIEIYTP

SEQ ID NO: 864515 - protein, 22 aa, Mycobacterium
TALLDERLADFVPLAAPDDVFA

SEQ ID NO: 864516 - protein, 17 aa, Mycobacterium
TALLDGLMGPESLEALR

SEQ ID NO: 864517 - protein, 21 aa, Mycobacterium
TALLDKIEIPVPEKILEEQIG

SEQ ID NO: 864518 - protein, 20 aa, Mycobacterium
TALLLGQIRDVPDARRGAAF

SEQ ID NO: 864519 - protein, 17 aa, Mycobacterium
TALLQRYPDAETVVLHP

SEQ ID NO: 864520 - protein, 20 aa, Mycobacterium
TALLTLYQQTGQWLPEARHL

SEQ ID NO: 864521 - protein, 19 aa, Mycobacterium
TALLVALRALLDMPGTVDP

SEQ ID NO: 864522 - protein, 19 aa, Mycobacterium
TALMLCTRDVLIRIGDEFA

SEQ ID NO: 864523 - protein, 18 aa, Mycobacterium
TALNRIIDILTEHTDFAK

SEQ ID NO: 864524 - protein, 17 aa, Mycobacterium
TALPFGAASTFALLLAL

SEQ ID NO: 864525 - protein, 29 aa, Mycobacterium
TALPGPVRRRVIRRWLLAGGATGLTDKQI

SEQ ID NO: 864526 - protein, 19 aa, Mycobacterium
TALPLPYFGRFLETNIRLY

SEQ ID NO: 864527 - protein, 17 aa, Mycobacterium
TALPLRRAVIMLMCGKA

SEQ ID NO: 864528 - protein, 18 aa, Mycobacterium
TALPPTLLHAVDALEADP

SEQ ID NO: 864529 - protein, 22 aa, Mycobacterium
TALPQPMWPGDDAAPAGLREPG

SEQ ID NO: 864530 - protein, 23 aa, Mycobacterium
TALQGNLDPVLLLAGWPVVERAA

SEQ ID NO: 864531 - protein, 24 aa, Mycobacterium
TALQIVDGFLRTRSINRALIVASD

SEQ ID NO: 864532 - protein, 23 aa, Mycobacterium
TALQTLFERFPRLSLAGEPEYLN

SEQ ID NO: 864533 - protein, 25 aa, Mycobacterium
TALRDLVARRTPLFEFAIRTALAES

SEQ ID NO: 864534 - protein, 20 aa, Mycobacterium
TALRLLERKIAQQPPKKHGN

SEQ ID NO: 864535 - protein, 19 aa, Mycobacterium
TALRLVRADPTLSAWFRPG

SEQ ID NO: 864536 - protein, 21 aa, Mycobacterium
TALRMQVWAGHTIVEALQAVE

SEQ ID NO: 864537 - protein, 17 aa, Mycobacterium
TALRRHFNWVRSWYDFA

SEQ ID NO: 864538 - protein, 25 aa, Mycobacterium
TALRRRFQFIELLPDSDLLEGHTVG

SEQ ID NO: 864539 - protein, 21 aa, Mycobacterium
TALRTLVRHRLGIDHPGYADG

SEQ ID NO: 864540 - protein, 23 aa, Mycobacterium
TALRVRCIRQLQNAMRAHVEELR

SEQ ID NO: 864541 - protein, 20 aa, Mycobacterium
TALRVRCVRQLRDAMREHVE

SEQ ID NO: 864542 - protein, 21 aa, Mycobacterium
TALRYYEKLGLLPAPERIGGR

SEQ ID NO: 864543 - protein, 17 aa, Mycobacterium
TALSYLPTYPYTQEFID

SEQ ID NO: 864544 - protein, 21 aa, Mycobacterium
TALTEGITWGWESYPEYLDAI

SEQ ID NO: 864545 - protein, 23 aa, Mycobacterium
TALTEGITWGWETYPEYLDAIDK

SEQ ID NO: 864546 - protein, 23 aa, Mycobacterium
TALTEGITWGWETYPEYLDTIGR

SEQ ID NO: 864547 - protein, 19 aa, Mycobacterium
TALTLLHLGTHPQLRRQLI

SEQ ID NO: 864548 - protein, 18 aa, Mycobacterium
TALTRRGPHKVLRGDLAF

SEQ ID NO: 864549 - protein, 27 aa, Mycobacterium
TALTSACRYAFFLTATPVQNDLLELYR

SEQ ID NO: 864550 - protein, 24 aa, Mycobacterium
TALTYDKRWDKALGRLTDADAEAL

SEQ ID NO: 864551 - protein, 25 aa, Mycobacterium
TALVAGLLRGLLDRGVKPVTSARAV

SEQ ID NO: 864552 - protein, 35 aa, Mycobacterium
TALVANLPYNVAVPALLHLLAEFPSIRTVMVMVQA

SEQ ID NO: 864553 - protein, 23 aa, Mycobacterium
TALVEFPPAGTLTGIAKRELRGT

SEQ ID NO: 864554 - protein, 24 aa, Mycobacterium
TALVLARRGWRVVVAADRFGVDTV

SEQ ID NO: 864555 - protein, 19 aa, Mycobacterium
TALVPALAKLWAQACEWEP

SEQ ID NO: 864556 - protein, 22 aa, Mycobacterium
TALVRTLRTFLANDGHWAKTAT

SEQ ID NO: 864557 - protein, 19 aa, Mycobacterium
TALVRYQVPQSPSLRIVDV

SEQ ID NO: 864558 - protein, 27 aa, Mycobacterium
TALVSLRRFVEAYPIAGTPRILADIDP

SEQ ID NO: 864559 - protein, 17 aa, Mycobacterium
TALVYSVGWTQHTLGAQ

SEQ ID NO: 864560 - protein, 18 aa, Mycobacterium
TALYLAAQSIRGGLADCV

SEQ ID NO: 864561 - protein, 27 aa, Mycobacterium
TAMAAGAAPYTSWLTLAAAHAQRAAEQ

SEQ ID NO: 864562 - protein, 20 aa, Mycobacterium
TAMAALSQAWRSSGGIVLGL

SEQ ID NO: 864563 - protein, 17 aa, Mycobacterium
TAMAGAAAPYLAWVTDA

SEQ ID NO: 864564 - protein, 28 aa, Mycobacterium
TAMASAAAPYLKWLTTAAAQAGQAATQV

SEQ ID NO: 864565 - protein, 19 aa, Mycobacterium
TAMDLVIKESLRLVAPVPL

SEQ ID NO: 864566 - protein, 20 aa, Mycobacterium
TAMDPQQRLLLETSWEAVEH

SEQ ID NO: 864567 - protein, 28 aa, Mycobacterium
TAMDPVVKIARWAALSAGSDVLATPARL

SEQ ID NO: 864568 - protein, 19 aa, Mycobacterium
TAMFGTRPVILWHRSFHEL

SEQ ID NO: 864569 - protein, 31 aa, Mycobacterium
TAMHPRVRWSASVKLPFALKTLGKTTEWFNP

SEQ ID NO: 864570 - protein, 20 aa, Mycobacterium
TAMLADWLARIRTGVSELTA

SEQ ID NO: 864571 - protein, 20 aa, Mycobacterium
TAMLAKVRRAPALIKVESVV

SEQ ID NO: 864572 - protein, 23 aa, Mycobacterium
TAMLSPILETGGARLTFRATVQV

SEQ ID NO: 864573 - protein, 20 aa, Mycobacterium
TAMLVIPDGERLLIAAIAES

SEQ ID NO: 864574 - protein, 23 aa, Mycobacterium
TAMPLMDYLDPIPEDIAWCGLSD

SEQ ID NO: 864575 - protein, 28 aa, Mycobacterium
TAMSHLLRELELLEPLRARLADGMPAYG

SEQ ID NO: 864576 - protein, 27 aa, Mycobacterium
TAMSLAPLAYTLFQRAMRHDPSDTTWL

SEQ ID NO: 864577 - protein, 26 aa, Mycobacterium
TAMSLAPLAYTLFQRTMVHDPSDTTW

SEQ ID NO: 864578 - protein, 17 aa, Mycobacterium
TAMSWLALGRDLEGLPE

SEQ ID NO: 864579 - protein, 27 aa, Mycobacterium
TAMTTADLFIRYLRPIRQGSALAVPRV

SEQ ID NO: 864580 - protein, 19 aa, Mycobacterium
TAMVPRPLIVANRSRRQSL

SEQ ID NO: 864581 - protein, 24 aa, Mycobacterium
TAMVRPVVVAANRNEFVQLVMSNL

SEQ ID NO: 864582 - protein, 25 aa, Mycobacterium
TAMWDAEDRRQFAWARIDHLDDDPG

SEQ ID NO: 864583 - protein, 24 aa, Mycobacterium
TANAAAVLPTTVLQAAGADEVSAA

SEQ ID NO: 864584 - protein, 20 aa, Mycobacterium
TANAKWFYENTKRGDVVIVS

SEQ ID NO: 864585 - protein, 29 aa, Mycobacterium
TANEALYDWNYQHQLLSIRLAEARGADIS

SEQ ID NO: 864586 - protein, 20 aa, Mycobacterium
TANFLLVGAAYQLGALPVTA

SEQ ID NO: 864587 - protein, 31 aa, Mycobacterium
TANGLDVNVGRLTITLASHGGFKLDSCTSNT

SEQ ID NO: 864588 - protein, 24 aa, Mycobacterium
TANHPFLTLDGWVPLGELKPGDRL

SEQ ID NO: 864589 - protein, 34 aa, Mycobacterium
TANHPLLCLVDVGGVPTLLWKLIEEIHPDDYVAL

SEQ ID NO: 864590 - protein, 35 aa, Mycobacterium
TANHPLLCLVDVGGVPTLLWRLIEEIRPDDCVVMQ

SEQ ID NO: 864591 - protein, 17 aa, Mycobacterium
TANLETMFFMSQAVAAE

SEQ ID NO: 864592 - protein, 17 aa, Mycobacterium
TANLMMVMLFAAGGEST

SEQ ID NO: 864593 - protein, 20 aa, Mycobacterium
TANPPWAGTPALPPSTSPAS

SEQ ID NO: 864594 - protein, 23 aa, Mycobacterium
TANRTRLRQLLATNRFGTNTAAI

SEQ ID NO: 864595 - protein, 24 aa, Mycobacterium
TANVSDLLCRLICGCIQMGSYPDF

SEQ ID NO: 864596 - protein, 20 aa, Mycobacterium
TAPADLVLAVNSLAVRHVTE

SEQ ID NO: 864597 - protein, 29 aa, Mycobacterium
TAPADWEPFLRVNLYGVLHCTRAVLPAMI

SEQ ID NO: 864598 - protein, 22 aa, Mycobacterium
TAPALLLAALGPTMLRIAGERA

SEQ ID NO: 864599 - protein, 20 aa, Mycobacterium
TAPAYKLVPGAAIPSMFDPS

SEQ ID NO: 864600 - protein, 24 aa, Mycobacterium
TAPAYRRRGVQSALLRARLADAAA

SEQ ID NO: 864601 - protein, 24 aa, Mycobacterium
TAPDAPPLVIDFGGGVLGSLQRFA

SEQ ID NO: 864602 - protein, 19 aa, Mycobacterium
TAPEISARVLMKLKRDAEA

SEQ ID NO: 864603 - protein, 20 aa, Mycobacterium
TAPEISARVLMKLKRDAEAY

SEQ ID NO: 864604 - protein, 22 aa, Mycobacterium
TAPFQEVFLRNQFYLRGNRAGA

SEQ ID NO: 864605 - protein, 26 aa, Mycobacterium
TAPGRWWALIRVACAGELLYSPAVPV

SEQ ID NO: 864606 - protein, 17 aa, Mycobacterium
TAPIHWANATHACTCEV

SEQ ID NO: 864607 - protein, 20 aa, Mycobacterium
TAPIWWQEQPDGVGGFNDGG

SEQ ID NO: 864608 - protein, 26 aa, Mycobacterium
TAPKLKGGFPGMAGLPGGMPAGFPDL

SEQ ID NO: 864609 - protein, 26 aa, Mycobacterium
TAPKPLHDFYIAYRAVVRAKVDCVRL

SEQ ID NO: 864610 - protein, 25 aa, Mycobacterium
TAPLESAIRLALLDALSAAAEEITR

SEQ ID NO: 864611 - protein, 21 aa, Mycobacterium
TAPLLVVHGTGDRLIPIEGSR

SEQ ID NO: 864612 - protein, 17 aa, Mycobacterium
TAPLRGPGLAKLQHLAD

SEQ ID NO: 864613 - protein, 19 aa, Mycobacterium
TAPLVLPDLRTVEHYDRHL

SEQ ID NO: 864614 - protein, 26 aa, Mycobacterium
TAPMVVAQWINCQYYFSTVAPDMFGA

SEQ ID NO: 864615 - protein, 21 aa, Mycobacterium
TAPNPVEYYLASLLSCQVVTY

SEQ ID NO: 864616 - protein, 33 aa, Mycobacterium
TAPQMLQFLERLSGWFEFVWKPGYADYYPELPG

SEQ ID NO: 864617 - protein, 25 aa, Mycobacterium
TAPQSLMDFYVAYRAVVRAKVECIR

SEQ ID NO: 864618 - protein, 23 aa, Mycobacterium
TAPRLFCDMLPRDAVPPKLLRDL

SEQ ID NO: 864619 - protein, 25 aa, Mycobacterium
TAPRLLLEVICARLLLPSASDAESA

SEQ ID NO: 864620 - protein, 24 aa, Mycobacterium
TAPRLLLEVVCARLLLPSASDAES

SEQ ID NO: 864621 - protein, 24 aa, Mycobacterium
TAPRLLLEVVCARLLLPSASDTEA

SEQ ID NO: 864622 - protein, 32 aa, Mycobacterium
TAPRLPDGTPFPTLYYLTHPALTAAASRLESG

SEQ ID NO: 864623 - protein, 30 aa, Mycobacterium
TAPSLHAGHLIPLLTLRRFQQAGHRPIVLA

SEQ ID NO: 864624 - protein, 29 aa, Mycobacterium
TAPTAWIAEGLLPYLPPQAQDRLLDNITA

SEQ ID NO: 864625 - protein, 29 aa, Mycobacterium
TAPTAWLAEGLLIYLPPEAQDRLFDNITA

SEQ ID NO: 864626 - protein, 17 aa, Mycobacterium
TAPTQKFMAIWRASKPV

SEQ ID NO: 864627 - protein, 17 aa, Mycobacterium
TAPVHLLAGTGISGRVG

SEQ ID NO: 864628 - protein, 27 aa, Mycobacterium
TAPVQRTWPELIPLLQSGRLDVDGIFT

SEQ ID NO: 864629 - protein, 22 aa, Mycobacterium
TAPVYKMPWGTMHPTTISAPIV

SEQ ID NO: 864630 - protein, 34 aa, Mycobacterium
TAPYAPNPLHPLTLPLLRPQQVIMLGRPTLHRPV

SEQ ID NO: 864631 - protein, 25 aa, Mycobacterium
TAQALVLPQFVSPPAIAAPGGVAAQ

SEQ ID NO: 864632 - protein, 22 aa, Mycobacterium
TAQDPRFRFFGNIKVGEHVEAA

SEQ ID NO: 864633 - protein, 19 aa, Mycobacterium
TAQEISARVLMKLKRDAEA

SEQ ID NO: 864634 - protein, 20 aa, Mycobacterium
TAQEISARVLMKLKRDAEAY

SEQ ID NO: 864635 - protein, 30 aa, Mycobacterium
TAQFDMVDVLPLTPLQHGLLFHTGLSQDSE

SEQ ID NO: 864636 - protein, 21 aa, Mycobacterium
TAQFILRRWLSTDTKTSPPLH

SEQ ID NO: 864637 - protein, 23 aa, Mycobacterium
TAQGRAVFTPGLAGLVLGEFRRI

SEQ ID NO: 864638 - protein, 37 aa, Mycobacterium
TAQLAYLRALRRVDPCGLLLMLKDIGAPTYISGDVGG

SEQ ID NO: 864639 - protein, 23 aa, Mycobacterium
TAQLQQMLIFRPAAGMGRAETPV

SEQ ID NO: 864640 - protein, 18 aa, Mycobacterium
TAQLVILLVDARKGVIEQ

SEQ ID NO: 864641 - protein, 18 aa, Mycobacterium
TAQMWSRTQLRPADLDVA

SEQ ID NO: 864642 - protein, 25 aa, Mycobacterium
TAQPWLADHAVAGVALFPGAGFAEL

SEQ ID NO: 864643 - protein, 24 aa, Mycobacterium
TAQQPLIVAGLAPLLAGALLQCYP

SEQ ID NO: 864644 - protein, 25 aa, Mycobacterium
TAQRDRWHFLPFAGGARSCIGEHFA

SEQ ID NO: 864645 - protein, 33 aa, Mycobacterium
TAQRIKDLVIPPAWKNVWISPSPNGHIQAVGTD

SEQ ID NO: 864646 - protein, 23 aa, Mycobacterium
TAQRILAHFGLDGHFEVIAGASN

SEQ ID NO: 864647 - protein, 25 aa, Mycobacterium
TAQRLRHRLPSRPDPHALLGNAFHS

SEQ ID NO: 864648 - protein, 25 aa, Mycobacterium
TAQRPLFTDFAPRLLVTHPAEVKIA

SEQ ID NO: 864649 - protein, 23 aa, Mycobacterium
TAQRRDYMWICRDGDRAKNHLLE

SEQ ID NO: 864650 - protein, 34 aa, Mycobacterium
TAQRRPSVAYALTKLAIVLFTRELHRRYHAKGLS

SEQ ID NO: 864651 - protein, 27 aa, Mycobacterium
TAQSMAYFALGYLLRRSEPERALALFD

SEQ ID NO: 864652 - protein, 19 aa, Mycobacterium
TAQVLAWTQTLRAAALPGV

SEQ ID NO: 864653 - protein, 20 aa, Mycobacterium
TAQVLSRIKIFARVDAVVTQ

SEQ ID NO: 864654 - protein, 19 aa, Mycobacterium
TAQWMMLTGRPMDAANALR

SEQ ID NO: 864655 - protein, 17 aa, Mycobacterium
TAQYDIWAKQFIAAHGD

SEQ ID NO: 864656 - protein, 25 aa, Mycobacterium
TARAALTMFLGRPDQPGRVRAVAAG

SEQ ID NO: 864657 - protein, 23 aa, Mycobacterium
TARAAWAWFRHLHGLADRTLAPS

SEQ ID NO: 864658 - protein, 23 aa, Mycobacterium
TARAAWAWFRHLHSLADRTLAPS

SEQ ID NO: 864659 - protein, 18 aa, Mycobacterium
TARAELFARFGRPLPQDA

SEQ ID NO: 864660 - protein, 21 aa, Mycobacterium
TARAEWWYSRAATVMGGTAEV

SEQ ID NO: 864661 - protein, 30 aa, Mycobacterium
TARAFQVTSIPTLILFQNGEATKRIVGAKS

SEQ ID NO: 864662 - protein, 23 aa, Mycobacterium
TARAIPEMFRKAFKVAETERPAA

SEQ ID NO: 864663 - protein, 17 aa, Mycobacterium
TARAKAFLSAHELQWHG

SEQ ID NO: 864664 - protein, 23 aa, Mycobacterium
TARALARILSSITLGGAVGGVRL

SEQ ID NO: 864665 - protein, 18 aa, Mycobacterium
TARALLRSRLLTPAGPAA

SEQ ID NO: 864666 - protein, 27 aa, Mycobacterium
TARAVVLTLFGELLETAPKLGAGLDWK

SEQ ID NO: 864667 - protein, 20 aa, Mycobacterium
TARAWLFGTNTRLDDRAPIE

SEQ ID NO: 864668 - protein, 21 aa, Mycobacterium
TARDVWWVDVLLTQLEAKLGL

SEQ ID NO: 864669 - protein, 18 aa, Mycobacterium
TARDYGITQPQPARWHLS

SEQ ID NO: 864670 - protein, 18 aa, Mycobacterium
TAREFVADFLAYFRDEIA

SEQ ID NO: 864671 - protein, 31 aa, Mycobacterium
TAREPGPGLGTWWGSWRRFLPAGQDQPERRV

SEQ ID NO: 864672 - protein, 29 aa, Mycobacterium
TARERVLGPSYRLFYERPVHLVRGQGSHL

SEQ ID NO: 864673 - protein, 20 aa, Mycobacterium
TARFAPRRLVGPRTLPVIRA

SEQ ID NO: 864674 - protein, 19 aa, Mycobacterium
TARFVIMATGPLSAALTPA

SEQ ID NO: 864675 - protein, 21 aa, Mycobacterium
TARGKLLHRLGEIIAREADQL

SEQ ID NO: 864676 - protein, 23 aa, Mycobacterium
TARGMLFYRLLQQSVNTDPHPLS

SEQ ID NO: 864677 - protein, 36 aa, Mycobacterium
TARHPAVVPLLLAHRHRLPASLRWGEAVLGVLAEAG

SEQ ID NO: 864678 - protein, 22 aa, Mycobacterium
TARICGICPVAYQVSACNAIEQ

SEQ ID NO: 864679 - protein, 22 aa, Mycobacterium
TARICGICPVAYQVSACNALEG

SEQ ID NO: 864680 - protein, 17 aa, Mycobacterium
TARISLAAQRFAAAVWT

SEQ ID NO: 864681 - protein, 17 aa, Mycobacterium
TARKIVEIPRPAGVVLA

SEQ ID NO: 864682 - protein, 18 aa, Mycobacterium
TARLAFDWAQLKPGDRVL

SEQ ID NO: 864683 - protein, 17 aa, Mycobacterium
TARLPFAVTVVHAQPSP

SEQ ID NO: 864684 - protein, 19 aa, Mycobacterium
TARLRAIVGDRGRPPFTKE

SEQ ID NO: 864685 - protein, 19 aa, Mycobacterium
TARNYLYPHWESFFGGIAP

SEQ ID NO: 864686 - protein, 28 aa, Mycobacterium
TARPVIPVFINAIGLPLGPLHRCRALGT

SEQ ID NO: 864687 - protein, 18 aa, Mycobacterium
TARRAGTRVAALGRVHLR

SEQ ID NO: 864688 - protein, 23 aa, Mycobacterium
TARRILEHFELDGYFEVIAGASP

SEQ ID NO: 864689 - protein, 25 aa, Mycobacterium
TARRSLLEMLLRGVPSEDLDLGDIA

SEQ ID NO: 864690 - protein, 26 aa, Mycobacterium
TARRWRDIWLHEGFACYAEWLWSEES

SEQ ID NO: 864691 - protein, 29 aa, Mycobacterium
TARRWRDIWLHEGFACYAEWLWSENSGGR

SEQ ID NO: 864692 - protein, 17 aa, Mycobacterium
TARSFARRIARNTQLLL

SEQ ID NO: 864693 - protein, 17 aa, Mycobacterium
TARSPLVGPQFVDLVDA

SEQ ID NO: 864694 - protein, 17 aa, Mycobacterium
TARTILGLAGPTARVGA

SEQ ID NO: 864695 - protein, 17 aa, Mycobacterium
TARTRTVLLKGWEQFDE

SEQ ID NO: 864696 - protein, 32 aa, Mycobacterium
TARVFNLDPPLGIPGTLWQKSLVPVVRAVMRL

SEQ ID NO: 864697 - protein, 20 aa, Mycobacterium
TARVPLRFLMGMRSYVNSAL

SEQ ID NO: 864698 - protein, 18 aa, Mycobacterium
TARVVLRFDLRKGAAAAQ

SEQ ID NO: 864699 - protein, 23 aa, Mycobacterium
TARVWVPATAPLTEVWVPGADLR

SEQ ID NO: 864700 - protein, 21 aa, Mycobacterium
TARWWPVKDFAGTAAKLIASV

SEQ ID NO: 864701 - protein, 22 aa, Mycobacterium
TARYLGGRPPYGYRLVDAGPHP

SEQ ID NO: 864702 - protein, 24 aa, Mycobacterium
TASAAVAIQQPAVPAGAAEAATGA

SEQ ID NO: 864703 - protein, 30 aa, Mycobacterium
TASAIQRPWDTLTLFQAVRCRSVTGACPGP

SEQ ID NO: 864704 - protein, 22 aa, Mycobacterium
TASALTWMVERACQQNLPAQPP

SEQ ID NO: 864705 - protein, 30 aa, Mycobacterium
TASDRQRHRLALWSRRLLGEAITQAQFVMA

SEQ ID NO: 864706 - protein, 22 aa, Mycobacterium
TASEALYDWNYQRQLLSIRLAE

SEQ ID NO: 864707 - protein, 19 aa, Mycobacterium
TASEFWKRANSWFFEQGVI

SEQ ID NO: 864708 - protein, 28 aa, Mycobacterium
TASGFMVPPQWFAMWARRHQHEYGSTSE

SEQ ID NO: 864709 - protein, 26 aa, Mycobacterium
TASGPLSFLRLFDYAAAVISMGGRRR

SEQ ID NO: 864710 - protein, 24 aa, Mycobacterium
TASKAGVAGLTRALARELGPTVRV

SEQ ID NO: 864711 - protein, 18 aa, Mycobacterium
TASKPLKYRLAYTADLEA

SEQ ID NO: 864712 - protein, 24 aa, Mycobacterium
TASLDILLRRNPRGGPLPPVDAGG

SEQ ID NO: 864713 - protein, 30 aa, Mycobacterium
TASLGPVDWTIFDIPAVTGLFNSTSSPSSG

SEQ ID NO: 864714 - protein, 26 aa, Mycobacterium
TASLNPARFFLGMAAAGFSFDRFTNG

SEQ ID NO: 864715 - protein, 30 aa, Mycobacterium
TASLSPLVELLIAAAPSTRWLRDATRGGVG

SEQ ID NO: 864716 - protein, 23 aa, Mycobacterium
TASPAELLAGVRALAGAVRRGTV

SEQ ID NO: 864717 - protein, 18 aa, Mycobacterium
TASPLDGYPRPGKTVLFL

SEQ ID NO: 864718 - protein, 25 aa, Mycobacterium
TASQQYIAIAVFFDGADLPQLAKHF

SEQ ID NO: 864719 - protein, 23 aa, Mycobacterium
TASQWRRRLCEHAQFAAVIDGRV

SEQ ID NO: 864720 - protein, 28 aa, Mycobacterium
TASQWSALPGQPRLFTEWLAGVVEALDQ

SEQ ID NO: 864721 - protein, 21 aa, Mycobacterium
TASRFVACPFGAPGTRMYRTG

SEQ ID NO: 864722 - protein, 24 aa, Mycobacterium
TASRFVACPFGGPGDRMYRTGDLV

SEQ ID NO: 864723 - protein, 23 aa, Mycobacterium
TASRFVACPFGKPGTRMYRTGDL

SEQ ID NO: 864724 - protein, 20 aa, Mycobacterium
TASRRRVEAALAGQLATGEL

SEQ ID NO: 864725 - protein, 22 aa, Mycobacterium
TASRWQKAMKALIPLNRDALAA

SEQ ID NO: 864726 - protein, 23 aa, Mycobacterium
TASSGWWPSLVGRAAQFVDLTGR

SEQ ID NO: 864727 - protein, 25 aa, Mycobacterium
TASTQWWEIGLFTTVDEIPEGVRAQ

SEQ ID NO: 864728 - protein, 24 aa, Mycobacterium
TASTWEFLPLDNAVFPAVDLARFA

SEQ ID NO: 864729 - protein, 25 aa, Mycobacterium
TASVHRRAWKAMFDEYLSDIADGAE

SEQ ID NO: 864730 - protein, 32 aa, Mycobacterium
TASVLARTLEWGLGAYVGVPLLGPDGSAVGMV

SEQ ID NO: 864731 - protein, 31 aa, Mycobacterium
TASVSPLVELLMAAAPATRWLRDATRGGVGT

SEQ ID NO: 864732 - protein, 30 aa, Mycobacterium
TASYPADRLLFLPADLSTLGFTAWGTPTTV

SEQ ID NO: 864733 - protein, 24 aa, Mycobacterium
TATAFEAFLIKLGLRMAIACPADG

SEQ ID NO: 864734 - protein, 25 aa, Mycobacterium
TATAGDLFMLIFTSGTSGEPKAVKC

SEQ ID NO: 864735 - protein, 19 aa, Mycobacterium
TATALIDAIVGLWLAPVTA

SEQ ID NO: 864736 - protein, 19 aa, Mycobacterium
TATALLLRALQIGLEKDDV

SEQ ID NO: 864737 - protein, 24 aa, Mycobacterium
TATANLPPGGLLLLYTDGLIERAG

SEQ ID NO: 864738 - protein, 24 aa, Mycobacterium
TATAPIPPAYSPSAPVRSLRRPDA

SEQ ID NO: 864739 - protein, 30 aa, Mycobacterium
TATARPVIPIFINAIATPLGPLRRCRALGT

SEQ ID NO: 864740 - protein, 26 aa, Mycobacterium
TATDAFLPMLKPLTEGLMSIGQAFVQ

SEQ ID NO: 864741 - protein, 26 aa, Mycobacterium
TATDWLVLCDFDETFFAHDPAVRSRR

SEQ ID NO: 864742 - protein, 25 aa, Mycobacterium
TATEFKLLAFLVQHAGRAFTRTRLM

SEQ ID NO: 864743 - protein, 25 aa, Mycobacterium
TATELARIDAALNTANAAAVLPTTV

SEQ ID NO: 864744 - protein, 23 aa, Mycobacterium
TATEMWALRYPASNRLYVLDRRY

SEQ ID NO: 864745 - protein, 24 aa, Mycobacterium
TATERWICSIFAQLFGRQRVGAED

SEQ ID NO: 864746 - protein, 19 aa, Mycobacterium
TATFGAPLAPGLTLVPDAL

SEQ ID NO: 864747 - protein, 25 aa, Mycobacterium
TATGAPLPLVALPQGELLTVNANDI

SEQ ID NO: 864748 - protein, 20 aa, Mycobacterium
TATGARLAWVPRRAGDRGAV

SEQ ID NO: 864749 - protein, 22 aa, Mycobacterium
TATGIDIFRIFDALNNVDSMRP

SEQ ID NO: 864750 - protein, 22 aa, Mycobacterium
TATGIDIFRIFDALNNVESMRP

SEQ ID NO: 864751 - protein, 17 aa, Mycobacterium
TATGLVCALLLTTRGAA

SEQ ID NO: 864752 - protein, 28 aa, Mycobacterium
TATGSLFTWSFFIEPSLGFTRHLKPVIR

SEQ ID NO: 864753 - protein, 21 aa, Mycobacterium
TATGVFDLLLGDAGPAVVGDE

SEQ ID NO: 864754 - protein, 37 aa, Mycobacterium
TATHGQLMTLYPSLSSDQAWAMLGVTPMIGVNDDTSE

SEQ ID NO: 864755 - protein, 20 aa, Mycobacterium
TATIALQRQLVDRDLPRLID

SEQ ID NO: 864756 - protein, 19 aa, Mycobacterium
TATKMFCGCANRFGAEPNT

SEQ ID NO: 864757 - protein, 23 aa, Mycobacterium
TATLAHVLHRPAVLPVPSLGPTL

SEQ ID NO: 864758 - protein, 18 aa, Mycobacterium
TATLIRSGSGGPSYLALS

SEQ ID NO: 864759 - protein, 25 aa, Mycobacterium
TATLRLGHNYIGTEHILLGIVSANS

SEQ ID NO: 864760 - protein, 21 aa, Mycobacterium
TATLSLLASEPMMVSVSLTAE

SEQ ID NO: 864761 - protein, 20 aa, Mycobacterium
TATLTFLTGCRQFCTPLGSG

SEQ ID NO: 864762 - protein, 25 aa, Mycobacterium
TATMDRLFRAVAADVGLAAAVRTTS

SEQ ID NO: 864763 - protein, 21 aa, Mycobacterium
TATMLIPLPMVGWKSSGVGGR

SEQ ID NO: 864764 - protein, 30 aa, Mycobacterium
TATNHLGPFLLTNLLLEPIVAAERARIVIT

SEQ ID NO: 864765 - protein, 25 aa, Mycobacterium
TATPELCAYPMRTARRPHPINPIGI

SEQ ID NO: 864766 - protein, 23 aa, Mycobacterium
TATPEWLAAINRPVVLLNTSSIR

SEQ ID NO: 864767 - protein, 24 aa, Mycobacterium
TATPGSLDPFSALAPPDMGGSAHT

SEQ ID NO: 864768 - protein, 38 aa, Mycobacterium
TATPTKWDMSFLTTLFAYEWDVALSPAGMWQWVPRNGA

SEQ ID NO: 864769 - protein, 23 aa, Mycobacterium
TATQLLNTLFGPSGAETYLTLFG

SEQ ID NO: 864770 - protein, 19 aa, Mycobacterium
TATQLVFKVPAADAFVADP

SEQ ID NO: 864771 - protein, 22 aa, Mycobacterium
TATRLTPFVPPPATTNLPGPLW

SEQ ID NO: 864772 - protein, 26 aa, Mycobacterium
TATRYHSLTILPESLPPVLEVTAHTD

SEQ ID NO: 864773 - protein, 25 aa, Mycobacterium
TATRYHSLTILPESLPPVLEVTART

SEQ ID NO: 864774 - protein, 24 aa, Mycobacterium
TATRYHSLTILPETLPAALEVVGQ

SEQ ID NO: 864775 - protein, 23 aa, Mycobacterium
TATTALVLAARYPERVQSLVVVD

SEQ ID NO: 864776 - protein, 24 aa, Mycobacterium
TATTLAWVFDLLLHHPDALRRVQE

SEQ ID NO: 864777 - protein, 17 aa, Mycobacterium
TATVLAQALVKAGLRNV

SEQ ID NO: 864778 - protein, 19 aa, Mycobacterium
TATVPDLIRLRLDAAHAAV

SEQ ID NO: 864779 - protein, 24 aa, Mycobacterium
TATVQEIHLMLLHGLCMALDEVVL

SEQ ID NO: 864780 - protein, 25 aa, Mycobacterium
TATVRGLVWLIQLYRHMVSPLRPAT

SEQ ID NO: 864781 - protein, 22 aa, Mycobacterium
TATVRICTCPLAEVAVDAPEVV

SEQ ID NO: 864782 - protein, 20 aa, Mycobacterium
TATYLVRMLRDIPGLSVTRI

SEQ ID NO: 864783 - protein, 18 aa, Mycobacterium
TAVAAHRALASKGPNPLI

SEQ ID NO: 864784 - protein, 26 aa, Mycobacterium
TAVADWIAMFSMWPVKQTPGLRCQLD

SEQ ID NO: 864785 - protein, 17 aa, Mycobacterium
TAVARQLAMSERTLRRR

SEQ ID NO: 864786 - protein, 26 aa, Mycobacterium
TAVATERLMLLWAQAEAARLTNVRAA

SEQ ID NO: 864787 - protein, 23 aa, Mycobacterium
TAVDLACRYPLDTAVTLIDALGN

SEQ ID NO: 864788 - protein, 22 aa, Mycobacterium
TAVDLTPFPGARLLGLERPYGR

SEQ ID NO: 864789 - protein, 19 aa, Mycobacterium
TAVEEFIRWATPVMTFRRT

SEQ ID NO: 864790 - protein, 25 aa, Mycobacterium
TAVEPYITWMHTTAAQLQQAASQAM

SEQ ID NO: 864791 - protein, 24 aa, Mycobacterium
TAVEVLWRGQRLRALVALPELVAA

SEQ ID NO: 864792 - protein, 17 aa, Mycobacterium
TAVFADPRWRAHHDRMS

SEQ ID NO: 864793 - protein, 19 aa, Mycobacterium
TAVFDRPFARQIAPLRRAL

SEQ ID NO: 864794 - protein, 24 aa, Mycobacterium
TAVFDSFVERIAPGGALVVCTDDP

SEQ ID NO: 864795 - protein, 17 aa, Mycobacterium
TAVFRHDDLASALAATE

SEQ ID NO: 864796 - protein, 25 aa, Mycobacterium
TAVGLPRFYVITVFKQIEPADLYVG

SEQ ID NO: 864797 - protein, 19 aa, Mycobacterium
TAVIARIRDWLDIDHVVVA

SEQ ID NO: 864798 - protein, 18 aa, Mycobacterium
TAVKQLRMITVGVAGWRS

SEQ ID NO: 864799 - protein, 20 aa, Mycobacterium
TAVLIETLVALGAEVRWASC

SEQ ID NO: 864800 - protein, 27 aa, Mycobacterium
TAVLLNPMAFLQRPARWMQLMGKFRGQ

SEQ ID NO: 864801 - protein, 27 aa, Mycobacterium
TAVLLSPMAFLQRPARWMQLLGRHRGQ

SEQ ID NO: 864802 - protein, 20 aa, Mycobacterium
TAVLNRLWKDGPSSASGLAS

SEQ ID NO: 864803 - protein, 20 aa, Mycobacterium
TAVLPADAFTPPVAVNGAHS

SEQ ID NO: 864804 - protein, 20 aa, Mycobacterium
TAVLRNWEFFRAPLGGIVSM

SEQ ID NO: 864805 - protein, 21 aa, Mycobacterium
TAVLTRLWKEGPSSASALAGA

SEQ ID NO: 864806 - protein, 21 aa, Mycobacterium
TAVLTRRIAYLLAEREVGVGQ

SEQ ID NO: 864807 - protein, 26 aa, Mycobacterium
TAVNDKIFFQIYWLGSRDAIAARMER

SEQ ID NO: 864808 - protein, 24 aa, Mycobacterium
TAVPAPIRLSPPIGIKGVTYAPNT

SEQ ID NO: 864809 - protein, 25 aa, Mycobacterium
TAVPDGEHWIINGEKWFSSFASMAS

SEQ ID NO: 864810 - protein, 18 aa, Mycobacterium
TAVPGLERLFPAGWEEQR

SEQ ID NO: 864811 - protein, 24 aa, Mycobacterium
TAVPTIHQILLERARTERPAGAGA

SEQ ID NO: 864812 - protein, 22 aa, Mycobacterium
TAVPVAVKLSPFFSATADMAHR

SEQ ID NO: 864813 - protein, 26 aa, Mycobacterium
TAVQYRLPMTFVLFNNNAHAMCVTRE

SEQ ID NO: 864814 - protein, 27 aa, Mycobacterium
TAVRERIPLVVLIWEDGGYGLIEWKMD

SEQ ID NO: 864815 - protein, 32 aa, Mycobacterium
TAVRERIPLVVLIWEDGGYGLIEWKMDLELGE

SEQ ID NO: 864816 - protein, 20 aa, Mycobacterium
TAVRGLAALLSIVTGGGGAG

SEQ ID NO: 864817 - protein, 17 aa, Mycobacterium
TAVRVPIGTPIRIGKTA

SEQ ID NO: 864818 - protein, 20 aa, Mycobacterium
TAVSILDRLLHHATVVITDG

SEQ ID NO: 864819 - protein, 20 aa, Mycobacterium
TAVTAPDWQQGLSASVRAGL

SEQ ID NO: 864820 - protein, 22 aa, Mycobacterium
TAVTLLNGGWYAPIPAPGTANI

SEQ ID NO: 864821 - protein, 27 aa, Mycobacterium
TAVTMPNFAGLSPWHAPTGPVPAYPRA

SEQ ID NO: 864822 - protein, 20 aa, Mycobacterium
TAVVELPPSGALSGIAKREM

SEQ ID NO: 864823 - protein, 17 aa, Mycobacterium
TAVVPPAADPVSLQTGI

SEQ ID NO: 864824 - protein, 21 aa, Mycobacterium
TAVVVRDWYAMRHYALTDDGC

SEQ ID NO: 864825 - protein, 26 aa, Mycobacterium
TAWAAEGLLGFLPPEAQDRLLDDVTA

SEQ ID NO: 864826 - protein, 18 aa, Mycobacterium
TAWALFRYDQVFAAARDA

SEQ ID NO: 864827 - protein, 25 aa, Mycobacterium
TAWATQLRIMQAQLLAKIAAAVGNG

SEQ ID NO: 864828 - protein, 24 aa, Mycobacterium
TAWATQLRIMQSQLLAKIAAAVGN

SEQ ID NO: 864829 - protein, 25 aa, Mycobacterium
TAWATQLRMIQAQLLAKIAAAVGNG

SEQ ID NO: 864830 - protein, 19 aa, Mycobacterium
TAWATQLRMIQSQVLAKIA

SEQ ID NO: 864831 - protein, 23 aa, Mycobacterium
TAWATQLRMVQSQILAKIAAAVG

SEQ ID NO: 864832 - protein, 19 aa, Mycobacterium
TAWDRVDQLAAWGYPFPAG

SEQ ID NO: 864833 - protein, 19 aa, Mycobacterium
TAWHFRLEPIPAGTRLTQA

SEQ ID NO: 864834 - protein, 26 aa, Mycobacterium
TAWIAEGLLVYLPPEAQDRLFDNITA

SEQ ID NO: 864835 - protein, 21 aa, Mycobacterium
TAWLLVSILRQKGLAARFVSG

SEQ ID NO: 864836 - protein, 17 aa, Mycobacterium
TAWLRGQVADLQAHMSD

SEQ ID NO: 864837 - protein, 21 aa, Mycobacterium
TAWLRTINTLGRSAFQLGVLE

SEQ ID NO: 864838 - protein, 17 aa, Mycobacterium
TAWQIHRCIGMDGSTLV

SEQ ID NO: 864839 - protein, 23 aa, Mycobacterium
TAWQQIVQLYLSGDIRAIGVSNF

SEQ ID NO: 864840 - protein, 21 aa, Mycobacterium
TAWQRYREAIIPLLAEAYPRR

SEQ ID NO: 864841 - protein, 26 aa, Mycobacterium
TAWRDGHWYTARLRPGPLRAAERRTT

SEQ ID NO: 864842 - protein, 19 aa, Mycobacterium
TAWRGLGSQVTLLARGSGL

SEQ ID NO: 864843 - protein, 25 aa, Mycobacterium
TAWRNGAWYTARLCPTPLLAEERKT

SEQ ID NO: 864844 - protein, 26 aa, Mycobacterium
TAWSAEGLLMYLPPDAQDRLFDNITE

SEQ ID NO: 864845 - protein, 21 aa, Mycobacterium
TAWSAEGLVRYLPARAQDLLF

SEQ ID NO: 864846 - protein, 20 aa, Mycobacterium
TAWTKYFVTVGLVGAQVGQA

SEQ ID NO: 864847 - protein, 21 aa, Mycobacterium
TAWVYIDHRITPGPPRPGYLN

SEQ ID NO: 864848 - protein, 23 aa, Mycobacterium
TAYDALYDPDATRYLLSLIDESA

SEQ ID NO: 864849 - protein, 19 aa, Mycobacterium
TAYHPWLRRIAAQHRGDVL

SEQ ID NO: 864850 - protein, 17 aa, Mycobacterium
TAYHPWLVDIAARHHGD

SEQ ID NO: 864851 - protein, 30 aa, Mycobacterium
TAYKVLKILETRYPAFRLSAARNRDIAGRP

SEQ ID NO: 864852 - protein, 19 aa, Mycobacterium
TAYLERFGAHVRAMVLDGA

SEQ ID NO: 864853 - protein, 25 aa, Mycobacterium
TAYQEYQKAWHQSAEDLNQILTQLN

SEQ ID NO: 864854 - protein, 20 aa, Mycobacterium
TCAAVWDALPLSAQVFHGKY

SEQ ID NO: 864855 - protein, 23 aa, Mycobacterium
TCAGFLHRALAWFAAHGVRVRRL

SEQ ID NO: 864856 - protein, 18 aa, Mycobacterium
TCCRALGIAVYDRKRPAD

SEQ ID NO: 864857 - protein, 18 aa, Mycobacterium
TCDILDEADLADGLVLAC

SEQ ID NO: 864858 - protein, 18 aa, Mycobacterium
TCDPIGGLVQIPCIERNA

SEQ ID NO: 864859 - protein, 25 aa, Mycobacterium
TCDPRTRIWWGAYLGTPDELLVAGT

SEQ ID NO: 864860 - protein, 17 aa, Mycobacterium
TCDPVGGLVQIPCIERN

SEQ ID NO: 864861 - protein, 30 aa, Mycobacterium
TCEDVCYLAMPLFHSNAVYAGWSVAVGAGA

SEQ ID NO: 864862 - protein, 23 aa, Mycobacterium
TCEKYARRGLVQFLGDDVGNPVA

SEQ ID NO: 864863 - protein, 31 aa, Mycobacterium
TCELLATGTLPGLPPLSGGMVGLFAYDMVRR

SEQ ID NO: 864864 - protein, 18 aa, Mycobacterium
TCFNAITGVYKPTSGSIV

SEQ ID NO: 864865 - protein, 30 aa, Mycobacterium
TCGGKWFRRFGGVNPRWLAPQGQKRPRLSA

SEQ ID NO: 864866 - protein, 17 aa, Mycobacterium
TCGIAVPHMIASGDARL

SEQ ID NO: 864867 - protein, 17 aa, Mycobacterium
TCGIAVPHMIASGDPRL

SEQ ID NO: 864868 - protein, 23 aa, Mycobacterium
TCGSDLHFIDGYLPGMREGDVFG

SEQ ID NO: 864869 - protein, 19 aa, Mycobacterium
TCHGFDSLLPDWTGSERLF

SEQ ID NO: 864870 - protein, 17 aa, Mycobacterium
TCHPQLGLLAQHQPPAQ

SEQ ID NO: 864871 - protein, 17 aa, Mycobacterium
TCHRAGGADLALAAVPA

SEQ ID NO: 864872 - protein, 25 aa, Mycobacterium
TCIPLPDELSFVDGALIACGFATAY

SEQ ID NO: 864873 - protein, 20 aa, Mycobacterium
TCKYHAWRYALNGDLTFIQQ

SEQ ID NO: 864874 - protein, 22 aa, Mycobacterium
TCLSLRVLRPAAQDLAALIASG

SEQ ID NO: 864875 - protein, 17 aa, Mycobacterium
TCMLMGDDAIRKMGSVG

SEQ ID NO: 864876 - protein, 26 aa, Mycobacterium
TCMSSSLPTLFRRAADYQRQITLTPS

SEQ ID NO: 864877 - protein, 18 aa, Mycobacterium
TCNGAPAVLLYLGDQLEG

SEQ ID NO: 864878 - protein, 17 aa, Mycobacterium
TCNLHGWQWNLTNGRCL

SEQ ID NO: 864879 - protein, 23 aa, Mycobacterium
TCNSAPAVLFYLGEHLEGVITLE

SEQ ID NO: 864880 - protein, 23 aa, Mycobacterium
TCNSAPAVLFYLGGQLEGVITLE

SEQ ID NO: 864881 - protein, 23 aa, Mycobacterium
TCPELGLRPLLPRLDTPERALRH

SEQ ID NO: 864882 - protein, 26 aa, Mycobacterium
TCPLWNVYETFAYPGKILVQIAQMPD

SEQ ID NO: 864883 - protein, 20 aa, Mycobacterium
TCPVALAFPDGQQPPLVEEF

SEQ ID NO: 864884 - protein, 30 aa, Mycobacterium
TCPVAWNQNYGGFWFLTSYEAVSQAARDGD

SEQ ID NO: 864885 - protein, 17 aa, Mycobacterium
TCRNPDCPKPRTGIILA

SEQ ID NO: 864886 - protein, 26 aa, Mycobacterium
TCRRLLDTYVDVLRLPKDVVVAERFA

SEQ ID NO: 864887 - protein, 17 aa, Mycobacterium
TCRTEVFFFPAAGHVEK

SEQ ID NO: 864888 - protein, 17 aa, Mycobacterium
TCTSTEQLIGVLRALTA

SEQ ID NO: 864889 - protein, 21 aa, Mycobacterium
TCVLVRATGAIYLLSTWDEGV

SEQ ID NO: 864890 - protein, 17 aa, Mycobacterium
TCVLWNSVPRDWADPHG

SEQ ID NO: 864891 - protein, 18 aa, Mycobacterium
TCVRILRNQASLLPGLNS

SEQ ID NO: 864892 - protein, 19 aa, Mycobacterium
TCVVKFVPLHTPAVTMSIN

SEQ ID NO: 864893 - protein, 26 aa, Mycobacterium
TCWGLSEQGRWWGLVTYPITHGGQKD

SEQ ID NO: 864894 - protein, 23 aa, Mycobacterium
TCWQDYRLGVFQAPLITALGFAF

SEQ ID NO: 864895 - protein, 21 aa, Mycobacterium
TCYEWAILDLAILAVGAVTVP

SEQ ID NO: 864896 - protein, 17 aa, Mycobacterium
TCYPGRPDYFTHWGGAF

SEQ ID NO: 864897 - protein, 27 aa, Mycobacterium
TCYVHPEIEFFLLKPGPNDGTPPEPAD

SEQ ID NO: 864898 - protein, 23 aa, Mycobacterium
TDAAGNLVGLLRGAPESADHVPP

SEQ ID NO: 864899 - protein, 21 aa, Mycobacterium
TDAAILMQSLAAVGGSTMGAT

SEQ ID NO: 864900 - protein, 23 aa, Mycobacterium
TDAAIVVVRILGGYRAWEDGIEA

SEQ ID NO: 864901 - protein, 25 aa, Mycobacterium
TDAALICVPPYHIAGVSAALSNLYA

SEQ ID NO: 864902 - protein, 26 aa, Mycobacterium
TDADFGRLRWAQLRDRVFGRTDAIAA

SEQ ID NO: 864903 - protein, 20 aa, Mycobacterium
TDADRPVLFLCRSGNRSIGA

SEQ ID NO: 864904 - protein, 25 aa, Mycobacterium
TDAECAWYGDPAFDLAFCLNHLLLK

SEQ ID NO: 864905 - protein, 26 aa, Mycobacterium
TDAEFTPLVRRLAGFLPADVRVRDIV

SEQ ID NO: 864906 - protein, 24 aa, Mycobacterium
TDAEIAAFFVLLAVAGNDTTRQTT

SEQ ID NO: 864907 - protein, 20 aa, Mycobacterium
TDAEQAIVLVPLDADQPPDE

SEQ ID NO: 864908 - protein, 23 aa, Mycobacterium
TDAFGPMILSLIATAADLARSLT

SEQ ID NO: 864909 - protein, 24 aa, Mycobacterium
TDAGDPVWWVVRALEFSQDFRTFA

SEQ ID NO: 864910 - protein, 24 aa, Mycobacterium
TDAGFHHIVWALPGGTLFGIHQHD

SEQ ID NO: 864911 - protein, 25 aa, Mycobacterium
TDAGMQYCWVIRLTGDHITEVIGYY

SEQ ID NO: 864912 - protein, 23 aa, Mycobacterium
TDAGRLLARIYSESDLLVAECLR

SEQ ID NO: 864913 - protein, 24 aa, Mycobacterium
TDAGTYLGALGWRIAGVSNTDLFA

SEQ ID NO: 864914 - protein, 25 aa, Mycobacterium
TDAHPAPLLFVHGAWHAAWCWDDHF

SEQ ID NO: 864915 - protein, 19 aa, Mycobacterium
TDAHRAILDTLGGGGAYFF

SEQ ID NO: 864916 - protein, 23 aa, Mycobacterium
TDALANIALLRRPPDLDAATWLH

SEQ ID NO: 864917 - protein, 17 aa, Mycobacterium
TDALLEWADIHGGLQRS

SEQ ID NO: 864918 - protein, 21 aa, Mycobacterium
TDALLVPTMIQKLIDHPDINR

SEQ ID NO: 864919 - protein, 28 aa, Mycobacterium
TDALTPTFAKLLPMAFPNAELIDAEQAM

SEQ ID NO: 864920 - protein, 24 aa, Mycobacterium
TDALTPTFAKLLPMAFPQAELVDG

SEQ ID NO: 864921 - protein, 18 aa, Mycobacterium
TDAMLDWQTARFTDLAIG

SEQ ID NO: 864922 - protein, 26 aa, Mycobacterium
TDAMQMWQPQPLSQAALELARSIAAR

SEQ ID NO: 864923 - protein, 20 aa, Mycobacterium
TDAPFLTPHPFRGAPNEPYC

SEQ ID NO: 864924 - protein, 20 aa, Mycobacterium
TDAPFLTPHPYRGAANEPYC

SEQ ID NO: 864925 - protein, 30 aa, Mycobacterium
TDAPGFDVPYYWWTFNMPTDHGEVALTDVR

SEQ ID NO: 864926 - protein, 24 aa, Mycobacterium
TDAPIQVIMHPTGYRFARGHRLRL

SEQ ID NO: 864927 - protein, 25 aa, Mycobacterium
TDAPPIAVRIYWPAGFESAGELPLV

SEQ ID NO: 864928 - protein, 24 aa, Mycobacterium
TDAPQFLLSLIDESAVRAASGTEV

SEQ ID NO: 864929 - protein, 18 aa, Mycobacterium
TDARPRLVVNRSARHIHV

SEQ ID NO: 864930 - protein, 24 aa, Mycobacterium
TDASYQRGLRNLAYKARTIRDETG

SEQ ID NO: 864931 - protein, 20 aa, Mycobacterium
TDAVAGMPIGLGPDLVHVVP

SEQ ID NO: 864932 - protein, 24 aa, Mycobacterium
TDAVFWEPFLDRGFSPDSGATWLL

SEQ ID NO: 864933 - protein, 21 aa, Mycobacterium
TDAVWRGLADLGTTGLLVPEH

SEQ ID NO: 864934 - protein, 17 aa, Mycobacterium
TDAWSWDAPFSYVAERY

SEQ ID NO: 864935 - protein, 19 aa, Mycobacterium
TDAYARLVAMRLVASRASD

SEQ ID NO: 864936 - protein, 20 aa, Mycobacterium
TDAYDWGLISAVYPADEFDA

SEQ ID NO: 864937 - protein, 30 aa, Mycobacterium
TDCPKPPPRRITLTLPAVQRSREVWLVVSG

SEQ ID NO: 864938 - protein, 20 aa, Mycobacterium
TDCPLRWLAERHGGTNPRDL

SEQ ID NO: 864939 - protein, 23 aa, Mycobacterium
TDDALRTLILMVLETGADVRRDL

SEQ ID NO: 864940 - protein, 29 aa, Mycobacterium
TDDDLELLRRPLYGFFSAAAAPSPPQPRP

SEQ ID NO: 864941 - protein, 25 aa, Mycobacterium
TDDELGRPLALISELRYPATDSIEQ

SEQ ID NO: 864942 - protein, 32 aa, Mycobacterium
TDDESLDYFLGLMLRAPFRLARDVIPHMGPGS

SEQ ID NO: 864943 - protein, 33 aa, Mycobacterium
TDDESLDYVLSLMLRAPFRLTREVLPHLRPGSA

SEQ ID NO: 864944 - protein, 32 aa, Mycobacterium
TDDETLDYFLGLMLRAPFRLARDVLPHMGPGS

SEQ ID NO: 864945 - protein, 25 aa, Mycobacterium
TDDEWHHVLDLNLSSAWYLSRAAAK

SEQ ID NO: 864946 - protein, 24 aa, Mycobacterium
TDDEWHRVLDLNLSSAWYLSRAAA

SEQ ID NO: 864947 - protein, 26 aa, Mycobacterium
TDDEWRQVLDLNLSSAWYLSRAAVKP

SEQ ID NO: 864948 - protein, 22 aa, Mycobacterium
TDDGLLITARPLHGGTWRSYAD

SEQ ID NO: 864949 - protein, 24 aa, Mycobacterium
TDDGPFARQFLSTGVIPIASTTMP

SEQ ID NO: 864950 - protein, 28 aa, Mycobacterium
TDDGRIHGWARFARFHLGRNGAVHGGAL

SEQ ID NO: 864951 - protein, 19 aa, Mycobacterium
TDDGRLLARIYSESDLLVA

SEQ ID NO: 864952 - protein, 27 aa, Mycobacterium
TDDIPGAWGLWFDLWAQAFRHDEVKAG

SEQ ID NO: 864953 - protein, 35 aa, Mycobacterium
TDDIQSWRAVQRVGWKWWLAACFQVTDDKEQLCEL

SEQ ID NO: 864954 - protein, 19 aa, Mycobacterium
TDDLLLVAGMRVGQRDKLI

SEQ ID NO: 864955 - protein, 19 aa, Mycobacterium
TDDLLLVAGMRVTQREKLL

SEQ ID NO: 864956 - protein, 23 aa, Mycobacterium
TDDMAALLRRAVRWQYHRRSRGG

SEQ ID NO: 864957 - protein, 28 aa, Mycobacterium
TDDPAKLALPQWYANNGQFVTTKFFGMK

SEQ ID NO: 864958 - protein, 19 aa, Mycobacterium
TDDPLLQRQLGVLASTAYV

SEQ ID NO: 864959 - protein, 22 aa, Mycobacterium
TDDRFHAFLHVAADSALAEAAR

SEQ ID NO: 864960 - protein, 27 aa, Mycobacterium
TDDRLAMFFVDYPRKQRLKVFGRGSVH

SEQ ID NO: 864961 - protein, 22 aa, Mycobacterium
TDDRNRELLAERLIALGEQQTV

SEQ ID NO: 864962 - protein, 25 aa, Mycobacterium
TDDRYYMLPMLDMWTDVFANPGKRT

SEQ ID NO: 864963 - protein, 18 aa, Mycobacterium
TDDVGGLGPVSWLNTTDG

SEQ ID NO: 864964 - protein, 20 aa, Mycobacterium
TDDWLGEWTFAFPQGSMTDE

SEQ ID NO: 864965 - protein, 23 aa, Mycobacterium
TDEALLDIYRKLRPGEPPTKESA

SEQ ID NO: 864966 - protein, 24 aa, Mycobacterium
TDEAQWTMELVFMTEAALALGNRE

SEQ ID NO: 864967 - protein, 24 aa, Mycobacterium
TDEDLPEFYGYPAKLSGTWLRANF

SEQ ID NO: 864968 - protein, 20 aa, Mycobacterium
TDEEALKRLGIGGGFFSFGI

SEQ ID NO: 864969 - protein, 23 aa, Mycobacterium
TDEEIGAFLILLASAGNDTTKQT

SEQ ID NO: 864970 - protein, 24 aa, Mycobacterium
TDEEVLAFLFLMVIAGNETTTKLL

SEQ ID NO: 864971 - protein, 25 aa, Mycobacterium
TDEEWHQVLDLNLSSAWYLSRAAAK

SEQ ID NO: 864972 - protein, 17 aa, Mycobacterium
TDEFAAELLTWLRDRLA

SEQ ID NO: 864973 - protein, 37 aa, Mycobacterium
TDEFAVVHKLRRVLSGLDPHQAIDLLMSQLRKTKNNY

SEQ ID NO: 864974 - protein, 24 aa, Mycobacterium
TDEFTKLHREILVQLMPHGADLDP

SEQ ID NO: 864975 - protein, 25 aa, Mycobacterium
TDEFTKLHREILVQLMPHGAELDPA

SEQ ID NO: 864976 - protein, 37 aa, Mycobacterium
TDEGFELQWGANYLGPFLLTHLLLPQLQASRSGDARV

SEQ ID NO: 864977 - protein, 26 aa, Mycobacterium
TDEGRADWFQWVESNVARRVGSNKEL

SEQ ID NO: 864978 - protein, 24 aa, Mycobacterium
TDEGTWIAPPNRALWIPSGAGHEH

SEQ ID NO: 864979 - protein, 22 aa, Mycobacterium
TDEHGLPLWQKLTIFTSESAQR

SEQ ID NO: 864980 - protein, 24 aa, Mycobacterium
TDEHLARVLIAYEPIWAIGENGRP

SEQ ID NO: 864981 - protein, 26 aa, Mycobacterium
TDEIIHLMRALWRPGWTEFEGAFYTA

SEQ ID NO: 864982 - protein, 18 aa, Mycobacterium
TDEILLDRLRQFGGDVEF

SEQ ID NO: 864983 - protein, 22 aa, Mycobacterium
TDEILLELGLDWDRIIELKTAG

SEQ ID NO: 864984 - protein, 20 aa, Mycobacterium
TDEIPPFAPFLSPEIAKERT

SEQ ID NO: 864985 - protein, 24 aa, Mycobacterium
TDEKGRRFLVQTAKIAYVEIGAAD

SEQ ID NO: 864986 - protein, 35 aa, Mycobacterium
TDEKMLCPGLSFLPIAIVVDYELTVSMPARLTADT

SEQ ID NO: 864987 - protein, 18 aa, Mycobacterium
TDELAQLPSLLAEKLKAP

SEQ ID NO: 864988 - protein, 17 aa, Mycobacterium
TDELFHRHPERSEGDLA

SEQ ID NO: 864989 - protein, 22 aa, Mycobacterium
TDELIDRCWAPKVHGAWNLHQA

SEQ ID NO: 864990 - protein, 20 aa, Mycobacterium
TDELLDRDWAPKVYGAWHLH

SEQ ID NO: 864991 - protein, 22 aa, Mycobacterium
TDELLDRDWAPKVYGAWHLHQA

SEQ ID NO: 864992 - protein, 21 aa, Mycobacterium
TDELPLLQSRTLRVAGHLLEI

SEQ ID NO: 864993 - protein, 26 aa, Mycobacterium
TDELRAILGERGLLARFLQVEAELAA

SEQ ID NO: 864994 - protein, 26 aa, Mycobacterium
TDEMIGPALLLLSDAGSFITGQVIVA

SEQ ID NO: 864995 - protein, 24 aa, Mycobacterium
TDEMLALMRELWKPGWTEFGGRFY

SEQ ID NO: 864996 - protein, 27 aa, Mycobacterium
TDEMLRQMLFDCCSLHAGQACILHSRL

SEQ ID NO: 864997 - protein, 26 aa, Mycobacterium
TDENLHMIFYRNLVEAGMHIAPDQAL

SEQ ID NO: 864998 - protein, 24 aa, Mycobacterium
TDEQKARWLGPIASGDVVASFALT

SEQ ID NO: 864999 - protein, 26 aa, Mycobacterium
TDEQKDFFLPRILTGEVFFCQGYSEP

SEQ ID NO: 865000 - protein, 26 aa, Mycobacterium
TDEQKKFFLPRIAAGNLHFSIGYSEP

SEQ ID NO: 865001 - protein, 24 aa, Mycobacterium
TDEQKQRWLPKFCSGEMITAIGMT

SEQ ID NO: 865002 - protein, 25 aa, Mycobacterium
TDEQLRPLGDYWLAGLHAAAQKRGL

SEQ ID NO: 865003 - protein, 28 aa, Mycobacterium
TDEQRAWARKLFADEDKPLLAGLAGGRT

SEQ ID NO: 865004 - protein, 26 aa, Mycobacterium
TDEQRRQWLKPLLDGEIRSAFSMTEP

SEQ ID NO: 865005 - protein, 25 aa, Mycobacterium
TDEQVLFLSDILPTGYMGAEMCDIT

SEQ ID NO: 865006 - protein, 18 aa, Mycobacterium
TDEQWRQLKRALGNPDWA

SEQ ID NO: 865007 - protein, 25 aa, Mycobacterium
TDERDRPLLDLFWDYAMEGDEPSGE

SEQ ID NO: 865008 - protein, 25 aa, Mycobacterium
TDERDRPLLDLWWDYELDGDEPSGE

SEQ ID NO: 865009 - protein, 21 aa, Mycobacterium
TDERLLAKMPAGWSPTAAATT

SEQ ID NO: 865010 - protein, 19 aa, Mycobacterium
TDERMVMRLLAFGLRAHRL

SEQ ID NO: 865011 - protein, 22 aa, Mycobacterium
TDERMVVRLLAFGLRAHRLSDV

SEQ ID NO: 865012 - protein, 33 aa, Mycobacterium
TDETLELLPLIPLVPKRALQGLGGLFFGSPDDL

SEQ ID NO: 865013 - protein, 24 aa, Mycobacterium
TDEVVDVVLLWWRDSDGDLVDTLM

SEQ ID NO: 865014 - protein, 19 aa, Mycobacterium
TDEYITEELRSAQVGNRWG

SEQ ID NO: 865015 - protein, 28 aa, Mycobacterium
TDFAALAYMLEIFAFRYKIICGAHATKP

SEQ ID NO: 865016 - protein, 20 aa, Mycobacterium
TDFADYWYTNLRTTVRFDQA

SEQ ID NO: 865017 - protein, 19 aa, Mycobacterium
TDFERLQRELSGGSASDGV

SEQ ID NO: 865018 - protein, 20 aa, Mycobacterium
TDFGAWEGLTFAEAAQRDPD

SEQ ID NO: 865019 - protein, 27 aa, Mycobacterium
TDFLAKFWNFPEGRRRWREAQDMLVRS

SEQ ID NO: 865020 - protein, 32 aa, Mycobacterium
TDFLTHNPWTPLYPNVILGGGLKLAIWAAIPL

SEQ ID NO: 865021 - protein, 22 aa, Mycobacterium
TDFPDQRAWLMEDFDGRIKGAV

SEQ ID NO: 865022 - protein, 23 aa, Mycobacterium
TDFPDQRAWLMEDFDGRIKGAVE

SEQ ID NO: 865023 - protein, 23 aa, Mycobacterium
TDFPGWTGMFLNETALRPAHWLQ

SEQ ID NO: 865024 - protein, 20 aa, Mycobacterium
TDFQRLQRELSGASPDTSDQ

SEQ ID NO: 865025 - protein, 23 aa, Mycobacterium
TDFRRPGCLCADQPQPCQWCRQL

SEQ ID NO: 865026 - protein, 21 aa, Mycobacterium
TDFRSWARVDLDLEPGRTVFV

SEQ ID NO: 865027 - protein, 31 aa, Mycobacterium
TDFSRRLLTLIRRIEQLPIPTVAVVHALNLT

SEQ ID NO: 865028 - protein, 22 aa, Mycobacterium
TDFTDYWYQNLRNTVRFDQAAV

SEQ ID NO: 865029 - protein, 18 aa, Mycobacterium
TDFTEYNGYWLPNRYANH

SEQ ID NO: 865030 - protein, 19 aa, Mycobacterium
TDFWRTYLRRGTILRDAVD

SEQ ID NO: 865031 - protein, 26 aa, Mycobacterium
TDGAAEHLYRLALPLGIYGGTLEVFR

SEQ ID NO: 865032 - protein, 31 aa, Mycobacterium
TDGADPEWALWYSGYLQARLWDRAGRLPSRS

SEQ ID NO: 865033 - protein, 25 aa, Mycobacterium
TDGANWANWAKPIVMQSSWARQGDP

SEQ ID NO: 865034 - protein, 22 aa, Mycobacterium
TDGDHPIPPGDYARLITYTVDA

SEQ ID NO: 865035 - protein, 24 aa, Mycobacterium
TDGDLLKGVRFFGGGCTTQSIVMR

SEQ ID NO: 865036 - protein, 25 aa, Mycobacterium
TDGFFSRPGLLTVGLRPLAPNVPRI

SEQ ID NO: 865037 - protein, 22 aa, Mycobacterium
TDGGDSIYWAGLNKGKRSVAAD

SEQ ID NO: 865038 - protein, 25 aa, Mycobacterium
TDGMEALLPVLRPDDHALLTDQLAE

SEQ ID NO: 865039 - protein, 26 aa, Mycobacterium
TDGMRRLFRQFSFPGGIPSHVAAQTP

SEQ ID NO: 865040 - protein, 30 aa, Mycobacterium
TDGPPDWPTGPLPPVRIAAADPPPGQYRDR

SEQ ID NO: 865041 - protein, 20 aa, Mycobacterium
TDGPPIRYFLPGADEWRTAH

SEQ ID NO: 865042 - protein, 17 aa, Mycobacterium
TDGPWLGGAALSMAGAA

SEQ ID NO: 865043 - protein, 27 aa, Mycobacterium
TDGRDDLWRLFVYDPSLDRKPTDSEIL

SEQ ID NO: 865044 - protein, 23 aa, Mycobacterium
TDGRKLPWFGPPMSAASMATARL

SEQ ID NO: 865045 - protein, 28 aa, Mycobacterium
TDGRPLWTDPTLLADPWLDPPTPVDSDA

SEQ ID NO: 865046 - protein, 26 aa, Mycobacterium
TDGRVITGLVLKWLAPGSDSDSSSRY

SEQ ID NO: 865047 - protein, 22 aa, Mycobacterium
TDGRVITHQLPIAPKPLPTLQV

SEQ ID NO: 865048 - protein, 27 aa, Mycobacterium
TDGRWDFKFLGMQIMIEGLALGAFTTI

SEQ ID NO: 865049 - protein, 17 aa, Mycobacterium
TDGRWSCVHWGDAVAPF

SEQ ID NO: 865050 - protein, 24 aa, Mycobacterium
TDGRWSCVQWGKLTPPFVGDAPVT

SEQ ID NO: 865051 - protein, 23 aa, Mycobacterium
TDGRWSCVRWGTKTPPFCAEVDS

SEQ ID NO: 865052 - protein, 27 aa, Mycobacterium
TDGRWSCVRWGTLTPPFYPEAEATPVA

SEQ ID NO: 865053 - protein, 26 aa, Mycobacterium
TDGSPARLRMHQRWPIVMVDEFQDTD

SEQ ID NO: 865054 - protein, 25 aa, Mycobacterium
TDGSPWVGNIAISFPYLDSEATRTA

SEQ ID NO: 865055 - protein, 24 aa, Mycobacterium
TDGSYWTGLVFADGKRWPEERTTW

SEQ ID NO: 865056 - protein, 24 aa, Mycobacterium
TDGTLTVRELPTPAAGPVGITATH

SEQ ID NO: 865057 - protein, 24 aa, Mycobacterium
TDGTPGGWLLGDGGAGGSGAANTG

SEQ ID NO: 865058 - protein, 23 aa, Mycobacterium
TDGTPGGWLLGDGGAGGSGGTGL

SEQ ID NO: 865059 - protein, 30 aa, Mycobacterium
TDGVDGLYLDYAATAPLHPAAARAVHAGQQ

SEQ ID NO: 865060 - protein, 21 aa, Mycobacterium
TDGVEYIFRLAGPTGIYGGTL

SEQ ID NO: 865061 - protein, 21 aa, Mycobacterium
TDGVGLVRRLSGGPAGMSVVE

SEQ ID NO: 865062 - protein, 24 aa, Mycobacterium
TDGWQIWMRPEAVPGLQKLTEAVH

SEQ ID NO: 865063 - protein, 18 aa, Mycobacterium
TDGWRRHGLDMDLATLTY

SEQ ID NO: 865064 - protein, 25 aa, Mycobacterium
TDGYRHRPHYFLAPDGVCRPFSDDA

SEQ ID NO: 865065 - protein, 20 aa, Mycobacterium
TDHELYLHPTGRLSEIAPPD

SEQ ID NO: 865066 - protein, 21 aa, Mycobacterium
TDHGLPVRTPGARLVPGGANA

SEQ ID NO: 865067 - protein, 18 aa, Mycobacterium
TDHHNVLLQRAPVPFLHH

SEQ ID NO: 865068 - protein, 24 aa, Mycobacterium
TDHILEFSTAITGGLFFSPTVDFL

SEQ ID NO: 865069 - protein, 17 aa, Mycobacterium
TDHLMRFPGKFSEQLLA

SEQ ID NO: 865070 - protein, 19 aa, Mycobacterium
TDHLPNLRRLTKLASGTIT

SEQ ID NO: 865071 - protein, 28 aa, Mycobacterium
TDHPAHRYFLAAKEIEFALGGATGQLRR

SEQ ID NO: 865072 - protein, 18 aa, Mycobacterium
TDHRLLVKVPAGWSHTAA

SEQ ID NO: 865073 - protein, 17 aa, Mycobacterium
TDHRLSHRILVGGLDTV

SEQ ID NO: 865074 - protein, 25 aa, Mycobacterium
TDHRPEILLSFGFVPKVESRVGLIN

SEQ ID NO: 865075 - protein, 21 aa, Mycobacterium
TDIAALNVLRVRRPVLRRELE

SEQ ID NO: 865076 - protein, 25 aa, Mycobacterium
TDIADQLARRRLGYGRGARMKFERD

SEQ ID NO: 865077 - protein, 24 aa, Mycobacterium
TDIAPLEMTKWFDTNYHYIVPELG

SEQ ID NO: 865078 - protein, 25 aa, Mycobacterium
TDIARPYPVPIICALLGAPREDWQR

SEQ ID NO: 865079 - protein, 33 aa, Mycobacterium
TDIEDIAPFIRFLVSDGWWITGQTILINGGYTT

SEQ ID NO: 865080 - protein, 18 aa, Mycobacterium
TDIILNLKSLVVSSEEDE

SEQ ID NO: 865081 - protein, 24 aa, Mycobacterium
TDIIRGYYFAGDPRAFAVLGRALP

SEQ ID NO: 865082 - protein, 26 aa, Mycobacterium
TDIKTELLSFRPGGSEAAFLFAITIG

SEQ ID NO: 865083 - protein, 24 aa, Mycobacterium
TDILRGYYFAGDPRAFAILGRALP

SEQ ID NO: 865084 - protein, 23 aa, Mycobacterium
TDIPVRIYWPPLEPEEALPVVVF

SEQ ID NO: 865085 - protein, 21 aa, Mycobacterium
TDIQQRLVLQAGYHALEDAGI

SEQ ID NO: 865086 - protein, 20 aa, Mycobacterium
TDITPYWRPASWAAGVAVID

SEQ ID NO: 865087 - protein, 21 aa, Mycobacterium
TDITPYWRPASWAAGVVVVDA

SEQ ID NO: 865088 - protein, 24 aa, Mycobacterium
TDIVEMLGRKPLTIRNLVSNRRTT

SEQ ID NO: 865089 - protein, 20 aa, Mycobacterium
TDIYIRWGLHHLASESPRVL

SEQ ID NO: 865090 - protein, 24 aa, Mycobacterium
TDKGLLNDPFAEPLLCAVGIDYLT

SEQ ID NO: 865091 - protein, 25 aa, Mycobacterium
TDKPLKYPHMFAAAGLVILNKIDLL

SEQ ID NO: 865092 - protein, 18 aa, Mycobacterium
TDKPWGVGFLSWAADVNT

SEQ ID NO: 865093 - protein, 25 aa, Mycobacterium
TDKSRDGLRLPWIPGVRGDTRTIAA

SEQ ID NO: 865094 - protein, 40 aa, Mycobacterium
TDKTILQAIELWKIVDRPNLLIKIPATKAGLPAITAVIAE

SEQ ID NO: 865095 - protein, 18 aa, Mycobacterium
TDKTVDLLLACHLAGCGY

SEQ ID NO: 865096 - protein, 32 aa, Mycobacterium
TDLAAFVARIRPAFLLLQTAFCVGITRAALTA

SEQ ID NO: 865097 - protein, 21 aa, Mycobacterium
TDLAFGPALVLPLGGGESTAG

SEQ ID NO: 865098 - protein, 32 aa, Mycobacterium
TDLAKVLEKGLFDGLFIADVLGIYDVFGGGPE

SEQ ID NO: 865099 - protein, 17 aa, Mycobacterium
TDLALLNGLLQLIVENG

SEQ ID NO: 865100 - protein, 26 aa, Mycobacterium
TDLDAHLPTLYRLFGNKDALIDEMAE

SEQ ID NO: 865101 - protein, 21 aa, Mycobacterium
TDLDKLTFLNAAPGRPFGGAI

SEQ ID NO: 865102 - protein, 20 aa, Mycobacterium
TDLDTYWRDGALGRLADQPA

SEQ ID NO: 865103 - protein, 19 aa, Mycobacterium
TDLISPEYSLRQLSQMLGV

SEQ ID NO: 865104 - protein, 18 aa, Mycobacterium
TDLKLRALAWGDTTVRIA

SEQ ID NO: 865105 - protein, 17 aa, Mycobacterium
TDLLDRLRAALAEPGVD

SEQ ID NO: 865106 - protein, 17 aa, Mycobacterium
TDLLNHFIGTWLEAFGI

SEQ ID NO: 865107 - protein, 21 aa, Mycobacterium
TDLLQELLWAYGPCGQEDQVR

SEQ ID NO: 865108 - protein, 17 aa, Mycobacterium
TDLLRVALTAPFIIGRF

SEQ ID NO: 865109 - protein, 23 aa, Mycobacterium
TDLPVFVRELLEPLGLTAEAPAG

SEQ ID NO: 865110 - protein, 21 aa, Mycobacterium
TDLPVLLYDIPGRSGVPIEPE

SEQ ID NO: 865111 - protein, 31 aa, Mycobacterium
TDLQGFVRRIRPAFLLLQTAFCSGVSVAALE

SEQ ID NO: 865112 - protein, 24 aa, Mycobacterium
TDLRAWLTTVVSRLGLDRLRSAAH

SEQ ID NO: 865113 - protein, 25 aa, Mycobacterium
TDLRDWVGALVRPLTDHLAALGNPT

SEQ ID NO: 865114 - protein, 32 aa, Mycobacterium
TDLRERLVRTWDLLLPALVEPASLDYFREFLA

SEQ ID NO: 865115 - protein, 24 aa, Mycobacterium
TDLRERMALFFDVISAWMEAEPNL

SEQ ID NO: 865116 - protein, 19 aa, Mycobacterium
TDLRVYGALLAVGTELFSR

SEQ ID NO: 865117 - protein, 18 aa, Mycobacterium
TDLRWFEELPRGGHFAAM

SEQ ID NO: 865118 - protein, 28 aa, Mycobacterium
TDLSAFNQLLASFPWPLNKTTTVDKCAA

SEQ ID NO: 865119 - protein, 26 aa, Mycobacterium
TDLSDLLWSFAPKRRARPQLLSEVPA

SEQ ID NO: 865120 - protein, 27 aa, Mycobacterium
TDLSVPMRRGPWWYYARSFEGKQYAVH

SEQ ID NO: 865121 - protein, 18 aa, Mycobacterium
TDLTFVHWPVLPNSIAQL

SEQ ID NO: 865122 - protein, 23 aa, Mycobacterium
TDLVRPVIDCVAAVAPRGYGQGN

SEQ ID NO: 865123 - protein, 17 aa, Mycobacterium
TDLVSVPDRLRGAVTAM

SEQ ID NO: 865124 - protein, 27 aa, Mycobacterium
TDMAHFYYIHFGFPTYFKNVFEGHIAS

SEQ ID NO: 865125 - protein, 32 aa, Mycobacterium
TDMGFVVVAPHRYFPRLRLELDKGFGWKAEVE

SEQ ID NO: 865126 - protein, 25 aa, Mycobacterium
TDMLHSAPMYRAFRPDLPNPKRADA

SEQ ID NO: 865127 - protein, 24 aa, Mycobacterium
TDMPAFIRFMLRKVIKAPEFLRLD

SEQ ID NO: 865128 - protein, 24 aa, Mycobacterium
TDMPAFIRFMLRRVLKAPEFLKLD

SEQ ID NO: 865129 - protein, 24 aa, Mycobacterium
TDMPDRVVWLPLNSPGSAVHRQLG

SEQ ID NO: 865130 - protein, 27 aa, Mycobacterium
TDNELLTSILTYHVVPGQAAPDAVAGE

SEQ ID NO: 865131 - protein, 20 aa, Mycobacterium
TDNFALFRREKILSADGTMT

SEQ ID NO: 865132 - protein, 21 aa, Mycobacterium
TDNGLVEIVPLGISKATGVDE

SEQ ID NO: 865133 - protein, 31 aa, Mycobacterium
TDNHTLAHLLKFDSILGRLPFDVSLEGQDTI

SEQ ID NO: 865134 - protein, 28 aa, Mycobacterium
TDNHTLAHLLKFDSILGRLPHDVSLEGE

SEQ ID NO: 865135 - protein, 19 aa, Mycobacterium
TDNLMRFPGKFSEHLLAEH

SEQ ID NO: 865136 - protein, 22 aa, Mycobacterium
TDNMFGFWDWVGGRYSVDSAIG

SEQ ID NO: 865137 - protein, 32 aa, Mycobacterium
TDNPLFSRLRQPGLGDYFAPGLPAAFDGVHPA

SEQ ID NO: 865138 - protein, 27 aa, Mycobacterium
TDNQTLAHLLKFDSILGRLPQDVSLEG

SEQ ID NO: 865139 - protein, 23 aa, Mycobacterium
TDNRLMEALKDLTDLLSAGINVA

SEQ ID NO: 865140 - protein, 29 aa, Mycobacterium
TDPAGATLGLWQPLQHRGFEIIGAAGAPV

SEQ ID NO: 865141 - protein, 22 aa, Mycobacterium
TDPAGYLAWLREIAGPSAWIVV

SEQ ID NO: 865142 - protein, 23 aa, Mycobacterium
TDPAQWLAARGWAVEPVRSTLEL

SEQ ID NO: 865143 - protein, 26 aa, Mycobacterium
TDPATPYLSLWARLRRFTVADLDTEL

SEQ ID NO: 865144 - protein, 20 aa, Mycobacterium
TDPDGILNLALRDLAKDLGD

SEQ ID NO: 865145 - protein, 18 aa, Mycobacterium
TDPDGNWWEIVAVRENGY

SEQ ID NO: 865146 - protein, 24 aa, Mycobacterium
TDPDKLPMRLGLEISGTIAAVGAG

SEQ ID NO: 865147 - protein, 27 aa, Mycobacterium
TDPDPMWPEAVLAAAAWFQGDNDRGSP

SEQ ID NO: 865148 - protein, 17 aa, Mycobacterium
TDPDRLRVLLRDVFVAA

SEQ ID NO: 865149 - protein, 25 aa, Mycobacterium
TDPEESIVLVLRLASAPPPSVSSRR

SEQ ID NO: 865150 - protein, 26 aa, Mycobacterium
TDPEQKFLRHLLSGELRQGALAGVMA

SEQ ID NO: 865151 - protein, 17 aa, Mycobacterium
TDPERVPPLALPPEPQD

SEQ ID NO: 865152 - protein, 27 aa, Mycobacterium
TDPGFVLYDVQLMRLRALLARARGDEE

SEQ ID NO: 865153 - protein, 24 aa, Mycobacterium
TDPGRFDVIVTDNLFGDIITDLAA

SEQ ID NO: 865154 - protein, 23 aa, Mycobacterium
TDPGRFDVIVTDNLFGDIITDLS

SEQ ID NO: 865155 - protein, 24 aa, Mycobacterium
TDPIEPLLRRLAARIAATFPWDAD

SEQ ID NO: 865156 - protein, 20 aa, Mycobacterium
TDPLCYVDPYLPIDSFRHRD

SEQ ID NO: 865157 - protein, 30 aa, Mycobacterium
TDPLCYVDPYLPIDSFRRRDEARKGLVALV

SEQ ID NO: 865158 - protein, 29 aa, Mycobacterium
TDPLCYVDPYLPIDSFRRRDEARVKLVAV

SEQ ID NO: 865159 - protein, 20 aa, Mycobacterium
TDPLCYVDPYLPIESFKRRD

SEQ ID NO: 865160 - protein, 22 aa, Mycobacterium
TDPLIRKWLGFAPAKPKVVFRE

SEQ ID NO: 865161 - protein, 18 aa, Mycobacterium
TDPLRQIPYVGTPIADLI

SEQ ID NO: 865162 - protein, 24 aa, Mycobacterium
TDPNAYIYFTIQEQNWVRTAEAIG

SEQ ID NO: 865163 - protein, 23 aa, Mycobacterium
TDPNFDRPLRPLARVAHVDFEEP

SEQ ID NO: 865164 - protein, 26 aa, Mycobacterium
TDPPAVWMRLVVLGVKFREAYGVDAR

SEQ ID NO: 865165 - protein, 23 aa, Mycobacterium
TDPRAIFDRLSEAHVPVAVLTRP

SEQ ID NO: 865166 - protein, 25 aa, Mycobacterium
TDPRSRVPALPRLDPADPLPRCRQT

SEQ ID NO: 865167 - protein, 23 aa, Mycobacterium
TDPRSRVPALPRLGPDDALPRCR

SEQ ID NO: 865168 - protein, 18 aa, Mycobacterium
TDPSLIPDPHPYFDYLRS

SEQ ID NO: 865169 - protein, 28 aa, Mycobacterium
TDPSRRVRFLPYGIAVSVLDTTPRSPGS

SEQ ID NO: 865170 - protein, 22 aa, Mycobacterium
TDPTIYRFYEALQVYGGAIKEL

SEQ ID NO: 865171 - protein, 25 aa, Mycobacterium
TDPTRRVRFLPYGIAVSVLDSGPDS

SEQ ID NO: 865172 - protein, 26 aa, Mycobacterium
TDPTVPKHFGLTYFLCDMTQPGVEVR

SEQ ID NO: 865173 - protein, 23 aa, Mycobacterium
TDPTVVRVLGAIEIPVVAQALAR

SEQ ID NO: 865174 - protein, 26 aa, Mycobacterium
TDPVDPLFMRILRNSQLLDVLLHDLL

SEQ ID NO: 865175 - protein, 34 aa, Mycobacterium
TDPVGHLAFVHAHPRWIGQAFADALGARAGELGA

SEQ ID NO: 865176 - protein, 34 aa, Mycobacterium
TDPVLAEWFLRRISLLDSLYMVPSPLIIGRAVAH

SEQ ID NO: 865177 - protein, 29 aa, Mycobacterium
TDPVLAEWFLRRTSLLDSLYLAPSPRVIG

SEQ ID NO: 865178 - protein, 19 aa, Mycobacterium
TDPYLFRLTGGRVNMGSII

SEQ ID NO: 865179 - protein, 23 aa, Mycobacterium
TDPYTVAPLWPDSVSLAALQARV

SEQ ID NO: 865180 - protein, 17 aa, Mycobacterium
TDQIIPAVYLKRVTRTG

SEQ ID NO: 865181 - protein, 22 aa, Mycobacterium
TDQIIPAVYLKRVTRTGFEDGL

SEQ ID NO: 865182 - protein, 19 aa, Mycobacterium
TDQILALKWVRDNISAFGG

SEQ ID NO: 865183 - protein, 25 aa, Mycobacterium
TDQLDALLWRAARPGEPSWPSPFGD

SEQ ID NO: 865184 - protein, 27 aa, Mycobacterium
TDQLRRVAHEVGFFYLVGHGVPQDLVD

SEQ ID NO: 865185 - protein, 17 aa, Mycobacterium
TDQPLVVLDLGGGSTDA

SEQ ID NO: 865186 - protein, 21 aa, Mycobacterium
TDQPWSLLTGPYLDALPDDPE

SEQ ID NO: 865187 - protein, 28 aa, Mycobacterium
TDRAFDLAARRRLPVVLFAEGGGGRPGD

SEQ ID NO: 865188 - protein, 25 aa, Mycobacterium
TDRARHWVHPLRAPRRLPGMLTGGG

SEQ ID NO: 865189 - protein, 22 aa, Mycobacterium
TDRDLRIRVVAAGLPVDVAVDR

SEQ ID NO: 865190 - protein, 30 aa, Mycobacterium
TDREFRAGHFPGLQWPLTLGHEIAGAVAEV

SEQ ID NO: 865191 - protein, 24 aa, Mycobacterium
TDREMLRPLRDLLTAPVTALGSSD

SEQ ID NO: 865192 - protein, 18 aa, Mycobacterium
TDRERRFHTLWSGDRTEV

SEQ ID NO: 865193 - protein, 19 aa, Mycobacterium
TDRERVFLLSTTHGPERGS

SEQ ID NO: 865194 - protein, 26 aa, Mycobacterium
TDRERWVFAHVPLAKKIYRTRLWLRS

SEQ ID NO: 865195 - protein, 25 aa, Mycobacterium
TDREWLLQATNYLQSLPATAGLVDE

SEQ ID NO: 865196 - protein, 18 aa, Mycobacterium
TDRFDLRALAACFCDEGV

SEQ ID NO: 865197 - protein, 28 aa, Mycobacterium
TDRFLAELMSVFADGPVVIGPTAATLGG

SEQ ID NO: 865198 - protein, 25 aa, Mycobacterium
TDRGFRGLSLRPFMIGRPASDPAYF

SEQ ID NO: 865199 - protein, 29 aa, Mycobacterium
TDRGIVNGVFPVASWPVTPGHEIAGTVAE

SEQ ID NO: 865200 - protein, 23 aa, Mycobacterium
TDRGLDIPVYFGNRNWEPYVEDT

SEQ ID NO: 865201 - protein, 27 aa, Mycobacterium
TDRGLFDALTAWFGRPAVPSPRLRASA

SEQ ID NO: 865202 - protein, 17 aa, Mycobacterium
TDRGVFNRLLRVEVPYH

SEQ ID NO: 865203 - protein, 31 aa, Mycobacterium
TDRILDFSTAITGGLFFAPAADFLDAPPSLP

SEQ ID NO: 865204 - protein, 24 aa, Mycobacterium
TDRILDFSTAITGGLFFSPTVDFL

SEQ ID NO: 865205 - protein, 24 aa, Mycobacterium
TDRILILDGLPNYQRLFSLRVGQT

SEQ ID NO: 865206 - protein, 31 aa, Mycobacterium
TDRIRLGTSILLAALRRPAVLAKQLATLDVL

SEQ ID NO: 865207 - protein, 19 aa, Mycobacterium
TDRIVAIKLLHPHFSDNEE

SEQ ID NO: 865208 - protein, 17 aa, Mycobacterium
TDRLGSKFTLLDWDCDH

SEQ ID NO: 865209 - protein, 24 aa, Mycobacterium
TDRLIPALSEAFEALFSYPGPTVA

SEQ ID NO: 865210 - protein, 24 aa, Mycobacterium
TDRLPVMTTPKWVHNRIQPIAVRD

SEQ ID NO: 865211 - protein, 18 aa, Mycobacterium
TDRLRRFHANLGRGLFGR

SEQ ID NO: 865212 - protein, 20 aa, Mycobacterium
TDRMAKMLRIAVDEVAEMQN

SEQ ID NO: 865213 - protein, 34 aa, Mycobacterium
TDRMMIRACPVTWPWNLLGWPSINVPAGFTSDGL

SEQ ID NO: 865214 - protein, 23 aa, Mycobacterium
TDRNRMIAEPYPRLLVARDQVNQ

SEQ ID NO: 865215 - protein, 20 aa, Mycobacterium
TDRPIWILLDSDENGRHARD

SEQ ID NO: 865216 - protein, 24 aa, Mycobacterium
TDRPSFIALRTIIGYPAPTKMNTG

SEQ ID NO: 865217 - protein, 25 aa, Mycobacterium
TDRQWRGIGMIPRSGWTLSPQYAEF

SEQ ID NO: 865218 - protein, 26 aa, Mycobacterium
TDRRGKYLWLTLNSPDSALVVHLGMS

SEQ ID NO: 865219 - protein, 27 aa, Mycobacterium
TDRRGKYLWLVLDGPGQPDTALVVHLG

SEQ ID NO: 865220 - protein, 25 aa, Mycobacterium
TDRRGLFTALAAQGFMLLAEALREA

SEQ ID NO: 865221 - protein, 21 aa, Mycobacterium
TDRRGLFTALATQGFQLLAAA

SEQ ID NO: 865222 - protein, 20 aa, Mycobacterium
TDRRIGWSDTWYKSTAGANP

SEQ ID NO: 865223 - protein, 23 aa, Mycobacterium
TDRRYPGFPIAEVAADGSSVITK

SEQ ID NO: 865224 - protein, 23 aa, Mycobacterium
TDRRYYSSWPVPVGDVALMAARA

SEQ ID NO: 865225 - protein, 24 aa, Mycobacterium
TDRSFAFLTIFNKNRPGGTIVADF

SEQ ID NO: 865226 - protein, 24 aa, Mycobacterium
TDRTRPLRAVGTCHGAGPTGSPGP

SEQ ID NO: 865227 - protein, 25 aa, Mycobacterium
TDRVALVWRAYLQEVLESADPQMPA

SEQ ID NO: 865228 - protein, 24 aa, Mycobacterium
TDRVLRAFFGLIQATLRTNYFVKK

SEQ ID NO: 865229 - protein, 25 aa, Mycobacterium
TDRWRSHGFDLDFSELVFLGERANV

SEQ ID NO: 865230 - protein, 26 aa, Mycobacterium
TDSEELVWLAFTRPDARSALARRKVW

SEQ ID NO: 865231 - protein, 22 aa, Mycobacterium
TDSEMFRRYWPADLHMIGKDII

SEQ ID NO: 865232 - protein, 22 aa, Mycobacterium
TDSETFRRYWPADLHMIGKDII

SEQ ID NO: 865233 - protein, 18 aa, Mycobacterium
TDSFVVKPMVFPGGTIGD

SEQ ID NO: 865234 - protein, 25 aa, Mycobacterium
TDSFYISIGGLPPHRGRMPLGHEPA

SEQ ID NO: 865235 - protein, 17 aa, Mycobacterium
TDSGYPRLVKRWKRGQS

SEQ ID NO: 865236 - protein, 19 aa, Mycobacterium
TDSKRRPWLVWVHGAGQGQ

SEQ ID NO: 865237 - protein, 26 aa, Mycobacterium
TDSLDLAVALVLLPTLPGLIRERRAA

SEQ ID NO: 865238 - protein, 24 aa, Mycobacterium
TDSLTHLFKAGGKRFRPLFTVLSA

SEQ ID NO: 865239 - protein, 28 aa, Mycobacterium
TDSMTALHLLPLADVLGTVPVLATDVLR

SEQ ID NO: 865240 - protein, 18 aa, Mycobacterium
TDSPARVRMHQRWPIVMV

SEQ ID NO: 865241 - protein, 25 aa, Mycobacterium
TDSPELLRALIHPSLRPKTLTPKRD

SEQ ID NO: 865242 - protein, 18 aa, Mycobacterium
TDSPIYLRSTALRSRREG

SEQ ID NO: 865243 - protein, 20 aa, Mycobacterium
TDSPVYRGFIGNLVFGGCAA

SEQ ID NO: 865244 - protein, 26 aa, Mycobacterium
TDSQDWWPADFGNYGPMFIRMAWHAA

SEQ ID NO: 865245 - protein, 24 aa, Mycobacterium
TDSRAIHRAAITNTPVLLREVLDT

SEQ ID NO: 865246 - protein, 24 aa, Mycobacterium
TDSRRKVRFLPYGIAVSVLDDSSG

SEQ ID NO: 865247 - protein, 24 aa, Mycobacterium
TDSSLRAEFGDRLPVVLLDGQEHS

SEQ ID NO: 865248 - protein, 26 aa, Mycobacterium
TDSTAPLPLFGELAARPARRVVDDAD

SEQ ID NO: 865249 - protein, 19 aa, Mycobacterium
TDSWVRRYPDVHVELVAAG

SEQ ID NO: 865250 - protein, 32 aa, Mycobacterium
TDSYGGGQLLDWLSRCIFPAEVKLADPAYAQR

SEQ ID NO: 865251 - protein, 23 aa, Mycobacterium
TDSYLTCLRILMAGRGYPMVASH

SEQ ID NO: 865252 - protein, 17 aa, Mycobacterium
TDSYRKLLLARGEHPGR

SEQ ID NO: 865253 - protein, 29 aa, Mycobacterium
TDTAGFNVPYYWWTLNMPTDHGEVELTNV

SEQ ID NO: 865254 - protein, 17 aa, Mycobacterium
TDTAKFADLLLPATMQA

SEQ ID NO: 865255 - protein, 22 aa, Mycobacterium
TDTELLDFNALAKIFGYPSTTE

SEQ ID NO: 865256 - protein, 23 aa, Mycobacterium
TDTELRIRCLEQLHAALVEHRDE

SEQ ID NO: 865257 - protein, 24 aa, Mycobacterium
TDTFELNRNLILTDGARADSVPNL

SEQ ID NO: 865258 - protein, 27 aa, Mycobacterium
TDTGSFRWASARALRLAARLVDAGVDN

SEQ ID NO: 865259 - protein, 26 aa, Mycobacterium
TDTGSFRWASARALRLAARLVDTGVD

SEQ ID NO: 865260 - protein, 25 aa, Mycobacterium
TDTHRVVLAVDPDIRYGARNAGYHG

SEQ ID NO: 865261 - protein, 20 aa, Mycobacterium
TDTKPPRWPTFGITVIPKLA

SEQ ID NO: 865262 - protein, 30 aa, Mycobacterium
TDTPGFDVPYYWWTFNMPTDHGEVELTDVR

SEQ ID NO: 865263 - protein, 24 aa, Mycobacterium
TDTPSYFYRGFDLNTGVWSAWERI

SEQ ID NO: 865264 - protein, 27 aa, Mycobacterium
TDTTILFETALPPRLYVRPSAVRTDLL

SEQ ID NO: 865265 - protein, 24 aa, Mycobacterium
TDTVGQVVLSWKVSNLQPSSDETP

SEQ ID NO: 865266 - protein, 17 aa, Mycobacterium
TDTVSVLLADNPGLMTL

SEQ ID NO: 865267 - protein, 21 aa, Mycobacterium
TDTYFDADWLASQGLDPSGPA

SEQ ID NO: 865268 - protein, 24 aa, Mycobacterium
TDVAILAYSAKFASAFYGPFREAV

SEQ ID NO: 865269 - protein, 20 aa, Mycobacterium
TDVALALHELAIPTIAKVTG

SEQ ID NO: 865270 - protein, 18 aa, Mycobacterium
TDVAPAVAFVAAGPALST

SEQ ID NO: 865271 - protein, 23 aa, Mycobacterium
TDVAVMLALAHVLAVEKLADLTF

SEQ ID NO: 865272 - protein, 26 aa, Mycobacterium
TDVDDMLWQVPYLPIDPRDVGRTYEA

SEQ ID NO: 865273 - protein, 23 aa, Mycobacterium
TDVDDWWEYGWVFHAMNTNKRSV

SEQ ID NO: 865274 - protein, 23 aa, Mycobacterium
TDVDGHHRGLANMLARCREHGGT

SEQ ID NO: 865275 - protein, 29 aa, Mycobacterium
TDVDVKLNLFLFTMLQKTLKGNIFGGGSS

SEQ ID NO: 865276 - protein, 25 aa, Mycobacterium
TDVEAQRIWFDNPLTRGRSAATIYL

SEQ ID NO: 865277 - protein, 27 aa, Mycobacterium
TDVEDMLWQVPYLPIDPKDVGRTYEAV

SEQ ID NO: 865278 - protein, 27 aa, Mycobacterium
TDVEYLGSQPWPFPRSLMVGFHAVGDP

SEQ ID NO: 865279 - protein, 21 aa, Mycobacterium
TDVGALVAFLLSTDASFITAQ

SEQ ID NO: 865280 - protein, 17 aa, Mycobacterium
TDVILYHLGLGAGVPHT

SEQ ID NO: 865281 - protein, 25 aa, Mycobacterium
TDVIVHRGIALTSFYQCGDLYRLDP

SEQ ID NO: 865282 - protein, 24 aa, Mycobacterium
TDVIVHRGIALTSFYQCGDLYRVD

SEQ ID NO: 865283 - protein, 18 aa, Mycobacterium
TDVKRTFPKPINISSQVL

SEQ ID NO: 865284 - protein, 26 aa, Mycobacterium
TDVLPRRPRFALLKGRGNYLCLNKVH

SEQ ID NO: 865285 - protein, 17 aa, Mycobacterium
TDVLTRLRGMFAFALWD

SEQ ID NO: 865286 - protein, 37 aa, Mycobacterium
TDVMVSWLPLFHDMGMIGFLTVPMYFGGELVKVTPMD

SEQ ID NO: 865287 - protein, 27 aa, Mycobacterium
TDVNAWLDGLEYGVRPALRALGELLIG

SEQ ID NO: 865288 - protein, 18 aa, Mycobacterium
TDVNRPYFAAAARGVLVF

SEQ ID NO: 865289 - protein, 18 aa, Mycobacterium
TDVPALTVSLRGLADCVV

SEQ ID NO: 865290 - protein, 32 aa, Mycobacterium
TDVPDVVLLDDIWWFHFALSGVITPLEDLFDE

SEQ ID NO: 865291 - protein, 30 aa, Mycobacterium
TDVQYLGSQPWPFPRSIMLGFHAIGDPSQP

SEQ ID NO: 865292 - protein, 26 aa, Mycobacterium
TDVQYLGSQPWPFPRSLMVGFHAIGD

SEQ ID NO: 865293 - protein, 29 aa, Mycobacterium
TDVTHLVEMLVAVVWGMGFYAGFVGDRSD

SEQ ID NO: 865294 - protein, 26 aa, Mycobacterium
TDVTLNLAGLTLLQKSLRGSLFGGGN

SEQ ID NO: 865295 - protein, 22 aa, Mycobacterium
TDVTVIRQLSWMLERIDPATCR

SEQ ID NO: 865296 - protein, 25 aa, Mycobacterium
TDVVRTRLYVTDISRWREVGAVHEE

SEQ ID NO: 865297 - protein, 26 aa, Mycobacterium
TDVVRTRVYVTDISRWREVAAVHAEF

SEQ ID NO: 865298 - protein, 18 aa, Mycobacterium
TDVVSPHPLITMLVAHQL

SEQ ID NO: 865299 - protein, 21 aa, Mycobacterium
TDVVVWYTFGIHHITRPEDWP

SEQ ID NO: 865300 - protein, 29 aa, Mycobacterium
TDWGATSAAFRNLLNDWKAAGRAPRETDD

SEQ ID NO: 865301 - protein, 24 aa, Mycobacterium
TDWGPTSGLFRDLLTEWKNAGRAS

SEQ ID NO: 865302 - protein, 17 aa, Mycobacterium
TDWHWYTTVVGSNCREI

SEQ ID NO: 865303 - protein, 18 aa, Mycobacterium
TDWLTAHPGLAVLVDQGI

SEQ ID NO: 865304 - protein, 17 aa, Mycobacterium
TDWMFGIEHVRFVNDVP

SEQ ID NO: 865305 - protein, 23 aa, Mycobacterium
TDWRQIVTLYDQLMRFTPTTVVA

SEQ ID NO: 865306 - protein, 20 aa, Mycobacterium
TDWTATSAEFRKLLTEWKAA

SEQ ID NO: 865307 - protein, 29 aa, Mycobacterium
TDWTATSAEFRKLLTEWKAAGRASKDVDD

SEQ ID NO: 865308 - protein, 17 aa, Mycobacterium
TDWVAICSAYDRLWQLT

SEQ ID NO: 865309 - protein, 25 aa, Mycobacterium
TDYAALLRLHRVERVRMVATSATRD

SEQ ID NO: 865310 - protein, 20 aa, Mycobacterium
TDYALFWSLSFAVKVPTWQR

SEQ ID NO: 865311 - protein, 19 aa, Mycobacterium
TDYDTADRLYFEPLTFEDV

SEQ ID NO: 865312 - protein, 23 aa, Mycobacterium
TDYFDDSRPRKLRPGDSLLVDTK

SEQ ID NO: 865313 - protein, 22 aa, Mycobacterium
TDYGALALPDCGVRHLWPQPAQ

SEQ ID NO: 865314 - protein, 17 aa, Mycobacterium
TDYGINPLVLGALTPRI

SEQ ID NO: 865315 - protein, 19 aa, Mycobacterium
TDYLILEMSARHPGNIAAL

SEQ ID NO: 865316 - protein, 21 aa, Mycobacterium
TDYLILEMSARHPGNIAALAQ

SEQ ID NO: 865317 - protein, 23 aa, Mycobacterium
TDYPFAIAERPAGAALLGAGLPD

SEQ ID NO: 865318 - protein, 17 aa, Mycobacterium
TDYQGMQGVFIQAVYYP

SEQ ID NO: 865319 - protein, 17 aa, Mycobacterium
TDYQGMQSMFIQAVYYP

SEQ ID NO: 865320 - protein, 24 aa, Mycobacterium
TDYRALLEFFFQIHDPTTKNRQGN

SEQ ID NO: 865321 - protein, 19 aa, Mycobacterium
TDYRTFFICEGVTQYLSEA

SEQ ID NO: 865322 - protein, 24 aa, Mycobacterium
TDYVEVLRRLWDSWEDDAEIRDVS

SEQ ID NO: 865323 - protein, 24 aa, Mycobacterium
TEAAGLMYALFIDNIDAVMFMVEF

SEQ ID NO: 865324 - protein, 30 aa, Mycobacterium
TEAALLAPRQSLTGTPLPPALPATAVAQSR

SEQ ID NO: 865325 - protein, 18 aa, Mycobacterium
TEAARLGLLGFSVPERFG

SEQ ID NO: 865326 - protein, 25 aa, Mycobacterium
TEAASWARRFVDGPPLALAAAKEAI

SEQ ID NO: 865327 - protein, 31 aa, Mycobacterium
TEAAVRHLIPALEVLHEALASKAREWNTVVK

SEQ ID NO: 865328 - protein, 23 aa, Mycobacterium
TEAAVRHLIPALEVLHESLDAKA

SEQ ID NO: 865329 - protein, 31 aa, Mycobacterium
TEADGHRPRLAFPTPLRRAVFHPRPHTDSSE

SEQ ID NO: 865330 - protein, 22 aa, Mycobacterium
TEAEVRLRRAWDIVNAERDPET

SEQ ID NO: 865331 - protein, 19 aa, Mycobacterium
TEAEYEAMWAADVAAMVGY

SEQ ID NO: 865332 - protein, 31 aa, Mycobacterium
TEAFRKTFGENFFYILYFQQPGVADAELNGD

SEQ ID NO: 865333 - protein, 33 aa, Mycobacterium
TEAGAADRLVMLGLPFLFFIHADYGCAGVLYHR

SEQ ID NO: 865334 - protein, 19 aa, Mycobacterium
TEAKRRGVALTRVIDWMAA

SEQ ID NO: 865335 - protein, 23 aa, Mycobacterium
TEAKRTFPKPIPLSTEVLLDRER

SEQ ID NO: 865336 - protein, 26 aa, Mycobacterium
TEALDGFRFWSVQGLQRSLPVLREDL

SEQ ID NO: 865337 - protein, 18 aa, Mycobacterium
TEALKWLLANAGRLRNER

SEQ ID NO: 865338 - protein, 18 aa, Mycobacterium
TEALLKRIESAAASVDRV

SEQ ID NO: 865339 - protein, 25 aa, Mycobacterium
TEAMDAFRLLCRTEGIIPAIESAHA

SEQ ID NO: 865340 - protein, 39 aa, Mycobacterium
TEAMLHSDYPLQALLYVVVLHRFLRWRQPGYDPRRHLGG

SEQ ID NO: 865341 - protein, 24 aa, Mycobacterium
TEANIVNFRRQLGRLGLGHDTRRS

SEQ ID NO: 865342 - protein, 23 aa, Mycobacterium
TEANYYRPLIEHPKVMRVVALSG

SEQ ID NO: 865343 - protein, 20 aa, Mycobacterium
TEAPARLLFERSLGMLDTTV

SEQ ID NO: 865344 - protein, 22 aa, Mycobacterium
TEARILGIFVDGRRVPVVSHVQ

SEQ ID NO: 865345 - protein, 23 aa, Mycobacterium
TEARLIAWRPSELGKTPPGHLWR

SEQ ID NO: 865346 - protein, 31 aa, Mycobacterium
TEASIVERLVPDFLWISTEHTARVSLDALDR

SEQ ID NO: 865347 - protein, 25 aa, Mycobacterium
TEASLPYFRQFLGREVMRHAPAVAP

SEQ ID NO: 865348 - protein, 25 aa, Mycobacterium
TEATAFIYIGEICRYLLNQPAKSTD

SEQ ID NO: 865349 - protein, 22 aa, Mycobacterium
TEATGILVALRALVDVPGMVDP

SEQ ID NO: 865350 - protein, 28 aa, Mycobacterium
TEATGLKRRLALWAIDTGVRAASQMLAG

SEQ ID NO: 865351 - protein, 24 aa, Mycobacterium
TEATRIVTWFRHGPTPKVIANHRG

SEQ ID NO: 865352 - protein, 22 aa, Mycobacterium
TEATRIVTWFRHGPTPKVTANH

SEQ ID NO: 865353 - protein, 23 aa, Mycobacterium
TEATRIVTWFRHGPTPKVTANHR

SEQ ID NO: 865354 - protein, 27 aa, Mycobacterium
TEATTQVLVDLLWGLAVDAGFYSDQHR

SEQ ID NO: 865355 - protein, 19 aa, Mycobacterium
TEATVPWLVSARSRAALAG

SEQ ID NO: 865356 - protein, 24 aa, Mycobacterium
TEAVAEIIELVEKLLASGAAYVLD

SEQ ID NO: 865357 - protein, 27 aa, Mycobacterium
TEAVDPLLPEVAWSWLVDALEQRAEHV

SEQ ID NO: 865358 - protein, 31 aa, Mycobacterium
TEAVDPLLPEVAWSWLVDALESRMEQVTALG

SEQ ID NO: 865359 - protein, 22 aa, Mycobacterium
TEAVLMQRWDPDAAVGLMLEHR

SEQ ID NO: 865360 - protein, 24 aa, Mycobacterium
TEAVSAMQERLPFFADLEASQRAS

SEQ ID NO: 865361 - protein, 24 aa, Mycobacterium
TEAVSVMQDRLPFFADLEASQRAS

SEQ ID NO: 865362 - protein, 23 aa, Mycobacterium
TEAVSVMQERLPFFADLEASQRA

SEQ ID NO: 865363 - protein, 24 aa, Mycobacterium
TEAYRLLMEVLGTAATLRTNSPGA

SEQ ID NO: 865364 - protein, 25 aa, Mycobacterium
TEAYRLLMEVLGTSATLRGDTRGAL

SEQ ID NO: 865365 - protein, 18 aa, Mycobacterium
TECLPLADHIACRFAGRG

SEQ ID NO: 865366 - protein, 25 aa, Mycobacterium
TEDAEFGGYMFPAGTFILVNTFVAN

SEQ ID NO: 865367 - protein, 17 aa, Mycobacterium
TEDAGMRVLLALSADGS

SEQ ID NO: 865368 - protein, 24 aa, Mycobacterium
TEDGYLGVFTRTHGWRWLRVRLAE

SEQ ID NO: 865369 - protein, 23 aa, Mycobacterium
TEDHPIEYLAFHGSIPKGEYGAG

SEQ ID NO: 865370 - protein, 22 aa, Mycobacterium
TEDIRLTARRWHTQSAALGVDP

SEQ ID NO: 865371 - protein, 19 aa, Mycobacterium
TEDPHLWARTLFDELEELG

SEQ ID NO: 865372 - protein, 26 aa, Mycobacterium
TEDQEVWRYFASVAFPSEPLVRNVLA

SEQ ID NO: 865373 - protein, 25 aa, Mycobacterium
TEDQKNWFLPRILSGDDRWCQGFSE

SEQ ID NO: 865374 - protein, 17 aa, Mycobacterium
TEDQWWEKSPIFAALNS

SEQ ID NO: 865375 - protein, 21 aa, Mycobacterium
TEDSWLRQLTMAGARDRYGPN

SEQ ID NO: 865376 - protein, 23 aa, Mycobacterium
TEDSWLRQLVMAGARHRYGPPDG

SEQ ID NO: 865377 - protein, 19 aa, Mycobacterium
TEDSWLRSLVMSGARERYG

SEQ ID NO: 865378 - protein, 24 aa, Mycobacterium
TEDVAGILGVDVHRGQRTGSEHHR

SEQ ID NO: 865379 - protein, 24 aa, Mycobacterium
TEDVQTVLRWACAHGVPVVTRGAG

SEQ ID NO: 865380 - protein, 26 aa, Mycobacterium
TEDWQGVSVLYVCPLRALLNNLQPRI

SEQ ID NO: 865381 - protein, 24 aa, Mycobacterium
TEDYWSLRPRGSQLGAWASHQSQP

SEQ ID NO: 865382 - protein, 24 aa, Mycobacterium
TEEALIWMLAWLREDERDEAIRIL

SEQ ID NO: 865383 - protein, 18 aa, Mycobacterium
TEEDGPVYQHRRWYHQFY

SEQ ID NO: 865384 - protein, 23 aa, Mycobacterium
TEEIKAEVLERLADTYEGREKEI

SEQ ID NO: 865385 - protein, 22 aa, Mycobacterium
TEEKLGVTFPAAFRAKMMADNG

SEQ ID NO: 865386 - protein, 19 aa, Mycobacterium
TEELFGPVLAVRRAADTEE

SEQ ID NO: 865387 - protein, 18 aa, Mycobacterium
TEEMIRWVTPVKAFMRTA

SEQ ID NO: 865388 - protein, 25 aa, Mycobacterium
TEEMPVKVPWSLPSARPAYDGEDAP

SEQ ID NO: 865389 - protein, 26 aa, Mycobacterium
TEEQRKQWLEPLLAGEIRSAFSMTEP

SEQ ID NO: 865390 - protein, 26 aa, Mycobacterium
TEEQRKQWLEPLLGGEIRSAFSMTEP

SEQ ID NO: 865391 - protein, 26 aa, Mycobacterium
TEEQRTQWLEPLLAGEIRSAFAMTEP

SEQ ID NO: 865392 - protein, 22 aa, Mycobacterium
TEEQWWEKSPIFEALNTNKKGL

SEQ ID NO: 865393 - protein, 24 aa, Mycobacterium
TEERLRPHIRREGFGLIYETPTDE

SEQ ID NO: 865394 - protein, 27 aa, Mycobacterium
TEERRQFDWIVDLLIKLGREADAYDAC

SEQ ID NO: 865395 - protein, 26 aa, Mycobacterium
TEESYLALLDALRWLGLDWDEGPEVG

SEQ ID NO: 865396 - protein, 23 aa, Mycobacterium
TEEVQAVMRWASANKVPVVPRGA

SEQ ID NO: 865397 - protein, 40 aa, Mycobacterium
TEFARRRWGGLLAPPALLMGWLIPPPWEPQGRPPVASLVL

SEQ ID NO: 865398 - protein, 20 aa, Mycobacterium
TEFAVAWRLGREAILFVGER

SEQ ID NO: 865399 - protein, 17 aa, Mycobacterium
TEFAVIIEPTRSDLGAS

SEQ ID NO: 865400 - protein, 24 aa, Mycobacterium
TEFELLRFLMRNPRRALSRSEILD

SEQ ID NO: 865401 - protein, 24 aa, Mycobacterium
TEFELLRFLMRNPRRALSRTEILD

SEQ ID NO: 865402 - protein, 27 aa, Mycobacterium
TEFKRKPHWLPAHFSADGSTRIPGTHV

SEQ ID NO: 865403 - protein, 18 aa, Mycobacterium
TEFLAFNSSIFSEQVWFL

SEQ ID NO: 865404 - protein, 19 aa, Mycobacterium
TEFPYVFCDATFCKARIGA

SEQ ID NO: 865405 - protein, 20 aa, Mycobacterium
TEFSLLPRFGPGKALVVIPR

SEQ ID NO: 865406 - protein, 26 aa, Mycobacterium
TEFVVSPLKWMQILTERRATITAAPN

SEQ ID NO: 865407 - protein, 23 aa, Mycobacterium
TEGDNVFVALSWSKHPVPQTYAE

SEQ ID NO: 865408 - protein, 33 aa, Mycobacterium
TEGFRPATLHQAYLALQAWGLPVSQHTTLVADL

SEQ ID NO: 865409 - protein, 31 aa, Mycobacterium
TEGITNYDPIWPLHGIRIIPGPSSLWLDANG

SEQ ID NO: 865410 - protein, 30 aa, Mycobacterium
TEGKVRRLRRLAGLWLAGQDRGWAAVRLDV

SEQ ID NO: 865411 - protein, 21 aa, Mycobacterium
TEGLLALAWPKEHGGGGGSVW

SEQ ID NO: 865412 - protein, 24 aa, Mycobacterium
TEGLLKQLFPAAELTRILGMPVDD

SEQ ID NO: 865413 - protein, 24 aa, Mycobacterium
TEGLNWHWETFPEYLDALAARRLD

SEQ ID NO: 865414 - protein, 26 aa, Mycobacterium
TEGLRKLFRQFSFPGGIPSHVAAQTP

SEQ ID NO: 865415 - protein, 24 aa, Mycobacterium
TEGLRLELDPSIRVTTISPGVVES

SEQ ID NO: 865416 - protein, 20 aa, Mycobacterium
TEGMFVNPRLPAGTAYVCQA

SEQ ID NO: 865417 - protein, 23 aa, Mycobacterium
TEGMLGWKRSFQVGSYIATVLPS

SEQ ID NO: 865418 - protein, 26 aa, Mycobacterium
TEGPANPLILVFGRVSELSTCSWSTH

SEQ ID NO: 865419 - protein, 23 aa, Mycobacterium
TEGPVVGTLWRAIPEVLSRAEVT

SEQ ID NO: 865420 - protein, 21 aa, Mycobacterium
TEGPWKLIIAQHFASADELMA

SEQ ID NO: 865421 - protein, 27 aa, Mycobacterium
TEGRPRLRYWLDRLSTDGILAHAAVVY

SEQ ID NO: 865422 - protein, 30 aa, Mycobacterium
TEGRTAWEWLVHLYEKWAAGLDFAVPSFAE

SEQ ID NO: 865423 - protein, 25 aa, Mycobacterium
TEGSARAWLFTVAHNLVRDNARSSR

SEQ ID NO: 865424 - protein, 23 aa, Mycobacterium
TEGTLRHKLFGRGPRLPETHRAA

SEQ ID NO: 865425 - protein, 27 aa, Mycobacterium
TEGYAPKGIFPWYAPGRDDFLGEFPLS

SEQ ID NO: 865426 - protein, 34 aa, Mycobacterium
TEHGGVLLITHYTRILRYIHPQHVHVFVGGRIVE

SEQ ID NO: 865427 - protein, 19 aa, Mycobacterium
TEHLAAEPILALSRLTATL

SEQ ID NO: 865428 - protein, 24 aa, Mycobacterium
TEHLAVLGNPTWYARFAAQAMTDP

SEQ ID NO: 865429 - protein, 18 aa, Mycobacterium
TEHLIEAATYWSKTADQW

SEQ ID NO: 865430 - protein, 24 aa, Mycobacterium
TEHLLFRHFGSKAALFREALVLPF

SEQ ID NO: 865431 - protein, 25 aa, Mycobacterium
TEHLLFRHFGSKAALFREALVLPFT

SEQ ID NO: 865432 - protein, 19 aa, Mycobacterium
TEHLTNAADYWSSTGNRWY

SEQ ID NO: 865433 - protein, 33 aa, Mycobacterium
TEHSLRVYLDYYQTLLTLFLRIPTESGKTVLDN

SEQ ID NO: 865434 - protein, 25 aa, Mycobacterium
TEIADQLARRRLGYGRGARMAFERD

SEQ ID NO: 865435 - protein, 25 aa, Mycobacterium
TEIADQLARRRLGYGRGARMTFERD

SEQ ID NO: 865436 - protein, 17 aa, Mycobacterium
TEIDGLDLHFIHQRSPH

SEQ ID NO: 865437 - protein, 24 aa, Mycobacterium
TEIDVPGVLSVRVVPGTPAAETQA

SEQ ID NO: 865438 - protein, 17 aa, Mycobacterium
TEIGGRRYRHPLCLSVH

SEQ ID NO: 865439 - protein, 24 aa, Mycobacterium
TEIGRLVPFVEWLRDAYPEQVISV

SEQ ID NO: 865440 - protein, 23 aa, Mycobacterium
TEIPLRAWLFRTAGDEHVLVSVL

SEQ ID NO: 865441 - protein, 18 aa, Mycobacterium
TEIPSLTVSLRGLADCVV

SEQ ID NO: 865442 - protein, 32 aa, Mycobacterium
TEIRYPLNLIHLATVMWFDGPALGNELAIMQR

SEQ ID NO: 865443 - protein, 23 aa, Mycobacterium
TEISRLSLFLTTPAARHITGQTL

SEQ ID NO: 865444 - protein, 26 aa, Mycobacterium
TEIVSRYYNLVLADCGAGLFQPGARG

SEQ ID NO: 865445 - protein, 18 aa, Mycobacterium
TEKFIIPASIVDEVLEVC

SEQ ID NO: 865446 - protein, 22 aa, Mycobacterium
TEKINEPRFPSFKGIMAAKKKE

SEQ ID NO: 865447 - protein, 24 aa, Mycobacterium
TEKVRIPLLPGRRSLNLSNAAAIA

SEQ ID NO: 865448 - protein, 21 aa, Mycobacterium
TEKWDLYVRKFELATGYSELI

SEQ ID NO: 865449 - protein, 25 aa, Mycobacterium
TELAGLARYPLPMAPAAAAQQAGMA

SEQ ID NO: 865450 - protein, 27 aa, Mycobacterium
TELAKELRPWVPVVSLVKGLEQGTNYR

SEQ ID NO: 865451 - protein, 21 aa, Mycobacterium
TELAQIQRRLGITSVYVTHDQ

SEQ ID NO: 865452 - protein, 33 aa, Mycobacterium
TELARHLPRIVRPLSNILGPVLFQSAEMGALPT

SEQ ID NO: 865453 - protein, 26 aa, Mycobacterium
TELDQTIAAIPWLRASMAHLIALNDG

SEQ ID NO: 865454 - protein, 27 aa, Mycobacterium
TELDRIFEIYPTLAGALRPGKPGEHDL

SEQ ID NO: 865455 - protein, 28 aa, Mycobacterium
TELDRLLDGVYLDLVPIVLEADGPAYGP

SEQ ID NO: 865456 - protein, 39 aa, Mycobacterium
TELEPDFDRAFKELAKQVRLPGFRPGKAPRKLLEARIGR

SEQ ID NO: 865457 - protein, 22 aa, Mycobacterium
TELFPLLLSVMSTGVTFVRSEE

SEQ ID NO: 865458 - protein, 28 aa, Mycobacterium
TELFSRPGVHFISGFYGPLERALRDAGA

SEQ ID NO: 865459 - protein, 18 aa, Mycobacterium
TELGLPWTMTYTGRSRES

SEQ ID NO: 865460 - protein, 25 aa, Mycobacterium
TELGRTLLPLVISLAQWAMAHHEEI

SEQ ID NO: 865461 - protein, 18 aa, Mycobacterium
TELGTISTLPLGWSNPWD

SEQ ID NO: 865462 - protein, 19 aa, Mycobacterium
TELGWLEMLGEMPGVAVPL

SEQ ID NO: 865463 - protein, 17 aa, Mycobacterium
TELGYQPKWTTIGAFGD

SEQ ID NO: 865464 - protein, 17 aa, Mycobacterium
TELIRRSNERDDVAVVY

SEQ ID NO: 865465 - protein, 25 aa, Mycobacterium
TELKFPGRLVVGLAVSRLGTSSVTY

SEQ ID NO: 865466 - protein, 17 aa, Mycobacterium
TELLAVFDVYRSRFGKL

SEQ ID NO: 865467 - protein, 17 aa, Mycobacterium
TELLAVFGNYRGPAGPI

SEQ ID NO: 865468 - protein, 17 aa, Mycobacterium
TELLYRYAELVDAGDFD

SEQ ID NO: 865469 - protein, 20 aa, Mycobacterium
TELMRWVHPGLVASTQGTGM

SEQ ID NO: 865470 - protein, 19 aa, Mycobacterium
TELPDRLGVLTPAAAMGDP

SEQ ID NO: 865471 - protein, 18 aa, Mycobacterium
TELPLLVVDVQRGGPSTG

SEQ ID NO: 865472 - protein, 41 aa, Mycobacterium
TELPYIAELLDLRPGQTRWRLAVEKVLRGVGLRLLVPDQHW

SEQ ID NO: 865473 - protein, 30 aa, Mycobacterium
TELREFAARFIAHSPFFCMATVGADGLLDT

SEQ ID NO: 865474 - protein, 21 aa, Mycobacterium
TELRELCDVLIRAARAADGWR

SEQ ID NO: 865475 - protein, 20 aa, Mycobacterium
TELRKLLRGDAREPVIPFAQ

SEQ ID NO: 865476 - protein, 17 aa, Mycobacterium
TELRRQLKPLGRQAEVA

SEQ ID NO: 865477 - protein, 23 aa, Mycobacterium
TELRVRCVRQLRDAMREHIEELR

SEQ ID NO: 865478 - protein, 24 aa, Mycobacterium
TELSCHQIALPQPILRNRELAKLI

SEQ ID NO: 865479 - protein, 26 aa, Mycobacterium
TELSKELRPWVPVVSLVKGLEQGTNM

SEQ ID NO: 865480 - protein, 19 aa, Mycobacterium
TELSWLDQIPTGKPLLFLA

SEQ ID NO: 865481 - protein, 28 aa, Mycobacterium
TELTRHYLRLHFSAPALLAERRLQPTMC

SEQ ID NO: 865482 - protein, 28 aa, Mycobacterium
TELTRNLPAIFRPAAAALGPVLFQSAAM

SEQ ID NO: 865483 - protein, 23 aa, Mycobacterium
TELVRVLRSSLVASGLPADTVQL

SEQ ID NO: 865484 - protein, 17 aa, Mycobacterium
TELWAEAGKLGFIGVNL

SEQ ID NO: 865485 - protein, 17 aa, Mycobacterium
TELWSWVTRYRTELTVR

SEQ ID NO: 865486 - protein, 22 aa, Mycobacterium
TELYETIRGSLLPGLRIGLLHG

SEQ ID NO: 865487 - protein, 24 aa, Mycobacterium
TEMIETWIEMAWQDGSFGWVGIAN

SEQ ID NO: 865488 - protein, 17 aa, Mycobacterium
TEMLTAGKLTPLPYTRF

SEQ ID NO: 865489 - protein, 26 aa, Mycobacterium
TEMTPPALMKAILKAPADLLWNGGIG

SEQ ID NO: 865490 - protein, 24 aa, Mycobacterium
TENAYFAESFVKRGLVVDGGGCYL

SEQ ID NO: 865491 - protein, 24 aa, Mycobacterium
TENDFVLLPDIKAQLSLGTAQIAA

SEQ ID NO: 865492 - protein, 23 aa, Mycobacterium
TENLRRIEPLLQTLRDVAADVDA

SEQ ID NO: 865493 - protein, 24 aa, Mycobacterium
TENLRRVEPLLQLLRDVATQLGAK

SEQ ID NO: 865494 - protein, 17 aa, Mycobacterium
TENLRRVEPLLQTLRDV

SEQ ID NO: 865495 - protein, 36 aa, Mycobacterium
TENPSFAVVAPLLSRSLILQLRPLTSDDIRIVVQRA

SEQ ID NO: 865496 - protein, 21 aa, Mycobacterium
TENSWLRHLVMQGARERYGPP

SEQ ID NO: 865497 - protein, 29 aa, Mycobacterium
TENTRALDLLTRWGDALAAPPVQPLDSPS

SEQ ID NO: 865498 - protein, 26 aa, Mycobacterium
TENYAILNDFPLFWDPQLLEHDVHLP

SEQ ID NO: 865499 - protein, 28 aa, Mycobacterium
TENYAILNDFPLFWDPQLLEHNLHLPRF

SEQ ID NO: 865500 - protein, 26 aa, Mycobacterium
TENYAILNDFPLFWDPRLLEHNVHLP

SEQ ID NO: 865501 - protein, 23 aa, Mycobacterium
TEPAELLAVFLLDAGDGPRTTDD

SEQ ID NO: 865502 - protein, 27 aa, Mycobacterium
TEPDAVTLVAYLSLRFAPAAVRVAAPP

SEQ ID NO: 865503 - protein, 19 aa, Mycobacterium
TEPDWLVWKHGCPGGESVE

SEQ ID NO: 865504 - protein, 22 aa, Mycobacterium
TEPEFPHFDLAPGTVFKTQKVS

SEQ ID NO: 865505 - protein, 25 aa, Mycobacterium
TEPEILRTNLAAVLLQMAALQIGDI

SEQ ID NO: 865506 - protein, 30 aa, Mycobacterium
TEPELDQLIGFFINILVLRNNLDGNPSLRE

SEQ ID NO: 865507 - protein, 32 aa, Mycobacterium
TEPEPPYKWIPIMIDPPDHAKWRHVLAEYFSP

SEQ ID NO: 865508 - protein, 26 aa, Mycobacterium
TEPGDYIFVPPYLPHREENPDPTMPA

SEQ ID NO: 865509 - protein, 25 aa, Mycobacterium
TEPGDYVFIPPYLPHREENPDPDTA

SEQ ID NO: 865510 - protein, 24 aa, Mycobacterium
TEPGHQLALTALALDPVVDLRMRL

SEQ ID NO: 865511 - protein, 23 aa, Mycobacterium
TEPGILRTPWYTVISGTGDTPVG

SEQ ID NO: 865512 - protein, 24 aa, Mycobacterium
TEPKARALRPYAEKLITHAKKGAL

SEQ ID NO: 865513 - protein, 19 aa, Mycobacterium
TEPLLLRGLDLSAGTRVAA

SEQ ID NO: 865514 - protein, 22 aa, Mycobacterium
TEPLLVVENLRKSYRSRGRRDR

SEQ ID NO: 865515 - protein, 17 aa, Mycobacterium
TEPLRVFAQLSLDGDEA

SEQ ID NO: 865516 - protein, 25 aa, Mycobacterium
TEPLSPVPALAYPVIVAETGTASRQ

SEQ ID NO: 865517 - protein, 17 aa, Mycobacterium
TEPMLFEWTDRDTLLYA

SEQ ID NO: 865518 - protein, 17 aa, Mycobacterium
TEPPPPTTAPPAAPLIP

SEQ ID NO: 865519 - protein, 18 aa, Mycobacterium
TEPQRLPILCGLDLTRKV

SEQ ID NO: 865520 - protein, 36 aa, Mycobacterium
TEPRDFLGARFDAGLAWVHFPVGFGGLDLPHTYQAQ

SEQ ID NO: 865521 - protein, 32 aa, Mycobacterium
TEPRITPFVLTMRLMLIALRHNEILNSTWADS

SEQ ID NO: 865522 - protein, 23 aa, Mycobacterium
TEPRKIFDLLEHAPIDVAVVTSA

SEQ ID NO: 865523 - protein, 23 aa, Mycobacterium
TEPRLPTDPSLKPAAAGGGSSGG

SEQ ID NO: 865524 - protein, 18 aa, Mycobacterium
TEPSRPLTVPLVRDGGVV

SEQ ID NO: 865525 - protein, 30 aa, Mycobacterium
TEPTPIMHNVALIYAWWSSADAVHYLHQSR

SEQ ID NO: 865526 - protein, 23 aa, Mycobacterium
TEPVHFVQMWIVPDEAGIAPGYQ

SEQ ID NO: 865527 - protein, 23 aa, Mycobacterium
TEPVRVQWLGRIDYQAAWDLQRE

SEQ ID NO: 865528 - protein, 32 aa, Mycobacterium
TEPWRGEPLLEYLRKMVFWSDVAPAAADMAVL

SEQ ID NO: 865529 - protein, 29 aa, Mycobacterium
TEPWRGEPLLNYLRKMVFWAEVTPDTADL

SEQ ID NO: 865530 - protein, 51 aa, Mycobacterium
TEPWYVVTFGGGATPTPTSLGAAAVDLSGTSCGLICNGQDGTGQNGGILFG

SEQ ID NO: 865531 - protein, 25 aa, Mycobacterium
TEQALAAVALLLNGGGLGNIQDITD

SEQ ID NO: 865532 - protein, 17 aa, Mycobacterium
TEQAVLLVLMAESRPVP

SEQ ID NO: 865533 - protein, 24 aa, Mycobacterium
TEQEWLVHWPSGSAGADVAPEPVV

SEQ ID NO: 865534 - protein, 24 aa, Mycobacterium
TEQHLWAILSVFAGSFDLPAARHV

SEQ ID NO: 865535 - protein, 24 aa, Mycobacterium
TEQIGKVVIAYEPVWAIGTGRVAS

SEQ ID NO: 865536 - protein, 26 aa, Mycobacterium
TEQLAAPQRFWVTKPFFDMGDVEIRK

SEQ ID NO: 865537 - protein, 25 aa, Mycobacterium
TEQLDFLRLAVLDALLVLLADTEPV

SEQ ID NO: 865538 - protein, 18 aa, Mycobacterium
TEQMIAVVVRGTMPASPI

SEQ ID NO: 865539 - protein, 18 aa, Mycobacterium
TEQPALTVSLRGLADCVV

SEQ ID NO: 865540 - protein, 31 aa, Mycobacterium
TEQPLPDELPAAALWWRLAAELTPAAALDTP

SEQ ID NO: 865541 - protein, 36 aa, Mycobacterium
TEQPMPSRLLFAEPLRRRMRVRFAERWIADSEDVLL

SEQ ID NO: 865542 - protein, 27 aa, Mycobacterium
TEQQLYSQTLRAQWTLFSAHNQGRTAD

SEQ ID NO: 865543 - protein, 23 aa, Mycobacterium
TEQRIYLLNAWAEAGDIYTDREK

SEQ ID NO: 865544 - protein, 18 aa, Mycobacterium
TEQRLALIAAWEEAGDLF

SEQ ID NO: 865545 - protein, 22 aa, Mycobacterium
TEQWNQIIAVNLTGTFLVVREA

SEQ ID NO: 865546 - protein, 23 aa, Mycobacterium
TERAELVRWLFEQGITAEEIRAT

SEQ ID NO: 865547 - protein, 18 aa, Mycobacterium
TERALMVHRRGHPLRYVF

SEQ ID NO: 865548 - protein, 26 aa, Mycobacterium
TERFTMLRPLLFTIAYEILGSVTEAD

SEQ ID NO: 865549 - protein, 19 aa, Mycobacterium
TERHLAMLTTLRSDGSPHV

SEQ ID NO: 865550 - protein, 33 aa, Mycobacterium
TERIDLLIREKVKVASFALAPKQDLIAKLKDNG

SEQ ID NO: 865551 - protein, 22 aa, Mycobacterium
TERIMFTHIAVPVMTRLKQPER

SEQ ID NO: 865552 - protein, 34 aa, Mycobacterium
TERKAIAACPLTWAWNLLGWPSINVPAGFTSDGL

SEQ ID NO: 865553 - protein, 30 aa, Mycobacterium
TERKVRRLRRLAALWLAGQDTRWAALRIDV

SEQ ID NO: 865554 - protein, 19 aa, Mycobacterium
TERLLRDRLGQLRPDDAIL

SEQ ID NO: 865555 - protein, 35 aa, Mycobacterium
TERLYELLADEIVMQWITPRWDLPATYELGYRIET

SEQ ID NO: 865556 - protein, 17 aa, Mycobacterium
TERMASWRMGDHHRGWA

SEQ ID NO: 865557 - protein, 24 aa, Mycobacterium
TERPEVPVLPWVVSAKSPSALRSQ

SEQ ID NO: 865558 - protein, 20 aa, Mycobacterium
TERPWLVHFADTWNHQDREV

SEQ ID NO: 865559 - protein, 20 aa, Mycobacterium
TERQKQILLDIYAAFTHQNE

SEQ ID NO: 865560 - protein, 24 aa, Mycobacterium
TERQKQVLLDIYTSFRQQNEAAGE

SEQ ID NO: 865561 - protein, 18 aa, Mycobacterium
TERQSHYFHVRPADQFDA

SEQ ID NO: 865562 - protein, 18 aa, Mycobacterium
TERRARRLARALHQWGFG

SEQ ID NO: 865563 - protein, 18 aa, Mycobacterium
TERRFVTLTDILGAEDAF

SEQ ID NO: 865564 - protein, 25 aa, Mycobacterium
TERRTNWLNNFYFGGEHGVADSVAR

SEQ ID NO: 865565 - protein, 24 aa, Mycobacterium
TERSARAWLFTVARNMIIDDRRSA

SEQ ID NO: 865566 - protein, 25 aa, Mycobacterium
TERSARAWLFTVARNMIIDDRRSAR

SEQ ID NO: 865567 - protein, 26 aa, Mycobacterium
TERTDALIFGPLRLQFWVCGVFEVHD

SEQ ID NO: 865568 - protein, 25 aa, Mycobacterium
TERTDALILGPLRIQFWVCGVFEVH

SEQ ID NO: 865569 - protein, 26 aa, Mycobacterium
TERTDALILGPLRLQFWVCGVFEVHD

SEQ ID NO: 865570 - protein, 31 aa, Mycobacterium
TERVRLSTNILLAALRRPVVLAKSAATLDIL

SEQ ID NO: 865571 - protein, 19 aa, Mycobacterium
TERWVPVQRVGLYVPGGNA

SEQ ID NO: 865572 - protein, 23 aa, Mycobacterium
TESASSFYPGRGGALYVASKFAV

SEQ ID NO: 865573 - protein, 32 aa, Mycobacterium
TESELDQLIGFFINILVLRNDLRDNPSLRDVG

SEQ ID NO: 865574 - protein, 20 aa, Mycobacterium
TESFEFLWCSMVNRLAEAAI

SEQ ID NO: 865575 - protein, 33 aa, Mycobacterium
TESFRLSPAPWLGLYWLLGGFLRKRRNVRDMTK

SEQ ID NO: 865576 - protein, 24 aa, Mycobacterium
TESKDLVAERLFIAPTTVRTHLQR

SEQ ID NO: 865577 - protein, 24 aa, Mycobacterium
TESPLRHTTYAQPALFAVELGLAR

SEQ ID NO: 865578 - protein, 26 aa, Mycobacterium
TESQRAFFYGLVLDGALFANAQAERG

SEQ ID NO: 865579 - protein, 23 aa, Mycobacterium
TESRLHTVVALLRQIVHGTEVQP

SEQ ID NO: 865580 - protein, 23 aa, Mycobacterium
TESSTIMCGWIDGAIRSGERAAT

SEQ ID NO: 865581 - protein, 21 aa, Mycobacterium
TESTRRLLSGLAPRKQPPKTV

SEQ ID NO: 865582 - protein, 26 aa, Mycobacterium
TESTWDRRPAWFRKLAGRATGVPDRV

SEQ ID NO: 865583 - protein, 26 aa, Mycobacterium
TESTWDRRPGWFRKVAGLATGVKDRA

SEQ ID NO: 865584 - protein, 25 aa, Mycobacterium
TESVTLPALMLMADGKKIQGSVYGA

SEQ ID NO: 865585 - protein, 31 aa, Mycobacterium
TESWRGQPLKDFLTKMVFWSKVEVAAADLKV

SEQ ID NO: 865586 - protein, 26 aa, Mycobacterium
TESYRLLKHGGFNRILFLVDRNNLAD

SEQ ID NO: 865587 - protein, 17 aa, Mycobacterium
TESYRNVLLARGQQPQQ

SEQ ID NO: 865588 - protein, 18 aa, Mycobacterium
TETDFTLSSLAGLDLREM

SEQ ID NO: 865589 - protein, 25 aa, Mycobacterium
TETEQAFLVRLLSGELRQGALAGIM

SEQ ID NO: 865590 - protein, 24 aa, Mycobacterium
TETERLLRDRLAELRPGDPILGEE

SEQ ID NO: 865591 - protein, 24 aa, Mycobacterium
TETFGPVVSLIPFADDDGAVRIAN

SEQ ID NO: 865592 - protein, 35 aa, Mycobacterium
TETFIALRVGIDNWRWAGVPIYLRTGKKMAEGIRI

SEQ ID NO: 865593 - protein, 21 aa, Mycobacterium
TETFPGLAGLGDLIVTCTSQR

SEQ ID NO: 865594 - protein, 23 aa, Mycobacterium
TETGFATLWRAAAKSRRWLVAAH

SEQ ID NO: 865595 - protein, 22 aa, Mycobacterium
TETGFATLWRAAGRRRRWLVAA

SEQ ID NO: 865596 - protein, 29 aa, Mycobacterium
TETGPYDNEWGWTWPMEPAGALQPGVGRP

SEQ ID NO: 865597 - protein, 21 aa, Mycobacterium
TETGYVILCLPTPIGEDGAAD

SEQ ID NO: 865598 - protein, 23 aa, Mycobacterium
TETLEPVQVLPAPAQGALAVECR

SEQ ID NO: 865599 - protein, 31 aa, Mycobacterium
TETLVRYVDRFLMYYIRTADRLQRTAPWVDS

SEQ ID NO: 865600 - protein, 26 aa, Mycobacterium
TETMNLVTPWLLAERDRFALLHGDYR

SEQ ID NO: 865601 - protein, 22 aa, Mycobacterium
TETPRLVGLYKQGLLKIDEMIT

SEQ ID NO: 865602 - protein, 18 aa, Mycobacterium
TETRPDGTWIDRGGAWIG

SEQ ID NO: 865603 - protein, 30 aa, Mycobacterium
TETRRRNLMRKELAWLRRGPPARTSKPKFR

SEQ ID NO: 865604 - protein, 23 aa, Mycobacterium
TETSPLCVVGRPLPKHDALDPAD

SEQ ID NO: 865605 - protein, 24 aa, Mycobacterium
TETTVFVPEYYCVDYRAARLTPVD

SEQ ID NO: 865606 - protein, 28 aa, Mycobacterium
TETVGGRTLSFWTPPGIYTVLDKGNPVV

SEQ ID NO: 865607 - protein, 25 aa, Mycobacterium
TETVPLGLLVTGVTYRHPGLLAKIV

SEQ ID NO: 865608 - protein, 18 aa, Mycobacterium
TEVAEVYLPLARLIHLQV

SEQ ID NO: 865609 - protein, 18 aa, Mycobacterium
TEVAKLGRPLKTIVLTAC

SEQ ID NO: 865610 - protein, 17 aa, Mycobacterium
TEVANASPLQSLEQQLL

SEQ ID NO: 865611 - protein, 29 aa, Mycobacterium
TEVDCPHFDHAMAAYYLILPSEVSSNLAR

SEQ ID NO: 865612 - protein, 17 aa, Mycobacterium
TEVEALWWDEERGQWQI

SEQ ID NO: 865613 - protein, 23 aa, Mycobacterium
TEVETLFATLTPITRLVVAAGDI

SEQ ID NO: 865614 - protein, 26 aa, Mycobacterium
TEVEYRQLRLERVVLVGVWTEGTSQE

SEQ ID NO: 865615 - protein, 18 aa, Mycobacterium
TEVKLEPLFGIPLTLMTT

SEQ ID NO: 865616 - protein, 20 aa, Mycobacterium
TEVLGRLLVEYARSAIQWCR

SEQ ID NO: 865617 - protein, 19 aa, Mycobacterium
TEVLLPGHGAVWRGPIREA

SEQ ID NO: 865618 - protein, 17 aa, Mycobacterium
TEVLPQFQGRGLATILV

SEQ ID NO: 865619 - protein, 17 aa, Mycobacterium
TEVLRLLDSGRTEVTVW

SEQ ID NO: 865620 - protein, 23 aa, Mycobacterium
TEVPLWSTRVARWLRRHTRPSAS

SEQ ID NO: 865621 - protein, 25 aa, Mycobacterium
TEVRMFLHHVPGLAFLPNRRPAEPN

SEQ ID NO: 865622 - protein, 26 aa, Mycobacterium
TEVRMFLHHVPGLAFLPNRRPPEPNQ

SEQ ID NO: 865623 - protein, 20 aa, Mycobacterium
TEVSKWWHSLTPGQQDRVKQ

SEQ ID NO: 865624 - protein, 18 aa, Mycobacterium
TEVSPVATLLLPDDHDDP

SEQ ID NO: 865625 - protein, 18 aa, Mycobacterium
TEVTLRLLPAQHASSIVV

SEQ ID NO: 865626 - protein, 24 aa, Mycobacterium
TEVVRMCVPLPWAAVAFERLFLFI

SEQ ID NO: 865627 - protein, 29 aa, Mycobacterium
TEWDPKKPLPLIGVDRLYDYFLESSRNMI

SEQ ID NO: 865628 - protein, 18 aa, Mycobacterium
TEWLKLALDEPHLLKTLG

SEQ ID NO: 865629 - protein, 17 aa, Mycobacterium
TEWLKLALDEPHLLQSL

SEQ ID NO: 865630 - protein, 23 aa, Mycobacterium
TEYADQWLLTRQVAGRPLKDRTR

SEQ ID NO: 865631 - protein, 26 aa, Mycobacterium
TEYAKTFQGPLPLPPSKHIAIVACMD

SEQ ID NO: 865632 - protein, 40 aa, Mycobacterium
TEYARRRWGGLLAPPALLMGWLIPPPWQPGGRVPAASLAL

SEQ ID NO: 865633 - protein, 24 aa, Mycobacterium
TEYGLVSYVFTNDLRRALRVAEAL

SEQ ID NO: 865634 - protein, 26 aa, Mycobacterium
TEYHGLHAFRWIAADGSARFVRYHLV

SEQ ID NO: 865635 - protein, 18 aa, Mycobacterium
TEYHMAVVLITHDLALVV

SEQ ID NO: 865636 - protein, 21 aa, Mycobacterium
TEYLKRPLIDGPAPEPVPRPI

SEQ ID NO: 865637 - protein, 20 aa, Mycobacterium
TEYLKRPLIDGPAPEPVTRP

SEQ ID NO: 865638 - protein, 20 aa, Mycobacterium
TEYRPDGTWIDRGGAWIGPG

SEQ ID NO: 865639 - protein, 19 aa, Mycobacterium
TFAAFLEINGLMKTFTRAG

SEQ ID NO: 865640 - protein, 19 aa, Mycobacterium
TFAAYPHFFELKRTRTEPP

SEQ ID NO: 865641 - protein, 26 aa, Mycobacterium
TFACDTRRRFCDMYRRIVGGGEQHDV

SEQ ID NO: 865642 - protein, 18 aa, Mycobacterium
TFACGPHHRMLDPGGWST

SEQ ID NO: 865643 - protein, 26 aa, Mycobacterium
TFADLELAWGPTWSGSLKSLWLGDGE

SEQ ID NO: 865644 - protein, 23 aa, Mycobacterium
TFADLEVFMQLLPRSSTAERMNP

SEQ ID NO: 865645 - protein, 20 aa, Mycobacterium
TFAECVLLETLVLSIFNHDT

SEQ ID NO: 865646 - protein, 25 aa, Mycobacterium
TFAEGYWRWITLLEDGFHRMRSAGL

SEQ ID NO: 865647 - protein, 24 aa, Mycobacterium
TFARLNELMIASAPFYCVTVIRVA

SEQ ID NO: 865648 - protein, 18 aa, Mycobacterium
TFASWRERRRLIKVLRKR

SEQ ID NO: 865649 - protein, 26 aa, Mycobacterium
TFATTDLFLERLGLTSLEDLPDIAPL

SEQ ID NO: 865650 - protein, 27 aa, Mycobacterium
TFATTELFLERLGLTSLTDLPDIAPLL

SEQ ID NO: 865651 - protein, 17 aa, Mycobacterium
TFATVPVLLDAIYNPWP

SEQ ID NO: 865652 - protein, 19 aa, Mycobacterium
TFATWRERRRLIKVLRKRG

SEQ ID NO: 865653 - protein, 33 aa, Mycobacterium
TFAVNVFGPVELTLALLPALRRAHGQVVFINSG

SEQ ID NO: 865654 - protein, 18 aa, Mycobacterium
TFAYRRLGRVDTGVARIF

SEQ ID NO: 865655 - protein, 20 aa, Mycobacterium
TFCETSFLYDSRGGRAGCAL

SEQ ID NO: 865656 - protein, 18 aa, Mycobacterium
TFCIVPSLRGKEVDRRPG

SEQ ID NO: 865657 - protein, 18 aa, Mycobacterium
TFCRICEPLCGMIATVED

SEQ ID NO: 865658 - protein, 26 aa, Mycobacterium
TFDAADRLAIINLLGAYAYLYDQDHL

SEQ ID NO: 865659 - protein, 23 aa, Mycobacterium
TFDEICLRRYPGIGRVDHVHHAG

SEQ ID NO: 865660 - protein, 20 aa, Mycobacterium
TFDGKFLDYAWQHSAEQAQE

SEQ ID NO: 865661 - protein, 24 aa, Mycobacterium
TFDLRVTAPLHWKVISNAAATSLD

SEQ ID NO: 865662 - protein, 25 aa, Mycobacterium
TFDNLLGLPFSAPVPPTTPLDTDAT

SEQ ID NO: 865663 - protein, 31 aa, Mycobacterium
TFDPERFQWWKVLGTLWWGVGLAAQAKSYLD

SEQ ID NO: 865664 - protein, 19 aa, Mycobacterium
TFDPPLPDAKRDAIRRLGF

SEQ ID NO: 865665 - protein, 25 aa, Mycobacterium
TFDRERPLWEFTLVEGLQGGEAAVI

SEQ ID NO: 865666 - protein, 28 aa, Mycobacterium
TFDRTVEHYLRIPFALTKSAVPHMRGQG

SEQ ID NO: 865667 - protein, 17 aa, Mycobacterium
TFDTACSSGLMAVHLAC

SEQ ID NO: 865668 - protein, 21 aa, Mycobacterium
TFDTQVWRFSPATDTALLTGD

SEQ ID NO: 865669 - protein, 26 aa, Mycobacterium
TFDYLDHFTWWRVVTWMRKRHHGLAW

SEQ ID NO: 865670 - protein, 20 aa, Mycobacterium
TFDYSTAKLPIVIELLGMQK

SEQ ID NO: 865671 - protein, 19 aa, Mycobacterium
TFEFPTRVIARLLGLPDED

SEQ ID NO: 865672 - protein, 26 aa, Mycobacterium
TFEGDMPAVLFHLGIVVADAAAWQIS

SEQ ID NO: 865673 - protein, 17 aa, Mycobacterium
TFEHGTITWKPGDAQAV

SEQ ID NO: 865674 - protein, 23 aa, Mycobacterium
TFEHRAVIVADDRDRLLAGLDEL

SEQ ID NO: 865675 - protein, 19 aa, Mycobacterium
TFELGEWIIPQGYSIVVAI

SEQ ID NO: 865676 - protein, 17 aa, Mycobacterium
TFELRPHFEWRGLGFIS

SEQ ID NO: 865677 - protein, 23 aa, Mycobacterium
TFEQRAVIVADDRDRLLAGLDEL

SEQ ID NO: 865678 - protein, 19 aa, Mycobacterium
TFERPLRPVARVAHVDFEE

SEQ ID NO: 865679 - protein, 28 aa, Mycobacterium
TFETARFIKFIITEIFPGGRLPSTQMMV

SEQ ID NO: 865680 - protein, 18 aa, Mycobacterium
TFFANDLDVAATAKALNV

SEQ ID NO: 865681 - protein, 19 aa, Mycobacterium
TFFERLQQTHDKRMSELGL

SEQ ID NO: 865682 - protein, 17 aa, Mycobacterium
TFFICEGVTQYLSEATV

SEQ ID NO: 865683 - protein, 18 aa, Mycobacterium
TFFMLVIKVAEYFCGGLT

SEQ ID NO: 865684 - protein, 18 aa, Mycobacterium
TFFMLVVKVAEYFCGGLT

SEQ ID NO: 865685 - protein, 19 aa, Mycobacterium
TFFVATAPSYSFVSSSLAK

SEQ ID NO: 865686 - protein, 19 aa, Mycobacterium
TFFVATTPQYSFVSSSLAK

SEQ ID NO: 865687 - protein, 17 aa, Mycobacterium
TFGAWDAVLLDPRDRRA

SEQ ID NO: 865688 - protein, 19 aa, Mycobacterium
TFGFILGEVVRRTTGKTLG

SEQ ID NO: 865689 - protein, 19 aa, Mycobacterium
TFGFIMGEVFRRVTGRTIG

SEQ ID NO: 865690 - protein, 33 aa, Mycobacterium
TFGIRYSGPAFLLPGMLVWGFTGQIISAMLEVS

SEQ ID NO: 865691 - protein, 17 aa, Mycobacterium
TFGNLLREVFGVDVPVG

SEQ ID NO: 865692 - protein, 24 aa, Mycobacterium
TFGPIGELWYRKSGTYRGKVQNLT

SEQ ID NO: 865693 - protein, 18 aa, Mycobacterium
TFGPLFGHIPNLVTMRGD

SEQ ID NO: 865694 - protein, 22 aa, Mycobacterium
TFGPLFGHIPNLVTMRGDRYRD

SEQ ID NO: 865695 - protein, 31 aa, Mycobacterium
TFGPQSLRPRLIWFAYRRLKEGRPIVTHRYR

SEQ ID NO: 865696 - protein, 18 aa, Mycobacterium
TFGRIGVKVWIYKGDIVG

SEQ ID NO: 865697 - protein, 24 aa, Mycobacterium
TFGTDLVRGVIAGGPVALTEAIEG

SEQ ID NO: 865698 - protein, 18 aa, Mycobacterium
TFGVKRVVARIYDAKRAE

SEQ ID NO: 865699 - protein, 18 aa, Mycobacterium
TFGVRRVVARIYDAKRAE

SEQ ID NO: 865700 - protein, 26 aa, Mycobacterium
TFHGLLLLRHVGDLVDTGWPVLMALS

SEQ ID NO: 865701 - protein, 25 aa, Mycobacterium
TFHSDWPISSIPYWADMATNFEYEH

SEQ ID NO: 865702 - protein, 18 aa, Mycobacterium
TFHSQFVHRLHTSAQAYA

SEQ ID NO: 865703 - protein, 23 aa, Mycobacterium
TFHSTCVRILRNQAALIEGLNSN

SEQ ID NO: 865704 - protein, 24 aa, Mycobacterium
TFHSTCVRILRNQAALIKGLNSNF

SEQ ID NO: 865705 - protein, 26 aa, Mycobacterium
TFHTLRAAIPVMRRQRYGRIVVTSSM

SEQ ID NO: 865706 - protein, 18 aa, Mycobacterium
TFHTSRWDYGYTGQGLQN

SEQ ID NO: 865707 - protein, 17 aa, Mycobacterium
TFIAGVFLRFVAGDQTF

SEQ ID NO: 865708 - protein, 18 aa, Mycobacterium
TFIDLVPSLLDPMLDRPE

SEQ ID NO: 865709 - protein, 26 aa, Mycobacterium
TFIGQPLWGSIGYTLPAALGAAVAHP

SEQ ID NO: 865710 - protein, 18 aa, Mycobacterium
TFILSRTPGLLGVHAAMT

SEQ ID NO: 865711 - protein, 33 aa, Mycobacterium
TFIVELSDLDLFLLRITLALLSDRPILVVGDLE

SEQ ID NO: 865712 - protein, 19 aa, Mycobacterium
TFIVQAAELFLTALAVPLL

SEQ ID NO: 865713 - protein, 21 aa, Mycobacterium
TFLCCQAVSPVMRKNQYGRII

SEQ ID NO: 865714 - protein, 22 aa, Mycobacterium
TFLDEIWAIRYHHIRRRRPGYF

SEQ ID NO: 865715 - protein, 19 aa, Mycobacterium
TFLDQRGLMKQKWPERLVL

SEQ ID NO: 865716 - protein, 25 aa, Mycobacterium
TFLEALASAWSWKLPAAVKHWGAQP

SEQ ID NO: 865717 - protein, 24 aa, Mycobacterium
TFLNRAFDQMLMDVALHKLPVTMV

SEQ ID NO: 865718 - protein, 18 aa, Mycobacterium
TFLQFADYMRPAVRLAAL

SEQ ID NO: 865719 - protein, 22 aa, Mycobacterium
TFLSTLDMRVLVIGSGGLSHSP

SEQ ID NO: 865720 - protein, 19 aa, Mycobacterium
TFMRLLLAAETPTSGDVRV

SEQ ID NO: 865721 - protein, 36 aa, Mycobacterium
TFNDIGLLINFPVSQWLKFAPPIAYGALPKDALGAG

SEQ ID NO: 865722 - protein, 22 aa, Mycobacterium
TFNDTIFKRTTGLAYFSNGMGQ

SEQ ID NO: 865723 - protein, 18 aa, Mycobacterium
TFNGLSKAYRVAGYRSGW

SEQ ID NO: 865724 - protein, 19 aa, Mycobacterium
TFNHMELVKYLAGGSSASS

SEQ ID NO: 865725 - protein, 17 aa, Mycobacterium
TFNILRSPNPHVGFGGT

SEQ ID NO: 865726 - protein, 33 aa, Mycobacterium
TFNRAAGRVKLSWFLLHAARYLPPQLFASDDDW

SEQ ID NO: 865727 - protein, 21 aa, Mycobacterium
TFNSVRRAIADAGLAFRVEDT

SEQ ID NO: 865728 - protein, 21 aa, Mycobacterium
TFNWAMLLHGSQEIRLHAPLP

SEQ ID NO: 865729 - protein, 26 aa, Mycobacterium
TFPILKGLSIKRLLINPGAMRTPHWH

SEQ ID NO: 865730 - protein, 18 aa, Mycobacterium
TFPLFTREPYRGSSPATR

SEQ ID NO: 865731 - protein, 19 aa, Mycobacterium
TFPLLSDPDRKVLAAYGAY

SEQ ID NO: 865732 - protein, 19 aa, Mycobacterium
TFPLLSDPDRKVLTAYGAY

SEQ ID NO: 865733 - protein, 18 aa, Mycobacterium
TFPLLSDPDRSVLTAWGA

SEQ ID NO: 865734 - protein, 19 aa, Mycobacterium
TFPQWRTQVRLQHALVLLA

SEQ ID NO: 865735 - protein, 31 aa, Mycobacterium
TFQAAFPLKGKPPNVYGFPLNKARAKDEFDA

SEQ ID NO: 865736 - protein, 20 aa, Mycobacterium
TFQAIAIRADLTRPAINHYF

SEQ ID NO: 865737 - protein, 21 aa, Mycobacterium
TFQEVLSRWQLIIDTVVNGIT

SEQ ID NO: 865738 - protein, 22 aa, Mycobacterium
TFQMWARPRGVAPDALFALMCG

SEQ ID NO: 865739 - protein, 18 aa, Mycobacterium
TFQRFAENLVFDRAPRLA

SEQ ID NO: 865740 - protein, 25 aa, Mycobacterium
TFQRIKEPFRRWASLVIHAGEPGAG

SEQ ID NO: 865741 - protein, 19 aa, Mycobacterium
TFQRYRRSLTAVAVVGVVP

SEQ ID NO: 865742 - protein, 27 aa, Mycobacterium
TFQVTVHVRVPIIGGKLENIIGARLAE

SEQ ID NO: 865743 - protein, 22 aa, Mycobacterium
TFRCCQVALPDMVDAGWGRIVL

SEQ ID NO: 865744 - protein, 32 aa, Mycobacterium
TFRDQLIYERGGWYFTSRALQWDSVPSRHPLV

SEQ ID NO: 865745 - protein, 24 aa, Mycobacterium
TFRDRLFTEIFPGRSTVPKTLIFA

SEQ ID NO: 865746 - protein, 26 aa, Mycobacterium
TFRFNEVIHYWALDGGWDCFAEHYPS

SEQ ID NO: 865747 - protein, 24 aa, Mycobacterium
TFRFNEVIHYWALEGDWACFENHY

SEQ ID NO: 865748 - protein, 20 aa, Mycobacterium
TFRFWFIGERWEWSDEVARM

SEQ ID NO: 865749 - protein, 21 aa, Mycobacterium
TFRGCEGDALLMLLDANGIEC

SEQ ID NO: 865750 - protein, 26 aa, Mycobacterium
TFRGCEGDSLLMLLDAKGIECSTGSA

SEQ ID NO: 865751 - protein, 20 aa, Mycobacterium
TFRGLPRTPPWNAVAFAARS

SEQ ID NO: 865752 - protein, 18 aa, Mycobacterium
TFRLAYEAPGGLLGLIAD

SEQ ID NO: 865753 - protein, 22 aa, Mycobacterium
TFRLNVGAYFHLAKAALPYLGP

SEQ ID NO: 865754 - protein, 28 aa, Mycobacterium
TFRLPDVGVVNALRWRPHPWGDDLRDRV

SEQ ID NO: 865755 - protein, 18 aa, Mycobacterium
TFRPSALQTLSHFPITIA

SEQ ID NO: 865756 - protein, 18 aa, Mycobacterium
TFRRLNGGLFAALPGLVV

SEQ ID NO: 865757 - protein, 23 aa, Mycobacterium
TFRRRCCRAPDPAALRTQGVRPG

SEQ ID NO: 865758 - protein, 19 aa, Mycobacterium
TFRTRALVVPGIGEGAPGK

SEQ ID NO: 865759 - protein, 26 aa, Mycobacterium
TFRYNEVIHYWALDGGWECFANHYPS

SEQ ID NO: 865760 - protein, 26 aa, Mycobacterium
TFRYNEVIHYWALEGGWECFANHYPS

SEQ ID NO: 865761 - protein, 19 aa, Mycobacterium
TFSAMIGHPFGSLVDERSG

SEQ ID NO: 865762 - protein, 21 aa, Mycobacterium
TFSDLLVINKTDLAPMVGADL

SEQ ID NO: 865763 - protein, 19 aa, Mycobacterium
TFSGLLQRFGRGKGCDICK

SEQ ID NO: 865764 - protein, 23 aa, Mycobacterium
TFSHGVDYGIWLEIENNGKDQII

SEQ ID NO: 865765 - protein, 24 aa, Mycobacterium
TFSKLQAIALLHYDGKEGAAMDAL

SEQ ID NO: 865766 - protein, 24 aa, Mycobacterium
TFSLGMSQRLGIAVALLGDPKVLL

SEQ ID NO: 865767 - protein, 22 aa, Mycobacterium
TFSNPIPTISAKWDLTPDLTIH

SEQ ID NO: 865768 - protein, 44 aa, Mycobacterium
TFTASSLQTLPLDVLNAVNAPFQAFTDRPLIGNGVAGAPGTGQN

SEQ ID NO: 865769 - protein, 24 aa, Mycobacterium
TFTEAALRALDAQGLIPATQSGAG

SEQ ID NO: 865770 - protein, 24 aa, Mycobacterium
TFTICSFWLVSALVEIGEIHRARH

SEQ ID NO: 865771 - protein, 22 aa, Mycobacterium
TFTICSFWLVSALVEIGEISRA

SEQ ID NO: 865772 - protein, 23 aa, Mycobacterium
TFTICSFWLVSALVEIGEVAQAK

SEQ ID NO: 865773 - protein, 23 aa, Mycobacterium
TFTICSFWLVSALVEIGEVARAK

SEQ ID NO: 865774 - protein, 22 aa, Mycobacterium
TFTICSFWLVSALVEIGEVGRA

SEQ ID NO: 865775 - protein, 24 aa, Mycobacterium
TFTICSFWLVSALVEIGEVRRAKR

SEQ ID NO: 865776 - protein, 26 aa, Mycobacterium
TFTICSFWLVSALVEIGEVRRARHLC

SEQ ID NO: 865777 - protein, 18 aa, Mycobacterium
TFTIVTFAAPGIPTPFIA

SEQ ID NO: 865778 - protein, 18 aa, Mycobacterium
TFTNIHMPLVRTPMIAPS

SEQ ID NO: 865779 - protein, 27 aa, Mycobacterium
TFTSSQGLLLMIPNMYKIAGELTSAVI

SEQ ID NO: 865780 - protein, 21 aa, Mycobacterium
TFTVRMDLGGAPLFGPVGAAA

SEQ ID NO: 865781 - protein, 21 aa, Mycobacterium
TFTYGLLYQQEDELAWQARTQ

SEQ ID NO: 865782 - protein, 25 aa, Mycobacterium
TFVARQLDLRRYFAESGGGVGAEQD

SEQ ID NO: 865783 - protein, 18 aa, Mycobacterium
TFVEELMRFSPATLGTVR

SEQ ID NO: 865784 - protein, 24 aa, Mycobacterium
TFVEKFPTVLSPRSALLILGDGRT

SEQ ID NO: 865785 - protein, 18 aa, Mycobacterium
TFVGPRFGLYGRTQPTWR

SEQ ID NO: 865786 - protein, 17 aa, Mycobacterium
TFVPRLRSSGHGGVINV

SEQ ID NO: 865787 - protein, 19 aa, Mycobacterium
TFVTMKLPSSMVFDGKDGS

SEQ ID NO: 865788 - protein, 24 aa, Mycobacterium
TFVYKGMLTTPQLKAFYLDLQDER

SEQ ID NO: 865789 - protein, 24 aa, Mycobacterium
TFVYKGMLTTPQLKQFYLDLQDER

SEQ ID NO: 865790 - protein, 17 aa, Mycobacterium
TFWNSDKWHALVQTWVI

SEQ ID NO: 865791 - protein, 20 aa, Mycobacterium
TFYEWVLGPSMTYTCAVYPN

SEQ ID NO: 865792 - protein, 21 aa, Mycobacterium
TFYGDLFPHAVKWQGVIYLED

SEQ ID NO: 865793 - protein, 27 aa, Mycobacterium
TGAAGVNPSPLPAGTPAAAGTPGGSDL

SEQ ID NO: 865794 - protein, 24 aa, Mycobacterium
TGAATFDPAFFGISLREAISMDPQ

SEQ ID NO: 865795 - protein, 21 aa, Mycobacterium
TGADFKRPSPQWWFDDEAVYG

SEQ ID NO: 865796 - protein, 25 aa, Mycobacterium
TGADGAPGGWLLGDGGAGGSGAPGL

SEQ ID NO: 865797 - protein, 26 aa, Mycobacterium
TGADGAPGGWLLGNGGAGGSGAAGMP

SEQ ID NO: 865798 - protein, 26 aa, Mycobacterium
TGADGGAGGLLWGNGGNGGSGAAGQT

SEQ ID NO: 865799 - protein, 24 aa, Mycobacterium
TGADGPIVFCRGAVRPVSPAPVGV

SEQ ID NO: 865800 - protein, 22 aa, Mycobacterium
TGADPVLMLTGPIPATEKVLKK

SEQ ID NO: 865801 - protein, 23 aa, Mycobacterium
TGADPVLMLTGPIPATEKVLRKS

SEQ ID NO: 865802 - protein, 22 aa, Mycobacterium
TGADPVLMLTGPIPATEKVLSK

SEQ ID NO: 865803 - protein, 23 aa, Mycobacterium
TGADWRRMIAINMMSPLVGSRLF

SEQ ID NO: 865804 - protein, 18 aa, Mycobacterium
TGAEDLLKRLLPTGRISG

SEQ ID NO: 865805 - protein, 17 aa, Mycobacterium
TGAFVKEQVCRFTITWL

SEQ ID NO: 865806 - protein, 21 aa, Mycobacterium
TGAGMAAWFGWLRRFAAESPA

SEQ ID NO: 865807 - protein, 23 aa, Mycobacterium
TGAGTPGLDLRAGIACQLKGLGV

SEQ ID NO: 865808 - protein, 25 aa, Mycobacterium
TGAGVKVIPWIPGPVKRLLTRGRSV

SEQ ID NO: 865809 - protein, 25 aa, Mycobacterium
TGAHDQWLRTVAAPQLRAPATRMAF

SEQ ID NO: 865810 - protein, 25 aa, Mycobacterium
TGAIIIDHWGIIKADIGIRDGRIVG

SEQ ID NO: 865811 - protein, 28 aa, Mycobacterium
TGAIKGGPLLLYNSLRRPIVTARSAAAN

SEQ ID NO: 865812 - protein, 18 aa, Mycobacterium
TGAIRRLLSLLAGAIGVD

SEQ ID NO: 865813 - protein, 21 aa, Mycobacterium
TGAKEILCIRVLGGSGRRYAG

SEQ ID NO: 865814 - protein, 26 aa, Mycobacterium
TGAKTWISNARRSGLIALLCKTDPKA

SEQ ID NO: 865815 - protein, 23 aa, Mycobacterium
TGALTYYGLTPRDSRSGSDNFMT

SEQ ID NO: 865816 - protein, 24 aa, Mycobacterium
TGANGYLGRFLCLEWLERLAETGG

SEQ ID NO: 865817 - protein, 28 aa, Mycobacterium
TGANNLYLAFGMLSWHLNDRELRSPLIL

SEQ ID NO: 865818 - protein, 29 aa, Mycobacterium
TGAPRISVAYFFNPRLDARIPVLELPPEL

SEQ ID NO: 865819 - protein, 17 aa, Mycobacterium
TGAQLDSALLLAGGFQE

SEQ ID NO: 865820 - protein, 28 aa, Mycobacterium
TGAQLPLLQFLIYPAVDFTVRRPSRDLF

SEQ ID NO: 865821 - protein, 23 aa, Mycobacterium
TGARFAFVCAVDMPLLSASLIDD

SEQ ID NO: 865822 - protein, 23 aa, Mycobacterium
TGARLLCETFPTRLERGAGVPAI

SEQ ID NO: 865823 - protein, 25 aa, Mycobacterium
TGARLLLCEFVIPEHDRDFHGKWVD

SEQ ID NO: 865824 - protein, 27 aa, Mycobacterium
TGARPQALLLPLGPLAEHNIRATFAAN

SEQ ID NO: 865825 - protein, 26 aa, Mycobacterium
TGARPRVLLLPLGPLAEHNIRATFAS

SEQ ID NO: 865826 - protein, 25 aa, Mycobacterium
TGARSVPALVAWKLGCSSGNAHTIA

SEQ ID NO: 865827 - protein, 20 aa, Mycobacterium
TGARYQDLFVLGERFLMPKR

SEQ ID NO: 865828 - protein, 20 aa, Mycobacterium
TGASLFEPYLAMLQASPSGT

SEQ ID NO: 865829 - protein, 20 aa, Mycobacterium
TGASRFLGGYLAARLVQNPM

SEQ ID NO: 865830 - protein, 19 aa, Mycobacterium
TGASVAQLSWPCGADPVRV

SEQ ID NO: 865831 - protein, 22 aa, Mycobacterium
TGATGFLGPFLVGSLLSRTSYN

SEQ ID NO: 865832 - protein, 29 aa, Mycobacterium
TGATGFLGRYLALQWLEQLELVDGKLICL

SEQ ID NO: 865833 - protein, 35 aa, Mycobacterium
TGATGFLGRYLVLEWLRRLRAVGGKLICLVRAASD

SEQ ID NO: 865834 - protein, 24 aa, Mycobacterium
TGATIITGYPFLRGALRTLTGNRS

SEQ ID NO: 865835 - protein, 24 aa, Mycobacterium
TGATLALSVLRAAVAALSSMATFT

SEQ ID NO: 865836 - protein, 24 aa, Mycobacterium
TGATLIPHLTFDPLRTLQAIEQHR

SEQ ID NO: 865837 - protein, 21 aa, Mycobacterium
TGATLKRLPIPASLPSGRGEV

SEQ ID NO: 865838 - protein, 23 aa, Mycobacterium
TGATPYMVLMAAFAALVHRYTQS

SEQ ID NO: 865839 - protein, 28 aa, Mycobacterium
TGATQPVELPFTGLNFPAGVAVDLNGNI

SEQ ID NO: 865840 - protein, 22 aa, Mycobacterium
TGATRPWQFGDTEPWNVTRTVT

SEQ ID NO: 865841 - protein, 25 aa, Mycobacterium
TGATVALPVLRAAVAALSSMATFAE

SEQ ID NO: 865842 - protein, 19 aa, Mycobacterium
TGAVFIKGTGLWLESAIEQ

SEQ ID NO: 865843 - protein, 25 aa, Mycobacterium
TGAVILDHWGIIKADIGIRDGRIVA

SEQ ID NO: 865844 - protein, 26 aa, Mycobacterium
TGAVILDHWGIIKADIGIRDGRIVGI

SEQ ID NO: 865845 - protein, 23 aa, Mycobacterium
TGAWPLICHTIGTGRLRLDVELA

SEQ ID NO: 865846 - protein, 23 aa, Mycobacterium
TGAWTTQVLYVAATLGIPDELAD

SEQ ID NO: 865847 - protein, 17 aa, Mycobacterium
TGCRGWEARFGTQEISQ

SEQ ID NO: 865848 - protein, 26 aa, Mycobacterium
TGDAEVDRIWFAPNVWPREVPELAPL

SEQ ID NO: 865849 - protein, 24 aa, Mycobacterium
TGDDGLWSFLTGDALVIAAMAAAV

SEQ ID NO: 865850 - protein, 22 aa, Mycobacterium
TGDGHALALRAGSALINMEFIQ

SEQ ID NO: 865851 - protein, 25 aa, Mycobacterium
TGDGYVFAHGLLREQLLTGMPALRR

SEQ ID NO: 865852 - protein, 24 aa, Mycobacterium
TGDHAWSRLLFFEAAEGGAGVLRR

SEQ ID NO: 865853 - protein, 24 aa, Mycobacterium
TGDIPMPDIWWQFRNAIQKAPKVD

SEQ ID NO: 865854 - protein, 17 aa, Mycobacterium
TGDIWLFRGASGPDRAI

SEQ ID NO: 865855 - protein, 24 aa, Mycobacterium
TGDLAAYLSVAWELSPQSYLYVAA

SEQ ID NO: 865856 - protein, 23 aa, Mycobacterium
TGDLANWMIPGKMVKGMGGAMDL

SEQ ID NO: 865857 - protein, 28 aa, Mycobacterium
TGDLLRNVNLLPVPARFADARVRAAGGV

SEQ ID NO: 865858 - protein, 18 aa, Mycobacterium
TGDLTVAAVLGIAPVLDA

SEQ ID NO: 865859 - protein, 24 aa, Mycobacterium
TGDMFNFGLAMFPTPKLICYRVDR

SEQ ID NO: 865860 - protein, 22 aa, Mycobacterium
TGDPAATPVLGWVREQLRVAQA

SEQ ID NO: 865861 - protein, 28 aa, Mycobacterium
TGDPEAFMALAARFLGPALTGVQPVRPS

SEQ ID NO: 865862 - protein, 30 aa, Mycobacterium
TGDPEVDRIWFAPNVWPDEVPALRSLVTEY

SEQ ID NO: 865863 - protein, 22 aa, Mycobacterium
TGDPKLLRYFQELAADHLEVVA

SEQ ID NO: 865864 - protein, 22 aa, Mycobacterium
TGDPLDLYFGGNMETFVPLGGQ

SEQ ID NO: 865865 - protein, 25 aa, Mycobacterium
TGDPRQLRWVAAPDRLPPLGVVRHA

SEQ ID NO: 865866 - protein, 18 aa, Mycobacterium
TGDPRRWPNDRGNSGIVH

SEQ ID NO: 865867 - protein, 23 aa, Mycobacterium
TGDPRTAPVWPPTSYRVGPPQPS

SEQ ID NO: 865868 - protein, 26 aa, Mycobacterium
TGDPVALRRVLPSPATLVVKDGARRA

SEQ ID NO: 865869 - protein, 29 aa, Mycobacterium
TGDRGSRRSVRLWHWLDPETRDALFSRAR

SEQ ID NO: 865870 - protein, 23 aa, Mycobacterium
TGDRIRFASSLPALLAGGGVDTG

SEQ ID NO: 865871 - protein, 25 aa, Mycobacterium
TGDRLHVLIFIKHGLWKSWSENNRR

SEQ ID NO: 865872 - protein, 28 aa, Mycobacterium
TGDRLLHSSPVPLAISPRGYRGSRAGTV

SEQ ID NO: 865873 - protein, 24 aa, Mycobacterium
TGDRRHRVYALGYLALIEAESGQL

SEQ ID NO: 865874 - protein, 21 aa, Mycobacterium
TGDSFFHLAPLGQSGALAGLN

SEQ ID NO: 865875 - protein, 24 aa, Mycobacterium
TGDTLGLGILFEGKVIAPLGGRSG

SEQ ID NO: 865876 - protein, 23 aa, Mycobacterium
TGDVGLIIAVKRLGAAKTRLAPV

SEQ ID NO: 865877 - protein, 18 aa, Mycobacterium
TGDVMLRYNFPGAGLSDD

SEQ ID NO: 865878 - protein, 19 aa, Mycobacterium
TGDYLAELTMLILGRDKMK

SEQ ID NO: 865879 - protein, 19 aa, Mycobacterium
TGDYLAELTMLILGRDRMK

SEQ ID NO: 865880 - protein, 21 aa, Mycobacterium
TGDYLAELTMLILGRDRMKDP

SEQ ID NO: 865881 - protein, 20 aa, Mycobacterium
TGDYLAELTMLILGRDRMKH

SEQ ID NO: 865882 - protein, 21 aa, Mycobacterium
TGDYLAELTMLILGRDRMKNP

SEQ ID NO: 865883 - protein, 19 aa, Mycobacterium
TGDYLREHITYGYAITVHS

SEQ ID NO: 865884 - protein, 19 aa, Mycobacterium
TGDYVGIPAERHALLAVED

SEQ ID NO: 865885 - protein, 20 aa, Mycobacterium
TGECLLLYTKGDIARRRRLV

SEQ ID NO: 865886 - protein, 24 aa, Mycobacterium
TGEDMAVFVSALLAGRVVPPAQLA

SEQ ID NO: 865887 - protein, 25 aa, Mycobacterium
TGEERARWFIAHDNFFIWGTSESRC

SEQ ID NO: 865888 - protein, 24 aa, Mycobacterium
TGEFAIRVFPGDHFYLNNNLPELV

SEQ ID NO: 865889 - protein, 21 aa, Mycobacterium
TGEFPLFPDYQDDVYAAVAAV

SEQ ID NO: 865890 - protein, 17 aa, Mycobacterium
TGEFQYCTAGHPPPLLV

SEQ ID NO: 865891 - protein, 21 aa, Mycobacterium
TGEIKWHYQFTPHDLWDYDST

SEQ ID NO: 865892 - protein, 27 aa, Mycobacterium
TGEIVSFAPVYRPPWDSFPRSEPYVVV

SEQ ID NO: 865893 - protein, 20 aa, Mycobacterium
TGEKFVPFDAAADYRTYVDG

SEQ ID NO: 865894 - protein, 20 aa, Mycobacterium
TGELLFFNYSKQDPYMHYGV

SEQ ID NO: 865895 - protein, 21 aa, Mycobacterium
TGELLSMRIGAHRVLVLVGRI

SEQ ID NO: 865896 - protein, 18 aa, Mycobacterium
TGELLSVPVGDHRVLVLA

SEQ ID NO: 865897 - protein, 17 aa, Mycobacterium
TGENFALHLIPSGVLTP

SEQ ID NO: 865898 - protein, 20 aa, Mycobacterium
TGEPFVPFDIADDYLRYVDG

SEQ ID NO: 865899 - protein, 21 aa, Mycobacterium
TGEPIWSSWYAGRPVLVTAND

SEQ ID NO: 865900 - protein, 36 aa, Mycobacterium
TGEPKAVLLPNRTFFAIPDILRAEGLRWIDWVAGET

SEQ ID NO: 865901 - protein, 23 aa, Mycobacterium
TGEPQYEIVDPQPLALLPEPDAG

SEQ ID NO: 865902 - protein, 25 aa, Mycobacterium
TGEQLLDMALTRPAGFAPGEKTVYT

SEQ ID NO: 865903 - protein, 26 aa, Mycobacterium
TGEQWRALLLAIEQRLVLANKHQGML

SEQ ID NO: 865904 - protein, 23 aa, Mycobacterium
TGEQWTMFLLDPAGNALEFKAFA

SEQ ID NO: 865905 - protein, 24 aa, Mycobacterium
TGERALLLGDFVRGFVGLDSYESS

SEQ ID NO: 865906 - protein, 24 aa, Mycobacterium
TGERPFAVIDLIKQSGLGALRVPR

SEQ ID NO: 865907 - protein, 22 aa, Mycobacterium
TGERYFAAVPLRRAGEPAEVGR

SEQ ID NO: 865908 - protein, 27 aa, Mycobacterium
TGESFCLKAWKSFGIAGVILGDQTPCA

SEQ ID NO: 865909 - protein, 27 aa, Mycobacterium
TGESRAYKMWLPPLTDPTPVNELVERD

SEQ ID NO: 865910 - protein, 24 aa, Mycobacterium
TGFAVRLHAVLPPVAAAGTCLSLR

SEQ ID NO: 865911 - protein, 21 aa, Mycobacterium
TGFDALYDPVAPQVLLSLIDS

SEQ ID NO: 865912 - protein, 21 aa, Mycobacterium
TGFDAPFFGLSTREVRLMDPQ

SEQ ID NO: 865913 - protein, 21 aa, Mycobacterium
TGFDAPFFGMSAREVRLMDPQ

SEQ ID NO: 865914 - protein, 22 aa, Mycobacterium
TGFDAPFFGMSTREVRLMDPQH

SEQ ID NO: 865915 - protein, 24 aa, Mycobacterium
TGFDGLLWRHYAEIGALGIGVPSD

SEQ ID NO: 865916 - protein, 33 aa, Mycobacterium
TGFDPNASWFGWASTWGNQFISSGFPINLLGVW

SEQ ID NO: 865917 - protein, 27 aa, Mycobacterium
TGFDRLRLIERITQRLPKPAPLLELDV

SEQ ID NO: 865918 - protein, 18 aa, Mycobacterium
TGFDRSRTTAWIAEGLFG

SEQ ID NO: 865919 - protein, 23 aa, Mycobacterium
TGFEDIVAVLALYRPGPMGQNAH

SEQ ID NO: 865920 - protein, 22 aa, Mycobacterium
TGFGFTLPSLFTVGVAPSFQVG

SEQ ID NO: 865921 - protein, 19 aa, Mycobacterium
TGFGMTGGDGAMGGAGGAA

SEQ ID NO: 865922 - protein, 23 aa, Mycobacterium
TGFHLKPIGFFDGNPALDLPPSP

SEQ ID NO: 865923 - protein, 26 aa, Mycobacterium
TGFKGPWLALLLLSRGHQVSGLALDS

SEQ ID NO: 865924 - protein, 28 aa, Mycobacterium
TGFLGRYLVLQWLERLELADGKLICLVR

SEQ ID NO: 865925 - protein, 27 aa, Mycobacterium
TGFLGRYLVLQWLRELEQVDGTLICLV

SEQ ID NO: 865926 - protein, 42 aa, Mycobacterium
TGFNDIGLLINFPASQFLKFAPHPGLGPLPKDALGGGLGLAP

SEQ ID NO: 865927 - protein, 18 aa, Mycobacterium
TGFPIVDAGMRQLAATGF

SEQ ID NO: 865928 - protein, 20 aa, Mycobacterium
TGFPNRWIIVGPYSWTGNGG

SEQ ID NO: 865929 - protein, 17 aa, Mycobacterium
TGFTTFAIALLMGQHLV

SEQ ID NO: 865930 - protein, 27 aa, Mycobacterium
TGGAAGATAFLGSAGVAGSAGNGGHGG

SEQ ID NO: 865931 - protein, 25 aa, Mycobacterium
TGGADDFLAWFFKADRGELEPFVLV

SEQ ID NO: 865932 - protein, 25 aa, Mycobacterium
TGGADDFLSWFFKADRGELEPFVLV

SEQ ID NO: 865933 - protein, 24 aa, Mycobacterium
TGGAGGLGLFGAGGAGGAGGMANA

SEQ ID NO: 865934 - protein, 22 aa, Mycobacterium
TGGAGGLHGAFGAGGDPGTGGG

SEQ ID NO: 865935 - protein, 23 aa, Mycobacterium
TGGAGGLLFGTGGSGGAGGGSNA

SEQ ID NO: 865936 - protein, 21 aa, Mycobacterium
TGGAGGMLFGNGGNGGAGGVG

SEQ ID NO: 865937 - protein, 22 aa, Mycobacterium
TGGAGGWLYGNGGAGGAGGASG

SEQ ID NO: 865938 - protein, 22 aa, Mycobacterium
TGGAGGWLYGNGGAGGAGGVGG

SEQ ID NO: 865939 - protein, 22 aa, Mycobacterium
TGGAGGWLYGNGGAGGSGGAGG

SEQ ID NO: 865940 - protein, 27 aa, Mycobacterium
TGGAKGPVLLWPDTFTNYLAPEVGRAA

SEQ ID NO: 865941 - protein, 23 aa, Mycobacterium
TGGAWLQVRLPEAPPPVENTPVD

SEQ ID NO: 865942 - protein, 17 aa, Mycobacterium
TGGCSVILDGTWRDEEE

SEQ ID NO: 865943 - protein, 22 aa, Mycobacterium
TGGDGALLWGNGGAGGQGGTGM

SEQ ID NO: 865944 - protein, 28 aa, Mycobacterium
TGGDGGRGFGIGKGGFGGGGGSAGLTNA

SEQ ID NO: 865945 - protein, 17 aa, Mycobacterium
TGGETFHPRGRAGAALP

SEQ ID NO: 865946 - protein, 17 aa, Mycobacterium
TGGFMLLLHLHHIAVDG

SEQ ID NO: 865947 - protein, 18 aa, Mycobacterium
TGGFSRYGLGGDGGTGGN

SEQ ID NO: 865948 - protein, 23 aa, Mycobacterium
TGGGAPMMLPPGSMGPPAGPVPP

SEQ ID NO: 865949 - protein, 25 aa, Mycobacterium
TGGGGLLLPLGVRSLRAYGPTRNAQ

SEQ ID NO: 865950 - protein, 22 aa, Mycobacterium
TGGGLLQGSGIPGVGGNGGAGG

SEQ ID NO: 865951 - protein, 23 aa, Mycobacterium
TGGHGGLLIGNGGAGGIGGTGGS

SEQ ID NO: 865952 - protein, 23 aa, Mycobacterium
TGGHGGWFGAAGTGGSGGFGFSI

SEQ ID NO: 865953 - protein, 26 aa, Mycobacterium
TGGHPPALLLPVDGPARYVATPGGQA

SEQ ID NO: 865954 - protein, 30 aa, Mycobacterium
TGGHSAGIGPLRWLPATPALLADDPEWGDY

SEQ ID NO: 865955 - protein, 22 aa, Mycobacterium
TGGIEVLFFPQAYSVYGADIAD

SEQ ID NO: 865956 - protein, 25 aa, Mycobacterium
TGGKALKFYASVRLDVRRIETLKDG

SEQ ID NO: 865957 - protein, 27 aa, Mycobacterium
TGGKPYGVDLLLPPKYVGAEQGGIDRQ

SEQ ID NO: 865958 - protein, 25 aa, Mycobacterium
TGGKRLDPGFFYAPTLLTNVDPDSE

SEQ ID NO: 865959 - protein, 23 aa, Mycobacterium
TGGKSLGNLPSGDGGVGGNAGTG

SEQ ID NO: 865960 - protein, 24 aa, Mycobacterium
TGGLAQFELLLITAALAEGWAVSV

SEQ ID NO: 865961 - protein, 22 aa, Mycobacterium
TGGLEIALYCDILIASDQARFA

SEQ ID NO: 865962 - protein, 17 aa, Mycobacterium
TGGLGGGGGTGADNTTT

SEQ ID NO: 865963 - protein, 20 aa, Mycobacterium
TGGLGGLAGLAGRIVDALAE

SEQ ID NO: 865964 - protein, 23 aa, Mycobacterium
TGGLHGAALFDADGNMLVVREDI

SEQ ID NO: 865965 - protein, 17 aa, Mycobacterium
TGGLLFGAAGDGGNGGF

SEQ ID NO: 865966 - protein, 20 aa, Mycobacterium
TGGLNWYRNFDRNWALTERL

SEQ ID NO: 865967 - protein, 20 aa, Mycobacterium
TGGLYRWEGRYLRGDDQRAS

SEQ ID NO: 865968 - protein, 27 aa, Mycobacterium
TGGMGAYAPLPWLPDDSYRQVVTEIIE

SEQ ID NO: 865969 - protein, 26 aa, Mycobacterium
TGGMGAYAPLPWLPDEVTKQIVDEIV

SEQ ID NO: 865970 - protein, 25 aa, Mycobacterium
TGGMNPYLPLLRYRTGDSARLVWSG

SEQ ID NO: 865971 - protein, 27 aa, Mycobacterium
TGGNAGEFQSLLGIGKGGDGGTGGDGG

SEQ ID NO: 865972 - protein, 35 aa, Mycobacterium
TGGNGGAILVKCQHDLSLGTHPMDVSAGTGGNGGI

SEQ ID NO: 865973 - protein, 25 aa, Mycobacterium
TGGNGGLGGLLYGSGGAGGTGGAGA

SEQ ID NO: 865974 - protein, 25 aa, Mycobacterium
TGGNHAFYLAIPPKAFPVVSEQLHK

SEQ ID NO: 865975 - protein, 26 aa, Mycobacterium
TGGNHAFYLAIPPKSFPVVCDQLHKS

SEQ ID NO: 865976 - protein, 26 aa, Mycobacterium
TGGNHAFYLAIPPKSFPVVCDQLHRS

SEQ ID NO: 865977 - protein, 25 aa, Mycobacterium
TGGNHAFYLAIPPKSFPVVCGQLHK

SEQ ID NO: 865978 - protein, 24 aa, Mycobacterium
TGGPADGQTCYWKRMADLHGGDII

SEQ ID NO: 865979 - protein, 19 aa, Mycobacterium
TGGPFFIEFRTYRFRAHSM

SEQ ID NO: 865980 - protein, 24 aa, Mycobacterium
TGGPRNLGMFLKAGDYTPMNYVPF

SEQ ID NO: 865981 - protein, 43 aa, Mycobacterium
TGGQAVIRRQPVGVLLGVMPWNFPVYQIARFAAPNLVLGNTML

SEQ ID NO: 865982 - protein, 26 aa, Mycobacterium
TGGRHRGFVILRWLDNPQAPDIEVSV

SEQ ID NO: 865983 - protein, 26 aa, Mycobacterium
TGGRHRGFVVLRWLDNPSPPEVTVSV

SEQ ID NO: 865984 - protein, 25 aa, Mycobacterium
TGGRPLDWFCSFSSAAALVGSPGQG

SEQ ID NO: 865985 - protein, 27 aa, Mycobacterium
TGGRQRGFIVLRWLDNPSPPDVTVSVH

SEQ ID NO: 865986 - protein, 34 aa, Mycobacterium
TGGRYQKVILSRRLELPFAVDFPATYRVGRRNNT

SEQ ID NO: 865987 - protein, 21 aa, Mycobacterium
TGGSARLVGFGGAGGGGGLGG

SEQ ID NO: 865988 - protein, 26 aa, Mycobacterium
TGGSHLLFNPIIVIPQVIADLQVVFT

SEQ ID NO: 865989 - protein, 23 aa, Mycobacterium
TGGSPRYQIYPAADGRYIACAAL

SEQ ID NO: 865990 - protein, 22 aa, Mycobacterium
TGGSSALLFGTGGVGGVGGSGG

SEQ ID NO: 865991 - protein, 30 aa, Mycobacterium
TGGTGGTAHLGPLAIHGQSGDPGQSGPPVV

SEQ ID NO: 865992 - protein, 28 aa, Mycobacterium
TGGTKWDKLFRFLALDRLQARLHRWRFN

SEQ ID NO: 865993 - protein, 28 aa, Mycobacterium
TGGTKWEKLFRFLALDRLQTRLHRWRLN

SEQ ID NO: 865994 - protein, 27 aa, Mycobacterium
TGGVFQNALLLRLTLAGLRDSGIHALT

SEQ ID NO: 865995 - protein, 25 aa, Mycobacterium
TGGVFQNVLLLRACRERLLRLGFEV

SEQ ID NO: 865996 - protein, 27 aa, Mycobacterium
TGGVGGAGGISLLWGSGGDGGDGGAAG

SEQ ID NO: 865997 - protein, 21 aa, Mycobacterium
TGGVQKPILWGPGKAAAVQRF

SEQ ID NO: 865998 - protein, 22 aa, Mycobacterium
TGGYLLDVALQRAIDQGWHAGP

SEQ ID NO: 865999 - protein, 20 aa, Mycobacterium
TGGYLLDVALQRAIEQGWHP

SEQ ID NO: 866000 - protein, 19 aa, Mycobacterium
TGHAIAMGAFLLCSGDHRV

SEQ ID NO: 866001 - protein, 23 aa, Mycobacterium
TGHAPRRPAYTPAPPRATASSSV

SEQ ID NO: 866002 - protein, 29 aa, Mycobacterium
TGHDQLFDTLFLYENYPIDAGALLGVHEL

SEQ ID NO: 866003 - protein, 29 aa, Mycobacterium
TGHDQLFDTLFLYENYPIDAGALSGADEL

SEQ ID NO: 866004 - protein, 29 aa, Mycobacterium
TGHEGADATYMWPWMFSKVADEYDRRYCL

SEQ ID NO: 866005 - protein, 27 aa, Mycobacterium
TGHEGADVRYLWPSMFAQVADEYDRRY

SEQ ID NO: 866006 - protein, 25 aa, Mycobacterium
TGHEGAEARYLWPSVFTQVADEYDR

SEQ ID NO: 866007 - protein, 18 aa, Mycobacterium
TGHHAGAPLLPRMARSLA

SEQ ID NO: 866008 - protein, 30 aa, Mycobacterium
TGHHNWALLRALPEFVATGIPVLLGASRKR

SEQ ID NO: 866009 - protein, 17 aa, Mycobacterium
TGHKPTFGLVSRSGVSA

SEQ ID NO: 866010 - protein, 32 aa, Mycobacterium
TGHKWFTSAPMCDIFLVLAQAPKGLSCFMLPR

SEQ ID NO: 866011 - protein, 21 aa, Mycobacterium
TGHLDGFLYLDRLVGRHARSA

SEQ ID NO: 866012 - protein, 22 aa, Mycobacterium
TGHLEAVFRKGAYGAAYSGAEG

SEQ ID NO: 866013 - protein, 18 aa, Mycobacterium
TGHLLLDLARRNGGRQEF

SEQ ID NO: 866014 - protein, 17 aa, Mycobacterium
TGHPFLQHLLAHRDVTR

SEQ ID NO: 866015 - protein, 18 aa, Mycobacterium
TGHQVFVNTFGVFATRRP

SEQ ID NO: 866016 - protein, 31 aa, Mycobacterium
TGHRYATTPVSWFLFPALTRHHTRQQARDRR

SEQ ID NO: 866017 - protein, 28 aa, Mycobacterium
TGHYLGCVHLQRLLREPPATLVSGIIDS

SEQ ID NO: 866018 - protein, 27 aa, Mycobacterium
TGHYLGCVHLQRLLREPPATLVSGIVD

SEQ ID NO: 866019 - protein, 26 aa, Mycobacterium
TGHYSALNVFKLFGPGNRAPLSFPMA

SEQ ID NO: 866020 - protein, 18 aa, Mycobacterium
TGIAKLARPNLKAHYGPR

SEQ ID NO: 866021 - protein, 18 aa, Mycobacterium
TGIALALVAAARGYRCVL

SEQ ID NO: 866022 - protein, 23 aa, Mycobacterium
TGIALAMVAAARGYKCVLTMPDT

SEQ ID NO: 866023 - protein, 20 aa, Mycobacterium
TGIALAMVSAARGYKCVLTM

SEQ ID NO: 866024 - protein, 27 aa, Mycobacterium
TGIDDALALIYLLASPDADVLGIASTG

SEQ ID NO: 866025 - protein, 18 aa, Mycobacterium
TGIDLVRAQLLVAAGEPL

SEQ ID NO: 866026 - protein, 24 aa, Mycobacterium
TGIDRRDWPLFRTVFTADCELDYG

SEQ ID NO: 866027 - protein, 25 aa, Mycobacterium
TGIEPEVIYLYNGPNGLVSFDMTLK

SEQ ID NO: 866028 - protein, 19 aa, Mycobacterium
TGIFLVPAQWQAVCAEQQA

SEQ ID NO: 866029 - protein, 26 aa, Mycobacterium
TGIGELKFFSQIGYGGGAAAATVQQA

SEQ ID NO: 866030 - protein, 23 aa, Mycobacterium
TGIGGDGGPGSPGAFAGQQGGNG

SEQ ID NO: 866031 - protein, 22 aa, Mycobacterium
TGILYIEIQLMYASLVHGSALQ

SEQ ID NO: 866032 - protein, 27 aa, Mycobacterium
TGIPAERVLVIIGNSPARFAIEGGRIL

SEQ ID NO: 866033 - protein, 17 aa, Mycobacterium
TGIPALYAEHWEPLWAA

SEQ ID NO: 866034 - protein, 26 aa, Mycobacterium
TGIPALYAEHWEPLWAACEDTGVVVN

SEQ ID NO: 866035 - protein, 19 aa, Mycobacterium
TGIPVFKLTEEETTRLLRM

SEQ ID NO: 866036 - protein, 18 aa, Mycobacterium
TGIPYGPKVLARYDDFSF

SEQ ID NO: 866037 - protein, 24 aa, Mycobacterium
TGIRLRDKHLLSADFFEVERFPEI

SEQ ID NO: 866038 - protein, 25 aa, Mycobacterium
TGISRAMIANRISYAFGLQGPSMTV

SEQ ID NO: 866039 - protein, 20 aa, Mycobacterium
TGITPFTEPPVPLVLQEMTL

SEQ ID NO: 866040 - protein, 24 aa, Mycobacterium
TGKAALYRRWATKCELVHAALVHT

SEQ ID NO: 866041 - protein, 21 aa, Mycobacterium
TGKENMVMFGSSYPHWQLNEP

SEQ ID NO: 866042 - protein, 23 aa, Mycobacterium
TGKFEWLDDNVVQWVPDRFWPAH

SEQ ID NO: 866043 - protein, 24 aa, Mycobacterium
TGKKALLMHGALWQGTVVATMAGW

SEQ ID NO: 866044 - protein, 23 aa, Mycobacterium
TGKLANNLISAAGAYLNSDEGLA

SEQ ID NO: 866045 - protein, 25 aa, Mycobacterium
TGKLFSLKMIPLRVKQMRLHRATST

SEQ ID NO: 866046 - protein, 22 aa, Mycobacterium
TGKLILDIPRAGSSSVVLPPQQ

SEQ ID NO: 866047 - protein, 17 aa, Mycobacterium
TGKPARLLKTKWTDAWD

SEQ ID NO: 866048 - protein, 25 aa, Mycobacterium
TGKPGWFLFDGLVKHDLRTGSQQEF

SEQ ID NO: 866049 - protein, 24 aa, Mycobacterium
TGKPGWFLFDGLVKHDLRTGTEER

SEQ ID NO: 866050 - protein, 22 aa, Mycobacterium
TGKPHGWIHNELRRICGGPPVA

SEQ ID NO: 866051 - protein, 24 aa, Mycobacterium
TGKRLEIPIKRILLGAAPGEAVQQ

SEQ ID NO: 866052 - protein, 26 aa, Mycobacterium
TGKSLYIAVLVKQLELLCERFGVSMQ

SEQ ID NO: 866053 - protein, 25 aa, Mycobacterium
TGKSQLYHYFKDRSELVKAVVERQT

SEQ ID NO: 866054 - protein, 26 aa, Mycobacterium
TGKSVFLKSLIGLLRPERGKIVVDGT

SEQ ID NO: 866055 - protein, 25 aa, Mycobacterium
TGKSVFLKSLIGLLRPERGSILIDG

SEQ ID NO: 866056 - protein, 26 aa, Mycobacterium
TGKSVFLKSLIGLLRPERGSIVIDGT

SEQ ID NO: 866057 - protein, 17 aa, Mycobacterium
TGKTAAFAIPILSKIDT

SEQ ID NO: 866058 - protein, 24 aa, Mycobacterium
TGKTAAFAIPILSKIDTTSTATQA

SEQ ID NO: 866059 - protein, 25 aa, Mycobacterium
TGKTAAFAIPILSKIDVASKATQAL

SEQ ID NO: 866060 - protein, 24 aa, Mycobacterium
TGKTMVVTGLQLLGGARADPTRVR

SEQ ID NO: 866061 - protein, 21 aa, Mycobacterium
TGKWDQWTLLARARAADSTCF

SEQ ID NO: 866062 - protein, 22 aa, Mycobacterium
TGLAAARHAVLARAGWDVSRDG

SEQ ID NO: 866063 - protein, 17 aa, Mycobacterium
TGLAELCTLTWTVYSLP

SEQ ID NO: 866064 - protein, 25 aa, Mycobacterium
TGLAGHLAALLYDIPHVLTAHSLEP

SEQ ID NO: 866065 - protein, 27 aa, Mycobacterium
TGLALSPTLIFDYPTPNGLAGYIRGEL

SEQ ID NO: 866066 - protein, 27 aa, Mycobacterium
TGLALSPTLIFDYPTPNGLAGYIRTEL

SEQ ID NO: 866067 - protein, 19 aa, Mycobacterium
TGLAPYILEYIDNMTMAAL

SEQ ID NO: 866068 - protein, 17 aa, Mycobacterium
TGLDISPTALITAARRA

SEQ ID NO: 866069 - protein, 19 aa, Mycobacterium
TGLDLVALQLAIAGGASYG

SEQ ID NO: 866070 - protein, 24 aa, Mycobacterium
TGLDTLVVLLPRSAKLDDGAAAAA

SEQ ID NO: 866071 - protein, 20 aa, Mycobacterium
TGLEPRVLSFLLTSPESVFE

SEQ ID NO: 866072 - protein, 22 aa, Mycobacterium
TGLESTLRFLLSGKSAYVDGQV

SEQ ID NO: 866073 - protein, 22 aa, Mycobacterium
TGLFDTLPTFRRTLDSSGLDDH

SEQ ID NO: 866074 - protein, 22 aa, Mycobacterium
TGLFRVAPPATVDWYSVDLPGV

SEQ ID NO: 866075 - protein, 24 aa, Mycobacterium
TGLGEGWFINQHITWRVGDEDVAE

SEQ ID NO: 866076 - protein, 38 aa, Mycobacterium
TGLGMLTAFEEMFWGDAGIALSIMGTGLAAAALAGNGT

SEQ ID NO: 866077 - protein, 38 aa, Mycobacterium; identical to SEQ ID NO: 117851

SEQ ID NO: 866078 - protein, 25 aa, Mycobacterium
TGLGSIYRMRLALPQLDPSGLALGR

SEQ ID NO: 866079 - protein, 20 aa, Mycobacterium
TGLHRVLTTPLVRSGKPMVT

SEQ ID NO: 866080 - protein, 17 aa, Mycobacterium
TGLIGDRLPMDKVLAGV

SEQ ID NO: 866081 - protein, 23 aa, Mycobacterium
TGLIGDRLPMDKVLAGVRTIVQD

SEQ ID NO: 866082 - protein, 18 aa, Mycobacterium
TGLIYRAIGFPTRMFTVL

SEQ ID NO: 866083 - protein, 19 aa, Mycobacterium
TGLIYRALGFPVRMFTVLF

SEQ ID NO: 866084 - protein, 24 aa, Mycobacterium
TGLKGWFQRWFFTAVGQVPIDRTD

SEQ ID NO: 866085 - protein, 29 aa, Mycobacterium
TGLKVPWAHAILPKRLVFAAAARKYGHPV

SEQ ID NO: 866086 - protein, 28 aa, Mycobacterium
TGLLADGPVVLFFYPAAMTPGCTKEACH

SEQ ID NO: 866087 - protein, 22 aa, Mycobacterium
TGLLDRRLPDFAPAPPTDDDLI

SEQ ID NO: 866088 - protein, 20 aa, Mycobacterium
TGLLGFVKFGARKWEQDEIN

SEQ ID NO: 866089 - protein, 20 aa, Mycobacterium
TGLLGVRKWVRIAGVHFAPD

SEQ ID NO: 866090 - protein, 22 aa, Mycobacterium
TGLLIDHLLPVEGSRVVAVASV

SEQ ID NO: 866091 - protein, 17 aa, Mycobacterium
TGLLTYRALQDMGIAVR

SEQ ID NO: 866092 - protein, 20 aa, Mycobacterium
TGLLVPPQYVNVAALGPPTG

SEQ ID NO: 866093 - protein, 21 aa, Mycobacterium
TGLMIYLEPTCFEGRALGALF

SEQ ID NO: 866094 - protein, 31 aa, Mycobacterium
TGLPDAVLVPDPTTFRVLPWADRTGWVLSEM

SEQ ID NO: 866095 - protein, 25 aa, Mycobacterium
TGLPVTFSLLVLNAGEPLWREAMEM

SEQ ID NO: 866096 - protein, 21 aa, Mycobacterium
TGLRAGHRVLVIGAGPIGLFA

SEQ ID NO: 866097 - protein, 26 aa, Mycobacterium
TGLRCPWSSCLPLPSPAVRIRIRGSS

SEQ ID NO: 866098 - protein, 17 aa, Mycobacterium
TGLRNLFKLSSLASFEG

SEQ ID NO: 866099 - protein, 18 aa, Mycobacterium
TGLRPAWIADLHNVFGSA

SEQ ID NO: 866100 - protein, 25 aa, Mycobacterium
TGLRWIMQNGMWNFGLDSPAALARA

SEQ ID NO: 866101 - protein, 21 aa, Mycobacterium
TGLSAFRDRFPDRFFDVGIAE

SEQ ID NO: 866102 - protein, 26 aa, Mycobacterium
TGLSGGIVWLPNNPLMRADGIADSHE

SEQ ID NO: 866103 - protein, 25 aa, Mycobacterium
TGLSGGIVWLPNNPLMRAEGIADTH

SEQ ID NO: 866104 - protein, 26 aa, Mycobacterium
TGLSGGMVWLPNNPLMRADGIPDSHE

SEQ ID NO: 866105 - protein, 24 aa, Mycobacterium
TGLSPKLQQMLLGSNPASLTGQGL

SEQ ID NO: 866106 - protein, 17 aa, Mycobacterium
TGLTDPIGPFASGVLSG

SEQ ID NO: 866107 - protein, 19 aa, Mycobacterium
TGLTLACELTRRGIACRVL

SEQ ID NO: 866108 - protein, 23 aa, Mycobacterium
TGLTLSGLDLRRAGSRAQCIQMV

SEQ ID NO: 866109 - protein, 26 aa, Mycobacterium
TGLTLSPTLIFDYPSPAALAEHLDGQ

SEQ ID NO: 866110 - protein, 26 aa, Mycobacterium
TGLTLSPTLIFDYPTPAALAEHLDSR

SEQ ID NO: 866111 - protein, 27 aa, Mycobacterium
TGLVAFSLHFPWSQQLPVHSLDGTAVL

SEQ ID NO: 866112 - protein, 25 aa, Mycobacterium
TGLVAFSLHYPWSQGLAVHSLDGRD

SEQ ID NO: 866113 - protein, 24 aa, Mycobacterium
TGLVAFSLHYPWSQRLPVHSLDGT

SEQ ID NO: 866114 - protein, 19 aa, Mycobacterium
TGLVMRRLVDYRLSPLLAS

SEQ ID NO: 866115 - protein, 27 aa, Mycobacterium
TGLVPRRIPALPDLDGIRVLRTFDESM

SEQ ID NO: 866116 - protein, 20 aa, Mycobacterium
TGLVPRRIPSIPDLEGIRVL

SEQ ID NO: 866117 - protein, 18 aa, Mycobacterium
TGLVRGLLTAAAGFSPRA

SEQ ID NO: 866118 - protein, 20 aa, Mycobacterium
TGLVRLAFLHSQAGSFVPDL

SEQ ID NO: 866119 - protein, 18 aa, Mycobacterium
TGLWGRLFPEWGAVRDLP

SEQ ID NO: 866120 - protein, 19 aa, Mycobacterium
TGLWGRLFPEWGAVRDLPP

SEQ ID NO: 866121 - protein, 19 aa, Mycobacterium
TGMFISLMFAGHHTSSGTA

SEQ ID NO: 866122 - protein, 34 aa, Mycobacterium
TGMFRDTLIYERGGWYFTSRALQWDSVPSRHPLV

SEQ ID NO: 866123 - protein, 26 aa, Mycobacterium
TGMGIDRLMMALTGLSIRETVLFPIV

SEQ ID NO: 866124 - protein, 25 aa, Mycobacterium
TGMGKTFAFGVPLLHRITTDTERPL

SEQ ID NO: 866125 - protein, 26 aa, Mycobacterium
TGMGKTFAFGVPLLQRITSDTAARPL

SEQ ID NO: 866126 - protein, 27 aa, Mycobacterium
TGMGKTFAFGVPLLQRITSGTAARPLN

SEQ ID NO: 866127 - protein, 26 aa, Mycobacterium
TGMGKTLAFGVPLLNRITAGVGVRAL

SEQ ID NO: 866128 - protein, 27 aa, Mycobacterium
TGMGKTYAFGVPLLHRIATGVEDRPLN

SEQ ID NO: 866129 - protein, 25 aa, Mycobacterium
TGMGKTYAFGVPLLHRVSSDENRPL

SEQ ID NO: 866130 - protein, 22 aa, Mycobacterium
TGMGPYARTTGRPQGRGLRIGM

SEQ ID NO: 866131 - protein, 18 aa, Mycobacterium
TGMGVERVAFILQGVHNV

SEQ ID NO: 866132 - protein, 22 aa, Mycobacterium
TGMGVERVAFILQGVHNVYETD

SEQ ID NO: 866133 - protein, 28 aa, Mycobacterium
TGMHLAQGILLALLARDRTGEGQKVQVN

SEQ ID NO: 866134 - protein, 19 aa, Mycobacterium
TGMLARLLEPLYATSAIAE

SEQ ID NO: 866135 - protein, 23 aa, Mycobacterium
TGMLDERALFLGQWGLRGQRGAD

SEQ ID NO: 866136 - protein, 25 aa, Mycobacterium
TGMPAGTFSLLYGYGPDLGSALVTD

SEQ ID NO: 866137 - protein, 19 aa, Mycobacterium
TGMPYGPKVLARYDDFSFN

SEQ ID NO: 866138 - protein, 18 aa, Mycobacterium
TGMPYGPKVLARYDNFSF

SEQ ID NO: 866139 - protein, 19 aa, Mycobacterium
TGMPYGPKVLARYDNFSFN

SEQ ID NO: 866140 - protein, 18 aa, Mycobacterium
TGMRSVIFVARTLGRFDV

SEQ ID NO: 866141 - protein, 21 aa, Mycobacterium
TGMTAYDWLTWRVTKGAEDAQ

SEQ ID NO: 866142 - protein, 17 aa, Mycobacterium
TGMWALRYPESHNLYIL

SEQ ID NO: 866143 - protein, 26 aa, Mycobacterium
TGNALTAYFMGSLRTAIHHQMVEMYA

SEQ ID NO: 866144 - protein, 21 aa, Mycobacterium
TGNAPQWLAQHGFVPTDKPVA

SEQ ID NO: 866145 - protein, 24 aa, Mycobacterium
TGNGLPFKIRDIPVAPDITGLVRS

SEQ ID NO: 866146 - protein, 22 aa, Mycobacterium
TGNKFWLGKVNLTMAMAKGTVR

SEQ ID NO: 866147 - protein, 23 aa, Mycobacterium
TGNKIILFGARTGLDGIGGVSVL

SEQ ID NO: 866148 - protein, 17 aa, Mycobacterium
TGNLFAQNAAHGALPTL

SEQ ID NO: 866149 - protein, 28 aa, Mycobacterium
TGNPAPELLPLAAVGWPDGSVLPLLYGA

SEQ ID NO: 866150 - protein, 23 aa, Mycobacterium
TGNPPWVMAPMIATAEEAKTFAD

SEQ ID NO: 866151 - protein, 18 aa, Mycobacterium
TGNPRQRTAYLKIDYRHI

SEQ ID NO: 866152 - protein, 20 aa, Mycobacterium
TGNTTGVYYTLGGALAEAIS

SEQ ID NO: 866153 - protein, 28 aa, Mycobacterium
TGNTTYYMFMTKNLPLLEPVRAIPFIGN

SEQ ID NO: 866154 - protein, 30 aa, Mycobacterium
TGNWASIVPHTWLWTTPTGGEIRPVPLVDP

SEQ ID NO: 866155 - protein, 22 aa, Mycobacterium
TGPALVEIFARRLRDRSTVRFA

SEQ ID NO: 866156 - protein, 23 aa, Mycobacterium
TGPALVLPLRATDAVAGVVVLLH

SEQ ID NO: 866157 - protein, 26 aa, Mycobacterium
TGPAVLMWPSLLMTGDLWAGQAARFG

SEQ ID NO: 866158 - protein, 20 aa, Mycobacterium
TGPDAWIVIEKILAVDEALD

SEQ ID NO: 866159 - protein, 23 aa, Mycobacterium
TGPDDLVFLMYTSGTTGAPKGVM

SEQ ID NO: 866160 - protein, 32 aa, Mycobacterium
TGPDDVVMGCLPLFHVFGLTCGLNASVIAGAT

SEQ ID NO: 866161 - protein, 19 aa, Mycobacterium
TGPDERITRRAILAEGDVV

SEQ ID NO: 866162 - protein, 24 aa, Mycobacterium
TGPDGLYRFLTIKPGPYPWRNHRN

SEQ ID NO: 866163 - protein, 37 aa, Mycobacterium
TGPEPLIHIVGTGGLLPIKIPIIDIAAAPGFGNSTTT

SEQ ID NO: 866164 - protein, 27 aa, Mycobacterium
TGPFHNRRALLDVPRLGPKAFEQCAGF

SEQ ID NO: 866165 - protein, 28 aa, Mycobacterium
TGPFRNRKALLDVPRLGPKAFEQCAGFL

SEQ ID NO: 866166 - protein, 24 aa, Mycobacterium
TGPGKLEQWTLLARARAIDTSSVV

SEQ ID NO: 866167 - protein, 22 aa, Mycobacterium
TGPHLHFEVHRNGTDKIDPMAW

SEQ ID NO: 866168 - protein, 17 aa, Mycobacterium
TGPIFTNLLLADEINRT

SEQ ID NO: 866169 - protein, 17 aa, Mycobacterium
TGPILRSTGLPHDLRKS

SEQ ID NO: 866170 - protein, 18 aa, Mycobacterium
TGPLEPLDIAGGCAAGAI

SEQ ID NO: 866171 - protein, 17 aa, Mycobacterium
TGPLFIGRDTHGLSEPA

SEQ ID NO: 866172 - protein, 21 aa, Mycobacterium
TGPLGPLTALDDDALRRTVEV

SEQ ID NO: 866173 - protein, 21 aa, Mycobacterium
TGPLKAGLLLEAEDLVKAVEQ

SEQ ID NO: 866174 - protein, 18 aa, Mycobacterium
TGPLLDGLVMDEDCLVLS

SEQ ID NO: 866175 - protein, 23 aa, Mycobacterium
TGPLLQANWTWARSALDEGQVAR

SEQ ID NO: 866176 - protein, 17 aa, Mycobacterium
TGPMVIERLAAPGSLPG

SEQ ID NO: 866177 - protein, 17 aa, Mycobacterium
TGPPHQDCLPAPLVDQA

SEQ ID NO: 866178 - protein, 23 aa, Mycobacterium
TGPQGEPWPLQDTVRPWDSLDDD

SEQ ID NO: 866179 - protein, 34 aa, Mycobacterium
TGPRHRLRLMSQTLERLLPIPPTAQKLSTGVAVL

SEQ ID NO: 866180 - protein, 25 aa, Mycobacterium
TGPRMMELVRSYADWWNVPANHLDK

SEQ ID NO: 866181 - protein, 35 aa, Mycobacterium
TGPRRTSWPLAFKPSTYLGLLKLGWIGAKVLGGRS

SEQ ID NO: 866182 - protein, 23 aa, Mycobacterium
TGPSPAWVYIDHRVEPGPPRPGY

SEQ ID NO: 866183 - protein, 33 aa, Mycobacterium
TGPSSALSLFTIAGVPYLLGIQSYLLPQNVANV

SEQ ID NO: 866184 - protein, 26 aa, Mycobacterium
TGPVEGWMPFGRVFETLAWGRRHVVM

SEQ ID NO: 866185 - protein, 34 aa, Mycobacterium
TGPVSIGHAFLFRQLTEDLIYFTHGTDLDEDSRA

SEQ ID NO: 866186 - protein, 26 aa, Mycobacterium
TGPVVATPIMRWLHSVEGPVEQFNQT

SEQ ID NO: 866187 - protein, 22 aa, Mycobacterium
TGPYGFVLGSYLWMIEATSAHL

SEQ ID NO: 866188 - protein, 29 aa, Mycobacterium
TGPYGFVLGSYLWMIEATSAHLARAIAET

SEQ ID NO: 866189 - protein, 26 aa, Mycobacterium
TGQAGAAGGILWGNGGSGGSGAAGQA

SEQ ID NO: 866190 - protein, 26 aa, Mycobacterium
TGQDKLFDTLFAYENYPLDTSAMAVD

SEQ ID NO: 866191 - protein, 25 aa, Mycobacterium
TGQDLLLITVLKGAVIFVTDLARAI

SEQ ID NO: 866192 - protein, 26 aa, Mycobacterium
TGQHNWALLHALPDFVSTGIPVLVGA

SEQ ID NO: 866193 - protein, 31 aa, Mycobacterium
TGQHNWALLHALPRLVATGIPVLLGASRKRF

SEQ ID NO: 866194 - protein, 27 aa, Mycobacterium
TGQHVGPIRLSFLDIPAAPGFGNSTTN

SEQ ID NO: 866195 - protein, 33 aa, Mycobacterium
TGQLARVQARRWAPTAFLQGIQRAIHAAIVAVA

SEQ ID NO: 866196 - protein, 26 aa, Mycobacterium
TGQLVDVPLPSWTRRSYLLDLSAQAQ

SEQ ID NO: 866197 - protein, 27 aa, Mycobacterium
TGQNGGDGGLLWGNGGNGGTGAAGQAG

SEQ ID NO: 866198 - protein, 29 aa, Mycobacterium
TGQPAWSQWYAGRPLLVTANDYGLRLYNG

SEQ ID NO: 866199 - protein, 21 aa, Mycobacterium
TGQPVELLWVKGSGGDLGTLT

SEQ ID NO: 866200 - protein, 25 aa, Mycobacterium
TGQQRWAVRWKPALNAFAVTFANRM

SEQ ID NO: 866201 - protein, 22 aa, Mycobacterium
TGQQYRFVLPGPELTAPVQEEC

SEQ ID NO: 866202 - protein, 23 aa, Mycobacterium
TGQRLHTTWTWAPSALDEEQIQR

SEQ ID NO: 866203 - protein, 27 aa, Mycobacterium
TGQTGQAGGLLWGNGGAGGSGAPGQSG

SEQ ID NO: 866204 - protein, 24 aa, Mycobacterium
TGQTPLDAQYWRRHSRQPVQFAES

SEQ ID NO: 866205 - protein, 19 aa, Mycobacterium
TGQTWPPKPAQRLLRLVAT

SEQ ID NO: 866206 - protein, 19 aa, Mycobacterium
TGQVRIPMLAGRRSLNLSN

SEQ ID NO: 866207 - protein, 25 aa, Mycobacterium
TGQVRRWRSALLPETRTRAVLMIAI

SEQ ID NO: 866208 - protein, 20 aa, Mycobacterium
TGQWRWREAAAQLLDAALDH

SEQ ID NO: 866209 - protein, 30 aa, Mycobacterium
TGRARVWVPAAAPLPAVWVPGADLRAADAL

SEQ ID NO: 866210 - protein, 26 aa, Mycobacterium
TGRASGFFAQFDMLILHTVGAKSGQP

SEQ ID NO: 866211 - protein, 29 aa, Mycobacterium
TGRDLLGTHYVPPFPYFMGSANAFQVLAG

SEQ ID NO: 866212 - protein, 20 aa, Mycobacterium
TGRELLLSCGAVLDHLRVAM

SEQ ID NO: 866213 - protein, 30 aa, Mycobacterium
TGRENLLMFGRLQGLKKKVAKQRAQELLEQ

SEQ ID NO: 866214 - protein, 26 aa, Mycobacterium
TGRENLVLFGRLRGLNRRQAKTRADE

SEQ ID NO: 866215 - protein, 32 aa, Mycobacterium
TGRFDDEQLFYLRARGIPEAQARRLVVRGFFN

SEQ ID NO: 866216 - protein, 27 aa, Mycobacterium
TGRFDDEQLFYLRSRGIPEEDARRLVV

SEQ ID NO: 866217 - protein, 18 aa, Mycobacterium
TGRGIWGEPADRAECIAV

SEQ ID NO: 866218 - protein, 18 aa, Mycobacterium
TGRGWPTRCMSAQSSAPS

SEQ ID NO: 866219 - protein, 19 aa, Mycobacterium
TGRGWRVSTRPRRDLFGDY

SEQ ID NO: 866220 - protein, 24 aa, Mycobacterium
TGRHFKRLWGLPGTQLGVVSWPSE

SEQ ID NO: 866221 - protein, 30 aa, Mycobacterium
TGRLGLVPLRWALACLLIDLGSVTLSTRQL

SEQ ID NO: 866222 - protein, 17 aa, Mycobacterium
TGRLIMQYASENLIPVT

SEQ ID NO: 866223 - protein, 18 aa, Mycobacterium
TGRMIAGVLASLAELELE

SEQ ID NO: 866224 - protein, 23 aa, Mycobacterium
TGRPAISVPLHWTDRGLPLGVQL

SEQ ID NO: 866225 - protein, 24 aa, Mycobacterium
TGRPAIVLPAFLSRGYHVRADLPA

SEQ ID NO: 866226 - protein, 21 aa, Mycobacterium
TGRPDLLIRVAGGYLPADVKH

SEQ ID NO: 866227 - protein, 24 aa, Mycobacterium
TGRPFAASAPRIGRPRWDTAIVGL

SEQ ID NO: 866228 - protein, 24 aa, Mycobacterium
TGRPFEYAYDLFRADRVRLTATSH

SEQ ID NO: 866229 - protein, 23 aa, Mycobacterium
TGRPKLVPISHGALALFVRAAGD

SEQ ID NO: 866230 - protein, 21 aa, Mycobacterium
TGRPLLPVPGDWLARRRAGDE

SEQ ID NO: 866231 - protein, 18 aa, Mycobacterium
TGRPRFAQLGYTLATDIR

SEQ ID NO: 866232 - protein, 23 aa, Mycobacterium
TGRPYLVEGVGEDFWPAAYDPAV

SEQ ID NO: 866233 - protein, 23 aa, Mycobacterium
TGRPYLVEGVGEDFWPAAYDPGV

SEQ ID NO: 866234 - protein, 17 aa, Mycobacterium
TGRPYLVEGVGEDFWPT

SEQ ID NO: 866235 - protein, 25 aa, Mycobacterium
TGRQLVKIPLPRKLAKGSLAHVPGL

SEQ ID NO: 866236 - protein, 25 aa, Mycobacterium
TGRRGKYLWLTLDDSAALVVHLGMS

SEQ ID NO: 866237 - protein, 20 aa, Mycobacterium
TGRRLHEGFFDFAQSNPGMP

SEQ ID NO: 866238 - protein, 26 aa, Mycobacterium
TGRRRPIPGLHWPWVARIGTVVMSWR

SEQ ID NO: 866239 - protein, 26 aa, Mycobacterium
TGRRRRCGWFDAVVARYATRVNGITD

SEQ ID NO: 866240 - protein, 39 aa, Mycobacterium
TGRRTMGLVRRYADWWNIPSHQLDRLPDLLPTVGAARAS

SEQ ID NO: 866241 - protein, 25 aa, Mycobacterium
TGRSFSDFPTILRSISERLGTLPGD

SEQ ID NO: 866242 - protein, 28 aa, Mycobacterium
TGRSMDWKVEIGTNLWALPRGVARTGQA

SEQ ID NO: 866243 - protein, 24 aa, Mycobacterium
TGRSVFLRGLARRLLLARQCPNCE

SEQ ID NO: 866244 - protein, 24 aa, Mycobacterium
TGRTPMQWITDQRVLYARRMLEET

SEQ ID NO: 866245 - protein, 23 aa, Mycobacterium
TGRVRWLRGPAEQLPFDDGALDA

SEQ ID NO: 866246 - protein, 23 aa, Mycobacterium
TGRVTPFAFMTPVKVAGSTVAQA

SEQ ID NO: 866247 - protein, 24 aa, Mycobacterium
TGRVTPFAFMTPVKVAGSTVAQAT

SEQ ID NO: 866248 - protein, 22 aa, Mycobacterium
TGRWADYLLASRSTTIYGGTSE

SEQ ID NO: 866249 - protein, 20 aa, Mycobacterium
TGRYLGCVHLQRLLREAPAE

SEQ ID NO: 866250 - protein, 23 aa, Mycobacterium
TGRYLGCVHLQRLLREPPSEIVG

SEQ ID NO: 866251 - protein, 23 aa, Mycobacterium
TGRYQQRCWLRQLTPYANRQQEN

SEQ ID NO: 866252 - protein, 25 aa, Mycobacterium
TGSAGLVVPIWDIGLQNLGVPTGFD

SEQ ID NO: 866253 - protein, 19 aa, Mycobacterium
TGSAIGQHWMYDGKHVLIV

SEQ ID NO: 866254 - protein, 20 aa, Mycobacterium
TGSAIGQHWMYNGKHVLIVF

SEQ ID NO: 866255 - protein, 27 aa, Mycobacterium
TGSAPTIFPRHISVPTIPALARARRHL

SEQ ID NO: 866256 - protein, 26 aa, Mycobacterium
TGSARVHYHVPLHLAPPAPLSNTSHV

SEQ ID NO: 866257 - protein, 27 aa, Mycobacterium
TGSEPPVIGPPLRPGSPELTLTGGVPG

SEQ ID NO: 866258 - protein, 24 aa, Mycobacterium
TGSGHPWWTLSQLSGEAVLELDVR

SEQ ID NO: 866259 - protein, 27 aa, Mycobacterium
TGSGKTLAAFLWAIDGLAREPRAERGT

SEQ ID NO: 866260 - protein, 26 aa, Mycobacterium
TGSGKTLAAFLWAIDTLVQEKEAEAA

SEQ ID NO: 866261 - protein, 27 aa, Mycobacterium
TGSGKTLAAFLWALDSLARSADRPAGT

SEQ ID NO: 866262 - protein, 27 aa, Mycobacterium
TGSGKTLAFSIPLVAALTGIRRQASRP

SEQ ID NO: 866263 - protein, 22 aa, Mycobacterium
TGSGYQRLFMPLFGKLIPAPHR

SEQ ID NO: 866264 - protein, 23 aa, Mycobacterium
TGSMLSALWESGKNRLVLIVHHL

SEQ ID NO: 866265 - protein, 23 aa, Mycobacterium
TGSMLSAVWVPGTAQLALVIHHL

SEQ ID NO: 866266 - protein, 29 aa, Mycobacterium
TGSNLAGFLLGPTLFNIGFANDGVGNILA

SEQ ID NO: 866267 - protein, 19 aa, Mycobacterium
TGSPWLRALAEGAPAAVSV

SEQ ID NO: 866268 - protein, 37 aa, Mycobacterium
TGSRISVAMPMFHGLGLGMLMLTIALGGTVLTHRQFD

SEQ ID NO: 866269 - protein, 18 aa, Mycobacterium
TGSRRQRTAYLKIDYRNI

SEQ ID NO: 866270 - protein, 21 aa, Mycobacterium
TGSRWLAHYTATSGYLDALAY

SEQ ID NO: 866271 - protein, 27 aa, Mycobacterium
TGSVAYRYTWHLPKNRTWTYDGQLNMV

SEQ ID NO: 866272 - protein, 31 aa, Mycobacterium
TGSVENYVAVPWFWTHQYSAKLQIAGKALEV

SEQ ID NO: 866273 - protein, 28 aa, Mycobacterium
TGSVLGMPFYLMRAIDGWSPMDGGWPAP

SEQ ID NO: 866274 - protein, 29 aa, Mycobacterium
TGSVRWVSPEFLRFGYRTSVLKHSSQWVV

SEQ ID NO: 866275 - protein, 21 aa, Mycobacterium
TGTAALFAFGAALDPQFGSDS

SEQ ID NO: 866276 - protein, 22 aa, Mycobacterium
TGTAALFAFGGPLDPRFGSDSS

SEQ ID NO: 866277 - protein, 24 aa, Mycobacterium
TGTADAILHVLARDMRHLEEALER

SEQ ID NO: 866278 - protein, 17 aa, Mycobacterium
TGTAMLADWLARIRTGV

SEQ ID NO: 866279 - protein, 27 aa, Mycobacterium
TGTAVGDWLDEHGHPRYADDTDSPAAK

SEQ ID NO: 866280 - protein, 25 aa, Mycobacterium
TGTDDLVFLVIYDSAEPRLSRGPAE

SEQ ID NO: 866281 - protein, 23 aa, Mycobacterium
TGTDSTDPTLAGQAGGQGGTGGT

SEQ ID NO: 866282 - protein, 25 aa, Mycobacterium
TGTELLRPGWLEIASDRVVAVGAGA

SEQ ID NO: 866283 - protein, 20 aa, Mycobacterium
TGTEPAWAIFCHELEAFLAE

SEQ ID NO: 866284 - protein, 25 aa, Mycobacterium
TGTERAVLLVLMAASRPVPNRELAV

SEQ ID NO: 866285 - protein, 21 aa, Mycobacterium
TGTEVEAFFARRAYLRDTSDE

SEQ ID NO: 866286 - protein, 19 aa, Mycobacterium
TGTFLGMRAAVEPMTAAGS

SEQ ID NO: 866287 - protein, 18 aa, Mycobacterium
TGTFSWPGAYGTWWQADP

SEQ ID NO: 866288 - protein, 21 aa, Mycobacterium
TGTFTFAELLAHELSVERASR

SEQ ID NO: 866289 - protein, 23 aa, Mycobacterium
TGTFTFAELLAHELSVERSRLGG

SEQ ID NO: 866290 - protein, 21 aa, Mycobacterium
TGTFTFAELLAHELSVERTSQ

SEQ ID NO: 866291 - protein, 25 aa, Mycobacterium
TGTFYTLRCYLDDQPVFLGRNGRIS

SEQ ID NO: 866292 - protein, 28 aa, Mycobacterium
TGTGGTSGFLLGLDGFNASGSTSPLHIL

SEQ ID NO: 866293 - protein, 25 aa, Mycobacterium
TGTGKSLAYLIPAVVRALDDNAPVV

SEQ ID NO: 866294 - protein, 26 aa, Mycobacterium
TGTHRYRFTLYQLPDDYQLPGGLAGV

SEQ ID NO: 866295 - protein, 32 aa, Mycobacterium
TGTIYLQHGFGAIGWFYEPLAVQLAQQTNSVV

SEQ ID NO: 866296 - protein, 17 aa, Mycobacterium
TGTKIPSRFVGREKQYD

SEQ ID NO: 866297 - protein, 22 aa, Mycobacterium
TGTLLLHLLAHRAGRRLRLDTV

SEQ ID NO: 866298 - protein, 17 aa, Mycobacterium
TGTLPGGPLFFLAAEIP

SEQ ID NO: 866299 - protein, 23 aa, Mycobacterium
TGTLSRLPAPPLPNGRLKPRPNP

SEQ ID NO: 866300 - protein, 36 aa, Mycobacterium
TGTLTAAFPRYHPKWAWWITKIPALREVLVSNLVLV

SEQ ID NO: 866301 - protein, 20 aa, Mycobacterium
TGTNLWGAFGLLAEMMREGR

SEQ ID NO: 866302 - protein, 17 aa, Mycobacterium
TGTNMSRLKGRQVEFFA

SEQ ID NO: 866303 - protein, 21 aa, Mycobacterium
TGTNVWGAFGLLAEMVAEGRS

SEQ ID NO: 866304 - protein, 28 aa, Mycobacterium
TGTPADAPPPPAPAPPATGTAPVAPVMT

SEQ ID NO: 866305 - protein, 18 aa, Mycobacterium
TGTPTPMPAPMTPAGGGL

SEQ ID NO: 866306 - protein, 26 aa, Mycobacterium
TGTRDKTYNLIWYTEQCLDNALRLET

SEQ ID NO: 866307 - protein, 17 aa, Mycobacterium
TGTRPLREWLAALTDGI

SEQ ID NO: 866308 - protein, 36 aa, Mycobacterium
TGTRSILLHAGFSPPLVWRVMERFGVTNFTAAPTVY

SEQ ID NO: 866309 - protein, 25 aa, Mycobacterium
TGTSALFAFGVPLQPRFGADSATHH

SEQ ID NO: 866310 - protein, 26 aa, Mycobacterium
TGTSDAILHVLARDMRHLEAALERIR

SEQ ID NO: 866311 - protein, 21 aa, Mycobacterium
TGTSYGIISPLLHGVTCIADE

SEQ ID NO: 866312 - protein, 22 aa, Mycobacterium
TGTSYGIISPLLHGVTSIVDQA

SEQ ID NO: 866313 - protein, 21 aa, Mycobacterium
TGTSYGIISPLLHGVTSVVDE

SEQ ID NO: 866314 - protein, 20 aa, Mycobacterium
TGTTILFDLLAQDPALRPPL

SEQ ID NO: 866315 - protein, 25 aa, Mycobacterium
TGTTPLTNWQLQFDLPTNESVTNLW

SEQ ID NO: 866316 - protein, 27 aa, Mycobacterium
TGTVVYRFTWHLPKNRTWTYDGQLKMA

SEQ ID NO: 866317 - protein, 23 aa, Mycobacterium
TGTYAVNMYAFDPCAPFGGYKNS

SEQ ID NO: 866318 - protein, 18 aa, Mycobacterium
TGTYFEPYNDWPGAGPRP

SEQ ID NO: 866319 - protein, 23 aa, Mycobacterium
TGTYGINMYAFDPGAPFGGYKNS

SEQ ID NO: 866320 - protein, 20 aa, Mycobacterium
TGTYYMIRTENLPLLDPVRA

SEQ ID NO: 866321 - protein, 21 aa, Mycobacterium
TGVAGLVAALAAHRAGRRVTV

SEQ ID NO: 866322 - protein, 22 aa, Mycobacterium
TGVDAMPWLLAGAKTLSYAVNM

SEQ ID NO: 866323 - protein, 27 aa, Mycobacterium
TGVDDALALIYLFASPDAEVVGIASTG

SEQ ID NO: 866324 - protein, 27 aa, Mycobacterium
TGVDDALALLYLLASPEAELVGIASTG

SEQ ID NO: 866325 - protein, 26 aa, Mycobacterium
TGVDLLDYLAMRLTYESILLSHNRSS

SEQ ID NO: 866326 - protein, 24 aa, Mycobacterium
TGVDLPLARIALQDLAAGLGVPHT

SEQ ID NO: 866327 - protein, 29 aa, Mycobacterium
TGVDPGFINDLLPFALAGTCQRIEQVRCM

SEQ ID NO: 866328 - protein, 26 aa, Mycobacterium
TGVDPGFVTDLLPLALASTCQHIEQI

SEQ ID NO: 866329 - protein, 22 aa, Mycobacterium
TGVDRWRPLGDYWFEGVSRAAR

SEQ ID NO: 866330 - protein, 25 aa, Mycobacterium
TGVGLAIVAQQRGYKCIFVCPDKVS

SEQ ID NO: 866331 - protein, 24 aa, Mycobacterium
TGVGLALVAQRKGYHCVFVCPDKV

SEQ ID NO: 866332 - protein, 24 aa, Mycobacterium
TGVGLALVAQRRGYRCVFVCPDKV

SEQ ID NO: 866333 - protein, 18 aa, Mycobacterium
TGVGYLTPAATWGAFPGH

SEQ ID NO: 866334 - protein, 25 aa, Mycobacterium
TGVLDLLNRLGIAALPNTAGCRGAA

SEQ ID NO: 866335 - protein, 25 aa, Mycobacterium
TGVLQALFIGPMLAAPVILEDRWDP

SEQ ID NO: 866336 - protein, 23 aa, Mycobacterium
TGVLSRPVAALGRGYDLIVNASP

SEQ ID NO: 866337 - protein, 20 aa, Mycobacterium
TGVMAIPETFMLAGGQMGAP

SEQ ID NO: 866338 - protein, 27 aa, Mycobacterium
TGVMVLNTWIRQGLVARGMVVSGEYIS

SEQ ID NO: 866339 - protein, 32 aa, Mycobacterium
TGVNIVRVALSAPLKQIAFNSGLEPGVVAEKV

SEQ ID NO: 866340 - protein, 24 aa, Mycobacterium
TGVNLRGFFELTRAALGALPAGGH

SEQ ID NO: 866341 - protein, 21 aa, Mycobacterium
TGVPFFDHMLTALGSHASFDL

SEQ ID NO: 866342 - protein, 20 aa, Mycobacterium
TGVPFFDHMLTSLGTHASFD

SEQ ID NO: 866343 - protein, 21 aa, Mycobacterium
TGVPFYDHMLTALGSHASFDL

SEQ ID NO: 866344 - protein, 21 aa, Mycobacterium
TGVPFYDHMLTALGTHASFDL

SEQ ID NO: 866345 - protein, 28 aa, Mycobacterium
TGVPKVILNLAPSLWIPQQGEPFLSNWT

SEQ ID NO: 866346 - protein, 24 aa, Mycobacterium
TGVPKVILNLAPSLWTPQHSEPFL

SEQ ID NO: 866347 - protein, 22 aa, Mycobacterium
TGVPKVILSLAPSLWTPQHGEP

SEQ ID NO: 866348 - protein, 25 aa, Mycobacterium
TGVPWARACAAALLAVTTPAGLRVG

SEQ ID NO: 866349 - protein, 26 aa, Mycobacterium
TGVQRVFYGWAQVWRTKSRQAEAIRR

SEQ ID NO: 866350 - protein, 18 aa, Mycobacterium
TGVRQGGIALQDRLDRAR

SEQ ID NO: 866351 - protein, 28 aa, Mycobacterium
TGVRSRLMLDIASWRRRRREELAALGER

SEQ ID NO: 866352 - protein, 20 aa, Mycobacterium
TGVRVFFPDPWPKARHHKRR

SEQ ID NO: 866353 - protein, 21 aa, Mycobacterium
TGVSCSVCARCTIAAATAAAA

SEQ ID NO: 866354 - protein, 18 aa, Mycobacterium
TGVSERSLRYYEQQNLLV

SEQ ID NO: 866355 - protein, 27 aa, Mycobacterium
TGVSRRHLEIRWDGQVALLADLNSTNG

SEQ ID NO: 866356 - protein, 27 aa, Mycobacterium
TGVSRRHLEIRWDGQVALLSDLNSTNG

SEQ ID NO: 866357 - protein, 28 aa, Mycobacterium
TGVSRRHLEIRWDGQVALLSDLNSTNGT

SEQ ID NO: 866358 - protein, 28 aa, Mycobacterium
TGVSRRHLEIRWDGQVALLTDLNSTNGT

SEQ ID NO: 866359 - protein, 20 aa, Mycobacterium
TGVTYRYPGLLAKAVTTLDV

SEQ ID NO: 866360 - protein, 26 aa, Mycobacterium
TGVVRFIGVDGYRWMIRCVINGAHET

SEQ ID NO: 866361 - protein, 17 aa, Mycobacterium
TGVWRSAETFLLQQTWM

SEQ ID NO: 866362 - protein, 19 aa, Mycobacterium
TGVYAFDIADLRSALTRLR

SEQ ID NO: 866363 - protein, 17 aa, Mycobacterium
TGWAAISLPLGVSGDGL

SEQ ID NO: 866364 - protein, 20 aa, Mycobacterium
TGWAEAIWDTGIAFGTIGVA

SEQ ID NO: 866365 - protein, 30 aa, Mycobacterium; identical to SEQ ID NO: 117870

SEQ ID NO: 866366 - protein, 17 aa, Mycobacterium
TGWEDGMFPHMRALGDP

SEQ ID NO: 866367 - protein, 33 aa, Mycobacterium
TGWFDVWNPTDQALWLEWVFDPAQQWQFPDFSF

SEQ ID NO: 866368 - protein, 17 aa, Mycobacterium
TGWGCERALMPRSNVVI

SEQ ID NO: 866369 - protein, 17 aa, Mycobacterium
TGWHTHEGLIYGIVKTG

SEQ ID NO: 866370 - protein, 29 aa, Mycobacterium
TGWHYHDCVFQWLFITKGWLELQFENGES

SEQ ID NO: 866371 - protein, 17 aa, Mycobacterium
TGWIFGYVDAALMRAER

SEQ ID NO: 866372 - protein, 18 aa, Mycobacterium
TGWLIVRDALVMGPWHDI

SEQ ID NO: 866373 - protein, 22 aa, Mycobacterium
TGWLIVRDALVMGPWHDIERRS

SEQ ID NO: 866374 - protein, 22 aa, Mycobacterium
TGWLLGDYVLSHADPTHAVVAS

SEQ ID NO: 866375 - protein, 27 aa, Mycobacterium
TGWRHGQWYTARLRPGPLRPAERRTTF

SEQ ID NO: 866376 - protein, 19 aa, Mycobacterium
TGWRLHGHTSRWIQIAAEW

SEQ ID NO: 866377 - protein, 25 aa, Mycobacterium
TGWTTPMGHRWVFGGGYVAGLGDTL

SEQ ID NO: 866378 - protein, 23 aa, Mycobacterium
TGYAMWTYTAEPFNLTLPGVQTE

SEQ ID NO: 866379 - protein, 31 aa, Mycobacterium
TGYAPITATPWLAAFAQRSPFAEAFRSNGQS

SEQ ID NO: 866380 - protein, 22 aa, Mycobacterium
TGYGIHPALLDAALHPMAAALG

SEQ ID NO: 866381 - protein, 25 aa, Mycobacterium
TGYLDHPRLGWADAPVGPVLAEALG

SEQ ID NO: 866382 - protein, 24 aa, Mycobacterium
TGYLDHPRLGWADAPVGPVLAETL

SEQ ID NO: 866383 - protein, 20 aa, Mycobacterium
TGYLDLYVRSLAVPDQSPAP

SEQ ID NO: 866384 - protein, 26 aa, Mycobacterium
TGYLVLDQPWPSMLRGIWGDPQRYVE

SEQ ID NO: 866385 - protein, 23 aa, Mycobacterium
TGYNITFPFFDRDFISAPDNQIR

SEQ ID NO: 866386 - protein, 20 aa, Mycobacterium
TGYQLDRVFARRLGHERSNG

SEQ ID NO: 866387 - protein, 29 aa, Mycobacterium
TGYSDGIIPVLRTIDYRAALPGGPLATAP

SEQ ID NO: 866388 - protein, 23 aa, Mycobacterium
TGYSHGELADRLNVALAALRAEA

SEQ ID NO: 866389 - protein, 29 aa, Mycobacterium
TGYSPTVGVPWLAAFAERSKFAEAFKASE

SEQ ID NO: 866390 - protein, 28 aa, Mycobacterium
TGYVPVKYHSVLLAAWRGNEDVATALIE

SEQ ID NO: 866391 - protein, 19 aa, Mycobacterium
THAASVAALTERRRMRAEI

SEQ ID NO: 866392 - protein, 17 aa, Mycobacterium
THAAWLNGLTRDTPDPK

SEQ ID NO: 866393 - protein, 25 aa, Mycobacterium
THAERLELLFAQRVRILAAMERLTE

SEQ ID NO: 866394 - protein, 19 aa, Mycobacterium
THAFPTMAEALLPVMDLTW

SEQ ID NO: 866395 - protein, 20 aa, Mycobacterium
THAHAWALRMSPDGNVWGAT

SEQ ID NO: 866396 - protein, 32 aa, Mycobacterium
THAHEDHIGAIPFLLKMRPDIPVVGSAFTLAL

SEQ ID NO: 866397 - protein, 26 aa, Mycobacterium
THAKAKWYVRVIVSLLAHPEDSEEDE

SEQ ID NO: 866398 - protein, 24 aa, Mycobacterium
THALRLIYSGLFDRFPRLQMILGH

SEQ ID NO: 866399 - protein, 17 aa, Mycobacterium
THAMQMFRYAEEGSLRM

SEQ ID NO: 866400 - protein, 29 aa, Mycobacterium
THAMSPLDFLARPSSWLRLISDVRATHTP

SEQ ID NO: 866401 - protein, 26 aa, Mycobacterium
THAMSPLDFLKRPSSWLRLISDVRAT

SEQ ID NO: 866402 - protein, 28 aa, Mycobacterium
THARVGLLPTWGLSVRLPQKVGVGLARR

SEQ ID NO: 866403 - protein, 30 aa, Mycobacterium
THARVGLMPTWGLSVRLPQKVGVGLARRMS

SEQ ID NO: 866404 - protein, 22 aa, Mycobacterium
THASPWLTRHVEEPDWHLHMAA

SEQ ID NO: 866405 - protein, 29 aa, Mycobacterium
THDDWRWVVDIDLWGNIHAVEAFLPRLRE

SEQ ID NO: 866406 - protein, 23 aa, Mycobacterium
THDELRPLKTLASRQPCHWLNPG

SEQ ID NO: 866407 - protein, 31 aa, Mycobacterium
THDELRPLKVLASRMPCPYLNPGHYVRGRPL

SEQ ID NO: 866408 - protein, 33 aa, Mycobacterium
THDELRPLKVLASRMPCPYLNPGPYVGGRPLVQ

SEQ ID NO: 866409 - protein, 29 aa, Mycobacterium
THDHEPLLLDWRAPAARAFYTATGANPEG

SEQ ID NO: 866410 - protein, 25 aa, Mycobacterium
THDRYFLDNVAQWILELDRGRAYPY

SEQ ID NO: 866411 - protein, 21 aa, Mycobacterium
THDRYFLERVSDVTYALTGGG

SEQ ID NO: 866412 - protein, 17 aa, Mycobacterium
THDSLRRFLLEETYELL

SEQ ID NO: 866413 - protein, 23 aa, Mycobacterium
THDSLRRYLLEETYELFDAVHGG

SEQ ID NO: 866414 - protein, 22 aa, Mycobacterium
THDSLRRYLLEETYELFDAVRT

SEQ ID NO: 866415 - protein, 20 aa, Mycobacterium
THDWRGLMAHIGLPTLVLAG

SEQ ID NO: 866416 - protein, 18 aa, Mycobacterium
THEFVRFTGVPPRTWLAA

SEQ ID NO: 866417 - protein, 22 aa, Mycobacterium
THEMPFVQYLVESFVLGLADGP

SEQ ID NO: 866418 - protein, 23 aa, Mycobacterium
THEMPFVQYLVESFVLGLADGPT

SEQ ID NO: 866419 - protein, 18 aa, Mycobacterium
THEVDMTRIVALRARAKG

SEQ ID NO: 866420 - protein, 18 aa, Mycobacterium
THEVPGDSFWDLVRKGAE

SEQ ID NO: 866421 - protein, 18 aa, Mycobacterium
THEVSWPRKAKLLDVLLN

SEQ ID NO: 866422 - protein, 18 aa, Mycobacterium
THEYNLLSRLTYDGLQAP

SEQ ID NO: 866423 - protein, 32 aa, Mycobacterium
THFAGVLTVVCKLLQIVRPDRVFFGEKDYQQL

SEQ ID NO: 866424 - protein, 24 aa, Mycobacterium
THFARLVHRWRWTADKDPVKIERA

SEQ ID NO: 866425 - protein, 27 aa, Mycobacterium
THFEVPAMHLALEAIWQVLGASNRYFS

SEQ ID NO: 866426 - protein, 24 aa, Mycobacterium
THFGMRVRHRATCILALVAPEWRH

SEQ ID NO: 866427 - protein, 26 aa, Mycobacterium
THGALRSAWIGYWVASGSTGGGVATA

SEQ ID NO: 866428 - protein, 26 aa, Mycobacterium
THGALRSAWIGYWVPRAATGGGVATA

SEQ ID NO: 866429 - protein, 27 aa, Mycobacterium
THGALRSAWIGYWVPSTHTGGGVATGA

SEQ ID NO: 866430 - protein, 21 aa, Mycobacterium
THGDLLLTSPAPNGNIQATEL

SEQ ID NO: 866431 - protein, 22 aa, Mycobacterium
THGFAILDRLRAWQPTAESVLM

SEQ ID NO: 866432 - protein, 23 aa, Mycobacterium
THGGQLCLPFYGALVTNCGLDRT

SEQ ID NO: 866433 - protein, 18 aa, Mycobacterium
THGIAESAMFAPATLCEY

SEQ ID NO: 866434 - protein, 25 aa, Mycobacterium
THGRIPMTGVWPRVPRRFWHVGPMA

SEQ ID NO: 866435 - protein, 25 aa, Mycobacterium
THGRRTQLELGGKAPFVVFDDADLD

SEQ ID NO: 866436 - protein, 17 aa, Mycobacterium
THGRTWDLLRLTRMPTV

SEQ ID NO: 866437 - protein, 23 aa, Mycobacterium
THGSPFRRAFEEGLLQETNMHVG

SEQ ID NO: 866438 - protein, 17 aa, Mycobacterium
THGVEWVRMVATSAARD

SEQ ID NO: 866439 - protein, 21 aa, Mycobacterium
THHDTDWYRPTKLRRAAADRI

SEQ ID NO: 866440 - protein, 25 aa, Mycobacterium
THHEHALHSPYWWLKCLVGTEKNDH

SEQ ID NO: 866441 - protein, 20 aa, Mycobacterium
THHLIKTFYTGPNGWTDRQL

SEQ ID NO: 866442 - protein, 26 aa, Mycobacterium
THHNVTWLIEALDELLPPGGVWAQCY

SEQ ID NO: 866443 - protein, 24 aa, Mycobacterium
THHPLIQVVLAWQNLPWQHDGPAA

SEQ ID NO: 866444 - protein, 17 aa, Mycobacterium
THHPTTAWLFTGQGSQY

SEQ ID NO: 866445 - protein, 23 aa, Mycobacterium
THHRSAITGKFVKGSTAARHPNT

SEQ ID NO: 866446 - protein, 23 aa, Mycobacterium
THHYRFTLYQLPNDYQLPGGLAG

SEQ ID NO: 866447 - protein, 31 aa, Mycobacterium
THITGSLKHRLARSLFLYALCNGFIGENTTI

SEQ ID NO: 866448 - protein, 28 aa, Mycobacterium
THITGSLKHRLARSLFLYALCNGWIDEG

SEQ ID NO: 866449 - protein, 29 aa, Mycobacterium
THITGSLKHRLARSLFLYALCNGWIDEGT

SEQ ID NO: 866450 - protein, 32 aa, Mycobacterium
THITGSLKHRLARSLFLYALCNGWIGEGTTVV

SEQ ID NO: 866451 - protein, 32 aa, Mycobacterium
THITGSLKHRLARSLFLYALCNGWIGENTTVV

SEQ ID NO: 866452 - protein, 31 aa, Mycobacterium
THITGSLKHRLARSLFLYALCNGWINEGTTV

SEQ ID NO: 866453 - protein, 28 aa, Mycobacterium
THITGSLKHRLARSLFLYGLCNGWICEG

SEQ ID NO: 866454 - protein, 25 aa, Mycobacterium
THKHTPSMPTLVAGALFGDGASAVV

SEQ ID NO: 866455 - protein, 22 aa, Mycobacterium
THKIMTPMFTPEPSPAPFPKVF

SEQ ID NO: 866456 - protein, 31 aa, Mycobacterium
THKLAALDVAIPFWMRAPGECPGTYAAEVAM

SEQ ID NO: 866457 - protein, 28 aa, Mycobacterium
THKPVGVAALVTPWNFPAAMATRKIAPA

SEQ ID NO: 866458 - protein, 21 aa, Mycobacterium
THKVWAAESGFLFPVLSDFWP

SEQ ID NO: 866459 - protein, 24 aa, Mycobacterium
THLEPLPLLVRDGVPSVALAEPMG

SEQ ID NO: 866460 - protein, 31 aa, Mycobacterium
THLFTAQVGIPLWRYVLWSRLRVAITLVQGG

SEQ ID NO: 866461 - protein, 26 aa, Mycobacterium
THLHGVDLRIPNMPPLGVGYTQRDGE

SEQ ID NO: 866462 - protein, 31 aa, Mycobacterium
THLHNLLAAAPTFRSLPYWESVEPFPLPAEQ

SEQ ID NO: 866463 - protein, 22 aa, Mycobacterium
THLRASGLPKPGRQTWHLDPES

SEQ ID NO: 866464 - protein, 23 aa, Mycobacterium
THLSFVPGWNRIQLRHLVRDLKG

SEQ ID NO: 866465 - protein, 23 aa, Mycobacterium
THLSFVPGWNRRQLRRLVHDLRG

SEQ ID NO: 866466 - protein, 22 aa, Mycobacterium
THLSFVPGWNRYQLHHLMRDVR

SEQ ID NO: 866467 - protein, 28 aa, Mycobacterium
THLTGRHADILVLLSRHPEGLSADHLAV

SEQ ID NO: 866468 - protein, 17 aa, Mycobacterium
THLTVVRSLLEGAAART

SEQ ID NO: 866469 - protein, 23 aa, Mycobacterium
THMAARMLMTMFVTANSIIAESD

SEQ ID NO: 866470 - protein, 24 aa, Mycobacterium
THMADWICFMLSDSADFLCGSVVF

SEQ ID NO: 866471 - protein, 28 aa, Mycobacterium
THNDPKPPPPLPPLPPGGDPTLPFTGTP

SEQ ID NO: 866472 - protein, 23 aa, Mycobacterium
THPAAALQALRPVLEELDKRAVG

SEQ ID NO: 866473 - protein, 21 aa, Mycobacterium
THPAARKRVLGMRRTFNRYRD

SEQ ID NO: 866474 - protein, 21 aa, Mycobacterium
THPAHWAVLLVEDTAWCDVET

SEQ ID NO: 866475 - protein, 26 aa, Mycobacterium
THPARLVIIDLQPVTFFGSAGLNAVL

SEQ ID NO: 866476 - protein, 19 aa, Mycobacterium
THPAVIRAAILRSLDAPPK

SEQ ID NO: 866477 - protein, 39 aa, Mycobacterium
THPAVIRAVILMALDAPPRSFWRIDIAPVSRTVLHHRAD

SEQ ID NO: 866478 - protein, 26 aa, Mycobacterium
THPDGTSAFALWFTGGIFVDDHGRRF

SEQ ID NO: 866479 - protein, 17 aa, Mycobacterium
THPDRVLFPADGITKRD

SEQ ID NO: 866480 - protein, 22 aa, Mycobacterium
THPGALLPYLLTDARLVRTVDV

SEQ ID NO: 866481 - protein, 27 aa, Mycobacterium
THPGSRLLFPTLCKPTATLWAGDPPQV

SEQ ID NO: 866482 - protein, 26 aa, Mycobacterium
THPGSRLLFPTLCKPTATLWTGDPPQ

SEQ ID NO: 866483 - protein, 27 aa, Mycobacterium
THPGSRLLFPTLCKPTATLWTGNPPQN

SEQ ID NO: 866484 - protein, 25 aa, Mycobacterium
THPGSRVLFPSLCRPTAPVAVDAGV

SEQ ID NO: 866485 - protein, 17 aa, Mycobacterium
THPLIARPLPAETGPAP

SEQ ID NO: 866486 - protein, 18 aa, Mycobacterium
THPLLVYDPADIAMAERA

SEQ ID NO: 866487 - protein, 26 aa, Mycobacterium
THPLWIVRRTMLDLIRPIEFQDMLRC

SEQ ID NO: 866488 - protein, 27 aa, Mycobacterium
THPLWIVRRTMVDLIRPIEFQDMLRCR

SEQ ID NO: 866489 - protein, 26 aa, Mycobacterium
THPPTLFRAELMLAWLADVTAGAPDH

SEQ ID NO: 866490 - protein, 17 aa, Mycobacterium
THQGAAEIMRPVSRKYD

SEQ ID NO: 866491 - protein, 19 aa, Mycobacterium
THQGAAELMRPIARKYDLK

SEQ ID NO: 866492 - protein, 25 aa, Mycobacterium
THQGLHMWLAEFPQPRPPRETWESH

SEQ ID NO: 866493 - protein, 18 aa, Mycobacterium
THQVIVVTHLPQVAAYAD

SEQ ID NO: 866494 - protein, 19 aa, Mycobacterium
THQVIVVTHLPQVAAYADA

SEQ ID NO: 866495 - protein, 19 aa, Mycobacterium
THQWTPATAPAWAKPVLAA

SEQ ID NO: 866496 - protein, 22 aa, Mycobacterium
THRAIMLADVTGAPLYVVHVSA

SEQ ID NO: 866497 - protein, 24 aa, Mycobacterium
THRAQVRIYLQKAGQWLDFDHWPP

SEQ ID NO: 866498 - protein, 18 aa, Mycobacterium
THRCLAAGRLVPVRGYPG

SEQ ID NO: 866499 - protein, 24 aa, Mycobacterium
THRDALTGLFTLWFSEHTADEITE

SEQ ID NO: 866500 - protein, 19 aa, Mycobacterium
THRDIAHRVGLSRSAAAAR

SEQ ID NO: 866501 - protein, 25 aa, Mycobacterium
THRDRAMVLVMLLGGLRSAEARGLL

SEQ ID NO: 866502 - protein, 29 aa, Mycobacterium
THREESMLVARRLAAVAALLRHRVATADG

SEQ ID NO: 866503 - protein, 20 aa, Mycobacterium
THRIWSLESGFTFPVLSDFW

SEQ ID NO: 866504 - protein, 22 aa, Mycobacterium
THRKALAAFTKAGGRVVEKVSA

SEQ ID NO: 866505 - protein, 19 aa, Mycobacterium
THRLAPGTMYLLDKHDRHT

SEQ ID NO: 866506 - protein, 19 aa, Mycobacterium
THRLLQTGVTWKDLGLIIV

SEQ ID NO: 866507 - protein, 17 aa, Mycobacterium
THRPDVIAIERVFSNQN

SEQ ID NO: 866508 - protein, 19 aa, Mycobacterium
THRPKYFPRPEGERRIMRH

SEQ ID NO: 866509 - protein, 25 aa, Mycobacterium
THRQQAFLISVMQQLRNAGTLTDIT

SEQ ID NO: 866510 - protein, 26 aa, Mycobacterium
THRQVELLRMLLSLQAIPDPDTPPGN

SEQ ID NO: 866511 - protein, 24 aa, Mycobacterium
THRRAVFPELVARRMRTLEDDIRA

SEQ ID NO: 866512 - protein, 22 aa, Mycobacterium
THRVQFTANPWLPDYMSQALGL

SEQ ID NO: 866513 - protein, 17 aa, Mycobacterium
THRWFGAYGVTKSAVDH

SEQ ID NO: 866514 - protein, 23 aa, Mycobacterium
THSFRWDHAIAFARWALADDCPT

SEQ ID NO: 866515 - protein, 23 aa, Mycobacterium
THSHRIPDFVKLAEALGCVGLRC

SEQ ID NO: 866516 - protein, 18 aa, Mycobacterium
THSLALEYAKQGLRAACV

SEQ ID NO: 866517 - protein, 40 aa, Mycobacterium
THSNALDIDLYLRIAPELFLKKALVGGFDKIFELNRVFRN

SEQ ID NO: 866518 - protein, 28 aa, Mycobacterium
THSNALDIDLYLRIAPELFLKRCIVGGF

SEQ ID NO: 866519 - protein, 30 aa, Mycobacterium
THSNALDIDLYLRIAPELFLKRCLVGGFEK

SEQ ID NO: 866520 - protein, 27 aa, Mycobacterium
THSNALDIDLYLRIAPELFLKRCVVGG

SEQ ID NO: 866521 - protein, 28 aa, Mycobacterium
THSNALDIDLYLRIAPELFLKRCVVGGF

SEQ ID NO: 866522 - protein, 28 aa, Mycobacterium
THSNALDMDLYLRIAPELFLKRCIVGGF

SEQ ID NO: 866523 - protein, 20 aa, Mycobacterium
THTARMDLTFSLADRWTEAG

SEQ ID NO: 866524 - protein, 24 aa, Mycobacterium
THTDHRALLMRLITPKRLKENEDA

SEQ ID NO: 866525 - protein, 34 aa, Mycobacterium
THTIMAPNFNPGPNPFGPPPVLLGALGPVMTRTA

SEQ ID NO: 866526 - protein, 22 aa, Mycobacterium
THTKGRMLAWASFYDEDGHPIA

SEQ ID NO: 866527 - protein, 17 aa, Mycobacterium
THTKGRMLQWGSFFDEH

SEQ ID NO: 866528 - protein, 27 aa, Mycobacterium
THTLNYGTLYHALGWTITPTSEGTTFT

SEQ ID NO: 866529 - protein, 25 aa, Mycobacterium
THTLTDLVPLIRYTIGADDELVPYA

SEQ ID NO: 866530 - protein, 19 aa, Mycobacterium
THTQMPDMPFYGGGGGIAH

SEQ ID NO: 866531 - protein, 17 aa, Mycobacterium
THVAHDLGLAFTDPAEV

SEQ ID NO: 866532 - protein, 21 aa, Mycobacterium
THVERVLVLDGLLGNARELTR

SEQ ID NO: 866533 - protein, 25 aa, Mycobacterium
THVETLLLPTLQPEERLAASLLAKG

SEQ ID NO: 866534 - protein, 35 aa, Mycobacterium
THVGGRLPLHTTGVGKVLLAFSPRTLLETVVAQGL

SEQ ID NO: 866535 - protein, 33 aa, Mycobacterium
THVKFELTVDPLIPLPGFVLKRAIKGAMETATD

SEQ ID NO: 866536 - protein, 17 aa, Mycobacterium
THVLGVKASVNDAALTI

SEQ ID NO: 866537 - protein, 18 aa, Mycobacterium
THVLNVLHLLLPAGEEFF

SEQ ID NO: 866538 - protein, 23 aa, Mycobacterium
THVLTATLHQLYAALWRAGVIEV

SEQ ID NO: 866539 - protein, 26 aa, Mycobacterium
THVPIYALNILLATATDLWALRYPDT

SEQ ID NO: 866540 - protein, 21 aa, Mycobacterium
THVTRLRLITSMLDRGYNLAH

SEQ ID NO: 866541 - protein, 18 aa, Mycobacterium
THVVALCGEVFPVTRSAK

SEQ ID NO: 866542 - protein, 17 aa, Mycobacterium
THWAFADRLAREFPAVD

SEQ ID NO: 866543 - protein, 20 aa, Mycobacterium
THWDFGLLDPFVEDVMAAAA

SEQ ID NO: 866544 - protein, 39 aa, Mycobacterium
THWDRLLFCAKETTYKAWFPLTARWLGFEDAHITIDPDG

SEQ ID NO: 866545 - protein, 20 aa, Mycobacterium
THWGGAFKYAASLLGLPIGA

SEQ ID NO: 866546 - protein, 24 aa, Mycobacterium
THYLRVYLAQLRRKLEDDPAHPRH

SEQ ID NO: 866547 - protein, 25 aa, Mycobacterium
THYLRVYLAQLRRKLEDDPSHPVHL

SEQ ID NO: 866548 - protein, 24 aa, Mycobacterium
THYLRVYLAQLRRKLEDDPSNPKH

SEQ ID NO: 866549 - protein, 27 aa, Mycobacterium
THYLRVYLAQLRRKLEIDPAHPKHLLT

SEQ ID NO: 866550 - protein, 23 aa, Mycobacterium
THYRHPMLIVVVSDEPDTDSRLE

SEQ ID NO: 866551 - protein, 17 aa, Mycobacterium
THYSCLELLAQRPGLSN

SEQ ID NO: 866552 - protein, 20 aa, Mycobacterium
TIAAIAARLEEFPRCVEGLR

SEQ ID NO: 866553 - protein, 19 aa, Mycobacterium
TIAALSFLLEHGCHHLQII

SEQ ID NO: 866554 - protein, 19 aa, Mycobacterium
TIAARRRLETPAATGRYPI

SEQ ID NO: 866555 - protein, 19 aa, Mycobacterium
TIAAVFPDGPQRYFDTVYN

SEQ ID NO: 866556 - protein, 26 aa, Mycobacterium
TIADLAWLRARGLDRALMAHVAAGKP

SEQ ID NO: 866557 - protein, 18 aa, Mycobacterium
TIAEVVHGFGWTGPLGVT

SEQ ID NO: 866558 - protein, 28 aa, Mycobacterium
TIAEVVNAFGWTGPLGVTYPGVVTHGVV

SEQ ID NO: 866559 - protein, 27 aa, Mycobacterium
TIAGRWLVGAIHYKAQRWPEVISSLGE

SEQ ID NO: 866560 - protein, 27 aa, Mycobacterium
TIAHGLLTLSLLPHFQFELIRVDNISM

SEQ ID NO: 866561 - protein, 32 aa, Mycobacterium; identical to SEQ ID NO: 132669

SEQ ID NO: 866562 - protein, 20 aa, Mycobacterium
TIAHQIAHLHWTDAQSLLAV

SEQ ID NO: 866563 - protein, 24 aa, Mycobacterium
TIAITDHRLLVKIPAGWSDTAAAT

SEQ ID NO: 866564 - protein, 20 aa, Mycobacterium
TIALGILHRLAATVARVGVF

SEQ ID NO: 866565 - protein, 22 aa, Mycobacterium
TIALGILHRLTATVAKVGVFRP

SEQ ID NO: 866566 - protein, 22 aa, Mycobacterium
TIALGLLHRLTATVAKVGVFRP

SEQ ID NO: 866567 - protein, 37 aa, Mycobacterium
TIALLMRHHLVLMSRFDPVQFLRLITDHRVTFLTTVP

SEQ ID NO: 866568 - protein, 19 aa, Mycobacterium
TIAMPSTPANYFHLLRRHG

SEQ ID NO: 866569 - protein, 24 aa, Mycobacterium
TIAPGWAHLAPIFTIGKFYEQEGR

SEQ ID NO: 866570 - protein, 21 aa, Mycobacterium
TIAPLADPAWVAVRALVPRRD

SEQ ID NO: 866571 - protein, 24 aa, Mycobacterium
TIAQVAIGLLRQQLAPGQMTHGIV

SEQ ID NO: 866572 - protein, 27 aa, Mycobacterium
TIARALRWQFDGVDRVGPDLLLSLVPR

SEQ ID NO: 866573 - protein, 33 aa, Mycobacterium
TIARYRVTNYFAPPTVWISLLRSPVFDEVDLSS

SEQ ID NO: 866574 - protein, 22 aa, Mycobacterium
TIARYVPPPAAYAPLPEDTTPP

SEQ ID NO: 866575 - protein, 19 aa, Mycobacterium
TIATLTWSGPGPADSTLAA

SEQ ID NO: 866576 - protein, 22 aa, Mycobacterium
TIATPYLIQPLSHGADIVVHSA

SEQ ID NO: 866577 - protein, 21 aa, Mycobacterium
TIAVLMLGYVPVRTLRFFYDA

SEQ ID NO: 866578 - protein, 28 aa, Mycobacterium
TIAVRPRKPLLPPPPQPPGREPIHRRRI

SEQ ID NO: 866579 - protein, 20 aa, Mycobacterium
TIAWGPWDQVGMSRGLNSAS

SEQ ID NO: 866580 - protein, 18 aa, Mycobacterium
TIAWLQQDIGEELRKLDA

SEQ ID NO: 866581 - protein, 17 aa, Mycobacterium
TICFLGYCTTITTTVYD

SEQ ID NO: 866582 - protein, 36 aa, Mycobacterium
TICKGTLWALRREAAKPGSYFWLKGGSRPVQPSAEQ

SEQ ID NO: 866583 - protein, 19 aa, Mycobacterium
TICRLLRDLADSGATVLIA

SEQ ID NO: 866584 - protein, 17 aa, Mycobacterium
TICVPQPIRRPPILIGG

SEQ ID NO: 866585 - protein, 25 aa, Mycobacterium
TIDAARDWLLGTPADDWVSMAVLSD

SEQ ID NO: 866586 - protein, 23 aa, Mycobacterium
TIDAVFLDINMPGLSGIELAGVL

SEQ ID NO: 866587 - protein, 24 aa, Mycobacterium
TIDDHQNSRWIAEPLRLLDCCQET

SEQ ID NO: 866588 - protein, 24 aa, Mycobacterium
TIDELIPLVRGVVRGAPEALVVAD

SEQ ID NO: 866589 - protein, 17 aa, Mycobacterium
TIDGLVYSVPRAARELI

SEQ ID NO: 866590 - protein, 25 aa, Mycobacterium
TIDGPAVLLPAFLASGYHVHHDIPE

SEQ ID NO: 866591 - protein, 29 aa, Mycobacterium
TIDSNLFLRDLVMALRWVKDNISAFGGDP

SEQ ID NO: 866592 - protein, 25 aa, Mycobacterium
TIDVAYRYFATPKRSFILADTPGHV

SEQ ID NO: 866593 - protein, 24 aa, Mycobacterium
TIEDRLLRVLAYSRLQQGADPARV

SEQ ID NO: 866594 - protein, 33 aa, Mycobacterium
TIEDYALSEWRRILDVNLTGVFLGIRAVVKPMK

SEQ ID NO: 866595 - protein, 17 aa, Mycobacterium
TIELTLTVTGTADGEWR

SEQ ID NO: 866596 - protein, 17 aa, Mycobacterium
TIELVSATPEHVALVID

SEQ ID NO: 866597 - protein, 26 aa, Mycobacterium
TIERTLYRPQYFDKIVAWGGGEAINN

SEQ ID NO: 866598 - protein, 19 aa, Mycobacterium
TIFAGEHRGLLDTLQFGQG

SEQ ID NO: 866599 - protein, 20 aa, Mycobacterium
TIFEPWERHPDMLRAYYRAR

SEQ ID NO: 866600 - protein, 19 aa, Mycobacterium
TIFTEVIVAPAYAPAALDQ

SEQ ID NO: 866601 - protein, 19 aa, Mycobacterium
TIGALGFLLERGCHHLQAV

SEQ ID NO: 866602 - protein, 24 aa, Mycobacterium
TIGAPRWDTAIIGLDWDTAVLDER

SEQ ID NO: 866603 - protein, 26 aa, Mycobacterium
TIGEITNLLLLRGMIGKPGAGVCPVR

SEQ ID NO: 866604 - protein, 26 aa, Mycobacterium
TIGGRSMLSHLLHAIAKVAPQHLAVV

SEQ ID NO: 866605 - protein, 25 aa, Mycobacterium
TIGGRSMLSHLLHAITKVAPQHLVV

SEQ ID NO: 866606 - protein, 30 aa, Mycobacterium
TIGGYSERMLLSAPLLLPVPNGLDFKHAAL

SEQ ID NO: 866607 - protein, 21 aa, Mycobacterium
TIGHLSARLTALGPAATLARG

SEQ ID NO: 866608 - protein, 26 aa, Mycobacterium
TIGIGGIFRGLRTFPVLAGIARDMQE

SEQ ID NO: 866609 - protein, 22 aa, Mycobacterium
TIGLELALACDFIWSAENVSMG

SEQ ID NO: 866610 - protein, 26 aa, Mycobacterium
TIGLHAPTVLTLLTHQLHALSLRDAR

SEQ ID NO: 866611 - protein, 18 aa, Mycobacterium
TIGLLKTVSDEYAQFGIT

SEQ ID NO: 866612 - protein, 22 aa, Mycobacterium
TIGLRFPVQYVIRPRTAEYPDY

SEQ ID NO: 866613 - protein, 18 aa, Mycobacterium
TIGLVFRARMSEPELLPQ

SEQ ID NO: 866614 - protein, 24 aa, Mycobacterium
TIGMDRPFIVLTSGLLDLMNEQEL

SEQ ID NO: 866615 - protein, 19 aa, Mycobacterium
TIGNIAHGALRSAWIGYWV

SEQ ID NO: 866616 - protein, 18 aa, Mycobacterium
TIGRRAVMKPWMGEVFDT

SEQ ID NO: 866617 - protein, 20 aa, Mycobacterium
TIGSLLHALLAEPGRTESEL

SEQ ID NO: 866618 - protein, 29 aa, Mycobacterium
TIGVISWTPEGFFGQMLATIRPYRPSLSQ

SEQ ID NO: 866619 - protein, 30 aa, Mycobacterium
TIGVISWTPEGFFGRMLAAIRPYRPSLSAA

SEQ ID NO: 866620 - protein, 28 aa, Mycobacterium
TIGVISWTPEGFFGRMLATIRPYRPSLS

SEQ ID NO: 866621 - protein, 29 aa, Mycobacterium
TIGVISWTPEGFFGRMLATIRPYRPSLSA

SEQ ID NO: 866622 - protein, 29 aa, Mycobacterium
TIGVSYLGFTQWALLQDPPPELAAAVITA

SEQ ID NO: 866623 - protein, 28 aa, Mycobacterium
TIGVTSFVWLHRGLFRDALPGATRGHID

SEQ ID NO: 866624 - protein, 32 aa, Mycobacterium
TIGYSLVDSPVGLLAWILDKFADWSDTEDSPF

SEQ ID NO: 866625 - protein, 25 aa, Mycobacterium
TIHDEFLDRFAALARRIRVGDPLSE

SEQ ID NO: 866626 - protein, 29 aa, Mycobacterium
TIHEHKVNLLFFTGDAMARPLLDALLAHQ

SEQ ID NO: 866627 - protein, 17 aa, Mycobacterium
TIHGRARAMKLFRQMEG

SEQ ID NO: 866628 - protein, 19 aa, Mycobacterium
TIHGYKRAFRIAGSGPAIL

SEQ ID NO: 866629 - protein, 27 aa, Mycobacterium
TIIEIDLTPFLAAAKLLYEGALVSERY

SEQ ID NO: 866630 - protein, 20 aa, Mycobacterium
TIIGAVLDRNGLRPSRIWVT

SEQ ID NO: 866631 - protein, 18 aa, Mycobacterium
TIIIPKARTARDVWWVDV

SEQ ID NO: 866632 - protein, 30 aa, Mycobacterium
TIINTIFDKLEPMKPILASVGRFVTNGLDQ

SEQ ID NO: 866633 - protein, 18 aa, Mycobacterium
TIIQIWERLSVDVLDLWD

SEQ ID NO: 866634 - protein, 18 aa, Mycobacterium
TIKTPIGTLAVLYAFTEL

SEQ ID NO: 866635 - protein, 17 aa, Mycobacterium
TILAAHPEIVQGRTAPT

SEQ ID NO: 866636 - protein, 17 aa, Mycobacterium
TILAWSFVRDDQPLADT

SEQ ID NO: 866637 - protein, 20 aa, Mycobacterium
TILDGLNQPLPGPGVPVPTE

SEQ ID NO: 866638 - protein, 29 aa, Mycobacterium
TILGREVIRLLPVPPIAMRMRTAVAILSY

SEQ ID NO: 866639 - protein, 18 aa, Mycobacterium
TILIAEFPPRNADPDPIG

SEQ ID NO: 866640 - protein, 19 aa, Mycobacterium
TILINVTAFFRDAEAWEYV

SEQ ID NO: 866641 - protein, 19 aa, Mycobacterium
TILINVTAFFRDPEAWEFI

SEQ ID NO: 866642 - protein, 21 aa, Mycobacterium
TILLARGDLALRMGLPVLAVV

SEQ ID NO: 866643 - protein, 21 aa, Mycobacterium
TILRPHTGGQKRVTASGSTLK

SEQ ID NO: 866644 - protein, 17 aa, Mycobacterium
TILRPQTGGQKRVTASG

SEQ ID NO: 866645 - protein, 18 aa, Mycobacterium
TILRTHTGGEKRVSASGD

SEQ ID NO: 866646 - protein, 25 aa, Mycobacterium
TILRYATMVLLLPSAQPLETADDIR

SEQ ID NO: 866647 - protein, 25 aa, Mycobacterium
TIMATPTPFIEFARQRGLAADGRCK

SEQ ID NO: 866648 - protein, 19 aa, Mycobacterium
TIMDRYGVRTKTEAVDLAL

SEQ ID NO: 866649 - protein, 22 aa, Mycobacterium
TIMEDYYHRPFRDLVARAAERA

SEQ ID NO: 866650 - protein, 18 aa, Mycobacterium
TIMGLRNLALRYDVPEIG

SEQ ID NO: 866651 - protein, 25 aa, Mycobacterium
TIMQPGMTFTIEPMINLGALDYEIW

SEQ ID NO: 866652 - protein, 18 aa, Mycobacterium
TINELRYPATLFSDGMPS

SEQ ID NO: 866653 - protein, 26 aa, Mycobacterium
TINHSVWFHRPLRFDDWVLYATESPV

SEQ ID NO: 866654 - protein, 21 aa, Mycobacterium
TINLGASLAEYGRRVLLVDLD

SEQ ID NO: 866655 - protein, 25 aa, Mycobacterium
TINLMFNAIADHMPNLAPAGDPKRL

SEQ ID NO: 866656 - protein, 24 aa, Mycobacterium
TINRRLAAISSLFAFREMRDPDAR

SEQ ID NO: 866657 - protein, 17 aa, Mycobacterium
TIPAGCVAGVYISWQGI

SEQ ID NO: 866658 - protein, 17 aa, Mycobacterium
TIPAGPGVAASPGARDT

SEQ ID NO: 866659 - protein, 21 aa, Mycobacterium
TIPAGRKVFLLYGSANRDERQ

SEQ ID NO: 866660 - protein, 20 aa, Mycobacterium
TIPAGRKVLLLYGSGNRDER

SEQ ID NO: 866661 - protein, 21 aa, Mycobacterium
TIPAGRRALLLYGSANRDERE

SEQ ID NO: 866662 - protein, 21 aa, Mycobacterium
TIPAGRRALLLYGSANRDERQ

SEQ ID NO: 866663 - protein, 26 aa, Mycobacterium
TIPAHKPVFLMKAAANRDPRAFDNAE

SEQ ID NO: 866664 - protein, 31 aa, Mycobacterium; identical to SEQ ID NO: 117894

SEQ ID NO: 866665 - protein, 30 aa, Mycobacterium
TIPDKGRILTAMSVFFFGLVDTPNHLAGPP

SEQ ID NO: 866666 - protein, 32 aa, Mycobacterium
TIPDKGRILTAMSVFFFGLVTAPNHLAGPPDD

SEQ ID NO: 866667 - protein, 18 aa, Mycobacterium
TIPFAPHLEYAVLPNAER

SEQ ID NO: 866668 - protein, 27 aa, Mycobacterium
TIPGFHLDFKALIPNNIIALQTGIAGQ

SEQ ID NO: 866669 - protein, 29 aa, Mycobacterium
TIPGVLKNAIDWLSRPYGDSALKDKPLAV

SEQ ID NO: 866670 - protein, 19 aa, Mycobacterium
TIPHEVGWIGGPGLGAVHL

SEQ ID NO: 866671 - protein, 17 aa, Mycobacterium
TIPIPGELNRFVFAMPE

SEQ ID NO: 866672 - protein, 17 aa, Mycobacterium
TIPLAARHFDHLNVIAG

SEQ ID NO: 866673 - protein, 17 aa, Mycobacterium
TIPLADSSLTWSPEEIH

SEQ ID NO: 866674 - protein, 17 aa, Mycobacterium
TIPPIGLGSFTTPPLTI

SEQ ID NO: 866675 - protein, 19 aa, Mycobacterium
TIPQFRTLVILSNRGPINL

SEQ ID NO: 866676 - protein, 30 aa, Mycobacterium
TIPSNATIVSWLPFYHDMGLVLGVCAPILG

SEQ ID NO: 866677 - protein, 40 aa, Mycobacterium
TIPTITIDALSITDFKIGPITIPTIKGILPVIDINIGNPD

SEQ ID NO: 866678 - protein, 28 aa, Mycobacterium
TIPTLRIVRQMFAKRPAFNFKHLVTEDD

SEQ ID NO: 866679 - protein, 18 aa, Mycobacterium
TIPTLRIVRQMFAKRPRF

SEQ ID NO: 866680 - protein, 28 aa, Mycobacterium
TIPVRELRRSGMLDKLLLLAGQDESPAP

SEQ ID NO: 866681 - protein, 21 aa, Mycobacterium
TIQMGFSDAGAHLRNMAFYNS

SEQ ID NO: 866682 - protein, 18 aa, Mycobacterium
TIQQTLYRLLAGRRNMFF

SEQ ID NO: 866683 - protein, 30 aa, Mycobacterium
TIQSISKPLTYALALHLIGLDAVDARIGVE

SEQ ID NO: 866684 - protein, 24 aa, Mycobacterium
TIQTSLFFLGNSVYLPAGFAPSLR

SEQ ID NO: 866685 - protein, 37 aa, Mycobacterium
TIQVLTQCRPELIERTFLACEGAPRAIVHFYNSTSIL

SEQ ID NO: 866686 - protein, 24 aa, Mycobacterium
TIRDRMSLFYRHAVPLAVEVTRRA

SEQ ID NO: 866687 - protein, 25 aa, Mycobacterium
TIRDWAWSLLCTPWARIGSRLHGET

SEQ ID NO: 866688 - protein, 23 aa, Mycobacterium
TIRELDWQVLSPVASLVSLATHN

SEQ ID NO: 866689 - protein, 30 aa, Mycobacterium
TIRGPDGRTWWIPPAHVDPYRTPRSNWFHH

SEQ ID NO: 866690 - protein, 19 aa, Mycobacterium
TIRLPYGTAHLPAGALASH

SEQ ID NO: 866691 - protein, 26 aa, Mycobacterium
TIRNWERLWREQGLYGLIDKRSLRGS

SEQ ID NO: 866692 - protein, 20 aa, Mycobacterium
TIRPGSPFVDRPLGDTKART

SEQ ID NO: 866693 - protein, 17 aa, Mycobacterium
TIRQMIADGRLTGYRSG

SEQ ID NO: 866694 - protein, 22 aa, Mycobacterium
TIRRDLDILAKSGRLKRLYGGA

SEQ ID NO: 866695 - protein, 18 aa, Mycobacterium
TIRRPPRCDGIATIIAEL

SEQ ID NO: 866696 - protein, 17 aa, Mycobacterium
TIRTEFGRFGRQVSGYS

SEQ ID NO: 866697 - protein, 23 aa, Mycobacterium
TIRYYEDIGLLPNPTRVGGQRRY

SEQ ID NO: 866698 - protein, 18 aa, Mycobacterium
TISAFRTLGLDGGGVNAS

SEQ ID NO: 866699 - protein, 24 aa, Mycobacterium
TISCSFLLLCSGYYYYEQGYSPYF

SEQ ID NO: 866700 - protein, 30 aa, Mycobacterium
TISHLLCGFDLLEPLRARLAAGLPAYGACA

SEQ ID NO: 866701 - protein, 20 aa, Mycobacterium
TISNFPFLRGLCLTNYVTDP

SEQ ID NO: 866702 - protein, 20 aa, Mycobacterium
TISVLEGRLAAWAVELDAAA

SEQ ID NO: 866703 - protein, 24 aa, Mycobacterium
TISYANALAALPTTAIPAAGGDEV

SEQ ID NO: 866704 - protein, 29 aa, Mycobacterium
TITADGTVLDTWFPAPELSASGPAGTARL

SEQ ID NO: 866705 - protein, 19 aa, Mycobacterium
TITALHQLPEPPALDFALP

SEQ ID NO: 866706 - protein, 25 aa, Mycobacterium
TITDISIPAVTFPKVPATGKVDLAI

SEQ ID NO: 866707 - protein, 25 aa, Mycobacterium
TITEQQPTVAAVLAGPRGPVGAIAD

SEQ ID NO: 866708 - protein, 27 aa, Mycobacterium
TITEVYDYLRLLYARAGTPHCPTCGER

SEQ ID NO: 866709 - protein, 27 aa, Mycobacterium
TITEVYDYLRLLYARAGTPHCPVCGEK

SEQ ID NO: 866710 - protein, 20 aa, Mycobacterium
TITEWRGRRNQPTPPPLVAL

SEQ ID NO: 866711 - protein, 18 aa, Mycobacterium
TITGHGLVPAAVARRLIS

SEQ ID NO: 866712 - protein, 21 aa, Mycobacterium
TITHVLWAMFGVLPPHQVQRP

SEQ ID NO: 866713 - protein, 18 aa, Mycobacterium
TITIASLFGIGGTGGDGG

SEQ ID NO: 866714 - protein, 18 aa, Mycobacterium
TITISSAAKMFNCTGWKI

SEQ ID NO: 866715 - protein, 29 aa, Mycobacterium
TITISSAAKMFNCTGWKIGWACGPAELIA

SEQ ID NO: 866716 - protein, 27 aa, Mycobacterium
TITLEDALKLLSLPRVVGTDPASGEEI

SEQ ID NO: 866717 - protein, 23 aa, Mycobacterium
TITNCVMTLLRNPGSWDLVRQRP

SEQ ID NO: 866718 - protein, 17 aa, Mycobacterium
TITNLHRSYAVLAVQGP

SEQ ID NO: 866719 - protein, 22 aa, Mycobacterium
TITPFAMIQLADRGQFFVEPGE

SEQ ID NO: 866720 - protein, 19 aa, Mycobacterium
TITRVRLLDRRTGEDRWAT

SEQ ID NO: 866721 - protein, 17 aa, Mycobacterium
TITRWEPPQGGSPGGCR

SEQ ID NO: 866722 - protein, 21 aa, Mycobacterium
TITSYPSIRTDLRNAGANVVD

SEQ ID NO: 866723 - protein, 17 aa, Mycobacterium
TITTYLIPSPTLPMLLP

SEQ ID NO: 866724 - protein, 22 aa, Mycobacterium
TITVKYLRGTPLGPLRSEAWID

SEQ ID NO: 866725 - protein, 25 aa, Mycobacterium
TITVQALINRYPRVSGMTGTALAAG

SEQ ID NO: 866726 - protein, 21 aa, Mycobacterium
TITYTLQNRPVTALITAAEDG

SEQ ID NO: 866727 - protein, 25 aa, Mycobacterium
TIVAAALRVLDLFELDRPVRLLGVR

SEQ ID NO: 866728 - protein, 26 aa, Mycobacterium
TIVDLTVIGLGRYIPRIARIAAATDL

SEQ ID NO: 866729 - protein, 27 aa, Mycobacterium
TIVDLTVIGLGRYIPRIARIAEATELN

SEQ ID NO: 866730 - protein, 26 aa, Mycobacterium
TIVDLTVIGLGRYIPRIARVAAATEL

SEQ ID NO: 866731 - protein, 26 aa, Mycobacterium
TIVDLTVIGLGRYIPRIARVAAATGL

SEQ ID NO: 866732 - protein, 25 aa, Mycobacterium
TIVDLTVIGLGRYIPRIARVAAQTE

SEQ ID NO: 866733 - protein, 18 aa, Mycobacterium
TIVELLRQLMERQALRRV

SEQ ID NO: 866734 - protein, 35 aa, Mycobacterium
TIVFNGLPPGDFPAPIFDIVLKGLTIRGSIVGTRQ

SEQ ID NO: 866735 - protein, 20 aa, Mycobacterium
TIVFRVLPHTPPVTQHITLG

SEQ ID NO: 866736 - protein, 24 aa, Mycobacterium
TIVGATGLIGRQLTPLLREAGHDV

SEQ ID NO: 866737 - protein, 19 aa, Mycobacterium
TIVGIPDIPGYAAKVFRAV

SEQ ID NO: 866738 - protein, 19 aa, Mycobacterium
TIVGWVTSELPEHKPRHLL

SEQ ID NO: 866739 - protein, 18 aa, Mycobacterium
TIVLLESMKMEIPVLAEV

SEQ ID NO: 866740 - protein, 21 aa, Mycobacterium
TIVNDFFVSGRLPPAGLELPA

SEQ ID NO: 866741 - protein, 19 aa, Mycobacterium
TIVPPIKAILESPDLRLSG

SEQ ID NO: 866742 - protein, 19 aa, Mycobacterium
TIVRATPFYEFAVGLADSA

SEQ ID NO: 866743 - protein, 17 aa, Mycobacterium
TIVTVLQAAADAAEKCV

SEQ ID NO: 866744 - protein, 17 aa, Mycobacterium
TIVVLGRPITAEAFGVV

SEQ ID NO: 866745 - protein, 19 aa, Mycobacterium
TIVVLGRPVTARAFGAVAR

SEQ ID NO: 866746 - protein, 18 aa, Mycobacterium
TIWASTQTPHELRAFAAR

SEQ ID NO: 866747 - protein, 22 aa, Mycobacterium
TIWHNHLHADAVTYLIAVRDDD

SEQ ID NO: 866748 - protein, 19 aa, Mycobacterium
TIYDKFPTLTPDQAAGVIT

SEQ ID NO: 866749 - protein, 26 aa, Mycobacterium
TIYLSTLFFHGFIDRGLTDWAGPDAL

SEQ ID NO: 866750 - protein, 21 aa, Mycobacterium
TIYREPLSLKPFDYLPRGLRR

SEQ ID NO: 866751 - protein, 17 aa, Mycobacterium
TIYRFHEALNVYGPALK

SEQ ID NO: 866752 - protein, 17 aa, Mycobacterium
TIYRLYEALQVYGGAIK

SEQ ID NO: 866753 - protein, 26 aa, Mycobacterium
TIYRQEMLRMFGLPESGLAETLRDAE

SEQ ID NO: 866754 - protein, 18 aa, Mycobacterium
TIYRRWPTKEALVEDAAF

SEQ ID NO: 866755 - protein, 18 aa, Mycobacterium
TIYSFTGASPRFLLDFSR

SEQ ID NO: 866756 - protein, 19 aa, Mycobacterium
TIYSFTGASPRFLLDFSRR

SEQ ID NO: 866757 - protein, 20 aa, Mycobacterium
TIYSFTGASPRFLLDFSRRY

SEQ ID NO: 866758 - protein, 17 aa, Mycobacterium
TIYSFTGASPRYLLDFS

SEQ ID NO: 866759 - protein, 18 aa, Mycobacterium
TIYSFTGATPRYLLDFSR

SEQ ID NO: 866760 - protein, 20 aa, Mycobacterium
TIYWHGIVEVLGQLPAGAEL

SEQ ID NO: 866761 - protein, 27 aa, Mycobacterium
TIYYTAPTLVRTFMRWGRQIPAEHDLS

SEQ ID NO: 866762 - protein, 24 aa, Mycobacterium
TKAAQLGFMRTAAIELAPHKITVN

SEQ ID NO: 866763 - protein, 25 aa, Mycobacterium
TKAASVLHGVQLWVALPAAARDTDR

SEQ ID NO: 866764 - protein, 17 aa, Mycobacterium
TKAATVEGIPWGSDPAA

SEQ ID NO: 866765 - protein, 29 aa, Mycobacterium
TKADSLIIGGGMCFTFLAAQGLSVGSSLL

SEQ ID NO: 866766 - protein, 24 aa, Mycobacterium
TKAKELGLTPLARIVSTGVSGLSP

SEQ ID NO: 866767 - protein, 29 aa, Mycobacterium
TKAKEQPLWRVLVALSIRHVGPTAARALA

SEQ ID NO: 866768 - protein, 23 aa, Mycobacterium
TKALPPPIMAKDIPVWGITNPEH

SEQ ID NO: 866769 - protein, 26 aa, Mycobacterium
TKARRRAKLLARRLRRLHYPQRRSMH

SEQ ID NO: 866770 - protein, 24 aa, Mycobacterium
TKASPWLTRHPEMPDWHLHLASVD

SEQ ID NO: 866771 - protein, 17 aa, Mycobacterium
TKATALVQIRYANDEKN

SEQ ID NO: 866772 - protein, 29 aa, Mycobacterium
TKDDRYVQLMMLQLDKFYPEAMRAIGLPE

SEQ ID NO: 866773 - protein, 23 aa, Mycobacterium
TKDGDQVMLYSPSHWTEVKPGTY

SEQ ID NO: 866774 - protein, 36 aa, Mycobacterium
TKDGRWIQLVFLQPDKFWVGFCRRMGLAELADDERF

SEQ ID NO: 866775 - protein, 23 aa, Mycobacterium
TKDHIEAIAKWDPSADPSVEIQF

SEQ ID NO: 866776 - protein, 24 aa, Mycobacterium
TKDHLLSIARRLEIRGRSSMNKEE

SEQ ID NO: 866777 - protein, 26 aa, Mycobacterium
TKDHPKKLWRPKVPIVVVVGEPIEPT

SEQ ID NO: 866778 - protein, 25 aa, Mycobacterium
TKDIPVYRFVLRAYAAQLVQNHANL

SEQ ID NO: 866779 - protein, 27 aa, Mycobacterium
TKDLIDRPMEFLGNLLLLIVGGNDTTR

SEQ ID NO: 866780 - protein, 25 aa, Mycobacterium
TKDSPVEVFVLRPCIVAGPNATVLA

SEQ ID NO: 866781 - protein, 24 aa, Mycobacterium
TKDVDLGWYQLPKGSLGGNYIRYQ

SEQ ID NO: 866782 - protein, 25 aa, Mycobacterium
TKDVVGAYRFLQRVWRLVVDENTGE

SEQ ID NO: 866783 - protein, 23 aa, Mycobacterium
TKDYTAHWYGRTLHFGVREHAMG

SEQ ID NO: 866784 - protein, 18 aa, Mycobacterium
TKEDLFLAVSDRYWRRYF

SEQ ID NO: 866785 - protein, 17 aa, Mycobacterium
TKEILRNYAIRRPGVPE

SEQ ID NO: 866786 - protein, 17 aa, Mycobacterium
TKELIFITSLTVLKASP

SEQ ID NO: 866787 - protein, 17 aa, Mycobacterium
TKENGCMKFLPGSHRTL

SEQ ID NO: 866788 - protein, 28 aa, Mycobacterium
TKEWMQLLIVTVRIATLPGLLSTTTIFG

SEQ ID NO: 866789 - protein, 24 aa, Mycobacterium
TKFDNPWLFDVGRHPNPHVGFGGG

SEQ ID NO: 866790 - protein, 29 aa, Mycobacterium
TKFEAELLVRSAPGLRYRIYRPAVVVGDS

SEQ ID NO: 866791 - protein, 21 aa, Mycobacterium
TKFFDEFVLAAADAGIRQVVS

SEQ ID NO: 866792 - protein, 19 aa, Mycobacterium
TKFFVRAITEALNLEWGHY

SEQ ID NO: 866793 - protein, 21 aa, Mycobacterium
TKFILALFVDLRGKPCAKLVP

SEQ ID NO: 866794 - protein, 32 aa, Mycobacterium
TKFPTEATIVSWLPFYHDMGLVLGVCAPILSG

SEQ ID NO: 866795 - protein, 22 aa, Mycobacterium
TKGALYHHFDSKEALASAIIEE

SEQ ID NO: 866796 - protein, 22 aa, Mycobacterium
TKGAVQALTIGLARELGPRGIT

SEQ ID NO: 866797 - protein, 26 aa, Mycobacterium
TKGHPKKLFRPKVPIVVLVGEPIEPT

SEQ ID NO: 866798 - protein, 17 aa, Mycobacterium
TKGLLLRRSIGEVRAVD

SEQ ID NO: 866799 - protein, 18 aa, Mycobacterium
TKGPLLPPPGQSPAFDPS

SEQ ID NO: 866800 - protein, 24 aa, Mycobacterium
TKGQLLHAIRRYATARGTLTGVYE

SEQ ID NO: 866801 - protein, 18 aa, Mycobacterium
TKGRFAGQRFDPDIWQVA

SEQ ID NO: 866802 - protein, 22 aa, Mycobacterium
TKGSFYWHFADMEGYRHALVEA

SEQ ID NO: 866803 - protein, 24 aa, Mycobacterium
TKGSFYWHFRDMAAYRAALVQAWA

SEQ ID NO: 866804 - protein, 24 aa, Mycobacterium
TKHDVPMGQFRWITVVSPEDPDGT

SEQ ID NO: 866805 - protein, 22 aa, Mycobacterium
TKHHRVLQLPPVTFGCSHEHAA

SEQ ID NO: 866806 - protein, 18 aa, Mycobacterium
TKHLLRKGFEFKELEAAG

SEQ ID NO: 866807 - protein, 27 aa, Mycobacterium
TKHSLNQWYRMFGPAFETSLGLEFLSF

SEQ ID NO: 866808 - protein, 19 aa, Mycobacterium
TKILGLLTGASKSYAATIR

SEQ ID NO: 866809 - protein, 21 aa, Mycobacterium
TKIPAGDILLLLPGSANRDDR

SEQ ID NO: 866810 - protein, 24 aa, Mycobacterium
TKKELDALLYKDATRLKIDGTNLT

SEQ ID NO: 866811 - protein, 24 aa, Mycobacterium
TKKFAYRHSGYPGGLRKRTIGELL

SEQ ID NO: 866812 - protein, 20 aa, Mycobacterium
TKKLPYSLKVLAENLLRNED

SEQ ID NO: 866813 - protein, 25 aa, Mycobacterium
TKLAPKQLIVDELLYRELQDRYGEY

SEQ ID NO: 866814 - protein, 26 aa, Mycobacterium
TKLATPPLLVPVLRAGLGMVDQAHEL

SEQ ID NO: 866815 - protein, 21 aa, Mycobacterium
TKLLAALHRFGIAAPASADRS

SEQ ID NO: 866816 - protein, 22 aa, Mycobacterium
TKLLETYAVPPLLHNQVLAIGV

SEQ ID NO: 866817 - protein, 18 aa, Mycobacterium
TKLLHRRVDVDFNGWWMC

SEQ ID NO: 866818 - protein, 25 aa, Mycobacterium
TKLNRSHFVPGRKALILPTLGRTDR

SEQ ID NO: 866819 - protein, 27 aa, Mycobacterium
TKLRPVTRVGKFTNLPALLALSSVYTD

SEQ ID NO: 866820 - protein, 28 aa, Mycobacterium
TKLVDFARLLMVQPRMVLLDEPAAGVAP

SEQ ID NO: 866821 - protein, 23 aa, Mycobacterium
TKLVTGTILRRLLIRPRAQRSSG

SEQ ID NO: 866822 - protein, 20 aa, Mycobacterium
TKMAGPGWTATFSDALIGYG

SEQ ID NO: 866823 - protein, 19 aa, Mycobacterium
TKNEIMRCIKRTSPARSTT

SEQ ID NO: 866824 - protein, 25 aa, Mycobacterium
TKPEWSERWPDLVAPFTAATRAEAG

SEQ ID NO: 866825 - protein, 22 aa, Mycobacterium
TKPFVLAELVARVKALLRRRGA

SEQ ID NO: 866826 - protein, 23 aa, Mycobacterium
TKPKILCNYLSTDQDRQLAVRGL

SEQ ID NO: 866827 - protein, 23 aa, Mycobacterium
TKPLSSLLFPNWNTTTTPTPPRP

SEQ ID NO: 866828 - protein, 23 aa, Mycobacterium
TKPPNFWAWLIGEVKNIDPDVLF

SEQ ID NO: 866829 - protein, 20 aa, Mycobacterium
TKPRPSTPPFKVNYDAQVRL

SEQ ID NO: 866830 - protein, 30 aa, Mycobacterium
TKPTAWLAEGLLMYLPAEAQDKLFTQIGEL

SEQ ID NO: 866831 - protein, 34 aa, Mycobacterium
TKPTLMLLDGNSLAFRAFYALPAENFKTRGGLTT

SEQ ID NO: 866832 - protein, 27 aa, Mycobacterium
TKPTTAAWIVNRLALRRKDTRERLADL

SEQ ID NO: 866833 - protein, 35 aa, Mycobacterium
TKQAVGPCYAITPWNFPLAMGTRKMGPAFAAGCTM

SEQ ID NO: 866834 - protein, 36 aa, Mycobacterium
TKQAVGPCYAITPWNFPLAMGTRKMGPAFAAGCTMI

SEQ ID NO: 866835 - protein, 23 aa, Mycobacterium
TKQFEYDFRLLLGQRHGGQAWSD

SEQ ID NO: 866836 - protein, 29 aa, Mycobacterium
TKQFMEELSQLRLHAVERGSTVLRFSKGP

SEQ ID NO: 866837 - protein, 33 aa, Mycobacterium
TKQPTLLLLDGNSLAFRAFYALPAENFKTQSGL

SEQ ID NO: 866838 - protein, 25 aa, Mycobacterium
TKRALTEAVLWPLQHPDTFSRLGID

SEQ ID NO: 866839 - protein, 23 aa, Mycobacterium
TKRFSSCISVTGPFPGFPVALDH

SEQ ID NO: 866840 - protein, 17 aa, Mycobacterium
TKRIAPIVVLTAFSQRD

SEQ ID NO: 866841 - protein, 20 aa, Mycobacterium
TKRITPMGIYVLLASPENVE

SEQ ID NO: 866842 - protein, 20 aa, Mycobacterium
TKRLPYSLKVLAENLLRNED

SEQ ID NO: 866843 - protein, 23 aa, Mycobacterium
TKRQFGFPPPRAQTARRAVAADL

SEQ ID NO: 866844 - protein, 17 aa, Mycobacterium
TKRRYLGKLSGPLLDRV

SEQ ID NO: 866845 - protein, 25 aa, Mycobacterium
TKRSLRLRRLGESLDWPSNLWMGVS

SEQ ID NO: 866846 - protein, 26 aa, Mycobacterium
TKRVCRDCGFFLPLSGSLGAMFGVCG

SEQ ID NO: 866847 - protein, 28 aa, Mycobacterium
TKRVCRDCGFFLPLSGSLGAMFGVCGNE

SEQ ID NO: 866848 - protein, 25 aa, Mycobacterium
TKSGYDYTWFVLNAKIIEKEFALSG

SEQ ID NO: 866849 - protein, 26 aa, Mycobacterium
TKSRVEDIYLPYKPKRRTKAQIAREA

SEQ ID NO: 866850 - protein, 18 aa, Mycobacterium
TKSTFFRHFPDKRDVLAA

SEQ ID NO: 866851 - protein, 26 aa, Mycobacterium
TKTDGVYEFMFVASPLPLTGASGSPV

SEQ ID NO: 866852 - protein, 31 aa, Mycobacterium
TKTDVFAEEFLLSRPLLTAIRREDPTVLLID

SEQ ID NO: 866853 - protein, 18 aa, Mycobacterium
TKTFVCQVVSGSALMISA

SEQ ID NO: 866854 - protein, 17 aa, Mycobacterium
TKTLQLTLTVTGTADGE

SEQ ID NO: 866855 - protein, 25 aa, Mycobacterium
TKTRAPRTYLLSGLLRCGRCGNRLY

SEQ ID NO: 866856 - protein, 24 aa, Mycobacterium
TKTSIPYRVPFPQMMPTQETSPTR

SEQ ID NO: 866857 - protein, 19 aa, Mycobacterium
TKVEKWQRIGRGRRDLHRR

SEQ ID NO: 866858 - protein, 18 aa, Mycobacterium
TKVICSFPRQADSYVFDA

SEQ ID NO: 866859 - protein, 32 aa, Mycobacterium
TKVLEAVENALWPDLFIVGGGISRKADKWVPL

SEQ ID NO: 866860 - protein, 23 aa, Mycobacterium
TKVLRIRRYSVITAACALLVRGW

SEQ ID NO: 866861 - protein, 26 aa, Mycobacterium
TKVRFDISIDLSVPLPGFIVKRTMKG

SEQ ID NO: 866862 - protein, 18 aa, Mycobacterium
TKVRLRVHRIPETTRYEA

SEQ ID NO: 866863 - protein, 21 aa, Mycobacterium
TKVWNALTDIASTLGSNAAVF

SEQ ID NO: 866864 - protein, 19 aa, Mycobacterium
TKWPTLLNPSTYRGMLTLG

SEQ ID NO: 866865 - protein, 23 aa, Mycobacterium
TKWSSIWDTDYHRDSFRSHLLAA

SEQ ID NO: 866866 - protein, 27 aa, Mycobacterium
TKYTQPFKFMGRITPYPGTPLYQAYSE

SEQ ID NO: 866867 - protein, 19 aa, Mycobacterium
TKYYELDMIVFATGFDAMT

SEQ ID NO: 866868 - protein, 25 aa, Mycobacterium
TLAAAAAWDGLAAELGDAASSFSAV

SEQ ID NO: 866869 - protein, 23 aa, Mycobacterium
TLAAAPNFAYELAAERGLPPSGD

SEQ ID NO: 866870 - protein, 25 aa, Mycobacterium
TLAADGSILDTWFPAPELTESGASA

SEQ ID NO: 866871 - protein, 25 aa, Mycobacterium
TLAADGSILDTWFPAPELTESGTGG

SEQ ID NO: 866872 - protein, 19 aa, Mycobacterium
TLAAFIARHNVELIAVGNG

SEQ ID NO: 866873 - protein, 18 aa, Mycobacterium
TLAAILKEEMRVLDAAGA

SEQ ID NO: 866874 - protein, 17 aa, Mycobacterium
TLAAIPVLLDAVYDPWP

SEQ ID NO: 866875 - protein, 24 aa, Mycobacterium
TLAALPMNLPPSLAPLAADFMADH

SEQ ID NO: 866876 - protein, 21 aa, Mycobacterium
TLAALTLSLRTRRGRYVDGLP

SEQ ID NO: 866877 - protein, 23 aa, Mycobacterium
TLAALTMRLPTRKGRYLDGLPED

SEQ ID NO: 866878 - protein, 17 aa, Mycobacterium
TLAARWARLRREGLAWI

SEQ ID NO: 866879 - protein, 17 aa, Mycobacterium
TLACLPPTLFQVGSDEI

SEQ ID NO: 866880 - protein, 24 aa, Mycobacterium
TLADAGFLIERPPEDWLLKAHNGE

SEQ ID NO: 866881 - protein, 24 aa, Mycobacterium
TLADAVIPLRWTDGGSTRVRILRG

SEQ ID NO: 866882 - protein, 21 aa, Mycobacterium
TLADLRAYLPDTTPAQRRNRA

SEQ ID NO: 866883 - protein, 25 aa, Mycobacterium
TLAELKPLGLKTFLMPLNPGKDDDG

SEQ ID NO: 866884 - protein, 28 aa, Mycobacterium
TLAEMNCKLLLEIGPRPVLTAAALGAWP

SEQ ID NO: 866885 - protein, 17 aa, Mycobacterium
TLAEVQWAAAGYIVALE

SEQ ID NO: 866886 - protein, 18 aa, Mycobacterium
TLAFFRRALELRRERREF

SEQ ID NO: 866887 - protein, 26 aa, Mycobacterium
TLAFVARRLLAEPVGLIFAVRDHGAP

SEQ ID NO: 866888 - protein, 37 aa, Mycobacterium
TLAGAFLRAGAIDRILAYVAPILLGGPVTAVDDVGVS

SEQ ID NO: 866889 - protein, 37 aa, Mycobacterium
TLAGAFLRAGLVDRILAYLAPMLLGGNVPAVEDVGVT

SEQ ID NO: 866890 - protein, 23 aa, Mycobacterium
TLAGEFDFRYLVGVLSVLADKDV

SEQ ID NO: 866891 - protein, 28 aa, Mycobacterium
TLAGFTINRRFSLPGLPAPYVIAQVAID

SEQ ID NO: 866892 - protein, 28 aa, Mycobacterium
TLAGFTVNHRFSLPGLPAPYVVAQVSIA

SEQ ID NO: 866893 - protein, 22 aa, Mycobacterium
TLAGIACPILLMAGDRDELTRQ

SEQ ID NO: 866894 - protein, 22 aa, Mycobacterium
TLAGIPGFLSTVPPPFNIVISN

SEQ ID NO: 866895 - protein, 24 aa, Mycobacterium
TLAGLFARPPIGTPATSLPAWSLT

SEQ ID NO: 866896 - protein, 19 aa, Mycobacterium
TLAGLLDKAALAGTEPAGP

SEQ ID NO: 866897 - protein, 19 aa, Mycobacterium
TLAGWVARRRDHGGVIFID

SEQ ID NO: 866898 - protein, 22 aa, Mycobacterium
TLAHRALGIHRQIGQLLPCNVV

SEQ ID NO: 866899 - protein, 22 aa, Mycobacterium
TLAIIHALNQWMAEHWTYNYAD

SEQ ID NO: 866900 - protein, 23 aa, Mycobacterium
TLAKAPLRKASVATTAWGLRVVR

SEQ ID NO: 866901 - protein, 17 aa, Mycobacterium
TLAKPPPSGSPGLMLAM

SEQ ID NO: 866902 - protein, 18 aa, Mycobacterium
TLALADLPAPVLPDAPTP

SEQ ID NO: 866903 - protein, 17 aa, Mycobacterium
TLALFDLDTGEYGTYTD

SEQ ID NO: 866904 - protein, 21 aa, Mycobacterium
TLALGLLHRLTATVAKVGVFR

SEQ ID NO: 866905 - protein, 18 aa, Mycobacterium
TLALIALSAKMRLDQIEE

SEQ ID NO: 866906 - protein, 18 aa, Mycobacterium
TLALLLQHPEHLDRLYDE

SEQ ID NO: 866907 - protein, 18 aa, Mycobacterium
TLALPRYRLADYDNPRAP

SEQ ID NO: 866908 - protein, 18 aa, Mycobacterium
TLALRWLVNFSRQRREKT

SEQ ID NO: 866909 - protein, 25 aa, Mycobacterium
TLALSYHVLFLYMPEPATNTVVARR

SEQ ID NO: 866910 - protein, 17 aa, Mycobacterium
TLAMLQQLVADGSLRPV

SEQ ID NO: 866911 - protein, 19 aa, Mycobacterium
TLAMLQQLVADGSLWPVNG

SEQ ID NO: 866912 - protein, 19 aa, Mycobacterium
TLANLPYLQRHGSAAFRAQ

SEQ ID NO: 866913 - protein, 27 aa, Mycobacterium
TLAPALRLGWLVAPRRRHPDLVAAKHA

SEQ ID NO: 866914 - protein, 17 aa, Mycobacterium
TLAPDDLLRAVRVLAEM

SEQ ID NO: 866915 - protein, 17 aa, Mycobacterium
TLAPLRRPGTRVGELSA

SEQ ID NO: 866916 - protein, 31 aa, Mycobacterium
TLAPTGYSWGPLAWMLLAQALGQLGLTVEAG

SEQ ID NO: 866917 - protein, 31 aa, Mycobacterium
TLAPTGYSWGPLAWMLLAQALGQRGMPVEAG

SEQ ID NO: 866918 - protein, 28 aa, Mycobacterium
TLAQATIPSFLRYGAYPQIVVVREQSPE

SEQ ID NO: 866919 - protein, 26 aa, Mycobacterium
TLAQLSILVTLLDQGPIRMTDLAAHE

SEQ ID NO: 866920 - protein, 26 aa, Mycobacterium
TLAQLSILVTLLDRGPIRMTDLAAHE

SEQ ID NO: 866921 - protein, 30 aa, Mycobacterium
TLARARDRKVWLPLRQLTRKRWPNGHVTHD

SEQ ID NO: 866922 - protein, 27 aa, Mycobacterium
TLARLFARPPIGTPLPAWSLTADQAIL

SEQ ID NO: 866923 - protein, 17 aa, Mycobacterium
TLARQFAVPGTPGLEHR

SEQ ID NO: 866924 - protein, 23 aa, Mycobacterium
TLASGGTVLLPAGGRFSAHTFWD

SEQ ID NO: 866925 - protein, 24 aa, Mycobacterium
TLASKIDYILLSPALSERVVAGGI

SEQ ID NO: 866926 - protein, 19 aa, Mycobacterium
TLASRWRRFDGGPGELLDL

SEQ ID NO: 866927 - protein, 29 aa, Mycobacterium
TLASSARRYLSRWHRRRPLWVGVAAGGVV

SEQ ID NO: 866928 - protein, 27 aa, Mycobacterium
TLATITLQNYFRLYDKLSGMTGTAETE

SEQ ID NO: 866929 - protein, 28 aa, Mycobacterium
TLATITLQNYFRLYNKLAGMTGTAQTEA

SEQ ID NO: 866930 - protein, 17 aa, Mycobacterium
TLATLPKLAGRTVDQPW

SEQ ID NO: 866931 - protein, 20 aa, Mycobacterium
TLAWLAQRGILVAPGEFYGP

SEQ ID NO: 866932 - protein, 17 aa, Mycobacterium
TLAWQRLRPWPDTVAGL

SEQ ID NO: 866933 - protein, 27 aa, Mycobacterium
TLCAFLYTDELIPSNPMPLIGRPKVPK

SEQ ID NO: 866934 - protein, 17 aa, Mycobacterium
TLCFMLGGELENVGAAT

SEQ ID NO: 866935 - protein, 20 aa, Mycobacterium
TLCNLLHWQSEHGGLAGAAV

SEQ ID NO: 866936 - protein, 19 aa, Mycobacterium
TLCSCYPRPILGNSPEWYR

SEQ ID NO: 866937 - protein, 21 aa, Mycobacterium
TLCTDTLLDAMAPGAVLVLHT

SEQ ID NO: 866938 - protein, 21 aa, Mycobacterium
TLCVAGLVAIWRYHRGDEGSV

SEQ ID NO: 866939 - protein, 25 aa, Mycobacterium
TLDAIWDDVVDRIRWLEAETGRTFG

SEQ ID NO: 866940 - protein, 27 aa, Mycobacterium
TLDALISLVLDWKRPVKVFIETKHPVR

SEQ ID NO: 866941 - protein, 20 aa, Mycobacterium
TLDDYIMLGLTITAVPAITA

SEQ ID NO: 866942 - protein, 26 aa, Mycobacterium
TLDEDLAYWRSLMADLPEPLELPGAN

SEQ ID NO: 866943 - protein, 38 aa, Mycobacterium
TLDEDLVLYLFGTPGQRRFWFMWDDLVRGAIGAIVLVD

SEQ ID NO: 866944 - protein, 19 aa, Mycobacterium
TLDGLRLVYERNRADQRGK

SEQ ID NO: 866945 - protein, 24 aa, Mycobacterium
TLDGNLLQWQNWSLRIGFNHREGM

SEQ ID NO: 866946 - protein, 36 aa, Mycobacterium
TLDGTTHEIRWPRSAKLLDVLLDKGLDAPFSCREGH

SEQ ID NO: 866947 - protein, 17 aa, Mycobacterium
TLDILGAIPVAPVRVRT

SEQ ID NO: 866948 - protein, 17 aa, Mycobacterium
TLDLQSPRGRELLRRLI

SEQ ID NO: 866949 - protein, 28 aa, Mycobacterium
TLDLQVPLIDTFTPTRPPFTGLPVDPTG

SEQ ID NO: 866950 - protein, 17 aa, Mycobacterium
TLDLSHVDYLVLDEADE

SEQ ID NO: 866951 - protein, 18 aa, Mycobacterium
TLDLVCGYLGLVAVPLQH

SEQ ID NO: 866952 - protein, 30 aa, Mycobacterium
TLDMLRRTTPMKLFWAREYSDYHPEQPGGS

SEQ ID NO: 866953 - protein, 25 aa, Mycobacterium
TLDPNGGWLLRDAIVTCRQLTDVLA

SEQ ID NO: 866954 - protein, 18 aa, Mycobacterium
TLDPNRISVLFNGSAVCI

SEQ ID NO: 866955 - protein, 17 aa, Mycobacterium
TLDPVFAAAFNTAADDG

SEQ ID NO: 866956 - protein, 18 aa, Mycobacterium
TLDPVFAAAYHTADDDAA

SEQ ID NO: 866957 - protein, 28 aa, Mycobacterium
TLDRDAIRWWLVLATLRWGVICLYQAER

SEQ ID NO: 866958 - protein, 20 aa, Mycobacterium
TLDRILAEEALLLDAVGARE

SEQ ID NO: 866959 - protein, 18 aa, Mycobacterium
TLDRLQTHYAGRPSPLYE

SEQ ID NO: 866960 - protein, 24 aa, Mycobacterium
TLDSFEVQTWLRYARDNGGTLPDF

SEQ ID NO: 866961 - protein, 29 aa, Mycobacterium
TLDSFVEIGLGYLSLARPAGTLSGGEAQR

SEQ ID NO: 866962 - protein, 22 aa, Mycobacterium
TLDSLTILPRGEQFAALTELRA

SEQ ID NO: 866963 - protein, 30 aa, Mycobacterium
TLDSPEKEFLAPRVRALWGGKPGRPLAWHS

SEQ ID NO: 866964 - protein, 20 aa, Mycobacterium
TLDVWDGHLAAHGAQLIAAR

SEQ ID NO: 866965 - protein, 27 aa, Mycobacterium
TLDWDDELLGFFDIPRQMLPEIRPSSS

SEQ ID NO: 866966 - protein, 32 aa, Mycobacterium
TLDWDDELLSFFAIPRAMLPRIGPSSSPQPYG

SEQ ID NO: 866967 - protein, 29 aa, Mycobacterium
TLDWDDELLSFFGIPRRMLPEIKPSSYPE

SEQ ID NO: 866968 - protein, 27 aa, Mycobacterium
TLDWDDELLSFFNIPRAMLPAVEPSSP

SEQ ID NO: 866969 - protein, 31 aa, Mycobacterium
TLDWDDELLSFFSIPRQMLPPIKASSPVEPF

SEQ ID NO: 866970 - protein, 25 aa, Mycobacterium
TLDWDDQLLSFFSVPRAMLPAIAPS

SEQ ID NO: 866971 - protein, 25 aa, Mycobacterium
TLDYEMPLILNTPTFTICCATLLDT

SEQ ID NO: 866972 - protein, 18 aa, Mycobacterium
TLDYLRLTGRPDTQVRLV

SEQ ID NO: 866973 - protein, 28 aa, Mycobacterium
TLDYPRGNLAFRWFLADGVPARPEVKLV

SEQ ID NO: 866974 - protein, 31 aa, Mycobacterium
TLEACWGDVALMLTVPYQGLGNAAISAVATN

SEQ ID NO: 866975 - protein, 34 aa, Mycobacterium
TLEALRRHIYLEEVFLFPPLREAGIVMPIFVMMR

SEQ ID NO: 866976 - protein, 22 aa, Mycobacterium
TLECRWWRRDAGGKMIRFVVCR

SEQ ID NO: 866977 - protein, 19 aa, Mycobacterium
TLEELKSLGLKTFLLPLNP

SEQ ID NO: 866978 - protein, 27 aa, Mycobacterium
TLEELKSLGLKTFLLPLNPGKDDEGNI

SEQ ID NO: 866979 - protein, 31 aa, Mycobacterium
TLEELVSLVLDWNRPVKLFIETKHPVRYGSL

SEQ ID NO: 866980 - protein, 33 aa, Mycobacterium
TLEERDIRFVRLWFTDVLGYLKSVSIAPAELEG

SEQ ID NO: 866981 - protein, 32 aa, Mycobacterium
TLEFAAVHGIRPWIEPMPLHEAATGYDRMMRN

SEQ ID NO: 866982 - protein, 17 aa, Mycobacterium
TLEFALYTRVLQLVWRV

SEQ ID NO: 866983 - protein, 24 aa, Mycobacterium
TLEFPHLMPLIDRTQFDTIYHEHF

SEQ ID NO: 866984 - protein, 20 aa, Mycobacterium
TLEGRWWRRDVGGVMVRFVV

SEQ ID NO: 866985 - protein, 22 aa, Mycobacterium
TLEKLEKVLDWPTGHITRIRRG

SEQ ID NO: 866986 - protein, 28 aa, Mycobacterium
TLEKRTGLALPPTLLWEHPTAAAVSDRI

SEQ ID NO: 866987 - protein, 24 aa, Mycobacterium
TLELLERVGMLPSHYDRYIHEFSG

SEQ ID NO: 866988 - protein, 20 aa, Mycobacterium
TLELRDFRPGDLEGAWYVIA

SEQ ID NO: 866989 - protein, 19 aa, Mycobacterium
TLELRSRVTVWAESLARRT

SEQ ID NO: 866990 - protein, 26 aa, Mycobacterium
TLEQDGMLFIWHDPQGNPPPEDVAIP

SEQ ID NO: 866991 - protein, 25 aa, Mycobacterium
TLEQIDLVRRLVARYPDRLVLATTA

SEQ ID NO: 866992 - protein, 30 aa, Mycobacterium
TLEQLKSLGLRTFLLPLNPGKDDEGNIYDY

SEQ ID NO: 866993 - protein, 25 aa, Mycobacterium
TLERGTIPLWSTKPGKLITALTVLT

SEQ ID NO: 866994 - protein, 29 aa, Mycobacterium
TLETLRARIEAQPWRWVGQELPELSVAPT

SEQ ID NO: 866995 - protein, 21 aa, Mycobacterium
TLEVKAILHRMLRSFTWKVPE

SEQ ID NO: 866996 - protein, 30 aa, Mycobacterium
TLEVNTRRWAGVPFYLRTGKRLGRRVTEIA

SEQ ID NO: 866997 - protein, 18 aa, Mycobacterium
TLEYDGFADFPRYPLNFI

SEQ ID NO: 866998 - protein, 21 aa, Mycobacterium
TLFASNYLLNQADIGMGCALG

SEQ ID NO: 866999 - protein, 37 aa, Mycobacterium
TLFDDLALVRPTELGFPPRIWDMLLERFGREVDRRLR

SEQ ID NO: 867000 - protein, 23 aa, Mycobacterium
TLFEGSFLDIRMLDELMSMGAVG

SEQ ID NO: 867001 - protein, 19 aa, Mycobacterium
TLFELMDVTKRTGIELTES

SEQ ID NO: 867002 - protein, 20 aa, Mycobacterium
TLFGIAQREYGDGGLFPVIA

SEQ ID NO: 867003 - protein, 18 aa, Mycobacterium
TLFGLLDATERTGIELTE

SEQ ID NO: 867004 - protein, 18 aa, Mycobacterium
TLFGTYGQTYQALAAQAS

SEQ ID NO: 867005 - protein, 20 aa, Mycobacterium
TLFIKWRYRHRDPPKLLLGQ

SEQ ID NO: 867006 - protein, 20 aa, Mycobacterium
TLFIQPRFPGYLSNALHTPE

SEQ ID NO: 867007 - protein, 21 aa, Mycobacterium
TLFSRGLVRKTYLARAAVDPA

SEQ ID NO: 867008 - protein, 20 aa, Mycobacterium
TLFVDMAHFAGLVAGKVFTG

SEQ ID NO: 867009 - protein, 18 aa, Mycobacterium
TLFVFRHAGQEFAVRSIR

SEQ ID NO: 867010 - protein, 19 aa, Mycobacterium
TLGAAIAWAPAPPDRAPDT

SEQ ID NO: 867011 - protein, 32 aa, Mycobacterium
TLGAANSAALARTTGLLAAAEDEVSTAIASLF

SEQ ID NO: 867012 - protein, 23 aa, Mycobacterium
TLGADYLELMRRAGYVVPGGTAH

SEQ ID NO: 867013 - protein, 35 aa, Mycobacterium
TLGAGPPPPMLWRVVELFVGDLWPNGDVAGLHAAA

SEQ ID NO: 867014 - protein, 31 aa, Mycobacterium
TLGAQFIRAGSIIQLLLGNIGRPGGGVFALR

SEQ ID NO: 867015 - protein, 20 aa, Mycobacterium
TLGARIALMFALGGSRVRIY

SEQ ID NO: 867016 - protein, 25 aa, Mycobacterium
TLGDTPLVGLPRLSPGWDNSPHVRL

SEQ ID NO: 867017 - protein, 25 aa, Mycobacterium
TLGEAGLLSLPYPEEWGGGGQPYEV

SEQ ID NO: 867018 - protein, 25 aa, Mycobacterium
TLGEAYQLLWAFRATSKNTQDRIAA

SEQ ID NO: 867019 - protein, 22 aa, Mycobacterium
TLGFLVAFRPGLVSPTLSAQMA

SEQ ID NO: 867020 - protein, 26 aa, Mycobacterium
TLGGEPLEIYPFLGSYLLGEAIDQAG

SEQ ID NO: 867021 - protein, 24 aa, Mycobacterium
TLGGFSTIWLARGAGPQGRVVTLE

SEQ ID NO: 867022 - protein, 19 aa, Mycobacterium
TLGGLPLRKVPDGQLLRIS

SEQ ID NO: 867023 - protein, 33 aa, Mycobacterium
TLGGYAEQMLLSAPLLLPIPNGLDPRHAALTEP

SEQ ID NO: 867024 - protein, 18 aa, Mycobacterium
TLGLDPGFRTGVKVAVVD

SEQ ID NO: 867025 - protein, 27 aa, Mycobacterium
TLGLLDFELKRLGFVTPMPLGVEVRGT

SEQ ID NO: 867026 - protein, 21 aa, Mycobacterium
TLGLRLLVLPISATDGCRNIV

SEQ ID NO: 867027 - protein, 24 aa, Mycobacterium
TLGPAKITIIDIPAAPGFGNSTTS

SEQ ID NO: 867028 - protein, 24 aa, Mycobacterium
TLGPIDSAPFYAVPIRVGAMGTKG

SEQ ID NO: 867029 - protein, 18 aa, Mycobacterium
TLGPRRLKGLGADDAREL

SEQ ID NO: 867030 - protein, 19 aa, Mycobacterium
TLGPTLPDGLRGAAALWGL

SEQ ID NO: 867031 - protein, 25 aa, Mycobacterium
TLGRQLRAAWLSFLATGDPSVQGPV

SEQ ID NO: 867032 - protein, 24 aa, Mycobacterium
TLGRVMFNELLPKSYPFVNEQMHK

SEQ ID NO: 867033 - protein, 24 aa, Mycobacterium
TLGSNYTTPFRWAEDMKIGDATVL

SEQ ID NO: 867034 - protein, 28 aa, Mycobacterium
TLGSSGVWELFWPGMTLGALYKFRVHGA

SEQ ID NO: 867035 - protein, 18 aa, Mycobacterium
TLGSYRWLRPSGRRTAKE

SEQ ID NO: 867036 - protein, 26 aa, Mycobacterium
TLGTALARLGMFAPALSYLEEPDGPV

SEQ ID NO: 867037 - protein, 23 aa, Mycobacterium
TLGTTRWLVAILENHQRPDGSVR

SEQ ID NO: 867038 - protein, 22 aa, Mycobacterium
TLGVITALDLRLHPTPSHRLTA

SEQ ID NO: 867039 - protein, 19 aa, Mycobacterium
TLGVPLFQEQLMQLAVDCA

SEQ ID NO: 867040 - protein, 18 aa, Mycobacterium
TLGVVVGDMFFVDPRPLE

SEQ ID NO: 867041 - protein, 27 aa, Mycobacterium
TLGYDIDKPWRKLPKRQRNWILFTEEQ

SEQ ID NO: 867042 - protein, 30 aa, Mycobacterium
TLGYPRGNLAFRWFLADELPTRPEVKLVPV

SEQ ID NO: 867043 - protein, 18 aa, Mycobacterium
TLHAGRLVARRLRASGVD

SEQ ID NO: 867044 - protein, 20 aa, Mycobacterium
TLHALAWMVPGEISLFGLDE

SEQ ID NO: 867045 - protein, 19 aa, Mycobacterium
TLHGVTRPVALSLSLEGVG

SEQ ID NO: 867046 - protein, 19 aa, Mycobacterium
TLHHAGWYAPIPAPGRANV

SEQ ID NO: 867047 - protein, 28 aa, Mycobacterium
TLHHLFEGGWAWVIPFDNYLGSTSRLCS

SEQ ID NO: 867048 - protein, 21 aa, Mycobacterium
TLHLGPLLSDAERRLLTCDAT

SEQ ID NO: 867049 - protein, 17 aa, Mycobacterium
TLHLPFAVADYVDFYAS

SEQ ID NO: 867050 - protein, 21 aa, Mycobacterium
TLHRCLDLGVTFIDTANVYGS

SEQ ID NO: 867051 - protein, 24 aa, Mycobacterium
TLHRIIGAARRLTSAPYGALAIRD

SEQ ID NO: 867052 - protein, 20 aa, Mycobacterium
TLHRQMISELRWPGDPDPDT

SEQ ID NO: 867053 - protein, 21 aa, Mycobacterium
TLHSALLERFAGVIGGGLTEL

SEQ ID NO: 867054 - protein, 24 aa, Mycobacterium
TLHVLRGRIRLTAPETSWDGAPGD

SEQ ID NO: 867055 - protein, 25 aa, Mycobacterium
TLIDIVAYPFILDLDAVLEDNPPDT

SEQ ID NO: 867056 - protein, 45 aa, Mycobacterium
TLIHRRDLPPLANLELLSVAPLITPEMYRLIGINAGRHAKGATPS

SEQ ID NO: 867057 - protein, 25 aa, Mycobacterium
TLIKWMSRFQTFLFKTTNGKLGNKF

SEQ ID NO: 867058 - protein, 17 aa, Mycobacterium
TLILAELRTAVATSGVA

SEQ ID NO: 867059 - protein, 19 aa, Mycobacterium
TLIPDEWLEPAATGSARQC

SEQ ID NO: 867060 - protein, 17 aa, Mycobacterium
TLIPRPQRMYLRFGEPI

SEQ ID NO: 867061 - protein, 18 aa, Mycobacterium
TLIRLTCGRALSLTPLPP

SEQ ID NO: 867062 - protein, 34 aa, Mycobacterium
TLISIPVVSQLLGCTPLGPVGWAQGLGSAAAATV

SEQ ID NO: 867063 - protein, 18 aa, Mycobacterium
TLISRLLSALVERGVSIA

SEQ ID NO: 867064 - protein, 19 aa, Mycobacterium
TLITGLPGVLSRRVDPRNS

SEQ ID NO: 867065 - protein, 20 aa, Mycobacterium
TLIVASAYTPATREAAAIDP

SEQ ID NO: 867066 - protein, 19 aa, Mycobacterium
TLKAVAVKAPFFGDRRKAF

SEQ ID NO: 867067 - protein, 21 aa, Mycobacterium
TLKAVLDRTPWRAEEPIVIVA

SEQ ID NO: 867068 - protein, 20 aa, Mycobacterium
TLKCRIALNGLASEAPSDAS

SEQ ID NO: 867069 - protein, 29 aa, Mycobacterium
TLKEEQLPFLRINSEFYPREIPRASLAPV

SEQ ID NO: 867070 - protein, 33 aa, Mycobacterium; identical to SEQ ID NO: 122744

SEQ ID NO: 867071 - protein, 19 aa, Mycobacterium
TLKGITKPVSLNLVFDGVN

SEQ ID NO: 867072 - protein, 26 aa, Mycobacterium
TLKIVGPAGPSWRKGRYHVSGRGPRD

SEQ ID NO: 867073 - protein, 17 aa, Mycobacterium
TLKLDLEALLRTLSASG

SEQ ID NO: 867074 - protein, 24 aa, Mycobacterium
TLKMHVTLRKAFGFGSMVMSLLGF

SEQ ID NO: 867075 - protein, 22 aa, Mycobacterium
TLKNKQLYTLDLGSLVAGSRYR

SEQ ID NO: 867076 - protein, 18 aa, Mycobacterium
TLKPFDAPWGQRYATVED

SEQ ID NO: 867077 - protein, 19 aa, Mycobacterium
TLKQQFLGAFAAVKDYLVG

SEQ ID NO: 867078 - protein, 18 aa, Mycobacterium
TLKRLLADAELEKVALKE

SEQ ID NO: 867079 - protein, 18 aa, Mycobacterium
TLKRSVMELGGYNPLIIL

SEQ ID NO: 867080 - protein, 19 aa, Mycobacterium
TLKSHRWISGTFGPDLSFG

SEQ ID NO: 867081 - protein, 32 aa, Mycobacterium
TLKSVPHYGIGYGLLRYLYAPTGRVLGAQRTP

SEQ ID NO: 867082 - protein, 30 aa, Mycobacterium
TLKTIDSPIDFLLLDGWPDLDLTILNIVED

SEQ ID NO: 867083 - protein, 22 aa, Mycobacterium
TLKVVILHRPGTELRRLTPRNT

SEQ ID NO: 867084 - protein, 19 aa, Mycobacterium
TLLAFGWMGGGCCVVGECG

SEQ ID NO: 867085 - protein, 18 aa, Mycobacterium
TLLAHQELIRRGLLNDQE

SEQ ID NO: 867086 - protein, 20 aa, Mycobacterium
TLLAPVVAAVHMVWRRQVDA

SEQ ID NO: 867087 - protein, 18 aa, Mycobacterium
TLLARHLAALIRPGTTVC

SEQ ID NO: 867088 - protein, 18 aa, Mycobacterium
TLLAVRRGRYQVASQGLQ

SEQ ID NO: 867089 - protein, 18 aa, Mycobacterium
TLLDFDDLLLHTAAAIEN

SEQ ID NO: 867090 - protein, 20 aa, Mycobacterium
TLLDLMCTAAGTPLPEVRAV

SEQ ID NO: 867091 - protein, 28 aa, Mycobacterium
TLLECTTALPMLLLNRCSVDTDGVAIEV

SEQ ID NO: 867092 - protein, 20 aa, Mycobacterium
TLLGNFQRQVKAVGALLEEL

SEQ ID NO: 867093 - protein, 19 aa, Mycobacterium
TLLGPPQYAVRARTIQKLL

SEQ ID NO: 867094 - protein, 22 aa, Mycobacterium
TLLGSIRRLLAQRRTLARVHVE

SEQ ID NO: 867095 - protein, 20 aa, Mycobacterium
TLLGTRYFRPLVARGLKLTA

SEQ ID NO: 867096 - protein, 19 aa, Mycobacterium
TLLGWGQLGYGLDLSDIQA

SEQ ID NO: 867097 - protein, 18 aa, Mycobacterium
TLLGWYRKNGMPEEALEK

SEQ ID NO: 867098 - protein, 19 aa, Mycobacterium
TLLHRADAAVFPSHYEPFG

SEQ ID NO: 867099 - protein, 28 aa, Mycobacterium
TLLHTVVEAVKFLLRPDIDHLVGETIVA

SEQ ID NO: 867100 - protein, 20 aa, Mycobacterium
TLLIEDWSRRAVPPALPQTE

SEQ ID NO: 867101 - protein, 18 aa, Mycobacterium
TLLLTLAGRFKASHGSLS

SEQ ID NO: 867102 - protein, 17 aa, Mycobacterium
TLLMSCFCDANPPNEQQ

SEQ ID NO: 867103 - protein, 20 aa, Mycobacterium
TLLNGYEPLFSLLNPHDADN

SEQ ID NO: 867104 - protein, 29 aa, Mycobacterium
TLLPEALETWPLSMFERFLPRHLEIIYEI

SEQ ID NO: 867105 - protein, 32 aa, Mycobacterium
TLLPEALETWPLSMFQRFLPRHLEIIYEINRR

SEQ ID NO: 867106 - protein, 18 aa, Mycobacterium
TLLPGRSGYLFGSGFMSA

SEQ ID NO: 867107 - protein, 17 aa, Mycobacterium
TLLPRDPGDADPTVAAI

SEQ ID NO: 867108 - protein, 27 aa, Mycobacterium
TLLREHGLLLPMEPNARLLTETQLWQL

SEQ ID NO: 867109 - protein, 23 aa, Mycobacterium
TLLRHHFRRLIGVTPSDYRRRFA

SEQ ID NO: 867110 - protein, 21 aa, Mycobacterium
TLLRRDLPLIADAAQRVPLSV

SEQ ID NO: 867111 - protein, 21 aa, Mycobacterium
TLLRTMSSPTPLPELQRRALD

SEQ ID NO: 867112 - protein, 20 aa, Mycobacterium
TLLSAGHRAFLEIGPHPALS

SEQ ID NO: 867113 - protein, 21 aa, Mycobacterium
TLLSVLPEFGVHPFEARRECT

SEQ ID NO: 867114 - protein, 17 aa, Mycobacterium
TLLTLSPTQRARTVAVV

SEQ ID NO: 867115 - protein, 21 aa, Mycobacterium
TLLTVLPEFGVHPFEARRECT

SEQ ID NO: 867116 - protein, 21 aa, Mycobacterium
TLLVRGPYGRRFPFSAIFAEV

SEQ ID NO: 867117 - protein, 23 aa, Mycobacterium
TLLYPLFNLWGPAYHDKYSNVTI

SEQ ID NO: 867118 - protein, 17 aa, Mycobacterium
TLMAYLRRRIRTHGLVA

SEQ ID NO: 867119 - protein, 21 aa, Mycobacterium
TLMGTGRFLRERVPGIHIVAA

SEQ ID NO: 867120 - protein, 20 aa, Mycobacterium
TLMHGLKSLPVRLTRVPQPR

SEQ ID NO: 867121 - protein, 19 aa, Mycobacterium
TLMLGPSYNLRKAGAALAE

SEQ ID NO: 867122 - protein, 21 aa, Mycobacterium
TLMPGPFLTDISNAWNFEGTD

SEQ ID NO: 867123 - protein, 18 aa, Mycobacterium
TLMPYFQLMHEMTVDHIH

SEQ ID NO: 867124 - protein, 19 aa, Mycobacterium
TLMTPMFVPQQHAYADPKV

SEQ ID NO: 867125 - protein, 31 aa, Mycobacterium
TLNAINAPAQSLFGRPLIGDGANATTPGGNG

SEQ ID NO: 867126 - protein, 24 aa, Mycobacterium
TLNARANLKWTPQPAMPGQLRAVT

SEQ ID NO: 867127 - protein, 38 aa, Mycobacterium
TLNEDFPRLMVYRGPRRKGVRYFGPYSHAWAIRETVDL

SEQ ID NO: 867128 - protein, 26 aa, Mycobacterium
TLNEEYPRLFVYRGPRRKGVRYFGPY

SEQ ID NO: 867129 - protein, 28 aa, Mycobacterium
TLNLNFFVHDPFTLEPYSRDPRNIARKA

SEQ ID NO: 867130 - protein, 27 aa, Mycobacterium
TLNLNFFVHDPFTLEPYSRDPRNVARK

SEQ ID NO: 867131 - protein, 26 aa, Mycobacterium
TLNLNRRNRLFWPTTSRIVEVIPEQK

SEQ ID NO: 867132 - protein, 24 aa, Mycobacterium
TLNTVTAFAWALVLGRLTDRTDVV

SEQ ID NO: 867133 - protein, 24 aa, Mycobacterium
TLPAEQLTYLFANADTRVVICEEQ

SEQ ID NO: 867134 - protein, 23 aa, Mycobacterium
TLPAGAVLRWRRVDLALFGRIRQ

SEQ ID NO: 867135 - protein, 28 aa, Mycobacterium
TLPARFEDYIEQLFFARLRIDDRDSGVP

SEQ ID NO: 867136 - protein, 34 aa, Mycobacterium
TLPCGPVLKRGGRPTLLTWGLLGPGKGIERGIDA

SEQ ID NO: 867137 - protein, 24 aa, Mycobacterium
TLPCSGLTAWFALVERGRVRAGET

SEQ ID NO: 867138 - protein, 20 aa, Mycobacterium
TLPDIRCVYWAGGNPFHHHQ

SEQ ID NO: 867139 - protein, 23 aa, Mycobacterium
TLPDPLSPVKLLTATPITATEAA

SEQ ID NO: 867140 - protein, 17 aa, Mycobacterium
TLPDVLTFDPSKPARYP

SEQ ID NO: 867141 - protein, 19 aa, Mycobacterium
TLPEFPWDTLADVTALARS

SEQ ID NO: 867142 - protein, 27 aa, Mycobacterium
TLPELTIPPIGIPPTIVGAFTLPEITT

SEQ ID NO: 867143 - protein, 25 aa, Mycobacterium
TLPESLASLPGCHLLVNPDAMRRDV

SEQ ID NO: 867144 - protein, 20 aa, Mycobacterium
TLPEWSERFATLAGPWAPVQ

SEQ ID NO: 867145 - protein, 19 aa, Mycobacterium
TLPFAGLRVVDMTTFWAGP

SEQ ID NO: 867146 - protein, 20 aa, Mycobacterium
TLPGASWQRCRTHYATNLMA

SEQ ID NO: 867147 - protein, 21 aa, Mycobacterium
TLPGFVLARLLAVGAAMGELV

SEQ ID NO: 867148 - protein, 22 aa, Mycobacterium
TLPGGPLFFLAAEIPDDLLLVI

SEQ ID NO: 867149 - protein, 21 aa, Mycobacterium
TLPGLPLLNTLTVTGSHFGGL

SEQ ID NO: 867150 - protein, 20 aa, Mycobacterium
TLPGMRRIVEALFHDPAYPA

SEQ ID NO: 867151 - protein, 18 aa, Mycobacterium
TLPGRSLLFVRNVGHLMT

SEQ ID NO: 867152 - protein, 20 aa, Mycobacterium
TLPGRSLLFVRNVGHLMTND

SEQ ID NO: 867153 - protein, 19 aa, Mycobacterium
TLPHILSGSGWHTALFGMQ

SEQ ID NO: 867154 - protein, 31 aa, Mycobacterium
TLPHPRAHLRAFVLVPWLALEPGAVLTVDGV

SEQ ID NO: 867155 - protein, 18 aa, Mycobacterium
TLPIMNPGGSIVGMDFDP

SEQ ID NO: 867156 - protein, 19 aa, Mycobacterium
TLPITARYAQHWNFAGGPP

SEQ ID NO: 867157 - protein, 22 aa, Mycobacterium
TLPLLAAILDRVEVPVLAAGGI

SEQ ID NO: 867158 - protein, 23 aa, Mycobacterium
TLPPAGGTLIRLFHAETVMCEMD

SEQ ID NO: 867159 - protein, 17 aa, Mycobacterium
TLPPAPRIPSLVQGLVF

SEQ ID NO: 867160 - protein, 21 aa, Mycobacterium
TLPPLEIPGITIPNLSLPPIT

SEQ ID NO: 867161 - protein, 23 aa, Mycobacterium
TLPPTLAFDYPTPAALATHLGQL

SEQ ID NO: 867162 - protein, 22 aa, Mycobacterium
TLPRTMTFKVLKRQLSADGVDC

SEQ ID NO: 867163 - protein, 22 aa, Mycobacterium
TLPSIYFAHRRKVFERDGMLLA

SEQ ID NO: 867164 - protein, 22 aa, Mycobacterium
TLPSPPMLQAPDLMAALAAAPT

SEQ ID NO: 867165 - protein, 19 aa, Mycobacterium
TLPTLLSGSDFIFSGFGSV

SEQ ID NO: 867166 - protein, 22 aa, Mycobacterium
TLPTYSFARQRFWLGEGAGRKA

SEQ ID NO: 867167 - protein, 20 aa, Mycobacterium
TLPVLPVPPSQEVMLENVFG

SEQ ID NO: 867168 - protein, 24 aa, Mycobacterium
TLQAHRIHRYGFPLGNVGHIQNIP

SEQ ID NO: 867169 - protein, 21 aa, Mycobacterium
TLQDLIIGALADLTSKTQELA

SEQ ID NO: 867170 - protein, 20 aa, Mycobacterium
TLQEAEAMVLDYIRQHVASA

SEQ ID NO: 867171 - protein, 17 aa, Mycobacterium
TLQEPLPERTWIYEYDP

SEQ ID NO: 867172 - protein, 17 aa, Mycobacterium
TLQITELLYRYAELVDA

SEQ ID NO: 867173 - protein, 18 aa, Mycobacterium
TLQLLVDEGLITETEGGS

SEQ ID NO: 867174 - protein, 23 aa, Mycobacterium
TLQLRYRFAPFSHQYTALFLREL

SEQ ID NO: 867175 - protein, 19 aa, Mycobacterium
TLQLTLTVTGTADGEWHAE

SEQ ID NO: 867176 - protein, 23 aa, Mycobacterium
TLQMLNDCPLRWLAERHGGTNPR

SEQ ID NO: 867177 - protein, 25 aa, Mycobacterium
TLQPIGAFKIRGAFNALGRLDTHTR

SEQ ID NO: 867178 - protein, 23 aa, Mycobacterium
TLQQLGEFAVIDRLVRGRRQPAA

SEQ ID NO: 867179 - protein, 18 aa, Mycobacterium
TLQQMRPLRGGPSGTPAG

SEQ ID NO: 867180 - protein, 28 aa, Mycobacterium
TLQRFIDRFAPFNLRDTAIRPSYGLAEA

SEQ ID NO: 867181 - protein, 28 aa, Mycobacterium
TLQRIKSLAIPPAWNEVWISPHINGHIQ

SEQ ID NO: 867182 - protein, 25 aa, Mycobacterium
TLQRSLLPDVIPTLESWQLSAHYEP

SEQ ID NO: 867183 - protein, 25 aa, Mycobacterium
TLQTSLLFIGNSVYLPAGFAPSRRT

SEQ ID NO: 867184 - protein, 31 aa, Mycobacterium
TLQVWAEPFVPLRVPKIFNLRTDPFERADIT

SEQ ID NO: 867185 - protein, 22 aa, Mycobacterium
TLRADEALPLFAISVGAALVRT

SEQ ID NO: 867186 - protein, 21 aa, Mycobacterium
TLRADEALPLLAISVGASLVR

SEQ ID NO: 867187 - protein, 20 aa, Mycobacterium
TLRAGAVLGVIMLGLTGCGG

SEQ ID NO: 867188 - protein, 22 aa, Mycobacterium
TLRARFVLAGVTPSALAGLLGE

SEQ ID NO: 867189 - protein, 34 aa, Mycobacterium
TLRATVALTPLPAAKVLCVLGFADSVTAAECVPV

SEQ ID NO: 867190 - protein, 21 aa, Mycobacterium
TLRDALLPWLPTESARRASGE

SEQ ID NO: 867191 - protein, 26 aa, Mycobacterium
TLRDPDGHRLPAWAAGAHLPITLPSG

SEQ ID NO: 867192 - protein, 18 aa, Mycobacterium
TLRDTNAFDLAHHVVSEA

SEQ ID NO: 867193 - protein, 28 aa, Mycobacterium
TLREIDDVWHYLLRWALMFGVTEDLLPR

SEQ ID NO: 867194 - protein, 17 aa, Mycobacterium
TLRELIGALILEPDDEA

SEQ ID NO: 867195 - protein, 19 aa, Mycobacterium
TLRELLPASKFLDAPVEFV

SEQ ID NO: 867196 - protein, 21 aa, Mycobacterium
TLRERLNWDVTWRTAQFVVAA

SEQ ID NO: 867197 - protein, 33 aa, Mycobacterium
TLRERMAFPSTLIARLPNLKLITIVGRSLPNLD

SEQ ID NO: 867198 - protein, 18 aa, Mycobacterium
TLRFAKTMRDSLQAAGLT

SEQ ID NO: 867199 - protein, 31 aa, Mycobacterium
TLRFDRIPQPWLREPAKRWIRLRLSRGLNLE

SEQ ID NO: 867200 - protein, 25 aa, Mycobacterium
TLRGDFLWCQLFSEPGAGSDLASLR

SEQ ID NO: 867201 - protein, 27 aa, Mycobacterium
TLRGEPFLYAGAITALIRDFLHRARQG

SEQ ID NO: 867202 - protein, 17 aa, Mycobacterium
TLRLFGRVGGDGGDGGR

SEQ ID NO: 867203 - protein, 29 aa, Mycobacterium
TLRLIPNIVVLPYRNPFVVAKAGATLDLI

SEQ ID NO: 867204 - protein, 20 aa, Mycobacterium
TLRMALLGKVMTVGDTVSLL

SEQ ID NO: 867205 - protein, 18 aa, Mycobacterium
TLRNGLRQSVYRSYVHPH

SEQ ID NO: 867206 - protein, 20 aa, Mycobacterium
TLRPLRPAFSVGLGARLGSG

SEQ ID NO: 867207 - protein, 24 aa, Mycobacterium
TLRPPRVPYLSNVTGTWIRPEEAI

SEQ ID NO: 867208 - protein, 24 aa, Mycobacterium
TLRQAVGICTDWLHRHGFSLPVAS

SEQ ID NO: 867209 - protein, 18 aa, Mycobacterium
TLRQLRRALRRADGSQPP

SEQ ID NO: 867210 - protein, 18 aa, Mycobacterium
TLRQLRRTLQRGRSGDSP

SEQ ID NO: 867211 - protein, 17 aa, Mycobacterium
TLRQRVIRLLRNRLSLT

SEQ ID NO: 867212 - protein, 20 aa, Mycobacterium
TLRQTMVALTAGAALHDHDS

SEQ ID NO: 867213 - protein, 19 aa, Mycobacterium
TLRQWAVHAELMRITAPWD

SEQ ID NO: 867214 - protein, 23 aa, Mycobacterium
TLRRAARYFVPKMLYGPGVAADP

SEQ ID NO: 867215 - protein, 20 aa, Mycobacterium
TLRRAFVNHLGISPKAYRDR

SEQ ID NO: 867216 - protein, 17 aa, Mycobacterium
TLRRALLVMHSPTDNTV

SEQ ID NO: 867217 - protein, 18 aa, Mycobacterium
TLRRDMWAGLAAAGLDSI

SEQ ID NO: 867218 - protein, 24 aa, Mycobacterium
TLRRLGEIAVRIKYLEVLCQRSIS

SEQ ID NO: 867219 - protein, 30 aa, Mycobacterium
TLRRSRRLSMFPRHPLVCLVIEPFGVAVTM

SEQ ID NO: 867220 - protein, 21 aa, Mycobacterium
TLRRVFVTHLGVSPKAYRDRF

SEQ ID NO: 867221 - protein, 27 aa, Mycobacterium
TLRRYDTTYLSELRWWTSPFTTDPSHA

SEQ ID NO: 867222 - protein, 23 aa, Mycobacterium
TLRSKLLRSLAGPGGMLSIACST

SEQ ID NO: 867223 - protein, 20 aa, Mycobacterium
TLRSLGLPAMSPTIGGHEGS

SEQ ID NO: 867224 - protein, 19 aa, Mycobacterium
TLRSLYFLSSRVTGGSPHA

SEQ ID NO: 867225 - protein, 19 aa, Mycobacterium
TLRSMVITAPEPLRTQLRS

SEQ ID NO: 867226 - protein, 18 aa, Mycobacterium
TLRTILTLALPDDRRKMR

SEQ ID NO: 867227 - protein, 18 aa, Mycobacterium
TLRTLAYGGSKVPLPLVR

SEQ ID NO: 867228 - protein, 20 aa, Mycobacterium
TLRVRTWKRSSFSGTEIFGK

SEQ ID NO: 867229 - protein, 25 aa, Mycobacterium
TLRVYEMSMGPLELSRPWATKDVVG

SEQ ID NO: 867230 - protein, 23 aa, Mycobacterium
TLSARANLKWTPQPAMPGQLRAV

SEQ ID NO: 867231 - protein, 26 aa, Mycobacterium
TLSAYGVRYLFGVPGAKIDSVFDALR

SEQ ID NO: 867232 - protein, 23 aa, Mycobacterium
TLSAYLTMQLLEAAGLPPGVINL

SEQ ID NO: 867233 - protein, 24 aa, Mycobacterium
TLSDEFDFRYLVGVLSVLADKDAN

SEQ ID NO: 867234 - protein, 29 aa, Mycobacterium
TLSDRLDIDRWLIAVSALPRRDRWHTLAR

SEQ ID NO: 867235 - protein, 19 aa, Mycobacterium
TLSEEMLYPWETSPELSAE

SEQ ID NO: 867236 - protein, 28 aa, Mycobacterium
TLSEKIDPYLRPLYDALHDMMDPELIPK

SEQ ID NO: 867237 - protein, 28 aa, Mycobacterium
TLSEKIDPYLRPLYDALHDMMDTELIPK

SEQ ID NO: 867238 - protein, 20 aa, Mycobacterium
TLSELKSLGLTTFLMPISPG

SEQ ID NO: 867239 - protein, 19 aa, Mycobacterium
TLSGALLIGGERINAASGG

SEQ ID NO: 867240 - protein, 22 aa, Mycobacterium
TLSGARILADRLLAADVAKAGV

SEQ ID NO: 867241 - protein, 25 aa, Mycobacterium
TLSGLARDALAGRVLLGAAISDVRR

SEQ ID NO: 867242 - protein, 18 aa, Mycobacterium
TLSHDILMTGPTADFFRR

SEQ ID NO: 867243 - protein, 23 aa, Mycobacterium
TLSLGMSQRLGIAAALIGDPPVL

SEQ ID NO: 867244 - protein, 26 aa, Mycobacterium
TLSLHQEWMLIALRTEWQVGEVTYPA

SEQ ID NO: 867245 - protein, 28 aa, Mycobacterium
TLSLLVVSQESLFKWQRLRLARVEATQP

SEQ ID NO: 867246 - protein, 17 aa, Mycobacterium
TLSLLYAEKNHAPHGRV

SEQ ID NO: 867247 - protein, 18 aa, Mycobacterium
TLSLWQGVDVPGPSLQLV

SEQ ID NO: 867248 - protein, 23 aa, Mycobacterium
TLSNHLACLRGCGLVVAVPEGRR

SEQ ID NO: 867249 - protein, 24 aa, Mycobacterium
TLSNLLRMLFSRAGTYPRGATERL

SEQ ID NO: 867250 - protein, 20 aa, Mycobacterium
TLSNLVRMLFSRAGTYPPGA

SEQ ID NO: 867251 - protein, 26 aa, Mycobacterium
TLSNTYIRLVSPFRLTTTALKDIDGL

SEQ ID NO: 867252 - protein, 19 aa, Mycobacterium
TLSPCWYCSGLVRQFNIGA

SEQ ID NO: 867253 - protein, 24 aa, Mycobacterium
TLSPTTWFPFSGGNRRCLGAGFAM

SEQ ID NO: 867254 - protein, 22 aa, Mycobacterium
TLSPTTWLPFGGGNRRCLGATF

SEQ ID NO: 867255 - protein, 22 aa, Mycobacterium
TLSPVTWFPFGGGNRRCLGATF

SEQ ID NO: 867256 - protein, 19 aa, Mycobacterium
TLSRALRWEYDQIERMGPD

SEQ ID NO: 867257 - protein, 23 aa, Mycobacterium
TLSRLPRGLYIGMAALVHASAEG

SEQ ID NO: 867258 - protein, 24 aa, Mycobacterium
TLSRTHPNLVRKLFSLEVPEISDG

SEQ ID NO: 867259 - protein, 25 aa, Mycobacterium
TLSRYLAGPLVPTMFGRDARLQLRH

SEQ ID NO: 867260 - protein, 23 aa, Mycobacterium
TLSSLILDPPYGLRVQSYAPRRQ

SEQ ID NO: 867261 - protein, 24 aa, Mycobacterium
TLSTAIRAARRWIRAPASTSSSVA

SEQ ID NO: 867262 - protein, 17 aa, Mycobacterium
TLSTHLDIALADAPPVV

SEQ ID NO: 867263 - protein, 19 aa, Mycobacterium
TLSTLTWRIATNVTKLPGL

SEQ ID NO: 867264 - protein, 19 aa, Mycobacterium
TLSVFLDRLRTGEGDLIDF

SEQ ID NO: 867265 - protein, 25 aa, Mycobacterium
TLSWLSRHSQPLRRLPFGISTTRDI

SEQ ID NO: 867266 - protein, 22 aa, Mycobacterium
TLTAGDLIILSSSLIPGNEEAV

SEQ ID NO: 867267 - protein, 31 aa, Mycobacterium
TLTAGTFGNVLRFLPPLTITDELLVDAFGVI

SEQ ID NO: 867268 - protein, 17 aa, Mycobacterium
TLTANPPWAGTPALPPS

SEQ ID NO: 867269 - protein, 22 aa, Mycobacterium
TLTARYTWANRLVAVVSDGSAV

SEQ ID NO: 867270 - protein, 22 aa, Mycobacterium
TLTATVAFRHPTIESLATVIIE

SEQ ID NO: 867271 - protein, 24 aa, Mycobacterium
TLTEFKLLSFLVQHAGRPFTRTRL

SEQ ID NO: 867272 - protein, 20 aa, Mycobacterium
TLTEGLARLGGEAALTGVGH

SEQ ID NO: 867273 - protein, 26 aa, Mycobacterium
TLTEHETMLIRRLLGSFGTDAAARLG

SEQ ID NO: 867274 - protein, 28 aa, Mycobacterium
TLTGFTVNHRFSLPGLPAPYVIAQVAIA

SEQ ID NO: 867275 - protein, 19 aa, Mycobacterium
TLTGMTFRDPTWADETYVF

SEQ ID NO: 867276 - protein, 19 aa, Mycobacterium
TLTIMALTVRACRFIVHDY

SEQ ID NO: 867277 - protein, 17 aa, Mycobacterium
TLTKGDVYTLWAPRWRA

SEQ ID NO: 867278 - protein, 19 aa, Mycobacterium
TLTLAHRAKREGWIGDIAG

SEQ ID NO: 867279 - protein, 17 aa, Mycobacterium
TLTLRYRRPTALERPLR

SEQ ID NO: 867280 - protein, 18 aa, Mycobacterium
TLTMLITTWDAAGGGPFA

SEQ ID NO: 867281 - protein, 23 aa, Mycobacterium
TLTPETPLAAVTRYFAAYNLVCG

SEQ ID NO: 867282 - protein, 25 aa, Mycobacterium
TLTPETPLAAVTRYLAAYNLVCGPV

SEQ ID NO: 867283 - protein, 30 aa, Mycobacterium
TLTPPVLRRHILENPAWYTAYTPYQPEISQ

SEQ ID NO: 867284 - protein, 20 aa, Mycobacterium
TLTRCDIRVPRFATVDLTGQ

SEQ ID NO: 867285 - protein, 21 aa, Mycobacterium
TLTSYPSIRTDLRNAGANVVD

SEQ ID NO: 867286 - protein, 21 aa, Mycobacterium
TLTSYPSIRTDLRNAGAQVED

SEQ ID NO: 867287 - protein, 20 aa, Mycobacterium
TLTTHPAGFNRTFRLQRHVP

SEQ ID NO: 867288 - protein, 19 aa, Mycobacterium
TLTTLIWRTEPGKAVFRTE

SEQ ID NO: 867289 - protein, 19 aa, Mycobacterium
TLTTLIWRTEPGKAVYRTE

SEQ ID NO: 867290 - protein, 21 aa, Mycobacterium
TLTTLIWRTEPGKAVYRTVVA

SEQ ID NO: 867291 - protein, 34 aa, Mycobacterium
TLTTRVFDVALGYPWPAHFPERVLRNAFTAAWDG

SEQ ID NO: 867292 - protein, 19 aa, Mycobacterium
TLTVELLKELLPEAAQFDV

SEQ ID NO: 867293 - protein, 43 aa, Mycobacterium
TLTVFQRTPIWCLPKFDFAVPRPLSALLRLAPGAQIAARGASQ

SEQ ID NO: 867294 - protein, 21 aa, Mycobacterium
TLTVQHRFDFIASRLGIGIAA

SEQ ID NO: 867295 - protein, 23 aa, Mycobacterium
TLTYQMMFELRDLGFSTAIGIGG

SEQ ID NO: 867296 - protein, 17 aa, Mycobacterium
TLTYSVRMAAVGMPLQH

SEQ ID NO: 867297 - protein, 20 aa, Mycobacterium
TLVADLRRILDPGYALRARE

SEQ ID NO: 867298 - protein, 27 aa, Mycobacterium
TLVAGDVRLLLPKPADWSYAEAAAISA

SEQ ID NO: 867299 - protein, 21 aa, Mycobacterium
TLVAMQRLPRAGSGKLDRIAL

SEQ ID NO: 867300 - protein, 25 aa, Mycobacterium
TLVDKERPFLVLTNNSIFTPRDLAA

SEQ ID NO: 867301 - protein, 31 aa, Mycobacterium
TLVDLGLIDQLLAWRARLGALVFGRTPTLEQ

SEQ ID NO: 867302 - protein, 27 aa, Mycobacterium
TLVDSNYLHIDAWLRAFATAGIDVETW

SEQ ID NO: 867303 - protein, 20 aa, Mycobacterium
TLVEGGVALGWIASRWPGLL

SEQ ID NO: 867304 - protein, 21 aa, Mycobacterium
TLVELISPQGLYRLTPRTGRT

SEQ ID NO: 867305 - protein, 18 aa, Mycobacterium
TLVENDRLNRLLTASFEP

SEQ ID NO: 867306 - protein, 24 aa, Mycobacterium
TLVENFLRMTFGFPAEPYEVDPEI

SEQ ID NO: 867307 - protein, 25 aa, Mycobacterium
TLVENFLRMTFGFPAEPYHPDPEVV

SEQ ID NO: 867308 - protein, 25 aa, Mycobacterium
TLVENFLRMTFGFPAEPYQADPEVV

SEQ ID NO: 867309 - protein, 24 aa, Mycobacterium
TLVENFLRMTFGLPAEPYQADPEI

SEQ ID NO: 867310 - protein, 25 aa, Mycobacterium
TLVENYLRALFPRGTHIELAEQSPT

SEQ ID NO: 867311 - protein, 27 aa, Mycobacterium
TLVEVDPPWRFSFRWCYPEGHTANPEN

SEQ ID NO: 867312 - protein, 19 aa, Mycobacterium
TLVEVNPLVRDPKDQILAL

SEQ ID NO: 867313 - protein, 17 aa, Mycobacterium
TLVFDHPTPTALAGLIA

SEQ ID NO: 867314 - protein, 19 aa, Mycobacterium
TLVFTDLVGFSAWSLRSGD

SEQ ID NO: 867315 - protein, 22 aa, Mycobacterium
TLVGDGIGIVLLKRASNAVADG

SEQ ID NO: 867316 - protein, 31 aa, Mycobacterium
TLVHGLPMYHVHGLVLGLLGSLRIGNRFVHT

SEQ ID NO: 867317 - protein, 20 aa, Mycobacterium
TLVHSLVPRAPEPHPGLLVT

SEQ ID NO: 867318 - protein, 19 aa, Mycobacterium
TLVIIPTYNERENLPLILG

SEQ ID NO: 867319 - protein, 25 aa, Mycobacterium
TLVLGCTHYPLLSGLIQLVMGDNVT

SEQ ID NO: 867320 - protein, 23 aa, Mycobacterium
TLVLGPRAVLTPLAREKARTLGI

SEQ ID NO: 867321 - protein, 19 aa, Mycobacterium
TLVMTHYVPALVPGQEEQW

SEQ ID NO: 867322 - protein, 28 aa, Mycobacterium
TLVNCVGIFDFYRGIGDIDPPDLPGAFD

SEQ ID NO: 867323 - protein, 20 aa, Mycobacterium
TLVNCVGVFDFYRGVSDIDA

SEQ ID NO: 867324 - protein, 23 aa, Mycobacterium
TLVNPRPHFVERIRLHQLVAGNA

SEQ ID NO: 867325 - protein, 23 aa, Mycobacterium
TLVNPRPQFVERIRLHQLAADAG

SEQ ID NO: 867326 - protein, 19 aa, Mycobacterium
TLVPRARPALRFVEIVAAD

SEQ ID NO: 867327 - protein, 18 aa, Mycobacterium
TLVPYAKRTPRLARTRAW

SEQ ID NO: 867328 - protein, 28 aa, Mycobacterium
TLVQQVRPLIGDLPLGAHFHNTRGAGLA

SEQ ID NO: 867329 - protein, 17 aa, Mycobacterium
TLVRCVGGLAAFMLGRQ

SEQ ID NO: 867330 - protein, 17 aa, Mycobacterium
TLVRHRLAVAHPGYDSE

SEQ ID NO: 867331 - protein, 28 aa, Mycobacterium
TLVRTLDDSWLVATAVFMVEDLYKSFFR

SEQ ID NO: 867332 - protein, 19 aa, Mycobacterium
TLVRYPEPLAPVASASRAG

SEQ ID NO: 867333 - protein, 29 aa, Mycobacterium
TLVRYVDRFVMYYIRTADRLQRTAPWVES

SEQ ID NO: 867334 - protein, 17 aa, Mycobacterium
TLVTMSRARTIAATDSN

SEQ ID NO: 867335 - protein, 34 aa, Mycobacterium
TLVTPLTPQQRAWLNLVRPLTIVEGFALLSVPSS

SEQ ID NO: 867336 - protein, 23 aa, Mycobacterium
TLVTSIPVLLSAKGFEPIIYSND

SEQ ID NO: 867337 - protein, 17 aa, Mycobacterium
TLVVYGGLILEQAQLRG

SEQ ID NO: 867338 - protein, 24 aa, Mycobacterium
TLWACVDVFLRSKGVIVDPDRALD

SEQ ID NO: 867339 - protein, 28 aa, Mycobacterium
TLWAEIAPIYDGIIAHPFITGLADGSLP

SEQ ID NO: 867340 - protein, 19 aa, Mycobacterium
TLWAIAERFYGDGSKYQVI

SEQ ID NO: 867341 - protein, 27 aa, Mycobacterium
TLWCEKPMYIQLDFLVRRFAEQVAADP

SEQ ID NO: 867342 - protein, 18 aa, Mycobacterium
TLWDLPVHGDNRGWFKEN

SEQ ID NO: 867343 - protein, 25 aa, Mycobacterium
TLWGKNIGQFQLIQLKLAKMEIARM

SEQ ID NO: 867344 - protein, 39 aa, Mycobacterium
TLWSYTENRYPPPPPYPAPDPFEPFAIAAVELAGEGLIV

SEQ ID NO: 867345 - protein, 20 aa, Mycobacterium
TLWTGIGRRDFLRAVAAVSA

SEQ ID NO: 867346 - protein, 17 aa, Mycobacterium
TLYDGDFVSTWKTLEEF

SEQ ID NO: 867347 - protein, 21 aa, Mycobacterium
TLYEPLEQFYVDKQWAHISDW

SEQ ID NO: 867348 - protein, 18 aa, Mycobacterium
TLYFGVPTVWSRVAADQA

SEQ ID NO: 867349 - protein, 17 aa, Mycobacterium
TLYLATRGGYFVVDVAT

SEQ ID NO: 867350 - protein, 17 aa, Mycobacterium
TLYQYFKGKDEIFLELL

SEQ ID NO: 867351 - protein, 18 aa, Mycobacterium
TLYRHFDGRTALLEALDH

SEQ ID NO: 867352 - protein, 20 aa, Mycobacterium
TLYRNFPTRDDLLRAVLEDG

SEQ ID NO: 867353 - protein, 28 aa, Mycobacterium
TMAAKSAPHVWIAGAWLTAGLVRPTAIP

SEQ ID NO: 867354 - protein, 20 aa, Mycobacterium
TMAENLAHIAPPDPDGKVLR

SEQ ID NO: 867355 - protein, 18 aa, Mycobacterium
TMAPIPSLLSVAAVHHHL

SEQ ID NO: 867356 - protein, 30 aa, Mycobacterium
TMAPTNIPSPILPLAFSRWVFARTEPGLPN

SEQ ID NO: 867357 - protein, 19 aa, Mycobacterium
TMARCFALWAGLIGAVSLE

SEQ ID NO: 867358 - protein, 24 aa, Mycobacterium
TMARGEARFYLRAGALLTEAASLA

SEQ ID NO: 867359 - protein, 18 aa, Mycobacterium
TMARLGNAAWLIGLARDR

SEQ ID NO: 867360 - protein, 23 aa, Mycobacterium
TMASAYAPYMAWMAGAGARAAET

SEQ ID NO: 867361 - protein, 24 aa, Mycobacterium
TMDAIWDDVLDRMGWLETQTSRTF

SEQ ID NO: 867362 - protein, 25 aa, Mycobacterium
TMDAWTLVHSWYRRFEGRRILNGTA

SEQ ID NO: 867363 - protein, 22 aa, Mycobacterium
TMDICRPCLGLAFRMHVTAATM

SEQ ID NO: 867364 - protein, 24 aa, Mycobacterium
TMDNLHRKGWLQRERVGKAFSYWP

SEQ ID NO: 867365 - protein, 23 aa, Mycobacterium
TMDRLFRAVAGFGANRDAGLAAA

SEQ ID NO: 867366 - protein, 25 aa, Mycobacterium
TMEEFQAMQSAWWKIAIDTAGYGRA

SEQ ID NO: 867367 - protein, 30 aa, Mycobacterium
TMEHTGINLLIIPLIMRVGMARPRGGMGML

SEQ ID NO: 867368 - protein, 24 aa, Mycobacterium
TMERGLFDAMFIADELAPYTTYKG

SEQ ID NO: 867369 - protein, 18 aa, Mycobacterium
TMFDTALLDRVAAPANGR

SEQ ID NO: 867370 - protein, 22 aa, Mycobacterium
TMFGAAMKLLPRIPLPEKPPHN

SEQ ID NO: 867371 - protein, 18 aa, Mycobacterium
TMGALAAGADEVSAAVAA

SEQ ID NO: 867372 - protein, 35 aa, Mycobacterium
TMGALIDPRILLGGVLYVPLLTRMLTNLNAMGLSE

SEQ ID NO: 867373 - protein, 24 aa, Mycobacterium
TMGALIIGCPLAVAFATRANARYC

SEQ ID NO: 867374 - protein, 20 aa, Mycobacterium
TMGCLYPGRIFLGVGTGEAL

SEQ ID NO: 867375 - protein, 21 aa, Mycobacterium
TMGCLYPGRIFLGVGTGEALN

SEQ ID NO: 867376 - protein, 22 aa, Mycobacterium
TMGCLYPNRIFLGVGTGEALNE

SEQ ID NO: 867377 - protein, 19 aa, Mycobacterium
TMHFAVLSGVRAWVEELPL

SEQ ID NO: 867378 - protein, 19 aa, Mycobacterium
TMHFGQFIAAYEDIVRRAR

SEQ ID NO: 867379 - protein, 26 aa, Mycobacterium
TMHGVRLRNVSLLYLDLHVAATLDIP

SEQ ID NO: 867380 - protein, 22 aa, Mycobacterium
TMHLPVPQRLAALAEPAVRRRL

SEQ ID NO: 867381 - protein, 17 aa, Mycobacterium
TMHSCFGPRFVLGLGRG

SEQ ID NO: 867382 - protein, 21 aa, Mycobacterium
TMHWMSSIGALNFFAGPAVDQ

SEQ ID NO: 867383 - protein, 21 aa, Mycobacterium
TMIAVPVMLQRIVDLPAKVRQ

SEQ ID NO: 867384 - protein, 30 aa, Mycobacterium
TMIEPWLLMNWHRTMDWLLLAPTLSAQQAL

SEQ ID NO: 867385 - protein, 31 aa, Mycobacterium
TMIEPWLLMNWHRTMDWLLLAPTLTAQEALD

SEQ ID NO: 867386 - protein, 25 aa, Mycobacterium
TMIHESFVKMLHLGAGSYAATEAIN

SEQ ID NO: 867387 - protein, 19 aa, Mycobacterium
TMIIGVDTLPPLPTDPGDR

SEQ ID NO: 867388 - protein, 18 aa, Mycobacterium
TMKLFRPDLKNPGPEDLK

SEQ ID NO: 867389 - protein, 20 aa, Mycobacterium
TMKRLLPDFFRPQTDHPAGS

SEQ ID NO: 867390 - protein, 20 aa, Mycobacterium
TMKRTFLELGGKSAMIVLDD

SEQ ID NO: 867391 - protein, 23 aa, Mycobacterium
TMKTELLQALLAAGGDPAVRAVV

SEQ ID NO: 867392 - protein, 19 aa, Mycobacterium
TMLAAHPELVVNRSAPTVL

SEQ ID NO: 867393 - protein, 17 aa, Mycobacterium
TMLALSLDMHFFADPVA

SEQ ID NO: 867394 - protein, 33 aa, Mycobacterium
TMLARCVIGLQWIPENILHFVGTRAALIHARDT

SEQ ID NO: 867395 - protein, 18 aa, Mycobacterium
TMLATLYAKALDADLPHP

SEQ ID NO: 867396 - protein, 20 aa, Mycobacterium
TMLEAAVFRTELREQGRGGE

SEQ ID NO: 867397 - protein, 22 aa, Mycobacterium
TMLNTEFAFALIELAKHGHAVV

SEQ ID NO: 867398 - protein, 33 aa, Mycobacterium
TMLPNGELVKRCYAEILPAARPGALFIDSSTIS

SEQ ID NO: 867399 - protein, 21 aa, Mycobacterium
TMLTGLRHGVTLGGPIAIEIG

SEQ ID NO: 867400 - protein, 18 aa, Mycobacterium
TMLTTLYLKALDADFDRP

SEQ ID NO: 867401 - protein, 18 aa, Mycobacterium
TMMLLLAAAHRDPAEYDR

SEQ ID NO: 867402 - protein, 18 aa, Mycobacterium
TMMVALTGLLAEHYRVPM

SEQ ID NO: 867403 - protein, 21 aa, Mycobacterium
TMMVVQLLDAWGVDITPEMAH

SEQ ID NO: 867404 - protein, 20 aa, Mycobacterium
TMNCLSWIEALGFCGIGEAR

SEQ ID NO: 867405 - protein, 17 aa, Mycobacterium
TMNHLAFHVPAEKFDEY

SEQ ID NO: 867406 - protein, 25 aa, Mycobacterium
TMNHSVWFHRPIRFDEWVLYSTTSP

SEQ ID NO: 867407 - protein, 21 aa, Mycobacterium
TMPARAAAITAPLLVVHGDKD

SEQ ID NO: 867408 - protein, 18 aa, Mycobacterium
TMPEAWLPTLTAELGRMA

SEQ ID NO: 867409 - protein, 20 aa, Mycobacterium
TMPEPIPDVLRSVASRFLDE

SEQ ID NO: 867410 - protein, 17 aa, Mycobacterium
TMPLLEAWTALSALARD

SEQ ID NO: 867411 - protein, 26 aa, Mycobacterium
TMPNRQPVFLYSATARPGNSGGPIVA

SEQ ID NO: 867412 - protein, 25 aa, Mycobacterium
TMQIKAIFSVLLREYEFEMAQPADS

SEQ ID NO: 867413 - protein, 17 aa, Mycobacterium
TMQPIRRYHVDAAILFS

SEQ ID NO: 867414 - protein, 28 aa, Mycobacterium
TMQRKRFGRIIFIGSVSGMWGIGNQANY

SEQ ID NO: 867415 - protein, 18 aa, Mycobacterium
TMRFGQFIAAYEDIVRRA

SEQ ID NO: 867416 - protein, 21 aa, Mycobacterium
TMRRNFLRRVGISPDQYRKAF

SEQ ID NO: 867417 - protein, 18 aa, Mycobacterium
TMRRRRATGGPAEQTFAT

SEQ ID NO: 867418 - protein, 26 aa, Mycobacterium
TMRRTFRRNLGISPGLYRNRFRTTGI

SEQ ID NO: 867419 - protein, 23 aa, Mycobacterium
TMRRTFRRNLGISPGVYRNRFRT

SEQ ID NO: 867420 - protein, 17 aa, Mycobacterium
TMRSHAYGLLRTILATA

SEQ ID NO: 867421 - protein, 17 aa, Mycobacterium
TMRVRADYWPDSLIRSV

SEQ ID NO: 867422 - protein, 23 aa, Mycobacterium
TMRVRLVHSLARRGLRSAWGEDN

SEQ ID NO: 867423 - protein, 26 aa, Mycobacterium
TMRVRWFAEFAKFERVCVLPQYRNSD

SEQ ID NO: 867424 - protein, 19 aa, Mycobacterium
TMRWIPNPVADLMFPEGTF

SEQ ID NO: 867425 - protein, 25 aa, Mycobacterium
TMSIERRMLLRAYGAELVLTPGADG

SEQ ID NO: 867426 - protein, 25 aa, Mycobacterium
TMSIERRMLLRAYGAELVLTPGAEG

SEQ ID NO: 867427 - protein, 27 aa, Mycobacterium
TMSNLLRVFELLDPLTERLRAGLPVYG

SEQ ID NO: 867428 - protein, 28 aa, Mycobacterium
TMTFRDNFTGFWNLWKDGIVKRDYVLLD

SEQ ID NO: 867429 - protein, 25 aa, Mycobacterium
TMTLNYYGPLRLIRGLAPGMLARGD

SEQ ID NO: 867430 - protein, 28 aa, Mycobacterium
TMTSVVINPFFDWGYDRAPMIPYHETVI

SEQ ID NO: 867431 - protein, 27 aa, Mycobacterium
TMTSVVINPFFDWGYDRAPVTPYNETV

SEQ ID NO: 867432 - protein, 21 aa, Mycobacterium
TMTTIFADALHLPVDYFTSRT

SEQ ID NO: 867433 - protein, 20 aa, Mycobacterium
TMTVPLSVPIVDSAVINFPV

SEQ ID NO: 867434 - protein, 25 aa, Mycobacterium
TMVDALPRNPALKVSLPAVAALYGA

SEQ ID NO: 867435 - protein, 30 aa, Mycobacterium; identical to SEQ ID NO: 132766

SEQ ID NO: 867436 - protein, 19 aa, Mycobacterium
TMVLLPLVAERVDLPLICA

SEQ ID NO: 867437 - protein, 24 aa, Mycobacterium
TMVLNYYAPLRLIRGLAPGMIERG

SEQ ID NO: 867438 - protein, 25 aa, Mycobacterium
TMVLNYYAPLRLIRGLAPKMLERGD

SEQ ID NO: 867439 - protein, 29 aa, Mycobacterium
TMVTLLAQKFVAPLLDRYLGRTGYDSQQT

SEQ ID NO: 867440 - protein, 30 aa, Mycobacterium
TMVTLLAQKFVAPLLDRYLGRTGYDSQQTQ

SEQ ID NO: 867441 - protein, 32 aa, Mycobacterium
TMVVDQPLIPAPLPFRFPFPSFATCIAEDEGP

SEQ ID NO: 867442 - protein, 17 aa, Mycobacterium
TMWAFLRSKANTIEGGT

SEQ ID NO: 867443 - protein, 17 aa, Mycobacterium
TMWAVRPPDLDGADCAG

SEQ ID NO: 867444 - protein, 28 aa, Mycobacterium
TMWCPSVSLSMWANAWLAGKAAPDDLLD

SEQ ID NO: 867445 - protein, 19 aa, Mycobacterium
TMWPSRHPNPHKDSWHAGR

SEQ ID NO: 867446 - protein, 18 aa, Mycobacterium
TMWVALSAPLVAGSGAPP

SEQ ID NO: 867447 - protein, 20 aa, Mycobacterium
TMYGLFHGPQLRAIDERHGG

SEQ ID NO: 867448 - protein, 18 aa, Mycobacterium
TMYGQMTAGSWIYIGTQG

SEQ ID NO: 867449 - protein, 17 aa, Mycobacterium
TMYLRKQGPGAVTAGDI

SEQ ID NO: 867450 - protein, 27 aa, Mycobacterium
TMYMISHFHYDPVWWNTQAAYTSVWTE

SEQ ID NO: 867451 - protein, 24 aa, Mycobacterium
TMYRDFALSPTLFHWESQSTTSST

SEQ ID NO: 867452 - protein, 17 aa, Mycobacterium
TMYTTSWCGYCVRLKKV

SEQ ID NO: 867453 - protein, 37 aa, Mycobacterium
TNAADALLGVINTPTQALLGRPLIGNGANGTTVNGVG

SEQ ID NO: 867454 - protein, 25 aa, Mycobacterium
TNAAFHDYLFTLTRNDRLLQAYQAL

SEQ ID NO: 867455 - protein, 25 aa, Mycobacterium
TNAAGGYELLLYESIRLFSERGYRE

SEQ ID NO: 867456 - protein, 18 aa, Mycobacterium
TNAARLGIALFGLGNARR

SEQ ID NO: 867457 - protein, 20 aa, Mycobacterium
TNADRPIAHYLRALARDLNE

SEQ ID NO: 867458 - protein, 27 aa, Mycobacterium
TNAERIARWFLPITGDLRAGGHYSLQG

SEQ ID NO: 867459 - protein, 23 aa, Mycobacterium
TNAFAKFVPLLATSLGNNVGVPL

SEQ ID NO: 867460 - protein, 17 aa, Mycobacterium
TNAICNLHLATGAICRT

SEQ ID NO: 867461 - protein, 17 aa, Mycobacterium
TNALCNLHLATGAICRP

SEQ ID NO: 867462 - protein, 20 aa, Mycobacterium
TNALFLRDALDKLGVEAQFI

SEQ ID NO: 867463 - protein, 22 aa, Mycobacterium
TNALKGYSAWVTGIRRVEAPTR

SEQ ID NO: 867464 - protein, 34 aa, Mycobacterium
TNASPIGMPLAHLGFFVLDAWLRPVPEGVTGELY

SEQ ID NO: 867465 - protein, 26 aa, Mycobacterium
TNATMPYVLALADKGWRQACRDDAAL

SEQ ID NO: 867466 - protein, 26 aa, Mycobacterium
TNATMPYVLALAERGWRAACRSDQAL

SEQ ID NO: 867467 - protein, 20 aa, Mycobacterium
TNAVLHLLAIAKEAEVELSL

SEQ ID NO: 867468 - protein, 21 aa, Mycobacterium
TNAVLLPGGFPEQFAAELSAN

SEQ ID NO: 867469 - protein, 18 aa, Mycobacterium
TNAVLRQAGTAPSGGGAG

SEQ ID NO: 867470 - protein, 26 aa, Mycobacterium
TNAVYGFTAMLINLLRDETPTHVAAA

SEQ ID NO: 867471 - protein, 23 aa, Mycobacterium
TNAWTDGYLFSLGGPIYAGTNEI

SEQ ID NO: 867472 - protein, 22 aa, Mycobacterium
TNCEQIYHRYLRPGEQVTITAE

SEQ ID NO: 867473 - protein, 20 aa, Mycobacterium
TNCEQTYHRYLRPGEQVTVV

SEQ ID NO: 867474 - protein, 24 aa, Mycobacterium
TNCGPRYTVITDLPYDRPATTMAR

SEQ ID NO: 867475 - protein, 25 aa, Mycobacterium
TNCPDILDVPLMAEVLRGLGATVEL

SEQ ID NO: 867476 - protein, 23 aa, Mycobacterium
TNCRLMASQLLYGTPTSVPIPDL

SEQ ID NO: 867477 - protein, 24 aa, Mycobacterium
TNDDPLRALWLINSEAGRTGLNAE

SEQ ID NO: 867478 - protein, 25 aa, Mycobacterium
TNDERILVFTALPPAIRPKTAAEEQ

SEQ ID NO: 867479 - protein, 17 aa, Mycobacterium
TNDFFVNLLDMGTEWKP

SEQ ID NO: 867480 - protein, 23 aa, Mycobacterium
TNDVRINLQLQLAAQWHTVDVLN

SEQ ID NO: 867481 - protein, 33 aa, Mycobacterium
TNEEEANEWPWRAAHLVVTLGSRGARYAGADGE

SEQ ID NO: 867482 - protein, 19 aa, Mycobacterium
TNEEPPFLNKLVINHALPM

SEQ ID NO: 867483 - protein, 23 aa, Mycobacterium
TNEGHAGFLGLERIREYIGQQGL

SEQ ID NO: 867484 - protein, 19 aa, Mycobacterium
TNELLALHGQNDQLRLLRP

SEQ ID NO: 867485 - protein, 23 aa, Mycobacterium
TNELLMNGGLDPFTIIHALNNNT

SEQ ID NO: 867486 - protein, 24 aa, Mycobacterium
TNELRSVQYFNRSPRAFAVAARVF

SEQ ID NO: 867487 - protein, 25 aa, Mycobacterium
TNELRSVQYFNRSPRAFAVAARVFL

SEQ ID NO: 867488 - protein, 24 aa, Mycobacterium
TNELRSVQYFNRSPRAFAVAVRVF

SEQ ID NO: 867489 - protein, 17 aa, Mycobacterium
TNEWLEGFDKQREEWEA

SEQ ID NO: 867490 - protein, 19 aa, Mycobacterium
TNFAAAPTVFRSLRASSTV

SEQ ID NO: 867491 - protein, 18 aa, Mycobacterium
TNFAGMWSPQIRTGDVVF

SEQ ID NO: 867492 - protein, 23 aa, Mycobacterium
TNFEYGLTCILDHASRLIDESNA

SEQ ID NO: 867493 - protein, 27 aa, Mycobacterium
TNFHNRAIAWLLRGSGYIYCDPMEACD

SEQ ID NO: 867494 - protein, 25 aa, Mycobacterium
TNFLGPFALTNLLYGRVRSKIVNVG

SEQ ID NO: 867495 - protein, 29 aa, Mycobacterium
TNGAAGIIPAVLYYALHYTPQGAADPDDA

SEQ ID NO: 867496 - protein, 27 aa, Mycobacterium
TNGDQFLVLRPLLVDYVMSMPRGAQVI

SEQ ID NO: 867497 - protein, 28 aa, Mycobacterium
TNGDQFLVLRPLLVDYVMSMPRGAQVVY

SEQ ID NO: 867498 - protein, 22 aa, Mycobacterium
TNGERQWELRACQGRPVCGVEI

SEQ ID NO: 867499 - protein, 33 aa, Mycobacterium
TNGGVLLITHYTRILRYIQPQFVHVFVGGRIVE

SEQ ID NO: 867500 - protein, 26 aa, Mycobacterium
TNGHLADFVFLLARTNPDKPKHKGLT

SEQ ID NO: 867501 - protein, 35 aa, Mycobacterium
TNGHVYLAENWDWLADTLPLTLMLEFEPVDGLRMV

SEQ ID NO: 867502 - protein, 25 aa, Mycobacterium
TNGLAWVMHTPPQWWVDVATDHQLQ

SEQ ID NO: 867503 - protein, 26 aa, Mycobacterium
TNGLFSTVYKEYLMKALPAMATAVSS

SEQ ID NO: 867504 - protein, 30 aa, Mycobacterium
TNGLHQGLALQIPPYKYAHPDDLLARARAE

SEQ ID NO: 867505 - protein, 30 aa, Mycobacterium
TNGLPYPASALMGNAFMRGIESPMFFTANT

SEQ ID NO: 867506 - protein, 29 aa, Mycobacterium
TNGPGHTEVLPLYARLPTAEQQKVFAPHT

SEQ ID NO: 867507 - protein, 24 aa, Mycobacterium
TNGRIGHRIPGVPPCLLLHTVGAK

SEQ ID NO: 867508 - protein, 24 aa, Mycobacterium
TNGRIGHRIPGVPPSLLLHTVGAK

SEQ ID NO: 867509 - protein, 29 aa, Mycobacterium
TNHAAGWVRMDFIVPSRGLIGFRTDFLTI

SEQ ID NO: 867510 - protein, 26 aa, Mycobacterium
TNHFGHFELTRLLVPQLAAAGAARIV

SEQ ID NO: 867511 - protein, 29 aa, Mycobacterium
TNHHIVMDGWSLPILLREILANYYGDQLP

SEQ ID NO: 867512 - protein, 32 aa, Mycobacterium
TNHHIVMDGWSLPILLREILTSYYGERLPAPA

SEQ ID NO: 867513 - protein, 29 aa, Mycobacterium
TNHLDADSIGWLRDFLRAHTGGLVIISHN

SEQ ID NO: 867514 - protein, 28 aa, Mycobacterium
TNHLDADSIGWLRDFLRAHTGGLVMISH

SEQ ID NO: 867515 - protein, 28 aa, Mycobacterium
TNHLDADSIGWLRDFLRSHTGGLVIISH

SEQ ID NO: 867516 - protein, 19 aa, Mycobacterium
TNHLDIEGITWLASHLQQR

SEQ ID NO: 867517 - protein, 32 aa, Mycobacterium
TNHTLLPEALETWPLELFAESLPRHLEIIYEI

SEQ ID NO: 867518 - protein, 24 aa, Mycobacterium
TNIDALLEAVLLTADAALDLRANP

SEQ ID NO: 867519 - protein, 17 aa, Mycobacterium
TNIPFLQAVIDDPDFRA

SEQ ID NO: 867520 - protein, 18 aa, Mycobacterium
TNIPFLQAVIDDPDFRAG

SEQ ID NO: 867521 - protein, 24 aa, Mycobacterium
TNKERPVSIFLRALARDLNASTPG

SEQ ID NO: 867522 - protein, 23 aa, Mycobacterium
TNKQRPVAQFLRALARDLNASTP

SEQ ID NO: 867523 - protein, 34 aa, Mycobacterium
TNLALALRREPALPTLLRRLVIMGGAFGPDTNPM

SEQ ID NO: 867524 - protein, 18 aa, Mycobacterium
TNLFLDMVRRRARIRMEA

SEQ ID NO: 867525 - protein, 17 aa, Mycobacterium
TNLFLDMVRRRSRIRME

SEQ ID NO: 867526 - protein, 24 aa, Mycobacterium
TNLFVPQTVIPWPGKAQGPRRAGV

SEQ ID NO: 867527 - protein, 18 aa, Mycobacterium
TNLGRLVLNEPAPLPCTP

SEQ ID NO: 867528 - protein, 21 aa, Mycobacterium
TNLHHALALATRHLRRHPNAQ

SEQ ID NO: 867529 - protein, 19 aa, Mycobacterium
TNLIYTYAELLDGGDLDGV

SEQ ID NO: 867530 - protein, 20 aa, Mycobacterium
TNLIYTYAQLLDGGDLDGVA

SEQ ID NO: 867531 - protein, 17 aa, Mycobacterium
TNLLAHAMAAGRRVLFV

SEQ ID NO: 867532 - protein, 20 aa, Mycobacterium
TNLLGPIRMTKAVVAHMLGQ

SEQ ID NO: 867533 - protein, 22 aa, Mycobacterium
TNLLNGTFDIDSDTWRVALVTS

SEQ ID NO: 867534 - protein, 22 aa, Mycobacterium
TNLQSLGATWAANPAPFLGQIV

SEQ ID NO: 867535 - protein, 25 aa, Mycobacterium
TNLRQLHAFLSDTILMTGIGFEPPA

SEQ ID NO: 867536 - protein, 24 aa, Mycobacterium
TNLTGLWNTMKAVVPPMIAAGNGG

SEQ ID NO: 867537 - protein, 24 aa, Mycobacterium
TNMKMFGLPYRITSTVTALEPDEV

SEQ ID NO: 867538 - protein, 19 aa, Mycobacterium
TNMLFTMRAAWAQADSDAA

SEQ ID NO: 867539 - protein, 20 aa, Mycobacterium
TNMWETHGVISALTNWAVAD

SEQ ID NO: 867540 - protein, 27 aa, Mycobacterium
TNNAIVPGWGTTWPESLGTPPGGAADE

SEQ ID NO: 867541 - protein, 21 aa, Mycobacterium
TNNGLVEIVPLGISKATGVRD

SEQ ID NO: 867542 - protein, 21 aa, Mycobacterium
TNNGLVEIVPLGTSKATGVDE

SEQ ID NO: 867543 - protein, 21 aa, Mycobacterium
TNNGTYIIGERFKDLIMDSST

SEQ ID NO: 867544 - protein, 17 aa, Mycobacterium
TNNLVRLGLVRASPEAV

SEQ ID NO: 867545 - protein, 25 aa, Mycobacterium
TNPAQWLAARGWVVEPVRNTLELEA

SEQ ID NO: 867546 - protein, 27 aa, Mycobacterium
TNPAVSAWNWLETVPGGWRRALARQAR

SEQ ID NO: 867547 - protein, 27 aa, Mycobacterium
TNPDAAWFYPRPSPLARRIKNHVAFWN

SEQ ID NO: 867548 - protein, 17 aa, Mycobacterium
TNPEQLFAIGYAACFHS

SEQ ID NO: 867549 - protein, 25 aa, Mycobacterium
TNPGLIHYHFGGLPGLHCAVARETC

SEQ ID NO: 867550 - protein, 25 aa, Mycobacterium
TNPIQRMWAGWLPSFGILEHVGRRS

SEQ ID NO: 867551 - protein, 17 aa, Mycobacterium
TNPLPAGLEDRIVAIVL

SEQ ID NO: 867552 - protein, 24 aa, Mycobacterium
TNPPFTLDEILIALARRGAPNFAA

SEQ ID NO: 867553 - protein, 18 aa, Mycobacterium
TNPPLLLATRHIIGDDGT

SEQ ID NO: 867554 - protein, 21 aa, Mycobacterium
TNPPPFAPWDTPDGTPPPGTG

SEQ ID NO: 867555 - protein, 26 aa, Mycobacterium
TNQAALRPLPPYTGPPDALGALARDL

SEQ ID NO: 867556 - protein, 26 aa, Mycobacterium
TNQPNRIFLRNWRDALQLPKEKHPDT

SEQ ID NO: 867557 - protein, 20 aa, Mycobacterium
TNRALVLAALAAREGSSRIS

SEQ ID NO: 867558 - protein, 25 aa, Mycobacterium
TNRDLLVNVLRHPAFLDGATDTAFF

SEQ ID NO: 867559 - protein, 24 aa, Mycobacterium
TNRDLLVNVLRHPAFLDGDTDTSF

SEQ ID NO: 867560 - protein, 24 aa, Mycobacterium
TNRDLLVNVLRHPAFRDGATDTAF

SEQ ID NO: 867561 - protein, 25 aa, Mycobacterium
TNREFDLLVFFLTHTDTVFSREDLL

SEQ ID NO: 867562 - protein, 25 aa, Mycobacterium
TNRGGDAPLLLLRAARRLEPIDARL

SEQ ID NO: 867563 - protein, 26 aa, Mycobacterium
TNRLFSTVYKEYLMKALPAMATAVSS

SEQ ID NO: 867564 - protein, 25 aa, Mycobacterium
TNRPAADYLRVGLRRLEYRGYDSVG

SEQ ID NO: 867565 - protein, 29 aa, Mycobacterium
TNRPELIDPALLRPGRMERLVFVEPPDAQ

SEQ ID NO: 867566 - protein, 19 aa, Mycobacterium
TNRRRPILRLVADTSPGVH

SEQ ID NO: 867567 - protein, 21 aa, Mycobacterium
TNRRWNPNIQTVHAVTSPGGN

SEQ ID NO: 867568 - protein, 25 aa, Mycobacterium
TNSDGRLLELTLHPGVMSGYAHGEL

SEQ ID NO: 867569 - protein, 23 aa, Mycobacterium
TNSGLLNFGTLLSGVKNLGIYTS

SEQ ID NO: 867570 - protein, 27 aa, Mycobacterium
TNSLAGWYAVPLQGPYSAAKAALRVLF

SEQ ID NO: 867571 - protein, 33 aa, Mycobacterium
TNSLLQMAGLTNEAPWLSNPLAALGLVGHTWNS

SEQ ID NO: 867572 - protein, 24 aa, Mycobacterium
TNSSFEPQIVKKRQRRLTGIDEIV

SEQ ID NO: 867573 - protein, 23 aa, Mycobacterium
TNSSRLIRYRLMNGQSATLNGHP

SEQ ID NO: 867574 - protein, 24 aa, Mycobacterium
TNSSRLIRYRLMNGQTTTLNGHPT

SEQ ID NO: 867575 - protein, 24 aa, Mycobacterium
TNSTMPYVLKLADKGWQAACASDS

SEQ ID NO: 867576 - protein, 28 aa, Mycobacterium
TNSVTEKWLRELLIAKDWIYSQQDSRWS

SEQ ID NO: 867577 - protein, 19 aa, Mycobacterium
TNSWILFGSPTHPKSRGRL

SEQ ID NO: 867578 - protein, 24 aa, Mycobacterium
TNSYTGIVTLFARLAREKQALEVY

SEQ ID NO: 867579 - protein, 28 aa, Mycobacterium
TNTANFELNEHFAMLATLAGLVSTDTNA

SEQ ID NO: 867580 - protein, 24 aa, Mycobacterium
TNTDTIILIRIPNNGKSATAISIP

SEQ ID NO: 867581 - protein, 22 aa, Mycobacterium
TNTGWILLPGQKRIPRLGHQWV

SEQ ID NO: 867582 - protein, 26 aa, Mycobacterium
TNTKINFGFDPYFPRIDLRHALRGAR

SEQ ID NO: 867583 - protein, 23 aa, Mycobacterium
TNTTVAVPATITPSPTSTTAGTH

SEQ ID NO: 867584 - protein, 19 aa, Mycobacterium
TNTVVWLPHFISAERRNDL

SEQ ID NO: 867585 - protein, 22 aa, Mycobacterium
TNTWAPNFAFGLIADRLAETPD

SEQ ID NO: 867586 - protein, 26 aa, Mycobacterium
TNVEFGPLFDGVDYRPFEQLHDSYAD

SEQ ID NO: 867587 - protein, 24 aa, Mycobacterium
TNVEFWAAVILDFAGVPANMMPAM

SEQ ID NO: 867588 - protein, 22 aa, Mycobacterium
TNVGAWLDLLVARLQALAQSSV

SEQ ID NO: 867589 - protein, 25 aa, Mycobacterium
TNVINYNRKGWKVWPTRAVLTAVEP

SEQ ID NO: 867590 - protein, 17 aa, Mycobacterium
TNVLSHLQSVRAALPRL

SEQ ID NO: 867591 - protein, 25 aa, Mycobacterium
TNVPELMMFPYTESLTFGATRNPWD

SEQ ID NO: 867592 - protein, 24 aa, Mycobacterium
TNVPELMMLPYTESLTFGATRNPW

SEQ ID NO: 867593 - protein, 24 aa, Mycobacterium
TNVPELMMMPYTESLTFGATRNPW

SEQ ID NO: 867594 - protein, 25 aa, Mycobacterium
TNVPELMMMPYTESLTFGATRNPWN

SEQ ID NO: 867595 - protein, 25 aa, Mycobacterium
TNVRPGALHRLGFDYAALAAHNPRL

SEQ ID NO: 867596 - protein, 24 aa, Mycobacterium
TNVSVPVLMRICDALGIGIGDLFE

SEQ ID NO: 867597 - protein, 28 aa, Mycobacterium
TNVVGTSMVWLVTPRHADGWLREPLERA

SEQ ID NO: 867598 - protein, 33 aa, Mycobacterium
TNWDVPKHEGLTMFLVPLKAPGITMRRIKEVNG

SEQ ID NO: 867599 - protein, 26 aa, Mycobacterium
TNWLTAGALLWLPRRSRPQLTAGGKG

SEQ ID NO: 867600 - protein, 20 aa, Mycobacterium
TNWSRNIPVLAERFHVLAVD

SEQ ID NO: 867601 - protein, 27 aa, Mycobacterium
TNYFAPPTVWISLLRSPVFDTVDLSSL

SEQ ID NO: 867602 - protein, 28 aa, Mycobacterium
TNYYMITHPNLPITAPLRAIPVIGDPLA

SEQ ID NO: 867603 - protein, 23 aa, Mycobacterium
TPAAFIAFDLLALGDDDYTRRPF

SEQ ID NO: 867604 - protein, 31 aa, Mycobacterium
TPAAGTFVLPAPRPIRTLLIAAGSGITPVLS

SEQ ID NO: 867605 - protein, 26 aa, Mycobacterium
TPAAHEFYIRDVLLDWGRDDPNHLEV

SEQ ID NO: 867606 - protein, 23 aa, Mycobacterium
TPAAIGAKSWPLVLATRLGISSK

SEQ ID NO: 867607 - protein, 24 aa, Mycobacterium
TPAALTQPRLWLLGSSMYSARLAA

SEQ ID NO: 867608 - protein, 27 aa, Mycobacterium
TPAATHHWPLLLDKIQQRYLEGPCLTA

SEQ ID NO: 867609 - protein, 36 aa, Mycobacterium
TPADAADALALAICHCWRAPMIAQMAKAHALAEQQR

SEQ ID NO: 867610 - protein, 24 aa, Mycobacterium
TPADAADALALAICHCWRAPMISR

SEQ ID NO: 867611 - protein, 25 aa, Mycobacterium
TPADLVGMCLFLLSDEASWITGQIF

SEQ ID NO: 867612 - protein, 21 aa, Mycobacterium
TPADLYHRPGTLTSARFIGNT

SEQ ID NO: 867613 - protein, 22 aa, Mycobacterium
TPADPVIFLKPNTAIVGPNVPI

SEQ ID NO: 867614 - protein, 22 aa, Mycobacterium
TPADWRLFSTIRLRALADSLGA

SEQ ID NO: 867615 - protein, 25 aa, Mycobacterium
TPAERLACSPWLDTEWRLVADDVRV

SEQ ID NO: 867616 - protein, 25 aa, Mycobacterium
TPAEVLVRNFWFCAVEDKSSFVQRD

SEQ ID NO: 867617 - protein, 18 aa, Mycobacterium
TPAGLIDLGAFLALTSRP

SEQ ID NO: 867618 - protein, 22 aa, Mycobacterium
TPAHFIGFDALALGDTPLMKEP

SEQ ID NO: 867619 - protein, 25 aa, Mycobacterium
TPAHPMGCKRLVFSSDYLPALTRPN

SEQ ID NO: 867620 - protein, 36 aa, Mycobacterium
TPAHVQTLLLPALQPEIRLAAPLLAKGLPACPGVAS

SEQ ID NO: 867621 - protein, 27 aa, Mycobacterium
TPAHVQTLLLPALQPEVRLAAKLLARG

SEQ ID NO: 867622 - protein, 26 aa, Mycobacterium
TPAIATLVLLAEQLDWLNGNGGLDWA

SEQ ID NO: 867623 - protein, 21 aa, Mycobacterium
TPAIRLASGLAPSAGIAAAPA

SEQ ID NO: 867624 - protein, 17 aa, Mycobacterium
TPALWEAGLYCRADDRG

SEQ ID NO: 867625 - protein, 23 aa, Mycobacterium
TPAPDRVVFLFPGQGAQHVGMAK

SEQ ID NO: 867626 - protein, 29 aa, Mycobacterium
TPAPKRQYGYYVWPLLLDGQLVARVDLKA

SEQ ID NO: 867627 - protein, 31 aa, Mycobacterium
TPAQIVLAWTLSVAPNVLLIPGTSSVAHLEQ

SEQ ID NO: 867628 - protein, 21 aa, Mycobacterium
TPAQVLVRWNLQLDNVVVSRS

SEQ ID NO: 867629 - protein, 29 aa, Mycobacterium
TPARIAKYLVTHPRVLAALPILGAANRIP

SEQ ID NO: 867630 - protein, 17 aa, Mycobacterium
TPARMFGMYGRKGVIQP

SEQ ID NO: 867631 - protein, 20 aa, Mycobacterium
TPASFIAFDLLALGDDDYTT

SEQ ID NO: 867632 - protein, 21 aa, Mycobacterium
TPASFIAFDLLALGGDDYTRR

SEQ ID NO: 867633 - protein, 25 aa, Mycobacterium
TPASILVLMELIADLLPSGTVNVVN

SEQ ID NO: 867634 - protein, 25 aa, Mycobacterium
TPASLHDAYRALGAWGLPVSEHTTK

SEQ ID NO: 867635 - protein, 24 aa, Mycobacterium
TPASSYWMVEKMQEIFPPGVCNLV

SEQ ID NO: 867636 - protein, 20 aa, Mycobacterium
TPATAPAWAKPVLAANPQLA

SEQ ID NO: 867637 - protein, 23 aa, Mycobacterium
TPATLIKIIRYPGRAAGSQGVGA

SEQ ID NO: 867638 - protein, 17 aa, Mycobacterium
TPATLIKIVRYPAQAET

SEQ ID NO: 867639 - protein, 24 aa, Mycobacterium
TPATLTDLVFAWRACRAVKSNAIV

SEQ ID NO: 867640 - protein, 20 aa, Mycobacterium
TPATPIDWSQPFPPAAATSP

SEQ ID NO: 867641 - protein, 21 aa, Mycobacterium
TPAVALAALGPSLSTLGGFGT

SEQ ID NO: 867642 - protein, 27 aa, Mycobacterium
TPAVATLILLAEQIDWLLGNGGLDWAV

SEQ ID NO: 867643 - protein, 26 aa, Mycobacterium
TPAVGALLCVLAKLTGAKAVVEVGTG

SEQ ID NO: 867644 - protein, 25 aa, Mycobacterium
TPAVIDAMLLVRLPYHLSSVTQAAA

SEQ ID NO: 867645 - protein, 28 aa, Mycobacterium
TPAVLANRIRLLALIATNFFGQNTPAIA

SEQ ID NO: 867646 - protein, 22 aa, Mycobacterium
TPAWPALKRPAEGAPNVVFIVL

SEQ ID NO: 867647 - protein, 20 aa, Mycobacterium
TPAWVWNMSSIGGVAVVPLQ

SEQ ID NO: 867648 - protein, 29 aa, Mycobacterium
TPAYELHRLLLQVLQWQQPRGRWVLKTPA

SEQ ID NO: 867649 - protein, 22 aa, Mycobacterium
TPCFQGDPERWFPEGQLPDAEA

SEQ ID NO: 867650 - protein, 27 aa, Mycobacterium
TPCQTFVKWLGVPGLIKTFTAAGEPGA

SEQ ID NO: 867651 - protein, 17 aa, Mycobacterium
TPCRTFAAFLEINGLMK

SEQ ID NO: 867652 - protein, 23 aa, Mycobacterium
TPDAAMILIQHGCRRAQGFLLSR

SEQ ID NO: 867653 - protein, 27 aa, Mycobacterium
TPDAAQFDLTRLRFILNGGEAIVPRVA

SEQ ID NO: 867654 - protein, 23 aa, Mycobacterium
TPDAKGVIFIDPLSTLSGTDTSD

SEQ ID NO: 867655 - protein, 25 aa, Mycobacterium
TPDANSIAWLIWHSARCQDVQICAM

SEQ ID NO: 867656 - protein, 25 aa, Mycobacterium
TPDDDAVMVLLPDDLVLPTGVLETM

SEQ ID NO: 867657 - protein, 24 aa, Mycobacterium
TPDDLHPMQRRFAEAAAFQCGFCT

SEQ ID NO: 867658 - protein, 27 aa, Mycobacterium
TPDDLLPEWVLPPEDIPFIYPDERIDA

SEQ ID NO: 867659 - protein, 24 aa, Mycobacterium
TPDDPIQWTYDGPAIAHDVAPFLP

SEQ ID NO: 867660 - protein, 38 aa, Mycobacterium
TPDELRAFLDGKVATWWIPERWAFVPEIPRTSVGKYDK

SEQ ID NO: 867661 - protein, 18 aa, Mycobacterium
TPDFIRQVDVLGLAAKAG

SEQ ID NO: 867662 - protein, 28 aa, Mycobacterium
TPDGFIDLLKAMRPGLTTPLRMGKHLLT

SEQ ID NO: 867663 - protein, 24 aa, Mycobacterium
TPDGLELLMKLLETADVFVTNLLP

SEQ ID NO: 867664 - protein, 17 aa, Mycobacterium
TPDGVAILLTYGPDRDW

SEQ ID NO: 867665 - protein, 23 aa, Mycobacterium
TPDHLLIGVLADAAALATVLLRL

SEQ ID NO: 867666 - protein, 23 aa, Mycobacterium
TPDHLLLGLLDDPAALATVLLHL

SEQ ID NO: 867667 - protein, 25 aa, Mycobacterium
TPDHLLLGVLADPAALATALLRMQA

SEQ ID NO: 867668 - protein, 23 aa, Mycobacterium
TPDHLRIVTLPWARDLASAIERL

SEQ ID NO: 867669 - protein, 24 aa, Mycobacterium
TPDHLRIVTLPWARDLSAAIERLG

SEQ ID NO: 867670 - protein, 24 aa, Mycobacterium
TPDKPKRAAGKRTKTLQLTLTVTG

SEQ ID NO: 867671 - protein, 30 aa, Mycobacterium
TPDLPGMGSLLLPPWVLTRYDPEGVEMTGH

SEQ ID NO: 867672 - protein, 27 aa, Mycobacterium
TPDLSTLRRIPWLPGTALVIADVGWAD

SEQ ID NO: 867673 - protein, 29 aa, Mycobacterium
TPDMTLEMPLIDFFSRGGSLKSSWYGDCL

SEQ ID NO: 867674 - protein, 24 aa, Mycobacterium
TPDQLAGIRRQLGWWLRAADVSDE

SEQ ID NO: 867675 - protein, 39 aa, Mycobacterium
TPDQPWRLSNLLQPLRNILLAIMFEWGIALQGWESQQRS

SEQ ID NO: 867676 - protein, 23 aa, Mycobacterium
TPDQYRYTFGGAAPVMRIKPQTV

SEQ ID NO: 867677 - protein, 24 aa, Mycobacterium
TPDRRNLWLLAREPSIDPATQEAY

SEQ ID NO: 867678 - protein, 28 aa, Mycobacterium
TPDSVYLSPAPLYHTAPSVWSMQVQAAG

SEQ ID NO: 867679 - protein, 23 aa, Mycobacterium
TPDWLGLPEKLGNRRAWGLATQL

SEQ ID NO: 867680 - protein, 22 aa, Mycobacterium
TPDWLGLPERLGNRRAWGLAVQ

SEQ ID NO: 867681 - protein, 25 aa, Mycobacterium
TPEAHEFYIRDVLLDWSRDDPNHLE

SEQ ID NO: 867682 - protein, 25 aa, Mycobacterium
TPEANSIAWLLWHSARCQDMQLCDI

SEQ ID NO: 867683 - protein, 29 aa, Mycobacterium
TPECMHMLVNLFSPRGIPANYRTMQGFGV

SEQ ID NO: 867684 - protein, 25 aa, Mycobacterium
TPEELDRCWIWVATPRHVEKAAAAG

SEQ ID NO: 867685 - protein, 21 aa, Mycobacterium
TPEEWLPILTKRIDDNMPRVR

SEQ ID NO: 867686 - protein, 20 aa, Mycobacterium
TPEFAVLQRPYQGPPVLEEA

SEQ ID NO: 867687 - protein, 18 aa, Mycobacterium
TPEFSISGAPIATLWVSV

SEQ ID NO: 867688 - protein, 21 aa, Mycobacterium
TPEGFSWLYNFIKAQGERNYG

SEQ ID NO: 867689 - protein, 21 aa, Mycobacterium
TPEGFSWLYRFIKAQGERNYG

SEQ ID NO: 867690 - protein, 32 aa, Mycobacterium
TPEGFYGQLLSTLRPYRPTLPMGAPHEVWWGR

SEQ ID NO: 867691 - protein, 29 aa, Mycobacterium
TPEGLKGLYEFFTPLLRNLGHSARVAVVG

SEQ ID NO: 867692 - protein, 17 aa, Mycobacterium
TPEGPWLRTGDLGFISE

SEQ ID NO: 867693 - protein, 18 aa, Mycobacterium
TPEHPFPVWTEQGGPATI

SEQ ID NO: 867694 - protein, 19 aa, Mycobacterium
TPEHPFPVWTERGGPATIV

SEQ ID NO: 867695 - protein, 20 aa, Mycobacterium
TPEHPFPVWTERGGPATIVP

SEQ ID NO: 867696 - protein, 23 aa, Mycobacterium
TPEHPFPVWTERGGPATIVPMFL

SEQ ID NO: 867697 - protein, 19 aa, Mycobacterium
TPEHRWAWQTRSWSHGQRE

SEQ ID NO: 867698 - protein, 25 aa, Mycobacterium
TPEKIEALLRVLEPYGVREIVQSGV

SEQ ID NO: 867699 - protein, 27 aa, Mycobacterium
TPEKLEALLRVLEPYGIREIAQSGVVS

SEQ ID NO: 867700 - protein, 18 aa, Mycobacterium
TPEKSLVRPLHGKGGRNA

SEQ ID NO: 867701 - protein, 20 aa, Mycobacterium
TPELFFAVGQGYRNFAQISD

SEQ ID NO: 867702 - protein, 17 aa, Mycobacterium
TPELLIEALIDTVRHRD

SEQ ID NO: 867703 - protein, 18 aa, Mycobacterium
TPELLQRSKARAAAQGLT

SEQ ID NO: 867704 - protein, 17 aa, Mycobacterium
TPELLQRSRARATAQGL

SEQ ID NO: 867705 - protein, 26 aa, Mycobacterium
TPELMPLPIALAHRLSRRLTEVRKDG

SEQ ID NO: 867706 - protein, 26 aa, Mycobacterium
TPELMPLPIALAHRLSRRLTEVRKNG

SEQ ID NO: 867707 - protein, 17 aa, Mycobacterium
TPELPLVTAVGAAAAEV

SEQ ID NO: 867708 - protein, 27 aa, Mycobacterium
TPEPLPISPVQLITPGLSIVGHPSGTA

SEQ ID NO: 867709 - protein, 23 aa, Mycobacterium
TPEPPWQDWLRLSRGDYGYEITG

SEQ ID NO: 867710 - protein, 21 aa, Mycobacterium
TPEPQLPLRPDLLALFEIGEL

SEQ ID NO: 867711 - protein, 23 aa, Mycobacterium
TPEQLEIELTWIDEHIGDHPYGV

SEQ ID NO: 867712 - protein, 30 aa, Mycobacterium
TPEQVAAAWLALGPAIVVVTFGADGALAMC

SEQ ID NO: 867713 - protein, 31 aa, Mycobacterium
TPERADAYGLKPLVRLVSWGVAGVAPNVMGI

SEQ ID NO: 867714 - protein, 28 aa, Mycobacterium
TPERLRVLERLERVARRLPVAEHALINQ

SEQ ID NO: 867715 - protein, 28 aa, Mycobacterium
TPERLRVLERLEVVARRLPVAQYALLNQ

SEQ ID NO: 867716 - protein, 22 aa, Mycobacterium
TPERLSVIARHYLDVAALTDEE

SEQ ID NO: 867717 - protein, 18 aa, Mycobacterium
TPERLVAQLIPPPTFADV

SEQ ID NO: 867718 - protein, 21 aa, Mycobacterium
TPERMALLERCEIVRRQLPSI

SEQ ID NO: 867719 - protein, 26 aa, Mycobacterium
TPERMPLPIALAHRLSRRLTEVRKNG

SEQ ID NO: 867720 - protein, 33 aa, Mycobacterium
TPEVASPMLPLAPLVSFVPKPALKRLAEAAFGY

SEQ ID NO: 867721 - protein, 31 aa, Mycobacterium
TPEVLAPLRLHYLRWLLFDVGSGLHFQYQGI

SEQ ID NO: 867722 - protein, 25 aa, Mycobacterium
TPEYKQVALFSATMPAAIRKITTKY

SEQ ID NO: 867723 - protein, 24 aa, Mycobacterium
TPEYKQVALFSATMPPAIKKITAK

SEQ ID NO: 867724 - protein, 31 aa, Mycobacterium
TPEYKQVALFSATMPPAIRKITTRYLHDPLE

SEQ ID NO: 867725 - protein, 17 aa, Mycobacterium
TPFAIRAWGAVFVEVGV

SEQ ID NO: 867726 - protein, 22 aa, Mycobacterium
TPFEDGGWIWFDITTDAKSTLH

SEQ ID NO: 867727 - protein, 17 aa, Mycobacterium
TPFGFRRIFCVASKPDG

SEQ ID NO: 867728 - protein, 25 aa, Mycobacterium
TPFGGVQIVLVGDLYQLPPVVREDE

SEQ ID NO: 867729 - protein, 19 aa, Mycobacterium
TPFGVEVPQPLWPPQDTAS

SEQ ID NO: 867730 - protein, 17 aa, Mycobacterium
TPFLVRDELCHVFGLDR

SEQ ID NO: 867731 - protein, 24 aa, Mycobacterium
TPFPRRRCLPAGPARWPAASATAA

SEQ ID NO: 867732 - protein, 21 aa, Mycobacterium
TPFSEAMMPFPPADRARLYDL

SEQ ID NO: 867733 - protein, 21 aa, Mycobacterium
TPGAALLPELGPEAGDLVLTR

SEQ ID NO: 867734 - protein, 33 aa, Mycobacterium
TPGAPAPGLYRRPFEFQTLLASTQLAKCFHLPE

SEQ ID NO: 867735 - protein, 32 aa, Mycobacterium
TPGAVRRPLALSGLTLLLACAHRLLENHRVTV

SEQ ID NO: 867736 - protein, 23 aa, Mycobacterium
TPGCVAYIGISFLDQAQGKGLGE

SEQ ID NO: 867737 - protein, 26 aa, Mycobacterium
TPGDEPLWNESWYFDFVDTAAGFGGW

SEQ ID NO: 867738 - protein, 33 aa, Mycobacterium
TPGDESRWHVVRSDELWFWHAGGPLEMVVNESG

SEQ ID NO: 867739 - protein, 32 aa, Mycobacterium
TPGDITGWAAYIAGVVWALRDRGHRVEGGRMS

SEQ ID NO: 867740 - protein, 20 aa, Mycobacterium
TPGDLLFHIRAESLDVCFEL

SEQ ID NO: 867741 - protein, 38 aa, Mycobacterium
TPGDSPPHFAPLPDTGPYQLPERAQLATPSDGAFFWSG

SEQ ID NO: 867742 - protein, 24 aa, Mycobacterium
TPGFERTFVSRSLDFWNRQRYELR

SEQ ID NO: 867743 - protein, 20 aa, Mycobacterium
TPGFERTLLGRALDFWNEEV

SEQ ID NO: 867744 - protein, 30 aa, Mycobacterium
TPGGYGAALLLDAWALLGRQDLRAAEDTLR

SEQ ID NO: 867745 - protein, 24 aa, Mycobacterium
TPGHQSLLVHLRGAGTLLLSGDVA

SEQ ID NO: 867746 - protein, 25 aa, Mycobacterium
TPGINPHFGLPLRGTVHDPTARRMG

SEQ ID NO: 867747 - protein, 24 aa, Mycobacterium
TPGLAGLVLGEFRRIEQSSPAGAD

SEQ ID NO: 867748 - protein, 19 aa, Mycobacterium
TPGLDLRAGIACQLKDLGV

SEQ ID NO: 867749 - protein, 19 aa, Mycobacterium
TPGLLMAMGPGFCSELVLL

SEQ ID NO: 867750 - protein, 18 aa, Mycobacterium
TPGLPISRWCRWEATART

SEQ ID NO: 867751 - protein, 27 aa, Mycobacterium
TPGNTPLDYLSWLLGSTGNNTNPAMLG

SEQ ID NO: 867752 - protein, 25 aa, Mycobacterium
TPGQLRYGYRRLFPDVYVPKAQPQS

SEQ ID NO: 867753 - protein, 23 aa, Mycobacterium
TPGQWYLHLFAPEQPDVNWDNPE

SEQ ID NO: 867754 - protein, 32 aa, Mycobacterium
TPGRAQFHYLESWLLPSLGLRATVFHFNPGHD

SEQ ID NO: 867755 - protein, 19 aa, Mycobacterium
TPGRPLIEVLRDLASRIFT

SEQ ID NO: 867756 - protein, 33 aa, Mycobacterium
TPGRVQFHYLESWLLPSFGLRATVFHFNPGHER

SEQ ID NO: 867757 - protein, 30 aa, Mycobacterium
TPGTPWGPPWSTMWLHVTGTVPPSWRGRDE

SEQ ID NO: 867758 - protein, 26 aa, Mycobacterium
TPGTTIPKQTFLNGGYIGPITIPSIT

SEQ ID NO: 867759 - protein, 22 aa, Mycobacterium
TPGVFRWRVVVPPRGTWQAEVV

SEQ ID NO: 867760 - protein, 43 aa, Mycobacterium
TPGVHRLLMNVDTFAVLKWIDEPYPDLAWRYNPDRPETIHPDD

SEQ ID NO: 867761 - protein, 24 aa, Mycobacterium
TPGYLDGRVFVQYANIPALVYGPI

SEQ ID NO: 867762 - protein, 34 aa, Mycobacterium
TPHDLAVIMRAALKYPLIAQIMRSPTAPFPGKTL

SEQ ID NO: 867763 - protein, 17 aa, Mycobacterium
TPHLLVMTATPIPRTVA

SEQ ID NO: 867764 - protein, 24 aa, Mycobacterium
TPHLVPVVFAVDRDVIFTAVDAKP

SEQ ID NO: 867765 - protein, 17 aa, Mycobacterium
TPHMLDLLDKQARPENI

SEQ ID NO: 867766 - protein, 24 aa, Mycobacterium
TPHPLQWDCFFFGIVQSDGHFTFY

SEQ ID NO: 867767 - protein, 17 aa, Mycobacterium
TPHPSAPDWHRKEWEPF

SEQ ID NO: 867768 - protein, 18 aa, Mycobacterium
TPHRTYGRFSPWGRLARY

SEQ ID NO: 867769 - protein, 26 aa, Mycobacterium
TPHVLGCIYSVFTEGYWSTAGPSAIR

SEQ ID NO: 867770 - protein, 18 aa, Mycobacterium
TPHVLSCIYSVFTEGYWS

SEQ ID NO: 867771 - protein, 30 aa, Mycobacterium
TPHVPIPYCYAVDLRFLLSPPVGATESTNP

SEQ ID NO: 867772 - protein, 17 aa, Mycobacterium
TPHVTWYTADTMRRYLS

SEQ ID NO: 867773 - protein, 18 aa, Mycobacterium
TPIDLRGKRILLTGASSG

SEQ ID NO: 867774 - protein, 21 aa, Mycobacterium
TPIELLELPAGISSTLQLWRP

SEQ ID NO: 867775 - protein, 21 aa, Mycobacterium
TPIERKPPWIRVRAKMGPEYT

SEQ ID NO: 867776 - protein, 21 aa, Mycobacterium
TPIFGLNAMIAAHLGRWGPSV

SEQ ID NO: 867777 - protein, 17 aa, Mycobacterium
TPIILSDGAHHTNATYY

SEQ ID NO: 867778 - protein, 31 aa, Mycobacterium; identical to SEQ ID NO: 147021

SEQ ID NO: 867779 - protein, 20 aa, Mycobacterium
TPILPMLDLAQRLGVDWSMI

SEQ ID NO: 867780 - protein, 17 aa, Mycobacterium
TPIPEMGAYATSKAAVF

SEQ ID NO: 867781 - protein, 21 aa, Mycobacterium
TPIPIYVAAMGPKALRITGEY

SEQ ID NO: 867782 - protein, 24 aa, Mycobacterium
TPIRSILSFELFIDGGSMAALNFY

SEQ ID NO: 867783 - protein, 24 aa, Mycobacterium
TPISSKMIDALRPMMRLVVTNGTA

SEQ ID NO: 867784 - protein, 31 aa, Mycobacterium
TPITFDPSIWEIFWPLIVGARLVIAEPEAHK

SEQ ID NO: 867785 - protein, 17 aa, Mycobacterium
TPIVDTWWQTETGAIMI

SEQ ID NO: 867786 - protein, 20 aa, Mycobacterium
TPIWGGWITGPTVLGPDEFA

SEQ ID NO: 867787 - protein, 22 aa, Mycobacterium
TPKAVVRLLRRLGCEVEFPAEQ

SEQ ID NO: 867788 - protein, 22 aa, Mycobacterium
TPKGCVFEYVYLARPDSTIVGR

SEQ ID NO: 867789 - protein, 17 aa, Mycobacterium
TPKLGLVGVFKGPLHDG

SEQ ID NO: 867790 - protein, 26 aa, Mycobacterium
TPKMSTYLVALIAGPYARWNDEYSDE

SEQ ID NO: 867791 - protein, 17 aa, Mycobacterium
TPKPRGRRKTRIGYVVS

SEQ ID NO: 867792 - protein, 30 aa, Mycobacterium
TPKQMIGSFRYLFPRLRPGGVYIVEDVCAN

SEQ ID NO: 867793 - protein, 29 aa, Mycobacterium
TPKREDRFSFGLWTIGWNGNDPFGVATRP

SEQ ID NO: 867794 - protein, 17 aa, Mycobacterium
TPKRNYGRLTPWGRLAA

SEQ ID NO: 867795 - protein, 18 aa, Mycobacterium
TPKVFHYVKKDKIVESAV

SEQ ID NO: 867796 - protein, 19 aa, Mycobacterium
TPLAITRFVLNATAATPGQ

SEQ ID NO: 867797 - protein, 28 aa, Mycobacterium
TPLAVDPAHPFPFVSGLSLNLAVTVRQP

SEQ ID NO: 867798 - protein, 18 aa, Mycobacterium
TPLDPFGYTEMRRLERRL

SEQ ID NO: 867799 - protein, 21 aa, Mycobacterium
TPLEPYLEVLKDFDTLLVMSV

SEQ ID NO: 867800 - protein, 20 aa, Mycobacterium
TPLEYLYDVFATYVEDRRAE

SEQ ID NO: 867801 - protein, 21 aa, Mycobacterium
TPLGAREFQRFLLDKQREITT

SEQ ID NO: 867802 - protein, 19 aa, Mycobacterium
TPLGVQFVGRHFAEQFLVQ

SEQ ID NO: 867803 - protein, 17 aa, Mycobacterium
TPLITLALGELIAEHTD

SEQ ID NO: 867804 - protein, 33 aa, Mycobacterium
TPLKRWQLCLDVNLTGVFLVTKAVIPHVRARGG

SEQ ID NO: 867805 - protein, 24 aa, Mycobacterium
TPLKRWQLCLDVNTTGVFLVTKAV

SEQ ID NO: 867806 - protein, 22 aa, Mycobacterium
TPLLDFIAPKVAGLSFSGLLGA

SEQ ID NO: 867807 - protein, 19 aa, Mycobacterium
TPLLLDEYSRNPATGSFIL

SEQ ID NO: 867808 - protein, 21 aa, Mycobacterium
TPLLREGATLVSLAKGIELGT

SEQ ID NO: 867809 - protein, 22 aa, Mycobacterium
TPLLVACDLQRPAAVNQLQVVG

SEQ ID NO: 867810 - protein, 18 aa, Mycobacterium
TPLLVLTVGKTDDVTIDA

SEQ ID NO: 867811 - protein, 18 aa, Mycobacterium
TPLMGDVRFLLNTNTGQL

SEQ ID NO: 867812 - protein, 19 aa, Mycobacterium
TPLPVIGVPVPLARLDGLD

SEQ ID NO: 867813 - protein, 32 aa, Mycobacterium
TPLSALLLAEVFHEAGLPAGWLNVVCGSGAEV

SEQ ID NO: 867814 - protein, 26 aa, Mycobacterium
TPLSGGLDLFSIKALGGATPVGPWIT

SEQ ID NO: 867815 - protein, 18 aa, Mycobacterium
TPLTLLLGPVEDALADAG

SEQ ID NO: 867816 - protein, 25 aa, Mycobacterium
TPLTYDFWGFPERFYDVTYAAPGAG

SEQ ID NO: 867817 - protein, 20 aa, Mycobacterium
TPLVRDLGVAYAGRCAGRAP

SEQ ID NO: 867818 - protein, 18 aa, Mycobacterium
TPLYDDCAFLADWPGVPV

SEQ ID NO: 867819 - protein, 19 aa, Mycobacterium
TPLYDDCAFLPEWPGVPVG

SEQ ID NO: 867820 - protein, 25 aa, Mycobacterium
TPMADWVPEDIFQSALGRIAQPHEV

SEQ ID NO: 867821 - protein, 22 aa, Mycobacterium
TPMAPPMPNFGGGPLPGLGTMP

SEQ ID NO: 867822 - protein, 17 aa, Mycobacterium
TPMARREAMRRRAARLR

SEQ ID NO: 867823 - protein, 17 aa, Mycobacterium
TPMATLLLGEIMGEVLP

SEQ ID NO: 867824 - protein, 18 aa, Mycobacterium
TPMDITPAQLKALEMAMD

SEQ ID NO: 867825 - protein, 20 aa, Mycobacterium
TPMIGILEYLAASAPEASVQ

SEQ ID NO: 867826 - protein, 28 aa, Mycobacterium
TPMINNEFIRRWLADLVAETGSGPGAGN

SEQ ID NO: 867827 - protein, 17 aa, Mycobacterium
TPMLRLLRLGAAHATEL

SEQ ID NO: 867828 - protein, 25 aa, Mycobacterium
TPMMSHLYSAKRWGADARLLYIHRA

SEQ ID NO: 867829 - protein, 20 aa, Mycobacterium
TPMPAYRFPGLVPGDRWCVT

SEQ ID NO: 867830 - protein, 20 aa, Mycobacterium
TPMPGSLIGGTGGASAGNPP

SEQ ID NO: 867831 - protein, 19 aa, Mycobacterium
TPMQWLTGVRVRHAQQLLE

SEQ ID NO: 867832 - protein, 24 aa, Mycobacterium
TPMTEWVPEDIFQTALGRIAQPVE

SEQ ID NO: 867833 - protein, 24 aa, Mycobacterium
TPMYVGSLAILRRPRAGLSYETLL

SEQ ID NO: 867834 - protein, 26 aa, Mycobacterium
TPMYVGSLMILRRPRAGLSYEALLAT

SEQ ID NO: 867835 - protein, 35 aa, Mycobacterium
TPNATSVPQLWLLGSSMYSAHLAAAKGLPYVFAHH

SEQ ID NO: 867836 - protein, 17 aa, Mycobacterium
TPNEVGGLFGLFRMGLP

SEQ ID NO: 867837 - protein, 29 aa, Mycobacterium
TPNFTGRSWPLADVRLLAPILASKVVCIG

SEQ ID NO: 867838 - protein, 29 aa, Mycobacterium
TPNFTGRSWPLADVRLLAPILASKVVCVG

SEQ ID NO: 867839 - protein, 19 aa, Mycobacterium
TPNGMLMGLGGPVMDTIGV

SEQ ID NO: 867840 - protein, 23 aa, Mycobacterium
TPNLTYACDTHWPWRHEDVVAPG

SEQ ID NO: 867841 - protein, 24 aa, Mycobacterium
TPNPLVHPWQRPAGSYTLKPRYKT

SEQ ID NO: 867842 - protein, 20 aa, Mycobacterium
TPNRHLAFGLGPHRCIGSHL

SEQ ID NO: 867843 - protein, 28 aa, Mycobacterium
TPNSAGRYRPFYLRNLLDAVQGRTLDEA

SEQ ID NO: 867844 - protein, 28 aa, Mycobacterium
TPNSAGRYRPFYLRNLLDAVQGRTLRDA

SEQ ID NO: 867845 - protein, 29 aa, Mycobacterium
TPNSAGRYRPFYLRNLLDVVQGRKLSDAV

SEQ ID NO: 867846 - protein, 32 aa, Mycobacterium
TPPAALLGLMKRLPWLSAVPAYFVGVGVLPEH

SEQ ID NO: 867847 - protein, 27 aa, Mycobacterium
TPPARLVGWTSRFLGMVLPGDEIEFRV

SEQ ID NO: 867848 - protein, 32 aa, Mycobacterium
TPPDRPTLVPAERYYSPAFAALEVKRMWPKVW

SEQ ID NO: 867849 - protein, 21 aa, Mycobacterium
TPPERVLQIAAAARDRGADRL

SEQ ID NO: 867850 - protein, 38 aa, Mycobacterium
TPPGGAPPPGIPQTPPLPGPEGPPPGAPAPFGGPNVQG

SEQ ID NO: 867851 - protein, 17 aa, Mycobacterium
TPPGLLHLAARAYTATG

SEQ ID NO: 867852 - protein, 19 aa, Mycobacterium
TPPGLPVELPGHGPEFVAL

SEQ ID NO: 867853 - protein, 22 aa, Mycobacterium
TPPGTYTFTNPLPAGLEDRIVA

SEQ ID NO: 867854 - protein, 20 aa, Mycobacterium
TPPLFFAVGQGYHNFAQTSD

SEQ ID NO: 867855 - protein, 21 aa, Mycobacterium
TPPLVFHGSRFRRLAAHPATE

SEQ ID NO: 867856 - protein, 25 aa, Mycobacterium
TPPPHPRHIAAQQLMALCLQQHRIG

SEQ ID NO: 867857 - protein, 19 aa, Mycobacterium
TPPPPTLKVAMNYIGGFRN

SEQ ID NO: 867858 - protein, 30 aa, Mycobacterium
TPPPTWEDIAWLREQWDGPFMLKGVIRVDD

SEQ ID NO: 867859 - protein, 21 aa, Mycobacterium
TPPQHLLAMKVLAARAVRDGD

SEQ ID NO: 867860 - protein, 19 aa, Mycobacterium
TPPRISFSTPYNLACDFYG

SEQ ID NO: 867861 - protein, 17 aa, Mycobacterium
TPPRPQSPSPPRPGRNL

SEQ ID NO: 867862 - protein, 24 aa, Mycobacterium
TPPSHLFPAEFAKRAKALATAEGI

SEQ ID NO: 867863 - protein, 22 aa, Mycobacterium
TPPSHLFPAEFAKRARSLGESV

SEQ ID NO: 867864 - protein, 19 aa, Mycobacterium
TPPSQFDALLLPLVDEAQA

SEQ ID NO: 867865 - protein, 17 aa, Mycobacterium
TPPTIMQPHNPPYYPRL

SEQ ID NO: 867866 - protein, 19 aa, Mycobacterium
TPPTVVMLAGLQGSGKTTL

SEQ ID NO: 867867 - protein, 22 aa, Mycobacterium
TPPVEWFSVRGWSTQGLDMFDL

SEQ ID NO: 867868 - protein, 20 aa, Mycobacterium
TPPWARMYTTGSWAGMLAAP

SEQ ID NO: 867869 - protein, 23 aa, Mycobacterium
TPQDLIASMRWAGDFLTGVMTDW

SEQ ID NO: 867870 - protein, 25 aa, Mycobacterium
TPQDVLLMIGLYELAGPQVLRRQLD

SEQ ID NO: 867871 - protein, 26 aa, Mycobacterium
TPQEYVLFLRQTPIFEQLLIDEGILL

SEQ ID NO: 867872 - protein, 18 aa, Mycobacterium
TPQGFAGDLLRRAYQHAD

SEQ ID NO: 867873 - protein, 23 aa, Mycobacterium
TPQGIANPYPLYDELRGLSPVAG

SEQ ID NO: 867874 - protein, 20 aa, Mycobacterium
TPQHWDAILGINVGGVISGS

SEQ ID NO: 867875 - protein, 31 aa, Mycobacterium
TPQIQIAPALAWLRDHFGIRSWCLVGDDYIW

SEQ ID NO: 867876 - protein, 17 aa, Mycobacterium
TPQPAGAALPAFEPLEP

SEQ ID NO: 867877 - protein, 22 aa, Mycobacterium
TPQPDDWVLVHVGFAMAKIDES

SEQ ID NO: 867878 - protein, 28 aa, Mycobacterium
TPQRAGWFRFYFTDQRWEWSDQVHRIHG

SEQ ID NO: 867879 - protein, 24 aa, Mycobacterium
TPQVNAMWFAWDGEVLRFTHTTKR

SEQ ID NO: 867880 - protein, 28 aa, Mycobacterium
TPQYDEGVNLLWMAGKRKTWTGTLPTVD

SEQ ID NO: 867881 - protein, 24 aa, Mycobacterium
TPRAGLALRRFVAQWLGPAILHPR

SEQ ID NO: 867882 - protein, 24 aa, Mycobacterium
TPRAGLLCVPTLSTHGYEVIPRSA

SEQ ID NO: 867883 - protein, 18 aa, Mycobacterium
TPRDVCYLSMPLFHSNAV

SEQ ID NO: 867884 - protein, 23 aa, Mycobacterium
TPREDYLRYFACTPRFGSHRGGF

SEQ ID NO: 867885 - protein, 35 aa, Mycobacterium
TPRFVSWMPLRWLQPLLRAVFTWGMRPGLRSLIEL

SEQ ID NO: 867886 - protein, 24 aa, Mycobacterium
TPRGIVHLLRRYDVPIAGAHVVVI

SEQ ID NO: 867887 - protein, 18 aa, Mycobacterium
TPRGQDWGLPPWRPDRLA

SEQ ID NO: 867888 - protein, 23 aa, Mycobacterium
TPRHKFLDTLWSYYVGDPPLPQI

SEQ ID NO: 867889 - protein, 18 aa, Mycobacterium
TPRHTGISILLVEPGPGL

SEQ ID NO: 867890 - protein, 21 aa, Mycobacterium
TPRLAALYKSGLLNIDDMVTR

SEQ ID NO: 867891 - protein, 23 aa, Mycobacterium
TPRLAFRLVLTPAIRRIAESESP

SEQ ID NO: 867892 - protein, 21 aa, Mycobacterium
TPRLAIPDRLLPQPTGWVPER

SEQ ID NO: 867893 - protein, 23 aa, Mycobacterium
TPRLLIEYWAHEAALMSIQDWPL

SEQ ID NO: 867894 - protein, 35 aa, Mycobacterium
TPRLWDAAIHYNLTQVFYLFQAAAKYMIGQGSGGS

SEQ ID NO: 867895 - protein, 30 aa, Mycobacterium
TPRNWSPFALARTLWHLAGILRAIGDELEK

SEQ ID NO: 867896 - protein, 19 aa, Mycobacterium
TPRPCWRWKRTVAQTVSSM

SEQ ID NO: 867897 - protein, 34 aa, Mycobacterium
TPRRGELLVFDKLTRPMVPLIVLAVPSSRGKGVL

SEQ ID NO: 867898 - protein, 29 aa, Mycobacterium
TPRRVGDLIALVRPLVGDTPLGAHFHNTR

SEQ ID NO: 867899 - protein, 34 aa, Mycobacterium
TPRRYGVRWHFRVPAWSEFVEVHWSRRGEAYVTP

SEQ ID NO: 867900 - protein, 21 aa, Mycobacterium
TPRSKLLAEVQRLQPVRLADL

SEQ ID NO: 867901 - protein, 24 aa, Mycobacterium
TPRTRMIWVETPTNPLLSIADIAA

SEQ ID NO: 867902 - protein, 20 aa, Mycobacterium
TPRVIQFSDLLKAPVVARSG

SEQ ID NO: 867903 - protein, 24 aa, Mycobacterium
TPSAVLYHFPDIQTLLIEANRAGI

SEQ ID NO: 867904 - protein, 29 aa, Mycobacterium
TPSELGNLRYLSFPSMPPLDGPAGGVDLI

SEQ ID NO: 867905 - protein, 24 aa, Mycobacterium
TPSKLRDYLAARLPEYMVPHVFMR

SEQ ID NO: 867906 - protein, 18 aa, Mycobacterium
TPSMWVQLRAAGLLDHGV

SEQ ID NO: 867907 - protein, 25 aa, Mycobacterium
TPSNFPIEVILNKLGPALAAGNTVV

SEQ ID NO: 867908 - protein, 25 aa, Mycobacterium
TPSNFPLEVILNKLGPALAAGNTVV

SEQ ID NO: 867909 - protein, 24 aa, Mycobacterium
TPSPFAASLLFGYVGAFMYEGDSP

SEQ ID NO: 867910 - protein, 23 aa, Mycobacterium
TPSPLEWGCVRFSIIQRADHFTF

SEQ ID NO: 867911 - protein, 19 aa, Mycobacterium
TPSQWGGAAAALLQRHVDL

SEQ ID NO: 867912 - protein, 18 aa, Mycobacterium
TPSRLRSIEIGEDLLRML

SEQ ID NO: 867913 - protein, 29 aa, Mycobacterium
TPSRPYSPRIAAPAWPQTSPEAWLETANG

SEQ ID NO: 867914 - protein, 21 aa, Mycobacterium
TPTAVAERAAWTYPAPTAAFV

SEQ ID NO: 867915 - protein, 25 aa, Mycobacterium
TPTDLIADLQWFYMDTALASSPTSW

SEQ ID NO: 867916 - protein, 18 aa, Mycobacterium
TPTEGRLYDIELALRLGA

SEQ ID NO: 867917 - protein, 26 aa, Mycobacterium
TPTEGWFVAPTLLTDVAPDAAILTDE

SEQ ID NO: 867918 - protein, 19 aa, Mycobacterium
TPTGGKFLVYNSALSEFAA

SEQ ID NO: 867919 - protein, 20 aa, Mycobacterium
TPTGLWCEDAWLTTAMLVER

SEQ ID NO: 867920 - protein, 19 aa, Mycobacterium
TPTIDVVFGLHASAYHVTS

SEQ ID NO: 867921 - protein, 28 aa, Mycobacterium
TPTITARLNFQLAFGTRVGQRLTDARQE

SEQ ID NO: 867922 - protein, 28 aa, Mycobacterium
TPTKWDNSFLEILYGNEWELTKSPAGAH

SEQ ID NO: 867923 - protein, 28 aa, Mycobacterium
TPTKWDNSFLEILYGNEWELTKSPAGAN

SEQ ID NO: 867924 - protein, 30 aa, Mycobacterium
TPTKWDNSFLEILYGYEWELTKSPAGAWQF

SEQ ID NO: 867925 - protein, 28 aa, Mycobacterium
TPTKWDNTFLETLYGYEWELTKSPGDAW

SEQ ID NO: 867926 - protein, 28 aa, Mycobacterium
TPTLTGVRPLINVTYPPPTVQLTLTGGT

SEQ ID NO: 867927 - protein, 29 aa, Mycobacterium
TPTPLKPGGLSLLSRFLIALEQAGSQLHH

SEQ ID NO: 867928 - protein, 25 aa, Mycobacterium
TPTPVPRPAMPIPTVPMRVPETPAL

SEQ ID NO: 867929 - protein, 17 aa, Mycobacterium
TPTQLLERLGFAKGQLS

SEQ ID NO: 867930 - protein, 24 aa, Mycobacterium
TPTQVHTPLGTIPLPHVEITTPVT

SEQ ID NO: 867931 - protein, 30 aa, Mycobacterium
TPTQWGNGFLELLYGYEWELTKSPAGAWQF

SEQ ID NO: 867932 - protein, 26 aa, Mycobacterium
TPTRSVYEPAPRPLLAEAPARPAPQF

SEQ ID NO: 867933 - protein, 18 aa, Mycobacterium
TPTTRWAADLPGTQWQHR

SEQ ID NO: 867934 - protein, 17 aa, Mycobacterium
TPTVAVLMDSLGRRSGV

SEQ ID NO: 867935 - protein, 31 aa, Mycobacterium
TPTVFRPLVNVFFSVIAQDAAMGALPTLRAA

SEQ ID NO: 867936 - protein, 22 aa, Mycobacterium
TPTVYDMLGITPPATVRGVPQK

SEQ ID NO: 867937 - protein, 19 aa, Mycobacterium
TPTWLPALTVTEAVLVGRR

SEQ ID NO: 867938 - protein, 18 aa, Mycobacterium
TPTWLRLDARFGSVYRRR

SEQ ID NO: 867939 - protein, 20 aa, Mycobacterium
TPTYDGIAIRALYTALDELP

SEQ ID NO: 867940 - protein, 20 aa, Mycobacterium
TPTYDGIAVRALYTALDELP

SEQ ID NO: 867941 - protein, 26 aa, Mycobacterium
TPVAHAYLAAMPMLVITGQKAVRDNR

SEQ ID NO: 867942 - protein, 17 aa, Mycobacterium
TPVANPPPYWQAAAEQG

SEQ ID NO: 867943 - protein, 23 aa, Mycobacterium
TPVDAITWVLDPIDGTVNFVYGI

SEQ ID NO: 867944 - protein, 25 aa, Mycobacterium
TPVEFDRVLGMLDRLSLSLKGDGKG

SEQ ID NO: 867945 - protein, 24 aa, Mycobacterium
TPVEYVMVALGGCLTAGIASIAQQ

SEQ ID NO: 867946 - protein, 26 aa, Mycobacterium
TPVGDPRWRSVLPQDFSNMAAVQQGM

SEQ ID NO: 867947 - protein, 23 aa, Mycobacterium
TPVGPALVLLDAGELGRFGELRL

SEQ ID NO: 867948 - protein, 18 aa, Mycobacterium
TPVGTWLRTGDLGVMSEG

SEQ ID NO: 867949 - protein, 23 aa, Mycobacterium
TPVGWVYPSERQGAPLREAALAG

SEQ ID NO: 867950 - protein, 20 aa, Mycobacterium
TPVHVARKVALLNILAGAMR

SEQ ID NO: 867951 - protein, 22 aa, Mycobacterium
TPVISFYVSGRIRRAIGRLANG

SEQ ID NO: 867952 - protein, 18 aa, Mycobacterium
TPVISRYWDDPESWTLAT

SEQ ID NO: 867953 - protein, 21 aa, Mycobacterium
TPVLAPIVYTSAIGLGDLFAG

SEQ ID NO: 867954 - protein, 25 aa, Mycobacterium
TPVLDTVGVLPYAAIGAVHADPVDP

SEQ ID NO: 867955 - protein, 28 aa, Mycobacterium
TPVLQVREQLLILPIIGVLDSQRARQVT

SEQ ID NO: 867956 - protein, 19 aa, Mycobacterium
TPVLYRPAAIAAAATRGAW

SEQ ID NO: 867957 - protein, 17 aa, Mycobacterium
TPVMAMLRTLVAEGHPG

SEQ ID NO: 867958 - protein, 29 aa, Mycobacterium
TPVNRPFRTLYMEYLMKTLPEVARAVSSN

SEQ ID NO: 867959 - protein, 25 aa, Mycobacterium
TPVPEYRFPGLLPGDRWCVVAVNWL

SEQ ID NO: 867960 - protein, 23 aa, Mycobacterium
TPVPNPPPYWRSASEQGLHGVHL

SEQ ID NO: 867961 - protein, 27 aa, Mycobacterium
TPVPTCPEWTLRQLFRHVGRGDRWAAQ

SEQ ID NO: 867962 - protein, 18 aa, Mycobacterium
TPVRARVGHSYIKALMAE

SEQ ID NO: 867963 - protein, 24 aa, Mycobacterium
TPVRDWLYDRFAAIRYRVFGKYDS

SEQ ID NO: 867964 - protein, 34 aa, Mycobacterium
TPVREAFLRLEAEGLLRLYPQRGALVVPVSPDEV

SEQ ID NO: 867965 - protein, 19 aa, Mycobacterium
TPVRGAMGFRLLVDKRKGA

SEQ ID NO: 867966 - protein, 19 aa, Mycobacterium
TPVRGAMGFRLQIDKRKAA

SEQ ID NO: 867967 - protein, 25 aa, Mycobacterium
TPVRRMLTRWLGPTDPVLASTVFGV

SEQ ID NO: 867968 - protein, 19 aa, Mycobacterium
TPVSYAGDITPEEAWKLLS

SEQ ID NO: 867969 - protein, 24 aa, Mycobacterium
TPVTINFSIPWTVAVTLVAGRLTP

SEQ ID NO: 867970 - protein, 26 aa, Mycobacterium
TPVTLPLLRRASRLMWRRAPAPDVEV

SEQ ID NO: 867971 - protein, 19 aa, Mycobacterium
TPVTVSYTVPVAPSGLTAE

SEQ ID NO: 867972 - protein, 25 aa, Mycobacterium
TPVVAFAVRHMPAVAGIQITASHNP

SEQ ID NO: 867973 - protein, 45 aa, Mycobacterium
TPVVWRGPMLHRALQQFLADVFWGDLDVLLLDLPPGTGDVAISVA

SEQ ID NO: 867974 - protein, 30 aa, Mycobacterium
TPVVWRGPMLHRALQQFLADVYWGDLDILL

SEQ ID NO: 867975 - protein, 31 aa, Mycobacterium; identical to SEQ ID NO: 117976

SEQ ID NO: 867976 - protein, 45 aa, Mycobacterium
TPVVWRGPMLHRALQQFLADVYWGDLDVLLLDLPPGTGDIAISVA

SEQ ID NO: 867977 - protein, 17 aa, Mycobacterium
TPWLEDINWLANDVFRP

SEQ ID NO: 867978 - protein, 23 aa, Mycobacterium
TPWMKWLLRAGPADYALALSVAG

SEQ ID NO: 867979 - protein, 19 aa, Mycobacterium
TPYAPVGVVPLFETIDDLQ

SEQ ID NO: 867980 - protein, 23 aa, Mycobacterium
TPYKYLGAEIKRFGTWESIGDLG

SEQ ID NO: 867981 - protein, 25 aa, Mycobacterium
TPYQLKPHRSAVRPGFDFAGFNRLA

SEQ ID NO: 867982 - protein, 27 aa, Mycobacterium
TPYRVFTPFFRRWSELGWPSPARTGRD

SEQ ID NO: 867983 - protein, 18 aa, Mycobacterium
TPYTRFLDEVASAGYRWI

SEQ ID NO: 867984 - protein, 23 aa, Mycobacterium
TPYYPHDFFVPNSKFYAAVNALP

SEQ ID NO: 867985 - protein, 25 aa, Mycobacterium
TQAAETPWLPLARAEALDASAQWVP

SEQ ID NO: 867986 - protein, 20 aa, Mycobacterium
TQAAIWFFTNGLELDNRPRN

SEQ ID NO: 867987 - protein, 18 aa, Mycobacterium
TQAALFPVAYTIGTDFRP

SEQ ID NO: 867988 - protein, 18 aa, Mycobacterium
TQAFFRWASGRDGHNKIL

SEQ ID NO: 867989 - protein, 26 aa, Mycobacterium
TQAIPVPEPEPAPKAAPAAAASAASN

SEQ ID NO: 867990 - protein, 27 aa, Mycobacterium
TQALSGLGLIANPLSLVAVAALTLGLG

SEQ ID NO: 867991 - protein, 22 aa, Mycobacterium
TQALVLCHISHVYPTGASLYFT

SEQ ID NO: 867992 - protein, 24 aa, Mycobacterium
TQARAMLGVFGYGPLLSELEDNGG

SEQ ID NO: 867993 - protein, 23 aa, Mycobacterium
TQARLSIDLLQRHPAELSGGQRQ

SEQ ID NO: 867994 - protein, 24 aa, Mycobacterium
TQAVLALLESPLGQLLNAAAIGNL

SEQ ID NO: 867995 - protein, 19 aa, Mycobacterium
TQCHSLAFDYSVWEIWGPL

SEQ ID NO: 867996 - protein, 31 aa, Mycobacterium
TQDFVTWFLETVPIAPIWLCPLRLRDNDGWP

SEQ ID NO: 867997 - protein, 22 aa, Mycobacterium
TQDGMLLARIYSESDLLVAECL

SEQ ID NO: 867998 - protein, 20 aa, Mycobacterium
TQDGRIGGWARFARFHLGRN

SEQ ID NO: 867999 - protein, 17 aa, Mycobacterium
TQDRLMYAYISTPTDNR

SEQ ID NO: 868000 - protein, 29 aa, Mycobacterium
TQEFPVGFDVWWFRLPRPETDEMYTLFPR

SEQ ID NO: 868001 - protein, 30 aa, Mycobacterium
TQEHDLSLLLLRVQALRPAWGDPALHRRRV

SEQ ID NO: 868002 - protein, 32 aa, Mycobacterium
TQEHDLSLLLLRVQALRPAWGDPTWHRHRVLE

SEQ ID NO: 868003 - protein, 26 aa, Mycobacterium
TQEQTPARPITLPGPATGLTGDGHGK

SEQ ID NO: 868004 - protein, 18 aa, Mycobacterium
TQERLGWRPVQPGLIADL

SEQ ID NO: 868005 - protein, 27 aa, Mycobacterium
TQESTLGLIFHWADQQGLALLDLKDLR

SEQ ID NO: 868006 - protein, 24 aa, Mycobacterium
TQESTLGLIFHWADQQQLPLQDLK

SEQ ID NO: 868007 - protein, 25 aa, Mycobacterium
TQESTLGLIFHWADQRELPLLDLKD

SEQ ID NO: 868008 - protein, 25 aa, Mycobacterium
TQESTLGLIFHWAKENSRPLVTLED

SEQ ID NO: 868009 - protein, 25 aa, Mycobacterium
TQESTLGLIFHWAKESNYQLVTLAN

SEQ ID NO: 868010 - protein, 26 aa, Mycobacterium
TQETFLRAIGALPRFAGRSNARTWLF

SEQ ID NO: 868011 - protein, 19 aa, Mycobacterium
TQEYRELRWLADDLADHHV

SEQ ID NO: 868012 - protein, 23 aa, Mycobacterium
TQFTAFGAQVFVLSAQGPGSITC

SEQ ID NO: 868013 - protein, 25 aa, Mycobacterium
TQFYAMLGTRGIWHKGWFANTVHAA

SEQ ID NO: 868014 - protein, 25 aa, Mycobacterium
TQFYTMLGTRGIWHRGWFANTVHAA

SEQ ID NO: 868015 - protein, 21 aa, Mycobacterium
TQGEGPWHLLPNGPVVCSSES

SEQ ID NO: 868016 - protein, 24 aa, Mycobacterium
TQGGYTAWLIEPYADRPDSTGSSP

SEQ ID NO: 868017 - protein, 25 aa, Mycobacterium
TQGKVIPDLIAWWCARDGVRPDKSR

SEQ ID NO: 868018 - protein, 26 aa, Mycobacterium
TQGQTVPYLHYALSFRHAKITAQLRE

SEQ ID NO: 868019 - protein, 18 aa, Mycobacterium
TQGRLLVVPIGENRTIVE

SEQ ID NO: 868020 - protein, 25 aa, Mycobacterium
TQGSAGTTGAWRAGGDGGSGGDGGD

SEQ ID NO: 868021 - protein, 20 aa, Mycobacterium
TQGSFLRQLGWHAAARGWDG

SEQ ID NO: 868022 - protein, 26 aa, Mycobacterium
TQGVDHVLVIPFFDNLYAAWESQLDG

SEQ ID NO: 868023 - protein, 26 aa, Mycobacterium
TQGVEASRLFLTQMIQHHRGAITMAQ

SEQ ID NO: 868024 - protein, 29 aa, Mycobacterium
TQGVRLAEPPLLVPVLRAGLGMVDQALAL

SEQ ID NO: 868025 - protein, 26 aa, Mycobacterium
TQGVRPRVWFGERWITSIFDLFEENV

SEQ ID NO: 868026 - protein, 21 aa, Mycobacterium
TQGWFTGQIPITVPVAGLSFN

SEQ ID NO: 868027 - protein, 23 aa, Mycobacterium
TQGWMGMVGAMITWWIRHPEQSA

SEQ ID NO: 868028 - protein, 20 aa, Mycobacterium
TQHRIYALMKEFGVAAFKQY

SEQ ID NO: 868029 - protein, 30 aa, Mycobacterium
TQIAVRKEWGWAKPMWIWAGRTSRSPSSMT

SEQ ID NO: 868030 - protein, 20 aa, Mycobacterium
TQICPVCLGLPGSLPVVNEK

SEQ ID NO: 868031 - protein, 28 aa, Mycobacterium
TQIKSELRWSAPVPTFVELSQEADLVVV

SEQ ID NO: 868032 - protein, 22 aa, Mycobacterium
TQISTSLFGGFLTYLRTGDLPG

SEQ ID NO: 868033 - protein, 28 aa, Mycobacterium
TQKFDGPYFVMQWLLRQPRHAILPVAGD

SEQ ID NO: 868034 - protein, 20 aa, Mycobacterium
TQKYIWWHPIDHVSSHWAGD

SEQ ID NO: 868035 - protein, 19 aa, Mycobacterium
TQLADLLLSAFQGGMLLTQ

SEQ ID NO: 868036 - protein, 28 aa, Mycobacterium
TQLAFHPLLTRIKNLFTFQPRDLCAKGP

SEQ ID NO: 868037 - protein, 24 aa, Mycobacterium
TQLALGKWGMLSPHGKCYAFDSRA

SEQ ID NO: 868038 - protein, 24 aa, Mycobacterium
TQLEWLAEALAARPASESLFDAVL

SEQ ID NO: 868039 - protein, 24 aa, Mycobacterium
TQLEWLAEALTQRPSSESLFDAVL

SEQ ID NO: 868040 - protein, 25 aa, Mycobacterium
TQLFDGDVLFLEWAADSAASRVDDG

SEQ ID NO: 868041 - protein, 24 aa, Mycobacterium
TQLGDLHWFYVYSGVMWACVFMRT

SEQ ID NO: 868042 - protein, 21 aa, Mycobacterium
TQLGGLPFSGPIGAVRVALID

SEQ ID NO: 868043 - protein, 18 aa, Mycobacterium
TQLGPLSDESRLLLLLIA

SEQ ID NO: 868044 - protein, 17 aa, Mycobacterium
TQLIVGQLQRRLRQKRL

SEQ ID NO: 868045 - protein, 26 aa, Mycobacterium
TQLLEAQTWIRLNGPDYVRSLELVTL

SEQ ID NO: 868046 - protein, 17 aa, Mycobacterium
TQLMERIARRMRGTGRS

SEQ ID NO: 868047 - protein, 23 aa, Mycobacterium
TQLPVKPSLAHKPTPQTKPGLTA

SEQ ID NO: 868048 - protein, 21 aa, Mycobacterium
TQLSGLPFSGPIGGVRVALID

SEQ ID NO: 868049 - protein, 26 aa, Mycobacterium
TQMYFPGDPFLALDPIFQSIVEPVAR

SEQ ID NO: 868050 - protein, 24 aa, Mycobacterium
TQNDFVLLPDLNAQYSLTARAVAA

SEQ ID NO: 868051 - protein, 24 aa, Mycobacterium
TQNDFVLLPDVAARLSLTAAQVAA

SEQ ID NO: 868052 - protein, 22 aa, Mycobacterium
TQNDFVVLPDPAAELSLTGSRV

SEQ ID NO: 868053 - protein, 18 aa, Mycobacterium
TQNWVVRTLTPDAPGIAG

SEQ ID NO: 868054 - protein, 34 aa, Mycobacterium
TQPAALYVWVMLLTVRGISRIVTWLFVNAAGAET

SEQ ID NO: 868055 - protein, 17 aa, Mycobacterium
TQPDWLATATPAAMDLD

SEQ ID NO: 868056 - protein, 25 aa, Mycobacterium
TQPEGWVRLRTDPALVLPSGPSAET

SEQ ID NO: 868057 - protein, 23 aa, Mycobacterium
TQPILAAARRLVAAAAPDIATRG

SEQ ID NO: 868058 - protein, 24 aa, Mycobacterium
TQPLLDRELLGIAEAIRSSGLAAG

SEQ ID NO: 868059 - protein, 22 aa, Mycobacterium
TQPLPGLEGGLPEFGRWHTRVR

SEQ ID NO: 868060 - protein, 31 aa, Mycobacterium
TQPLVMLLHGFGSFWWSWRHQLRGLTGARVV

SEQ ID NO: 868061 - protein, 17 aa, Mycobacterium
TQPLVVAATLLAHQELT

SEQ ID NO: 868062 - protein, 21 aa, Mycobacterium
TQPRPAIATSSRYLGTALHFN

SEQ ID NO: 868063 - protein, 26 aa, Mycobacterium
TQPTAWLAEGLLPYLPSDAQDRLFDM

SEQ ID NO: 868064 - protein, 27 aa, Mycobacterium
TQPTAWLAEGLLPYLPSDAQDRLFEML

SEQ ID NO: 868065 - protein, 18 aa, Mycobacterium
TQPTGFKRTFRLERRAPA

SEQ ID NO: 868066 - protein, 22 aa, Mycobacterium
TQPTVLLWHGMQTDARAAFRPL

SEQ ID NO: 868067 - protein, 26 aa, Mycobacterium
TQPVSVAGLVAIPWAQGDRSGVAFRA

SEQ ID NO: 868068 - protein, 19 aa, Mycobacterium
TQQCYGEQMAAALALLEAE

SEQ ID NO: 868069 - protein, 24 aa, Mycobacterium
TQQKLADMTLEYGKGFLLALHLGR

SEQ ID NO: 868070 - protein, 23 aa, Mycobacterium
TQQLGRLASLLRDKRIPLEMCPS

SEQ ID NO: 868071 - protein, 22 aa, Mycobacterium
TQQRPRLVVHRSARHIHVQLVN

SEQ ID NO: 868072 - protein, 23 aa, Mycobacterium
TQQSPFYVALTDAAKAEAQAQGD

SEQ ID NO: 868073 - protein, 26 aa, Mycobacterium
TQQSVAPTALWLRGNEPDCWQRTARL

SEQ ID NO: 868074 - protein, 21 aa, Mycobacterium
TQQTYLLAFGRVKDDLRRSQT

SEQ ID NO: 868075 - protein, 28 aa, Mycobacterium
TQQVARPPLLKRIVLQTAARLSRRGRRL

SEQ ID NO: 868076 - protein, 24 aa, Mycobacterium
TQQVAVLRWLAVTINAFNRIAISS

SEQ ID NO: 868077 - protein, 23 aa, Mycobacterium
TQRAEARTWWRIGEPYEGVDVAT

SEQ ID NO: 868078 - protein, 23 aa, Mycobacterium
TQRAELVPLLDALDARMRAAKTM

SEQ ID NO: 868079 - protein, 24 aa, Mycobacterium
TQRAVAALRTAFDSPDAEVLFALT

SEQ ID NO: 868080 - protein, 23 aa, Mycobacterium
TQRAVENFPISFRGLERTQIRAL

SEQ ID NO: 868081 - protein, 18 aa, Mycobacterium
TQRFAWMRELFPFDHVVT

SEQ ID NO: 868082 - protein, 27 aa, Mycobacterium
TQRGKWAYYRLVPAALDALGGVFVVRC

SEQ ID NO: 868083 - protein, 18 aa, Mycobacterium
TQRLAAQKLIFNTLLDGI

SEQ ID NO: 868084 - protein, 22 aa, Mycobacterium
TQRMITQMYFPGDPLFAFDPIY

SEQ ID NO: 868085 - protein, 33 aa, Mycobacterium
TQRMVTQMYFPGDPLLCLDPIFQAIPDQKARSR

SEQ ID NO: 868086 - protein, 29 aa, Mycobacterium
TQRNVLGRLHFALAPQGTLFLGHAEMLLS

SEQ ID NO: 868087 - protein, 18 aa, Mycobacterium
TQRPSWPGGIAVGKTAVS

SEQ ID NO: 868088 - protein, 25 aa, Mycobacterium
TQRPVWPMIVLRTPKGWTGPKVVDG

SEQ ID NO: 868089 - protein, 20 aa, Mycobacterium
TQRQSVMLPAYTAAKSMLMS

SEQ ID NO: 868090 - protein, 20 aa, Mycobacterium
TQRQSVMLPAYTAAKSMLTS

SEQ ID NO: 868091 - protein, 24 aa, Mycobacterium
TQRRRPIVAYAISKLANILFTKEL

SEQ ID NO: 868092 - protein, 23 aa, Mycobacterium
TQRRVARRRGAQLRFEAFLVGVG

SEQ ID NO: 868093 - protein, 20 aa, Mycobacterium
TQRTARRLVAAGLPGSIVNL

SEQ ID NO: 868094 - protein, 24 aa, Mycobacterium
TQRTVRALLTGYLLHTLGGDKTYR

SEQ ID NO: 868095 - protein, 32 aa, Mycobacterium
TQRVKANLFYRGLAFHRFPVIGDTLTTRTEVV

SEQ ID NO: 868096 - protein, 28 aa, Mycobacterium
TQRVKANLFYRGLTFHRFPVIGDSLSTR

SEQ ID NO: 868097 - protein, 29 aa, Mycobacterium
TQRVKANLFYRGLTFHRFPVIGDTVYTRT

SEQ ID NO: 868098 - protein, 33 aa, Mycobacterium
TQRVKANLFYRGLTFHRYPVLGDTIYTRTEVVG

SEQ ID NO: 868099 - protein, 34 aa, Mycobacterium; identical to SEQ ID NO: 122787

SEQ ID NO: 868100 - protein, 21 aa, Mycobacterium
TQRVPFLSICLSHQVLCRQLG

SEQ ID NO: 868101 - protein, 29 aa, Mycobacterium
TQRWSDVLGLFPIDKRWYRPEYECAATAM

SEQ ID NO: 868102 - protein, 23 aa, Mycobacterium
TQSGLPYAILRLGGVISPDGSAN

SEQ ID NO: 868103 - protein, 25 aa, Mycobacterium
TQSGYDYTWFVLNAKIIEKEFALSG

SEQ ID NO: 868104 - protein, 17 aa, Mycobacterium
TQSIPWGPVVTAQADWL

SEQ ID NO: 868105 - protein, 25 aa, Mycobacterium
TQSKLDALLRMLDPYGIREIVQSGV

SEQ ID NO: 868106 - protein, 23 aa, Mycobacterium
TQSTVPFTLVRLVVGVSAKVDDR

SEQ ID NO: 868107 - protein, 26 aa, Mycobacterium
TQSVSVVGLVAIPWAQGDRSGVAFRA

SEQ ID NO: 868108 - protein, 23 aa, Mycobacterium
TQSWVRSFPNCPTAIARAGNVIG

SEQ ID NO: 868109 - protein, 19 aa, Mycobacterium
TQTFFPWDSWEHPYTAMPA

SEQ ID NO: 868110 - protein, 30 aa, Mycobacterium
TQTLEPVTDSWYLTSIQAGFEPWSGSVGAG

SEQ ID NO: 868111 - protein, 22 aa, Mycobacterium
TQTQVLAGLLALSGLAAESTVH

SEQ ID NO: 868112 - protein, 29 aa, Mycobacterium
TQTVNRLHVLLTHLMPAGAPRGLTAERAA

SEQ ID NO: 868113 - protein, 24 aa, Mycobacterium
TQVARAKFAFRCAPISGVLAVSTA

SEQ ID NO: 868114 - protein, 25 aa, Mycobacterium
TQVFQRLQIWYLRTIGHKKAATIEG

SEQ ID NO: 868115 - protein, 21 aa, Mycobacterium
TQVLAPVVFTSALGLGPLFGD

SEQ ID NO: 868116 - protein, 19 aa, Mycobacterium
TQVLPGIHPVIGVEAGGAT

SEQ ID NO: 868117 - protein, 20 aa, Mycobacterium
TQVLPVPRGVSITAAAALPE

SEQ ID NO: 868118 - protein, 25 aa, Mycobacterium
TQVPQFEVMYLLSGCAPEAVEHLRA

SEQ ID NO: 868119 - protein, 18 aa, Mycobacterium
TQVRAGVLAYLRYDELHP

SEQ ID NO: 868120 - protein, 19 aa, Mycobacterium
TQVRALLRKISGIDAVVAN

SEQ ID NO: 868121 - protein, 18 aa, Mycobacterium
TQVRLQHALMLLAENHGV

SEQ ID NO: 868122 - protein, 18 aa, Mycobacterium
TQVRLQHALVLLADRRDV

SEQ ID NO: 868123 - protein, 19 aa, Mycobacterium
TQVSLFLDYFNASPAFGFA

SEQ ID NO: 868124 - protein, 19 aa, Mycobacterium
TQVTWLTQESHDRLKAELD

SEQ ID NO: 868125 - protein, 21 aa, Mycobacterium
TQVVKIFDLVAARTGLREHEA

SEQ ID NO: 868126 - protein, 29 aa, Mycobacterium
TQVVRLRDLLKFDFYFADSAAFHQNVAEE

SEQ ID NO: 868127 - protein, 19 aa, Mycobacterium
TQYFEIFGNRAVYQDGWIA

SEQ ID NO: 868128 - protein, 19 aa, Mycobacterium
TQYFEMLGHRSIYHDGWRA

SEQ ID NO: 868129 - protein, 44 aa, Mycobacterium
TQYLPGLLLSHYLWPHHYLQLQYFERFFLPSLAKEARPRFAEVG

SEQ ID NO: 868130 - protein, 19 aa, Mycobacterium
TQYLWTTLEHPVNQWPPQE

SEQ ID NO: 868131 - protein, 27 aa, Mycobacterium
TRAADHSKLWFGIAAGLMALGSPSVKR

SEQ ID NO: 868132 - protein, 45 aa, Mycobacterium
TRAADTLLIIDLPRPPAPLHLVRLATMLPWAPLVPFVHDGVISSL

SEQ ID NO: 868133 - protein, 31 aa, Mycobacterium
TRAAGPDNLALVALFVPQLAEVEQKIIGCFR

SEQ ID NO: 868134 - protein, 22 aa, Mycobacterium
TRAAHVVLKIRSSVWLGEDGWV

SEQ ID NO: 868135 - protein, 25 aa, Mycobacterium
TRAAICRFATWWVVLERHGELVRLY

SEQ ID NO: 868136 - protein, 25 aa, Mycobacterium
TRAALADYAALLKTHGVEWVRMVAT

SEQ ID NO: 868137 - protein, 29 aa, Mycobacterium
TRAALDAATKYPWLRPPGGGKFGAYDDEV

SEQ ID NO: 868138 - protein, 25 aa, Mycobacterium
TRAAMQWYWDQYLPDPALRDHPYAA

SEQ ID NO: 868139 - protein, 20 aa, Mycobacterium
TRAASPRRYAMTPPSFFAVE

SEQ ID NO: 868140 - protein, 23 aa, Mycobacterium
TRADDLFMLIFTSGTSGEPKAVR

SEQ ID NO: 868141 - protein, 18 aa, Mycobacterium
TRADELVLLLVVHHICWD

SEQ ID NO: 868142 - protein, 25 aa, Mycobacterium
TRADGERRPGWVGLPLAGVQTRLVD

SEQ ID NO: 868143 - protein, 22 aa, Mycobacterium
TRADQFHLFACCHHIILDGTGV

SEQ ID NO: 868144 - protein, 23 aa, Mycobacterium
TRADWRTIFADNLETAFFMSRAV

SEQ ID NO: 868145 - protein, 25 aa, Mycobacterium
TRAEAWPVLCKHLAIIGADGRDPFA

SEQ ID NO: 868146 - protein, 23 aa, Mycobacterium
TRAEGVACYQLFISGLLDVTDNV

SEQ ID NO: 868147 - protein, 32 aa, Mycobacterium
TRAGGAIFRFGLPPFKWWQGLQGRKLLEEYFA

SEQ ID NO: 868148 - protein, 27 aa, Mycobacterium
TRAGIGRIRVLNRSLPRAQRLAGKVRG

SEQ ID NO: 868149 - protein, 17 aa, Mycobacterium
TRAGLKDPRRPSGSFIF

SEQ ID NO: 868150 - protein, 24 aa, Mycobacterium
TRAGRRLWVYGRAGEPCRRCGTCI

SEQ ID NO: 868151 - protein, 25 aa, Mycobacterium
TRAGVGILILTHYVPTLQPGQEDDW

SEQ ID NO: 868152 - protein, 22 aa, Mycobacterium
TRAGVLRFVVLDGLAKPGRLEG

SEQ ID NO: 868153 - protein, 22 aa, Mycobacterium
TRAGVLRFVVLDGLAKPGRMVG

SEQ ID NO: 868154 - protein, 18 aa, Mycobacterium
TRAIGVTPGSCGCANYTR

SEQ ID NO: 868155 - protein, 34 aa, Mycobacterium
TRAISVRIRFSFSSLPRVLDWREYGKYPRFEILH

SEQ ID NO: 868156 - protein, 19 aa, Mycobacterium
TRAIVRLRYRPTAVSLSIS

SEQ ID NO: 868157 - protein, 18 aa, Mycobacterium
TRALLPKLVESGDGLIVT

SEQ ID NO: 868158 - protein, 27 aa, Mycobacterium
TRALSLNTVFLSHPLPNPGPGRTAVDV

SEQ ID NO: 868159 - protein, 20 aa, Mycobacterium
TRAMYLSVDAPLRSVRYAPS

SEQ ID NO: 868160 - protein, 21 aa, Mycobacterium
TRANLSLGGPALLFENIVGHE

SEQ ID NO: 868161 - protein, 20 aa, Mycobacterium
TRAPTPTPGLPISRWCRWEA

SEQ ID NO: 868162 - protein, 31 aa, Mycobacterium
TRARNSGMPVLFWLDPYRPHENELIKKVKLY

SEQ ID NO: 868163 - protein, 30 aa, Mycobacterium
TRARNSGMPVLFWLDPYRPHENELIKKVKT

SEQ ID NO: 868164 - protein, 18 aa, Mycobacterium
TRARQGWGAWPTCSGRIG

SEQ ID NO: 868165 - protein, 19 aa, Mycobacterium
TRARSFAWAPHPVPADDPL

SEQ ID NO: 868166 - protein, 28 aa, Mycobacterium
TRAVGADVPLLGQIPLDPALVDAGDSGM

SEQ ID NO: 868167 - protein, 31 aa, Mycobacterium
TRAYLPGCHLAKDPLLRRLPAERRQALIATR

SEQ ID NO: 868168 - protein, 19 aa, Mycobacterium
TRCAGAWLWSGRRGIVAGL

SEQ ID NO: 868169 - protein, 18 aa, Mycobacterium
TRCDVRVPRYATVDLSGA

SEQ ID NO: 868170 - protein, 26 aa, Mycobacterium
TRCGDAWLLNGFKWFASNCAGEAFVV

SEQ ID NO: 868171 - protein, 18 aa, Mycobacterium
TRCGIGLLGLGSTPLRAT

SEQ ID NO: 868172 - protein, 29 aa, Mycobacterium
TRCKIVDPSWFNWPALPVAMADTIVPDFP

SEQ ID NO: 868173 - protein, 30 aa, Mycobacterium
TRCKIVDPSWFNWPALPVAMADTIVPDFPL

SEQ ID NO: 868174 - protein, 24 aa, Mycobacterium
TRDAALYRYLWRSVLEFDGATRFR

SEQ ID NO: 868175 - protein, 19 aa, Mycobacterium
TRDAFTDGWFKTGDLGALD

SEQ ID NO: 868176 - protein, 17 aa, Mycobacterium
TRDALLAALQRGINARQ

SEQ ID NO: 868177 - protein, 24 aa, Mycobacterium
TRDAQLPLRFISAAPIDAASYRDI

SEQ ID NO: 868178 - protein, 28 aa, Mycobacterium
TRDAQPRARFGLVLRYRAAPAHHRRSVK

SEQ ID NO: 868179 - protein, 25 aa, Mycobacterium
TRDAWVEFPIFDAKSRSLKKAFLGK

SEQ ID NO: 868180 - protein, 26 aa, Mycobacterium
TRDAWVEFPIFDAKSRSLKKAFLGKA

SEQ ID NO: 868181 - protein, 26 aa, Mycobacterium
TRDDLIVAALRWWMDTHRYAAVAAHS

SEQ ID NO: 868182 - protein, 31 aa, Mycobacterium
TRDDRYLCINPFFHNFGYKAGILACLQTGAT

SEQ ID NO: 868183 - protein, 32 aa, Mycobacterium
TRDDVFSEEFLLTRPLLTAIRRTEPTVLLIDE

SEQ ID NO: 868184 - protein, 39 aa, Mycobacterium
TRDEPWQPVHLLQPLRNLLLAVIFEWGIALHGIHSERDR

SEQ ID NO: 868185 - protein, 31 aa, Mycobacterium
TRDFASAYWHWFFLIQPAPLPETLIGADPRA

SEQ ID NO: 868186 - protein, 38 aa, Mycobacterium
TRDFVSTRQVMLAAAIPAAITAKLIPPGGAAAAMAIEL

SEQ ID NO: 868187 - protein, 27 aa, Mycobacterium
TRDGRWIQLVFLQPDKFWAGFCERVGL

SEQ ID NO: 868188 - protein, 31 aa, Mycobacterium
TRDGRWIQLVFLQPDKFWAGFCRRMGLAELV

SEQ ID NO: 868189 - protein, 24 aa, Mycobacterium
TRDGRWWMINVPEIDQLTQARRIN

SEQ ID NO: 868190 - protein, 33 aa, Mycobacterium
TRDKPVIFAYHGYPWLIHRLAYRRANHARIHVR

SEQ ID NO: 868191 - protein, 32 aa, Mycobacterium
TRDKPVIFAYHGYPWLIHRLAYRRANHPRIHV

SEQ ID NO: 868192 - protein, 32 aa, Mycobacterium
TRDKPVIFAYHGYPWLIHRLTYRRTNHPHIHV

SEQ ID NO: 868193 - protein, 37 aa, Mycobacterium
TRDKVLEVAAAKWWRKPLVRRWYGFAEMQKDVARKIP

SEQ ID NO: 868194 - protein, 26 aa, Mycobacterium
TRDLGVSAFVLFSSIAGTVGAPGQGN

SEQ ID NO: 868195 - protein, 17 aa, Mycobacterium
TRDLLVAVPDPVAIVEI

SEQ ID NO: 868196 - protein, 25 aa, Mycobacterium
TRDNRFFGMIGLHPKLRDGITEYLG

SEQ ID NO: 868197 - protein, 32 aa, Mycobacterium
TRDPIAEKIYLQEWHYFFQNTCRWRDLRKITI

SEQ ID NO: 868198 - protein, 32 aa, Mycobacterium
TRDQEPAILPLLRELGIGFVAYSPLGRGFLTG

SEQ ID NO: 868199 - protein, 26 aa, Mycobacterium
TRDQWWQERNLLPLLKEIDIPVYLGC

SEQ ID NO: 868200 - protein, 17 aa, Mycobacterium
TRDRLLMVTLADVASRV

SEQ ID NO: 868201 - protein, 23 aa, Mycobacterium
TRDRRSGRHLRRLTTLVGEYEAV

SEQ ID NO: 868202 - protein, 31 aa, Mycobacterium
TRDRVLDLAAARWWRKPLVHRWYGFSAMQKQ

SEQ ID NO: 868203 - protein, 35 aa, Mycobacterium
TRDRVLDLAAARWWRKPLVQRWYGFLAMQQQVARQ

SEQ ID NO: 868204 - protein, 31 aa, Mycobacterium
TRDRVLDLAAARWWRKPLVRRWYGFLDMQQE

SEQ ID NO: 868205 - protein, 24 aa, Mycobacterium
TRDSPLEVFVLRPCVVAGPNATAL

SEQ ID NO: 868206 - protein, 19 aa, Mycobacterium
TRDTLVSDLRRILSPEYAV

SEQ ID NO: 868207 - protein, 17 aa, Mycobacterium
TRDWVVTRVAVRSPRRL

SEQ ID NO: 868208 - protein, 17 aa, Mycobacterium
TREAWCRERLAFTRTRL

SEQ ID NO: 868209 - protein, 32 aa, Mycobacterium
TREDILEFLAERVVRWWLPDDVVFVDELPHTA

SEQ ID NO: 868210 - protein, 25 aa, Mycobacterium
TREEGVACYRLFIAGLLDITDNVDK

SEQ ID NO: 868211 - protein, 32 aa, Mycobacterium
TREFIRCRQIEALLCWDRYGGDLLNVVYAAWV

SEQ ID NO: 868212 - protein, 23 aa, Mycobacterium
TREHRLHEFTQPALAWRSEFGSV

SEQ ID NO: 868213 - protein, 28 aa, Mycobacterium
TREHRLHVFTSAALALRAQDRTTREWDA

SEQ ID NO: 868214 - protein, 19 aa, Mycobacterium
TREIILIHHTDCGMLTFSD

SEQ ID NO: 868215 - protein, 18 aa, Mycobacterium
TREIILIHHTDCGMLTFT

SEQ ID NO: 868216 - protein, 19 aa, Mycobacterium
TREIILIHHTDCGMLTFTD

SEQ ID NO: 868217 - protein, 18 aa, Mycobacterium
TRELLLERGFDGLSIEAV

SEQ ID NO: 868218 - protein, 18 aa, Mycobacterium
TRELLLERGFDGLTIEAV

SEQ ID NO: 868219 - protein, 30 aa, Mycobacterium
TRENLQPLIFGLWHMVARYHAARPQVVPRR

SEQ ID NO: 868220 - protein, 26 aa, Mycobacterium
TRENLQPLIFGLWQMVSEYNAARPQA

SEQ ID NO: 868221 - protein, 24 aa, Mycobacterium
TRENQLWLDLYVSTSLEFNNTKFY

SEQ ID NO: 868222 - protein, 30 aa, Mycobacterium
TREQLAEIVGAYFPLGWPIACHVQGDAGVD

SEQ ID NO: 868223 - protein, 27 aa, Mycobacterium
TREQLFYGDLYSYNRFRCSRLGSGLAE

SEQ ID NO: 868224 - protein, 28 aa, Mycobacterium
TRERLDMEILKWLLAEAYARLDDVQARI

SEQ ID NO: 868225 - protein, 23 aa, Mycobacterium
TRERRRVGTLTTVTGDTAGTALT

SEQ ID NO: 868226 - protein, 24 aa, Mycobacterium
TRERRRVRTLATVTGDTASPAGPA

SEQ ID NO: 868227 - protein, 24 aa, Mycobacterium
TRERRRVRTLATVTGNPAGTALTT

SEQ ID NO: 868228 - protein, 20 aa, Mycobacterium
TRESGAVFQQFQGGAIIAKN

SEQ ID NO: 868229 - protein, 24 aa, Mycobacterium
TRETLIADLRRILAPDYVARAREL

SEQ ID NO: 868230 - protein, 20 aa, Mycobacterium
TREVVGVLRAVLFAPEDLAL

SEQ ID NO: 868231 - protein, 29 aa, Mycobacterium
TRFAGLVDRFTLLTPYPLGDEAAAAIVAG

SEQ ID NO: 868232 - protein, 17 aa, Mycobacterium
TRFAIYLGDLGNDTAAR

SEQ ID NO: 868233 - protein, 25 aa, Mycobacterium
TRFARGWHCLGLADSFRDGAPHGIN

SEQ ID NO: 868234 - protein, 23 aa, Mycobacterium
TRFARGWHCLGLIRDFGDGTPHQ

SEQ ID NO: 868235 - protein, 20 aa, Mycobacterium
TRFDGWFVTAVLTTAIYCRP

SEQ ID NO: 868236 - protein, 18 aa, Mycobacterium
TRFFDDFFLDAARAGVRQ

SEQ ID NO: 868237 - protein, 22 aa, Mycobacterium
TRFHDQIPTVFPLMPEMAELFE

SEQ ID NO: 868238 - protein, 32 aa, Mycobacterium
TRFHNHLYDVYGLDFLYKAFTTTDIVAAIGGV

SEQ ID NO: 868239 - protein, 31 aa, Mycobacterium
TRFLDEVASAGYRWIELGPYGYLPTDPDKLA

SEQ ID NO: 868240 - protein, 17 aa, Mycobacterium
TRFPDLDENLISDLILG

SEQ ID NO: 868241 - protein, 28 aa, Mycobacterium
TRGCPLFDLAILVSYWMEPDDPAGVRAV

SEQ ID NO: 868242 - protein, 22 aa, Mycobacterium
TRGGAIFRPVFNQLSVEVGFHT

SEQ ID NO: 868243 - protein, 21 aa, Mycobacterium
TRGGYLKDIKGFDAEFFTLSK

SEQ ID NO: 868244 - protein, 34 aa, Mycobacterium
TRGHAQDGTLFEWLTTLYPLWSHLDADLEYVAAS

SEQ ID NO: 868245 - protein, 34 aa, Mycobacterium
TRGHLGGLAAAVPAAIRLLGAIGYRVVLLETVGV

SEQ ID NO: 868246 - protein, 31 aa, Mycobacterium
TRGHLGGLAAAVPAAIRLVGAIGYDVVLLET

SEQ ID NO: 868247 - protein, 27 aa, Mycobacterium
TRGHYSALNVFKLFGPGNRAPLSFPMA

SEQ ID NO: 868248 - protein, 31 aa, Mycobacterium
TRGINDRCRRLRPYAELLVDGFGIPENLRYA

SEQ ID NO: 868249 - protein, 23 aa, Mycobacterium
TRGLALAVLTADCVPVLLADART

SEQ ID NO: 868250 - protein, 26 aa, Mycobacterium
TRGLDLDWAGVFAGLNARRVELPTYG

SEQ ID NO: 868251 - protein, 17 aa, Mycobacterium
TRGLFVHSAPWAVPAMG

SEQ ID NO: 868252 - protein, 19 aa, Mycobacterium
TRGLGRFVPTPFVPTDERS

SEQ ID NO: 868253 - protein, 26 aa, Mycobacterium
TRGNLRHLATLGPLLPGIEARVVDED

SEQ ID NO: 868254 - protein, 23 aa, Mycobacterium
TRGNPLALLELPRSLAGRELAGG

SEQ ID NO: 868255 - protein, 18 aa, Mycobacterium
TRGWFMSWLASSHPELVW

SEQ ID NO: 868256 - protein, 23 aa, Mycobacterium
TRGWGVFAHGFTLGKDSPAASRI

SEQ ID NO: 868257 - protein, 18 aa, Mycobacterium
TRGWGYDGVLWYSVHEPY

SEQ ID NO: 868258 - protein, 18 aa, Mycobacterium
TRGYSVMLGYWREDEKTA

SEQ ID NO: 868259 - protein, 18 aa, Mycobacterium
TRGYSVMSGYWKAPERTA

SEQ ID NO: 868260 - protein, 30 aa, Mycobacterium
TRGYTQKGTLFQWLTEMYPVWGRLDAELEF

SEQ ID NO: 868261 - protein, 25 aa, Mycobacterium
TRHAALRALEREGRTWRIACVSDSQ

SEQ ID NO: 868262 - protein, 23 aa, Mycobacterium
TRHADRLAVVPLLAAEPVGIRAL

SEQ ID NO: 868263 - protein, 26 aa, Mycobacterium
TRHGDSWLLNGFKWFASNCAGEAFVV

SEQ ID NO: 868264 - protein, 25 aa, Mycobacterium
TRHGSTLIVADRWFPSSQLHHRCTH

SEQ ID NO: 868265 - protein, 23 aa, Mycobacterium
TRHHPHLVALSRDLYDHPEIAWE

SEQ ID NO: 868266 - protein, 18 aa, Mycobacterium
TRHLGQRLEAPPPGIHGS

SEQ ID NO: 868267 - protein, 22 aa, Mycobacterium
TRHLGQRMQAPPPGVHGAPNNP

SEQ ID NO: 868268 - protein, 23 aa, Mycobacterium
TRHLRRVWGLPGTQLGVVAWPAA

SEQ ID NO: 868269 - protein, 19 aa, Mycobacterium
TRHNLGFMVADLLAARLGA

SEQ ID NO: 868270 - protein, 21 aa, Mycobacterium
TRHNLGFMVADLLAARLGSKF

SEQ ID NO: 868271 - protein, 25 aa, Mycobacterium
TRHNLGFMVADLLAGRLGSKFKVHK

SEQ ID NO: 868272 - protein, 20 aa, Mycobacterium
TRHNVGFMVADLLAARMGSK

SEQ ID NO: 868273 - protein, 17 aa, Mycobacterium
TRHSLIDGINRGTDALI

SEQ ID NO: 868274 - protein, 19 aa, Mycobacterium
TRHTTYVVEWPGAAPDLGN

SEQ ID NO: 868275 - protein, 22 aa, Mycobacterium
TRHVLPNLRALNFVIEGILGQG

SEQ ID NO: 868276 - protein, 32 aa, Mycobacterium
TRHYAYLKRVLQALTFLRGPRTWVLKSPQHCE

SEQ ID NO: 868277 - protein, 29 aa, Mycobacterium
TRIGRIGLLVCWDIWFPETARIVAQQGAD

SEQ ID NO: 868278 - protein, 20 aa, Mycobacterium
TRIKARVPVTLAGRLQEFTV

SEQ ID NO: 868279 - protein, 45 aa, Mycobacterium
TRIKPNLDFPTGPAYYLMDFPIESFTPLFVMSRITGWTAHIMEQA

SEQ ID NO: 868280 - protein, 19 aa, Mycobacterium
TRILNLQAAPKPADAADAL

SEQ ID NO: 868281 - protein, 18 aa, Mycobacterium
TRILTRLENEGLVRVVPD

SEQ ID NO: 868282 - protein, 21 aa, Mycobacterium
TRINDRCEVEWIPPPGLDTGQ

SEQ ID NO: 868283 - protein, 23 aa, Mycobacterium
TRIPDFEVDLDGVTWADGSYVRR

SEQ ID NO: 868284 - protein, 17 aa, Mycobacterium
TRIQVWRNYAGSMGVDD

SEQ ID NO: 868285 - protein, 20 aa, Mycobacterium
TRIRFHHPLVRSAAYRAASV

SEQ ID NO: 868286 - protein, 19 aa, Mycobacterium
TRISGLDHPVLREIAPGER

SEQ ID NO: 868287 - protein, 28 aa, Mycobacterium
TRIVVLEDAWALLKFLNDDRYAIDPKAA

SEQ ID NO: 868288 - protein, 33 aa, Mycobacterium
TRIYCPDWVGLFRWLKPVLSTPLGELPVRKATA

SEQ ID NO: 868289 - protein, 25 aa, Mycobacterium
TRKAFGEELIKFQALQFRLADMATE

SEQ ID NO: 868290 - protein, 18 aa, Mycobacterium
TRKALADQGFGVLTEIDM

SEQ ID NO: 868291 - protein, 26 aa, Mycobacterium
TRKHKDACIFLNRPGFKGGPGCALHT

SEQ ID NO: 868292 - protein, 26 aa, Mycobacterium
TRKHKDACIFLNRPGFPGGVGCALHS

SEQ ID NO: 868293 - protein, 20 aa, Mycobacterium
TRKITRAVARIKAGLQPDVY

SEQ ID NO: 868294 - protein, 20 aa, Mycobacterium
TRKLARIRFFTTPQGASKAQ

SEQ ID NO: 868295 - protein, 17 aa, Mycobacterium
TRKLDFEEIQIPTPPRL

SEQ ID NO: 868296 - protein, 25 aa, Mycobacterium
TRKLDTEFFAPVLLGVPYEVSAELV

SEQ ID NO: 868297 - protein, 27 aa, Mycobacterium
TRKLGERGWIAAGWPIAEGGAGLDPFE

SEQ ID NO: 868298 - protein, 36 aa, Mycobacterium
TRKPLGVVGVITPFNFPIAIPAWKIAPALAYGNAVV

SEQ ID NO: 868299 - protein, 38 aa, Mycobacterium
TRKPLGVVGVITPFNFPIAIPAWKIAPALVYGNAVLWK

SEQ ID NO: 868300 - protein, 24 aa, Mycobacterium
TRKRFRVALDAAPARRLAAASPDD

SEQ ID NO: 868301 - protein, 17 aa, Mycobacterium
TRKTIYAHSDLLERIRA

SEQ ID NO: 868302 - protein, 19 aa, Mycobacterium
TRKVVLARLEPPGPLRFFT

SEQ ID NO: 868303 - protein, 26 aa, Mycobacterium
TRLAAPLLPLITEVIWRAVTGERSVH

SEQ ID NO: 868304 - protein, 24 aa, Mycobacterium
TRLAHIYFELSAHLGVDGLLYAVS

SEQ ID NO: 868305 - protein, 27 aa, Mycobacterium
TRLAQAPAEPMLIWAKPRRCNIHTRLI

SEQ ID NO: 868306 - protein, 26 aa, Mycobacterium
TRLDIRRWTFLNTDLAVHIHRLPDGE

SEQ ID NO: 868307 - protein, 24 aa, Mycobacterium
TRLENTVRWSWKPGDLAIWDNRAT

SEQ ID NO: 868308 - protein, 27 aa, Mycobacterium
TRLERKLFRTNILPVTFGIPFGFSVVA

SEQ ID NO: 868309 - protein, 18 aa, Mycobacterium
TRLGALLHDGKGLLLDFD

SEQ ID NO: 868310 - protein, 20 aa, Mycobacterium
TRLGAYAARVWLPMLRAEGA

SEQ ID NO: 868311 - protein, 29 aa, Mycobacterium
TRLGDPPAWFGVIKPLQIAPVAAAGGTAP

SEQ ID NO: 868312 - protein, 24 aa, Mycobacterium
TRLGEVVWLEPFPDSLMPEARYER

SEQ ID NO: 868313 - protein, 19 aa, Mycobacterium
TRLITAHTATVEWLTTVLA

SEQ ID NO: 868314 - protein, 30 aa, Mycobacterium
TRLLAYALDIFDLPFRVAAPPFVMRQLVKV

SEQ ID NO: 868315 - protein, 22 aa, Mycobacterium
TRLLNMVPYFQANPGISAAEAA

SEQ ID NO: 868316 - protein, 31 aa, Mycobacterium
TRLPPSTPAHLLWQHVLGRPIDDLPAALATA

SEQ ID NO: 868317 - protein, 17 aa, Mycobacterium
TRLQRELLAAAIRLTRP

SEQ ID NO: 868318 - protein, 23 aa, Mycobacterium
TRLRGLMSRVFTPRRMAALEDQI

SEQ ID NO: 868319 - protein, 24 aa, Mycobacterium
TRLRNAGLLRWFGDDNLGRDAAEV

SEQ ID NO: 868320 - protein, 24 aa, Mycobacterium
TRLRPDFVVPLTDAVSVAALDALA

SEQ ID NO: 868321 - protein, 18 aa, Mycobacterium
TRLRPGAAVIGWPGEPMA

SEQ ID NO: 868322 - protein, 27 aa, Mycobacterium
TRLSMRTLLLDLWREHGFGVLLVTHDV

SEQ ID NO: 868323 - protein, 18 aa, Mycobacterium
TRLSVLREKLTAAQTELT

SEQ ID NO: 868324 - protein, 22 aa, Mycobacterium
TRLSWAVLNWNADAITLYDGVG

SEQ ID NO: 868325 - protein, 19 aa, Mycobacterium
TRLTAQRRLATNTQTGLAS

SEQ ID NO: 868326 - protein, 27 aa, Mycobacterium
TRLTDRVLLAFGLHQALRLGKPLQLHV

SEQ ID NO: 868327 - protein, 33 aa, Mycobacterium
TRLTEFFGIEQPVLLAPMALVSGGRLAAAVTGA

SEQ ID NO: 868328 - protein, 21 aa, Mycobacterium
TRLTGRSPILLAGMTPTTVDA

SEQ ID NO: 868329 - protein, 25 aa, Mycobacterium
TRLYEVLRVCMYGDLLFDITGSDPP

SEQ ID NO: 868330 - protein, 17 aa, Mycobacterium
TRMFAEEPDVVAYLGRA

SEQ ID NO: 868331 - protein, 24 aa, Mycobacterium
TRMKLARNMLTFTIYAAVGEAWKL

SEQ ID NO: 868332 - protein, 23 aa, Mycobacterium
TRMKLARNMLTFVSYAAAAEAEK

SEQ ID NO: 868333 - protein, 18 aa, Mycobacterium
TRMPFLDAVNRPTIDARE

SEQ ID NO: 868334 - protein, 20 aa, Mycobacterium
TRMRVALSALTMAEFFRDEQ

SEQ ID NO: 868335 - protein, 19 aa, Mycobacterium
TRMRVALSALTMAEWFRDE

SEQ ID NO: 868336 - protein, 23 aa, Mycobacterium
TRNALLVALHQGLYSRQAPAEPV

SEQ ID NO: 868337 - protein, 34 aa, Mycobacterium
TRNAPHLVHAMPQLVPLLPSMGAPSRALVRFGFA

SEQ ID NO: 868338 - protein, 19 aa, Mycobacterium
TRNKIKAAPVLWTQQVLTT

SEQ ID NO: 868339 - protein, 19 aa, Mycobacterium
TRNLIALGTLALIAHPDQC

SEQ ID NO: 868340 - protein, 19 aa, Mycobacterium
TRNLIALGTLALIDHPDQF

SEQ ID NO: 868341 - protein, 20 aa, Mycobacterium
TRNLPLIGAPANPGIIAAPD

SEQ ID NO: 868342 - protein, 24 aa, Mycobacterium
TRNPAVGLVFFVPGLREVIRVNGD

SEQ ID NO: 868343 - protein, 23 aa, Mycobacterium
TRNPMIVSWPARITDRGGLRSQF

SEQ ID NO: 868344 - protein, 27 aa, Mycobacterium
TRNTRTWIQKYIFPGGLLPSAEAIAAI

SEQ ID NO: 868345 - protein, 18 aa, Mycobacterium
TRPAGPPAGPAGAGGSGG

SEQ ID NO: 868346 - protein, 23 aa, Mycobacterium
TRPAPVLLYDGVCGFCNGAVQTI

SEQ ID NO: 868347 - protein, 25 aa, Mycobacterium
TRPDARYDMVRPGIAVYGINPLGAA

SEQ ID NO: 868348 - protein, 20 aa, Mycobacterium
TRPDTLFGATYLVLAPEHDL

SEQ ID NO: 868349 - protein, 20 aa, Mycobacterium
TRPELLDLLAAAETLLAATG

SEQ ID NO: 868350 - protein, 21 aa, Mycobacterium
TRPFATYRIAVGKRHKIGPGA

SEQ ID NO: 868351 - protein, 24 aa, Mycobacterium
TRPFVTFLMVSRRLQPGYDYLVHR

SEQ ID NO: 868352 - protein, 17 aa, Mycobacterium
TRPIDPWAGSYYVEWLT

SEQ ID NO: 868353 - protein, 21 aa, Mycobacterium
TRPIKNFRFRLTKPVFVGDAI

SEQ ID NO: 868354 - protein, 18 aa, Mycobacterium
TRPLHEWLDALTAGIDAL

SEQ ID NO: 868355 - protein, 17 aa, Mycobacterium
TRPLSATKRWRLVEILE

SEQ ID NO: 868356 - protein, 23 aa, Mycobacterium
TRPPAILYHVSRTLAIQPVAIGS

SEQ ID NO: 868357 - protein, 21 aa, Mycobacterium
TRPPQWLVDVLAARLTDLARY

SEQ ID NO: 868358 - protein, 21 aa, Mycobacterium
TRPQLLLLDEPFSALDPATRG

SEQ ID NO: 868359 - protein, 25 aa, Mycobacterium
TRPSLAHFVRTGQEFSWRAEELFSA

SEQ ID NO: 868360 - protein, 24 aa, Mycobacterium
TRPTRRQFLTRNRLVAALGRATVV

SEQ ID NO: 868361 - protein, 17 aa, Mycobacterium
TRPVIRPIPVDESGFTV

SEQ ID NO: 868362 - protein, 27 aa, Mycobacterium
TRPVPLWQHVMVGRRLFDLFDGDEPLG

SEQ ID NO: 868363 - protein, 24 aa, Mycobacterium
TRQFRFGLQLLVDGLAAHGGGSEF

SEQ ID NO: 868364 - protein, 26 aa, Mycobacterium
TRQISPAGMALMKRLMVRPGQVVSRE

SEQ ID NO: 868365 - protein, 21 aa, Mycobacterium
TRQLQHFIAVARGDAAPLVTV

SEQ ID NO: 868366 - protein, 24 aa, Mycobacterium
TRQPPEWLSAYPRELFVYELAESA

SEQ ID NO: 868367 - protein, 19 aa, Mycobacterium
TRQRAAISALLETVDDFRS

SEQ ID NO: 868368 - protein, 19 aa, Mycobacterium
TRQRAAISTLLETLDEFRS

SEQ ID NO: 868369 - protein, 19 aa, Mycobacterium
TRQRLLDMALNHHCDPAPD

SEQ ID NO: 868370 - protein, 23 aa, Mycobacterium
TRQRRRRWRLFAAASTVVAVTAV

SEQ ID NO: 868371 - protein, 22 aa, Mycobacterium
TRQRTAYLTINYRNIVPIEKKL

SEQ ID NO: 868372 - protein, 30 aa, Mycobacterium
TRQRYVDPFRNEVQRLGRLVFGEDFEVDVD

SEQ ID NO: 868373 - protein, 23 aa, Mycobacterium
TRQTAQLLGLRPATEPLLADLDC

SEQ ID NO: 868374 - protein, 18 aa, Mycobacterium
TRQVAVVQYPTLSTSKVR

SEQ ID NO: 868375 - protein, 24 aa, Mycobacterium
TRQVELMCQMLVPAFGDHPPADIE

SEQ ID NO: 868376 - protein, 18 aa, Mycobacterium
TRRAAVDEVLLVLDATIG

SEQ ID NO: 868377 - protein, 17 aa, Mycobacterium
TRRAILALARAEYRILG

SEQ ID NO: 868378 - protein, 25 aa, Mycobacterium
TRRAVYMYGAFLPRGPLGQVGAGLG

SEQ ID NO: 868379 - protein, 19 aa, Mycobacterium
TRRDLPESLYLAAAGGRKP

SEQ ID NO: 868380 - protein, 23 aa, Mycobacterium
TRRDPWVNMLRTTVAAFAAGVGG

SEQ ID NO: 868381 - protein, 19 aa, Mycobacterium
TRREPMLTLELPGRDPIPG

SEQ ID NO: 868382 - protein, 20 aa, Mycobacterium
TRRGNWWYYARTFEGKQYGV

SEQ ID NO: 868383 - protein, 18 aa, Mycobacterium
TRRIAELYATDPEFAAAA

SEQ ID NO: 868384 - protein, 24 aa, Mycobacterium
TRRIERAMALLRRGNLSITDVCFA

SEQ ID NO: 868385 - protein, 24 aa, Mycobacterium
TRRIGRWRTAYLVLSGRSIDAATA

SEQ ID NO: 868386 - protein, 25 aa, Mycobacterium
TRRIGRWRTAYLVLSGRTIDAGTAR

SEQ ID NO: 868387 - protein, 25 aa, Mycobacterium
TRRIGRWRTAYLVLSGRTIDAGTAS

SEQ ID NO: 868388 - protein, 24 aa, Mycobacterium
TRRIGRWRTAYLVLSGRTIDPTTA

SEQ ID NO: 868389 - protein, 23 aa, Mycobacterium
TRRILLAMGMRYDMPALPGLAEL

SEQ ID NO: 868390 - protein, 17 aa, Mycobacterium
TRRLAREEGLLVGGSCG

SEQ ID NO: 868391 - protein, 20 aa, Mycobacterium
TRRLLVTDAGFFPRATRHGR

SEQ ID NO: 868392 - protein, 19 aa, Mycobacterium
TRRLVKEAGINVPRVRLAS

SEQ ID NO: 868393 - protein, 25 aa, Mycobacterium
TRRPQLEFSPAWIDRLVVATGRKFN

SEQ ID NO: 868394 - protein, 18 aa, Mycobacterium
TRRQAALVLADALARTRL

SEQ ID NO: 868395 - protein, 22 aa, Mycobacterium
TRRQWTDFFIATDIAGAPAFLG

SEQ ID NO: 868396 - protein, 26 aa, Mycobacterium
TRRRDAERFLRRKLGDLPAAPLTETS

SEQ ID NO: 868397 - protein, 17 aa, Mycobacterium
TRRRRRPGRPPAPAPDG

SEQ ID NO: 868398 - protein, 21 aa, Mycobacterium
TRRRYLSLLLDGLNPTHAQQL

SEQ ID NO: 868399 - protein, 27 aa, Mycobacterium
TRRTLLDGTLELLKVRGFAAVSLREVA

SEQ ID NO: 868400 - protein, 23 aa, Mycobacterium
TRRTVYRYFATTEDLFTAAAEVA

SEQ ID NO: 868401 - protein, 27 aa, Mycobacterium
TRRVCRSCGFYLPLAGSLGVAFGVCAN

SEQ ID NO: 868402 - protein, 26 aa, Mycobacterium
TRSADTHLLRYPLPAAWCDDVDVALY

SEQ ID NO: 868403 - protein, 23 aa, Mycobacterium
TRSAIVRLLLESGPVTAGHIGQQ

SEQ ID NO: 868404 - protein, 29 aa, Mycobacterium
TRSALRWNYRRIFPDVYLPVDVRPTLYDL

SEQ ID NO: 868405 - protein, 23 aa, Mycobacterium
TRSAPWVMAPMIATPDEAKRFAA

SEQ ID NO: 868406 - protein, 24 aa, Mycobacterium
TRSCKRWFGIGPAAYRAKTRVRAT

SEQ ID NO: 868407 - protein, 32 aa, Mycobacterium
TRSDLEVFLPPIGGQTIYIFGDPRDLADPSVE

SEQ ID NO: 868408 - protein, 29 aa, Mycobacterium
TRSFGAPMDVWWFRLPRRPDDPTGLAGIF

SEQ ID NO: 868409 - protein, 23 aa, Mycobacterium
TRSFRQSFLLSYAARIGERLTAT

SEQ ID NO: 868410 - protein, 27 aa, Mycobacterium
TRSGIRILRIGMPYPLDPQIVSRLADG

SEQ ID NO: 868411 - protein, 23 aa, Mycobacterium
TRSLAVTFRRPTPVLTELRFDIA

SEQ ID NO: 868412 - protein, 32 aa, Mycobacterium
TRSLGIRRLLDPVALPRLVRTIRQGRYDVVHA

SEQ ID NO: 868413 - protein, 27 aa, Mycobacterium
TRSLMAYLFEVDYLDHFVFVLTEGVDG

SEQ ID NO: 868414 - protein, 29 aa, Mycobacterium
TRSLPAIEHFLDLLRADPRLPHWRSVTAQ

SEQ ID NO: 868415 - protein, 22 aa, Mycobacterium
TRSLRPVAAVSPLLPEPEPELF

SEQ ID NO: 868416 - protein, 20 aa, Mycobacterium
TRSMPAIPILAGTTRDEWRI

SEQ ID NO: 868417 - protein, 25 aa, Mycobacterium
TRSPYPAGGPIPHKYYRTLDPFVAL

SEQ ID NO: 868418 - protein, 25 aa, Mycobacterium
TRSTAPPRILWLDSAAPDQLVLEVR

SEQ ID NO: 868419 - protein, 26 aa, Mycobacterium
TRSTAPPRILWVDTATAGQLIVEVRA

SEQ ID NO: 868420 - protein, 17 aa, Mycobacterium
TRSWITDVKSGLLFVWH

SEQ ID NO: 868421 - protein, 25 aa, Mycobacterium
TRTALDLGCWYPITTAVAAIDALAR

SEQ ID NO: 868422 - protein, 21 aa, Mycobacterium
TRTARLPFAVTVIDAPHSTER

SEQ ID NO: 868423 - protein, 20 aa, Mycobacterium
TRTDLPPILTFGGGAHYCLG

SEQ ID NO: 868424 - protein, 28 aa, Mycobacterium
TRTEKSLLFVIPWGSHWIVGTTDTDWSL

SEQ ID NO: 868425 - protein, 18 aa, Mycobacterium
TRTFPLRSSFAPTYNMTI

SEQ ID NO: 868426 - protein, 19 aa, Mycobacterium
TRTGDLWLFRGRSGPDRAI

SEQ ID NO: 868427 - protein, 26 aa, Mycobacterium
TRTGVFWVRDILPTGKLREILSAAMV

SEQ ID NO: 868428 - protein, 17 aa, Mycobacterium
TRTGVGMALLLDSPERW

SEQ ID NO: 868429 - protein, 19 aa, Mycobacterium
TRTHRIRRTSETPALVVIV

SEQ ID NO: 868430 - protein, 21 aa, Mycobacterium
TRTIGELISKPLLPGLTQRLT

SEQ ID NO: 868431 - protein, 18 aa, Mycobacterium
TRTIGVTPGSCGCANYTR

SEQ ID NO: 868432 - protein, 23 aa, Mycobacterium
TRTLAELLTARGWTPPSLQGRHV

SEQ ID NO: 868433 - protein, 18 aa, Mycobacterium
TRTLAQVLHRPAVLPVPA

SEQ ID NO: 868434 - protein, 18 aa, Mycobacterium
TRTLQLARDRLQAAAANA

SEQ ID NO: 868435 - protein, 29 aa, Mycobacterium
TRTPLLSVRDLRLPPKIEKVSFDLFAGEV

SEQ ID NO: 868436 - protein, 18 aa, Mycobacterium
TRTQLYPADARCLVHESM

SEQ ID NO: 868437 - protein, 20 aa, Mycobacterium
TRTRPWLEAVASSLTELFAP

SEQ ID NO: 868438 - protein, 25 aa, Mycobacterium
TRTRRKHPVRLLPVRGHPVGISPRR

SEQ ID NO: 868439 - protein, 20 aa, Mycobacterium
TRTVADAALLLGVLAGRDGL

SEQ ID NO: 868440 - protein, 23 aa, Mycobacterium
TRTWAEPEHNPFGAWYVTCDITE

SEQ ID NO: 868441 - protein, 23 aa, Mycobacterium
TRVDELLRRLSPMAQAAVLLMSL

SEQ ID NO: 868442 - protein, 25 aa, Mycobacterium
TRVDGQWRFARRRCRFITSGGLSDN

SEQ ID NO: 868443 - protein, 19 aa, Mycobacterium
TRVEGDLCLPLPKFSDIRY

SEQ ID NO: 868444 - protein, 19 aa, Mycobacterium
TRVHLDRHWRNARTLASHN

SEQ ID NO: 868445 - protein, 21 aa, Mycobacterium
TRVIGLILTDIANPFYTEIAA

SEQ ID NO: 868446 - protein, 35 aa, Mycobacterium
TRVINGKEWLLFGPFAGWSPKFLKMGKVTDLPASI

SEQ ID NO: 868447 - protein, 17 aa, Mycobacterium
TRVIPTVSPISVIEARA

SEQ ID NO: 868448 - protein, 26 aa, Mycobacterium
TRVLGEAIVRLLRYGPRLDGPHAQDV

SEQ ID NO: 868449 - protein, 23 aa, Mycobacterium
TRVQSLRLHYARTLDLWAEALEA

SEQ ID NO: 868450 - protein, 29 aa, Mycobacterium
TRVQVAPRWLFPPFVAVFSPRGVRDVLGR

SEQ ID NO: 868451 - protein, 31 aa, Mycobacterium
TRVQWGCSPLDVSLLHVLRYVQAVGGLDHML

SEQ ID NO: 868452 - protein, 21 aa, Mycobacterium
TRVRFAITVEPFAPLPEFWVS

SEQ ID NO: 868453 - protein, 34 aa, Mycobacterium
TRVRFDIAIDLSVPLPGFLLKRTMKGGVETATEG

SEQ ID NO: 868454 - protein, 32 aa, Mycobacterium
TRVRFDLTVDLLMPVPGFLIKRGSKSLMDTAT

SEQ ID NO: 868455 - protein, 23 aa, Mycobacterium
TRVRFWRLHFAAMRAVVDRARDR

SEQ ID NO: 868456 - protein, 19 aa, Mycobacterium
TRVRQQVIQLLSGYQGRET

SEQ ID NO: 868457 - protein, 26 aa, Mycobacterium
TRVRTTGLLAVAPYVARLTPELLSIE

SEQ ID NO: 868458 - protein, 23 aa, Mycobacterium
TRVSLRYRLLAGSAKPLTDVIGH

SEQ ID NO: 868459 - protein, 26 aa, Mycobacterium
TRVTDFTAFWAGPVATQLLGALGADV

SEQ ID NO: 868460 - protein, 24 aa, Mycobacterium
TRVVKVVGFVASAPGFHGQPNVIN

SEQ ID NO: 868461 - protein, 30 aa, Mycobacterium
TRVWESQLGPDLLWLSDHVIDDLCVLPGSA

SEQ ID NO: 868462 - protein, 23 aa, Mycobacterium
TRVYDVVRRLDWPAGYDARALGN

SEQ ID NO: 868463 - protein, 17 aa, Mycobacterium
TRWASHLGYVPTLTNQA

SEQ ID NO: 868464 - protein, 18 aa, Mycobacterium
TRWGAFLDDVAGFDCDFF

SEQ ID NO: 868465 - protein, 28 aa, Mycobacterium
TRWLTDPPERPFLLTAGFFETHRPYPRD

SEQ ID NO: 868466 - protein, 24 aa, Mycobacterium
TRYARGWHCLGVAKDFMDGEPHGV

SEQ ID NO: 868467 - protein, 18 aa, Mycobacterium
TRYDAVWCSGMRAKLGLP

SEQ ID NO: 868468 - protein, 35 aa, Mycobacterium
TRYDTYFEQATPAPLFLAVLVSQVQKRYLAQKFHL

SEQ ID NO: 868469 - protein, 17 aa, Mycobacterium
TRYLAQLAEPFRASGAC

SEQ ID NO: 868470 - protein, 19 aa, Mycobacterium
TRYLELLNRDSLLAPVAGV

SEQ ID NO: 868471 - protein, 23 aa, Mycobacterium
TRYPGGMALRFARVVRYRDDKAA

SEQ ID NO: 868472 - protein, 23 aa, Mycobacterium
TRYPGGVALRFARVLRYRDDKSP

SEQ ID NO: 868473 - protein, 37 aa, Mycobacterium
TRYQPLGVVLAVMPWNFPLWQAVRFAAPALMAGNVGL

SEQ ID NO: 868474 - protein, 26 aa, Mycobacterium
TRYRDLGILGLLYQLPEHARRGFVTE

SEQ ID NO: 868475 - protein, 17 aa, Mycobacterium
TRYRRFEGVGQLALEKL

SEQ ID NO: 868476 - protein, 18 aa, Mycobacterium
TSAAPAAMMLPPPGMGAP

SEQ ID NO: 868477 - protein, 22 aa, Mycobacterium
TSAAPLYFPAAYVDGHRLIDGG

SEQ ID NO: 868478 - protein, 49 aa, Mycobacterium
TSAASPATWIDWLVNWYLPISQLFYNTVGLPYFAIGIGSSLITSERALG

SEQ ID NO: 868479 - protein, 31 aa, Mycobacterium
TSADIRALYAFKRLAWWPYSVAMRQVNVIFT

SEQ ID NO: 868480 - protein, 24 aa, Mycobacterium
TSADLTAWYLDRIATLDSIDNPDG

SEQ ID NO: 868481 - protein, 22 aa, Mycobacterium
TSAEIASFFILLVVAGNETTRN

SEQ ID NO: 868482 - protein, 26 aa, Mycobacterium
TSAEIDLLPVPEFYGGAVYFAADDVA

SEQ ID NO: 868483 - protein, 18 aa, Mycobacterium
TSAEQWQWAVHATVEEFG

SEQ ID NO: 868484 - protein, 28 aa, Mycobacterium
TSAGALRGAGWTVPAPQAAPGTVIPGMP

SEQ ID NO: 868485 - protein, 24 aa, Mycobacterium
TSAGELMWYAMQLAARKAEEPGDD

SEQ ID NO: 868486 - protein, 28 aa, Mycobacterium
TSAGMFGFSPFLDITAESWSRIIDVNLT

SEQ ID NO: 868487 - protein, 19 aa, Mycobacterium
TSAIAAAAADEISAAIAEL

SEQ ID NO: 868488 - protein, 23 aa, Mycobacterium
TSAIDLALALHPTPAVGGVPTEA

SEQ ID NO: 868489 - protein, 26 aa, Mycobacterium
TSALLPGGLNWPLDLTVSDGRLYVAD

SEQ ID NO: 868490 - protein, 18 aa, Mycobacterium
TSALLRPHKPAPSAGWRK

SEQ ID NO: 868491 - protein, 22 aa, Mycobacterium
TSALLVAYLPASSRDEMFGAGR

SEQ ID NO: 868492 - protein, 20 aa, Mycobacterium
TSALRRPFAAVTAGLLTPVI

SEQ ID NO: 868493 - protein, 28 aa, Mycobacterium
TSALRRWLASHDTVPSHPLRTMMPISTR

SEQ ID NO: 868494 - protein, 17 aa, Mycobacterium
TSALVLPGGFPEEFVTE

SEQ ID NO: 868495 - protein, 24 aa, Mycobacterium
TSAMSGYTGIYRSSIQAGKDAARA

SEQ ID NO: 868496 - protein, 26 aa, Mycobacterium
TSAPDKPFFVYFAPGATHSPHHVWPE

SEQ ID NO: 868497 - protein, 26 aa, Mycobacterium
TSAPDKPFFVYLAPGATHSPHHVWPE

SEQ ID NO: 868498 - protein, 26 aa, Mycobacterium
TSAPDKPFLLYLAPGATHSPHHVWPE

SEQ ID NO: 868499 - protein, 24 aa, Mycobacterium
TSAPKGIFPWYVPGADGFLGQFPL

SEQ ID NO: 868500 - protein, 17 aa, Mycobacterium
TSAPLVVWAHGGQWVRT

SEQ ID NO: 868501 - protein, 17 aa, Mycobacterium
TSAPLWCAVDLRDGNQA

SEQ ID NO: 868502 - protein, 20 aa, Mycobacterium
TSAPNVWALGDVASWRDPMG

SEQ ID NO: 868503 - protein, 20 aa, Mycobacterium
TSAPNVWALGDVASWRDQMG

SEQ ID NO: 868504 - protein, 28 aa, Mycobacterium
TSAPVYLYRFDFATPMLRLLRLGAAHAT

SEQ ID NO: 868505 - protein, 25 aa, Mycobacterium
TSAQAGLAWMLQNPDITAPVIGART

SEQ ID NO: 868506 - protein, 27 aa, Mycobacterium
TSARLLPRFDTISYRDLWANVGAIASA

SEQ ID NO: 868507 - protein, 18 aa, Mycobacterium
TSASNLRRLLADSAIMES

SEQ ID NO: 868508 - protein, 19 aa, Mycobacterium
TSATFRYPGPLAISVAQVD

SEQ ID NO: 868509 - protein, 23 aa, Mycobacterium
TSATFSRRIARNTQLLLLEESHI

SEQ ID NO: 868510 - protein, 20 aa, Mycobacterium
TSATGLLTRALRIGLEKDDA

SEQ ID NO: 868511 - protein, 18 aa, Mycobacterium
TSAWTLIELIRHPDVYAE

SEQ ID NO: 868512 - protein, 22 aa, Mycobacterium
TSAWTLIELLRHPDAYAAVIDE

SEQ ID NO: 868513 - protein, 20 aa, Mycobacterium
TSAWTLIELLRHPDAYAEVI

SEQ ID NO: 868514 - protein, 26 aa, Mycobacterium
TSCSLSTLALLAKGFDVPVTSLFRGA

SEQ ID NO: 868515 - protein, 25 aa, Mycobacterium
TSCSLSTLALLAKGLDVPVTSLFRG

SEQ ID NO: 868516 - protein, 24 aa, Mycobacterium
TSDGDEFLFARSQLVLAAAAANCP

SEQ ID NO: 868517 - protein, 29 aa, Mycobacterium
TSDGFPADMPFLIWGYGATAAGSPGIAAG

SEQ ID NO: 868518 - protein, 17 aa, Mycobacterium
TSDGYIAALIYNDKHWN

SEQ ID NO: 868519 - protein, 36 aa, Mycobacterium
TSDGYVCILPYTDANWRGFFTLTGLTDLLTDPRFTD

SEQ ID NO: 868520 - protein, 18 aa, Mycobacterium
TSDIIRGYRMAGPSHRVM

SEQ ID NO: 868521 - protein, 28 aa, Mycobacterium
TSDIKNLLPLFAVFKPTVVVSVPRVFEK

SEQ ID NO: 868522 - protein, 24 aa, Mycobacterium
TSDKALTIGSLIREANRLAEFATT

SEQ ID NO: 868523 - protein, 23 aa, Mycobacterium
TSDLFSAFYPLSVASPALRALNL

SEQ ID NO: 868524 - protein, 27 aa, Mycobacterium
TSDLGFRMPSIWFADGHRAVAPVYLYR

SEQ ID NO: 868525 - protein, 36 aa, Mycobacterium
TSDLSNIKLLGPVGDLLPILRIPGDTAFNVANVIRT

SEQ ID NO: 868526 - protein, 25 aa, Mycobacterium
TSDLVDYWIFVIDTAAGDDIPRKKG

SEQ ID NO: 868527 - protein, 23 aa, Mycobacterium
TSDPVTYVFSLDGTVVMRGGPGE

SEQ ID NO: 868528 - protein, 25 aa, Mycobacterium
TSDQDLLLITVLKGAVLFVTDLARA

SEQ ID NO: 868529 - protein, 24 aa, Mycobacterium
TSDQEVRWCPGCGDYVILNTIRGF

SEQ ID NO: 868530 - protein, 24 aa, Mycobacterium
TSDQEVRWCPGCGDYVILNTIRNF

SEQ ID NO: 868531 - protein, 23 aa, Mycobacterium
TSDRLYPIRLQQELAELLPGCQG

SEQ ID NO: 868532 - protein, 23 aa, Mycobacterium
TSDRLYPLRLQEELADLLPGCTG

SEQ ID NO: 868533 - protein, 23 aa, Mycobacterium
TSDRRIRRFSEIPSPHDVLTEFP

SEQ ID NO: 868534 - protein, 23 aa, Mycobacterium
TSDYRLLVNPTGKFVLGGPMGDA

SEQ ID NO: 868535 - protein, 25 aa, Mycobacterium
TSEEDTWRLFWLEADTEFLPDDDSY

SEQ ID NO: 868536 - protein, 28 aa, Mycobacterium
TSEELELLNRLWKLVSLRCNFFTPTKKP

SEQ ID NO: 868537 - protein, 17 aa, Mycobacterium
TSEFLRPIVERPDLRVI

SEQ ID NO: 868538 - protein, 22 aa, Mycobacterium
TSEHGFEFLVSKGRALMPALFE

SEQ ID NO: 868539 - protein, 23 aa, Mycobacterium
TSEIALAIGERYLRNARARVILA

SEQ ID NO: 868540 - protein, 19 aa, Mycobacterium
TSEKHFRRARGRKVELTLA

SEQ ID NO: 868541 - protein, 23 aa, Mycobacterium
TSELQRRLAAAGSPLRAIAVHPG

SEQ ID NO: 868542 - protein, 19 aa, Mycobacterium
TSELQRRLDAAGSTLRALA

SEQ ID NO: 868543 - protein, 19 aa, Mycobacterium
TSELVELLYEAIPAPARRT

SEQ ID NO: 868544 - protein, 26 aa, Mycobacterium
TSEQLSMWIWRELATLLPMMSAVSVS

SEQ ID NO: 868545 - protein, 24 aa, Mycobacterium
TSEQQRLWLLQQRDPQNRAYDVRL

SEQ ID NO: 868546 - protein, 28 aa, Mycobacterium
TSEREHAHRLLNERLLTIEWEPRELPEP

SEQ ID NO: 868547 - protein, 32 aa, Mycobacterium
TSFARPVVALPNGLLYYAVDHSPSYLWDSATW

SEQ ID NO: 868548 - protein, 17 aa, Mycobacterium
TSFAYCRQITRDEIRSV

SEQ ID NO: 868549 - protein, 24 aa, Mycobacterium
TSFDRLLGLRFGAAAVRALDEGHS

SEQ ID NO: 868550 - protein, 25 aa, Mycobacterium
TSFDRLLGLRFGAAAVRALDEGHYG

SEQ ID NO: 868551 - protein, 30 aa, Mycobacterium
TSFDSFELWNAWFRVWTIGTLYGVNGQMEA

SEQ ID NO: 868552 - protein, 19 aa, Mycobacterium
TSFGRWSRLLDQHARTADV

SEQ ID NO: 868553 - protein, 20 aa, Mycobacterium
TSFLRWSKRLADHAHTAEVT

SEQ ID NO: 868554 - protein, 20 aa, Mycobacterium
TSFPVMIWPGRANPRYSIVY

SEQ ID NO: 868555 - protein, 26 aa, Mycobacterium
TSFSDHPEWVLPTDWTVAPGRPVLEV

SEQ ID NO: 868556 - protein, 29 aa, Mycobacterium
TSFSMVMENRWLPMKQTALALNHLVCTRF

SEQ ID NO: 868557 - protein, 29 aa, Mycobacterium
TSFSMVMENRWLPMKRTALALNHLVSTRF

SEQ ID NO: 868558 - protein, 20 aa, Mycobacterium
TSFWRLDSALPGKKFRWLTV

SEQ ID NO: 868559 - protein, 18 aa, Mycobacterium
TSFYDWYADLPVASPQVF

SEQ ID NO: 868560 - protein, 20 aa, Mycobacterium
TSFYFRTRSALLRAVAERSA

SEQ ID NO: 868561 - protein, 17 aa, Mycobacterium
TSGAAARRLGLRPLARI

SEQ ID NO: 868562 - protein, 23 aa, Mycobacterium
TSGAPTAILLDGSKFGGLITGLL

SEQ ID NO: 868563 - protein, 23 aa, Mycobacterium
TSGAWLQVRLPEAPPPLENTPVD

SEQ ID NO: 868564 - protein, 49 aa, Mycobacterium
TSGEQRLSGFLLWQSAYSEMWFTEAYWPEFRRVDFLRALRDYSARHRRY

SEQ ID NO: 868565 - protein, 25 aa, Mycobacterium
TSGFDSVFLMDHFYQLPGIGTPDQP

SEQ ID NO: 868566 - protein, 22 aa, Mycobacterium
TSGFGVHPALLDAALHTAVIAN

SEQ ID NO: 868567 - protein, 21 aa, Mycobacterium
TSGFTVYRLHGIFGAAGFSAI

SEQ ID NO: 868568 - protein, 19 aa, Mycobacterium
TSGGWLGPASLSMASAFWP

SEQ ID NO: 868569 - protein, 33 aa, Mycobacterium
TSGHFVWVREPLDLRGKFPLKAGLVTSLGFGHV

SEQ ID NO: 868570 - protein, 24 aa, Mycobacterium
TSGKTTTTYLIESALRAAGHTAGL

SEQ ID NO: 868571 - protein, 18 aa, Mycobacterium
TSGKTTTTYLVEAGLRAA

SEQ ID NO: 868572 - protein, 19 aa, Mycobacterium
TSGLLIGNGGDGGSGGAGG

SEQ ID NO: 868573 - protein, 25 aa, Mycobacterium
TSGPKAPHLIFLCTSVFSSGVHNYA

SEQ ID NO: 868574 - protein, 21 aa, Mycobacterium
TSGQLFLEEYYTQAVIAHGAI

SEQ ID NO: 868575 - protein, 27 aa, Mycobacterium
TSGQPAISLPLEWTPEGLPLGVQLVAA

SEQ ID NO: 868576 - protein, 24 aa, Mycobacterium
TSGQRALYELGMTGIPVVNVNNNC

SEQ ID NO: 868577 - protein, 21 aa, Mycobacterium
TSGRVSFMIRFGAGLLPEAKT

SEQ ID NO: 868578 - protein, 24 aa, Mycobacterium
TSGRYWTVIAFGPAGNEVAREWSD

SEQ ID NO: 868579 - protein, 20 aa, Mycobacterium
TSGTWTWTEQMIAVVVRGTM

SEQ ID NO: 868580 - protein, 17 aa, Mycobacterium
TSGVFSSGAFTSGFFNT

SEQ ID NO: 868581 - protein, 28 aa, Mycobacterium
TSHAGHYTFWFVPSLKPVNRRATELLLA

SEQ ID NO: 868582 - protein, 25 aa, Mycobacterium
TSHAVRITLGIALAKLGMVNPALSY

SEQ ID NO: 868583 - protein, 21 aa, Mycobacterium
TSHRMLLHHFGSREDLLIAIV

SEQ ID NO: 868584 - protein, 19 aa, Mycobacterium
TSHWAALPVLKTLGAQPVG

SEQ ID NO: 868585 - protein, 17 aa, Mycobacterium
TSHYFFQFDQRYMFAGY

SEQ ID NO: 868586 - protein, 26 aa, Mycobacterium
TSIAQPLTNLSLQCKLPISPSQAMGM

SEQ ID NO: 868587 - protein, 26 aa, Mycobacterium
TSIARLICEMYFGLGILESPEFIEVS

SEQ ID NO: 868588 - protein, 24 aa, Mycobacterium
TSIARWQSFGRTDRLSFANLSPIR

SEQ ID NO: 868589 - protein, 17 aa, Mycobacterium
TSIDIRAAFLRPVWADT

SEQ ID NO: 868590 - protein, 17 aa, Mycobacterium
TSIDPEILLLDEGLGAV

SEQ ID NO: 868591 - protein, 25 aa, Mycobacterium
TSIHEPLWIPTPTDSRLRQACALIT

SEQ ID NO: 868592 - protein, 26 aa, Mycobacterium
TSIIYDEPFWRADGLSGQSAAPGSPA

SEQ ID NO: 868593 - protein, 27 aa, Mycobacterium
TSILALMRHELFFTRKPFGESKLAELF

SEQ ID NO: 868594 - protein, 18 aa, Mycobacterium
TSILPDWMQDLQTMMSIF

SEQ ID NO: 868595 - protein, 26 aa, Mycobacterium
TSIPGNPLLMLLASDIPPLSWVLGNS

SEQ ID NO: 868596 - protein, 18 aa, Mycobacterium
TSIPWQARYRALGDMVGA

SEQ ID NO: 868597 - protein, 37 aa, Mycobacterium
TSISDLRAIPWVLAWSQSRVMLPGWYGTGTAFEDYVG

SEQ ID NO: 868598 - protein, 29 aa, Mycobacterium
TSISEPWRNPLLPADSYIEFARQRAAGGL

SEQ ID NO: 868599 - protein, 23 aa, Mycobacterium
TSITLVAYSVPEPGWSKIIPAFN

SEQ ID NO: 868600 - protein, 20 aa, Mycobacterium
TSKAFARYLADYIQEQGWQT

SEQ ID NO: 868601 - protein, 24 aa, Mycobacterium
TSKPAIYRRWPSKAYLVHEAVFPI

SEQ ID NO: 868602 - protein, 17 aa, Mycobacterium
TSKPAIYRRWRGKAHLV

SEQ ID NO: 868603 - protein, 26 aa, Mycobacterium
TSKPYPQFLVEILQRGGLLQRLEEDG

SEQ ID NO: 868604 - protein, 27 aa, Mycobacterium
TSKRYMHHYNFPPYSTGETGRVGSPKR

SEQ ID NO: 868605 - protein, 23 aa, Mycobacterium
TSKTRRDLPLSPYLVAAAGGVPS

SEQ ID NO: 868606 - protein, 34 aa, Mycobacterium
TSLAFDRYLLDETSVFWCPLPLFHTAGLATLTAC

SEQ ID NO: 868607 - protein, 17 aa, Mycobacterium
TSLAHWAQWCFVVARTE

SEQ ID NO: 868608 - protein, 24 aa, Mycobacterium
TSLEKAIRWLTYTVESELLLNQIL

SEQ ID NO: 868609 - protein, 24 aa, Mycobacterium
TSLEPRHLVLPMFVADGIEEPRPI

SEQ ID NO: 868610 - protein, 21 aa, Mycobacterium
TSLEVIPDHIPWEVAALNEPM

SEQ ID NO: 868611 - protein, 24 aa, Mycobacterium
TSLFGQFLAYLRTGDLPGTARIGA

SEQ ID NO: 868612 - protein, 28 aa, Mycobacterium
TSLGLVQLTRKRLGTGLIEAFSSSCPQC

SEQ ID NO: 868613 - protein, 22 aa, Mycobacterium
TSLKEKFLELLPNRVITDSIGS

SEQ ID NO: 868614 - protein, 21 aa, Mycobacterium
TSLLGFGSGMLLGRLVDHAFG

SEQ ID NO: 868615 - protein, 27 aa, Mycobacterium
TSLLGFGSGMLLGRLVDHAFGRKLTPQ

SEQ ID NO: 868616 - protein, 25 aa, Mycobacterium
TSLLHQYPHLLALSASSPFWDGEDT

SEQ ID NO: 868617 - protein, 17 aa, Mycobacterium
TSLLRFAGGLHIVGGRV

SEQ ID NO: 868618 - protein, 18 aa, Mycobacterium
TSLPLTLYSDPGATGLEC

SEQ ID NO: 868619 - protein, 20 aa, Mycobacterium
TSLQDVLLRPLAEHLPAAAT

SEQ ID NO: 868620 - protein, 30 aa, Mycobacterium
TSLRAFYQHFSTKDELLLALVEKIMAEATE

SEQ ID NO: 868621 - protein, 23 aa, Mycobacterium
TSLREALKAVPARRLWVNPDCGL

SEQ ID NO: 868622 - protein, 19 aa, Mycobacterium
TSLRPFTAPGLKTAYTPGR

SEQ ID NO: 868623 - protein, 17 aa, Mycobacterium
TSLRRSYALLRPGGRLV

SEQ ID NO: 868624 - protein, 28 aa, Mycobacterium
TSLRRYRMWCRLLRAGALLATGHDLTTA

SEQ ID NO: 868625 - protein, 27 aa, Mycobacterium
TSLRVATIVPKPWLPGSLTQPDYEQWA

SEQ ID NO: 868626 - protein, 17 aa, Mycobacterium
TSLRVGTFVLNSAFYRP

SEQ ID NO: 868627 - protein, 21 aa, Mycobacterium
TSLVLIGTDIDEAAALSALQG

SEQ ID NO: 868628 - protein, 20 aa, Mycobacterium
TSLVTGWASIHGYPVGILAN

SEQ ID NO: 868629 - protein, 21 aa, Mycobacterium
TSLWHSEFRQCSLLGSTFTDC

SEQ ID NO: 868630 - protein, 24 aa, Mycobacterium
TSLYNHCLRCWYFGDFFAQLEGHR

SEQ ID NO: 868631 - protein, 29 aa, Mycobacterium
TSMAVAVQPYLAWLTYTAESAAHAGAQAT

SEQ ID NO: 868632 - protein, 28 aa, Mycobacterium
TSMHFVPSLLGLFLSLPGVGQWRTLRRV

SEQ ID NO: 868633 - protein, 18 aa, Mycobacterium
TSMKWRAHPADVLPLWVA

SEQ ID NO: 868634 - protein, 24 aa, Mycobacterium
TSMNTGYLPFGQQAIYISNSPSGV

SEQ ID NO: 868635 - protein, 26 aa, Mycobacterium
TSMVSLTLMARLLEAVRPGARLILVG

SEQ ID NO: 868636 - protein, 25 aa, Mycobacterium
TSMVSLTMMARLLEAVRPDTRLLFV

SEQ ID NO: 868637 - protein, 25 aa, Mycobacterium
TSMVSLTMMARLLEAVRPQARLLLV

SEQ ID NO: 868638 - protein, 24 aa, Mycobacterium
TSMVSLTMMARLLEAVRPQTRLLL

SEQ ID NO: 868639 - protein, 27 aa, Mycobacterium
TSNAFTLLLARMFALGVPGLPAEGMQA

SEQ ID NO: 868640 - protein, 25 aa, Mycobacterium
TSNAQRAAALAPWLEIYNTQRRHSA

SEQ ID NO: 868641 - protein, 31 aa, Mycobacterium
TSNATLAHLLKFDSILGRLPYDVSLEGEDTI

SEQ ID NO: 868642 - protein, 34 aa, Mycobacterium
TSNHPLLCLVDVAGVPTLLWKLIEEIRPDDRVVL

SEQ ID NO: 868643 - protein, 33 aa, Mycobacterium
TSNHPLLCLVDVGGVPTLLWKLIGEIRPGDHVV

SEQ ID NO: 868644 - protein, 19 aa, Mycobacterium
TSNPWTLRKILRANQIAFQ

SEQ ID NO: 868645 - protein, 19 aa, Mycobacterium
TSNPWTLRKILRANQIALE

SEQ ID NO: 868646 - protein, 28 aa, Mycobacterium
TSPAPRQPPPSPMLTRPAPDRPSPTSPA

SEQ ID NO: 868647 - protein, 30 aa, Mycobacterium
TSPASPTRFASRYRVGAAAPGATITTDRTR

SEQ ID NO: 868648 - protein, 21 aa, Mycobacterium
TSPDRHRGLTLLVMERGLDGF

SEQ ID NO: 868649 - protein, 18 aa, Mycobacterium
TSPEQVILECEPYRRLAF

SEQ ID NO: 868650 - protein, 21 aa, Mycobacterium
TSPFNTLSCSCPETAPAGSPA

SEQ ID NO: 868651 - protein, 24 aa, Mycobacterium
TSPGYWRTPREPGNDHRRARLDVM

SEQ ID NO: 868652 - protein, 30 aa, Mycobacterium
TSPLMIQFRSHLFSRIVPIVKDIGLWGDKV

SEQ ID NO: 868653 - protein, 31 aa, Mycobacterium
TSPLMIQFRSHLFSRIVPIVKDIGLWGGKVQ

SEQ ID NO: 868654 - protein, 17 aa, Mycobacterium
TSPRDRAKVLRRFAAIL

SEQ ID NO: 868655 - protein, 38 aa, Mycobacterium
TSPTVLKRDFGMAWGVGGWLLTTFLQSAGAETFVRLRA

SEQ ID NO: 868656 - protein, 24 aa, Mycobacterium
TSPTYVLARVHPARRPGRPAMIHV

SEQ ID NO: 868657 - protein, 21 aa, Mycobacterium
TSPYPFFEYMRRTDPVWHGAL

SEQ ID NO: 868658 - protein, 23 aa, Mycobacterium
TSQFTRLDFLANYDARFVIVTAG

SEQ ID NO: 868659 - protein, 17 aa, Mycobacterium
TSQIADALMRKLDPRGA

SEQ ID NO: 868660 - protein, 21 aa, Mycobacterium
TSQLAIAWTLAQPGVHTAIMG

SEQ ID NO: 868661 - protein, 22 aa, Mycobacterium
TSQLSANQFFYGLRSGEEHRVQ

SEQ ID NO: 868662 - protein, 27 aa, Mycobacterium
TSRALRFWEVMYPSPPPGPAVGASEAT

SEQ ID NO: 868663 - protein, 24 aa, Mycobacterium
TSRAPRWAIAYKYPPEEATTELLD

SEQ ID NO: 868664 - protein, 20 aa, Mycobacterium
TSRAPRWAVAYKYPPEEAQT

SEQ ID NO: 868665 - protein, 19 aa, Mycobacterium
TSRAPRWAVAYKYPPQEAQ

SEQ ID NO: 868666 - protein, 24 aa, Mycobacterium
TSRDVLLFAAHLYVSGARFCGSER

SEQ ID NO: 868667 - protein, 24 aa, Mycobacterium
TSRELKHLLINDLPIERQAQDVSW

SEQ ID NO: 868668 - protein, 20 aa, Mycobacterium
TSRFFRDQRLLSIGGGADEV

SEQ ID NO: 868669 - protein, 21 aa, Mycobacterium
TSRFRDLICSRAVDIAIGPAG

SEQ ID NO: 868670 - protein, 25 aa, Mycobacterium
TSRIKLGTMLTPLSRRKPWDLASTT

SEQ ID NO: 868671 - protein, 30 aa, Mycobacterium
TSRIRLAPLVLSMTFRHPAVLANWAATVDH

SEQ ID NO: 868672 - protein, 23 aa, Mycobacterium
TSRNLLYVALTRGRAANHVYLHD

SEQ ID NO: 868673 - protein, 30 aa, Mycobacterium
TSRPAGLRDLLWTPTDLYPAEVLTGALSAP

SEQ ID NO: 868674 - protein, 27 aa, Mycobacterium
TSRPLRIVGLDEFIDLYPTVAEALDGR

SEQ ID NO: 868675 - protein, 34 aa, Mycobacterium
TSRPLVLLLHGFGSFWWSWRHQLGALPGARVVAV

SEQ ID NO: 868676 - protein, 28 aa, Mycobacterium
TSRPRDFPKNGWVVSALQAAWSAIATTA

SEQ ID NO: 868677 - protein, 24 aa, Mycobacterium
TSRPRKSRPAVPAWEDVLLGVRSS

SEQ ID NO: 868678 - protein, 21 aa, Mycobacterium
TSRRLAVITLTALEGAFVLCR

SEQ ID NO: 868679 - protein, 25 aa, Mycobacterium
TSRRLLLVRGISRPPRDPRTAASGE

SEQ ID NO: 868680 - protein, 18 aa, Mycobacterium
TSRRNVVIDVAICAPTGS

SEQ ID NO: 868681 - protein, 21 aa, Mycobacterium
TSRRRMMDWLSRRNGDVFALN

SEQ ID NO: 868682 - protein, 23 aa, Mycobacterium
TSRSLPPAIRLDGPEIARVQQIV

SEQ ID NO: 868683 - protein, 21 aa, Mycobacterium
TSRVLNAYRRAPAAVSGDAQD

SEQ ID NO: 868684 - protein, 19 aa, Mycobacterium
TSRWNLLPEPGGTRLRVTY

SEQ ID NO: 868685 - protein, 22 aa, Mycobacterium
TSRYLGGRPPYGYRLVDAGPHP

SEQ ID NO: 868686 - protein, 18 aa, Mycobacterium
TSSDPAAALAFLRRLHDE

SEQ ID NO: 868687 - protein, 30 aa, Mycobacterium
TSSEDLLFALRPDWLTPSAFESLVLLSEKI

SEQ ID NO: 868688 - protein, 23 aa, Mycobacterium
TSSFLPLTPAGQTPLRVLTIAGS

SEQ ID NO: 868689 - protein, 29 aa, Mycobacterium
TSSGWVLLAGFARRDLWSYLGSLPAEDDA

SEQ ID NO: 868690 - protein, 31 aa, Mycobacterium
TSSIAKYAMVLLLRRVWTATLGLAGRVAMLE

SEQ ID NO: 868691 - protein, 17 aa, Mycobacterium
TSSITGPITGYPGWSHY

SEQ ID NO: 868692 - protein, 28 aa, Mycobacterium
TSSITGPITGYPGWSHYGASKAAQLGFL

SEQ ID NO: 868693 - protein, 25 aa, Mycobacterium
TSSKPPYSIVLPPPNVTGSLHMGHA

SEQ ID NO: 868694 - protein, 25 aa, Mycobacterium
TSSQLTRRIRLKVPLVSSAMDTVTE

SEQ ID NO: 868695 - protein, 22 aa, Mycobacterium
TSSWAAKIEYLVGVALSVDPEG

SEQ ID NO: 868696 - protein, 29 aa, Mycobacterium
TSSWVAEDWLTGVWAFIQGVKSHALVLSR

SEQ ID NO: 868697 - protein, 25 aa, Mycobacterium
TSSYGRGFLTPRDSLRQRCVTHQIT

SEQ ID NO: 868698 - protein, 23 aa, Mycobacterium
TSTALRRSTLPGGLRVVTEYLPS

SEQ ID NO: 868699 - protein, 26 aa, Mycobacterium
TSTDRQFDFWFSPALLHCQRRTNRVA

SEQ ID NO: 868700 - protein, 26 aa, Mycobacterium
TSTGRQYRFVLPGPQLTSADQQRCLQ

SEQ ID NO: 868701 - protein, 22 aa, Mycobacterium
TSTGVFDLLLGDAGPAVVGDEI

SEQ ID NO: 868702 - protein, 22 aa, Mycobacterium
TSTLAFMAVFGALGVHRLGIVT

SEQ ID NO: 868703 - protein, 25 aa, Mycobacterium
TSTLRFYTHVLKLGSRQPLLLARQV

SEQ ID NO: 868704 - protein, 20 aa, Mycobacterium
TSTRFVACPFGAPGARMYRT

SEQ ID NO: 868705 - protein, 22 aa, Mycobacterium
TSTSPIHTLQQQALNAINAPIQ

SEQ ID NO: 868706 - protein, 22 aa, Mycobacterium
TSTTWPKLKDLPMLGISVLGEA

SEQ ID NO: 868707 - protein, 23 aa, Mycobacterium
TSTVIPFAYIEDTDVASWLHAFN

SEQ ID NO: 868708 - protein, 21 aa, Mycobacterium
TSTVLQFPYRDSVINLLDTPG

SEQ ID NO: 868709 - protein, 22 aa, Mycobacterium
TSTWRLTTLFGLMDAVAAAIEG

SEQ ID NO: 868710 - protein, 27 aa, Mycobacterium
TSVCDLEPYWEALRKVYAPFESGLPSP

SEQ ID NO: 868711 - protein, 24 aa, Mycobacterium
TSVDELLTIPLAKELAWAPEEIRE

SEQ ID NO: 868712 - protein, 19 aa, Mycobacterium
TSVEVIIATAWDCPFDGPT

SEQ ID NO: 868713 - protein, 24 aa, Mycobacterium
TSVKLFINYLTGADSFRFAHAPHF

SEQ ID NO: 868714 - protein, 23 aa, Mycobacterium
TSVLPGGLNWPLDLAVGQDGQLY

SEQ ID NO: 868715 - protein, 22 aa, Mycobacterium
TSVLTPTFRYNPAVTAQAFATM

SEQ ID NO: 868716 - protein, 26 aa, Mycobacterium
TSVQRLEALPGWPTGPLSPVHISAAI

SEQ ID NO: 868717 - protein, 27 aa, Mycobacterium
TSVRHPLRWHHLALVMWYPDQGSEVDE

SEQ ID NO: 868718 - protein, 18 aa, Mycobacterium
TSVSLPINGLVKVDLKPG

SEQ ID NO: 868719 - protein, 25 aa, Mycobacterium
TSVVFATAFYALRDLASVQPGQRIL

SEQ ID NO: 868720 - protein, 19 aa, Mycobacterium
TSVYFALVRTRMIEPTPML

SEQ ID NO: 868721 - protein, 17 aa, Mycobacterium
TSWLSALRGSKVALRVP

SEQ ID NO: 868722 - protein, 17 aa, Mycobacterium
TSWNVRAIWEMYAGWFR

SEQ ID NO: 868723 - protein, 17 aa, Mycobacterium
TSWQGAGGIGGFFEKTF

SEQ ID NO: 868724 - protein, 26 aa, Mycobacterium
TSWSDYQAGYFIGAATGAFCPEYEWK

SEQ ID NO: 868725 - protein, 24 aa, Mycobacterium
TSWSFGENMRRWGLLGSFGTVGDC

SEQ ID NO: 868726 - protein, 17 aa, Mycobacterium
TSYLRGPSVLVAHGEVS

SEQ ID NO: 868727 - protein, 29 aa, Mycobacterium
TSYSAYFLTHLFLMDKLGDLPLYEADLVE

SEQ ID NO: 868728 - protein, 27 aa, Mycobacterium
TSYVPPAITGTFGLPVALTLDAAGSAV

SEQ ID NO: 868729 - protein, 36 aa, Mycobacterium
TSYYGERLPAPASYRSYLTWLAAQDRTAARAAWGEV

SEQ ID NO: 868730 - protein, 17 aa, Mycobacterium
TSYYYRTRTALLRGVGK

SEQ ID NO: 868731 - protein, 22 aa, Mycobacterium
TTAAIPLYRTLRAGEFIKIVQS

SEQ ID NO: 868732 - protein, 27 aa, Mycobacterium
TTAAPLLYPHMWSWDAAFVAIGLAPLS

SEQ ID NO: 868733 - protein, 26 aa, Mycobacterium
TTAARYVWELPYYPTYYVPITDVRRE

SEQ ID NO: 868734 - protein, 30 aa, Mycobacterium
TTAARYVWEVPYYPQYYIPLADVRAEFLRD

SEQ ID NO: 868735 - protein, 28 aa, Mycobacterium
TTAARYVWEVPYYPQYYIPLADVRTEFL

SEQ ID NO: 868736 - protein, 26 aa, Mycobacterium
TTADRVITLRYLLSMIAAERGMVATF

SEQ ID NO: 868737 - protein, 23 aa, Mycobacterium
TTADRVITLRYLLSMIADERGMI

SEQ ID NO: 868738 - protein, 22 aa, Mycobacterium
TTAEPLLSGFLPLQCQYAELTF

SEQ ID NO: 868739 - protein, 24 aa, Mycobacterium
TTAERLEMLLRRLQSLNSFPSDYV

SEQ ID NO: 868740 - protein, 27 aa, Mycobacterium
TTAGLLDAMRWLADSVPIFGVNVLLST

SEQ ID NO: 868741 - protein, 30 aa, Mycobacterium
TTAGPGTKLLVLPPLIHGAAQWTVMTALTT

SEQ ID NO: 868742 - protein, 26 aa, Mycobacterium
TTAGVPTAFWFWGGYEQQRFEEAAAA

SEQ ID NO: 868743 - protein, 22 aa, Mycobacterium
TTAIDLALALHPTPAVGGVPTN

SEQ ID NO: 868744 - protein, 27 aa, Mycobacterium
TTAIRYPLRWHHVGLIMWSGDQGFDVD

SEQ ID NO: 868745 - protein, 17 aa, Mycobacterium
TTALLQGLPTPDIGRAI

SEQ ID NO: 868746 - protein, 24 aa, Mycobacterium
TTALQRIWSLLDDDPLIVIDAQGL

SEQ ID NO: 868747 - protein, 26 aa, Mycobacterium
TTALYKIAERLPLRAALLWSRIGDQL

SEQ ID NO: 868748 - protein, 28 aa, Mycobacterium
TTAPGYDIDLWSRMSRELGLPSLLVPEE

SEQ ID NO: 868749 - protein, 20 aa, Mycobacterium
TTAPITIPPIGLGSFTTPPL

SEQ ID NO: 868750 - protein, 30 aa, Mycobacterium
TTAPTAWLAEGLLIYLPPDAQDRLFDNITA

SEQ ID NO: 868751 - protein, 32 aa, Mycobacterium
TTARLLVPLRAVLKERVALAPAPPPALDLTVL

SEQ ID NO: 868752 - protein, 24 aa, Mycobacterium
TTARMLIQFGFIERLAVAGDRRTF

SEQ ID NO: 868753 - protein, 25 aa, Mycobacterium
TTASSLSLWFSLPGDERLADAVRHL

SEQ ID NO: 868754 - protein, 26 aa, Mycobacterium
TTATGAPLPLVALPQGELLTVNEHDV

SEQ ID NO: 868755 - protein, 27 aa, Mycobacterium
TTATGIWAMEDLLIFGDGRELYGAGHY

SEQ ID NO: 868756 - protein, 18 aa, Mycobacterium
TTATTLAWVFERLTRQPE

SEQ ID NO: 868757 - protein, 24 aa, Mycobacterium
TTATVLAQALVKGGLRLVAAGANP

SEQ ID NO: 868758 - protein, 25 aa, Mycobacterium
TTATVLAQALVKSGLRLVAAGANPI

SEQ ID NO: 868759 - protein, 30 aa, Mycobacterium
TTATVLAQALVKTGLRLVAAGINPIALGSG

SEQ ID NO: 868760 - protein, 24 aa, Mycobacterium
TTATVNWYRAMRYSLRSPARPSRV

SEQ ID NO: 868761 - protein, 22 aa, Mycobacterium
TTAVLMDRWDPVRAVALMNDER

SEQ ID NO: 868762 - protein, 24 aa, Mycobacterium
TTAYGVFMLLLELTEPARALTGSR

SEQ ID NO: 868763 - protein, 21 aa, Mycobacterium
TTAYTISKFSMSLVAIGLAAE

SEQ ID NO: 868764 - protein, 25 aa, Mycobacterium
TTCGSDLHFIDGYLPGMRAGDIFGH

SEQ ID NO: 868765 - protein, 25 aa, Mycobacterium
TTCYDIRFPELYVELARRGAQLITV

SEQ ID NO: 868766 - protein, 17 aa, Mycobacterium
TTDAGSVANWWARHLRL

SEQ ID NO: 868767 - protein, 25 aa, Mycobacterium
TTDAKFLSNLLDRIPRQTDPIRNRT

SEQ ID NO: 868768 - protein, 35 aa, Mycobacterium
TTDALVVWLPQERILFTGNLFGPLFGHVPNLMTIR

SEQ ID NO: 868769 - protein, 26 aa, Mycobacterium
TTDERLYRLVDLVLPRVPGDSRLIAA

SEQ ID NO: 868770 - protein, 24 aa, Mycobacterium
TTDFGLLNVLINNAGIVALGAIGK

SEQ ID NO: 868771 - protein, 18 aa, Mycobacterium
TTDFMKLTPDRYVHELLV

SEQ ID NO: 868772 - protein, 22 aa, Mycobacterium
TTDFRTFTSVPMVGPAAANKGL

SEQ ID NO: 868773 - protein, 17 aa, Mycobacterium
TTDGDGPLPLMWGEYRP

SEQ ID NO: 868774 - protein, 28 aa, Mycobacterium
TTDGRWSCVRWATLTPPFHPEPDVQPVT

SEQ ID NO: 868775 - protein, 30 aa, Mycobacterium
TTDHPYREPLWVQLITAYYLAERQSDALDA

SEQ ID NO: 868776 - protein, 19 aa, Mycobacterium
TTDHRFVPAAVFTDPQLAA

SEQ ID NO: 868777 - protein, 24 aa, Mycobacterium
TTDKDGIILALLASEMLAVTGTSP

SEQ ID NO: 868778 - protein, 21 aa, Mycobacterium
TTDLAFVEELVLLTAQRHTEI

SEQ ID NO: 868779 - protein, 26 aa, Mycobacterium
TTDLMPQTVAWLMLGVALSAYENWLA

SEQ ID NO: 868780 - protein, 19 aa, Mycobacterium
TTDLVEWLEANASFHAAIY

SEQ ID NO: 868781 - protein, 25 aa, Mycobacterium
TTDPKALGMFLGHYGLTSLGSEALH

SEQ ID NO: 868782 - protein, 25 aa, Mycobacterium
TTDQLPLVSVLLGGVALGLADGPTE

SEQ ID NO: 868783 - protein, 24 aa, Mycobacterium
TTDQPLDWFCSFSSAAAMLGSPGQ

SEQ ID NO: 868784 - protein, 25 aa, Mycobacterium
TTDSPLRALILRLADDRVVLGLNYH

SEQ ID NO: 868785 - protein, 27 aa, Mycobacterium
TTDTGSFRWASARGYRLAARLVEIGVD

SEQ ID NO: 868786 - protein, 25 aa, Mycobacterium
TTDTGSFRWASPRGLRLAARLVDIG

SEQ ID NO: 868787 - protein, 25 aa, Mycobacterium
TTEAQRRLWRRSPGHIVRGVTGELS

SEQ ID NO: 868788 - protein, 24 aa, Mycobacterium
TTEEHLLDCRPPRSAYGFSKLTGE

SEQ ID NO: 868789 - protein, 29 aa, Mycobacterium
TTEGDPWASFVTYGLLGGAPVLCVSDMAE

SEQ ID NO: 868790 - protein, 23 aa, Mycobacterium
TTEGWPGFADRLLELARAAEAGS

SEQ ID NO: 868791 - protein, 19 aa, Mycobacterium
TTEKHFRRARGRKAELSLA

SEQ ID NO: 868792 - protein, 29 aa, Mycobacterium
TTELPTTYRLLGRTPRRLRRLRAAPSAVV

SEQ ID NO: 868793 - protein, 25 aa, Mycobacterium
TTELPTTYRLLGRTPRRVRALRASP

SEQ ID NO: 868794 - protein, 18 aa, Mycobacterium
TTELRRQLKPLGRQAEMA

SEQ ID NO: 868795 - protein, 19 aa, Mycobacterium
TTELRRQLKPLGRQAEVAR

SEQ ID NO: 868796 - protein, 24 aa, Mycobacterium
TTEPKARALRPYAEKLITHAKKGT

SEQ ID NO: 868797 - protein, 28 aa, Mycobacterium
TTEPVTPDSFWLPIFTHVRGLGEKDLSL

SEQ ID NO: 868798 - protein, 25 aa, Mycobacterium
TTEQLGYNRRYTLSVKALGMGGAAS

SEQ ID NO: 868799 - protein, 23 aa, Mycobacterium
TTEQLVLRHGVPAHLDLRGPQRV

SEQ ID NO: 868800 - protein, 23 aa, Mycobacterium
TTERAVLMSAARRLLLDPVEIGP

SEQ ID NO: 868801 - protein, 25 aa, Mycobacterium
TTETLKFLVALRPGLVSPTLAAQMA

SEQ ID NO: 868802 - protein, 23 aa, Mycobacterium
TTEVRMIRWLSARGLIVGTVASA

SEQ ID NO: 868803 - protein, 21 aa, Mycobacterium
TTFATGGTRRTAAAVTAVTAV

SEQ ID NO: 868804 - protein, 18 aa, Mycobacterium
TTFDFLRDKPHAPQGAQW

SEQ ID NO: 868805 - protein, 20 aa, Mycobacterium
TTFDKWRLIPVLDADDRVVD

SEQ ID NO: 868806 - protein, 22 aa, Mycobacterium
TTFGRIGVKVWIYKGDIVGGKR

SEQ ID NO: 868807 - protein, 26 aa, Mycobacterium
TTFLDTFAFARRAAGLPASAINWGLW

SEQ ID NO: 868808 - protein, 28 aa, Mycobacterium
TTFTASQGLLLMIPNMYKIAGELTSAVM

SEQ ID NO: 868809 - protein, 20 aa, Mycobacterium
TTFTKKTLFWRRLDSKQGHG

SEQ ID NO: 868810 - protein, 18 aa, Mycobacterium
TTFWRLTDALPDAEFHWL

SEQ ID NO: 868811 - protein, 29 aa, Mycobacterium
TTGAGGIGGLLLGLDGYNAPTSTSPIHVA

SEQ ID NO: 868812 - protein, 27 aa, Mycobacterium
TTGARVPLCFGFHPYLQLPGVPRSQWQ

SEQ ID NO: 868813 - protein, 26 aa, Mycobacterium
TTGARVTYLYQLFPNVMLATFPDVIA

SEQ ID NO: 868814 - protein, 18 aa, Mycobacterium
TTGDLAPLATLMTALKTP

SEQ ID NO: 868815 - protein, 28 aa, Mycobacterium
TTGHAILGLLPDNGAVLGGRIAFRGQDL

SEQ ID NO: 868816 - protein, 20 aa, Mycobacterium
TTGIGLRGWIAAADGWGLAG

SEQ ID NO: 868817 - protein, 31 aa, Mycobacterium
TTGLGSRYFRLLPQGLVQRLVPKPGSGPSAA

SEQ ID NO: 868818 - protein, 18 aa, Mycobacterium
TTGLTGRASYGGIGARRP

SEQ ID NO: 868819 - protein, 21 aa, Mycobacterium
TTGMGSIRLLEAIRLSRVECR

SEQ ID NO: 868820 - protein, 28 aa, Mycobacterium
TTGMPKGVLWRQHDIFLSSMGGRPFGAE

SEQ ID NO: 868821 - protein, 23 aa, Mycobacterium
TTGMPYLRPFRGAQPLLVMPVAL

SEQ ID NO: 868822 - protein, 17 aa, Mycobacterium
TTGPLTRQYRHTLRTIL

SEQ ID NO: 868823 - protein, 28 aa, Mycobacterium
TTGRRRRCGWFDAVIARYATRVNGITDF

SEQ ID NO: 868824 - protein, 18 aa, Mycobacterium
TTGRRTWPPQPSQRLLGL

SEQ ID NO: 868825 - protein, 24 aa, Mycobacterium
TTGSFYHYFPNWSAYTRELIEHWR

SEQ ID NO: 868826 - protein, 26 aa, Mycobacterium
TTGSLAALGAMWLARRRRCVDAQQSR

SEQ ID NO: 868827 - protein, 29 aa, Mycobacterium
TTGSLHALDLLLGSWPARGGTLACLPGEY

SEQ ID NO: 868828 - protein, 17 aa, Mycobacterium
TTGSLHALDLLLGSWPR

SEQ ID NO: 868829 - protein, 22 aa, Mycobacterium
TTGTNPTPHPITSHANPGTDGT

SEQ ID NO: 868830 - protein, 27 aa, Mycobacterium
TTGTPGDWWTVFALVPDALKHSVQGFA

SEQ ID NO: 868831 - protein, 22 aa, Mycobacterium
TTGVLRLYQFAAAGELAFPAIN

SEQ ID NO: 868832 - protein, 25 aa, Mycobacterium
TTHAEDLLSLPYVRDIEHPAVAYQV

SEQ ID NO: 868833 - protein, 19 aa, Mycobacterium
TTHELWPGKAYPLGATYDG

SEQ ID NO: 868834 - protein, 18 aa, Mycobacterium
TTHFCNVLHLLLPAGEEF

SEQ ID NO: 868835 - protein, 24 aa, Mycobacterium
TTHGDLALPLLPTDRELAAGDVLW

SEQ ID NO: 868836 - protein, 23 aa, Mycobacterium
TTHGLPFLHDWTPDAVPPGWSVD

SEQ ID NO: 868837 - protein, 24 aa, Mycobacterium
TTHGRVMAWPHIGPDRSTWISYAA

SEQ ID NO: 868838 - protein, 26 aa, Mycobacterium
TTHLDWYIAMACFKLAIVIEGTWSRY

SEQ ID NO: 868839 - protein, 17 aa, Mycobacterium
TTHPIAGTRWRGATDEE

SEQ ID NO: 868840 - protein, 21 aa, Mycobacterium
TTHQFCHIVLKSLGVAGDSDS

SEQ ID NO: 868841 - protein, 19 aa, Mycobacterium
TTHWLAAELLTATYPAVRV

SEQ ID NO: 868842 - protein, 27 aa, Mycobacterium
TTIAGVEYPIPEPFLVIATQNPVDQEG

SEQ ID NO: 868843 - protein, 17 aa, Mycobacterium
TTIFQQTREPLLKQLLK

SEQ ID NO: 868844 - protein, 20 aa, Mycobacterium
TTIKPGPYPWRNHHNAWRPA

SEQ ID NO: 868845 - protein, 19 aa, Mycobacterium
TTINILSTLIRPSSGHASV

SEQ ID NO: 868846 - protein, 25 aa, Mycobacterium
TTINTVLQAAWAQLLMRVTGQYDVA

SEQ ID NO: 868847 - protein, 20 aa, Mycobacterium
TTIPMAELPAFSPPSAAGHG

SEQ ID NO: 868848 - protein, 23 aa, Mycobacterium
TTIRFRYNRLLESNAARVMCIVN

SEQ ID NO: 868849 - protein, 17 aa, Mycobacterium
TTISHLLRDFELLAPLR

SEQ ID NO: 868850 - protein, 25 aa, Mycobacterium
TTISMYPRMWDATGVDYPTLLDAMV

SEQ ID NO: 868851 - protein, 26 aa, Mycobacterium
TTITDTRWRLVAKELILALLAPNHNA

SEQ ID NO: 868852 - protein, 21 aa, Mycobacterium
TTIVALKYPGGVLIAGDRRST

SEQ ID NO: 868853 - protein, 19 aa, Mycobacterium
TTIVLTTHYLEEAAALADR

SEQ ID NO: 868854 - protein, 17 aa, Mycobacterium
TTKIKPITYLSTVAVAI

SEQ ID NO: 868855 - protein, 21 aa, Mycobacterium
TTKLFNATRFALMNGAALGEL

SEQ ID NO: 868856 - protein, 18 aa, Mycobacterium
TTKLLANAAYWGHRNPDQ

SEQ ID NO: 868857 - protein, 24 aa, Mycobacterium
TTKTLPCHAGYLSVSGKNNTITLT

SEQ ID NO: 868858 - protein, 24 aa, Mycobacterium
TTKYYGLSLQVYRLRKADLDLPEP

SEQ ID NO: 868859 - protein, 25 aa, Mycobacterium
TTLAEAALAIRAGAYWVAANVDATL

SEQ ID NO: 868860 - protein, 29 aa, Mycobacterium
TTLAHVVIGRVIPLLVLEGRAWDTGLENL

SEQ ID NO: 868861 - protein, 20 aa, Mycobacterium
TTLALIPAGYADGVFRALSN

SEQ ID NO: 868862 - protein, 25 aa, Mycobacterium
TTLDRARFDLGWNRLGMIGPTVTAA

SEQ ID NO: 868863 - protein, 24 aa, Mycobacterium
TTLEGLPVVILYTIGAKSGQIRKA

SEQ ID NO: 868864 - protein, 26 aa, Mycobacterium
TTLGDRILVYSAALQRIHTRRIGLME

SEQ ID NO: 868865 - protein, 34 aa, Mycobacterium
TTLGGYAERMLLSAPLLLPVPNGLDAGPAALTEP

SEQ ID NO: 868866 - protein, 32 aa, Mycobacterium
TTLGQTGARFWPWLAYSGAILRGTKLSTRDTE

SEQ ID NO: 868867 - protein, 28 aa, Mycobacterium
TTLGRVLFNELLPHGYPFVNKQMHKKVQ

SEQ ID NO: 868868 - protein, 26 aa, Mycobacterium
TTLGRVLFNELLPLGYAFVNKQMHKK

SEQ ID NO: 868869 - protein, 30 aa, Mycobacterium
TTLGTNLLGPFALTNLLLGRVRSQVIIVGS

SEQ ID NO: 868870 - protein, 29 aa, Mycobacterium
TTLGYPRGNLAFRWFLADGVPQRPEVKLV

SEQ ID NO: 868871 - protein, 25 aa, Mycobacterium
TTLGYYIAFLLDTPEYRDVPMEEID

SEQ ID NO: 868872 - protein, 17 aa, Mycobacterium
TTLHLKAALVRAVQVCA

SEQ ID NO: 868873 - protein, 26 aa, Mycobacterium
TTLHYDKLILATGSRSFFPPMAGLWA

SEQ ID NO: 868874 - protein, 22 aa, Mycobacterium
TTLIDLNVRWRKGQTLEPDWKI

SEQ ID NO: 868875 - protein, 48 aa, Mycobacterium
TTLIPNAPTEPADMPGVWAVMAWARRQPMYSDPAMRTTVNPQAQLPVP

SEQ ID NO: 868876 - protein, 22 aa, Mycobacterium
TTLKNWLGMWSLSHAQTRAEPH

SEQ ID NO: 868877 - protein, 19 aa, Mycobacterium
TTLLALARFGGQPAVVLGQ

SEQ ID NO: 868878 - protein, 21 aa, Mycobacterium
TTLLLTLAGRFRPSHGTLTVL

SEQ ID NO: 868879 - protein, 20 aa, Mycobacterium
TTLLNHVLRSPDARIGVVIN

SEQ ID NO: 868880 - protein, 17 aa, Mycobacterium
TTLLVTDLAGGWIPPHV

SEQ ID NO: 868881 - protein, 19 aa, Mycobacterium
TTLMPLHYQGDNWWLRARI

SEQ ID NO: 868882 - protein, 22 aa, Mycobacterium
TTLQQDGMLFVWNDPERKPPPA

SEQ ID NO: 868883 - protein, 23 aa, Mycobacterium
TTLRLPAPYRLTRGKRNPIAEWL

SEQ ID NO: 868884 - protein, 24 aa, Mycobacterium
TTLRNWLGMWSLRHAQTRAEPHLA

SEQ ID NO: 868885 - protein, 25 aa, Mycobacterium
TTLSNLLRMLFSRAGTYPPGATERL

SEQ ID NO: 868886 - protein, 26 aa, Mycobacterium
TTLSRYLAGPFVPTMFGRDARLQLLH

SEQ ID NO: 868887 - protein, 26 aa, Mycobacterium
TTLSRYLAGPLVPTMFGRDARLQLLH

SEQ ID NO: 868888 - protein, 30 aa, Mycobacterium
TTLSWLSRYSQPLRRLPFGLSATRDHLTRL

SEQ ID NO: 868889 - protein, 29 aa, Mycobacterium
TTLSWVDANVWRRIVPKGWFYNVMVTGVK

SEQ ID NO: 868890 - protein, 21 aa, Mycobacterium
TTLTAMAWLSLGPDIEQVPSA

SEQ ID NO: 868891 - protein, 21 aa, Mycobacterium
TTLTDPTGYGRILRTQDREVI

SEQ ID NO: 868892 - protein, 22 aa, Mycobacterium
TTLTRYPGMYHGFLMRYEATAR

SEQ ID NO: 868893 - protein, 25 aa, Mycobacterium
TTLVNTVLGLLPRTATVTADTLALD

SEQ ID NO: 868894 - protein, 18 aa, Mycobacterium
TTMAAFKGIPGASGYSAS

SEQ ID NO: 868895 - protein, 17 aa, Mycobacterium
TTMDPAPPPMDYIRGSG

SEQ ID NO: 868896 - protein, 19 aa, Mycobacterium
TTMDVRLVPLARAWTRGAV

SEQ ID NO: 868897 - protein, 29 aa, Mycobacterium
TTMEPHERAFWQFHASLMEPWDGPACVTF

SEQ ID NO: 868898 - protein, 24 aa, Mycobacterium
TTMGMMAFLEHPGQWELFKSARPS

SEQ ID NO: 868899 - protein, 24 aa, Mycobacterium
TTMGWFDRDWYLDGLRDQVFDRNG

SEQ ID NO: 868900 - protein, 22 aa, Mycobacterium
TTMPGAAFFSSSTSFGIIRGGH

SEQ ID NO: 868901 - protein, 22 aa, Mycobacterium
TTMRLILGLDHPTSGTATIDGK

SEQ ID NO: 868902 - protein, 23 aa, Mycobacterium
TTMRRARYEHRLMSVLAEMAAVQ

SEQ ID NO: 868903 - protein, 31 aa, Mycobacterium
TTMSHLLGDLGLLEPLRGLLADGLPAYGACA

SEQ ID NO: 868904 - protein, 30 aa, Mycobacterium
TTMSPAERWQLLATAWLDLPGRPALIGSRG

SEQ ID NO: 868905 - protein, 35 aa, Mycobacterium
TTMTADYWYANLRQPVRFYDSIKVLLAAAEQVFVE

SEQ ID NO: 868906 - protein, 26 aa, Mycobacterium
TTMTALAPMGMYPASALMSPMMVLAH

SEQ ID NO: 868907 - protein, 27 aa, Mycobacterium
TTMYERDDFMIPFATLRPAPYRQATEA

SEQ ID NO: 868908 - protein, 23 aa, Mycobacterium
TTNAIGSGFYTPGNFFGTMCDFF

SEQ ID NO: 868909 - protein, 23 aa, Mycobacterium
TTNEYSVVILKRGPKFGDESSPG

SEQ ID NO: 868910 - protein, 28 aa, Mycobacterium
TTNGAAQFFLLLVGPRKMRTALIHKLLA

SEQ ID NO: 868911 - protein, 60 aa, Mycobacterium
TTNLLPAAADEVSAAIASLFGTHALAYQAIGAQAATFHDGFVQALSRAASRYAATEVANV

SEQ ID NO: 868912 - protein, 24 aa, Mycobacterium
TTNPDWLPTIRRAAALVTETGGMT

SEQ ID NO: 868913 - protein, 30 aa, Mycobacterium
TTNPIFMPGRVEPLYSEWLTFIGISVDHAE

SEQ ID NO: 868914 - protein, 17 aa, Mycobacterium
TTNPNELIYWCIDDVAR

SEQ ID NO: 868915 - protein, 24 aa, Mycobacterium
TTNPRQLRWVVPPDRLPPRGVVRQ

SEQ ID NO: 868916 - protein, 24 aa, Mycobacterium
TTNRDLLVGILRENDFRAGAIDTG

SEQ ID NO: 868917 - protein, 23 aa, Mycobacterium
TTNSTGWWHTARSLPVGAFTDDQ

SEQ ID NO: 868918 - protein, 27 aa, Mycobacterium
TTNTGTRGLPGVAPQPSTGAAGTPGTG

SEQ ID NO: 868919 - protein, 26 aa, Mycobacterium
TTNTPGMMFPDRWIPNLADQVRAAAL

SEQ ID NO: 868920 - protein, 24 aa, Mycobacterium
TTNYTRRIPYFATSVAVRRVSDGT

SEQ ID NO: 868921 - protein, 24 aa, Mycobacterium
TTPAALNIMRLLRERGADPTIETT

SEQ ID NO: 868922 - protein, 27 aa, Mycobacterium
TTPAPDLLAGAAAFKVLYRLRALMQTG

SEQ ID NO: 868923 - protein, 24 aa, Mycobacterium
TTPDAPWGLYRTEGDDHWVAITVR

SEQ ID NO: 868924 - protein, 24 aa, Mycobacterium
TTPDNLYMLGTYRLDPDEALVLDI

SEQ ID NO: 868925 - protein, 22 aa, Mycobacterium
TTPDQVVGLLSGGPGAFVTAVE

SEQ ID NO: 868926 - protein, 32 aa, Mycobacterium
TTPEGGLIKAAWIDTWRLPAAPPGTVKIVVGV

SEQ ID NO: 868927 - protein, 28 aa, Mycobacterium
TTPEQWRLVVDVNLIGAWNTCAAALPHV

SEQ ID NO: 868928 - protein, 24 aa, Mycobacterium
TTPERLWHAITNPGTSLGYLGHAI

SEQ ID NO: 868929 - protein, 17 aa, Mycobacterium
TTPFGLLPPIDPVDFAG

SEQ ID NO: 868930 - protein, 24 aa, Mycobacterium
TTPFGTLPIVFSLGGLNAGSTGFG

SEQ ID NO: 868931 - protein, 25 aa, Mycobacterium
TTPGDLPPLQFFARTVHAETSLGGV

SEQ ID NO: 868932 - protein, 24 aa, Mycobacterium
TTPGSALLFPSLCAATGAIAAPEA

SEQ ID NO: 868933 - protein, 18 aa, Mycobacterium
TTPHFDGYPVVLVRLGAI

SEQ ID NO: 868934 - protein, 34 aa, Mycobacterium
TTPISLIKHAAGAERIWFQRFWAGLEESECDGYS

SEQ ID NO: 868935 - protein, 22 aa, Mycobacterium
TTPLITMNMGIKPSLQGTITDD

SEQ ID NO: 868936 - protein, 28 aa, Mycobacterium
TTPLPARLILRLLNFDESRFMDWVGWVH

SEQ ID NO: 868937 - protein, 17 aa, Mycobacterium
TTPLPPPSPHDLAYLIY

SEQ ID NO: 868938 - protein, 31 aa, Mycobacterium
TTPLRMAKHFLRHPRLLGALPVLRDANKIPA

SEQ ID NO: 868939 - protein, 31 aa, Mycobacterium
TTPLRMGKHLLTHPGLLGRLPILREANRIPA

SEQ ID NO: 868940 - protein, 23 aa, Mycobacterium
TTPPGLLALASRAYAASGIGSNI

SEQ ID NO: 868941 - protein, 21 aa, Mycobacterium
TTPPLTIPSIHLPGTTIGEFA

SEQ ID NO: 868942 - protein, 23 aa, Mycobacterium
TTPQMFTYGLQQRARSNRKHIVL

SEQ ID NO: 868943 - protein, 21 aa, Mycobacterium
TTPSMFAQLAACGLLSTVPLA

SEQ ID NO: 868944 - protein, 24 aa, Mycobacterium
TTPTATWPPVPYPESLAIRLEDEG

SEQ ID NO: 868945 - protein, 29 aa, Mycobacterium
TTPTILDQFHIPPLPYMQGAPLTDPSFDS

SEQ ID NO: 868946 - protein, 29 aa, Mycobacterium
TTQARYVWEVPYYPAYYVPLADVRAEFLR

SEQ ID NO: 868947 - protein, 17 aa, Mycobacterium
TTQEIYLEVWRTASDYD

SEQ ID NO: 868948 - protein, 18 aa, Mycobacterium
TTQFFGMKANRYLHDHNI

SEQ ID NO: 868949 - protein, 18 aa, Mycobacterium
TTQFFGMKANRYLHEHGI

SEQ ID NO: 868950 - protein, 18 aa, Mycobacterium
TTQFFGMKANRYLHTHHV

SEQ ID NO: 868951 - protein, 29 aa, Mycobacterium
TTQNAQLDWPLAEALRYPARLIDEFEWER

SEQ ID NO: 868952 - protein, 19 aa, Mycobacterium
TTQPLLPPRQICAQQTMAF

SEQ ID NO: 868953 - protein, 34 aa, Mycobacterium
TTQRIVLSRNPKWWGARPRLDNITYLVLDDAARL

SEQ ID NO: 868954 - protein, 24 aa, Mycobacterium
TTQTPLDAQYWRRHSRQPVQFAES

SEQ ID NO: 868955 - protein, 18 aa, Mycobacterium
TTQVLLEALRLCPPAAGV

SEQ ID NO: 868956 - protein, 22 aa, Mycobacterium
TTRDGWRLQIRLDHEQVNPVPN

SEQ ID NO: 868957 - protein, 17 aa, Mycobacterium
TTRELPKRRPVDLRLKD

SEQ ID NO: 868958 - protein, 20 aa, Mycobacterium
TTRFLITATGFLSQPRLPDI

SEQ ID NO: 868959 - protein, 19 aa, Mycobacterium
TTRGITLRCLADGLDTATS

SEQ ID NO: 868960 - protein, 20 aa, Mycobacterium
TTRGWFMSWISHSHPELVGR

SEQ ID NO: 868961 - protein, 31 aa, Mycobacterium
TTRGWSMNRPFDGIPALLADLQAAGVRMAVA

SEQ ID NO: 868962 - protein, 25 aa, Mycobacterium
TTRHADVILPPPPPSRAPHFDVALN

SEQ ID NO: 868963 - protein, 19 aa, Mycobacterium
TTRHIPAFKLTRSSAAYWR

SEQ ID NO: 868964 - protein, 17 aa, Mycobacterium
TTRLLAGLAPRRQPPKT

SEQ ID NO: 868965 - protein, 17 aa, Mycobacterium
TTRPFTVVGTDPSSDIA

SEQ ID NO: 868966 - protein, 29 aa, Mycobacterium
TTRQRYVEPYRAELQRLGRPVFGPTFEVD

SEQ ID NO: 868967 - protein, 19 aa, Mycobacterium
TTRRLPFGVAVLGGPTTVV

SEQ ID NO: 868968 - protein, 32 aa, Mycobacterium
TTRSPWPQAPILVRQYLRSRAAWPIFGKQFVI

SEQ ID NO: 868969 - protein, 29 aa, Mycobacterium
TTRVIDLIMPIGKGQRALIVSPPKAGKTT

SEQ ID NO: 868970 - protein, 20 aa, Mycobacterium
TTRWGSFLDDLPGFDAEFFG

SEQ ID NO: 868971 - protein, 24 aa, Mycobacterium
TTSDAPLLPVRSLVAICGGGEIQR

SEQ ID NO: 868972 - protein, 23 aa, Mycobacterium
TTSFARAYGLPPAAYRASMPSAA

SEQ ID NO: 868973 - protein, 17 aa, Mycobacterium
TTSGTFSPTLQAGIALA

SEQ ID NO: 868974 - protein, 26 aa, Mycobacterium
TTSITLVPVFAFEQVFRYVDQDKAEH

SEQ ID NO: 868975 - protein, 18 aa, Mycobacterium
TTSLLDYNRAGVPLIEIV

SEQ ID NO: 868976 - protein, 25 aa, Mycobacterium
TTSMLHAMLTAAGLPNLLCGNIGSP

SEQ ID NO: 868977 - protein, 22 aa, Mycobacterium
TTSMVLQAALMVLLHKLGAGDD

SEQ ID NO: 868978 - protein, 23 aa, Mycobacterium
TTSPAGFSFHRGPCNHISPTSTP

SEQ ID NO: 868979 - protein, 34 aa, Mycobacterium
TTSRAGRRIAPLRKLPPARPLPRRRACRRVDGHQ

SEQ ID NO: 868980 - protein, 27 aa, Mycobacterium
TTSRPRWAAVDRWLPPAPPVDAEQARA

SEQ ID NO: 868981 - protein, 19 aa, Mycobacterium
TTSTALTWTLALLSRCPAA

SEQ ID NO: 868982 - protein, 23 aa, Mycobacterium
TTSTVLTYALWALGRHSQLQDRV

SEQ ID NO: 868983 - protein, 25 aa, Mycobacterium
TTTAAVWLRYWVDEIKKPKVRPNTY

SEQ ID NO: 868984 - protein, 28 aa, Mycobacterium
TTTADLNLSFPISLPISIDIGKIVIESF

SEQ ID NO: 868985 - protein, 33 aa, Mycobacterium
TTTATVLAQALLKAGLRLVAAGVNPIALGAGIG

SEQ ID NO: 868986 - protein, 18 aa, Mycobacterium
TTTDFRTFTSGPLVGRAA

SEQ ID NO: 868987 - protein, 24 aa, Mycobacterium
TTTDPIALNFVWDQLYHYEVGPRT

SEQ ID NO: 868988 - protein, 34 aa, Mycobacterium
TTTFELTERGLLLDPPALLRKVSALRSGGVRIAL

SEQ ID NO: 868989 - protein, 18 aa, Mycobacterium
TTTFGAAAGVRRGNALPS

SEQ ID NO: 868990 - protein, 26 aa, Mycobacterium
TTTFPDIVRILPVGRLLNGRVLLIND

SEQ ID NO: 868991 - protein, 20 aa, Mycobacterium
TTTIGVDWPPGADVPVDDMH

SEQ ID NO: 868992 - protein, 21 aa, Mycobacterium
TTTINILSTLIRPSSGRASVA

SEQ ID NO: 868993 - protein, 24 aa, Mycobacterium
TTTIVPIITSFLERHNLVGTPMVV

SEQ ID NO: 868994 - protein, 17 aa, Mycobacterium
TTTKISWQYGSHTALNF

SEQ ID NO: 868995 - protein, 24 aa, Mycobacterium
TTTKRLKWITAAAAVHIPAVSYAG

SEQ ID NO: 868996 - protein, 28 aa, Mycobacterium
TTTKTIRFYEDLGLLPPPARSASGYRDY

SEQ ID NO: 868997 - protein, 17 aa, Mycobacterium
TTTLAMFNLAAKGAAMA

SEQ ID NO: 868998 - protein, 23 aa, Mycobacterium
TTTLGLRVRLPWHTTRTPVTAAA

SEQ ID NO: 868999 - protein, 30 aa, Mycobacterium
TTTLKLSMYVLNSAFYKPALLSRDMQALDL

SEQ ID NO: 869000 - protein, 22 aa, Mycobacterium
TTTMRMILGLDRPTSGTATIDG

SEQ ID NO: 869001 - protein, 29 aa, Mycobacterium
TTTPKVEGSWFWVDGQNAHWRPEHYYAPG

SEQ ID NO: 869002 - protein, 23 aa, Mycobacterium
TTTQLALPGGMQPLWGPDVRRVM

SEQ ID NO: 869003 - protein, 25 aa, Mycobacterium
TTTRLLPRFDTMTYRELWADVRAIA

SEQ ID NO: 869004 - protein, 24 aa, Mycobacterium
TTTSMLIVALQHSGFDPSFAVGGE

SEQ ID NO: 869005 - protein, 19 aa, Mycobacterium
TTTTYLVEAGLRSAGRVAG

SEQ ID NO: 869006 - protein, 33 aa, Mycobacterium
TTTTYLVPTKTLPLVQLLPFLKSQEASLKAKID

SEQ ID NO: 869007 - protein, 18 aa, Mycobacterium
TTTVVFATAYYALVDLAA

SEQ ID NO: 869008 - protein, 25 aa, Mycobacterium
TTTWTSTVAAYRQLPKPLQDLADNL

SEQ ID NO: 869009 - protein, 18 aa, Mycobacterium
TTTYLVEAGLRAAGRVAG

SEQ ID NO: 869010 - protein, 25 aa, Mycobacterium
TTVAQDYLKVIWKAQEWSLEKVSTK

SEQ ID NO: 869011 - protein, 24 aa, Mycobacterium
TTVAQDYLKVIWTAQEWSHEKVST

SEQ ID NO: 869012 - protein, 26 aa, Mycobacterium
TTVASSRWPAVRFAIRNTIVQGPNAV

SEQ ID NO: 869013 - protein, 24 aa, Mycobacterium
TTVATGLIGALRQAGRRVAPFKVG

SEQ ID NO: 869014 - protein, 35 aa, Mycobacterium
TTVDRVAFHWWLVLATLRWGVICRFQAERHLSGQH

SEQ ID NO: 869015 - protein, 20 aa, Mycobacterium
TTVFVIVPRNLEAVTQVIVP

SEQ ID NO: 869016 - protein, 24 aa, Mycobacterium
TTVGDPLLDLAWALLGYDGEEPRA

SEQ ID NO: 869017 - protein, 30 aa, Mycobacterium
TTVGDPLTDLGWLEMLWAQPVGINSHPAAP

SEQ ID NO: 869018 - protein, 24 aa, Mycobacterium
TTVGKYWVVDDIRPAFIHANAVVF

SEQ ID NO: 869019 - protein, 20 aa, Mycobacterium
TTVHMALVRTPMISPTTIYD

SEQ ID NO: 869020 - protein, 25 aa, Mycobacterium
TTVHPAVVTANRSLLATLVATNLLG

SEQ ID NO: 869021 - protein, 17 aa, Mycobacterium
TTVLDEEQLWGTLLASA

SEQ ID NO: 869022 - protein, 23 aa, Mycobacterium
TTVLLASPRSFCAGVHRAIEAVE

SEQ ID NO: 869023 - protein, 22 aa, Mycobacterium
TTVMEPRWRDGLSASVRAGLRQ

SEQ ID NO: 869024 - protein, 25 aa, Mycobacterium
TTVMKAIWESLLLRGKDAEQLTLDF

SEQ ID NO: 869025 - protein, 23 aa, Mycobacterium
TTVMLAELAAKHLPPGVLNVVTG

SEQ ID NO: 869026 - protein, 25 aa, Mycobacterium
TTVPFVDLYAPLNFMVSLHTAMAEP

SEQ ID NO: 869027 - protein, 44 aa, Mycobacterium
TTVPGPVQFVLLDGWKDLYLPVVRLLEPVLPAGALILADNTESA

SEQ ID NO: 869028 - protein, 25 aa, Mycobacterium
TTVPKVWFHDLIRPEGRPFQDIEVL

SEQ ID NO: 869029 - protein, 18 aa, Mycobacterium
TTVPSYNLNLFLDGIEQA

SEQ ID NO: 869030 - protein, 18 aa, Mycobacterium
TTVRISGPIVAVDPALAD

SEQ ID NO: 869031 - protein, 22 aa, Mycobacterium
TTVRYRAPYATQWQELELDTAM

SEQ ID NO: 869032 - protein, 19 aa, Mycobacterium
TTVSIWMGSLLTDRVRAII

SEQ ID NO: 869033 - protein, 25 aa, Mycobacterium
TTVSTVLQAAWAQLLMVLTGQDDVA

SEQ ID NO: 869034 - protein, 32 aa, Mycobacterium
TTVSTVLQAAWAQLLMWLTGQHDVTFGTAVSG

SEQ ID NO: 869035 - protein, 32 aa, Mycobacterium
TTVSTVLQAAWAQLLMWLTGQHDVVFGTAVSG

SEQ ID NO: 869036 - protein, 32 aa, Mycobacterium
TTVSTVLQAAWAQLLMWLTGQTDVAFGTAVSG

SEQ ID NO: 869037 - protein, 17 aa, Mycobacterium
TTVVLPLQDIGVRAVEL

SEQ ID NO: 869038 - protein, 20 aa, Mycobacterium
TTVYFALVRTRMIEPTPVLG

SEQ ID NO: 869039 - protein, 35 aa, Mycobacterium
TTVYKSMMLSGVPNLVFALGYTNISWTLKVDLVCE

SEQ ID NO: 869040 - protein, 17 aa, Mycobacterium
TTWAQMLAVWQAADDID

SEQ ID NO: 869041 - protein, 22 aa, Mycobacterium
TTWPKLVARPRLGLSLLAEDHE

SEQ ID NO: 869042 - protein, 19 aa, Mycobacterium
TTWRTGDAALPLTYRFEPG

SEQ ID NO: 869043 - protein, 18 aa, Mycobacterium
TTYGVTFPLLAKTDVNGD

SEQ ID NO: 869044 - protein, 27 aa, Mycobacterium
TTYHQATIRMFGLPESGLAETLRAAQT

SEQ ID NO: 869045 - protein, 25 aa, Mycobacterium
TTYHVDWPERVPDLGPIAAAALAAS

SEQ ID NO: 869046 - protein, 30 aa, Mycobacterium
TTYLIPSPTLPMLLPLEQIGVPAPIVAGLN

SEQ ID NO: 869047 - protein, 25 aa, Mycobacterium
TTYNGQFPGPLLRFTEGKQITVDVH

SEQ ID NO: 869048 - protein, 24 aa, Mycobacterium
TTYPLLLHEAYVRLYPAQVIKQAD

SEQ ID NO: 869049 - protein, 24 aa, Mycobacterium
TTYPLLLHEAYVRLYPTQVIKQAD

SEQ ID NO: 869050 - protein, 25 aa, Mycobacterium
TTYSYWFEPNPYWSRLYAPGTELKS

SEQ ID NO: 869051 - protein, 23 aa, Mycobacterium
TVAAAILGLLAPGGRIIAGRIVF

SEQ ID NO: 869052 - protein, 22 aa, Mycobacterium
TVAAGLYHFSLLDIIDIGDIND

SEQ ID NO: 869053 - protein, 23 aa, Mycobacterium
TVAAHLYKVFPKLGITRRNQLHA

SEQ ID NO: 869054 - protein, 20 aa, Mycobacterium
TVAALLGCAVLTGGGAVLNV

SEQ ID NO: 869055 - protein, 20 aa, Mycobacterium
TVAALTADRSRAGGGVCAIA

SEQ ID NO: 869056 - protein, 18 aa, Mycobacterium
TVAAPQWVISVAALGDLG

SEQ ID NO: 869057 - protein, 24 aa, Mycobacterium
TVAARRFRWQALVDGEPVITAAVN

SEQ ID NO: 869058 - protein, 27 aa, Mycobacterium
TVAATVASAWRFGPGEVLWTAMPLFHL

SEQ ID NO: 869059 - protein, 21 aa, Mycobacterium
TVAAVLGIAPVLDALTALAAG

SEQ ID NO: 869060 - protein, 26 aa, Mycobacterium
TVADGRKLPWFGPPMSAASMATARLM

SEQ ID NO: 869061 - protein, 18 aa, Mycobacterium
TVADLFEFLSIRELSRHL

SEQ ID NO: 869062 - protein, 25 aa, Mycobacterium
TVADLLGHLWSIESWVRQILRTREL

SEQ ID NO: 869063 - protein, 25 aa, Mycobacterium
TVADLVALRFGPQVVARLVDPLLGG

SEQ ID NO: 869064 - protein, 23 aa, Mycobacterium
TVADMMIYLAWTMGGRGAQEGRS

SEQ ID NO: 869065 - protein, 26 aa, Mycobacterium
TVADRMRLLTFFIGDTAMPGLQVTGA

SEQ ID NO: 869066 - protein, 29 aa, Mycobacterium
TVADTALGLILMTLRRFGAADRYVRAGKW

SEQ ID NO: 869067 - protein, 35 aa, Mycobacterium
TVAFPAWRDMSLARRSAILFNFRELLNARKEELAA

SEQ ID NO: 869068 - protein, 18 aa, Mycobacterium
TVAGGGFCWGYHSELDLV

SEQ ID NO: 869069 - protein, 29 aa, Mycobacterium
TVAINYLGGVGLVLRLLPGMRARGSGHIV

SEQ ID NO: 869070 - protein, 22 aa, Mycobacterium
TVAMLMRFQRATSLLALSARRG

SEQ ID NO: 869071 - protein, 20 aa, Mycobacterium
TVAMLRLVADPTAGPAALRV

SEQ ID NO: 869072 - protein, 29 aa, Mycobacterium
TVAMPSTPANYFHLLRRHALDGITRPMVV

SEQ ID NO: 869073 - protein, 18 aa, Mycobacterium
TVAPLAILVDAAAGIVNH

SEQ ID NO: 869074 - protein, 26 aa, Mycobacterium
TVAQELLPALDLITEALHIAQQAGNV

SEQ ID NO: 869075 - protein, 19 aa, Mycobacterium
TVAQRLRLSVRTVEGHVYR

SEQ ID NO: 869076 - protein, 20 aa, Mycobacterium
TVAQRRLPLLIASGADVHVI

SEQ ID NO: 869077 - protein, 23 aa, Mycobacterium
TVAQRRLPLLLANGADVHVITRA

SEQ ID NO: 869078 - protein, 24 aa, Mycobacterium
TVAQVAIGLLRQQLAPGQMMHGIV

SEQ ID NO: 869079 - protein, 26 aa, Mycobacterium
TVAQVAIGLLRQQLAPGQMVHGIVTN

SEQ ID NO: 869080 - protein, 18 aa, Mycobacterium
TVARALLDLFNPAQLDVL

SEQ ID NO: 869081 - protein, 26 aa, Mycobacterium
TVARDRPRRLFFAARSRFADDVTARA

SEQ ID NO: 869082 - protein, 31 aa, Mycobacterium
TVAREGLRPLIFALWDMVAAYRAAQPAAVPR

SEQ ID NO: 869083 - protein, 22 aa, Mycobacterium
TVARLLALFAEQAQLAGKARLR

SEQ ID NO: 869084 - protein, 26 aa, Mycobacterium
TVARRGGIVILPQDLPVPAVQQTVQF

SEQ ID NO: 869085 - protein, 26 aa, Mycobacterium
TVARRGGIVVLPQDLPITAVSETVDF

SEQ ID NO: 869086 - protein, 25 aa, Mycobacterium
TVARRGGIVVLPQDLPPSAVRHTVD

SEQ ID NO: 869087 - protein, 25 aa, Mycobacterium
TVARRGGLVVLPQDLPITAVQQTVE

SEQ ID NO: 869088 - protein, 20 aa, Mycobacterium
TVARTAAGAFYQRLRELYAE

SEQ ID NO: 869089 - protein, 23 aa, Mycobacterium
TVARWPALTPARLAARVDRIVAH

SEQ ID NO: 869090 - protein, 36 aa, Mycobacterium
TVATDRFAALPTAERWQLLAGSWLDLPSRPALIGTR

SEQ ID NO: 869091 - protein, 24 aa, Mycobacterium
TVATFCIVSFPFPGQVFTPPYAVA

SEQ ID NO: 869092 - protein, 24 aa, Mycobacterium
TVATGLIGALRRAGHTVAPFKVGP

SEQ ID NO: 869093 - protein, 20 aa, Mycobacterium
TVATGLYQFSLLDVIDIADI

SEQ ID NO: 869094 - protein, 25 aa, Mycobacterium
TVATGRWPGVRFAVRNTAVQGPNAV

SEQ ID NO: 869095 - protein, 23 aa, Mycobacterium
TVATPYLIQPLAHGADVVVHSAT

SEQ ID NO: 869096 - protein, 22 aa, Mycobacterium
TVATVPWTTDRLLNVLTRETET

SEQ ID NO: 869097 - protein, 22 aa, Mycobacterium
TVATVVPVLEPDGIRSGTAVTT

SEQ ID NO: 869098 - protein, 25 aa, Mycobacterium
TVAVAKMLGIPRALAERVKRTPAIR

SEQ ID NO: 869099 - protein, 23 aa, Mycobacterium
TVAVARVLGIPRALAEKVKRTPA

SEQ ID NO: 869100 - protein, 25 aa, Mycobacterium
TVAVLPAAANDPLITALQAAAVPHR

SEQ ID NO: 869101 - protein, 30 aa, Mycobacterium
TVAVMPFFHGHGLVAVLLSTLAGGGKVLLP

SEQ ID NO: 869102 - protein, 30 aa, Mycobacterium
TVAVMPLYHGHGLLAALLATLASGGAVLLP

SEQ ID NO: 869103 - protein, 30 aa, Mycobacterium
TVAVMPLYHGHGLLAALLATLASGGTVLLP

SEQ ID NO: 869104 - protein, 27 aa, Mycobacterium
TVAVMPLYHGHGLMAALLSTLASGGAV

SEQ ID NO: 869105 - protein, 25 aa, Mycobacterium
TVAVMPLYHGHGLMAALLSTLVSGG

SEQ ID NO: 869106 - protein, 33 aa, Mycobacterium
TVAVRLPAHWQTAGVLLGIWWAGAELVFGDAST

SEQ ID NO: 869107 - protein, 27 aa, Mycobacterium
TVAVRPRKPLLPPPQQPLGRAPMHRRV

SEQ ID NO: 869108 - protein, 17 aa, Mycobacterium
TVAYGLTNSFFFGYGEN

SEQ ID NO: 869109 - protein, 22 aa, Mycobacterium
TVCALLSDWLPATTGTVIFADG

SEQ ID NO: 869110 - protein, 19 aa, Mycobacterium
TVCALLSDWLPATTGTVIY

SEQ ID NO: 869111 - protein, 18 aa, Mycobacterium
TVCILDRPRHAKLMEEVR

SEQ ID NO: 869112 - protein, 39 aa, Mycobacterium
TVCLTPVFSASRFLPDVRYFGATFFTYVGKALAYLMATP

SEQ ID NO: 869113 - protein, 20 aa, Mycobacterium
TVDADWLVRMLGAGADMVLG

SEQ ID NO: 869114 - protein, 18 aa, Mycobacterium
TVDALIGYSLRGAPRGRA

SEQ ID NO: 869115 - protein, 21 aa, Mycobacterium
TVDANLKLGLPADARDYGTGA

SEQ ID NO: 869116 - protein, 22 aa, Mycobacterium
TVDARLIDLLPAAPADANAPVD

SEQ ID NO: 869117 - protein, 30 aa, Mycobacterium
TVDATTYDPIILDFLWENTYHYDIGPRIFG

SEQ ID NO: 869118 - protein, 28 aa, Mycobacterium
TVDAVTFDLRWKAACGLPITAAAFHSTT

SEQ ID NO: 869119 - protein, 26 aa, Mycobacterium
TVDAVTFDLRWKAACGLPVTAGAFHS

SEQ ID NO: 869120 - protein, 17 aa, Mycobacterium
TVDEWRPGTLGKALPPY

SEQ ID NO: 869121 - protein, 25 aa, Mycobacterium
TVDEYPNWRLPLPETLEELRADPRV

SEQ ID NO: 869122 - protein, 21 aa, Mycobacterium
TVDFVLVVVGVKPDVELAADA

SEQ ID NO: 869123 - protein, 18 aa, Mycobacterium
TVDFYLGLSNYVNNWLRL

SEQ ID NO: 869124 - protein, 26 aa, Mycobacterium
TVDFYSNILGMPLIKSLDLPGGAGQH

SEQ ID NO: 869125 - protein, 23 aa, Mycobacterium
TVDGPAFHNLGATAAWELAATIG

SEQ ID NO: 869126 - protein, 23 aa, Mycobacterium
TVDGPAFHNLGATAAWELAGTVA

SEQ ID NO: 869127 - protein, 17 aa, Mycobacterium
TVDGPLRFELIDAATGV

SEQ ID NO: 869128 - protein, 25 aa, Mycobacterium
TVDHAQLNWPYGCGGIMLGTHKPDA

SEQ ID NO: 869129 - protein, 30 aa, Mycobacterium
TVDHYAEIGLLGFALITDALGGVDVCLNAP

SEQ ID NO: 869130 - protein, 18 aa, Mycobacterium
TVDLALAWRDGVDNPVVD

SEQ ID NO: 869131 - protein, 17 aa, Mycobacterium
TVDLMRQLGLSGPDQVT

SEQ ID NO: 869132 - protein, 18 aa, Mycobacterium
TVDMRCLLIIGSTQTRWQ

SEQ ID NO: 869133 - protein, 28 aa, Mycobacterium
TVDNHINPLVWGALTPRIISLDVEYFGV

SEQ ID NO: 869134 - protein, 24 aa, Mycobacterium
TVDPEIWVPWGYAVVRVDSRGAGR

SEQ ID NO: 869135 - protein, 23 aa, Mycobacterium
TVDPFHDFWLPDYCPRCNPLGHN

SEQ ID NO: 869136 - protein, 24 aa, Mycobacterium
TVDPIDVYRILRVTNPSPYMYLIQ

SEQ ID NO: 869137 - protein, 18 aa, Mycobacterium
TVDPLLFPTADGAGLFAL

SEQ ID NO: 869138 - protein, 22 aa, Mycobacterium
TVDPWTRQPWARVALGGAEEAA

SEQ ID NO: 869139 - protein, 32 aa, Mycobacterium
TVDQAIERIGLLGQPFLFFVDTGRDRGSVLYH

SEQ ID NO: 869140 - protein, 30 aa, Mycobacterium
TVDQTGLPFSRIRILLRLSRGSMTVKEVAH

SEQ ID NO: 869141 - protein, 30 aa, Mycobacterium; identical to SEQ ID NO: 741325

SEQ ID NO: 869142 - protein, 32 aa, Mycobacterium
TVDRIASTLLLDRDWLLIKTDFLMHAARHPDL

SEQ ID NO: 869143 - protein, 24 aa, Mycobacterium
TVDSAIVAALIFSRGLDALGATIA

SEQ ID NO: 869144 - protein, 34 aa, Mycobacterium
TVDSISVLMTQNRVRHVPVLDGQKLIGIVSIGDV

SEQ ID NO: 869145 - protein, 34 aa, Mycobacterium
TVDSLSVLMTNNRVRHVPVLDGKKLIGIVSIGDV

SEQ ID NO: 869146 - protein, 26 aa, Mycobacterium
TVDYPPVNAIPSRGWFELADALTAAG

SEQ ID NO: 869147 - protein, 26 aa, Mycobacterium
TVDYPPVNAIPSRGWFELADAVTAAG

SEQ ID NO: 869148 - protein, 26 aa, Mycobacterium
TVEAAELYVFPLAAPHLTPMPRAELP

SEQ ID NO: 869149 - protein, 29 aa, Mycobacterium
TVEAHLISPWGTWEWLRPNIVGGALPARG

SEQ ID NO: 869150 - protein, 24 aa, Mycobacterium
TVEAVRPLFTKYVTKLRTRARARL

SEQ ID NO: 869151 - protein, 20 aa, Mycobacterium
TVEDLLHHYPRRYSTDFSLR

SEQ ID NO: 869152 - protein, 27 aa, Mycobacterium
TVEDRTAQWAAFLPADIAGALAAAQGP

SEQ ID NO: 869153 - protein, 26 aa, Mycobacterium
TVEDVRTIYLAAWRARVKGITVYRYG

SEQ ID NO: 869154 - protein, 26 aa, Mycobacterium
TVEEGKLWLLQTRAAKRSAQAAVRLA

SEQ ID NO: 869155 - protein, 23 aa, Mycobacterium
TVEEVLRYLPPSNLGALRYAVED

SEQ ID NO: 869156 - protein, 20 aa, Mycobacterium
TVEFVKSRDLVLDTPVVLAP

SEQ ID NO: 869157 - protein, 19 aa, Mycobacterium
TVEFYLDLSNYVNNWRKLG

SEQ ID NO: 869158 - protein, 24 aa, Mycobacterium
TVEGHLYRLFTKLGVNNRDQLVQL

SEQ ID NO: 869159 - protein, 28 aa, Mycobacterium
TVEGPAGELLPLMSLPAQMQQDLIDLLP

SEQ ID NO: 869160 - protein, 29 aa, Mycobacterium
TVEHYDRHLTLDGLRLVFERNRANQRGKL

SEQ ID NO: 869161 - protein, 22 aa, Mycobacterium
TVEIPKIVINRFDLTGFNVGNV

SEQ ID NO: 869162 - protein, 37 aa, Mycobacterium
TVELAFDVTPPPWLEPGQWWALVRVGCAGGLVYSPAV

SEQ ID NO: 869163 - protein, 23 aa, Mycobacterium
TVELNASFYRWPKDSTFAGWRAQ

SEQ ID NO: 869164 - protein, 24 aa, Mycobacterium
TVELNASFYRWPRDSTFAGWRTQL

SEQ ID NO: 869165 - protein, 19 aa, Mycobacterium
TVELPRLMDNPHVNRIVVI

SEQ ID NO: 869166 - protein, 31 aa, Mycobacterium
TVELPTYAFQRRHYWLAAPTPTPATVSDPAE

SEQ ID NO: 869167 - protein, 23 aa, Mycobacterium
TVELQDRLFAEAFRVLRPGGVFA

SEQ ID NO: 869168 - protein, 24 aa, Mycobacterium
TVENGKLWLLQTRSAERSAQAAVR

SEQ ID NO: 869169 - protein, 25 aa, Mycobacterium
TVENGPELVWLGAAIIIGAGSTSFE

SEQ ID NO: 869170 - protein, 23 aa, Mycobacterium
TVEQIYEYTAANSDLKRLPTTDE

SEQ ID NO: 869171 - protein, 36 aa, Mycobacterium
TVEQNALGLINAPTQTLLGRPLIGDGAAGTATNPNG

SEQ ID NO: 869172 - protein, 24 aa, Mycobacterium
TVERFRTTLLPKAIGAYHLDRLTK

SEQ ID NO: 869173 - protein, 27 aa, Mycobacterium
TVERIITLHGPAGRPMLGLVSPQANTG

SEQ ID NO: 869174 - protein, 18 aa, Mycobacterium
TVERIYRMYADGAGLRFI

SEQ ID NO: 869175 - protein, 17 aa, Mycobacterium
TVESGDTLWAIAERFYG

SEQ ID NO: 869176 - protein, 27 aa, Mycobacterium
TVESRAYKMWLPPLVDPTPLDELVARD

SEQ ID NO: 869177 - protein, 37 aa, Mycobacterium
TVEVLAGLKPAFRNELWQQRFPGLDWKVTAGNSSPIN

SEQ ID NO: 869178 - protein, 19 aa, Mycobacterium
TVEVRVPLVGGKIENFIGS

SEQ ID NO: 869179 - protein, 32 aa, Mycobacterium
TVEVTLNGHHWLKDVYIQDGLLRLGSETVEDR

SEQ ID NO: 869180 - protein, 27 aa, Mycobacterium
TVEYLVEAVFNYPTFSEAYKVAALDVM

SEQ ID NO: 869181 - protein, 19 aa, Mycobacterium
TVFARAPRRVVTEVPLWST

SEQ ID NO: 869182 - protein, 19 aa, Mycobacterium
TVFARIYHPPAAGATSAVY

SEQ ID NO: 869183 - protein, 17 aa, Mycobacterium
TVFDFTVQWALDRHTFG

SEQ ID NO: 869184 - protein, 24 aa, Mycobacterium
TVFDPFGYAHVRRVERRLLAEYTD

SEQ ID NO: 869185 - protein, 23 aa, Mycobacterium
TVFDRLRFEINLGFQPFNFELAM

SEQ ID NO: 869186 - protein, 26 aa, Mycobacterium
TVFEHLGRLLIIDCGVLFPTHDEPGV

SEQ ID NO: 869187 - protein, 26 aa, Mycobacterium
TVFEHLGRLLIVDCGVLFPGHDEPGV

SEQ ID NO: 869188 - protein, 26 aa, Mycobacterium
TVFEHLGRLLIVDCGVLFPTHDEPGV

SEQ ID NO: 869189 - protein, 21 aa, Mycobacterium
TVFEIDLPKVLEFKAQVLAQQ

SEQ ID NO: 869190 - protein, 25 aa, Mycobacterium
TVFEPFFDCWAVRPGGGWGWAVEPP

SEQ ID NO: 869191 - protein, 20 aa, Mycobacterium
TVFFDYPPHPRTIAHTVRGF

SEQ ID NO: 869192 - protein, 22 aa, Mycobacterium
TVFHIHLHVLPRRDGDKLSVAK

SEQ ID NO: 869193 - protein, 21 aa, Mycobacterium
TVFHIHLHVLPRRNGDKLSVA

SEQ ID NO: 869194 - protein, 33 aa, Mycobacterium
TVFNSARWHVSVWPDVPILLVCGQLTVRRAIAT

SEQ ID NO: 869195 - protein, 17 aa, Mycobacterium
TVFQRLAPGIMPLSVAE

SEQ ID NO: 869196 - protein, 20 aa, Mycobacterium
TVFQRTPIYVGPKPDWRYNG

SEQ ID NO: 869197 - protein, 20 aa, Mycobacterium
TVFQRTPPWMVPKDDRPYSA

SEQ ID NO: 869198 - protein, 20 aa, Mycobacterium
TVFQSILRPMHEKIVGRIAV

SEQ ID NO: 869199 - protein, 26 aa, Mycobacterium
TVFTDVLTWALTERAIPRIGKGWLTR

SEQ ID NO: 869200 - protein, 18 aa, Mycobacterium
TVFTLDLQNQVIAHAAGF

SEQ ID NO: 869201 - protein, 21 aa, Mycobacterium
TVFTRQFRAVWRPGAPPTGAA

SEQ ID NO: 869202 - protein, 17 aa, Mycobacterium
TVFVTQHRITQLMRLHA

SEQ ID NO: 869203 - protein, 18 aa, Mycobacterium
TVFYCVANMPGAVPRTST

SEQ ID NO: 869204 - protein, 22 aa, Mycobacterium
TVGAAWYLRDIGRPIKTLQVPA

SEQ ID NO: 869205 - protein, 19 aa, Mycobacterium
TVGAFNLPGLAIPSLTIPS

SEQ ID NO: 869206 - protein, 25 aa, Mycobacterium
TVGAIRAMRDGHATVFMAMGGNFAS

SEQ ID NO: 869207 - protein, 17 aa, Mycobacterium
TVGAWLWSGRRGVLAGV

SEQ ID NO: 869208 - protein, 19 aa, Mycobacterium
TVGDIPPEWEDRAHNAIAN

SEQ ID NO: 869209 - protein, 25 aa, Mycobacterium
TVGDKLWAPTFVRDFPVETTPLTRA

SEQ ID NO: 869210 - protein, 19 aa, Mycobacterium
TVGDPLLDLGWLLVCWPDG

SEQ ID NO: 869211 - protein, 29 aa, Mycobacterium
TVGDPLTDIGWLEMLWMQPVGVNSHPAAL

SEQ ID NO: 869212 - protein, 26 aa, Mycobacterium
TVGDTLWAPTFVRDFPVETTPLTRPH

SEQ ID NO: 869213 - protein, 25 aa, Mycobacterium
TVGEATLAGLRFAREHRMAAPAAGS

SEQ ID NO: 869214 - protein, 21 aa, Mycobacterium
TVGHSVAEAAWWFITMERSCQ

SEQ ID NO: 869215 - protein, 25 aa, Mycobacterium
TVGKRLMHVLGTSAYVPDLLMRAPE

SEQ ID NO: 869216 - protein, 17 aa, Mycobacterium
TVGLIADRLLPGGVLHV

SEQ ID NO: 869217 - protein, 34 aa, Mycobacterium
TVGLRSSYIASWYAAPLLAAQDRALIAFTSSPGS

SEQ ID NO: 869218 - protein, 29 aa, Mycobacterium
TVGLTLCYDIRFPELYVELADRGAEIITA

SEQ ID NO: 869219 - protein, 34 aa, Mycobacterium
TVGMVTTMRRAGLIAPLRPDKYLRIVAAMARENM

SEQ ID NO: 869220 - protein, 35 aa, Mycobacterium
TVGPELDLAAWARAFPLLVPVFDAARGRALIRWDN

SEQ ID NO: 869221 - protein, 24 aa, Mycobacterium
TVGPYTYLRPGTVLGDDGKLGAFV

SEQ ID NO: 869222 - protein, 21 aa, Mycobacterium
TVGQGGNLALGGQGGTGGAAG

SEQ ID NO: 869223 - protein, 23 aa, Mycobacterium
TVGQWVMRGLADLVPNMESRLTQ

SEQ ID NO: 869224 - protein, 20 aa, Mycobacterium
TVGRHLKWLAALAGTEVRRI

SEQ ID NO: 869225 - protein, 20 aa, Mycobacterium
TVGRIWKALGLKPHLVDTFK

SEQ ID NO: 869226 - protein, 30 aa, Mycobacterium
TVGRLVFLAPMGEFPIYLDLFAARHGFGRR

SEQ ID NO: 869227 - protein, 17 aa, Mycobacterium
TVGRTLAALTLSLRTRR

SEQ ID NO: 869228 - protein, 20 aa, Mycobacterium
TVGRTLAVLTLRMPTRKGRY

SEQ ID NO: 869229 - protein, 24 aa, Mycobacterium
TVGRYSPFAVYLPGGDPGRLEPVR

SEQ ID NO: 869230 - protein, 27 aa, Mycobacterium
TVGRYSPYAVYLLGGDPGLLAPVRDGQ

SEQ ID NO: 869231 - protein, 25 aa, Mycobacterium
TVGRYSPYAVYLPGGDPGRLAPVRD

SEQ ID NO: 869232 - protein, 32 aa, Mycobacterium
TVGSHVPNLPWPWGLIDLTARVLIPASATVRE

SEQ ID NO: 869233 - protein, 29 aa, Mycobacterium
TVGSRFLDRLNTLPDTKPGVDYLVVSTND

SEQ ID NO: 869234 - protein, 24 aa, Mycobacterium
TVGSSPIIAPLELLAYAAACTTRL

SEQ ID NO: 869235 - protein, 21 aa, Mycobacterium
TVGWPGDLPWHITSRGIGGRR

SEQ ID NO: 869236 - protein, 24 aa, Mycobacterium
TVHCVYKPVAGEQPLWDFPDGTLA

SEQ ID NO: 869237 - protein, 24 aa, Mycobacterium
TVHCVYKPVSGEQPLWDFPDGTLA

SEQ ID NO: 869238 - protein, 17 aa, Mycobacterium
TVHDFLTTLSLPQMVVG

SEQ ID NO: 869239 - protein, 33 aa, Mycobacterium
TVHINIGLLAKFMPNFLFVPDAALPLIPRRDDA

SEQ ID NO: 869240 - protein, 20 aa, Mycobacterium
TVHIRGFSLWGAVGIARKAR

SEQ ID NO: 869241 - protein, 18 aa, Mycobacterium
TVHLLGQPWSELTEKERR

SEQ ID NO: 869242 - protein, 29 aa, Mycobacterium
TVHNPTVLGAEQPLPVLVAALGPVMLQIA

SEQ ID NO: 869243 - protein, 26 aa, Mycobacterium
TVHPSGHILVRSCRGGYMHSVALSEG

SEQ ID NO: 869244 - protein, 26 aa, Mycobacterium
TVHPSGHILVRSCRGGYMHSVTLSEG

SEQ ID NO: 869245 - protein, 26 aa, Mycobacterium
TVHPTTMRLLDELGLWEPFAALPFTE

SEQ ID NO: 869246 - protein, 27 aa, Mycobacterium
TVHPTTMRLLDELGLWERFAELPFSEV

SEQ ID NO: 869247 - protein, 26 aa, Mycobacterium
TVHQHVLVTYRDALYAPCRRIAGQSM

SEQ ID NO: 869248 - protein, 18 aa, Mycobacterium
TVHRLWRGDPITFQRNGI

SEQ ID NO: 869249 - protein, 21 aa, Mycobacterium
TVHRVLTRYGLAKLRWLDRAT

SEQ ID NO: 869250 - protein, 17 aa, Mycobacterium
TVHRYIELVAKGSADDL

SEQ ID NO: 869251 - protein, 18 aa, Mycobacterium
TVHVTFRRLMRADIFGAH

SEQ ID NO: 869252 - protein, 32 aa, Mycobacterium
TVHYRPRPVVGIIAPWNYPVANALMDAIGALA

SEQ ID NO: 869253 - protein, 27 aa, Mycobacterium
TVICNGIETARWPFAARRPRTGPAELL

SEQ ID NO: 869254 - protein, 26 aa, Mycobacterium
TVIDMLANSAFYYGALRTLAEADPQP

SEQ ID NO: 869255 - protein, 28 aa, Mycobacterium
TVIDMMANAAFYYGLLRTLSEEDRPIWT

SEQ ID NO: 869256 - protein, 18 aa, Mycobacterium
TVIDPRWVLPVPDGVREL

SEQ ID NO: 869257 - protein, 17 aa, Mycobacterium
TVIEIDFEAIYSGELLV

SEQ ID NO: 869258 - protein, 21 aa, Mycobacterium
TVIHHWTPATAPAWAKPVLAA

SEQ ID NO: 869259 - protein, 19 aa, Mycobacterium
TVILPADFSWGPAEVPAAE

SEQ ID NO: 869260 - protein, 33 aa, Mycobacterium
TVISSGLMNTGFLPFWNQPVYIDYSPAGTGTTV

SEQ ID NO: 869261 - protein, 33 aa, Mycobacterium
TVITEYRGLSVSALATLRRSLGASATYAVAKNT

SEQ ID NO: 869262 - protein, 27 aa, Mycobacterium
TVKDLLPLLEKVIQGGKPLLIIAEDVE

SEQ ID NO: 869263 - protein, 27 aa, Mycobacterium
TVKDLLPLLEKVIQSGKPLLIIAEDVE

SEQ ID NO: 869264 - protein, 20 aa, Mycobacterium
TVKFVFDRWLSTDPPSSPIF

SEQ ID NO: 869265 - protein, 17 aa, Mycobacterium
TVKIRIENLKKAFGDLV

SEQ ID NO: 869266 - protein, 22 aa, Mycobacterium
TVKIVMRVYFEKPRTTIGWKGL

SEQ ID NO: 869267 - protein, 18 aa, Mycobacterium
TVKPVLRDLAPEPRLVVG

SEQ ID NO: 869268 - protein, 24 aa, Mycobacterium
TVKRTSMELGGNAPFIVFDDADPE

SEQ ID NO: 869269 - protein, 18 aa, Mycobacterium
TVKRVFLELGGKSAAIML

SEQ ID NO: 869270 - protein, 17 aa, Mycobacterium
TVKRVFLELGGKSAVIM

SEQ ID NO: 869271 - protein, 18 aa, Mycobacterium
TVKRVFLELGGKSAVIML

SEQ ID NO: 869272 - protein, 24 aa, Mycobacterium
TVKSRLHYSLKRLRLILAEMGCHA

SEQ ID NO: 869273 - protein, 19 aa, Mycobacterium
TVKTFKRARGQVWLMPHNP

SEQ ID NO: 869274 - protein, 26 aa, Mycobacterium
TVKVNRLLLRNVSVVGVGWGEFVRRN

SEQ ID NO: 869275 - protein, 27 aa, Mycobacterium
TVLAHPWVSVASDGWMLAPSGPGRPHP

SEQ ID NO: 869276 - protein, 18 aa, Mycobacterium
TVLAPRREQLTGDEAHER

SEQ ID NO: 869277 - protein, 20 aa, Mycobacterium
TVLAQALVKAGLRNVAAGAN

SEQ ID NO: 869278 - protein, 28 aa, Mycobacterium
TVLARNTFHWVLAFAHRGLSTPKVFGEL

SEQ ID NO: 869279 - protein, 18 aa, Mycobacterium
TVLAWLDGRLRLEREELA

SEQ ID NO: 869280 - protein, 19 aa, Mycobacterium
TVLAWRERLARLVFGETPT

SEQ ID NO: 869281 - protein, 24 aa, Mycobacterium
TVLDMLANSAFYYGALRSLAEAEQ

SEQ ID NO: 869282 - protein, 23 aa, Mycobacterium
TVLELAEVIWRKMRPDTPFRYES

SEQ ID NO: 869283 - protein, 24 aa, Mycobacterium
TVLELAEVIWRKMRPDTPFRYESD

SEQ ID NO: 869284 - protein, 17 aa, Mycobacterium
TVLFPDNPVARESVGRY

SEQ ID NO: 869285 - protein, 28 aa, Mycobacterium
TVLGALAHQDYPFALLVERLRPSRDLSY

SEQ ID NO: 869286 - protein, 20 aa, Mycobacterium
TVLGSKFAIPDPPPGGYVIV

SEQ ID NO: 869287 - protein, 27 aa, Mycobacterium
TVLHAAWAQLLAWLTGQHDVAFGTTVS

SEQ ID NO: 869288 - protein, 20 aa, Mycobacterium
TVLHDIAWRAMQVHGALGVT

SEQ ID NO: 869289 - protein, 33 aa, Mycobacterium
TVLIVSHVTPIKTLLRLALDAGPAMLYRLHLDL

SEQ ID NO: 869290 - protein, 17 aa, Mycobacterium
TVLKRAFKHRTVEKRYH

SEQ ID NO: 869291 - protein, 18 aa, Mycobacterium
TVLLAISRTNGCQYCVAA

SEQ ID NO: 869292 - protein, 20 aa, Mycobacterium
TVLLATLIRAAVMTALDSPD

SEQ ID NO: 869293 - protein, 17 aa, Mycobacterium
TVLLATLVRAAVMSALE

SEQ ID NO: 869294 - protein, 18 aa, Mycobacterium
TVLLNCHYPIDANSFVLQ

SEQ ID NO: 869295 - protein, 17 aa, Mycobacterium
TVLLPLDGTRMMRVIRT

SEQ ID NO: 869296 - protein, 33 aa, Mycobacterium
TVLMSPVSFLQRPARWMQLLAKESHAFSASPNF

SEQ ID NO: 869297 - protein, 31 aa, Mycobacterium
TVLPNGRPHLVAMWYAILDGEIWFETKAKSQ

SEQ ID NO: 869298 - protein, 20 aa, Mycobacterium
TVLPTAVFTGELRGAALAAA

SEQ ID NO: 869299 - protein, 18 aa, Mycobacterium
TVLQAAGADEVSAAVAAL

SEQ ID NO: 869300 - protein, 27 aa, Mycobacterium
TVLQAAWALLLTWLTGQDDVVFGTAVS

SEQ ID NO: 869301 - protein, 27 aa, Mycobacterium
TVLQGAWAQLLMWLTGQHDVAFGTAVS

SEQ ID NO: 869302 - protein, 18 aa, Mycobacterium
TVLRFRAFTRDSVGLSSA

SEQ ID NO: 869303 - protein, 22 aa, Mycobacterium
TVLRPHTGGQKRVFATGDTLGA

SEQ ID NO: 869304 - protein, 27 aa, Mycobacterium
TVLSRNTFHWVLAFARSGLSTPAVFTE

SEQ ID NO: 869305 - protein, 26 aa, Mycobacterium
TVLSRNTFHWVLTFAHSGLSTPAVFT

SEQ ID NO: 869306 - protein, 33 aa, Mycobacterium
TVLSTRLDPEPYRLLVGGYRDLVQRIVDRHDGR

SEQ ID NO: 869307 - protein, 18 aa, Mycobacterium
TVLTAMVTPFAPDGSLDT

SEQ ID NO: 869308 - protein, 18 aa, Mycobacterium
TVLTLVTHALYALSLRDP

SEQ ID NO: 869309 - protein, 32 aa, Mycobacterium
TVLVVSHVTPIKTLLRLALDAGPSVLYRLHLD

SEQ ID NO: 869310 - protein, 19 aa, Mycobacterium
TVLWARMLDRLAGASPPAI

SEQ ID NO: 869311 - protein, 19 aa, Mycobacterium
TVLYGPSTGGSGGAGGAGG

SEQ ID NO: 869312 - protein, 18 aa, Mycobacterium
TVMALFQRERAKAPTEIP

SEQ ID NO: 869313 - protein, 17 aa, Mycobacterium
TVMAPNFNPGPNPFGPP

SEQ ID NO: 869314 - protein, 27 aa, Mycobacterium
TVMDVRFLPNPHWIDRLRPHTGQNADV

SEQ ID NO: 869315 - protein, 25 aa, Mycobacterium
TVMEDYYHRPFRDLVARAADRAEAP

SEQ ID NO: 869316 - protein, 20 aa, Mycobacterium
TVMHVVEPMIVNWPVPPVQG

SEQ ID NO: 869317 - protein, 19 aa, Mycobacterium
TVMLGYWNRPQETAATLRQ

SEQ ID NO: 869318 - protein, 23 aa, Mycobacterium
TVMLRMPLHPVAIELLREVGPLA

SEQ ID NO: 869319 - protein, 19 aa, Mycobacterium
TVMRTLLPRLHGDALTVDG

SEQ ID NO: 869320 - protein, 19 aa, Mycobacterium
TVMSNLGLHLAMRAAGIDV

SEQ ID NO: 869321 - protein, 20 aa, Mycobacterium
TVMSNLGLHLAMRAAGVTVR

SEQ ID NO: 869322 - protein, 19 aa, Mycobacterium
TVMSNLGLHLAMRSAGITV

SEQ ID NO: 869323 - protein, 27 aa, Mycobacterium
TVNCLRIQLMAFAYDGAWAEYTVAQAA

SEQ ID NO: 869324 - protein, 17 aa, Mycobacterium
TVNERFGFPDMPPPYVV

SEQ ID NO: 869325 - protein, 22 aa, Mycobacterium
TVNGWFKRVYDLGLPLNIHANG

SEQ ID NO: 869326 - protein, 17 aa, Mycobacterium
TVNIGDLLEYWSGRRWP

SEQ ID NO: 869327 - protein, 18 aa, Mycobacterium
TVNLAGLFGGRRQLIVYR

SEQ ID NO: 869328 - protein, 17 aa, Mycobacterium
TVNLGWSSWATQWLSTL

SEQ ID NO: 869329 - protein, 28 aa, Mycobacterium
TVNLVAPDVPIAPPGPRPAETTAAIMEA

SEQ ID NO: 869330 - protein, 17 aa, Mycobacterium
TVNPMAKRMSRMGLAYL

SEQ ID NO: 869331 - protein, 28 aa, Mycobacterium
TVNTLMQMAWALVLSRLTDRDDVVFGVT

SEQ ID NO: 869332 - protein, 23 aa, Mycobacterium
TVNTLMQMAWALVLSRLTDTDDV

SEQ ID NO: 869333 - protein, 23 aa, Mycobacterium
TVNTLMQMAWALVLSRLTDTHDV

SEQ ID NO: 869334 - protein, 30 aa, Mycobacterium
TVNTVLQAAWAQLLMWMTGQRDVVFGTAVS

SEQ ID NO: 869335 - protein, 22 aa, Mycobacterium
TVNTVLQAGWAQLLMRLTGHHD

SEQ ID NO: 869336 - protein, 19 aa, Mycobacterium
TVNYRLGVLGFLDLTSLDT

SEQ ID NO: 869337 - protein, 23 aa, Mycobacterium
TVPAGSAMLLLFGAANRDPRRYT

SEQ ID NO: 869338 - protein, 19 aa, Mycobacterium
TVPAQWLPGARELRAWVLA

SEQ ID NO: 869339 - protein, 18 aa, Mycobacterium
TVPCPGLDRLAAGAGALV

SEQ ID NO: 869340 - protein, 24 aa, Mycobacterium
TVPERNHLLLKAATLHQRLGSPGD

SEQ ID NO: 869341 - protein, 17 aa, Mycobacterium
TVPETIMGLRNLALRYD

SEQ ID NO: 869342 - protein, 17 aa, Mycobacterium
TVPFPLGPTHPSNLKLL

SEQ ID NO: 869343 - protein, 37 aa, Mycobacterium
TVPGAGPLYYPRFLTELPYLGQALLLGIPGPSSASIL

SEQ ID NO: 869344 - protein, 18 aa, Mycobacterium
TVPGFPNLFISSAPNYSP

SEQ ID NO: 869345 - protein, 24 aa, Mycobacterium
TVPGSLTAWPQDPAGSLPGPELGR

SEQ ID NO: 869346 - protein, 26 aa, Mycobacterium
TVPGSRWVFPQWDTTTTTLPPPPPRA

SEQ ID NO: 869347 - protein, 17 aa, Mycobacterium
TVPIPGEINRFVFAMPE

SEQ ID NO: 869348 - protein, 17 aa, Mycobacterium
TVPLPRDHWQQVIDPQT

SEQ ID NO: 869349 - protein, 30 aa, Mycobacterium
TVPNALIDQLLLRGALVRGLQVCAALDRIV

SEQ ID NO: 869350 - protein, 19 aa, Mycobacterium
TVPNRIWMSPMCQYSAAPA

SEQ ID NO: 869351 - protein, 26 aa, Mycobacterium
TVPNWHEAAIIYLGATLAGMVVNPIL

SEQ ID NO: 869352 - protein, 17 aa, Mycobacterium
TVPPALILENRLQLVTL

SEQ ID NO: 869353 - protein, 19 aa, Mycobacterium
TVPPFFPQGSLAAPPPSTA

SEQ ID NO: 869354 - protein, 30 aa, Mycobacterium
TVPPGKLGWGWAKFAFNGWKALSWVDENVW

SEQ ID NO: 869355 - protein, 20 aa, Mycobacterium
TVPPVRFIKTIGDAVMFVCP

SEQ ID NO: 869356 - protein, 18 aa, Mycobacterium
TVPSLFMAGTKDPVLSFA

SEQ ID NO: 869357 - protein, 19 aa, Mycobacterium
TVPTIEWDGRPWTYRQRIC

SEQ ID NO: 869358 - protein, 17 aa, Mycobacterium
TVPVAVKLSPYFSATAD

SEQ ID NO: 869359 - protein, 19 aa, Mycobacterium
TVPVLVVPNPLLAEEFAAL

SEQ ID NO: 869360 - protein, 20 aa, Mycobacterium
TVPVYDYVLATEPLTGEQLD

SEQ ID NO: 869361 - protein, 26 aa, Mycobacterium
TVPYRANMWALRALGARRVFAPCAVG

SEQ ID NO: 869362 - protein, 27 aa, Mycobacterium
TVPYRANMWALRKLGVRRIFGPCAVGS

SEQ ID NO: 869363 - protein, 26 aa, Mycobacterium
TVPYRANMWALRKLGVRRVLAPCAVG

SEQ ID NO: 869364 - protein, 29 aa, Mycobacterium
TVQAEPSQWFPYFPVRVGAMTPAWCSGPG

SEQ ID NO: 869365 - protein, 20 aa, Mycobacterium
TVQALIRWDPVGHAATELAA

SEQ ID NO: 869366 - protein, 28 aa, Mycobacterium
TVQASMWRGMFPARLFRLGPEDEPVAAF

SEQ ID NO: 869367 - protein, 19 aa, Mycobacterium
TVQFALRTRGRLAAGETVL

SEQ ID NO: 869368 - protein, 25 aa, Mycobacterium
TVQHYDRHLTLDGLRLVFERNRDNQ

SEQ ID NO: 869369 - protein, 26 aa, Mycobacterium
TVQLTAYLRALPADGWLRVMCTATQI

SEQ ID NO: 869370 - protein, 27 aa, Mycobacterium
TVQLTAYLRGLPADGWLRVMCTTVQIG

SEQ ID NO: 869371 - protein, 29 aa, Mycobacterium
TVQLTTYLRTLPADGWLRVLCSTNQIGQH

SEQ ID NO: 869372 - protein, 23 aa, Mycobacterium
TVQNILALRFANQFWDPIWNAHY

SEQ ID NO: 869373 - protein, 19 aa, Mycobacterium
TVQPLEKLFGAATARPVIP

SEQ ID NO: 869374 - protein, 17 aa, Mycobacterium
TVQPLEKLFGTATARPV

SEQ ID NO: 869375 - protein, 19 aa, Mycobacterium
TVQPLEKLFGTATARPVIP

SEQ ID NO: 869376 - protein, 18 aa, Mycobacterium
TVQRRGVRPLLDELAVID

SEQ ID NO: 869377 - protein, 19 aa, Mycobacterium
TVQRYLPGFNTANDPRRAT

SEQ ID NO: 869378 - protein, 28 aa, Mycobacterium
TVQSVDRALLVLELLADLGKAGVTEVAD

SEQ ID NO: 869379 - protein, 20 aa, Mycobacterium
TVQTLYLAWGSKRALLRGYL

SEQ ID NO: 869380 - protein, 24 aa, Mycobacterium
TVQVDELFGYKPDWGLPGPADVEA

SEQ ID NO: 869381 - protein, 34 aa, Mycobacterium
TVQVVETWVERPHYLPLFVAPQPIPEAIDEDNGT

SEQ ID NO: 869382 - protein, 18 aa, Mycobacterium
TVQWALDRHTFGRPLASY

SEQ ID NO: 869383 - protein, 17 aa, Mycobacterium
TVQYGTAIVLLVTTVLL

SEQ ID NO: 869384 - protein, 18 aa, Mycobacterium
TVRAAGAVLWRDASEHGG

SEQ ID NO: 869385 - protein, 29 aa, Mycobacterium
TVRALLEAGHSVRLLVLPQEQDAPVIDRL

SEQ ID NO: 869386 - protein, 17 aa, Mycobacterium
TVRALYHDWEREEAPEL

SEQ ID NO: 869387 - protein, 26 aa, Mycobacterium
TVRDIEVSGPWYRNLLGTDPMLDEHT

SEQ ID NO: 869388 - protein, 25 aa, Mycobacterium
TVRDLAVSGPWYRALIGADPVLDER

SEQ ID NO: 869389 - protein, 23 aa, Mycobacterium
TVREFLYRTLNAFGTRFVGSAEQ

SEQ ID NO: 869390 - protein, 17 aa, Mycobacterium
TVRFTVEIPDRADLAFL

SEQ ID NO: 869391 - protein, 18 aa, Mycobacterium
TVRGGAFVRLSFAGPSSD

SEQ ID NO: 869392 - protein, 19 aa, Mycobacterium
TVRGQRILRQCSVCLYAGS

SEQ ID NO: 869393 - protein, 18 aa, Mycobacterium
TVRGQRLLQTCPVCLYAG

SEQ ID NO: 869394 - protein, 21 aa, Mycobacterium
TVRHFLSHPALVASETRRLVE

SEQ ID NO: 869395 - protein, 27 aa, Mycobacterium
TVRHLEVIALTPARLLMVVITDTGRVD

SEQ ID NO: 869396 - protein, 19 aa, Mycobacterium
TVRILFDPAVVPDSAVDIG

SEQ ID NO: 869397 - protein, 20 aa, Mycobacterium
TVRIPVPDLPSPYSLAVVQL

SEQ ID NO: 869398 - protein, 20 aa, Mycobacterium
TVRLHIPIIGRVRVPHVDHL

SEQ ID NO: 869399 - protein, 18 aa, Mycobacterium
TVRLHLLHTLQTLSPHVR

SEQ ID NO: 869400 - protein, 23 aa, Mycobacterium
TVRLPAHYVIKHVTLGYAATIDS

SEQ ID NO: 869401 - protein, 19 aa, Mycobacterium
TVRMFGIQKAFMEVLSQGT

SEQ ID NO: 869402 - protein, 18 aa, Mycobacterium
TVRNHLRWIAATHRIASR

SEQ ID NO: 869403 - protein, 24 aa, Mycobacterium
TVRNRPYVERLRLAIAGHPAPDSI

SEQ ID NO: 869404 - protein, 17 aa, Mycobacterium
TVRPIMYRAALSEMVVP

SEQ ID NO: 869405 - protein, 21 aa, Mycobacterium
TVRPQLPAAWGRVALTDLRLG

SEQ ID NO: 869406 - protein, 30 aa, Mycobacterium
TVRQRLAAFITPIPVPLRDGTQLMLRPVLP

SEQ ID NO: 869407 - protein, 22 aa, Mycobacterium
TVRQRLAAFITPVPVRIRDGTQ

SEQ ID NO: 869408 - protein, 23 aa, Mycobacterium
TVRRAPLVVPRYGVRITVMTRPP

SEQ ID NO: 869409 - protein, 23 aa, Mycobacterium
TVRRARLLGYEHVSLGLSSDEEK

SEQ ID NO: 869410 - protein, 26 aa, Mycobacterium
TVRRDPMAMLPFLGYNVGDYFAHWIN

SEQ ID NO: 869411 - protein, 25 aa, Mycobacterium
TVRRDPMAMLPFLGYNVGDYFQHWI

SEQ ID NO: 869412 - protein, 25 aa, Mycobacterium
TVRRDPMAMLPFMGYHVGDYLNHWI

SEQ ID NO: 869413 - protein, 18 aa, Mycobacterium
TVRRFGRMFIAGARLTVP

SEQ ID NO: 869414 - protein, 21 aa, Mycobacterium
TVRRLEARLAQWAAALEAGTG

SEQ ID NO: 869415 - protein, 18 aa, Mycobacterium
TVRRLLTTVYQRTADGEL

SEQ ID NO: 869416 - protein, 17 aa, Mycobacterium
TVRRSAPFATLPRSVYE

SEQ ID NO: 869417 - protein, 24 aa, Mycobacterium
TVRRSIHLTPFGEDFCRAVIPTDP

SEQ ID NO: 869418 - protein, 18 aa, Mycobacterium
TVRRTPGRLYGLVNIAGG

SEQ ID NO: 869419 - protein, 20 aa, Mycobacterium
TVRSDFWELVDYATAHHVGV

SEQ ID NO: 869420 - protein, 17 aa, Mycobacterium
TVRTFTIVTFAAPGIPT

SEQ ID NO: 869421 - protein, 23 aa, Mycobacterium
TVRTRFFDDFFLDATNAGIKQAV

SEQ ID NO: 869422 - protein, 20 aa, Mycobacterium
TVRTRIYTGKPARLLKTKWT

SEQ ID NO: 869423 - protein, 24 aa, Mycobacterium
TVRVRVWVGAARFPHLARSRGDGA

SEQ ID NO: 869424 - protein, 18 aa, Mycobacterium
TVRVVRQPWWAPIVDVGP

SEQ ID NO: 869425 - protein, 19 aa, Mycobacterium
TVRYRLRKMAEITTLSLDD

SEQ ID NO: 869426 - protein, 20 aa, Mycobacterium
TVRYRLRKMAELTNLSLDDA

SEQ ID NO: 869427 - protein, 20 aa, Mycobacterium
TVSAHWDWVCDTLSPHDVTA

SEQ ID NO: 869428 - protein, 25 aa, Mycobacterium
TVSDEAVLAAARRLRIIAATPQART

SEQ ID NO: 869429 - protein, 25 aa, Mycobacterium
TVSDEAVLAAARRLRILPAASATRA

SEQ ID NO: 869430 - protein, 20 aa, Mycobacterium
TVSFTPVLIPTSRGILATCT

SEQ ID NO: 869431 - protein, 18 aa, Mycobacterium
TVSLWTKLALESARARRS

SEQ ID NO: 869432 - protein, 25 aa, Mycobacterium
TVSMDWYSRCITGMRLSPTTKSIDV

SEQ ID NO: 869433 - protein, 20 aa, Mycobacterium
TVSPQLYIALGISGAIQHRA

SEQ ID NO: 869434 - protein, 29 aa, Mycobacterium
TVSRDGLRPLIFALWEMVKKYRDAQPVAA

SEQ ID NO: 869435 - protein, 29 aa, Mycobacterium
TVSRFAEALQLIRLLWNADGPIDFTGRYF

SEQ ID NO: 869436 - protein, 27 aa, Mycobacterium
TVSRPGARRHLLSWGIGECGICGAKLR

SEQ ID NO: 869437 - protein, 23 aa, Mycobacterium
TVSRPVILLVSDAAMRDAAGARL

SEQ ID NO: 869438 - protein, 30 aa, Mycobacterium
TVSSIFLMCLPDRVLAYGDCAIIPNPTPEQ

SEQ ID NO: 869439 - protein, 32 aa, Mycobacterium
TVSSIFLMCLPDRVLAYGDCAIIPNPTVEELA

SEQ ID NO: 869440 - protein, 24 aa, Mycobacterium
TVSSLVLDPPFGLRVQAYAPRRQK

SEQ ID NO: 869441 - protein, 24 aa, Mycobacterium
TVSSTPWPEQWPKPSRVEQGGMVF

SEQ ID NO: 869442 - protein, 17 aa, Mycobacterium
TVSTGLIGALRAAGHTV

SEQ ID NO: 869443 - protein, 18 aa, Mycobacterium
TVSTVLQGAWAQLLMWLT

SEQ ID NO: 869444 - protein, 21 aa, Mycobacterium
TVSVLPYRFGTHSGWLEASYD

SEQ ID NO: 869445 - protein, 24 aa, Mycobacterium
TVSVPVSFHELALGTTLSVPTLEG

SEQ ID NO: 869446 - protein, 26 aa, Mycobacterium
TVSVRLSYWLVARAETLRRPVVAVVV

SEQ ID NO: 869447 - protein, 28 aa, Mycobacterium
TVSVTPMDFLGDPLLWAKLISTYRGSMT

SEQ ID NO: 869448 - protein, 22 aa, Mycobacterium
TVSWLASDVPSLGWKTYQLIPT

SEQ ID NO: 869449 - protein, 28 aa, Mycobacterium
TVTADRTIPADAAVPPQPSRASSSAVAA

SEQ ID NO: 869450 - protein, 27 aa, Mycobacterium
TVTAGQPLIWLEAMKMEHTISAPTDGV

SEQ ID NO: 869451 - protein, 24 aa, Mycobacterium
TVTAGQPLIWLEAMKMEHTITAPV

SEQ ID NO: 869452 - protein, 23 aa, Mycobacterium
TVTAMSWLALGADMEHLPLSASP

SEQ ID NO: 869453 - protein, 25 aa, Mycobacterium
TVTATVAVGKYPWGVAVDPNTRTVY

SEQ ID NO: 869454 - protein, 26 aa, Mycobacterium
TVTAVRTVWPEHLPLFVRVSATDWLS

SEQ ID NO: 869455 - protein, 24 aa, Mycobacterium
TVTDLTFQGPVVRLSLAAPDDSTI

SEQ ID NO: 869456 - protein, 31 aa, Mycobacterium
TVTDTFWVNLIGRGYPAPRPKFRWCTERLKI

SEQ ID NO: 869457 - protein, 18 aa, Mycobacterium
TVTFVDIAGIVKGASEGA

SEQ ID NO: 869458 - protein, 20 aa, Mycobacterium
TVTGGIPSIALSLAPTASLT

SEQ ID NO: 869459 - protein, 23 aa, Mycobacterium
TVTGWREISPHYLRLSFDDGGML

SEQ ID NO: 869460 - protein, 29 aa, Mycobacterium
TVTHPQKIRDLLATVYRLIADGTLPLPEI

SEQ ID NO: 869461 - protein, 26 aa, Mycobacterium
TVTLEDALKLLSLPRVVGVDPQTGEE

SEQ ID NO: 869462 - protein, 27 aa, Mycobacterium
TVTLEDALKLLSLPRVVGVDPTTNEEI

SEQ ID NO: 869463 - protein, 27 aa, Mycobacterium
TVTLEDALRLLSLPRVVGVDPASGEEI

SEQ ID NO: 869464 - protein, 17 aa, Mycobacterium
TVTLLQTLRAAVGRPTS

SEQ ID NO: 869465 - protein, 24 aa, Mycobacterium
TVTLPGAAVWHMAWSDKDDAIDWQ

SEQ ID NO: 869466 - protein, 17 aa, Mycobacterium
TVTLPKAHIKQIGSYVL

SEQ ID NO: 869467 - protein, 22 aa, Mycobacterium
TVTNALTALQRVNSVAVDLDAD

SEQ ID NO: 869468 - protein, 37 aa, Mycobacterium
TVTPGAWHLARMLEALDTWPMNVALLGKGNTVSSEAM

SEQ ID NO: 869469 - protein, 37 aa, Mycobacterium
TVTPGAWHLGRMLQALDGWPMNILMLGKGNTVNPDAM

SEQ ID NO: 869470 - protein, 18 aa, Mycobacterium
TVTPLIKRWFRAEVRGLE

SEQ ID NO: 869471 - protein, 17 aa, Mycobacterium
TVTPLRAFPVIRDLVTD

SEQ ID NO: 869472 - protein, 26 aa, Mycobacterium
TVTPTGWPYLQYRSGPAGFVRHLGGN

SEQ ID NO: 869473 - protein, 25 aa, Mycobacterium
TVTQLDVSLRRFGIDTTFVGGTDPA

SEQ ID NO: 869474 - protein, 26 aa, Mycobacterium
TVTQVAIGLLRQQLAPGQMVHGIVTD

SEQ ID NO: 869475 - protein, 27 aa, Mycobacterium
TVTRADLLIGAVLLPGGKAPELVSNSL

SEQ ID NO: 869476 - protein, 18 aa, Mycobacterium
TVTRWRQRRGQPTPAPLL

SEQ ID NO: 869477 - protein, 26 aa, Mycobacterium
TVTTKIGFLPPPYFQAETIADFMVLG

SEQ ID NO: 869478 - protein, 24 aa, Mycobacterium
TVTTKVGFLPPPYFEATTIEEFMD

SEQ ID NO: 869479 - protein, 26 aa, Mycobacterium
TVTTKVSFLPPPYFQAETIADFMVLG

SEQ ID NO: 869480 - protein, 24 aa, Mycobacterium
TVTTLPALILDIIDSGGVLPRLAA

SEQ ID NO: 869481 - protein, 20 aa, Mycobacterium
TVTVAAYLDGRVHQIALSPK

SEQ ID NO: 869482 - protein, 17 aa, Mycobacterium
TVTVGVAEALIAAKEAE

SEQ ID NO: 869483 - protein, 25 aa, Mycobacterium
TVTVKTVATGILTPGLHGLHVHEIG

SEQ ID NO: 869484 - protein, 18 aa, Mycobacterium
TVTVLLLGGRMRGRTLAT

SEQ ID NO: 869485 - protein, 19 aa, Mycobacterium
TVTVLLRRSAAGNRGRQVA

SEQ ID NO: 869486 - protein, 25 aa, Mycobacterium
TVTVPELLVVRRAPGVWHLVSTVAA

SEQ ID NO: 869487 - protein, 25 aa, Mycobacterium
TVTVPELLVVRRAPGVWHLVSTVSA

SEQ ID NO: 869488 - protein, 23 aa, Mycobacterium
TVVAAPKLLQPLSLRSYTEGAQS

SEQ ID NO: 869489 - protein, 24 aa, Mycobacterium
TVVAIPIFAQGLTLPMGLASMAMV

SEQ ID NO: 869490 - protein, 17 aa, Mycobacterium
TVVAKLLTLFGTEEQKR

SEQ ID NO: 869491 - protein, 17 aa, Mycobacterium
TVVAKLLTLFGTEEQKT

SEQ ID NO: 869492 - protein, 17 aa, Mycobacterium
TVVAKLLTLFGTEEQRR

SEQ ID NO: 869493 - protein, 19 aa, Mycobacterium
TVVAKLLTLFGTQEQKRAY

SEQ ID NO: 869494 - protein, 19 aa, Mycobacterium
TVVALDRPGYGASAPYPEA

SEQ ID NO: 869495 - protein, 20 aa, Mycobacterium
TVVALHRVAYLLYTQRKRME

SEQ ID NO: 869496 - protein, 25 aa, Mycobacterium
TVVALHRVAYLLYTQRKRMESHGVL

SEQ ID NO: 869497 - protein, 24 aa, Mycobacterium
TVVANAATRWVWLAEATNLDIDTI

SEQ ID NO: 869498 - protein, 26 aa, Mycobacterium
TVVAQPALFALQYALTTTFAAHGVRP

SEQ ID NO: 869499 - protein, 26 aa, Mycobacterium
TVVCVLTHDPKFDVPLLEVALRLPDI

SEQ ID NO: 869500 - protein, 29 aa, Mycobacterium
TVVDMLANSAFFYGLLRSLSEGDDPVWGS

SEQ ID NO: 869501 - protein, 29 aa, Mycobacterium
TVVDMLANSSFFYGMLRSLSEADSPLWDR

SEQ ID NO: 869502 - protein, 19 aa, Mycobacterium
TVVDSALFHALPVTRRDDY

SEQ ID NO: 869503 - protein, 19 aa, Mycobacterium
TVVDVNLNGTWRTIRAAVP

SEQ ID NO: 869504 - protein, 24 aa, Mycobacterium
TVVELYNLVVWNERNIELAEELLG

SEQ ID NO: 869505 - protein, 17 aa, Mycobacterium
TVVFAHGGGFVFCDLDS

SEQ ID NO: 869506 - protein, 19 aa, Mycobacterium
TVVFDRGGYSYGGRIAALA

SEQ ID NO: 869507 - protein, 18 aa, Mycobacterium
TVVFRRLHDGIAFGHTMV

SEQ ID NO: 869508 - protein, 20 aa, Mycobacterium
TVVIGLYPSWDISQNGLDAA

SEQ ID NO: 869509 - protein, 19 aa, Mycobacterium
TVVIVLPSPALLDDHEAAD

SEQ ID NO: 869510 - protein, 23 aa, Mycobacterium
TVVIVVFDGMKLLDVAGPAEVFA

SEQ ID NO: 869511 - protein, 24 aa, Mycobacterium
TVVLGCTHYPLLSGLIQLAMGEDV

SEQ ID NO: 869512 - protein, 25 aa, Mycobacterium
TVVLKPSPLTPLAGLALARIIDEHT

SEQ ID NO: 869513 - protein, 22 aa, Mycobacterium
TVVLPDAPVKIFLTASAETRAR

SEQ ID NO: 869514 - protein, 19 aa, Mycobacterium
TVVMSWRLRTRHGLPVHDI

SEQ ID NO: 869515 - protein, 19 aa, Mycobacterium
TVVPMTRPTLRETIARLAP

SEQ ID NO: 869516 - protein, 21 aa, Mycobacterium
TVVQPGVIVNLPMGNMVLSHG

SEQ ID NO: 869517 - protein, 24 aa, Mycobacterium
TVVQTCVIHLIRGTFRYAGRQHRD

SEQ ID NO: 869518 - protein, 24 aa, Mycobacterium
TVVRGPFRPFPRSVVHGEWALSPK

SEQ ID NO: 869519 - protein, 31 aa, Mycobacterium
TVVRRGDTPLPVRTPLAVQLPEPMAQQLREA

SEQ ID NO: 869520 - protein, 26 aa, Mycobacterium
TVVRRPLGVVASFTPWNGATILSWRA

SEQ ID NO: 869521 - protein, 33 aa, Mycobacterium
TVVSGLRNALLASGYRIAPRKLLLAVSERMLRS

SEQ ID NO: 869522 - protein, 33 aa, Mycobacterium
TVVSVPTLIGAGLPILFEALSPILQVGLTAQGV

SEQ ID NO: 869523 - protein, 26 aa, Mycobacterium
TVVTSFYDWSDIDPKWREAGIFPILS

SEQ ID NO: 869524 - protein, 26 aa, Mycobacterium
TVVTSFYDWSNIDPKWREAGIFPILS

SEQ ID NO: 869525 - protein, 19 aa, Mycobacterium
TVVVFGWHRDMTALVGLAE

SEQ ID NO: 869526 - protein, 18 aa, Mycobacterium
TVVVLPGPPRELQPMWQA

SEQ ID NO: 869527 - protein, 23 aa, Mycobacterium
TVVVRLRPRPHQTFRELLAQTRD

SEQ ID NO: 869528 - protein, 29 aa, Mycobacterium
TVVVVAPMFHAWGFSQLIFAASMACTVVT

SEQ ID NO: 869529 - protein, 26 aa, Mycobacterium
TVVYDPELTLPLPPATAVVSGFNAIA

SEQ ID NO: 869530 - protein, 18 aa, Mycobacterium
TVWAVVGPLHRAVAPRLM

SEQ ID NO: 869531 - protein, 17 aa, Mycobacterium
TVWEIFGALLHGGRLVI

SEQ ID NO: 869532 - protein, 19 aa, Mycobacterium
TVWLITTAGERIVGSWQAG

SEQ ID NO: 869533 - protein, 27 aa, Mycobacterium
TVWSAEGLLIYLPPEAQDRLFASITEL

SEQ ID NO: 869534 - protein, 21 aa, Mycobacterium
TVWVRAGQRRTLAARAANLTT

SEQ ID NO: 869535 - protein, 17 aa, Mycobacterium
TVYDLLDITPPATVRGV

SEQ ID NO: 869536 - protein, 19 aa, Mycobacterium
TVYFALVRTRMIEPTPILG

SEQ ID NO: 869537 - protein, 22 aa, Mycobacterium
TVYHYYASKSLILFDIYRQAAE

SEQ ID NO: 869538 - protein, 27 aa, Mycobacterium
TVYHYYASKSLILYDIYKGAADFTVDA

SEQ ID NO: 869539 - protein, 24 aa, Mycobacterium
TVYIPTAIFDFPVTPSASGPHRID

SEQ ID NO: 869540 - protein, 24 aa, Mycobacterium
TVYIPTAIFDFPVTPTAAGPVKID

SEQ ID NO: 869541 - protein, 23 aa, Mycobacterium
TVYIPTAIFDFPVTPTASGPVRI

SEQ ID NO: 869542 - protein, 17 aa, Mycobacterium
TVYKEYLMRALPRVARA

SEQ ID NO: 869543 - protein, 25 aa, Mycobacterium
TVYLDEGFTPRLIAERLAEQELTVV

SEQ ID NO: 869544 - protein, 27 aa, Mycobacterium
TVYLSPAPIYHAAPLRFCGFVQSMGGT

SEQ ID NO: 869545 - protein, 19 aa, Mycobacterium
TVYLSTAGGYFALDIASGR

SEQ ID NO: 869546 - protein, 19 aa, Mycobacterium
TVYPQDKLPPLDLQAPPPA

SEQ ID NO: 869547 - protein, 29 aa, Mycobacterium
TVYQRTPIWVMPKLDFPFGRAAQRLFAKV

SEQ ID NO: 869548 - protein, 21 aa, Mycobacterium
TVYRLRLELPQIDPATLSLGR

SEQ ID NO: 869549 - protein, 17 aa, Mycobacterium
TVYRRFMGVPGKRMITY

SEQ ID NO: 869550 - protein, 19 aa, Mycobacterium
TVYRTLLLRVQPGTSEPTL

SEQ ID NO: 869551 - protein, 33 aa, Mycobacterium
TVYSFVMPQYPPLPFLQYPYVVALIELDEGVRI

SEQ ID NO: 869552 - protein, 20 aa, Mycobacterium
TVYVRATRVPPIAPTAAEPG

SEQ ID NO: 869553 - protein, 19 aa, Mycobacterium
TVYVTKPSRFFVLDATAFA

SEQ ID NO: 869554 - protein, 27 aa, Mycobacterium
TWAATILARQIWAATISVPRTSVNSTL

SEQ ID NO: 869555 - protein, 18 aa, Mycobacterium
TWALELWTAAHGVAAMLI

SEQ ID NO: 869556 - protein, 17 aa, Mycobacterium
TWALLGRQDLRAAEDAL

SEQ ID NO: 869557 - protein, 22 aa, Mycobacterium
TWALRTWGLPEYAGIDHAITTC

SEQ ID NO: 869558 - protein, 23 aa, Mycobacterium
TWANPWPMYRALRDHDPVHHVVP

SEQ ID NO: 869559 - protein, 19 aa, Mycobacterium
TWAPKSAGALAYRVLAREF

SEQ ID NO: 869560 - protein, 27 aa, Mycobacterium
TWAQHMSILSLFYRWALDEGHALAEPF

SEQ ID NO: 869561 - protein, 18 aa, Mycobacterium
TWASLRWFERRVVDAATG

SEQ ID NO: 869562 - protein, 30 aa, Mycobacterium
TWAVAMDRGGQLRWFGLDGVEHTGGPLIDL

SEQ ID NO: 869563 - protein, 25 aa, Mycobacterium
TWCALDTLIFPTILDRPASIESESP

SEQ ID NO: 869564 - protein, 30 aa, Mycobacterium
TWDCLVHVYLRRALTSTELWPVSLQEVGRG

SEQ ID NO: 869565 - protein, 31 aa, Mycobacterium
TWDDIAWLRELWGGPFMLKGVMRVDDAKRAV

SEQ ID NO: 869566 - protein, 20 aa, Mycobacterium
TWDLVRDGIFVGYQLDRVFA

SEQ ID NO: 869567 - protein, 25 aa, Mycobacterium
TWDPFPEFLNGLRSAGAQVVPIHVY

SEQ ID NO: 869568 - protein, 19 aa, Mycobacterium
TWDRRWPELGIDALAGSPR

SEQ ID NO: 869569 - protein, 30 aa, Mycobacterium
TWEDIAWLRELWGGPFMLKGVIRVDDAKRA

SEQ ID NO: 869570 - protein, 31 aa, Mycobacterium; identical to SEQ ID NO: 133020

SEQ ID NO: 869571 - protein, 28 aa, Mycobacterium
TWEDVAWLREQWGGPFLLKGLVRVDDAK

SEQ ID NO: 869572 - protein, 17 aa, Mycobacterium
TWEFQALLKARPAVGDP

SEQ ID NO: 869573 - protein, 34 aa, Mycobacterium
TWEHDAHLYLKRLLSWSAFLGGPDRYLTELGARL

SEQ ID NO: 869574 - protein, 26 aa, Mycobacterium
TWEHDLHLFLRRIKVDEAFNGSVAEH

SEQ ID NO: 869575 - protein, 28 aa, Mycobacterium
TWEHDLHLYLRRVALYRAMFGSPEDHHR

SEQ ID NO: 869576 - protein, 28 aa, Mycobacterium
TWEHDLHLYLRRVMLYRSMFGTPEEHNL

SEQ ID NO: 869577 - protein, 19 aa, Mycobacterium
TWEHPAHLFVRRARTGLQL

SEQ ID NO: 869578 - protein, 18 aa, Mycobacterium
TWERIAFDALNIYRQVSS

SEQ ID NO: 869579 - protein, 17 aa, Mycobacterium
TWERLPRMNFSVSPPEI

SEQ ID NO: 869580 - protein, 19 aa, Mycobacterium
TWERNVLGAIPYSTNRALL

SEQ ID NO: 869581 - protein, 24 aa, Mycobacterium
TWERRSVPFPAALAPELAALMVGK

SEQ ID NO: 869582 - protein, 26 aa, Mycobacterium
TWFQASPTIRYELIGSMPAGVSGKDV

SEQ ID NO: 869583 - protein, 19 aa, Mycobacterium
TWFWPADDFAPKLFSRVMS

SEQ ID NO: 869584 - protein, 18 aa, Mycobacterium
TWGALRREKSSFGTYILD

SEQ ID NO: 869585 - protein, 23 aa, Mycobacterium
TWGELFNIPLTAHFLGGAAIADS

SEQ ID NO: 869586 - protein, 18 aa, Mycobacterium
TWGGVYVHSAPWSVGSQG

SEQ ID NO: 869587 - protein, 19 aa, Mycobacterium
TWGGWIGMSPTLLPVAGQS

SEQ ID NO: 869588 - protein, 18 aa, Mycobacterium
TWGMQRMTDMLAARTRYI

SEQ ID NO: 869589 - protein, 19 aa, Mycobacterium
TWGREWDDYVRRLAGAAVA

SEQ ID NO: 869590 - protein, 18 aa, Mycobacterium
TWGVMGIGLGYSIAAAVE

SEQ ID NO: 869591 - protein, 19 aa, Mycobacterium
TWHAATNIMKLPMLSDWRR

SEQ ID NO: 869592 - protein, 25 aa, Mycobacterium
TWHIARPLPERAVIARAAQIIRSAT

SEQ ID NO: 869593 - protein, 17 aa, Mycobacterium
TWHLHQVPVFTRAGYRC

SEQ ID NO: 869594 - protein, 26 aa, Mycobacterium
TWHLNAGDVYFIPRAYPHHIEVIDCD

SEQ ID NO: 869595 - protein, 22 aa, Mycobacterium
TWHTMQEIWERGFKAVMADAVG

SEQ ID NO: 869596 - protein, 18 aa, Mycobacterium
TWIDRGGAWIGPGQDRIY

SEQ ID NO: 869597 - protein, 20 aa, Mycobacterium
TWIEIRFTLTDVVRSGGAPI

SEQ ID NO: 869598 - protein, 17 aa, Mycobacterium
TWISLLHGRTRASLAAT

SEQ ID NO: 869599 - protein, 27 aa, Mycobacterium
TWISTEYLFYRDADGDYWLAGRRGSVV

SEQ ID NO: 869600 - protein, 20 aa, Mycobacterium
TWKHIAPVQRAAWSRKTFEY

SEQ ID NO: 869601 - protein, 23 aa, Mycobacterium
TWKKSFGHHPLLAFLDRPEIAGG

SEQ ID NO: 869602 - protein, 17 aa, Mycobacterium
TWLCSVMGKSGLFSDYL

SEQ ID NO: 869603 - protein, 26 aa, Mycobacterium
TWLDDQPGYLPPVQLGEVIRAAGIGE

SEQ ID NO: 869604 - protein, 22 aa, Mycobacterium
TWLIAGFDELAAKVPGCVPIDR

SEQ ID NO: 869605 - protein, 17 aa, Mycobacterium
TWLSTFAPGAPFAIAVA

SEQ ID NO: 869606 - protein, 17 aa, Mycobacterium
TWMLQRAVGPQVARAAL

SEQ ID NO: 869607 - protein, 20 aa, Mycobacterium
TWNDEFVLRLSFTNWATSDD

SEQ ID NO: 869608 - protein, 17 aa, Mycobacterium
TWPDVDGFDSAVWAYFG

SEQ ID NO: 869609 - protein, 22 aa, Mycobacterium
TWPHTRDWLKRSFWDIPVAETR

SEQ ID NO: 869610 - protein, 20 aa, Mycobacterium
TWPKLRNRPRLGVSVLAEGH

SEQ ID NO: 869611 - protein, 33 aa, Mycobacterium
TWPKQYGGRDAPLLHWVIFEEEYFRAGAPGRAS

SEQ ID NO: 869612 - protein, 17 aa, Mycobacterium
TWPLIRSTGKLAVNVLA

SEQ ID NO: 869613 - protein, 17 aa, Mycobacterium
TWPNLRGAPRLGISVLG

SEQ ID NO: 869614 - protein, 18 aa, Mycobacterium
TWPVVFPELPPSADGGPC

SEQ ID NO: 869615 - protein, 18 aa, Mycobacterium
TWQGKFPYRNDGALGWVG

SEQ ID NO: 869616 - protein, 19 aa, Mycobacterium
TWQGRFPYRNDGALGWTGT

SEQ ID NO: 869617 - protein, 17 aa, Mycobacterium
TWQTHTGWLIVRDALVM

SEQ ID NO: 869618 - protein, 18 aa, Mycobacterium
TWQYWLATRSVKPEEYQF

SEQ ID NO: 869619 - protein, 17 aa, Mycobacterium
TWRAAWHEHTRTQQSRE

SEQ ID NO: 869620 - protein, 26 aa, Mycobacterium
TWRAGDLELPLSYRYQPGAADDGVTV

SEQ ID NO: 869621 - protein, 18 aa, Mycobacterium
TWRERFRYRPTQWAHRPT

SEQ ID NO: 869622 - protein, 18 aa, Mycobacterium
TWREYGTAALRAAAKLRA

SEQ ID NO: 869623 - protein, 37 aa, Mycobacterium
TWRNEKPVLLCRKVLIELLAWQFASPVRWIETQDLLF

SEQ ID NO: 869624 - protein, 17 aa, Mycobacterium
TWRNWPAKRAGTAAALW

SEQ ID NO: 869625 - protein, 17 aa, Mycobacterium
TWRSVIPPLSKKFRVIA

SEQ ID NO: 869626 - protein, 28 aa, Mycobacterium
TWSLPDPQAWWQMTWRGRPDPTLGEWWS

SEQ ID NO: 869627 - protein, 21 aa, Mycobacterium
TWSLVSSSLLKALDGAYRLSP

SEQ ID NO: 869628 - protein, 17 aa, Mycobacterium
TWSMVRDTVLDRVMSSP

SEQ ID NO: 869629 - protein, 24 aa, Mycobacterium
TWSNPAEYVAAIDALPLGPNIASL

SEQ ID NO: 869630 - protein, 24 aa, Mycobacterium
TWSRALLILLSETLPFKAHADALT

SEQ ID NO: 869631 - protein, 22 aa, Mycobacterium
TWSSAPNFAFDLAARKTTDKDL

SEQ ID NO: 869632 - protein, 21 aa, Mycobacterium
TWSSCISVTGPFPGFPVPLEG

SEQ ID NO: 869633 - protein, 18 aa, Mycobacterium
TWSSYADHRMATAGAIIG

SEQ ID NO: 869634 - protein, 19 aa, Mycobacterium
TWTAGRPCLSIHAAIVFTS

SEQ ID NO: 869635 - protein, 17 aa, Mycobacterium
TWTAGYLGLHDKPVVLL

SEQ ID NO: 869636 - protein, 25 aa, Mycobacterium
TWTEEQTYFFRLSAYADKLLAHYDA

SEQ ID NO: 869637 - protein, 25 aa, Mycobacterium
TWTEEQTYFFRLSAYADKLLAHYEA

SEQ ID NO: 869638 - protein, 20 aa, Mycobacterium
TWTPPELSIRFLQRISAPTE

SEQ ID NO: 869639 - protein, 18 aa, Mycobacterium
TWVAVSGLNLLYQGYLRV

SEQ ID NO: 869640 - protein, 17 aa, Mycobacterium
TWVPPRPADELETSFAW

SEQ ID NO: 869641 - protein, 25 aa, Mycobacterium
TWVRVPTMTFGHSPHHLFAAAVSLQ

SEQ ID NO: 869642 - protein, 18 aa, Mycobacterium
TWWAAVEDIGLLRDGIGV

SEQ ID NO: 869643 - protein, 18 aa, Mycobacterium
TWYTADTMRRYLTEAVRN

SEQ ID NO: 869644 - protein, 17 aa, Mycobacterium
TYAGKRLVRTYSGGMRR

SEQ ID NO: 869645 - protein, 24 aa, Mycobacterium
TYAKLRRLRRLAGIWLAAQGGSWS

SEQ ID NO: 869646 - protein, 23 aa, Mycobacterium
TYALYLILRHPDVLCRIQDEVAV

SEQ ID NO: 869647 - protein, 18 aa, Mycobacterium
TYANWLAQQDWTRPYQRH

SEQ ID NO: 869648 - protein, 22 aa, Mycobacterium
TYAPLNAWHVLGQPTIAVNANF

SEQ ID NO: 869649 - protein, 25 aa, Mycobacterium
TYAPPTVTFLDKSFLRTLDQRHLSN

SEQ ID NO: 869650 - protein, 17 aa, Mycobacterium
TYCSETCYWTDAVAFRG

SEQ ID NO: 869651 - protein, 17 aa, Mycobacterium
TYDHRLVDGADAGRFLT

SEQ ID NO: 869652 - protein, 24 aa, Mycobacterium
TYDKMSLFIVPAETPGIEIVRNVG

SEQ ID NO: 869653 - protein, 22 aa, Mycobacterium
TYDLSSLFLLASTAALFSTSIK

SEQ ID NO: 869654 - protein, 27 aa, Mycobacterium
TYDMEAPEQILLCRMLSGVFEETHHGQ

SEQ ID NO: 869655 - protein, 27 aa, Mycobacterium
TYELLQQRSNRFARWLVAQGAGTEDVI

SEQ ID NO: 869656 - protein, 30 aa, Mycobacterium
TYELTVDLAVPMIGLLKRKAERRLTDTALK

SEQ ID NO: 869657 - protein, 24 aa, Mycobacterium
TYENAMRWYSFDPFTHISREQATV

SEQ ID NO: 869658 - protein, 20 aa, Mycobacterium
TYERLRATPVQWPCPSEDAP

SEQ ID NO: 869659 - protein, 18 aa, Mycobacterium
TYERLRETPLQWPCPPTD

SEQ ID NO: 869660 - protein, 22 aa, Mycobacterium
TYEVHLASWRPGLNYRDLAREL

SEQ ID NO: 869661 - protein, 19 aa, Mycobacterium
TYEVHLGSWRPGLNYRQLA

SEQ ID NO: 869662 - protein, 23 aa, Mycobacterium
TYEVHLGSWRPGLNYRQLARELT

SEQ ID NO: 869663 - protein, 20 aa, Mycobacterium
TYFGRLLSNLVAGPGGTPLM

SEQ ID NO: 869664 - protein, 17 aa, Mycobacterium
TYFGTPVDDFSLVTGDD

SEQ ID NO: 869665 - protein, 17 aa, Mycobacterium
TYFLAHWARDRASGRFT

SEQ ID NO: 869666 - protein, 17 aa, Mycobacterium
TYFLAHWARDRKSGRFT

SEQ ID NO: 869667 - protein, 17 aa, Mycobacterium
TYFLTHWARDRASGRFS

SEQ ID NO: 869668 - protein, 21 aa, Mycobacterium
TYGHFGQAGGFIWADPDRDLA

SEQ ID NO: 869669 - protein, 18 aa, Mycobacterium
TYGINWYAFDPCCPFGGY

SEQ ID NO: 869670 - protein, 21 aa, Mycobacterium
TYGLPPQFLVDALDTHIRQWQ

SEQ ID NO: 869671 - protein, 18 aa, Mycobacterium
TYGQTYQALAAQASTLHQ

SEQ ID NO: 869672 - protein, 27 aa, Mycobacterium
TYGRPGLVPSPLYDSLLAKVITHVHGS

SEQ ID NO: 869673 - protein, 19 aa, Mycobacterium
TYGVIPFHDEIWLDTEDSV

SEQ ID NO: 869674 - protein, 18 aa, Mycobacterium
TYHELLSLVVEGYRREGK

SEQ ID NO: 869675 - protein, 19 aa, Mycobacterium
TYHFVATSAAPRYLGAVLG

SEQ ID NO: 869676 - protein, 19 aa, Mycobacterium
TYHRDMFSEHLLLHPMSAP

SEQ ID NO: 869677 - protein, 19 aa, Mycobacterium
TYIGPIEVFEFTMSSALAA

SEQ ID NO: 869678 - protein, 41 aa, Mycobacterium
TYIHPEDRFMLKDPIYGLGPRLAQLVAGAFWREPKQVVELD

SEQ ID NO: 869679 - protein, 33 aa, Mycobacterium
TYIHPEDRFMLKDPIYGLGPRVAQLFAGAFFRE

SEQ ID NO: 869680 - protein, 22 aa, Mycobacterium
TYINRAITWMRDNYASPVRIED

SEQ ID NO: 869681 - protein, 17 aa, Mycobacterium
TYIVEPEGEPRFTVAAL

SEQ ID NO: 869682 - protein, 21 aa, Mycobacterium
TYKEFELLKYLAQHAGRVFTR

SEQ ID NO: 869683 - protein, 26 aa, Mycobacterium
TYKVHPPTLRALGRRKKIGLGPRSHV

SEQ ID NO: 869684 - protein, 27 aa, Mycobacterium
TYLFTNDYEWDLLLQKSGWSEAEVMNQ

SEQ ID NO: 869685 - protein, 21 aa, Mycobacterium
TYLQAHLTRLPGWAAHVRWSA

SEQ ID NO: 869686 - protein, 17 aa, Mycobacterium
TYLRRYAYIADVKLEVI

SEQ ID NO: 869687 - protein, 23 aa, Mycobacterium
TYLRTGEGWLYLCAVRDGCSRRV

SEQ ID NO: 869688 - protein, 21 aa, Mycobacterium
TYLYRYDYAPRTLRWSGFGAT

SEQ ID NO: 869689 - protein, 25 aa, Mycobacterium
TYLYTTSLMHCMTVSLALDGAGLGA

SEQ ID NO: 869690 - protein, 26 aa, Mycobacterium
TYLYTTSLMHCMTVSLALDGAGLGTA

SEQ ID NO: 869691 - protein, 22 aa, Mycobacterium
TYMNYVGKPLAYILATPERDDD

SEQ ID NO: 869692 - protein, 20 aa, Mycobacterium
TYMYGTLLPRGPMGQVGCGL

SEQ ID NO: 869693 - protein, 19 aa, Mycobacterium
TYNAFFAAAAAPPILIGDP

SEQ ID NO: 869694 - protein, 24 aa, Mycobacterium
TYNDIVSWRWTDVPGALGVTNHLA

SEQ ID NO: 869695 - protein, 24 aa, Mycobacterium
TYNDVPFRFHYEGPGGLLDGPEIM

SEQ ID NO: 869696 - protein, 25 aa, Mycobacterium
TYNDVPFRFHYEGPGGLLGGPEIMT

SEQ ID NO: 869697 - protein, 21 aa, Mycobacterium
TYNEWSFGLAQKLTMARIVTS

SEQ ID NO: 869698 - protein, 25 aa, Mycobacterium
TYPTEPWVEHFEWLNPLFNERIEIR

SEQ ID NO: 869699 - protein, 18 aa, Mycobacterium
TYPVLYMLHGGAADFRQF

SEQ ID NO: 869700 - protein, 17 aa, Mycobacterium
TYQAGHVPFINPTDRLG

SEQ ID NO: 869701 - protein, 22 aa, Mycobacterium
TYQMMYELRDFGFSTAIGIGGD

SEQ ID NO: 869702 - protein, 18 aa, Mycobacterium
TYQPLPVYKPRATRAQAV

SEQ ID NO: 869703 - protein, 18 aa, Mycobacterium
TYQPTWAVVAAPTTSLPE

SEQ ID NO: 869704 - protein, 21 aa, Mycobacterium
TYQRSLDVLTAARQFGLVTKS

SEQ ID NO: 869705 - protein, 23 aa, Mycobacterium
TYQYLDMHMAIASALSMYDNVLA

SEQ ID NO: 869706 - protein, 31 aa, Mycobacterium
TYRDGTNIRAWLFKILTNTWINAYHTAQRRP

SEQ ID NO: 869707 - protein, 20 aa, Mycobacterium
TYRGADLLGTRYLPPFPYFV

SEQ ID NO: 869708 - protein, 23 aa, Mycobacterium
TYRGKDIMWWMDAAGLFDERYDE

SEQ ID NO: 869709 - protein, 24 aa, Mycobacterium
TYRMDKRFIAADGRIVWCDLTAVL

SEQ ID NO: 869710 - protein, 25 aa, Mycobacterium
TYRQEWHFYFENTKRWRDLRKITIA

SEQ ID NO: 869711 - protein, 17 aa, Mycobacterium
TYRQLWDRAARVAGGLR

SEQ ID NO: 869712 - protein, 26 aa, Mycobacterium
TYRSSGNLLFLLLTHPEQLAAVQADR

SEQ ID NO: 869713 - protein, 31 aa, Mycobacterium
TYSPLPATHIGGLWWILNGLMHGASCITGGE

SEQ ID NO: 869714 - protein, 17 aa, Mycobacterium
TYSSAWFDAISAPPKLG

SEQ ID NO: 869715 - protein, 20 aa, Mycobacterium
TYSSAWFDAISKPPKLGRAA

SEQ ID NO: 869716 - protein, 19 aa, Mycobacterium
TYSSAWFDAISPPPKLGRA

SEQ ID NO: 869717 - protein, 19 aa, Mycobacterium
TYSYFFEPNPNWSRLFSTG

SEQ ID NO: 869718 - protein, 24 aa, Mycobacterium
TYTERMASWRMGDRHRGWASVWAL

SEQ ID NO: 869719 - protein, 19 aa, Mycobacterium
TYTFAGTPARRLGTAGWEA

SEQ ID NO: 869720 - protein, 26 aa, Mycobacterium
TYTGPTPLRLFPARTLKAERAGDYLT

SEQ ID NO: 869721 - protein, 31 aa, Mycobacterium
TYTGYTPILGTPWIANLARRSRFAEAFRYDG

SEQ ID NO: 869722 - protein, 22 aa, Mycobacterium
TYTLARFPELVDAAPKGLFMTG

SEQ ID NO: 869723 - protein, 25 aa, Mycobacterium
TYTLDRFPELVAAAPKGLFLTGTAL

SEQ ID NO: 869724 - protein, 19 aa, Mycobacterium
TYTMDLLRVLPTADAAERI

SEQ ID NO: 869725 - protein, 24 aa, Mycobacterium
TYTTQEFPPPLPYKGNRDPKVFQP

SEQ ID NO: 869726 - protein, 33 aa, Mycobacterium
TYVALRTEIDNWRWAGVPIFLRAGKALPEKVTE

SEQ ID NO: 869727 - protein, 19 aa, Mycobacterium
TYVATVMGTVPRGLGKKLK

SEQ ID NO: 869728 - protein, 23 aa, Mycobacterium
TYVELYARMFTDLAPDVVLLCAT

SEQ ID NO: 869729 - protein, 18 aa, Mycobacterium
TYVGDLAAALLQIVDDRV

SEQ ID NO: 869730 - protein, 32 aa, Mycobacterium
TYVGTRRYVRRQRSWFRRDHRVRWLDVSSADS

SEQ ID NO: 869731 - protein, 19 aa, Mycobacterium
TYVHAAVARLLAGKIPGVA

SEQ ID NO: 869732 - protein, 31 aa, Mycobacterium
TYVLIRRENLPLLEPLRNLGLGALADQLNAP

SEQ ID NO: 869733 - protein, 17 aa, Mycobacterium
TYVLRRGPRHLRPRSNS

SEQ ID NO: 869734 - protein, 20 aa, Mycobacterium
TYVNIGFWSSVPAGAVEGAT

SEQ ID NO: 869735 - protein, 18 aa, Mycobacterium
TYVRACQQLGYHHPDLTS

SEQ ID NO: 869736 - protein, 24 aa, Mycobacterium
TYVRKPPYFEGMPAEPQPVTDISG

SEQ ID NO: 869737 - protein, 29 aa, Mycobacterium
TYVTTPGSALLFPGLCRATGAIATPEADA

SEQ ID NO: 869738 - protein, 28 aa, Mycobacterium
TYVTTPGSALLFPSLCYAVGGMPTPEAD

SEQ ID NO: 869739 - protein, 17 aa, Mycobacterium
TYWLAQIYERLETGRGT

SEQ ID NO: 869740 - protein, 17 aa, Mycobacterium
TYYGFSKAALEALGSLF

SEQ ID NO: 869741 - protein, 20 aa, Mycobacterium
VAAAAPTMGALAAGADEVSA

SEQ ID NO: 869742 - protein, 18 aa, Mycobacterium
VAAAARQGIAPSGAVAAV

SEQ ID NO: 869743 - protein, 26 aa, Mycobacterium
VAAAARWARTFGIGPFHVLPTVEQHT

SEQ ID NO: 869744 - protein, 18 aa, Mycobacterium
VAAAARWVREELDYLPGT

SEQ ID NO: 869745 - protein, 25 aa, Mycobacterium
VAAADQLILMRIIVARVARRHGLRA

SEQ ID NO: 869746 - protein, 17 aa, Mycobacterium
VAAAHPGVIYRTYDLSS

SEQ ID NO: 869747 - protein, 24 aa, Mycobacterium
VAAAILLTEWRLRNTPHVPIPYVY

SEQ ID NO: 869748 - protein, 33 aa, Mycobacterium
VAAAKYYIDYSDFSVWVLRVQRVRWVGGYGRMD

SEQ ID NO: 869749 - protein, 25 aa, Mycobacterium
VAAALNGWFDPRPDLVLSGINHGAN

SEQ ID NO: 869750 - protein, 17 aa, Mycobacterium
VAAALPFRALSDAAPVA

SEQ ID NO: 869751 - protein, 20 aa, Mycobacterium
VAAALPTTGILAAGADDVST

SEQ ID NO: 869752 - protein, 19 aa, Mycobacterium
VAAALRKYADLGVSHFVLS

SEQ ID NO: 869753 - protein, 29 aa, Mycobacterium
VAAALTPFTRPLQSLAGQVSRLGGAVAGV

SEQ ID NO: 869754 - protein, 18 aa, Mycobacterium
VAAAYALGQALARVPDRL

SEQ ID NO: 869755 - protein, 22 aa, Mycobacterium
VAAAYIDFITNAKASQLLLDTG

SEQ ID NO: 869756 - protein, 19 aa, Mycobacterium
VAAAYLARAGLAVRLLERL

SEQ ID NO: 869757 - protein, 28 aa, Mycobacterium
VAADADWLDPMIALSFAAAATSTIRIAT

SEQ ID NO: 869758 - protein, 35 aa, Mycobacterium
VAADAYDAYLRLHLLSHRLVAPHGLNAGGLFGVLT

SEQ ID NO: 869759 - protein, 27 aa, Mycobacterium
VAADDPLRALWLLNSDARLSVLNTEFM

SEQ ID NO: 869760 - protein, 32 aa, Mycobacterium
VAADFRAQYPVPTKLWTIADLGGWSAADPQLF

SEQ ID NO: 869761 - protein, 59 aa, Mycobacterium
VAADIPFSGLLSPLQPLSLTATTPVLPLLNSLTITGPPVGGLVPSLVQYVPELLATSLG

SEQ ID NO: 869762 - protein, 23 aa, Mycobacterium
VAADLLSLTLLTPPGELGADIAV

SEQ ID NO: 869763 - protein, 35 aa, Mycobacterium
VAADLRLDFLTVLRLDWLLAIPDEDWQPVAPASKD

SEQ ID NO: 869764 - protein, 18 aa, Mycobacterium
VAADPAVAAIAAHREQSA

SEQ ID NO: 869765 - protein, 21 aa, Mycobacterium
VAADRLALLALAPSDIMLLLC

SEQ ID NO: 869766 - protein, 28 aa, Mycobacterium
VAAENRGFDYVWTFDSHLLWQEPYVIHS

SEQ ID NO: 869767 - protein, 17 aa, Mycobacterium
VAAERIHRALKLPGGAE

SEQ ID NO: 869768 - protein, 26 aa, Mycobacterium
VAAEVARLALFLTSPSARHITGQTLH

SEQ ID NO: 869769 - protein, 26 aa, Mycobacterium
VAAEVARLALFLTTSAARHITGQTLH

SEQ ID NO: 869770 - protein, 25 aa, Mycobacterium
VAAFELVVVNLYPFTQTVNSGAGVD

SEQ ID NO: 869771 - protein, 17 aa, Mycobacterium
VAAFLPHSPLRVYVMGQ

SEQ ID NO: 869772 - protein, 18 aa, Mycobacterium
VAAFLPHSPLRVYVMGRR

SEQ ID NO: 869773 - protein, 17 aa, Mycobacterium
VAAFRWGRVAIADPAHF

SEQ ID NO: 869774 - protein, 27 aa, Mycobacterium
VAAGAPWFMTLFGRDSLLTAWMSLPLD

SEQ ID NO: 869775 - protein, 34 aa, Mycobacterium
VAAGATFVLATGRPPRWIQPVVDGLGLAPMAVCA

SEQ ID NO: 869776 - protein, 33 aa, Mycobacterium
VAAGDRVAVWSPNTWHWVVACLAIHHAGAAMVP

SEQ ID NO: 869777 - protein, 25 aa, Mycobacterium
VAAGEPLFTLYTDTPERFGAALAEL

SEQ ID NO: 869778 - protein, 27 aa, Mycobacterium
VAAGEPLFTLYTETPHRLAAAASELDG

SEQ ID NO: 869779 - protein, 24 aa, Mycobacterium
VAAGGGLLRLPKRIPYQKALELAL

SEQ ID NO: 869780 - protein, 25 aa, Mycobacterium
VAAGGRLRLLRLSPTVYKGTHVDLP

SEQ ID NO: 869781 - protein, 19 aa, Mycobacterium
VAAGLADRPGSPVTAVAQG

SEQ ID NO: 869782 - protein, 21 aa, Mycobacterium
VAAGLAMGFPMLCAGVSAGTV

SEQ ID NO: 869783 - protein, 20 aa, Mycobacterium
VAAGLPIGGAIASGPAGGSE

SEQ ID NO: 869784 - protein, 20 aa, Mycobacterium
VAAGLRRTRWWTDDGGDFGL

SEQ ID NO: 869785 - protein, 21 aa, Mycobacterium
VAAGMRPHPWPVADALGRPHT

SEQ ID NO: 869786 - protein, 32 aa, Mycobacterium
VAAGNWACIVPHTWLWTSPLGPEVRAVEMVDP

SEQ ID NO: 869787 - protein, 25 aa, Mycobacterium
VAAGPAIAAVTRPVITGGETFHPRG

SEQ ID NO: 869788 - protein, 25 aa, Mycobacterium
VAAGSGLAPWFCWSESAVGTNGIGT

SEQ ID NO: 869789 - protein, 32 aa, Mycobacterium
VAAGVAWHAGVGMYPWLPANMGNWHTIGIECA

SEQ ID NO: 869790 - protein, 20 aa, Mycobacterium
VAAGWLHDIGYAPSVRRTGF

SEQ ID NO: 869791 - protein, 26 aa, Mycobacterium
VAAHAFRPLHYPMTSAIGLGIITAGH

SEQ ID NO: 869792 - protein, 20 aa, Mycobacterium
VAAHKFGGPAGVGALLLRRD

SEQ ID NO: 869793 - protein, 32 aa, Mycobacterium
VAAHKFGGPPGVGALLLRRDVTCVPLSHGGGQ

SEQ ID NO: 869794 - protein, 23 aa, Mycobacterium
VAAHLVNLMWNGLIGLEADPRLQ

SEQ ID NO: 869795 - protein, 17 aa, Mycobacterium
VAAHPGARPLDYAQALA

SEQ ID NO: 869796 - protein, 31 aa, Mycobacterium
VAAIAAWNVPLFLALNKIGPAFLAGCAVVLK

SEQ ID NO: 869797 - protein, 24 aa, Mycobacterium
VAAIDHVVLMSPNLDRTVRALTAI

SEQ ID NO: 869798 - protein, 29 aa, Mycobacterium
VAAIEAPLVVTPWRSLLICDLDEAVADTV

SEQ ID NO: 869799 - protein, 17 aa, Mycobacterium
VAAIFPDGPMRYHGTIY

SEQ ID NO: 869800 - protein, 18 aa, Mycobacterium
VAAIFPDGPQRYFDTIYN

SEQ ID NO: 869801 - protein, 18 aa, Mycobacterium
VAAIKLRLHAIRDSARDY

SEQ ID NO: 869802 - protein, 17 aa, Mycobacterium
VAAILRYCSDHGIAVVP

SEQ ID NO: 869803 - protein, 17 aa, Mycobacterium
VAAIRAMRDGQAAVFMA

SEQ ID NO: 869804 - protein, 17 aa, Mycobacterium
VAAIRAMRDGRAKVFVG

SEQ ID NO: 869805 - protein, 26 aa, Mycobacterium
VAAKLPVPPGFVLLRDCYRDSMRAGG

SEQ ID NO: 869806 - protein, 24 aa, Mycobacterium
VAAKRIAWMKLLNAGQTCVAPDYV

SEQ ID NO: 869807 - protein, 33 aa, Mycobacterium
VAAKRTPFALSAWTIRLLSRFPQRAVVALATNV

SEQ ID NO: 869808 - protein, 18 aa, Mycobacterium
VAALAAGALDAAAAGSGC

SEQ ID NO: 869809 - protein, 25 aa, Mycobacterium
VAALARAWTREAPLTGASRAWSVLP

SEQ ID NO: 869810 - protein, 24 aa, Mycobacterium
VAALEVRLQAWALILEAVAGRDVS

SEQ ID NO: 869811 - protein, 25 aa, Mycobacterium
VAALEVRLQAWALILEAVAGRDVSA

SEQ ID NO: 869812 - protein, 26 aa, Mycobacterium
VAALFGSYAQGYQSLSAQAAAFHERF

SEQ ID NO: 869813 - protein, 43 aa, Mycobacterium
VAALFTGHAQAYQWLGAQAGAFHSQFIQALTGSGIAYAGAEAA

SEQ ID NO: 869814 - protein, 25 aa, Mycobacterium
VAALHTEFWLHAIRNPGAMDVLAES

SEQ ID NO: 869815 - protein, 17 aa, Mycobacterium
VAALHWDGDITGLVRSH

SEQ ID NO: 869816 - protein, 32 aa, Mycobacterium
VAALITRGLAEIMRLGIALGATPATLAGLAGV

SEQ ID NO: 869817 - protein, 29 aa, Mycobacterium
VAALLAEGRTDWRTVRLVITRTDLVTDRE

SEQ ID NO: 869818 - protein, 22 aa, Mycobacterium
VAALLCRIMLQGLATRPPTDAA

SEQ ID NO: 869819 - protein, 19 aa, Mycobacterium
VAALLGCAVLTGGGAVLNV

SEQ ID NO: 869820 - protein, 17 aa, Mycobacterium
VAALLMSAALTEAAAGG

SEQ ID NO: 869821 - protein, 17 aa, Mycobacterium
VAALLPPPPADDVNLAD

SEQ ID NO: 869822 - protein, 19 aa, Mycobacterium
VAALPDLPAIDAIAHRLNA

SEQ ID NO: 869823 - protein, 18 aa, Mycobacterium
VAALRFEIRGMVAGEPVI

SEQ ID NO: 869824 - protein, 22 aa, Mycobacterium
VAALRSIGIQPDALILRCDRDV

SEQ ID NO: 869825 - protein, 23 aa, Mycobacterium
VAALRSIGITPDALILRCDRDVP

SEQ ID NO: 869826 - protein, 22 aa, Mycobacterium
VAALSINKMCLSGIDAIALADQ

SEQ ID NO: 869827 - protein, 17 aa, Mycobacterium
VAALVDHTLLKPEATEA

SEQ ID NO: 869828 - protein, 17 aa, Mycobacterium
VAALVDHTLLKPEATPS

SEQ ID NO: 869829 - protein, 25 aa, Mycobacterium
VAALVPGLIRTDTLLEFARGNGIEL

SEQ ID NO: 869830 - protein, 24 aa, Mycobacterium
VAAMPNVTLQLLGGRVRGLTQAAV

SEQ ID NO: 869831 - protein, 29 aa, Mycobacterium
VAAMPYLKAWFELLGLRAGPVRPPVKARL

SEQ ID NO: 869832 - protein, 27 aa, Mycobacterium
VAANRARLAMLLATNFFGINAPAIAET

SEQ ID NO: 869833 - protein, 29 aa, Mycobacterium
VAANRARLAMLLATNFFGVNYPAIAETEA

SEQ ID NO: 869834 - protein, 25 aa, Mycobacterium
VAANRARLMMLVATNIFGQNTPAIA

SEQ ID NO: 869835 - protein, 18 aa, Mycobacterium
VAANRNALVQLVLTNLFG

SEQ ID NO: 869836 - protein, 25 aa, Mycobacterium
VAANRVRLLALIQTNIFGQNTPAIM

SEQ ID NO: 869837 - protein, 26 aa, Mycobacterium
VAAPASYFQLAFTRVGLMPDGGASAL

SEQ ID NO: 869838 - protein, 17 aa, Mycobacterium
VAAPDRPVIALQADGSA

SEQ ID NO: 869839 - protein, 25 aa, Mycobacterium
VAAPPERLLVGWTGAPAATTAQIGR

SEQ ID NO: 869840 - protein, 34 aa, Mycobacterium
VAAPPRVPPSPVTWGWMLQLYALRSAHSWGIGDL

SEQ ID NO: 869841 - protein, 18 aa, Mycobacterium
VAAPRRQWPSPMLPALQT

SEQ ID NO: 869842 - protein, 19 aa, Mycobacterium
VAAPTWLTSATELPPLVRG

SEQ ID NO: 869843 - protein, 18 aa, Mycobacterium
VAAPYAGWLGAVAAQAQQ

SEQ ID NO: 869844 - protein, 19 aa, Mycobacterium
VAAQLAVYLAPPGYGEMFA

SEQ ID NO: 869845 - protein, 23 aa, Mycobacterium
VAAQLREFLDSLGGLWAEGKLAD

SEQ ID NO: 869846 - protein, 18 aa, Mycobacterium
VAAQPRIEFLQRAIDIAA

SEQ ID NO: 869847 - protein, 22 aa, Mycobacterium
VAAQRDPIAKVLTFFDLAATAA

SEQ ID NO: 869848 - protein, 24 aa, Mycobacterium
VAAQRFFTNAYHPGWRITEFARGA

SEQ ID NO: 869849 - protein, 26 aa, Mycobacterium
VAAQVDMPSLPWPAADDWLAAVRASP

SEQ ID NO: 869850 - protein, 19 aa, Mycobacterium
VAAQVMCALALWADSGEWA

SEQ ID NO: 869851 - protein, 25 aa, Mycobacterium
VAARALLTDELLGQRIPLTGPQAFT

SEQ ID NO: 869852 - protein, 19 aa, Mycobacterium
VAARDKDAWLAVFADDAIV

SEQ ID NO: 869853 - protein, 20 aa, Mycobacterium
VAARGRFMQALPAGGAMVAV

SEQ ID NO: 869854 - protein, 20 aa, Mycobacterium
VAARIAALIRTTPDAVIGVA

SEQ ID NO: 869855 - protein, 24 aa, Mycobacterium
VAARIALRVPLYSPGRHAAKITAP

SEQ ID NO: 869856 - protein, 27 aa, Mycobacterium
VAARIGTLSALALLLRRERAGEGGSAS

SEQ ID NO: 869857 - protein, 20 aa, Mycobacterium
VAARIRPRRSLTGPPVPPEL

SEQ ID NO: 869858 - protein, 23 aa, Mycobacterium
VAARLLDRLGALPPRSEILDGTH

SEQ ID NO: 869859 - protein, 25 aa, Mycobacterium
VAARLRCSVAMGASYLRYAMAMRDR

SEQ ID NO: 869860 - protein, 30 aa, Mycobacterium
VAARPPASLVLFSPLIDLTFGLSAARERTK

SEQ ID NO: 869861 - protein, 18 aa, Mycobacterium
VAARRALPQWAGVTPAER

SEQ ID NO: 869862 - protein, 19 aa, Mycobacterium
VAARRFAIPAVEAKGSLLL

SEQ ID NO: 869863 - protein, 23 aa, Mycobacterium
VAARRFRWQALVDGEPVITAAVN

SEQ ID NO: 869864 - protein, 26 aa, Mycobacterium
VAARSGFGTAILLRHHFRRGVGITPT

SEQ ID NO: 869865 - protein, 30 aa, Mycobacterium
VAARVLLGASSRRWAWWTGSVALAAAKIIE

SEQ ID NO: 869866 - protein, 18 aa, Mycobacterium
VAARVPGLLIDAPSIMRG

SEQ ID NO: 869867 - protein, 29 aa, Mycobacterium
VAASAPVFLQYPWGVLPENMLTPIENAAR

SEQ ID NO: 869868 - protein, 25 aa, Mycobacterium
VAASDAFFPFPDGLEVLSQAGVRAV

SEQ ID NO: 869869 - protein, 24 aa, Mycobacterium
VAASDAFFPFPDGLQVLTEADVKA

SEQ ID NO: 869870 - protein, 25 aa, Mycobacterium
VAASDLERLGSTISAANVAAAGSTT

SEQ ID NO: 869871 - protein, 33 aa, Mycobacterium
VAASHNEIYLQFYDLLLPTIHRAVEAGPVGTCT

SEQ ID NO: 869872 - protein, 53 aa, Mycobacterium
VAASSFSSVTAGLASGAWQGPASAAMSAVAAPYASWLSAAAAQAAGTAGRASA

SEQ ID NO: 869873 - protein, 17 aa, Mycobacterium
VAATAAPAGVLLGGGNP

SEQ ID NO: 869874 - protein, 26 aa, Mycobacterium
VAATELEFMVFDTGFRDAWAAGYRNL

SEQ ID NO: 869875 - protein, 19 aa, Mycobacterium
VAATHRTVWALGDYALMAE

SEQ ID NO: 869876 - protein, 21 aa, Mycobacterium
VAATLPYGLAPLVVPQLKTIT

SEQ ID NO: 869877 - protein, 18 aa, Mycobacterium
VAATRFRDVVERWNAESL

SEQ ID NO: 869878 - protein, 17 aa, Mycobacterium
VAATYRNLLTAVTGRMT

SEQ ID NO: 869879 - protein, 17 aa, Mycobacterium
VAAVLRPVLGGLAAAHR

SEQ ID NO: 869880 - protein, 17 aa, Mycobacterium
VAAVREQVAAVPGVTGV

SEQ ID NO: 869881 - protein, 17 aa, Mycobacterium
VAAVRFLIEGLVDGRPA

SEQ ID NO: 869882 - protein, 24 aa, Mycobacterium
VAAVRLLAPIPRPPSIRDSLCFLD

SEQ ID NO: 869883 - protein, 31 aa, Mycobacterium
VAAVSAIVVVKMMGLLRAPCRVVYVIDEPDT

SEQ ID NO: 869884 - protein, 18 aa, Mycobacterium
VAAVVLYEPPLPISERVA

SEQ ID NO: 869885 - protein, 17 aa, Mycobacterium
VAAVYDPVLERHHALAA

SEQ ID NO: 869886 - protein, 18 aa, Mycobacterium
VAAWTELVADRSAPPIVD

SEQ ID NO: 869887 - protein, 26 aa, Mycobacterium
VAAYELMKLGLRPVLYESARIGGRLR

SEQ ID NO: 869888 - protein, 17 aa, Mycobacterium
VAAYLDAVAQREPRQES

SEQ ID NO: 869889 - protein, 19 aa, Mycobacterium
VAAYLTAHAMTVPPALVAA

SEQ ID NO: 869890 - protein, 22 aa, Mycobacterium
VAAYRLLNLRVNATMSSGALGM

SEQ ID NO: 869891 - protein, 27 aa, Mycobacterium
VACALALQRAPLAPLRLRIGVHTGEVQ

SEQ ID NO: 869892 - protein, 32 aa, Mycobacterium
VACLRKTDWLFPQYRELGAYLVRGIPPGHVGA

SEQ ID NO: 869893 - protein, 18 aa, Mycobacterium
VACPGRLDDLLKQGHLTL

SEQ ID NO: 869894 - protein, 25 aa, Mycobacterium
VACRPWLIAEIEAVRPRVIVCLGAT

SEQ ID NO: 869895 - protein, 20 aa, Mycobacterium
VACYALPAARRALDLTKAYA

SEQ ID NO: 869896 - protein, 24 aa, Mycobacterium
VADADAALALLRAELRPGDVVLVK

SEQ ID NO: 869897 - protein, 24 aa, Mycobacterium
VADADAALALLRDELRPGDVVLVK

SEQ ID NO: 869898 - protein, 24 aa, Mycobacterium
VADALLPSLFRGAALSDLPAREAV

SEQ ID NO: 869899 - protein, 27 aa, Mycobacterium
VADARRRMWLPVGAIFGRLEPNANDYH

SEQ ID NO: 869900 - protein, 31 aa, Mycobacterium
VADASLSHPYLDTVLFLLGITRGEIEAADAI

SEQ ID NO: 869901 - protein, 30 aa, Mycobacterium
VADASLSHPYLDTVLFLLGVTRGEIEAADN

SEQ ID NO: 869902 - protein, 30 aa, Mycobacterium
VADAVHSLLMYRYLVPLVLVVGSLVPVPQA

SEQ ID NO: 869903 - protein, 23 aa, Mycobacterium
VADDRFWEIVRAMGEDRRPDWAT

SEQ ID NO: 869904 - protein, 28 aa, Mycobacterium
VADDWAPVTLLEGGTPLIAAPRLSKQTG

SEQ ID NO: 869905 - protein, 25 aa, Mycobacterium
VADEFTRLALFLSTPAARHITGQTL

SEQ ID NO: 869906 - protein, 36 aa, Mycobacterium
VADEPPDGPQPLRDIWLLRMRAALAGARGAGGDYQR

SEQ ID NO: 869907 - protein, 27 aa, Mycobacterium
VADFDRLHLWYFGDARRRQQPELSPED

SEQ ID NO: 869908 - protein, 28 aa, Mycobacterium
VADFLSLQIRRWPIKPFAQRAYQLRTTH

SEQ ID NO: 869909 - protein, 24 aa, Mycobacterium
VADGGLPWRYHPDGSVALASPPKE

SEQ ID NO: 869910 - protein, 26 aa, Mycobacterium
VADGMYVHALLRYPVKSMLGEAVATL

SEQ ID NO: 869911 - protein, 25 aa, Mycobacterium
VADGRKLPWFGPPMSAASMATARLM

SEQ ID NO: 869912 - protein, 32 aa, Mycobacterium
VADHHNIPAQFAAPIASPFSPQTQFAPEVASH

SEQ ID NO: 869913 - protein, 18 aa, Mycobacterium
VADHVRRFWEPRMQRRLF

SEQ ID NO: 869914 - protein, 27 aa, Mycobacterium
VADIARPYPIPIICALLGAPPEDWEQF

SEQ ID NO: 869915 - protein, 27 aa, Mycobacterium
VADIARPYPIPIICALLGAPREDWRLF

SEQ ID NO: 869916 - protein, 26 aa, Mycobacterium
VADIARPYPPIMCALIGAPREDWQKF

SEQ ID NO: 869917 - protein, 25 aa, Mycobacterium
VADIDLWEINEAFAAVPLKTMRDLD

SEQ ID NO: 869918 - protein, 21 aa, Mycobacterium
VADIFFLVCDGLKGLPQSVGA

SEQ ID NO: 869919 - protein, 23 aa, Mycobacterium
VADILRTLRWLNETTGITILSGL

SEQ ID NO: 869920 - protein, 34 aa, Mycobacterium
VADIMERRLDRSRPLWECWIIEGLPSDRWAILMK

SEQ ID NO: 869921 - protein, 27 aa, Mycobacterium
VADINLKLFGFIRMTRAALPHLLKTGS

SEQ ID NO: 869922 - protein, 23 aa, Mycobacterium
VADIVIRQIRSITWCRRRTIQVG

SEQ ID NO: 869923 - protein, 26 aa, Mycobacterium
VADKFHATFDALLYNFYGPTETVINA

SEQ ID NO: 869924 - protein, 25 aa, Mycobacterium
VADLDRAALPALRHIVRIPIDAADG

SEQ ID NO: 869925 - protein, 26 aa, Mycobacterium
VADLERYPLVYFIDSMLQVDDLDLAP

SEQ ID NO: 869926 - protein, 28 aa, Mycobacterium
VADLFEAFGMYPVDFYDLRDAASPVPVV

SEQ ID NO: 869927 - protein, 21 aa, Mycobacterium
VADLKRDALPALRHIVRIPVD

SEQ ID NO: 869928 - protein, 22 aa, Mycobacterium
VADLRAGLPRGLAVAGAYLDGI

SEQ ID NO: 869929 - protein, 24 aa, Mycobacterium
VADLSFISLGTVLPALIDCASPGA

SEQ ID NO: 869930 - protein, 28 aa, Mycobacterium
VADLSFISLTTVLPALAACALPHADIVP

SEQ ID NO: 869931 - protein, 18 aa, Mycobacterium
VADLTWLDDLGIPTVQAV

SEQ ID NO: 869932 - protein, 27 aa, Mycobacterium
VADMRLLHAYIAVREYRLALVLADTAI

SEQ ID NO: 869933 - protein, 24 aa, Mycobacterium
VADMTYLQWLQRYVELAIGDGDST

SEQ ID NO: 869934 - protein, 24 aa, Mycobacterium
VADMTYLQWLQRYVELTIGDGNST

SEQ ID NO: 869935 - protein, 18 aa, Mycobacterium
VADNATVLVCYMGVNGRD

SEQ ID NO: 869936 - protein, 25 aa, Mycobacterium
VADNLPPELIAQMVDLGLAAGSRIT

SEQ ID NO: 869937 - protein, 25 aa, Mycobacterium
VADNLPPELIARMVDLGLAAGSRIT

SEQ ID NO: 869938 - protein, 26 aa, Mycobacterium
VADNLPPELITRMVDLGLAAGSRITQ

SEQ ID NO: 869939 - protein, 27 aa, Mycobacterium
VADPDWMLFPHLYGELPARAVISVAAY

SEQ ID NO: 869940 - protein, 23 aa, Mycobacterium
VADPPLHPMPFHANFDSPIYEDV

SEQ ID NO: 869941 - protein, 28 aa, Mycobacterium
VADPVSALGLPSLGLAAATPLNLGAANV

SEQ ID NO: 869942 - protein, 24 aa, Mycobacterium
VADQPWSLLTGPYLDALPIDPEPD

SEQ ID NO: 869943 - protein, 17 aa, Mycobacterium
VADRGAMFDPSAVFYMN

SEQ ID NO: 869944 - protein, 18 aa, Mycobacterium
VADRGAMFDPSAVFYMNK

SEQ ID NO: 869945 - protein, 24 aa, Mycobacterium
VADRHALITQRFLDAGLVIFGMTN

SEQ ID NO: 869946 - protein, 25 aa, Mycobacterium
VADRPAILVATYFGDLGAALPALAR

SEQ ID NO: 869947 - protein, 28 aa, Mycobacterium
VADRSSWSRWWPDLWLQVTEDRADKGIR

SEQ ID NO: 869948 - protein, 24 aa, Mycobacterium
VADRVTELLPYYASVHRGAGYASR

SEQ ID NO: 869949 - protein, 27 aa, Mycobacterium
VADRYNLPVLAPPIPRTVRFAEASASG

SEQ ID NO: 869950 - protein, 28 aa, Mycobacterium
VADRYQLPVLAPPIPRTVRFAEASASGA

SEQ ID NO: 869951 - protein, 30 aa, Mycobacterium
VADSYTELIPFRLTVLHAAWLIDQGDERGA

SEQ ID NO: 869952 - protein, 27 aa, Mycobacterium
VADTALGLMLMTLRRFGAADRYVRAGR

SEQ ID NO: 869953 - protein, 25 aa, Mycobacterium
VADTASWRRWWPDLRLTVVEDRAEK

SEQ ID NO: 869954 - protein, 20 aa, Mycobacterium
VADTVKVPWQAYLGAGHPLL

SEQ ID NO: 869955 - protein, 26 aa, Mycobacterium
VADVEFAGYLFPAGTFVFVNTFTANR

SEQ ID NO: 869956 - protein, 19 aa, Mycobacterium
VADVIWTYEQPYPAVAEIA

SEQ ID NO: 869957 - protein, 18 aa, Mycobacterium
VADVLPAEQAPKAHRMLE

SEQ ID NO: 869958 - protein, 31 aa, Mycobacterium
VADWIRVVCFPERWLDLRYVGPAREPGTGTG

SEQ ID NO: 869959 - protein, 29 aa, Mycobacterium
VADYHLRNPLRFAPLRPGGHGWRVPAVAG

SEQ ID NO: 869960 - protein, 27 aa, Mycobacterium
VAEAFGAEWLVIRALSDLAGEDSRFEF

SEQ ID NO: 869961 - protein, 26 aa, Mycobacterium
VAEARVAVGWWLVGSARAMLALARQH

SEQ ID NO: 869962 - protein, 23 aa, Mycobacterium
VAEAVMMGRWRRLGLLRRPSRAD

SEQ ID NO: 869963 - protein, 24 aa, Mycobacterium
VAEDYLDHIDFAASAPVIAEQILV

SEQ ID NO: 869964 - protein, 30 aa, Mycobacterium
VAEFLAEHPAISTVLYPGLPSHPGHAVAAR

SEQ ID NO: 869965 - protein, 17 aa, Mycobacterium
VAEFLPHDVLLPLVDVL

SEQ ID NO: 869966 - protein, 24 aa, Mycobacterium
VAEGGLPWRYHPDGTVALASPAKE

SEQ ID NO: 869967 - protein, 17 aa, Mycobacterium
VAEGRAYRALADPIAVC

SEQ ID NO: 869968 - protein, 25 aa, Mycobacterium
VAEGWQPIFYLPEKAHDVWGQALAA

SEQ ID NO: 869969 - protein, 20 aa, Mycobacterium
VAEGYFATDGPFLHIGPEAE

SEQ ID NO: 869970 - protein, 20 aa, Mycobacterium
VAEHLLGLLSGVTGPTLAVV

SEQ ID NO: 869971 - protein, 28 aa, Mycobacterium
VAEIDRGTWTPAPVFAMIAQRGRVTRDE

SEQ ID NO: 869972 - protein, 28 aa, Mycobacterium
VAEIDRGTWTPAPVFAMIAQRGRVVREE

SEQ ID NO: 869973 - protein, 26 aa, Mycobacterium
VAEIVELGQLFRLPIAALGNGSTIRD

SEQ ID NO: 869974 - protein, 17 aa, Mycobacterium
VAEKALLRRLVEAGTRV

SEQ ID NO: 869975 - protein, 18 aa, Mycobacterium
VAEKALLRRLVEAGTRVV

SEQ ID NO: 869976 - protein, 24 aa, Mycobacterium
VAEKLGVKSVLVMRSEPDSMVVAA

SEQ ID NO: 869977 - protein, 23 aa, Mycobacterium
VAELARLDLGSVLIPMPEAGQLQ

SEQ ID NO: 869978 - protein, 24 aa, Mycobacterium
VAELARLDLGSVLIPMPEAGQLQV

SEQ ID NO: 869979 - protein, 19 aa, Mycobacterium
VAELARLFSAPIRSGSRGI

SEQ ID NO: 869980 - protein, 29 aa, Mycobacterium
VAELDRGSWTPGPIFAMIAQRGRIERAEM

SEQ ID NO: 869981 - protein, 21 aa, Mycobacterium
VAELGRLDIILANAGIGNGGQ

SEQ ID NO: 869982 - protein, 24 aa, Mycobacterium
VAELLEIVGLRRADATRYPAEFSG

SEQ ID NO: 869983 - protein, 25 aa, Mycobacterium
VAELLLRGLPYRDIGAQLFISAKTV

SEQ ID NO: 869984 - protein, 29 aa, Mycobacterium
VAELLSGPYLAGVQRWCPPRRWVDIGTFD

SEQ ID NO: 869985 - protein, 23 aa, Mycobacterium
VAELSIAPPLFVSRSIRAQRSAR

SEQ ID NO: 869986 - protein, 24 aa, Mycobacterium
VAELVVLESYLLRPKNRPSDTVLV

SEQ ID NO: 869987 - protein, 29 aa, Mycobacterium
VAELYDGFTYLTIAWLEALGICGDGEAGP

SEQ ID NO: 869988 - protein, 27 aa, Mycobacterium
VAEMDRGTWTPAPVFAMIAQRGRVTRE

SEQ ID NO: 869989 - protein, 24 aa, Mycobacterium
VAEMTYLQWLRRYVELAIGDGNST

SEQ ID NO: 869990 - protein, 26 aa, Mycobacterium
VAEPAAWFTYYYWLDDDRAPEFAPCV

SEQ ID NO: 869991 - protein, 24 aa, Mycobacterium
VAEPIEWHTLRLLADQSAVEEAEQ

SEQ ID NO: 869992 - protein, 23 aa, Mycobacterium
VAEPYIPLRARRHLEKGRVVIFG

SEQ ID NO: 869993 - protein, 20 aa, Mycobacterium
VAEPYIPLRAVRHLEKGRVV

SEQ ID NO: 869994 - protein, 21 aa, Mycobacterium
VAEPYIPLRAVRHLEKGRVVI

SEQ ID NO: 869995 - protein, 24 aa, Mycobacterium
VAEQLLVGYLPPQEQSRLLRGVTA

SEQ ID NO: 869996 - protein, 22 aa, Mycobacterium
VAEQMRIMAAFGAAADNFRKEH

SEQ ID NO: 869997 - protein, 20 aa, Mycobacterium
VAEQPPVYVPPPGDLPPMPP

SEQ ID NO: 869998 - protein, 18 aa, Mycobacterium
VAERGAMFDPSAVFYMNK

SEQ ID NO: 869999 - protein, 24 aa, Mycobacterium
VAERGAMFDPSAVYYMNKIAVGPE

SEQ ID NO: 870000 - protein, 25 aa, Mycobacterium
VAERGLLRRYLTFDLDGGAAWEPIA

SEQ ID NO: 870001 - protein, 18 aa, Mycobacterium
VAERLAAGGLKLNRFHTT

SEQ ID NO: 870002 - protein, 20 aa, Mycobacterium
VAERLLARNGWRNTSLAQIA

SEQ ID NO: 870003 - protein, 17 aa, Mycobacterium
VAERPPVAVLTSNRSRD

SEQ ID NO: 870004 - protein, 17 aa, Mycobacterium
VAERPPVVVLTSNRSRD

SEQ ID NO: 870005 - protein, 24 aa, Mycobacterium
VAESFHRIEKAHPGRFVLGVGVGH

SEQ ID NO: 870006 - protein, 27 aa, Mycobacterium
VAESFRRIEAAYPGRFLLGIGVGHPEA

SEQ ID NO: 870007 - protein, 25 aa, Mycobacterium
VAESGRLLAWRLNRVVDAASQLRDE

SEQ ID NO: 870008 - protein, 22 aa, Mycobacterium
VAESLGLSALLGRKPKDLSGGQ

SEQ ID NO: 870009 - protein, 30 aa, Mycobacterium
VAESVVGRWFTPGFLAADPGRKAAYQQMIA

SEQ ID NO: 870010 - protein, 29 aa, Mycobacterium
VAESYHRIEKAFPGRFLLGVGVGHPEHTQ

SEQ ID NO: 870011 - protein, 20 aa, Mycobacterium
VAETIDWARTVLALGMDTID

SEQ ID NO: 870012 - protein, 24 aa, Mycobacterium
VAETIDWGRTILALGLDTLDDAVI

SEQ ID NO: 870013 - protein, 28 aa, Mycobacterium
VAEVKRMWVDDRWRGAGLGSRILRHLET

SEQ ID NO: 870014 - protein, 32 aa, Mycobacterium
VAEVMERRLDRDHPLWQCWVADGLPANRWAIL

SEQ ID NO: 870015 - protein, 26 aa, Mycobacterium
VAEVQTYVPGYRLLNEPQFDEPSLNS

SEQ ID NO: 870016 - protein, 25 aa, Mycobacterium
VAEVQTYVPGYRLLNEPQFDEPSVV

SEQ ID NO: 870017 - protein, 17 aa, Mycobacterium
VAEVVYQIGALQAIAQS

SEQ ID NO: 870018 - protein, 25 aa, Mycobacterium
VAEWIKVVCFPERWLDLRYVGPGTG

SEQ ID NO: 870019 - protein, 20 aa, Mycobacterium
VAEWLTTRVTLGRTAYQLGV

SEQ ID NO: 870020 - protein, 22 aa, Mycobacterium
VAEWQLTATAWLQLITDEARAG

SEQ ID NO: 870021 - protein, 18 aa, Mycobacterium
VAEYGIPKAWRAYRALDA

SEQ ID NO: 870022 - protein, 32 aa, Mycobacterium
VAEYLAAIEAPLVITPWRSVLVCDLDEAVADV

SEQ ID NO: 870023 - protein, 32 aa, Mycobacterium
VAEYLAAIEAPLVITPWRSVLVCDLQESVADT

SEQ ID NO: 870024 - protein, 25 aa, Mycobacterium
VAEYRHTMAQLFAPMSKVAAKNPFS

SEQ ID NO: 870025 - protein, 18 aa, Mycobacterium
VAFAKRWVTECIRSAYPL

SEQ ID NO: 870026 - protein, 23 aa, Mycobacterium
VAFDILRRWLMARGCDVAFIRNV

SEQ ID NO: 870027 - protein, 31 aa, Mycobacterium
VAFEFGTYRFNLQHRLAPGTPLARVFAPRAE

SEQ ID NO: 870028 - protein, 17 aa, Mycobacterium
VAFFGPVLSKIPRGEEA

SEQ ID NO: 870029 - protein, 21 aa, Mycobacterium
VAFHEPVHWDGWLLYSHESTQ

SEQ ID NO: 870030 - protein, 17 aa, Mycobacterium
VAFLQMVKIAAAVRLHQ

SEQ ID NO: 870031 - protein, 27 aa, Mycobacterium
VAFLQSIQRWFLTVAADVRTMQLLIAA

SEQ ID NO: 870032 - protein, 19 aa, Mycobacterium
VAFPRSPFVTAATAWELQE

SEQ ID NO: 870033 - protein, 23 aa, Mycobacterium
VAFPVVALEVMRYACGDRAEEVL

SEQ ID NO: 870034 - protein, 28 aa, Mycobacterium
VAFRPDLRVPLLTLITETDLFGGAREGY

SEQ ID NO: 870035 - protein, 19 aa, Mycobacterium
VAFRTAMLQTLCLPTDEPD

SEQ ID NO: 870036 - protein, 18 aa, Mycobacterium
VAFSERLAGLLPDPLDTV

SEQ ID NO: 870037 - protein, 24 aa, Mycobacterium
VAFTATHPFLDPSGRPFPPLAAEA

SEQ ID NO: 870038 - protein, 21 aa, Mycobacterium
VAFVDFPMDYVFSMSDDDGRP

SEQ ID NO: 870039 - protein, 39 aa, Mycobacterium
VAFVGRIQPLKAPDLLVRAAERLPGVRVLIVGGPSGSGL

SEQ ID NO: 870040 - protein, 26 aa, Mycobacterium
VAFVNALPVFIASDPAWAKKFKDAGV

SEQ ID NO: 870041 - protein, 25 aa, Mycobacterium
VAFYRDVLGLEVLSPPFVMAGNAIR

SEQ ID NO: 870042 - protein, 27 aa, Mycobacterium
VAGAAHFLEHLLFKATPTRTAVQIAQA

SEQ ID NO: 870043 - protein, 27 aa, Mycobacterium
VAGAAHFLEHLLFKSTPTRSAADIAQS

SEQ ID NO: 870044 - protein, 27 aa, Mycobacterium
VAGAAHFLEHLLFKSTPTRSAVDIAQA

SEQ ID NO: 870045 - protein, 27 aa, Mycobacterium
VAGAAHFLEHLLFKSTPTRTAVDIAQA

SEQ ID NO: 870046 - protein, 27 aa, Mycobacterium
VAGAAHFLEHLLFKSTPTRTAVDIAQT

SEQ ID NO: 870047 - protein, 27 aa, Mycobacterium
VAGAAIGLLDLLLASGGDLVTVLVGAG

SEQ ID NO: 870048 - protein, 17 aa, Mycobacterium
VAGAERAYRILYSTVDQ

SEQ ID NO: 870049 - protein, 35 aa, Mycobacterium
VAGAFLRCGAISRILAYVAPILLGGPVTAVDDVGV

SEQ ID NO: 870050 - protein, 23 aa, Mycobacterium
VAGAKILRQYGIGPLPGVAMMVV

SEQ ID NO: 870051 - protein, 31 aa, Mycobacterium
VAGALRALHRRCADVRYLGSWPTGETGGAAP

SEQ ID NO: 870052 - protein, 31 aa, Mycobacterium
VAGARLVHHLFVEFAYPRGLFGGQPHGEQPA

SEQ ID NO: 870053 - protein, 26 aa, Mycobacterium
VAGASLFVLDGWLRPVPVGVVGELYV

SEQ ID NO: 870054 - protein, 17 aa, Mycobacterium
VAGATNGYGGQGGIGGT

SEQ ID NO: 870055 - protein, 18 aa, Mycobacterium
VAGAWLEVRLPEAPKPVE

SEQ ID NO: 870056 - protein, 18 aa, Mycobacterium
VAGAWLEVRLPPPPAPVE

SEQ ID NO: 870057 - protein, 20 aa, Mycobacterium
VAGDPFIELLERGALQQVGI

SEQ ID NO: 870058 - protein, 25 aa, Mycobacterium
VAGDPWPVLRRWAATQPRAAIVERA

SEQ ID NO: 870059 - protein, 25 aa, Mycobacterium
VAGEPLFTLYTETPERFGPALAMLD

SEQ ID NO: 870060 - protein, 28 aa, Mycobacterium
VAGEQPLGHLWRWELQPAGEGRTLVTHT

SEQ ID NO: 870061 - protein, 23 aa, Mycobacterium
VAGERFDLIVSNPPFVVGSGARD

SEQ ID NO: 870062 - protein, 25 aa, Mycobacterium
VAGERFDLIVSNPPFVVGTGSLDYI

SEQ ID NO: 870063 - protein, 32 aa, Mycobacterium
VAGFGSTETLRRVFLSRLGITPSAYRDRFRTS

SEQ ID NO: 870064 - protein, 25 aa, Mycobacterium
VAGFIGRDRGYRGLQFREAGEVPLY

SEQ ID NO: 870065 - protein, 17 aa, Mycobacterium
VAGFLRHGRNGSIATRP

SEQ ID NO: 870066 - protein, 19 aa, Mycobacterium
VAGFPLDFFVDGVARTSPA

SEQ ID NO: 870067 - protein, 17 aa, Mycobacterium
VAGFRRSHWQARDARSV

SEQ ID NO: 870068 - protein, 28 aa, Mycobacterium
VAGFSHFTLLLVNALRQQFSRVRVFAFI

SEQ ID NO: 870069 - protein, 23 aa, Mycobacterium
VAGFSHFTLMLVSALRQQFSRVR

SEQ ID NO: 870070 - protein, 28 aa, Mycobacterium
VAGGATFILATGRPPRWVRPVVEELGFT

SEQ ID NO: 870071 - protein, 24 aa, Mycobacterium
VAGGAVHVYLKKGELPQKAAAAQK

SEQ ID NO: 870072 - protein, 25 aa, Mycobacterium
VAGGIELALWCDLRVVEEDAVLGVF

SEQ ID NO: 870073 - protein, 19 aa, Mycobacterium
VAGGLELALWCDLRVAEED

SEQ ID NO: 870074 - protein, 19 aa, Mycobacterium
VAGGLELALWCDLRVAEQD

SEQ ID NO: 870075 - protein, 21 aa, Mycobacterium
VAGGLELALWCDLRVVDEDAT

SEQ ID NO: 870076 - protein, 18 aa, Mycobacterium
VAGGLFNTTLRGTGWVAL

SEQ ID NO: 870077 - protein, 18 aa, Mycobacterium
VAGGLRAAGLRPGDRVAV

SEQ ID NO: 870078 - protein, 26 aa, Mycobacterium
VAGGMELLLCCDIVLAADTALIGDGH

SEQ ID NO: 870079 - protein, 23 aa, Mycobacterium
VAGHAVWVRMRTLGGDAPDRPLF

SEQ ID NO: 870080 - protein, 19 aa, Mycobacterium
VAGHGLLEFSIPGFAEFVH

SEQ ID NO: 870081 - protein, 22 aa, Mycobacterium
VAGHIAILFGLTGPTSVYSPFS

SEQ ID NO: 870082 - protein, 22 aa, Mycobacterium
VAGHRHFRFFLNVEVGRHLSHA

SEQ ID NO: 870083 - protein, 19 aa, Mycobacterium
VAGIDLPSPIRGACVLLVD

SEQ ID NO: 870084 - protein, 19 aa, Mycobacterium
VAGIDTFFVATAPSYSFVS

SEQ ID NO: 870085 - protein, 21 aa, Mycobacterium
VAGILALPETFPGTVAVIPRF

SEQ ID NO: 870086 - protein, 19 aa, Mycobacterium
VAGIPSYRDVLPGALQTSG

SEQ ID NO: 870087 - protein, 18 aa, Mycobacterium
VAGIQLPVVCSVRGWAVG

SEQ ID NO: 870088 - protein, 25 aa, Mycobacterium
VAGIRFALSLGFRVRVAATVAAPAP

SEQ ID NO: 870089 - protein, 30 aa, Mycobacterium
VAGITPFNFPAMIPLWKAGPALACGNAFVL

SEQ ID NO: 870090 - protein, 22 aa, Mycobacterium
VAGLDRKALPALRHIVRIPIEE

SEQ ID NO: 870091 - protein, 26 aa, Mycobacterium
VAGLDTAFRAVYGSGPLVIGVCAEYD

SEQ ID NO: 870092 - protein, 39 aa, Mycobacterium
VAGLGKRYLIVLPFLTPAIASLWVGTVTPIPPGLARPLI

SEQ ID NO: 870093 - protein, 29 aa, Mycobacterium
VAGLHRRYLIVLPFLTPTIASLWVGTVTP

SEQ ID NO: 870094 - protein, 18 aa, Mycobacterium
VAGLIATGAIDIGIACGI

SEQ ID NO: 870095 - protein, 24 aa, Mycobacterium
VAGLLARVPARFPLRGVFHAAGVL

SEQ ID NO: 870096 - protein, 27 aa, Mycobacterium
VAGLLCRIILQGLATRSPTDAALDRSK

SEQ ID NO: 870097 - protein, 18 aa, Mycobacterium
VAGLLDRLDHMLSYHEMY

SEQ ID NO: 870098 - protein, 18 aa, Mycobacterium
VAGLLDRLDHMLSYHQMY

SEQ ID NO: 870099 - protein, 30 aa, Mycobacterium
VAGLLLDVIGMPDPPRRLLVGPDAYRYATA

SEQ ID NO: 870100 - protein, 28 aa, Mycobacterium
VAGLLRRLEGVPIATVVRLPNADPAPIG

SEQ ID NO: 870101 - protein, 24 aa, Mycobacterium
VAGLLTARRPLITEPPFVAPHHTS

SEQ ID NO: 870102 - protein, 26 aa, Mycobacterium
VAGLLTGPYLSGAQRFCPPRHWLEIG

SEQ ID NO: 870103 - protein, 41 aa, Mycobacterium
VAGLSGLVWSGPSSMLMTAAVTPYVAWLQAGAAQAAQTAEQ

SEQ ID NO: 870104 - protein, 25 aa, Mycobacterium
VAGMADMGLFGLPFPEEYGGMGGDY

SEQ ID NO: 870105 - protein, 20 aa, Mycobacterium
VAGMFAAHAQAYQALSQQAD

SEQ ID NO: 870106 - protein, 29 aa, Mycobacterium
VAGNSVLTERFLRYYAGYVDKSHGASTPV

SEQ ID NO: 870107 - protein, 18 aa, Mycobacterium
VAGPGFINLRLEASAQAV

SEQ ID NO: 870108 - protein, 24 aa, Mycobacterium
VAGPGLRIYLAVAGGLHADEYLGS

SEQ ID NO: 870109 - protein, 28 aa, Mycobacterium
VAGPLLRRKFRLSKNTMAPLRIALDRGA

SEQ ID NO: 870110 - protein, 31 aa, Mycobacterium
VAGPLYHNAPLMFSSYGLLLGHHLVVQPKFD

SEQ ID NO: 870111 - protein, 36 aa, Mycobacterium
VAGPQVTLYFLGARLTAIYPLGPIFHGCGLNITVIS

SEQ ID NO: 870112 - protein, 38 aa, Mycobacterium
VAGPRPPRVPLSFAQSRLWFLEQLQGPSAVYNIPVVLH

SEQ ID NO: 870113 - protein, 28 aa, Mycobacterium
VAGPVMGRIGWFVESWLSPRLHRRNQYV

SEQ ID NO: 870114 - protein, 22 aa, Mycobacterium
VAGPYFRDLANDEQKARWFPGF

SEQ ID NO: 870115 - protein, 18 aa, Mycobacterium
VAGRGLGFTERPPAKPLI

SEQ ID NO: 870116 - protein, 29 aa, Mycobacterium
VAGRITTPLLPDDYLQLANPLWSARELRG

SEQ ID NO: 870117 - protein, 19 aa, Mycobacterium
VAGRKFRWQALADGKPVIT

SEQ ID NO: 870118 - protein, 23 aa, Mycobacterium
VAGRPMILKRFVKGITQEAVFQK

SEQ ID NO: 870119 - protein, 22 aa, Mycobacterium
VAGRRFHWEALRGEQVVVRVTV

SEQ ID NO: 870120 - protein, 18 aa, Mycobacterium
VAGRRFHWEALVGDKVVV

SEQ ID NO: 870121 - protein, 25 aa, Mycobacterium
VAGRYRTVRIGSHTARLLLAKNPAG

SEQ ID NO: 870122 - protein, 25 aa, Mycobacterium
VAGSLYPPLIVRGLGTRQVFSASTL

SEQ ID NO: 870123 - protein, 29 aa, Mycobacterium
VAGSSLTVFSGYRFLRHAAARGIPVAIIN

SEQ ID NO: 870124 - protein, 24 aa, Mycobacterium
VAGSWAPYLTMAEGIKIAAQSFSA

SEQ ID NO: 870125 - protein, 25 aa, Mycobacterium
VAGTAPRRRILVRRSLWVRHPTDSA

SEQ ID NO: 870126 - protein, 26 aa, Mycobacterium
VAGTKTFFPDVPLNSGLYAAITTDIG

SEQ ID NO: 870127 - protein, 28 aa, Mycobacterium
VAGTLFTVQTMLPLLNSGASIVLTGSTA

SEQ ID NO: 870128 - protein, 25 aa, Mycobacterium
VAGTPKFWAFRRGEFQLSYTTERAD

SEQ ID NO: 870129 - protein, 25 aa, Mycobacterium
VAGTRAWLNRQLRPIGKALDREGPD

SEQ ID NO: 870130 - protein, 20 aa, Mycobacterium
VAGVDTFFVATTPQYSFVSS

SEQ ID NO: 870131 - protein, 24 aa, Mycobacterium
VAGVGMDWRAVYAGWGARLVELPT

SEQ ID NO: 870132 - protein, 21 aa, Mycobacterium
VAGVPILPGPVAAPAAPVVPA

SEQ ID NO: 870133 - protein, 25 aa, Mycobacterium
VAGVSSGLLYYHFKDRDGLLAAALT

SEQ ID NO: 870134 - protein, 18 aa, Mycobacterium
VAGWIKRGPSGFIGTNKS

SEQ ID NO: 870135 - protein, 18 aa, Mycobacterium
VAGWIKRGPTGFIGTNKS

SEQ ID NO: 870136 - protein, 21 aa, Mycobacterium
VAGWLTGVVDAFEGLSALATP

SEQ ID NO: 870137 - protein, 19 aa, Mycobacterium
VAGWVVHRLGGDPALEMSL

SEQ ID NO: 870138 - protein, 27 aa, Mycobacterium
VAGYALGGGCELAMLCDLVIAADTARF

SEQ ID NO: 870139 - protein, 27 aa, Mycobacterium
VAGYALGGGCELAMMCDILIAADTAKF

SEQ ID NO: 870140 - protein, 24 aa, Mycobacterium
VAGYVRKGSLWPATFGLACCAIEM

SEQ ID NO: 870141 - protein, 25 aa, Mycobacterium
VAGYVRKGSLWPATFGLACCAIEMM

SEQ ID NO: 870142 - protein, 27 aa, Mycobacterium
VAHALRNHFWFVEQALRSAPDSPRRAY

SEQ ID NO: 870143 - protein, 27 aa, Mycobacterium
VAHDFGGPWALAWAAEHLGAVASITLI

SEQ ID NO: 870144 - protein, 33 aa, Mycobacterium
VAHGAEGPKPWWYRPMYSLFDQFLGAAETDPVL

SEQ ID NO: 870145 - protein, 30 aa, Mycobacterium
VAHGDALSWLRTMYALGRSAFQLGVLERGL

SEQ ID NO: 870146 - protein, 27 aa, Mycobacterium
VAHGLSNAMLLPAVTRFSVESAIGRYA

SEQ ID NO: 870147 - protein, 24 aa, Mycobacterium
VAHGTFFFHFPTKEHVLLELEQRE

SEQ ID NO: 870148 - protein, 23 aa, Mycobacterium
VAHGTFFFHFPTKEHVLVELENR

SEQ ID NO: 870149 - protein, 25 aa, Mycobacterium
VAHGWIPPGIALPQGVRLLPPKRRS

SEQ ID NO: 870150 - protein, 21 aa, Mycobacterium
VAHHNILFGDAWHDTFTDIID

SEQ ID NO: 870151 - protein, 20 aa, Mycobacterium
VAHLARLARLALTDAELDGY

SEQ ID NO: 870152 - protein, 20 aa, Mycobacterium
VAHLARLARLALTEDELDGF

SEQ ID NO: 870153 - protein, 20 aa, Mycobacterium
VAHLARLARLALTEDELDSF

SEQ ID NO: 870154 - protein, 20 aa, Mycobacterium
VAHLARLARLALTESELDHF

SEQ ID NO: 870155 - protein, 19 aa, Mycobacterium
VAHLARLSRLALTDAELDS

SEQ ID NO: 870156 - protein, 20 aa, Mycobacterium
VAHLARLSRLALTDSELDSF

SEQ ID NO: 870157 - protein, 20 aa, Mycobacterium
VAHLRLAGERHPRVMRLAVP

SEQ ID NO: 870158 - protein, 22 aa, Mycobacterium
VAHNVAFDYAFLAAEAELADIE

SEQ ID NO: 870159 - protein, 22 aa, Mycobacterium
VAHNVAFDYAFLAAEAELAEAE

SEQ ID NO: 870160 - protein, 24 aa, Mycobacterium
VAHPNIALIKYWGKRDEEFMLPMT

SEQ ID NO: 870161 - protein, 23 aa, Mycobacterium
VAHPVGVQPLQLGDVLGLVDERE

SEQ ID NO: 870162 - protein, 17 aa, Mycobacterium
VAHPWRTMPNNAMTPHV

SEQ ID NO: 870163 - protein, 24 aa, Mycobacterium
VAHRLAGEWAFRRARREPPLAVLL

SEQ ID NO: 870164 - protein, 25 aa, Mycobacterium
VAHSLVAERWPTVQEWALLGEEHED

SEQ ID NO: 870165 - protein, 19 aa, Mycobacterium
VAHSYSGLIADLYARMHPE

SEQ ID NO: 870166 - protein, 23 aa, Mycobacterium
VAHTGIGFRGWLAAAEGWGLVNP

SEQ ID NO: 870167 - protein, 19 aa, Mycobacterium
VAHVFDTYAQEYQTFGAHM

SEQ ID NO: 870168 - protein, 20 aa, Mycobacterium
VAHWKTRGLDLDPIFAVPTD

SEQ ID NO: 870169 - protein, 21 aa, Mycobacterium
VAHWNLARFAETLLPLIAEDV

SEQ ID NO: 870170 - protein, 24 aa, Mycobacterium
VAHYWRTRYDWRKFEARLNEIGQF

SEQ ID NO: 870171 - protein, 27 aa, Mycobacterium
VAIAAHRPTLLGSATPFFVAFMAAQAK

SEQ ID NO: 870172 - protein, 18 aa, Mycobacterium
VAIAFPRNPIHLAHQAVD

SEQ ID NO: 870173 - protein, 17 aa, Mycobacterium
VAIARELAGWCWSLATL

SEQ ID NO: 870174 - protein, 35 aa, Mycobacterium
VAIDAASPIDLAAAANLNVAAPIDAAAGANVLAYG

SEQ ID NO: 870175 - protein, 22 aa, Mycobacterium
VAIDATMGLPLALGVEALGGPV

SEQ ID NO: 870176 - protein, 34 aa, Mycobacterium
VAIDHGVWLRPFRNLIYVMPPYICTPAEIATITS

SEQ ID NO: 870177 - protein, 18 aa, Mycobacterium
VAIDLRDDWPAALLEAGF

SEQ ID NO: 870178 - protein, 24 aa, Mycobacterium
VAIDRPIFVTGLPRTGTTALHRLL

SEQ ID NO: 870179 - protein, 20 aa, Mycobacterium
VAIENAVWPDLFIAGGGISR

SEQ ID NO: 870180 - protein, 19 aa, Mycobacterium
VAIHPGQLARRATAAMLAA

SEQ ID NO: 870181 - protein, 30 aa, Mycobacterium
VAIIAEILGLPRDSYPRMLGWGRSGSPLLD

SEQ ID NO: 870182 - protein, 34 aa, Mycobacterium
VAIILRTENSVMFVIPWGSHWIIGTTDTDWDLDL

SEQ ID NO: 870183 - protein, 17 aa, Mycobacterium
VAILAVLKTGAAYLPID

SEQ ID NO: 870184 - protein, 17 aa, Mycobacterium
VAILSRQRPEIDWFPWL

SEQ ID NO: 870185 - protein, 22 aa, Mycobacterium
VAINYLGPVHVCSAFLPGMIET

SEQ ID NO: 870186 - protein, 18 aa, Mycobacterium
VAIQTFCPYKGICSYYDI

SEQ ID NO: 870187 - protein, 18 aa, Mycobacterium
VAISKRRKARRARGPLSL

SEQ ID NO: 870188 - protein, 20 aa, Mycobacterium
VAITEFVVSPLFGSPPAAEL

SEQ ID NO: 870189 - protein, 18 aa, Mycobacterium
VAITPRFVSWMPLRWLQP

SEQ ID NO: 870190 - protein, 21 aa, Mycobacterium
VAITQFVVSPLFGTPAAADLL

SEQ ID NO: 870191 - protein, 20 aa, Mycobacterium
VAIVCELARTILGPAHPVPW

SEQ ID NO: 870192 - protein, 18 aa, Mycobacterium
VAIVGSGPSGYFAAASLL

SEQ ID NO: 870193 - protein, 31 aa, Mycobacterium
VAIWSPEAKIIAERRLWLAVLRAQAELGVAV

SEQ ID NO: 870194 - protein, 22 aa, Mycobacterium
VAKAELEWSLTRSVLWEAAAMP

SEQ ID NO: 870195 - protein, 25 aa, Mycobacterium
VAKEQHWLPRLAPQLPLPIPQPVAM

SEQ ID NO: 870196 - protein, 25 aa, Mycobacterium
VAKEYGALLQDAAAFLGRAVQAFES

SEQ ID NO: 870197 - protein, 26 aa, Mycobacterium
VAKMGEMGLFGLPFPEDYGGMGGDYF

SEQ ID NO: 870198 - protein, 25 aa, Mycobacterium
VAKMGEMGLFGLPFPEEYGGMGGDY

SEQ ID NO: 870199 - protein, 26 aa, Mycobacterium
VAKMGEMGLFGLPFPEEYGGMGGDYF

SEQ ID NO: 870200 - protein, 26 aa, Mycobacterium
VAKMINDPMYAMKMLTGYDANGSAAP

SEQ ID NO: 870201 - protein, 25 aa, Mycobacterium
VAKNMIQAFFFDLQAINAGGSRPDG

SEQ ID NO: 870202 - protein, 24 aa, Mycobacterium
VAKNMIQAFFFDLQAINAGKSRPD

SEQ ID NO: 870203 - protein, 34 aa, Mycobacterium
VAKNRVVIIPGLQYKALTTGGRLVPRNVVRALTK

SEQ ID NO: 870204 - protein, 24 aa, Mycobacterium
VAKPDLLQIITTDSGPIITRASGR

SEQ ID NO: 870205 - protein, 23 aa, Mycobacterium
VAKPDLLQIITTGSAPIITRASE

SEQ ID NO: 870206 - protein, 24 aa, Mycobacterium
VAKPDLLQLITTDSAPIITRASAR

SEQ ID NO: 870207 - protein, 23 aa, Mycobacterium
VAKPKLYRYFEDKADLHSAVLER

SEQ ID NO: 870208 - protein, 28 aa, Mycobacterium
VAKPSTGMLFFLASSRILNWGKGVRMSM

SEQ ID NO: 870209 - protein, 23 aa, Mycobacterium
VAKPVQWYDIAQVLPELGVQRTV

SEQ ID NO: 870210 - protein, 17 aa, Mycobacterium
VAKQLLHLAQRFGTREG

SEQ ID NO: 870211 - protein, 25 aa, Mycobacterium
VAKQTVYRWWSSKVDVLMDVFLEDA

SEQ ID NO: 870212 - protein, 18 aa, Mycobacterium
VAKRLMQILGTSAYVPDL

SEQ ID NO: 870213 - protein, 20 aa, Mycobacterium
VAKRLWRDSGLKPADIQTAF

SEQ ID NO: 870214 - protein, 17 aa, Mycobacterium
VAKRPWVVNGELAVRDV

SEQ ID NO: 870215 - protein, 18 aa, Mycobacterium
VAKTLLAGVPLVVVPGGG

SEQ ID NO: 870216 - protein, 24 aa, Mycobacterium
VAKTLLVRTLAAALQLDFTRVQFT

SEQ ID NO: 870217 - protein, 23 aa, Mycobacterium
VAKTLLVRTLAAALQLEFKRVQF

SEQ ID NO: 870218 - protein, 22 aa, Mycobacterium
VAKTLMVRALAAALQLEFKRVQ

SEQ ID NO: 870219 - protein, 22 aa, Mycobacterium
VAKVILADLPDAELRPFVATMD

SEQ ID NO: 870220 - protein, 24 aa, Mycobacterium
VAKVPQLIPLPDPGMVRTVVAEHV

SEQ ID NO: 870221 - protein, 18 aa, Mycobacterium
VAKWRFVGTDIDWDNTYF

SEQ ID NO: 870222 - protein, 18 aa, Mycobacterium
VAKYGGRFLARGGDLEIL

SEQ ID NO: 870223 - protein, 25 aa, Mycobacterium
VALAAVLPDLPFAVGPVPEWLHDND

SEQ ID NO: 870224 - protein, 18 aa, Mycobacterium
VALADRLNRWRRLGCWVS

SEQ ID NO: 870225 - protein, 26 aa, Mycobacterium
VALADRLPAYMVPAAVVVLDALPLTV

SEQ ID NO: 870226 - protein, 28 aa, Mycobacterium
VALAGELKLLRAQLGHCLPDLVAEVRRV

SEQ ID NO: 870227 - protein, 17 aa, Mycobacterium
VALALNGKVTLLEALPR

SEQ ID NO: 870228 - protein, 33 aa, Mycobacterium
VALARFDELHRQRPWLENPVNQRFLAYFADRDW

SEQ ID NO: 870229 - protein, 39 aa, Mycobacterium
VALDDLIGFFRDPVKGFFRALDFTLPWDVDGLDDAIPVD

SEQ ID NO: 870230 - protein, 21 aa, Mycobacterium
VALDILGPVPLEPVRVRAWIE

SEQ ID NO: 870231 - protein, 32 aa, Mycobacterium
VALEHGVWLRPFRNLVYAMPPYICAPDEIAQI

SEQ ID NO: 870232 - protein, 26 aa, Mycobacterium
VALEPYGGAWLNSWLDRDLGVSGRLS

SEQ ID NO: 870233 - protein, 23 aa, Mycobacterium
VALFELVADFLRPVFAAHWDQLE

SEQ ID NO: 870234 - protein, 18 aa, Mycobacterium
VALFRPAAVAVHLAPPRG

SEQ ID NO: 870235 - protein, 25 aa, Mycobacterium
VALGENYWAAPGLVTSLRKANLIEH

SEQ ID NO: 870236 - protein, 24 aa, Mycobacterium
VALGFGFRCGFLGLLHMEISRERL

SEQ ID NO: 870237 - protein, 22 aa, Mycobacterium
VALGFGFRCGFLGLLHMEITRE

SEQ ID NO: 870238 - protein, 26 aa, Mycobacterium
VALGVPTPALLRQQQWMLGPSAGGVD

SEQ ID NO: 870239 - protein, 20 aa, Mycobacterium
VALGWIASRWPGLLPEVQRL

SEQ ID NO: 870240 - protein, 19 aa, Mycobacterium
VALHAWSDMGPLDFPSTNW

SEQ ID NO: 870241 - protein, 18 aa, Mycobacterium
VALHHCVVALASMGWQAT

SEQ ID NO: 870242 - protein, 17 aa, Mycobacterium
VALHRVVAVGVVPGDPV

SEQ ID NO: 870243 - protein, 28 aa, Mycobacterium
VALHSCAAALPWDLLQRSGISAVSVDVA

SEQ ID NO: 870244 - protein, 29 aa, Mycobacterium
VALHTTVMPFILRGVALLGIDSVQMPIGP

SEQ ID NO: 870245 - protein, 26 aa, Mycobacterium
VALIDVAHWASEFPWCAQAAELLRGQ

SEQ ID NO: 870246 - protein, 20 aa, Mycobacterium
VALITDGRLTVPISATYPLD

SEQ ID NO: 870247 - protein, 21 aa, Mycobacterium
VALIVGVPMDFRLGFGAVFGQ

SEQ ID NO: 870248 - protein, 29 aa, Mycobacterium
VALKPTYGLVPLYPMSAFGSLAHVGPMTR

SEQ ID NO: 870249 - protein, 20 aa, Mycobacterium
VALLAPWEQALQNLPGLPGE

SEQ ID NO: 870250 - protein, 18 aa, Mycobacterium
VALLEWLQTTHPAPKVSA

SEQ ID NO: 870251 - protein, 18 aa, Mycobacterium
VALLPIAPELSAILIPLG

SEQ ID NO: 870252 - protein, 19 aa, Mycobacterium
VALLPIAPELSAILIPLGE

SEQ ID NO: 870253 - protein, 20 aa, Mycobacterium
VALLRACRSTRDKLIVLLMA

SEQ ID NO: 870254 - protein, 18 aa, Mycobacterium
VALLRICGGADLAAMTGF

SEQ ID NO: 870255 - protein, 20 aa, Mycobacterium
VALLRLACEAADAALADLVE

SEQ ID NO: 870256 - protein, 19 aa, Mycobacterium
VALLRLACEAADAALKDLL

SEQ ID NO: 870257 - protein, 19 aa, Mycobacterium
VALLRLACEAADAALTDLV

SEQ ID NO: 870258 - protein, 17 aa, Mycobacterium
VALLRRGGGADLAAMAG

SEQ ID NO: 870259 - protein, 17 aa, Mycobacterium
VALPAGHNFPLACPGLL

SEQ ID NO: 870260 - protein, 17 aa, Mycobacterium
VALPLHPEYRTMPMVWY

SEQ ID NO: 870261 - protein, 17 aa, Mycobacterium
VALPNRLVAWGGSAGGL

SEQ ID NO: 870262 - protein, 23 aa, Mycobacterium
VALPVVRTFITRIKERAKGAEVS

SEQ ID NO: 870263 - protein, 18 aa, Mycobacterium
VALQLLTSPLHTFALYSE

SEQ ID NO: 870264 - protein, 25 aa, Mycobacterium
VALQNLLPCIYLVDSGGAFLPHQDE

SEQ ID NO: 870265 - protein, 18 aa, Mycobacterium
VALRAYWEMDRAAANTRK

SEQ ID NO: 870266 - protein, 17 aa, Mycobacterium
VALRCAVELGIGVLHVP

SEQ ID NO: 870267 - protein, 24 aa, Mycobacterium
VALREAALASLRLLADSEAAGAGS

SEQ ID NO: 870268 - protein, 20 aa, Mycobacterium
VALREAALASLRLLAGEAPS

SEQ ID NO: 870269 - protein, 28 aa, Mycobacterium
VALRFEAAGYRVLALFLSACSAPGHIKY

SEQ ID NO: 870270 - protein, 18 aa, Mycobacterium
VALRFLGRSTTWGELDRR

SEQ ID NO: 870271 - protein, 18 aa, Mycobacterium
VALRFQSAGYRILALFVS

SEQ ID NO: 870272 - protein, 18 aa, Mycobacterium
VALRLSVGSLFDNIVWAV

SEQ ID NO: 870273 - protein, 23 aa, Mycobacterium
VALRLVCISEFEGQYKRFAYGLP

SEQ ID NO: 870274 - protein, 18 aa, Mycobacterium
VALRRLICERFITEARYR

SEQ ID NO: 870275 - protein, 19 aa, Mycobacterium
VALSFIPACGRCEPCSRGM

SEQ ID NO: 870276 - protein, 17 aa, Mycobacterium
VALSLKVPFSGFPAQLH

SEQ ID NO: 870277 - protein, 17 aa, Mycobacterium
VALSRLPRDEWIGVQAD

SEQ ID NO: 870278 - protein, 24 aa, Mycobacterium
VALSVRALFEAPTIRRLAPRLDGG

SEQ ID NO: 870279 - protein, 23 aa, Mycobacterium
VALTIGPWTHSQLLSKGLAVSAQ

SEQ ID NO: 870280 - protein, 17 aa, Mycobacterium
VALTRRYQKWLTTHPDA

SEQ ID NO: 870281 - protein, 25 aa, Mycobacterium
VALVDGRLVWFLERGGRSLLSFGAD

SEQ ID NO: 870282 - protein, 23 aa, Mycobacterium
VALVDVAHWASEFPWCAQAARVL

SEQ ID NO: 870283 - protein, 17 aa, Mycobacterium
VALVFSAYPTKHARIGN

SEQ ID NO: 870284 - protein, 20 aa, Mycobacterium
VALVGGLGVHRLGHRRGGVR

SEQ ID NO: 870285 - protein, 18 aa, Mycobacterium
VALVLRQAVPPLVDLGGI

SEQ ID NO: 870286 - protein, 24 aa, Mycobacterium
VALVNSWSAAFARYGRTVGQVLLS

SEQ ID NO: 870287 - protein, 24 aa, Mycobacterium
VALVPTIIYLLLDHPRRSEFDLST

SEQ ID NO: 870288 - protein, 22 aa, Mycobacterium
VALWDVLKACRRAGSADSAIEP

SEQ ID NO: 870289 - protein, 18 aa, Mycobacterium
VALWLELGAPRWVTAEDR

SEQ ID NO: 870290 - protein, 19 aa, Mycobacterium
VALYGLLDALLFRGSLDAR

SEQ ID NO: 870291 - protein, 23 aa, Mycobacterium
VALYLLDDVLGLNAQAGPKADAR

SEQ ID NO: 870292 - protein, 17 aa, Mycobacterium
VALYQRFVAEMKAAGLS

SEQ ID NO: 870293 - protein, 17 aa, Mycobacterium
VAMAFESYALYPQKTVA

SEQ ID NO: 870294 - protein, 26 aa, Mycobacterium
VAMESRARLFPQGLAAFIGLRDQHCR

SEQ ID NO: 870295 - protein, 27 aa, Mycobacterium
VAMESRARLFPRGLAAFIELRDQRCRT

SEQ ID NO: 870296 - protein, 26 aa, Mycobacterium
VAMESRSRIFPRGLAAFIGLRDQRCR

SEQ ID NO: 870297 - protein, 27 aa, Mycobacterium
VAMESRSRLFPRGLAAFIELRDQRCRT

SEQ ID NO: 870298 - protein, 24 aa, Mycobacterium
VAMFNQFCYIQLSGSRTKEPDDLA

SEQ ID NO: 870299 - protein, 24 aa, Mycobacterium
VAMFNQFCYLQLSGARAREPDDQA

SEQ ID NO: 870300 - protein, 22 aa, Mycobacterium
VAMGKALFYRQIETDIESAYAD

SEQ ID NO: 870301 - protein, 24 aa, Mycobacterium
VAMGKGEASLWLEDFRGETTATMV

SEQ ID NO: 870302 - protein, 33 aa, Mycobacterium
VAMILRTEKSVMFIIPWGSHWIIGTTDTDWNLD

SEQ ID NO: 870303 - protein, 34 aa, Mycobacterium
VAMILRTEKSVMFIIPWGSHWIIGTTDTDWNLDL

SEQ ID NO: 870304 - protein, 18 aa, Mycobacterium
VAMLLPRCAEAIVAVLAV

SEQ ID NO: 870305 - protein, 17 aa, Mycobacterium
VAMLLVNSTEFIQVLLG

SEQ ID NO: 870306 - protein, 24 aa, Mycobacterium
VAMLVEQMLLERGVAAYVLDGDNL

SEQ ID NO: 870307 - protein, 20 aa, Mycobacterium
VAMLVRMRRVARRFGRTRPR

SEQ ID NO: 870308 - protein, 28 aa, Mycobacterium
VAMQFAYQFPQFVDRLILVGAGGVTKDV

SEQ ID NO: 870309 - protein, 20 aa, Mycobacterium
VAMREAALASLRLLATEDGD

SEQ ID NO: 870310 - protein, 30 aa, Mycobacterium; identical to SEQ ID NO: 742731

SEQ ID NO: 870311 - protein, 22 aa, Mycobacterium
VAMTPALLNRLATAAGSPSTAM

SEQ ID NO: 870312 - protein, 17 aa, Mycobacterium
VAMVGLSGIPFTNVFNA

SEQ ID NO: 870313 - protein, 23 aa, Mycobacterium
VAMVLRRLLRLCARYSAEPGCGP

SEQ ID NO: 870314 - protein, 26 aa, Mycobacterium
VAMVLRRLLRLCARYSAHPTVIFASA

SEQ ID NO: 870315 - protein, 21 aa, Mycobacterium
VAMYGFVPSAGAVLAEWGADV

SEQ ID NO: 870316 - protein, 27 aa, Mycobacterium
VANAIALRLGWRLFEPMLRSATGLDEL

SEQ ID NO: 870317 - protein, 23 aa, Mycobacterium
VANAITFLLSDQADWITGAILNV

SEQ ID NO: 870318 - protein, 25 aa, Mycobacterium
VANCLVAIAILDVLGVSAATAAPGI

SEQ ID NO: 870319 - protein, 18 aa, Mycobacterium
VANHWRLRRSGNATIVEL

SEQ ID NO: 870320 - protein, 22 aa, Mycobacterium
VANLAELRRALGDSATYTVAKN

SEQ ID NO: 870321 - protein, 23 aa, Mycobacterium
VANLAELRRSLGASATYSVAKNT

SEQ ID NO: 870322 - protein, 33 aa, Mycobacterium
VANNYGLGYISPWVKLPAPVKFAFADESIPIAE

SEQ ID NO: 870323 - protein, 17 aa, Mycobacterium
VANPPPYWQAAAEQGLQ

SEQ ID NO: 870324 - protein, 19 aa, Mycobacterium
VANPYAWIRTPMTAEEICR

SEQ ID NO: 870325 - protein, 20 aa, Mycobacterium
VANYLLIPTRADQASLGGVE

SEQ ID NO: 870326 - protein, 25 aa, Mycobacterium
VAPAAVHWYYPTKDDLFAAAVTSIF

SEQ ID NO: 870327 - protein, 26 aa, Mycobacterium
VAPAIISLTLLPKLSARAAARYYLTG

SEQ ID NO: 870328 - protein, 26 aa, Mycobacterium
VAPAIISLTLLPKLSPRAAARYYLTG

SEQ ID NO: 870329 - protein, 26 aa, Mycobacterium
VAPASLRDFYIAYRAVVRAKTDCVRL

SEQ ID NO: 870330 - protein, 17 aa, Mycobacterium
VAPDDFSTPLRLLARRI

SEQ ID NO: 870331 - protein, 28 aa, Mycobacterium
VAPDQAAYRVLWFVSSPSNISGATIPEG

SEQ ID NO: 870332 - protein, 17 aa, Mycobacterium
VAPFYINAYLAADSARG

SEQ ID NO: 870333 - protein, 25 aa, Mycobacterium
VAPGEWSYLAAGLKDKLRNAFGQNG

SEQ ID NO: 870334 - protein, 26 aa, Mycobacterium
VAPGEWWALIRVGCAGRLLYSPAVQV

SEQ ID NO: 870335 - protein, 24 aa, Mycobacterium
VAPGLMIPGKIDKLGYKGIDTTEL

SEQ ID NO: 870336 - protein, 23 aa, Mycobacterium
VAPGLTGELLARFAPDSAARSDV

SEQ ID NO: 870337 - protein, 24 aa, Mycobacterium
VAPGLTIPGKLDKLGYKGIDTTEL

SEQ ID NO: 870338 - protein, 20 aa, Mycobacterium
VAPGPLYPVSTVLAALVDCA

SEQ ID NO: 870339 - protein, 24 aa, Mycobacterium
VAPGQLAIAAFSPPLDKVGNSVRA

SEQ ID NO: 870340 - protein, 36 aa, Mycobacterium
VAPGSPLLGLMLPYSPIHHLLLAPVPGHAGPVPDAL

SEQ ID NO: 870341 - protein, 24 aa, Mycobacterium
VAPHQHFPRLRLELDRGLGWKAEV

SEQ ID NO: 870342 - protein, 21 aa, Mycobacterium
VAPHQSCLWGFGRAASLELPH

SEQ ID NO: 870343 - protein, 27 aa, Mycobacterium
VAPIAALIRMLWCVDPHLDLLGIGGGV

SEQ ID NO: 870344 - protein, 26 aa, Mycobacterium
VAPKPVPPLDIWLGGSAPAAFRRIGA

SEQ ID NO: 870345 - protein, 22 aa, Mycobacterium
VAPLAQALWLRGAALTMLQQPT

SEQ ID NO: 870346 - protein, 23 aa, Mycobacterium
VAPLFHTRYEPLWALCAELDLTV

SEQ ID NO: 870347 - protein, 18 aa, Mycobacterium
VAPMPGGWPIELGQMLRY

SEQ ID NO: 870348 - protein, 18 aa, Mycobacterium
VAPMTFVSILAKLVQSDF

SEQ ID NO: 870349 - protein, 19 aa, Mycobacterium
VAPPAMAQVWTMAGLYGER

SEQ ID NO: 870350 - protein, 30 aa, Mycobacterium
VAPPDTTIVSWLPFYHDMGLVLGVCAPVLG

SEQ ID NO: 870351 - protein, 17 aa, Mycobacterium
VAPPIPKLLVSRQLRPV

SEQ ID NO: 870352 - protein, 25 aa, Mycobacterium
VAPPVFAIVPVFESLLTPTVDVAPV

SEQ ID NO: 870353 - protein, 26 aa, Mycobacterium
VAPQKPWFMYFCPGCGHAPHHVFKDW

SEQ ID NO: 870354 - protein, 24 aa, Mycobacterium
VAPRFLDTLTPFRPDRRWGGDNTD

SEQ ID NO: 870355 - protein, 31 aa, Mycobacterium
VAPRHRAIQWWRSPHWLCPYGATAVSRAALA

SEQ ID NO: 870356 - protein, 29 aa, Mycobacterium
VAPSIISLTLLPKMTPRSAGRYFLTGERF

SEQ ID NO: 870357 - protein, 25 aa, Mycobacterium
VAPSRRRVYRPPSPPTPQTLAAVVA

SEQ ID NO: 870358 - protein, 25 aa, Mycobacterium
VAPTLPGPGLPRSCAVYGASVLVLP

SEQ ID NO: 870359 - protein, 18 aa, Mycobacterium
VAPTLQPIRPLRCGPAAS

SEQ ID NO: 870360 - protein, 18 aa, Mycobacterium
VAPTLQQMRPLRGGPSGT

SEQ ID NO: 870361 - protein, 34 aa, Mycobacterium
VAPTQAWRKTFGENFFYILYFQEPGVADAELNSD

SEQ ID NO: 870362 - protein, 19 aa, Mycobacterium
VAPVLRLRALVRDSVGLGS

SEQ ID NO: 870363 - protein, 17 aa, Mycobacterium
VAPVPAYATLALGADPI

SEQ ID NO: 870364 - protein, 20 aa, Mycobacterium
VAPVPFLSSAVLSTVALLRA

SEQ ID NO: 870365 - protein, 52 aa, Mycobacterium
VAPVRPEAWLGYFLSRLLPGLNRHFMYPIPYWLGLDIDTLIPRLQRLIDNVA

SEQ ID NO: 870366 - protein, 26 aa, Mycobacterium
VAPVSGKLLKLMPHAYVVMTADNVGV

SEQ ID NO: 870367 - protein, 25 aa, Mycobacterium
VAPYSPYIFAEILAAAGVPAGVFNL

SEQ ID NO: 870368 - protein, 17 aa, Mycobacterium
VAPYVAWMRATAAAAEQ

SEQ ID NO: 870369 - protein, 18 aa, Mycobacterium
VAQAEAWRRVAATPPPLP

SEQ ID NO: 870370 - protein, 18 aa, Mycobacterium
VAQAWHWVDPERAIPEVA

SEQ ID NO: 870371 - protein, 18 aa, Mycobacterium
VAQCSPGARLPLADAARQ

SEQ ID NO: 870372 - protein, 26 aa, Mycobacterium
VAQEKIIVGSGLPYTIVRATQFQEFA

SEQ ID NO: 870373 - protein, 18 aa, Mycobacterium
VAQFAPLLCGGLPHERER

SEQ ID NO: 870374 - protein, 19 aa, Mycobacterium
VAQFLTEWLAAVEPALDAT

SEQ ID NO: 870375 - protein, 21 aa, Mycobacterium
VAQFVAEMHRAGWRGHWGVEI

SEQ ID NO: 870376 - protein, 25 aa, Mycobacterium
VAQGISVYAALRRAADTRCDGRSRG

SEQ ID NO: 870377 - protein, 27 aa, Mycobacterium
VAQGKDFAVRQIPLREITKAVVQVEFS

SEQ ID NO: 870378 - protein, 24 aa, Mycobacterium
VAQIALNWLLRRTSVSSVIIGARD

SEQ ID NO: 870379 - protein, 23 aa, Mycobacterium
VAQILAARLAFLVSGGTGAGKTT

SEQ ID NO: 870380 - protein, 30 aa, Mycobacterium
VAQKIQYAAMLWLARLLGGIRPPLTRSGIR

SEQ ID NO: 870381 - protein, 17 aa, Mycobacterium
VAQLAIPIPSVTTPQMF

SEQ ID NO: 870382 - protein, 24 aa, Mycobacterium
VAQLALEHGIPLLRPDRPNSDEFV

SEQ ID NO: 870383 - protein, 19 aa, Mycobacterium
VAQLELVLPAMAGLVGSLT

SEQ ID NO: 870384 - protein, 18 aa, Mycobacterium
VAQLLYAGAPRTLDPIFA

SEQ ID NO: 870385 - protein, 28 aa, Mycobacterium
VAQNVARWLVLYLRRPGGQTQFAAPVWM

SEQ ID NO: 870386 - protein, 32 aa, Mycobacterium
VAQPWLADHAVAGTVLFPGAGFVELMLRAGDE

SEQ ID NO: 870387 - protein, 23 aa, Mycobacterium
VAQQAQKLVYRYATRRLKDDDVV

SEQ ID NO: 870388 - protein, 27 aa, Mycobacterium
VAQQPHRGFVVLPLTKRDLADVAYVQA

SEQ ID NO: 870389 - protein, 26 aa, Mycobacterium
VAQRLAKDGFTLVLGYHPGSEAPQTP

SEQ ID NO: 870390 - protein, 19 aa, Mycobacterium
VAQRLLTRNGWRSTTLAQI

SEQ ID NO: 870391 - protein, 39 aa, Mycobacterium
VAQRPIGVVGAITPWNFPLGLAMWKIAPALLAGNTVVVK

SEQ ID NO: 870392 - protein, 18 aa, Mycobacterium
VAQRRLPLLISSGADVHV

SEQ ID NO: 870393 - protein, 25 aa, Mycobacterium
VAQRRWVVIPFWHPQALHKRFRIRR

SEQ ID NO: 870394 - protein, 28 aa, Mycobacterium
VAQTVARWLVLYLRRPGGQTQFAAPVWM

SEQ ID NO: 870395 - protein, 31 aa, Mycobacterium
VAQVARQLISSGYIGFFLCPGVPELSFRSHV

SEQ ID NO: 870396 - protein, 22 aa, Mycobacterium
VAQVPRIRWPAAAFPVRAVRAG

SEQ ID NO: 870397 - protein, 20 aa, Mycobacterium
VAQYIYQAAIGRGYSPHDAT

SEQ ID NO: 870398 - protein, 19 aa, Mycobacterium
VARACPWANRAIIVRRLLG

SEQ ID NO: 870399 - protein, 46 aa, Mycobacterium
VARAFDAARAATVHPLMVAINRNRFVQLVASNVLGLNAPAIASAEA

SEQ ID NO: 870400 - protein, 27 aa, Mycobacterium
VARAGKLPVTLFTAGGIATPADAAMMM

SEQ ID NO: 870401 - protein, 25 aa, Mycobacterium
VARALAADPPILLMDEPFSAVDPVV

SEQ ID NO: 870402 - protein, 25 aa, Mycobacterium
VARAQLRAIFGELLRQLPGIQAGDP

SEQ ID NO: 870403 - protein, 25 aa, Mycobacterium
VARARPFYRLFPYDEGALLLTDAGP

SEQ ID NO: 870404 - protein, 19 aa, Mycobacterium
VARASFFPVIPVCSQSGVG

SEQ ID NO: 870405 - protein, 17 aa, Mycobacterium
VARASTLFLRRGEQPPG

SEQ ID NO: 870406 - protein, 25 aa, Mycobacterium
VARAVRDFNADLPVLTLPHGVFGDR

SEQ ID NO: 870407 - protein, 19 aa, Mycobacterium
VARAVRPPTPGRRLPKSLT

SEQ ID NO: 870408 - protein, 18 aa, Mycobacterium
VARAWREMLWGYNEVPED

SEQ ID NO: 870409 - protein, 17 aa, Mycobacterium
VARAWTSFAPTVVSLPD

SEQ ID NO: 870410 - protein, 25 aa, Mycobacterium
VARAYQSWIVANEPPPWLAGKEFAA

SEQ ID NO: 870411 - protein, 26 aa, Mycobacterium
VARDDAFRSWWDLAGNRAASPSAARA

SEQ ID NO: 870412 - protein, 25 aa, Mycobacterium
VARDDLFTAFVPFAARWPVEVHIYP

SEQ ID NO: 870413 - protein, 22 aa, Mycobacterium
VARDLGPDYFVPAGCRGSGNPA

SEQ ID NO: 870414 - protein, 24 aa, Mycobacterium
VARDSLVKTALFGSDPNWGRVLAA

SEQ ID NO: 870415 - protein, 27 aa, Mycobacterium
VAREAILRIFGPLLDAAPTLGAGLDWK

SEQ ID NO: 870416 - protein, 25 aa, Mycobacterium
VAREALDRGIPVLRPSRPNSPEFVA

SEQ ID NO: 870417 - protein, 25 aa, Mycobacterium
VAREALERGIPLLRPARPNADEFVA

SEQ ID NO: 870418 - protein, 27 aa, Mycobacterium
VAREGLQPLIFGLWTMISEYKAAQPEI

SEQ ID NO: 870419 - protein, 17 aa, Mycobacterium
VARELKYSSPQTDFQRL

SEQ ID NO: 870420 - protein, 25 aa, Mycobacterium
VARFDEALALWRGIPELPDGRRGTS

SEQ ID NO: 870421 - protein, 27 aa, Mycobacterium
VARFEGYRGFLFGSLNPDVLPLTEHLG

SEQ ID NO: 870422 - protein, 27 aa, Mycobacterium
VARFESYRGFLFGSLNPDVLPLTEHLG

SEQ ID NO: 870423 - protein, 31 aa, Mycobacterium
VARFIGLGRGYRWLQLIDAAGLPLHDVERIP

SEQ ID NO: 870424 - protein, 20 aa, Mycobacterium
VARFLPYFTDVIVGDLRAGK

SEQ ID NO: 870425 - protein, 21 aa, Mycobacterium
VARFVEALATIRALWESGGEP

SEQ ID NO: 870426 - protein, 30 aa, Mycobacterium
VARGLRIARQLLLDIIDIGLPVGCEFLEPT

SEQ ID NO: 870427 - protein, 20 aa, Mycobacterium
VARGLSRFRYGPGAFKVDFA

SEQ ID NO: 870428 - protein, 21 aa, Mycobacterium
VARGSFFPVIPVCSGTGVGTL

SEQ ID NO: 870429 - protein, 24 aa, Mycobacterium
VARHRRFRFYLNVEIGRKLSHADL

SEQ ID NO: 870430 - protein, 28 aa, Mycobacterium
VARHVKRTLDAWLRELTATISAAQADGD

SEQ ID NO: 870431 - protein, 21 aa, Mycobacterium
VARIDVDLPWSQLAALPETYA

SEQ ID NO: 870432 - protein, 17 aa, Mycobacterium
VARIGLANYFAGAFLLP

SEQ ID NO: 870433 - protein, 23 aa, Mycobacterium
VARIKFPTPAACGRTPLVATGLS

SEQ ID NO: 870434 - protein, 20 aa, Mycobacterium
VARIKFPTPAPCGKTPLIAK

SEQ ID NO: 870435 - protein, 23 aa, Mycobacterium
VARIKFPTPAPCGRTPLVAKGLS

SEQ ID NO: 870436 - protein, 23 aa, Mycobacterium
VARIKFPTPAPCGRTPLVAKGLT

SEQ ID NO: 870437 - protein, 22 aa, Mycobacterium
VARIVPFNHPVLFAGSKIAAPL

SEQ ID NO: 870438 - protein, 23 aa, Mycobacterium
VARKLSFIAATVYALDAVLELSA

SEQ ID NO: 870439 - protein, 25 aa, Mycobacterium
VARKPRSLSFRDAAALPLTTITAWE

SEQ ID NO: 870440 - protein, 17 aa, Mycobacterium
VARLARHAVEYRDVVMA

SEQ ID NO: 870441 - protein, 21 aa, Mycobacterium
VARLGARLLLQTAIEAEVAAF

SEQ ID NO: 870442 - protein, 17 aa, Mycobacterium
VARLNWVKQGPAPAPVT

SEQ ID NO: 870443 - protein, 26 aa, Mycobacterium
VARLRRGQTLIGFLAPRNADNSIGAL

SEQ ID NO: 870444 - protein, 19 aa, Mycobacterium
VARLRRRETRLSPLTVRLM

SEQ ID NO: 870445 - protein, 18 aa, Mycobacterium
VARLSRMMVLGPLGESFG

SEQ ID NO: 870446 - protein, 23 aa, Mycobacterium
VARLSTLWFQALAGICAHVRDGG

SEQ ID NO: 870447 - protein, 23 aa, Mycobacterium
VARMWSDDIAVWRAGAHRDDDKA

SEQ ID NO: 870448 - protein, 41 aa, Mycobacterium
VARNRYLIYTSLDIRALYLFKRTMWLPYSIAMKQVNPLFTR

SEQ ID NO: 870449 - protein, 23 aa, Mycobacterium
VARNYPDFPIVLEAVRECLQDVY

SEQ ID NO: 870450 - protein, 23 aa, Mycobacterium
VARPYPIPVICALFGAPREDWEL

SEQ ID NO: 870451 - protein, 23 aa, Mycobacterium
VARQLLEVLDRNGVRRGADAPLR

SEQ ID NO: 870452 - protein, 22 aa, Mycobacterium
VARQTLHRWLARYEAQGLDGLV

SEQ ID NO: 870453 - protein, 18 aa, Mycobacterium
VARRGGITVLPQDLPVQA

SEQ ID NO: 870454 - protein, 24 aa, Mycobacterium
VARRGGIVVLPQDLPIPAVHQTVE

SEQ ID NO: 870455 - protein, 22 aa, Mycobacterium
VARRGLPLITESFQYPIEGFTD

SEQ ID NO: 870456 - protein, 24 aa, Mycobacterium
VARRGLTMALIYRGDYWQIAYLMP

SEQ ID NO: 870457 - protein, 19 aa, Mycobacterium
VARRHGLRASLSPPPFAGG

SEQ ID NO: 870458 - protein, 19 aa, Mycobacterium
VARRIPMFEFAVRSLIPSG

SEQ ID NO: 870459 - protein, 18 aa, Mycobacterium
VARRLAGLFASYARQRPE

SEQ ID NO: 870460 - protein, 18 aa, Mycobacterium
VARRLAGLFASYARQRPR

SEQ ID NO: 870461 - protein, 20 aa, Mycobacterium
VARRLAGLFASYARQRPRVL

SEQ ID NO: 870462 - protein, 20 aa, Mycobacterium
VARRLLNKHLTPFEYIDRGI

SEQ ID NO: 870463 - protein, 21 aa, Mycobacterium
VARRLMTDRYTRPVLVAAITE

SEQ ID NO: 870464 - protein, 19 aa, Mycobacterium
VARRLPVAEHALINQIVEQ

SEQ ID NO: 870465 - protein, 20 aa, Mycobacterium
VARRLPVAQYALLNQLDEQA

SEQ ID NO: 870466 - protein, 18 aa, Mycobacterium
VARRLWRDSGLEPADIQT

SEQ ID NO: 870467 - protein, 28 aa, Mycobacterium
VARRRGYRRVPLQPLMFGGGQERGLRPG

SEQ ID NO: 870468 - protein, 18 aa, Mycobacterium
VARRWEFRQVRLAAQTVA

SEQ ID NO: 870469 - protein, 20 aa, Mycobacterium
VARSNALLLNTFGAEVVLVA

SEQ ID NO: 870470 - protein, 17 aa, Mycobacterium
VARTLLRHWAASLGSPA

SEQ ID NO: 870471 - protein, 25 aa, Mycobacterium
VARTQLRAIFGELLHQLPDIRAGEP

SEQ ID NO: 870472 - protein, 23 aa, Mycobacterium
VARTTIFEAIRLASIVSGVAQAL

SEQ ID NO: 870473 - protein, 17 aa, Mycobacterium
VARTVRMFGIQKAFMEV

SEQ ID NO: 870474 - protein, 17 aa, Mycobacterium
VARTVRMFGIQNAFMNI

SEQ ID NO: 870475 - protein, 30 aa, Mycobacterium
VARVEWFRDEFLLYAKLVAGDWPYPRQPPG

SEQ ID NO: 870476 - protein, 19 aa, Mycobacterium
VARVGTVVMSWRLRTRHGL

SEQ ID NO: 870477 - protein, 33 aa, Mycobacterium
VARVLAMIEPVAALAYRFAQSSTVLFLGRHVGY

SEQ ID NO: 870478 - protein, 32 aa, Mycobacterium
VARVRTTWFADPWGVVFILVEKSRPERPYFAQ

SEQ ID NO: 870479 - protein, 32 aa, Mycobacterium
VARVRTTWFADPWGVVFILVEKSRPQRPYFAQ

SEQ ID NO: 870480 - protein, 21 aa, Mycobacterium
VARVVPSNFLTLFPEHEKHSL

SEQ ID NO: 870481 - protein, 23 aa, Mycobacterium
VARYIPRHMVNRATLPVFQRLTR

SEQ ID NO: 870482 - protein, 21 aa, Mycobacterium
VARYPNILKNALRCAGMVASE

SEQ ID NO: 870483 - protein, 17 aa, Mycobacterium
VASAAVVALALPGGTPL

SEQ ID NO: 870484 - protein, 17 aa, Mycobacterium
VASAPWPYNVLVHVAAW

SEQ ID NO: 870485 - protein, 25 aa, Mycobacterium
VASATPLPVIGVPVPLARLDGLDSL

SEQ ID NO: 870486 - protein, 25 aa, Mycobacterium
VASATPLPVIGVPVPLARLDGMDSL

SEQ ID NO: 870487 - protein, 38 aa, Mycobacterium
VASDVVVSWLPLFHDMGMMGLLIIPMYEGMDAVHITPA

SEQ ID NO: 870488 - protein, 25 aa, Mycobacterium
VASERAWFAESFVQLGLIPGDGGTW

SEQ ID NO: 870489 - protein, 20 aa, Mycobacterium
VASFQKLKQMDVQTTYPGHG

SEQ ID NO: 870490 - protein, 26 aa, Mycobacterium
VASGDPLLHGIGGTLIRLFGNARVTV

SEQ ID NO: 870491 - protein, 25 aa, Mycobacterium
VASGRIAYALGLHGPALTFDTACSS

SEQ ID NO: 870492 - protein, 17 aa, Mycobacterium
VASGWGPKAAWYRNVLA

SEQ ID NO: 870493 - protein, 20 aa, Mycobacterium
VASGWLVTAAKFEVEWPAEP

SEQ ID NO: 870494 - protein, 26 aa, Mycobacterium
VASGWRAPLRFLFIDGGHSEAAANED

SEQ ID NO: 870495 - protein, 41 aa, Mycobacterium
VASHKLLIRAGYIRPVAPGLYSWLPLGLRVLRRIEGIVREE

SEQ ID NO: 870496 - protein, 33 aa, Mycobacterium
VASHKYDLRAAARLGLRTAFVARPLEFGIGGAA

SEQ ID NO: 870497 - protein, 17 aa, Mycobacterium
VASIELLLSGDWKTRVA

SEQ ID NO: 870498 - protein, 17 aa, Mycobacterium
VASITEMFLAALAEPHT

SEQ ID NO: 870499 - protein, 19 aa, Mycobacterium
VASIVARRSPTLQWARSPE

SEQ ID NO: 870500 - protein, 24 aa, Mycobacterium
VASKAHARVLFRAGLLTEEQRDGL

SEQ ID NO: 870501 - protein, 18 aa, Mycobacterium
VASKWAVRGLTKSAALEL

SEQ ID NO: 870502 - protein, 18 aa, Mycobacterium
VASKWGVRGLAKSAALEL

SEQ ID NO: 870503 - protein, 22 aa, Mycobacterium
VASKWIPFGPVMTARARWLESV

SEQ ID NO: 870504 - protein, 27 aa, Mycobacterium
VASLDPRFPVFDLLAEPLLANDFGKSE

SEQ ID NO: 870505 - protein, 19 aa, Mycobacterium
VASLFSRRGYNIQSLAVGA

SEQ ID NO: 870506 - protein, 17 aa, Mycobacterium
VASLLGVRHRIDYEGQA

SEQ ID NO: 870507 - protein, 26 aa, Mycobacterium
VASLQLGLSLIWTEAKRRGVALTRVI

SEQ ID NO: 870508 - protein, 18 aa, Mycobacterium
VASLVLRVPLPGTTFINA

SEQ ID NO: 870509 - protein, 20 aa, Mycobacterium
VASMSWTLALLLQHPEHLDR

SEQ ID NO: 870510 - protein, 20 aa, Mycobacterium
VASPALDVYALLSPQADRHL

SEQ ID NO: 870511 - protein, 19 aa, Mycobacterium
VASPLLRCRATVEPLADAL

SEQ ID NO: 870512 - protein, 31 aa, Mycobacterium
VASPVPFLELTLAEWNRVLDINSTGTFIVNQ

SEQ ID NO: 870513 - protein, 23 aa, Mycobacterium
VASTFEAAWAAMIHPVAVGQNRS

SEQ ID NO: 870514 - protein, 18 aa, Mycobacterium
VASTFVDYLLPTATEVPP

SEQ ID NO: 870515 - protein, 23 aa, Mycobacterium
VASVAFLGPISRVYVNLPDGPVI

SEQ ID NO: 870516 - protein, 18 aa, Mycobacterium
VASVFYRGGLSRAGNLRW

SEQ ID NO: 870517 - protein, 18 aa, Mycobacterium
VASYARYWREAFRLPGMD

SEQ ID NO: 870518 - protein, 35 aa, Mycobacterium
VASYGGLSWWGNFGEFGFLTKLRSEQLRDLGATLA

SEQ ID NO: 870519 - protein, 18 aa, Mycobacterium
VASYLLSEGLFQDRLRDS

SEQ ID NO: 870520 - protein, 23 aa, Mycobacterium
VATAAADLGLPLAALGLVSVRNM

SEQ ID NO: 870521 - protein, 26 aa, Mycobacterium
VATACQPGRPVASITAAAPGATDETI

SEQ ID NO: 870522 - protein, 20 aa, Mycobacterium
VATAERRYADTRRALCAALA

SEQ ID NO: 870523 - protein, 21 aa, Mycobacterium
VATALAWTHLGMTPPAGANQP

SEQ ID NO: 870524 - protein, 17 aa, Mycobacterium
VATALDLLGGPAAVVID

SEQ ID NO: 870525 - protein, 19 aa, Mycobacterium
VATALEWLPREKYIGLIMA

SEQ ID NO: 870526 - protein, 20 aa, Mycobacterium
VATAQAWKHLGMTPPAGAGG

SEQ ID NO: 870527 - protein, 20 aa, Mycobacterium
VATAVREFGRLDVLVNNAGI

SEQ ID NO: 870528 - protein, 24 aa, Mycobacterium
VATDFETWPDWLRTEFTEHAFDGH

SEQ ID NO: 870529 - protein, 24 aa, Mycobacterium
VATDGTALAAWLHSRELNDVDVVG

SEQ ID NO: 870530 - protein, 23 aa, Mycobacterium
VATDLELISRLPGWDSPAADAAR

SEQ ID NO: 870531 - protein, 27 aa, Mycobacterium
VATDQGRQLRWFGLDGAEHTGGPLVDF

SEQ ID NO: 870532 - protein, 25 aa, Mycobacterium
VATETFAPILYVLTYDDLDDAIALN

SEQ ID NO: 870533 - protein, 26 aa, Mycobacterium
VATETFAPILYVLTYDRLGDAIALNN

SEQ ID NO: 870534 - protein, 22 aa, Mycobacterium
VATETFAPVLYVLAYDELDDAI

SEQ ID NO: 870535 - protein, 18 aa, Mycobacterium
VATGIVNIWTAAPGPVAE

SEQ ID NO: 870536 - protein, 27 aa, Mycobacterium
VATGTMTHAWLITGPPGSGRSVAALCF

SEQ ID NO: 870537 - protein, 23 aa, Mycobacterium
VATGWHRVAAYLARARVATAQGL

SEQ ID NO: 870538 - protein, 27 aa, Mycobacterium
VATHHDLHLWLPHPSDALWTSLRDVRD

SEQ ID NO: 870539 - protein, 25 aa, Mycobacterium
VATHLFNAMAPLGHREPGPALALLK

SEQ ID NO: 870540 - protein, 31 aa, Mycobacterium
VATKTSYALFLLYMLFETPAGRALLGPAAPA

SEQ ID NO: 870541 - protein, 22 aa, Mycobacterium
VATLLAPYFGMVPAGTWRDRRH

SEQ ID NO: 870542 - protein, 17 aa, Mycobacterium
VATNFFGINTIPIAFNE

SEQ ID NO: 870543 - protein, 24 aa, Mycobacterium
VATNIPFLQAVLDDPDFRAGHVTT

SEQ ID NO: 870544 - protein, 26 aa, Mycobacterium
VATNRNQLVMLAMSNLFGLNAPAIAA

SEQ ID NO: 870545 - protein, 27 aa, Mycobacterium
VATPALVDAMLLVRLPYHLSTVTQAAA

SEQ ID NO: 870546 - protein, 18 aa, Mycobacterium
VATPIINAGLMTLTAASN

SEQ ID NO: 870547 - protein, 25 aa, Mycobacterium
VATPLAWTHLGLQPPVTGIGQAGLF

SEQ ID NO: 870548 - protein, 35 aa, Mycobacterium
VATPPSHILGLLNILTALRTGALVRLHPRFDVDRM

SEQ ID NO: 870549 - protein, 17 aa, Mycobacterium
VATQDARWFSLCKVDGV

SEQ ID NO: 870550 - protein, 20 aa, Mycobacterium
VATQYMAWLSAAATQAEQVA

SEQ ID NO: 870551 - protein, 25 aa, Mycobacterium
VATRLWPFWALCRIVYVVDEPNRRG

SEQ ID NO: 870552 - protein, 21 aa, Mycobacterium
VATRSIFAPEAWPLRVEVYDA

SEQ ID NO: 870553 - protein, 26 aa, Mycobacterium
VATSREGGRFVGRAAGDDSFDAEQSG

SEQ ID NO: 870554 - protein, 17 aa, Mycobacterium
VATTLLLPSVLDAVKDT

SEQ ID NO: 870555 - protein, 19 aa, Mycobacterium
VATTPITSWNNFDVMEFID

SEQ ID NO: 870556 - protein, 19 aa, Mycobacterium
VATTPLIEQSADEWDRVVA

SEQ ID NO: 870557 - protein, 28 aa, Mycobacterium
VATTTLLNAMLAANQPLDLPPGYVVGNE

SEQ ID NO: 870558 - protein, 23 aa, Mycobacterium
VATTYIGVMIRPKNTNPTAKATV

SEQ ID NO: 870559 - protein, 17 aa, Mycobacterium
VATVDGYTPIRVHLVNT

SEQ ID NO: 870560 - protein, 25 aa, Mycobacterium
VATVMRFCRTVGLTSYSQLRLALAA

SEQ ID NO: 870561 - protein, 20 aa, Mycobacterium
VATVPWTTDRLLNVLTRETE

SEQ ID NO: 870562 - protein, 19 aa, Mycobacterium
VATVSFLGAITRVGITMPD

SEQ ID NO: 870563 - protein, 26 aa, Mycobacterium
VATVSIWMGILLTEKLRAAFSADPAA

SEQ ID NO: 870564 - protein, 26 aa, Mycobacterium
VATVSVWMGILLTAKLRGAFDSDPDA

SEQ ID NO: 870565 - protein, 19 aa, Mycobacterium
VAVAALTLGLGATAGLVGG

SEQ ID NO: 870566 - protein, 27 aa, Mycobacterium
VAVAQRLWGMKFPLNPQRDLPGYRFVA

SEQ ID NO: 870567 - protein, 24 aa, Mycobacterium
VAVARLEAVFASAPLIRQIFVYGN

SEQ ID NO: 870568 - protein, 20 aa, Mycobacterium
VAVARLVLGPGMRVQAPPNL

SEQ ID NO: 870569 - protein, 25 aa, Mycobacterium
VAVATTWHNLVFVGPLDAITASADR

SEQ ID NO: 870570 - protein, 23 aa, Mycobacterium
VAVCDLLHRHGFVGAQAYLGVDG

SEQ ID NO: 870571 - protein, 24 aa, Mycobacterium
VAVDAGHRWLLHAGDAFYHHSEID

SEQ ID NO: 870572 - protein, 24 aa, Mycobacterium
VAVDFHKLLFQAISCSALLVRDAE

SEQ ID NO: 870573 - protein, 30 aa, Mycobacterium
VAVDHRVPILLSALSPRMLRIAGTFADGVV

SEQ ID NO: 870574 - protein, 26 aa, Mycobacterium
VAVDILEMLPTPWGLVRSGVAPDHPK

SEQ ID NO: 870575 - protein, 26 aa, Mycobacterium
VAVDMLEMLPTPWGLVRSGVAPDHPK

SEQ ID NO: 870576 - protein, 17 aa, Mycobacterium
VAVDRKIWSGAATFLFT

SEQ ID NO: 870577 - protein, 18 aa, Mycobacterium
VAVDRKIWSGKATFLFTR

SEQ ID NO: 870578 - protein, 23 aa, Mycobacterium
VAVDVLLPAAHGPNPVLPKGCHR

SEQ ID NO: 870579 - protein, 37 aa, Mycobacterium
VAVELGRRLPACEPALVTPLGPVLALHVGAEAVAVCV

SEQ ID NO: 870580 - protein, 26 aa, Mycobacterium
VAVENMFPFRADRFFGAGPTSIERMR

SEQ ID NO: 870581 - protein, 17 aa, Mycobacterium
VAVFAPGGRLQQCDQPA

SEQ ID NO: 870582 - protein, 26 aa, Mycobacterium
VAVFARNLKDLLLAAPAGTRTTLGLD

SEQ ID NO: 870583 - protein, 28 aa, Mycobacterium
VAVGVAWHAGVGMYPWIPANMGNWHLIG

SEQ ID NO: 870584 - protein, 32 aa, Mycobacterium
VAVGVAWHAGVGMYPWLPTNMGNWHLIGIECA

SEQ ID NO: 870585 - protein, 26 aa, Mycobacterium
VAVHARLDMLLPLASLPTTAVGKIDK

SEQ ID NO: 870586 - protein, 26 aa, Mycobacterium
VAVHDLTLAVLPGMIERRAGGILISG

SEQ ID NO: 870587 - protein, 24 aa, Mycobacterium
VAVHLLPLIHNAGIVCALHAAHSV

SEQ ID NO: 870588 - protein, 17 aa, Mycobacterium
VAVIHRPRYDDWSLPKG

SEQ ID NO: 870589 - protein, 23 aa, Mycobacterium
VAVILDVTVSVAGDFRAAQRVRG

SEQ ID NO: 870590 - protein, 24 aa, Mycobacterium
VAVIRKFCHQLPGWVSAAAREFAE

SEQ ID NO: 870591 - protein, 24 aa, Mycobacterium
VAVIRKFYHQLPGWVSAAAREFAE

SEQ ID NO: 870592 - protein, 24 aa, Mycobacterium
VAVIRRLFRRLPESVDLDTREHAE

SEQ ID NO: 870593 - protein, 17 aa, Mycobacterium
VAVKGPPMARGFQYGYL

SEQ ID NO: 870594 - protein, 17 aa, Mycobacterium
VAVLGGNRIPFARSDGA

SEQ ID NO: 870595 - protein, 17 aa, Mycobacterium
VAVLKSMLPAYAAVGSE

SEQ ID NO: 870596 - protein, 24 aa, Mycobacterium
VAVLLRITEVFGVDATFFSPQDDT

SEQ ID NO: 870597 - protein, 17 aa, Mycobacterium
VAVLMDSLGRRSGVRVA

SEQ ID NO: 870598 - protein, 24 aa, Mycobacterium
VAVLQALLDRHAMLRLRLDDGADG

SEQ ID NO: 870599 - protein, 22 aa, Mycobacterium
VAVLQALLDRHAMLRLRVDDDG

SEQ ID NO: 870600 - protein, 18 aa, Mycobacterium
VAVMAPFPHMRFPNDWIA

SEQ ID NO: 870601 - protein, 24 aa, Mycobacterium
VAVMGDLSRRRWWPLAEALTADRL

SEQ ID NO: 870602 - protein, 20 aa, Mycobacterium
VAVNALAWGGPPIGALVFRD

SEQ ID NO: 870603 - protein, 19 aa, Mycobacterium
VAVNALAWGGPPIGAVVFR

SEQ ID NO: 870604 - protein, 30 aa, Mycobacterium
VAVNDKIFFQIYWLGDRDAILARAERAKAA

SEQ ID NO: 870605 - protein, 24 aa, Mycobacterium
VAVNMFAHMRLTMGCHERLRASAA

SEQ ID NO: 870606 - protein, 27 aa, Mycobacterium
VAVNYPLYVILSLLGLPESDFDRMLKL

SEQ ID NO: 870607 - protein, 28 aa, Mycobacterium
VAVNYPLYVILSLLGLPESDFPRMLKLT

SEQ ID NO: 870608 - protein, 28 aa, Mycobacterium
VAVNYPLYVILSLLGLPESDFPRMLRLT

SEQ ID NO: 870609 - protein, 24 aa, Mycobacterium
VAVPFTNLIDYRLEIDYPGVGDAV

SEQ ID NO: 870610 - protein, 20 aa, Mycobacterium
VAVPPHIRPIIKEHLKNHVN

SEQ ID NO: 870611 - protein, 21 aa, Mycobacterium
VAVPRTEESRFRAMCEARGLP

SEQ ID NO: 870612 - protein, 20 aa, Mycobacterium
VAVPRTEESRLRAMCAARGL

SEQ ID NO: 870613 - protein, 37 aa, Mycobacterium
VAVPVGVPIAFLEPIVDPLSELLSRYARTRGPFTTME

SEQ ID NO: 870614 - protein, 30 aa, Mycobacterium
VAVQNGFTLMIPPVLVRPEVMRGTGFLGAH

SEQ ID NO: 870615 - protein, 29 aa, Mycobacterium
VAVRPEPFGALLYHFGTRKLSFLKNRTVV

SEQ ID NO: 870616 - protein, 18 aa, Mycobacterium
VAVRPLVLPDIEERFWAI

SEQ ID NO: 870617 - protein, 28 aa, Mycobacterium
VAVRRGNYLAYPGFQFGADGKPLPAIER

SEQ ID NO: 870618 - protein, 32 aa, Mycobacterium
VAVRVGHHCAWPLHRRFGIAATARASFAVYNT

SEQ ID NO: 870619 - protein, 32 aa, Mycobacterium
VAVRYPAGMDWVLAFWGVVMAGGIAVAVNTRS

SEQ ID NO: 870620 - protein, 33 aa, Mycobacterium
VAVSDIEFVQFHPTMLFGAAAGGRRPLITEALR

SEQ ID NO: 870621 - protein, 30 aa, Mycobacterium
VAVSDLEFIQFHPTMLYAVGSGGRCPLVSE

SEQ ID NO: 870622 - protein, 25 aa, Mycobacterium
VAVSGFPNFFMLYGPNTNQGGNSIV

SEQ ID NO: 870623 - protein, 23 aa, Mycobacterium
VAVSRLEAIFANSPLVRQIFVYA

SEQ ID NO: 870624 - protein, 24 aa, Mycobacterium
VAVSTRFPFTGFRATLHPEIRSAL

SEQ ID NO: 870625 - protein, 25 aa, Mycobacterium
VAVTREVLGAGIPLFGICFGNQILG

SEQ ID NO: 870626 - protein, 23 aa, Mycobacterium
VAVVLQALLDRHPMLRLRVQDDG

SEQ ID NO: 870627 - protein, 20 aa, Mycobacterium
VAVVTALRALGNDIPICVLS

SEQ ID NO: 870628 - protein, 18 aa, Mycobacterium
VAWDFIHATGFLGGQITL

SEQ ID NO: 870629 - protein, 29 aa, Mycobacterium
VAWDTPVAAKLPWFTLGDPYVSGHVTIAD

SEQ ID NO: 870630 - protein, 18 aa, Mycobacterium
VAWFADGFGRLREWRNDE

SEQ ID NO: 870631 - protein, 17 aa, Mycobacterium
VAWIVEGYPEGVPGPDR

SEQ ID NO: 870632 - protein, 17 aa, Mycobacterium
VAWLANRLAPHGVWLER

SEQ ID NO: 870633 - protein, 26 aa, Mycobacterium
VAWLNDRYARRRAGDAAALRPFLLVA

SEQ ID NO: 870634 - protein, 17 aa, Mycobacterium
VAWMIYAHLVFQELAAL

SEQ ID NO: 870635 - protein, 20 aa, Mycobacterium
VAYERIYWDQASLLVQVGLL

SEQ ID NO: 870636 - protein, 20 aa, Mycobacterium
VAYFDVDGRIYIVGSAAGRD

SEQ ID NO: 870637 - protein, 26 aa, Mycobacterium
VAYGASKAFDMVFAEALWAELHDKGV

SEQ ID NO: 870638 - protein, 31 aa, Mycobacterium
VAYGASKAFDMVFAEALWSELQPKGVDVLGL

SEQ ID NO: 870639 - protein, 27 aa, Mycobacterium
VAYNQMHLTPHLLIFGAPKSGKTRIAH

SEQ ID NO: 870640 - protein, 17 aa, Mycobacterium
VAYPNRLPRIECRGGLA

SEQ ID NO: 870641 - protein, 20 aa, Mycobacterium
VAYQLAFHEGSRYPLDRGAA

SEQ ID NO: 870642 - protein, 24 aa, Mycobacterium
VAYSLGFCKPVPHFTFGSSDVRTP

SEQ ID NO: 870643 - protein, 32 aa, Mycobacterium
VCAAKVRGLALLAGSWPLRPDCRILACSSVFG

SEQ ID NO: 870644 - protein, 23 aa, Mycobacterium
VCADSIIDLLPLANAAGTEAMTR

SEQ ID NO: 870645 - protein, 17 aa, Mycobacterium
VCAESCALLLDAEGNRL

SEQ ID NO: 870646 - protein, 24 aa, Mycobacterium
VCAHRRIPIITVINKWDRPGRHAL

SEQ ID NO: 870647 - protein, 22 aa, Mycobacterium
VCALARIDIPIMQAPMTYIAGA

SEQ ID NO: 870648 - protein, 32 aa, Mycobacterium
VCALKAGERLRLVKYLAYGWSSLRSRPALRDQ

SEQ ID NO: 870649 - protein, 23 aa, Mycobacterium
VCALLSDWLPATTGDIIFADGGA

SEQ ID NO: 870650 - protein, 21 aa, Mycobacterium
VCALLSDWLPATTGTIIYADG

SEQ ID NO: 870651 - protein, 22 aa, Mycobacterium
VCALLSEWLPATTGDIIFADGG

SEQ ID NO: 870652 - protein, 27 aa, Mycobacterium
VCALSAYWELPAMIGQFARAGLGVVPV

SEQ ID NO: 870653 - protein, 23 aa, Mycobacterium
VCAVLSDWLPATTGTIIFADGGA

SEQ ID NO: 870654 - protein, 33 aa, Mycobacterium
VCDEWARRGWLAVRYNLPYRRRRPTGPPSGSAA

SEQ ID NO: 870655 - protein, 19 aa, Mycobacterium
VCDLAITLAIGGDCLADIA

SEQ ID NO: 870656 - protein, 24 aa, Mycobacterium
VCDPANIFYLTGYAAWSFYTPQCL

SEQ ID NO: 870657 - protein, 18 aa, Mycobacterium
VCDQLAAATPWWEPGTAQ

SEQ ID NO: 870658 - protein, 24 aa, Mycobacterium
VCDRIQVLRLGRRVATYPGQGTSV

SEQ ID NO: 870659 - protein, 26 aa, Mycobacterium
VCELARIDIPIIQAPMTYIAGAQLAA

SEQ ID NO: 870660 - protein, 25 aa, Mycobacterium
VCEYLPGKAMVMQMLVRYVDGDLGR

SEQ ID NO: 870661 - protein, 18 aa, Mycobacterium
VCFLPQDPVARSAARERI

SEQ ID NO: 870662 - protein, 20 aa, Mycobacterium
VCFQLPALLAPEARATVVVS

SEQ ID NO: 870663 - protein, 19 aa, Mycobacterium
VCFTVLLDDGRTLTRTLRL

SEQ ID NO: 870664 - protein, 18 aa, Mycobacterium
VCGACSVFVDGRGVRACL

SEQ ID NO: 870665 - protein, 23 aa, Mycobacterium
VCGAEPLFLQDYIAIGRTVPERV

SEQ ID NO: 870666 - protein, 18 aa, Mycobacterium
VCGLADKPTFRAALIRVA

SEQ ID NO: 870667 - protein, 18 aa, Mycobacterium
VCGSVIIRGPRRSLLRRQ

SEQ ID NO: 870668 - protein, 18 aa, Mycobacterium
VCIGLLRDDRLGTGILQH

SEQ ID NO: 870669 - protein, 28 aa, Mycobacterium
VCIGLSPAWGRSVWLTLCGLTVGEVLRQ

SEQ ID NO: 870670 - protein, 23 aa, Mycobacterium
VCKSLGIHLVLPSGAVVFSAYRS

SEQ ID NO: 870671 - protein, 18 aa, Mycobacterium
VCLDGGLLPDMPSGSALV

SEQ ID NO: 870672 - protein, 19 aa, Mycobacterium
VCLETPPLFFAVGQGYHNF

SEQ ID NO: 870673 - protein, 17 aa, Mycobacterium
VCLGIAPEVFDVDDDDY

SEQ ID NO: 870674 - protein, 32 aa, Mycobacterium
VCLPSTFRPGRALPLTLLLHSLALGQSQFAAI

SEQ ID NO: 870675 - protein, 17 aa, Mycobacterium
VCLVDDLQWLDQASSQT

SEQ ID NO: 870676 - protein, 18 aa, Mycobacterium
VCMDQFLVDLGPGPLDVA

SEQ ID NO: 870677 - protein, 17 aa, Mycobacterium
VCMGAGYCYRSYPQLFA

SEQ ID NO: 870678 - protein, 19 aa, Mycobacterium
VCMGIAPEVFRVGDDDMLT

SEQ ID NO: 870679 - protein, 24 aa, Mycobacterium
VCMGINPEIFLLGDDDMLTVLQEE

SEQ ID NO: 870680 - protein, 19 aa, Mycobacterium
VCMIIAASGFKDADYRAIL

SEQ ID NO: 870681 - protein, 21 aa, Mycobacterium
VCPFHGWCWAIDGRNIYVARP

SEQ ID NO: 870682 - protein, 19 aa, Mycobacterium
VCPLPLRETKRIVMGHGGG

SEQ ID NO: 870683 - protein, 21 aa, Mycobacterium
VCPVCLGLPGSLPVLNRTAVE

SEQ ID NO: 870684 - protein, 21 aa, Mycobacterium
VCPVPTHPIPLLIGGHSEAAL

SEQ ID NO: 870685 - protein, 22 aa, Mycobacterium
VCPWHGLRLTGRSRPDWPSVPT

SEQ ID NO: 870686 - protein, 23 aa, Mycobacterium
VCQDFAHLSLIVLRGMGIPARYV

SEQ ID NO: 870687 - protein, 27 aa, Mycobacterium
VCQDYAHLTLVLLRSMGVPARYVSGYL

SEQ ID NO: 870688 - protein, 22 aa, Mycobacterium
VCQRAGLAARYFYESFGDKDAF

SEQ ID NO: 870689 - protein, 28 aa, Mycobacterium
VCRDDDWRPQWRVDLIPSYKAHRVLEEN

SEQ ID NO: 870690 - protein, 17 aa, Mycobacterium
VCRQIEFDLPVARRSIR

SEQ ID NO: 870691 - protein, 18 aa, Mycobacterium
VCRRAGIPVIADGGLQYS

SEQ ID NO: 870692 - protein, 24 aa, Mycobacterium
VCRRAGLAARYFYESFTDKDEFVS

SEQ ID NO: 870693 - protein, 18 aa, Mycobacterium
VCRTEYYINRSFAAVGRL

SEQ ID NO: 870694 - protein, 29 aa, Mycobacterium
VCRYRPGRAMVILMLMRYVDGDLGEYLEY

SEQ ID NO: 870695 - protein, 19 aa, Mycobacterium
VCSLTRPQLIERPADLTAE

SEQ ID NO: 870696 - protein, 22 aa, Mycobacterium
VCSPQLLMLSGIGPARHLRELD

SEQ ID NO: 870697 - protein, 31 aa, Mycobacterium
VCSRESIVPYALRGLLFCAACGRRMQGAARV

SEQ ID NO: 870698 - protein, 30 aa, Mycobacterium
VCSTAMTPWIWPTMHLNPPNWIEPVTVACE

SEQ ID NO: 870699 - protein, 30 aa, Mycobacterium
VCSTAMTPWIWPTMHLNPPQWIQPITEACE

SEQ ID NO: 870700 - protein, 30 aa, Mycobacterium
VCSTAMTPWIWPTMHLNPPQWIQPITEACT

SEQ ID NO: 870701 - protein, 27 aa, Mycobacterium
VCTGKTWHMVPPTIRYDLVGQKPDHIN

SEQ ID NO: 870702 - protein, 25 aa, Mycobacterium
VCTHQGCRLWFDAPDDTLRCPCHST

SEQ ID NO: 870703 - protein, 26 aa, Mycobacterium
VCTVSIWMGILLTEKLRAAFAGNPEA

SEQ ID NO: 870704 - protein, 24 aa, Mycobacterium
VCVDDPLLMRRALEYASGLGVLIA

SEQ ID NO: 870705 - protein, 22 aa, Mycobacterium
VCVGTARRGWASDGLLGPTATD

SEQ ID NO: 870706 - protein, 32 aa, Mycobacterium
VCVRPQPLGAFGLPLGYLLVPAGSDTDAARAA

SEQ ID NO: 870707 - protein, 18 aa, Mycobacterium
VCVSPSMVPAARTALGAG

SEQ ID NO: 870708 - protein, 18 aa, Mycobacterium
VCWFAPELGVVFSGDTLF

SEQ ID NO: 870709 - protein, 29 aa, Mycobacterium
VCWLADKPLKAGARLLLKHGTRTVPAIIG

SEQ ID NO: 870710 - protein, 24 aa, Mycobacterium
VCYDDFEWSDLFEPKLTAAAQDVE

SEQ ID NO: 870711 - protein, 23 aa, Mycobacterium
VCYSGHPLYPNADRLWELLEAER

SEQ ID NO: 870712 - protein, 23 aa, Mycobacterium
VDAAAPGARLAWRDDARWAPHGG

SEQ ID NO: 870713 - protein, 36 aa, Mycobacterium
VDAAAVLHKLSLRTPVRRFVLFSSITGLLGSRAVAH

SEQ ID NO: 870714 - protein, 30 aa, Mycobacterium
VDAADWAEMLMRMYIRWAEAHKYPVEVFDT

SEQ ID NO: 870715 - protein, 29 aa, Mycobacterium
VDAADWAEMLMRMYIRWAEKHDYPVEIFD

SEQ ID NO: 870716 - protein, 28 aa, Mycobacterium
VDAADWAEMLMRMYIRWAEQHDYPVEVF

SEQ ID NO: 870717 - protein, 29 aa, Mycobacterium
VDAADWAEMLMRMYIRWAEQHKYPVELFD

SEQ ID NO: 870718 - protein, 29 aa, Mycobacterium
VDAADWAEMLMRMYIRWAEQHKYPVEVFD

SEQ ID NO: 870719 - protein, 29 aa, Mycobacterium
VDAADWAEMLMRMYLRWAEQHKYPVEVFD

SEQ ID NO: 870720 - protein, 28 aa, Mycobacterium
VDAADWAEMLMRMYVRWAEQHKYPVEVF

SEQ ID NO: 870721 - protein, 29 aa, Mycobacterium
VDAAFFTELAAYLRWERPPGLATPQCFVV

SEQ ID NO: 870722 - protein, 22 aa, Mycobacterium
VDAAHLWHPYSGIGIPAAAQRP

SEQ ID NO: 870723 - protein, 24 aa, Mycobacterium
VDAALRIIKPLRKLIKPKVYGIEN

SEQ ID NO: 870724 - protein, 24 aa, Mycobacterium
VDAALVHHYFGTKQQLFAAAIHVA

SEQ ID NO: 870725 - protein, 20 aa, Mycobacterium
VDAARSWLLGTPADDWVSMA

SEQ ID NO: 870726 - protein, 32 aa, Mycobacterium
VDAATRAALLDRFGMFGLRISIAVLRAGVRDS

SEQ ID NO: 870727 - protein, 22 aa, Mycobacterium
VDAATYVVPILQRVAGELSAEF

SEQ ID NO: 870728 - protein, 22 aa, Mycobacterium
VDAAVFFDRFIARVGTFARRVA

SEQ ID NO: 870729 - protein, 18 aa, Mycobacterium
VDADGYLRLCGRRHDMVV

SEQ ID NO: 870730 - protein, 22 aa, Mycobacterium
VDADMLLVAAGRRSNSDRLDVA

SEQ ID NO: 870731 - protein, 25 aa, Mycobacterium
VDADRPFLEYGLDSLGMLEMRTHIE

SEQ ID NO: 870732 - protein, 24 aa, Mycobacterium
VDADRPFVEYGLDSLGMLEMRTHI

SEQ ID NO: 870733 - protein, 26 aa, Mycobacterium
VDAEKPPLRVFFGERPLEIAKADYER

SEQ ID NO: 870734 - protein, 25 aa, Mycobacterium
VDAEKPPLRVFFGSSPLETAKADYE

SEQ ID NO: 870735 - protein, 24 aa, Mycobacterium
VDAEPIWIPARPAATPPHRAPWRR

SEQ ID NO: 870736 - protein, 23 aa, Mycobacterium
VDAFLAVCRKWDVLATVIGEVTD

SEQ ID NO: 870737 - protein, 17 aa, Mycobacterium
VDAFRQVIAGRLNKLDP

SEQ ID NO: 870738 - protein, 25 aa, Mycobacterium
VDAGELRLHTLRRPLADIETVWSEK

SEQ ID NO: 870739 - protein, 25 aa, Mycobacterium
VDAGPVLHGVQLWVALPAAARDTAR

SEQ ID NO: 870740 - protein, 24 aa, Mycobacterium
VDAGVFMDTFSKWVSPARLAVTQF

SEQ ID NO: 870741 - protein, 18 aa, Mycobacterium
VDAHRLVYLADSVVNWCP

SEQ ID NO: 870742 - protein, 20 aa, Mycobacterium
VDAIPVPGAIPMPAVAGAPG

SEQ ID NO: 870743 - protein, 28 aa, Mycobacterium
VDAIQVQRLSRLWFEALVGICTHVRTGG

SEQ ID NO: 870744 - protein, 25 aa, Mycobacterium
VDAKEPWFAQAYTRALDWANASQWT

SEQ ID NO: 870745 - protein, 26 aa, Mycobacterium
VDALHRWLVAWADIYDAHAAVFAEFP

SEQ ID NO: 870746 - protein, 18 aa, Mycobacterium
VDALRPNSGLVVDLSGLA

SEQ ID NO: 870747 - protein, 31 aa, Mycobacterium
VDALRVGVLPTPAVAYLTSAYDADFGVMISA

SEQ ID NO: 870748 - protein, 26 aa, Mycobacterium
VDALSELDLSYTPPLGSPWDAVQVAA

SEQ ID NO: 870749 - protein, 23 aa, Mycobacterium
VDALSPLLMMTAVAMAPTATTAP

SEQ ID NO: 870750 - protein, 18 aa, Mycobacterium
VDAMCARFRISGLPVVDD

SEQ ID NO: 870751 - protein, 18 aa, Mycobacterium
VDAMCPLGPILGGAGLNI

SEQ ID NO: 870752 - protein, 27 aa, Mycobacterium
VDAMPLHHRILLPERLGPGRVRLATLG

SEQ ID NO: 870753 - protein, 19 aa, Mycobacterium
VDANLAIRDELLHKVIDVC

SEQ ID NO: 870754 - protein, 22 aa, Mycobacterium
VDAPLVFDWIDWQGVRRTDQPT

SEQ ID NO: 870755 - protein, 25 aa, Mycobacterium
VDAQFYWMSAKIPNDQFLLYAFDGE

SEQ ID NO: 870756 - protein, 22 aa, Mycobacterium
VDARAALAIAQRQRQTLGDIEQ

SEQ ID NO: 870757 - protein, 23 aa, Mycobacterium
VDARAPLALPAQAALAAMHRSVG

SEQ ID NO: 870758 - protein, 25 aa, Mycobacterium
VDARHLVLPLEQYPDLLDFGDANDL

SEQ ID NO: 870759 - protein, 33 aa, Mycobacterium
VDARILAQLLAADFLPPVWLPDDRTRSLRRQVM

SEQ ID NO: 870760 - protein, 19 aa, Mycobacterium
VDARKYLPAAWADVSLALL

SEQ ID NO: 870761 - protein, 31 aa, Mycobacterium
VDARLSRYSYLVSLLPRRIVDDLGARVQLAR

SEQ ID NO: 870762 - protein, 28 aa, Mycobacterium
VDARLSRYSYLVSLLPRSIVDDLGARVR

SEQ ID NO: 870763 - protein, 34 aa, Mycobacterium
VDARTYWLSRSIPDDQFLLYAFDGTADDLDEALA

SEQ ID NO: 870764 - protein, 22 aa, Mycobacterium
VDASMPAMIRLGGKMYGADGRT

SEQ ID NO: 870765 - protein, 24 aa, Mycobacterium
VDATARLAAMNLLLHGIGTADGDS

SEQ ID NO: 870766 - protein, 17 aa, Mycobacterium
VDAVEDMFRLPDLTHVV

SEQ ID NO: 870767 - protein, 26 aa, Mycobacterium
VDAVRVVNLLSWRYRDPGLLLAERIG

SEQ ID NO: 870768 - protein, 18 aa, Mycobacterium
VDAWLADFESALAARDIE

SEQ ID NO: 870769 - protein, 20 aa, Mycobacterium
VDAWLTGWDESFTAALAARG

SEQ ID NO: 870770 - protein, 22 aa, Mycobacterium
VDAYPRLWDKAAALLQSLARNH

SEQ ID NO: 870771 - protein, 30 aa, Mycobacterium
VDAYSYLALTIDTDWYLAWLAHEAEVAGVT

SEQ ID NO: 870772 - protein, 21 aa, Mycobacterium
VDCAIALGFEKMQPGSLGGGA

SEQ ID NO: 870773 - protein, 31 aa, Mycobacterium
VDCDPDFTTVLWRKLVLNALAGLMALSGRRS

SEQ ID NO: 870774 - protein, 17 aa, Mycobacterium
VDCIPSPRLIARYRAAA

SEQ ID NO: 870775 - protein, 17 aa, Mycobacterium
VDCLAFELKMDPAEVRL

SEQ ID NO: 870776 - protein, 18 aa, Mycobacterium
VDCLAFELKMDPAEVRLR

SEQ ID NO: 870777 - protein, 27 aa, Mycobacterium
VDCPHFEHALSAYYLILPSEVSSNLAR

SEQ ID NO: 870778 - protein, 21 aa, Mycobacterium
VDDALGLIYLLASEDAEIVGI

SEQ ID NO: 870779 - protein, 33 aa, Mycobacterium
VDDALYEMELVGHDFFLFFDQETERPTVVYRRH

SEQ ID NO: 870780 - protein, 26 aa, Mycobacterium
VDDALYEMELVGHDFFLFHDKETDRP

SEQ ID NO: 870781 - protein, 19 aa, Mycobacterium
VDDAQILHAVDEAGYSAVR

SEQ ID NO: 870782 - protein, 19 aa, Mycobacterium
VDDAQILRAVDEAGYSAVR

SEQ ID NO: 870783 - protein, 24 aa, Mycobacterium
VDDAQLPWSIVTLGLSSVAPQRSP

SEQ ID NO: 870784 - protein, 25 aa, Mycobacterium
VDDARQLWRSMAGRCGHLYTGHSVV

SEQ ID NO: 870785 - protein, 23 aa, Mycobacterium
VDDDGYLFLTDRKAFVIISGGVN

SEQ ID NO: 870786 - protein, 25 aa, Mycobacterium
VDDEAALLFIDFGTGAALHLTGTAR

SEQ ID NO: 870787 - protein, 22 aa, Mycobacterium
VDDFEIGDRVAVGWFGGHCNRC

SEQ ID NO: 870788 - protein, 22 aa, Mycobacterium
VDDGLLRRRPSGFFPAPGLDPH

SEQ ID NO: 870789 - protein, 34 aa, Mycobacterium
VDDIATFDLYSCFPFPVFVACEALGLAGDDPRGV

SEQ ID NO: 870790 - protein, 31 aa, Mycobacterium
VDDIATFDLYSCFPVPVFNICDGLGIATDDP

SEQ ID NO: 870791 - protein, 24 aa, Mycobacterium
VDDLASFARPYTSRLWARLHGRDV

SEQ ID NO: 870792 - protein, 20 aa, Mycobacterium
VDDLAYPLPVSVICDMLGVP

SEQ ID NO: 870793 - protein, 22 aa, Mycobacterium
VDDLDFFLVSSSVSSLFGSPGQ

SEQ ID NO: 870794 - protein, 24 aa, Mycobacterium
VDDLGLMFTTFGRVLVAGGQIVVI

SEQ ID NO: 870795 - protein, 18 aa, Mycobacterium
VDDLGLPDMLLLLATDVA

SEQ ID NO: 870796 - protein, 23 aa, Mycobacterium
VDDLKAPLLAAVGAADLALERVN

SEQ ID NO: 870797 - protein, 18 aa, Mycobacterium
VDDLNAYLFAVRAPWREP

SEQ ID NO: 870798 - protein, 23 aa, Mycobacterium
VDDLNPLIMPVDAEFRVGTMGLG

SEQ ID NO: 870799 - protein, 24 aa, Mycobacterium
VDDLQLPDMLLMLATDVAAVDHHE

SEQ ID NO: 870800 - protein, 26 aa, Mycobacterium
VDDMARWLMMLLGNGTYNGRRIVAPE

SEQ ID NO: 870801 - protein, 22 aa, Mycobacterium
VDDMFRSLQALAKLPGDPTVYP

SEQ ID NO: 870802 - protein, 18 aa, Mycobacterium
VDDPRIALLSATGSVRMG

SEQ ID NO: 870803 - protein, 28 aa, Mycobacterium
VDDPVVRMLFTLHGIIRPDTTTLAEQAL

SEQ ID NO: 870804 - protein, 19 aa, Mycobacterium
VDDPWYRMRVAPSVFKHVW

SEQ ID NO: 870805 - protein, 18 aa, Mycobacterium
VDDPWYRMRVARSIFTHV

SEQ ID NO: 870806 - protein, 22 aa, Mycobacterium
VDDQCQLVCRACPYRAHQHAGA

SEQ ID NO: 870807 - protein, 25 aa, Mycobacterium
VDDQDLVRSGLRRILRRKDGFVIVA

SEQ ID NO: 870808 - protein, 18 aa, Mycobacterium
VDDQEKGLRFYTDVLGFV

SEQ ID NO: 870809 - protein, 29 aa, Mycobacterium
VDDQELVRTGLRRILRRKDGFAIVGECAD

SEQ ID NO: 870810 - protein, 17 aa, Mycobacterium
VDDRWLYVSCWGTGELK

SEQ ID NO: 870811 - protein, 30 aa, Mycobacterium
VDDTIAAMITKLLAWHRENPGRQPALTFPQ

SEQ ID NO: 870812 - protein, 22 aa, Mycobacterium
VDDTRLLGPPQYAVRARAIQEL

SEQ ID NO: 870813 - protein, 17 aa, Mycobacterium
VDDVGLDSVAFAVGMVA

SEQ ID NO: 870814 - protein, 29 aa, Mycobacterium
VDDVKLPGMLHLAILRSPYAHATINSIDV

SEQ ID NO: 870815 - protein, 23 aa, Mycobacterium
VDDVLAAWQSTLGDRAWVVSRDE

SEQ ID NO: 870816 - protein, 17 aa, Mycobacterium
VDDVLALVHGRWPAGPV

SEQ ID NO: 870817 - protein, 23 aa, Mycobacterium
VDDVRAFELLRRLSQESQTKLID

SEQ ID NO: 870818 - protein, 25 aa, Mycobacterium
VDDVRAVYLSAWRAKVKGITVYRYG

SEQ ID NO: 870819 - protein, 22 aa, Mycobacterium
VDDYDRFLPYTTRSPWPQAPIL

SEQ ID NO: 870820 - protein, 27 aa, Mycobacterium
VDEAAQLMIDLFWYGLKGSPEEREAAR

SEQ ID NO: 870821 - protein, 28 aa, Mycobacterium
VDEADLRPRLRWEMLRLAADHADAGWIE

SEQ ID NO: 870822 - protein, 29 aa, Mycobacterium
VDEAHTEMPAMPLIRFLDGYETIAEMEAA

SEQ ID NO: 870823 - protein, 25 aa, Mycobacterium
VDECHYYRGVFGSNVALILQRLLRL

SEQ ID NO: 870824 - protein, 20 aa, Mycobacterium
VDEFIRLHLDKQLTAEQAAM

SEQ ID NO: 870825 - protein, 18 aa, Mycobacterium
VDEFLSVNPGLAGRFNRK

SEQ ID NO: 870826 - protein, 17 aa, Mycobacterium
VDEFPLTGLGKVAKSEL

SEQ ID NO: 870827 - protein, 26 aa, Mycobacterium
VDEGIAWVPYFPLGSALPGFPKVADD

SEQ ID NO: 870828 - protein, 20 aa, Mycobacterium
VDEILPLKISQADGSVIEFA

SEQ ID NO: 870829 - protein, 27 aa, Mycobacterium
VDEIRINWVWNPPWGPDKITDDGREQL

SEQ ID NO: 870830 - protein, 26 aa, Mycobacterium
VDEIRLVVYPVLLGSGLALFGERRQP

SEQ ID NO: 870831 - protein, 28 aa, Mycobacterium
VDELAELRRVAPIWWNAQPIGAGGFDDG

SEQ ID NO: 870832 - protein, 24 aa, Mycobacterium
VDELARLWALPTTPGAPAPGLYRR

SEQ ID NO: 870833 - protein, 24 aa, Mycobacterium
VDELERRNARRALITLCIGGGMGV

SEQ ID NO: 870834 - protein, 25 aa, Mycobacterium
VDELERRNARRALITLCIGGGMGVA

SEQ ID NO: 870835 - protein, 18 aa, Mycobacterium
VDELGGFRAAVRRAKVLA

SEQ ID NO: 870836 - protein, 19 aa, Mycobacterium
VDELGGFRTALRRAKILAG

SEQ ID NO: 870837 - protein, 36 aa, Mycobacterium
VDELIDRYGALPEPALRLVAVARLRLLCRASGITDV

SEQ ID NO: 870838 - protein, 22 aa, Mycobacterium
VDELIPLVRGVARGAPHALVVA

SEQ ID NO: 870839 - protein, 26 aa, Mycobacterium
VDELKINWVWNPPWGPDKITDDGREQ

SEQ ID NO: 870840 - protein, 18 aa, Mycobacterium
VDELLEIVKLSDFAKRKP

SEQ ID NO: 870841 - protein, 17 aa, Mycobacterium
VDELLPVELVWSNARPP

SEQ ID NO: 870842 - protein, 17 aa, Mycobacterium
VDELPLTAMLKPDRLAL

SEQ ID NO: 870843 - protein, 27 aa, Mycobacterium
VDELRINWVWNPPWGPDKITDDGREQL

SEQ ID NO: 870844 - protein, 25 aa, Mycobacterium
VDELRMMVFPFVLGAGDRLFGATSG

SEQ ID NO: 870845 - protein, 25 aa, Mycobacterium
VDELTLQAPLMLPAKGSGAGSVAVQ

SEQ ID NO: 870846 - protein, 25 aa, Mycobacterium
VDELVWLPMVDALKKLSYAHDRKML

SEQ ID NO: 870847 - protein, 17 aa, Mycobacterium
VDEPFLAPARIDLGALR

SEQ ID NO: 870848 - protein, 29 aa, Mycobacterium
VDEPNACTRFLLVGPPGPPPARTGADRTA

SEQ ID NO: 870849 - protein, 31 aa, Mycobacterium
VDERGKFPGQWWGPASWRRKPHRSRGKGTDV

SEQ ID NO: 870850 - protein, 24 aa, Mycobacterium
VDERTVICVLTHDPKFDVPVLEVA

SEQ ID NO: 870851 - protein, 30 aa, Mycobacterium
VDESRLTFLAVRRWFGWSAGRIINLDIGGG

SEQ ID NO: 870852 - protein, 29 aa, Mycobacterium
VDESRLTFLAVRRWYGWSAGRIINIDIGG

SEQ ID NO: 870853 - protein, 33 aa, Mycobacterium
VDESRLTFLAVRRWYGWSAGRIVNIDIGGGSLE

SEQ ID NO: 870854 - protein, 33 aa, Mycobacterium
VDESRLTFLAVRRWYGWSAGRIVNLDIGGGSLE

SEQ ID NO: 870855 - protein, 18 aa, Mycobacterium
VDESSRLGLLKRREEVLP

SEQ ID NO: 870856 - protein, 23 aa, Mycobacterium
VDETHGFRFFDNRDLLGFVDGTE

SEQ ID NO: 870857 - protein, 30 aa, Mycobacterium
VDETITFPQFRTLVILFNEGPINLATLAQS

SEQ ID NO: 870858 - protein, 23 aa, Mycobacterium
VDETLASYPVIWTAAGTADSVMP

SEQ ID NO: 870859 - protein, 22 aa, Mycobacterium
VDEVHGFRFFDNRDLLGFVDGT

SEQ ID NO: 870860 - protein, 18 aa, Mycobacterium
VDEVHGFRYFDNRDLLGF

SEQ ID NO: 870861 - protein, 22 aa, Mycobacterium
VDEVHGFRYFDNRDLLGFVDGT

SEQ ID NO: 870862 - protein, 25 aa, Mycobacterium
VDEWAPGDRLFLFGAGRGAVSAYAL

SEQ ID NO: 870863 - protein, 21 aa, Mycobacterium
VDEWDAMIDVNVRGLLNGIAA

SEQ ID NO: 870864 - protein, 23 aa, Mycobacterium
VDEWGMPLIRLDMGWEAAKIAVE

SEQ ID NO: 870865 - protein, 23 aa, Mycobacterium
VDEYVSMCNKIFAALGRRFNADE

SEQ ID NO: 870866 - protein, 17 aa, Mycobacterium
VDFAGEPLTIAFNPTYL

SEQ ID NO: 870867 - protein, 25 aa, Mycobacterium
VDFDEIYEWGLDLLSRIVAEQDDIA

SEQ ID NO: 870868 - protein, 24 aa, Mycobacterium
VDFDHPLWVLYSSGTTGLPKGIMH

SEQ ID NO: 870869 - protein, 24 aa, Mycobacterium
VDFDWSTLPFYYVPNEPFTTHFCN

SEQ ID NO: 870870 - protein, 20 aa, Mycobacterium
VDFHIRRIAVPSPGGRKELD

SEQ ID NO: 870871 - protein, 23 aa, Mycobacterium
VDFKIARYVISARIKALQGDRLG

SEQ ID NO: 870872 - protein, 20 aa, Mycobacterium
VDFLPAGLAMVRAGRRMRFM

SEQ ID NO: 870873 - protein, 17 aa, Mycobacterium
VDFLVLPEAAIGGYLSS

SEQ ID NO: 870874 - protein, 17 aa, Mycobacterium
VDFPPVNAIPSRGWFEL

SEQ ID NO: 870875 - protein, 24 aa, Mycobacterium
VDFSKIPVLSIGSAAPHVASRHLQ

SEQ ID NO: 870876 - protein, 21 aa, Mycobacterium
VDFVCASLRNPVLLELASEAD

SEQ ID NO: 870877 - protein, 22 aa, Mycobacterium
VDFVCASLRNPVLRELAGEADA

SEQ ID NO: 870878 - protein, 24 aa, Mycobacterium
VDFYSNVLGMPLIKSLDLPGGIGQ

SEQ ID NO: 870879 - protein, 24 aa, Mycobacterium
VDFYSNVLGMPLIKSLDLPGGMGQ

SEQ ID NO: 870880 - protein, 25 aa, Mycobacterium
VDFYSNVLGMPLIKSLDLPMGQGQH

SEQ ID NO: 870881 - protein, 26 aa, Mycobacterium
VDGAALFVLDAWLRPVPPGVVGELYV

SEQ ID NO: 870882 - protein, 25 aa, Mycobacterium
VDGAALFVLDGWLRPVAAGVVGELY

SEQ ID NO: 870883 - protein, 31 aa, Mycobacterium
VDGAAYLFTNDYEWELLLNKTGWSEADVQGK

SEQ ID NO: 870884 - protein, 20 aa, Mycobacterium
VDGAGRRPFWTYAHVPSGST

SEQ ID NO: 870885 - protein, 17 aa, Mycobacterium
VDGAMHAVFIRAPWVER

SEQ ID NO: 870886 - protein, 25 aa, Mycobacterium
VDGDAIMVVLALAMRDAGELASDTL

SEQ ID NO: 870887 - protein, 24 aa, Mycobacterium
VDGDDTPWSKAFLAAAYASRGIKM

SEQ ID NO: 870888 - protein, 23 aa, Mycobacterium
VDGDIPLLLEMPMAYTARALEDS

SEQ ID NO: 870889 - protein, 24 aa, Mycobacterium
VDGDLLRFWIGDDLVKTAARTSRG

SEQ ID NO: 870890 - protein, 20 aa, Mycobacterium
VDGDLLRLGDLALPIAPGTA

SEQ ID NO: 870891 - protein, 23 aa, Mycobacterium
VDGDWVDWFPPTHPDRPDAPNMD

SEQ ID NO: 870892 - protein, 23 aa, Mycobacterium
VDGETVVPLLPAQDFKRVGDNDS

SEQ ID NO: 870893 - protein, 22 aa, Mycobacterium
VDGETVVPLLPAQDFKRVGEGD

SEQ ID NO: 870894 - protein, 20 aa, Mycobacterium
VDGFDSAVWAYFGEAERVAT

SEQ ID NO: 870895 - protein, 28 aa, Mycobacterium
VDGFEEITTHYSPSAWLSVTHRQKGAGV

SEQ ID NO: 870896 - protein, 18 aa, Mycobacterium
VDGFGIPENLRYAEMLHP

SEQ ID NO: 870897 - protein, 24 aa, Mycobacterium
VDGFGYALLVNRIALVYSELSSGA

SEQ ID NO: 870898 - protein, 26 aa, Mycobacterium
VDGGMQAWLRFYRNSLHALESGTAAF

SEQ ID NO: 870899 - protein, 24 aa, Mycobacterium
VDGGRLQRRAGLAGGPRGAGVPGR

SEQ ID NO: 870900 - protein, 24 aa, Mycobacterium
VDGGTFDWTQGRFPGFTTPDPSYH

SEQ ID NO: 870901 - protein, 26 aa, Mycobacterium
VDGGVDLLIIETIFDSLNAKAAVFAV

SEQ ID NO: 870902 - protein, 37 aa, Mycobacterium
VDGGYTLGPALIELGFKALHGNPLPVVARPFLEELSE

SEQ ID NO: 870903 - protein, 23 aa, Mycobacterium
VDGHLYRMFAKLGVADRDQLAKL

SEQ ID NO: 870904 - protein, 27 aa, Mycobacterium
VDGIRADRFWMMGPPTPADQVVSAKAS

SEQ ID NO: 870905 - protein, 25 aa, Mycobacterium
VDGLAGSGLLFECYCTRRDIAQAPR

SEQ ID NO: 870906 - protein, 26 aa, Mycobacterium
VDGLGWHLLGELAGSAPLLAAVLAGQ

SEQ ID NO: 870907 - protein, 18 aa, Mycobacterium
VDGLPLAIELAAARMRAM

SEQ ID NO: 870908 - protein, 18 aa, Mycobacterium
VDGMNVIGSRPDGWWRDR

SEQ ID NO: 870909 - protein, 23 aa, Mycobacterium
VDGNRNFGFGNWGNANLGSGNHS

SEQ ID NO: 870910 - protein, 24 aa, Mycobacterium
VDGPATLRRLGLAATLRAGPAIVE

SEQ ID NO: 870911 - protein, 26 aa, Mycobacterium
VDGPDLPPLWEVFGARLRTDDRWVLP

SEQ ID NO: 870912 - protein, 51 aa, Mycobacterium
VDGQHISTLLLTLLFRFMKPLVENGHIFLAQPPLYKLKWQRSEPEFAYSDR

SEQ ID NO: 870913 - protein, 52 aa, Mycobacterium
VDGQHISTLLLTLLFRFMKPLVENGHIFLAQPPLYKLKWQRSEPEFAYSDRE

SEQ ID NO: 870914 - protein, 51 aa, Mycobacterium
VDGQHISTLLLTLLFRFMKPLVENGHIFLAQPPLYKLKWQRTDPEFAYSDR

SEQ ID NO: 870915 - protein, 51 aa, Mycobacterium
VDGQHISTLLLTLLFRFMRPLIENGHVFLAQPPLYKLKWQRTDPEFAYSDR

SEQ ID NO: 870916 - protein, 52 aa, Mycobacterium
VDGQHISTLLLTLLFRFMRPLIENGHVFLAQPPLYKLKWQRTEPEFAYSDRE

SEQ ID NO: 870917 - protein, 51 aa, Mycobacterium
VDGQHISTLLLTLLFRFMRPLVEHGHIFLAQPPLYKLKWQRTQPEFAYSDR

SEQ ID NO: 870918 - protein, 23 aa, Mycobacterium
VDGQLLHVDLLKGRLFSRDVCTG

SEQ ID NO: 870919 - protein, 21 aa, Mycobacterium
VDGQLVIIGMQGGIKAELNLG

SEQ ID NO: 870920 - protein, 27 aa, Mycobacterium
VDGQSHAWIQAWTGEWRYYDPTNDAEI

SEQ ID NO: 870921 - protein, 22 aa, Mycobacterium
VDGRGFIPTKYAQSHWGSDHLN

SEQ ID NO: 870922 - protein, 21 aa, Mycobacterium
VDGRMIGMRYPYEVNLVADAK

SEQ ID NO: 870923 - protein, 17 aa, Mycobacterium
VDGRPRGHLRKFGLSRM

SEQ ID NO: 870924 - protein, 26 aa, Mycobacterium
VDGRSHAWIQAWTGGWWSYDPTLETE

SEQ ID NO: 870925 - protein, 17 aa, Mycobacterium
VDGSPWIGNIDLSFPYL

SEQ ID NO: 870926 - protein, 18 aa, Mycobacterium
VDGTGAWFAAPPPITARS

SEQ ID NO: 870927 - protein, 26 aa, Mycobacterium
VDGVIALRPEVFFPAVPADAWTELVT

SEQ ID NO: 870928 - protein, 17 aa, Mycobacterium
VDGVILFVPTQTVGYQP

SEQ ID NO: 870929 - protein, 23 aa, Mycobacterium
VDGVPRTLRLDQLIRLYVDHQLD

SEQ ID NO: 870930 - protein, 23 aa, Mycobacterium
VDGVPRTLRLDQLIRLYVNHQLD

SEQ ID NO: 870931 - protein, 26 aa, Mycobacterium
VDGVPTATWGWLSLATGLAVVDTVTP

SEQ ID NO: 870932 - protein, 18 aa, Mycobacterium
VDGVQALLPGYRLKHRVQ

SEQ ID NO: 870933 - protein, 23 aa, Mycobacterium
VDGVSWRVLLDDLNTGWAQYRRA

SEQ ID NO: 870934 - protein, 36 aa, Mycobacterium
VDHAWFIAETIGAGSFPWVLAITCPYRDAAERNAFL

SEQ ID NO: 870935 - protein, 19 aa, Mycobacterium
VDHDWLEELGEQLPVYRPP

SEQ ID NO: 870936 - protein, 21 aa, Mycobacterium
VDHISGGRLILGLGAGWYEKD

SEQ ID NO: 870937 - protein, 20 aa, Mycobacterium
VDHLFGTIWTRPGLSMRDRR

SEQ ID NO: 870938 - protein, 18 aa, Mycobacterium
VDHVFALGRSWDAGAAHW

SEQ ID NO: 870939 - protein, 29 aa, Mycobacterium
VDHYAEIGLLGFALITDALGGVNVCLNEP

SEQ ID NO: 870940 - protein, 25 aa, Mycobacterium
VDHYSDDWARLWWVRADGVATIHDD

SEQ ID NO: 870941 - protein, 25 aa, Mycobacterium
VDHYSDDWTQLWWVRADGVATTHHS

SEQ ID NO: 870942 - protein, 25 aa, Mycobacterium
VDIAFNWDHFFPLFGDPDGAHFECW

SEQ ID NO: 870943 - protein, 27 aa, Mycobacterium
VDIAFNWDHFFPLYGAPDGAHFECWTM

SEQ ID NO: 870944 - protein, 26 aa, Mycobacterium
VDIALRAGEELPWHPGRCAEIVVDGQ

SEQ ID NO: 870945 - protein, 18 aa, Mycobacterium
VDIALWDIAGKLANAPVS

SEQ ID NO: 870946 - protein, 23 aa, Mycobacterium
VDICPWALREGVILRRLDSEADG

SEQ ID NO: 870947 - protein, 37 aa, Mycobacterium
VDIDRLRAFLLDKVAKWWIPERWSFVSEIPRTSVGKY

SEQ ID NO: 870948 - protein, 20 aa, Mycobacterium
VDIEYKFGFAGNPWGELEGV

SEQ ID NO: 870949 - protein, 21 aa, Mycobacterium
VDIEYKFGFLGNPWGELEGVA

SEQ ID NO: 870950 - protein, 38 aa, Mycobacterium
VDIPKDILQAQTTFSWPPQIYLPGYKPVTKPHGKQVRE

SEQ ID NO: 870951 - protein, 27 aa, Mycobacterium
VDIPLAQWGSLLFVNVTMRTPRALPVP

SEQ ID NO: 870952 - protein, 24 aa, Mycobacterium
VDIPSSLLGLLSQIPNRTPVDAQE

SEQ ID NO: 870953 - protein, 28 aa, Mycobacterium
VDIPSVIYQYSFFRNPHWSRVFAPGDEV

SEQ ID NO: 870954 - protein, 20 aa, Mycobacterium
VDIPWKLHHPMWIQNAEIDV

SEQ ID NO: 870955 - protein, 22 aa, Mycobacterium
VDIRFHIRLVELSDSPRLSRMH

SEQ ID NO: 870956 - protein, 24 aa, Mycobacterium
VDISNAVLFLISDEARHVTGLEFK

SEQ ID NO: 870957 - protein, 31 aa, Mycobacterium
VDIVDRCLQFFGGYGYMMEYPIARAYAAARV

SEQ ID NO: 870958 - protein, 22 aa, Mycobacterium
VDIVYFTVPVPFFGGKKLSVPF

SEQ ID NO: 870959 - protein, 18 aa, Mycobacterium
VDIWLGGSGPVALARIGR

SEQ ID NO: 870960 - protein, 26 aa, Mycobacterium
VDKALLARIGDAFLALPEGFTAHPRV

SEQ ID NO: 870961 - protein, 25 aa, Mycobacterium
VDKDGAWLAAPPPIVPRSTVGAGDS

SEQ ID NO: 870962 - protein, 18 aa, Mycobacterium
VDKFPRMVDYVLPSGVRI

SEQ ID NO: 870963 - protein, 24 aa, Mycobacterium
VDKGRWTFGYLMSRATTIGAGTAE

SEQ ID NO: 870964 - protein, 23 aa, Mycobacterium
VDKHIFESTLYFVPPRNARERLA

SEQ ID NO: 870965 - protein, 24 aa, Mycobacterium
VDKHIFETTLYFVPPRNARERLAQ

SEQ ID NO: 870966 - protein, 23 aa, Mycobacterium
VDKHLFECTLYFVPPRNARERLA

SEQ ID NO: 870967 - protein, 27 aa, Mycobacterium
VDKLRRQAETPLLLAVDGKLIGLISLR

SEQ ID NO: 870968 - protein, 27 aa, Mycobacterium
VDKLRRQAETPLLLAVDGKLVGLISLR

SEQ ID NO: 870969 - protein, 25 aa, Mycobacterium
VDKPASALLFFLASSRILNRRKGVR

SEQ ID NO: 870970 - protein, 18 aa, Mycobacterium
VDKVLLPSLGHRGLSKPD

SEQ ID NO: 870971 - protein, 25 aa, Mycobacterium
VDLAADGVLPLPSGWHTTGMAESDT

SEQ ID NO: 870972 - protein, 26 aa, Mycobacterium
VDLAGFDAWLSRWRALRPDADVMDRA

SEQ ID NO: 870973 - protein, 38 aa, Mycobacterium
VDLAPGALGFRYDTGLYLQFRAATPDDFHLAYAAALAT

SEQ ID NO: 870974 - protein, 27 aa, Mycobacterium
VDLAREKLLADVLRAASRDGLVSAAHD

SEQ ID NO: 870975 - protein, 21 aa, Mycobacterium
VDLATLEPYVALPGTVSRNGL

SEQ ID NO: 870976 - protein, 27 aa, Mycobacterium
VDLATRRSIFIPILRVAAIEPDAVTLA

SEQ ID NO: 870977 - protein, 22 aa, Mycobacterium
VDLAVGFRIPVAPIATPEMLPT

SEQ ID NO: 870978 - protein, 26 aa, Mycobacterium
VDLDHYLLKPWDPPEEKFYPVIDGLL

SEQ ID NO: 870979 - protein, 27 aa, Mycobacterium
VDLDHYLLKPWDPPQEKFYPVIDGLLD

SEQ ID NO: 870980 - protein, 22 aa, Mycobacterium
VDLDLWQAQRVLQSAPTTAADL

SEQ ID NO: 870981 - protein, 22 aa, Mycobacterium
VDLDPMPGVEWQQILDVAMVAR

SEQ ID NO: 870982 - protein, 27 aa, Mycobacterium
VDLDSMDWLNFLVGIHKRLHVDIPEAD

SEQ ID NO: 870983 - protein, 18 aa, Mycobacterium
VDLEHRIGYAYVANRFDA

SEQ ID NO: 870984 - protein, 26 aa, Mycobacterium
VDLELFKHLHKAGLRRVFVGLETGSY

SEQ ID NO: 870985 - protein, 27 aa, Mycobacterium
VDLGDWRQWWRWVPGACWRHPFGPHSD

SEQ ID NO: 870986 - protein, 31 aa, Mycobacterium
VDLGRTIYLGLPYYGRWLLAVARVLTEKHHI

SEQ ID NO: 870987 - protein, 24 aa, Mycobacterium
VDLGSWWTCYPGRPDYFTHWGGAF

SEQ ID NO: 870988 - protein, 18 aa, Mycobacterium
VDLHRLIAYVPGDVTLWP

SEQ ID NO: 870989 - protein, 20 aa, Mycobacterium
VDLIGARRIPVVSTLAPDAD

SEQ ID NO: 870990 - protein, 23 aa, Mycobacterium
VDLIPAAMALLRKGGICVLTGIT

SEQ ID NO: 870991 - protein, 19 aa, Mycobacterium
VDLIPAWNLLSAPAREQFR

SEQ ID NO: 870992 - protein, 27 aa, Mycobacterium
VDLKNWKLLKWLDEPAPFIDWRNREGG

SEQ ID NO: 870993 - protein, 20 aa, Mycobacterium
VDLNVNGTMYVLKHAAREMV

SEQ ID NO: 870994 - protein, 26 aa, Mycobacterium
VDLPADSHLLLLWGAANRDPAQFEIP

SEQ ID NO: 870995 - protein, 26 aa, Mycobacterium
VDLPGPWAFLCVIAGRFRHGAKANRS

SEQ ID NO: 870996 - protein, 18 aa, Mycobacterium
VDLPLEVAVPSLTVMARE

SEQ ID NO: 870997 - protein, 24 aa, Mycobacterium
VDLPSAIPMLVFSGIMNSGQACVA

SEQ ID NO: 870998 - protein, 24 aa, Mycobacterium
VDLPSAIPMLVFSGIMNTGQACVA

SEQ ID NO: 870999 - protein, 22 aa, Mycobacterium
VDLPTYAFQRRRFWETPGGDGP

SEQ ID NO: 871000 - protein, 17 aa, Mycobacterium
VDLRADWPTAVRAAGLD

SEQ ID NO: 871001 - protein, 18 aa, Mycobacterium
VDLRVEAGTLDEALGGLL

SEQ ID NO: 871002 - protein, 24 aa, Mycobacterium
VDLSEVDAYYFAPQKNFAGDGGLW

SEQ ID NO: 871003 - protein, 19 aa, Mycobacterium
VDLSILRSQKMWFIDQIES

SEQ ID NO: 871004 - protein, 24 aa, Mycobacterium
VDLSRTVGWFTTKYPVALSVAEMP

SEQ ID NO: 871005 - protein, 25 aa, Mycobacterium
VDLTDRIVIFQAAFGEQLAKLKSVF

SEQ ID NO: 871006 - protein, 20 aa, Mycobacterium
VDLVALHVWIDVGDIPPIGP

SEQ ID NO: 871007 - protein, 18 aa, Mycobacterium
VDLVCEHFCRLLDHMDAH

SEQ ID NO: 871008 - protein, 19 aa, Mycobacterium
VDLVDPSVVPLRKAPRDAE

SEQ ID NO: 871009 - protein, 26 aa, Mycobacterium
VDLVKSVIEFFKDPAGYLKQKGSDAL

SEQ ID NO: 871010 - protein, 28 aa, Mycobacterium
VDLVVLARYMQILSPAFLAAIGCPLINI

SEQ ID NO: 871011 - protein, 19 aa, Mycobacterium
VDMAALPAVPFAGAAGAVG

SEQ ID NO: 871012 - protein, 26 aa, Mycobacterium
VDMAHFFYIHHAYPTYFKNVIEGHTA

SEQ ID NO: 871013 - protein, 26 aa, Mycobacterium
VDMAHFFYIHHAYPTYFKNVIEGQTA

SEQ ID NO: 871014 - protein, 17 aa, Mycobacterium
VDMAIKLGLRSYANPGT

SEQ ID NO: 871015 - protein, 19 aa, Mycobacterium
VDMASPMAGLPMGAKFGTL

SEQ ID NO: 871016 - protein, 17 aa, Mycobacterium
VDMEPFFDAYRAVKPYL

SEQ ID NO: 871017 - protein, 20 aa, Mycobacterium
VDMIKAVLPAMRARGSGHII

SEQ ID NO: 871018 - protein, 19 aa, Mycobacterium
VDMKDMVGMMIVVARQLKR

SEQ ID NO: 871019 - protein, 27 aa, Mycobacterium
VDMLLTTFRAPLFYRTITTGDPIDDAL

SEQ ID NO: 871020 - protein, 24 aa, Mycobacterium
VDMMANAAFYYGVLRTLSEEDRPL

SEQ ID NO: 871021 - protein, 28 aa, Mycobacterium
VDMTMMHLGPFRPAWGFGGYRTPVPGLY

SEQ ID NO: 871022 - protein, 25 aa, Mycobacterium
VDNALKLLLLLGERPEIRLSEATRY

SEQ ID NO: 871023 - protein, 26 aa, Mycobacterium
VDNALKLLLLLGERPQIRLSEATRYL

SEQ ID NO: 871024 - protein, 22 aa, Mycobacterium
VDNALRLLLLLGERSEIRLTDA

SEQ ID NO: 871025 - protein, 30 aa, Mycobacterium
VDNAYLGHVIVLWSWALKQPNEASPGSATV

SEQ ID NO: 871026 - protein, 26 aa, Mycobacterium
VDNDFRQLWFGWADPAQILVEYAQLR

SEQ ID NO: 871027 - protein, 20 aa, Mycobacterium
VDNFFTWLHTARPGSWDGIA

SEQ ID NO: 871028 - protein, 18 aa, Mycobacterium
VDNGRIMFDHVRVPRVNL

SEQ ID NO: 871029 - protein, 23 aa, Mycobacterium
VDNIRGARLTGVGFRRPFAFVVP

SEQ ID NO: 871030 - protein, 30 aa, Mycobacterium
VDNKLAEFEDYLNGTLRSVGRGRHQLRTGA

SEQ ID NO: 871031 - protein, 27 aa, Mycobacterium
VDNKLAEFEEFLNGTLRSVGRGRHQLR

SEQ ID NO: 871032 - protein, 29 aa, Mycobacterium
VDNKLAEFEEFLNGTLRSVGRGRHQLRTA

SEQ ID NO: 871033 - protein, 25 aa, Mycobacterium
VDNLIHGFILAAQHLVPGGSAPGQA

SEQ ID NO: 871034 - protein, 17 aa, Mycobacterium
VDNLLQYRLPDGSAFSD

SEQ ID NO: 871035 - protein, 21 aa, Mycobacterium
VDNMLHDMSWFKQDSTAMAKA

SEQ ID NO: 871036 - protein, 24 aa, Mycobacterium
VDNPNPLLILTHSLPNTGTVVLQG

SEQ ID NO: 871037 - protein, 23 aa, Mycobacterium
VDNQFRERWFGSSDPAEVLAEYA

SEQ ID NO: 871038 - protein, 25 aa, Mycobacterium
VDNQTRFWNKFYDVVLEAHGDRNGD

SEQ ID NO: 871039 - protein, 26 aa, Mycobacterium
VDNSPGFLGFQLLRPVKGEDRYFVVT

SEQ ID NO: 871040 - protein, 24 aa, Mycobacterium
VDPALARLGLAVIRGLLLDLVATD

SEQ ID NO: 871041 - protein, 19 aa, Mycobacterium
VDPALIDRSLAGAALGSVW

SEQ ID NO: 871042 - protein, 25 aa, Mycobacterium
VDPALVHHYFGTKTQLFAAAIHIPI

SEQ ID NO: 871043 - protein, 18 aa, Mycobacterium
VDPAPLWKSYLDAGWTEL

SEQ ID NO: 871044 - protein, 24 aa, Mycobacterium
VDPAQALTLLAERGLRRVLTEGGP

SEQ ID NO: 871045 - protein, 36 aa, Mycobacterium
VDPASPIMIRLTAGMWWVPVWLLRALEVIVYGPDRV

SEQ ID NO: 871046 - protein, 24 aa, Mycobacterium
VDPASVPYFSLVLVPGAQSATDID

SEQ ID NO: 871047 - protein, 35 aa, Mycobacterium
VDPATGLPWMAEYVEEFGLIPPPADRLTGYADLRT

SEQ ID NO: 871048 - protein, 23 aa, Mycobacterium
VDPAVAGWIRTVCRPDRWLELRY

SEQ ID NO: 871049 - protein, 17 aa, Mycobacterium
VDPAVLLMDEPFGALDA

SEQ ID NO: 871050 - protein, 24 aa, Mycobacterium
VDPDILVRTNWLVTNRSDRVGMRL

SEQ ID NO: 871051 - protein, 17 aa, Mycobacterium
VDPDLLVHTHWVASDRS

SEQ ID NO: 871052 - protein, 32 aa, Mycobacterium
VDPDTLTQWDLMAWTLPKAANRFWMLSESEEA

SEQ ID NO: 871053 - protein, 24 aa, Mycobacterium
VDPFRTEVERLGRIVFGDTFEVDV

SEQ ID NO: 871054 - protein, 21 aa, Mycobacterium
VDPFTGRPWARVPDAAAADVD

SEQ ID NO: 871055 - protein, 24 aa, Mycobacterium
VDPGFINDLIPFALAGTCQSIEQV

SEQ ID NO: 871056 - protein, 20 aa, Mycobacterium
VDPIQASSLPFFGDLELELF

SEQ ID NO: 871057 - protein, 21 aa, Mycobacterium
VDPITDLFPLRGAIIGANRVA

SEQ ID NO: 871058 - protein, 29 aa, Mycobacterium
VDPPALPDPLPTGPTRRVPLGLIAGARSG

SEQ ID NO: 871059 - protein, 26 aa, Mycobacterium
VDPPQAPIQAIWLPHTQSAIRDALTS

SEQ ID NO: 871060 - protein, 25 aa, Mycobacterium
VDPQIVHEYLYPLANPQDTDFAVSE

SEQ ID NO: 871061 - protein, 19 aa, Mycobacterium
VDPQLPWPSGVAPAPELAR

SEQ ID NO: 871062 - protein, 21 aa, Mycobacterium
VDPQRLALLGISFGGYFVARA

SEQ ID NO: 871063 - protein, 25 aa, Mycobacterium
VDPQVQPRYAGWTTYARLPRLEDVS

SEQ ID NO: 871064 - protein, 22 aa, Mycobacterium
VDPRAILAAAPPGYRLSIPENS

SEQ ID NO: 871065 - protein, 17 aa, Mycobacterium
VDPRFYHLDTALAVLDD

SEQ ID NO: 871066 - protein, 17 aa, Mycobacterium
VDPRFYHLDTALAVLDP

SEQ ID NO: 871067 - protein, 22 aa, Mycobacterium
VDPSLIYHYFGSKEGLLDAATT

SEQ ID NO: 871068 - protein, 18 aa, Mycobacterium
VDPTFWTTAKVRGAKIDI

SEQ ID NO: 871069 - protein, 19 aa, Mycobacterium
VDPTIRLRPSRGTHLVFDA

SEQ ID NO: 871070 - protein, 21 aa, Mycobacterium
VDPTTLEQWLWRNAARLLGLS

SEQ ID NO: 871071 - protein, 25 aa, Mycobacterium
VDPVKLRLGIGYVIQSAGLMPHLRV

SEQ ID NO: 871072 - protein, 17 aa, Mycobacterium
VDPWFVAQIGELVKLRA

SEQ ID NO: 871073 - protein, 20 aa, Mycobacterium
VDPWFVEQIAGLVDLRAELV

SEQ ID NO: 871074 - protein, 30 aa, Mycobacterium
VDQAAFFNAVLVRYPDLLDTYLTVGGLCHP

SEQ ID NO: 871075 - protein, 36 aa, Mycobacterium
VDQAWFLADTLSAGTFPWVLAVTVPFRDEAQRAGFN

SEQ ID NO: 871076 - protein, 22 aa, Mycobacterium
VDQELKFFKPIKAGDRLYCDVY

SEQ ID NO: 871077 - protein, 23 aa, Mycobacterium
VDQGAPYWLPRNIEADLDLPSGG

SEQ ID NO: 871078 - protein, 21 aa, Mycobacterium
VDQGLSLTLFFKDTATTRDVN

SEQ ID NO: 871079 - protein, 28 aa, Mycobacterium
VDQHHEFLGGRRRLLYTPCTATQTYLAF

SEQ ID NO: 871080 - protein, 20 aa, Mycobacterium
VDQIATVQVVLADNGHVMLQ

SEQ ID NO: 871081 - protein, 27 aa, Mycobacterium
VDQLRKLTDRYLYLHLAVIGNVEHLQE

SEQ ID NO: 871082 - protein, 17 aa, Mycobacterium
VDQLSVLLKTPQSAPGY

SEQ ID NO: 871083 - protein, 22 aa, Mycobacterium
VDQLSVLLKTPQSAPGYEDEWN

SEQ ID NO: 871084 - protein, 22 aa, Mycobacterium
VDQPRVIEFKTATLAGLGAQPT

SEQ ID NO: 871085 - protein, 23 aa, Mycobacterium
VDQRFVFYKPVLAGDKLWARMDI

SEQ ID NO: 871086 - protein, 30 aa, Mycobacterium
VDQVANWMMQRYIRHVLVEQDGMPAGIVSA

SEQ ID NO: 871087 - protein, 27 aa, Mycobacterium
VDQVYERLMELLLNGTLKAGDPVSIDG

SEQ ID NO: 871088 - protein, 29 aa, Mycobacterium
VDRAIDYRRDGWWKGLDSYDLVLDALGGT

SEQ ID NO: 871089 - protein, 28 aa, Mycobacterium
VDRALTILSQAQRPLIVLGKGAAYAQAD

SEQ ID NO: 871090 - protein, 25 aa, Mycobacterium
VDREAAHLRAFLTFAEHAQRFALDQ

SEQ ID NO: 871091 - protein, 20 aa, Mycobacterium
VDREGALTLFSAWTGVDWSR

SEQ ID NO: 871092 - protein, 25 aa, Mycobacterium
VDRFEEFLPTWTTADVRTLLAKFGL

SEQ ID NO: 871093 - protein, 22 aa, Mycobacterium
VDRFGFPWERLQEINPRLIYAS

SEQ ID NO: 871094 - protein, 20 aa, Mycobacterium
VDRFTRVCDVAITDFVTAPA

SEQ ID NO: 871095 - protein, 25 aa, Mycobacterium
VDRGQPFLALVDYAHKPGALAAVLQ

SEQ ID NO: 871096 - protein, 31 aa, Mycobacterium
VDRHGRRIAGHLGGFRRTPATLREGARRARR

SEQ ID NO: 871097 - protein, 19 aa, Mycobacterium
VDRHVLIERLGLSADLVAS

SEQ ID NO: 871098 - protein, 17 aa, Mycobacterium
VDRHWRVYIDPVLLGTD

SEQ ID NO: 871099 - protein, 19 aa, Mycobacterium
VDRIRRRYGNSALTRAVLV

SEQ ID NO: 871100 - protein, 23 aa, Mycobacterium
VDRLAHRIFRRKHGPPNLLNADD

SEQ ID NO: 871101 - protein, 17 aa, Mycobacterium
VDRLDPEQGWMLSAVWL

SEQ ID NO: 871102 - protein, 25 aa, Mycobacterium
VDRLGLFFELLGATRTMGRVYGWLL

SEQ ID NO: 871103 - protein, 17 aa, Mycobacterium
VDRLLAGESLRGITDRL

SEQ ID NO: 871104 - protein, 18 aa, Mycobacterium
VDRLLDPGSPFLELAPLA

SEQ ID NO: 871105 - protein, 17 aa, Mycobacterium
VDRLPGIGLVRRQLDAL

SEQ ID NO: 871106 - protein, 24 aa, Mycobacterium
VDRLRQRFPKLQDPPSDDICYATQ

SEQ ID NO: 871107 - protein, 26 aa, Mycobacterium
VDRLRQWGIHRIFGYPGDGILSMLGA

SEQ ID NO: 871108 - protein, 20 aa, Mycobacterium
VDRLSQLWFEALAGICAHVK

SEQ ID NO: 871109 - protein, 25 aa, Mycobacterium
VDRNAFRLIPGEYSIWAGNSSRDLP

SEQ ID NO: 871110 - protein, 22 aa, Mycobacterium
VDRNVFAPLKMSETRYLPVTKV

SEQ ID NO: 871111 - protein, 24 aa, Mycobacterium
VDRPARAWLFTVARNMIIDERRSA

SEQ ID NO: 871112 - protein, 26 aa, Mycobacterium
VDRPIEWSKVHLFWGDERYVPEDDDE

SEQ ID NO: 871113 - protein, 18 aa, Mycobacterium
VDRPLTTEKHFRRARGRK

SEQ ID NO: 871114 - protein, 34 aa, Mycobacterium
VDRPLTTVAHFRRAHLRLAQIRLTNGEDLLGRIG

SEQ ID NO: 871115 - protein, 25 aa, Mycobacterium
VDRPRSYSYLILRSFPPLIHQGGTL

SEQ ID NO: 871116 - protein, 24 aa, Mycobacterium
VDRQSMLFSATMPDPIITLARTFM

SEQ ID NO: 871117 - protein, 33 aa, Mycobacterium
VDRRAPLPLAPMQANLWYLQQLAPTMSAYNIVE

SEQ ID NO: 871118 - protein, 27 aa, Mycobacterium
VDRRELSLTIFTRSRPNPSWPVARVEY

SEQ ID NO: 871119 - protein, 18 aa, Mycobacterium
VDRRRIFGPLINQENRLL

SEQ ID NO: 871120 - protein, 23 aa, Mycobacterium
VDRRRLIALLEDLGVPIGQPAAA

SEQ ID NO: 871121 - protein, 17 aa, Mycobacterium
VDRSAAYAMRWVAKNIV

SEQ ID NO: 871122 - protein, 24 aa, Mycobacterium
VDRSAAYAMRWVAKNIVAAGLAER

SEQ ID NO: 871123 - protein, 24 aa, Mycobacterium
VDRSGFAFQPLLGGLSPEEGWKSL

SEQ ID NO: 871124 - protein, 26 aa, Mycobacterium
VDRSTIILAMWQYLLHRYTSQDTVVV

SEQ ID NO: 871125 - protein, 21 aa, Mycobacterium
VDRSVLAALGPEGYLINIARG

SEQ ID NO: 871126 - protein, 26 aa, Mycobacterium
VDRTLIAAYAGGLTPILCLTKTDLAP

SEQ ID NO: 871127 - protein, 22 aa, Mycobacterium
VDRVFVRRVLEDVVLPLAIAPG

SEQ ID NO: 871128 - protein, 19 aa, Mycobacterium
VDRVGAHGWWRCYDGCGAG

SEQ ID NO: 871129 - protein, 31 aa, Mycobacterium
VDRVHVPGLRRRLTPALRQLGAHRREELARQ

SEQ ID NO: 871130 - protein, 24 aa, Mycobacterium
VDRVKERLPVWKHQFFTDGSDEWV

SEQ ID NO: 871131 - protein, 24 aa, Mycobacterium
VDRVKPFRPFQVNEQLLGLADSEA

SEQ ID NO: 871132 - protein, 21 aa, Mycobacterium
VDRWAALDPIPRYRTYLQAQG

SEQ ID NO: 871133 - protein, 17 aa, Mycobacterium
VDRYARLAHRHARTTST

SEQ ID NO: 871134 - protein, 31 aa, Mycobacterium
VDRYGALPEPALRLVAVARLRLLCRAAGITE

SEQ ID NO: 871135 - protein, 22 aa, Mycobacterium
VDSAWFAAAVAAALAIKAQVFN

SEQ ID NO: 871136 - protein, 20 aa, Mycobacterium
VDSAWRDHLLVAITIEEVDG

SEQ ID NO: 871137 - protein, 25 aa, Mycobacterium
VDSEKLWDVSLSKLYETYDAEMSRE

SEQ ID NO: 871138 - protein, 26 aa, Mycobacterium
VDSETPLLSLPIDSAVLMSLMTELED

SEQ ID NO: 871139 - protein, 33 aa, Mycobacterium
VDSFNRGPLLDLSFGDLQFGNRDTTAIGDGAVA

SEQ ID NO: 871140 - protein, 25 aa, Mycobacterium
VDSGLTLSWLLRNLKSRHPRSLRVC

SEQ ID NO: 871141 - protein, 25 aa, Mycobacterium
VDSGLTLSWLLRNLKTRHPRSLKVC

SEQ ID NO: 871142 - protein, 17 aa, Mycobacterium
VDSILFTAVARSLGLRG

SEQ ID NO: 871143 - protein, 27 aa, Mycobacterium
VDSKLAEFEEFLNGTLRSVGRGRHQLR

SEQ ID NO: 871144 - protein, 21 aa, Mycobacterium
VDSLIELGGKTWRFVDTAGLR

SEQ ID NO: 871145 - protein, 21 aa, Mycobacterium
VDSLIELGGKVWRFVDTAGLR

SEQ ID NO: 871146 - protein, 30 aa, Mycobacterium
VDSLIEMDGKLWRFVDTAGLRRKVGQASGH

SEQ ID NO: 871147 - protein, 22 aa, Mycobacterium
VDSLKKALAAYGQIFVQLYGQG

SEQ ID NO: 871148 - protein, 20 aa, Mycobacterium
VDSLWFSELVYSPAVDPTVG

SEQ ID NO: 871149 - protein, 20 aa, Mycobacterium
VDSLWFSELVYSPAVDPVVG

SEQ ID NO: 871150 - protein, 22 aa, Mycobacterium
VDSLWLSELVYSSAVEPFVGMA

SEQ ID NO: 871151 - protein, 26 aa, Mycobacterium
VDSMICGLISGPWLGASATAMAAAAA

SEQ ID NO: 871152 - protein, 25 aa, Mycobacterium
VDSNYLHVHAWMRAFDDENLPVSAW

SEQ ID NO: 871153 - protein, 23 aa, Mycobacterium
VDSPFLGPVLADDLTRHVGADGA

SEQ ID NO: 871154 - protein, 25 aa, Mycobacterium
VDSPHYAYKLEWLAALRDNAQKWLA

SEQ ID NO: 871155 - protein, 24 aa, Mycobacterium
VDSPRHWVAHLNVLRGIQDRTGGF

SEQ ID NO: 871156 - protein, 23 aa, Mycobacterium
VDSRHLVLPLETYPKLNDFGEAN

SEQ ID NO: 871157 - protein, 27 aa, Mycobacterium
VDSRRWAGVPFYLRTGKRLGRRVTEIA

SEQ ID NO: 871158 - protein, 19 aa, Mycobacterium
VDSSLLAQAMWAIAPSISA

SEQ ID NO: 871159 - protein, 33 aa, Mycobacterium
VDSVRVVNLLSWRYRDPGLLLAGRIGAAGARTR

SEQ ID NO: 871160 - protein, 23 aa, Mycobacterium
VDSWFKKVYDLGVPLNIHANGDA

SEQ ID NO: 871161 - protein, 17 aa, Mycobacterium
VDSWLHRIVVNACLDRL

SEQ ID NO: 871162 - protein, 21 aa, Mycobacterium
VDSWLLGQRIRPKTMSAYITS

SEQ ID NO: 871163 - protein, 25 aa, Mycobacterium
VDSYHTVWFELHEELIVAVGLTREE

SEQ ID NO: 871164 - protein, 22 aa, Mycobacterium
VDTALMMCLRDALSAVHDEMAT

SEQ ID NO: 871165 - protein, 18 aa, Mycobacterium
VDTAWFKGNYPPEISVEA

SEQ ID NO: 871166 - protein, 20 aa, Mycobacterium
VDTAWFKGNYPPEVSIEALA

SEQ ID NO: 871167 - protein, 18 aa, Mycobacterium
VDTFASHVLPLDAAPHAY

SEQ ID NO: 871168 - protein, 18 aa, Mycobacterium
VDTILLDQSRMRAITGAG

SEQ ID NO: 871169 - protein, 33 aa, Mycobacterium
VDTIVRTTFGFRLGFFGPFAIADQAGLDVYVKG

SEQ ID NO: 871170 - protein, 27 aa, Mycobacterium
VDTLSVFLQLMLFPDTPRSVLRSLSLH

SEQ ID NO: 871171 - protein, 23 aa, Mycobacterium
VDTLVKRFLTNPVTRSIAEPKSV

SEQ ID NO: 871172 - protein, 32 aa, Mycobacterium
VDTNFVPLGEYPGEFWAYARNKVIVAARIAGI

SEQ ID NO: 871173 - protein, 30 aa, Mycobacterium
VDTPHGPVRFPGVPTWFSQTPGRIAGPAPE

SEQ ID NO: 871174 - protein, 30 aa, Mycobacterium
VDTPHGPVRFPGVPTWFSQTPGRVAGPAPE

SEQ ID NO: 871175 - protein, 18 aa, Mycobacterium
VDTPIWFAFDGDGLVFRT

SEQ ID NO: 871176 - protein, 17 aa, Mycobacterium
VDTPYVLIVPTYGGGHP

SEQ ID NO: 871177 - protein, 25 aa, Mycobacterium
VDTRGWTPMILLDRTEPADRGWFSN

SEQ ID NO: 871178 - protein, 24 aa, Mycobacterium
VDTRRPPRLFGLIKQSGGHAARDW

SEQ ID NO: 871179 - protein, 30 aa, Mycobacterium
VDTVGARMMLLRRLAFPDDARLGEPLRVVV

SEQ ID NO: 871180 - protein, 18 aa, Mycobacterium
VDTVVILGALLADTPHTR

SEQ ID NO: 871181 - protein, 17 aa, Mycobacterium
VDTWWQTETGAIMISPL

SEQ ID NO: 871182 - protein, 20 aa, Mycobacterium
VDTYQLYIGGRWAEPHNGRY

SEQ ID NO: 871183 - protein, 22 aa, Mycobacterium
VDVAAQFLVPAVALDLDADGRA

SEQ ID NO: 871184 - protein, 28 aa, Mycobacterium
VDVAGLGQRWLHAGIRPLDVDVAPPTVN

SEQ ID NO: 871185 - protein, 23 aa, Mycobacterium
VDVAMVYYFFGNKEGLFTASALT

SEQ ID NO: 871186 - protein, 24 aa, Mycobacterium
VDVAVAFRIPVAPIASPEMLPKLD

SEQ ID NO: 871187 - protein, 25 aa, Mycobacterium
VDVCTYHRVGTILRPWYDHSAEEWR

SEQ ID NO: 871188 - protein, 22 aa, Mycobacterium
VDVDDLFRYVYAQPTSQLREQH

SEQ ID NO: 871189 - protein, 28 aa, Mycobacterium
VDVDDLPRLPWWLRPFARFRADDHFTGT

SEQ ID NO: 871190 - protein, 26 aa, Mycobacterium
VDVDMTVLIDLQFAREWIQPHRIHDP

SEQ ID NO: 871191 - protein, 24 aa, Mycobacterium
VDVDPEPWPLYMADTELVLNPGDL

SEQ ID NO: 871192 - protein, 29 aa, Mycobacterium
VDVDVKFNLFLFTMLQKTLKGNIFGGGTT

SEQ ID NO: 871193 - protein, 30 aa, Mycobacterium
VDVFASALSAPLYWIATNAGLDGSVVVNKV

SEQ ID NO: 871194 - protein, 24 aa, Mycobacterium
VDVFKEKLIRRDISMKAFDAGDPQ

SEQ ID NO: 871195 - protein, 30 aa, Mycobacterium
VDVFSEALAAPLYWIATNAGLDGAVAVHKV

SEQ ID NO: 871196 - protein, 30 aa, Mycobacterium
VDVFSEALAAPLYWIATNAGLDGAVAVSKV

SEQ ID NO: 871197 - protein, 30 aa, Mycobacterium
VDVFSEALAAPLYWIATNAGLDGSVVVNKV

SEQ ID NO: 871198 - protein, 19 aa, Mycobacterium
VDVGYGQLAWSLRSDARVV

SEQ ID NO: 871199 - protein, 24 aa, Mycobacterium
VDVIPDVLRHRLVLTYDALADEIS

SEQ ID NO: 871200 - protein, 24 aa, Mycobacterium
VDVLADQLLWDRELYRFVSDHREG

SEQ ID NO: 871201 - protein, 18 aa, Mycobacterium
VDVLFLDTGYHFVETIGT

SEQ ID NO: 871202 - protein, 21 aa, Mycobacterium
VDVLHRQGLPVGGPPGGPAGV

SEQ ID NO: 871203 - protein, 45 aa, Mycobacterium
VDVLRVHLDTARYQLLVQYPAVSPALLLKCMLMAATEGIASGDRV

SEQ ID NO: 871204 - protein, 19 aa, Mycobacterium
VDVLTLFSYPVHPPGKPDR

SEQ ID NO: 871205 - protein, 25 aa, Mycobacterium
VDVNIIRRTIFTPENFTFGLRVPEG

SEQ ID NO: 871206 - protein, 27 aa, Mycobacterium
VDVPAAPYLHLFVTRGRIDLDGAGELA

SEQ ID NO: 871207 - protein, 23 aa, Mycobacterium
VDVPELGYFLTDKPFPRGELLVK

SEQ ID NO: 871208 - protein, 23 aa, Mycobacterium
VDVPFLGPVLADDLARHLDTERG

SEQ ID NO: 871209 - protein, 26 aa, Mycobacterium
VDVPSTGWGWLPLATGVAVVDTVAPL

SEQ ID NO: 871210 - protein, 17 aa, Mycobacterium
VDVRCRATVGEVGNAEQ

SEQ ID NO: 871211 - protein, 23 aa, Mycobacterium
VDVRPEIALPDLTGLSVSVDAIE

SEQ ID NO: 871212 - protein, 31 aa, Mycobacterium
VDVRYQDRLLLPLPMFHVAALTTVIMCAMRG

SEQ ID NO: 871213 - protein, 27 aa, Mycobacterium
VDVSELYIPYSWYEPMWMENIGLAPES

SEQ ID NO: 871214 - protein, 31 aa, Mycobacterium
VDVSLLGVGAWASALSVGLALLEGGPPAPRA

SEQ ID NO: 871215 - protein, 23 aa, Mycobacterium
VDVSLLNAAIWQLGPDIVGSGVT

SEQ ID NO: 871216 - protein, 32 aa, Mycobacterium
VDVSMFESLLATLPYPMLMAARLKSLGLPMNS

SEQ ID NO: 871217 - protein, 26 aa, Mycobacterium
VDVSMPMEMPPFQTPADADLVLTAES

SEQ ID NO: 871218 - protein, 21 aa, Mycobacterium
VDVTLYLPWGAVKGNIEPCWY

SEQ ID NO: 871219 - protein, 22 aa, Mycobacterium
VDVVWHLRYDDEYRLTESVWRI

SEQ ID NO: 871220 - protein, 20 aa, Mycobacterium
VDVVYYLLHGIGEPGFREAD

SEQ ID NO: 871221 - protein, 25 aa, Mycobacterium
VDWDELPRWSMIDKALGLDSPDPAE

SEQ ID NO: 871222 - protein, 25 aa, Mycobacterium
VDWDELPRWSMIDKALGLDTPDPAE

SEQ ID NO: 871223 - protein, 25 aa, Mycobacterium
VDWDELPRWTMIDKALGLGSPDPAE

SEQ ID NO: 871224 - protein, 25 aa, Mycobacterium
VDWDELTRWALIDKALGLDNPEPAE

SEQ ID NO: 871225 - protein, 17 aa, Mycobacterium
VDWFPPTHPDRPDAPNL

SEQ ID NO: 871226 - protein, 33 aa, Mycobacterium
VDWVRINGFGTPWWADDLAALATTPVGGVMLAM

SEQ ID NO: 871227 - protein, 39 aa, Mycobacterium
VDYALALSAIAAFRRAIQSWWHDGWDLLLTPTVASLPVK

SEQ ID NO: 871228 - protein, 17 aa, Mycobacterium
VDYALRRRALLAEVYSG

SEQ ID NO: 871229 - protein, 21 aa, Mycobacterium
VDYDYLLYAVGSTGGVPTSVP

SEQ ID NO: 871230 - protein, 19 aa, Mycobacterium
VDYLKRLTADLRRTRRRVA

SEQ ID NO: 871231 - protein, 17 aa, Mycobacterium
VDYLLPTATEVPAIEYG

SEQ ID NO: 871232 - protein, 18 aa, Mycobacterium
VDYLQGLGLRVLARNWRC

SEQ ID NO: 871233 - protein, 23 aa, Mycobacterium
VDYLTARGWRVAAHPARELYAQN

SEQ ID NO: 871234 - protein, 26 aa, Mycobacterium
VDYLTFRLTGRWVGSQMNAVCKYNYD

SEQ ID NO: 871235 - protein, 30 aa, Mycobacterium
VDYPKVNAIPSRGWFELADAILAAGNDPST

SEQ ID NO: 871236 - protein, 19 aa, Mycobacterium
VDYRALKSLALELLGREKP

SEQ ID NO: 871237 - protein, 23 aa, Mycobacterium
VDYRALPDMLADLKIRSATDTLG

SEQ ID NO: 871238 - protein, 26 aa, Mycobacterium
VEAADRIERWYLQTRHKRAQPVTPFD

SEQ ID NO: 871239 - protein, 20 aa, Mycobacterium
VEAALLRHPRIGGAVVIPAN

SEQ ID NO: 871240 - protein, 25 aa, Mycobacterium
VEAARTMEFPLFVKAVSGGGGRGMR

SEQ ID NO: 871241 - protein, 25 aa, Mycobacterium
VEAAYENWIDTRKPPLFGTEPDARV

SEQ ID NO: 871242 - protein, 21 aa, Mycobacterium
VEADLLTFGKVMSGGLPAAAF

SEQ ID NO: 871243 - protein, 17 aa, Mycobacterium
VEADRPGFRRGRVLSKI

SEQ ID NO: 871244 - protein, 25 aa, Mycobacterium
VEAFELVVVNLYPFSETVASGASVD

SEQ ID NO: 871245 - protein, 18 aa, Mycobacterium
VEAFWGLDWPREISIVAA

SEQ ID NO: 871246 - protein, 25 aa, Mycobacterium
VEAGHALILVAHHDPIPLLQQLHDR

SEQ ID NO: 871247 - protein, 18 aa, Mycobacterium
VEAGRRVGGRRRGRAVAG

SEQ ID NO: 871248 - protein, 25 aa, Mycobacterium
VEAGSVVVPLLLASAYHARIDIPAL

SEQ ID NO: 871249 - protein, 18 aa, Mycobacterium
VEAIAAGVALMGDAVRGA

SEQ ID NO: 871250 - protein, 22 aa, Mycobacterium
VEAIAGITLLRLLTRGADLDDA

SEQ ID NO: 871251 - protein, 17 aa, Mycobacterium
VEAIIWRYRTGCPWRDL

SEQ ID NO: 871252 - protein, 18 aa, Mycobacterium
VEAILARSVAAESRISGT

SEQ ID NO: 871253 - protein, 21 aa, Mycobacterium
VEAIRGWLRREGTCLLLAPHH

SEQ ID NO: 871254 - protein, 28 aa, Mycobacterium
VEALAAAVALLRYEGRDAGWVPCSVPDA

SEQ ID NO: 871255 - protein, 20 aa, Mycobacterium
VEALDRHRLLSDITRVLADE

SEQ ID NO: 871256 - protein, 19 aa, Mycobacterium
VEALDRHRLLSDVTRVLAD

SEQ ID NO: 871257 - protein, 18 aa, Mycobacterium
VEALEHFPSALPATRESA

SEQ ID NO: 871258 - protein, 23 aa, Mycobacterium
VEALGLERFPLLGVSQGGAVAVA

SEQ ID NO: 871259 - protein, 17 aa, Mycobacterium
VEALLPLAPGLADVVPD

SEQ ID NO: 871260 - protein, 18 aa, Mycobacterium
VEALRNRLPGCRTVPDWD

SEQ ID NO: 871261 - protein, 18 aa, Mycobacterium
VEALSALTYANLTRWLRG

SEQ ID NO: 871262 - protein, 24 aa, Mycobacterium
VEAMGLLRGGDAWLFVGWCRLREG

SEQ ID NO: 871263 - protein, 42 aa, Mycobacterium
VEAMLHSDYPLQALLYSVVLHRFLRWRLPDYHPDRHLGGVLY

SEQ ID NO: 871264 - protein, 24 aa, Mycobacterium
VEAMRQLLLDLLTDNPDLADMDQR

SEQ ID NO: 871265 - protein, 19 aa, Mycobacterium
VEAPMALGWSRWRALDGGR

SEQ ID NO: 871266 - protein, 29 aa, Mycobacterium
VEARDVTEAVLWLAGPRSRYVTGVSIPVD

SEQ ID NO: 871267 - protein, 24 aa, Mycobacterium
VEARHTALPLERYAELSGFTEAND

SEQ ID NO: 871268 - protein, 33 aa, Mycobacterium
VEARKRGIPVILRPVVLAKLMTGYTTLMVTGTH

SEQ ID NO: 871269 - protein, 32 aa, Mycobacterium; identical to SEQ ID NO: 118186

SEQ ID NO: 871270 - protein, 32 aa, Mycobacterium
VEARRRGIPVILRPAVLARLMDDRTSLLVTGT

SEQ ID NO: 871271 - protein, 32 aa, Mycobacterium
VEARRRGIPVILRPAVLARLMEGRTTLMVTGT

SEQ ID NO: 871272 - protein, 33 aa, Mycobacterium
VEARRRGIPVLLRPVVLAKLMAGRTTLMVTGTH

SEQ ID NO: 871273 - protein, 26 aa, Mycobacterium
VEARVPIVPLIVWGAHRVWTKDHPRA

SEQ ID NO: 871274 - protein, 25 aa, Mycobacterium
VEASMIWQWFIDPVVREQFPDVEHD

SEQ ID NO: 871275 - protein, 17 aa, Mycobacterium
VEASRFAEPLFTPATKA

SEQ ID NO: 871276 - protein, 25 aa, Mycobacterium
VEATVPLQILARTLALALGHDVDKP

SEQ ID NO: 871277 - protein, 23 aa, Mycobacterium
VEAVSRHLIFSPTRGARVVQLNG

SEQ ID NO: 871278 - protein, 18 aa, Mycobacterium
VEAVWIVAQREGLAVRPL

SEQ ID NO: 871279 - protein, 22 aa, Mycobacterium
VEAWGGLPLVLDLESTDADDVA

SEQ ID NO: 871280 - protein, 28 aa, Mycobacterium
VECAQACGLPLLRRPPSVDTAWRAHSTG

SEQ ID NO: 871281 - protein, 24 aa, Mycobacterium
VECPAGAMLVFDSTLWHAAGQNIS

SEQ ID NO: 871282 - protein, 22 aa, Mycobacterium
VEDAIEELHWAAGKGFKAVFLP

SEQ ID NO: 871283 - protein, 24 aa, Mycobacterium
VEDAVRRRGVVPDALRDNALNNRD

SEQ ID NO: 871284 - protein, 24 aa, Mycobacterium
VEDEPMFHAWIFDFMMGSDLGPDG

SEQ ID NO: 871285 - protein, 25 aa, Mycobacterium
VEDFAWSWHILMKGAIILAAVGDPD

SEQ ID NO: 871286 - protein, 25 aa, Mycobacterium
VEDFAWSWHILMKGAIIMAAVGDAE

SEQ ID NO: 871287 - protein, 21 aa, Mycobacterium
VEDFAYPIPVAVICKILGVPI

SEQ ID NO: 871288 - protein, 25 aa, Mycobacterium
VEDFDRVIGINLRGAWLCTKHAAPK

SEQ ID NO: 871289 - protein, 18 aa, Mycobacterium
VEDFTPGYVLRVLEWMPR

SEQ ID NO: 871290 - protein, 26 aa, Mycobacterium
VEDIANLAVFLLSDAASFITGQVINV

SEQ ID NO: 871291 - protein, 26 aa, Mycobacterium
VEDIEWLWDAVWDYFDIRAASPPRAV

SEQ ID NO: 871292 - protein, 18 aa, Mycobacterium
VEDIPAGWAARQVYIDLR

SEQ ID NO: 871293 - protein, 26 aa, Mycobacterium
VEDLGRLAVYLCTRDCYATNAVFHVD

SEQ ID NO: 871294 - protein, 26 aa, Mycobacterium
VEDLGRLTVYLCTRDCYATNAIFHVD

SEQ ID NO: 871295 - protein, 30 aa, Mycobacterium
VEDLHSLAKFPEPLAPLAAAHRAGADLPSR

SEQ ID NO: 871296 - protein, 18 aa, Mycobacterium
VEDLKPLITPVDAEFRVG

SEQ ID NO: 871297 - protein, 23 aa, Mycobacterium
VEDLNPLIMPVDAEFRVGTMGLG

SEQ ID NO: 871298 - protein, 27 aa, Mycobacterium
VEDPGWANLLDLLAALRLNAEPVRVDD

SEQ ID NO: 871299 - protein, 18 aa, Mycobacterium
VEDQPPELIPFSGPARKA

SEQ ID NO: 871300 - protein, 28 aa, Mycobacterium
VEDRRLRQVWPRYDAMRIELAVGQLCDL

SEQ ID NO: 871301 - protein, 24 aa, Mycobacterium
VEDRYSQLFKLDRVRPAVVADGLA

SEQ ID NO: 871302 - protein, 24 aa, Mycobacterium
VEDRYSQLFTLDRVRPAVVADGLA

SEQ ID NO: 871303 - protein, 23 aa, Mycobacterium
VEDTMHFAVLSGVRAWIEELPLA

SEQ ID NO: 871304 - protein, 26 aa, Mycobacterium
VEDVANLAMFLLSDAAGFITGQVINV

SEQ ID NO: 871305 - protein, 26 aa, Mycobacterium
VEDVANMAMFLLSDAASFVTGQVINV

SEQ ID NO: 871306 - protein, 25 aa, Mycobacterium
VEDVFPLPRELVGEGSLFLLKVVGD

SEQ ID NO: 871307 - protein, 26 aa, Mycobacterium
VEDVFPLPRELVGQGTLFLLKVVGES

SEQ ID NO: 871308 - protein, 25 aa, Mycobacterium
VEDVKGKAKEAVGAVTGQDDLTREG

SEQ ID NO: 871309 - protein, 23 aa, Mycobacterium
VEDYLYTHPELLAQPLRVTIEHD

SEQ ID NO: 871310 - protein, 26 aa, Mycobacterium
VEEARPLLRQFPVLVPTGVDFMKNAG

SEQ ID NO: 871311 - protein, 25 aa, Mycobacterium
VEEDGPVYQLRRWYEQFYVDVEDVT

SEQ ID NO: 871312 - protein, 25 aa, Mycobacterium
VEEFGRLDFVLANAGILPIAGDQGR

SEQ ID NO: 871313 - protein, 32 aa, Mycobacterium
VEEFLGKPLTMSRFLVVMSSYYGRARVEDDAF

SEQ ID NO: 871314 - protein, 24 aa, Mycobacterium
VEEFRFHVGLARLAGNTLLDLFLR

SEQ ID NO: 871315 - protein, 24 aa, Mycobacterium
VEEFSWQLEKALPVPVFAQTMAQV

SEQ ID NO: 871316 - protein, 32 aa, Mycobacterium
VEEGAFDMFSPANISPLVAYLSTEKNPWTGQV

SEQ ID NO: 871317 - protein, 25 aa, Mycobacterium
VEEGDIWRMPIVKDAPIRDWVKLAV

SEQ ID NO: 871318 - protein, 24 aa, Mycobacterium
VEEGLEVLGWRKLPVDPDGAGIGA

SEQ ID NO: 871319 - protein, 24 aa, Mycobacterium
VEEKRAFIELAVKDALYGRASVPR

SEQ ID NO: 871320 - protein, 25 aa, Mycobacterium
VEEKRPLIELGLKDVLYGTAGAPMI

SEQ ID NO: 871321 - protein, 25 aa, Mycobacterium
VEELAMSSLLYLQPSTYYSDITRPT

SEQ ID NO: 871322 - protein, 18 aa, Mycobacterium
VEELAPPESDRIGRLAFA

SEQ ID NO: 871323 - protein, 20 aa, Mycobacterium
VEELFAAGLIKAVFATETLA

SEQ ID NO: 871324 - protein, 17 aa, Mycobacterium
VEELFTAGLVRAVFATE

SEQ ID NO: 871325 - protein, 20 aa, Mycobacterium
VEELGFGQIALLLPTLPTDE

SEQ ID NO: 871326 - protein, 20 aa, Mycobacterium
VEELKAPLLAAVGAADLALA

SEQ ID NO: 871327 - protein, 23 aa, Mycobacterium
VEELLRYLSIIQNGQRRVAVEDI

SEQ ID NO: 871328 - protein, 26 aa, Mycobacterium
VEEMGGMNLFFVFGSGGSARLVTPEL

SEQ ID NO: 871329 - protein, 26 aa, Mycobacterium
VEEMGGMNLFFVFGSGGTARLVTPEL

SEQ ID NO: 871330 - protein, 26 aa, Mycobacterium
VEEPPEHLIFIFATTEPEKVLPTIRS

SEQ ID NO: 871331 - protein, 25 aa, Mycobacterium
VEEPPPRTVFLLCAPSVDPEDISIT

SEQ ID NO: 871332 - protein, 25 aa, Mycobacterium
VEEPPPSTVFLLCAPSVDPEDIAIT

SEQ ID NO: 871333 - protein, 25 aa, Mycobacterium
VEEQYGCIFMWYQPQGKEPQWELPD

SEQ ID NO: 871334 - protein, 23 aa, Mycobacterium
VEERPFMEFTPGYVLRSIDELPK

SEQ ID NO: 871335 - protein, 25 aa, Mycobacterium
VEERSCWHIWISPAQRRAIGIATGT

SEQ ID NO: 871336 - protein, 17 aa, Mycobacterium
VEESMKLFEYLGGPQTY

SEQ ID NO: 871337 - protein, 26 aa, Mycobacterium
VEETALIARWLAAPRVRIVRVTGIPD

SEQ ID NO: 871338 - protein, 29 aa, Mycobacterium
VEETIKLPRTILMYPMTLISQAAHLVMRF

SEQ ID NO: 871339 - protein, 29 aa, Mycobacterium
VEETIRLPKTILMYPMTLASQAAHIVMRF

SEQ ID NO: 871340 - protein, 18 aa, Mycobacterium
VEETLHFAMLSGVRARVE

SEQ ID NO: 871341 - protein, 19 aa, Mycobacterium
VEETLRYEAPFRGHYRHVR

SEQ ID NO: 871342 - protein, 22 aa, Mycobacterium
VEETMHFAVLSGVRAWIEERPL

SEQ ID NO: 871343 - protein, 29 aa, Mycobacterium
VEETMKLPRTILMYPMTLASQAAHLVMLF

SEQ ID NO: 871344 - protein, 27 aa, Mycobacterium
VEEVLRDFLDWLFGRYQQILDTATSPL

SEQ ID NO: 871345 - protein, 23 aa, Mycobacterium
VEEWDIALLHRDHRSRPGACVRA

SEQ ID NO: 871346 - protein, 20 aa, Mycobacterium
VEEYLWTFNMPTDHAHVSLT

SEQ ID NO: 871347 - protein, 23 aa, Mycobacterium
VEFDWAKLPFYYVPNEPFTTHFC

SEQ ID NO: 871348 - protein, 18 aa, Mycobacterium
VEFGIKRGRKTVNIVAAG

SEQ ID NO: 871349 - protein, 19 aa, Mycobacterium
VEFIARHFEIGPGDRCLAL

SEQ ID NO: 871350 - protein, 29 aa, Mycobacterium
VEFLAVELSSFQLHWAPSVRPVAGAVLNV

SEQ ID NO: 871351 - protein, 23 aa, Mycobacterium
VEFMMLDRLFPRSVYYSLRMAEH

SEQ ID NO: 871352 - protein, 23 aa, Mycobacterium
VEFPVVQAPMTYIARAELAAAVS

SEQ ID NO: 871353 - protein, 25 aa, Mycobacterium
VEFSKFILAEIFPGGWLPTPQTVGE

SEQ ID NO: 871354 - protein, 17 aa, Mycobacterium
VEFTCSLPVVAAGERIA

SEQ ID NO: 871355 - protein, 18 aa, Mycobacterium
VEFTGIVHPGLMGTAPSA

SEQ ID NO: 871356 - protein, 18 aa, Mycobacterium
VEFTLRTMLSFFVAPNDP

SEQ ID NO: 871357 - protein, 27 aa, Mycobacterium
VEFVDRAVRRLLLQKVQLGLLDPGWTP

SEQ ID NO: 871358 - protein, 17 aa, Mycobacterium
VEFVGEPLTIAFNPTYL

SEQ ID NO: 871359 - protein, 27 aa, Mycobacterium
VEGDERAHWWELAVAAYPPYAEYQTKT

SEQ ID NO: 871360 - protein, 18 aa, Mycobacterium
VEGDRIVCPFHGWEWNRD

SEQ ID NO: 871361 - protein, 23 aa, Mycobacterium
VEGDTVIAAVDPGWRRGATQGHS

SEQ ID NO: 871362 - protein, 23 aa, Mycobacterium
VEGFGVRLRKGDIVLPGSCTFAV

SEQ ID NO: 871363 - protein, 24 aa, Mycobacterium
VEGHDPYDTLLIGSTLYVNESNNA

SEQ ID NO: 871364 - protein, 27 aa, Mycobacterium
VEGIRADRFWMMGPPTPADEVVTRKAA

SEQ ID NO: 871365 - protein, 29 aa, Mycobacterium
VEGLSLFRRRLVTPFIRAGAAVLSCDHMP

SEQ ID NO: 871366 - protein, 18 aa, Mycobacterium
VEGLYTDWPDRTSLVSEI

SEQ ID NO: 871367 - protein, 23 aa, Mycobacterium
VEGMIEALPIAAFSMMRAMSTRN

SEQ ID NO: 871368 - protein, 19 aa, Mycobacterium
VEGMPAMMSGMMDGGMMGP

SEQ ID NO: 871369 - protein, 24 aa, Mycobacterium
VEGMPAMMSGMMDGGMMGPGMGHG

SEQ ID NO: 871370 - protein, 18 aa, Mycobacterium
VEGNWVAGWVDFAGPTVD

SEQ ID NO: 871371 - protein, 26 aa, Mycobacterium
VEGPGQALFVFFRDMVRSAAVDHGLV

SEQ ID NO: 871372 - protein, 30 aa, Mycobacterium
VEGRDIGTVVFPDAPVKIFLTASAETRARR

SEQ ID NO: 871373 - protein, 23 aa, Mycobacterium
VEGRRYLDCLSAYSAVNFGHCNP

SEQ ID NO: 871374 - protein, 24 aa, Mycobacterium
VEGRTRVSLALPGDLVPGDPRVPF

SEQ ID NO: 871375 - protein, 18 aa, Mycobacterium
VEGSGMASVILYGPPGSG

SEQ ID NO: 871376 - protein, 21 aa, Mycobacterium
VEGSKIAWRPAEPGKQPPGHL

SEQ ID NO: 871377 - protein, 21 aa, Mycobacterium
VEGTFLLTRALAPAMVARGEG

SEQ ID NO: 871378 - protein, 24 aa, Mycobacterium
VEGTPFLHEIPLSAFFGTGVVVSI

SEQ ID NO: 871379 - protein, 24 aa, Mycobacterium
VEGVHLRFGFVARGGLRWSDRRED

SEQ ID NO: 871380 - protein, 28 aa, Mycobacterium
VEGVPGGRLHALPQPVLRPPTRVDDVAG

SEQ ID NO: 871381 - protein, 25 aa, Mycobacterium
VEGYDFLEQLAKFSPNRLQTDPIGY

SEQ ID NO: 871382 - protein, 31 aa, Mycobacterium
VEHDFDLYSTHPWVLLAYAVPRNGMQPETLV

SEQ ID NO: 871383 - protein, 31 aa, Mycobacterium; identical to SEQ ID NO: 133243

SEQ ID NO: 871384 - protein, 18 aa, Mycobacterium
VEHDSQGYRLIFENDLVG

SEQ ID NO: 871385 - protein, 18 aa, Mycobacterium
VEHEGAQVSWLPTAADGS

SEQ ID NO: 871386 - protein, 24 aa, Mycobacterium
VEHETFFPLLPIVVPDTSDGDLAL

SEQ ID NO: 871387 - protein, 22 aa, Mycobacterium
VEHFDWLEDLGFQFERSYFPGK

SEQ ID NO: 871388 - protein, 26 aa, Mycobacterium
VEHFILEDYWGRWLGRWTAEEHLHAI

SEQ ID NO: 871389 - protein, 22 aa, Mycobacterium
VEHFNWLEDLGFQFERSYFPGK

SEQ ID NO: 871390 - protein, 30 aa, Mycobacterium
VEHKAIIRDVLAAGDFWGGAGSLACQEFIT

SEQ ID NO: 871391 - protein, 19 aa, Mycobacterium
VEHLAALRAIPNLSVVRPG

SEQ ID NO: 871392 - protein, 24 aa, Mycobacterium
VEHLFREGRLLGWSTPATGVLVQT

SEQ ID NO: 871393 - protein, 25 aa, Mycobacterium
VEHLTVFQRTPIWVFPKPDKEVTSA

SEQ ID NO: 871394 - protein, 31 aa, Mycobacterium
VEHLTVFQRTPIWVFPKPDMEIKSVGRWVLG

SEQ ID NO: 871395 - protein, 17 aa, Mycobacterium
VEHPVVERPEALRWLAN

SEQ ID NO: 871396 - protein, 29 aa, Mycobacterium
VEHPYREPLWAQLITAYYLTDRQSDALSA

SEQ ID NO: 871397 - protein, 27 aa, Mycobacterium
VEHSRSIPLLVWQFREPRLCISSGPLG

SEQ ID NO: 871398 - protein, 27 aa, Mycobacterium
VEHVLATQTLPLRPFKTMAVNVDGDLP

SEQ ID NO: 871399 - protein, 27 aa, Mycobacterium
VEHVLATQTLPLRPFKTMAVNVDGKLP

SEQ ID NO: 871400 - protein, 28 aa, Mycobacterium
VEHVLATQTLPLRPFKTMAVNVDGRLPA

SEQ ID NO: 871401 - protein, 27 aa, Mycobacterium
VEHVLATQTLPLRPFKTMAVNVEGQLP

SEQ ID NO: 871402 - protein, 21 aa, Mycobacterium
VEHVVLCINKMDLVDWSPQRF

SEQ ID NO: 871403 - protein, 29 aa, Mycobacterium
VEHYVTTKEPWFLDAYRRAWEWADSTGWR

SEQ ID NO: 871404 - protein, 20 aa, Mycobacterium
VEIAVIHRPRYDDWSLPKGK

SEQ ID NO: 871405 - protein, 23 aa, Mycobacterium
VEIEATGLVHRVAHRGYQVAPPM

SEQ ID NO: 871406 - protein, 19 aa, Mycobacterium
VEIFGGPLRDRLRACPGPG

SEQ ID NO: 871407 - protein, 35 aa, Mycobacterium
VEIGKRDIYADTRLGLFPFRRNLSFYAVDLALMTV

SEQ ID NO: 871408 - protein, 21 aa, Mycobacterium
VEIHRRLVRSGLPFGTCLDAV

SEQ ID NO: 871409 - protein, 17 aa, Mycobacterium
VEILRDGFEWQQVYTRS

SEQ ID NO: 871410 - protein, 20 aa, Mycobacterium
VEINVRWRKGQTLQPDWKID

SEQ ID NO: 871411 - protein, 23 aa, Mycobacterium
VEIRYYSIIYQAIDEIESALKGM

SEQ ID NO: 871412 - protein, 17 aa, Mycobacterium
VEIRYYSVIYQAIDEIE

SEQ ID NO: 871413 - protein, 19 aa, Mycobacterium
VEITDTATLLAVRRGRYQV

SEQ ID NO: 871414 - protein, 25 aa, Mycobacterium
VEIVTPGSWRREPIAGIPASTNTVI

SEQ ID NO: 871415 - protein, 26 aa, Mycobacterium
VEIYGSTHILDWPRGKKLLDVLLDAG

SEQ ID NO: 871416 - protein, 25 aa, Mycobacterium
VEKANFELWCFAVSSINGCPDCVAA

SEQ ID NO: 871417 - protein, 26 aa, Mycobacterium
VEKARLIFAAVRDRIWYDPYSTDDDP

SEQ ID NO: 871418 - protein, 24 aa, Mycobacterium
VEKAVAFAAANKLKIAPRGGGHSY

SEQ ID NO: 871419 - protein, 23 aa, Mycobacterium
VEKDYWVCEVLRTIAASHRDEIV

SEQ ID NO: 871420 - protein, 25 aa, Mycobacterium
VEKFTTAFAPYGLPATAVKPSYGMA

SEQ ID NO: 871421 - protein, 24 aa, Mycobacterium
VEKHLYQELFLHELNWSAPDSPPI

SEQ ID NO: 871422 - protein, 28 aa, Mycobacterium
VELADAWRQLLATPAALPAVRPAVDTYA

SEQ ID NO: 871423 - protein, 17 aa, Mycobacterium
VELALAAPTFQQLIARA

SEQ ID NO: 871424 - protein, 19 aa, Mycobacterium
VELALASYPGFTVTAPPGD

SEQ ID NO: 871425 - protein, 17 aa, Mycobacterium
VELAPEPVYADVSWVSD

SEQ ID NO: 871426 - protein, 31 aa, Mycobacterium
VELAPSLHRPPPLFALVNFFDAQASPLSMMT

SEQ ID NO: 871427 - protein, 26 aa, Mycobacterium
VELCSLTYPGYKPSLAGLVGSALFAD

SEQ ID NO: 871428 - protein, 24 aa, Mycobacterium
VELFGMTLPSPMFMAPIGVIGICA

SEQ ID NO: 871429 - protein, 18 aa, Mycobacterium
VELFKKSVAKTHRPEVLG

SEQ ID NO: 871430 - protein, 21 aa, Mycobacterium
VELFYGRPRTQSSWELVTDAL

SEQ ID NO: 871431 - protein, 17 aa, Mycobacterium
VELGLGAGWFEEEHLAY

SEQ ID NO: 871432 - protein, 17 aa, Mycobacterium
VELGRIRQVPPADRRVL

SEQ ID NO: 871433 - protein, 18 aa, Mycobacterium
VELGVWVAAPAAAAILAD

SEQ ID NO: 871434 - protein, 17 aa, Mycobacterium
VELGYDFLPGTTVNRYC

SEQ ID NO: 871435 - protein, 18 aa, Mycobacterium
VELGYDFLPGTTVNRYCS

SEQ ID NO: 871436 - protein, 19 aa, Mycobacterium
VELHFERFAAPPVVDGRPF

SEQ ID NO: 871437 - protein, 21 aa, Mycobacterium
VELHRRLVRSGLPFGTCLTAS

SEQ ID NO: 871438 - protein, 17 aa, Mycobacterium
VELISPEGLYRLTPRTG

SEQ ID NO: 871439 - protein, 17 aa, Mycobacterium
VELKENIKKQWWRSVVT

SEQ ID NO: 871440 - protein, 17 aa, Mycobacterium
VELKENIKRQWWKSVVT

SEQ ID NO: 871441 - protein, 17 aa, Mycobacterium
VELKKWLIGYVVANIDC

SEQ ID NO: 871442 - protein, 27 aa, Mycobacterium
VELLARLHATFWGRLPERRGTGPLGWL

SEQ ID NO: 871443 - protein, 19 aa, Mycobacterium
VELLIPDFNAIPAQLDEVF

SEQ ID NO: 871444 - protein, 19 aa, Mycobacterium
VELLLAQDWRARVAGIAAG

SEQ ID NO: 871445 - protein, 17 aa, Mycobacterium
VELLLRHYGPLLDRWKA

SEQ ID NO: 871446 - protein, 17 aa, Mycobacterium
VELLREAWLTATRARNA

SEQ ID NO: 871447 - protein, 23 aa, Mycobacterium
VELLTYLPLITTAINAQFRPNDQ

SEQ ID NO: 871448 - protein, 18 aa, Mycobacterium
VELLWKLIEQSPGLEITA

SEQ ID NO: 871449 - protein, 26 aa, Mycobacterium
VELNADPYPMFRRLRDEAPLYYNAQH

SEQ ID NO: 871450 - protein, 25 aa, Mycobacterium
VELNADPYPMFRRLREEAPLYYNAQ

SEQ ID NO: 871451 - protein, 18 aa, Mycobacterium
VELNFDALTTPEWLALVE

SEQ ID NO: 871452 - protein, 38 aa, Mycobacterium; identical to SEQ ID NO: 223938

SEQ ID NO: 871453 - protein, 17 aa, Mycobacterium
VELPGGDALYWVGDTAP

SEQ ID NO: 871454 - protein, 23 aa, Mycobacterium
VELPLMFEPYDRKALRKRAIELL

SEQ ID NO: 871455 - protein, 23 aa, Mycobacterium
VELPPLPVQYADFAAWQAELLAG

SEQ ID NO: 871456 - protein, 23 aa, Mycobacterium
VELPTYAFQRRRFWLSGDGVAAD

SEQ ID NO: 871457 - protein, 18 aa, Mycobacterium
VELPVSWALDDWQQYCFV

SEQ ID NO: 871458 - protein, 33 aa, Mycobacterium
VELRARLADRLPAYLVPAAVVAIEALPLTPNGK

SEQ ID NO: 871459 - protein, 21 aa, Mycobacterium
VELRRTAYLQRMSTVIGRRVW

SEQ ID NO: 871460 - protein, 26 aa, Mycobacterium
VELSDLELFLLRITLALMSNRPILVI

SEQ ID NO: 871461 - protein, 17 aa, Mycobacterium
VELSLALHRVFESPYDP

SEQ ID NO: 871462 - protein, 20 aa, Mycobacterium
VELTGMGVTWMLRPSAENVT

SEQ ID NO: 871463 - protein, 18 aa, Mycobacterium
VELVAAVRPDWTPGEARF

SEQ ID NO: 871464 - protein, 18 aa, Mycobacterium
VELVAAWTRKRTPVRAAQ

SEQ ID NO: 871465 - protein, 18 aa, Mycobacterium
VELVLDRTPLYAEAGGQI

SEQ ID NO: 871466 - protein, 18 aa, Mycobacterium
VELVWNPEFLREGFAVQG

SEQ ID NO: 871467 - protein, 24 aa, Mycobacterium
VELWEAMLGIAKLGAVIMPTTGAL

SEQ ID NO: 871468 - protein, 28 aa, Mycobacterium
VELWGKTWAAPMFFAPIGVIALCAQDGH

SEQ ID NO: 871469 - protein, 17 aa, Mycobacterium
VELYNLVVWNECNLELA

SEQ ID NO: 871470 - protein, 18 aa, Mycobacterium
VEMAKYAGLPWDVVLGSD

SEQ ID NO: 871471 - protein, 17 aa, Mycobacterium
VEMAVAPIALALASHPT

SEQ ID NO: 871472 - protein, 26 aa, Mycobacterium
VEMENGYLLLMRVGDGSNLATLAGRS

SEQ ID NO: 871473 - protein, 19 aa, Mycobacterium
VEMFRKLLDQGQAGDNVGL

SEQ ID NO: 871474 - protein, 26 aa, Mycobacterium
VEMGKGEASLWLEDFRGEVTATMVYD

SEQ ID NO: 871475 - protein, 26 aa, Mycobacterium
VEMGLARLWQSWGIQPDVVLGHSVGQ

SEQ ID NO: 871476 - protein, 22 aa, Mycobacterium
VEMKQRWLPGIADGSQKMAFSL

SEQ ID NO: 871477 - protein, 22 aa, Mycobacterium
VEMLMPCFAQLYSDLGITKSDI

SEQ ID NO: 871478 - protein, 17 aa, Mycobacterium
VEMLRRTTPMKFQWAKG

SEQ ID NO: 871479 - protein, 17 aa, Mycobacterium
VEMQLIMRWLDEQRTRH

SEQ ID NO: 871480 - protein, 25 aa, Mycobacterium
VEMQNGFLLLMRVGDGSHLAALAVT

SEQ ID NO: 871481 - protein, 25 aa, Mycobacterium
VEMQNGFLLLMRVGDGSHLATLAVT

SEQ ID NO: 871482 - protein, 27 aa, Mycobacterium
VEMQVAFATLARRLPGLKLAVPPEELR

SEQ ID NO: 871483 - protein, 25 aa, Mycobacterium
VEMQVAFATLARRLPGLKLAVSPAE

SEQ ID NO: 871484 - protein, 26 aa, Mycobacterium
VEMTHAHLLFEAYALDAVLPSRFGDR

SEQ ID NO: 871485 - protein, 18 aa, Mycobacterium
VENALLSLCGEPPWPRPR

SEQ ID NO: 871486 - protein, 19 aa, Mycobacterium
VENFLLEGAKWGLGKRDLV

SEQ ID NO: 871487 - protein, 30 aa, Mycobacterium
VENGARLNIPWRRDFNALVYVLSGSGYVGP

SEQ ID NO: 871488 - protein, 26 aa, Mycobacterium
VENIATSPWLVQPLSAPAGAGKTTSL

SEQ ID NO: 871489 - protein, 25 aa, Mycobacterium
VENKLLALLHRYGIAAPASADMARA

SEQ ID NO: 871490 - protein, 19 aa, Mycobacterium
VENKLRTVLWGWAGKPVDE

SEQ ID NO: 871491 - protein, 26 aa, Mycobacterium
VENKVLALLHRFGIAAPASADMSRAV

SEQ ID NO: 871492 - protein, 21 aa, Mycobacterium
VENLKLLFRDTNATSEAVING

SEQ ID NO: 871493 - protein, 28 aa, Mycobacterium
VENLVNAPVLGLTGRPLIGNGANGAAGT

SEQ ID NO: 871494 - protein, 19 aa, Mycobacterium
VENMFPFRADRFFGAGQTS

SEQ ID NO: 871495 - protein, 28 aa, Mycobacterium
VENNIGVPFAPYLYTVSTLHCMTVSLAL

SEQ ID NO: 871496 - protein, 39 aa, Mycobacterium
VENPRVHLFFGARYFCELYDLRTLWQVAAHNPWLSVSPV

SEQ ID NO: 871497 - protein, 23 aa, Mycobacterium
VENPTGFHQPRPPWLMSRCAPAP

SEQ ID NO: 871498 - protein, 27 aa, Mycobacterium
VENQPGFLGFQLLRPVKGEDRYFVVTQ

SEQ ID NO: 871499 - protein, 26 aa, Mycobacterium
VENSPGFLGFQLLRPVKGEDRYFVVT

SEQ ID NO: 871500 - protein, 25 aa, Mycobacterium
VENVALPLRYAGVRKPAAIARARQL

SEQ ID NO: 871501 - protein, 17 aa, Mycobacterium
VEPAILRPSFRNWDHPI

SEQ ID NO: 871502 - protein, 17 aa, Mycobacterium
VEPALLELLSARAQQLV

SEQ ID NO: 871503 - protein, 17 aa, Mycobacterium
VEPDRLRMLRSFDPRAG

SEQ ID NO: 871504 - protein, 19 aa, Mycobacterium
VEPDVVLLDLKLSAGSDFE

SEQ ID NO: 871505 - protein, 23 aa, Mycobacterium
VEPGQLRRVYVGYIGLDGRPHRG

SEQ ID NO: 871506 - protein, 28 aa, Mycobacterium
VEPHEELSFLRPLPVQALWGVGSVTAEK

SEQ ID NO: 871507 - protein, 18 aa, Mycobacterium
VEPIVFKDILRLRRWCSG

SEQ ID NO: 871508 - protein, 28 aa, Mycobacterium
VEPLTEYHRLWEPKIPLGRIGRPEELTG

SEQ ID NO: 871509 - protein, 18 aa, Mycobacterium
VEPLTLKPEVCWQLPIRR

SEQ ID NO: 871510 - protein, 18 aa, Mycobacterium
VEPPLADMIEMWIEMAWQ

SEQ ID NO: 871511 - protein, 18 aa, Mycobacterium
VEPRFMEVLKPVLAFVDF

SEQ ID NO: 871512 - protein, 26 aa, Mycobacterium
VEPRKEWVLEFTIGAAPRSSAVVATL

SEQ ID NO: 871513 - protein, 26 aa, Mycobacterium
VEPSAPLPEFWIKRARKKILHAALEG

SEQ ID NO: 871514 - protein, 26 aa, Mycobacterium
VEPSAPLPEFWVNRARRKILHSALEG

SEQ ID NO: 871515 - protein, 18 aa, Mycobacterium
VEPTPGAALAERRCMLYA

SEQ ID NO: 871516 - protein, 22 aa, Mycobacterium
VEPVQLLLDAGGARRARHAFDR

SEQ ID NO: 871517 - protein, 23 aa, Mycobacterium
VEPVWREWVARWPVPSAMAKTSV

SEQ ID NO: 871518 - protein, 19 aa, Mycobacterium
VEQATRWLTDPPERPFLLT

SEQ ID NO: 871519 - protein, 18 aa, Mycobacterium
VEQDGAQRLYRGRFLFFG

SEQ ID NO: 871520 - protein, 29 aa, Mycobacterium
VEQEYAMGPGIRRLLRLGMTAPLKAIDRQ

SEQ ID NO: 871521 - protein, 30 aa, Mycobacterium
VEQGGERRLYRGRFLFFGSGYYNYDEGYTP

SEQ ID NO: 871522 - protein, 23 aa, Mycobacterium
VEQGIVHIIGPQLGLTQPGTTVV

SEQ ID NO: 871523 - protein, 22 aa, Mycobacterium
VEQHIADLVPLTSTPIVLASRP

SEQ ID NO: 871524 - protein, 18 aa, Mycobacterium
VEQIHRRQRLRGVGGHRE

SEQ ID NO: 871525 - protein, 26 aa, Mycobacterium
VEQIKRFRILPTLWEPGGDEITLTMK

SEQ ID NO: 871526 - protein, 28 aa, Mycobacterium
VEQKPYTRRPYAPFMTSTLQQEAARKLR

SEQ ID NO: 871527 - protein, 27 aa, Mycobacterium
VEQKPYTRRPYAPFMTSTLQQEAGRKL

SEQ ID NO: 871528 - protein, 19 aa, Mycobacterium
VEQLPEIWRRLVEGGMESG

SEQ ID NO: 871529 - protein, 27 aa, Mycobacterium
VEQLRATIPELPWLSRKRIQQEWGIGD

SEQ ID NO: 871530 - protein, 25 aa, Mycobacterium
VEQNGFPFEAFLVNTVQLTAEQRAQ

SEQ ID NO: 871531 - protein, 24 aa, Mycobacterium
VEQVVIRHRLTLGVLVCCPAAVAD

SEQ ID NO: 871532 - protein, 24 aa, Mycobacterium
VEQVWLRDGWVDRFALDLPRNDTG

SEQ ID NO: 871533 - protein, 17 aa, Mycobacterium
VEQYSQWPAWTSLTPEV

SEQ ID NO: 871534 - protein, 17 aa, Mycobacterium
VERAAELGQILLDRISS

SEQ ID NO: 871535 - protein, 23 aa, Mycobacterium
VERAEVPWLEPLPDLMADPADPS

SEQ ID NO: 871536 - protein, 29 aa, Mycobacterium
VERALQLLAQAQRPLIVLGKGAAYAQADD

SEQ ID NO: 871537 - protein, 19 aa, Mycobacterium
VERATAERLPLLASPSSGG

SEQ ID NO: 871538 - protein, 29 aa, Mycobacterium
VERDLRAAVYGWLAFTFEMCRQRLMDASL

SEQ ID NO: 871539 - protein, 24 aa, Mycobacterium
VERDMEGFTRGRKLDKMGLHSQDT

SEQ ID NO: 871540 - protein, 25 aa, Mycobacterium
VEREPYGVVGVLAPWNGPLVVVGAA

SEQ ID NO: 871541 - protein, 27 aa, Mycobacterium
VEREVVRAMMLLRLSTLATGHTGIRPQ

SEQ ID NO: 871542 - protein, 18 aa, Mycobacterium
VERFFAQSWDRLAAGRAG

SEQ ID NO: 871543 - protein, 20 aa, Mycobacterium
VERFPFVPADPRRLQQDCYE

SEQ ID NO: 871544 - protein, 18 aa, Mycobacterium
VERFPRRASYAYQLDAFA

SEQ ID NO: 871545 - protein, 18 aa, Mycobacterium
VERFVVTEELLAAGAPVA

SEQ ID NO: 871546 - protein, 24 aa, Mycobacterium
VERGARILVLTDDPRRSVVIVPGC

SEQ ID NO: 871547 - protein, 26 aa, Mycobacterium
VERGMPISFTFARFIKFIVTEIFPGG

SEQ ID NO: 871548 - protein, 25 aa, Mycobacterium
VERGMPLTFELARFIKFMVTEIFPG

SEQ ID NO: 871549 - protein, 29 aa, Mycobacterium
VERGQIPRNLHFTRWNPAIDASATRLFVP

SEQ ID NO: 871550 - protein, 21 aa, Mycobacterium
VERHYRDCRILGIGGGTNEIM

SEQ ID NO: 871551 - protein, 18 aa, Mycobacterium
VERIAAMPLNQLMMIKLA

SEQ ID NO: 871552 - protein, 27 aa, Mycobacterium
VERIDAEYALYFTGTGRPTGEWARAGA

SEQ ID NO: 871553 - protein, 22 aa, Mycobacterium
VERIDAPVRRLALSSGTSLDYD

SEQ ID NO: 871554 - protein, 20 aa, Mycobacterium
VERIGLRYVLEIRVPAGVDG

SEQ ID NO: 871555 - protein, 22 aa, Mycobacterium
VERIGLRYVLEIRVPVGVDGRV

SEQ ID NO: 871556 - protein, 30 aa, Mycobacterium
VERISLPARLIPCTGGYRAVLPRPVTALLG

SEQ ID NO: 871557 - protein, 19 aa, Mycobacterium
VERIWDRHLLNSAAVAELL

SEQ ID NO: 871558 - protein, 17 aa, Mycobacterium
VERIYRDVRLLRLYEGT

SEQ ID NO: 871559 - protein, 25 aa, Mycobacterium
VERIYRDVRLLRLYEGTSEIQRLIV

SEQ ID NO: 871560 - protein, 26 aa, Mycobacterium
VERIYREVRLLRLYEGTSEIQRLIIG

SEQ ID NO: 871561 - protein, 20 aa, Mycobacterium
VERLAIPLPVEMICHILGID

SEQ ID NO: 871562 - protein, 24 aa, Mycobacterium
VERLLSELFGGHALLAPTTTLAHM

SEQ ID NO: 871563 - protein, 23 aa, Mycobacterium
VERLPEPLVIVDERYRDMVGAAP

SEQ ID NO: 871564 - protein, 26 aa, Mycobacterium
VERLREQGVRLIYDAPRRGTANSRIN

SEQ ID NO: 871565 - protein, 24 aa, Mycobacterium
VERLRQRFPKLQDPPSDDICYATQ

SEQ ID NO: 871566 - protein, 26 aa, Mycobacterium
VERLRQTIPELPWLSRKRIQEEWGIS

SEQ ID NO: 871567 - protein, 27 aa, Mycobacterium
VERLRTTIPELPWLARKRIQDDWGVSD

SEQ ID NO: 871568 - protein, 31 aa, Mycobacterium
VERLRVLGVDPTVILSRLRFVAPARPVRAEW

SEQ ID NO: 871569 - protein, 24 aa, Mycobacterium
VERLVLSRAVLWHCEDRVIRFGNQ

SEQ ID NO: 871570 - protein, 20 aa, Mycobacterium
VERLWSASQRYELPGSHPLI

SEQ ID NO: 871571 - protein, 17 aa, Mycobacterium
VERMLKLRAADDGLSFV

SEQ ID NO: 871572 - protein, 21 aa, Mycobacterium
VERNWFRRVVTGERVPGIFGS

SEQ ID NO: 871573 - protein, 23 aa, Mycobacterium
VERPRVRWKILDAWQAAAAESGI

SEQ ID NO: 871574 - protein, 23 aa, Mycobacterium
VERPRVRWKILDAWQAAAAQFGI

SEQ ID NO: 871575 - protein, 24 aa, Mycobacterium
VERPVWPMIVLRTPKGWTGPKMVD

SEQ ID NO: 871576 - protein, 21 aa, Mycobacterium
VERQVLYWLDPVGGTASFVDH

SEQ ID NO: 871577 - protein, 30 aa, Mycobacterium
VERRARWVVRVIVSMLLFPGHDEADERAMI

SEQ ID NO: 871578 - protein, 25 aa, Mycobacterium
VERREVPWLEPLPELTDHPADPSVV

SEQ ID NO: 871579 - protein, 22 aa, Mycobacterium
VERRLYELMVLMKAADDRLSKG

SEQ ID NO: 871580 - protein, 25 aa, Mycobacterium
VERRYRAWIRWNAAIMVHRAQRPGV

SEQ ID NO: 871581 - protein, 25 aa, Mycobacterium
VERSAQIVWGARALGGPVAIPEDVN

SEQ ID NO: 871582 - protein, 17 aa, Mycobacterium
VERSIIGFGARIGPRAL

SEQ ID NO: 871583 - protein, 22 aa, Mycobacterium
VERSNRLAAFLHAQGLGCHTER

SEQ ID NO: 871584 - protein, 19 aa, Mycobacterium
VERTPGMRAKLFDAARLAA

SEQ ID NO: 871585 - protein, 24 aa, Mycobacterium
VERTPGMRAKLFDAARLAAGAIGY

SEQ ID NO: 871586 - protein, 17 aa, Mycobacterium
VERYGRIDVLVNNAGII

SEQ ID NO: 871587 - protein, 24 aa, Mycobacterium
VESAEPLHWLPAEDEWIWGRATVL

SEQ ID NO: 871588 - protein, 28 aa, Mycobacterium
VESAIRIGLALNCEIAPWGRFARKNYFY

SEQ ID NO: 871589 - protein, 29 aa, Mycobacterium
VESAIRIGLALNCEIAPWGRFARKNYFYP

SEQ ID NO: 871590 - protein, 26 aa, Mycobacterium
VESFGILDALYPGRIDLGLGRTGHRI

SEQ ID NO: 871591 - protein, 24 aa, Mycobacterium
VESGELPWSIVALGLSSVAPQQPP

SEQ ID NO: 871592 - protein, 24 aa, Mycobacterium
VESGPTMLLPYSQTFEAGYIAFYR

SEQ ID NO: 871593 - protein, 20 aa, Mycobacterium
VESIDYFGFSYGTYLGVVYA

SEQ ID NO: 871594 - protein, 26 aa, Mycobacterium
VESLADHPFDLLARLRFRVTVNTDNR

SEQ ID NO: 871595 - protein, 22 aa, Mycobacterium
VESLLHHAMVIPKALPQGRVAV

SEQ ID NO: 871596 - protein, 18 aa, Mycobacterium
VESLRETPLRNAVLAYLA

SEQ ID NO: 871597 - protein, 22 aa, Mycobacterium
VESLSHPLIDHVRGRGLLLGIV

SEQ ID NO: 871598 - protein, 21 aa, Mycobacterium
VESMILPPIAHEVKVISIAQF

SEQ ID NO: 871599 - protein, 17 aa, Mycobacterium
VESPAERLGQLWGLLLP

SEQ ID NO: 871600 - protein, 24 aa, Mycobacterium
VESPLGSQLIFPVSSTSAEELRRT

SEQ ID NO: 871601 - protein, 17 aa, Mycobacterium
VESQMAPMFPLVIIVHA

SEQ ID NO: 871602 - protein, 36 aa, Mycobacterium
VESRAQMATLPRLKPRIFYDLVVEVALIRPGPIQGG

SEQ ID NO: 871603 - protein, 35 aa, Mycobacterium
VESRAQMATLPRLKPRMFYDLVVEVALIRPGPIQG

SEQ ID NO: 871604 - protein, 24 aa, Mycobacterium
VESREMWLFMRDRCLSIAGGTTQI

SEQ ID NO: 871605 - protein, 29 aa, Mycobacterium
VESSIEALYPHFLATDPIAQTATRALQPA

SEQ ID NO: 871606 - protein, 24 aa, Mycobacterium
VESTVELLIERISDKIRGDQSAHD

SEQ ID NO: 871607 - protein, 26 aa, Mycobacterium
VESVPMYRLRRYFAPGAGTEDAGPVV

SEQ ID NO: 871608 - protein, 19 aa, Mycobacterium
VESWVELVAAVRPDWTPGE

SEQ ID NO: 871609 - protein, 26 aa, Mycobacterium
VETAEKAMLWMRLTARARAGHGSMVH

SEQ ID NO: 871610 - protein, 30 aa, Mycobacterium
VETALRLGISKDRWIFPLAGAQANDTFALS

SEQ ID NO: 871611 - protein, 26 aa, Mycobacterium
VETAPRTWLLLVTGLLTVEDAAASGE

SEQ ID NO: 871612 - protein, 26 aa, Mycobacterium
VETDAAHYLLPPQQAAWIPAGLQHQA

SEQ ID NO: 871613 - protein, 27 aa, Mycobacterium
VETDARTWLLLATGLLSVDDAAAAGAL

SEQ ID NO: 871614 - protein, 28 aa, Mycobacterium
VETDEVVGIVLLLRDVLARSLFEKYQTD

SEQ ID NO: 871615 - protein, 29 aa, Mycobacterium
VETDEVVGIVLLLRDVLARSLFEKYQTDF

SEQ ID NO: 871616 - protein, 29 aa, Mycobacterium
VETDEVVGIVLLLRDVLARSLFEKYQTEF

SEQ ID NO: 871617 - protein, 30 aa, Mycobacterium; identical to SEQ ID NO: 118205

SEQ ID NO: 871618 - protein, 18 aa, Mycobacterium
VETDPLIYAPDSHSWWDV

SEQ ID NO: 871619 - protein, 17 aa, Mycobacterium
VETDPMVFAPDSHSWWD

SEQ ID NO: 871620 - protein, 26 aa, Mycobacterium
VETDPRTWLLLAAGLVPFDEAKDAGA

SEQ ID NO: 871621 - protein, 26 aa, Mycobacterium
VETDPRTWLLLATGKLSFAEAKGTGT

SEQ ID NO: 871622 - protein, 31 aa, Mycobacterium
VETFAFPELTGTFNWAIDWFDAIARGNDRPA

SEQ ID NO: 871623 - protein, 19 aa, Mycobacterium
VETFGKFLGGSAANVAVAA

SEQ ID NO: 871624 - protein, 24 aa, Mycobacterium
VETFGPVVSLIRFVDDDEAVRLAN

SEQ ID NO: 871625 - protein, 17 aa, Mycobacterium
VETGFLEHLWNAPTKDI

SEQ ID NO: 871626 - protein, 24 aa, Mycobacterium
VETGPAQIIWKDGLTSAGGCSCWI

SEQ ID NO: 871627 - protein, 25 aa, Mycobacterium
VETGSTGLFGTKGGAGGTGGVGGAG

SEQ ID NO: 871628 - protein, 19 aa, Mycobacterium
VETLGPIMHEVKSAVGDVL

SEQ ID NO: 871629 - protein, 21 aa, Mycobacterium
VETLIRLRPTFGAVNLEDISA

SEQ ID NO: 871630 - protein, 28 aa, Mycobacterium
VETLKFTYVVGWPHLWRAYKKFSDPDAT

SEQ ID NO: 871631 - protein, 24 aa, Mycobacterium
VETLTGFKWLVRAADSDLVYAYEE

SEQ ID NO: 871632 - protein, 21 aa, Mycobacterium
VETLVMFLASASLGAVWSSCS

SEQ ID NO: 871633 - protein, 22 aa, Mycobacterium
VETMIGLFINTVPLRVRLDANA

SEQ ID NO: 871634 - protein, 23 aa, Mycobacterium
VETMIGLFINTVPMRVRLDPAAS

SEQ ID NO: 871635 - protein, 26 aa, Mycobacterium
VETRTELLRLQRRLGITSLYVTHDQE

SEQ ID NO: 871636 - protein, 24 aa, Mycobacterium
VETSKPEPLIRDPYARMLVTNANA

SEQ ID NO: 871637 - protein, 20 aa, Mycobacterium
VETSLPYFREFLAREAMRSR

SEQ ID NO: 871638 - protein, 26 aa, Mycobacterium
VETTAAGLLLAWRGDAGHAAQAAIAL

SEQ ID NO: 871639 - protein, 18 aa, Mycobacterium
VETTLPDHIPPNALVCFP

SEQ ID NO: 871640 - protein, 27 aa, Mycobacterium
VETTPRTWLLLVTGLLTLEQAIADRTV

SEQ ID NO: 871641 - protein, 20 aa, Mycobacterium
VETTWKLLLDSQSGIRVLDD

SEQ ID NO: 871642 - protein, 18 aa, Mycobacterium
VETVFGWLRVRQGDYVVI

SEQ ID NO: 871643 - protein, 26 aa, Mycobacterium
VETVPRIFKRIRPAFRYDRSLAVITA

SEQ ID NO: 871644 - protein, 25 aa, Mycobacterium
VETVPRIFKRIRPGFRYERSLAVIT

SEQ ID NO: 871645 - protein, 23 aa, Mycobacterium
VETVPRVFKRIRPAFTYQRSLDV

SEQ ID NO: 871646 - protein, 18 aa, Mycobacterium
VEVALIRPGPIQGGSVHP

SEQ ID NO: 871647 - protein, 20 aa, Mycobacterium
VEVCREEMLRLGRTPVPASV

SEQ ID NO: 871648 - protein, 20 aa, Mycobacterium
VEVEFLVTLIAVCSQGPQGP

SEQ ID NO: 871649 - protein, 30 aa, Mycobacterium
VEVFASALSSPLYWIATNAGLDGAVVVNKV

SEQ ID NO: 871650 - protein, 19 aa, Mycobacterium
VEVFLRLAHGVGRRQVLLA

SEQ ID NO: 871651 - protein, 30 aa, Mycobacterium
VEVFRMLADATRVRVLWALTAGELSVNELA

SEQ ID NO: 871652 - protein, 30 aa, Mycobacterium
VEVFSEALAAPLYWIAANAGLDGAVAVSKV

SEQ ID NO: 871653 - protein, 19 aa, Mycobacterium
VEVGDLHWFHVYSAVVWCC

SEQ ID NO: 871654 - protein, 24 aa, Mycobacterium
VEVGDLHWFYVYSGVMWACVFMRT

SEQ ID NO: 871655 - protein, 25 aa, Mycobacterium
VEVGGRPVLWHIMKVLGHHGISDFV

SEQ ID NO: 871656 - protein, 34 aa, Mycobacterium
VEVGKLADLVLWEPAFFGVRPHAVIKGGGIVWAA

SEQ ID NO: 871657 - protein, 34 aa, Mycobacterium
VEVGKLADLVLWEPAFFGVRPHAVIKGGMIAWAA

SEQ ID NO: 871658 - protein, 38 aa, Mycobacterium
VEVGKLADLVLWEPAFFGVRPHAVLKGGMIAWAAMGDA

SEQ ID NO: 871659 - protein, 34 aa, Mycobacterium
VEVGKLADLVLWEPAFFGVRPHAVVKGGAIAWAA

SEQ ID NO: 871660 - protein, 33 aa, Mycobacterium
VEVGKLADLVLWEPAFFGVRPHAVVKGGMIAWA

SEQ ID NO: 871661 - protein, 46 aa, Mycobacterium
VEVGKVADLVIWKPAFFGVKPQVVLKNGYIAWAALGDAAGSISSSE

SEQ ID NO: 871662 - protein, 24 aa, Mycobacterium
VEVGLKWPNDVLAGPPGSPGKLAG

SEQ ID NO: 871663 - protein, 17 aa, Mycobacterium
VEVGRHLSHADLLAHHH

SEQ ID NO: 871664 - protein, 21 aa, Mycobacterium
VEVIVGLPRTLGDRASASAHD

SEQ ID NO: 871665 - protein, 21 aa, Mycobacterium
VEVLLLSELLTEALHSGAARM

SEQ ID NO: 871666 - protein, 19 aa, Mycobacterium
VEVLLVADLLTEALAHSGA

SEQ ID NO: 871667 - protein, 18 aa, Mycobacterium
VEVLRRLLDNAAATPGRN

SEQ ID NO: 871668 - protein, 25 aa, Mycobacterium
VEVNPPYPVIVGTGLLGELVDNLKG

SEQ ID NO: 871669 - protein, 17 aa, Mycobacterium
VEVPFEMPIGETLVRGR

SEQ ID NO: 871670 - protein, 23 aa, Mycobacterium
VEVPRPEFGVIRAAKVVTAASRL

SEQ ID NO: 871671 - protein, 29 aa, Mycobacterium
VEVRLSRYSYLVSLLPPQIIKDLGAPVRL

SEQ ID NO: 871672 - protein, 20 aa, Mycobacterium
VEVRPMSQLRWPGHDDPDVA

SEQ ID NO: 871673 - protein, 26 aa, Mycobacterium
VEVSPHPLLSYAIKDTLTGPHRNLPT

SEQ ID NO: 871674 - protein, 19 aa, Mycobacterium
VEVSSPYLSLLRKGERSNP

SEQ ID NO: 871675 - protein, 24 aa, Mycobacterium
VEVTDKCLQLFGGYGYMMEYPIAQ

SEQ ID NO: 871676 - protein, 18 aa, Mycobacterium
VEVTMRLVWTTDGSPYRY

SEQ ID NO: 871677 - protein, 30 aa, Mycobacterium
VEVVAFIVERLPEEPLLTLLLENDRTNQFS

SEQ ID NO: 871678 - protein, 17 aa, Mycobacterium
VEVVVGENFTFGKKAAG

SEQ ID NO: 871679 - protein, 29 aa, Mycobacterium
VEWKPAVRPTILTWGLLGPGKGVERVIDV

SEQ ID NO: 871680 - protein, 17 aa, Mycobacterium
VEWLEANASFHAAIYHR

SEQ ID NO: 871681 - protein, 27 aa, Mycobacterium
VEWPRNTPLLDVLLARGIDAPYSCREG

SEQ ID NO: 871682 - protein, 30 aa, Mycobacterium
VEWRHPLGHRWRWEFEALSPNLTQVTETFD

SEQ ID NO: 871683 - protein, 18 aa, Mycobacterium
VEWRRHIHRYPELGRQEY

SEQ ID NO: 871684 - protein, 20 aa, Mycobacterium
VEWRRHIHRYPELGRQEYAT

SEQ ID NO: 871685 - protein, 25 aa, Mycobacterium
VEYAQLRAQWGWRLVAAASTLPTPA

SEQ ID NO: 871686 - protein, 31 aa, Mycobacterium
VEYAQQRAEWGWRLVAAASTLPTPALRDAGV

SEQ ID NO: 871687 - protein, 20 aa, Mycobacterium
VEYFLLDHPSTSIWQGTADL

SEQ ID NO: 871688 - protein, 18 aa, Mycobacterium
VEYFLWLRRTDSDVDVEA

SEQ ID NO: 871689 - protein, 25 aa, Mycobacterium
VEYLVDAVFNYPTFSEAYKVAALDV

SEQ ID NO: 871690 - protein, 18 aa, Mycobacterium
VEYPLVGPWGAARVFAPQ

SEQ ID NO: 871691 - protein, 19 aa, Mycobacterium
VEYQPPEAAHWLACGIEAA

SEQ ID NO: 871692 - protein, 21 aa, Mycobacterium
VEYVLVALGGCLTAGIASIAQ

SEQ ID NO: 871693 - protein, 19 aa, Mycobacterium
VEYYLSVASGPMLALLRDR

SEQ ID NO: 871694 - protein, 18 aa, Mycobacterium
VFAAMRRQQEMPHGLLGF

SEQ ID NO: 871695 - protein, 29 aa, Mycobacterium
VFAARPVRMSARRFWVRYAAEVAGALTLD

SEQ ID NO: 871696 - protein, 34 aa, Mycobacterium
VFAEAGFIDLFIAYPLWVTAQKARRLRQVASRAA

SEQ ID NO: 871697 - protein, 23 aa, Mycobacterium
VFAELAPHPLLTRAVEKTAESLD

SEQ ID NO: 871698 - protein, 25 aa, Mycobacterium
VFAETCPQYLYLSLEEQLAAPGFEG

SEQ ID NO: 871699 - protein, 25 aa, Mycobacterium
VFAETCPQYLYLSLEEQLGAGGFEG

SEQ ID NO: 871700 - protein, 20 aa, Mycobacterium
VFAFDYRGFGASEGTPRQSL

SEQ ID NO: 871701 - protein, 19 aa, Mycobacterium
VFAGVLAAGWPAGHEHALQ

SEQ ID NO: 871702 - protein, 18 aa, Mycobacterium
VFAHYLRASGMEGRDEFV

SEQ ID NO: 871703 - protein, 17 aa, Mycobacterium
VFAKTPPTVVMLAGLQG

SEQ ID NO: 871704 - protein, 25 aa, Mycobacterium
VFANELSFVFGLRPGTPVGELTDPL

SEQ ID NO: 871705 - protein, 22 aa, Mycobacterium
VFANFKPGTLTALGFSYDNLRA

SEQ ID NO: 871706 - protein, 24 aa, Mycobacterium
VFAPGQVALLSPPELPYSGRVCGA

SEQ ID NO: 871707 - protein, 17 aa, Mycobacterium
VFAPPYEALNDPAMQAS

SEQ ID NO: 871708 - protein, 20 aa, Mycobacterium
VFAPRPERMSARKFWMRYAA

SEQ ID NO: 871709 - protein, 20 aa, Mycobacterium
VFAPVFEPVRVEVGFHTPRL

SEQ ID NO: 871710 - protein, 18 aa, Mycobacterium
VFARTRPADEQGAGIAVF

SEQ ID NO: 871711 - protein, 26 aa, Mycobacterium
VFASLHLQYAPFLKPEEVTRAVLFLV

SEQ ID NO: 871712 - protein, 20 aa, Mycobacterium
VFASLRALGGSPPYTVVVGC

SEQ ID NO: 871713 - protein, 20 aa, Mycobacterium
VFATAYYALVDLAAAKRGQR

SEQ ID NO: 871714 - protein, 19 aa, Mycobacterium
VFATPLLQQGVPLGVDVVV

SEQ ID NO: 871715 - protein, 23 aa, Mycobacterium
VFCRRWGVPLIDGGTIRLPRLIG

SEQ ID NO: 871716 - protein, 18 aa, Mycobacterium
VFCRRWGVPLIDGGTVRL

SEQ ID NO: 871717 - protein, 20 aa, Mycobacterium
VFCRRWGVPLIDGGTVRLPR

SEQ ID NO: 871718 - protein, 19 aa, Mycobacterium
VFDAIPRILGPRYEDIMAS

SEQ ID NO: 871719 - protein, 25 aa, Mycobacterium
VFDDDPVMRFFVTTTANLLSAEWQA

SEQ ID NO: 871720 - protein, 21 aa, Mycobacterium
VFDDITLALMVHPGPTDIAGA

SEQ ID NO: 871721 - protein, 24 aa, Mycobacterium
VFDDPFRFDILRDPNPHLGFGGNG

SEQ ID NO: 871722 - protein, 24 aa, Mycobacterium
VFDDPFTFDILRDPNPHVGFGGTG

SEQ ID NO: 871723 - protein, 24 aa, Mycobacterium
VFDDPFTFDILRSPNPHLGFGGTG

SEQ ID NO: 871724 - protein, 24 aa, Mycobacterium
VFDDPFTFNILRDPNPHVGFGGTG

SEQ ID NO: 871725 - protein, 24 aa, Mycobacterium
VFDDPFTFNILRSPNPHVGFGGTG

SEQ ID NO: 871726 - protein, 24 aa, Mycobacterium
VFDDPYTFDILRDPNPHVGFGGTG

SEQ ID NO: 871727 - protein, 24 aa, Mycobacterium
VFDDPYTFNILRDPNPHVGFGGTG

SEQ ID NO: 871728 - protein, 19 aa, Mycobacterium
VFDELLLRCDDIALGPPKV

SEQ ID NO: 871729 - protein, 17 aa, Mycobacterium
VFDFFHPSRIVIGADDS

SEQ ID NO: 871730 - protein, 17 aa, Mycobacterium
VFDFPEGIGPVECVNVE

SEQ ID NO: 871731 - protein, 36 aa, Mycobacterium
VFDGPSIDRPLYRFPVFGFFALSIGAAALGNARAAI

SEQ ID NO: 871732 - protein, 25 aa, Mycobacterium
VFDGYFVPEDGFVSVWRAGAFGTLE

SEQ ID NO: 871733 - protein, 25 aa, Mycobacterium
VFDLAVRNRLPVVLFAEGGGGRPGD

SEQ ID NO: 871734 - protein, 34 aa, Mycobacterium
VFDLRPGAIIRDLDLLRPIYAPTAAYGHFGRTDI

SEQ ID NO: 871735 - protein, 31 aa, Mycobacterium
VFDMVTRRYWWHAWWWIPQAIVRGGVDKVHA

SEQ ID NO: 871736 - protein, 24 aa, Mycobacterium
VFDNPFNFDILRNPNPHLAFGGNG

SEQ ID NO: 871737 - protein, 23 aa, Mycobacterium
VFDPRTPYVVFWVIDPETGERVP

SEQ ID NO: 871738 - protein, 23 aa, Mycobacterium
VFDQFVDRIKPVGALVVCVDDPG

SEQ ID NO: 871739 - protein, 17 aa, Mycobacterium
VFDSVHLQRYGFLGVEP

SEQ ID NO: 871740 - protein, 17 aa, Mycobacterium
VFDTAFFHDLPAAAATY

SEQ ID NO: 871741 - protein, 23 aa, Mycobacterium
VFDTAFFHDLPAPASTYAIDREL

SEQ ID NO: 871742 - protein, 31 aa, Mycobacterium
VFDVCTVTLRRGQILLFYTDGLIEARLDDLR

SEQ ID NO: 871743 - protein, 20 aa, Mycobacterium
VFDVIYIDNFVDAMVLVLAT

SEQ ID NO: 871744 - protein, 34 aa, Mycobacterium
VFDVVKQALASSYIWFFLCPVVPELAIRSRATGK

SEQ ID NO: 871745 - protein, 25 aa, Mycobacterium
VFEADFFELWSKFAATRTPTIAAVA

SEQ ID NO: 871746 - protein, 18 aa, Mycobacterium
VFEALDELGAIVEEARGV

SEQ ID NO: 871747 - protein, 17 aa, Mycobacterium
VFEDALAAIVHPAVVAT

SEQ ID NO: 871748 - protein, 24 aa, Mycobacterium
VFEDPFTFNILRDPNPHVGFGGTG

SEQ ID NO: 871749 - protein, 24 aa, Mycobacterium
VFEDPYTFNILRNPNPHVGFGGTG

SEQ ID NO: 871750 - protein, 19 aa, Mycobacterium
VFEGRQRFPLSARVGDRYP

SEQ ID NO: 871751 - protein, 18 aa, Mycobacterium
VFEKAILDGQLKPGDRFE

SEQ ID NO: 871752 - protein, 17 aa, Mycobacterium
VFEPGAMFHYSDIGFII

SEQ ID NO: 871753 - protein, 28 aa, Mycobacterium
VFEQAEDVWFPLFRPVSGAEPGRLPVDE

SEQ ID NO: 871754 - protein, 28 aa, Mycobacterium
VFEQIEDVWLPLFRPATAEASAALPGDD

SEQ ID NO: 871755 - protein, 25 aa, Mycobacterium
VFERELSWEALVNGGVTALPVPERL

SEQ ID NO: 871756 - protein, 24 aa, Mycobacterium
VFETKPIAFALRDVIPGTDLTSVA

SEQ ID NO: 871757 - protein, 18 aa, Mycobacterium
VFEVAALLMQRGQQAAGL

SEQ ID NO: 871758 - protein, 26 aa, Mycobacterium
VFEVNEAFAPVPLAWQAETGADPAKL

SEQ ID NO: 871759 - protein, 19 aa, Mycobacterium
VFFCTQLPTDLPKDVLSQL

SEQ ID NO: 871760 - protein, 20 aa, Mycobacterium
VFFCTQLPTDLPNTVLSQLG

SEQ ID NO: 871761 - protein, 17 aa, Mycobacterium
VFFESQGMPMPFSASHS

SEQ ID NO: 871762 - protein, 17 aa, Mycobacterium
VFFPGLRQEWRGTRPFV

SEQ ID NO: 871763 - protein, 17 aa, Mycobacterium
VFFSAGPPKPSRALLGA

SEQ ID NO: 871764 - protein, 17 aa, Mycobacterium
VFFVPGSPRHWGVEDDI

SEQ ID NO: 871765 - protein, 19 aa, Mycobacterium
VFFVRNLGFCQPTTTRRID

SEQ ID NO: 871766 - protein, 24 aa, Mycobacterium
VFGAGPIGCMHIRIARGVHNCGPI

SEQ ID NO: 871767 - protein, 28 aa, Mycobacterium
VFGAGPIGIGLWFALRGKGLDDVFVVEP

SEQ ID NO: 871768 - protein, 29 aa, Mycobacterium
VFGAGPIGIGLWFALRGKGLESVYVAEPS

SEQ ID NO: 871769 - protein, 34 aa, Mycobacterium
VFGAGPVGLFAAKSAWLMGAGRVIVIDHLEYRLE

SEQ ID NO: 871770 - protein, 25 aa, Mycobacterium
VFGDGPIDLLVLPGPFIPIDCVDSE

SEQ ID NO: 871771 - protein, 32 aa, Mycobacterium
VFGDLIDQPRFVQPYLWALDSLHRVGARATLQ

SEQ ID NO: 871772 - protein, 22 aa, Mycobacterium
VFGHAVKIFYKDAFEKHQKLFD

SEQ ID NO: 871773 - protein, 17 aa, Mycobacterium
VFGHFRHLLRTAAVIST

SEQ ID NO: 871774 - protein, 26 aa, Mycobacterium
VFGHSHIPWDTIAASGLRLLNPGSPT

SEQ ID NO: 871775 - protein, 18 aa, Mycobacterium
VFGITDWTRNGALAQYVA

SEQ ID NO: 871776 - protein, 21 aa, Mycobacterium
VFGLARGGVPVAWEIAAALGA

SEQ ID NO: 871777 - protein, 18 aa, Mycobacterium
VFGLHRMTRAVLPHMRAR

SEQ ID NO: 871778 - protein, 31 aa, Mycobacterium
VFGLLDIDDEFFIILRPAPSGTRLLLSDATA

SEQ ID NO: 871779 - protein, 24 aa, Mycobacterium
VFGLPELALGLIPGAGGTVSVTRR

SEQ ID NO: 871780 - protein, 18 aa, Mycobacterium
VFGLRRDTWSDTEPSMPA

SEQ ID NO: 871781 - protein, 22 aa, Mycobacterium
VFGNGMLLSKHIRLIAAFDHRH

SEQ ID NO: 871782 - protein, 23 aa, Mycobacterium
VFGNGMLLSKHIRLLAAFDHRHI

SEQ ID NO: 871783 - protein, 26 aa, Mycobacterium
VFGPRIRWRAMLDLLVAEGFPIEVPR

SEQ ID NO: 871784 - protein, 17 aa, Mycobacterium
VFGPVLAVISYTDDDDA

SEQ ID NO: 871785 - protein, 25 aa, Mycobacterium
VFGSGRAFGYIAYPPRPDGQPTFNE

SEQ ID NO: 871786 - protein, 17 aa, Mycobacterium
VFGTEKIQYIGRLAEEI

SEQ ID NO: 871787 - protein, 22 aa, Mycobacterium
VFGTHWHGLLDNDDFRRAWLTR

SEQ ID NO: 871788 - protein, 17 aa, Mycobacterium
VFGVCFPGPLGLAAGFD

SEQ ID NO: 871789 - protein, 17 aa, Mycobacterium
VFHAFPASRWRRYDKLE

SEQ ID NO: 871790 - protein, 31 aa, Mycobacterium
VFHDTLVYERGGWYFTSRTLQWDSVPSRHPL

SEQ ID NO: 871791 - protein, 17 aa, Mycobacterium
VFHECSITEIIKENGRV

SEQ ID NO: 871792 - protein, 25 aa, Mycobacterium
VFHGIQLWVNLPRKDKFASPRYQAI

SEQ ID NO: 871793 - protein, 26 aa, Mycobacterium
VFHGVRAFLPKMIDAGTPAWVWNMSS

SEQ ID NO: 871794 - protein, 24 aa, Mycobacterium
VFHIDRGYPLFVENLQSLGAEVER

SEQ ID NO: 871795 - protein, 25 aa, Mycobacterium
VFHQRHLLLSGWIKMQEGQLPSASA

SEQ ID NO: 871796 - protein, 17 aa, Mycobacterium
VFHRVIRGFMIQGGDPT

SEQ ID NO: 871797 - protein, 28 aa, Mycobacterium
VFHSGEAHWFFRGLLGDSSLFVLDEDEH

SEQ ID NO: 871798 - protein, 25 aa, Mycobacterium
VFHYTRRWLQRMTVSQIDRSVAQIK

SEQ ID NO: 871799 - protein, 25 aa, Mycobacterium
VFILTAHVLALDPASWRIVVGELET

SEQ ID NO: 871800 - protein, 20 aa, Mycobacterium
VFIPVTHLCRDKCHYCTFVT

SEQ ID NO: 871801 - protein, 19 aa, Mycobacterium
VFITPFHPIGQSPTVALEY

SEQ ID NO: 871802 - protein, 18 aa, Mycobacterium
VFITPFHPVGQSPTVALE

SEQ ID NO: 871803 - protein, 18 aa, Mycobacterium
VFKEKLVRRDISMKAFDA

SEQ ID NO: 871804 - protein, 44 aa, Mycobacterium
VFKFVAYAVLDPMIYFGPFTPAISPLGLPAVTVGLAGLACISTP

SEQ ID NO: 871805 - protein, 29 aa, Mycobacterium
VFKHGIQLFGAMGFTWENDLQFALKRAKA

SEQ ID NO: 871806 - protein, 17 aa, Mycobacterium
VFKKPASLSFNEAAGFL

SEQ ID NO: 871807 - protein, 17 aa, Mycobacterium
VFKLPDNVSFEAGAGLL

SEQ ID NO: 871808 - protein, 18 aa, Mycobacterium
VFKRHFYTCFISDKVGVR

SEQ ID NO: 871809 - protein, 19 aa, Mycobacterium
VFKRLIGPGRRVWSHLSGS

SEQ ID NO: 871810 - protein, 17 aa, Mycobacterium
VFLALPHGHSAALATQL

SEQ ID NO: 871811 - protein, 18 aa, Mycobacterium
VFLPERFGFVFVGAAEMA

SEQ ID NO: 871812 - protein, 19 aa, Mycobacterium
VFLRGALGARLLSEAAFKA

SEQ ID NO: 871813 - protein, 19 aa, Mycobacterium
VFLRLGPPPDEPNAFVVEG

SEQ ID NO: 871814 - protein, 18 aa, Mycobacterium
VFLTLREAARQMVAAGRG

SEQ ID NO: 871815 - protein, 20 aa, Mycobacterium
VFLTSFLPGHRQKFGIDVDD

SEQ ID NO: 871816 - protein, 20 aa, Mycobacterium
VFLTTHNWGRAARFYQALGY

SEQ ID NO: 871817 - protein, 17 aa, Mycobacterium
VFLTTPAARAALPGLVG

SEQ ID NO: 871818 - protein, 20 aa, Mycobacterium
VFLVQHALPYLQKSQNAAVL

SEQ ID NO: 871819 - protein, 17 aa, Mycobacterium
VFMDAARREWNPSTIVE

SEQ ID NO: 871820 - protein, 24 aa, Mycobacterium
VFMGPLFILLGRPKIEGLENIPSS

SEQ ID NO: 871821 - protein, 33 aa, Mycobacterium
VFMGVLEYIQDLPALVDWLAERFPKCVVSYACA

SEQ ID NO: 871822 - protein, 19 aa, Mycobacterium
VFMVEDLYKSFFREFRWSS

SEQ ID NO: 871823 - protein, 18 aa, Mycobacterium
VFMVLRDPAADMSLNVTC

SEQ ID NO: 871824 - protein, 18 aa, Mycobacterium
VFMVLRDPAADMSLTLTC

SEQ ID NO: 871825 - protein, 18 aa, Mycobacterium
VFNHWYGPIPPIKEVRDQ

SEQ ID NO: 871826 - protein, 17 aa, Mycobacterium
VFNLLGPLTNPAKPRAG

SEQ ID NO: 871827 - protein, 19 aa, Mycobacterium
VFNLPHMLRLKAMMQPWEA

SEQ ID NO: 871828 - protein, 25 aa, Mycobacterium
VFNPEGILYGRLPNFRLSDKGQGQA

SEQ ID NO: 871829 - protein, 25 aa, Mycobacterium
VFNVTKPVIAMLHLSALPGDPGYDS

SEQ ID NO: 871830 - protein, 18 aa, Mycobacterium
VFNYPTLTFADVGAIGWL

SEQ ID NO: 871831 - protein, 25 aa, Mycobacterium
VFPEATMCRFGVPLAPIAEPLDGPW

SEQ ID NO: 871832 - protein, 24 aa, Mycobacterium
VFPEATMCRFGVPLAPIAEPVDGP

SEQ ID NO: 871833 - protein, 25 aa, Mycobacterium
VFPEATMCRFGVPLGPVAQPVNGRW

SEQ ID NO: 871834 - protein, 18 aa, Mycobacterium
VFPHTEVLPQFQGRGLAT

SEQ ID NO: 871835 - protein, 18 aa, Mycobacterium
VFPLSNWTEYDIWAYIGA

SEQ ID NO: 871836 - protein, 25 aa, Mycobacterium
VFPRAKAMLPKAIAAGVRIACGTDA

SEQ ID NO: 871837 - protein, 23 aa, Mycobacterium
VFQAPLITALGFAFAASTERGDE

SEQ ID NO: 871838 - protein, 28 aa, Mycobacterium
VFQDAAPADLFMLIFTSGTSGEPKAVKC

SEQ ID NO: 871839 - protein, 23 aa, Mycobacterium
VFQHFNLFPHRNVVDNVTLAPRK

SEQ ID NO: 871840 - protein, 20 aa, Mycobacterium
VFQMLGLCQVLRDGVIPPNR

SEQ ID NO: 871841 - protein, 18 aa, Mycobacterium
VFQPDFDTAILLTRFLVG

SEQ ID NO: 871842 - protein, 19 aa, Mycobacterium
VFQQLPPVQQLALSAFNIG

SEQ ID NO: 871843 - protein, 31 aa, Mycobacterium
VFQRTPIYCLPKPDFSIPSWAATVMRLVPGA

SEQ ID NO: 871844 - protein, 43 aa, Mycobacterium
VFQRTPVYCIPKPDFRIPAIAQWALRIPGLTAAIEWGALVGGS

SEQ ID NO: 871845 - protein, 20 aa, Mycobacterium
VFRDHFLTCFISDKVGVALR

SEQ ID NO: 871846 - protein, 36 aa, Mycobacterium
VFRDYGYRRMRAKARIKFLVKDWGVQKFREVMENEY

SEQ ID NO: 871847 - protein, 19 aa, Mycobacterium
VFREHFLACFISDPVGVKL

SEQ ID NO: 871848 - protein, 20 aa, Mycobacterium
VFREHFLTCFISDKVGVALR

SEQ ID NO: 871849 - protein, 20 aa, Mycobacterium
VFRERFLTCFIADPIGVKLR

SEQ ID NO: 871850 - protein, 18 aa, Mycobacterium
VFRGLHLDPVAQVGFCRL

SEQ ID NO: 871851 - protein, 30 aa, Mycobacterium
VFRIVNQLPRKLAMELLLTGEPITAADAYD

SEQ ID NO: 871852 - protein, 20 aa, Mycobacterium
VFRIVNQLPRKVAMEMLLTG

SEQ ID NO: 871853 - protein, 18 aa, Mycobacterium
VFRLLTSGPIRVGDEVEV

SEQ ID NO: 871854 - protein, 20 aa, Mycobacterium
VFRRHALRRISLIRVATGFG

SEQ ID NO: 871855 - protein, 26 aa, Mycobacterium
VFRSRHLLLSAWIKMQDGQLPSAAAD

SEQ ID NO: 871856 - protein, 26 aa, Mycobacterium
VFRSYVHPYLGRPNLTVLTGAVVTRV

SEQ ID NO: 871857 - protein, 28 aa, Mycobacterium
VFSDHVALPFKWAFPRVFRAFAEEDLHH

SEQ ID NO: 871858 - protein, 29 aa, Mycobacterium
VFSDHVALPFKWAFPRVYRAFAEEGLHHD

SEQ ID NO: 871859 - protein, 24 aa, Mycobacterium
VFSGHAQAYQALGAQVAAFHDQLV

SEQ ID NO: 871860 - protein, 20 aa, Mycobacterium
VFSGYRFVRHAAARGIPVGI

SEQ ID NO: 871861 - protein, 20 aa, Mycobacterium
VFSHGGVINVALHGILKTER

SEQ ID NO: 871862 - protein, 18 aa, Mycobacterium
VFSPFVCYGPLARSVRDL

SEQ ID NO: 871863 - protein, 25 aa, Mycobacterium
VFSSDFFAAWGKFAATRTPTIAAVA

SEQ ID NO: 871864 - protein, 28 aa, Mycobacterium
VFSVNVKGYLLAAEAAWRELVKTRGSII

SEQ ID NO: 871865 - protein, 19 aa, Mycobacterium
VFTDPYRFDILRDPNPHVG

SEQ ID NO: 871866 - protein, 24 aa, Mycobacterium
VFTGSLLTRPVSPEKIHAALSAAG

SEQ ID NO: 871867 - protein, 19 aa, Mycobacterium
VFTLAMLGIPLKKWNMYSE

SEQ ID NO: 871868 - protein, 20 aa, Mycobacterium
VFTLLGRCPELYVTILGALR

SEQ ID NO: 871869 - protein, 21 aa, Mycobacterium
VFTRNFWFCAVEDKSSFVQRD

SEQ ID NO: 871870 - protein, 20 aa, Mycobacterium
VFTRNFWFCAVEDKSSFVQY

SEQ ID NO: 871871 - protein, 27 aa, Mycobacterium
VFTSARWHVSVWPDVPILLVCSAPRVR

SEQ ID NO: 871872 - protein, 24 aa, Mycobacterium
VFTSLTKQALPIIRYRTRDLTKLL

SEQ ID NO: 871873 - protein, 18 aa, Mycobacterium
VFTTAYMAFIHLAEVQPG

SEQ ID NO: 871874 - protein, 17 aa, Mycobacterium
VFTTAYYAFVHLANVQP

SEQ ID NO: 871875 - protein, 33 aa, Mycobacterium
VFTTDRPIIFAYHGYPWLIHRLTYRHANHAQLH

SEQ ID NO: 871876 - protein, 18 aa, Mycobacterium
VFTTVHDLGLFAQALLDR

SEQ ID NO: 871877 - protein, 18 aa, Mycobacterium
VFTTVHDMGRFAQALLDR

SEQ ID NO: 871878 - protein, 17 aa, Mycobacterium
VFTVDYFWPVTYQFKSD

SEQ ID NO: 871879 - protein, 25 aa, Mycobacterium
VFTVQKILPLLNDGASIILTGSTAP

SEQ ID NO: 871880 - protein, 18 aa, Mycobacterium
VFVALSWTKHPAPQTYEE

SEQ ID NO: 871881 - protein, 20 aa, Mycobacterium
VFVGGFTLDYQLLQNQGRTS

SEQ ID NO: 871882 - protein, 19 aa, Mycobacterium
VFVGYWMKPATTAEAFRGG

SEQ ID NO: 871883 - protein, 19 aa, Mycobacterium
VFVHGEVISSRRGELSVLA

SEQ ID NO: 871884 - protein, 19 aa, Mycobacterium
VFVHGVLTNSLLWRDVVTA

SEQ ID NO: 871885 - protein, 17 aa, Mycobacterium
VFVHLCSAAQWTAITGE

SEQ ID NO: 871886 - protein, 18 aa, Mycobacterium
VFVKLGIGSRRQLRTIEW

SEQ ID NO: 871887 - protein, 17 aa, Mycobacterium
VFVLAATSNPEGASVQR

SEQ ID NO: 871888 - protein, 17 aa, Mycobacterium
VFVLAATSNPEGATIQR

SEQ ID NO: 871889 - protein, 17 aa, Mycobacterium
VFVLAATSNPEGATVQR

SEQ ID NO: 871890 - protein, 18 aa, Mycobacterium
VFVLIHGGGWVIGDLDTH

SEQ ID NO: 871891 - protein, 17 aa, Mycobacterium
VFVNEMMVLYRAGGDPS

SEQ ID NO: 871892 - protein, 21 aa, Mycobacterium
VFVNLFRGRIGAPMRPDAIGE

SEQ ID NO: 871893 - protein, 19 aa, Mycobacterium
VFVPASRTFELFTRQPYRG

SEQ ID NO: 871894 - protein, 21 aa, Mycobacterium
VFVPQGRTFGLFAREPRRGSS

SEQ ID NO: 871895 - protein, 25 aa, Mycobacterium
VFVRLTHSLILAPSPRRELATREDA

SEQ ID NO: 871896 - protein, 20 aa, Mycobacterium
VFVSYLRRKLERDGLPRVIH

SEQ ID NO: 871897 - protein, 17 aa, Mycobacterium
VFVTHDFGEAVKLGDRI

SEQ ID NO: 871898 - protein, 17 aa, Mycobacterium
VFVWCMPGDADLAPSQL

SEQ ID NO: 871899 - protein, 18 aa, Mycobacterium
VFWRSGYAHTSTEDLVTE

SEQ ID NO: 871900 - protein, 17 aa, Mycobacterium
VFWVWPDSAGDVDHDAE

SEQ ID NO: 871901 - protein, 22 aa, Mycobacterium
VFYATALEYLLDRLKTRRIVLT

SEQ ID NO: 871902 - protein, 19 aa, Mycobacterium
VFYNFAPERVAKALPAAWE

SEQ ID NO: 871903 - protein, 19 aa, Mycobacterium
VFYPVIPPGSWVATTEFKL

SEQ ID NO: 871904 - protein, 31 aa, Mycobacterium
VFYSTGDAEELLWLQAPPPATGSGTSGSTSG

SEQ ID NO: 871905 - protein, 26 aa, Mycobacterium
VGAADPFQLFRILFEVIRGGGLDPSS

SEQ ID NO: 871906 - protein, 30 aa, Mycobacterium
VGAAIDAALTVRLLLAPDTDVRFGIGWGAV

SEQ ID NO: 871907 - protein, 25 aa, Mycobacterium
VGAAPRLRAAAAWFTLLKQERRRRR

SEQ ID NO: 871908 - protein, 17 aa, Mycobacterium
VGAAWDRRLARIKLIAE

SEQ ID NO: 871909 - protein, 19 aa, Mycobacterium
VGAAYRRYAIERPHMYRLM

SEQ ID NO: 871910 - protein, 17 aa, Mycobacterium
VGACRPFDRDRSGFVFG

SEQ ID NO: 871911 - protein, 22 aa, Mycobacterium
VGADAMPWLLAGAKTLSYAVNM

SEQ ID NO: 871912 - protein, 31 aa, Mycobacterium
VGADEMIRVRILPTWLRIDARFGSVYRRRGD

SEQ ID NO: 871913 - protein, 49 aa, Mycobacterium
VGADPVAQLPLIAGPRPPRVPLSFAQSRLWFLEQLQGPSAVYNIPVVLH

SEQ ID NO: 871914 - protein, 31 aa, Mycobacterium
VGADRGYRGLQFFHATGLPLHDIRHVGEPEI

SEQ ID NO: 871915 - protein, 31 aa, Mycobacterium
VGADRGYRGLQFFHATGLPLHEIRHVAEPLI

SEQ ID NO: 871916 - protein, 17 aa, Mycobacterium
VGADYYLRPVPNTAAHT

SEQ ID NO: 871917 - protein, 21 aa, Mycobacterium
VGAFLAWGDPSLYDSTLRILE

SEQ ID NO: 871918 - protein, 31 aa, Mycobacterium
VGAGDAFMTGLLDALWSLDLLGADRRRNLAH

SEQ ID NO: 871919 - protein, 27 aa, Mycobacterium
VGAIANWRLFSILLRSLNIPLESGTDG

SEQ ID NO: 871920 - protein, 27 aa, Mycobacterium
VGAIANWRLFSILLRSLNIPLESGTDS

SEQ ID NO: 871921 - protein, 28 aa, Mycobacterium
VGAITPWNFPHQINLAKIGPALAAGNSV

SEQ ID NO: 871922 - protein, 27 aa, Mycobacterium
VGAITPWNFPHQINLAKIGPALAAGNT

SEQ ID NO: 871923 - protein, 28 aa, Mycobacterium
VGAITPWNFPHQINLAKLGPALAAGNSV

SEQ ID NO: 871924 - protein, 28 aa, Mycobacterium
VGAITPWNFPHQINLAKLGPALAAGNTV

SEQ ID NO: 871925 - protein, 26 aa, Mycobacterium
VGAITPWNFPHQINLAKVGPALAAGN

SEQ ID NO: 871926 - protein, 28 aa, Mycobacterium
VGAITPWNVPFYLNIAETVPALMAGNTV

SEQ ID NO: 871927 - protein, 31 aa, Mycobacterium
VGAIVAWNVPLFLAINKLGPALLAGCTVVLK

SEQ ID NO: 871928 - protein, 39 aa, Mycobacterium
VGAIVPWNVPQFLIMPKLIPALIAGCAVIIKPAPETPLD

SEQ ID NO: 871929 - protein, 36 aa, Mycobacterium; identical to SEQ ID NO: 118226

SEQ ID NO: 871930 - protein, 24 aa, Mycobacterium
VGAKRAELAVLDQLLVALSERFGD

SEQ ID NO: 871931 - protein, 18 aa, Mycobacterium
VGALAAALGIGIAIASLP

SEQ ID NO: 871932 - protein, 19 aa, Mycobacterium
VGALLAFRDRMGWDLPWVS

SEQ ID NO: 871933 - protein, 20 aa, Mycobacterium
VGALLSVFARLSGGKAVVEV

SEQ ID NO: 871934 - protein, 18 aa, Mycobacterium
VGALRLRAPRPIEPWEGV

SEQ ID NO: 871935 - protein, 17 aa, Mycobacterium
VGANEILVAAALGNNNS

SEQ ID NO: 871936 - protein, 24 aa, Mycobacterium
VGAPPLAFRIPDGTTFTWRATSQG

SEQ ID NO: 871937 - protein, 29 aa, Mycobacterium
VGAPRIRDLELVQWVAGLVLVLNGKGQGD

SEQ ID NO: 871938 - protein, 18 aa, Mycobacterium
VGAPTIYRRWPTKEALVE

SEQ ID NO: 871939 - protein, 26 aa, Mycobacterium
VGAPVTGDWLLLVELAADHDQTERLA

SEQ ID NO: 871940 - protein, 24 aa, Mycobacterium
VGAQISYPLKLFRLATPEEARKKT

SEQ ID NO: 871941 - protein, 22 aa, Mycobacterium
VGAQLGVVARTVEAMLALGARA

SEQ ID NO: 871942 - protein, 23 aa, Mycobacterium
VGARARYMWVSTFHSTCVRILRN

SEQ ID NO: 871943 - protein, 23 aa, Mycobacterium
VGARELWRDWSALAAQGGVDRDQ

SEQ ID NO: 871944 - protein, 34 aa, Mycobacterium
VGARRVILIHWDDFFRPLSKPLRALPYAGDDLDC

SEQ ID NO: 871945 - protein, 17 aa, Mycobacterium
VGASWWLREQGTPVNTL

SEQ ID NO: 871946 - protein, 32 aa, Mycobacterium
VGATKGLIYYHFRSKFDIFLAVYEDGMRRVRE

SEQ ID NO: 871947 - protein, 30 aa, Mycobacterium
VGAVTAWNVPFFLAANKLGPALLAGCTVVL

SEQ ID NO: 871948 - protein, 17 aa, Mycobacterium
VGAVTIVNLIRALLRNP

SEQ ID NO: 871949 - protein, 17 aa, Mycobacterium
VGAVTIVNLIRTLLRNP

SEQ ID NO: 871950 - protein, 25 aa, Mycobacterium
VGAVVATPIMRWLHDFDGPVDEYNQ

SEQ ID NO: 871951 - protein, 30 aa, Mycobacterium
VGAVVAWNVPFFLAANKLGPALLAGCTIVL

SEQ ID NO: 871952 - protein, 28 aa, Mycobacterium
VGAVVDWLQRFIDELLVCLHGSGAANLS

SEQ ID NO: 871953 - protein, 24 aa, Mycobacterium
VGAYHLMRSYGGRGVLMGGVPGVA

SEQ ID NO: 871954 - protein, 31 aa, Mycobacterium
VGCPLINIHHSFLPAFIGASPYRRAKERGVK

SEQ ID NO: 871955 - protein, 17 aa, Mycobacterium
VGCRAIGIAGGEQKCRW

SEQ ID NO: 871956 - protein, 18 aa, Mycobacterium
VGCRDRLPHLQRLAVYTG

SEQ ID NO: 871957 - protein, 23 aa, Mycobacterium
VGCRLMFTCTPQHTFLGLEPSGE

SEQ ID NO: 871958 - protein, 18 aa, Mycobacterium
VGCRLRPLTFDDVDFTLA

SEQ ID NO: 871959 - protein, 26 aa, Mycobacterium
VGDATARLGLPPPAALTGDWFGALAV

SEQ ID NO: 871960 - protein, 25 aa, Mycobacterium
VGDATLGERLILSSGFVAVTVVVRR

SEQ ID NO: 871961 - protein, 24 aa, Mycobacterium
VGDATLGERLILSSGFVSITVVVH

SEQ ID NO: 871962 - protein, 25 aa, Mycobacterium
VGDAYHHVLMRILIAARANGIAAID

SEQ ID NO: 871963 - protein, 27 aa, Mycobacterium
VGDDASEWVLRRPPLHGLTPSAHDMAR

SEQ ID NO: 871964 - protein, 22 aa, Mycobacterium
VGDDLLSADRIFLNVGGRAVAP

SEQ ID NO: 871965 - protein, 26 aa, Mycobacterium
VGDDPLYMLTGIIPATAKVLDRAGLS

SEQ ID NO: 871966 - protein, 33 aa, Mycobacterium
VGDEQLIAAAAYLWARQWSAAGGDLWRVPSGWR

SEQ ID NO: 871967 - protein, 20 aa, Mycobacterium
VGDFAYPLPVAVICRLLGVP

SEQ ID NO: 871968 - protein, 17 aa, Mycobacterium
VGDFRDWLLETITKPHG

SEQ ID NO: 871969 - protein, 25 aa, Mycobacterium
VGDGHWRIRAFTPLYQIWLDGDDAG

SEQ ID NO: 871970 - protein, 18 aa, Mycobacterium
VGDGPAVVVLRPEQLRVG

SEQ ID NO: 871971 - protein, 23 aa, Mycobacterium
VGDGRAFSFYVERQELVVEIYRP

SEQ ID NO: 871972 - protein, 39 aa, Mycobacterium
VGDGVRWAMRHLPFYGRWYRFLLLWPGADKGLDAARTDP

SEQ ID NO: 871973 - protein, 20 aa, Mycobacterium
VGDHIRRFILGEDRVVLDMS

SEQ ID NO: 871974 - protein, 24 aa, Mycobacterium
VGDHVAYLLEPIAVWAPDAPEELL

SEQ ID NO: 871975 - protein, 17 aa, Mycobacterium
VGDICVPLARRGGTVLI

SEQ ID NO: 871976 - protein, 18 aa, Mycobacterium
VGDLRFRAPQPLQPWSGV

SEQ ID NO: 871977 - protein, 21 aa, Mycobacterium
VGDMLGGWRGASGSAFASAWE

SEQ ID NO: 871978 - protein, 23 aa, Mycobacterium
VGDMYAAFLQGFRDFFVESAADP

SEQ ID NO: 871979 - protein, 26 aa, Mycobacterium
VGDNIGIVPRLLKWDKNRVAARIDEL

SEQ ID NO: 871980 - protein, 17 aa, Mycobacterium
VGDPFRGGTLVGPLIHT

SEQ ID NO: 871981 - protein, 23 aa, Mycobacterium
VGDQEFIKFRVASNSRRRTADGG

SEQ ID NO: 871982 - protein, 22 aa, Mycobacterium
VGDQFCWLTVDLPPMVEIRNKL

SEQ ID NO: 871983 - protein, 18 aa, Mycobacterium
VGDQLLKCGWRPGDSVIL

SEQ ID NO: 871984 - protein, 27 aa, Mycobacterium
VGDRHWLVPVTAFWQAHRDAAGTYSRL

SEQ ID NO: 871985 - protein, 25 aa, Mycobacterium
VGDRKTYLFAFLDDHSRLVVGHRFG

SEQ ID NO: 871986 - protein, 23 aa, Mycobacterium
VGDRLQLLPVDPAYRAQFADGSA

SEQ ID NO: 871987 - protein, 25 aa, Mycobacterium
VGDRPSGPIPLTLAASRPLVRCPQC

SEQ ID NO: 871988 - protein, 22 aa, Mycobacterium
VGDRRLTVALLFAALGAKFQTG

SEQ ID NO: 871989 - protein, 24 aa, Mycobacterium
VGDSPLLMLSLAFAAEAVTDRAGA

SEQ ID NO: 871990 - protein, 27 aa, Mycobacterium
VGDVADFLIVLAYIEPEHAPTMFLIDV

SEQ ID NO: 871991 - protein, 20 aa, Mycobacterium
VGDVRGEGFFYGIELVKDKD

SEQ ID NO: 871992 - protein, 20 aa, Mycobacterium
VGDVRGEGFFYGIELVKDKT

SEQ ID NO: 871993 - protein, 20 aa, Mycobacterium
VGDVRGEGFFYGVELVKDKA

SEQ ID NO: 871994 - protein, 43 aa, Mycobacterium
VGDVRGLRGWIRLFANLPAKRLRILALLDPPVESLMLTPPGAI

SEQ ID NO: 871995 - protein, 17 aa, Mycobacterium
VGDVYACPFAIHDKFLA

SEQ ID NO: 871996 - protein, 21 aa, Mycobacterium
VGDYHVPKMIGWTLVGHPVDD

SEQ ID NO: 871997 - protein, 31 aa, Mycobacterium
VGDYVTMVLPNSIEWIQAAVACWKLGAVPQP

SEQ ID NO: 871998 - protein, 25 aa, Mycobacterium
VGDYVTMVLPNSVEWIQAAVACWKL

SEQ ID NO: 871999 - protein, 19 aa, Mycobacterium
VGEAAQFLRWTAAQAPEAA

SEQ ID NO: 872000 - protein, 21 aa, Mycobacterium
VGEAREEAIRIAAAAKREYEA

SEQ ID NO: 872001 - protein, 31 aa, Mycobacterium
VGEEWLYQSWAAAYLPLMRVLTTLADEDRRG

SEQ ID NO: 872002 - protein, 22 aa, Mycobacterium
VGEFAVHLALAAAGKCFYTTPL

SEQ ID NO: 872003 - protein, 21 aa, Mycobacterium
VGEFAVHLALAAGGKCFYTTP

SEQ ID NO: 872004 - protein, 19 aa, Mycobacterium
VGEFAVHLALASGGKCFYT

SEQ ID NO: 872005 - protein, 21 aa, Mycobacterium
VGEFHRLAIDLLGFRADMETA

SEQ ID NO: 872006 - protein, 20 aa, Mycobacterium
VGEFQQAMLASGTAVAEHFT

SEQ ID NO: 872007 - protein, 25 aa, Mycobacterium
VGEFRGKPQLTHPDYLVLETALGES

SEQ ID NO: 872008 - protein, 30 aa, Mycobacterium
VGEFSPYVDMTLWPKFDYASAANAGIDDVT

SEQ ID NO: 872009 - protein, 22 aa, Mycobacterium
VGEFYTRWFAADLTARDLFPPD

SEQ ID NO: 872010 - protein, 25 aa, Mycobacterium
VGEITLGERLILSSGFIAVTVVVHR

SEQ ID NO: 872011 - protein, 25 aa, Mycobacterium
VGEITLGERLILSSGFVAVTVVVKR

SEQ ID NO: 872012 - protein, 26 aa, Mycobacterium
VGEITVSTVWPIAKKVVGAVRKVISI

SEQ ID NO: 872013 - protein, 25 aa, Mycobacterium
VGEKAPLEHLLIERAYRLGVTAPEM

SEQ ID NO: 872014 - protein, 23 aa, Mycobacterium
VGELDRVWTSDITYLRTGEGWLY

SEQ ID NO: 872015 - protein, 24 aa, Mycobacterium
VGELKLFQRTPPWVLPRTNVEFGA

SEQ ID NO: 872016 - protein, 26 aa, Mycobacterium
VGENFSRRFVPASFLLSAATLVVTRD

SEQ ID NO: 872017 - protein, 25 aa, Mycobacterium
VGEPEFLPLVRRLGRFLPTDVRVLG

SEQ ID NO: 872018 - protein, 25 aa, Mycobacterium
VGEPGLIVAVWDRRLHAGAQAAGCR

SEQ ID NO: 872019 - protein, 28 aa, Mycobacterium
VGEQALRVLDALRVDIAFIGTNAISLRH

SEQ ID NO: 872020 - protein, 30 aa, Mycobacterium
VGEQLELYRRMWVLRLLDMALEESRIDGLL

SEQ ID NO: 872021 - protein, 27 aa, Mycobacterium
VGEQTLRVLDTLRVDIAFIGTNAISAR

SEQ ID NO: 872022 - protein, 19 aa, Mycobacterium
VGERAAKLVGVELPKRAEA

SEQ ID NO: 872023 - protein, 23 aa, Mycobacterium
VGERHPHFVTQLRTPIIAAINGA

SEQ ID NO: 872024 - protein, 25 aa, Mycobacterium
VGERSWRIPATAFWQSHRDAAKVYS

SEQ ID NO: 872025 - protein, 25 aa, Mycobacterium
VGERTLYRRFPTKADLVRAALDQSI

SEQ ID NO: 872026 - protein, 17 aa, Mycobacterium
VGERWTLLIVRELASGP

SEQ ID NO: 872027 - protein, 28 aa, Mycobacterium
VGEVVATPIMLWLQSLDGPLKEFNQTAL

SEQ ID NO: 872028 - protein, 28 aa, Mycobacterium
VGFAARSWRLVNVLSLTGASLVETARRA

SEQ ID NO: 872029 - protein, 30 aa, Mycobacterium
VGFCFGGGLVWQLLAAGEPRLAAAAPFYGP

SEQ ID NO: 872030 - protein, 25 aa, Mycobacterium
VGFCGFAPGFAYLVGGDPRLAIPRR

SEQ ID NO: 872031 - protein, 17 aa, Mycobacterium
VGFEPFLRRARPFSPFL

SEQ ID NO: 872032 - protein, 28 aa, Mycobacterium
VGFFKNVMQLTHPAFLILDSPDGKNRGT

SEQ ID NO: 872033 - protein, 18 aa, Mycobacterium
VGFGGWYSPIALHVESDS

SEQ ID NO: 872034 - protein, 25 aa, Mycobacterium
VGFGGYVALPAYLAARGGLTGRRKV

SEQ ID NO: 872035 - protein, 24 aa, Mycobacterium
VGFGGYVALPAYLAARGIPGMRRR

SEQ ID NO: 872036 - protein, 29 aa, Mycobacterium
VGFIDPRTRWLLRELIHALLVKKDHRAAG

SEQ ID NO: 872037 - protein, 23 aa, Mycobacterium
VGFMALNYLYHLMNMIAEGVFER

SEQ ID NO: 872038 - protein, 20 aa, Mycobacterium
VGFRPFVHQLASELGLSGFV

SEQ ID NO: 872039 - protein, 19 aa, Mycobacterium
VGFRPLRPAMTATFTRFEG

SEQ ID NO: 872040 - protein, 27 aa, Mycobacterium
VGFSAPYPSWPILPSAFDDATQYTPRQ

SEQ ID NO: 872041 - protein, 24 aa, Mycobacterium
VGFSLALGEHLAYGPAAVCARLAE

SEQ ID NO: 872042 - protein, 25 aa, Mycobacterium
VGFSTWAHHMSLRYLNASSTGGFDE

SEQ ID NO: 872043 - protein, 29 aa, Mycobacterium
VGFTVVAPHPYFPRLRLELDKGLGWKAEV

SEQ ID NO: 872044 - protein, 22 aa, Mycobacterium
VGFVGFQIPRLERRAVGALINV

SEQ ID NO: 872045 - protein, 17 aa, Mycobacterium
VGGAAGLLGWGGGGGAG

SEQ ID NO: 872046 - protein, 27 aa, Mycobacterium
VGGADSLLVFPFDVAIDGGFPGTATSF

SEQ ID NO: 872047 - protein, 24 aa, Mycobacterium
VGGADTVLVHPFDVAIPGGFPGTP

SEQ ID NO: 872048 - protein, 29 aa, Mycobacterium
VGGADTVLVLPFDVAIPGGFPGTARSFAR

SEQ ID NO: 872049 - protein, 23 aa, Mycobacterium
VGGAFPIAVLNLKGGVGKTAVVE

SEQ ID NO: 872050 - protein, 28 aa, Mycobacterium
VGGAGGKGGLLFGAGGEGGAGGTGGAGG

SEQ ID NO: 872051 - protein, 25 aa, Mycobacterium
VGGAGGLFGGGGLGGAGGAGVSASG

SEQ ID NO: 872052 - protein, 24 aa, Mycobacterium
VGGAGVKLLYNIVPESATYLADRD

SEQ ID NO: 872053 - protein, 25 aa, Mycobacterium
VGGAPNPYIWPENLPRVNARGGPGG

SEQ ID NO: 872054 - protein, 26 aa, Mycobacterium
VGGAPNPYIWPENLPRVNARGGPGGA

SEQ ID NO: 872055 - protein, 24 aa, Mycobacterium
VGGAPNPYVWPENLPRVNARGGPG

SEQ ID NO: 872056 - protein, 17 aa, Mycobacterium
VGGCSLHLAPVAFAGGR

SEQ ID NO: 872057 - protein, 30 aa, Mycobacterium
VGGDADVVERCRPVFATYADPIVHLGELGS

SEQ ID NO: 872058 - protein, 18 aa, Mycobacterium
VGGDWYSVTPLAHPGRIA

SEQ ID NO: 872059 - protein, 21 aa, Mycobacterium
VGGEGSVMLLLKRLSDALRDG

SEQ ID NO: 872060 - protein, 32 aa, Mycobacterium
VGGELLVHCCASDPPWELLREANIRAIAIDVA

SEQ ID NO: 872061 - protein, 26 aa, Mycobacterium
VGGFAYAGGWLRPGALTPPRFADRFE

SEQ ID NO: 872062 - protein, 23 aa, Mycobacterium
VGGFFPNVVVLQGDLPALQTQEL

SEQ ID NO: 872063 - protein, 30 aa, Mycobacterium
VGGFGLAGIPWFLIEALLEQGADDLTIVSN

SEQ ID NO: 872064 - protein, 31 aa, Mycobacterium
VGGFGLAGIPWFLIEALLEQGADDLTIVSNN

SEQ ID NO: 872065 - protein, 27 aa, Mycobacterium
VGGGLPFFPNLPSWISLRLLENRTFPG

SEQ ID NO: 872066 - protein, 18 aa, Mycobacterium
VGGGPYLQALRKLAKDRQ

SEQ ID NO: 872067 - protein, 23 aa, Mycobacterium
VGGGWFGYLSYPDAGADGVGPRI

SEQ ID NO: 872068 - protein, 24 aa, Mycobacterium
VGGHLTALRRTRAGRFGLDQAYSL

SEQ ID NO: 872069 - protein, 24 aa, Mycobacterium
VGGHLTVLRRTRVGRYGLDEAHTL

SEQ ID NO: 872070 - protein, 17 aa, Mycobacterium
VGGIFSPGGTGGTGGAG

SEQ ID NO: 872071 - protein, 17 aa, Mycobacterium
VGGIPRQAQPDLALVEP

SEQ ID NO: 872072 - protein, 23 aa, Mycobacterium
VGGLFEILRRWIDGQLNLSTEML

SEQ ID NO: 872073 - protein, 22 aa, Mycobacterium
VGGLLDYLGIPPSARPVVVAAF

SEQ ID NO: 872074 - protein, 21 aa, Mycobacterium
VGGLLRLRQVGQTYRLLLLPP

SEQ ID NO: 872075 - protein, 18 aa, Mycobacterium
VGGLSVPRMPASAAAATI

SEQ ID NO: 872076 - protein, 27 aa, Mycobacterium
VGGMGGLGFVVARWLAEQGAGLVVLNG

SEQ ID NO: 872077 - protein, 17 aa, Mycobacterium
VGGPEWLRRAVMAVIWT

SEQ ID NO: 872078 - protein, 26 aa, Mycobacterium
VGGPIHKVIADWLRISYADACRRVRD

SEQ ID NO: 872079 - protein, 24 aa, Mycobacterium
VGGPILNAVLGRLAPRARVVLCGV

SEQ ID NO: 872080 - protein, 24 aa, Mycobacterium
VGGPLGLLRMGLPSGISMSAYSGG

SEQ ID NO: 872081 - protein, 27 aa, Mycobacterium
VGGQFEGFPLLLLTSTGARSGAQRVNP

SEQ ID NO: 872082 - protein, 28 aa, Mycobacterium
VGGQFEGFPLMLLTSIGAKSGAERVNPL

SEQ ID NO: 872083 - protein, 23 aa, Mycobacterium
VGGRAKYMWVSTFHSTCVRILRN

SEQ ID NO: 872084 - protein, 18 aa, Mycobacterium
VGGRALIARFLKAIGEYP

SEQ ID NO: 872085 - protein, 24 aa, Mycobacterium
VGGRRLEVSLPGDISLGGGGGAAN

SEQ ID NO: 872086 - protein, 23 aa, Mycobacterium
VGGRRLEVSLPGDLAIGGGGGAA

SEQ ID NO: 872087 - protein, 25 aa, Mycobacterium
VGGRRLEVSLPGDLALSGGGSGGGE

SEQ ID NO: 872088 - protein, 17 aa, Mycobacterium
VGGRWISGGGQAVISVC

SEQ ID NO: 872089 - protein, 18 aa, Mycobacterium
VGGSLRFERRRWDRGEAR

SEQ ID NO: 872090 - protein, 23 aa, Mycobacterium
VGGSRLLPGVPLDRILAFGAEDD

SEQ ID NO: 872091 - protein, 27 aa, Mycobacterium
VGGSVGLWFLINTPGVVMRPLMRLFDR

SEQ ID NO: 872092 - protein, 25 aa, Mycobacterium
VGGTLAISVPRWLPERVCWLLSDEY

SEQ ID NO: 872093 - protein, 27 aa, Mycobacterium
VGGTLAVSVPRWLPERLCWLLSDEYHA

SEQ ID NO: 872094 - protein, 25 aa, Mycobacterium
VGGTLAVSVPRWLPERVCWLLSDEY

SEQ ID NO: 872095 - protein, 17 aa, Mycobacterium
VGGTPPFITQARGCWLT

SEQ ID NO: 872096 - protein, 26 aa, Mycobacterium
VGGTSGLLLGLDGFNAPASASPIHAL

SEQ ID NO: 872097 - protein, 21 aa, Mycobacterium
VGGTWHWNTYPGIAVDIPSYS

SEQ ID NO: 872098 - protein, 17 aa, Mycobacterium
VGGTWRANRYPGCRVDI

SEQ ID NO: 872099 - protein, 17 aa, Mycobacterium
VGGTWRRNTYPGAACDI

SEQ ID NO: 872100 - protein, 22 aa, Mycobacterium
VGGTYLLSRAPGALGLHAALTG

SEQ ID NO: 872101 - protein, 23 aa, Mycobacterium
VGGVGGRVVGLFGSGGGGGAGGD

SEQ ID NO: 872102 - protein, 19 aa, Mycobacterium
VGHASRITAPKGWELVRHA

SEQ ID NO: 872103 - protein, 17 aa, Mycobacterium
VGHDWGAVVVWNAPLLH

SEQ ID NO: 872104 - protein, 24 aa, Mycobacterium
VGHGMHVFATLLAAAGRQTRSGAV

SEQ ID NO: 872105 - protein, 25 aa, Mycobacterium
VGHGRCRWLLLTGELLPASELADAG

SEQ ID NO: 872106 - protein, 25 aa, Mycobacterium
VGHGTMRWITVGPPNQPGTSIVLYP

SEQ ID NO: 872107 - protein, 26 aa, Mycobacterium
VGHHCAMPLHRRFGVAATARASFAVY

SEQ ID NO: 872108 - protein, 23 aa, Mycobacterium
VGHLGARLATLGPAATLARGYAV

SEQ ID NO: 872109 - protein, 21 aa, Mycobacterium
VGHPFIDIWEAVKPARLGMKA

SEQ ID NO: 872110 - protein, 17 aa, Mycobacterium
VGHVLHALAWLVPGEIA

SEQ ID NO: 872111 - protein, 26 aa, Mycobacterium
VGIADLPWPAAGEWLAAVRASPLVGS

SEQ ID NO: 872112 - protein, 17 aa, Mycobacterium
VGIAPPLEHLPAATPRR

SEQ ID NO: 872113 - protein, 17 aa, Mycobacterium
VGIATLYRHFPTRESLV

SEQ ID NO: 872114 - protein, 18 aa, Mycobacterium
VGIDITGEFVKPGPTKSS

SEQ ID NO: 872115 - protein, 24 aa, Mycobacterium
VGIDKIPLPYYRTKLRVEQLLADS

SEQ ID NO: 872116 - protein, 19 aa, Mycobacterium
VGIDLYGLGLDYRGLDLDY

SEQ ID NO: 872117 - protein, 19 aa, Mycobacterium
VGIEYPIMQDGMGPSPTTL

SEQ ID NO: 872118 - protein, 20 aa, Mycobacterium
VGIGFCFAPQFHPSYRHASV

SEQ ID NO: 872119 - protein, 23 aa, Mycobacterium
VGIGIVRTMMRHAPKAEKSTPSN

SEQ ID NO: 872120 - protein, 19 aa, Mycobacterium
VGIKIWVDGSPWIGNIDLS

SEQ ID NO: 872121 - protein, 24 aa, Mycobacterium
VGIPTPGLLRQQQWMLGPSAGSVD

SEQ ID NO: 872122 - protein, 25 aa, Mycobacterium
VGIPTPSLLRQQQWMLGPPAGSVAG

SEQ ID NO: 872123 - protein, 22 aa, Mycobacterium
VGISQMHVSRLLAKSLTRLRDQ

SEQ ID NO: 872124 - protein, 24 aa, Mycobacterium
VGITRARRRLYLSRAIVRSSWGQP

SEQ ID NO: 872125 - protein, 20 aa, Mycobacterium
VGIVDVLRILLSNPAVWEKT

SEQ ID NO: 872126 - protein, 23 aa, Mycobacterium
VGKAAIYRRWRSKQALAADLVAK

SEQ ID NO: 872127 - protein, 24 aa, Mycobacterium
VGKAAIYRRWSSKAALITDALVYW

SEQ ID NO: 872128 - protein, 23 aa, Mycobacterium
VGKAAIYRRWSSKAALTADAILH

SEQ ID NO: 872129 - protein, 24 aa, Mycobacterium
VGKAAIYRRWSSKVALITDALVYW

SEQ ID NO: 872130 - protein, 27 aa, Mycobacterium
VGKGDVVVLWLPSGIDYATCYAAAAMI

SEQ ID NO: 872131 - protein, 32 aa, Mycobacterium
VGKGTLFRRFGSRAGLMIVLLDEDEKAQQHAL

SEQ ID NO: 872132 - protein, 28 aa, Mycobacterium
VGKGTLFRRFGSRAGLMLVLLDEEERAS

SEQ ID NO: 872133 - protein, 27 aa, Mycobacterium
VGKGTLFRRFGSRAGLMMVLLDEDERT

SEQ ID NO: 872134 - protein, 23 aa, Mycobacterium
VGKHSLYRRWASKAPLVAEAVMN

SEQ ID NO: 872135 - protein, 20 aa, Mycobacterium
VGKIFLLAEVARRFENRTLD

SEQ ID NO: 872136 - protein, 17 aa, Mycobacterium
VGKLESQLLSPMRDRTL

SEQ ID NO: 872137 - protein, 23 aa, Mycobacterium
VGKLLRPKLKERYGDRLERLYAD

SEQ ID NO: 872138 - protein, 17 aa, Mycobacterium
VGKLSVPPSWAGPATPV

SEQ ID NO: 872139 - protein, 23 aa, Mycobacterium
VGKPALYRRWPSRAHLVFEAVFG

SEQ ID NO: 872140 - protein, 25 aa, Mycobacterium
VGKPGWPGFVSVPLAAYRRHFETSV

SEQ ID NO: 872141 - protein, 32 aa, Mycobacterium
VGKQLRLAQQYFFVSCSLQDILHLLEDFAGLP

SEQ ID NO: 872142 - protein, 29 aa, Mycobacterium
VGKQTMGVYPYQDLYMLDAARQFVPVMRN

SEQ ID NO: 872143 - protein, 23 aa, Mycobacterium
VGKSTLFNALTRNNVLAANYPFA

SEQ ID NO: 872144 - protein, 20 aa, Mycobacterium
VGKSTLLLEVAHRWAQSGQR

SEQ ID NO: 872145 - protein, 25 aa, Mycobacterium
VGKSTLLLEVAHRWASTGRRALYLS

SEQ ID NO: 872146 - protein, 21 aa, Mycobacterium
VGKSTVYRRWGTVPALVADLL

SEQ ID NO: 872147 - protein, 21 aa, Mycobacterium
VGKVVLTMPDAWAAGTVLITG

SEQ ID NO: 872148 - protein, 18 aa, Mycobacterium
VGLAADCPIPDPLDLLAF

SEQ ID NO: 872149 - protein, 18 aa, Mycobacterium
VGLALVAQHRGYKCVFVC

SEQ ID NO: 872150 - protein, 23 aa, Mycobacterium
VGLARFCTLRSWLSQWSYDDANG

SEQ ID NO: 872151 - protein, 22 aa, Mycobacterium
VGLAVVRWLVDHGAGRLVLNGR

SEQ ID NO: 872152 - protein, 22 aa, Mycobacterium
VGLDALTLTALQAAVAAAVSSG

SEQ ID NO: 872153 - protein, 22 aa, Mycobacterium
VGLDFFTRMLDGELDLSVFPDS

SEQ ID NO: 872154 - protein, 20 aa, Mycobacterium
VGLFSTARFSRQGEHRARDL

SEQ ID NO: 872155 - protein, 24 aa, Mycobacterium
VGLGLALPGLALTGGYLSSRADKP

SEQ ID NO: 872156 - protein, 24 aa, Mycobacterium
VGLGRIGALPKPEPLRDFVSRVCA

SEQ ID NO: 872157 - protein, 18 aa, Mycobacterium
VGLGSVRYLLAVGDLIIG

SEQ ID NO: 872158 - protein, 19 aa, Mycobacterium
VGLGTFNVDWKGRVPGRYR

SEQ ID NO: 872159 - protein, 19 aa, Mycobacterium
VGLHARPAAIIAEAVVNAG

SEQ ID NO: 872160 - protein, 23 aa, Mycobacterium
VGLHLAKGWVTPVTTPAGPPAEG

SEQ ID NO: 872161 - protein, 19 aa, Mycobacterium
VGLHPFGRFEGKSAMEMAT

SEQ ID NO: 872162 - protein, 19 aa, Mycobacterium
VGLHPFGRFEGKSAMEMGV

SEQ ID NO: 872163 - protein, 21 aa, Mycobacterium
VGLHPFGRFEGKTAMQMGVDA

SEQ ID NO: 872164 - protein, 21 aa, Mycobacterium
VGLHPVRRWDDGPVAVVQGLS

SEQ ID NO: 872165 - protein, 25 aa, Mycobacterium
VGLILTQWAHLLGARVITTVSTPEK

SEQ ID NO: 872166 - protein, 26 aa, Mycobacterium
VGLILTQWAHLLGARVITTVSTPEKA

SEQ ID NO: 872167 - protein, 18 aa, Mycobacterium
VGLKYHPGQTPLLSKEWT

SEQ ID NO: 872168 - protein, 17 aa, Mycobacterium
VGLLFPSADGCAGHSDG

SEQ ID NO: 872169 - protein, 25 aa, Mycobacterium
VGLLNVQYALKDDILYVLEANPRAS

SEQ ID NO: 872170 - protein, 20 aa, Mycobacterium
VGLMQPWRFIRITDDSLRRR

SEQ ID NO: 872171 - protein, 26 aa, Mycobacterium
VGLMQVWANELAQYWIRVNTIHPTGV

SEQ ID NO: 872172 - protein, 18 aa, Mycobacterium
VGLPLAGVQTRLLDDAGG

SEQ ID NO: 872173 - protein, 17 aa, Mycobacterium
VGLPLALVLADEGYTVD

SEQ ID NO: 872174 - protein, 28 aa, Mycobacterium
VGLQFARRLAALGARRIVLLSRNGIEGN

SEQ ID NO: 872175 - protein, 23 aa, Mycobacterium
VGLQIMAPALADDRLYRVGAAYE

SEQ ID NO: 872176 - protein, 20 aa, Mycobacterium
VGLQWIPENILRDVGKRAGL

SEQ ID NO: 872177 - protein, 17 aa, Mycobacterium
VGLQWWRRFGQDRPLHG

SEQ ID NO: 872178 - protein, 23 aa, Mycobacterium
VGLRDVLAALHWVRENIAAFGGD

SEQ ID NO: 872179 - protein, 20 aa, Mycobacterium
VGLRPYRFVPGVYGKPIVVA

SEQ ID NO: 872180 - protein, 26 aa, Mycobacterium
VGLRSAYVASWHAAPLLLAGDKGLIA

SEQ ID NO: 872181 - protein, 26 aa, Mycobacterium
VGLRVPVTSRHTLLLGPPGTGKTSVA

SEQ ID NO: 872182 - protein, 26 aa, Mycobacterium
VGLSVSPRYDSLLAKVITHISGSSFA

SEQ ID NO: 872183 - protein, 22 aa, Mycobacterium
VGLSYGPAFQRIQSVRIGSAGC

SEQ ID NO: 872184 - protein, 25 aa, Mycobacterium
VGLSYPAQFWPLTSGLTLNQSVAEG

SEQ ID NO: 872185 - protein, 18 aa, Mycobacterium
VGLTFRSPNKLPVTFAPA

SEQ ID NO: 872186 - protein, 25 aa, Mycobacterium
VGLTKSTFFRYFPDKREVLAAGQET

SEQ ID NO: 872187 - protein, 24 aa, Mycobacterium
VGLTSYLERVQTGIWDIPAGYLPA

SEQ ID NO: 872188 - protein, 18 aa, Mycobacterium
VGLWGYSGGGLASAWAAE

SEQ ID NO: 872189 - protein, 30 aa, Mycobacterium
VGLWVRTDEQWRWLANTLTVELLKELLPEA

SEQ ID NO: 872190 - protein, 17 aa, Mycobacterium
VGLYRRYHVSAAELQVL

SEQ ID NO: 872191 - protein, 24 aa, Mycobacterium
VGMAAVQLARLWGAKVFVTASRGK

SEQ ID NO: 872192 - protein, 20 aa, Mycobacterium
VGMALFIDLQLTVPGGNVLS

SEQ ID NO: 872193 - protein, 17 aa, Mycobacterium
VGMALLTPLMGQEFLDK

SEQ ID NO: 872194 - protein, 25 aa, Mycobacterium
VGMERFNAIWTGPETLPLPAEIEEP

SEQ ID NO: 872195 - protein, 31 aa, Mycobacterium
VGMGRALIGPLRIGLQRAGVPVLLNTALTDL

SEQ ID NO: 872196 - protein, 18 aa, Mycobacterium
VGMLFQRPNPFPMSIMDN

SEQ ID NO: 872197 - protein, 19 aa, Mycobacterium
VGMPAWLSYTIDGARTRAG

SEQ ID NO: 872198 - protein, 27 aa, Mycobacterium
VGMRAPHLTLKIGPLAVGVRGPVTLAL

SEQ ID NO: 872199 - protein, 21 aa, Mycobacterium
VGMRPPRFGVPIRAMAAAAHL

SEQ ID NO: 872200 - protein, 18 aa, Mycobacterium
VGMSPMEYGPRASVADAY

SEQ ID NO: 872201 - protein, 21 aa, Mycobacterium
VGMTLPIARDLSREFIRVCTI

SEQ ID NO: 872202 - protein, 25 aa, Mycobacterium
VGMVFQQFNLFPHMTAFENIIEAPV

SEQ ID NO: 872203 - protein, 20 aa, Mycobacterium
VGMVRRLAVIQFERAAVARS

SEQ ID NO: 872204 - protein, 26 aa, Mycobacterium
VGNACNGRDGGLIWGNGGAGANGGHG

SEQ ID NO: 872205 - protein, 19 aa, Mycobacterium
VGNATRYLAASMLAAFPHT

SEQ ID NO: 872206 - protein, 18 aa, Mycobacterium
VGNFPPLWTEWNGKYRDT

SEQ ID NO: 872207 - protein, 17 aa, Mycobacterium
VGNGWHQVTSELSFERS

SEQ ID NO: 872208 - protein, 26 aa, Mycobacterium
VGNGWYFRELGEVLLWRQSNKLVAGE

SEQ ID NO: 872209 - protein, 24 aa, Mycobacterium
VGNIYEAFLQGFRAFFAESAADPL

SEQ ID NO: 872210 - protein, 17 aa, Mycobacterium
VGNIYLGIVQNVLPSME

SEQ ID NO: 872211 - protein, 28 aa, Mycobacterium
VGNLGFSEIAFPAPLFHGDTLYAESEVI

SEQ ID NO: 872212 - protein, 24 aa, Mycobacterium
VGNLTFDAIHLQGHTPGSVALALA

SEQ ID NO: 872213 - protein, 17 aa, Mycobacterium
VGNLYARALADLTWKAT

SEQ ID NO: 872214 - protein, 29 aa, Mycobacterium
VGNNTPIFFMRDPLKFQHFIRSQKRLQAS

SEQ ID NO: 872215 - protein, 28 aa, Mycobacterium
VGNNTPVFFIRDAIKFPDFIRSQKRLPG

SEQ ID NO: 872216 - protein, 39 aa, Mycobacterium
VGNPAHWHDFFASWPLLYVSHLMSLVFDGAFDRHPDLRV

SEQ ID NO: 872217 - protein, 39 aa, Mycobacterium
VGNPAHWHDFFASWPLLYVSHLMSLVFDGAFDRHPNLRV

SEQ ID NO: 872218 - protein, 23 aa, Mycobacterium
VGNPTDLLAWLQGSFHTRTSAVV

SEQ ID NO: 872219 - protein, 22 aa, Mycobacterium
VGNVGLFNSYIGNFGLGNSGLL

SEQ ID NO: 872220 - protein, 21 aa, Mycobacterium
VGNWLPSLLFRRLERLQLAYA

SEQ ID NO: 872221 - protein, 24 aa, Mycobacterium
VGNYDAFIPFRAAIRAMESAAEAT

SEQ ID NO: 872222 - protein, 17 aa, Mycobacterium
VGPAIFLASPASAYVNG

SEQ ID NO: 872223 - protein, 17 aa, Mycobacterium
VGPAISKRVLLAEPRGY

SEQ ID NO: 872224 - protein, 18 aa, Mycobacterium
VGPAIWAAMADINAVALG

SEQ ID NO: 872225 - protein, 23 aa, Mycobacterium
VGPALHRLMRGADGRVIVACFAS

SEQ ID NO: 872226 - protein, 26 aa, Mycobacterium
VGPASARLFVASALARLGPLLVVTAT

SEQ ID NO: 872227 - protein, 25 aa, Mycobacterium
VGPASPVNPLLAAALDAAVECGYAA

SEQ ID NO: 872228 - protein, 30 aa, Mycobacterium
VGPDDVILGALPLFHAFGQTAGLNAAVAAG

SEQ ID NO: 872229 - protein, 25 aa, Mycobacterium
VGPDGVLRWLALDGQPVHQFTVAAS

SEQ ID NO: 872230 - protein, 26 aa, Mycobacterium
VGPDGVLRWLALDGRPIHQFTVAASE

SEQ ID NO: 872231 - protein, 22 aa, Mycobacterium
VGPDWLFLAVPEGKAVKNRIHF

SEQ ID NO: 872232 - protein, 21 aa, Mycobacterium
VGPEHAWLRESGRAEYRPITD

SEQ ID NO: 872233 - protein, 19 aa, Mycobacterium
VGPFLDLGLPYPGDSELVD

SEQ ID NO: 872234 - protein, 18 aa, Mycobacterium
VGPFQQRQSWGATADLMD

SEQ ID NO: 872235 - protein, 17 aa, Mycobacterium
VGPGPGRRRRRAHHRPL

SEQ ID NO: 872236 - protein, 20 aa, Mycobacterium
VGPGRLRDVHRETRIVRLGQ

SEQ ID NO: 872237 - protein, 30 aa, Mycobacterium
VGPGYLIDGKPVILTAPKKAGPAAPTRTAS

SEQ ID NO: 872238 - protein, 18 aa, Mycobacterium
VGPIFFASSDIQGIGYMH

SEQ ID NO: 872239 - protein, 17 aa, Mycobacterium
VGPILGQFFTALRECRI

SEQ ID NO: 872240 - protein, 24 aa, Mycobacterium
VGPIPLGHHLFGVRYARTGTVANS

SEQ ID NO: 872241 - protein, 18 aa, Mycobacterium
VGPKYGFRPTVMARPPFG

SEQ ID NO: 872242 - protein, 29 aa, Mycobacterium
VGPLSHLSPTLWWFIRRSGMPKESVDFFR

SEQ ID NO: 872243 - protein, 17 aa, Mycobacterium
VGPLTRAFLLTNVVEAE

SEQ ID NO: 872244 - protein, 27 aa, Mycobacterium
VGPPELYAWLHYDPIPDRDDLAKALIA

SEQ ID NO: 872245 - protein, 27 aa, Mycobacterium
VGPPELYAWLHYDPIPERDDLAKALLA

SEQ ID NO: 872246 - protein, 20 aa, Mycobacterium
VGPQTWIVIEKILAVDEALE

SEQ ID NO: 872247 - protein, 25 aa, Mycobacterium
VGPRATFLLMQAVHPVMVAAGGGSI

SEQ ID NO: 872248 - protein, 28 aa, Mycobacterium
VGPSHHWIIRDMLGLPYDKPAAYTRDYL

SEQ ID NO: 872249 - protein, 18 aa, Mycobacterium
VGPSWRKGPYNVRGRGPR

SEQ ID NO: 872250 - protein, 22 aa, Mycobacterium
VGPTLSKFFTALRDRHVLGVRG

SEQ ID NO: 872251 - protein, 20 aa, Mycobacterium
VGPTLSKFFTALRERRILGV

SEQ ID NO: 872252 - protein, 25 aa, Mycobacterium
VGPVAATPIMRWLHSVDGPVEEFNQ

SEQ ID NO: 872253 - protein, 19 aa, Mycobacterium
VGPVTWSVELDERWVVLGP

SEQ ID NO: 872254 - protein, 26 aa, Mycobacterium
VGPVVATPIMRWLQSIEGPIEQFNQT

SEQ ID NO: 872255 - protein, 18 aa, Mycobacterium
VGPWEWDVKRLVTSMAIL

SEQ ID NO: 872256 - protein, 17 aa, Mycobacterium
VGPWFRWATVGVDSAAV

SEQ ID NO: 872257 - protein, 18 aa, Mycobacterium
VGPYLIRQLADMGASTIV

SEQ ID NO: 872258 - protein, 19 aa, Mycobacterium
VGQAWQGPASAAMTAAAAP

SEQ ID NO: 872259 - protein, 26 aa, Mycobacterium
VGQDRLRLALVLCAVRPEIGGVLIRG

SEQ ID NO: 872260 - protein, 19 aa, Mycobacterium
VGQIYLLDNPLLTEPLAPE

SEQ ID NO: 872261 - protein, 23 aa, Mycobacterium
VGQIYLLSNPLLAEPLVPTHVKP

SEQ ID NO: 872262 - protein, 21 aa, Mycobacterium
VGQLAELVALPQGVVDVLHRQ

SEQ ID NO: 872263 - protein, 18 aa, Mycobacterium
VGQLDVDFALSGLSAISV

SEQ ID NO: 872264 - protein, 17 aa, Mycobacterium
VGQLRSICRDLGLAESG

SEQ ID NO: 872265 - protein, 24 aa, Mycobacterium
VGQNLLDHLITPLGFDVAGDSLAA

SEQ ID NO: 872266 - protein, 23 aa, Mycobacterium
VGQPVAVAGLVALPWSQDGRSGI

SEQ ID NO: 872267 - protein, 18 aa, Mycobacterium
VGQPVLIPGTMGTASYVL

SEQ ID NO: 872268 - protein, 18 aa, Mycobacterium
VGQQLWQQSGLKPTDIQT

SEQ ID NO: 872269 - protein, 25 aa, Mycobacterium
VGQRPAILMPLRAREEVVGVIAIAR

SEQ ID NO: 872270 - protein, 18 aa, Mycobacterium
VGQSGLPGTGGTIGIAGV

SEQ ID NO: 872271 - protein, 18 aa, Mycobacterium
VGQSVLLRVLPDGDVSFP

SEQ ID NO: 872272 - protein, 29 aa, Mycobacterium
VGQSYPFAPPVGLMFVLWDDEAEQDWLRR

SEQ ID NO: 872273 - protein, 20 aa, Mycobacterium
VGQVFHVPVAPAITGRQFIE

SEQ ID NO: 872274 - protein, 25 aa, Mycobacterium
VGQVHRILDMRGLYQLLTGSSAPPQ

SEQ ID NO: 872275 - protein, 23 aa, Mycobacterium
VGQYYNFLRLGRAGYTQVMQCLS

SEQ ID NO: 872276 - protein, 28 aa, Mycobacterium
VGRAEYLGLPYYGRWLLSVARVLVEKHH

SEQ ID NO: 872277 - protein, 31 aa, Mycobacterium
VGRAIYQGIPYYGRWLWAVARVLIEKHHISH

SEQ ID NO: 872278 - protein, 17 aa, Mycobacterium
VGRALISAILRRRGLTA

SEQ ID NO: 872279 - protein, 17 aa, Mycobacterium
VGRAQFLADRGLSMLRP

SEQ ID NO: 872280 - protein, 24 aa, Mycobacterium
VGRATRWRLAGLGLRVIAHDPYND

SEQ ID NO: 872281 - protein, 30 aa, Mycobacterium
VGRAVYLGFPYYGRWLWAVARVLVEKHHIS

SEQ ID NO: 872282 - protein, 18 aa, Mycobacterium
VGRCLEAIAAGEVYQACV

SEQ ID NO: 872283 - protein, 29 aa, Mycobacterium
VGRDNVFFLHVSLVPYLKPSGELKTKPTQ

SEQ ID NO: 872284 - protein, 17 aa, Mycobacterium
VGRDQIVAFLTRKWQRE

SEQ ID NO: 872285 - protein, 26 aa, Mycobacterium
VGRENCFFLHVSLVPYLAPSGELKTK

SEQ ID NO: 872286 - protein, 20 aa, Mycobacterium
VGRERNVLLALMLSSQEQYS

SEQ ID NO: 872287 - protein, 24 aa, Mycobacterium
VGREWRLPRWQFAPDNTTGTLPEL

SEQ ID NO: 872288 - protein, 25 aa, Mycobacterium
VGRFQQERIPLSAIALHADTSALTA

SEQ ID NO: 872289 - protein, 25 aa, Mycobacterium
VGRFRDERIPLSAIALHADTSAVTA

SEQ ID NO: 872290 - protein, 28 aa, Mycobacterium
VGRGPLTVPIWYYYTAGGELWIPTGKGS

SEQ ID NO: 872291 - protein, 34 aa, Mycobacterium
VGRGSPWAAPLPLMIPRRIAMELVLTGAPISAAR

SEQ ID NO: 872292 - protein, 33 aa, Mycobacterium
VGRGSPWATPLSWLVPPRVAMQILLTGDPITAA

SEQ ID NO: 872293 - protein, 34 aa, Mycobacterium
VGRGSPWATPLSWLVPPRVAMQILLTGDPITAAR

SEQ ID NO: 872294 - protein, 17 aa, Mycobacterium
VGRGTTVEMWKWVPPRA

SEQ ID NO: 872295 - protein, 30 aa, Mycobacterium
VGRIIPYNHPILFAAAKVGAPLITGNTLIL

SEQ ID NO: 872296 - protein, 30 aa, Mycobacterium
VGRIRAMQMALLPERLPAAEALSWGLVSAV

SEQ ID NO: 872297 - protein, 34 aa, Mycobacterium
VGRIVLHLEPWLEADPICWAINTVPVRVGPGFVD

SEQ ID NO: 872298 - protein, 20 aa, Mycobacterium
VGRLDLLRRWLELPDGRDDR

SEQ ID NO: 872299 - protein, 22 aa, Mycobacterium
VGRLILMHLPDPPATLRHLSSL

SEQ ID NO: 872300 - protein, 25 aa, Mycobacterium
VGRLKRPWLEGYLGPDVMDLNRRIK

SEQ ID NO: 872301 - protein, 21 aa, Mycobacterium
VGRLSVPASWSTAAPAVTADI

SEQ ID NO: 872302 - protein, 33 aa, Mycobacterium
VGRMEYERFGLPEPDWQVLLAVPVELAGERSRG

SEQ ID NO: 872303 - protein, 24 aa, Mycobacterium
VGRPLTERALLRFARAWELAEAPR

SEQ ID NO: 872304 - protein, 17 aa, Mycobacterium
VGRPLVDLLVAAGADVR

SEQ ID NO: 872305 - protein, 24 aa, Mycobacterium
VGRPRLTYEIAPRLDYADIVALFA

SEQ ID NO: 872306 - protein, 19 aa, Mycobacterium
VGRQRLPILCGLDLTRKVA

SEQ ID NO: 872307 - protein, 19 aa, Mycobacterium
VGRRLAPEPVLHAALGPGA

SEQ ID NO: 872308 - protein, 25 aa, Mycobacterium
VGRRLMHVLGTSAFVPDLLMRAPEV

SEQ ID NO: 872309 - protein, 20 aa, Mycobacterium
VGRRLTYVVRRGRCEGPRIA

SEQ ID NO: 872310 - protein, 17 aa, Mycobacterium
VGRRRTSRFLAEGPNLV

SEQ ID NO: 872311 - protein, 25 aa, Mycobacterium
VGRRTLYMLITTWDAAGGGPFAASA

SEQ ID NO: 872312 - protein, 22 aa, Mycobacterium
VGRRVFAVAAAAGAAWMLGPAV

SEQ ID NO: 872313 - protein, 18 aa, Mycobacterium
VGRSYVIQYLTPKSDTKP

SEQ ID NO: 872314 - protein, 18 aa, Mycobacterium
VGRTAVIARFAYPQRAPE

SEQ ID NO: 872315 - protein, 26 aa, Mycobacterium
VGRVHALFRRVLTFGLPTVAAINGHA

SEQ ID NO: 872316 - protein, 28 aa, Mycobacterium
VGRVQGLLARVLTFPLPTAAAVVGHAFG

SEQ ID NO: 872317 - protein, 24 aa, Mycobacterium
VGRYSPYAVYLPGGDPARLAPVRD

SEQ ID NO: 872318 - protein, 23 aa, Mycobacterium
VGRYVTTLARRRGLKTLNIVRRE

SEQ ID NO: 872319 - protein, 23 aa, Mycobacterium
VGSAFPIAVLNLKGGVGKTAVVE

SEQ ID NO: 872320 - protein, 20 aa, Mycobacterium
VGSALAPRYVDLRPFAVNDG

SEQ ID NO: 872321 - protein, 22 aa, Mycobacterium
VGSANTLVRTPAGWRADNTDID

SEQ ID NO: 872322 - protein, 19 aa, Mycobacterium
VGSCWIGSTIFAPELVRAA

SEQ ID NO: 872323 - protein, 20 aa, Mycobacterium
VGSDLRPGNIWQTVEIPRLM

SEQ ID NO: 872324 - protein, 25 aa, Mycobacterium
VGSEVLYRLHLDLASLSIAEFYADG

SEQ ID NO: 872325 - protein, 18 aa, Mycobacterium
VGSGFLRGLGGPLTDGEV

SEQ ID NO: 872326 - protein, 25 aa, Mycobacterium
VGSGPVFLQYPWQVIPDELVKPLED

SEQ ID NO: 872327 - protein, 27 aa, Mycobacterium
VGSGPVFLQYPWQVIPEELIKPLEDAA

SEQ ID NO: 872328 - protein, 18 aa, Mycobacterium
VGSGRLIAGLDDAVVGLS

SEQ ID NO: 872329 - protein, 25 aa, Mycobacterium
VGSHFHFFEVNRALRFDRAVTFGMR

SEQ ID NO: 872330 - protein, 26 aa, Mycobacterium
VGSHLDAIRYAEAPLIFPVVPDGHNE

SEQ ID NO: 872331 - protein, 23 aa, Mycobacterium
VGSHLIARIRKLATKHPLIGTVH

SEQ ID NO: 872332 - protein, 29 aa, Mycobacterium
VGSHVPNFPWPWGLIDLAARVVLPVSATV

SEQ ID NO: 872333 - protein, 25 aa, Mycobacterium
VGSLARLPLILNDGHLRELALTGKD

SEQ ID NO: 872334 - protein, 24 aa, Mycobacterium
VGSLFSPLERLLGPPLIGGPGSAT

SEQ ID NO: 872335 - protein, 21 aa, Mycobacterium
VGSLLLGLYDSDGALASVGVI

SEQ ID NO: 872336 - protein, 19 aa, Mycobacterium
VGSLLLGLYQQDGQLASVG

SEQ ID NO: 872337 - protein, 26 aa, Mycobacterium
VGSLNMDLTFAVTTLPRPGETVLASA

SEQ ID NO: 872338 - protein, 26 aa, Mycobacterium
VGSLVVQLLVLRQARVLGIAGRGNAD

SEQ ID NO: 872339 - protein, 23 aa, Mycobacterium
VGSLWDVVRDRRLTHRPQVRGGV

SEQ ID NO: 872340 - protein, 28 aa, Mycobacterium
VGSMEKLRRIPGWSHVYRVADRLGGTAP

SEQ ID NO: 872341 - protein, 26 aa, Mycobacterium
VGSPAYDLCYSTLWSALTRGGTLLLA

SEQ ID NO: 872342 - protein, 24 aa, Mycobacterium
VGSPAYVLPVVTGALMVLAIEICQ

SEQ ID NO: 872343 - protein, 25 aa, Mycobacterium
VGSPELGVYVSYLTFDEARPLSLDE

SEQ ID NO: 872344 - protein, 20 aa, Mycobacterium
VGSPPFISPSYYGLGVNSLE

SEQ ID NO: 872345 - protein, 17 aa, Mycobacterium
VGSRAMALTLRQSQPLV

SEQ ID NO: 872346 - protein, 28 aa, Mycobacterium
VGSRLANPPLLVPVLRAGLGMVDQAHAL

SEQ ID NO: 872347 - protein, 26 aa, Mycobacterium
VGSSAVFLQYPWQVLPEELVKPIEDA

SEQ ID NO: 872348 - protein, 23 aa, Mycobacterium
VGSSPGFLSYPWGVIGDHTIEKV

SEQ ID NO: 872349 - protein, 23 aa, Mycobacterium
VGSTVGFTFRRLYTAGDVHNYFW

SEQ ID NO: 872350 - protein, 25 aa, Mycobacterium
VGSWHGTPPRLWVVSRGGLAVTDGD

SEQ ID NO: 872351 - protein, 22 aa, Mycobacterium
VGTAELIRLALTAKLKPYTFVS

SEQ ID NO: 872352 - protein, 24 aa, Mycobacterium
VGTAFQRTVWTALREIPYGQTCSY

SEQ ID NO: 872353 - protein, 23 aa, Mycobacterium
VGTALAAFLTSGGHRVIRLVRGD

SEQ ID NO: 872354 - protein, 24 aa, Mycobacterium
VGTAMMRYLMEIPPLSELATEDVI

SEQ ID NO: 872355 - protein, 30 aa, Mycobacterium
VGTELFSWPGVHYLSGFYGPLERALRDSGA

SEQ ID NO: 872356 - protein, 18 aa, Mycobacterium
VGTFSWPGAYGTWWQADP

SEQ ID NO: 872357 - protein, 40 aa, Mycobacterium
VGTGGATLPLLIFASARAGLTFTPINYRLSADGIRALIRR

SEQ ID NO: 872358 - protein, 30 aa, Mycobacterium
VGTGGNGGILGLGLPPGTAGTGGTGGTLIG

SEQ ID NO: 872359 - protein, 25 aa, Mycobacterium
VGTGLSYDPGLRRRQLRDLGALVCE

SEQ ID NO: 872360 - protein, 23 aa, Mycobacterium
VGTGMLRYVMRVPPLSSLGVDEV

SEQ ID NO: 872361 - protein, 31 aa, Mycobacterium
VGTHLFNAMPPLDHRAPGPALALLADPRVTV

SEQ ID NO: 872362 - protein, 25 aa, Mycobacterium
VGTKPSAFAWIPFGGGTRRCVGAAF

SEQ ID NO: 872363 - protein, 27 aa, Mycobacterium
VGTLKALIRVLAYEHPDLRATLLDVGA

SEQ ID NO: 872364 - protein, 17 aa, Mycobacterium
VGTLPPQMREVCQLHWD

SEQ ID NO: 872365 - protein, 21 aa, Mycobacterium
VGTLVMTHYVPAPVAGQEEQW

SEQ ID NO: 872366 - protein, 26 aa, Mycobacterium
VGTMPALQFLPRALAAAGGRPVLLAG

SEQ ID NO: 872367 - protein, 29 aa, Mycobacterium
VGTNQSWIIPLKLTLLQQIAGALDFIHDE

SEQ ID NO: 872368 - protein, 22 aa, Mycobacterium
VGTPDAGAFWRVISEHKVKALF

SEQ ID NO: 872369 - protein, 17 aa, Mycobacterium
VGTPFQRRVWEALLTIP

SEQ ID NO: 872370 - protein, 25 aa, Mycobacterium
VGTPPQIPVMVPVMAGNPFSGKGFG

SEQ ID NO: 872371 - protein, 18 aa, Mycobacterium
VGTPTMSPAPAPAGPLPP

SEQ ID NO: 872372 - protein, 25 aa, Mycobacterium
VGTRLGMCGMEYFGHPWEFGPRRTK

SEQ ID NO: 872373 - protein, 29 aa, Mycobacterium
VGTRLGMCGVEYFGHPWEFGPRKAKELLL

SEQ ID NO: 872374 - protein, 19 aa, Mycobacterium
VGTRLVGRPLQHRDPDRQL

SEQ ID NO: 872375 - protein, 23 aa, Mycobacterium
VGTRLVGRPLTHRNPDRQLPSEG

SEQ ID NO: 872376 - protein, 30 aa, Mycobacterium
VGTSFVRPLAHVPHIRGCDYWNIRWIHVDD

SEQ ID NO: 872377 - protein, 21 aa, Mycobacterium
VGTSFVWLVAPEFTDEWLREP

SEQ ID NO: 872378 - protein, 20 aa, Mycobacterium
VGTVEILKWAKSQGISITAE

SEQ ID NO: 872379 - protein, 24 aa, Mycobacterium
VGTVFAPRPERMSARRFWVRYAAE

SEQ ID NO: 872380 - protein, 25 aa, Mycobacterium
VGTVFAPRPGRMSARRFWVRYAAES

SEQ ID NO: 872381 - protein, 23 aa, Mycobacterium
VGTWRSKRIILADDKVGFSFHET

SEQ ID NO: 872382 - protein, 34 aa, Mycobacterium
VGVAILSRRRPELSWFPWLSRHLRDAEPGRARGC

SEQ ID NO: 872383 - protein, 30 aa, Mycobacterium
VGVAPRDLAGWLVEALVSHAAIAGAEIAGP

SEQ ID NO: 872384 - protein, 30 aa, Mycobacterium
VGVAQIRLYRPFPAEALLAALPPTVRAIAV

SEQ ID NO: 872385 - protein, 17 aa, Mycobacterium
VGVDIMPGMYRTAGGAT

SEQ ID NO: 872386 - protein, 20 aa, Mycobacterium
VGVDLLSALGYHVVASTGKA

SEQ ID NO: 872387 - protein, 18 aa, Mycobacterium
VGVDYYRPTGRGAEREMA

SEQ ID NO: 872388 - protein, 26 aa, Mycobacterium
VGVFARNLKDLLLAAPAGTRATLGLD

SEQ ID NO: 872389 - protein, 24 aa, Mycobacterium
VGVFDAFVERLAPGGALVVCADDP

SEQ ID NO: 872390 - protein, 24 aa, Mycobacterium
VGVFDAFVERLAPGGALVVCVDDP

SEQ ID NO: 872391 - protein, 19 aa, Mycobacterium
VGVFPILGMDWRERESQGE

SEQ ID NO: 872392 - protein, 24 aa, Mycobacterium
VGVGMFLQTFLLALTERGIGSCVQ

SEQ ID NO: 872393 - protein, 41 aa, Mycobacterium
VGVHDLQPFPLPALTCLLRSITLRLTIAPVQRTWSELIPLL

SEQ ID NO: 872394 - protein, 33 aa, Mycobacterium
VGVHDLTPYPLPALVCLLRSLTLRMTTAPVQQT

SEQ ID NO: 872395 - protein, 28 aa, Mycobacterium
VGVIGPWNFPVQLTVLPAAAAFAAGNRV

SEQ ID NO: 872396 - protein, 24 aa, Mycobacterium
VGVLANNPLRLGGCLNSESAEKAA

SEQ ID NO: 872397 - protein, 24 aa, Mycobacterium
VGVLKPLLDELGLVGYPKTSGGRG

SEQ ID NO: 872398 - protein, 27 aa, Mycobacterium
VGVLRHLRSLLRPGGQLRYLEHVASAG

SEQ ID NO: 872399 - protein, 29 aa, Mycobacterium
VGVPLPALGALVTGIARIAAARDLTISVI

SEQ ID NO: 872400 - protein, 37 aa, Mycobacterium
VGVPMVFLHGLGLNRRVYIRLLSRVAGLGFRIVAIDA

SEQ ID NO: 872401 - protein, 24 aa, Mycobacterium
VGVQRLLAHLLEHIAEPVRRPHTH

SEQ ID NO: 872402 - protein, 19 aa, Mycobacterium
VGVRDGLNGLLLPDAYPDG

SEQ ID NO: 872403 - protein, 25 aa, Mycobacterium
VGVRDNRMVLLRLPEVLFAEADGNE

SEQ ID NO: 872404 - protein, 19 aa, Mycobacterium
VGVRPRELPMTPARIWRAL

SEQ ID NO: 872405 - protein, 30 aa, Mycobacterium
VGVRRTIGMVFQRPNPFPTMSIRDNVVAGL

SEQ ID NO: 872406 - protein, 27 aa, Mycobacterium
VGVRVYRLPMNAARVWRVINDSGGGES

SEQ ID NO: 872407 - protein, 32 aa, Mycobacterium
VGVRYPAGVDWVLAFWGTVMAGGVVVPVNTRS

SEQ ID NO: 872408 - protein, 25 aa, Mycobacterium
VGVSKPMVLAYFGSKEQLYIACVER

SEQ ID NO: 872409 - protein, 27 aa, Mycobacterium
VGVSPRTFFRYFPTKESVLFFGEYDFI

SEQ ID NO: 872410 - protein, 27 aa, Mycobacterium
VGVSSTDYVRLLFPGGRKPTIWDNTGG

SEQ ID NO: 872411 - protein, 25 aa, Mycobacterium
VGVTAYDYMLMMSGAVRAEELDAYL

SEQ ID NO: 872412 - protein, 24 aa, Mycobacterium
VGVTPPSLYLHFADKDTLLDAVCA

SEQ ID NO: 872413 - protein, 30 aa, Mycobacterium
VGVVHIRLYRPFPAQAVLTALPPTVRAIAV

SEQ ID NO: 872414 - protein, 36 aa, Mycobacterium
VGVVPIAVTNWFGDQPFAVWPWAAPKLGGARPVVLN

SEQ ID NO: 872415 - protein, 29 aa, Mycobacterium
VGVYLRSHPKYWRRFPARIEWADTEWSAR

SEQ ID NO: 872416 - protein, 19 aa, Mycobacterium
VGWARRFVDGPPRALAAAK

SEQ ID NO: 872417 - protein, 19 aa, Mycobacterium
VGWPDGSVLPLLYGAPAMS

SEQ ID NO: 872418 - protein, 17 aa, Mycobacterium
VGWRRHIHRYPELGRQE

SEQ ID NO: 872419 - protein, 27 aa, Mycobacterium
VGWSDQYGGFWLLATYDDVLEVARDHE

SEQ ID NO: 872420 - protein, 19 aa, Mycobacterium
VGWYNAHPNFEHSTPDLSG

SEQ ID NO: 872421 - protein, 24 aa, Mycobacterium
VGYEALARWPAYDSLSPLDVFAHA

SEQ ID NO: 872422 - protein, 20 aa, Mycobacterium
VGYFFGHMFLNMTEGTALSS

SEQ ID NO: 872423 - protein, 25 aa, Mycobacterium
VGYGGWTWHYTLEPIGPAQTRVTLT

SEQ ID NO: 872424 - protein, 27 aa, Mycobacterium
VGYGRLGEWFWGFQQQGVVPDIVSMAK

SEQ ID NO: 872425 - protein, 26 aa, Mycobacterium
VGYGRLGQWFWGFQQQDAVPDIVSVA

SEQ ID NO: 872426 - protein, 38 aa, Mycobacterium
VGYIPLLIVASLPNFARRLPMLRGWVADLLDRDARDRA

SEQ ID NO: 872427 - protein, 32 aa, Mycobacterium
VGYKARNPFAPLLLVLLQFQAGIKIDFRSEAL

SEQ ID NO: 872428 - protein, 19 aa, Mycobacterium
VGYPADRPLRPIRTPNRRP

SEQ ID NO: 872429 - protein, 17 aa, Mycobacterium
VGYPCVFDHKGQRFLIY

SEQ ID NO: 872430 - protein, 23 aa, Mycobacterium
VGYPREWAQRKPYSWLRQILPAP

SEQ ID NO: 872431 - protein, 22 aa, Mycobacterium
VGYPREWRRRKPYSWLRQVLPD

SEQ ID NO: 872432 - protein, 28 aa, Mycobacterium
VGYPRGNLAFRWFLADGVPARPQVRLVQ

SEQ ID NO: 872433 - protein, 25 aa, Mycobacterium
VGYRDLAGFGRRFIDIAAADLYADV

SEQ ID NO: 872434 - protein, 25 aa, Mycobacterium
VGYSLWAAGRFMRTGKDRVRCVAVQ

SEQ ID NO: 872435 - protein, 17 aa, Mycobacterium
VGYTRLSRHLDPDELAS

SEQ ID NO: 872436 - protein, 29 aa, Mycobacterium
VGYVFQDPRLLPWRTVMANLGFVQHERTG

SEQ ID NO: 872437 - protein, 26 aa, Mycobacterium
VGYVPLLMAAALPRPLRRVPLLGDRI

SEQ ID NO: 872438 - protein, 19 aa, Mycobacterium
VHAAGVRTVVLPQATHYVH

SEQ ID NO: 872439 - protein, 22 aa, Mycobacterium
VHAALREVLGPNAVQAGSLNRP

SEQ ID NO: 872440 - protein, 28 aa, Mycobacterium
VHAATSWVLADPLRWLTIADRYGVTNTW

SEQ ID NO: 872441 - protein, 25 aa, Mycobacterium
VHAECAGLIYLVSELDGYPMCGVLA

SEQ ID NO: 872442 - protein, 24 aa, Mycobacterium
VHAELLRTLPSGALLSGLTAPVAT

SEQ ID NO: 872443 - protein, 24 aa, Mycobacterium
VHAFLPAPADIYGFGRALPSTFIE

SEQ ID NO: 872444 - protein, 26 aa, Mycobacterium
VHAGMDLYKWAFKLGPLIESGLVLDC

SEQ ID NO: 872445 - protein, 26 aa, Mycobacterium
VHAQVPQQWLSWHYRSQDEALIAFSN

SEQ ID NO: 872446 - protein, 18 aa, Mycobacterium
VHARQFARLVGRGGHTLI

SEQ ID NO: 872447 - protein, 22 aa, Mycobacterium
VHARSWAAPQWLQLGRELAGSD

SEQ ID NO: 872448 - protein, 23 aa, Mycobacterium
VHARTWAAPQWLQLGRELAGSDS

SEQ ID NO: 872449 - protein, 30 aa, Mycobacterium
VHASMQQWVRLGVGPWFYIDDVVTDYFRYR

SEQ ID NO: 872450 - protein, 25 aa, Mycobacterium
VHATTLYYPLVKTPMIAPTRAYDGL

SEQ ID NO: 872451 - protein, 35 aa, Mycobacterium
VHAVDPALPVLGLPGSAFFAEARRLGLRTVSEAFA

SEQ ID NO: 872452 - protein, 25 aa, Mycobacterium
VHAVRKALAPIFGLEPEQIRVIAPH

SEQ ID NO: 872453 - protein, 17 aa, Mycobacterium
VHAWLHRVTPRLTRAEI

SEQ ID NO: 872454 - protein, 33 aa, Mycobacterium
VHAWNRDVIVPDGPLHYLVQFTVTTTEAQSAAL

SEQ ID NO: 872455 - protein, 23 aa, Mycobacterium
VHCVYKPVAGEAPLWDFPDGTLA

SEQ ID NO: 872456 - protein, 25 aa, Mycobacterium
VHDAARALTPPALIARVVAALKEGH

SEQ ID NO: 872457 - protein, 20 aa, Mycobacterium
VHDFDALRWITGQNAVEVYA

SEQ ID NO: 872458 - protein, 18 aa, Mycobacterium
VHDFPLAADILPEGRRAL

SEQ ID NO: 872459 - protein, 22 aa, Mycobacterium
VHDFQVAGPLLPEATRSLRQIG

SEQ ID NO: 872460 - protein, 23 aa, Mycobacterium
VHDFQVAGPLLPEAVRSLRQIGE

SEQ ID NO: 872461 - protein, 20 aa, Mycobacterium
VHDFVILEKWGAAGGTWHAN

SEQ ID NO: 872462 - protein, 25 aa, Mycobacterium
VHDHVTSVFRHDTLAAALAATGLGE

SEQ ID NO: 872463 - protein, 19 aa, Mycobacterium
VHDKLAKLPGVRPVRRPVS

SEQ ID NO: 872464 - protein, 42 aa, Mycobacterium
VHDKLYLPGLVKLRRLVDEGFFGRILSMRGEFGYWVFEGDGQ

SEQ ID NO: 872465 - protein, 25 aa, Mycobacterium
VHDLQHYRLIGWRRGICGYRRFFSI

SEQ ID NO: 872466 - protein, 19 aa, Mycobacterium
VHDPSDTTWLGRDRFVLSC

SEQ ID NO: 872467 - protein, 22 aa, Mycobacterium
VHDRLDYQILAEILALELGDTT

SEQ ID NO: 872468 - protein, 22 aa, Mycobacterium
VHDTVFYCVANMPGAVPRTSTY

SEQ ID NO: 872469 - protein, 18 aa, Mycobacterium
VHDVARRAELLLLSVPDA

SEQ ID NO: 872470 - protein, 18 aa, Mycobacterium
VHDVLRRSILADGMDLVL

SEQ ID NO: 872471 - protein, 27 aa, Mycobacterium
VHEASELMINLFWRGLKGSPSAASDRD

SEQ ID NO: 872472 - protein, 19 aa, Mycobacterium
VHEAVGVIVGWLAEADARA

SEQ ID NO: 872473 - protein, 25 aa, Mycobacterium
VHEFNLKKMWLSPNGTIRNILGGTI

SEQ ID NO: 872474 - protein, 23 aa, Mycobacterium
VHEGLVAVLKIPARDRFQIITAH

SEQ ID NO: 872475 - protein, 24 aa, Mycobacterium
VHEPLDVDGLLRRLRDLNVKGIDQ

SEQ ID NO: 872476 - protein, 20 aa, Mycobacterium
VHEVARFFATGWPVNYWRID

SEQ ID NO: 872477 - protein, 19 aa, Mycobacterium
VHEVDMTRIVALRAKAKAG

SEQ ID NO: 872478 - protein, 19 aa, Mycobacterium
VHEVVAPDDLMPAALRLAR

SEQ ID NO: 872479 - protein, 17 aa, Mycobacterium
VHFAALHHPCCGDLVYG

SEQ ID NO: 872480 - protein, 19 aa, Mycobacterium
VHFAFVSNSSPWTYANTRP

SEQ ID NO: 872481 - protein, 17 aa, Mycobacterium
VHFDAPAGMLIPDSVAT

SEQ ID NO: 872482 - protein, 26 aa, Mycobacterium
VHFGRGVMPLVLLRTKGAKSGVEREV

SEQ ID NO: 872483 - protein, 17 aa, Mycobacterium
VHFHPPRSLWCDGRAGG

SEQ ID NO: 872484 - protein, 27 aa, Mycobacterium
VHFKSVVYELLWFLRGDSNVGWLQQHG

SEQ ID NO: 872485 - protein, 25 aa, Mycobacterium
VHFSQFILAEIFPGGWLPTIPTVEE

SEQ ID NO: 872486 - protein, 24 aa, Mycobacterium
VHFSQFILTEIFPGGWLPTPQTVG

SEQ ID NO: 872487 - protein, 23 aa, Mycobacterium
VHGDLYGTVLFAGAAAPGITDIT

SEQ ID NO: 872488 - protein, 22 aa, Mycobacterium
VHGDLYGTVLFIGTAAPGITDI

SEQ ID NO: 872489 - protein, 23 aa, Mycobacterium
VHGDLYGTVLFVGAAAPGITDIT

SEQ ID NO: 872490 - protein, 20 aa, Mycobacterium
VHGDLYGTVLFVGTAAPGIT

SEQ ID NO: 872491 - protein, 24 aa, Mycobacterium
VHGESSYFVWLNRGKESLTVDLKQ

SEQ ID NO: 872492 - protein, 19 aa, Mycobacterium
VHGFRYFDNRDLLGFVDGT

SEQ ID NO: 872493 - protein, 25 aa, Mycobacterium
VHGGVLPLLFDSMFGMVIHATGRPI

SEQ ID NO: 872494 - protein, 25 aa, Mycobacterium
VHGHRTQLELGGKAPFVVFDDADMD

SEQ ID NO: 872495 - protein, 26 aa, Mycobacterium
VHGHRTQLELGGKAPFVVFSDADLDA

SEQ ID NO: 872496 - protein, 32 aa, Mycobacterium
VHGHVQGVGFRWWTRCRALELGLTGYAANHAD

SEQ ID NO: 872497 - protein, 29 aa, Mycobacterium
VHGIAAQLPDWFRADDFFPVPCCFPTCRS

SEQ ID NO: 872498 - protein, 17 aa, Mycobacterium
VHGLEYQRLGLPAPDWQ

SEQ ID NO: 872499 - protein, 28 aa, Mycobacterium
VHGQVQGVGFRWWTRSRALELVLTGFAA

SEQ ID NO: 872500 - protein, 37 aa, Mycobacterium
VHGSYRQRPQLDWQRLARIVEELPVAVSLHGTSGLPA

SEQ ID NO: 872501 - protein, 25 aa, Mycobacterium
VHGTLLDRHRPLWEAYLIEGMADGR

SEQ ID NO: 872502 - protein, 23 aa, Mycobacterium
VHGYMMGGQLWRQVSERLAARGL

SEQ ID NO: 872503 - protein, 22 aa, Mycobacterium
VHHDFARRLLVLAVVGAIFGTP

SEQ ID NO: 872504 - protein, 26 aa, Mycobacterium
VHHRPSGRRLLIQGSAGFVRGALDGY

SEQ ID NO: 872505 - protein, 20 aa, Mycobacterium
VHHTGQKVPFMLLAGDRDVQ

SEQ ID NO: 872506 - protein, 18 aa, Mycobacterium
VHIFFPSNKDLRGFLREP

SEQ ID NO: 872507 - protein, 19 aa, Mycobacterium
VHIKGVEAAVPAWQLLGVV

SEQ ID NO: 872508 - protein, 17 aa, Mycobacterium
VHILVTSAGLVDFAPFL

SEQ ID NO: 872509 - protein, 26 aa, Mycobacterium
VHIPKLDLRRKFRAIWVGGRTPPAGA

SEQ ID NO: 872510 - protein, 19 aa, Mycobacterium
VHIVSQLVWPGRTVDECLA

SEQ ID NO: 872511 - protein, 23 aa, Mycobacterium
VHKRRYRPQWCRVIDYPFTGRAE

SEQ ID NO: 872512 - protein, 26 aa, Mycobacterium
VHKTVHHYLMRFLGGELSDDDVEVTE

SEQ ID NO: 872513 - protein, 25 aa, Mycobacterium
VHKTVHHYLMRFLGGELSDEDVEVT

SEQ ID NO: 872514 - protein, 19 aa, Mycobacterium
VHKTVHHYLMRSLGGELSD

SEQ ID NO: 872515 - protein, 18 aa, Mycobacterium
VHLDAFNLLPYLTGEVEE

SEQ ID NO: 872516 - protein, 17 aa, Mycobacterium
VHLFLGRGEANTGGADK

SEQ ID NO: 872517 - protein, 19 aa, Mycobacterium
VHLIAKTEFLTPPDVPWTT

SEQ ID NO: 872518 - protein, 17 aa, Mycobacterium
VHLIDRCLQLHGGYGFM

SEQ ID NO: 872519 - protein, 26 aa, Mycobacterium
VHLKGTWNGIRLAAAIMRENKRGAIV

SEQ ID NO: 872520 - protein, 28 aa, Mycobacterium
VHLKSVIYELLWFLRGESNVRWLQERGV

SEQ ID NO: 872521 - protein, 18 aa, Mycobacterium
VHLLVHRQRLAGEQGLVD

SEQ ID NO: 872522 - protein, 26 aa, Mycobacterium
VHLMGTVWMCRAAWPHMRDAGYGRIV

SEQ ID NO: 872523 - protein, 20 aa, Mycobacterium
VHLPRFYPDMPSRFAILPRR

SEQ ID NO: 872524 - protein, 17 aa, Mycobacterium
VHLPYDRPPLSKEVLRK

SEQ ID NO: 872525 - protein, 18 aa, Mycobacterium
VHLPYDRPPLSKEVLRKE

SEQ ID NO: 872526 - protein, 18 aa, Mycobacterium
VHLPYDRPPLSKEVLRSE

SEQ ID NO: 872527 - protein, 22 aa, Mycobacterium
VHLSNILDWLTPDEALITLARA

SEQ ID NO: 872528 - protein, 25 aa, Mycobacterium
VHLTPRAVQYLFRQQLDTTPTEYLR

SEQ ID NO: 872529 - protein, 17 aa, Mycobacterium
VHLTPRAVQYLFRRQLA

SEQ ID NO: 872530 - protein, 17 aa, Mycobacterium
VHLVLATLGCWKIGAVP

SEQ ID NO: 872531 - protein, 24 aa, Mycobacterium
VHMIDGLRIITLDTSVPGYHHGEL

SEQ ID NO: 872532 - protein, 25 aa, Mycobacterium
VHNPEKILYGRLPDYHLSDRGQAQA

SEQ ID NO: 872533 - protein, 27 aa, Mycobacterium
VHNRLLTPLLFDMGSFAGLARPLRNAI

SEQ ID NO: 872534 - protein, 25 aa, Mycobacterium
VHNTQPWRWRVGAPSLDLFSEPDMQ

SEQ ID NO: 872535 - protein, 17 aa, Mycobacterium
VHPFVALRHLRFHSITD

SEQ ID NO: 872536 - protein, 24 aa, Mycobacterium
VHPGDPYPLLRALAERMEFKRPPA

SEQ ID NO: 872537 - protein, 17 aa, Mycobacterium
VHPGVYVRSFYFFDPDG

SEQ ID NO: 872538 - protein, 17 aa, Mycobacterium
VHPHWPVRIARQDVGPH

SEQ ID NO: 872539 - protein, 24 aa, Mycobacterium
VHPIDFRVQRWVEAMPQYGPGHAD

SEQ ID NO: 872540 - protein, 28 aa, Mycobacterium
VHPIEEGKPCWLLGLLFSDENGCEGHSD

SEQ ID NO: 872541 - protein, 21 aa, Mycobacterium
VHPLALASPFFVEFDLAARGV

SEQ ID NO: 872542 - protein, 33 aa, Mycobacterium
VHPLTSVLRRRWLNPEFYLFRHGLRLDEVTAET

SEQ ID NO: 872543 - protein, 22 aa, Mycobacterium
VHPMTLRKWIRQADIDDGAIPG

SEQ ID NO: 872544 - protein, 17 aa, Mycobacterium
VHPNWFDYRDPSGLWQR

SEQ ID NO: 872545 - protein, 25 aa, Mycobacterium
VHPPEGFLLDRRWEHLVPDAPYEVR

SEQ ID NO: 872546 - protein, 19 aa, Mycobacterium
VHPPFRWQRRYAEGFSEQV

SEQ ID NO: 872547 - protein, 24 aa, Mycobacterium
VHPQMQFTRLIGYRSRYVSGYSDS

SEQ ID NO: 872548 - protein, 24 aa, Mycobacterium
VHPRLRRFLRRLPQVDGVAAFTFF

SEQ ID NO: 872549 - protein, 25 aa, Mycobacterium
VHPSLKLWTLKLWVGLPALRGCVSI

SEQ ID NO: 872550 - protein, 18 aa, Mycobacterium
VHPTFTRALHWLRAHLYE

SEQ ID NO: 872551 - protein, 26 aa, Mycobacterium
VHPTTLRLLDDLGLWPRFADISHSRL

SEQ ID NO: 872552 - protein, 27 aa, Mycobacterium
VHQDFEGYVLVFVGRQAALAHPGHQLG

SEQ ID NO: 872553 - protein, 17 aa, Mycobacterium
VHQIPQPIAWPGSSDRN

SEQ ID NO: 872554 - protein, 25 aa, Mycobacterium
VHQLEYERFGLPHPDWQVFLDVSPE

SEQ ID NO: 872555 - protein, 30 aa, Mycobacterium
VHQLGDLPVTLHALVFNLKGAQRAIASGCR

SEQ ID NO: 872556 - protein, 18 aa, Mycobacterium
VHQMGPAQAHRLLERSFA

SEQ ID NO: 872557 - protein, 23 aa, Mycobacterium
VHQTVEFIKSRDLVLDTPVTLAP

SEQ ID NO: 872558 - protein, 19 aa, Mycobacterium
VHRARFGNVYVPAAGPVVV

SEQ ID NO: 872559 - protein, 33 aa, Mycobacterium
VHRARGLSWAAFRLLFVTWLAGPLEPKKAAELA

SEQ ID NO: 872560 - protein, 26 aa, Mycobacterium
VHRATGVPLFLFLDPCGANVQYEAIT

SEQ ID NO: 872561 - protein, 25 aa, Mycobacterium
VHRDGGHYYFAVPDGVELPPGPPGA

SEQ ID NO: 872562 - protein, 25 aa, Mycobacterium
VHRDPQLLLNYLGRIELDSADHALL

SEQ ID NO: 872563 - protein, 26 aa, Mycobacterium
VHREDFQIILVDTPGLHRPRTLLGQR

SEQ ID NO: 872564 - protein, 26 aa, Mycobacterium
VHRESFQIILVDTPGLHRPRTLLGKR

SEQ ID NO: 872565 - protein, 19 aa, Mycobacterium
VHRGVALSSFYQCGDLYRI

SEQ ID NO: 872566 - protein, 19 aa, Mycobacterium
VHRGVALTSFYQCGDLYRI

SEQ ID NO: 872567 - protein, 23 aa, Mycobacterium
VHRHLRHYMNWIPAEYVDAMAPM

SEQ ID NO: 872568 - protein, 24 aa, Mycobacterium
VHRHLRRYMNWIPAEYVDAMAPMT

SEQ ID NO: 872569 - protein, 23 aa, Mycobacterium
VHRNVAAAFRRSAARPAVHAVVD

SEQ ID NO: 872570 - protein, 19 aa, Mycobacterium
VHRRASPPMLGFGGGLHYC

SEQ ID NO: 872571 - protein, 24 aa, Mycobacterium
VHRSELLVLLGLSGSGKSTLLRCL

SEQ ID NO: 872572 - protein, 26 aa, Mycobacterium
VHRTIAYRLLLTLTQFRLVAKGEDGR

SEQ ID NO: 872573 - protein, 23 aa, Mycobacterium
VHRVFYEYVSIVGSPAYVLPVVT

SEQ ID NO: 872574 - protein, 24 aa, Mycobacterium
VHRVPARMFPKVTTLPLGVPTPRI

SEQ ID NO: 872575 - protein, 30 aa, Mycobacterium
VHRVPSAMFPKVTSLPLGVPRPRMVGVLRG

SEQ ID NO: 872576 - protein, 24 aa, Mycobacterium
VHRVPSRMFPKVTTLPLGVPTPRM

SEQ ID NO: 872577 - protein, 23 aa, Mycobacterium
VHRWRSIPYARPPVGPLRFRAPQ

SEQ ID NO: 872578 - protein, 24 aa, Mycobacterium
VHSAAWVNFVYPYQHLKATNVEST

SEQ ID NO: 872579 - protein, 18 aa, Mycobacterium
VHSALSLPLIVDDDVIGA

SEQ ID NO: 872580 - protein, 27 aa, Mycobacterium
VHSCAADLPWKALLRSNIHAISVDVST

SEQ ID NO: 872581 - protein, 19 aa, Mycobacterium
VHSFEPLARGLAAAAGAVV

SEQ ID NO: 872582 - protein, 22 aa, Mycobacterium
VHSLHGYFLRPGDARAPAIYTV

SEQ ID NO: 872583 - protein, 20 aa, Mycobacterium
VHSSPIPLVISPRGARYQKN

SEQ ID NO: 872584 - protein, 26 aa, Mycobacterium
VHSTTLYYPLVATPMIAPTKAYEGMP

SEQ ID NO: 872585 - protein, 25 aa, Mycobacterium
VHSTTLYYPLVATPMIAPTKAYSGM

SEQ ID NO: 872586 - protein, 26 aa, Mycobacterium
VHSTTLYYPLVSTPMIAPTKAYEGMP

SEQ ID NO: 872587 - protein, 25 aa, Mycobacterium
VHSVPEHTFDIEPRPDQAFEFSVDV

SEQ ID NO: 872588 - protein, 18 aa, Mycobacterium
VHSWGYWDAQLSAMKPDM

SEQ ID NO: 872589 - protein, 29 aa, Mycobacterium
VHSYKDLPTAADPRFVIPAIPPREDYRDA

SEQ ID NO: 872590 - protein, 24 aa, Mycobacterium
VHSYKDLPTAVDPRFMIAATPVRE

SEQ ID NO: 872591 - protein, 19 aa, Mycobacterium
VHTAAVPVAIAPRGYPLQD

SEQ ID NO: 872592 - protein, 20 aa, Mycobacterium
VHTGAPLPTLADAVIPLRWT

SEQ ID NO: 872593 - protein, 20 aa, Mycobacterium
VHTGYPMDSVWRGALPADNG

SEQ ID NO: 872594 - protein, 24 aa, Mycobacterium
VHTIARVGPLSGDPYRLAGELGMP

SEQ ID NO: 872595 - protein, 20 aa, Mycobacterium
VHTKAWKAMFDAYLSDRAQR

SEQ ID NO: 872596 - protein, 29 aa, Mycobacterium
VHTKSIVYELLWFLRGDSNVRWLQERGVT

SEQ ID NO: 872597 - protein, 29 aa, Mycobacterium
VHTKSVIYELLWFLRGDSNVRWLQEHGVT

SEQ ID NO: 872598 - protein, 20 aa, Mycobacterium
VHTLLDFHFHPHLQAPNGTQ

SEQ ID NO: 872599 - protein, 19 aa, Mycobacterium
VHTNFGRGNRFGLFVMIEG

SEQ ID NO: 872600 - protein, 25 aa, Mycobacterium
VHTTMRYVYYIGETYRIAFEGTWAA

SEQ ID NO: 872601 - protein, 21 aa, Mycobacterium
VHTWDLITALARPIVRDESGA

SEQ ID NO: 872602 - protein, 22 aa, Mycobacterium
VHVAGLRRRRPPVLGELGAHGR

SEQ ID NO: 872603 - protein, 18 aa, Mycobacterium
VHVALWQAGELVAGAVAL

SEQ ID NO: 872604 - protein, 19 aa, Mycobacterium
VHVALWQRTTNGRPQITDA

SEQ ID NO: 872605 - protein, 23 aa, Mycobacterium
VHVAVENMFPLRADRLFGAGQTS

SEQ ID NO: 872606 - protein, 28 aa, Mycobacterium
VHVDLRMDNFYPLTDFFPPQGSMTEDFA

SEQ ID NO: 872607 - protein, 23 aa, Mycobacterium
VHVEPLLLSIYDVDRNAFRLIPG

SEQ ID NO: 872608 - protein, 24 aa, Mycobacterium
VHVFHYQHHIEAVWLTAGTGTLTN

SEQ ID NO: 872609 - protein, 19 aa, Mycobacterium
VHVHLGLYGAFTEWERPAA

SEQ ID NO: 872610 - protein, 19 aa, Mycobacterium
VHVKAPLYGVEFGDGAYGA

SEQ ID NO: 872611 - protein, 17 aa, Mycobacterium
VHVLSCHPLIAFGTDEQ

SEQ ID NO: 872612 - protein, 23 aa, Mycobacterium
VHVNVFEMLPTPYGLVRAGVAPD

SEQ ID NO: 872613 - protein, 23 aa, Mycobacterium
VHVQKYLHNMAAWSALPVDEQEK

SEQ ID NO: 872614 - protein, 20 aa, Mycobacterium
VHVQLAEWYRLRGLSGPAGR

SEQ ID NO: 872615 - protein, 17 aa, Mycobacterium
VHVRIASPPVRWPCFYG

SEQ ID NO: 872616 - protein, 31 aa, Mycobacterium
VHVRIASPPVRWPCFYGIDFASPAELIANAV

SEQ ID NO: 872617 - protein, 18 aa, Mycobacterium
VHVRWDAVDMWLEEGRRL

SEQ ID NO: 872618 - protein, 17 aa, Mycobacterium
VHVTFRRLRREDVLGGR

SEQ ID NO: 872619 - protein, 24 aa, Mycobacterium
VHVTGPYDYLLHIRVRDTADLDRL

SEQ ID NO: 872620 - protein, 26 aa, Mycobacterium
VHVTRIPLVIVLFKDIEIGKNATLTL

SEQ ID NO: 872621 - protein, 24 aa, Mycobacterium
VHVTRPSRFFVMDAPVFAQFMRDQ

SEQ ID NO: 872622 - protein, 27 aa, Mycobacterium
VHVVRKTLAPIFGLEPEQMRVVAPHVG

SEQ ID NO: 872623 - protein, 40 aa, Mycobacterium
VHVYLAYAGTIDSPLWRDGLWLRLALPRALAGADPAAPPS

SEQ ID NO: 872624 - protein, 27 aa, Mycobacterium
VHWDDFFRPLSKPMRAFPYAADDLDMS

SEQ ID NO: 872625 - protein, 17 aa, Mycobacterium
VHWGLEYLFGVLEYDRS

SEQ ID NO: 872626 - protein, 17 aa, Mycobacterium
VHWVSGPVSRGFAAAFN

SEQ ID NO: 872627 - protein, 23 aa, Mycobacterium
VHYGPYFPGVPDDLPYVWPRSDR

SEQ ID NO: 872628 - protein, 18 aa, Mycobacterium
VHYMLPVHAYHRYHLPVA

SEQ ID NO: 872629 - protein, 34 aa, Mycobacterium
VHYRPRAVVGIIAPWNYPVANAMMDAIGALAAGC

SEQ ID NO: 872630 - protein, 17 aa, Mycobacterium
VHYSTVPVLVVPNPLLA

SEQ ID NO: 872631 - protein, 20 aa, Mycobacterium
VHYVDIPLPGPRLPHDMAFT

SEQ ID NO: 872632 - protein, 20 aa, Mycobacterium
VIAAAERRIMLAAARSLPED

SEQ ID NO: 872633 - protein, 18 aa, Mycobacterium
VIAAGARRIVVVRAITAA

SEQ ID NO: 872634 - protein, 17 aa, Mycobacterium
VIAALPLARMATREDVA

SEQ ID NO: 872635 - protein, 30 aa, Mycobacterium
VIAANRAQLMMLIATNFFGQNLPAIAATEA

SEQ ID NO: 872636 - protein, 17 aa, Mycobacterium
VIAAVDPQWRRGATQGH

SEQ ID NO: 872637 - protein, 18 aa, Mycobacterium
VIAAYPERSRVLVEGVNR

SEQ ID NO: 872638 - protein, 20 aa, Mycobacterium
VIACVRYQIRHGARLIKVSA

SEQ ID NO: 872639 - protein, 24 aa, Mycobacterium
VIADGFFAFLTKEQIIATLRAITD

SEQ ID NO: 872640 - protein, 24 aa, Mycobacterium
VIADRTQRPPPFPEDIWIPERDPG

SEQ ID NO: 872641 - protein, 19 aa, Mycobacterium
VIADRTRRPPPFPEDIWIP

SEQ ID NO: 872642 - protein, 25 aa, Mycobacterium
VIADVSLSVRPVTAFTLRLAQAMHR

SEQ ID NO: 872643 - protein, 35 aa, Mycobacterium
VIAFQLPNWMEAAAAFWATSFLGAVTVPIVHFYGR

SEQ ID NO: 872644 - protein, 19 aa, Mycobacterium
VIAFRRVPIVNGVDLQITQ

SEQ ID NO: 872645 - protein, 19 aa, Mycobacterium
VIAGAALWLPPDGARTVRG

SEQ ID NO: 872646 - protein, 25 aa, Mycobacterium
VIAGATLTLIPRFDPRKALEVIERD

SEQ ID NO: 872647 - protein, 17 aa, Mycobacterium
VIAGKDKGAKGKVIAAY

SEQ ID NO: 872648 - protein, 17 aa, Mycobacterium
VIAGKDKGAKGKVLQAY

SEQ ID NO: 872649 - protein, 26 aa, Mycobacterium
VIAGLLAPLRIDYTLNYRRGVPPVIN

SEQ ID NO: 872650 - protein, 19 aa, Mycobacterium
VIAGRQLAPRNPLYGSFPA

SEQ ID NO: 872651 - protein, 20 aa, Mycobacterium
VIAILGAFKAGAAYVPVDPA

SEQ ID NO: 872652 - protein, 29 aa, Mycobacterium
VIAIPPQADWLDPMIALSFAAAASSRITV

SEQ ID NO: 872653 - protein, 19 aa, Mycobacterium
VIAKILQVGRIAGGGTAAV

SEQ ID NO: 872654 - protein, 21 aa, Mycobacterium
VIALALVKRGLPVDTALTTGG

SEQ ID NO: 872655 - protein, 17 aa, Mycobacterium
VIALAYADGVLFVAENP

SEQ ID NO: 872656 - protein, 19 aa, Mycobacterium
VIALLLPRSDHAILAILAI

SEQ ID NO: 872657 - protein, 25 aa, Mycobacterium
VIALSVVVPPRVLPLLQSREVDRPA

SEQ ID NO: 872658 - protein, 17 aa, Mycobacterium
VIALVRDPAAAARYAAN

SEQ ID NO: 872659 - protein, 18 aa, Mycobacterium
VIAMLKQADVDVALQFVN

SEQ ID NO: 872660 - protein, 19 aa, Mycobacterium
VIANYTAFLNLNRALAKGG

SEQ ID NO: 872661 - protein, 18 aa, Mycobacterium
VIAPDKPWFSYVCPGAGH

SEQ ID NO: 872662 - protein, 25 aa, Mycobacterium
VIARDSLVKTALFGSDPNWGRVLAA

SEQ ID NO: 872663 - protein, 25 aa, Mycobacterium
VIARLGARHLFIKPHCPWQNGKVER

SEQ ID NO: 872664 - protein, 20 aa, Mycobacterium
VIARLPFVPSSLEWLHAGRT

SEQ ID NO: 872665 - protein, 19 aa, Mycobacterium
VIASLRLDSTAWTRLRAEA

SEQ ID NO: 872666 - protein, 18 aa, Mycobacterium
VIASLTSGPWIGPSSLAM

SEQ ID NO: 872667 - protein, 17 aa, Mycobacterium
VIASNRALLAALIATNW

SEQ ID NO: 872668 - protein, 18 aa, Mycobacterium
VIASTFLGLVPSPASPEL

SEQ ID NO: 872669 - protein, 18 aa, Mycobacterium
VIASTFLGLVPSPATPEL

SEQ ID NO: 872670 - protein, 32 aa, Mycobacterium
VIATALGLLRQRGVLVLVGLGAQPGPIDLNDL

SEQ ID NO: 872671 - protein, 25 aa, Mycobacterium
VIATMPTVAPGRTRERRRVRTLATV

SEQ ID NO: 872672 - protein, 25 aa, Mycobacterium
VIATMPTVTPGRTRERRRVRTLATV

SEQ ID NO: 872673 - protein, 18 aa, Mycobacterium
VIAVGRIHDPARAERILA

SEQ ID NO: 872674 - protein, 28 aa, Mycobacterium
VIAVHLRGHFLLTRNAATYWRSKAKEGD

SEQ ID NO: 872675 - protein, 17 aa, Mycobacterium
VIAVRTSPERHQGLSLL

SEQ ID NO: 872676 - protein, 25 aa, Mycobacterium
VIAVSDWMRAVPEQIRPWVPGTFVT

SEQ ID NO: 872677 - protein, 25 aa, Mycobacterium
VIAVSDWMRAVPEQIRPWVPGTYVT

SEQ ID NO: 872678 - protein, 28 aa, Mycobacterium
VIAVTHDRWFARTFTRFLIFGEDGKVRE

SEQ ID NO: 872679 - protein, 24 aa, Mycobacterium
VIAYARKFLDEAVPLESGSWADAT

SEQ ID NO: 872680 - protein, 17 aa, Mycobacterium
VIAYRNKAYSRMGELLR

SEQ ID NO: 872681 - protein, 21 aa, Mycobacterium
VICEQQFLPQVRSAVGLGGKV

SEQ ID NO: 872682 - protein, 18 aa, Mycobacterium
VICSGFHHGLQLIAQALT

SEQ ID NO: 872683 - protein, 31 aa, Mycobacterium
VIDALCDPPESFQLYGIVAHVLTYSAHRREL

SEQ ID NO: 872684 - protein, 22 aa, Mycobacterium
VIDAMFAHHIDELLRLASADEA

SEQ ID NO: 872685 - protein, 24 aa, Mycobacterium
VIDDVCIAVQRWGKLSPNRDNVVV

SEQ ID NO: 872686 - protein, 25 aa, Mycobacterium
VIDFDDCGWSWFMADLGAVVSWVED

SEQ ID NO: 872687 - protein, 18 aa, Mycobacterium
VIDGAWWPRSGQIASELP

SEQ ID NO: 872688 - protein, 17 aa, Mycobacterium
VIDGRRWRATDPAIPEQ

SEQ ID NO: 872689 - protein, 17 aa, Mycobacterium
VIDGVRRGFDVANYGDT

SEQ ID NO: 872690 - protein, 17 aa, Mycobacterium
VIDGWSLPILLQEIFAS

SEQ ID NO: 872691 - protein, 26 aa, Mycobacterium
VIDGWSLPILLQEIFSIYYGHQLPAP

SEQ ID NO: 872692 - protein, 31 aa, Mycobacterium
VIDGWSLPVLLQEIFAAYFDQSLPSAAPYRN

SEQ ID NO: 872693 - protein, 20 aa, Mycobacterium
VIDIPGFGPLPFGHSRFDSG

SEQ ID NO: 872694 - protein, 17 aa, Mycobacterium
VIDLAVGLPARPGLVRD

SEQ ID NO: 872695 - protein, 19 aa, Mycobacterium
VIDLHKGLPPRAGIVTDRG

SEQ ID NO: 872696 - protein, 17 aa, Mycobacterium
VIDLIKSIRDRGIPVVL

SEQ ID NO: 872697 - protein, 18 aa, Mycobacterium
VIDLRRRLYHETDNYRMI

SEQ ID NO: 872698 - protein, 25 aa, Mycobacterium
VIDLVPPVVIGWVMGVYTGLQLSRF

SEQ ID NO: 872699 - protein, 17 aa, Mycobacterium
VIDPACWTPYPDTATVL

SEQ ID NO: 872700 - protein, 28 aa, Mycobacterium
VIDPANQVEFFFLRPKDIAIYVGSGELD

SEQ ID NO: 872701 - protein, 19 aa, Mycobacterium
VIDPLDWVELFGADALRFT

SEQ ID NO: 872702 - protein, 26 aa, Mycobacterium
VIDPLPNLLFTRDSSFWIGPRVAITS

SEQ ID NO: 872703 - protein, 23 aa, Mycobacterium
VIDPTNPYILGPQLLCAATELPL

SEQ ID NO: 872704 - protein, 28 aa, Mycobacterium
VIDPVNQVEFFFLRPKDIAIYVGSGQLD

SEQ ID NO: 872705 - protein, 23 aa, Mycobacterium
VIDPYHRVYGYPTMYVVDGASIS

SEQ ID NO: 872706 - protein, 18 aa, Mycobacterium
VIDPYQRIYGHPGLHICD

SEQ ID NO: 872707 - protein, 20 aa, Mycobacterium
VIDRAPLWCAVDLRDGNQAL

SEQ ID NO: 872708 - protein, 25 aa, Mycobacterium
VIDRREGYFLWDMSGRRLIDLHLNG

SEQ ID NO: 872709 - protein, 25 aa, Mycobacterium
VIDRRQDYFLWDMTGRRLIDMHLNG

SEQ ID NO: 872710 - protein, 25 aa, Mycobacterium
VIDSALDGVLFLDEAYALVSTGAKN

SEQ ID NO: 872711 - protein, 17 aa, Mycobacterium
VIDTLVLATGFDLWEAN

SEQ ID NO: 872712 - protein, 18 aa, Mycobacterium
VIDTVEGLAWIAQQAALE

SEQ ID NO: 872713 - protein, 17 aa, Mycobacterium
VIDTWFTSGLRGTGSMD

SEQ ID NO: 872714 - protein, 24 aa, Mycobacterium
VIDVMANAAFYYGALRSLSEDDRP

SEQ ID NO: 872715 - protein, 28 aa, Mycobacterium
VIDYRRDRWWRDLPPYDLVLDALGGTSL

SEQ ID NO: 872716 - protein, 17 aa, Mycobacterium
VIEDLWPGQGPLVAMGQ

SEQ ID NO: 872717 - protein, 25 aa, Mycobacterium
VIEDSPDLPPLWRAFGASRRGDGHW

SEQ ID NO: 872718 - protein, 17 aa, Mycobacterium
VIEFKTSTLAGIGAEPT

SEQ ID NO: 872719 - protein, 23 aa, Mycobacterium
VIEGMMALTGYYAWHRICVDRHI

SEQ ID NO: 872720 - protein, 31 aa, Mycobacterium
VIELGDWVRPVLLDGLAVLLLEPPRGRDGGG

SEQ ID NO: 872721 - protein, 18 aa, Mycobacterium
VIELLADPAIRIISLTIT

SEQ ID NO: 872722 - protein, 19 aa, Mycobacterium
VIELLHTIHLPVVCGVQGW

SEQ ID NO: 872723 - protein, 24 aa, Mycobacterium
VIELRPDMDWDKGKTLRWVIDHLR

SEQ ID NO: 872724 - protein, 26 aa, Mycobacterium
VIEMEHGYLLLMRVGDGSHLATLTAR

SEQ ID NO: 872725 - protein, 26 aa, Mycobacterium
VIENGALLLHYLPEIDMRTGDILAME

SEQ ID NO: 872726 - protein, 25 aa, Mycobacterium
VIEPLDIDAYREFLTEIGYLLPEPA

SEQ ID NO: 872727 - protein, 37 aa, Mycobacterium
VIEPLPNLLFTRDSSFWIGRKFAITTLALPARVRETS

SEQ ID NO: 872728 - protein, 24 aa, Mycobacterium
VIERFEHVWTCLGDPVFDLPNPPE

SEQ ID NO: 872729 - protein, 17 aa, Mycobacterium
VIERPIFVTGLVRTGTT

SEQ ID NO: 872730 - protein, 20 aa, Mycobacterium
VIERSIIGFGARIGPRALVR

SEQ ID NO: 872731 - protein, 28 aa, Mycobacterium
VIETIFTHPINYWREHGIAVTLSDMKFT

SEQ ID NO: 872732 - protein, 21 aa, Mycobacterium
VIEVAPLAYMRGRTINDAFII

SEQ ID NO: 872733 - protein, 17 aa, Mycobacterium
VIFAFIPACGKCPPCMR

SEQ ID NO: 872734 - protein, 20 aa, Mycobacterium
VIFAGPLHIAFWVCGVSELS

SEQ ID NO: 872735 - protein, 18 aa, Mycobacterium
VIFGAYGFDLRDGTRHTI

SEQ ID NO: 872736 - protein, 19 aa, Mycobacterium
VIFIVVKFTAKPEYAETFP

SEQ ID NO: 872737 - protein, 18 aa, Mycobacterium
VIFMTDHGPALPRAKSTL

SEQ ID NO: 872738 - protein, 23 aa, Mycobacterium
VIFPNTVPPFFPHGSLAAPPPET

SEQ ID NO: 872739 - protein, 17 aa, Mycobacterium
VIFVPTGQPWQKQGRKV

SEQ ID NO: 872740 - protein, 60 aa, Mycobacterium
VIGAESDALLVQPAHTLSQAWITSPLGQVVDPVINAPFEAAIGRDLIGNGAPGVAGVNGG

SEQ ID NO: 872741 - protein, 19 aa, Mycobacterium
VIGAFAAWTPVHRTLDDTD

SEQ ID NO: 872742 - protein, 18 aa, Mycobacterium
VIGAFPMAERRRLFAELQ

SEQ ID NO: 872743 - protein, 21 aa, Mycobacterium
VIGAFPMAERRRLFAEMQPLV

SEQ ID NO: 872744 - protein, 20 aa, Mycobacterium
VIGAFPMARRRALLAELQPL

SEQ ID NO: 872745 - protein, 19 aa, Mycobacterium
VIGAGFAGLYALHRLKRSG

SEQ ID NO: 872746 - protein, 18 aa, Mycobacterium
VIGALDHHRQLFGAVAGE

SEQ ID NO: 872747 - protein, 17 aa, Mycobacterium
VIGAVLVPGAKAPKLVT

SEQ ID NO: 872748 - protein, 42 aa, Mycobacterium
VIGDGFWRLIGELDALRLDWSRPMWMSYLIDGLDGGRFAFYI

SEQ ID NO: 872749 - protein, 17 aa, Mycobacterium
VIGDRWAQLAVDHADQL

SEQ ID NO: 872750 - protein, 17 aa, Mycobacterium
VIGFLHADRLYSGRIVD

SEQ ID NO: 872751 - protein, 26 aa, Mycobacterium
VIGGGEIYRLFLPLAQRCEVTVVEAD

SEQ ID NO: 872752 - protein, 17 aa, Mycobacterium
VIGGGQVYLAALPYATR

SEQ ID NO: 872753 - protein, 17 aa, Mycobacterium
VIGGQILYRSAALVRPT

SEQ ID NO: 872754 - protein, 18 aa, Mycobacterium
VIGHLQWDREALVALIAR

SEQ ID NO: 872755 - protein, 23 aa, Mycobacterium
VIGKHRHWPTFDDLLAAAPAVDP

SEQ ID NO: 872756 - protein, 18 aa, Mycobacterium
VIGLMRAFAVELGPHMIR

SEQ ID NO: 872757 - protein, 17 aa, Mycobacterium
VIGLMRTFAVELGQHSI

SEQ ID NO: 872758 - protein, 20 aa, Mycobacterium
VIGLPEVTLGLLPGGGGVAR

SEQ ID NO: 872759 - protein, 17 aa, Mycobacterium
VIGLPPLLHMDDEELIR

SEQ ID NO: 872760 - protein, 21 aa, Mycobacterium
VIGLQWLHWDPTLLGGPIVCA

SEQ ID NO: 872761 - protein, 27 aa, Mycobacterium
VIGLSLPLLRSLLPRVGLSVATLWARD

SEQ ID NO: 872762 - protein, 26 aa, Mycobacterium
VIGLVALLRERAAPAVAPWIHRGLTS

SEQ ID NO: 872763 - protein, 18 aa, Mycobacterium
VIGLYPHWDISEDGIAAA

SEQ ID NO: 872764 - protein, 27 aa, Mycobacterium
VIGPDGVPRWLALDGTPLHHATVAASE

SEQ ID NO: 872765 - protein, 23 aa, Mycobacterium
VIGQAICRRLLQSDYVPVAADLK

SEQ ID NO: 872766 - protein, 31 aa, Mycobacterium
VIGQVAPWNYPMMMAIWKICPAVAAGNTVVI

SEQ ID NO: 872767 - protein, 18 aa, Mycobacterium
VIGSPPFVLVNNAQRIPL

SEQ ID NO: 872768 - protein, 23 aa, Mycobacterium
VIGSRPDGWWKDREGAMVALVER

SEQ ID NO: 872769 - protein, 28 aa, Mycobacterium
VIGTKELIAWLPTLLGLGADDLIVIPEL

SEQ ID NO: 872770 - protein, 21 aa, Mycobacterium
VIGTRSAVFAPLSDLGLVMVW

SEQ ID NO: 872771 - protein, 22 aa, Mycobacterium
VIGTRSAVFAPLSDLGLVMVWA

SEQ ID NO: 872772 - protein, 22 aa, Mycobacterium
VIGVAVMGLLDRAWHTVHRQTV

SEQ ID NO: 872773 - protein, 19 aa, Mycobacterium
VIGVMRHFARSLAEKNIRV

SEQ ID NO: 872774 - protein, 21 aa, Mycobacterium
VIGVQVALPDGSLLRRHSRVR

SEQ ID NO: 872775 - protein, 17 aa, Mycobacterium
VIGVSMSSFLFAVPDEL

SEQ ID NO: 872776 - protein, 26 aa, Mycobacterium
VIGVSPAFGTKLFRTLSGMTIYDVLE

SEQ ID NO: 872777 - protein, 26 aa, Mycobacterium
VIGWALDGDRLPLRGTVLMVSGRASF

SEQ ID NO: 872778 - protein, 19 aa, Mycobacterium
VIGWLLSGPEHTYHVPLPE

SEQ ID NO: 872779 - protein, 17 aa, Mycobacterium
VIGYGPIELDPSAIVLH

SEQ ID NO: 872780 - protein, 17 aa, Mycobacterium
VIGYVEAAFELAAQLRD

SEQ ID NO: 872781 - protein, 24 aa, Mycobacterium
VIHDRLLRVLAYSRLQQHADPARV

SEQ ID NO: 872782 - protein, 19 aa, Mycobacterium
VIHGALYRHPKLKVAIVEA

SEQ ID NO: 872783 - protein, 20 aa, Mycobacterium
VIHGALYRHPKLKVAIVEAG

SEQ ID NO: 872784 - protein, 18 aa, Mycobacterium
VIHNHSLHYLPVAMASAL

SEQ ID NO: 872785 - protein, 29 aa, Mycobacterium
VIHPKYGNFILLGTILVGAPITSYGEPLD

SEQ ID NO: 872786 - protein, 18 aa, Mycobacterium
VIHSALLPALVGASRTTW

SEQ ID NO: 872787 - protein, 20 aa, Mycobacterium
VIIGGGIVPAPLLAELIARG

SEQ ID NO: 872788 - protein, 17 aa, Mycobacterium
VIIMLGTNDTKAYFRRT

SEQ ID NO: 872789 - protein, 22 aa, Mycobacterium
VIINAGLVFEGYLRKKAFADIA

SEQ ID NO: 872790 - protein, 28 aa, Mycobacterium
VIIPEGADPFVFLFSESSGRVLVAVPRT

SEQ ID NO: 872791 - protein, 19 aa, Mycobacterium
VIIPGRLERVRSAPAVFLD

SEQ ID NO: 872792 - protein, 23 aa, Mycobacterium
VIITRWVSTFTPDAPPLPIIGPP

SEQ ID NO: 872793 - protein, 18 aa, Mycobacterium
VIKALRRIRQQYSDLMVR

SEQ ID NO: 872794 - protein, 21 aa, Mycobacterium
VIKDLQIVVLWEMWLEAARQA

SEQ ID NO: 872795 - protein, 17 aa, Mycobacterium
VIKLLPPLTTSTEDLDA

SEQ ID NO: 872796 - protein, 20 aa, Mycobacterium
VIKLMGYAHGFMNPEYIHLT

SEQ ID NO: 872797 - protein, 20 aa, Mycobacterium
VIKPGWGFSFDYQPGQYIGI

SEQ ID NO: 872798 - protein, 28 aa, Mycobacterium
VILAAGLDARSWRLAWPAGTTVYELDQP

SEQ ID NO: 872799 - protein, 20 aa, Mycobacterium
VILAARNPEALAETARWIAS

SEQ ID NO: 872800 - protein, 18 aa, Mycobacterium
VILAIPAPRLVPLVEEIA

SEQ ID NO: 872801 - protein, 18 aa, Mycobacterium
VILAMGAAPRYLGVPGED

SEQ ID NO: 872802 - protein, 36 aa, Mycobacterium
VILAPQGLEYILAFLGSMQAGMIAVPLPLPHRGSNH

SEQ ID NO: 872803 - protein, 22 aa, Mycobacterium
VILAPQGLPYIEAFLGAMQAGL

SEQ ID NO: 872804 - protein, 18 aa, Mycobacterium
VILDLIEADPRAAVDPTG

SEQ ID NO: 872805 - protein, 18 aa, Mycobacterium
VILDLRGLKFIGTAGFSA

SEQ ID NO: 872806 - protein, 18 aa, Mycobacterium
VILDRKGNRHFSFGIGVH

SEQ ID NO: 872807 - protein, 17 aa, Mycobacterium
VILEKFDAALALDVIER

SEQ ID NO: 872808 - protein, 25 aa, Mycobacterium
VILFYAKDGLAVLAPLPGDIFRVVA

SEQ ID NO: 872809 - protein, 25 aa, Mycobacterium
VILGEVPPIRRSWVGGRPIVADGQM

SEQ ID NO: 872810 - protein, 19 aa, Mycobacterium
VILIEPYYDSYAAVVAMAG

SEQ ID NO: 872811 - protein, 25 aa, Mycobacterium
VILKRASLRPIQRVLRGPLGPVAAR

SEQ ID NO: 872812 - protein, 17 aa, Mycobacterium
VILLDEFAKRFDGFSIG

SEQ ID NO: 872813 - protein, 25 aa, Mycobacterium
VILNGGLPLHPAIDGLVAGLGQRLP

SEQ ID NO: 872814 - protein, 19 aa, Mycobacterium
VILNKIDLLPYVNFDIETC

SEQ ID NO: 872815 - protein, 17 aa, Mycobacterium
VILPRFELDTFLGSIAN

SEQ ID NO: 872816 - protein, 24 aa, Mycobacterium
VILSHAGGFVPFIAERIATCVPIE

SEQ ID NO: 872817 - protein, 19 aa, Mycobacterium
VILSPPAPMLHYATAKAAL

SEQ ID NO: 872818 - protein, 18 aa, Mycobacterium
VILVHRMLKNLVPVPEYV

SEQ ID NO: 872819 - protein, 25 aa, Mycobacterium
VIMARRVTAPPGPFWGPLSSADYCA

SEQ ID NO: 872820 - protein, 17 aa, Mycobacterium
VIMDVKMPRRDGIDAAS

SEQ ID NO: 872821 - protein, 29 aa, Mycobacterium
VIMDYLVHQRRLLPLIAKSYALQFAQNEL

SEQ ID NO: 872822 - protein, 19 aa, Mycobacterium
VIMLGRPTLHRPVSALLAD

SEQ ID NO: 872823 - protein, 27 aa, Mycobacterium
VIMNTDLVYLALNKPFGMLSTMSDDRG

SEQ ID NO: 872824 - protein, 18 aa, Mycobacterium
VIMPAGSCIFFLGTLWHG

SEQ ID NO: 872825 - protein, 27 aa, Mycobacterium
VIMRAANLLWPLRSPEESWRVIDEALV

SEQ ID NO: 872826 - protein, 17 aa, Mycobacterium
VINDRWAQLQLPKVPGV

SEQ ID NO: 872827 - protein, 17 aa, Mycobacterium
VINFQANWNNSVTPWYG

SEQ ID NO: 872828 - protein, 25 aa, Mycobacterium
VINGEKWFSSFAQLASFLIVMAVTD

SEQ ID NO: 872829 - protein, 20 aa, Mycobacterium
VINGRKWWTSGASDPRCKIL

SEQ ID NO: 872830 - protein, 20 aa, Mycobacterium
VINHPEACILGMGAIKARPV

SEQ ID NO: 872831 - protein, 18 aa, Mycobacterium
VINKFYIMDIAPGRSMIE

SEQ ID NO: 872832 - protein, 24 aa, Mycobacterium
VINYRAERWSDVVKLLTPIVNDTD

SEQ ID NO: 872833 - protein, 21 aa, Mycobacterium
VIPADLYRRLSTDLSANGCKV

SEQ ID NO: 872834 - protein, 34 aa, Mycobacterium
VIPAIHLQYMPLSHVYGLEWLIATLSSGGIGYFA

SEQ ID NO: 872835 - protein, 20 aa, Mycobacterium
VIPANLHYSAENPLLDLAGS

SEQ ID NO: 872836 - protein, 26 aa, Mycobacterium
VIPAQGAVYVLLLKADGLQSDQASLI

SEQ ID NO: 872837 - protein, 24 aa, Mycobacterium
VIPGRNGMLLPVADFEARLGMAVD

SEQ ID NO: 872838 - protein, 18 aa, Mycobacterium
VIPIDLRGDWPTALRAAG

SEQ ID NO: 872839 - protein, 21 aa, Mycobacterium
VIPLPVNCATAPLPTGRRVAE

SEQ ID NO: 872840 - protein, 27 aa, Mycobacterium
VIPNEYLYYYYFNRDAVRRILESPQTR

SEQ ID NO: 872841 - protein, 19 aa, Mycobacterium
VIPNVLLKLTMNERRWRTG

SEQ ID NO: 872842 - protein, 17 aa, Mycobacterium
VIPQISLIMGPAAGGHV

SEQ ID NO: 872843 - protein, 18 aa, Mycobacterium
VIPSDLLRVGDSLYLHAI

SEQ ID NO: 872844 - protein, 19 aa, Mycobacterium
VIPTESALRFIGAATFEAL

SEQ ID NO: 872845 - protein, 17 aa, Mycobacterium
VIQAGLAVLLAKVSATS

SEQ ID NO: 872846 - protein, 17 aa, Mycobacterium
VIQLPIGAENDFEGIID

SEQ ID NO: 872847 - protein, 21 aa, Mycobacterium
VIQMMGVLRAPCRVVYVIDEP

SEQ ID NO: 872848 - protein, 18 aa, Mycobacterium
VIQMWARPRGVAPDALFA

SEQ ID NO: 872849 - protein, 28 aa, Mycobacterium
VIQRELDRYLPFLATTRILIAAVRAGVG

SEQ ID NO: 872850 - protein, 28 aa, Mycobacterium
VIQRELDRYLPFLATTRILMAAVRAGVG

SEQ ID NO: 872851 - protein, 17 aa, Mycobacterium
VIQWATGGVGKAAIECI

SEQ ID NO: 872852 - protein, 25 aa, Mycobacterium
VIQWSDMLPALYDGPLEAGVLFVQC

SEQ ID NO: 872853 - protein, 24 aa, Mycobacterium
VIRALGRPVMIIGASMGGLTGILA

SEQ ID NO: 872854 - protein, 28 aa, Mycobacterium
VIRAMGEHLQLLKGWHPVASVSNGEKRW

SEQ ID NO: 872855 - protein, 23 aa, Mycobacterium
VIRATAAAYPDPALRSLDAIHLA

SEQ ID NO: 872856 - protein, 24 aa, Mycobacterium
VIRDPETFRYSWGPAIAGLDTPTT

SEQ ID NO: 872857 - protein, 26 aa, Mycobacterium
VIREAGAVPSFLGYHGFPASICSSVN

SEQ ID NO: 872858 - protein, 19 aa, Mycobacterium
VIRGRFVLAGVTPAVLAGL

SEQ ID NO: 872859 - protein, 22 aa, Mycobacterium
VIRINPHLAIVPRIASELTVGV

SEQ ID NO: 872860 - protein, 23 aa, Mycobacterium
VIRLLVHQWFGCIQVCLNGGLTV

SEQ ID NO: 872861 - protein, 18 aa, Mycobacterium
VIRRALLALERVEYRILG

SEQ ID NO: 872862 - protein, 22 aa, Mycobacterium
VIRREARLLGALRGQGVPAPEL

SEQ ID NO: 872863 - protein, 34 aa, Mycobacterium
VIRRGDTPLPVRTPLPVQLPEPMVEQLRQAAAAQ

SEQ ID NO: 872864 - protein, 17 aa, Mycobacterium
VIRRLTSLLLAMEHPHP

SEQ ID NO: 872865 - protein, 24 aa, Mycobacterium
VIRRMSRVLPLMRERLERLCTGPD

SEQ ID NO: 872866 - protein, 26 aa, Mycobacterium
VIRTSVPPFTWWRGIRARQLLENYFA

SEQ ID NO: 872867 - protein, 23 aa, Mycobacterium
VIRTTFYQQDLLREAPESFPSAP

SEQ ID NO: 872868 - protein, 17 aa, Mycobacterium
VIRVMPNAPVIVGGGVS

SEQ ID NO: 872869 - protein, 20 aa, Mycobacterium
VIRVPVYRWEPPEDQRPMDR

SEQ ID NO: 872870 - protein, 20 aa, Mycobacterium
VIRVRRLTYTYPKASAAAVR

SEQ ID NO: 872871 - protein, 31 aa, Mycobacterium
VISAIVFEQFPISALTDPLAWYGASDQQQLS

SEQ ID NO: 872872 - protein, 21 aa, Mycobacterium
VISCSRFQPFPGGPLGARSSL

SEQ ID NO: 872873 - protein, 23 aa, Mycobacterium
VISDPFMAAAPLLSGMGMTVLSI

SEQ ID NO: 872874 - protein, 19 aa, Mycobacterium
VISEPTDLVAVRQALQEAG

SEQ ID NO: 872875 - protein, 24 aa, Mycobacterium
VISFDEAFKLVKINPLAAWSDDEV

SEQ ID NO: 872876 - protein, 17 aa, Mycobacterium
VISGKDKGAKGKVLVAY

SEQ ID NO: 872877 - protein, 19 aa, Mycobacterium
VISGLHMLLHQAFAQVEQF

SEQ ID NO: 872878 - protein, 24 aa, Mycobacterium
VISGLPLFPYMDIHVTPLARHPSD

SEQ ID NO: 872879 - protein, 17 aa, Mycobacterium
VISGLVGGPWQGAASVA

SEQ ID NO: 872880 - protein, 25 aa, Mycobacterium
VISGQKRFITNAPVANLFVVFARTR

SEQ ID NO: 872881 - protein, 18 aa, Mycobacterium
VISGRWPDSTKEWAQLLM

SEQ ID NO: 872882 - protein, 18 aa, Mycobacterium
VISHHPFVFARAASTLDN

SEQ ID NO: 872883 - protein, 19 aa, Mycobacterium
VISLQAFRDLFAEATLRPG

SEQ ID NO: 872884 - protein, 17 aa, Mycobacterium
VISLVRDPEAAARYAAN

SEQ ID NO: 872885 - protein, 25 aa, Mycobacterium
VISQLTLKVVPLFTLHRDDELKPLA

SEQ ID NO: 872886 - protein, 27 aa, Mycobacterium
VISRMDTEAPRRLMFERAVGSIDATVG

SEQ ID NO: 872887 - protein, 17 aa, Mycobacterium
VISSPRKRALTTAELAG

SEQ ID NO: 872888 - protein, 18 aa, Mycobacterium
VISTFVFDLLDVDYARDV

SEQ ID NO: 872889 - protein, 17 aa, Mycobacterium
VISYLTVADARAAIGFY

SEQ ID NO: 872890 - protein, 18 aa, Mycobacterium
VITALDDAGLLPAITFVF

SEQ ID NO: 872891 - protein, 22 aa, Mycobacterium
VITALELRLHPVPTHSVAALTG

SEQ ID NO: 872892 - protein, 31 aa, Mycobacterium
VITATPLRPGRWRAYADHRMAMAGAIVGLRV

SEQ ID NO: 872893 - protein, 31 aa, Mycobacterium
VITDELWDLLPGYLIFRSIIPGRPPTRRTVQ

SEQ ID NO: 872894 - protein, 17 aa, Mycobacterium
VITDTMGRAWRTGQTDF

SEQ ID NO: 872895 - protein, 28 aa, Mycobacterium
VITGAVIIDYWGIIKADIGIRDGRIVAI

SEQ ID NO: 872896 - protein, 23 aa, Mycobacterium
VITIEVGGRYRLADAMKAHQDLE

SEQ ID NO: 872897 - protein, 17 aa, Mycobacterium
VITLTRRHFRDLVDVTG

SEQ ID NO: 872898 - protein, 19 aa, Mycobacterium
VITRRMPNPRRTGPAPWKA

SEQ ID NO: 872899 - protein, 23 aa, Mycobacterium
VITTVGPYTRYGLPLVAACAAAG

SEQ ID NO: 872900 - protein, 17 aa, Mycobacterium
VIVCHKFLDPRLDRPIV

SEQ ID NO: 872901 - protein, 18 aa, Mycobacterium
VIVDIDRLRASSASAWTV

SEQ ID NO: 872902 - protein, 18 aa, Mycobacterium
VIVEVIVATAWDCPFDGP

SEQ ID NO: 872903 - protein, 21 aa, Mycobacterium
VIVGFRMPYIKGPDTEPLQTK

SEQ ID NO: 872904 - protein, 22 aa, Mycobacterium
VIVGHCYPSMEAPAIGRVIALD

SEQ ID NO: 872905 - protein, 20 aa, Mycobacterium
VIVIDLVRYDSMFSQDVLGP

SEQ ID NO: 872906 - protein, 17 aa, Mycobacterium
VIVIMPSPKGSATLHAK

SEQ ID NO: 872907 - protein, 17 aa, Mycobacterium
VIVLPGQQLRAVLVADN

SEQ ID NO: 872908 - protein, 32 aa, Mycobacterium
VIVLTCGMFGNIIRLLPPLTIGDELLAEGIDI

SEQ ID NO: 872909 - protein, 18 aa, Mycobacterium
VIVLTCSPGRYDGVANAH

SEQ ID NO: 872910 - protein, 19 aa, Mycobacterium
VIVNLPMGNMVLSHGGTGA

SEQ ID NO: 872911 - protein, 20 aa, Mycobacterium
VIVPVVRKDFKGPSPWIMIS

SEQ ID NO: 872912 - protein, 26 aa, Mycobacterium
VIVREQGHWYSTGADFKRPSPHWWFD

SEQ ID NO: 872913 - protein, 25 aa, Mycobacterium
VIVRSELLTRYLPGTPAGLVDLGAF

SEQ ID NO: 872914 - protein, 19 aa, Mycobacterium
VIVVHRRGKELGIWIIERA

SEQ ID NO: 872915 - protein, 17 aa, Mycobacterium
VIVVMPSPKNSATLHSK

SEQ ID NO: 872916 - protein, 20 aa, Mycobacterium
VIVVNSWYSWMPPELYNLPP

SEQ ID NO: 872917 - protein, 17 aa, Mycobacterium
VIVYLSTPPFGSRGLRA

SEQ ID NO: 872918 - protein, 20 aa, Mycobacterium
VIWEHGRRNFGLRDDGVLAV

SEQ ID NO: 872919 - protein, 20 aa, Mycobacterium
VIWGHGWDESRWPDGRPLTT

SEQ ID NO: 872920 - protein, 19 aa, Mycobacterium
VIYLQSHPMWLAARQRENQ

SEQ ID NO: 872921 - protein, 20 aa, Mycobacterium
VIYVIQLYRHTISPLRLPTC

SEQ ID NO: 872922 - protein, 26 aa, Mycobacterium
VKAADPDVLFLSEAFTRPARLYGLAR

SEQ ID NO: 872923 - protein, 25 aa, Mycobacterium
VKAANFPYRYPWRDVERQLQRMAGL

SEQ ID NO: 872924 - protein, 18 aa, Mycobacterium
VKAELVCKDFGALKVLKG

SEQ ID NO: 872925 - protein, 23 aa, Mycobacterium
VKAFIAAGLWSPKGKSWHITEFT

SEQ ID NO: 872926 - protein, 21 aa, Mycobacterium
VKALLAALRPDALEVSDRLTL

SEQ ID NO: 872927 - protein, 18 aa, Mycobacterium
VKALRKLGVTIVSGPDIL

SEQ ID NO: 872928 - protein, 25 aa, Mycobacterium
VKALYTPWAARAWARAGVDPRKLHN

SEQ ID NO: 872929 - protein, 30 aa, Mycobacterium
VKAMAAIDEFAMPVAPWMFGAAGREHMKQY

SEQ ID NO: 872930 - protein, 24 aa, Mycobacterium
VKAMYPLGPIFHGSGLNITVMSLT

SEQ ID NO: 872931 - protein, 35 aa, Mycobacterium
VKAQVLAEALPWLKQLHGKIIVIKYGGNAMIDDTL

SEQ ID NO: 872932 - protein, 26 aa, Mycobacterium
VKATAPGSWNNFWCVADRNVNGNWKS

SEQ ID NO: 872933 - protein, 18 aa, Mycobacterium
VKAVNLFKLPSSDPFTTV

SEQ ID NO: 872934 - protein, 25 aa, Mycobacterium
VKAVRRGVFPVFVPKMFGGMYRTMS

SEQ ID NO: 872935 - protein, 23 aa, Mycobacterium
VKAYAAGLAAWWTVLEHTGTDWR

SEQ ID NO: 872936 - protein, 25 aa, Mycobacterium
VKDAAAYISGFFNTGSNLSGFFNTG

SEQ ID NO: 872937 - protein, 22 aa, Mycobacterium
VKDFGFFWVTAVTTDGTIVVAN

SEQ ID NO: 872938 - protein, 29 aa, Mycobacterium
VKDGYGRNFLLPRGLAIMASRGAQRQADD

SEQ ID NO: 872939 - protein, 29 aa, Mycobacterium
VKDGYGRNFLLPRGLAIVASRGAQKQADE

SEQ ID NO: 872940 - protein, 32 aa, Mycobacterium
VKDGYGRNYLLPRGLAIVASRGAERQAEEIRR

SEQ ID NO: 872941 - protein, 29 aa, Mycobacterium
VKDGYGRNYLLPRGLAIVASRGAQKQADD

SEQ ID NO: 872942 - protein, 29 aa, Mycobacterium
VKDGYGRNYLLPRGLAIVATRGAERQAND

SEQ ID NO: 872943 - protein, 30 aa, Mycobacterium
VKDGYGRNYLLPRGLAIVATRGAQRQADDI

SEQ ID NO: 872944 - protein, 18 aa, Mycobacterium
VKDIRRIEMLEQLGWIVI

SEQ ID NO: 872945 - protein, 20 aa, Mycobacterium
VKDRPIVLNTPNRVVYSPHD

SEQ ID NO: 872946 - protein, 24 aa, Mycobacterium
VKDVFFYEPIILPEKSSREVQLTL

SEQ ID NO: 872947 - protein, 22 aa, Mycobacterium
VKDVWSNRIVGYSIAERMTSQL

SEQ ID NO: 872948 - protein, 27 aa, Mycobacterium
VKEAQRALDDWFKTTAPRDYNVNLDHW

SEQ ID NO: 872949 - protein, 22 aa, Mycobacterium
VKEAYHRALLIRNKPMPLDQPL

SEQ ID NO: 872950 - protein, 18 aa, Mycobacterium
VKEDVAIRRLLSTGLERA

SEQ ID NO: 872951 - protein, 26 aa, Mycobacterium
VKEFTFDYPSRIIAGLLGLPEEDYPQ

SEQ ID NO: 872952 - protein, 18 aa, Mycobacterium
VKEHCRTPFRQANWDRLA

SEQ ID NO: 872953 - protein, 41 aa, Mycobacterium
VKEPIGVCGLITPWNWPINQIACKVFPALATGCTMVLKPSE

SEQ ID NO: 872954 - protein, 23 aa, Mycobacterium
VKERYLELLPNRVITDAIGASET

SEQ ID NO: 872955 - protein, 18 aa, Mycobacterium
VKETLRIRPLAFAVGRVL

SEQ ID NO: 872956 - protein, 20 aa, Mycobacterium
VKETPWLPGQVQVFIHGEAQ

SEQ ID NO: 872957 - protein, 27 aa, Mycobacterium
VKEVLDTWLYGKDILDILRIGGDALSL

SEQ ID NO: 872958 - protein, 28 aa, Mycobacterium
VKFKDAELLGVPWILVVGRGWANGVVEL

SEQ ID NO: 872959 - protein, 25 aa, Mycobacterium
VKGELNIGKLLAKRARVIGTTLRGR

SEQ ID NO: 872960 - protein, 17 aa, Mycobacterium
VKGFIKGKWDRTDPSYA

SEQ ID NO: 872961 - protein, 17 aa, Mycobacterium
VKGFYRRPLKVSGAEDA

SEQ ID NO: 872962 - protein, 29 aa, Mycobacterium
VKGGLNWDSLPLRLFAGGNAKFWNPADID

SEQ ID NO: 872963 - protein, 19 aa, Mycobacterium
VKGGRLTAYRWSGESTIKA

SEQ ID NO: 872964 - protein, 22 aa, Mycobacterium
VKGMLTGPVTILAWSFVRDDQA

SEQ ID NO: 872965 - protein, 24 aa, Mycobacterium
VKGNIEPCWYFDQKLLGYLETVGG

SEQ ID NO: 872966 - protein, 24 aa, Mycobacterium
VKGPQGEPWPLQDTVRPWDSLNDE

SEQ ID NO: 872967 - protein, 30 aa, Mycobacterium
VKHDVQFFNEFYALDLVLTETPRGPVATGV

SEQ ID NO: 872968 - protein, 29 aa, Mycobacterium
VKHDVQFFNEFYALDLVLTQTPSGPVATG

SEQ ID NO: 872969 - protein, 46 aa, Mycobacterium
VKHLTVFQRTPIWCFPKFDFPLPAALRWAMRIPGGKALQRLLSQAY

SEQ ID NO: 872970 - protein, 23 aa, Mycobacterium
VKHVWDVLRRVLRYALHHGAIVT

SEQ ID NO: 872971 - protein, 27 aa, Mycobacterium
VKIDLQDFILMNKTLAGTIFGSCNPRA

SEQ ID NO: 872972 - protein, 21 aa, Mycobacterium
VKIRGFRIEPCEVGAALSRMA

SEQ ID NO: 872973 - protein, 18 aa, Mycobacterium
VKIVGLMPGLSTPGGPSH

SEQ ID NO: 872974 - protein, 17 aa, Mycobacterium
VKIYNRKALEPAQVVES

SEQ ID NO: 872975 - protein, 27 aa, Mycobacterium
VKKAVAEHGLWYPPDPSSFEICSIGGN

SEQ ID NO: 872976 - protein, 17 aa, Mycobacterium
VKKDDPRNLFWTTGPAS

SEQ ID NO: 872977 - protein, 28 aa, Mycobacterium
VKLEMPPLPVWFAGRDTVLKFLAERAVA

SEQ ID NO: 872978 - protein, 40 aa, Mycobacterium
VKLGQIRAQIDGRFWLHLDRGWRFFAPENLITRLVAVLEA

SEQ ID NO: 872979 - protein, 28 aa, Mycobacterium
VKLGVRSMLSFQLFTFGENLGALNLYAQ

SEQ ID NO: 872980 - protein, 18 aa, Mycobacterium
VKLHPQLTHNASVLAPFA

SEQ ID NO: 872981 - protein, 20 aa, Mycobacterium
VKLMLKWPNLYYSTSAFAPK

SEQ ID NO: 872982 - protein, 26 aa, Mycobacterium
VKLMLTRRHLYAVTGYRPRNRQRLAI

SEQ ID NO: 872983 - protein, 20 aa, Mycobacterium
VKLMRDAWEPVLRNWQEMSA

SEQ ID NO: 872984 - protein, 25 aa, Mycobacterium
VKLPGKIRLLSLAAGDFASAGLELS

SEQ ID NO: 872985 - protein, 18 aa, Mycobacterium
VKLWKQFAPDDYAKALRR

SEQ ID NO: 872986 - protein, 17 aa, Mycobacterium
VKMALQYWRSRGRPGKH

SEQ ID NO: 872987 - protein, 20 aa, Mycobacterium
VKMFQVVPNPAWVARPGQYA

SEQ ID NO: 872988 - protein, 21 aa, Mycobacterium
VKMPKRRTGYRIHASLIEWHA

SEQ ID NO: 872989 - protein, 21 aa, Mycobacterium
VKMTWMRIRRRRWSSDTLPSS

SEQ ID NO: 872990 - protein, 26 aa, Mycobacterium
VKNNLQTVAALLRLQARRTANAEGRE

SEQ ID NO: 872991 - protein, 26 aa, Mycobacterium
VKNNLQTVAALLRLQARRTNNPEGRE

SEQ ID NO: 872992 - protein, 26 aa, Mycobacterium
VKNNLQTVAALLRLQARRTPNDEARE

SEQ ID NO: 872993 - protein, 25 aa, Mycobacterium
VKNNLQTVAALLRLQARRTSNEEAR

SEQ ID NO: 872994 - protein, 26 aa, Mycobacterium
VKNNLQTVAALLRLQARRTTNAEGRE

SEQ ID NO: 872995 - protein, 27 aa, Mycobacterium
VKNYPAYFGFLKSRLRTGGLLLNHCIT

SEQ ID NO: 872996 - protein, 29 aa, Mycobacterium
VKPALVHYYFPTMDELYLDVFRRGAAAYL

SEQ ID NO: 872997 - protein, 20 aa, Mycobacterium
VKPANFLDIGGGASAAVMAA

SEQ ID NO: 872998 - protein, 28 aa, Mycobacterium
VKPFVLAELVARVKALLRRRGSSATFSS

SEQ ID NO: 872999 - protein, 28 aa, Mycobacterium
VKPFVLAELVARVKALLRRRGSTATFSS

SEQ ID NO: 873000 - protein, 24 aa, Mycobacterium
VKPKGALYAFPRLDPEVYDIADDE

SEQ ID NO: 873001 - protein, 20 aa, Mycobacterium
VKPLLLPMTVGVEPYVFHGQ

SEQ ID NO: 873002 - protein, 28 aa, Mycobacterium
VKPNTVRSWWRNGSLPYEVFPELGAKSN

SEQ ID NO: 873003 - protein, 24 aa, Mycobacterium
VKPPEDLRFLIRLARQQGERLGRA

SEQ ID NO: 873004 - protein, 19 aa, Mycobacterium
VKPRGALYAFPRLDPEVYD

SEQ ID NO: 873005 - protein, 23 aa, Mycobacterium
VKPSVMLGLLVYSPLLTRMVTNI

SEQ ID NO: 873006 - protein, 25 aa, Mycobacterium
VKQFTFDYPSRIIAGLLGLPEQDYP

SEQ ID NO: 873007 - protein, 21 aa, Mycobacterium
VKQHSPLLRATLERLYDLPIV

SEQ ID NO: 873008 - protein, 32 aa, Mycobacterium
VKQLTVFQRTPIWCFPKLDVALPAPARWAMRI

SEQ ID NO: 873009 - protein, 22 aa, Mycobacterium
VKQLYGIYDRYIAESLAQIGLP

SEQ ID NO: 873010 - protein, 22 aa, Mycobacterium
VKQRFLPPTASLDIWWCQGFSE

SEQ ID NO: 873011 - protein, 25 aa, Mycobacterium
VKRADLVIGAVLIPGAKAPKLISNS

SEQ ID NO: 873012 - protein, 26 aa, Mycobacterium
VKRADLVIGAVLRPGAKAPSLVSNSL

SEQ ID NO: 873013 - protein, 21 aa, Mycobacterium
VKRCRIALGRLRHKEQRAGQR

SEQ ID NO: 873014 - protein, 22 aa, Mycobacterium
VKRPNFLVIVADDLGFSDIGAF

SEQ ID NO: 873015 - protein, 22 aa, Mycobacterium
VKRRDRALLSKDATIREIHHRV

SEQ ID NO: 873016 - protein, 23 aa, Mycobacterium
VKRRDRALLSKDATIREIHHRVK

SEQ ID NO: 873017 - protein, 17 aa, Mycobacterium
VKRREFNAAYMSGAAVA

SEQ ID NO: 873018 - protein, 20 aa, Mycobacterium
VKRRGLWACHLGPELGGPGY

SEQ ID NO: 873019 - protein, 20 aa, Mycobacterium
VKRRIMIGAYALSAGYYDAY

SEQ ID NO: 873020 - protein, 19 aa, Mycobacterium
VKRRSGHIINIASLSGVIP

SEQ ID NO: 873021 - protein, 21 aa, Mycobacterium
VKRVQQLRLHYARTLDTWAGA

SEQ ID NO: 873022 - protein, 17 aa, Mycobacterium
VKRVVTRRAAVDEVLLV

SEQ ID NO: 873023 - protein, 25 aa, Mycobacterium
VKSAVDIALLGRFYERFADHAVEIG

SEQ ID NO: 873024 - protein, 24 aa, Mycobacterium
VKSGFSFLQIPIGPSSFLGITIPQ

SEQ ID NO: 873025 - protein, 25 aa, Mycobacterium
VKSIAEHPFDLLARARFRVTVNTDN

SEQ ID NO: 873026 - protein, 19 aa, Mycobacterium
VKSLVLLDPAIGLDGDWMR

SEQ ID NO: 873027 - protein, 21 aa, Mycobacterium
VKTAWSAAGSFRRTDKRGGAN

SEQ ID NO: 873028 - protein, 24 aa, Mycobacterium
VKTELLSFRAGGTEAAFLFAITVG

SEQ ID NO: 873029 - protein, 31 aa, Mycobacterium
VKTKKTELLFVALFLKLLKPGGRAAVIVPDG

SEQ ID NO: 873030 - protein, 23 aa, Mycobacterium
VKTPMTEWVPEDLFQTALGRAAE

SEQ ID NO: 873031 - protein, 22 aa, Mycobacterium
VKTPNYASILFTPTSAHVVIDG

SEQ ID NO: 873032 - protein, 18 aa, Mycobacterium
VKTSPLYRAWADASGDDL

SEQ ID NO: 873033 - protein, 17 aa, Mycobacterium
VKTSWQGAGGIGGFFEK

SEQ ID NO: 873034 - protein, 25 aa, Mycobacterium
VKTVPPRWLPGPRELRAWALAAGSP

SEQ ID NO: 873035 - protein, 26 aa, Mycobacterium
VKTVPPRWLPGPRELRAWTLAAGNPE

SEQ ID NO: 873036 - protein, 26 aa, Mycobacterium
VKTVPPRWLPGPRELRTWTLAAGSPE

SEQ ID NO: 873037 - protein, 24 aa, Mycobacterium
VKTWSWQDFPQLAALVKVPAQFIA

SEQ ID NO: 873038 - protein, 18 aa, Mycobacterium
VKVAGPRLILRGCEIHEP

SEQ ID NO: 873039 - protein, 25 aa, Mycobacterium
VKVAHAPLLALLTELMEAASDAGKL

SEQ ID NO: 873040 - protein, 25 aa, Mycobacterium
VKVDPVRLPVSALVPLLTEIEASLP

SEQ ID NO: 873041 - protein, 25 aa, Mycobacterium
VKVGSDVLPWLPVRGVFLLVERGSA

SEQ ID NO: 873042 - protein, 33 aa, Mycobacterium
VKVKPTSVPAFRPGAQFKAVISGAQKLPADGPA

SEQ ID NO: 873043 - protein, 34 aa, Mycobacterium
VKVKPTSVPAFRPGAQFKAVVAGAQKLPAEGPAV

SEQ ID NO: 873044 - protein, 29 aa, Mycobacterium
VKVKPTSVPAFRPGAQFKAVVSGAQKLPA

SEQ ID NO: 873045 - protein, 34 aa, Mycobacterium; identical to SEQ ID NO: 224090

SEQ ID NO: 873046 - protein, 34 aa, Mycobacterium
VKVKPTSVPAFRPGAQFKAVVSGAQRLPSDGPAV

SEQ ID NO: 873047 - protein, 34 aa, Mycobacterium; identical to SEQ ID NO: 118300

SEQ ID NO: 873048 - protein, 32 aa, Mycobacterium
VKVKPTSVPTFRPGAQFKAVVSGAQKLPADGP

SEQ ID NO: 873049 - protein, 24 aa, Mycobacterium
VKVNRLLLRNVSVVGVGWGEFVNR

SEQ ID NO: 873050 - protein, 24 aa, Mycobacterium
VKVPDHYGLITDALTAGKAVFSEW

SEQ ID NO: 873051 - protein, 18 aa, Mycobacterium
VKVPVRWWHGDSDHIVPF

SEQ ID NO: 873052 - protein, 21 aa, Mycobacterium
VKVRHQFGRPIGSFQAVKHAC

SEQ ID NO: 873053 - protein, 29 aa, Mycobacterium
VKVVWSGSIPNWIVALERIRAFGAKIVVP

SEQ ID NO: 873054 - protein, 29 aa, Mycobacterium
VKWLTPQAFRLWRNLGLRGFTGAGMPHPD

SEQ ID NO: 873055 - protein, 24 aa, Mycobacterium
VKYEELFVVYGRIAERLAQQGFTV

SEQ ID NO: 873056 - protein, 17 aa, Mycobacterium
VKYFRDTVQLNHPAFLV

SEQ ID NO: 873057 - protein, 18 aa, Mycobacterium
VKYPAGFFGVFTGSYDIE

SEQ ID NO: 873058 - protein, 23 aa, Mycobacterium
VKYRLGRDVARMEAALSAPGMFG

SEQ ID NO: 873059 - protein, 27 aa, Mycobacterium
VKYTDTTGYLIVEPVKRDGSTGSSIVN

SEQ ID NO: 873060 - protein, 33 aa, Mycobacterium
VLAAALDTLLRLLHPVIPFITEALWQALTREES

SEQ ID NO: 873061 - protein, 17 aa, Mycobacterium
VLAADYPERVRSLVLIN

SEQ ID NO: 873062 - protein, 35 aa, Mycobacterium
VLAAEGFTVVLLPRPLPTPVLAFAVRQVDAAAGIQ

SEQ ID NO: 873063 - protein, 17 aa, Mycobacterium
VLAAGWPEHIPGTTVNR

SEQ ID NO: 873064 - protein, 23 aa, Mycobacterium
VLAALGRIDYWFVTDGRRVHKTV

SEQ ID NO: 873065 - protein, 19 aa, Mycobacterium
VLAALLLNRISLAPGEAIF

SEQ ID NO: 873066 - protein, 26 aa, Mycobacterium
VLAALQPHFRLRPDPAPRGSAPAELW

SEQ ID NO: 873067 - protein, 20 aa, Mycobacterium
VLAANTPRWFVGSRLPQMPE

SEQ ID NO: 873068 - protein, 17 aa, Mycobacterium
VLAAPLGCGFQTGAGAV

SEQ ID NO: 873069 - protein, 25 aa, Mycobacterium
VLAARPVGVPAIVVPPTGVARTEVS

SEQ ID NO: 873070 - protein, 17 aa, Mycobacterium
VLAARPVGVPAIVVRPD

SEQ ID NO: 873071 - protein, 18 aa, Mycobacterium
VLAARQKLPIDVVAYVPM

SEQ ID NO: 873072 - protein, 26 aa, Mycobacterium
VLAATDRFRLAVRELTWVTTAGDVEA

SEQ ID NO: 873073 - protein, 33 aa, Mycobacterium
VLAATLDTLLRLLHPVIPFITEALWQALTHNET

SEQ ID NO: 873074 - protein, 20 aa, Mycobacterium
VLAAVKRLYLLGKNDRPTGT

SEQ ID NO: 873075 - protein, 32 aa, Mycobacterium
VLAAVLDTLLKLLHPVMPFVTETLWKTLTGGE

SEQ ID NO: 873076 - protein, 38 aa, Mycobacterium
VLAAVLDTLLRLLHPVIPFLTEALWQALTNRESLVVAE

SEQ ID NO: 873077 - protein, 18 aa, Mycobacterium
VLACLDAIAAGEVYQACV

SEQ ID NO: 873078 - protein, 32 aa, Mycobacterium
VLADELSRIPVLPSLTEMATMTGISGLGSLAR

SEQ ID NO: 873079 - protein, 20 aa, Mycobacterium
VLADLPRLQVLALSGLNMAP

SEQ ID NO: 873080 - protein, 28 aa, Mycobacterium
VLADQGFSVLLLPGPVPTPVVAFAVRHT

SEQ ID NO: 873081 - protein, 23 aa, Mycobacterium
VLADRMSPLRRRARAHLPAVHSS

SEQ ID NO: 873082 - protein, 21 aa, Mycobacterium
VLADSWRMAAKSLRPLPVAHK

SEQ ID NO: 873083 - protein, 26 aa, Mycobacterium
VLAEQRRWLAPWFSRVPADTGRDKLD

SEQ ID NO: 873084 - protein, 27 aa, Mycobacterium
VLAEQRRWLAPWYSLVPLQAGQAELTE

SEQ ID NO: 873085 - protein, 20 aa, Mycobacterium
VLAEVDYLKPFWDTHPWERA

SEQ ID NO: 873086 - protein, 23 aa, Mycobacterium
VLAEVFSLFGLFETQHQPMIAIG

SEQ ID NO: 873087 - protein, 30 aa, Mycobacterium
VLAEYSIDLFALLPLAELWVAATRIRQVDQ

SEQ ID NO: 873088 - protein, 30 aa, Mycobacterium
VLAEYSIDLYSLLPLGELWVAAARMRRIDR

SEQ ID NO: 873089 - protein, 18 aa, Mycobacterium
VLAFLPPGVGERIIDQLE

SEQ ID NO: 873090 - protein, 32 aa, Mycobacterium
VLAGAPLLERLMGWVLTYPFNMTTNPAISIPV

SEQ ID NO: 873091 - protein, 19 aa, Mycobacterium
VLAGDRDFLTPAGDSRIIA

SEQ ID NO: 873092 - protein, 24 aa, Mycobacterium
VLAGYPLVNLKVTLLDGAYHEVDS

SEQ ID NO: 873093 - protein, 24 aa, Mycobacterium
VLAHAVRDLWASRLLPYAHNLRMR

SEQ ID NO: 873094 - protein, 18 aa, Mycobacterium
VLAHFLPGPKVTEFLSPH

SEQ ID NO: 873095 - protein, 32 aa, Mycobacterium
VLAHHSFHVFVVYPWIRFLDRNPEPALHVLQN

SEQ ID NO: 873096 - protein, 24 aa, Mycobacterium
VLAHLLDGRLITPDPWDALRGNFS

SEQ ID NO: 873097 - protein, 17 aa, Mycobacterium
VLAHNRLAGALITEFRE

SEQ ID NO: 873098 - protein, 25 aa, Mycobacterium
VLAIKDMAGLLRAPAAATLVSALKS

SEQ ID NO: 873099 - protein, 25 aa, Mycobacterium
VLAIKDMAGLLRPPAAATLVSALRS

SEQ ID NO: 873100 - protein, 25 aa, Mycobacterium
VLAIKDMAGLLRPPAAATLVTALRS

SEQ ID NO: 873101 - protein, 22 aa, Mycobacterium
VLAIWCMDWPAVAAAAAADLPA

SEQ ID NO: 873102 - protein, 18 aa, Mycobacterium
VLAIWEAIDTRDADGWTV

SEQ ID NO: 873103 - protein, 26 aa, Mycobacterium
VLAKRQPLLIVSSDLRRALDTAETLG

SEQ ID NO: 873104 - protein, 30 aa, Mycobacterium
VLALALHPFVIGQPFRHKYLDQALGFLAGQ

SEQ ID NO: 873105 - protein, 29 aa, Mycobacterium
VLALALHPFVIGQPFRHKYLDQALSFLTA

SEQ ID NO: 873106 - protein, 19 aa, Mycobacterium
VLALGYIGMTLGAYRWLRP

SEQ ID NO: 873107 - protein, 18 aa, Mycobacterium
VLALGYIGMTLGSYRWLR

SEQ ID NO: 873108 - protein, 20 aa, Mycobacterium
VLALLGVRPIWDEASRRVVD

SEQ ID NO: 873109 - protein, 18 aa, Mycobacterium
VLALPPGHPMADRHGVPV

SEQ ID NO: 873110 - protein, 17 aa, Mycobacterium
VLALRGADPRELLTEAL

SEQ ID NO: 873111 - protein, 30 aa, Mycobacterium
VLALTRYPEQRRLWWSRFDELAPTAVEEIV

SEQ ID NO: 873112 - protein, 18 aa, Mycobacterium
VLAMCAGALRAYLTDQHA

SEQ ID NO: 873113 - protein, 19 aa, Mycobacterium
VLAMCAGALRYYLIEQDAL

SEQ ID NO: 873114 - protein, 20 aa, Mycobacterium
VLAMCAGALRYYLIEQDALP

SEQ ID NO: 873115 - protein, 19 aa, Mycobacterium
VLAMCSGALRYYLLEQNAL

SEQ ID NO: 873116 - protein, 17 aa, Mycobacterium
VLAMIGVDLSRLAEDVI

SEQ ID NO: 873117 - protein, 23 aa, Mycobacterium
VLAMTHAWALEFAKAGIRFNSVQ

SEQ ID NO: 873118 - protein, 23 aa, Mycobacterium
VLAMTNQWLFDRHSFGRPLASYQ

SEQ ID NO: 873119 - protein, 24 aa, Mycobacterium
VLANFGVDGLRFLTPVKPGDALTV

SEQ ID NO: 873120 - protein, 19 aa, Mycobacterium
VLAPLTPAAIFLVATIDDG

SEQ ID NO: 873121 - protein, 19 aa, Mycobacterium
VLAPLTPAAIFLVVTIDDG

SEQ ID NO: 873122 - protein, 19 aa, Mycobacterium
VLAPLTPAAVFLVATIDEG

SEQ ID NO: 873123 - protein, 19 aa, Mycobacterium
VLAPPEHRNGRRRGHLRVL

SEQ ID NO: 873124 - protein, 25 aa, Mycobacterium
VLAPQGLDYIVAFLGALQAGQIAVP

SEQ ID NO: 873125 - protein, 18 aa, Mycobacterium
VLAPVVFTSALDLGELFA

SEQ ID NO: 873126 - protein, 18 aa, Mycobacterium
VLAPVVFTSALGLGELFS

SEQ ID NO: 873127 - protein, 30 aa, Mycobacterium
VLAQATMPSYLRYGAYPYIVVVRESPGASR

SEQ ID NO: 873128 - protein, 24 aa, Mycobacterium
VLAQRHWDMLIAQHRLRGRRFVAP

SEQ ID NO: 873129 - protein, 23 aa, Mycobacterium
VLARELLPERALMGDASAIVALH

SEQ ID NO: 873130 - protein, 21 aa, Mycobacterium
VLARHAALTAGLTQVPGLANN

SEQ ID NO: 873131 - protein, 30 aa, Mycobacterium
VLARHLMDQTLLGPVRVLIAGHVARRQAVT

SEQ ID NO: 873132 - protein, 20 aa, Mycobacterium
VLARHLRLPAGWDDAERQEF

SEQ ID NO: 873133 - protein, 17 aa, Mycobacterium
VLARKGRTLITESRLGL

SEQ ID NO: 873134 - protein, 23 aa, Mycobacterium
VLARLPLRSLAFDVPPEYVFRAV

SEQ ID NO: 873135 - protein, 46 aa, Mycobacterium
VLARQLFMSWYTLFHQLPLLPEWLLPWLLRLYWRRWSPGYDARADL

SEQ ID NO: 873136 - protein, 27 aa, Mycobacterium
VLARQTVWPPRLFSILAGFVEAGESFE

SEQ ID NO: 873137 - protein, 31 aa, Mycobacterium
VLARREDGRWSWRWDPAFVTSNFQFLQGDPD

SEQ ID NO: 873138 - protein, 19 aa, Mycobacterium
VLARTWPVVCDELIGHYEA

SEQ ID NO: 873139 - protein, 26 aa, Mycobacterium
VLARVSRLVFGAWEPKTGAVGSLWDV

SEQ ID NO: 873140 - protein, 20 aa, Mycobacterium
VLARWPEVIASPTPSTTGRV

SEQ ID NO: 873141 - protein, 23 aa, Mycobacterium
VLASALATRISWLRPFGVTDAGQ

SEQ ID NO: 873142 - protein, 28 aa, Mycobacterium
VLASEEAFFMLAFTKIGLMPDGGASALV

SEQ ID NO: 873143 - protein, 28 aa, Mycobacterium
VLASESAYFLLAFTKIGLMPDGGASALI

SEQ ID NO: 873144 - protein, 18 aa, Mycobacterium
VLASLRLDSAWTAARTET

SEQ ID NO: 873145 - protein, 19 aa, Mycobacterium
VLASLRLLGYQPGDVRAIL

SEQ ID NO: 873146 - protein, 24 aa, Mycobacterium
VLASVLAGRLRAAGWRRGDAVVLA

SEQ ID NO: 873147 - protein, 34 aa, Mycobacterium
VLATDLVIHDSFRQLWFGWSDPARVLVEYAQQRA

SEQ ID NO: 873148 - protein, 23 aa, Mycobacterium
VLATGSYAFVPPLPGHDLPGCHV

SEQ ID NO: 873149 - protein, 24 aa, Mycobacterium
VLATGVMPGLPPLSGGMVGFFAYD

SEQ ID NO: 873150 - protein, 18 aa, Mycobacterium
VLATIKPVAALAYQFAQS

SEQ ID NO: 873151 - protein, 31 aa, Mycobacterium
VLATLPDPVRRRVIRSWLLAGGAIGLTDKQI

SEQ ID NO: 873152 - protein, 24 aa, Mycobacterium
VLATMNFPSFPGFAARLFATDDEE

SEQ ID NO: 873153 - protein, 24 aa, Mycobacterium
VLATPSIFIGFSRQRGLATDGRCK

SEQ ID NO: 873154 - protein, 32 aa, Mycobacterium
VLATVLDTLLRLLHPVIPFVTEVLWKSVTGGE

SEQ ID NO: 873155 - protein, 32 aa, Mycobacterium
VLATVLDVLLKLLHPVMPFVTEVLWKTLTGGE

SEQ ID NO: 873156 - protein, 17 aa, Mycobacterium
VLAVARAIRGRGLGLTI

SEQ ID NO: 873157 - protein, 20 aa, Mycobacterium
VLAVLGREPFLDDVLASGGL

SEQ ID NO: 873158 - protein, 17 aa, Mycobacterium
VLAVLTAEQLRHAMFPI

SEQ ID NO: 873159 - protein, 17 aa, Mycobacterium
VLAVLTAEQLRHAVFPI

SEQ ID NO: 873160 - protein, 17 aa, Mycobacterium
VLAVRGRGLWAGVDIDP

SEQ ID NO: 873161 - protein, 18 aa, Mycobacterium
VLAWHDALNAADIETLAS

SEQ ID NO: 873162 - protein, 17 aa, Mycobacterium
VLAWHDALNAADLDTLV

SEQ ID NO: 873163 - protein, 18 aa, Mycobacterium
VLAWHDALNAADMDTLLS

SEQ ID NO: 873164 - protein, 18 aa, Mycobacterium
VLAWHDALNDKDFDTLVS

SEQ ID NO: 873165 - protein, 17 aa, Mycobacterium
VLAWSDALNAADIDTLV

SEQ ID NO: 873166 - protein, 18 aa, Mycobacterium
VLAYLRYDELHPHGAWAA

SEQ ID NO: 873167 - protein, 21 aa, Mycobacterium
VLCALHGWLAPLPPEGASAIV

SEQ ID NO: 873168 - protein, 25 aa, Mycobacterium
VLCALPARYITPMSPKKPRSLGDAL

SEQ ID NO: 873169 - protein, 19 aa, Mycobacterium
VLCAYIALYAARRPDDITI

SEQ ID NO: 873170 - protein, 18 aa, Mycobacterium
VLCEKDEIVPPGRFGKLI

SEQ ID NO: 873171 - protein, 19 aa, Mycobacterium
VLCETFPTRLERGAGIPAV

SEQ ID NO: 873172 - protein, 23 aa, Mycobacterium
VLCGTTLIVWTTIAEPRQVPGLW

SEQ ID NO: 873173 - protein, 38 aa, Mycobacterium
VLCHEPLGVVSILTPWNFPHSLNVMKLSRALAAGNTVV

SEQ ID NO: 873174 - protein, 37 aa, Mycobacterium
VLCHEPLGVVSILTPWNFPHSLNVMKLSRALAGGNTV

SEQ ID NO: 873175 - protein, 24 aa, Mycobacterium
VLCITSPGLLFQAWQARQGRRSAD

SEQ ID NO: 873176 - protein, 19 aa, Mycobacterium
VLCQLWGPMTDLPPAIPRF

SEQ ID NO: 873177 - protein, 20 aa, Mycobacterium
VLCRDLFGPLPGTGRWHTAL

SEQ ID NO: 873178 - protein, 18 aa, Mycobacterium
VLCVPDHLGAVAPIPALT

SEQ ID NO: 873179 - protein, 18 aa, Mycobacterium
VLDALDGRIALGVASSPG

SEQ ID NO: 873180 - protein, 22 aa, Mycobacterium
VLDALSVWAPKQSVTAYDAVAA

SEQ ID NO: 873181 - protein, 19 aa, Mycobacterium
VLDAQPFSRLLGAAITRVD

SEQ ID NO: 873182 - protein, 19 aa, Mycobacterium
VLDCPINWKLAVDTFSENY

SEQ ID NO: 873183 - protein, 26 aa, Mycobacterium
VLDCTPHDLWPNQYPPSTASAVATAS

SEQ ID NO: 873184 - protein, 26 aa, Mycobacterium
VLDDIRRYLSYFPASAWSYPPAAEID

SEQ ID NO: 873185 - protein, 18 aa, Mycobacterium
VLDDLRRILTADGLLCVA

SEQ ID NO: 873186 - protein, 17 aa, Mycobacterium
VLDFLTYVVTSAAAGVV

SEQ ID NO: 873187 - protein, 20 aa, Mycobacterium
VLDFLVSRVPKWIDHEIVVV

SEQ ID NO: 873188 - protein, 17 aa, Mycobacterium
VLDFWSMVKPELAGMHG

SEQ ID NO: 873189 - protein, 22 aa, Mycobacterium
VLDFYQLMVQFVEKRAASSQPG

SEQ ID NO: 873190 - protein, 28 aa, Mycobacterium
VLDGGALLNWMVPLGTHFPAEVPAAIDE

SEQ ID NO: 873191 - protein, 20 aa, Mycobacterium
VLDGQPAVFRRPPAGPIAEG

SEQ ID NO: 873192 - protein, 26 aa, Mycobacterium
VLDGWLVDRAFGVDIPLIEVSKLPVG

SEQ ID NO: 873193 - protein, 33 aa, Mycobacterium
VLDHARSWYRPPPRTDWQLLVSDLSGLPATARI

SEQ ID NO: 873194 - protein, 18 aa, Mycobacterium
VLDIAPPDTRYWNVTLES

SEQ ID NO: 873195 - protein, 31 aa, Mycobacterium
VLDIARGAPWPAKYPGRSLGHPFLEQWRGRE

SEQ ID NO: 873196 - protein, 20 aa, Mycobacterium
VLDIMRGGIDSALMGLGKKS

SEQ ID NO: 873197 - protein, 29 aa, Mycobacterium
VLDLFEELQRQWRFACLFISHDLAVVDRL

SEQ ID NO: 873198 - protein, 22 aa, Mycobacterium
VLDLIAARRIPVVSTLAPDAEG

SEQ ID NO: 873199 - protein, 19 aa, Mycobacterium
VLDLIDTLRVGSSTSIVLV

SEQ ID NO: 873200 - protein, 20 aa, Mycobacterium
VLDLNSIFAIQDPGAYPLVL

SEQ ID NO: 873201 - protein, 26 aa, Mycobacterium
VLDLPTYPFEHRQYWFSDSREPVAAA

SEQ ID NO: 873202 - protein, 17 aa, Mycobacterium
VLDLRSGLLDVAARVRQ

SEQ ID NO: 873203 - protein, 20 aa, Mycobacterium
VLDLYRENIRYFPSLLPEVS

SEQ ID NO: 873204 - protein, 24 aa, Mycobacterium
VLDMLAPWEVLESVARLLIPGGVL

SEQ ID NO: 873205 - protein, 25 aa, Mycobacterium
VLDMLAPWEVLPAVSRALVAGGVLM

SEQ ID NO: 873206 - protein, 25 aa, Mycobacterium
VLDNVFATPLLQQGIPLGADVVVYS

SEQ ID NO: 873207 - protein, 22 aa, Mycobacterium
VLDNWAVYAGWVHLAAGRLSAA

SEQ ID NO: 873208 - protein, 21 aa, Mycobacterium
VLDPAIYREAVLRLDRHFAIS

SEQ ID NO: 873209 - protein, 21 aa, Mycobacterium
VLDPDVVTCLVRRGRPHDPLN

SEQ ID NO: 873210 - protein, 26 aa, Mycobacterium
VLDQHDRPLRWLSLSELSDAHSLERV

SEQ ID NO: 873211 - protein, 19 aa, Mycobacterium
VLDQRPFEVQLMGAAALHL

SEQ ID NO: 873212 - protein, 29 aa, Mycobacterium
VLDRHTQPLIRLPLSTEALSRRLISDVRD

SEQ ID NO: 873213 - protein, 23 aa, Mycobacterium
VLDRLEHLVIKPVEGSGGYGIVF

SEQ ID NO: 873214 - protein, 26 aa, Mycobacterium
VLDRLHVVALPMRVRFRGITTREVAL

SEQ ID NO: 873215 - protein, 26 aa, Mycobacterium
VLDRLPLRCVLGAPLLFGAGRGVTLV

SEQ ID NO: 873216 - protein, 18 aa, Mycobacterium
VLDRRRWTTRAELRLAIV

SEQ ID NO: 873217 - protein, 30 aa, Mycobacterium
VLDRSTFRWWLTVATLRWGVICRHQAERHL

SEQ ID NO: 873218 - protein, 24 aa, Mycobacterium
VLDRYDYVLIDCQPSLGLLTVNAL

SEQ ID NO: 873219 - protein, 22 aa, Mycobacterium
VLDRYVPVLTELRLRYLDDHDW

SEQ ID NO: 873220 - protein, 25 aa, Mycobacterium
VLDSDGILDLVSLPASMVVVGAGVI

SEQ ID NO: 873221 - protein, 21 aa, Mycobacterium
VLDSLPYSEKRLRQALAARDC

SEQ ID NO: 873222 - protein, 26 aa, Mycobacterium
VLDSSRFRYLIADRADLAVANVHGII

SEQ ID NO: 873223 - protein, 24 aa, Mycobacterium
VLDTLARRGVAAIFFVVGENVSSP

SEQ ID NO: 873224 - protein, 26 aa, Mycobacterium
VLDTLRPHFRLRPDPAPRGSAPAELW

SEQ ID NO: 873225 - protein, 17 aa, Mycobacterium
VLDTSVLLSDPWATNRF

SEQ ID NO: 873226 - protein, 22 aa, Mycobacterium
VLDVCAIRMPVLTPTLVIAEKL

SEQ ID NO: 873227 - protein, 29 aa, Mycobacterium
VLDVLAREPIVQRIVFVEAPMALGWSRWR

SEQ ID NO: 873228 - protein, 19 aa, Mycobacterium
VLDWNRPVKIFIETKHPVR

SEQ ID NO: 873229 - protein, 18 aa, Mycobacterium
VLDYLAIAEPLSLADLTV

SEQ ID NO: 873230 - protein, 24 aa, Mycobacterium
VLEAGFFMPEPGQEKAWFEEHHAR

SEQ ID NO: 873231 - protein, 23 aa, Mycobacterium
VLEAIAFGFRHHTEVFAHMGVSL

SEQ ID NO: 873232 - protein, 18 aa, Mycobacterium
VLEAVVRRPNHIGPATAA

SEQ ID NO: 873233 - protein, 39 aa, Mycobacterium
VLEDALVLLHRDKISSLPDLLPLLELVAKEGKPLLIVAE

SEQ ID NO: 873234 - protein, 26 aa, Mycobacterium
VLEDALVLLHREKISSLPDLLPLLEK

SEQ ID NO: 873235 - protein, 23 aa, Mycobacterium
VLEDYGLTPWPKTSGSRGFHVYA

SEQ ID NO: 873236 - protein, 24 aa, Mycobacterium
VLEETGLLPHLNPGVMSWAELARL

SEQ ID NO: 873237 - protein, 23 aa, Mycobacterium
VLEETGLLPHLNPGVMSWSELSR

SEQ ID NO: 873238 - protein, 22 aa, Mycobacterium
VLEETGLLPHLNPGVMSWSEMS

SEQ ID NO: 873239 - protein, 18 aa, Mycobacterium
VLEFKAHVLARHGAKPKA

SEQ ID NO: 873240 - protein, 25 aa, Mycobacterium
VLEGFHYHFHPVTQRAFAVAAGGEL

SEQ ID NO: 873241 - protein, 17 aa, Mycobacterium
VLEGKPDLIKVSHEELL

SEQ ID NO: 873242 - protein, 17 aa, Mycobacterium
VLEGLASPLASAVSATA

SEQ ID NO: 873243 - protein, 17 aa, Mycobacterium
VLEGRAWDPGLGNLWVY

SEQ ID NO: 873244 - protein, 17 aa, Mycobacterium
VLEGRLEQLRTFEREYR

SEQ ID NO: 873245 - protein, 18 aa, Mycobacterium
VLEGRLEQLRTFEREYRT

SEQ ID NO: 873246 - protein, 30 aa, Mycobacterium
VLEHLPGPDRLHPLYTLAGTALPPEAVIDS

SEQ ID NO: 873247 - protein, 17 aa, Mycobacterium
VLEIALRELCIEKGLFT

SEQ ID NO: 873248 - protein, 21 aa, Mycobacterium
VLEITGLDRFVQQRVDGIRLR

SEQ ID NO: 873249 - protein, 20 aa, Mycobacterium
VLEIYRRIEDWHGPADPDRG

SEQ ID NO: 873250 - protein, 19 aa, Mycobacterium
VLEKPLLDVIFDVDGPEAE

SEQ ID NO: 873251 - protein, 18 aa, Mycobacterium
VLEKVYVIGVGMTKFEKP

SEQ ID NO: 873252 - protein, 34 aa, Mycobacterium
VLELLSRLQSELALTYLLIGHDLAVIRQLSHDVL

SEQ ID NO: 873253 - protein, 18 aa, Mycobacterium
VLELVLGVTRTPAMQRAG

SEQ ID NO: 873254 - protein, 19 aa, Mycobacterium
VLENIRVALMPLGRSKVSA

SEQ ID NO: 873255 - protein, 26 aa, Mycobacterium
VLENPGLARFLPDLSRRLLDEPLALS

SEQ ID NO: 873256 - protein, 25 aa, Mycobacterium
VLEPDAYRLELWRQIEKDQSVLRES

SEQ ID NO: 873257 - protein, 19 aa, Mycobacterium
VLEPGMTFTIEPMINLGSL

SEQ ID NO: 873258 - protein, 18 aa, Mycobacterium
VLEQIGRPTVLIGASMGG

SEQ ID NO: 873259 - protein, 20 aa, Mycobacterium
VLEQLPPAFVSPVVGYLCTE

SEQ ID NO: 873260 - protein, 23 aa, Mycobacterium
VLEQNPVFDMWAEYASPAQNTLA

SEQ ID NO: 873261 - protein, 26 aa, Mycobacterium
VLEQSRLLPAITFIFSRAGCDAAVKQ

SEQ ID NO: 873262 - protein, 18 aa, Mycobacterium
VLEREGLIAVRRGRGGGF

SEQ ID NO: 873263 - protein, 17 aa, Mycobacterium
VLERGLLLRLRFELDHH

SEQ ID NO: 873264 - protein, 18 aa, Mycobacterium
VLERIPIPVLAIEKDGRI

SEQ ID NO: 873265 - protein, 19 aa, Mycobacterium
VLERIPVPVLAIGDDGSIL

SEQ ID NO: 873266 - protein, 42 aa, Mycobacterium
VLERSLVHLGLKHYFLVDFPQEPGALRRFLDEVLGPNDDITL

SEQ ID NO: 873267 - protein, 18 aa, Mycobacterium
VLERYLQPWLGADGQAAF

SEQ ID NO: 873268 - protein, 19 aa, Mycobacterium
VLESPLRAYHLDNRDQRIA

SEQ ID NO: 873269 - protein, 19 aa, Mycobacterium
VLESWKQTLKDTVHWDDWA

SEQ ID NO: 873270 - protein, 17 aa, Mycobacterium
VLETSHPPTYYLPPGCF

SEQ ID NO: 873271 - protein, 26 aa, Mycobacterium
VLEVLAAIYRDQDWRFLLDREGHSYN

SEQ ID NO: 873272 - protein, 27 aa, Mycobacterium
VLEVRGEVFFRVADFQALNASLVEEGK

SEQ ID NO: 873273 - protein, 17 aa, Mycobacterium
VLFDRSWYNRAGVEKVM

SEQ ID NO: 873274 - protein, 18 aa, Mycobacterium
VLFELLQRRITAPENTIR

SEQ ID NO: 873275 - protein, 20 aa, Mycobacterium
VLFELSYPDEKIAREALTRA

SEQ ID NO: 873276 - protein, 18 aa, Mycobacterium
VLFEVGVLSTKAAHRRIH

SEQ ID NO: 873277 - protein, 25 aa, Mycobacterium
VLFHARAKLRRKGCDLLVVNAVGDG

SEQ ID NO: 873278 - protein, 18 aa, Mycobacterium
VLFLGRYDEPRKGMAVLL

SEQ ID NO: 873279 - protein, 17 aa, Mycobacterium
VLFLLSDESRYVTGLEF

SEQ ID NO: 873280 - protein, 18 aa, Mycobacterium
VLFLNDSIVLPGMVVPIE

SEQ ID NO: 873281 - protein, 38 aa, Mycobacterium
VLFSIPTSPYALTTWLNALWSNPLTTPFDAYFQSAGVD

SEQ ID NO: 873282 - protein, 26 aa, Mycobacterium
VLFSRYETLLATGARLFRAQGYPAVS

SEQ ID NO: 873283 - protein, 20 aa, Mycobacterium
VLFVDYLTLVPATGDAPPLR

SEQ ID NO: 873284 - protein, 22 aa, Mycobacterium
VLFVIGCIGVTPILPMIRAAAQ

SEQ ID NO: 873285 - protein, 17 aa, Mycobacterium
VLFVSDTIVLPGMVVPI

SEQ ID NO: 873286 - protein, 18 aa, Mycobacterium
VLFVTDTIVLPGMVVPIA

SEQ ID NO: 873287 - protein, 22 aa, Mycobacterium
VLFVTDTIVLPGMVVPIALDEA

SEQ ID NO: 873288 - protein, 17 aa, Mycobacterium
VLFWMHGGGMVIGNRHM

SEQ ID NO: 873289 - protein, 20 aa, Mycobacterium
VLGADFIMFASDYPHWDGEW

SEQ ID NO: 873290 - protein, 29 aa, Mycobacterium
VLGADRLPGVRLWLYTNFHCNLSCDYCCV

SEQ ID NO: 873291 - protein, 26 aa, Mycobacterium
VLGAGSYPWVLAITPPYSDHSQRSAF

SEQ ID NO: 873292 - protein, 28 aa, Mycobacterium
VLGAIDSVTLLPLYFELDGTFPNHEANP

SEQ ID NO: 873293 - protein, 31 aa, Mycobacterium
VLGAINAPTQALLGRPLIGDGATGAAGQNGG

SEQ ID NO: 873294 - protein, 28 aa, Mycobacterium
VLGALNTPTQAIFGRPLIGDGANGTATS

SEQ ID NO: 873295 - protein, 37 aa, Mycobacterium
VLGARIRLLRDRIHQGWILTALWLIDTGVTAAALERR

SEQ ID NO: 873296 - protein, 29 aa, Mycobacterium
VLGASWLTAFAQRSPFAELFLADTQGASE

SEQ ID NO: 873297 - protein, 25 aa, Mycobacterium
VLGATAHLPRRPAYTGTLTLRYRRG

SEQ ID NO: 873298 - protein, 20 aa, Mycobacterium
VLGDDFIMFASDYPHWDGEW

SEQ ID NO: 873299 - protein, 23 aa, Mycobacterium
VLGDDFIMFASDYPHWDGEWPES

SEQ ID NO: 873300 - protein, 23 aa, Mycobacterium
VLGDPALPHLFFVDGGALAVENA

SEQ ID NO: 873301 - protein, 24 aa, Mycobacterium
VLGEGLVLTIFRAGEYLSKTHVDK

SEQ ID NO: 873302 - protein, 30 aa, Mycobacterium
VLGEYSLDLFALLPLGELWVAAARNRQVDQ

SEQ ID NO: 873303 - protein, 28 aa, Mycobacterium
VLGFAVDGGWWVLGVHTPAAAECLRGVP

SEQ ID NO: 873304 - protein, 26 aa, Mycobacterium
VLGFLNEGLPYRVPYPQTTPTQESGP

SEQ ID NO: 873305 - protein, 17 aa, Mycobacterium
VLGFLTLSDPSGLRHEL

SEQ ID NO: 873306 - protein, 33 aa, Mycobacterium
VLGFRSRGAFRVPLPAEFGPIRVRFLGINARHH

SEQ ID NO: 873307 - protein, 17 aa, Mycobacterium
VLGFVKFGDRDWTGVEL

SEQ ID NO: 873308 - protein, 30 aa, Mycobacterium; identical to SEQ ID NO: 746902

SEQ ID NO: 873309 - protein, 30 aa, Mycobacterium
VLGGMSLGGYLSLAFHLVHPQRVAALVLVD

SEQ ID NO: 873310 - protein, 25 aa, Mycobacterium
VLGKLQPLLIVSSDLRRAYDTATRL

SEQ ID NO: 873311 - protein, 26 aa, Mycobacterium
VLGKRRQLPYLGEQVVIFPSTAGTLR

SEQ ID NO: 873312 - protein, 27 aa, Mycobacterium
VLGKVADGLWYPLWDANVRLDHSVRTV

SEQ ID NO: 873313 - protein, 18 aa, Mycobacterium
VLGKVQPLLIVSSDLHRA

SEQ ID NO: 873314 - protein, 19 aa, Mycobacterium
VLGLAIPIPGGNGEPTFAI

SEQ ID NO: 873315 - protein, 24 aa, Mycobacterium
VLGLPELALGLIPGAGGTVSITRR

SEQ ID NO: 873316 - protein, 20 aa, Mycobacterium
VLGLPEVTLGLLPGGGGVTR

SEQ ID NO: 873317 - protein, 18 aa, Mycobacterium
VLGLPKEPDPWKGKPWKD

SEQ ID NO: 873318 - protein, 20 aa, Mycobacterium
VLGLRNAGLLLNRPGRTLGC

SEQ ID NO: 873319 - protein, 17 aa, Mycobacterium
VLGLSEALRIELEPHRI

SEQ ID NO: 873320 - protein, 29 aa, Mycobacterium
VLGMNDWMELTGYWWPKHAGRYAALASPA

SEQ ID NO: 873321 - protein, 22 aa, Mycobacterium
VLGMPFYVMRAIDGWSPMDGGW

SEQ ID NO: 873322 - protein, 24 aa, Mycobacterium
VLGNTSYRLPLMRKLMFTENEDTD

SEQ ID NO: 873323 - protein, 28 aa, Mycobacterium
VLGPARDGGWWVLGVGAPAMAQCLRTVP

SEQ ID NO: 873324 - protein, 18 aa, Mycobacterium
VLGPFPTDRGWAVRDLLD

SEQ ID NO: 873325 - protein, 23 aa, Mycobacterium
VLGPRAVMTPLARERARALGVTI

SEQ ID NO: 873326 - protein, 21 aa, Mycobacterium
VLGPVWPRNPWTKAYRQEHLE

SEQ ID NO: 873327 - protein, 21 aa, Mycobacterium
VLGQALLARRMGKTRVIAETG

SEQ ID NO: 873328 - protein, 18 aa, Mycobacterium
VLGQRRIVGGLVGPGALR

SEQ ID NO: 873329 - protein, 18 aa, Mycobacterium
VLGRFLHEFAGIGAEWTP

SEQ ID NO: 873330 - protein, 18 aa, Mycobacterium
VLGRGSFTDSFPLFGYDL

SEQ ID NO: 873331 - protein, 23 aa, Mycobacterium
VLGRPFYLMGFVEGWSPMDRHGV

SEQ ID NO: 873332 - protein, 26 aa, Mycobacterium
VLGRPFYLMGYVDGWSPMDTHGTWPE

SEQ ID NO: 873333 - protein, 36 aa, Mycobacterium
VLGRYRGADLLGTRYLPPFPYFMESPKAFRVLPGDF

SEQ ID NO: 873334 - protein, 28 aa, Mycobacterium
VLGSIASLTLKPLYFELDGEFPNHEANP

SEQ ID NO: 873335 - protein, 22 aa, Mycobacterium
VLGSSFFGRAKIYCAPEVVGHL

SEQ ID NO: 873336 - protein, 31 aa, Mycobacterium
VLGSSGVWELFWPGFPLEGLYKFRVHGADGV

SEQ ID NO: 873337 - protein, 30 aa, Mycobacterium
VLGSSGVWELFWPGFPPDGLYKFRVHGADG

SEQ ID NO: 873338 - protein, 18 aa, Mycobacterium
VLGTYLRDVIRRNPDRFR

SEQ ID NO: 873339 - protein, 20 aa, Mycobacterium
VLGVHDLTLAVLPGMVERRA

SEQ ID NO: 873340 - protein, 27 aa, Mycobacterium
VLGVHDLVLAVLPGMVARRAGGILISG

SEQ ID NO: 873341 - protein, 31 aa, Mycobacterium
VLGVINAPTQTLLGRPLIGDGAAGTAANPNG

SEQ ID NO: 873342 - protein, 27 aa, Mycobacterium
VLGVTTNIEFLRFLLADDDVAAGRLDT

SEQ ID NO: 873343 - protein, 17 aa, Mycobacterium
VLGVWQPGAPAAVLVGL

SEQ ID NO: 873344 - protein, 25 aa, Mycobacterium
VLGVYGPPLKFDVSLPLAAISEFAA

SEQ ID NO: 873345 - protein, 25 aa, Mycobacterium
VLGVYGPPLKFDVSLPLSAISEFER

SEQ ID NO: 873346 - protein, 18 aa, Mycobacterium
VLGWLTNRNWEGKWAPIG

SEQ ID NO: 873347 - protein, 19 aa, Mycobacterium
VLGYRVERLLKMATIHVLD

SEQ ID NO: 873348 - protein, 24 aa, Mycobacterium
VLHAPRLWPEYHPGYYGAFVRDPD

SEQ ID NO: 873349 - protein, 19 aa, Mycobacterium
VLHAWRTWCVTLPESVNTS

SEQ ID NO: 873350 - protein, 19 aa, Mycobacterium
VLHCTRAVLPAMITNTWGR

SEQ ID NO: 873351 - protein, 19 aa, Mycobacterium
VLHDIAWRAMQVHGALGVT

SEQ ID NO: 873352 - protein, 27 aa, Mycobacterium
VLHELPGQRVWFPIPGKYAFHVELQRG

SEQ ID NO: 873353 - protein, 39 aa, Mycobacterium; identical to SEQ ID NO: 118310

SEQ ID NO: 873354 - protein, 17 aa, Mycobacterium
VLHEVAHHLCRVPPPHG

SEQ ID NO: 873355 - protein, 18 aa, Mycobacterium
VLHLINPRILPAGSDGDG

SEQ ID NO: 873356 - protein, 17 aa, Mycobacterium
VLHLVPGLRVAPTGQRT

SEQ ID NO: 873357 - protein, 27 aa, Mycobacterium
VLHPDRAMRVPLAKVIRPSQFGIDVAP

SEQ ID NO: 873358 - protein, 40 aa, Mycobacterium
VLHRPKLGFPVPIRHWLRAGELLDWAYGLAASSQAGELVD

SEQ ID NO: 873359 - protein, 31 aa, Mycobacterium
VLHRPKLGFPVPIRHWLRAGELLEWAYQMVA

SEQ ID NO: 873360 - protein, 30 aa, Mycobacterium
VLHRRRGWTWSGFRIMNVLWVFGTVEQRDV

SEQ ID NO: 873361 - protein, 17 aa, Mycobacterium
VLHRTLRSELLGKPVRL

SEQ ID NO: 873362 - protein, 18 aa, Mycobacterium
VLHSAALRRLADKTQVVG

SEQ ID NO: 873363 - protein, 20 aa, Mycobacterium
VLHSGKLTMLVDHLPDHAPV

SEQ ID NO: 873364 - protein, 17 aa, Mycobacterium
VLHVTALVERSAQIVWG

SEQ ID NO: 873365 - protein, 23 aa, Mycobacterium
VLIDGRWRWRSYSLTSAPAMSGS

SEQ ID NO: 873366 - protein, 20 aa, Mycobacterium
VLIEPRIDLWGRVLRRQPLP

SEQ ID NO: 873367 - protein, 18 aa, Mycobacterium
VLIFPNAIRVVEESGLPA

SEQ ID NO: 873368 - protein, 18 aa, Mycobacterium
VLIGGGPAPRRVVEAAAA

SEQ ID NO: 873369 - protein, 27 aa, Mycobacterium
VLIGKQFLYVERYMKLLAPKWQMMSDP

SEQ ID NO: 873370 - protein, 18 aa, Mycobacterium
VLIGSTADWLLHASPVPV

SEQ ID NO: 873371 - protein, 18 aa, Mycobacterium
VLILMLNRPEYVESWLAI

SEQ ID NO: 873372 - protein, 28 aa, Mycobacterium
VLIRHRVTVQWPWKLTIGDNSWIGVGSE

SEQ ID NO: 873373 - protein, 29 aa, Mycobacterium
VLISGERVIPQWVKIRNIDGFNGSYWQGG

SEQ ID NO: 873374 - protein, 17 aa, Mycobacterium
VLITTPESLFLMLTSAA

SEQ ID NO: 873375 - protein, 17 aa, Mycobacterium
VLIVFDDLTKQAEAYRA

SEQ ID NO: 873376 - protein, 20 aa, Mycobacterium
VLIVLIDDVGFGASSAFGGP

SEQ ID NO: 873377 - protein, 25 aa, Mycobacterium
VLKDTMVLEYVWPPDRTSVTWSLVS

SEQ ID NO: 873378 - protein, 18 aa, Mycobacterium
VLKEIRYGSFRRSFRLPA

SEQ ID NO: 873379 - protein, 31 aa, Mycobacterium
VLKEVQFRLGFLLDVGLQYLSLSRAAGTLSG

SEQ ID NO: 873380 - protein, 17 aa, Mycobacterium
VLKHAQMTLRRAGETVP

SEQ ID NO: 873381 - protein, 18 aa, Mycobacterium
VLKIPRLRDAYLKRFPDY

SEQ ID NO: 873382 - protein, 19 aa, Mycobacterium
VLKIRPPLVFSRSDVDWFC

SEQ ID NO: 873383 - protein, 17 aa, Mycobacterium
VLKLINWELASTEAAPS

SEQ ID NO: 873384 - protein, 27 aa, Mycobacterium
VLKLKHALFDKLVYGKLRAALGGRCHA

SEQ ID NO: 873385 - protein, 18 aa, Mycobacterium
VLKLKSGIDIPSDLRAEV

SEQ ID NO: 873386 - protein, 29 aa, Mycobacterium
VLKNYGVDVTIVEFLPRALPNEDAEVSKE

SEQ ID NO: 873387 - protein, 19 aa, Mycobacterium
VLKPAQLTPWSGSEYGRIV

SEQ ID NO: 873388 - protein, 26 aa, Mycobacterium
VLKPDEHAPLLALELAREFDAAGLPP

SEQ ID NO: 873389 - protein, 30 aa, Mycobacterium
VLKPDPHTPWNATRLGRLIAEKTDFPPGVV

SEQ ID NO: 873390 - protein, 21 aa, Mycobacterium
VLKQHLPRIYLPPIAQKVMLT

SEQ ID NO: 873391 - protein, 19 aa, Mycobacterium
VLKQLVAYVGLDAFLAGLR

SEQ ID NO: 873392 - protein, 21 aa, Mycobacterium
VLKRRAFADQPYWGRPVPGWG

SEQ ID NO: 873393 - protein, 21 aa, Mycobacterium
VLKRTIQTHRGWLFKHTGDGV

SEQ ID NO: 873394 - protein, 17 aa, Mycobacterium
VLLAWNPELAERILSAP

SEQ ID NO: 873395 - protein, 24 aa, Mycobacterium
VLLDLRGLSAVRYAPSGYLHAMTG

SEQ ID NO: 873396 - protein, 20 aa, Mycobacterium
VLLEFSGKSAALQAGLRTLD

SEQ ID NO: 873397 - protein, 18 aa, Mycobacterium
VLLEIGPQPVLTAAALRA

SEQ ID NO: 873398 - protein, 17 aa, Mycobacterium
VLLELLIDDLVVVARHA

SEQ ID NO: 873399 - protein, 21 aa, Mycobacterium
VLLENTPFFSAMLTAAGMSGI

SEQ ID NO: 873400 - protein, 19 aa, Mycobacterium
VLLGDDWDALPESLRSRWV

SEQ ID NO: 873401 - protein, 24 aa, Mycobacterium
VLLGDWLIQLPREVTVPAPEVVVG

SEQ ID NO: 873402 - protein, 17 aa, Mycobacterium
VLLHCYPYEREAGYLAQ

SEQ ID NO: 873403 - protein, 24 aa, Mycobacterium
VLLHDHYLIEKLAQFNRERVPERI

SEQ ID NO: 873404 - protein, 18 aa, Mycobacterium
VLLIGHLGHEETDGTLGV

SEQ ID NO: 873405 - protein, 17 aa, Mycobacterium
VLLISDIDALLPAAAEP

SEQ ID NO: 873406 - protein, 23 aa, Mycobacterium
VLLKIRLRQGLPMSRLDSAERER

SEQ ID NO: 873407 - protein, 18 aa, Mycobacterium
VLLLAAHVLAMDPASWRV

SEQ ID NO: 873408 - protein, 17 aa, Mycobacterium
VLLLCWRDTGHPQGGGS

SEQ ID NO: 873409 - protein, 30 aa, Mycobacterium
VLLLRESAGDRYLPIWIGQSEAAAIALEQQ

SEQ ID NO: 873410 - protein, 25 aa, Mycobacterium
VLLLVAHHIAWDDGSWRVFFTDLTR

SEQ ID NO: 873411 - protein, 25 aa, Mycobacterium
VLLMAVERIELFADALIKGGRPADT

SEQ ID NO: 873412 - protein, 30 aa, Mycobacterium
VLLMAVERIELFVEALLKGGRPADTPVLVV

SEQ ID NO: 873413 - protein, 29 aa, Mycobacterium
VLLMAVERIELFVKVLLKGGRPADTPVLV

SEQ ID NO: 873414 - protein, 17 aa, Mycobacterium
VLLMLAIVKCGAIAGML

SEQ ID NO: 873415 - protein, 18 aa, Mycobacterium
VLLPDFPVPDLRNALQEL

SEQ ID NO: 873416 - protein, 24 aa, Mycobacterium
VLLQLPNSCQFAVALFALLRAGVV

SEQ ID NO: 873417 - protein, 29 aa, Mycobacterium
VLLQLPNSCRFAVALFGLLRAGAIPVMCL

SEQ ID NO: 873418 - protein, 24 aa, Mycobacterium
VLLQRAPVPFLHHSSWQVDDVDAI

SEQ ID NO: 873419 - protein, 18 aa, Mycobacterium
VLLQVLFHARIAEDAPEH

SEQ ID NO: 873420 - protein, 18 aa, Mycobacterium
VLLQVLFHARIAEDAPHH

SEQ ID NO: 873421 - protein, 17 aa, Mycobacterium
VLLQVLFHARIAEDAPQ

SEQ ID NO: 873422 - protein, 18 aa, Mycobacterium
VLLQVLFHARIAEEAPQS

SEQ ID NO: 873423 - protein, 32 aa, Mycobacterium
VLLRDSILDGMRDLLLTRDWSAITLSHVAQAA

SEQ ID NO: 873424 - protein, 28 aa, Mycobacterium
VLLRLAEKAFRPAPLPFPVLHVDTGHNF

SEQ ID NO: 873425 - protein, 25 aa, Mycobacterium
VLLRNIMENPAWYTAYTPYQPEISQ

SEQ ID NO: 873426 - protein, 17 aa, Mycobacterium
VLLSAGHNFPLACPGLL

SEQ ID NO: 873427 - protein, 19 aa, Mycobacterium
VLLVDILDQALAATTAELD

SEQ ID NO: 873428 - protein, 17 aa, Mycobacterium
VLLVLFDRRGRFLDTAG

SEQ ID NO: 873429 - protein, 20 aa, Mycobacterium
VLMASAPPRGYLGSGVRWFR

SEQ ID NO: 873430 - protein, 28 aa, Mycobacterium
VLMDARATHPLLWKSGALHRSPDYAPNE

SEQ ID NO: 873431 - protein, 17 aa, Mycobacterium
VLMDMRLGDGSGAQATA

SEQ ID NO: 873432 - protein, 31 aa, Mycobacterium
VLMERYADFGLPEWSWPFIAESWRRSDPHVY

SEQ ID NO: 873433 - protein, 19 aa, Mycobacterium
VLMFMAHRDVETRVMAALG

SEQ ID NO: 873434 - protein, 17 aa, Mycobacterium
VLMFYRSANFDEEVFED

SEQ ID NO: 873435 - protein, 19 aa, Mycobacterium
VLMGGYFAGLLNRGVLGTT

SEQ ID NO: 873436 - protein, 18 aa, Mycobacterium
VLMLAPLAPHLAEELWLR

SEQ ID NO: 873437 - protein, 18 aa, Mycobacterium
VLMMADCFDLTLDEVKFS

SEQ ID NO: 873438 - protein, 17 aa, Mycobacterium
VLMRHAKSAYPDGVADH

SEQ ID NO: 873439 - protein, 17 aa, Mycobacterium
VLMSFPDEAAFRGWAQS

SEQ ID NO: 873440 - protein, 25 aa, Mycobacterium
VLMTATPFTATILGSPRIGPNRELK

SEQ ID NO: 873441 - protein, 19 aa, Mycobacterium
VLMTGYGFAPPLVTPTWGE

SEQ ID NO: 873442 - protein, 18 aa, Mycobacterium
VLMTRMANHMRDNGIRYG

SEQ ID NO: 873443 - protein, 17 aa, Mycobacterium
VLMVAPLAPHLAEELWK

SEQ ID NO: 873444 - protein, 23 aa, Mycobacterium
VLMVTYGISAERAFDILVWRSQE

SEQ ID NO: 873445 - protein, 26 aa, Mycobacterium
VLNAARRLRIVPAEGPASTLPAVLRA

SEQ ID NO: 873446 - protein, 24 aa, Mycobacterium
VLNGAGLATLLFDLLTPAEERNRA

SEQ ID NO: 873447 - protein, 24 aa, Mycobacterium
VLNGTKAFLPYLIASGDGHVINVS

SEQ ID NO: 873448 - protein, 17 aa, Mycobacterium
VLNIFPSVDTPVCAASV

SEQ ID NO: 873449 - protein, 26 aa, Mycobacterium
VLNKLRSKGIRRIVMLTGDHPDTAEV

SEQ ID NO: 873450 - protein, 25 aa, Mycobacterium
VLNLSPLCGGLPPEIAWPYLKRVGE

SEQ ID NO: 873451 - protein, 18 aa, Mycobacterium
VLNPWLSCGPRGIAPPCP

SEQ ID NO: 873452 - protein, 24 aa, Mycobacterium
VLNPWRLQMLSLLDTLGTVRSVAE

SEQ ID NO: 873453 - protein, 30 aa, Mycobacterium
VLNRETGRVRWYGPDELRFGYRTSILKGTS

SEQ ID NO: 873454 - protein, 18 aa, Mycobacterium
VLNRLRRAQGQLAGVISM

SEQ ID NO: 873455 - protein, 32 aa, Mycobacterium
VLNSPLPQLTAPWANLIKFLGGINFAIANFNP

SEQ ID NO: 873456 - protein, 28 aa, Mycobacterium
VLNTTFEPVAPPKPIAVPPGSEAAFAGA

SEQ ID NO: 873457 - protein, 27 aa, Mycobacterium
VLNVNFMPLNHLGGRIPLSTAFQAGGT

SEQ ID NO: 873458 - protein, 18 aa, Mycobacterium
VLPAAKFTERTLAEVRRR

SEQ ID NO: 873459 - protein, 21 aa, Mycobacterium
VLPALMVDRLTRHTAGHPGHV

SEQ ID NO: 873460 - protein, 17 aa, Mycobacterium
VLPAMITNTWGRILTIV

SEQ ID NO: 873461 - protein, 26 aa, Mycobacterium
VLPDGRPHLVAMWYAVVDGEIWFETK

SEQ ID NO: 873462 - protein, 18 aa, Mycobacterium
VLPDHELRRIAALCAAFD

SEQ ID NO: 873463 - protein, 20 aa, Mycobacterium
VLPDKPVCCGLTWISTGQLS

SEQ ID NO: 873464 - protein, 17 aa, Mycobacterium
VLPDLRTVEHYDRHLTL

SEQ ID NO: 873465 - protein, 17 aa, Mycobacterium
VLPDTELRRIAALCAAF

SEQ ID NO: 873466 - protein, 23 aa, Mycobacterium
VLPEAEHTFWVSDFADSSVPFPT

SEQ ID NO: 873467 - protein, 20 aa, Mycobacterium
VLPELIRRAVAVKADVVAAD

SEQ ID NO: 873468 - protein, 19 aa, Mycobacterium
VLPGARLQRLVLWRHLLTW

SEQ ID NO: 873469 - protein, 18 aa, Mycobacterium
VLPGMLERRRGDLIFVGS

SEQ ID NO: 873470 - protein, 25 aa, Mycobacterium
VLPGQSLLVYEMTPALFAAVAANEA

SEQ ID NO: 873471 - protein, 18 aa, Mycobacterium
VLPIMNPGGGIVGMDFDP

SEQ ID NO: 873472 - protein, 19 aa, Mycobacterium
VLPIPARVDLVDAAGLPEV

SEQ ID NO: 873473 - protein, 22 aa, Mycobacterium
VLPIPPTALQLSTGVAVLCYDD

SEQ ID NO: 873474 - protein, 30 aa, Mycobacterium
VLPIVPMFHANAWGLPYAALMAGADLVLPD

SEQ ID NO: 873475 - protein, 18 aa, Mycobacterium
VLPLLGGLAVMYGELPPL

SEQ ID NO: 873476 - protein, 24 aa, Mycobacterium
VLPLNFGPLSRPGGERRLNVAVTR

SEQ ID NO: 873477 - protein, 20 aa, Mycobacterium
VLPLTIGLDHRFVDGYQAAT

SEQ ID NO: 873478 - protein, 20 aa, Mycobacterium
VLPNEPWRPRKRALQPVFTP

SEQ ID NO: 873479 - protein, 18 aa, Mycobacterium
VLPPAAGTLIRLFHSETV

SEQ ID NO: 873480 - protein, 19 aa, Mycobacterium
VLPPEQIPVFRPDGSYIIT

SEQ ID NO: 873481 - protein, 19 aa, Mycobacterium
VLPPEWNLDFASALTRLLT

SEQ ID NO: 873482 - protein, 29 aa, Mycobacterium
VLPPPPAPLDPFAPPPPPPAPAPFDALAA

SEQ ID NO: 873483 - protein, 18 aa, Mycobacterium
VLPPTLHVDAPSPHIDWS

SEQ ID NO: 873484 - protein, 17 aa, Mycobacterium
VLPSMEAAFVDIGRGRN

SEQ ID NO: 873485 - protein, 26 aa, Mycobacterium
VLPSPTNWWSLTPGNYTAIIKQTLQA

SEQ ID NO: 873486 - protein, 29 aa, Mycobacterium
VLPSVTRPALALLGLLPGPVAGAVRTGLD

SEQ ID NO: 873487 - protein, 19 aa, Mycobacterium
VLPTAKFTDRVLAEVRRRG

SEQ ID NO: 873488 - protein, 26 aa, Mycobacterium
VLPTALRELIRYVRPPRLRRWVRDGY

SEQ ID NO: 873489 - protein, 31 aa, Mycobacterium
VLPTIRSRTHHYPFRLLAPKTMRTLIEKIVA

SEQ ID NO: 873490 - protein, 31 aa, Mycobacterium
VLPTIRSRTHHYPFRLLAPKTMRTLVEGICA

SEQ ID NO: 873491 - protein, 31 aa, Mycobacterium
VLPTIRSRTHHYPFRLLAPRTMRPLLERICA

SEQ ID NO: 873492 - protein, 17 aa, Mycobacterium
VLPTQITGRRFRFGPEP

SEQ ID NO: 873493 - protein, 18 aa, Mycobacterium
VLPTVWDAWSARLAVDAG

SEQ ID NO: 873494 - protein, 22 aa, Mycobacterium
VLPTYAVICCPAFGAAGKIGKF

SEQ ID NO: 873495 - protein, 22 aa, Mycobacterium
VLPTYAVICCPAFGAAGKVGTF

SEQ ID NO: 873496 - protein, 21 aa, Mycobacterium
VLPTYAVICCPAFGAAGLVGK

SEQ ID NO: 873497 - protein, 17 aa, Mycobacterium
VLPYLTDLTTLEQQQRW

SEQ ID NO: 873498 - protein, 17 aa, Mycobacterium
VLPYPVYKRLRDEAPLY

SEQ ID NO: 873499 - protein, 17 aa, Mycobacterium
VLQAAGKYPPPPGASEI

SEQ ID NO: 873500 - protein, 19 aa, Mycobacterium
VLQAAGKYPPPPGASEIIG

SEQ ID NO: 873501 - protein, 26 aa, Mycobacterium
VLQAAWAQLLTWLTGNYDVAFGTTVS

SEQ ID NO: 873502 - protein, 18 aa, Mycobacterium
VLQAHDIVFVPGLNEELA

SEQ ID NO: 873503 - protein, 17 aa, Mycobacterium
VLQALTSPLASAASSTA

SEQ ID NO: 873504 - protein, 22 aa, Mycobacterium
VLQANWTWAPSALQRGQVRRLS

SEQ ID NO: 873505 - protein, 25 aa, Mycobacterium
VLQAVILRAETDRPIWILLDSDENG

SEQ ID NO: 873506 - protein, 19 aa, Mycobacterium
VLQAVRYPELWRDNGGFDA

SEQ ID NO: 873507 - protein, 17 aa, Mycobacterium
VLQFAIRSFANYSAPVF

SEQ ID NO: 873508 - protein, 26 aa, Mycobacterium
VLQGAWAQLLTWLTGQHDVAFGTAVS

SEQ ID NO: 873509 - protein, 26 aa, Mycobacterium
VLQGAWTQLLTWLTGQHDVAFGTAVS

SEQ ID NO: 873510 - protein, 18 aa, Mycobacterium
VLQIPRLQDAYFKRFPEY

SEQ ID NO: 873511 - protein, 22 aa, Mycobacterium
VLQIPSLHDPQLAPEGKHAASA

SEQ ID NO: 873512 - protein, 28 aa, Mycobacterium
VLQQFPQIAQFYRRKFRHILVDEYQDTN

SEQ ID NO: 873513 - protein, 24 aa, Mycobacterium
VLQRFDRMYPTELPYISALHQYRD

SEQ ID NO: 873514 - protein, 27 aa, Mycobacterium
VLQRTADGLWYPLWDANVRLDHSVRTV

SEQ ID NO: 873515 - protein, 18 aa, Mycobacterium
VLQRVGERSWRIPATAFW

SEQ ID NO: 873516 - protein, 32 aa, Mycobacterium
VLQTASLDHALWFLRPFRADEWMLYDETSPSA

SEQ ID NO: 873517 - protein, 29 aa, Mycobacterium
VLQTEYNHSFKFVLLESLNADVLKAIYGA

SEQ ID NO: 873518 - protein, 28 aa, Mycobacterium
VLQTPFSGALPVPLVYSLGGFNFGTEGA

SEQ ID NO: 873519 - protein, 18 aa, Mycobacterium
VLQTVLDAVPFQLTTDGG

SEQ ID NO: 873520 - protein, 21 aa, Mycobacterium
VLQVPSVHDPDLAPPGKHAAS

SEQ ID NO: 873521 - protein, 19 aa, Mycobacterium
VLQWGVIVEKPKGLDDATT

SEQ ID NO: 873522 - protein, 20 aa, Mycobacterium
VLQYVRLRAGLTERERAAAR

SEQ ID NO: 873523 - protein, 19 aa, Mycobacterium
VLRADLLRPWANWITPEAE

SEQ ID NO: 873524 - protein, 24 aa, Mycobacterium
VLRAGDEMLFIADSFLERSVWAAM

SEQ ID NO: 873525 - protein, 24 aa, Mycobacterium
VLRAIRGLRYAEPVRRYLLGRYTG

SEQ ID NO: 873526 - protein, 17 aa, Mycobacterium
VLRAMGLPLAGLRVGDW

SEQ ID NO: 873527 - protein, 19 aa, Mycobacterium
VLRATRGTDYLILEMSARH

SEQ ID NO: 873528 - protein, 23 aa, Mycobacterium
VLRAVSAALKRAGGGASARIESI

SEQ ID NO: 873529 - protein, 18 aa, Mycobacterium
VLRAVWATIGYDLPLPLP

SEQ ID NO: 873530 - protein, 17 aa, Mycobacterium
VLRDGGYHEPEILRWLF

SEQ ID NO: 873531 - protein, 18 aa, Mycobacterium
VLRDNGFAIVRSEGTRRM

SEQ ID NO: 873532 - protein, 23 aa, Mycobacterium
VLRDTRFQIPPGLNLLVQGITSG

SEQ ID NO: 873533 - protein, 18 aa, Mycobacterium
VLRELLAAFIHALMGAEA

SEQ ID NO: 873534 - protein, 18 aa, Mycobacterium
VLRELLATFIHTLMGAEA

SEQ ID NO: 873535 - protein, 31 aa, Mycobacterium; identical to SEQ ID NO: 23023

SEQ ID NO: 873536 - protein, 34 aa, Mycobacterium
VLREPLTWLELVDRYRITVTWAPNFAYQLVTARL

SEQ ID NO: 873537 - protein, 24 aa, Mycobacterium
VLRETLRVFLREGGSYKAAAERLH

SEQ ID NO: 873538 - protein, 17 aa, Mycobacterium
VLRFIDPSSAATAAHNM

SEQ ID NO: 873539 - protein, 17 aa, Mycobacterium
VLRFVTVHKVALQGAEP

SEQ ID NO: 873540 - protein, 17 aa, Mycobacterium
VLRGLMCECGVPDHLAA

SEQ ID NO: 873541 - protein, 26 aa, Mycobacterium
VLRGRIERMHRSCLILTFGGGTNEIQ

SEQ ID NO: 873542 - protein, 25 aa, Mycobacterium
VLRGYTLPNGLQLRQQRVPLGVVGM

SEQ ID NO: 873543 - protein, 17 aa, Mycobacterium
VLRHWATARSALEAWQV

SEQ ID NO: 873544 - protein, 17 aa, Mycobacterium
VLRIPDALPLDAAAPLL

SEQ ID NO: 873545 - protein, 17 aa, Mycobacterium
VLRIPDSLPLDAAAPLL

SEQ ID NO: 873546 - protein, 18 aa, Mycobacterium
VLRKWRIFEREDFSGEAA

SEQ ID NO: 873547 - protein, 17 aa, Mycobacterium
VLRLDPRLAPVKVAVLP

SEQ ID NO: 873548 - protein, 34 aa, Mycobacterium
VLRLHQYLIGLRRRHPWLHSATTTPLLLTNTQYV

SEQ ID NO: 873549 - protein, 24 aa, Mycobacterium
VLRLLARGYTYREIAEDLVISVKT

SEQ ID NO: 873550 - protein, 18 aa, Mycobacterium
VLRLLRDGLPTVPRSRTI

SEQ ID NO: 873551 - protein, 18 aa, Mycobacterium
VLRLNPEPPARYPSGLIS

SEQ ID NO: 873552 - protein, 18 aa, Mycobacterium
VLRLRFDDFGRATRSRTL

SEQ ID NO: 873553 - protein, 24 aa, Mycobacterium
VLRPALQPETRLAAPLLAKGLPAC

SEQ ID NO: 873554 - protein, 24 aa, Mycobacterium
VLRPGLLVLSVRGAARYFGSEDAA

SEQ ID NO: 873555 - protein, 17 aa, Mycobacterium
VLRPLLDELGLVGYPKT

SEQ ID NO: 873556 - protein, 24 aa, Mycobacterium
VLRQFVGYIVEKRFNLSWAIEGTR

SEQ ID NO: 873557 - protein, 29 aa, Mycobacterium
VLRQQLAGRTLTRCDIRVPRFAAVDLSGH

SEQ ID NO: 873558 - protein, 32 aa, Mycobacterium
VLRQRDDGRWIWRWDPAFITSNFQFLQGDPAT

SEQ ID NO: 873559 - protein, 33 aa, Mycobacterium
VLRQRDDGRWIWRWDPAFITSNFQFLQGDPATG

SEQ ID NO: 873560 - protein, 31 aa, Mycobacterium
VLRQRDDGRWIWRWDPAFITSNLEFLRGDRA

SEQ ID NO: 873561 - protein, 24 aa, Mycobacterium
VLRQRLYGIATDRILGLPDGTVEV

SEQ ID NO: 873562 - protein, 17 aa, Mycobacterium
VLRQRVTALGVSRFDDG

SEQ ID NO: 873563 - protein, 21 aa, Mycobacterium
VLRQYLAERNALPDSSLVASV

SEQ ID NO: 873564 - protein, 19 aa, Mycobacterium
VLRRLEGHFTLVFANADDP

SEQ ID NO: 873565 - protein, 18 aa, Mycobacterium
VLRRLEGHFTLVFTNAEE

SEQ ID NO: 873566 - protein, 36 aa, Mycobacterium
VLRRLKRLPGFGDQKARIFLALLGKQYGVTPEGWRE

SEQ ID NO: 873567 - protein, 24 aa, Mycobacterium
VLRRLYSLLRPGGELRYLEHIASA

SEQ ID NO: 873568 - protein, 24 aa, Mycobacterium
VLRRNLIESPAWYTAYTPYQPEIS

SEQ ID NO: 873569 - protein, 23 aa, Mycobacterium
VLRRVGGAPYLHTLIATVPTAAN

SEQ ID NO: 873570 - protein, 21 aa, Mycobacterium
VLRSAALRVTRPRMAVLSAVG

SEQ ID NO: 873571 - protein, 19 aa, Mycobacterium
VLRSRFGFLAIHGGGLERM

SEQ ID NO: 873572 - protein, 22 aa, Mycobacterium
VLRTAALWESVFSDPSDMHGQL

SEQ ID NO: 873573 - protein, 17 aa, Mycobacterium
VLRTLRQDGPLLLAVDD

SEQ ID NO: 873574 - protein, 19 aa, Mycobacterium
VLRTYLLEGLAASRLALGQ

SEQ ID NO: 873575 - protein, 21 aa, Mycobacterium
VLRVFELHPLFNPAGYIEAEI

SEQ ID NO: 873576 - protein, 17 aa, Mycobacterium
VLRVGVADFRRSLERVM

SEQ ID NO: 873577 - protein, 20 aa, Mycobacterium
VLRVLAPLGLVFDENSPWLR

SEQ ID NO: 873578 - protein, 20 aa, Mycobacterium
VLRVLELHPLLNPAGYVVAE

SEQ ID NO: 873579 - protein, 19 aa, Mycobacterium
VLRVLGREPFLSDVLANGG

SEQ ID NO: 873580 - protein, 17 aa, Mycobacterium
VLRVLQLPDDRLEELLA

SEQ ID NO: 873581 - protein, 17 aa, Mycobacterium
VLRVLRMSPDPMSIAAI

SEQ ID NO: 873582 - protein, 17 aa, Mycobacterium
VLRVPRRGDKRALAETV

SEQ ID NO: 873583 - protein, 19 aa, Mycobacterium
VLRVTKPAAIVWAAQMGTV

SEQ ID NO: 873584 - protein, 25 aa, Mycobacterium
VLRWAQVFGQPLCWDDLSWLRSLTE

SEQ ID NO: 873585 - protein, 25 aa, Mycobacterium
VLSANQVTIWSALRAAGHKAVGPGQ

SEQ ID NO: 873586 - protein, 28 aa, Mycobacterium
VLSAQAAKFHSRFAQTLAAAAASYAGME

SEQ ID NO: 873587 - protein, 28 aa, Mycobacterium
VLSEELIENLFLPAFDTADAGPARDSAL

SEQ ID NO: 873588 - protein, 24 aa, Mycobacterium
VLSETFNVIVFQYPGRQDRAAEPS

SEQ ID NO: 873589 - protein, 33 aa, Mycobacterium
VLSGRKFYSTGALFADWILVRASLSDGSVTVPT

SEQ ID NO: 873590 - protein, 17 aa, Mycobacterium
VLSIEYRLAPEAPFPAA

SEQ ID NO: 873591 - protein, 17 aa, Mycobacterium
VLSLGRWDTREQLRIAI

SEQ ID NO: 873592 - protein, 18 aa, Mycobacterium
VLSLHGSFAECVLLETVV

SEQ ID NO: 873593 - protein, 20 aa, Mycobacterium
VLSNGWTWNQRWLNTIRNIR

SEQ ID NO: 873594 - protein, 25 aa, Mycobacterium
VLSQGWDVMDFIQQLQKLSGGNVAF

SEQ ID NO: 873595 - protein, 21 aa, Mycobacterium
VLSQPSLPLPLTPRHKRDPGL

SEQ ID NO: 873596 - protein, 19 aa, Mycobacterium
VLSQPSVPLPLTRAQRRDP

SEQ ID NO: 873597 - protein, 27 aa, Mycobacterium
VLSQRSKLLYDYFVELFAQVTNPPLDA

SEQ ID NO: 873598 - protein, 22 aa, Mycobacterium
VLSRARRCLQEGRSVILDGTWR

SEQ ID NO: 873599 - protein, 18 aa, Mycobacterium
VLSRFLHEFAGIESAWTA

SEQ ID NO: 873600 - protein, 26 aa, Mycobacterium
VLSRGMLEVLPLTHIRGRSLHDSFVI

SEQ ID NO: 873601 - protein, 27 aa, Mycobacterium
VLSRGMLEVLPLTHIRGRSLHDSFVIV

SEQ ID NO: 873602 - protein, 24 aa, Mycobacterium
VLSRIQRVIGPDQLLPLVADIDDP

SEQ ID NO: 873603 - protein, 18 aa, Mycobacterium
VLSRKQLLDTVWGDTWVG

SEQ ID NO: 873604 - protein, 17 aa, Mycobacterium
VLSRLLNAPVSVSATTT

SEQ ID NO: 873605 - protein, 25 aa, Mycobacterium
VLSRNTFHWVLAFADGELLTPSVFG

SEQ ID NO: 873606 - protein, 25 aa, Mycobacterium
VLSRNTFHWVLAFADSELLTPAVFT

SEQ ID NO: 873607 - protein, 19 aa, Mycobacterium
VLSRSKFDQLLLTAARRAV

SEQ ID NO: 873608 - protein, 25 aa, Mycobacterium
VLSRTRLLELVWGYDFDVETNVADV

SEQ ID NO: 873609 - protein, 17 aa, Mycobacterium
VLSRWHGVGPMGGTDLD

SEQ ID NO: 873610 - protein, 20 aa, Mycobacterium
VLSRYVEAIVWRTFAHERLE

SEQ ID NO: 873611 - protein, 21 aa, Mycobacterium
VLSRYVEAIVWRTFGQDRLEA

SEQ ID NO: 873612 - protein, 25 aa, Mycobacterium
VLSSPAIFEWFDISGADDIPPVFGG

SEQ ID NO: 873613 - protein, 27 aa, Mycobacterium
VLSSRSRLLYDYFVELFAQVTNPPLDA

SEQ ID NO: 873614 - protein, 23 aa, Mycobacterium
VLSVGSFQVFPGNGAYAAAKAAE

SEQ ID NO: 873615 - protein, 24 aa, Mycobacterium
VLSVHHGAIPKQLHFTKLTPQAGD

SEQ ID NO: 873616 - protein, 19 aa, Mycobacterium
VLSVLYLIYNEGYAASSGA

SEQ ID NO: 873617 - protein, 21 aa, Mycobacterium
VLSWGRVWELTDEQWDAVIGV

SEQ ID NO: 873618 - protein, 17 aa, Mycobacterium
VLSWLASLAPEALQAVQ

SEQ ID NO: 873619 - protein, 18 aa, Mycobacterium
VLTALHAVVLATGTRPNI

SEQ ID NO: 873620 - protein, 24 aa, Mycobacterium
VLTALPGAVVVRTAWVYTGGDGKD

SEQ ID NO: 873621 - protein, 21 aa, Mycobacterium
VLTAMAAGVVRRWLRDRGELP

SEQ ID NO: 873622 - protein, 28 aa, Mycobacterium
VLTDRDFGDWTYPLWPAISDGVLREIGT

SEQ ID NO: 873623 - protein, 17 aa, Mycobacterium
VLTDRPFDGWANQVWPQ

SEQ ID NO: 873624 - protein, 18 aa, Mycobacterium
VLTGLAKGFGQEADLLTG

SEQ ID NO: 873625 - protein, 22 aa, Mycobacterium
VLTHHHFDHVLGHPVFDGAQTF

SEQ ID NO: 873626 - protein, 19 aa, Mycobacterium
VLTIQRFAHLIGGARMGSD

SEQ ID NO: 873627 - protein, 19 aa, Mycobacterium
VLTIQRFAHLIGGARMGTR

SEQ ID NO: 873628 - protein, 17 aa, Mycobacterium
VLTKKPPRWVVVADLVE

SEQ ID NO: 873629 - protein, 20 aa, Mycobacterium
VLTLAMLGIPLKNWQMYSEP

SEQ ID NO: 873630 - protein, 19 aa, Mycobacterium
VLTLELPGGEPIPGVSFVF

SEQ ID NO: 873631 - protein, 18 aa, Mycobacterium
VLTLVLDSPGLNSVGPQM

SEQ ID NO: 873632 - protein, 20 aa, Mycobacterium
VLTMTYLDGLDWTAAQQADQ

SEQ ID NO: 873633 - protein, 29 aa, Mycobacterium
VLTPPAMIQAILSAPVDLLFNGGIGTYVK

SEQ ID NO: 873634 - protein, 26 aa, Mycobacterium
VLTQPALPRRSLPALLAAQAARTPAA

SEQ ID NO: 873635 - protein, 17 aa, Mycobacterium
VLTRRIAYLIAARGVGV

SEQ ID NO: 873636 - protein, 18 aa, Mycobacterium
VLTRTGAVRTGLYTPAVD

SEQ ID NO: 873637 - protein, 26 aa, Mycobacterium
VLTSMRPPILPALLNRPTRETIELRG

SEQ ID NO: 873638 - protein, 24 aa, Mycobacterium
VLTSQYAMILPAASAQAMVETNLL

SEQ ID NO: 873639 - protein, 19 aa, Mycobacterium
VLTTLARPDRRLAVVFGAG

SEQ ID NO: 873640 - protein, 17 aa, Mycobacterium
VLTTRFSVGSFDAVRRT

SEQ ID NO: 873641 - protein, 20 aa, Mycobacterium
VLTTTLADPTGYGRILRTQD

SEQ ID NO: 873642 - protein, 19 aa, Mycobacterium
VLTTTLSDPHGYGRILRTQ

SEQ ID NO: 873643 - protein, 20 aa, Mycobacterium
VLTTTLSDPHGYGRILRTQD

SEQ ID NO: 873644 - protein, 19 aa, Mycobacterium
VLTTTLSDPSGYGRILRTQ

SEQ ID NO: 873645 - protein, 27 aa, Mycobacterium
VLTTVPEHVFALSLPRSVTTAVPLVDE

SEQ ID NO: 873646 - protein, 25 aa, Mycobacterium
VLTVAELLRRTGVVGKFVDFYGPGV

SEQ ID NO: 873647 - protein, 18 aa, Mycobacterium
VLTVLARLGFGPDADGPD

SEQ ID NO: 873648 - protein, 24 aa, Mycobacterium
VLTVPDHIAPILSPFAGCAAAGAV

SEQ ID NO: 873649 - protein, 17 aa, Mycobacterium
VLTVRYHDTGDTETFLL

SEQ ID NO: 873650 - protein, 24 aa, Mycobacterium
VLTVVQRLLRSWDRPVRDVAVTLD

SEQ ID NO: 873651 - protein, 20 aa, Mycobacterium
VLTVVYPHNVALGGDLIALV

SEQ ID NO: 873652 - protein, 18 aa, Mycobacterium
VLTWIDWSDVDTGLLEFT

SEQ ID NO: 873653 - protein, 26 aa, Mycobacterium
VLTYIPPAPELLRQWAGRHIVVVGSG

SEQ ID NO: 873654 - protein, 18 aa, Mycobacterium
VLVAASRWTVRLAETGWG

SEQ ID NO: 873655 - protein, 35 aa, Mycobacterium
VLVAMNSLWELNLPRRDLRMLAARLGSDVPFALHG

SEQ ID NO: 873656 - protein, 17 aa, Mycobacterium
VLVCPYHHRAHHRGIIV

SEQ ID NO: 873657 - protein, 18 aa, Mycobacterium
VLVCPYHHRLHHRGLITI

SEQ ID NO: 873658 - protein, 29 aa, Mycobacterium
VLVDCLGTWLTAVLDDNGLWDKGSREATD

SEQ ID NO: 873659 - protein, 24 aa, Mycobacterium
VLVDFWASWCGPCRSFAPTFQASS

SEQ ID NO: 873660 - protein, 21 aa, Mycobacterium
VLVDLIELHLQGKQAHWNVVG

SEQ ID NO: 873661 - protein, 18 aa, Mycobacterium
VLVDLIELNLQGKQAHWN

SEQ ID NO: 873662 - protein, 23 aa, Mycobacterium
VLVDLSLTNLLAPVLPDLGTVHT

SEQ ID NO: 873663 - protein, 18 aa, Mycobacterium
VLVDWHRVATFRAPPGAA

SEQ ID NO: 873664 - protein, 20 aa, Mycobacterium
VLVFADCGFSLARAARRLQV

SEQ ID NO: 873665 - protein, 30 aa, Mycobacterium
VLVFGHGLLMDGRQWRKVIPLLPGCRCITP

SEQ ID NO: 873666 - protein, 17 aa, Mycobacterium
VLVGDPYQLAPVKARGG

SEQ ID NO: 873667 - protein, 19 aa, Mycobacterium
VLVGGERPNRPGWFLSPAV

SEQ ID NO: 873668 - protein, 22 aa, Mycobacterium
VLVGPVTWAVELDERWVVIGPN

SEQ ID NO: 873669 - protein, 33 aa, Mycobacterium
VLVGQPTLRHRLRLGVLAALDQRIAVRYALPGM

SEQ ID NO: 873670 - protein, 18 aa, Mycobacterium
VLVGRIHAYEGHDLAHVV

SEQ ID NO: 873671 - protein, 24 aa, Mycobacterium
VLVGRLHRIQAALAQPLVGEKVDV

SEQ ID NO: 873672 - protein, 28 aa, Mycobacterium
VLVGVQLALTALWRSYGVTPDAVIGHSM

SEQ ID NO: 873673 - protein, 31 aa, Mycobacterium
VLVHGLPMYHVHGLVLGLLGSLRVGNRFVHT

SEQ ID NO: 873674 - protein, 20 aa, Mycobacterium
VLVHGPLQAALLGRAIGDWV

SEQ ID NO: 873675 - protein, 17 aa, Mycobacterium
VLVIAGKDKGAKGKVIA

SEQ ID NO: 873676 - protein, 20 aa, Mycobacterium
VLVIAGKDKGAKGKVLKVYP

SEQ ID NO: 873677 - protein, 17 aa, Mycobacterium
VLVIAGKDKGAKGKVLQ

SEQ ID NO: 873678 - protein, 19 aa, Mycobacterium
VLVIAGKDKGAKGKVLQAY

SEQ ID NO: 873679 - protein, 18 aa, Mycobacterium
VLVKYVTFANLVAPHWWS

SEQ ID NO: 873680 - protein, 20 aa, Mycobacterium
VLVLAGRIHAYEGHDLRHVV

SEQ ID NO: 873681 - protein, 25 aa, Mycobacterium
VLVLDPPQPRVTPKGLQRLLGDYDK

SEQ ID NO: 873682 - protein, 18 aa, Mycobacterium
VLVLMDLGSAVLSAELAL

SEQ ID NO: 873683 - protein, 19 aa, Mycobacterium
VLVLSYHHPLELVKRYGTL

SEQ ID NO: 873684 - protein, 17 aa, Mycobacterium
VLVLVPNPDGFQDIGWD

SEQ ID NO: 873685 - protein, 18 aa, Mycobacterium
VLVNAAGLWQAGIPGYIG

SEQ ID NO: 873686 - protein, 18 aa, Mycobacterium
VLVNEQLISPPPVTVVRL

SEQ ID NO: 873687 - protein, 17 aa, Mycobacterium
VLVNNVGHWLRHPGNFV

SEQ ID NO: 873688 - protein, 17 aa, Mycobacterium
VLVPDNPTFVAAQLRLQ

SEQ ID NO: 873689 - protein, 21 aa, Mycobacterium
VLVPGLPRSVAFDDALYAAAA

SEQ ID NO: 873690 - protein, 21 aa, Mycobacterium
VLVPHALRLREAALLGAVDAA

SEQ ID NO: 873691 - protein, 17 aa, Mycobacterium
VLVPHLAGEPIGPKALA

SEQ ID NO: 873692 - protein, 17 aa, Mycobacterium
VLVPVNFMLTAEEICYI

SEQ ID NO: 873693 - protein, 17 aa, Mycobacterium
VLVPVNFMLTAEEVAYI

SEQ ID NO: 873694 - protein, 18 aa, Mycobacterium
VLVRPHDIRVGRNPDMAI

SEQ ID NO: 873695 - protein, 22 aa, Mycobacterium
VLVSGHHWGATGLKPRGPSDFL

SEQ ID NO: 873696 - protein, 17 aa, Mycobacterium
VLVSGRLLSDITKALPA

SEQ ID NO: 873697 - protein, 21 aa, Mycobacterium
VLVSLQRGLEQMGAFRTAAAL

SEQ ID NO: 873698 - protein, 20 aa, Mycobacterium
VLVSWLPQHHDMGLISAYLF

SEQ ID NO: 873699 - protein, 17 aa, Mycobacterium
VLVSYLPVGSEEADKFY

SEQ ID NO: 873700 - protein, 36 aa, Mycobacterium
VLVTDLAHGWIPAGINLPAGVRLLEPEQRTGRVSAL

SEQ ID NO: 873701 - protein, 38 aa, Mycobacterium
VLVTGGNGWLGRWLVLDWLERLAPNGGKVYALIRGADA

SEQ ID NO: 873702 - protein, 28 aa, Mycobacterium
VLVTGYDILFFWVARMMMFGTFVADGPA

SEQ ID NO: 873703 - protein, 29 aa, Mycobacterium
VLVTGYDILFFWVARMMMFGTFVGADDAI

SEQ ID NO: 873704 - protein, 28 aa, Mycobacterium
VLVTGYDILFFWVARMMMFGTFVGDDDA

SEQ ID NO: 873705 - protein, 28 aa, Mycobacterium
VLVTGYDILFFWVARMMMFGTFVGDDPA

SEQ ID NO: 873706 - protein, 29 aa, Mycobacterium
VLVTGYDILFFWVARMMMFGTFVGGDDVI

SEQ ID NO: 873707 - protein, 29 aa, Mycobacterium
VLVTGYDILFFWVARMMMFGTFVGGDEVI

SEQ ID NO: 873708 - protein, 29 aa, Mycobacterium
VLVTGYDILFFWVARMMMFGTFVGGDPAI

SEQ ID NO: 873709 - protein, 18 aa, Mycobacterium
VLVTLRRYRVDQAFVELM

SEQ ID NO: 873710 - protein, 25 aa, Mycobacterium
VLVTNDRWWGAKAITKRVTVWPQGA

SEQ ID NO: 873711 - protein, 20 aa, Mycobacterium
VLVVGRDHRTLLGLMLSSQE

SEQ ID NO: 873712 - protein, 17 aa, Mycobacterium
VLVVGRDRRVLLGLMVS

SEQ ID NO: 873713 - protein, 20 aa, Mycobacterium
VLVVLSQGQWRIGFYEASSV

SEQ ID NO: 873714 - protein, 24 aa, Mycobacterium
VLVVQRMLASRFIPRALLGTDRRL

SEQ ID NO: 873715 - protein, 30 aa, Mycobacterium
VLVVQRMLASRFSPRALLGTDRRLLELKDD

SEQ ID NO: 873716 - protein, 31 aa, Mycobacterium
VLVVSHVTPIKTILRLALDAGEGILYRLHLD

SEQ ID NO: 873717 - protein, 17 aa, Mycobacterium
VLVWQDMAGLSSGKAPR

SEQ ID NO: 873718 - protein, 18 aa, Mycobacterium
VLVWQDMAGLTSGKTAKF

SEQ ID NO: 873719 - protein, 18 aa, Mycobacterium
VLWAAHVVDRIAVGGRWH

SEQ ID NO: 873720 - protein, 21 aa, Mycobacterium
VLWAIGRVRPNTGWLPGELLD

SEQ ID NO: 873721 - protein, 18 aa, Mycobacterium
VLWGIQAAAAKFVELGVP

SEQ ID NO: 873722 - protein, 20 aa, Mycobacterium
VLWNSFVAQCSPGARLPLAD

SEQ ID NO: 873723 - protein, 17 aa, Mycobacterium
VLWTQEPAEYHGRFVDF

SEQ ID NO: 873724 - protein, 17 aa, Mycobacterium
VLYAVGRKALNYYKFRN

SEQ ID NO: 873725 - protein, 18 aa, Mycobacterium
VLYELMIAARTDDKLKET

SEQ ID NO: 873726 - protein, 18 aa, Mycobacterium
VLYRDALPQALAGLAEGD

SEQ ID NO: 873727 - protein, 17 aa, Mycobacterium
VLYYLVRAAELPAGVNR

SEQ ID NO: 873728 - protein, 18 aa, Mycobacterium
VMAALREPGIGVIAEVKR

SEQ ID NO: 873729 - protein, 33 aa, Mycobacterium
VMAAVRAKFKPEFINRLDDVLIFDGLNPEELVQ

SEQ ID NO: 873730 - protein, 23 aa, Mycobacterium
VMADEIFGPLLPIITYRSVDQAV

SEQ ID NO: 873731 - protein, 22 aa, Mycobacterium
VMADPLPYYRVLRDQHPVYYLP

SEQ ID NO: 873732 - protein, 24 aa, Mycobacterium
VMAEPLTYFFSDPAARDFVTGVAQ

SEQ ID NO: 873733 - protein, 22 aa, Mycobacterium
VMAFRDGVLVYRQAGAMPPAAL

SEQ ID NO: 873734 - protein, 19 aa, Mycobacterium
VMAGLRRRFPSGLGQDYID

SEQ ID NO: 873735 - protein, 23 aa, Mycobacterium
VMAIFYLRLPATFGIGTYGVSAD

SEQ ID NO: 873736 - protein, 18 aa, Mycobacterium
VMALFGAPAALEDHALRA

SEQ ID NO: 873737 - protein, 18 aa, Mycobacterium
VMALFYRYKSVGGSEYVS

SEQ ID NO: 873738 - protein, 17 aa, Mycobacterium
VMALPSGLKFQPVDVRD

SEQ ID NO: 873739 - protein, 19 aa, Mycobacterium
VMALVRDPDAAARYAADPA

SEQ ID NO: 873740 - protein, 25 aa, Mycobacterium
VMANPLPYYRILRDHHPVYYMPQWD

SEQ ID NO: 873741 - protein, 28 aa, Mycobacterium
VMAPRQWRGLRRWLGEPPDFQDPKYDVI

SEQ ID NO: 873742 - protein, 27 aa, Mycobacterium
VMARIDLRGVELTAARLRTALPRGGAD

SEQ ID NO: 873743 - protein, 17 aa, Mycobacterium
VMARYILQLEPFASLPA

SEQ ID NO: 873744 - protein, 20 aa, Mycobacterium
VMATIGVSPFLGADGASELS

SEQ ID NO: 873745 - protein, 25 aa, Mycobacterium
VMAVWTILRAMDALDLLPLRDRLDL

SEQ ID NO: 873746 - protein, 32 aa, Mycobacterium
VMAVWVILRAIDALQLMPLPNRLDLCEELGLT

SEQ ID NO: 873747 - protein, 20 aa, Mycobacterium
VMAYERVTLYGLPLAARRRV

SEQ ID NO: 873748 - protein, 18 aa, Mycobacterium
VMCALDLQLAPLEPFALC

SEQ ID NO: 873749 - protein, 28 aa, Mycobacterium
VMCFQDSLQALLPWRTVQANVEFALSLA

SEQ ID NO: 873750 - protein, 18 aa, Mycobacterium
VMCRAGYGRIVLTSSIGG

SEQ ID NO: 873751 - protein, 18 aa, Mycobacterium
VMCWVALDRGAKLAARQG

SEQ ID NO: 873752 - protein, 24 aa, Mycobacterium
VMDAYALRLLGSAALSRAARGEED

SEQ ID NO: 873753 - protein, 19 aa, Mycobacterium
VMDGAAFLGDAPSTWTCFF

SEQ ID NO: 873754 - protein, 18 aa, Mycobacterium
VMDQLRFGPADAPDTRRV

SEQ ID NO: 873755 - protein, 21 aa, Mycobacterium
VMDRSGGYLGLLSGRTSAEVF

SEQ ID NO: 873756 - protein, 24 aa, Mycobacterium
VMDVRFLPNPHWVDELRPLTGQDP

SEQ ID NO: 873757 - protein, 24 aa, Mycobacterium
VMDVRFLPNPHWVDELRPLTGQHP

SEQ ID NO: 873758 - protein, 24 aa, Mycobacterium
VMDVRFLPNPHWVDELRPLTGQHQ

SEQ ID NO: 873759 - protein, 21 aa, Mycobacterium
VMDVRFLPNPHWVDELRPRTG

SEQ ID NO: 873760 - protein, 23 aa, Mycobacterium
VMDYYALRLLGSAALGRAARGDV

SEQ ID NO: 873761 - protein, 18 aa, Mycobacterium
VMESLIPDYLAYGVQRQR

SEQ ID NO: 873762 - protein, 26 aa, Mycobacterium
VMFAPRPEYAFRHPLIRMVALESQLK

SEQ ID NO: 873763 - protein, 17 aa, Mycobacterium
VMFDRIMELPTKVLNRY

SEQ ID NO: 873764 - protein, 20 aa, Mycobacterium
VMFGPPGHLYTYRSHGIHVC

SEQ ID NO: 873765 - protein, 22 aa, Mycobacterium
VMFGPPGRLYTYRSHGIHVCAN

SEQ ID NO: 873766 - protein, 22 aa, Mycobacterium
VMFGVVPKWGFYLSSKAAFDIW

SEQ ID NO: 873767 - protein, 18 aa, Mycobacterium
VMGARIAGCRTIVAVDPV

SEQ ID NO: 873768 - protein, 25 aa, Mycobacterium
VMGDDPVIPRLFQAMGFLGDGAREI

SEQ ID NO: 873769 - protein, 19 aa, Mycobacterium
VMGFMRSPGRYLYHDVVLV

SEQ ID NO: 873770 - protein, 28 aa, Mycobacterium
VMGGLGLAGALWRFLPDRVRVLDFPTGF

SEQ ID NO: 873771 - protein, 25 aa, Mycobacterium
VMGLPSIFVGFSRQRGLAADGRCKA

SEQ ID NO: 873772 - protein, 17 aa, Mycobacterium
VMGNCVFHIAVQGFLRT

SEQ ID NO: 873773 - protein, 21 aa, Mycobacterium
VMGNLEFLIANGIHAVVGTTG

SEQ ID NO: 873774 - protein, 20 aa, Mycobacterium
VMGNLEFLIGNGIHAVVGTT

SEQ ID NO: 873775 - protein, 19 aa, Mycobacterium
VMGRRTWDSLPASARPLPG

SEQ ID NO: 873776 - protein, 19 aa, Mycobacterium
VMGSPGFFVEFSKQHALSD

SEQ ID NO: 873777 - protein, 17 aa, Mycobacterium
VMHINHTGPQLSAGLAA

SEQ ID NO: 873778 - protein, 20 aa, Mycobacterium
VMHTSRSLMWQYISSIVAGS

SEQ ID NO: 873779 - protein, 18 aa, Mycobacterium
VMIDIYSRYIVGVHVHAR

SEQ ID NO: 873780 - protein, 26 aa, Mycobacterium
VMIFGYMRLPAHLFGIGLYTVNLDLD

SEQ ID NO: 873781 - protein, 19 aa, Mycobacterium
VMIGSWFAGTYESPGDLMR

SEQ ID NO: 873782 - protein, 18 aa, Mycobacterium
VMILMLNRTEFVESVLAA

SEQ ID NO: 873783 - protein, 17 aa, Mycobacterium
VMIQLAEPAKTPALTFA

SEQ ID NO: 873784 - protein, 18 aa, Mycobacterium
VMIQNHFFQNVDIGLETM

SEQ ID NO: 873785 - protein, 17 aa, Mycobacterium
VMISDKKLAWPADLKLG

SEQ ID NO: 873786 - protein, 26 aa, Mycobacterium
VMISTAHDLLLWAKELRDGTLLSPEL

SEQ ID NO: 873787 - protein, 24 aa, Mycobacterium
VMKKAVAYLLPFIEAEKEDNGTAG

SEQ ID NO: 873788 - protein, 23 aa, Mycobacterium
VMKKAVAYLLPFIEAEKEQNGAS

SEQ ID NO: 873789 - protein, 26 aa, Mycobacterium
VMKKAVAYLLPFIEKEKEQNGTAAAK

SEQ ID NO: 873790 - protein, 33 aa, Mycobacterium
VMLAAAGHFALSYRAVCERLHTAGLRTAVIGHD

SEQ ID NO: 873791 - protein, 22 aa, Mycobacterium
VMLGGLAMKWRWRARTKDWKGR

SEQ ID NO: 873792 - protein, 18 aa, Mycobacterium
VMLGYWREDEKTAQAIDA

SEQ ID NO: 873793 - protein, 23 aa, Mycobacterium
VMLHLAVKAFRPGRLPFPVMHVD

SEQ ID NO: 873794 - protein, 19 aa, Mycobacterium
VMLKTRLRTGLPAATLSAR

SEQ ID NO: 873795 - protein, 19 aa, Mycobacterium
VMLLHCYPYEREAGYLAQA

SEQ ID NO: 873796 - protein, 26 aa, Mycobacterium
VMLNGVYFTVDAALPALLRNPDGGAI

SEQ ID NO: 873797 - protein, 18 aa, Mycobacterium
VMLPGHASLPNGFGLDYV

SEQ ID NO: 873798 - protein, 18 aa, Mycobacterium
VMLPYLPVDKEHPIERLR

SEQ ID NO: 873799 - protein, 19 aa, Mycobacterium
VMLRFATPASAIAGARRIF

SEQ ID NO: 873800 - protein, 24 aa, Mycobacterium
VMLRMPMHPVAIELLRAVGPMAVS

SEQ ID NO: 873801 - protein, 17 aa, Mycobacterium
VMLTASTRRLVEGAATL

SEQ ID NO: 873802 - protein, 21 aa, Mycobacterium
VMMHSLSQIALMAPGPEVAAL

SEQ ID NO: 873803 - protein, 21 aa, Mycobacterium
VMMNAGIIPPADGYLAEIRDL

SEQ ID NO: 873804 - protein, 18 aa, Mycobacterium
VMNEYWVRHLCGESGASL

SEQ ID NO: 873805 - protein, 17 aa, Mycobacterium
VMNGRFLREVPGMCGVV

SEQ ID NO: 873806 - protein, 24 aa, Mycobacterium
VMNLGVRVAPLLKLGGSPLRLSAS

SEQ ID NO: 873807 - protein, 19 aa, Mycobacterium
VMNSLIGKVKIPGPIAAKA

SEQ ID NO: 873808 - protein, 26 aa, Mycobacterium
VMPHEPKFPFFDYPYVVALVELEEGV

SEQ ID NO: 873809 - protein, 29 aa, Mycobacterium
VMPHEPKFPFFEYPYVVVLVELAEGVRLV

SEQ ID NO: 873810 - protein, 28 aa, Mycobacterium
VMPHQPRFPFFDYPYIVVLVELAEGVRL

SEQ ID NO: 873811 - protein, 18 aa, Mycobacterium
VMPLPPNVGLVDAAALPE

SEQ ID NO: 873812 - protein, 18 aa, Mycobacterium
VMPMDAWRQGEEFVVEFD

SEQ ID NO: 873813 - protein, 19 aa, Mycobacterium
VMPMDVWRDGDTFIVELDV

SEQ ID NO: 873814 - protein, 26 aa, Mycobacterium
VMPPSLLHTWFELLGPEKIVTAYGMT

SEQ ID NO: 873815 - protein, 24 aa, Mycobacterium
VMPQPMRTGIRFIGKWAMGEYPYH

SEQ ID NO: 873816 - protein, 23 aa, Mycobacterium
VMPTIYGDTWLVRVEDRPVNIAY

SEQ ID NO: 873817 - protein, 21 aa, Mycobacterium
VMPVLKKWRIFEREDFNGESA

SEQ ID NO: 873818 - protein, 23 aa, Mycobacterium
VMPVLRKWRIFEREDFTGEGARL

SEQ ID NO: 873819 - protein, 22 aa, Mycobacterium
VMPVLRKWRIFEREDFTGEGAW

SEQ ID NO: 873820 - protein, 17 aa, Mycobacterium
VMQANLADLPLPDASMD

SEQ ID NO: 873821 - protein, 24 aa, Mycobacterium
VMQKLAPLGPVYQAGTLSGNPVAM

SEQ ID NO: 873822 - protein, 22 aa, Mycobacterium
VMRAHQILLARVEAALRPYDLS

SEQ ID NO: 873823 - protein, 19 aa, Mycobacterium
VMRGMLAFLAVNSTYRGPF

SEQ ID NO: 873824 - protein, 20 aa, Mycobacterium
VMRGMLAFLAVNSTYRGPYT

SEQ ID NO: 873825 - protein, 18 aa, Mycobacterium
VMRHIPIQTLLETTGRKS

SEQ ID NO: 873826 - protein, 19 aa, Mycobacterium
VMRIKPQTVLTLWAEDAYG

SEQ ID NO: 873827 - protein, 27 aa, Mycobacterium
VMRLRDLLKFEFYFADSAAYREHVREE

SEQ ID NO: 873828 - protein, 25 aa, Mycobacterium
VMRLYEALRPYRSSAEDLDALQASL

SEQ ID NO: 873829 - protein, 17 aa, Mycobacterium
VMRRYRDSDRLAWLAEH

SEQ ID NO: 873830 - protein, 27 aa, Mycobacterium
VMRSDRGFFCLPEVNVGLPFTPGMSAL

SEQ ID NO: 873831 - protein, 21 aa, Mycobacterium
VMRSLGLPTMFPTIGGHEGSG

SEQ ID NO: 873832 - protein, 19 aa, Mycobacterium
VMRTLMARGLITEAGTDAD

SEQ ID NO: 873833 - protein, 21 aa, Mycobacterium
VMRVAVGWLAEPLATMAGYHL

SEQ ID NO: 873834 - protein, 22 aa, Mycobacterium
VMRWRRPRWGARLGVEPVTALL

SEQ ID NO: 873835 - protein, 27 aa, Mycobacterium
VMSAETDWIGLTAEYLLAVRHDPQQAQ

SEQ ID NO: 873836 - protein, 19 aa, Mycobacterium
VMSEGCVMVLLKRLDDAVR

SEQ ID NO: 873837 - protein, 18 aa, Mycobacterium
VMSFLALDDPAHLRLRTL

SEQ ID NO: 873838 - protein, 17 aa, Mycobacterium
VMSGYWKAPERTAEVID

SEQ ID NO: 873839 - protein, 17 aa, Mycobacterium
VMSLVRDPEAAARYAAD

SEQ ID NO: 873840 - protein, 17 aa, Mycobacterium
VMSMLLTQSARSLSNEE

SEQ ID NO: 873841 - protein, 31 aa, Mycobacterium
VMSNEGFGYIPWGVFLPRTARLLAADERVDN

SEQ ID NO: 873842 - protein, 18 aa, Mycobacterium
VMSNLGLHLAMRSAGITV

SEQ ID NO: 873843 - protein, 20 aa, Mycobacterium
VMSQFRASFIGKVSPVHFFW

SEQ ID NO: 873844 - protein, 25 aa, Mycobacterium
VMSQLRTALRMQIVAGYPVAEALAA

SEQ ID NO: 873845 - protein, 24 aa, Mycobacterium
VMSQLRTALRMQVVAGYPIAEALE

SEQ ID NO: 873846 - protein, 19 aa, Mycobacterium
VMSRWLATVLPGGAAPEVS

SEQ ID NO: 873847 - protein, 18 aa, Mycobacterium
VMSVPLRNGKPITGRSFV

SEQ ID NO: 873848 - protein, 25 aa, Mycobacterium
VMTARLRAPELLLIHGGASGIGTHA

SEQ ID NO: 873849 - protein, 17 aa, Mycobacterium
VMTATPIPRTVALTVYG

SEQ ID NO: 873850 - protein, 26 aa, Mycobacterium
VMTDLAQHLLGGRYLLAMTGSAPISD

SEQ ID NO: 873851 - protein, 24 aa, Mycobacterium
VMTELPLLVIDVQRGGPSTGLPTK

SEQ ID NO: 873852 - protein, 21 aa, Mycobacterium
VMTNEIFGPILPVLTVKSLDE

SEQ ID NO: 873853 - protein, 33 aa, Mycobacterium
VMTPPSHILGLLNIIMALDTGAWIRLHRRFDID

SEQ ID NO: 873854 - protein, 23 aa, Mycobacterium
VMTQELLEFPGGVLGVALNLDEH

SEQ ID NO: 873855 - protein, 24 aa, Mycobacterium
VMTQELLEFPGGVLGVALNLDERS

SEQ ID NO: 873856 - protein, 18 aa, Mycobacterium
VMTTPKWVHNRIQPIAIR

SEQ ID NO: 873857 - protein, 19 aa, Mycobacterium
VMTTPKWVHNRIQPIAVHD

SEQ ID NO: 873858 - protein, 33 aa, Mycobacterium
VMVFGHGLLMDGRQWRKVLPQLPEYRCITPTLP

SEQ ID NO: 873859 - protein, 23 aa, Mycobacterium
VMVGGSMWGTLWVTGVDGRRFDD

SEQ ID NO: 873860 - protein, 22 aa, Mycobacterium
VMVHSCAPELPWELLRRSAIGA

SEQ ID NO: 873861 - protein, 17 aa, Mycobacterium
VMVKPAMGYLDIVSAAA

SEQ ID NO: 873862 - protein, 18 aa, Mycobacterium
VMVPMSAEPDRIRRVSEL

SEQ ID NO: 873863 - protein, 20 aa, Mycobacterium
VMVPVNFMLGPDEIAFILGH

SEQ ID NO: 873864 - protein, 19 aa, Mycobacterium
VMVSALWVTSSAQLALVIH

SEQ ID NO: 873865 - protein, 18 aa, Mycobacterium
VMVWLHGGAYLLGSGSQP

SEQ ID NO: 873866 - protein, 18 aa, Mycobacterium
VMVWTDIAELPYLRTRLS

SEQ ID NO: 873867 - protein, 20 aa, Mycobacterium
VMWAATLAGIAFGNAGVHLP

SEQ ID NO: 873868 - protein, 17 aa, Mycobacterium
VMYAIGDAAAEIEASRN

SEQ ID NO: 873869 - protein, 20 aa, Mycobacterium
VMYGLFHGPRLREMDARHGG

SEQ ID NO: 873870 - protein, 27 aa, Mycobacterium
VNAAAPDVIRLAPPLIITEDQLDGFIA

SEQ ID NO: 873871 - protein, 20 aa, Mycobacterium
VNAATGFPLVTGPVGHAGPV

SEQ ID NO: 873872 - protein, 24 aa, Mycobacterium
VNAAYRVLSPPIDSIGLLTREVYP

SEQ ID NO: 873873 - protein, 27 aa, Mycobacterium
VNADSGPALLLGARGRRIDVRQARTVV

SEQ ID NO: 873874 - protein, 34 aa, Mycobacterium
VNAFYTSRCNLIAWDRGVFMPVAQKYFGDMSVNG

SEQ ID NO: 873875 - protein, 21 aa, Mycobacterium
VNAGFLERLAGLGSGRAELVE

SEQ ID NO: 873876 - protein, 18 aa, Mycobacterium
VNAGPIYVMARIDDPWVQ

SEQ ID NO: 873877 - protein, 27 aa, Mycobacterium
VNAIAPIARTRLTLATPGMGALMGEPE

SEQ ID NO: 873878 - protein, 18 aa, Mycobacterium
VNAIDWVCDAPAGLIGAE

SEQ ID NO: 873879 - protein, 24 aa, Mycobacterium
VNALALDGLPGIALPITGSDSGDA

SEQ ID NO: 873880 - protein, 18 aa, Mycobacterium
VNALFEHLACRLNPKPGD

SEQ ID NO: 873881 - protein, 22 aa, Mycobacterium
VNALQPIEWRYTNDPSWVMRDK

SEQ ID NO: 873882 - protein, 22 aa, Mycobacterium
VNALQPIEWRYTNDPSWVMREK

SEQ ID NO: 873883 - protein, 20 aa, Mycobacterium
VNALTALLRVAALGIDARKP

SEQ ID NO: 873884 - protein, 26 aa, Mycobacterium
VNARGRDWLVLPGSPPGALLVRPLGG

SEQ ID NO: 873885 - protein, 25 aa, Mycobacterium
VNARPAPLVTYWFGPDDHDFRSFVR

SEQ ID NO: 873886 - protein, 22 aa, Mycobacterium
VNAVALLRRSLDEAGFVAVGVQ

SEQ ID NO: 873887 - protein, 17 aa, Mycobacterium
VNCVGIFDFYRGVGDID

SEQ ID NO: 873888 - protein, 26 aa, Mycobacterium
VNDELIGILGGQTRELVFAKTPPTVI

SEQ ID NO: 873889 - protein, 31 aa, Mycobacterium
VNDERARQMLRFLSSPLWRAYTSTYIEGYRL

SEQ ID NO: 873890 - protein, 32 aa, Mycobacterium
VNDERARQMLRFLSSPLWRAYTSTYVEGYRLL

SEQ ID NO: 873891 - protein, 24 aa, Mycobacterium
VNDLRLTLGVLLDVGPRGPERLPA

SEQ ID NO: 873892 - protein, 24 aa, Mycobacterium
VNDLRLTLGVLLNVGPQGPERLPA

SEQ ID NO: 873893 - protein, 22 aa, Mycobacterium
VNDLYLPLRYGQVSLQEKMPRR

SEQ ID NO: 873894 - protein, 25 aa, Mycobacterium
VNDQAWIEEYFIPTVAKRGAAIIDA

SEQ ID NO: 873895 - protein, 17 aa, Mycobacterium
VNDQPWRADLLGRKLHA

SEQ ID NO: 873896 - protein, 24 aa, Mycobacterium
VNDVRLALGTLLEIGPDGPDRLPP

SEQ ID NO: 873897 - protein, 21 aa, Mycobacterium
VNDWLLDRWLDPDPTNRFRGT

SEQ ID NO: 873898 - protein, 26 aa, Mycobacterium
VNEAFAPVPLAWLRDIGADEKKLNPN

SEQ ID NO: 873899 - protein, 26 aa, Mycobacterium
VNEAFAPVPLAWLRDIGADENRLNPN

SEQ ID NO: 873900 - protein, 20 aa, Mycobacterium
VNEFGWTGPLGVTYPGVVTH

SEQ ID NO: 873901 - protein, 25 aa, Mycobacterium
VNEFQYFVEMWNRAAGVMESYASAT

SEQ ID NO: 873902 - protein, 26 aa, Mycobacterium
VNEIKINWVWNPPWGPDKITEDGREQ

SEQ ID NO: 873903 - protein, 26 aa, Mycobacterium
VNEMQINWVWNPPWGPDKITEDGREQ

SEQ ID NO: 873904 - protein, 23 aa, Mycobacterium
VNEQSWVMMLEHDRFRGFIADDI

SEQ ID NO: 873905 - protein, 29 aa, Mycobacterium
VNESRLTFLAVRRWYGWSAGRIINLDIGG

SEQ ID NO: 873906 - protein, 24 aa, Mycobacterium
VNETDYFVRMWNQAAAAMDRYQAE

SEQ ID NO: 873907 - protein, 31 aa, Mycobacterium
VNETEAAEWHWPVRHLVITRGARGASYVSDD

SEQ ID NO: 873908 - protein, 19 aa, Mycobacterium
VNFGAFVDLGGVDGLVHVS

SEQ ID NO: 873909 - protein, 18 aa, Mycobacterium
VNFLGVVELLEAWRPALA

SEQ ID NO: 873910 - protein, 25 aa, Mycobacterium
VNFQLLAVPFHLYSDGMDLVIFEEF

SEQ ID NO: 873911 - protein, 26 aa, Mycobacterium
VNFRDVLVVLGMYPGQAPPLGGEGAG

SEQ ID NO: 873912 - protein, 19 aa, Mycobacterium
VNFVYGIPAYAVSIAVQLD

SEQ ID NO: 873913 - protein, 34 aa, Mycobacterium
VNGAPALVLVSWPERGPLLGVDLEGSLYTSTDNA

SEQ ID NO: 873914 - protein, 29 aa, Mycobacterium
VNGEWRIGRLRAYWELPAMMRQFLRTGSR

SEQ ID NO: 873915 - protein, 21 aa, Mycobacterium
VNGGWTVMRFALDAEHGITEV

SEQ ID NO: 873916 - protein, 25 aa, Mycobacterium
VNGHRRLIGLSINPGILGMGAHDVA

SEQ ID NO: 873917 - protein, 25 aa, Mycobacterium
VNGKPWPYAPRVILKSLIQRCADAG

SEQ ID NO: 873918 - protein, 30 aa, Mycobacterium
VNGKSWLMFGPFAGWSPKFLKRGHLRDLPG

SEQ ID NO: 873919 - protein, 21 aa, Mycobacterium
VNGKTYAIKGTATGLDMSNPQ

SEQ ID NO: 873920 - protein, 23 aa, Mycobacterium
VNGKVWEITPIPAPAVLRDSESW

SEQ ID NO: 873921 - protein, 19 aa, Mycobacterium
VNGLLGRPGAQPGPIGPVP

SEQ ID NO: 873922 - protein, 18 aa, Mycobacterium
VNGLLTHGIAESAMFAPA

SEQ ID NO: 873923 - protein, 17 aa, Mycobacterium
VNGLNLYRQNMPAPMLA

SEQ ID NO: 873924 - protein, 26 aa, Mycobacterium
VNGPPVFFFGHSMGGLLAFEVARRFE

SEQ ID NO: 873925 - protein, 19 aa, Mycobacterium
VNGRLIEWEKGDFVTLPVG

SEQ ID NO: 873926 - protein, 18 aa, Mycobacterium
VNGVLPYRDLFTPNVVGT

SEQ ID NO: 873927 - protein, 18 aa, Mycobacterium
VNGVLPYRELFGPNVAGT

SEQ ID NO: 873928 - protein, 20 aa, Mycobacterium
VNGVRRVISVRLLATDNPED

SEQ ID NO: 873929 - protein, 33 aa, Mycobacterium
VNGVRWWNVKHPNTYARRLLGEGQLPVGGHEIL

SEQ ID NO: 873930 - protein, 27 aa, Mycobacterium
VNGYNPFSALWYNTEGLPYFSVGMGNF

SEQ ID NO: 873931 - protein, 22 aa, Mycobacterium
VNHFIPNPTFDPIIVPGCLDLL

SEQ ID NO: 873932 - protein, 24 aa, Mycobacterium
VNHLELIRDWFGRPLWEIQPADAD

SEQ ID NO: 873933 - protein, 22 aa, Mycobacterium
VNHVLPAWDVSCGLYVALAVTA

SEQ ID NO: 873934 - protein, 33 aa, Mycobacterium
VNIFMNIPVTDGGHLSWLPAVSRAGDAVTFEAD

SEQ ID NO: 873935 - protein, 19 aa, Mycobacterium
VNIGMLPDETFSPGDWVII

SEQ ID NO: 873936 - protein, 25 aa, Mycobacterium
VNIHIEGVGWVTIDGTRSQIAQLLG

SEQ ID NO: 873937 - protein, 19 aa, Mycobacterium
VNIHSVLSWLGGAGAYGAS

SEQ ID NO: 873938 - protein, 22 aa, Mycobacterium
VNIMSLFGLHRRLRGAAIGHFA

SEQ ID NO: 873939 - protein, 18 aa, Mycobacterium
VNIPIDLRQDWPAALLDS

SEQ ID NO: 873940 - protein, 30 aa, Mycobacterium
VNIVYLTAPVLTVLPPHGLTGVHTLLVGAE

SEQ ID NO: 873941 - protein, 18 aa, Mycobacterium
VNKFRGDLDLLAPGLRDL

SEQ ID NO: 873942 - protein, 17 aa, Mycobacterium
VNKVRWVWEIVCQAVAA

SEQ ID NO: 873943 - protein, 26 aa, Mycobacterium
VNLAAMVQRLLGLQLMKGHGAADWSK

SEQ ID NO: 873944 - protein, 30 aa, Mycobacterium
VNLGRLARLLRLLGLDVWWSSAADDPTLVD

SEQ ID NO: 873945 - protein, 23 aa, Mycobacterium
VNLHLVLGSWRILGSVQQALRIV

SEQ ID NO: 873946 - protein, 24 aa, Mycobacterium
VNLHLVLGSWRMLGAVQQSLNIAT

SEQ ID NO: 873947 - protein, 25 aa, Mycobacterium
VNLIGTFNVLRLAAERIAKTEPIGE

SEQ ID NO: 873948 - protein, 25 aa, Mycobacterium
VNLIGTFNVLRLAAERIAKTEPIGP

SEQ ID NO: 873949 - protein, 19 aa, Mycobacterium
VNLIWRNLASIPGALRWTW

SEQ ID NO: 873950 - protein, 19 aa, Mycobacterium
VNLLFFTGDAMARPLLDAL

SEQ ID NO: 873951 - protein, 19 aa, Mycobacterium
VNLLLPFVHRAHVAVCVDA

SEQ ID NO: 873952 - protein, 27 aa, Mycobacterium
VNLMLTPILSIFYTQAGLSAPDGRCRP

SEQ ID NO: 873953 - protein, 18 aa, Mycobacterium
VNLMRWKLEHELGYAITH

SEQ ID NO: 873954 - protein, 28 aa, Mycobacterium
VNLRGYVAAMKYAIPRMLDRGGGAIVNM

SEQ ID NO: 873955 - protein, 18 aa, Mycobacterium
VNLRPGRLYPGVSSPLAG

SEQ ID NO: 873956 - protein, 20 aa, Mycobacterium
VNLSGVWKTVKAGVPHILAG

SEQ ID NO: 873957 - protein, 25 aa, Mycobacterium
VNLTGTFLCIRAALPDMVKAQWGRI

SEQ ID NO: 873958 - protein, 25 aa, Mycobacterium
VNLTGTFLMTRQALPALLESGRGVV

SEQ ID NO: 873959 - protein, 29 aa, Mycobacterium
VNLTQFYHMLDITTGWQYAYGPAGFAQHQ

SEQ ID NO: 873960 - protein, 20 aa, Mycobacterium
VNMAAFLNTALGPGADERRI

SEQ ID NO: 873961 - protein, 19 aa, Mycobacterium
VNMEPFFDAYRAVKPFLVT

SEQ ID NO: 873962 - protein, 19 aa, Mycobacterium
VNNAAIYGGMKLDLLLTVP

SEQ ID NO: 873963 - protein, 24 aa, Mycobacterium
VNNAGVMPIGPFLSTSDRAIRSML

SEQ ID NO: 873964 - protein, 24 aa, Mycobacterium
VNNGYIPRHLNFRQLTPHASEAAT

SEQ ID NO: 873965 - protein, 25 aa, Mycobacterium
VNNIRPLYEPGQKQALWLTERRSQV

SEQ ID NO: 873966 - protein, 17 aa, Mycobacterium
VNNKKLAVRYHLLNFLD

SEQ ID NO: 873967 - protein, 24 aa, Mycobacterium
VNPCGRLPITFPVGLGQTPRPELP

SEQ ID NO: 873968 - protein, 18 aa, Mycobacterium
VNPIAFPVSHIGGAAMLA

SEQ ID NO: 873969 - protein, 28 aa, Mycobacterium
VNPMNSAVFFLLGLYALLITTNHWPTGH

SEQ ID NO: 873970 - protein, 17 aa, Mycobacterium
VNPPKPPAAIKIDPPPP

SEQ ID NO: 873971 - protein, 23 aa, Mycobacterium
VNPREEFVHRLRLHQFAAGTGIA

SEQ ID NO: 873972 - protein, 23 aa, Mycobacterium
VNPRPVFVERIRLHQLAAGSGTA

SEQ ID NO: 873973 - protein, 18 aa, Mycobacterium
VNPRRHLAELRLADNEDA

SEQ ID NO: 873974 - protein, 27 aa, Mycobacterium
VNPVNSAVFFLLGFYALLVTTNDWPTR

SEQ ID NO: 873975 - protein, 24 aa, Mycobacterium
VNPVRLRLGIGYVIQNAGLMPHQR

SEQ ID NO: 873976 - protein, 18 aa, Mycobacterium
VNQAFLAPARIDLAALRA

SEQ ID NO: 873977 - protein, 18 aa, Mycobacterium
VNQGWRLARTTLANERVA

SEQ ID NO: 873978 - protein, 23 aa, Mycobacterium
VNQGYTMDPFAPFGGVKGSGYGR

SEQ ID NO: 873979 - protein, 25 aa, Mycobacterium
VNQQEVMIWFNHQGPIQPVGSVVGN

SEQ ID NO: 873980 - protein, 24 aa, Mycobacterium
VNQSDTIVLRRSRPLEISTDGGGT

SEQ ID NO: 873981 - protein, 23 aa, Mycobacterium
VNQYLAVSALIAGGLYGIERDLE

SEQ ID NO: 873982 - protein, 17 aa, Mycobacterium
VNRAPAKVPYTRGLHPV

SEQ ID NO: 873983 - protein, 19 aa, Mycobacterium
VNRLAIMVRGNLGAALQGF

SEQ ID NO: 873984 - protein, 20 aa, Mycobacterium
VNRLLLNNIDVVGVGWGAWA

SEQ ID NO: 873985 - protein, 28 aa, Mycobacterium
VNRRLLGKYLPELPPPGGVADLDRVAHL

SEQ ID NO: 873986 - protein, 18 aa, Mycobacterium
VNRRLQRPLIKLRPNLQS

SEQ ID NO: 873987 - protein, 17 aa, Mycobacterium
VNRVWFLDAVRGEADVY

SEQ ID NO: 873988 - protein, 17 aa, Mycobacterium
VNRWLRELPASGAPARS

SEQ ID NO: 873989 - protein, 28 aa, Mycobacterium
VNRYLPRFIRQFPFNVLLHDLDRRIKKG

SEQ ID NO: 873990 - protein, 24 aa, Mycobacterium
VNSDPYGAGWLLDVQVSDVAEVES

SEQ ID NO: 873991 - protein, 25 aa, Mycobacterium
VNSDPYGDGWLLDLQVESSAAAEAA

SEQ ID NO: 873992 - protein, 33 aa, Mycobacterium
VNSFSKYYAMTGWRLGWLLVPAELRRAVDRLTG

SEQ ID NO: 873993 - protein, 18 aa, Mycobacterium
VNSGRMYAGPGPGPMLAA

SEQ ID NO: 873994 - protein, 19 aa, Mycobacterium
VNSGRWYSFILASGGRRSG

SEQ ID NO: 873995 - protein, 26 aa, Mycobacterium
VNSGTHLIKLWFSVSRKEQLARFEAR

SEQ ID NO: 873996 - protein, 18 aa, Mycobacterium
VNSIAHPVSFPAFASVRE

SEQ ID NO: 873997 - protein, 26 aa, Mycobacterium
VNSNSLFINVTCWGRLVTGVGAALGK

SEQ ID NO: 873998 - protein, 18 aa, Mycobacterium
VNSPDLDWQSVWDRGWTL

SEQ ID NO: 873999 - protein, 25 aa, Mycobacterium
VNSPDLDWQSVWDRGWTLAAAAEDK

SEQ ID NO: 874000 - protein, 17 aa, Mycobacterium
VNSPVLAPISLVSSYGP

SEQ ID NO: 874001 - protein, 24 aa, Mycobacterium
VNSRHLVLPLERYPSLTDFGEANE

SEQ ID NO: 874002 - protein, 24 aa, Mycobacterium
VNSRHLVLPLERYPTLTDFGQANR

SEQ ID NO: 874003 - protein, 23 aa, Mycobacterium
VNSRHLVLPLETYPKLNDFGEAN

SEQ ID NO: 874004 - protein, 20 aa, Mycobacterium
VNSRPKPLSAYLFTKSREIR

SEQ ID NO: 874005 - protein, 23 aa, Mycobacterium
VNSRQFVLPIEQYPALTDFGDAN

SEQ ID NO: 874006 - protein, 26 aa, Mycobacterium
VNSTEFIQVLLGCAKIGALAVPLNVR

SEQ ID NO: 874007 - protein, 17 aa, Mycobacterium
VNSVAPDLVPKLSKYEP

SEQ ID NO: 874008 - protein, 26 aa, Mycobacterium
VNSVAPGPIWTPLIPSTMPPDSVESF

SEQ ID NO: 874009 - protein, 24 aa, Mycobacterium
VNTAIILGAMAKVPAFTTWQPPPQ

SEQ ID NO: 874010 - protein, 24 aa, Mycobacterium
VNTASRFFNWFVNEINERNAEVKA

SEQ ID NO: 874011 - protein, 25 aa, Mycobacterium
VNTDGYVDYLMRLQMIYTAIEDAVR

SEQ ID NO: 874012 - protein, 28 aa, Mycobacterium
VNTDMLHSPPMYRAFRPDLAEPTREDAE

SEQ ID NO: 874013 - protein, 29 aa, Mycobacterium
VNTDMLHSPPMYRAFRPDLKEPTRADAEP

SEQ ID NO: 874014 - protein, 23 aa, Mycobacterium
VNTGSFAFLGDYGGTGYPAGKGA

SEQ ID NO: 874015 - protein, 25 aa, Mycobacterium
VNTHAALLPTVPFGGAKWSGIGVEN

SEQ ID NO: 874016 - protein, 23 aa, Mycobacterium
VNTIFLSTRFRAWRVGGYNEYLY

SEQ ID NO: 874017 - protein, 17 aa, Mycobacterium
VNTLGFSAGTYGATESL

SEQ ID NO: 874018 - protein, 17 aa, Mycobacterium
VNTLVLRVDLAGNPTLA

SEQ ID NO: 874019 - protein, 17 aa, Mycobacterium
VNTLYIQHIAPGAIAKA

SEQ ID NO: 874020 - protein, 17 aa, Mycobacterium
VNTMTDWLLSRLPTLAR

SEQ ID NO: 874021 - protein, 26 aa, Mycobacterium
VNTPMGGGDMIAALFAAIETNPTLNN

SEQ ID NO: 874022 - protein, 30 aa, Mycobacterium
VNTSDADVIRYLRWFTFLSAEELAELEQAT

SEQ ID NO: 874023 - protein, 24 aa, Mycobacterium
VNTSTGFQVFTPAGGTSGSGQVNG

SEQ ID NO: 874024 - protein, 23 aa, Mycobacterium
VNTTLVWGLHDTVAPLRVPNHVW

SEQ ID NO: 874025 - protein, 25 aa, Mycobacterium
VNVDAVMRTLLARGLITEAGTDPDT

SEQ ID NO: 874026 - protein, 27 aa, Mycobacterium
VNVDTWGGWIWINMDPAAQPLRQYLEP

SEQ ID NO: 874027 - protein, 20 aa, Mycobacterium
VNVFAFALTAAGIGRRPLRT

SEQ ID NO: 874028 - protein, 20 aa, Mycobacterium
VNVGLLMHPDHGRPALGFAT

SEQ ID NO: 874029 - protein, 25 aa, Mycobacterium
VNVKVVGYLRAARAVAPHLKAQGWG

SEQ ID NO: 874030 - protein, 18 aa, Mycobacterium
VNVLRSDATPIEKLDALS

SEQ ID NO: 874031 - protein, 20 aa, Mycobacterium
VNVLTVLSPGVQRFDYFRLL

SEQ ID NO: 874032 - protein, 29 aa, Mycobacterium
VNVPDMFTRLLLSLLITGVAPRSFYIGDG

SEQ ID NO: 874033 - protein, 19 aa, Mycobacterium
VNVRIWVHPDHRKKGYGTA

SEQ ID NO: 874034 - protein, 39 aa, Mycobacterium; identical to SEQ ID NO: 133534

SEQ ID NO: 874035 - protein, 17 aa, Mycobacterium
VNWLMGEADLDTGWTLG

SEQ ID NO: 874036 - protein, 17 aa, Mycobacterium
VNYAGLPSSPWYELGRK

SEQ ID NO: 874037 - protein, 27 aa, Mycobacterium
VNYFGVVDLLTAWRAALAASGRAKAVV

SEQ ID NO: 874038 - protein, 24 aa, Mycobacterium
VNYIDTYFRSGQYPRELPFILGSE

SEQ ID NO: 874039 - protein, 20 aa, Mycobacterium
VNYTFTAMPVSEPAGMYTAA

SEQ ID NO: 874040 - protein, 17 aa, Mycobacterium
VPAAFALPLPSGYTDTE

SEQ ID NO: 874041 - protein, 18 aa, Mycobacterium
VPAAFYRHFDSMDALGLV

SEQ ID NO: 874042 - protein, 18 aa, Mycobacterium
VPAAFYRHFDSMEALGLV

SEQ ID NO: 874043 - protein, 26 aa, Mycobacterium
VPAAGLFVLDGWLRPVPPGVVGELYV

SEQ ID NO: 874044 - protein, 22 aa, Mycobacterium
VPAARFALIERLRRLDEPTLDA

SEQ ID NO: 874045 - protein, 31 aa, Mycobacterium
VPAARFYIDYSDFSVWILDVERVRWVGGYGR

SEQ ID NO: 874046 - protein, 18 aa, Mycobacterium
VPAARTILVKLAGQRYLA

SEQ ID NO: 874047 - protein, 17 aa, Mycobacterium
VPAARYYIDYSDFTLWV

SEQ ID NO: 874048 - protein, 27 aa, Mycobacterium
VPAAVETWFHLLERYGTWRLSDVLGYA

SEQ ID NO: 874049 - protein, 19 aa, Mycobacterium
VPADAALNLFTKALDHADP

SEQ ID NO: 874050 - protein, 25 aa, Mycobacterium
VPADAPVMIFVPGGAWVHGGRMLQG

SEQ ID NO: 874051 - protein, 26 aa, Mycobacterium
VPADGFLPALLDWCRSNDVVFIADEV

SEQ ID NO: 874052 - protein, 18 aa, Mycobacterium
VPADGYYQVRRYGAEYLA

SEQ ID NO: 874053 - protein, 24 aa, Mycobacterium
VPADLPMSALLDAAFPPASVTGTP

SEQ ID NO: 874054 - protein, 30 aa, Mycobacterium
VPADRRKVPGGWWPPLMLEPGWVGAHHDLF

SEQ ID NO: 874055 - protein, 29 aa, Mycobacterium
VPADRVLAALHGWLAPLPPEGASAIVFRD

SEQ ID NO: 874056 - protein, 30 aa, Mycobacterium
VPADVRLRLLQTLDLFGIALGVAAFRQGRT

SEQ ID NO: 874057 - protein, 25 aa, Mycobacterium
VPAELLDVVLAIVRDRPLQPVARIS

SEQ ID NO: 874058 - protein, 23 aa, Mycobacterium
VPAFADHGWRWGGAWTTPIGYQH

SEQ ID NO: 874059 - protein, 23 aa, Mycobacterium
VPAGALIFGRRSIAGSLIGGIAE

SEQ ID NO: 874060 - protein, 24 aa, Mycobacterium
VPAGDIVIVALLYAHVVPVVAQYG

SEQ ID NO: 874061 - protein, 17 aa, Mycobacterium
VPAGRKVLLLYGSANRD

SEQ ID NO: 874062 - protein, 32 aa, Mycobacterium
VPAGRLGWGWAKFAFNGWKALSWADANVWRRV

SEQ ID NO: 874063 - protein, 26 aa, Mycobacterium
VPAGSPLLFPGSWSPSGIATPVEGGY

SEQ ID NO: 874064 - protein, 26 aa, Mycobacterium
VPAGVDIHLLPFPDLADDDAGTDADA

SEQ ID NO: 874065 - protein, 21 aa, Mycobacterium
VPAHAPGEHPMFKAMAAGSSL

SEQ ID NO: 874066 - protein, 27 aa, Mycobacterium
VPAIIAEYLGLPQLTHVRKLSVEGGKV

SEQ ID NO: 874067 - protein, 28 aa, Mycobacterium
VPAIIAEYLGLPQLTHVRKLSVENGKVT

SEQ ID NO: 874068 - protein, 18 aa, Mycobacterium
VPAIILHGVDWFRSMGTE

SEQ ID NO: 874069 - protein, 18 aa, Mycobacterium
VPAIPPGLIGAAEAVDLI

SEQ ID NO: 874070 - protein, 20 aa, Mycobacterium
VPAKQLLYYAAKGHGSWRVK

SEQ ID NO: 874071 - protein, 17 aa, Mycobacterium
VPALAELAGPLGLESTE

SEQ ID NO: 874072 - protein, 23 aa, Mycobacterium
VPALALDVWLSYELRRAGFDSDA

SEQ ID NO: 874073 - protein, 17 aa, Mycobacterium
VPALEVAERRRPFDLER

SEQ ID NO: 874074 - protein, 20 aa, Mycobacterium
VPALKRYVLEMRFKPMPSYE

SEQ ID NO: 874075 - protein, 25 aa, Mycobacterium
VPALLAGCTVILKPAPESPLDALLL

SEQ ID NO: 874076 - protein, 24 aa, Mycobacterium
VPALLRILTEFDSVKTILVMVQSE

SEQ ID NO: 874077 - protein, 23 aa, Mycobacterium
VPALTALMDRIAQRRVRILEVET

SEQ ID NO: 874078 - protein, 17 aa, Mycobacterium
VPALTHLEGPYLELVRD

SEQ ID NO: 874079 - protein, 19 aa, Mycobacterium
VPAMFTRMLKLPDAVRHSY

SEQ ID NO: 874080 - protein, 22 aa, Mycobacterium
VPAMFTRMLKLPESIRNSYDVS

SEQ ID NO: 874081 - protein, 19 aa, Mycobacterium
VPAMFVRMLKLPEAVRISY

SEQ ID NO: 874082 - protein, 21 aa, Mycobacterium
VPAMRPPPYPVVRGVTCVPPN

SEQ ID NO: 874083 - protein, 19 aa, Mycobacterium
VPAPGRPFGIYVHVPFCAT

SEQ ID NO: 874084 - protein, 23 aa, Mycobacterium
VPAPSYPPELDRFTKLGLVPSIA

SEQ ID NO: 874085 - protein, 24 aa, Mycobacterium
VPARARPGLYPIRAQLRIAAEEAP

SEQ ID NO: 874086 - protein, 20 aa, Mycobacterium
VPARIFVVDELPRGAALKVD

SEQ ID NO: 874087 - protein, 30 aa, Mycobacterium
VPARLHPGMFYALPQSPQLFKQLLMVAGME

SEQ ID NO: 874088 - protein, 17 aa, Mycobacterium
VPARWTLDHGRTFRPVD

SEQ ID NO: 874089 - protein, 29 aa, Mycobacterium
VPASFVDDFVLYWGFLALAQVRGGRHMFG

SEQ ID NO: 874090 - protein, 24 aa, Mycobacterium
VPASLVLLSFAPDASLSNPAICDV

SEQ ID NO: 874091 - protein, 17 aa, Mycobacterium
VPASMVEYVIMGQVLTA

SEQ ID NO: 874092 - protein, 26 aa, Mycobacterium
VPASRPRIRLAYRLTPRRVLGPQRAT

SEQ ID NO: 874093 - protein, 26 aa, Mycobacterium
VPASVRALPLHGVVFRDLVDGGTVDL

SEQ ID NO: 874094 - protein, 27 aa, Mycobacterium
VPATALADLPLLLLDEGHCLRDQALDV

SEQ ID NO: 874095 - protein, 27 aa, Mycobacterium
VPATGRFVLMYHLLWELTHVCFEHPGL

SEQ ID NO: 874096 - protein, 32 aa, Mycobacterium
VPAVLTLALMGVPLKKWQLYCEPAHANVYTPA

SEQ ID NO: 874097 - protein, 25 aa, Mycobacterium
VPAVRARLVALQREMAAGPGDVVVE

SEQ ID NO: 874098 - protein, 17 aa, Mycobacterium
VPAYLSRMLITGGTAGP

SEQ ID NO: 874099 - protein, 20 aa, Mycobacterium
VPDALVGRCWPAVFAAIGSA

SEQ ID NO: 874100 - protein, 23 aa, Mycobacterium
VPDDRILATVLFTDIVDSTRCAA

SEQ ID NO: 874101 - protein, 44 aa, Mycobacterium
VPDDVSLWGLLIPLRRAFNQYVNLRPVRLLPGIASPLAGVSDEA

SEQ ID NO: 874102 - protein, 25 aa, Mycobacterium
VPDEKFGHRLAAFVVLQPGSDTDEA

SEQ ID NO: 874103 - protein, 26 aa, Mycobacterium
VPDELSPARFFAVMLTIVLDNSNITQ

SEQ ID NO: 874104 - protein, 23 aa, Mycobacterium
VPDGPVVVVLRPEQLRAAEAGTP

SEQ ID NO: 874105 - protein, 26 aa, Mycobacterium
VPDGVDIHLLPFPDLGDEEPTEDDAP

SEQ ID NO: 874106 - protein, 25 aa, Mycobacterium
VPDHFRLYVAEKLARLERFDRTIYL

SEQ ID NO: 874107 - protein, 21 aa, Mycobacterium
VPDLAGFWRPYLEAARDTGEI

SEQ ID NO: 874108 - protein, 27 aa, Mycobacterium
VPDLVHAHDWLVAHPAIALAEFFDVPL

SEQ ID NO: 874109 - protein, 24 aa, Mycobacterium
VPDMFTRLILSLVATGIAPRSFYQ

SEQ ID NO: 874110 - protein, 33 aa, Mycobacterium
VPDNPMYAMLIPQPKLVRLLEKRARDLGVDLRW

SEQ ID NO: 874111 - protein, 19 aa, Mycobacterium
VPDPGFPLQLVHHDDVAAA

SEQ ID NO: 874112 - protein, 26 aa, Mycobacterium
VPDPHPYFDYLRSQNPVLRLPHYGVV

SEQ ID NO: 874113 - protein, 23 aa, Mycobacterium
VPDPSRVWPLLQRKKSALAAIGA

SEQ ID NO: 874114 - protein, 27 aa, Mycobacterium
VPDQFTRLILSLIATGIAPGSFYQAHA

SEQ ID NO: 874115 - protein, 26 aa, Mycobacterium
VPDQFTRLILSLIATGVAPGSFYQAH

SEQ ID NO: 874116 - protein, 24 aa, Mycobacterium
VPDREVFLASWPREFRALVEQQRE

SEQ ID NO: 874117 - protein, 26 aa, Mycobacterium
VPDRGLLLAHHPLLLRGVDTVAASTA

SEQ ID NO: 874118 - protein, 26 aa, Mycobacterium
VPDRGLTPQLLLNTYNLRGLAEQGYT

SEQ ID NO: 874119 - protein, 24 aa, Mycobacterium
VPDRQPVRRWWVAAELAMARGDGE

SEQ ID NO: 874120 - protein, 24 aa, Mycobacterium
VPDSAPLLLLERLTHLDDGTPVDL

SEQ ID NO: 874121 - protein, 22 aa, Mycobacterium
VPDYALLKQLLAERIQSIPRCT

SEQ ID NO: 874122 - protein, 19 aa, Mycobacterium
VPEDCSHRFRYKAGQFLTV

SEQ ID NO: 874123 - protein, 24 aa, Mycobacterium
VPEDFRMWVCLHEVTHRVQFRANP

SEQ ID NO: 874124 - protein, 25 aa, Mycobacterium
VPEDQARVILFLASELSGFVTGHTV

SEQ ID NO: 874125 - protein, 23 aa, Mycobacterium
VPEELVDVVLAIVRDRPLEPVAR

SEQ ID NO: 874126 - protein, 24 aa, Mycobacterium
VPEFQVRWRWTPNSVAIWDNRSTQ

SEQ ID NO: 874127 - protein, 22 aa, Mycobacterium
VPEHADLLVRWAEELAAGSWIA

SEQ ID NO: 874128 - protein, 25 aa, Mycobacterium
VPEIPVGLDWWDPLADDAVRPEIDA

SEQ ID NO: 874129 - protein, 20 aa, Mycobacterium
VPEKLEIKTALWGQIDQAAP

SEQ ID NO: 874130 - protein, 17 aa, Mycobacterium
VPELFNALHADITYKEL

SEQ ID NO: 874131 - protein, 18 aa, Mycobacterium
VPELLRVLDFTPAEDVLV

SEQ ID NO: 874132 - protein, 17 aa, Mycobacterium
VPELVLVDVTPSAPERH

SEQ ID NO: 874133 - protein, 23 aa, Mycobacterium
VPENLPVGYYTQATLLADVDPDS

SEQ ID NO: 874134 - protein, 24 aa, Mycobacterium
VPEPALPIRAPRVLSPAAVVGRLR

SEQ ID NO: 874135 - protein, 17 aa, Mycobacterium
VPEPVPCEIYCHTLADP

SEQ ID NO: 874136 - protein, 19 aa, Mycobacterium
VPERFWASTLPRVRERFGD

SEQ ID NO: 874137 - protein, 18 aa, Mycobacterium
VPERLEIKVPLWGQIDQA

SEQ ID NO: 874138 - protein, 24 aa, Mycobacterium
VPESKRFCWNCGRPVGRSDAEGTG

SEQ ID NO: 874139 - protein, 30 aa, Mycobacterium
VPESLPDDFILYWGFLATAQVLTGRYSFGK

SEQ ID NO: 874140 - protein, 28 aa, Mycobacterium
VPESVRALPLDGVVFRDLLDGGTVELAL

SEQ ID NO: 874141 - protein, 20 aa, Mycobacterium
VPETLPDWFVREHDLMSEDE

SEQ ID NO: 874142 - protein, 25 aa, Mycobacterium
VPEVADLVAMLRLIADPTAGSAVMR

SEQ ID NO: 874143 - protein, 31 aa, Mycobacterium
VPEWARRWQRLLFDNGWLIPGNPPEFGGRNA

SEQ ID NO: 874144 - protein, 17 aa, Mycobacterium
VPEYVGSLLAYLDGSRG

SEQ ID NO: 874145 - protein, 17 aa, Mycobacterium
VPFAKRGKRMDECIEII

SEQ ID NO: 874146 - protein, 18 aa, Mycobacterium
VPFEIRQPVGVDATEELL

SEQ ID NO: 874147 - protein, 42 aa, Mycobacterium
VPFERVLELAPRLATPLSRGCFPMLSFLDAGVPPLSAVFAPH

SEQ ID NO: 874148 - protein, 30 aa, Mycobacterium
VPFERVLELAPWLKKPPPRGGFPMVSFLDG

SEQ ID NO: 874149 - protein, 29 aa, Mycobacterium
VPFFADFARRYTDLPFLIKLEQRGEMLVP

SEQ ID NO: 874150 - protein, 28 aa, Mycobacterium
VPFFVDYVRRFTDLPFLVKLESRGDDVV

SEQ ID NO: 874151 - protein, 19 aa, Mycobacterium
VPFHLLPLVARELGKDTEI

SEQ ID NO: 874152 - protein, 19 aa, Mycobacterium
VPFLVAASLPRILHALPVV

SEQ ID NO: 874153 - protein, 17 aa, Mycobacterium
VPFLVMPFCGRGSVQQR

SEQ ID NO: 874154 - protein, 17 aa, Mycobacterium
VPFLWNESNPAFSSMAN

SEQ ID NO: 874155 - protein, 17 aa, Mycobacterium
VPFMLLAGDRDVQADAV

SEQ ID NO: 874156 - protein, 17 aa, Mycobacterium
VPFMLLAGDRDVQAGAV

SEQ ID NO: 874157 - protein, 18 aa, Mycobacterium
VPFPADVMAQRLAAAVDA

SEQ ID NO: 874158 - protein, 18 aa, Mycobacterium
VPFPVAALEVMRYACGDR

SEQ ID NO: 874159 - protein, 17 aa, Mycobacterium
VPFSDRLAAEEWRSLRL

SEQ ID NO: 874160 - protein, 17 aa, Mycobacterium
VPFYGGLSRMVNRNDDA

SEQ ID NO: 874161 - protein, 25 aa, Mycobacterium
VPGAALFVLDGWLRPTPVGVVGELY

SEQ ID NO: 874162 - protein, 26 aa, Mycobacterium
VPGAAVMPLLDALELFAIGSALHETQ

SEQ ID NO: 874163 - protein, 28 aa, Mycobacterium
VPGAEILRPGLLALPVTGAARYFGSEHA

SEQ ID NO: 874164 - protein, 27 aa, Mycobacterium
VPGAGLLVLDGWLRPVPPGVVGELYVA

SEQ ID NO: 874165 - protein, 33 aa, Mycobacterium
VPGAGPLYYPNFITTLPYLGQVLLQGGVPGPSS

SEQ ID NO: 874166 - protein, 20 aa, Mycobacterium
VPGAIPMPAVAGAPGAPMPG

SEQ ID NO: 874167 - protein, 18 aa, Mycobacterium
VPGANFYADGYRGAARIV

SEQ ID NO: 874168 - protein, 29 aa, Mycobacterium
VPGAPRSLAYDRAWWFARFVADTFGAPKL

SEQ ID NO: 874169 - protein, 17 aa, Mycobacterium
VPGARAALAWSVETAQL

SEQ ID NO: 874170 - protein, 18 aa, Mycobacterium
VPGASADLVWLDRDPRTV

SEQ ID NO: 874171 - protein, 19 aa, Mycobacterium
VPGAYVAGWIKRGPTGFIG

SEQ ID NO: 874172 - protein, 23 aa, Mycobacterium
VPGDVRGLPAGTQFGRDAIAAGE

SEQ ID NO: 874173 - protein, 18 aa, Mycobacterium
VPGEGELPLRDILSVLPS

SEQ ID NO: 874174 - protein, 19 aa, Mycobacterium
VPGFPLLTNRRSISGSLIG

SEQ ID NO: 874175 - protein, 25 aa, Mycobacterium
VPGFPNLFTVFGPYGYVGSSYFALI

SEQ ID NO: 874176 - protein, 25 aa, Mycobacterium
VPGGAWVMGWRRPQAYPLMAHLVSR

SEQ ID NO: 874177 - protein, 26 aa, Mycobacterium
VPGGRDELWRFTPLKRLRGLHDGSAT

SEQ ID NO: 874178 - protein, 27 aa, Mycobacterium
VPGGRDELWRFTPLRRLRGLHDGTAVA

SEQ ID NO: 874179 - protein, 25 aa, Mycobacterium
VPGGRLVFNAFLTDPDYILDEATRE

SEQ ID NO: 874180 - protein, 28 aa, Mycobacterium
VPGGTVRNWPWRRLVLSKTANTYSRFLL

SEQ ID NO: 874181 - protein, 17 aa, Mycobacterium
VPGIIDDALRRARPGTR

SEQ ID NO: 874182 - protein, 24 aa, Mycobacterium
VPGLFTLVLHTHLPWLAHHGRWPV

SEQ ID NO: 874183 - protein, 18 aa, Mycobacterium
VPGLHRIVRGDHAVVVAD

SEQ ID NO: 874184 - protein, 18 aa, Mycobacterium
VPGLHRRAAKWFEAEGLV

SEQ ID NO: 874185 - protein, 17 aa, Mycobacterium
VPGLQIDRRCGGGLQAV

SEQ ID NO: 874186 - protein, 25 aa, Mycobacterium
VPGLQIDRRCGSGLQAVLYAAGQVA

SEQ ID NO: 874187 - protein, 26 aa, Mycobacterium
VPGLQLDRRCGSGLQAVLYAAGQVAT

SEQ ID NO: 874188 - protein, 25 aa, Mycobacterium
VPGLRALARLGIYWAQEALAFGMTK

SEQ ID NO: 874189 - protein, 22 aa, Mycobacterium
VPGLRALFRSGMYFGAEAGAYA

SEQ ID NO: 874190 - protein, 18 aa, Mycobacterium
VPGLRRDGRDRQSSSHDA

SEQ ID NO: 874191 - protein, 19 aa, Mycobacterium
VPGMRGLVRVLGGPGTGKS

SEQ ID NO: 874192 - protein, 26 aa, Mycobacterium
VPGNPDYGLRLSWDFLARSTAGLRDW

SEQ ID NO: 874193 - protein, 28 aa, Mycobacterium
VPGPDRVPLLALLRRRLTDDEVRAVVTE

SEQ ID NO: 874194 - protein, 25 aa, Mycobacterium
VPGPDRVPLMALLRSTPLTEDQIRE

SEQ ID NO: 874195 - protein, 24 aa, Mycobacterium
VPGPFDGYLTYRGIKTLALRMQRH

SEQ ID NO: 874196 - protein, 19 aa, Mycobacterium
VPGPFLCEPSPQRTPVLFQ

SEQ ID NO: 874197 - protein, 24 aa, Mycobacterium
VPGPFQFLRVIGAYYTPSFHPSKL

SEQ ID NO: 874198 - protein, 24 aa, Mycobacterium
VPGPFQFLRVIGAYYTPSFHPSQL

SEQ ID NO: 874199 - protein, 18 aa, Mycobacterium
VPGPFVPSAIASALIAAH

SEQ ID NO: 874200 - protein, 19 aa, Mycobacterium
VPGPRSPLYCAGRRVCEHY

SEQ ID NO: 874201 - protein, 30 aa, Mycobacterium
VPGPSLQLVIIDRIPFPRPDDPLLTARQRA

SEQ ID NO: 874202 - protein, 27 aa, Mycobacterium
VPGPTALLAPPWVPWERRVQPGDLSPG

SEQ ID NO: 874203 - protein, 18 aa, Mycobacterium
VPGPTFPLYLGGARVEHL

SEQ ID NO: 874204 - protein, 20 aa, Mycobacterium
VPGQIYHYALDAKAAGAGLM

SEQ ID NO: 874205 - protein, 20 aa, Mycobacterium
VPGRIFAGPALAQPPGASPA

SEQ ID NO: 874206 - protein, 24 aa, Mycobacterium
VPGRQLFLHACDLSRIPDGSYQVN

SEQ ID NO: 874207 - protein, 17 aa, Mycobacterium
VPGRWVYKSLSVNYRTP

SEQ ID NO: 874208 - protein, 25 aa, Mycobacterium
VPGSRWVFPQWDTTTSALPPPPPRS

SEQ ID NO: 874209 - protein, 25 aa, Mycobacterium
VPGTALFVLDGWLRPTPVGVVGELY

SEQ ID NO: 874210 - protein, 17 aa, Mycobacterium
VPGTGWPEPGGLLPREA

SEQ ID NO: 874211 - protein, 25 aa, Mycobacterium
VPGTPFLEEVPLPNFFGTGVVVSIP

SEQ ID NO: 874212 - protein, 18 aa, Mycobacterium
VPGVNRTVAYRNGRRWIL

SEQ ID NO: 874213 - protein, 18 aa, Mycobacterium
VPGVVMFAVASSGAPGRP

SEQ ID NO: 874214 - protein, 20 aa, Mycobacterium
VPGVYVAGWIKRGPSGFIGT

SEQ ID NO: 874215 - protein, 17 aa, Mycobacterium
VPGWCWHHQDCPAGHCC

SEQ ID NO: 874216 - protein, 28 aa, Mycobacterium
VPGYLARADMMFALSVPLPGHHIINAST

SEQ ID NO: 874217 - protein, 27 aa, Mycobacterium
VPGYRLKQKVQFQRYTRNSPLRLPEQE

SEQ ID NO: 874218 - protein, 20 aa, Mycobacterium
VPHDDIWGEPVFAGAHRLNG

SEQ ID NO: 874219 - protein, 24 aa, Mycobacterium
VPHEWFLAGHIVVGWPRGHHGPVR

SEQ ID NO: 874220 - protein, 17 aa, Mycobacterium
VPHGMSVILNAPAAFRL

SEQ ID NO: 874221 - protein, 24 aa, Mycobacterium
VPHHYQSVLLSPTRSRLLLTQSSD

SEQ ID NO: 874222 - protein, 18 aa, Mycobacterium
VPHIVWGAQRIWTKDHPK

SEQ ID NO: 874223 - protein, 18 aa, Mycobacterium
VPHIVWGAQRIWTKGHPK

SEQ ID NO: 874224 - protein, 24 aa, Mycobacterium
VPHLHIHVFPTRHLSDFGFATVDR

SEQ ID NO: 874225 - protein, 23 aa, Mycobacterium
VPHLHVHVFPGYQLTDFSFENAD

SEQ ID NO: 874226 - protein, 24 aa, Mycobacterium
VPHLHVHVFPTRSLSDFGFANVDR

SEQ ID NO: 874227 - protein, 18 aa, Mycobacterium
VPHLPVRVQHRSGALWIL

SEQ ID NO: 874228 - protein, 20 aa, Mycobacterium
VPHRITPRDAADERTSMITA

SEQ ID NO: 874229 - protein, 21 aa, Mycobacterium
VPHYPAPGGVKLAAGWLVEHA

SEQ ID NO: 874230 - protein, 29 aa, Mycobacterium
VPIALNSRAIALLFFGDLDGAADAVDEIQ

SEQ ID NO: 874231 - protein, 26 aa, Mycobacterium
VPIDLRADWPAALRAAGFDPAAPTAW

SEQ ID NO: 874232 - protein, 21 aa, Mycobacterium
VPIHRAIVRRLYRRRRPDGAT

SEQ ID NO: 874233 - protein, 26 aa, Mycobacterium
VPILPQQALLYRLCGDRNPLHSDPEF

SEQ ID NO: 874234 - protein, 22 aa, Mycobacterium
VPIRVYRWHPAPRNGDFDQLVA

SEQ ID NO: 874235 - protein, 20 aa, Mycobacterium
VPISAILFGGRRKTTVPLVT

SEQ ID NO: 874236 - protein, 18 aa, Mycobacterium
VPISGILFGGRRKTTVPL

SEQ ID NO: 874237 - protein, 33 aa, Mycobacterium
VPIVDSAVINFPVNGILVPPHDYTATVVIAGFS

SEQ ID NO: 874238 - protein, 17 aa, Mycobacterium
VPIVIRNAEVIAARDSS

SEQ ID NO: 874239 - protein, 25 aa, Mycobacterium
VPIVPAAVIFDLPVGGWNCRPGADF

SEQ ID NO: 874240 - protein, 26 aa, Mycobacterium
VPIVPAAVIFDLPVGGWQCRPTDEFG

SEQ ID NO: 874241 - protein, 17 aa, Mycobacterium
VPKAPFLRTVAVWGPSD

SEQ ID NO: 874242 - protein, 17 aa, Mycobacterium
VPKAVLLTAACRAAGIP

SEQ ID NO: 874243 - protein, 19 aa, Mycobacterium
VPKHAGLTYFLCDMTQPGV

SEQ ID NO: 874244 - protein, 26 aa, Mycobacterium
VPKLESKIGLIDWLIQDPGNEAVARE

SEQ ID NO: 874245 - protein, 21 aa, Mycobacterium
VPKQRLNLERFTIAEVPPGVT

SEQ ID NO: 874246 - protein, 20 aa, Mycobacterium
VPKVWAPARSWAFYTPQADG

SEQ ID NO: 874247 - protein, 28 aa, Mycobacterium
VPLAEHDLLACWLLESAGLPVDDARRTV

SEQ ID NO: 874248 - protein, 20 aa, Mycobacterium
VPLAIDHFRYFAGVLRAQEG

SEQ ID NO: 874249 - protein, 23 aa, Mycobacterium
VPLAPLTTLRVGPVARRLVTCVT

SEQ ID NO: 874250 - protein, 28 aa, Mycobacterium
VPLGNLAFFVLDGWLRPVPVGVVGELYV

SEQ ID NO: 874251 - protein, 22 aa, Mycobacterium
VPLHDCFAALEWLHGHAGELGV

SEQ ID NO: 874252 - protein, 18 aa, Mycobacterium
VPLLEVALRLPDIAYIGA

SEQ ID NO: 874253 - protein, 27 aa, Mycobacterium
VPLNRAMADYRIRLWEALRELERIHGD

SEQ ID NO: 874254 - protein, 17 aa, Mycobacterium
VPLNVRLAGPEIGYILA

SEQ ID NO: 874255 - protein, 22 aa, Mycobacterium
VPLPVNFEVALLFLAIGMSVTP

SEQ ID NO: 874256 - protein, 17 aa, Mycobacterium
VPLRGGIASDPPGLRPE

SEQ ID NO: 874257 - protein, 17 aa, Mycobacterium
VPLSFAQQRLWFIDQLQ

SEQ ID NO: 874258 - protein, 19 aa, Mycobacterium
VPLSGTVLLVSGRASFELT

SEQ ID NO: 874259 - protein, 18 aa, Mycobacterium
VPLTATLIRSGSGGPSYL

SEQ ID NO: 874260 - protein, 21 aa, Mycobacterium
VPLTGTVLLVSGRASFELAQK

SEQ ID NO: 874261 - protein, 22 aa, Mycobacterium
VPLVGEVCYHFLHSVKAGIKDS

SEQ ID NO: 874262 - protein, 17 aa, Mycobacterium
VPLVIDKKPPATDVPYA

SEQ ID NO: 874263 - protein, 17 aa, Mycobacterium
VPLWDEAALAQKLPPPR

SEQ ID NO: 874264 - protein, 22 aa, Mycobacterium
VPLYALGEFVNTLKLPKILKDD

SEQ ID NO: 874265 - protein, 20 aa, Mycobacterium
VPLYYQLAQAIEAAIRDGEL

SEQ ID NO: 874266 - protein, 26 aa, Mycobacterium
VPMFHANAWGLIYAALMSGADLVLPD

SEQ ID NO: 874267 - protein, 19 aa, Mycobacterium
VPMGALLDAAFPPASVTGT

SEQ ID NO: 874268 - protein, 22 aa, Mycobacterium
VPMREDMCIMLAARKVPAALKW

SEQ ID NO: 874269 - protein, 25 aa, Mycobacterium
VPMRPDLLDLFQISELEKYYTAEEL

SEQ ID NO: 874270 - protein, 21 aa, Mycobacterium
VPMSQLIRWAATSHHYLAVFD

SEQ ID NO: 874271 - protein, 24 aa, Mycobacterium
VPNAAPLAGLLADSPRGSKQALDR

SEQ ID NO: 874272 - protein, 17 aa, Mycobacterium
VPNAARLDKVSFEEMLE

SEQ ID NO: 874273 - protein, 29 aa, Mycobacterium
VPNAQIYRRLNALFMQLPIDTAYGEFVAA

SEQ ID NO: 874274 - protein, 17 aa, Mycobacterium
VPNLLLLASEMEAQRNH

SEQ ID NO: 874275 - protein, 24 aa, Mycobacterium
VPNPFGAGRLYRTGDRARWTPDGR

SEQ ID NO: 874276 - protein, 24 aa, Mycobacterium
VPNPLLAEEFAALARGPIVVAFDG

SEQ ID NO: 874277 - protein, 24 aa, Mycobacterium
VPNSLHVYLLRAGDARYPVEMQVM

SEQ ID NO: 874278 - protein, 26 aa, Mycobacterium
VPNWNDPAYLNAFGQLLAALGRRYDG

SEQ ID NO: 874279 - protein, 22 aa, Mycobacterium
VPPDICGPGALRPRVIRSVCSI

SEQ ID NO: 874280 - protein, 31 aa, Mycobacterium
VPPDRELAFLHPLPVRRLWGVGAKTADKLRA

SEQ ID NO: 874281 - protein, 30 aa, Mycobacterium
VPPDRELAFLHPLPVRRLWGVGAKTAEKLR

SEQ ID NO: 874282 - protein, 18 aa, Mycobacterium
VPPEAPLKRPSLPAVLAG

SEQ ID NO: 874283 - protein, 18 aa, Mycobacterium
VPPFFPQGSLAAPPPQTA

SEQ ID NO: 874284 - protein, 18 aa, Mycobacterium
VPPGFSHCLLLAEGHVVA

SEQ ID NO: 874285 - protein, 27 aa, Mycobacterium
VPPGRLGWGWAKFAFGSWTTLSWVDAN

SEQ ID NO: 874286 - protein, 27 aa, Mycobacterium
VPPGSEGLLVLPYLAGERTPVFDPQAR

SEQ ID NO: 874287 - protein, 18 aa, Mycobacterium
VPPLFSALNAEITYEAMA

SEQ ID NO: 874288 - protein, 19 aa, Mycobacterium
VPPLPPRAPLLPVPPNVAA

SEQ ID NO: 874289 - protein, 26 aa, Mycobacterium
VPPNGLPVILGPDHPITGGYPVVGVV

SEQ ID NO: 874290 - protein, 19 aa, Mycobacterium
VPPNGLPVILGPDHPVTGG

SEQ ID NO: 874291 - protein, 24 aa, Mycobacterium
VPPNGLPVILGPDHPVTGGYPVVG

SEQ ID NO: 874292 - protein, 20 aa, Mycobacterium
VPPNWGGYRIAPEVVEFWQG

SEQ ID NO: 874293 - protein, 24 aa, Mycobacterium
VPPPPDPFLSPPINQLPPPPPPGA

SEQ ID NO: 874294 - protein, 23 aa, Mycobacterium
VPPPPIPGLPDPYGLRLVDPDAD

SEQ ID NO: 874295 - protein, 28 aa, Mycobacterium
VPPPQRSISLPMLYALSALGSLKARLTG

SEQ ID NO: 874296 - protein, 31 aa, Mycobacterium
VPPQGWVNLHFSLLPAWRGAAPVQAAIAAGD

SEQ ID NO: 874297 - protein, 36 aa, Mycobacterium
VPPRDTSVVSWLPFYHDMGFVLGVIAPILGGYRGDL

SEQ ID NO: 874298 - protein, 18 aa, Mycobacterium
VPPSMLASRQEGWTKTLT

SEQ ID NO: 874299 - protein, 17 aa, Mycobacterium
VPPSWAGSTPVVGSSAA

SEQ ID NO: 874300 - protein, 34 aa, Mycobacterium
VPPTQAWNKLFGDNFFYILYFQEPGVADADLNRD

SEQ ID NO: 874301 - protein, 17 aa, Mycobacterium
VPPTWTAVGPTTGRLAA

SEQ ID NO: 874302 - protein, 20 aa, Mycobacterium
VPPVFTSRPQVHPTYSHLDG

SEQ ID NO: 874303 - protein, 28 aa, Mycobacterium
VPPVPPVPPWPPAPWIPPVPVPAAPPVP

SEQ ID NO: 874304 - protein, 24 aa, Mycobacterium
VPQCPRRWRYLSPAIPADLEGRIE

SEQ ID NO: 874305 - protein, 23 aa, Mycobacterium
VPQDEWPARLRRLIVEQASVILR

SEQ ID NO: 874306 - protein, 21 aa, Mycobacterium
VPQFLAIARAAAERATGLKPF

SEQ ID NO: 874307 - protein, 17 aa, Mycobacterium
VPQHWATLTSAVTPATV

SEQ ID NO: 874308 - protein, 23 aa, Mycobacterium
VPQLLTMGLLRRIDADTVILPRH

SEQ ID NO: 874309 - protein, 30 aa, Mycobacterium
VPQLSTITPRWLLHLLNWVPVEAGIYRVNR

SEQ ID NO: 874310 - protein, 17 aa, Mycobacterium
VPQLVKTAWASAASFRG

SEQ ID NO: 874311 - protein, 24 aa, Mycobacterium
VPQQFWAKVLPRVRDRYPRAWFVG

SEQ ID NO: 874312 - protein, 26 aa, Mycobacterium
VPQRLIGLARIWEEILGRPVLDPDAD

SEQ ID NO: 874313 - protein, 26 aa, Mycobacterium
VPQSEFNVSLPWSKVVVLNPGVQTES

SEQ ID NO: 874314 - protein, 48 aa, Mycobacterium
VPQVAVFDTAFFFGLPPAAAIYALDRAVAERYGIRRYGFHGTSHQYVS

SEQ ID NO: 874315 - protein, 18 aa, Mycobacterium
VPQVLIEPGVRTGLPLLV

SEQ ID NO: 874316 - protein, 24 aa, Mycobacterium
VPQVWRDMATTLAAAPLGDHSTAV

SEQ ID NO: 874317 - protein, 42 aa, Mycobacterium
VPQWGIDSWLFYPNFMLLIWEPGWFLTYHYWPTAVDKHLFEC

SEQ ID NO: 874318 - protein, 19 aa, Mycobacterium
VPQWRAVTVPADGTLAVGA

SEQ ID NO: 874319 - protein, 31 aa, Mycobacterium
VPRDPDLAYEFLPVVWRVIQHYGIDVGGRRY

SEQ ID NO: 874320 - protein, 23 aa, Mycobacterium
VPREAELSPVQRARAAWLWSGRA

SEQ ID NO: 874321 - protein, 19 aa, Mycobacterium
VPREPALYQEMMSLIAQCG

SEQ ID NO: 874322 - protein, 20 aa, Mycobacterium
VPRFTQLVHKHAFDLAAPGW

SEQ ID NO: 874323 - protein, 21 aa, Mycobacterium
VPRGFVTTIPKFRTVTQVEAA

SEQ ID NO: 874324 - protein, 17 aa, Mycobacterium
VPRGISFLLNRNRLNVA

SEQ ID NO: 874325 - protein, 18 aa, Mycobacterium
VPRGYRIVARPGTVTRRA

SEQ ID NO: 874326 - protein, 30 aa, Mycobacterium
VPRHILDSWVLRTFIVHLRENRFEAGEFAT

SEQ ID NO: 874327 - protein, 17 aa, Mycobacterium
VPRIFKRVRPAFSYQRS

SEQ ID NO: 874328 - protein, 22 aa, Mycobacterium
VPRIWETLYGEFQRQVERRLAD

SEQ ID NO: 874329 - protein, 17 aa, Mycobacterium
VPRLFNLDRDFIQEIRD

SEQ ID NO: 874330 - protein, 27 aa, Mycobacterium
VPRLQERVLQLLGVALPAVAVFEYPTL

SEQ ID NO: 874331 - protein, 19 aa, Mycobacterium
VPRLYRALRQPKPVKFSAL

SEQ ID NO: 874332 - protein, 20 aa, Mycobacterium
VPRMRGVLALFEGVATGAAD

SEQ ID NO: 874333 - protein, 17 aa, Mycobacterium
VPRNVVRALTKVVGKGR

SEQ ID NO: 874334 - protein, 17 aa, Mycobacterium
VPRPEQLAYYGGLAALA

SEQ ID NO: 874335 - protein, 17 aa, Mycobacterium
VPRPETEALLAWVTAQP

SEQ ID NO: 874336 - protein, 36 aa, Mycobacterium
VPRPVDLVLLDGWPDLALPVLKVLEPHLRAGTLILV

SEQ ID NO: 874337 - protein, 19 aa, Mycobacterium
VPRRGVLGEYIPEPWRSSY

SEQ ID NO: 874338 - protein, 22 aa, Mycobacterium
VPRRPVIRPIPVDETAFSVVPD

SEQ ID NO: 874339 - protein, 20 aa, Mycobacterium
VPRRQLALAGVSPIDRLRPC

SEQ ID NO: 874340 - protein, 31 aa, Mycobacterium
VPRTPAYDGVLGRLWLARGGTYVLANIRGGG

SEQ ID NO: 874341 - protein, 18 aa, Mycobacterium
VPRYAGIATFARLPQRFE

SEQ ID NO: 874342 - protein, 19 aa, Mycobacterium
VPSARGFERGLMSMMTGRR

SEQ ID NO: 874343 - protein, 24 aa, Mycobacterium
VPSDFRMWVCLHEVTHRVQFSANP

SEQ ID NO: 874344 - protein, 23 aa, Mycobacterium
VPSFAYQYSFARNPQWSRLFPKG

SEQ ID NO: 874345 - protein, 26 aa, Mycobacterium
VPSFDEFWDRGYLELPTDAGLTLLSD

SEQ ID NO: 874346 - protein, 25 aa, Mycobacterium
VPSFLQVPVSWLGAGVYQLVNIPAQ

SEQ ID NO: 874347 - protein, 26 aa, Mycobacterium
VPSGDGLRPLRLTLSQLRLRELLVEV

SEQ ID NO: 874348 - protein, 19 aa, Mycobacterium
VPSGWRNLRGPSSGFQTKE

SEQ ID NO: 874349 - protein, 41 aa, Mycobacterium
VPSHKLLIRAGYVRPIAPGLYSWLPLGLRVLRNIERVVREE

SEQ ID NO: 874350 - protein, 25 aa, Mycobacterium
VPSHKLLIRAGYVRPVAPGVYSWLP

SEQ ID NO: 874351 - protein, 40 aa, Mycobacterium
VPSHKLLIRAGYVRPVGPGLYSWLPLGLKVLRKIEHIVRS

SEQ ID NO: 874352 - protein, 25 aa, Mycobacterium
VPSHPPVWFMRQAGRSLPEYRAVRA

SEQ ID NO: 874353 - protein, 18 aa, Mycobacterium
VPSIAVFNDVDLRWVILA

SEQ ID NO: 874354 - protein, 27 aa, Mycobacterium
VPSITEISNLLLMRGMIGKPGAGLCPV

SEQ ID NO: 874355 - protein, 28 aa, Mycobacterium
VPSLDLYREPDPFRIPRPSEIRSSIDLE

SEQ ID NO: 874356 - protein, 23 aa, Mycobacterium
VPSLDLYREPDPFRVPRPSEIRD

SEQ ID NO: 874357 - protein, 21 aa, Mycobacterium
VPSLWAEFVARWEIQSPSPDP

SEQ ID NO: 874358 - protein, 20 aa, Mycobacterium
VPSLWAEFVARWETRAPSPD

SEQ ID NO: 874359 - protein, 17 aa, Mycobacterium
VPSMRPTPYPVAPGIDC

SEQ ID NO: 874360 - protein, 24 aa, Mycobacterium
VPSNPADAYWLLRHAIACPDPVMY

SEQ ID NO: 874361 - protein, 17 aa, Mycobacterium
VPSPGMGLSGIWLGAVV

SEQ ID NO: 874362 - protein, 18 aa, Mycobacterium
VPSPLIIGRAVAHNARMW

SEQ ID NO: 874363 - protein, 28 aa, Mycobacterium
VPSQAYRTLFLQELLKRGVLGQSFVTSA

SEQ ID NO: 874364 - protein, 25 aa, Mycobacterium
VPSQSLRANLTPWADLIEPNSSVVS

SEQ ID NO: 874365 - protein, 20 aa, Mycobacterium
VPSQVHPAHPIAAAAAVAAP

SEQ ID NO: 874366 - protein, 19 aa, Mycobacterium
VPSRVELPWRSVSAAREDV

SEQ ID NO: 874367 - protein, 24 aa, Mycobacterium
VPSRYYSYSFAPNPRWSKGFSPGS

SEQ ID NO: 874368 - protein, 36 aa, Mycobacterium
VPSTAVSWLPFYHDMGLMLGIILPMINQDTAVLLNP

SEQ ID NO: 874369 - protein, 36 aa, Mycobacterium
VPSTAVSWLPFYHDMGLMLGVILPMINQDTAVLLSP

SEQ ID NO: 874370 - protein, 34 aa, Mycobacterium
VPSTGAPPPPGPPMPEPPPAPPAPPEPAAGATGA

SEQ ID NO: 874371 - protein, 18 aa, Mycobacterium
VPSTPGDAYWLLRHAIAC

SEQ ID NO: 874372 - protein, 23 aa, Mycobacterium
VPSVKVRYFGKVKRLGTVSPAVF

SEQ ID NO: 874373 - protein, 17 aa, Mycobacterium
VPSVYYHVPGKQAALDL

SEQ ID NO: 874374 - protein, 18 aa, Mycobacterium
VPSWHYPGGYAESVTVPA

SEQ ID NO: 874375 - protein, 17 aa, Mycobacterium
VPSWLSGDDDREARTTE

SEQ ID NO: 874376 - protein, 32 aa, Mycobacterium
VPTAALQDQLFAEAFRLLRPGGVFAGSDGVPS

SEQ ID NO: 874377 - protein, 18 aa, Mycobacterium
VPTAFYRHFESMEDLGTV

SEQ ID NO: 874378 - protein, 18 aa, Mycobacterium
VPTAQLLDTYSPEIYCLM

SEQ ID NO: 874379 - protein, 26 aa, Mycobacterium
VPTAWLAEGLLMYLPADAQDQLFAHV

SEQ ID NO: 874380 - protein, 28 aa, Mycobacterium
VPTCPDWTLRQLLRHVGRGNRWAAQIIS

SEQ ID NO: 874381 - protein, 24 aa, Mycobacterium
VPTDLLLEQLSIRLGWAQRRVELP

SEQ ID NO: 874382 - protein, 18 aa, Mycobacterium
VPTDLVGIFAGSGSLLPS

SEQ ID NO: 874383 - protein, 28 aa, Mycobacterium
VPTIAWTTWHMIFWWSTALAHVRGLTPP

SEQ ID NO: 874384 - protein, 21 aa, Mycobacterium
VPTLFLLGQCLFGPVLVDPPT

SEQ ID NO: 874385 - protein, 19 aa, Mycobacterium
VPTLFPFVESQSRLLAAYA

SEQ ID NO: 874386 - protein, 21 aa, Mycobacterium
VPTLTRVLTLGPVPAELAEVG

SEQ ID NO: 874387 - protein, 18 aa, Mycobacterium
VPTPKLLALIGERAPEAD

SEQ ID NO: 874388 - protein, 20 aa, Mycobacterium
VPTPPRPPQPGAPRIDIAAI

SEQ ID NO: 874389 - protein, 36 aa, Mycobacterium
VPTQPFSIPRHPGIAALTYHWTALYPDPGAPRFSVT

SEQ ID NO: 874390 - protein, 27 aa, Mycobacterium
VPTRQGQWWYYARTFEGKQYRVQCRCP

SEQ ID NO: 874391 - protein, 23 aa, Mycobacterium
VPTRRGNWWYYARTFEGRQYGVH

SEQ ID NO: 874392 - protein, 25 aa, Mycobacterium
VPTSIKDALWTRGWPTLRGSTLIDE

SEQ ID NO: 874393 - protein, 24 aa, Mycobacterium
VPTSLIFHRFPRGYTMSSLPQLTH

SEQ ID NO: 874394 - protein, 17 aa, Mycobacterium
VPTTLLHVVQDLDTWLQ

SEQ ID NO: 874395 - protein, 34 aa, Mycobacterium
VPTTQAFRRVFGDRFMYILYFQEPGPADAELARD

SEQ ID NO: 874396 - protein, 25 aa, Mycobacterium
VPTTTGWRMLSGDETGWLLGDYILS

SEQ ID NO: 874397 - protein, 49 aa, Mycobacterium
VPTVASAVLDPTQIVNWLIYQPLHAAGQQFWVVSPIGSTLGGVINTISG

SEQ ID NO: 874398 - protein, 22 aa, Mycobacterium
VPTVTALTFALLNLLALASEVT

SEQ ID NO: 874399 - protein, 23 aa, Mycobacterium
VPTVWPGTPYPLGATYDGAGTNF

SEQ ID NO: 874400 - protein, 23 aa, Mycobacterium
VPTYSYCRIYWNGAVLEKHTDGA

SEQ ID NO: 874401 - protein, 30 aa, Mycobacterium
VPVAPHGSIPVLRPEWPRAALSVGDLGWSD

SEQ ID NO: 874402 - protein, 20 aa, Mycobacterium
VPVARLEFMLADAAPIAVAT

SEQ ID NO: 874403 - protein, 19 aa, Mycobacterium
VPVAYHTFGGWKRSGFGDL

SEQ ID NO: 874404 - protein, 23 aa, Mycobacterium
VPVDWPAVFAGSGGRRVDLPTYA

SEQ ID NO: 874405 - protein, 41 aa, Mycobacterium
VPVERTCEFLEWFLGNVPIAPIWLCPLRLRDHEGWPLYPMR

SEQ ID NO: 874406 - protein, 23 aa, Mycobacterium
VPVGQLIRKPAQLGWETAGSLYV

SEQ ID NO: 874407 - protein, 20 aa, Mycobacterium
VPVGTKPWKIAVDLGTHGVY

SEQ ID NO: 874408 - protein, 26 aa, Mycobacterium
VPVGWGGWLEGILPGMLGAGHGSALI

SEQ ID NO: 874409 - protein, 21 aa, Mycobacterium
VPVHRALVRRLLGSGAAGGAT

SEQ ID NO: 874410 - protein, 27 aa, Mycobacterium
VPVHRVPAIMFPKVSTLPLGVPQPRMV

SEQ ID NO: 874411 - protein, 17 aa, Mycobacterium
VPVINYPEAAILGMGSL

SEQ ID NO: 874412 - protein, 18 aa, Mycobacterium
VPVLAFVAGQLPAWAHQV

SEQ ID NO: 874413 - protein, 26 aa, Mycobacterium
VPVLPDLILDILAGGGVLPRLAERGY

SEQ ID NO: 874414 - protein, 18 aa, Mycobacterium
VPVLSLGRYAGARRNAIV

SEQ ID NO: 874415 - protein, 20 aa, Mycobacterium
VPVLTTLHTPPFPALEAAVG

SEQ ID NO: 874416 - protein, 18 aa, Mycobacterium
VPVMSFLIKHAKAIPVDR

SEQ ID NO: 874417 - protein, 19 aa, Mycobacterium
VPVPFVVTDFEPGRRWAWE

SEQ ID NO: 874418 - protein, 28 aa, Mycobacterium
VPVPHAPIAEYFVWFGDEYRIDETDRLL

SEQ ID NO: 874419 - protein, 21 aa, Mycobacterium
VPVPLNTRWAAPEKLFVLEHS

SEQ ID NO: 874420 - protein, 23 aa, Mycobacterium
VPVPMHWDLPEWERNRVLDVIDA

SEQ ID NO: 874421 - protein, 19 aa, Mycobacterium
VPVPPRIHYGAIAYAPTGE

SEQ ID NO: 874422 - protein, 17 aa, Mycobacterium
VPVPVDLGDDWPRALTA

SEQ ID NO: 874423 - protein, 22 aa, Mycobacterium
VPVQVGYQRRFDAAFAAAKREV

SEQ ID NO: 874424 - protein, 18 aa, Mycobacterium
VPVRAFINPANRLMVYRR

SEQ ID NO: 874425 - protein, 19 aa, Mycobacterium
VPVRFYRGGSAPAPAVVYC

SEQ ID NO: 874426 - protein, 20 aa, Mycobacterium
VPVRIPVGAAERLVLAADVV

SEQ ID NO: 874427 - protein, 17 aa, Mycobacterium
VPVRRMVFHEITEQAIL

SEQ ID NO: 874428 - protein, 24 aa, Mycobacterium
VPVRTEAWLGYVLGRVAPGINRRT

SEQ ID NO: 874429 - protein, 24 aa, Mycobacterium
VPVSATWIDIRFTLPANTVDGGIP

SEQ ID NO: 874430 - protein, 25 aa, Mycobacterium
VPVSGVWVEIPFTLPPNTVDGATPV

SEQ ID NO: 874431 - protein, 30 aa, Mycobacterium
VPVSWVEVPDYRPFWAITKHADIMDIERDN

SEQ ID NO: 874432 - protein, 27 aa, Mycobacterium
VPVTEAALFVLDSWLRPVPVGVAGELY

SEQ ID NO: 874433 - protein, 27 aa, Mycobacterium
VPVTLDELIPLVRGVVRGAPHALVVAD

SEQ ID NO: 874434 - protein, 26 aa, Mycobacterium
VPVVGSPWLTALAARSRFAEGFHSPT

SEQ ID NO: 874435 - protein, 21 aa, Mycobacterium
VPVVGWLGKHYLMPLLRGELA

SEQ ID NO: 874436 - protein, 18 aa, Mycobacterium
VPVVLMTFDPHPMEVVFP

SEQ ID NO: 874437 - protein, 20 aa, Mycobacterium
VPVVTYPPPSLTRHAALRAL

SEQ ID NO: 874438 - protein, 18 aa, Mycobacterium
VPWAAILEPAGWTPVGKA

SEQ ID NO: 874439 - protein, 21 aa, Mycobacterium
VPWQELARRTGATLRWYGVTD

SEQ ID NO: 874440 - protein, 17 aa, Mycobacterium
VPWSQMAVIVRSVPRAA

SEQ ID NO: 874441 - protein, 29 aa, Mycobacterium
VPWVELNPHPLYLPSKGLPPLGSGLAPGV

SEQ ID NO: 874442 - protein, 17 aa, Mycobacterium
VPWWDPLADNAVDPAVD

SEQ ID NO: 874443 - protein, 19 aa, Mycobacterium
VPYFTDFARRFTDLPFLAK

SEQ ID NO: 874444 - protein, 20 aa, Mycobacterium
VPYLYRFELMGTAEDVEQVL

SEQ ID NO: 874445 - protein, 23 aa, Mycobacterium
VPYRANLWALRSLGVRRVFAPCA

SEQ ID NO: 874446 - protein, 17 aa, Mycobacterium
VPYTRIHEFRHFHPERT

SEQ ID NO: 874447 - protein, 23 aa, Mycobacterium
VQADILQLLKRLQNEHGTAILFV

SEQ ID NO: 874448 - protein, 24 aa, Mycobacterium
VQAFRSHYRLVTRSLERGYYQGWD

SEQ ID NO: 874449 - protein, 24 aa, Mycobacterium
VQALHEIWACWRDGTRLNFEGEFY

SEQ ID NO: 874450 - protein, 19 aa, Mycobacterium
VQALIRWDPVGHAEAELDG

SEQ ID NO: 874451 - protein, 17 aa, Mycobacterium
VQALLVALAVRGLGSCW

SEQ ID NO: 874452 - protein, 18 aa, Mycobacterium
VQALLVALAVRGLGSCWI

SEQ ID NO: 874453 - protein, 23 aa, Mycobacterium
VQAMFIGPVFNPLLKMLGVDKIA

SEQ ID NO: 874454 - protein, 21 aa, Mycobacterium
VQAMGYLKRVPFPGTPKDVPL

SEQ ID NO: 874455 - protein, 24 aa, Mycobacterium
VQARELLPERALMGDASAIVALHT

SEQ ID NO: 874456 - protein, 22 aa, Mycobacterium
VQARLLNTERLAILADASAFPA

SEQ ID NO: 874457 - protein, 19 aa, Mycobacterium
VQAVIGSVWPLIAEGRVRP

SEQ ID NO: 874458 - protein, 17 aa, Mycobacterium
VQAWIRAVGKRLDVRPA

SEQ ID NO: 874459 - protein, 17 aa, Mycobacterium
VQAWLHRVMPRLTRAEI

SEQ ID NO: 874460 - protein, 19 aa, Mycobacterium
VQAYTLMSRMAELGWICVS

SEQ ID NO: 874461 - protein, 22 aa, Mycobacterium
VQDFAIGDRVAVGWFGGCCYHC

SEQ ID NO: 874462 - protein, 23 aa, Mycobacterium
VQDFSGPFPVEVITRMAGVPEDF

SEQ ID NO: 874463 - protein, 24 aa, Mycobacterium
VQDGLWLRMLDIPAVLQARTYDAD

SEQ ID NO: 874464 - protein, 25 aa, Mycobacterium
VQDLGWEQYPYPVALDQLLAGNSGE

SEQ ID NO: 874465 - protein, 23 aa, Mycobacterium
VQDLVSHMACSFWLAVDPSALPD

SEQ ID NO: 874466 - protein, 17 aa, Mycobacterium
VQDMLWSASMDRINLMT

SEQ ID NO: 874467 - protein, 20 aa, Mycobacterium
VQDTAYAWAYNMQKGGKTRI

SEQ ID NO: 874468 - protein, 19 aa, Mycobacterium
VQDVFFIRGRGIVATGRVE

SEQ ID NO: 874469 - protein, 19 aa, Mycobacterium
VQDVLLIAFALAWNEFLGA

SEQ ID NO: 874470 - protein, 23 aa, Mycobacterium
VQDYGAPIGWRLALRDPSAITAI

SEQ ID NO: 874471 - protein, 23 aa, Mycobacterium
VQDYQLGPYFPPAEHYSLLRHVV

SEQ ID NO: 874472 - protein, 54 aa, Mycobacterium
VQDYQLQLVPKMLRMLRPDLTIGFFLHIPFPPVELFMQMPWRTEIVDGLLGADL

SEQ ID NO: 874473 - protein, 23 aa, Mycobacterium
VQDYQLQLVPKMLRTMRPDLTIG

SEQ ID NO: 874474 - protein, 17 aa, Mycobacterium
VQEDVAVVGLSILSGAH

SEQ ID NO: 874475 - protein, 23 aa, Mycobacterium
VQEELRYLVANHPSLECVVSDAI

SEQ ID NO: 874476 - protein, 19 aa, Mycobacterium
VQEQLATTLGISAGSYAAT

SEQ ID NO: 874477 - protein, 20 aa, Mycobacterium
VQEQLATTLGISAGSYAATE

SEQ ID NO: 874478 - protein, 17 aa, Mycobacterium
VQERMVWHFLMCDDELG

SEQ ID NO: 874479 - protein, 23 aa, Mycobacterium
VQETLLRAWRHQPDLRTGGGADG

SEQ ID NO: 874480 - protein, 30 aa, Mycobacterium
VQEVAVNFPLYVILSLLGLPESDFGRMLKL

SEQ ID NO: 874481 - protein, 26 aa, Mycobacterium
VQEVLRTLPPRPVLVGASLGGFTSML

SEQ ID NO: 874482 - protein, 17 aa, Mycobacterium
VQEYLPPQYPPGAWDSE

SEQ ID NO: 874483 - protein, 18 aa, Mycobacterium
VQFDITLSGALDPRRLRT

SEQ ID NO: 874484 - protein, 26 aa, Mycobacterium
VQFFGGYGYMMEYPIARAYAAARVNK

SEQ ID NO: 874485 - protein, 17 aa, Mycobacterium
VQFFPSHDVYTWDAATL

SEQ ID NO: 874486 - protein, 20 aa, Mycobacterium
VQFGRPLAKFQAVQNLISDI

SEQ ID NO: 874487 - protein, 21 aa, Mycobacterium
VQFMVPAMWTALTQVSDFDSF

SEQ ID NO: 874488 - protein, 24 aa, Mycobacterium
VQGAWAALVAYYNRLRCGTGEYID

SEQ ID NO: 874489 - protein, 41 aa, Mycobacterium
VQGDFYTYRYFASEGFLPGYSFPRLPLSAFIPAERRTRNGE

SEQ ID NO: 874490 - protein, 24 aa, Mycobacterium
VQGHAALRRWAEAAGISVTPGRMY

SEQ ID NO: 874491 - protein, 18 aa, Mycobacterium
VQGLCGRLRLADFDHLEL

SEQ ID NO: 874492 - protein, 25 aa, Mycobacterium
VQGLVPDLAAFWTRYLLAARDTGEI

SEQ ID NO: 874493 - protein, 18 aa, Mycobacterium
VQGQWQWVPQQPQGPQSA

SEQ ID NO: 874494 - protein, 23 aa, Mycobacterium
VQGSLAMFAIWHNGSEEQKQQWL

SEQ ID NO: 874495 - protein, 17 aa, Mycobacterium
VQGSLAMYAIHAFGSDE

SEQ ID NO: 874496 - protein, 18 aa, Mycobacterium
VQGSLPSGWRNLASGYQA

SEQ ID NO: 874497 - protein, 24 aa, Mycobacterium
VQGSLSMFSIYRYGSEEQKNEWLP

SEQ ID NO: 874498 - protein, 24 aa, Mycobacterium
VQGSPPSRFWWNLAATYVETVQPD

SEQ ID NO: 874499 - protein, 24 aa, Mycobacterium
VQGVGFRPFVYTQATLLGLSGWVR

SEQ ID NO: 874500 - protein, 17 aa, Mycobacterium
VQHFQAVQLEAFRQGSR

SEQ ID NO: 874501 - protein, 32 aa, Mycobacterium
VQHGLPQRWIDFLRRWDPSRWPRRASAAGPAP

SEQ ID NO: 874502 - protein, 30 aa, Mycobacterium
VQHLMRRRGAQLWQWLQDGAQLYVCGNADP

SEQ ID NO: 874503 - protein, 33 aa, Mycobacterium
VQIGGGLLLATGKLPRFASAALALSVVPGSLGG

SEQ ID NO: 874504 - protein, 18 aa, Mycobacterium
VQIGRRLAKLAHTHQVIV

SEQ ID NO: 874505 - protein, 18 aa, Mycobacterium
VQIGRRLARLARTHQVIV

SEQ ID NO: 874506 - protein, 19 aa, Mycobacterium
VQIGRRLARLARTHQVIVV

SEQ ID NO: 874507 - protein, 36 aa, Mycobacterium
VQIMTVFVSKGLQYPIVYLPFAFNRNTQDRDVVLFH

SEQ ID NO: 874508 - protein, 33 aa, Mycobacterium
VQIMTVFVSKGLQYPIVYLPFAFNRNTQDSDVV

SEQ ID NO: 874509 - protein, 17 aa, Mycobacterium
VQIVADFRPGPDCRLGV

SEQ ID NO: 874510 - protein, 22 aa, Mycobacterium
VQKDWRLIAMLDMGWEKYQVAA

SEQ ID NO: 874511 - protein, 25 aa, Mycobacterium
VQKEISQNIRTCTKALVEMDQRNAG

SEQ ID NO: 874512 - protein, 33 aa, Mycobacterium
VQKLHGNRLLAPNEYIITLGMHDFGKVSTDPDL

SEQ ID NO: 874513 - protein, 17 aa, Mycobacterium
VQKLMRHTGPALSPFNA

SEQ ID NO: 874514 - protein, 26 aa, Mycobacterium
VQLASGVLPIYIRTPSLLAMTAAGLD

SEQ ID NO: 874515 - protein, 22 aa, Mycobacterium
VQLAYNLFMLQKGQVASEVIDS

SEQ ID NO: 874516 - protein, 27 aa, Mycobacterium
VQLCNQTAPFILVSRLRPAMAASSARR

SEQ ID NO: 874517 - protein, 19 aa, Mycobacterium
VQLDDRRLARIRGDKAHPA

SEQ ID NO: 874518 - protein, 30 aa, Mycobacterium
VQLEKMLLERAYFLGVTAPQLTALVGGLRA

SEQ ID NO: 874519 - protein, 20 aa, Mycobacterium
VQLIAKTEFMAPPGVPWETD

SEQ ID NO: 874520 - protein, 17 aa, Mycobacterium
VQLISMARPLLADPDWV

SEQ ID NO: 874521 - protein, 18 aa, Mycobacterium
VQLLAALGRRYDGDERLS

SEQ ID NO: 874522 - protein, 26 aa, Mycobacterium
VQLMLSPFTSIALSKWSALSPTGRCK

SEQ ID NO: 874523 - protein, 24 aa, Mycobacterium
VQLNAGGALRFTLTNNRPAETERL

SEQ ID NO: 874524 - protein, 27 aa, Mycobacterium
VQLPDAPYLHLFVPRGTVTLEGAGALQ

SEQ ID NO: 874525 - protein, 24 aa, Mycobacterium
VQLPGMGGTFRLAPPLTATDNEID

SEQ ID NO: 874526 - protein, 29 aa, Mycobacterium
VQLPNTAEFAVALFGLLRAGAVPVMCLPG

SEQ ID NO: 874527 - protein, 18 aa, Mycobacterium
VQLPRMTYDMIHKGMTVD

SEQ ID NO: 874528 - protein, 23 aa, Mycobacterium
VQLPTALLALWDSELGPRLIATV

SEQ ID NO: 874529 - protein, 23 aa, Mycobacterium
VQLSDRIVVLAPGGYIHEVIDVE

SEQ ID NO: 874530 - protein, 17 aa, Mycobacterium
VQLVGRPYDEATLLSLA

SEQ ID NO: 874531 - protein, 21 aa, Mycobacterium
VQLVKSFLQPVPADITESLAR

SEQ ID NO: 874532 - protein, 20 aa, Mycobacterium
VQLYDWLVLNGERVLTGDSF

SEQ ID NO: 874533 - protein, 24 aa, Mycobacterium
VQMDQYFARFGGVRDYLMAVVEQA

SEQ ID NO: 874534 - protein, 25 aa, Mycobacterium
VQMFGLTLPSPVFMAPIGVIGICAQ

SEQ ID NO: 874535 - protein, 21 aa, Mycobacterium
VQMWRFVRINLKMMRIIFSGH

SEQ ID NO: 874536 - protein, 28 aa, Mycobacterium
VQNFLAQRQLFDPALLARARVIAADGGC

SEQ ID NO: 874537 - protein, 22 aa, Mycobacterium
VQNILALRFANALYEPIWNNNY

SEQ ID NO: 874538 - protein, 22 aa, Mycobacterium
VQNLIPVVAESLSMSVPAHGLD

SEQ ID NO: 874539 - protein, 19 aa, Mycobacterium
VQNNIEFLRFLLADERVQA

SEQ ID NO: 874540 - protein, 20 aa, Mycobacterium
VQNPPPYWQAAAEQGLQGVH

SEQ ID NO: 874541 - protein, 23 aa, Mycobacterium
VQNRIRFQPSQWAHGPRIVEHTA

SEQ ID NO: 874542 - protein, 29 aa, Mycobacterium
VQNSSSTWPLLKDLPYLGISVLGEAHDEA

SEQ ID NO: 874543 - protein, 17 aa, Mycobacterium
VQNTIMHDVNILEIAAA

SEQ ID NO: 874544 - protein, 17 aa, Mycobacterium
VQNWSVLTPPEPDARMA

SEQ ID NO: 874545 - protein, 29 aa, Mycobacterium
VQPALFAVMVSMAALWRSCGVQPDMVIGH

SEQ ID NO: 874546 - protein, 31 aa, Mycobacterium
VQPALFTQMVGLAALWRTVGVTPRAVVGHSQ

SEQ ID NO: 874547 - protein, 25 aa, Mycobacterium
VQPALWAIMVSLAELWRSVGVVPDA

SEQ ID NO: 874548 - protein, 24 aa, Mycobacterium
VQPARMVRGLPPMLRHIDQLPTMR

SEQ ID NO: 874549 - protein, 19 aa, Mycobacterium
VQPAVIRMLLDAKVPAEDL

SEQ ID NO: 874550 - protein, 17 aa, Mycobacterium
VQPAVVAANRALVRALA

SEQ ID NO: 874551 - protein, 18 aa, Mycobacterium
VQPKKPAGPLDFVPLDMP

SEQ ID NO: 874552 - protein, 17 aa, Mycobacterium
VQPLLAALPERDRLVLK

SEQ ID NO: 874553 - protein, 19 aa, Mycobacterium
VQPLLIVSSDLHRAYDTAV

SEQ ID NO: 874554 - protein, 29 aa, Mycobacterium
VQPNTLMAFLRRLYALAPRLGHLLTVGVH

SEQ ID NO: 874555 - protein, 24 aa, Mycobacterium
VQPPYHLFRRDIESDLLPYCHAHD

SEQ ID NO: 874556 - protein, 18 aa, Mycobacterium
VQPRPTLFERAAATGVAV

SEQ ID NO: 874557 - protein, 18 aa, Mycobacterium
VQQAIRRRAFTRALRITG

SEQ ID NO: 874558 - protein, 23 aa, Mycobacterium
VQQGLLFHTSFVPGLDDLYTVQL

SEQ ID NO: 874559 - protein, 18 aa, Mycobacterium
VQQLAVHGSIKLIVTMRS

SEQ ID NO: 874560 - protein, 32 aa, Mycobacterium
VQQMLLEFGVISRRYLHAAGEYKVVITDRAQA

SEQ ID NO: 874561 - protein, 24 aa, Mycobacterium
VQQTWAELVPLLQAGRLSVDGIFT

SEQ ID NO: 874562 - protein, 19 aa, Mycobacterium
VQRALPRTALIQLSDYVLG

SEQ ID NO: 874563 - protein, 24 aa, Mycobacterium
VQRARAAWLWSGRAGVPAGLSASA

SEQ ID NO: 874564 - protein, 24 aa, Mycobacterium
VQRASAGGLLLPVGVRRLRTYCST

SEQ ID NO: 874565 - protein, 26 aa, Mycobacterium
VQRDGNFVVYTADKPVWHTDTKGKKN

SEQ ID NO: 874566 - protein, 23 aa, Mycobacterium
VQREELRLPRATKPSPWRITERR

SEQ ID NO: 874567 - protein, 18 aa, Mycobacterium
VQRFRLWGSSDLRRWLPL

SEQ ID NO: 874568 - protein, 17 aa, Mycobacterium
VQRFYVWFADFAAADTL

SEQ ID NO: 874569 - protein, 28 aa, Mycobacterium
VQRIGSRVWRVPVTAFWQAHREAAALYS

SEQ ID NO: 874570 - protein, 20 aa, Mycobacterium
VQRIVPETCLYVAAVSRRSH

SEQ ID NO: 874571 - protein, 25 aa, Mycobacterium
VQRIVRYGCGWIPWGPAADDIQTGI

SEQ ID NO: 874572 - protein, 17 aa, Mycobacterium
VQRLARAGWHVAALDVD

SEQ ID NO: 874573 - protein, 21 aa, Mycobacterium
VQRLCDCVRRIDPDVLALQEV

SEQ ID NO: 874574 - protein, 26 aa, Mycobacterium
VQRLHGNRLLAPNEYIITLGRHDFEK

SEQ ID NO: 874575 - protein, 22 aa, Mycobacterium
VQRLLLEVLALQDAAALGVDHL

SEQ ID NO: 874576 - protein, 23 aa, Mycobacterium
VQRLPLNVTWVNLTTGRSGSATL

SEQ ID NO: 874577 - protein, 27 aa, Mycobacterium
VQRLQQIECDYLILDCLRPVLDALGLD

SEQ ID NO: 874578 - protein, 24 aa, Mycobacterium
VQRRMSWIFNLVDVIIAPTTAQPP

SEQ ID NO: 874579 - protein, 37 aa, Mycobacterium
VQRSQGKWYPGEPLPRWQIGLYWRADGEPLWSDDRLL

SEQ ID NO: 874580 - protein, 25 aa, Mycobacterium
VQRSQGKWYPGEPLPRWQIGLYWRR

SEQ ID NO: 874581 - protein, 25 aa, Mycobacterium
VQRSQGRWYPGEPLPRWQIALYRRT

SEQ ID NO: 874582 - protein, 24 aa, Mycobacterium
VQRSQYTGPYLPGYVARTSAYRKR

SEQ ID NO: 874583 - protein, 20 aa, Mycobacterium
VQRTGACGPIISLYVRDPDN

SEQ ID NO: 874584 - protein, 24 aa, Mycobacterium
VQRTWRYLLVPCAIEFWDEDGGAA

SEQ ID NO: 874585 - protein, 27 aa, Mycobacterium
VQRVADVWRLFDSLHLALRVVIAGQDG

SEQ ID NO: 874586 - protein, 30 aa, Mycobacterium
VQRVAQALPLLKPPFPDPGTPLQLVHHDDV

SEQ ID NO: 874587 - protein, 34 aa, Mycobacterium
VQRVIDLVRRRNLPIMFPLEVRFGAPDDAFLSTA

SEQ ID NO: 874588 - protein, 29 aa, Mycobacterium
VQRWLTNHPRFVLHFTPTSSSWLNLVERW

SEQ ID NO: 874589 - protein, 26 aa, Mycobacterium
VQSDACDGFILVPHLTPHGLDEFVDK

SEQ ID NO: 874590 - protein, 24 aa, Mycobacterium
VQSFAALPQVRLCCSLTGPRNLLL

SEQ ID NO: 874591 - protein, 17 aa, Mycobacterium
VQSIFRAAAPGAALYIL

SEQ ID NO: 874592 - protein, 18 aa, Mycobacterium
VQSLIRWDPVGHAEAELE

SEQ ID NO: 874593 - protein, 18 aa, Mycobacterium
VQSLRLYERHGLVTPARS

SEQ ID NO: 874594 - protein, 22 aa, Mycobacterium
VQSSFAGVLADFVRKRNPDTAD

SEQ ID NO: 874595 - protein, 23 aa, Mycobacterium
VQSWAMSWPSVIKQLREDRKGLL

SEQ ID NO: 874596 - protein, 19 aa, Mycobacterium
VQSWDIFRCVRQVLDVLDP

SEQ ID NO: 874597 - protein, 21 aa, Mycobacterium
VQSWLDERLLAAIAQRNRGGV

SEQ ID NO: 874598 - protein, 23 aa, Mycobacterium
VQTAIIDFPGRTNIFNAGLGNLG

SEQ ID NO: 874599 - protein, 23 aa, Mycobacterium
VQTEVSFITLYRDQPSFGDVDLE

SEQ ID NO: 874600 - protein, 17 aa, Mycobacterium
VQTLILRAVAVLDLADA

SEQ ID NO: 874601 - protein, 17 aa, Mycobacterium
VQTLSASSASYAGAEAS

SEQ ID NO: 874602 - protein, 21 aa, Mycobacterium
VQTLTGFKWLARADADRPGTL

SEQ ID NO: 874603 - protein, 25 aa, Mycobacterium
VQTPDDLFMFLQRGELDDVVGDFAL

SEQ ID NO: 874604 - protein, 18 aa, Mycobacterium
VQTPHPPIIIGGQGAKRT

SEQ ID NO: 874605 - protein, 27 aa, Mycobacterium
VQTVLQPGVIVNLPLGNMVLSRGNTGA

SEQ ID NO: 874606 - protein, 17 aa, Mycobacterium
VQTVQRSLLGQMLTSRP

SEQ ID NO: 874607 - protein, 18 aa, Mycobacterium
VQTVVILGALLADTPHTR

SEQ ID NO: 874608 - protein, 23 aa, Mycobacterium
VQTWGLHQYLVGLRRRHPWLHAA

SEQ ID NO: 874609 - protein, 19 aa, Mycobacterium
VQVARLPIYVLGSGADHYG

SEQ ID NO: 874610 - protein, 25 aa, Mycobacterium
VQVDQKFIYHKPLLAGDQLHAVMEI

SEQ ID NO: 874611 - protein, 27 aa, Mycobacterium
VQVDQRFVFYKPVLAGDKLWARMEVHS

SEQ ID NO: 874612 - protein, 26 aa, Mycobacterium
VQVDQVLKFFAPLVAGDKLYCDVYVD

SEQ ID NO: 874613 - protein, 29 aa, Mycobacterium
VQVGLRGYWPPQDTFEWMLEQKMTWHTMQ

SEQ ID NO: 874614 - protein, 28 aa, Mycobacterium
VQVGLRGYWPPRDTFDWMLEQKMTWHTM

SEQ ID NO: 874615 - protein, 21 aa, Mycobacterium
VQVGYQRRFDTAFAAVKQAAD

SEQ ID NO: 874616 - protein, 20 aa, Mycobacterium
VQVPIPRAGGIGAPRIRDVE

SEQ ID NO: 874617 - protein, 21 aa, Mycobacterium
VQVPIYPLLQQGGTAGTVVPT

SEQ ID NO: 874618 - protein, 19 aa, Mycobacterium
VQVPRRGYVPALACTKCRT

SEQ ID NO: 874619 - protein, 19 aa, Mycobacterium
VQVPRRGYVPSLACGRCRA

SEQ ID NO: 874620 - protein, 20 aa, Mycobacterium
VQVRDHLLVAARADLARLPD

SEQ ID NO: 874621 - protein, 20 aa, Mycobacterium
VQVRVPIIGGKLESIIGTRL

SEQ ID NO: 874622 - protein, 34 aa, Mycobacterium
VQVVETWVERPHYMPLFVAPQPISEPVAGDDADD

SEQ ID NO: 874623 - protein, 17 aa, Mycobacterium
VQVYNQEAWYYNSLKAQ

SEQ ID NO: 874624 - protein, 26 aa, Mycobacterium
VQWANRVAPRLGRQWLLPVCAETWDG

SEQ ID NO: 874625 - protein, 19 aa, Mycobacterium
VQWGLEYMFGVLGTAPRAD

SEQ ID NO: 874626 - protein, 30 aa, Mycobacterium
VQWVDVHMGPVLWRVVDWAGYEAALAVLRN

SEQ ID NO: 874627 - protein, 20 aa, Mycobacterium
VQYAFTATLRRALAEEGPSL

SEQ ID NO: 874628 - protein, 25 aa, Mycobacterium
VQYAKTWRTLAKLSLPDKYLRDNAD

SEQ ID NO: 874629 - protein, 21 aa, Mycobacterium
VQYAPVIRPGKLPDTDLDAGG

SEQ ID NO: 874630 - protein, 20 aa, Mycobacterium
VQYGLLDNARRSRLGLGVAE

SEQ ID NO: 874631 - protein, 25 aa, Mycobacterium
VQYLKARYNALVTNPLFASMEFIDD

SEQ ID NO: 874632 - protein, 22 aa, Mycobacterium
VQYVDYTLWQRAQFGDLDDPHS

SEQ ID NO: 874633 - protein, 21 aa, Mycobacterium
VQYVDYTLWQRAQFGDLDDSE

SEQ ID NO: 874634 - protein, 21 aa, Mycobacterium
VQYVDYTLWQRAQFGDLEDPH

SEQ ID NO: 874635 - protein, 30 aa, Mycobacterium; identical to SEQ ID NO: 133613

SEQ ID NO: 874636 - protein, 20 aa, Mycobacterium
VRAADGLRFRIYRPAVVVGD

SEQ ID NO: 874637 - protein, 17 aa, Mycobacterium
VRAAGAVQVLPFAVAAT

SEQ ID NO: 874638 - protein, 17 aa, Mycobacterium
VRAAGGRTLGLFSSMRA

SEQ ID NO: 874639 - protein, 18 aa, Mycobacterium
VRAALDEGRIVLVAGFQG

SEQ ID NO: 874640 - protein, 18 aa, Mycobacterium
VRAALEGLRLPALSTRAG

SEQ ID NO: 874641 - protein, 29 aa, Mycobacterium
VRAANTVQWLRYLHDGPLTVVAVNPDGTG

SEQ ID NO: 874642 - protein, 18 aa, Mycobacterium
VRAAPGYAAYAAAKAGVV

SEQ ID NO: 874643 - protein, 22 aa, Mycobacterium
VRAAQILDHLAGRPTLPLSMTE

SEQ ID NO: 874644 - protein, 26 aa, Mycobacterium
VRAAQQHVLPPLRSYLKTAERLAESA

SEQ ID NO: 874645 - protein, 36 aa, Mycobacterium
VRAATVHPMLVAANRAQLVSLVRSNLLGLNAPAIAT

SEQ ID NO: 874646 - protein, 24 aa, Mycobacterium
VRADLEDLVRIQSVWADPARRGEV

SEQ ID NO: 874647 - protein, 19 aa, Mycobacterium
VRADLLRRAGRPADAVAWY

SEQ ID NO: 874648 - protein, 24 aa, Mycobacterium
VRADPEMFELWDAPTSAPGWPAVT

SEQ ID NO: 874649 - protein, 29 aa, Mycobacterium
VRADVRAALWPLLVGNIIAARGVLRAIRG

SEQ ID NO: 874650 - protein, 30 aa, Mycobacterium
VRAEVALLKILALQFIMSDPRHLGTQALQR

SEQ ID NO: 874651 - protein, 29 aa, Mycobacterium
VRAEVAVLKILALQFIMSDPRHLETQARQ

SEQ ID NO: 874652 - protein, 18 aa, Mycobacterium
VRAFELLRKLSQDSNVPL

SEQ ID NO: 874653 - protein, 19 aa, Mycobacterium
VRAFSRHATWWSRLGAPLT

SEQ ID NO: 874654 - protein, 26 aa, Mycobacterium
VRAGARTLLLIEGSALRVQPGDRIGL

SEQ ID NO: 874655 - protein, 18 aa, Mycobacterium
VRAGARTLVYAPGPALRI

SEQ ID NO: 874656 - protein, 27 aa, Mycobacterium
VRAGATHAFFVPPVIARFLQAGEAATA

SEQ ID NO: 874657 - protein, 18 aa, Mycobacterium
VRAGFPSRLKIFATQSDS

SEQ ID NO: 874658 - protein, 33 aa, Mycobacterium
VRAGGGIFWTRLGLLLQFNPWGDTEWTTNTFSW

SEQ ID NO: 874659 - protein, 23 aa, Mycobacterium
VRAGLKAIYLSGWQVAGDANLSG

SEQ ID NO: 874660 - protein, 20 aa, Mycobacterium
VRAHLAPYLPGHPLADELSD

SEQ ID NO: 874661 - protein, 21 aa, Mycobacterium
VRAILAGHLHYSTNATFVGIP

SEQ ID NO: 874662 - protein, 28 aa, Mycobacterium
VRAIRAALPLLRAADWARVVTLSAHSIQ

SEQ ID NO: 874663 - protein, 21 aa, Mycobacterium
VRAIRMAFDPKYPFDPAVDVP

SEQ ID NO: 874664 - protein, 23 aa, Mycobacterium
VRAIWEMYAGWFRHQSTTELFGV

SEQ ID NO: 874665 - protein, 24 aa, Mycobacterium
VRAIWEMYTGWFRHRSTTELYGIA

SEQ ID NO: 874666 - protein, 24 aa, Mycobacterium
VRAIWFRGTEHRADPANILLLTAH

SEQ ID NO: 874667 - protein, 19 aa, Mycobacterium
VRAKLTEALQCRWTEVALW

SEQ ID NO: 874668 - protein, 22 aa, Mycobacterium
VRAKYGWTDVARFAALGIPAVN

SEQ ID NO: 874669 - protein, 23 aa, Mycobacterium
VRAKYGWTDVARFAALGIPAVNF

SEQ ID NO: 874670 - protein, 22 aa, Mycobacterium
VRALIDAGLAEGARLAAGGAIP

SEQ ID NO: 874671 - protein, 22 aa, Mycobacterium
VRALKIQGLDLAQLPPVAVIGH

SEQ ID NO: 874672 - protein, 17 aa, Mycobacterium
VRALLDIPGNHAVAAIV

SEQ ID NO: 874673 - protein, 17 aa, Mycobacterium
VRALSVPPTWGVSPTIS

SEQ ID NO: 874674 - protein, 26 aa, Mycobacterium
VRALVDLRVARLLAYRAVSLQDDPAA

SEQ ID NO: 874675 - protein, 24 aa, Mycobacterium
VRALVDLRVARLLAYRAVSLQEDP

SEQ ID NO: 874676 - protein, 26 aa, Mycobacterium
VRALVGSELPPPSGPLPPVADAAPKT

SEQ ID NO: 874677 - protein, 21 aa, Mycobacterium
VRAMRYTLERLIRGLDTIAAT

SEQ ID NO: 874678 - protein, 18 aa, Mycobacterium
VRAQLLVAMGRPLPEEMH

SEQ ID NO: 874679 - protein, 20 aa, Mycobacterium
VRARHRLTLDEGRELAVGKR

SEQ ID NO: 874680 - protein, 28 aa, Mycobacterium
VRARLGRLTRPEQWSGFGALGEAAPESA

SEQ ID NO: 874681 - protein, 21 aa, Mycobacterium
VRARRVIVAIPLAIATSIAYE

SEQ ID NO: 874682 - protein, 23 aa, Mycobacterium
VRARRVIVAIPLAVAPSIVYEPM

SEQ ID NO: 874683 - protein, 25 aa, Mycobacterium
VRARTVLCPAPLVEGLVVAAVAAAG

SEQ ID NO: 874684 - protein, 20 aa, Mycobacterium
VRARWLAPDRFRAWNRRRLG

SEQ ID NO: 874685 - protein, 24 aa, Mycobacterium
VRATIRSFGPILLSKVLGLNATQE

SEQ ID NO: 874686 - protein, 19 aa, Mycobacterium
VRATWLALEPSHFAGERLD

SEQ ID NO: 874687 - protein, 27 aa, Mycobacterium
VRATWLRTRPELFDRAIEYYRSSVLPA

SEQ ID NO: 874688 - protein, 21 aa, Mycobacterium
VRATWYTAVPTIHQILLERAR

SEQ ID NO: 874689 - protein, 20 aa, Mycobacterium
VRAVFIRAPWVERAGAGVRV

SEQ ID NO: 874690 - protein, 24 aa, Mycobacterium
VRAVGLEFFRRLVDGELDRADAQD

SEQ ID NO: 874691 - protein, 18 aa, Mycobacterium
VRAVGVTFLTRWASGELV

SEQ ID NO: 874692 - protein, 24 aa, Mycobacterium
VRAVKAAVPALPIQVQCEPPADLA

SEQ ID NO: 874693 - protein, 20 aa, Mycobacterium
VRAVLAHPILDLIGLHCQLG

SEQ ID NO: 874694 - protein, 24 aa, Mycobacterium
VRAVVASRRSLLPAGITGVSGRFH

SEQ ID NO: 874695 - protein, 19 aa, Mycobacterium
VRAWFVSEQGRKRILRATI

SEQ ID NO: 874696 - protein, 18 aa, Mycobacterium
VRAWIERPGRRIALAVAE

SEQ ID NO: 874697 - protein, 25 aa, Mycobacterium
VRAYAAGLAAWWTLLEHTGTGWTQI

SEQ ID NO: 874698 - protein, 18 aa, Mycobacterium
VRAYANASAAMNLMRALT

SEQ ID NO: 874699 - protein, 17 aa, Mycobacterium
VRAYANASAAMNLVRAL

SEQ ID NO: 874700 - protein, 26 aa, Mycobacterium
VRCGHRIAFLLRGHSPVSFSAIKQLE

SEQ ID NO: 874701 - protein, 18 aa, Mycobacterium
VRCPWHNWEFDITTGQSV

SEQ ID NO: 874702 - protein, 18 aa, Mycobacterium
VRCPWHNWEFDVTTGRNV

SEQ ID NO: 874703 - protein, 18 aa, Mycobacterium
VRCRATVGEVGNAEQANI

SEQ ID NO: 874704 - protein, 27 aa, Mycobacterium
VRCVRAALPLLRAAEWARVVNVTAMSV

SEQ ID NO: 874705 - protein, 17 aa, Mycobacterium
VRDATLAAYRALGTDVV

SEQ ID NO: 874706 - protein, 28 aa, Mycobacterium
VRDAVPFSAYLFYKWAAHPGAEPDGWGA

SEQ ID NO: 874707 - protein, 23 aa, Mycobacterium
VRDDHGFIPAGPDLRDVSGWTLD

SEQ ID NO: 874708 - protein, 25 aa, Mycobacterium
VRDESKVIWLSQTTLSVDETMETVR

SEQ ID NO: 874709 - protein, 28 aa, Mycobacterium
VRDEVEPLEVLFPGCEFLPLDDQRRRIV

SEQ ID NO: 874710 - protein, 37 aa, Mycobacterium
VRDFGITTRALMLTYKCIGLPTGLLLPSPELLEESCE

SEQ ID NO: 874711 - protein, 17 aa, Mycobacterium
VRDFVFIDDVVDALFAA

SEQ ID NO: 874712 - protein, 25 aa, Mycobacterium
VRDGAPLVVTWWDVVRAASAVEPPA

SEQ ID NO: 874713 - protein, 25 aa, Mycobacterium
VRDGELFIIGRIKDLLIVYGRNHSP

SEQ ID NO: 874714 - protein, 17 aa, Mycobacterium
VRDGYAWVQPRLSPVAR

SEQ ID NO: 874715 - protein, 23 aa, Mycobacterium
VRDGYGWLQPRLSPVARSALPPH

SEQ ID NO: 874716 - protein, 24 aa, Mycobacterium
VRDHGARLLVRLVGVTDRDAADAL

SEQ ID NO: 874717 - protein, 24 aa, Mycobacterium
VRDHNMQWDFWTLSPESAHQVTWL

SEQ ID NO: 874718 - protein, 29 aa, Mycobacterium
VRDHSDFYVLFVEYWLRAQRDNQLRERLI

SEQ ID NO: 874719 - protein, 21 aa, Mycobacterium
VRDIAAPLPMAVIGDMLGVLP

SEQ ID NO: 874720 - protein, 19 aa, Mycobacterium
VRDILHYLVQSASVPFPTT

SEQ ID NO: 874721 - protein, 24 aa, Mycobacterium
VRDLEFIYCPWHQWGFELATGTTA

SEQ ID NO: 874722 - protein, 19 aa, Mycobacterium
VRDLHARGVPHLPVRVRDG

SEQ ID NO: 874723 - protein, 18 aa, Mycobacterium
VRDLKTLRALEDRGWIVI

SEQ ID NO: 874724 - protein, 24 aa, Mycobacterium
VRDMRFEQMLLLDEETPLSVVGSV

SEQ ID NO: 874725 - protein, 25 aa, Mycobacterium
VRDPNKVIWLSQTTLSVDETMETVR

SEQ ID NO: 874726 - protein, 19 aa, Mycobacterium
VRDRIVRYVPEAAADAMLA

SEQ ID NO: 874727 - protein, 30 aa, Mycobacterium
VRDSDTAWSAFWRIDPRPDGRRAPDGPFIN

SEQ ID NO: 874728 - protein, 18 aa, Mycobacterium
VRDVFFYEPIILADKSSR

SEQ ID NO: 874729 - protein, 21 aa, Mycobacterium
VRDVIGLYLNPTEKAVVLCVD

SEQ ID NO: 874730 - protein, 28 aa, Mycobacterium
VRDVRYLGSQPWPFPRSLMVGFHAIADP

SEQ ID NO: 874731 - protein, 28 aa, Mycobacterium
VRDVRYLGSQPWPFPRSLMVGFHAVADP

SEQ ID NO: 874732 - protein, 30 aa, Mycobacterium
VRDVRYLGSQPWPFPRSLMVGFHAVGDPAQ

SEQ ID NO: 874733 - protein, 27 aa, Mycobacterium
VRDVRYLGSQPWPLPRSLMVGFHAVGD

SEQ ID NO: 874734 - protein, 23 aa, Mycobacterium
VRDVVSHMACSFWLAVDPSHLPD

SEQ ID NO: 874735 - protein, 22 aa, Mycobacterium
VRDWLRRYYMRYSGPGGMTEQD

SEQ ID NO: 874736 - protein, 19 aa, Mycobacterium
VREACLWSRGLAAAGVRRR

SEQ ID NO: 874737 - protein, 37 aa, Mycobacterium
VREAPVDLPALLPSPGRPFGLYLHVPFCVTRCGYCDF

SEQ ID NO: 874738 - protein, 28 aa, Mycobacterium
VREAPVSQPMLAGLYAAFVERYADMITP

SEQ ID NO: 874739 - protein, 22 aa, Mycobacterium
VREFGPLTRQMFVRYAGASGDF

SEQ ID NO: 874740 - protein, 22 aa, Mycobacterium
VREFGRLDIVLANAGIIRLGGE

SEQ ID NO: 874741 - protein, 23 aa, Mycobacterium
VREFLHQHLAGYKIPPSPDFIEF

SEQ ID NO: 874742 - protein, 20 aa, Mycobacterium
VREFLYRTVNGWGAAVVGTP

SEQ ID NO: 874743 - protein, 24 aa, Mycobacterium
VREFNLKKMWLSPNGTIRNILGGT

SEQ ID NO: 874744 - protein, 24 aa, Mycobacterium
VREGYGWLQPRLSPIARVALPPKL

SEQ ID NO: 874745 - protein, 20 aa, Mycobacterium
VREHGARLLVRLAGVNDRDT

SEQ ID NO: 874746 - protein, 18 aa, Mycobacterium
VREHQFRYYIRDAPIITD

SEQ ID NO: 874747 - protein, 17 aa, Mycobacterium
VREHQFRYYVRDAPIIT

SEQ ID NO: 874748 - protein, 18 aa, Mycobacterium
VREHSIFAAILRSDPELL

SEQ ID NO: 874749 - protein, 19 aa, Mycobacterium
VREHYLMRLTRPQQAAIAE

SEQ ID NO: 874750 - protein, 17 aa, Mycobacterium
VREIITRLTHRGALHLP

SEQ ID NO: 874751 - protein, 21 aa, Mycobacterium
VREILAALGMRTLREARGRSD

SEQ ID NO: 874752 - protein, 18 aa, Mycobacterium
VREKLIPRYGLGCKRPSM

SEQ ID NO: 874753 - protein, 19 aa, Mycobacterium
VRELAVYWVARQIGCSWCV

SEQ ID NO: 874754 - protein, 18 aa, Mycobacterium
VRELFLTGGEPFLLPDIA

SEQ ID NO: 874755 - protein, 28 aa, Mycobacterium
VRELIDGIGLTLFPLTSGSKGLHLYAPL

SEQ ID NO: 874756 - protein, 17 aa, Mycobacterium
VRELIEITLVKNPQMRY

SEQ ID NO: 874757 - protein, 21 aa, Mycobacterium
VRELLELTSRWHSTLLDRHRP

SEQ ID NO: 874758 - protein, 30 aa, Mycobacterium
VRELNLMTTKPFLYVFNADESVLGDEARVA

SEQ ID NO: 874759 - protein, 17 aa, Mycobacterium
VREMLPTHKIREILSAA

SEQ ID NO: 874760 - protein, 24 aa, Mycobacterium
VREMSLRYRFIRYDERGCGLSDWD

SEQ ID NO: 874761 - protein, 24 aa, Mycobacterium
VREMTWNWDCLLPDGTIEYNPAKS

SEQ ID NO: 874762 - protein, 18 aa, Mycobacterium
VREPAHRVLVVLGFPDIA

SEQ ID NO: 874763 - protein, 25 aa, Mycobacterium
VREPKDLVICDLGMPRDVDAAVAGL

SEQ ID NO: 874764 - protein, 37 aa, Mycobacterium
VREPLGVVAAIVPWNIPLLTTVWKIGPALVAGNSVVL

SEQ ID NO: 874765 - protein, 21 aa, Mycobacterium
VREPVRRLVELAVGHRVAVAY

SEQ ID NO: 874766 - protein, 21 aa, Mycobacterium
VREQLATTLGISAGSYAATEL

SEQ ID NO: 874767 - protein, 23 aa, Mycobacterium
VRERVAEAMFPRLLTAAADVACD

SEQ ID NO: 874768 - protein, 18 aa, Mycobacterium
VRESFADAVSWVAKNLPS

SEQ ID NO: 874769 - protein, 25 aa, Mycobacterium
VRETDRPFLMPVEDVFTITGRGTVV

SEQ ID NO: 874770 - protein, 28 aa, Mycobacterium
VRETLRLGEKFPLKAGMLTSLGFGHVSG

SEQ ID NO: 874771 - protein, 29 aa, Mycobacterium
VRETSLTDLIYAHHPRFLRVRRAYESRSA

SEQ ID NO: 874772 - protein, 19 aa, Mycobacterium
VREVFVKALREKAGAVKSG

SEQ ID NO: 874773 - protein, 26 aa, Mycobacterium
VREVILRLFGELLDTAPTLGAGLDWK

SEQ ID NO: 874774 - protein, 19 aa, Mycobacterium
VREVTGVPILFASAGEKLE

SEQ ID NO: 874775 - protein, 24 aa, Mycobacterium
VREVVIARLAQPDALDWLMGDDEQ

SEQ ID NO: 874776 - protein, 22 aa, Mycobacterium
VREYMAQLGFRTLNEAIGQVKA

SEQ ID NO: 874777 - protein, 36 aa, Mycobacterium
VRFFGNVRRYGMVSPTVFWPIPRVYSGLVRIDRYET

SEQ ID NO: 874778 - protein, 17 aa, Mycobacterium
VRFLTDWAGPEAMVKKL

SEQ ID NO: 874779 - protein, 19 aa, Mycobacterium
VRFVRCPGWSDYYPNHKGG

SEQ ID NO: 874780 - protein, 21 aa, Mycobacterium
VRFVWHEPGPIAADSHVLLVG

SEQ ID NO: 874781 - protein, 21 aa, Mycobacterium
VRFYRDLVGLPLYETFEDSYG

SEQ ID NO: 874782 - protein, 22 aa, Mycobacterium
VRFYTEIAPQLGAGPIAPCYHS

SEQ ID NO: 874783 - protein, 28 aa, Mycobacterium
VRGAAGAPWFAVSPLMHAAGMWTAFSAI

SEQ ID NO: 874784 - protein, 17 aa, Mycobacterium
VRGFASLMHCDKPTVVK

SEQ ID NO: 874785 - protein, 26 aa, Mycobacterium
VRGGATFVLDGWLRPVPPGVVGELYL

SEQ ID NO: 874786 - protein, 26 aa, Mycobacterium
VRGGKQPRILFATQAATRPPTFVLFT

SEQ ID NO: 874787 - protein, 25 aa, Mycobacterium
VRGGKQPRILFATQATARPPTFVLF

SEQ ID NO: 874788 - protein, 25 aa, Mycobacterium
VRGGKQPRILFATQATSRPPTFVLF

SEQ ID NO: 874789 - protein, 26 aa, Mycobacterium
VRGGRQPRILFATQATARPPTFVLFT

SEQ ID NO: 874790 - protein, 17 aa, Mycobacterium
VRGIYPTAVTIGAEGAE

SEQ ID NO: 874791 - protein, 29 aa, Mycobacterium
VRGKGYPTFCPTGPWLFTTGSDTTFETFD

SEQ ID NO: 874792 - protein, 21 aa, Mycobacterium
VRGLAFSRFLDIAKLLKKKTS

SEQ ID NO: 874793 - protein, 23 aa, Mycobacterium
VRGLGLNFFDYMALLTVGRGGRF

SEQ ID NO: 874794 - protein, 17 aa, Mycobacterium
VRGLIGCLAAGVVPVPI

SEQ ID NO: 874795 - protein, 24 aa, Mycobacterium
VRGLIPEIAAFWEPYIQAAVDRGE

SEQ ID NO: 874796 - protein, 18 aa, Mycobacterium
VRGLRFRAPQPPERWTEV

SEQ ID NO: 874797 - protein, 19 aa, Mycobacterium
VRGLRITPQELRAVAEREG

SEQ ID NO: 874798 - protein, 19 aa, Mycobacterium
VRGLRITPQQLRDIAEREG

SEQ ID NO: 874799 - protein, 17 aa, Mycobacterium
VRGMERYVRSELTHFLG

SEQ ID NO: 874800 - protein, 18 aa, Mycobacterium
VRGPNVFVGYWMKPATTA

SEQ ID NO: 874801 - protein, 17 aa, Mycobacterium
VRGPWITGGYYLGRDAE

SEQ ID NO: 874802 - protein, 20 aa, Mycobacterium
VRGRDIAYLELYWGAKDLIS

SEQ ID NO: 874803 - protein, 30 aa, Mycobacterium
VRGRSVADALDILRWAPQAASEPVAKVIAS

SEQ ID NO: 874804 - protein, 24 aa, Mycobacterium
VRGRTRLLPRRWVTGRAAQLGTVG

SEQ ID NO: 874805 - protein, 23 aa, Mycobacterium
VRGRWQLPILIGAAPATDLIARK

SEQ ID NO: 874806 - protein, 25 aa, Mycobacterium
VRGSRLDWTIVRPSGLFDLPAPTHY

SEQ ID NO: 874807 - protein, 17 aa, Mycobacterium
VRGSWGAARPRRSITCR

SEQ ID NO: 874808 - protein, 20 aa, Mycobacterium
VRGSYVAGWIKRGPTGFIGT

SEQ ID NO: 874809 - protein, 25 aa, Mycobacterium
VRGTEVFWAVAFHGPEQLTLIVTRV

SEQ ID NO: 874810 - protein, 27 aa, Mycobacterium
VRGVLRSPLHPVLSGNIALFTFTGRKS

SEQ ID NO: 874811 - protein, 18 aa, Mycobacterium
VRGVPVRIQHRSGALWIL

SEQ ID NO: 874812 - protein, 23 aa, Mycobacterium
VRGVPVWCTLIALLDDGVPRVGV

SEQ ID NO: 874813 - protein, 17 aa, Mycobacterium
VRGVVHPAVLGRGALAH

SEQ ID NO: 874814 - protein, 19 aa, Mycobacterium
VRGWGVFAHGFTLGKDSPA

SEQ ID NO: 874815 - protein, 28 aa, Mycobacterium
VRHAAEHPLWYRFATANPPRLGAESDEI

SEQ ID NO: 874816 - protein, 26 aa, Mycobacterium
VRHAQPTEWLVGRLAARLPDLAHYPS

SEQ ID NO: 874817 - protein, 28 aa, Mycobacterium
VRHDPDWSVLRSFKRLLNEAGPQTEVSL

SEQ ID NO: 874818 - protein, 30 aa, Mycobacterium
VRHDPGWSVLRSFKRLLNDAGPQTQVNLAG

SEQ ID NO: 874819 - protein, 25 aa, Mycobacterium
VRHGDGAILIRRPTEEGSIRALREH

SEQ ID NO: 874820 - protein, 19 aa, Mycobacterium
VRHIALPRPGGDRELLQLA

SEQ ID NO: 874821 - protein, 17 aa, Mycobacterium
VRHLDCVYGKTEAWYVL

SEQ ID NO: 874822 - protein, 24 aa, Mycobacterium
VRHLIPALEVLHASLAAKAKQWRT

SEQ ID NO: 874823 - protein, 18 aa, Mycobacterium
VRHLWTLAPGRVFLGLGS

SEQ ID NO: 874824 - protein, 18 aa, Mycobacterium
VRHPLYGKIIRTTKKVKA

SEQ ID NO: 874825 - protein, 20 aa, Mycobacterium
VRHPVRLRELPDRRQRAVGQ

SEQ ID NO: 874826 - protein, 29 aa, Mycobacterium
VRHSAFYSTALAYLLSRLDTKRLIITGQV

SEQ ID NO: 874827 - protein, 21 aa, Mycobacterium
VRHWREALRLTPRDRIQIATP

SEQ ID NO: 874828 - protein, 24 aa, Mycobacterium
VRHWVRARLDRPPANAFLAEILAS

SEQ ID NO: 874829 - protein, 29 aa, Mycobacterium
VRIDGPIALEFLLQLLAPLDVAMRGFIDG

SEQ ID NO: 874830 - protein, 17 aa, Mycobacterium
VRIDLSATMLWNNPSIA

SEQ ID NO: 874831 - protein, 23 aa, Mycobacterium
VRIDRFDVLDIRRPDDFPDFVDV

SEQ ID NO: 874832 - protein, 17 aa, Mycobacterium
VRIIIVGGQFDVLTALT

SEQ ID NO: 874833 - protein, 27 aa, Mycobacterium
VRIKGALEPIPAYRLLGMVDGHRAVGR

SEQ ID NO: 874834 - protein, 23 aa, Mycobacterium
VRILDYEWGGFRDIVLDIAHALT

SEQ ID NO: 874835 - protein, 20 aa, Mycobacterium
VRINSAFSIDLPVLEILRGV

SEQ ID NO: 874836 - protein, 27 aa, Mycobacterium
VRIPLAEHDLLACWLLDAHDMGADAAV

SEQ ID NO: 874837 - protein, 18 aa, Mycobacterium
VRIPVRNPKPGRPRFRIP

SEQ ID NO: 874838 - protein, 28 aa, Mycobacterium
VRIQHRSGALWILNSEALGRIGLAEHPD

SEQ ID NO: 874839 - protein, 26 aa, Mycobacterium
VRIQHRSGVQWTLNTAGLALVGKHDH

SEQ ID NO: 874840 - protein, 26 aa, Mycobacterium
VRISINALIVPLYDPIRLAEDIAVLD

SEQ ID NO: 874841 - protein, 25 aa, Mycobacterium
VRISINALIVPLYDPVRLAEDIAVL

SEQ ID NO: 874842 - protein, 26 aa, Mycobacterium
VRITDFTAFWAGPVATQLLGALGADV

SEQ ID NO: 874843 - protein, 25 aa, Mycobacterium
VRITRELVDLPGEPPRLFVVTRNAQ

SEQ ID NO: 874844 - protein, 25 aa, Mycobacterium
VRKAPYFDGMPLEPTPVTDIKGARV

SEQ ID NO: 874845 - protein, 22 aa, Mycobacterium
VRKMRQVWPGAKMLNAYSLTEA

SEQ ID NO: 874846 - protein, 23 aa, Mycobacterium
VRKNGVLPYLRPDGKTQVTIEFE

SEQ ID NO: 874847 - protein, 23 aa, Mycobacterium
VRKNGVLPYLRPDGKTQVTIEYE

SEQ ID NO: 874848 - protein, 36 aa, Mycobacterium
VRKPTRALLEYLFEVDYADHFVWVMTEGALGPVIAD

SEQ ID NO: 874849 - protein, 23 aa, Mycobacterium
VRKVIYFNALVPVRGRSLVDDHP

SEQ ID NO: 874850 - protein, 18 aa, Mycobacterium
VRLAALMNIDPIYVWTHD

SEQ ID NO: 874851 - protein, 20 aa, Mycobacterium
VRLAGLVAHQEILFGTEGET

SEQ ID NO: 874852 - protein, 21 aa, Mycobacterium
VRLAGLVAHQEILFGTEGETL

SEQ ID NO: 874853 - protein, 18 aa, Mycobacterium
VRLAHRGGGRKGKKVALV

SEQ ID NO: 874854 - protein, 17 aa, Mycobacterium
VRLALEPLHPVFCADRA

SEQ ID NO: 874855 - protein, 25 aa, Mycobacterium
VRLAPPLIITEGQIEAFITALPAVL

SEQ ID NO: 874856 - protein, 17 aa, Mycobacterium
VRLCDVDRKGRSHNVTD

SEQ ID NO: 874857 - protein, 17 aa, Mycobacterium
VRLCLSYVPMPPEADHD

SEQ ID NO: 874858 - protein, 24 aa, Mycobacterium
VRLDRFLYTPMAYPTDYGFIENTL

SEQ ID NO: 874859 - protein, 21 aa, Mycobacterium
VRLDRYLYTSMGYPTDYGFIE

SEQ ID NO: 874860 - protein, 24 aa, Mycobacterium
VRLELEQAFMFYLPRICEHCLNPS

SEQ ID NO: 874861 - protein, 18 aa, Mycobacterium
VRLELRLVDRDQPQGSIY

SEQ ID NO: 874862 - protein, 22 aa, Mycobacterium
VRLFETVLLGMSMQRPFVSNAS

SEQ ID NO: 874863 - protein, 17 aa, Mycobacterium
VRLGRLASILRDKRIPL

SEQ ID NO: 874864 - protein, 30 aa, Mycobacterium
VRLHHPVHPHEPLRFVLAAGQPVPLRRMLP

SEQ ID NO: 874865 - protein, 27 aa, Mycobacterium
VRLHKQAHLPYLVYLRHPTTGGVFASW

SEQ ID NO: 874866 - protein, 17 aa, Mycobacterium
VRLIAMRCAGYNNVDIK

SEQ ID NO: 874867 - protein, 21 aa, Mycobacterium
VRLIDIGLELPESALREFDAS

SEQ ID NO: 874868 - protein, 17 aa, Mycobacterium
VRLIQVGFMRRFDPEYA

SEQ ID NO: 874869 - protein, 37 aa, Mycobacterium
VRLKVRAAGLNPIDWKIVAGFMRELMPVDLPAGVGSD

SEQ ID NO: 874870 - protein, 20 aa, Mycobacterium
VRLLNMVPYFQANPKVTRAE

SEQ ID NO: 874871 - protein, 20 aa, Mycobacterium
VRLLNMVPYFQANPRITRAE

SEQ ID NO: 874872 - protein, 22 aa, Mycobacterium
VRLLNMVPYFQANPRITRVEAA

SEQ ID NO: 874873 - protein, 22 aa, Mycobacterium
VRLLNMVPYFQANPRITYTEAA

SEQ ID NO: 874874 - protein, 22 aa, Mycobacterium
VRLLNMVPYFQANPRVTRAKAA

SEQ ID NO: 874875 - protein, 26 aa, Mycobacterium
VRLLRSLRAFRHNPLFSRAAIERFRS

SEQ ID NO: 874876 - protein, 19 aa, Mycobacterium
VRLLTRARIALRHPGEIFA

SEQ ID NO: 874877 - protein, 25 aa, Mycobacterium
VRLLVANNLAGYLTLMERHLDRGTK

SEQ ID NO: 874878 - protein, 17 aa, Mycobacterium
VRLLVESGTITAGEIGD

SEQ ID NO: 874879 - protein, 19 aa, Mycobacterium
VRLLVNNAGIEQFGYLWDT

SEQ ID NO: 874880 - protein, 25 aa, Mycobacterium
VRLMDPQHRILLETAWRAVEHSGYA

SEQ ID NO: 874881 - protein, 25 aa, Mycobacterium
VRLMDPQHRLLLETAWRAIEHSGTA

SEQ ID NO: 874882 - protein, 25 aa, Mycobacterium
VRLMDPQHRLLLETAWRAVEHSGIA

SEQ ID NO: 874883 - protein, 26 aa, Mycobacterium
VRLPESLVALLRRQNGGYLQVGFPED

SEQ ID NO: 874884 - protein, 27 aa, Mycobacterium
VRLRFGDQELYKFRVASNSRRRSPEGT

SEQ ID NO: 874885 - protein, 19 aa, Mycobacterium
VRLRIQLEPVKPFVALRHI

SEQ ID NO: 874886 - protein, 22 aa, Mycobacterium
VRLSERFLLADIHLDWAVDRAG

SEQ ID NO: 874887 - protein, 28 aa, Mycobacterium
VRLSEYPYLVPLIDREIRRPTYVFAAVD

SEQ ID NO: 874888 - protein, 19 aa, Mycobacterium
VRLSQRSLVPPRSIGLVDH

SEQ ID NO: 874889 - protein, 24 aa, Mycobacterium
VRLSRYSYLVSLLPQRIVDELGAP

SEQ ID NO: 874890 - protein, 18 aa, Mycobacterium
VRLTEVPSLDLYREPDPF

SEQ ID NO: 874891 - protein, 18 aa, Mycobacterium
VRLVGARARYMWVSTFHS

SEQ ID NO: 874892 - protein, 18 aa, Mycobacterium
VRMADLLTHGWDLARATG

SEQ ID NO: 874893 - protein, 18 aa, Mycobacterium
VRMDCTVRRVISASSLSA

SEQ ID NO: 874894 - protein, 17 aa, Mycobacterium
VRMFGIQKAFMEVLSQG

SEQ ID NO: 874895 - protein, 21 aa, Mycobacterium
VRMIDAYHRLSKLNEYSAVNF

SEQ ID NO: 874896 - protein, 19 aa, Mycobacterium
VRMPHHRVVLRQQIFGYTY

SEQ ID NO: 874897 - protein, 29 aa, Mycobacterium
VRMPNVARSLLLYRYRRLPEARRAAHRAG

SEQ ID NO: 874898 - protein, 19 aa, Mycobacterium
VRMPVLPPTMVLIQQLRSL

SEQ ID NO: 874899 - protein, 26 aa, Mycobacterium
VRMVAPQLMTRLFDLTIEATEEAILN

SEQ ID NO: 874900 - protein, 29 aa, Mycobacterium
VRNAVRVWAMQPNLAWPLGSIDRMVGLLP

SEQ ID NO: 874901 - protein, 23 aa, Mycobacterium
VRNFTAVTTLRILDGVRLPKGST

SEQ ID NO: 874902 - protein, 21 aa, Mycobacterium
VRNFVPSHRWAVEGGWNIADC

SEQ ID NO: 874903 - protein, 20 aa, Mycobacterium
VRNIYQTALGLEGLIRNAGV

SEQ ID NO: 874904 - protein, 20 aa, Mycobacterium
VRNLASWLQSAPVTMPERLA

SEQ ID NO: 874905 - protein, 23 aa, Mycobacterium
VRNLITAPQYAGWDIFYSLFTGN

SEQ ID NO: 874906 - protein, 24 aa, Mycobacterium
VRNLPGVHILTPGQLNTYDVLRSD

SEQ ID NO: 874907 - protein, 24 aa, Mycobacterium
VRNLVLAATFEWGIALHGLRSERD

SEQ ID NO: 874908 - protein, 29 aa, Mycobacterium
VRNLVLTEDFFLIQKLQKYAREAIDGYSD

SEQ ID NO: 874909 - protein, 17 aa, Mycobacterium
VRNQAESLVYQTEKFVA

SEQ ID NO: 874910 - protein, 18 aa, Mycobacterium
VRNRLPHAAAIAGFLAAG

SEQ ID NO: 874911 - protein, 26 aa, Mycobacterium
VRNRPLLRKAPTWPSERRNPLGKDPH

SEQ ID NO: 874912 - protein, 31 aa, Mycobacterium
VRNRRLYDAIDQWAFCALTNSPGARTFYDQH

SEQ ID NO: 874913 - protein, 31 aa, Mycobacterium
VRNRRLYDAIDQWAFCALTSSPGARTFYDQR

SEQ ID NO: 874914 - protein, 28 aa, Mycobacterium
VRNWLPEPGVVWLWQPTPATVANARDAP

SEQ ID NO: 874915 - protein, 19 aa, Mycobacterium
VRPAFPLMCGAGYGRIVLT

SEQ ID NO: 874916 - protein, 19 aa, Mycobacterium
VRPAFPVMCDNGYGRIVLT

SEQ ID NO: 874917 - protein, 23 aa, Mycobacterium
VRPDALPWHPRGLALDVMIPNPQ

SEQ ID NO: 874918 - protein, 22 aa, Mycobacterium
VRPDRSTTLALRWLVNFSRQRR

SEQ ID NO: 874919 - protein, 27 aa, Mycobacterium
VRPDRSVTLALRWLVSFSKARREKTMI

SEQ ID NO: 874920 - protein, 23 aa, Mycobacterium
VRPEERTMFLKWSDDLVGALSST

SEQ ID NO: 874921 - protein, 19 aa, Mycobacterium
VRPEHALVQVLVGFRDADS

SEQ ID NO: 874922 - protein, 21 aa, Mycobacterium
VRPEPFGALLYHFGTRKLSFL

SEQ ID NO: 874923 - protein, 23 aa, Mycobacterium
VRPEPFGALLYHFGTRKLSFLKN

SEQ ID NO: 874924 - protein, 18 aa, Mycobacterium
VRPGLLTWRGVAKVMSEA

SEQ ID NO: 874925 - protein, 25 aa, Mycobacterium
VRPGQRSFALDDLSLRYLKRELRAD

SEQ ID NO: 874926 - protein, 27 aa, Mycobacterium
VRPGQSVRLHWSRPRVLVGAGPRSTDA

SEQ ID NO: 874927 - protein, 20 aa, Mycobacterium
VRPLGHLPHPRGRVAGRPRT

SEQ ID NO: 874928 - protein, 19 aa, Mycobacterium
VRPLPPEKLTGKKVAVVGS

SEQ ID NO: 874929 - protein, 22 aa, Mycobacterium
VRPPFARNVRFLPTAAAAQQEG

SEQ ID NO: 874930 - protein, 23 aa, Mycobacterium
VRPPFARNVRFLPTAAAAQREGF

SEQ ID NO: 874931 - protein, 17 aa, Mycobacterium
VRPPRLRRWVRDGYGWL

SEQ ID NO: 874932 - protein, 21 aa, Mycobacterium
VRPPWLRRWVRDGYGWLQPRL

SEQ ID NO: 874933 - protein, 18 aa, Mycobacterium
VRPQLIVCLGATAAQSLL

SEQ ID NO: 874934 - protein, 21 aa, Mycobacterium
VRPRHRMVLTTFRSGGSPQSS

SEQ ID NO: 874935 - protein, 26 aa, Mycobacterium
VRPSKRYRYLLIASPAGAYFKGGVNP

SEQ ID NO: 874936 - protein, 28 aa, Mycobacterium
VRPTELNFVPRVWDMLFGTFQSEVRRRS

SEQ ID NO: 874937 - protein, 23 aa, Mycobacterium
VRPTPPIRRLASDRFARQHRAEG

SEQ ID NO: 874938 - protein, 19 aa, Mycobacterium
VRPTSAKLRRRAVRIVRDA

SEQ ID NO: 874939 - protein, 19 aa, Mycobacterium
VRPVAVDLTYIPLVGWAMS

SEQ ID NO: 874940 - protein, 23 aa, Mycobacterium
VRPVVAELQRKFSVSAAETGSRD

SEQ ID NO: 874941 - protein, 22 aa, Mycobacterium
VRPVVAELRRKFAVSAAETGSL

SEQ ID NO: 874942 - protein, 22 aa, Mycobacterium
VRPYPFSAIVGHDQLRLALLLC

SEQ ID NO: 874943 - protein, 19 aa, Mycobacterium
VRPYRDYIAWLNAQDTTEA

SEQ ID NO: 874944 - protein, 29 aa, Mycobacterium
VRQAGTLAFFPLWGYATPTAIELAERLAG

SEQ ID NO: 874945 - protein, 32 aa, Mycobacterium
VRQAHPDVAGPYAWWSWRGKAFDNDAGWRIDY

SEQ ID NO: 874946 - protein, 25 aa, Mycobacterium
VRQARFAAAFTFQYSKRPGTPAADF

SEQ ID NO: 874947 - protein, 25 aa, Mycobacterium
VRQARFAAAFTFQYSKRPGTPAAEL

SEQ ID NO: 874948 - protein, 22 aa, Mycobacterium
VRQFRASVCVLGPLVGRCKRAR

SEQ ID NO: 874949 - protein, 22 aa, Mycobacterium
VRQFRASVCVLGPLVGRCRRAK

SEQ ID NO: 874950 - protein, 23 aa, Mycobacterium
VRQGIPLALALRSAADAAAAGVQ

SEQ ID NO: 874951 - protein, 23 aa, Mycobacterium
VRQGVLEFLPGYAGPDIASRGLD

SEQ ID NO: 874952 - protein, 24 aa, Mycobacterium
VRQHLLAAARRREFRRWLDESCAK

SEQ ID NO: 874953 - protein, 17 aa, Mycobacterium
VRQIFVYGNSERSFLLA

SEQ ID NO: 874954 - protein, 38 aa, Mycobacterium
VRQIPLANLMRFYRLAQTLLWQWMWDRITAAATDRAQQ

SEQ ID NO: 874955 - protein, 18 aa, Mycobacterium
VRQLFVFQRTPSTVDVRA

SEQ ID NO: 874956 - protein, 17 aa, Mycobacterium
VRQLGTVEYRTAWQLQR

SEQ ID NO: 874957 - protein, 19 aa, Mycobacterium
VRQLIAEWSDRGLMAREVA

SEQ ID NO: 874958 - protein, 31 aa, Mycobacterium
VRQLILLDAPAVLGWSAFRDVAQRYSLGMTE

SEQ ID NO: 874959 - protein, 21 aa, Mycobacterium
VRQMLRRVTIIDSGATEFLPG

SEQ ID NO: 874960 - protein, 24 aa, Mycobacterium
VRQPDYLHAFAALWDSEDLDDWKC

SEQ ID NO: 874961 - protein, 24 aa, Mycobacterium
VRQPLREKLTLLWHNHFATSARKV

SEQ ID NO: 874962 - protein, 23 aa, Mycobacterium
VRQQLLDLLPIADATEVAGLLRL

SEQ ID NO: 874963 - protein, 17 aa, Mycobacterium
VRQQVVMSSLAHSALSG

SEQ ID NO: 874964 - protein, 26 aa, Mycobacterium
VRQRRQLWHFGLLPEQVADFLAEYGW

SEQ ID NO: 874965 - protein, 26 aa, Mycobacterium
VRQTDYGIKPYSLLMGSVQVADDVSV

SEQ ID NO: 874966 - protein, 26 aa, Mycobacterium
VRQTSQLVLIIHHLAVDGVSWRILLE

SEQ ID NO: 874967 - protein, 28 aa, Mycobacterium
VRQVFENLWGTELLAEPGLRIPNMFDAA

SEQ ID NO: 874968 - protein, 20 aa, Mycobacterium
VRQVSARRFGYLGPGLVCGN

SEQ ID NO: 874969 - protein, 18 aa, Mycobacterium
VRQWQTLFYDERYSQTNL

SEQ ID NO: 874970 - protein, 25 aa, Mycobacterium
VRQYAARHGLWQLDARIAYLSGDCV

SEQ ID NO: 874971 - protein, 17 aa, Mycobacterium
VRRADVTALPFADGAFD

SEQ ID NO: 874972 - protein, 17 aa, Mycobacterium
VRRAGQAAGLRPALRRD

SEQ ID NO: 874973 - protein, 47 aa, Mycobacterium
VRRAPAVLPALLRLFPRASREFIGDPRYLLDRYLPVDYLQDSSPVGV

SEQ ID NO: 874974 - protein, 24 aa, Mycobacterium
VRRARFSSAFTFQYSIRPGTPAAK

SEQ ID NO: 874975 - protein, 22 aa, Mycobacterium
VRRDHGLVVTGTYVHAADARTV

SEQ ID NO: 874976 - protein, 24 aa, Mycobacterium
VRRDLEDLVRIQSVWADPGRRDQV

SEQ ID NO: 874977 - protein, 30 aa, Mycobacterium
VRRDPGWSVLRSFKRLLNDAGPHTEVSLAG

SEQ ID NO: 874978 - protein, 28 aa, Mycobacterium
VRRDRMSAAFRRLLAVLPPDTSLRSQLL

SEQ ID NO: 874979 - protein, 29 aa, Mycobacterium
VRREPGWSVLRSFKRLLNDAGPHTEVNLA

SEQ ID NO: 874980 - protein, 30 aa, Mycobacterium
VRRFGELTARLYALEALLARGTAIIDAGQS

SEQ ID NO: 874981 - protein, 18 aa, Mycobacterium
VRRFLKLPADTKTVLIVR

SEQ ID NO: 874982 - protein, 27 aa, Mycobacterium
VRRFNEAFGPFGFPPKAIKPSYGLAEA

SEQ ID NO: 874983 - protein, 19 aa, Mycobacterium
VRRFTRTALATLVSLGASF

SEQ ID NO: 874984 - protein, 18 aa, Mycobacterium
VRRGARWLAYDRETRARG

SEQ ID NO: 874985 - protein, 25 aa, Mycobacterium
VRRGARWLYMLITLSRIRCGSDAWP

SEQ ID NO: 874986 - protein, 27 aa, Mycobacterium
VRRGDYLYNFWRDAANPRGLWRRTTLD

SEQ ID NO: 874987 - protein, 31 aa, Mycobacterium
VRRGNGRWELSWWAGPWPIDERWWEEREPTS

SEQ ID NO: 874988 - protein, 19 aa, Mycobacterium
VRRHFRDHGWSLHVPRAIR

SEQ ID NO: 874989 - protein, 20 aa, Mycobacterium
VRRIAEILIALYGPPGCGSF

SEQ ID NO: 874990 - protein, 17 aa, Mycobacterium
VRRIGTPEDIAAACAFL

SEQ ID NO: 874991 - protein, 21 aa, Mycobacterium
VRRILLANALVDPGALRWLVQ

SEQ ID NO: 874992 - protein, 31 aa, Mycobacterium
VRRKIHHQPVYYLVFLTRAPHGRWIFGDALA

SEQ ID NO: 874993 - protein, 24 aa, Mycobacterium
VRRKLRGLLRFLEKAKRNQVYTDF

SEQ ID NO: 874994 - protein, 23 aa, Mycobacterium
VRRLGNGKADYRWAKAHAAQRVE

SEQ ID NO: 874995 - protein, 20 aa, Mycobacterium
VRRLGNGKADYRWAKSQVAP

SEQ ID NO: 874996 - protein, 18 aa, Mycobacterium
VRRLLGLEGVLSIGFCGP

SEQ ID NO: 874997 - protein, 23 aa, Mycobacterium
VRRLMAIRRMKPLGFTLDEMGRL

SEQ ID NO: 874998 - protein, 20 aa, Mycobacterium
VRRLNLAFRDVDWTQWNDLL

SEQ ID NO: 874999 - protein, 24 aa, Mycobacterium
VRRLNLPFRDVDWTEWDDLLRRVH

SEQ ID NO: 875000 - protein, 23 aa, Mycobacterium
VRRLSRLWFEALAGICAHVRSGG

SEQ ID NO: 875001 - protein, 27 aa, Mycobacterium
VRRMMKGNPIPLPWLQPEDVSRAVVYL

SEQ ID NO: 875002 - protein, 30 aa, Mycobacterium
VRRPPEEVYRFWRDLENLPRFMHHLKSVTP

SEQ ID NO: 875003 - protein, 22 aa, Mycobacterium
VRRQIAFYGSTPAYRHVLELHG

SEQ ID NO: 875004 - protein, 26 aa, Mycobacterium
VRRQRSWFRRDHRVVWLDGASEGLVD

SEQ ID NO: 875005 - protein, 34 aa, Mycobacterium
VRRRGEYLYNFWRDAANPKGLWRRTTLESYRAEN

SEQ ID NO: 875006 - protein, 18 aa, Mycobacterium
VRRRGLALRARLMLECAN

SEQ ID NO: 875007 - protein, 23 aa, Mycobacterium
VRRRIYTGKPARLLKSRWTDAWD

SEQ ID NO: 875008 - protein, 31 aa, Mycobacterium
VRRRYRHSLINLVKLLPVLTGLRMYDNSASA

SEQ ID NO: 875009 - protein, 24 aa, Mycobacterium
VRRSAPFATLPRSAFEATLDLLSG

SEQ ID NO: 875010 - protein, 22 aa, Mycobacterium
VRRSDGFQLPHPPRDSREFPTH

SEQ ID NO: 875011 - protein, 21 aa, Mycobacterium
VRRSNFVYGSTKAGLDGFYLG

SEQ ID NO: 875012 - protein, 25 aa, Mycobacterium
VRRSRRLVISMICTVGNYEYGFFWY

SEQ ID NO: 875013 - protein, 24 aa, Mycobacterium
VRRTQAFIVVHRLDNLRRSGRIGG

SEQ ID NO: 875014 - protein, 20 aa, Mycobacterium
VRRVPPGEPGLLLSRVNRLQ

SEQ ID NO: 875015 - protein, 19 aa, Mycobacterium
VRRVRLRPPGRPAAHRAGS

SEQ ID NO: 875016 - protein, 24 aa, Mycobacterium
VRRWSVPEVFWAWVSRMPVPAGTL

SEQ ID NO: 875017 - protein, 17 aa, Mycobacterium
VRRWVVQAQIDGGQRHG

SEQ ID NO: 875018 - protein, 18 aa, Mycobacterium
VRRYGVDAAILFSDIVVP

SEQ ID NO: 875019 - protein, 18 aa, Mycobacterium
VRRYVTDAGPLLARLHKL

SEQ ID NO: 875020 - protein, 20 aa, Mycobacterium
VRSAREILGVLRAVLFAPED

SEQ ID NO: 875021 - protein, 18 aa, Mycobacterium
VRSAREILGVLRAVLFSP

SEQ ID NO: 875022 - protein, 22 aa, Mycobacterium
VRSCDLQFRQFGGRAEFAGPIS

SEQ ID NO: 875023 - protein, 29 aa, Mycobacterium
VRSDASYRWLVHTLTVDVLRDLLPEAAEL

SEQ ID NO: 875024 - protein, 32 aa, Mycobacterium
VRSELMERLTPRLPLPEWAPALSVAQRLQLGE

SEQ ID NO: 875025 - protein, 21 aa, Mycobacterium
VRSFMLQLGGIRALGFSPELV

SEQ ID NO: 875026 - protein, 20 aa, Mycobacterium
VRSGACDGFLLVPDPTPHGL

SEQ ID NO: 875027 - protein, 20 aa, Mycobacterium
VRSGIWIPDSPAVTVRRAPT

SEQ ID NO: 875028 - protein, 18 aa, Mycobacterium
VRSGLGYNFCDVGAVLNV

SEQ ID NO: 875029 - protein, 29 aa, Mycobacterium
VRSGVAFDILRRWLIARGFDVAFIRNVTD

SEQ ID NO: 875030 - protein, 20 aa, Mycobacterium
VRSILAGHLHYSTNATFVGI

SEQ ID NO: 875031 - protein, 28 aa, Mycobacterium
VRSIRASLPLLRSADWARIVTLSAHSIQ

SEQ ID NO: 875032 - protein, 23 aa, Mycobacterium
VRSKWPTLLNPVTYVGMARLAGI

SEQ ID NO: 875033 - protein, 22 aa, Mycobacterium
VRSLARAWANELADRNIRVNVI

SEQ ID NO: 875034 - protein, 20 aa, Mycobacterium
VRSLLQPMTPQLGRQEPLAL

SEQ ID NO: 875035 - protein, 25 aa, Mycobacterium
VRSLPGNRLLAPNEYIITLSVHDAE

SEQ ID NO: 875036 - protein, 25 aa, Mycobacterium
VRSLQTILVFAKALAYFRGTRIVAI

SEQ ID NO: 875037 - protein, 21 aa, Mycobacterium
VRSMLSIQLFGHSDGGAVLNL

SEQ ID NO: 875038 - protein, 21 aa, Mycobacterium
VRSMRYTLERLIRGLDTIAAT

SEQ ID NO: 875039 - protein, 22 aa, Mycobacterium
VRSQLLSLLSDALFGSPDTKRY

SEQ ID NO: 875040 - protein, 26 aa, Mycobacterium
VRSRLMLDIASWRRKRREELAALGDK

SEQ ID NO: 875041 - protein, 18 aa, Mycobacterium
VRSSDILRPLYTPEELYP

SEQ ID NO: 875042 - protein, 17 aa, Mycobacterium
VRSTREVIGVLRAVLFA

SEQ ID NO: 875043 - protein, 17 aa, Mycobacterium
VRSTREVVGVLRAVLFA

SEQ ID NO: 875044 - protein, 18 aa, Mycobacterium
VRSVLRRAPAWGATTIWI

SEQ ID NO: 875045 - protein, 29 aa, Mycobacterium
VRSVRAALPMLRAAEWARIVTLSAHSIQR

SEQ ID NO: 875046 - protein, 19 aa, Mycobacterium
VRSWLLAERAILTTFVGVQ

SEQ ID NO: 875047 - protein, 27 aa, Mycobacterium
VRTDEQWRWLAHTLTVERLKELLPEAA

SEQ ID NO: 875048 - protein, 25 aa, Mycobacterium
VRTDGIITHRFALDDYGRALEALRS

SEQ ID NO: 875049 - protein, 24 aa, Mycobacterium
VRTDPPYPVIIGRGLLGDLGRVLD

SEQ ID NO: 875050 - protein, 23 aa, Mycobacterium
VRTEPPHPGSRYTQIAVLEDGIV

SEQ ID NO: 875051 - protein, 20 aa, Mycobacterium
VRTEPPHPGTRYTQIAVLED

SEQ ID NO: 875052 - protein, 19 aa, Mycobacterium
VRTEPPHQGARYTQIAVLE

SEQ ID NO: 875053 - protein, 20 aa, Mycobacterium
VRTFSPWPELVDGAAARLLT

SEQ ID NO: 875054 - protein, 19 aa, Mycobacterium
VRTHLPDRLAALYQLSTNL

SEQ ID NO: 875055 - protein, 19 aa, Mycobacterium
VRTIEERLGARPLVIQLPI

SEQ ID NO: 875056 - protein, 17 aa, Mycobacterium
VRTKLLAASAYIDAARS

SEQ ID NO: 875057 - protein, 24 aa, Mycobacterium
VRTLDAGLLLTSIGYRGKAIADLP

SEQ ID NO: 875058 - protein, 20 aa, Mycobacterium
VRTPEYWVEQLISPVHLKKA

SEQ ID NO: 875059 - protein, 23 aa, Mycobacterium
VRTPFAYEGLFGHLAAGAVPACE

SEQ ID NO: 875060 - protein, 26 aa, Mycobacterium
VRTPGRGWQHRWALSVLNSALGGGLS

SEQ ID NO: 875061 - protein, 26 aa, Mycobacterium
VRTPGRHWEHRWALSVLNTALGGGLS

SEQ ID NO: 875062 - protein, 27 aa, Mycobacterium
VRTPGRHWEHRWALSVLNTALGGGLSS

SEQ ID NO: 875063 - protein, 27 aa, Mycobacterium
VRTPGRSWRHRWALSVLHSALGGGLSS

SEQ ID NO: 875064 - protein, 23 aa, Mycobacterium
VRTPIGRYGGMFKALSAVDLGVT

SEQ ID NO: 875065 - protein, 17 aa, Mycobacterium
VRTPLRQLVLDATNPSP

SEQ ID NO: 875066 - protein, 17 aa, Mycobacterium
VRTPMISPTTLYDKFPA

SEQ ID NO: 875067 - protein, 28 aa, Mycobacterium
VRTPRLEVGLPQPIVDIFATHHLAGRIG

SEQ ID NO: 875068 - protein, 17 aa, Mycobacterium
VRTPSGFDIEYGWDAVT

SEQ ID NO: 875069 - protein, 25 aa, Mycobacterium
VRTRAYDLVRKLDWPAGYDARALGN

SEQ ID NO: 875070 - protein, 22 aa, Mycobacterium
VRTRFFDDFFCDAAGAGIRQSV

SEQ ID NO: 875071 - protein, 18 aa, Mycobacterium
VRTRFFDQALLDGAATGI

SEQ ID NO: 875072 - protein, 19 aa, Mycobacterium
VRTSFVDEKLPGLAAAALS

SEQ ID NO: 875073 - protein, 26 aa, Mycobacterium
VRTSGLMMVAPYLARSMPQLLSVECW

SEQ ID NO: 875074 - protein, 28 aa, Mycobacterium
VRTVEGHLYRLFAKLGINTREQLICLMR

SEQ ID NO: 875075 - protein, 25 aa, Mycobacterium
VRTVHSYAFAVLRLAAQRNGDPPPR

SEQ ID NO: 875076 - protein, 22 aa, Mycobacterium
VRTVLDWALEYDKYVITLCHGP

SEQ ID NO: 875077 - protein, 19 aa, Mycobacterium
VRTVLPPVLSIRNGRRSVV

SEQ ID NO: 875078 - protein, 19 aa, Mycobacterium
VRTVVRFSHPMFGEAVRRR

SEQ ID NO: 875079 - protein, 18 aa, Mycobacterium
VRTWAEWDDARPGFVEID

SEQ ID NO: 875080 - protein, 27 aa, Mycobacterium
VRVALIDGTWVAFPTVEQLERAVFDMV

SEQ ID NO: 875081 - protein, 24 aa, Mycobacterium
VRVAPMRPFRALGRGKRIASDFSS

SEQ ID NO: 875082 - protein, 23 aa, Mycobacterium
VRVAVHFGVRRILLANALVDPGA

SEQ ID NO: 875083 - protein, 25 aa, Mycobacterium
VRVDMLEMLPTPWGLVRSGVAPDHP

SEQ ID NO: 875084 - protein, 23 aa, Mycobacterium
VRVDRLKTWWRPGLLCIGDAAHA

SEQ ID NO: 875085 - protein, 18 aa, Mycobacterium
VRVEGVPYGLIANSTHHL

SEQ ID NO: 875086 - protein, 28 aa, Mycobacterium
VRVGLPEHDLLACWLLEVAGIAVDDNTR

SEQ ID NO: 875087 - protein, 23 aa, Mycobacterium
VRVGLVVPLLTRLGGFYQQTGSS

SEQ ID NO: 875088 - protein, 17 aa, Mycobacterium
VRVIDEPVPWQTNGRVR

SEQ ID NO: 875089 - protein, 26 aa, Mycobacterium
VRVIVALGGFAWKVALGLPGSLGAPR

SEQ ID NO: 875090 - protein, 17 aa, Mycobacterium
VRVIVLTGAGKGFCAGA

SEQ ID NO: 875091 - protein, 19 aa, Mycobacterium
VRVLAPEGRLLVIGFAAGA

SEQ ID NO: 875092 - protein, 20 aa, Mycobacterium
VRVLELGTLISGPFAGRLLG

SEQ ID NO: 875093 - protein, 24 aa, Mycobacterium
VRVLELQFDLGTRFFPHTPPAGWR

SEQ ID NO: 875094 - protein, 17 aa, Mycobacterium
VRVLYGRDPHHITEAEY

SEQ ID NO: 875095 - protein, 17 aa, Mycobacterium
VRVLYGRDPHHITEAQY

SEQ ID NO: 875096 - protein, 24 aa, Mycobacterium
VRVNNFVAFIPNNIEFLQTGQPGV

SEQ ID NO: 875097 - protein, 18 aa, Mycobacterium
VRVNRLSRWYTDGLLCIG

SEQ ID NO: 875098 - protein, 18 aa, Mycobacterium
VRVNSVVPGYMWGENLKG

SEQ ID NO: 875099 - protein, 20 aa, Mycobacterium
VRVPEGFDALTAAPLLCAGV

SEQ ID NO: 875100 - protein, 18 aa, Mycobacterium
VRVPPPPEPAPAPVPEPA

SEQ ID NO: 875101 - protein, 25 aa, Mycobacterium
VRVPRAGGLALAAALRRATAVLSAR

SEQ ID NO: 875102 - protein, 19 aa, Mycobacterium
VRVPYRARVPMTRAALMHR

SEQ ID NO: 875103 - protein, 18 aa, Mycobacterium
VRVRTAMSALAQDTSRYL

SEQ ID NO: 875104 - protein, 26 aa, Mycobacterium
VRVRTGLQVAPFCDLVLDVAGAQVFA

SEQ ID NO: 875105 - protein, 28 aa, Mycobacterium
VRVSDKIDFWLWLDAGFDDHAIEAWIIE

SEQ ID NO: 875106 - protein, 27 aa, Mycobacterium
VRVSDKIDFWLWLDAGFEDHAIEAWVI

SEQ ID NO: 875107 - protein, 19 aa, Mycobacterium
VRVSKPPHPLMPRRNPDAP

SEQ ID NO: 875108 - protein, 26 aa, Mycobacterium
VRVSMGHALLVPYARATDWPAELVAL

SEQ ID NO: 875109 - protein, 27 aa, Mycobacterium
VRVTRRWGPARIAYLLRLNVSTVHNVL

SEQ ID NO: 875110 - protein, 19 aa, Mycobacterium
VRVVLADDYTGPGAGLDGS

SEQ ID NO: 875111 - protein, 20 aa, Mycobacterium
VRVYPVTTKAGIARFLAEHR

SEQ ID NO: 875112 - protein, 26 aa, Mycobacterium
VRWDDIVSRIFGRIDPISMSGEDYRR

SEQ ID NO: 875113 - protein, 17 aa, Mycobacterium
VRWDLCTATLRELEVGA

SEQ ID NO: 875114 - protein, 18 aa, Mycobacterium
VRWEPPLLTITRVATRDT

SEQ ID NO: 875115 - protein, 19 aa, Mycobacterium
VRWEPPLLTITRVATRDTE

SEQ ID NO: 875116 - protein, 22 aa, Mycobacterium
VRWFDIEPCYVYHPLNAYTETR

SEQ ID NO: 875117 - protein, 21 aa, Mycobacterium
VRWFDVEPCYVFHPMNAYDSP

SEQ ID NO: 875118 - protein, 17 aa, Mycobacterium
VRWGLWQGTTIAGADDV

SEQ ID NO: 875119 - protein, 20 aa, Mycobacterium
VRWMYSFLSADKRKTYCLYE

SEQ ID NO: 875120 - protein, 19 aa, Mycobacterium
VRWTVLLDGPVRISVGCQS

SEQ ID NO: 875121 - protein, 17 aa, Mycobacterium
VRWVDGPDRPALLAAVP

SEQ ID NO: 875122 - protein, 18 aa, Mycobacterium
VRWVLQDSGAVLAFAETD

SEQ ID NO: 875123 - protein, 17 aa, Mycobacterium
VRWVPRQSDAKAWQEIE

SEQ ID NO: 875124 - protein, 17 aa, Mycobacterium
VRYAAEVAGALTLDEGA

SEQ ID NO: 875125 - protein, 29 aa, Mycobacterium
VRYDRIGNMFGLYELVPGAPYVLAGSHLD

SEQ ID NO: 875126 - protein, 23 aa, Mycobacterium
VRYFTEGLALMKAAWSDRPRVKF

SEQ ID NO: 875127 - protein, 28 aa, Mycobacterium
VRYITAKEPWFRNAYRQAWEWADATGWK

SEQ ID NO: 875128 - protein, 17 aa, Mycobacterium
VRYKRRGRDILYTQAEY

SEQ ID NO: 875129 - protein, 30 aa, Mycobacterium
VRYPAGNDWVLAFWGIVMAGGIAVAVNTRS

SEQ ID NO: 875130 - protein, 19 aa, Mycobacterium
VRYRAGVADWTFVDSSACG

SEQ ID NO: 875131 - protein, 26 aa, Mycobacterium
VRYRESLGFQVLPLSGGERPPFEVLC

SEQ ID NO: 875132 - protein, 18 aa, Mycobacterium
VRYVGALIKILASDPGRT

SEQ ID NO: 875133 - protein, 19 aa, Mycobacterium
VRYVTGAPQLWVAGTRPFG

SEQ ID NO: 875134 - protein, 20 aa, Mycobacterium
VRYVTGAPQLWVAGTRPFGP

SEQ ID NO: 875135 - protein, 26 aa, Mycobacterium
VSAAAPYRHFADKAALLATVAEQGFR

SEQ ID NO: 875136 - protein, 24 aa, Mycobacterium
VSAAEALTMLPTRAWSGLVILDPG

SEQ ID NO: 875137 - protein, 25 aa, Mycobacterium
VSAAEAMDFPLFVKAVSGGGGRGMR

SEQ ID NO: 875138 - protein, 25 aa, Mycobacterium
VSAALAASATIPPAATVTASRTTGA

SEQ ID NO: 875139 - protein, 26 aa, Mycobacterium
VSAAQVILRWHLQLGNVVIPKSVTPA

SEQ ID NO: 875140 - protein, 26 aa, Mycobacterium
VSAATGLIDLLLAAGGELVTVLTGDG

SEQ ID NO: 875141 - protein, 21 aa, Mycobacterium
VSAATLYNWRRQYGGMDTDAA

SEQ ID NO: 875142 - protein, 24 aa, Mycobacterium
VSAATLYNWRRTYGSYGGMDVDAA

SEQ ID NO: 875143 - protein, 49 aa, Mycobacterium
VSAAVAELFGDHAQAYQVVSAQAAAFHQRFVVALAAAAGSYGRAESAGA

SEQ ID NO: 875144 - protein, 23 aa, Mycobacterium
VSAAVGCGFITWTLKGNEHVLEH

SEQ ID NO: 875145 - protein, 27 aa, Mycobacterium
VSAAVSSFFGAYARDYQAFSVQVEALH

SEQ ID NO: 875146 - protein, 50 aa, Mycobacterium
VSAAVTRMFGAYAQEFQTLSARMEQFHTDFVRALLTGAGAYSGAEAANAS

SEQ ID NO: 875147 - protein, 22 aa, Mycobacterium
VSACGLGRIRGVRTAVRVRGRG

SEQ ID NO: 875148 - protein, 25 aa, Mycobacterium
VSADAALGLLRRHKIEKLPIVDGHG

SEQ ID NO: 875149 - protein, 25 aa, Mycobacterium
VSADAALGLLRRNKIEKLPVVDGHG

SEQ ID NO: 875150 - protein, 22 aa, Mycobacterium
VSADAFLIRMTEERFEKVIDAN

SEQ ID NO: 875151 - protein, 35 aa, Mycobacterium
VSADAVPQIWPGRAIYRIWPDFDVQPLIDASSRTV

SEQ ID NO: 875152 - protein, 29 aa, Mycobacterium
VSADRIGAALRWFGLDGVEHPASADAADL

SEQ ID NO: 875153 - protein, 26 aa, Mycobacterium
VSAEAALGLLRRNKIEKLPIVDGHGK

SEQ ID NO: 875154 - protein, 19 aa, Mycobacterium
VSAEFPPHVLTGHALSRVS

SEQ ID NO: 875155 - protein, 26 aa, Mycobacterium
VSAGFMKILGPQFLSQFLGRVINTHP

SEQ ID NO: 875156 - protein, 41 aa, Mycobacterium
VSAGFMKILGPQFLSRFYGRVINTHPALLPAFPGAHGVADA

SEQ ID NO: 875157 - protein, 25 aa, Mycobacterium
VSAGFMRILGPQFLSKFHQRILNTH

SEQ ID NO: 875158 - protein, 26 aa, Mycobacterium
VSAGIAALFEAHGNAYQTLGAQTLAL

SEQ ID NO: 875159 - protein, 27 aa, Mycobacterium
VSAGLPYRYFGTRSGLLIALVQDFYQR

SEQ ID NO: 875160 - protein, 24 aa, Mycobacterium
VSAGNVMTFLAPSTRARVLGRLRA

SEQ ID NO: 875161 - protein, 18 aa, Mycobacterium
VSAGNVMTFLAPSTRVRV

SEQ ID NO: 875162 - protein, 24 aa, Mycobacterium
VSAGPLREWLHKQRTGRPHVTWKY

SEQ ID NO: 875163 - protein, 25 aa, Mycobacterium
VSAGTLAMPAMAPMAACYITLGTAG

SEQ ID NO: 875164 - protein, 22 aa, Mycobacterium
VSAHKFGGPRGIGALLVRSGHR

SEQ ID NO: 875165 - protein, 18 aa, Mycobacterium
VSAIPIYDEDFVLALPPG

SEQ ID NO: 875166 - protein, 18 aa, Mycobacterium
VSAITRWAQRHDVPLVDL

SEQ ID NO: 875167 - protein, 18 aa, Mycobacterium
VSALALGRSLREALQIGA

SEQ ID NO: 875168 - protein, 17 aa, Mycobacterium
VSALEMSFFGALVQAGS

SEQ ID NO: 875169 - protein, 20 aa, Mycobacterium
VSALEMTFFGALVNAGSGAF

SEQ ID NO: 875170 - protein, 18 aa, Mycobacterium
VSALIVDTFFSSDGIYPD

SEQ ID NO: 875171 - protein, 20 aa, Mycobacterium
VSALLAAAELYWITTVRPDG

SEQ ID NO: 875172 - protein, 17 aa, Mycobacterium
VSALLVRAIERCAPRDD

SEQ ID NO: 875173 - protein, 25 aa, Mycobacterium
VSALLVRALQRCAWREDTRLSRVVV

SEQ ID NO: 875174 - protein, 32 aa, Mycobacterium
VSALPAKYLNRLSDLLFILARAANPDGDVLWR

SEQ ID NO: 875175 - protein, 17 aa, Mycobacterium
VSALPVDGSYPSGTAAY

SEQ ID NO: 875176 - protein, 24 aa, Mycobacterium
VSALTAMHFAAHAKAFQAVYTRAI

SEQ ID NO: 875177 - protein, 21 aa, Mycobacterium
VSALTFHAAAHRQLRYFWPRV

SEQ ID NO: 875178 - protein, 25 aa, Mycobacterium
VSALVSFEVFIREPLRAAMGLTPAR

SEQ ID NO: 875179 - protein, 29 aa, Mycobacterium
VSALVSFEVFIRPALRLAMGLPDPRRPQR

SEQ ID NO: 875180 - protein, 29 aa, Mycobacterium
VSALVSFEVFIRPALRTAMGLPDPERPHR

SEQ ID NO: 875181 - protein, 31 aa, Mycobacterium; identical to SEQ ID NO: 749680

SEQ ID NO: 875182 - protein, 20 aa, Mycobacterium
VSANYHLAWYRMLAGSTPGG

SEQ ID NO: 875183 - protein, 23 aa, Mycobacterium
VSAPALARRWWAAEGQGAFGSFN

SEQ ID NO: 875184 - protein, 25 aa, Mycobacterium
VSAPEALTMFLGRPDRPGQARSVAV

SEQ ID NO: 875185 - protein, 26 aa, Mycobacterium
VSAPFDTPTRLWLDGLLAGMFARTET

SEQ ID NO: 875186 - protein, 21 aa, Mycobacterium
VSAPFLLREQKVTLGFAGPEA

SEQ ID NO: 875187 - protein, 24 aa, Mycobacterium
VSAPLLPLFGRMWKGYARIVLEKL

SEQ ID NO: 875188 - protein, 19 aa, Mycobacterium
VSAPWRFLWIQRERFWRYD

SEQ ID NO: 875189 - protein, 23 aa, Mycobacterium
VSAQAAAAFASAGAQMLASNSSA

SEQ ID NO: 875190 - protein, 20 aa, Mycobacterium
VSAQAAAIHQAFVAALTASA

SEQ ID NO: 875191 - protein, 24 aa, Mycobacterium
VSARDRAAHWRAVDVVPMGAAGQE

SEQ ID NO: 875192 - protein, 23 aa, Mycobacterium
VSATDLPLLALLAGTVTEFAGHV

SEQ ID NO: 875193 - protein, 32 aa, Mycobacterium
VSATLHPGVYVRSFYFLDPDGITLEFACWTKE

SEQ ID NO: 875194 - protein, 18 aa, Mycobacterium
VSATQRAYSAWLWTGRRG

SEQ ID NO: 875195 - protein, 24 aa, Mycobacterium
VSATVAYFEHLLEFGLATSTVAGV

SEQ ID NO: 875196 - protein, 29 aa, Mycobacterium
VSAVAMTAVGIALLELLLTTFENAEKLVE

SEQ ID NO: 875197 - protein, 26 aa, Mycobacterium
VSAYEALLCRIASLGIAYLHVLVEPS

SEQ ID NO: 875198 - protein, 24 aa, Mycobacterium
VSAYELLRKALGSAPVHRAAVATT

SEQ ID NO: 875199 - protein, 19 aa, Mycobacterium
VSCFLVPGDLPGLSFGKPE

SEQ ID NO: 875200 - protein, 17 aa, Mycobacterium
VSCLLNPRAGHETLLTL

SEQ ID NO: 875201 - protein, 20 aa, Mycobacterium
VSCSALKRAYRDQLRAHCPQ

SEQ ID NO: 875202 - protein, 21 aa, Mycobacterium
VSDAAALIHKRAHGAAVVLDH

SEQ ID NO: 875203 - protein, 22 aa, Mycobacterium
VSDAIALIHKRAHGVAVVVSEG

SEQ ID NO: 875204 - protein, 23 aa, Mycobacterium
VSDAMALIHKRAHGVAVVVFEGR

SEQ ID NO: 875205 - protein, 23 aa, Mycobacterium
VSDANALLHKRAHGAAVVVFEGR

SEQ ID NO: 875206 - protein, 31 aa, Mycobacterium
VSDAPYLGFQLGSLWYISLDYINHQTSLNNT

SEQ ID NO: 875207 - protein, 22 aa, Mycobacterium
VSDATALIHKRAHGVAVVVFEG

SEQ ID NO: 875208 - protein, 27 aa, Mycobacterium
VSDDFPLARLYSWHRAMRLFDGPDEVH

SEQ ID NO: 875209 - protein, 24 aa, Mycobacterium
VSDDMIAFLLARARGGVALAFADV

SEQ ID NO: 875210 - protein, 23 aa, Mycobacterium
VSDEAGSHALYWTQKRIIGGDDP

SEQ ID NO: 875211 - protein, 20 aa, Mycobacterium
VSDEAGSHSLYWTQKRIIGG

SEQ ID NO: 875212 - protein, 23 aa, Mycobacterium
VSDEFFALFLDPTMAYTCAYFER

SEQ ID NO: 875213 - protein, 30 aa, Mycobacterium
VSDEQFRGKPLLLNIFPSVDTPVCSASVRK

SEQ ID NO: 875214 - protein, 23 aa, Mycobacterium
VSDERPLWLAEDGPVRVSPSNVE

SEQ ID NO: 875215 - protein, 26 aa, Mycobacterium
VSDESLDLRWWPLDQIPEEDHSVVVL

SEQ ID NO: 875216 - protein, 29 aa, Mycobacterium
VSDFAIYDVAYWWKIKGGKLIHLPAPLIT

SEQ ID NO: 875217 - protein, 20 aa, Mycobacterium
VSDFAYPLPVAVICRLLGVP

SEQ ID NO: 875218 - protein, 28 aa, Mycobacterium
VSDFRQTELFRLLLPARFGGLQASFPEL

SEQ ID NO: 875219 - protein, 19 aa, Mycobacterium
VSDGLLLRTAGDTDRRVCQ

SEQ ID NO: 875220 - protein, 17 aa, Mycobacterium
VSDHLEIVVIDNGRGIP

SEQ ID NO: 875221 - protein, 17 aa, Mycobacterium
VSDITVCILDRPRHGEL

SEQ ID NO: 875222 - protein, 23 aa, Mycobacterium
VSDLTFQGPVVRLSLAAPDDSTV

SEQ ID NO: 875223 - protein, 25 aa, Mycobacterium
VSDLVNGLRFTDIPVLIGLRGGANA

SEQ ID NO: 875224 - protein, 26 aa, Mycobacterium
VSDLVNVRYLSGFTGSNAALLVLAQD

SEQ ID NO: 875225 - protein, 19 aa, Mycobacterium
VSDLYRNRRMPYTAGLLGS

SEQ ID NO: 875226 - protein, 40 aa, Mycobacterium
VSDMFQRRVYFLADLPFVEVYLAREWARCGDLDGAIAHMR

SEQ ID NO: 875227 - protein, 39 aa, Mycobacterium
VSDPAKWAVRHLPYYGRWLRFVTWWPIADGAAHLTVIDP

SEQ ID NO: 875228 - protein, 29 aa, Mycobacterium
VSDRITTYALYIDPPLGRAGLTVEQVRAS

SEQ ID NO: 875229 - protein, 28 aa, Mycobacterium
VSDRITTYALYIDPPLGRAGMSVAQAQA

SEQ ID NO: 875230 - protein, 22 aa, Mycobacterium
VSDRITTYALYIDPPLGRAGMT

SEQ ID NO: 875231 - protein, 24 aa, Mycobacterium
VSDRITTYALYIDPPLGRAGMTAD

SEQ ID NO: 875232 - protein, 25 aa, Mycobacterium
VSDVAVFLDWRYFDSTGVLDDFAPA

SEQ ID NO: 875233 - protein, 27 aa, Mycobacterium
VSDVDLTLFQGDLRFLIGPNGAGKTTV

SEQ ID NO: 875234 - protein, 19 aa, Mycobacterium
VSDVLRAGDFWGGAGSTAC

SEQ ID NO: 875235 - protein, 17 aa, Mycobacterium
VSDVTVCILDRPRHAKL

SEQ ID NO: 875236 - protein, 22 aa, Mycobacterium
VSDVVAPLLQGAFELQECPAAA

SEQ ID NO: 875237 - protein, 20 aa, Mycobacterium
VSDWLFTDTALQQATVAAVA

SEQ ID NO: 875238 - protein, 30 aa, Mycobacterium
VSDYFARNPYRFAHGAARPGVWRGPSSPPR

SEQ ID NO: 875239 - protein, 18 aa, Mycobacterium
VSDYRIDPFTVPATDKIG

SEQ ID NO: 875240 - protein, 38 aa, Mycobacterium
VSEAGSVFPRTYYLGGLFFLGPINLGASTLTIPTVTIA

SEQ ID NO: 875241 - protein, 19 aa, Mycobacterium
VSEALADQTWYLRTLRDEG

SEQ ID NO: 875242 - protein, 27 aa, Mycobacterium
VSEAYFAALLGLPFVAVMPAATSASKI

SEQ ID NO: 875243 - protein, 27 aa, Mycobacterium
VSEAYFAALLGLPFVAVMPAATSASKV

SEQ ID NO: 875244 - protein, 26 aa, Mycobacterium
VSEAYFAALLGLPFVAVMPASTSSSK

SEQ ID NO: 875245 - protein, 25 aa, Mycobacterium
VSEAYFAAMLGLPFIAVMPESTSAS

SEQ ID NO: 875246 - protein, 26 aa, Mycobacterium
VSEAYFAQLLGLPFIAVMTASTSPSK

SEQ ID NO: 875247 - protein, 27 aa, Mycobacterium
VSEAYFASLLGLPFVAVMPAATSAAKV

SEQ ID NO: 875248 - protein, 30 aa, Mycobacterium
VSEEILTALWALIGYRIPTPIPRISYADAM

SEQ ID NO: 875249 - protein, 19 aa, Mycobacterium
VSEFACRLLKYMDANGFGM

SEQ ID NO: 875250 - protein, 20 aa, Mycobacterium
VSEFLVALRLGDPDGGVVPL

SEQ ID NO: 875251 - protein, 23 aa, Mycobacterium
VSEFPFRLIPRRHQNFMNSSGTA

SEQ ID NO: 875252 - protein, 18 aa, Mycobacterium
VSEFVCRLLNYMDANDYD

SEQ ID NO: 875253 - protein, 26 aa, Mycobacterium
VSEGELFIVGRIKDLLIIRGRNYYPE

SEQ ID NO: 875254 - protein, 24 aa, Mycobacterium
VSEGEMFIVGRMKDLLIVYGRNHY

SEQ ID NO: 875255 - protein, 18 aa, Mycobacterium
VSELLVIARTFLADTLAG

SEQ ID NO: 875256 - protein, 23 aa, Mycobacterium
VSELPYIVPIVEHGFDPPNYVLV

SEQ ID NO: 875257 - protein, 18 aa, Mycobacterium
VSELRDVLSSPAPVRSLL

SEQ ID NO: 875258 - protein, 24 aa, Mycobacterium
VSEPLTELLHRYAGQLPVSLELLE

SEQ ID NO: 875259 - protein, 24 aa, Mycobacterium
VSEPLTELLQRYAAQLPVALELLD

SEQ ID NO: 875260 - protein, 27 aa, Mycobacterium
VSERGKYRLGFAIPRLAHVAGGQNDLV

SEQ ID NO: 875261 - protein, 18 aa, Mycobacterium
VSERLLTVAAPVAGEHAI

SEQ ID NO: 875262 - protein, 34 aa, Mycobacterium
VSERMVWKMCSISQWWCAFGKKRRGRKGLPGAPA

SEQ ID NO: 875263 - protein, 23 aa, Mycobacterium
VSETHWHGMLLELALERSRYADD

SEQ ID NO: 875264 - protein, 24 aa, Mycobacterium
VSEYLLFRHFGSKAGLFREALVLP

SEQ ID NO: 875265 - protein, 24 aa, Mycobacterium
VSEYLLFRHFGSKAGLFREALVVP

SEQ ID NO: 875266 - protein, 20 aa, Mycobacterium
VSFAGTMYRAGRAWRGKEVE

SEQ ID NO: 875267 - protein, 26 aa, Mycobacterium
VSFATYFNAFPASYWRRWSICKSVVL

SEQ ID NO: 875268 - protein, 28 aa, Mycobacterium
VSFATYFNAFPASYWRRWSTLDTVVLRV

SEQ ID NO: 875269 - protein, 26 aa, Mycobacterium
VSFGDDPLRMLRAARFVAQLGFAVAP

SEQ ID NO: 875270 - protein, 21 aa, Mycobacterium
VSFGDDPLRMLRAARFVSQLG

SEQ ID NO: 875271 - protein, 22 aa, Mycobacterium
VSFGGLPILPPGAGLNVTVASV

SEQ ID NO: 875272 - protein, 18 aa, Mycobacterium
VSFGHGRFLCPGAWLARC

SEQ ID NO: 875273 - protein, 17 aa, Mycobacterium
VSFLLISSGIVEITHVG

SEQ ID NO: 875274 - protein, 23 aa, Mycobacterium
VSFMQGFPNVLSPRSSLLVLGDG

SEQ ID NO: 875275 - protein, 24 aa, Mycobacterium
VSFQPEWWQRAAELGWASLLVPEE

SEQ ID NO: 875276 - protein, 19 aa, Mycobacterium
VSFTPVLIPTSRGILATCT

SEQ ID NO: 875277 - protein, 21 aa, Mycobacterium
VSFWRAVQTRVWRGRPDPVRD

SEQ ID NO: 875278 - protein, 27 aa, Mycobacterium
VSFYTAPIKALVSEKFFALCEVFGAVN

SEQ ID NO: 875279 - protein, 23 aa, Mycobacterium
VSGAMLQLARDLKLGTGCEEVIG

SEQ ID NO: 875280 - protein, 28 aa, Mycobacterium
VSGARVGLAWILAHAPNTLLIPGTRSIA

SEQ ID NO: 875281 - protein, 20 aa, Mycobacterium
VSGAYVAGWIKRGPSGFIGT

SEQ ID NO: 875282 - protein, 24 aa, Mycobacterium
VSGDLANWMIPGKMVKGMGGAMDL

SEQ ID NO: 875283 - protein, 25 aa, Mycobacterium
VSGEGSVVLLLKRLPDALRDGDRVL

SEQ ID NO: 875284 - protein, 18 aa, Mycobacterium
VSGELGLRRYLEAHGHEL

SEQ ID NO: 875285 - protein, 19 aa, Mycobacterium
VSGEWPLKLSDLKSGLEQL

SEQ ID NO: 875286 - protein, 23 aa, Mycobacterium
VSGFGIHPVMLDAALHAVILASD

SEQ ID NO: 875287 - protein, 20 aa, Mycobacterium
VSGFQNMNTGFFSVGSGFGN

SEQ ID NO: 875288 - protein, 18 aa, Mycobacterium
VSGFVRTGLFKRLSSSGH

SEQ ID NO: 875289 - protein, 26 aa, Mycobacterium
VSGGAAFLMCRRATRLTSHSAQWALP

SEQ ID NO: 875290 - protein, 26 aa, Mycobacterium
VSGGPHDIAAGRLTLFVGGAEPAVDR

SEQ ID NO: 875291 - protein, 27 aa, Mycobacterium
VSGGQTWPLYAPLVVSDARTAASLASS

SEQ ID NO: 875292 - protein, 19 aa, Mycobacterium
VSGHRPTPGTAAYGAAKAG

SEQ ID NO: 875293 - protein, 18 aa, Mycobacterium
VSGIYRYFSGKCEILATG

SEQ ID NO: 875294 - protein, 30 aa, Mycobacterium
VSGKSLPDFLSIEIFRPLDLAMVVDPISAD

SEQ ID NO: 875295 - protein, 20 aa, Mycobacterium
VSGLFHGPRLREMDARHGGS

SEQ ID NO: 875296 - protein, 21 aa, Mycobacterium
VSGLIDGRFPAGITAWNAAHQ

SEQ ID NO: 875297 - protein, 18 aa, Mycobacterium
VSGLIGTALFGDGAAAVV

SEQ ID NO: 875298 - protein, 18 aa, Mycobacterium
VSGLRMAPGHWSGAYACW

SEQ ID NO: 875299 - protein, 26 aa, Mycobacterium
VSGLTAWQGLFLHGHIVAGQSVLIHG

SEQ ID NO: 875300 - protein, 22 aa, Mycobacterium
VSGLTPITLGSSANLRVGQDVV

SEQ ID NO: 875301 - protein, 24 aa, Mycobacterium
VSGLVVALLCRGHVLLEGVPGVAK

SEQ ID NO: 875302 - protein, 25 aa, Mycobacterium
VSGMADMGLFGLPFPEEYGGMGGDY

SEQ ID NO: 875303 - protein, 22 aa, Mycobacterium
VSGPAPWRPLLGMSGPTRLPLE

SEQ ID NO: 875304 - protein, 31 aa, Mycobacterium
VSGPGPRPGPRPGPRPGPRPSPRPVAHPVVV

SEQ ID NO: 875305 - protein, 17 aa, Mycobacterium
VSGPLLSGGYWNLPEAT

SEQ ID NO: 875306 - protein, 18 aa, Mycobacterium
VSGPLLSGGYWNLPEETA

SEQ ID NO: 875307 - protein, 26 aa, Mycobacterium
VSGPNFLGWEHPPAAAVPATTPTKPE

SEQ ID NO: 875308 - protein, 24 aa, Mycobacterium
VSGPSAHHMSKWVRSRFGNPTPKN

SEQ ID NO: 875309 - protein, 18 aa, Mycobacterium
VSGPWAIRHNYVLDFLAF

SEQ ID NO: 875310 - protein, 26 aa, Mycobacterium
VSGQRFAGMLVAGVFLREFVADSVDW

SEQ ID NO: 875311 - protein, 21 aa, Mycobacterium
VSGRLRQPTGTTGPAGPAGPA

SEQ ID NO: 875312 - protein, 23 aa, Mycobacterium
VSGRPYFVHTGEPDYMVQFTIAG

SEQ ID NO: 875313 - protein, 19 aa, Mycobacterium
VSGRRPTPGTAAYGAAKAG

SEQ ID NO: 875314 - protein, 27 aa, Mycobacterium
VSGSGPAYFFLLVEALVDAGVAVGLSR

SEQ ID NO: 875315 - protein, 26 aa, Mycobacterium
VSGSGPAYFFLMVEALVDAGVDAGLP

SEQ ID NO: 875316 - protein, 24 aa, Mycobacterium
VSGSPAFLAPELLGGDAASAASDV

SEQ ID NO: 875317 - protein, 23 aa, Mycobacterium
VSGTMHRRFLDDDLADFHKVMGV

SEQ ID NO: 875318 - protein, 24 aa, Mycobacterium
VSGTMHRRFLDDDLADFHRVMAVN

SEQ ID NO: 875319 - protein, 24 aa, Mycobacterium
VSGVMHRRFLDDDLADFHRVMAVN

SEQ ID NO: 875320 - protein, 27 aa, Mycobacterium
VSHAFHSPLMEPMLDEFARIVARLEPR

SEQ ID NO: 875321 - protein, 23 aa, Mycobacterium
VSHAFLYNHPELRTRIEHLRGTR

SEQ ID NO: 875322 - protein, 35 aa, Mycobacterium
VSHDDARFNVSRAALLVVALSERPDLLMPATEDVL

SEQ ID NO: 875323 - protein, 24 aa, Mycobacterium
VSHDSVLVLPITDAPFHEAAAHIL

SEQ ID NO: 875324 - protein, 27 aa, Mycobacterium
VSHELRTPLMLILEPARRLLESTEPAE

SEQ ID NO: 875325 - protein, 24 aa, Mycobacterium
VSHGAAIRLVSALLAGVDSRFAVD

SEQ ID NO: 875326 - protein, 26 aa, Mycobacterium
VSHHPYFPRLRLELEQGLGWKAGVEA

SEQ ID NO: 875327 - protein, 18 aa, Mycobacterium
VSHLALAKALTSNLAELA

SEQ ID NO: 875328 - protein, 22 aa, Mycobacterium
VSHLLDLRGPSVALDAACAASL

SEQ ID NO: 875329 - protein, 17 aa, Mycobacterium
VSHLYLSPILTAGVGSS

SEQ ID NO: 875330 - protein, 17 aa, Mycobacterium
VSHLYLSPIMTATTGSN

SEQ ID NO: 875331 - protein, 32 aa, Mycobacterium
VSHPELMTVYWDRYILPRRVQATRLLERAREL

SEQ ID NO: 875332 - protein, 17 aa, Mycobacterium
VSHSIAETLLGLGFGEH

SEQ ID NO: 875333 - protein, 17 aa, Mycobacterium
VSHTIPFGSVGDALELA

SEQ ID NO: 875334 - protein, 21 aa, Mycobacterium
VSIASIRKFNAAFGPYGLPDN

SEQ ID NO: 875335 - protein, 19 aa, Mycobacterium
VSIGPWKGAVAWDVSTGDP

SEQ ID NO: 875336 - protein, 18 aa, Mycobacterium
VSIGTAALELLLVEYGRS

SEQ ID NO: 875337 - protein, 17 aa, Mycobacterium
VSIGWLRQELDDLPEDI

SEQ ID NO: 875338 - protein, 30 aa, Mycobacterium
VSIKEQWFSLFGLGRRLGLAVLLTELPGVG

SEQ ID NO: 875339 - protein, 35 aa, Mycobacterium
VSIPPRLPVPDDFALVRYFAAGLAVLHVVLPGFSV

SEQ ID NO: 875340 - protein, 36 aa, Mycobacterium
VSIQAGIINLLLDLQALFGLSYLFVSHDLSVIKHLA

SEQ ID NO: 875341 - protein, 36 aa, Mycobacterium
VSIQAGIINLLLDLQDRFGLSYLFVSHDLSVVKHLA

SEQ ID NO: 875342 - protein, 27 aa, Mycobacterium
VSIQAGIINLLLDLQERYGLSYLFVSH

SEQ ID NO: 875343 - protein, 36 aa, Mycobacterium
VSIQAGIVNLLLDLQERFGLAYLFVSHDLSVVRHLA

SEQ ID NO: 875344 - protein, 17 aa, Mycobacterium
VSISVGCNNSCTFCIVP

SEQ ID NO: 875345 - protein, 24 aa, Mycobacterium
VSISVGCNNSCTFCIVPSLRGKEI

SEQ ID NO: 875346 - protein, 17 aa, Mycobacterium
VSISVGCNNTCTFCIVP

SEQ ID NO: 875347 - protein, 18 aa, Mycobacterium
VSITGFPNRWIIVGPYSW

SEQ ID NO: 875348 - protein, 18 aa, Mycobacterium
VSIVFFDVSATRALLDKV

SEQ ID NO: 875349 - protein, 18 aa, Mycobacterium
VSKAATERLYTGLAADLR

SEQ ID NO: 875350 - protein, 23 aa, Mycobacterium
VSKDLPFAFARFCGAEGIENVTT

SEQ ID NO: 875351 - protein, 17 aa, Mycobacterium
VSKEELFDTVWGGRFVG

SEQ ID NO: 875352 - protein, 23 aa, Mycobacterium
VSKFYNLVLADCGAGLFDPVTLG

SEQ ID NO: 875353 - protein, 19 aa, Mycobacterium
VSKLLWANWHRDLGELAMD

SEQ ID NO: 875354 - protein, 19 aa, Mycobacterium
VSKLLWANWHRELGEIAMD

SEQ ID NO: 875355 - protein, 25 aa, Mycobacterium
VSLAMPWYHRLPDYARLFPTYGQNL

SEQ ID NO: 875356 - protein, 42 aa, Mycobacterium
VSLDAWSQWKWMKNYRIWEANRKIFLYPENWIEPALRDDKSP

SEQ ID NO: 875357 - protein, 25 aa, Mycobacterium
VSLDSPPFYDPWFAKARAAGAIEAR

SEQ ID NO: 875358 - protein, 25 aa, Mycobacterium
VSLDSPPFYDPWFAKARTGGAIEAR

SEQ ID NO: 875359 - protein, 25 aa, Mycobacterium
VSLEPGISFIIRPSEPTQAVAVFGP

SEQ ID NO: 875360 - protein, 31 aa, Mycobacterium; identical to SEQ ID NO: 133699

SEQ ID NO: 875361 - protein, 20 aa, Mycobacterium
VSLFGAQFITWRGIPLIPSD

SEQ ID NO: 875362 - protein, 26 aa, Mycobacterium
VSLGDGWMPFGLRTSGIRALLDATPT

SEQ ID NO: 875363 - protein, 26 aa, Mycobacterium
VSLHREWLLVELRSDWFFGGTTYGAG

SEQ ID NO: 875364 - protein, 23 aa, Mycobacterium
VSLKRLYQMFPSKEDLVVSFLQQ

SEQ ID NO: 875365 - protein, 17 aa, Mycobacterium
VSLKVLGPGDHVSRVSR

SEQ ID NO: 875366 - protein, 18 aa, Mycobacterium
VSLLAEHGRIGEPIVGVA

SEQ ID NO: 875367 - protein, 20 aa, Mycobacterium
VSLLDLFDGRRQLIVQHFMF

SEQ ID NO: 875368 - protein, 26 aa, Mycobacterium
VSLLEKLRHEVPPPTPPCVLVTRRST

SEQ ID NO: 875369 - protein, 19 aa, Mycobacterium
VSLNRLRAMPTTAALLDNA

SEQ ID NO: 875370 - protein, 39 aa, Mycobacterium
VSLPAKKWLGQRGFDPLYGARPLRRLVQQAIGDQLAKML

SEQ ID NO: 875371 - protein, 25 aa, Mycobacterium
VSLPDLRRLLDAVPGILIVDEAYGE

SEQ ID NO: 875372 - protein, 25 aa, Mycobacterium
VSLPDLRRLLDVVPGILIVDEAYGE

SEQ ID NO: 875373 - protein, 22 aa, Mycobacterium
VSLPHRGLAAIEYIVEAVGEFV

SEQ ID NO: 875374 - protein, 17 aa, Mycobacterium
VSLPRECLLIFGAEGPG

SEQ ID NO: 875375 - protein, 33 aa, Mycobacterium
VSLPRNLAHWPGFLVLYYAALRPLHDDGSLLTT

SEQ ID NO: 875376 - protein, 18 aa, Mycobacterium
VSLPVVRAFVARIKERAK

SEQ ID NO: 875377 - protein, 19 aa, Mycobacterium
VSLPVVRAFVTRIKDRAKG

SEQ ID NO: 875378 - protein, 20 aa, Mycobacterium
VSLPVVRAFVTRIKDRAKGA

SEQ ID NO: 875379 - protein, 18 aa, Mycobacterium
VSLQNRLFAEAFRVLRPG

SEQ ID NO: 875380 - protein, 23 aa, Mycobacterium
VSLRPAVFYFTRPVDEDPAELAK

SEQ ID NO: 875381 - protein, 23 aa, Mycobacterium
VSLSIIKFLGFEQMFKNALTGLP

SEQ ID NO: 875382 - protein, 25 aa, Mycobacterium
VSLTKIANDVRWMGSGPLTGLAEIQ

SEQ ID NO: 875383 - protein, 18 aa, Mycobacterium
VSLYAFRIVVHPAIARTF

SEQ ID NO: 875384 - protein, 29 aa, Mycobacterium
VSLYPQPRQTDLPTWIAALGSPETFRTAG

SEQ ID NO: 875385 - protein, 25 aa, Mycobacterium
VSMGHALLVPFARAANWPADLNILR

SEQ ID NO: 875386 - protein, 26 aa, Mycobacterium
VSMGHALLVPFARASSWPTDLELLRD

SEQ ID NO: 875387 - protein, 17 aa, Mycobacterium
VSMLAGVPPLGNTVGNF

SEQ ID NO: 875388 - protein, 23 aa, Mycobacterium
VSMLRVLTFAPVRTSDIRALEHA

SEQ ID NO: 875389 - protein, 17 aa, Mycobacterium
VSMPLFHSNAVVAGWAP

SEQ ID NO: 875390 - protein, 26 aa, Mycobacterium
VSMPLQCGTQWDALAHIFYRGQMYNG

SEQ ID NO: 875391 - protein, 22 aa, Mycobacterium
VSMRPDDLAAQMVRAALDKVPA

SEQ ID NO: 875392 - protein, 26 aa, Mycobacterium
VSMTMNGAVLPILALYVVAAEEQGVG

SEQ ID NO: 875393 - protein, 20 aa, Mycobacterium
VSMVPVKRFDDQLNALVIRR

SEQ ID NO: 875394 - protein, 23 aa, Mycobacterium
VSNASPWTFVGNRPVWTNPGCTF

SEQ ID NO: 875395 - protein, 17 aa, Mycobacterium
VSNDGKLHILNPGPPEC

SEQ ID NO: 875396 - protein, 23 aa, Mycobacterium
VSNQLRLLRTLGLVTGDRSGRNI

SEQ ID NO: 875397 - protein, 31 aa, Mycobacterium
VSNRGKLNWWESRALYGWTVLVPRTKDQAGE

SEQ ID NO: 875398 - protein, 17 aa, Mycobacterium
VSNYLYKHAAVGDVYSI

SEQ ID NO: 875399 - protein, 22 aa, Mycobacterium
VSPALWLTAGAAAPGAFDGADD

SEQ ID NO: 875400 - protein, 25 aa, Mycobacterium
VSPETSWLALNRLIPPLVKSTAGNS

SEQ ID NO: 875401 - protein, 17 aa, Mycobacterium
VSPFLGFGSLRPLLEVA

SEQ ID NO: 875402 - protein, 17 aa, Mycobacterium
VSPILTFDMTRPLADVQ

SEQ ID NO: 875403 - protein, 31 aa, Mycobacterium
VSPLAAPLSLMPWVLTMPNPIFTRAARQMVA

SEQ ID NO: 875404 - protein, 19 aa, Mycobacterium
VSPLFSAFGPEPVATRLRL

SEQ ID NO: 875405 - protein, 27 aa, Mycobacterium
VSPLIREMMIYGLRWPIDRADGDEISD

SEQ ID NO: 875406 - protein, 21 aa, Mycobacterium
VSPLTVQMFMPNGPAAVIGLE

SEQ ID NO: 875407 - protein, 27 aa, Mycobacterium
VSPPPLAPMPHPWFQLIFEGGEQKTTE

SEQ ID NO: 875408 - protein, 21 aa, Mycobacterium
VSPPPRLMLFCGMSIGYEDPS

SEQ ID NO: 875409 - protein, 22 aa, Mycobacterium
VSPPVMLQTWTMPAPKLEGIRE

SEQ ID NO: 875410 - protein, 17 aa, Mycobacterium
VSPRSRVLVLSASDERD

SEQ ID NO: 875411 - protein, 19 aa, Mycobacterium
VSPSWAVLGFGRASAGPGQ

SEQ ID NO: 875412 - protein, 18 aa, Mycobacterium
VSPVFLYAHNDGELQELS

SEQ ID NO: 875413 - protein, 31 aa, Mycobacterium
VSQAADRPWRLWLAGRPEVSAYRRSPRAPAP

SEQ ID NO: 875414 - protein, 17 aa, Mycobacterium
VSQAHLRAVSEDGPWRI

SEQ ID NO: 875415 - protein, 29 aa, Mycobacterium
VSQAWRSAFLRMPYQRDALARRSVIAETF

SEQ ID NO: 875416 - protein, 32 aa, Mycobacterium
VSQAWSQLFPIQQLLRGLPRIPIPPCGTPPTT

SEQ ID NO: 875417 - protein, 26 aa, Mycobacterium
VSQELSDLIFNLGIGNVGTFNLGSGN

SEQ ID NO: 875418 - protein, 18 aa, Mycobacterium
VSQKFMPRPVAEGLNRIL

SEQ ID NO: 875419 - protein, 27 aa, Mycobacterium
VSQLHAKLFYQPLLESIGPAGLEIAHG

SEQ ID NO: 875420 - protein, 26 aa, Mycobacterium
VSQLHAKLFYQPLLESIGPAGLEIGH

SEQ ID NO: 875421 - protein, 24 aa, Mycobacterium
VSQLLTSLGIRRRRLKTSLLSAAD

SEQ ID NO: 875422 - protein, 25 aa, Mycobacterium
VSQRGWPVFKVSTLTRDGLRPLTFA

SEQ ID NO: 875423 - protein, 25 aa, Mycobacterium
VSQVLPAIHPYIGIDSLPAVNHQPE

SEQ ID NO: 875424 - protein, 23 aa, Mycobacterium
VSQWCVGWLRYGLAVDVDAVKPM

SEQ ID NO: 875425 - protein, 17 aa, Mycobacterium
VSQWVQWREGEAAKPPS

SEQ ID NO: 875426 - protein, 17 aa, Mycobacterium
VSRAMFNELWPGFDPDE

SEQ ID NO: 875427 - protein, 23 aa, Mycobacterium
VSRAMFNELWPGFDPGEVPIGSI

SEQ ID NO: 875428 - protein, 24 aa, Mycobacterium
VSRAVLRCLRLPNDLPMLEDRSIH

SEQ ID NO: 875429 - protein, 25 aa, Mycobacterium
VSRDIPVRLVYIIDPAQAPASDRDG

SEQ ID NO: 875430 - protein, 22 aa, Mycobacterium
VSRFSEMFKFELKSLPFILGAK

SEQ ID NO: 875431 - protein, 25 aa, Mycobacterium
VSRHFDIPLTIIRICSTYGPEGGAA

SEQ ID NO: 875432 - protein, 24 aa, Mycobacterium
VSRHGCWGTFVIADARHAVTLPAG

SEQ ID NO: 875433 - protein, 19 aa, Mycobacterium
VSRHIATREPILVAGELGT

SEQ ID NO: 875434 - protein, 23 aa, Mycobacterium
VSRHQIHPPALYIGDSAASSVFR

SEQ ID NO: 875435 - protein, 21 aa, Mycobacterium
VSRIILTRPAVEAGERLGFLP

SEQ ID NO: 875436 - protein, 19 aa, Mycobacterium
VSRIVPGAYFDSIAAAEQA

SEQ ID NO: 875437 - protein, 26 aa, Mycobacterium
VSRIVPLLGPMIQEMLFMQLRHMMET

SEQ ID NO: 875438 - protein, 26 aa, Mycobacterium
VSRKTVYRYFPSTTALLRAAATEGTR

SEQ ID NO: 875439 - protein, 17 aa, Mycobacterium
VSRLRRHARLRKKIEGT

SEQ ID NO: 875440 - protein, 23 aa, Mycobacterium
VSRNVGLLIRRGWVEAVASDAKG

SEQ ID NO: 875441 - protein, 24 aa, Mycobacterium
VSRPTLYRWFADKQELLEAFGNYE

SEQ ID NO: 875442 - protein, 22 aa, Mycobacterium
VSRPTLYRYFADKRELLDVFVV

SEQ ID NO: 875443 - protein, 25 aa, Mycobacterium
VSRPTVYRRFPDTRSILAALLTARI

SEQ ID NO: 875444 - protein, 24 aa, Mycobacterium
VSRPTVYRRWPDTRSIIAALLTSH

SEQ ID NO: 875445 - protein, 23 aa, Mycobacterium
VSRPTVYRRWPDTRSIISALLTS

SEQ ID NO: 875446 - protein, 24 aa, Mycobacterium
VSRQTVHAWLRRYAREGAVLNLED

SEQ ID NO: 875447 - protein, 17 aa, Mycobacterium
VSRSGWYGIDQVAGDLV

SEQ ID NO: 875448 - protein, 17 aa, Mycobacterium
VSRSLIAPILRAASFSD

SEQ ID NO: 875449 - protein, 26 aa, Mycobacterium
VSRSTLYRRFPSRDALITELGRQTFE

SEQ ID NO: 875450 - protein, 32 aa, Mycobacterium
VSRVFDVAAGLPWPARYPSRVLANDFVAQWTG

SEQ ID NO: 875451 - protein, 19 aa, Mycobacterium
VSRVVAFLDDALFAKFGLP

SEQ ID NO: 875452 - protein, 17 aa, Mycobacterium
VSRYLAAMKSVCVRVAD

SEQ ID NO: 875453 - protein, 19 aa, Mycobacterium
VSRYLGPWVAEPQLWQDPV

SEQ ID NO: 875454 - protein, 24 aa, Mycobacterium
VSRYVSRLLGYLFENGIASVTPHL

SEQ ID NO: 875455 - protein, 32 aa, Mycobacterium
VSSALGVFGVPSTPGWLKGISQLIGGISIGGG

SEQ ID NO: 875456 - protein, 24 aa, Mycobacterium
VSSAPRRWQAPRRTVLVGTSTAAA

SEQ ID NO: 875457 - protein, 27 aa, Mycobacterium
VSSARSWAQQTWYPVPGIIESAAANRN

SEQ ID NO: 875458 - protein, 17 aa, Mycobacterium
VSSAWLEQQLRSGLRRA

SEQ ID NO: 875459 - protein, 27 aa, Mycobacterium
VSSAYAMGLLFALDRRDARDELAGLTR

SEQ ID NO: 875460 - protein, 25 aa, Mycobacterium
VSSCATCDGFFFRDQDIAVIGGGDS

SEQ ID NO: 875461 - protein, 20 aa, Mycobacterium
VSSDLTPELLQRSRARATAQ

SEQ ID NO: 875462 - protein, 41 aa, Mycobacterium
VSSEPGVYFLGLPWQSRRGSSFLWGVWHDAKYIADHIAIQR

SEQ ID NO: 875463 - protein, 25 aa, Mycobacterium
VSSFTDSYAKLIFLPQSHEGPGPRD

SEQ ID NO: 875464 - protein, 23 aa, Mycobacterium
VSSIFLMCLPDRVLAYGDCAIIP

SEQ ID NO: 875465 - protein, 22 aa, Mycobacterium
VSSIFLMCLPDRVLAYGDCAIV

SEQ ID NO: 875466 - protein, 18 aa, Mycobacterium
VSSISMFGGTLDGLAPIA

SEQ ID NO: 875467 - protein, 22 aa, Mycobacterium
VSSITQAHRWRFDGMQAIGPDV

SEQ ID NO: 875468 - protein, 18 aa, Mycobacterium
VSSKKRDDLQAVQALLRG

SEQ ID NO: 875469 - protein, 24 aa, Mycobacterium
VSSKYALVIYAAKRARQINDYYNQ

SEQ ID NO: 875470 - protein, 25 aa, Mycobacterium
VSSKYALVIYAAKRARQINDYYNQL

SEQ ID NO: 875471 - protein, 23 aa, Mycobacterium
VSSLFSRRGFNIQSLAVGATEQK

SEQ ID NO: 875472 - protein, 24 aa, Mycobacterium
VSSLIAQLRPVIGDMPLGGHFHNT

SEQ ID NO: 875473 - protein, 24 aa, Mycobacterium
VSSLPYHHPLMLADRMVLLDHLTR

SEQ ID NO: 875474 - protein, 24 aa, Mycobacterium
VSSNLARFDAMRYGLRIGDDGSHS

SEQ ID NO: 875475 - protein, 24 aa, Mycobacterium
VSSPFGLLDCDVPIDGSIAVVVSH

SEQ ID NO: 875476 - protein, 33 aa, Mycobacterium
VSSPRLYGGTYNLLHYTLPRLGISTTFVEDPDD

SEQ ID NO: 875477 - protein, 24 aa, Mycobacterium
VSSPRVLSDLFWLGRYGERAENLV

SEQ ID NO: 875478 - protein, 27 aa, Mycobacterium
VSSREAPYPHFPYYRQDGFARLNPPVG

SEQ ID NO: 875479 - protein, 18 aa, Mycobacterium
VSSREPYRRLVNQGYIQA

SEQ ID NO: 875480 - protein, 22 aa, Mycobacterium
VSSRFKAPFAFTGGTIAQVTVD

SEQ ID NO: 875481 - protein, 20 aa, Mycobacterium
VSSRYKAPFAFTGGSIARVT

SEQ ID NO: 875482 - protein, 17 aa, Mycobacterium
VSSSLPRRGVAEAVLVV

SEQ ID NO: 875483 - protein, 32 aa, Mycobacterium
VSSTDRYLCINPFFHNFGYKAGILACLQTGAT

SEQ ID NO: 875484 - protein, 25 aa, Mycobacterium
VSSTVLATGLLLDLTERDPDADKRL

SEQ ID NO: 875485 - protein, 17 aa, Mycobacterium
VSSVEQLPYVLDTAIRA

SEQ ID NO: 875486 - protein, 24 aa, Mycobacterium
VSSVLTIGLGKPRPEWPADTIRRA

SEQ ID NO: 875487 - protein, 20 aa, Mycobacterium
VSSVQVDALILSPTSADASV

SEQ ID NO: 875488 - protein, 30 aa, Mycobacterium
VSTAGIIILLCARYFRNVWQMAASWSTRPI

SEQ ID NO: 875489 - protein, 27 aa, Mycobacterium
VSTAQRRALLGRLIRALPGMVSDAVKT

SEQ ID NO: 875490 - protein, 24 aa, Mycobacterium
VSTDLTPELLLRSRDRAAAQGLTI

SEQ ID NO: 875491 - protein, 20 aa, Mycobacterium
VSTDLTPELLQRSKARAAAQ

SEQ ID NO: 875492 - protein, 18 aa, Mycobacterium
VSTELRQVLGYDGETVVT

SEQ ID NO: 875493 - protein, 20 aa, Mycobacterium
VSTGMILNPAVIARLRPDLE

SEQ ID NO: 875494 - protein, 18 aa, Mycobacterium
VSTGYQFDLLAPVFEDTA

SEQ ID NO: 875495 - protein, 30 aa, Mycobacterium
VSTIVDTWPEALRSLYRLVCGAEPLTASLQ

SEQ ID NO: 875496 - protein, 28 aa, Mycobacterium
VSTKPGIYYPPLRNLMERRLRALERRYA

SEQ ID NO: 875497 - protein, 17 aa, Mycobacterium
VSTNFLWAPDPGPMRLV

SEQ ID NO: 875498 - protein, 24 aa, Mycobacterium
VSTPFGLLDCDVPIDGSIAVVVSS

SEQ ID NO: 875499 - protein, 24 aa, Mycobacterium
VSTPLGLLDCDVPIDGSIAVVVSH

SEQ ID NO: 875500 - protein, 23 aa, Mycobacterium
VSTQAMLAFTKHAGQMLALNQAA

SEQ ID NO: 875501 - protein, 25 aa, Mycobacterium
VSTQLTMLMADHWCRAYDLSSLRVV

SEQ ID NO: 875502 - protein, 19 aa, Mycobacterium
VSTQRRYRPGRRGRIGPSP

SEQ ID NO: 875503 - protein, 24 aa, Mycobacterium
VSTSAFHFFDQPAALTEFHRVLTP

SEQ ID NO: 875504 - protein, 23 aa, Mycobacterium
VSTSFYESKLPAGSPVIRVMPNA

SEQ ID NO: 875505 - protein, 24 aa, Mycobacterium
VSTSRPSPAGLFTSGYYGQLKVPV

SEQ ID NO: 875506 - protein, 17 aa, Mycobacterium
VSTVLHAAWAQLLAWLT

SEQ ID NO: 875507 - protein, 29 aa, Mycobacterium
VSTVLQGAWAQVLMWLTGQPDVAFGTAVS

SEQ ID NO: 875508 - protein, 27 aa, Mycobacterium
VSTYAALLERIDPLGLAYLHVVIDPGA

SEQ ID NO: 875509 - protein, 26 aa, Mycobacterium
VSTYHAFAGSLLRDYGLLLPVEPDTS

SEQ ID NO: 875510 - protein, 23 aa, Mycobacterium
VSTYLPGDPIPAGYYARFAESDD

SEQ ID NO: 875511 - protein, 31 aa, Mycobacterium
VSVAADRPWRFWLPGYPEVSAYRRSPRAPQP

SEQ ID NO: 875512 - protein, 25 aa, Mycobacterium
VSVDTFAGFIFLNPDPHAAPLREYL

SEQ ID NO: 875513 - protein, 27 aa, Mycobacterium
VSVEVAVFLRLLGVPVIVVAQPGDRTD

SEQ ID NO: 875514 - protein, 18 aa, Mycobacterium
VSVFAWKGETLEEYWWAA

SEQ ID NO: 875515 - protein, 24 aa, Mycobacterium
VSVGDYHIPKMVGWTLLGRPVDDA

SEQ ID NO: 875516 - protein, 19 aa, Mycobacterium
VSVGLLYKYFGGKEDLLLA

SEQ ID NO: 875517 - protein, 26 aa, Mycobacterium
VSVHTRGLLDRLITRAYLPGCHLAKD

SEQ ID NO: 875518 - protein, 17 aa, Mycobacterium
VSVIRYTELRPFVVHVN

SEQ ID NO: 875519 - protein, 26 aa, Mycobacterium
VSVKRPYRMALAHLWAAGLPWDRDLA

SEQ ID NO: 875520 - protein, 18 aa, Mycobacterium
VSVLLMDPLGSFYDQPSG

SEQ ID NO: 875521 - protein, 33 aa, Mycobacterium
VSVLPAKYLNRLSDLLFILSRVANPRGDLMWRP

SEQ ID NO: 875522 - protein, 30 aa, Mycobacterium
VSVLVRQMGALLLQPLIDAAWDRVQSGDAP

SEQ ID NO: 875523 - protein, 18 aa, Mycobacterium
VSVNFRLSRLGFFAHPAL

SEQ ID NO: 875524 - protein, 27 aa, Mycobacterium
VSVPDFPNLFTVFGPYGYVGSSYFALI

SEQ ID NO: 875525 - protein, 26 aa, Mycobacterium
VSVPEEVAWRLGWIDDEQLMRRARSL

SEQ ID NO: 875526 - protein, 24 aa, Mycobacterium
VSVPKLELPENATPAYLGFNLFGH

SEQ ID NO: 875527 - protein, 21 aa, Mycobacterium
VSVPMKWLPDSLALAGVFPRN

SEQ ID NO: 875528 - protein, 18 aa, Mycobacterium
VSVPVRYLPNFSAVAEQV

SEQ ID NO: 875529 - protein, 37 aa, Mycobacterium
VSVQSRVLDLLADLQRELGLAYLFIAHDLAVVHRMSH

SEQ ID NO: 875530 - protein, 18 aa, Mycobacterium
VSVSALMDGRIHRVTLSA

SEQ ID NO: 875531 - protein, 24 aa, Mycobacterium
VSVSFHEPVTWGGWLLYTHESTQV

SEQ ID NO: 875532 - protein, 24 aa, Mycobacterium
VSVSVGCNNSCTFCIVPSLRGKEV

SEQ ID NO: 875533 - protein, 26 aa, Mycobacterium
VSVVDPGWVWPLNPALTELARQHRIT

SEQ ID NO: 875534 - protein, 17 aa, Mycobacterium
VSVWLSHEYVRASPGGT

SEQ ID NO: 875535 - protein, 18 aa, Mycobacterium
VSVYLDRLRTGTGDLIDF

SEQ ID NO: 875536 - protein, 29 aa, Mycobacterium
VSWVDVEGYNPFWAITKHADIMAIERDNT

SEQ ID NO: 875537 - protein, 22 aa, Mycobacterium
VSYDPALPPRLAVGLQPLACVL

SEQ ID NO: 875538 - protein, 28 aa, Mycobacterium
VSYKGLMLTGLPNFIFTFGYTNASWTLR

SEQ ID NO: 875539 - protein, 28 aa, Mycobacterium
VSYKGMMLSGVPNFAWTVGYTNASWTLK

SEQ ID NO: 875540 - protein, 18 aa, Mycobacterium
VSYRPTRCASRIGCPILV

SEQ ID NO: 875541 - protein, 17 aa, Mycobacterium
VSYRVDGRPLPLGNAAI

SEQ ID NO: 875542 - protein, 26 aa, Mycobacterium
VSYSSPGFILLGLIAESAAGMPLDQL

SEQ ID NO: 875543 - protein, 19 aa, Mycobacterium
VSYVEWAITLGHPGTVIVV

SEQ ID NO: 875544 - protein, 26 aa, Mycobacterium
VTAAESMTFPLFVKAVAGGGGRGMRR

SEQ ID NO: 875545 - protein, 23 aa, Mycobacterium
VTAALLTQLRLKAALVRSIQVSA

SEQ ID NO: 875546 - protein, 25 aa, Mycobacterium
VTAAPTMRRLLRDLLTAEHRTALIV

SEQ ID NO: 875547 - protein, 28 aa, Mycobacterium
VTADAHAALWRALLGLDLIDRVSIGTHP

SEQ ID NO: 875548 - protein, 34 aa, Mycobacterium
VTAEIQYILDFGWFPFPLPPLPSFPVPGAAGASA

SEQ ID NO: 875549 - protein, 26 aa, Mycobacterium
VTAGAAYLAITAYPSNSSGTAGATGA

SEQ ID NO: 875550 - protein, 25 aa, Mycobacterium
VTAGEPLFTLYTDTPERFGAALAEL

SEQ ID NO: 875551 - protein, 25 aa, Mycobacterium
VTAGEYGYDLAYFNRMLAAQAVDCL

SEQ ID NO: 875552 - protein, 25 aa, Mycobacterium
VTAGGIFGYLPLLTGAGADFEARTT

SEQ ID NO: 875553 - protein, 29 aa, Mycobacterium
VTAGLLTPVIPLAHLAYSGLAAVMPDGDK

SEQ ID NO: 875554 - protein, 25 aa, Mycobacterium
VTAGYLARRAGRIPKRFWAQASSPQ

SEQ ID NO: 875555 - protein, 29 aa, Mycobacterium
VTAGYLARRAGRIPKRFWAQASSPTLVTT

SEQ ID NO: 875556 - protein, 17 aa, Mycobacterium
VTAGYMCPAPRAEFYRH

SEQ ID NO: 875557 - protein, 18 aa, Mycobacterium
VTAHKFGGPAAVGALLLR

SEQ ID NO: 875558 - protein, 24 aa, Mycobacterium
VTAHKFGGPPGIGALLLRRDVACV

SEQ ID NO: 875559 - protein, 26 aa, Mycobacterium
VTAIGMSQWLVNPLSAPAGAGKTHSL

SEQ ID NO: 875560 - protein, 24 aa, Mycobacterium
VTAITAADWQQGLSASVRAGLAQA

SEQ ID NO: 875561 - protein, 17 aa, Mycobacterium
VTAIVGSDLRPGNIWQT

SEQ ID NO: 875562 - protein, 22 aa, Mycobacterium
VTALAGLMLIDRGLLKPTTPVA

SEQ ID NO: 875563 - protein, 21 aa, Mycobacterium
VTALALPVPSLVISQLLGVPY

SEQ ID NO: 875564 - protein, 17 aa, Mycobacterium
VTALLPVAQGVSVYAAL

SEQ ID NO: 875565 - protein, 17 aa, Mycobacterium
VTALLQTARLLHGRDHR

SEQ ID NO: 875566 - protein, 22 aa, Mycobacterium
VTALRRYGLVPRMLRDRTVRDM

SEQ ID NO: 875567 - protein, 22 aa, Mycobacterium
VTALWKDNYLQRFELDPLTQRQ

SEQ ID NO: 875568 - protein, 17 aa, Mycobacterium
VTAMVTRILALQTKPTP

SEQ ID NO: 875569 - protein, 19 aa, Mycobacterium
VTAMVTRILNLQAAPKPAD

SEQ ID NO: 875570 - protein, 24 aa, Mycobacterium
VTANGRFTIAAYAAPKSAGLWREV

SEQ ID NO: 875571 - protein, 23 aa, Mycobacterium
VTANLVAGAWQGASATAMAAVAT

SEQ ID NO: 875572 - protein, 19 aa, Mycobacterium
VTANPLFSRLHQDGLGEYF

SEQ ID NO: 875573 - protein, 26 aa, Mycobacterium
VTANRAELAVLILTNLFGQNSARIAE

SEQ ID NO: 875574 - protein, 23 aa, Mycobacterium
VTANRVLLMTLVATNFFGQNTPA

SEQ ID NO: 875575 - protein, 24 aa, Mycobacterium
VTAPAGFRATGIAAGIKASGALDL

SEQ ID NO: 875576 - protein, 18 aa, Mycobacterium
VTAPGPNRLWLADITEHR

SEQ ID NO: 875577 - protein, 23 aa, Mycobacterium
VTAQLARWDGGVALGFDGFARLS

SEQ ID NO: 875578 - protein, 24 aa, Mycobacterium
VTARARIPHRLLVPAPNRLEHDAG

SEQ ID NO: 875579 - protein, 18 aa, Mycobacterium
VTARDKQAWLAVFADDAV

SEQ ID NO: 875580 - protein, 23 aa, Mycobacterium
VTARHTALPLSRYGHLSGFTEAN

SEQ ID NO: 875581 - protein, 30 aa, Mycobacterium
VTASAALIWQRPRWSRRLQPEPISDLLAES

SEQ ID NO: 875582 - protein, 24 aa, Mycobacterium
VTASLDPALTLRAAPAIKAFDRPV

SEQ ID NO: 875583 - protein, 23 aa, Mycobacterium
VTASPYLGFGSLQPLLDTAQQNG

SEQ ID NO: 875584 - protein, 25 aa, Mycobacterium
VTASPYLGFGSLSPLLDLARERDRG

SEQ ID NO: 875585 - protein, 24 aa, Mycobacterium
VTASRHAHWLNPEPKHLWGSGDSA

SEQ ID NO: 875586 - protein, 24 aa, Mycobacterium
VTASRHAHWLNPEPQHLWGSGDSA

SEQ ID NO: 875587 - protein, 21 aa, Mycobacterium
VTATFFNADYIKKGLTKNTRV

SEQ ID NO: 875588 - protein, 27 aa, Mycobacterium
VTATGPRRVFTLLHAARPVLLNLGGAG

SEQ ID NO: 875589 - protein, 18 aa, Mycobacterium
VTAVAWLARKVEGFGVRL

SEQ ID NO: 875590 - protein, 19 aa, Mycobacterium
VTAVRFVAAGVGLTVVPRL

SEQ ID NO: 875591 - protein, 25 aa, Mycobacterium
VTAVTRCWMSLFSPRVITYRASRGF

SEQ ID NO: 875592 - protein, 17 aa, Mycobacterium
VTAWLLAVSDTTDVASD

SEQ ID NO: 875593 - protein, 18 aa, Mycobacterium
VTAWRRERGQPTPAPLLA

SEQ ID NO: 875594 - protein, 28 aa, Mycobacterium
VTAYHKLLVWDLMQRPKITQLAESLLNP

SEQ ID NO: 875595 - protein, 17 aa, Mycobacterium
VTAYIECAQACGLTLLG

SEQ ID NO: 875596 - protein, 18 aa, Mycobacterium
VTCDLLVVGGGYTGLWSA

SEQ ID NO: 875597 - protein, 27 aa, Mycobacterium
VTCMSSSLPTLFRRAADYQRQITLTAS

SEQ ID NO: 875598 - protein, 24 aa, Mycobacterium
VTCNGAPAVLLYLADQLEGVITLE

SEQ ID NO: 875599 - protein, 19 aa, Mycobacterium
VTCSCGAVAPFSATGNYRA

SEQ ID NO: 875600 - protein, 21 aa, Mycobacterium
VTCSFLFLCSGYYNYDQGYTP

SEQ ID NO: 875601 - protein, 21 aa, Mycobacterium
VTCTGRFYDFLGRHGDSWTIV

SEQ ID NO: 875602 - protein, 19 aa, Mycobacterium
VTCTLSMEPSYMVQSFEGT

SEQ ID NO: 875603 - protein, 32 aa, Mycobacterium
VTDAPYLGFQLGSLWYISLDYINHQTSLNGTQ

SEQ ID NO: 875604 - protein, 31 aa, Mycobacterium; identical to SEQ ID NO: 118475

SEQ ID NO: 875605 - protein, 25 aa, Mycobacterium
VTDAYVIGLLKLRLATYGKPEFTTD

SEQ ID NO: 875606 - protein, 26 aa, Mycobacterium
VTDDFPLAMAWAHLRTLRLADGPDEV

SEQ ID NO: 875607 - protein, 23 aa, Mycobacterium
VTDDLLERLLFEGCTMHAGQACI

SEQ ID NO: 875608 - protein, 18 aa, Mycobacterium
VTDGIAILTLNRPQRRNA

SEQ ID NO: 875609 - protein, 18 aa, Mycobacterium
VTDGLFQGFSSNGSQPLD

SEQ ID NO: 875610 - protein, 21 aa, Mycobacterium
VTDGVNPGWSWFVSGSAARGE

SEQ ID NO: 875611 - protein, 32 aa, Mycobacterium
VTDIDALLPVPPDPVATLILTELRSAVAGGVV

SEQ ID NO: 875612 - protein, 29 aa, Mycobacterium
VTDIGNMWLALRFDGPLQTPALIAALNDV

SEQ ID NO: 875613 - protein, 17 aa, Mycobacterium
VTDIIPFSEFSKAFDQF

SEQ ID NO: 875614 - protein, 35 aa, Mycobacterium
VTDKLIPTPVGQLPLTMPLLELGVPPDLVTALDPF

SEQ ID NO: 875615 - protein, 26 aa, Mycobacterium
VTDLARPYPVPIICALLGAPREDWQQ

SEQ ID NO: 875616 - protein, 24 aa, Mycobacterium
VTDLGAIMPMKVISALLGIPEEDQ

SEQ ID NO: 875617 - protein, 38 aa, Mycobacterium
VTDLLPAGKTPWPGGAPYAALPTGVHWDPALRADVVDT

SEQ ID NO: 875618 - protein, 17 aa, Mycobacterium
VTDLLVHIVARDTDDLY

SEQ ID NO: 875619 - protein, 23 aa, Mycobacterium
VTDLPLHPGFAASWQLLRTAPVT

SEQ ID NO: 875620 - protein, 24 aa, Mycobacterium
VTDLVTLEAFLTRRIRSHGLVTAS

SEQ ID NO: 875621 - protein, 28 aa, Mycobacterium
VTDMAHFFYIHFGLPTYFKNVFEGHIAS

SEQ ID NO: 875622 - protein, 28 aa, Mycobacterium
VTDMAHFFYIHFGLPTYFKNVFEGHVAS

SEQ ID NO: 875623 - protein, 26 aa, Mycobacterium
VTDMPDRVVWLPLNSPGSAVHRRLGV

SEQ ID NO: 875624 - protein, 30 aa, Mycobacterium
VTDPAWRRRPCWYLIATEDRMIPLAAQRVM

SEQ ID NO: 875625 - protein, 19 aa, Mycobacterium
VTDPDGITLIFVQVPSTHP

SEQ ID NO: 875626 - protein, 28 aa, Mycobacterium
VTDPEPLPVGHPLWRTPNTHITPHNSGD

SEQ ID NO: 875627 - protein, 26 aa, Mycobacterium
VTDPGHTEVLPLYARLPTAEQQKVFS

SEQ ID NO: 875628 - protein, 25 aa, Mycobacterium
VTDPGRFDVIVTDNLFGDIITDLAA

SEQ ID NO: 875629 - protein, 25 aa, Mycobacterium
VTDPGRFDVIVTDNLFGDIITDLTA

SEQ ID NO: 875630 - protein, 28 aa, Mycobacterium
VTDPIVKPLPSTWWNPGMAGSDTRSVQF

SEQ ID NO: 875631 - protein, 28 aa, Mycobacterium
VTDPKILTMFRPKQIWEWEKRAKRLNQQ

SEQ ID NO: 875632 - protein, 17 aa, Mycobacterium
VTDPLYVLAGRAEGYVP

SEQ ID NO: 875633 - protein, 23 aa, Mycobacterium
VTDPTRAYRTILYSIVLAPQYLS

SEQ ID NO: 875634 - protein, 27 aa, Mycobacterium
VTDSMPALHLLPLADALGVLPVLATDV

SEQ ID NO: 875635 - protein, 19 aa, Mycobacterium
VTDTIVLPGMVVPIALDDA

SEQ ID NO: 875636 - protein, 26 aa, Mycobacterium
VTDYRAILEFFFQIHDPTTKDRQGND

SEQ ID NO: 875637 - protein, 26 aa, Mycobacterium
VTDYRTMLEFFFQIHDPTTKDRQGND

SEQ ID NO: 875638 - protein, 39 aa, Mycobacterium
VTDYYNKAGLWPYLEKLGFFLVGYGCTTCIGNSGPLPEE

SEQ ID NO: 875639 - protein, 23 aa, Mycobacterium
VTEALLTAGYLLEDPRYREAAYA

SEQ ID NO: 875640 - protein, 20 aa, Mycobacterium
VTEDLINYHRLPAAGGVGMT

SEQ ID NO: 875641 - protein, 20 aa, Mycobacterium
VTEDLITYHRLPAAGGVGMT

SEQ ID NO: 875642 - protein, 24 aa, Mycobacterium
VTEDQWWERSPIFSGLNTNKRGIT

SEQ ID NO: 875643 - protein, 21 aa, Mycobacterium
VTEELVYPAGRRPPVTEPSRP

SEQ ID NO: 875644 - protein, 19 aa, Mycobacterium
VTEFGMLEALRRFLPDDGA

SEQ ID NO: 875645 - protein, 21 aa, Mycobacterium
VTEKMRWDAPWYRAIRRADDA

SEQ ID NO: 875646 - protein, 22 aa, Mycobacterium
VTELDRRFTLAAGLLELADREF

SEQ ID NO: 875647 - protein, 19 aa, Mycobacterium
VTELLYRYAELIDAGDFDG

SEQ ID NO: 875648 - protein, 17 aa, Mycobacterium
VTELRMTHWPLAPESRE

SEQ ID NO: 875649 - protein, 17 aa, Mycobacterium
VTELRRARTPFVHATVV

SEQ ID NO: 875650 - protein, 18 aa, Mycobacterium
VTELTMVQAINRALRDAM

SEQ ID NO: 875651 - protein, 26 aa, Mycobacterium
VTELVGLARYPLPMAPVAAAEQAGQP

SEQ ID NO: 875652 - protein, 24 aa, Mycobacterium
VTEPDYWGPARNPWNIRHTPGGSS

SEQ ID NO: 875653 - protein, 29 aa, Mycobacterium
VTEPGRLPRPVLTDLQWAIREGREGNLVI

SEQ ID NO: 875654 - protein, 29 aa, Mycobacterium
VTEPKVRRLRRLAGLWLAGQDQRWAAVRI

SEQ ID NO: 875655 - protein, 25 aa, Mycobacterium
VTEPPVEGSWAWLPDEAAGSRVHWR

SEQ ID NO: 875656 - protein, 21 aa, Mycobacterium
VTEQCILYSALDGYLRHYEVV

SEQ ID NO: 875657 - protein, 24 aa, Mycobacterium
VTEQLLACLGVRGKLGLLGVPASP

SEQ ID NO: 875658 - protein, 22 aa, Mycobacterium
VTERLLRLFGLDAQEARTICQR

SEQ ID NO: 875659 - protein, 24 aa, Mycobacterium
VTESHWLPGWLAADNLLALLSESP

SEQ ID NO: 875660 - protein, 27 aa, Mycobacterium
VTESTWDRRPRWFRKIAGMATGVGDRA

SEQ ID NO: 875661 - protein, 25 aa, Mycobacterium
VTETLTWAQLYRRTLNVAHEVKRHG

SEQ ID NO: 875662 - protein, 26 aa, Mycobacterium
VTEVAEKLWYPLWDANIRLDHSVRTV

SEQ ID NO: 875663 - protein, 24 aa, Mycobacterium
VTEVAWVPIPELPSRLAYADERRL

SEQ ID NO: 875664 - protein, 17 aa, Mycobacterium
VTEVAWVPLRELPSRLA

SEQ ID NO: 875665 - protein, 31 aa, Mycobacterium
VTEVDCPHFDYSLPAYYLILPSEVSSNLAKF

SEQ ID NO: 875666 - protein, 25 aa, Mycobacterium
VTEVLQAFYEEQYWRARLAETPVDV

SEQ ID NO: 875667 - protein, 25 aa, Mycobacterium
VTEVRMFLHHVPGFSFLPNRRPPDP

SEQ ID NO: 875668 - protein, 25 aa, Mycobacterium
VTEVRMFLHHVPGFSFLPNRRPPEP

SEQ ID NO: 875669 - protein, 29 aa, Mycobacterium
VTEYLMPPLPNTLYTRDTTCWIYGGLTLN

SEQ ID NO: 875670 - protein, 23 aa, Mycobacterium
VTFDRIVVLLTERGFIAPGDTPT

SEQ ID NO: 875671 - protein, 20 aa, Mycobacterium
VTFERLVFDGILQEVVLFCG

SEQ ID NO: 875672 - protein, 17 aa, Mycobacterium
VTFGFPFGLSIVAPVNM

SEQ ID NO: 875673 - protein, 17 aa, Mycobacterium
VTFGMRLDIPSGTAVRF

SEQ ID NO: 875674 - protein, 27 aa, Mycobacterium
VTFIGQPLWGSIGYTLPAALGAAVAHP

SEQ ID NO: 875675 - protein, 19 aa, Mycobacterium
VTFLRPLDGFPERRARLMI

SEQ ID NO: 875676 - protein, 20 aa, Mycobacterium
VTFLRPLDGFPERRARLMLE

SEQ ID NO: 875677 - protein, 22 aa, Mycobacterium
VTFQGSTYVIWGGKRSQIDPAN

SEQ ID NO: 875678 - protein, 27 aa, Mycobacterium
VTFTDTERWWLDRMVSVIASSAGIRVE

SEQ ID NO: 875679 - protein, 40 aa, Mycobacterium
VTFTEWTLALVIRVWSWLIMRAIHAERILLPQARPAGRSD

SEQ ID NO: 875680 - protein, 21 aa, Mycobacterium
VTGAHRWGKYLGLQAGELFLI

SEQ ID NO: 875681 - protein, 19 aa, Mycobacterium
VTGAPGELLLFVAGRDQVR

SEQ ID NO: 875682 - protein, 25 aa, Mycobacterium
VTGAPTRLFLLRHGQTELSVDRRYS

SEQ ID NO: 875683 - protein, 29 aa, Mycobacterium
VTGDLDAIRLEFATHFWGTLSMTRAFAPI

SEQ ID NO: 875684 - protein, 23 aa, Mycobacterium
VTGEYLVAIAGRIGRAALVESPG

SEQ ID NO: 875685 - protein, 17 aa, Mycobacterium
VTGFAVGQSIPLAFPAG

SEQ ID NO: 875686 - protein, 20 aa, Mycobacterium
VTGGHYFYWANPQALSTILT

SEQ ID NO: 875687 - protein, 23 aa, Mycobacterium
VTGGLELALYCDILIASENAKFA

SEQ ID NO: 875688 - protein, 27 aa, Mycobacterium
VTGGVPTAGLPIGGWFGAPSPFAGVGT

SEQ ID NO: 875689 - protein, 31 aa, Mycobacterium; identical to SEQ ID NO: 123181

SEQ ID NO: 875690 - protein, 28 aa, Mycobacterium
VTGHDQLFDTLFLYENYPIDAGAMMGAQ

SEQ ID NO: 875691 - protein, 31 aa, Mycobacterium
VTGHTGFKGSWLCLWLHALGAEVTGLALDPS

SEQ ID NO: 875692 - protein, 25 aa, Mycobacterium
VTGHYKDTFARVDGAWRFDTRTMFV

SEQ ID NO: 875693 - protein, 28 aa, Mycobacterium
VTGIDLVQWQILVAAGERLPLSQEQIVL

SEQ ID NO: 875694 - protein, 31 aa, Mycobacterium
VTGIDPGAVSPWWLQRRLLMCGMRVTSPAVD

SEQ ID NO: 875695 - protein, 31 aa, Mycobacterium
VTGIWSLLAPAYDLAILQQWVYRPPHDEVLA

SEQ ID NO: 875696 - protein, 17 aa, Mycobacterium
VTGLDPWASVRAAVNHH

SEQ ID NO: 875697 - protein, 23 aa, Mycobacterium
VTGLGWYSTKHSVGVWSATPPPT

SEQ ID NO: 875698 - protein, 17 aa, Mycobacterium
VTGLHLQFGRHAGTEVV

SEQ ID NO: 875699 - protein, 18 aa, Mycobacterium
VTGLLEQHFGRLVDYGFT

SEQ ID NO: 875700 - protein, 17 aa, Mycobacterium
VTGLRLMSRMAQTGSSL

SEQ ID NO: 875701 - protein, 29 aa, Mycobacterium
VTGLSLSPTLIFDYPTPNGLANYIRAELA

SEQ ID NO: 875702 - protein, 24 aa, Mycobacterium
VTGLSWTVYSFSAVPPPGHFDLGE

SEQ ID NO: 875703 - protein, 32 aa, Mycobacterium; identical to SEQ ID NO: 118480

SEQ ID NO: 875704 - protein, 24 aa, Mycobacterium
VTGQKVWTSLAHMCQWGLATVRTD

SEQ ID NO: 875705 - protein, 31 aa, Mycobacterium
VTGQTLLVDGGLNLKWSHLGADNTSLFLKDE

SEQ ID NO: 875706 - protein, 24 aa, Mycobacterium
VTGREGRWWAVEIPELNGVTQAAR

SEQ ID NO: 875707 - protein, 26 aa, Mycobacterium
VTGRFTAFGTVYFVGAGFTGGHHEGP

SEQ ID NO: 875708 - protein, 24 aa, Mycobacterium
VTGRPHTMLLLTLLSEVGPDDAPT

SEQ ID NO: 875709 - protein, 23 aa, Mycobacterium
VTGRRYLDCLAAYSAVNFGHRNP

SEQ ID NO: 875710 - protein, 17 aa, Mycobacterium
VTGRYVKASTAARNPRT

SEQ ID NO: 875711 - protein, 29 aa, Mycobacterium
VTGSEHLVSWLKAVIFGAAERWTDVIDEV

SEQ ID NO: 875712 - protein, 23 aa, Mycobacterium
VTGSIDFLEIWDAQAWQEYQELH

SEQ ID NO: 875713 - protein, 33 aa, Mycobacterium
VTGSVIFLVDYLMNFFQYHLPGVQAYHLDVTPD

SEQ ID NO: 875714 - protein, 25 aa, Mycobacterium
VTGTDVFLLMCTPIHVVENLPDPSP

SEQ ID NO: 875715 - protein, 20 aa, Mycobacterium
VTGTVTIYTLPRLHAFNIVM

SEQ ID NO: 875716 - protein, 17 aa, Mycobacterium
VTGVDPLDRSAIAARFG

SEQ ID NO: 875717 - protein, 36 aa, Mycobacterium
VTGVTLGWRWDAAVEAILLFTQLMHTAPSELDLQLS

SEQ ID NO: 875718 - protein, 24 aa, Mycobacterium
VTGWAAYVAGVIWALRQADYPVPG

SEQ ID NO: 875719 - protein, 17 aa, Mycobacterium
VTGWARLHGYPLGILAN

SEQ ID NO: 875720 - protein, 18 aa, Mycobacterium
VTGWFMIGWSAEFEVGDV

SEQ ID NO: 875721 - protein, 21 aa, Mycobacterium
VTGWFMVGWSPEFPIGEVRPL

SEQ ID NO: 875722 - protein, 28 aa, Mycobacterium
VTGYLVLDQPWPAMLRGIWGDPQRFKDT

SEQ ID NO: 875723 - protein, 30 aa, Mycobacterium
VTGYLVLDQPWPSMLRGIWGDPARFHYAYW

SEQ ID NO: 875724 - protein, 27 aa, Mycobacterium
VTGYLVLDQPWPSMLRGIWGDPARYHY

SEQ ID NO: 875725 - protein, 26 aa, Mycobacterium
VTGYLVLDQPWPSMLRGIWGDPERYV

SEQ ID NO: 875726 - protein, 18 aa, Mycobacterium
VTGYWNIFKQNIGIMIAV

SEQ ID NO: 875727 - protein, 27 aa, Mycobacterium
VTHAQFVPTMFVRMLKLPKAVRERYDV

SEQ ID NO: 875728 - protein, 17 aa, Mycobacterium
VTHAQFVPTMFVRMLRM

SEQ ID NO: 875729 - protein, 25 aa, Mycobacterium
VTHMADWICFLLSDSADFLCGSVVF

SEQ ID NO: 875730 - protein, 21 aa, Mycobacterium
VTHYVPFADWADGTVLLGDRR

SEQ ID NO: 875731 - protein, 18 aa, Mycobacterium
VTIAAPVFDGRRVALMLA

SEQ ID NO: 875732 - protein, 22 aa, Mycobacterium
VTIEEQCFIGVNATLRDHITVG

SEQ ID NO: 875733 - protein, 20 aa, Mycobacterium
VTIKPGPYPWRNHHNAWRPA

SEQ ID NO: 875734 - protein, 18 aa, Mycobacterium
VTILLSSHILAETEALCE

SEQ ID NO: 875735 - protein, 17 aa, Mycobacterium
VTILPLHQPIDLAKALA

SEQ ID NO: 875736 - protein, 21 aa, Mycobacterium
VTILYDEPRVVLLPSDHPLAQ

SEQ ID NO: 875737 - protein, 26 aa, Mycobacterium
VTIMATPAPFIEFARQRGLAADGRCK

SEQ ID NO: 875738 - protein, 21 aa, Mycobacterium
VTINYRLGVLGFLDLSSLGSA

SEQ ID NO: 875739 - protein, 22 aa, Mycobacterium
VTIPLAVRRKLGIEPGSEVEFE

SEQ ID NO: 875740 - protein, 17 aa, Mycobacterium
VTIQSRELLDHAAADLG

SEQ ID NO: 875741 - protein, 25 aa, Mycobacterium
VTIQVLTQCRPELIERTFLACEGAS

SEQ ID NO: 875742 - protein, 38 aa, Mycobacterium
VTIQVLTQCRPELIERTFLACQGAPRAIVHFYNSTSIL

SEQ ID NO: 875743 - protein, 24 aa, Mycobacterium
VTIRPGEIPVFWACGVTPQAAVMQ

SEQ ID NO: 875744 - protein, 17 aa, Mycobacterium
VTISSAAKMFNCTGWKI

SEQ ID NO: 875745 - protein, 20 aa, Mycobacterium
VTIVGLPDIPGYAAKVFRAI

SEQ ID NO: 875746 - protein, 26 aa, Mycobacterium
VTIVNLIRTLLRNPAVWEKTALIIAY

SEQ ID NO: 875747 - protein, 23 aa, Mycobacterium
VTKDVNFVLRWASLPMGSEAIAL

SEQ ID NO: 875748 - protein, 18 aa, Mycobacterium
VTKEDLFLAVSDRYWRRY

SEQ ID NO: 875749 - protein, 17 aa, Mycobacterium
VTKLARTYKPFGPVLSD

SEQ ID NO: 875750 - protein, 18 aa, Mycobacterium
VTKLARTYKPFGPVLSDA

SEQ ID NO: 875751 - protein, 17 aa, Mycobacterium
VTKLARTYKPYGPVLSD

SEQ ID NO: 875752 - protein, 24 aa, Mycobacterium
VTKLENTIRWSWELGDIAVWDNRA

SEQ ID NO: 875753 - protein, 23 aa, Mycobacterium
VTKLLAAHLGVPPSRVELASGAT

SEQ ID NO: 875754 - protein, 17 aa, Mycobacterium
VTKNSIWEIRDSGSILP

SEQ ID NO: 875755 - protein, 23 aa, Mycobacterium
VTKRVGVQGIWYAGSHGFELTAP

SEQ ID NO: 875756 - protein, 28 aa, Mycobacterium
VTKVERQGWHALLTLRLNGDVNLPANCT

SEQ ID NO: 875757 - protein, 20 aa, Mycobacterium
VTKWDPPHEVALSGSGKGGA

SEQ ID NO: 875758 - protein, 19 aa, Mycobacterium
VTKWLKDNAALTALAPAVS

SEQ ID NO: 875759 - protein, 26 aa, Mycobacterium
VTLADLLDFFKNPVKGFFRALDVTLP

SEQ ID NO: 875760 - protein, 17 aa, Mycobacterium
VTLAPLLTKKMDKAAAE

SEQ ID NO: 875761 - protein, 26 aa, Mycobacterium
VTLDDALRLLSLPRVVGVDPANGEEI

SEQ ID NO: 875762 - protein, 23 aa, Mycobacterium
VTLDPLARPAFTLHAGGEQVPVT

SEQ ID NO: 875763 - protein, 24 aa, Mycobacterium
VTLEDALKLLSLPRVVGVDPDSGE

SEQ ID NO: 875764 - protein, 29 aa, Mycobacterium
VTLGIALARLGMFAPALSYLERPEGPVTV

SEQ ID NO: 875765 - protein, 25 aa, Mycobacterium
VTLGVPTVLYPLGAFDPDGLLDVLE

SEQ ID NO: 875766 - protein, 28 aa, Mycobacterium
VTLISPVDYLLYTPLLPEVAGGATDPRF

SEQ ID NO: 875767 - protein, 20 aa, Mycobacterium
VTLLDALREHLQVTAPKKGC

SEQ ID NO: 875768 - protein, 17 aa, Mycobacterium
VTLLWDVLAAKGFEKDT

SEQ ID NO: 875769 - protein, 19 aa, Mycobacterium
VTLMHEHVFIMTTEIALNY

SEQ ID NO: 875770 - protein, 29 aa, Mycobacterium
VTLNLTGPYRLTVGLRRALKASTASGGAS

SEQ ID NO: 875771 - protein, 21 aa, Mycobacterium
VTLPREWGNWATRAAMPSLRI

SEQ ID NO: 875772 - protein, 20 aa, Mycobacterium
VTLPTPIYAGIAMPRTSAAA

SEQ ID NO: 875773 - protein, 25 aa, Mycobacterium
VTLQRAMATGYFRPYTNPDVIGAEV

SEQ ID NO: 875774 - protein, 19 aa, Mycobacterium
VTLRLLELLDQSHSPAFVL

SEQ ID NO: 875775 - protein, 28 aa, Mycobacterium
VTLRRLGEIALRIKYLEVLCQRSISATL

SEQ ID NO: 875776 - protein, 20 aa, Mycobacterium
VTLRVLRGRLLRRPTDKTKP

SEQ ID NO: 875777 - protein, 17 aa, Mycobacterium
VTLTNYLPFAVNAWTVR

SEQ ID NO: 875778 - protein, 30 aa, Mycobacterium
VTLTSVMRATRAALRYFRDAPHGGVIVNNA

SEQ ID NO: 875779 - protein, 29 aa, Mycobacterium
VTLTSVMRATRAALRYFRGVDHGGVIVNN

SEQ ID NO: 875780 - protein, 22 aa, Mycobacterium
VTLVAALTRRFAPPTLTNTEGD

SEQ ID NO: 875781 - protein, 20 aa, Mycobacterium
VTLVGFSMGGGEVAAYCARK

SEQ ID NO: 875782 - protein, 23 aa, Mycobacterium
VTMATRALSPMRRLGGGLVEIPR

SEQ ID NO: 875783 - protein, 28 aa, Mycobacterium
VTMFQRTPQWILPWPNRQYSKVSRACYR

SEQ ID NO: 875784 - protein, 18 aa, Mycobacterium
VTMLAGVRHGLTLGGPIA

SEQ ID NO: 875785 - protein, 18 aa, Mycobacterium
VTMLIVTHDLPYAAQLCT

SEQ ID NO: 875786 - protein, 20 aa, Mycobacterium
VTMLPGPPTLYHSLLTVPDK

SEQ ID NO: 875787 - protein, 31 aa, Mycobacterium
VTMMPEALTKPRWLWQWGKTMRPPNLRVPNQ

SEQ ID NO: 875788 - protein, 17 aa, Mycobacterium
VTMPWRDSVRAIVQAWY

SEQ ID NO: 875789 - protein, 22 aa, Mycobacterium
VTMTLVLGYHHPLAIVKRYGTL

SEQ ID NO: 875790 - protein, 18 aa, Mycobacterium
VTMYLRKQGPGAVTAGDI

SEQ ID NO: 875791 - protein, 20 aa, Mycobacterium
VTNAEWLAFMADGGYRRQEL

SEQ ID NO: 875792 - protein, 17 aa, Mycobacterium
VTNAFGASVSLIDGNTH

SEQ ID NO: 875793 - protein, 30 aa, Mycobacterium
VTNDPLLQARLFSYLDTQLTRLGGPNFNQL

SEQ ID NO: 875794 - protein, 26 aa, Mycobacterium
VTNGLNVLPPNKFPYIPPGAEPDPGT

SEQ ID NO: 875795 - protein, 22 aa, Mycobacterium
VTNLMYSLATGEPFLRRFRVKF

SEQ ID NO: 875796 - protein, 17 aa, Mycobacterium
VTNLPLHPGFAASWARL

SEQ ID NO: 875797 - protein, 23 aa, Mycobacterium
VTNQRGVLCCPVELTLQVPESGR

SEQ ID NO: 875798 - protein, 24 aa, Mycobacterium
VTNRVGVPGIWYAGSHGFELTAPD

SEQ ID NO: 875799 - protein, 23 aa, Mycobacterium
VTNTARGLRLFRDGWRICGVVPT

SEQ ID NO: 875800 - protein, 27 aa, Mycobacterium
VTNYFAPPTVWISLLRSPVFDQVDLTS

SEQ ID NO: 875801 - protein, 32 aa, Mycobacterium
VTPADVGCSWLPLYHDMGLSFLLASSLGGMSV

SEQ ID NO: 875802 - protein, 26 aa, Mycobacterium
VTPAKLFEQWFPASKLVRLGLCLSSI

SEQ ID NO: 875803 - protein, 24 aa, Mycobacterium
VTPALTVTFGGFKPVHAFGDCGRL

SEQ ID NO: 875804 - protein, 24 aa, Mycobacterium
VTPCCVVPLGWPRGRYGPTTRRPV

SEQ ID NO: 875805 - protein, 17 aa, Mycobacterium
VTPDPFAEPGWFRTDDI

SEQ ID NO: 875806 - protein, 21 aa, Mycobacterium
VTPEHPFPVWTERGGPATIVP

SEQ ID NO: 875807 - protein, 17 aa, Mycobacterium
VTPFDPNAGWFSYFSTW

SEQ ID NO: 875808 - protein, 36 aa, Mycobacterium
VTPGAWHLARMLESLDCWPVNFALLGKGNTVSHEGL

SEQ ID NO: 875809 - protein, 38 aa, Mycobacterium
VTPGAWHLARMLESLDSWPMNIVLLGKGNTVSADSMWE

SEQ ID NO: 875810 - protein, 35 aa, Mycobacterium
VTPGGWHLARMLEALDSWPVNIALLGKGNTVNPDA

SEQ ID NO: 875811 - protein, 18 aa, Mycobacterium
VTPIKMLLREALDAGPGI

SEQ ID NO: 875812 - protein, 17 aa, Mycobacterium
VTPLPFNIRSTVRDTDL

SEQ ID NO: 875813 - protein, 23 aa, Mycobacterium
VTPLQQRVLLAWLGDRDDLTVVG

SEQ ID NO: 875814 - protein, 20 aa, Mycobacterium
VTPMGPFHQWPTGSGFEYFY

SEQ ID NO: 875815 - protein, 26 aa, Mycobacterium
VTPMNSAIYFLLGLYALLVTTDESTG

SEQ ID NO: 875816 - protein, 20 aa, Mycobacterium
VTPNWHCRLPGYPYAGPDPD

SEQ ID NO: 875817 - protein, 25 aa, Mycobacterium
VTPSLVQYYFPTLDDIFLAAIRRYS

SEQ ID NO: 875818 - protein, 25 aa, Mycobacterium
VTPSLVQYYFPTLDDIFLSAIRRYS

SEQ ID NO: 875819 - protein, 23 aa, Mycobacterium
VTPSLVQYYFPTLDDVFIAAIRR

SEQ ID NO: 875820 - protein, 18 aa, Mycobacterium
VTPSPNLRPLAKGPFYAV

SEQ ID NO: 875821 - protein, 19 aa, Mycobacterium
VTPTLPTTAPRWVVDPDFN

SEQ ID NO: 875822 - protein, 18 aa, Mycobacterium
VTPTRLRSALDEGQIVLV

SEQ ID NO: 875823 - protein, 19 aa, Mycobacterium
VTPVAKACTLPPPGWVCSR

SEQ ID NO: 875824 - protein, 23 aa, Mycobacterium
VTQLGTMYPGNFGLGPVAVLGEH

SEQ ID NO: 875825 - protein, 20 aa, Mycobacterium
VTQPLVVAATLLAYEELNKR

SEQ ID NO: 875826 - protein, 17 aa, Mycobacterium
VTQQRIAVTYATLGRWA

SEQ ID NO: 875827 - protein, 26 aa, Mycobacterium
VTQSYRLLKHGGVDRVLFLVDRNNLA

SEQ ID NO: 875828 - protein, 19 aa, Mycobacterium
VTQWPYTELEYARRTWRIK

SEQ ID NO: 875829 - protein, 32 aa, Mycobacterium
VTRAFDVAQARPWPARFPSRVLTNDFVERWTG

SEQ ID NO: 875830 - protein, 18 aa, Mycobacterium
VTRAFLPAMVARRAGAVV

SEQ ID NO: 875831 - protein, 22 aa, Mycobacterium
VTRAIAAWLWSGRSATAVGLSA

SEQ ID NO: 875832 - protein, 19 aa, Mycobacterium
VTRALLPKLIASGDGLIVT

SEQ ID NO: 875833 - protein, 23 aa, Mycobacterium
VTRALLPKLIDSGDGLIVTITSI

SEQ ID NO: 875834 - protein, 25 aa, Mycobacterium
VTRARFYIFVNQIANFVPFAVSSGV

SEQ ID NO: 875835 - protein, 24 aa, Mycobacterium
VTRARFYILVNQIANFVPFAVSSG

SEQ ID NO: 875836 - protein, 26 aa, Mycobacterium
VTRARVHLALSWALARTPGGRQGRRP

SEQ ID NO: 875837 - protein, 25 aa, Mycobacterium
VTRARVHLALTWALARSPGGRQGRK

SEQ ID NO: 875838 - protein, 28 aa, Mycobacterium
VTRARVHLTLSWALARKPGGRQGRRPSR

SEQ ID NO: 875839 - protein, 23 aa, Mycobacterium
VTRCATPLKWVRLDSAPFTDRLV

SEQ ID NO: 875840 - protein, 37 aa, Mycobacterium
VTRDRNGLPVPLKPYFEADWRFHQTILDHCGNGFLRR

SEQ ID NO: 875841 - protein, 24 aa, Mycobacterium
VTREKLLPYYGFGCKRPSFSNTYL

SEQ ID NO: 875842 - protein, 21 aa, Mycobacterium
VTRFGNTWLEPLWNSSRIDHV

SEQ ID NO: 875843 - protein, 23 aa, Mycobacterium
VTRGSFYWHFDDMDSYRAALVES

SEQ ID NO: 875844 - protein, 23 aa, Mycobacterium
VTRHTSLLASTWATLAEFTGGRV

SEQ ID NO: 875845 - protein, 20 aa, Mycobacterium
VTRIILTRPAVEAGERLGFL

SEQ ID NO: 875846 - protein, 17 aa, Mycobacterium
VTRIPAEARARLLYERS

SEQ ID NO: 875847 - protein, 18 aa, Mycobacterium
VTRIPTEAPARLLFERSL

SEQ ID NO: 875848 - protein, 39 aa, Mycobacterium
VTRKPLGVVGVITPFNFPIAIPAWKIAPALVYGNTVVWK

SEQ ID NO: 875849 - protein, 25 aa, Mycobacterium
VTRLAIRRLIVVCTPPQAGLAQAVT

SEQ ID NO: 875850 - protein, 21 aa, Mycobacterium
VTRLAVFDVPIPGASLWDGIL

SEQ ID NO: 875851 - protein, 17 aa, Mycobacterium
VTRLFERVAGHERFRFY

SEQ ID NO: 875852 - protein, 26 aa, Mycobacterium
VTRLFLADPEFAEHGGLFFAAASASS

SEQ ID NO: 875853 - protein, 23 aa, Mycobacterium
VTRLPAPPLPTTRLLPRPLPNRE

SEQ ID NO: 875854 - protein, 23 aa, Mycobacterium
VTRLSRLWFEALAGICAHVRSGG

SEQ ID NO: 875855 - protein, 21 aa, Mycobacterium
VTRLSYVMSLMPPTIVRDLAL

SEQ ID NO: 875856 - protein, 19 aa, Mycobacterium
VTRMDYLSPFFNETAYCLG

SEQ ID NO: 875857 - protein, 26 aa, Mycobacterium
VTRPIEVTRLARILRPYPSVGEAVAA

SEQ ID NO: 875858 - protein, 33 aa, Mycobacterium
VTRPMWDSMLQPLRRRGAVRTGAWEQLIETPIG

SEQ ID NO: 875859 - protein, 19 aa, Mycobacterium
VTRPNPALLMQGMWVRFRA

SEQ ID NO: 875860 - protein, 19 aa, Mycobacterium
VTRPRRLVALGGSAGGLLM

SEQ ID NO: 875861 - protein, 17 aa, Mycobacterium
VTRPRTPCRTFAAFLEI

SEQ ID NO: 875862 - protein, 26 aa, Mycobacterium
VTRQTVYRYFPNADALLIASAMRAVD

SEQ ID NO: 875863 - protein, 26 aa, Mycobacterium
VTRQTVYRYFPNADALLIASAMRSVN

SEQ ID NO: 875864 - protein, 25 aa, Mycobacterium
VTRQTVYRYFPNADALLIASAMRTA

SEQ ID NO: 875865 - protein, 24 aa, Mycobacterium
VTRQTVYRYFPSTDALLVAAAVHA

SEQ ID NO: 875866 - protein, 26 aa, Mycobacterium
VTRRAKLACVLLPGIGTIEDLKRARD

SEQ ID NO: 875867 - protein, 19 aa, Mycobacterium
VTRRIHAAPQDVFRVLADP

SEQ ID NO: 875868 - protein, 29 aa, Mycobacterium
VTRSAAPPRILWLQSAIPGQLLLEVRAMD

SEQ ID NO: 875869 - protein, 28 aa, Mycobacterium
VTRSDGLPVWIYQFKISPHPTIESASTQ

SEQ ID NO: 875870 - protein, 23 aa, Mycobacterium
VTRSTRRILLPDRNEIGRNISDE

SEQ ID NO: 875871 - protein, 23 aa, Mycobacterium
VTRSYFIPPPMIGILDHATFANI

SEQ ID NO: 875872 - protein, 20 aa, Mycobacterium
VTRSYHLYAIPRGVNRWAVS

SEQ ID NO: 875873 - protein, 21 aa, Mycobacterium
VTRTLFVTRSLPAIEHFLDLL

SEQ ID NO: 875874 - protein, 17 aa, Mycobacterium
VTRTVRMFGIQKAFMEV

SEQ ID NO: 875875 - protein, 31 aa, Mycobacterium
VTRVFDVAKGLPWPARFPSRVLANEFVEHWT

SEQ ID NO: 875876 - protein, 28 aa, Mycobacterium
VTRVQFGPRWLVPPLVAVFSPEGIRDVL

SEQ ID NO: 875877 - protein, 19 aa, Mycobacterium
VTRVVKVVGFVASAPGFNG

SEQ ID NO: 875878 - protein, 20 aa, Mycobacterium
VTRVVKVVGFVASAPGFNGQ

SEQ ID NO: 875879 - protein, 18 aa, Mycobacterium
VTRWARRTAVLPEWAGAG

SEQ ID NO: 875880 - protein, 24 aa, Mycobacterium
VTSAGPHYPLPLTGPGTTGLGKAL

SEQ ID NO: 875881 - protein, 19 aa, Mycobacterium
VTSALFEVLSKHGVELLNV

SEQ ID NO: 875882 - protein, 19 aa, Mycobacterium
VTSALFEVLSRYGVTLLNV

SEQ ID NO: 875883 - protein, 19 aa, Mycobacterium
VTSIPVLLSAKGVEPIFSS

SEQ ID NO: 875884 - protein, 28 aa, Mycobacterium
VTSLGLVQLTRKRLGTGLIEAFSTTCTH

SEQ ID NO: 875885 - protein, 41 aa, Mycobacterium
VTSLYYDTPDLRFYWEKIEGLRFRRKLRMRLYGAPSACTDD

SEQ ID NO: 875886 - protein, 22 aa, Mycobacterium
VTSPSWRRGLATLGKTLKHRRA

SEQ ID NO: 875887 - protein, 22 aa, Mycobacterium
VTSRFMTRWQGDPDPKHVEAID

SEQ ID NO: 875888 - protein, 24 aa, Mycobacterium
VTSSLTGAWLGPAAMSMARAAAPY

SEQ ID NO: 875889 - protein, 18 aa, Mycobacterium
VTSSTTLAPMPLAAAYTA

SEQ ID NO: 875890 - protein, 30 aa, Mycobacterium
VTSTLRFNIFVLKLPIRPPALVAKQASSIA

SEQ ID NO: 875891 - protein, 17 aa, Mycobacterium
VTSWLHRIVVNACLDRL

SEQ ID NO: 875892 - protein, 22 aa, Mycobacterium
VTSWPQWAHPDAIAAFAAQGVT

SEQ ID NO: 875893 - protein, 23 aa, Mycobacterium
VTTAEAMLLHRNTIQYRVAQAME

SEQ ID NO: 875894 - protein, 25 aa, Mycobacterium
VTTAKLTTLLLPGIGTVAELKRAYS

SEQ ID NO: 875895 - protein, 17 aa, Mycobacterium
VTTALLQPTWWEGDGPP

SEQ ID NO: 875896 - protein, 17 aa, Mycobacterium
VTTAVLLAASGLRVRVV

SEQ ID NO: 875897 - protein, 26 aa, Mycobacterium
VTTDPAVAGSWFWVDDQNAHWRPEHY

SEQ ID NO: 875898 - protein, 27 aa, Mycobacterium
VTTDSYVVQPLFFPGGDIGHLAVNGTI

SEQ ID NO: 875899 - protein, 21 aa, Mycobacterium
VTTEWLNRLLRSTSALFSTDD

SEQ ID NO: 875900 - protein, 22 aa, Mycobacterium
VTTFYMAKQMGFMVIDMGRQFI

SEQ ID NO: 875901 - protein, 25 aa, Mycobacterium
VTTHQHQDHWLALQAVTEATGAPTA

SEQ ID NO: 875902 - protein, 27 aa, Mycobacterium
VTTIMQPGMTFTIEPMINLGGLDYEIW

SEQ ID NO: 875903 - protein, 19 aa, Mycobacterium
VTTKFFGMKANHYLHKHNI

SEQ ID NO: 875904 - protein, 30 aa, Mycobacterium
VTTKLHFNHFVLKLPIRPPALVAKQAGSLA

SEQ ID NO: 875905 - protein, 29 aa, Mycobacterium
VTTKLKLSMFVLNAAFYKPALLSRDLGDL

SEQ ID NO: 875906 - protein, 22 aa, Mycobacterium
VTTLALSFDHRLVDGEQGSKFL

SEQ ID NO: 875907 - protein, 25 aa, Mycobacterium
VTTLDGAPLWTQRRSIYARGEGGFG

SEQ ID NO: 875908 - protein, 26 aa, Mycobacterium
VTTLDRTVPLIEDRLKLAGLDARCAS

SEQ ID NO: 875909 - protein, 24 aa, Mycobacterium
VTTLPAGMPAVAWAGPGGYGTGPR

SEQ ID NO: 875910 - protein, 24 aa, Mycobacterium
VTTLPLGVPTPRILRVLRGFDPDV

SEQ ID NO: 875911 - protein, 28 aa, Mycobacterium
VTTLPLYSTQLFFDQLLQGNLIDAFGYP

SEQ ID NO: 875912 - protein, 17 aa, Mycobacterium
VTTLPRPGETVLASALN

SEQ ID NO: 875913 - protein, 19 aa, Mycobacterium
VTTLVEVFRRVDALGLELA

SEQ ID NO: 875914 - protein, 29 aa, Mycobacterium
VTTMTAEPRRTRLAAIATVAAAATDTADR

SEQ ID NO: 875915 - protein, 26 aa, Mycobacterium
VTTNHTVWFHRPIRFDEWVLYSTTSP

SEQ ID NO: 875916 - protein, 36 aa, Mycobacterium
VTTNPPVEGAFYWLSNREVRWRPAEYWEPGTKVEVS

SEQ ID NO: 875917 - protein, 25 aa, Mycobacterium
VTTPGSALLFPNLCAPTGELPEHTQ

SEQ ID NO: 875918 - protein, 25 aa, Mycobacterium
VTTPGSALLFPSLCAATGAIAAPEA

SEQ ID NO: 875919 - protein, 18 aa, Mycobacterium
VTTPQMFIHQLTLQARSD

SEQ ID NO: 875920 - protein, 24 aa, Mycobacterium
VTTSAFHFFDQPAALAEFYRVLVP

SEQ ID NO: 875921 - protein, 22 aa, Mycobacterium
VTTSRYEWMFFDAAYRREAWPV

SEQ ID NO: 875922 - protein, 24 aa, Mycobacterium
VTTSYFESKLPAGTPVVRAMPNAA

SEQ ID NO: 875923 - protein, 19 aa, Mycobacterium
VTTTLVRLRDRGIFAFSGA

SEQ ID NO: 875924 - protein, 17 aa, Mycobacterium
VTTTVLVPYLDPAAELS

SEQ ID NO: 875925 - protein, 17 aa, Mycobacterium
VTTVAATRWPAVRFAVR

SEQ ID NO: 875926 - protein, 18 aa, Mycobacterium
VTTVAATRWPAVRFAVRN

SEQ ID NO: 875927 - protein, 24 aa, Mycobacterium
VTTVGPYMRYGLPLVAACAAAGTD

SEQ ID NO: 875928 - protein, 23 aa, Mycobacterium
VTTVGPYTRYGLPLVAACAAAGT

SEQ ID NO: 875929 - protein, 18 aa, Mycobacterium
VTTWDPPHQVALSGSGKG

SEQ ID NO: 875930 - protein, 25 aa, Mycobacterium
VTVADMPNLFFLLGPNTGLGHNSVV

SEQ ID NO: 875931 - protein, 26 aa, Mycobacterium
VTVANYEYLTYWRFYQDGNIECEVRA

SEQ ID NO: 875932 - protein, 24 aa, Mycobacterium
VTVARVAMKWGFGHLGRFSAEYRR

SEQ ID NO: 875933 - protein, 17 aa, Mycobacterium
VTVDDLLDHLLPHDWRV

SEQ ID NO: 875934 - protein, 20 aa, Mycobacterium
VTVDEKQLFFFSAATYNGHR

SEQ ID NO: 875935 - protein, 19 aa, Mycobacterium
VTVDETQMFFFSAATYNGH

SEQ ID NO: 875936 - protein, 21 aa, Mycobacterium
VTVGIPMRCVFALTAMGFLPQ

SEQ ID NO: 875937 - protein, 25 aa, Mycobacterium
VTVGTNPWLFPGGRSGGHLSANQVG

SEQ ID NO: 875938 - protein, 17 aa, Mycobacterium
VTVLEPGGMRTDWAGSS

SEQ ID NO: 875939 - protein, 18 aa, Mycobacterium
VTVLGLGPIGDMAARIAH

SEQ ID NO: 875940 - protein, 17 aa, Mycobacterium
VTVLHMVPSLLGSVLLL

SEQ ID NO: 875941 - protein, 18 aa, Mycobacterium
VTVLLPPADSRLLTRELF

SEQ ID NO: 875942 - protein, 22 aa, Mycobacterium
VTVLQALLDRHAMLRLRVDRHS

SEQ ID NO: 875943 - protein, 18 aa, Mycobacterium
VTVNFRFAPDRDVDQAVA

SEQ ID NO: 875944 - protein, 17 aa, Mycobacterium
VTVNFRFAPDRTIEQAH

SEQ ID NO: 875945 - protein, 17 aa, Mycobacterium
VTVNSLVQVAWALVLGA

SEQ ID NO: 875946 - protein, 19 aa, Mycobacterium
VTVNYRFAPDRSVAAALQH

SEQ ID NO: 875947 - protein, 24 aa, Mycobacterium
VTVPAIYSLLLRHKGFAGTDVSGI

SEQ ID NO: 875948 - protein, 20 aa, Mycobacterium
VTVPANFTSGLLLGSSAQVF

SEQ ID NO: 875949 - protein, 23 aa, Mycobacterium
VTVPELLVVRRAPGVWHLVSTVA

SEQ ID NO: 875950 - protein, 23 aa, Mycobacterium
VTVPELLVVRRAPGVWHLVSTVS

SEQ ID NO: 875951 - protein, 29 aa, Mycobacterium
VTVPGWPNAYMLIGPWAYSPGSYLVLLES

SEQ ID NO: 875952 - protein, 21 aa, Mycobacterium
VTVPIPSIPVLNLGVTIDNEI

SEQ ID NO: 875953 - protein, 36 aa, Mycobacterium
VTVPSLDARLIPRLGLRPDIRRVPILGLGCVAGAAG

SEQ ID NO: 875954 - protein, 18 aa, Mycobacterium
VTVPVRYLRDFSAVAEVV

SEQ ID NO: 875955 - protein, 23 aa, Mycobacterium
VTVPVSFHELALGTTLSVPTLDG

SEQ ID NO: 875956 - protein, 22 aa, Mycobacterium
VTVPVSFTELALGSTLSVPTLD

SEQ ID NO: 875957 - protein, 23 aa, Mycobacterium
VTVPVSFTELALGSTLSVPTLDG

SEQ ID NO: 875958 - protein, 24 aa, Mycobacterium
VTVPWTALARIPDGLSFVEAAPMG

SEQ ID NO: 875959 - protein, 21 aa, Mycobacterium
VTVQGALGDLLPITTIPGQIS

SEQ ID NO: 875960 - protein, 18 aa, Mycobacterium
VTVRAAEPVNFLPGQYVS

SEQ ID NO: 875961 - protein, 26 aa, Mycobacterium
VTVRARFAVLAIPPNLYSTIDYQPPL

SEQ ID NO: 875962 - protein, 27 aa, Mycobacterium
VTVRELSRAYPYCPLALALTDGTELEV

SEQ ID NO: 875963 - protein, 24 aa, Mycobacterium
VTVSKLEPLFGDSPLVRQIYIYGN

SEQ ID NO: 875964 - protein, 18 aa, Mycobacterium
VTVSSLLHNIGYLSLSDL

SEQ ID NO: 875965 - protein, 26 aa, Mycobacterium
VTVSSMMHWIGRINLRDLNWKARPYS

SEQ ID NO: 875966 - protein, 29 aa, Mycobacterium
VTVTQLVSVSGLVAIPWAQGDRSGVAFRA

SEQ ID NO: 875967 - protein, 30 aa, Mycobacterium
VTVTSVFVVFEPNLLWGLWEEGVAVRGAAA

SEQ ID NO: 875968 - protein, 18 aa, Mycobacterium
VTVVDLLARLQRGPLSGV

SEQ ID NO: 875969 - protein, 26 aa, Mycobacterium
VTVVDPRWVLPVPEALADLARDHKLV

SEQ ID NO: 875970 - protein, 20 aa, Mycobacterium
VTVVFAHGFCLRMGAFHFQR

SEQ ID NO: 875971 - protein, 17 aa, Mycobacterium
VTVVRLSEYPYLVPLID

SEQ ID NO: 875972 - protein, 23 aa, Mycobacterium
VTVWGQAWEGAFAGFFNSISGAS

SEQ ID NO: 875973 - protein, 17 aa, Mycobacterium
VTWLPRWVSAHLNGQLR

SEQ ID NO: 875974 - protein, 17 aa, Mycobacterium
VTWNPSGMYFWLDYADG

SEQ ID NO: 875975 - protein, 19 aa, Mycobacterium
VTWRWTVYPRNAVAGLAMP

SEQ ID NO: 875976 - protein, 17 aa, Mycobacterium
VTWVLDPIDGTVNFVYG

SEQ ID NO: 875977 - protein, 28 aa, Mycobacterium
VTYAELLAAIRFVAPYSGYPAAADALAR

SEQ ID NO: 875978 - protein, 26 aa, Mycobacterium
VTYDSDYNPGPPYGTSGQSGATGATG

SEQ ID NO: 875979 - protein, 22 aa, Mycobacterium
VTYEELILSRELPESIIIAGCG

SEQ ID NO: 875980 - protein, 31 aa, Mycobacterium; identical to SEQ ID NO: 118496

SEQ ID NO: 875981 - protein, 40 aa, Mycobacterium
VTYHRDLFSEHLLLHPMSAPMALRWLTDRFAARPLTANLV

SEQ ID NO: 875982 - protein, 20 aa, Mycobacterium
VTYNAFFAAAAAPPILIGDP

SEQ ID NO: 875983 - protein, 29 aa, Mycobacterium
VTYSPGEHLHRFLRTLRHATDLPLRVILA

SEQ ID NO: 875984 - protein, 21 aa, Mycobacterium
VTYWLFAPCGSDCTLATSQDG

SEQ ID NO: 875985 - protein, 18 aa, Mycobacterium
VVAAAHWVRDELDYLPGT

SEQ ID NO: 875986 - protein, 17 aa, Mycobacterium
VVAAARWARSELDYLPG

SEQ ID NO: 875987 - protein, 30 aa, Mycobacterium
VVAAEPSPFVPWLPDIPGRDDFPGASFPAA

SEQ ID NO: 875988 - protein, 28 aa, Mycobacterium
VVAAGDVARWWHPLYERHLRTEHWDDAG

SEQ ID NO: 875989 - protein, 17 aa, Mycobacterium
VVAAGLLRRAGGEIADA

SEQ ID NO: 875990 - protein, 23 aa, Mycobacterium
VVAAIALPVPSLVISQLLGVPYE

SEQ ID NO: 875991 - protein, 31 aa, Mycobacterium
VVAAITPFNFPFFLNIVKVLPALAAGCTVVL

SEQ ID NO: 875992 - protein, 33 aa, Mycobacterium
VVAAIVPWNMPQFLIATKLVPALLAGCTVILKP

SEQ ID NO: 875993 - protein, 33 aa, Mycobacterium
VVAAIVPWNMPQFLIVTKLVPALLAGCAVVLKP

SEQ ID NO: 875994 - protein, 18 aa, Mycobacterium
VVAAKYPITVALHTDHCP

SEQ ID NO: 875995 - protein, 18 aa, Mycobacterium
VVAALGMYPGQAPPLGAE

SEQ ID NO: 875996 - protein, 19 aa, Mycobacterium
VVAAMHWNGDVTGLVRSHL

SEQ ID NO: 875997 - protein, 27 aa, Mycobacterium
VVAANRARLAILVATNFFGQNTPAIAA

SEQ ID NO: 875998 - protein, 23 aa, Mycobacterium
VVAANRVLLTTLIVTNFFGQNTP

SEQ ID NO: 875999 - protein, 23 aa, Mycobacterium
VVAARYLARRLLRRGWRKTATRA

SEQ ID NO: 876000 - protein, 34 aa, Mycobacterium
VVAASHNALYLELYDSLLGLMDHYMRGNPIGAEC

SEQ ID NO: 876001 - protein, 17 aa, Mycobacterium
VVAAVDPEWRRGATQGH

SEQ ID NO: 876002 - protein, 17 aa, Mycobacterium
VVADFSRVLAGPYATMM

SEQ ID NO: 876003 - protein, 35 aa, Mycobacterium
VVADIMRSYRRSFARYPRLIPLLTIHAVNSTQAFR

SEQ ID NO: 876004 - protein, 23 aa, Mycobacterium
VVADLAALLREAALRAASRASAD

SEQ ID NO: 876005 - protein, 23 aa, Mycobacterium
VVADLAALLREAALRAASRASTD

SEQ ID NO: 876006 - protein, 23 aa, Mycobacterium
VVADLAALLREGALRAASRASTD

SEQ ID NO: 876007 - protein, 24 aa, Mycobacterium
VVADLAARFLAVPAAASWAEAATE

SEQ ID NO: 876008 - protein, 29 aa, Mycobacterium
VVADLITPRPALTVPLADALGLALAADVV

SEQ ID NO: 876009 - protein, 17 aa, Mycobacterium
VVADLPFGSYEAGAQQA

SEQ ID NO: 876010 - protein, 27 aa, Mycobacterium
VVADLSFISLATVLPALAACASPGADI

SEQ ID NO: 876011 - protein, 26 aa, Mycobacterium
VVADLSFISLATVLPALAGCAAPNAD

SEQ ID NO: 876012 - protein, 20 aa, Mycobacterium
VVADLVLKVLTMARPHARNV

SEQ ID NO: 876013 - protein, 18 aa, Mycobacterium
VVADPQYPPLRITQPYVD

SEQ ID NO: 876014 - protein, 26 aa, Mycobacterium
VVADRSIVFLPSDSAGRWWTWAGTKA

SEQ ID NO: 876015 - protein, 26 aa, Mycobacterium
VVADSGILYLLQGQDLRIDDLCLLIG

SEQ ID NO: 876016 - protein, 27 aa, Mycobacterium
VVADVPVPVRVFYMGRGFAKATLFGPT

SEQ ID NO: 876017 - protein, 24 aa, Mycobacterium
VVAEHGLWYPPDPSSFEICSIGGN

SEQ ID NO: 876018 - protein, 25 aa, Mycobacterium
VVAELQRPVLLFSAGKDSIVLLRLA

SEQ ID NO: 876019 - protein, 18 aa, Mycobacterium
VVAELTGGPWLGPSSGAM

SEQ ID NO: 876020 - protein, 20 aa, Mycobacterium
VVAERLWRDSGLKPQDIQTA

SEQ ID NO: 876021 - protein, 26 aa, Mycobacterium
VVAESVAGGFAWLYKVLSTFEDNGRC

SEQ ID NO: 876022 - protein, 26 aa, Mycobacterium
VVAEVRKMQLRFGAGPLGDGLYRVMV

SEQ ID NO: 876023 - protein, 17 aa, Mycobacterium
VVAFANPLQGVAVDAAY

SEQ ID NO: 876024 - protein, 23 aa, Mycobacterium
VVAFVRRARRLLPGDPEFGDPLS

SEQ ID NO: 876025 - protein, 20 aa, Mycobacterium
VVAGASFFDSATSFAMIRGG

SEQ ID NO: 876026 - protein, 25 aa, Mycobacterium
VVAGEPLFTLYTDTQERLPAALDAL

SEQ ID NO: 876027 - protein, 32 aa, Mycobacterium
VVAGITPFNFPAMIPLWKAGPALACGNAFLLK

SEQ ID NO: 876028 - protein, 23 aa, Mycobacterium
VVAGLLQNLLVNLPKTFADAIDN

SEQ ID NO: 876029 - protein, 25 aa, Mycobacterium
VVAGNAMDWVYRDSGYRQFRENQLS

SEQ ID NO: 876030 - protein, 26 aa, Mycobacterium
VVAGTGRLLELLPRFGFDDQACELLA

SEQ ID NO: 876031 - protein, 30 aa, Mycobacterium
VVAGYRRRLPLLVRALMTVPLACAHARDLA

SEQ ID NO: 876032 - protein, 20 aa, Mycobacterium
VVAHAPRRVVAEIPLWSTRA

SEQ ID NO: 876033 - protein, 24 aa, Mycobacterium
VVAHFEWTGPLGVTYPGVVADGIV

SEQ ID NO: 876034 - protein, 25 aa, Mycobacterium
VVAHPRSWKLLRGKIALPSRDRMRQ

SEQ ID NO: 876035 - protein, 29 aa, Mycobacterium
VVAIGNDAMWLRFCAAIDLPDLASDPDLA

SEQ ID NO: 876036 - protein, 32 aa, Mycobacterium
VVAKIRYSMWLGEDGWIVDRFLGGNAPLVLAE

SEQ ID NO: 876037 - protein, 31 aa, Mycobacterium
VVAKTEPLAPLPALPYPVIISETRTASRQAM

SEQ ID NO: 876038 - protein, 19 aa, Mycobacterium
VVALDPASWRVILGELGAA

SEQ ID NO: 876039 - protein, 19 aa, Mycobacterium
VVALERLGRWNVPGPVTES

SEQ ID NO: 876040 - protein, 21 aa, Mycobacterium
VVALLAMMQAIDAGYQCALLA

SEQ ID NO: 876041 - protein, 17 aa, Mycobacterium
VVALLRNPVMPTPDRRR

SEQ ID NO: 876042 - protein, 19 aa, Mycobacterium
VVALPMRVRFRGITTREVA

SEQ ID NO: 876043 - protein, 26 aa, Mycobacterium
VVALRTALLAPQRVRALALIGPTAEA

SEQ ID NO: 876044 - protein, 19 aa, Mycobacterium
VVALVFNPLAAFLTTGGLP

SEQ ID NO: 876045 - protein, 33 aa, Mycobacterium
VVALYSTFLHRAFDQLLFDVGLHQLPVTLVLDR

SEQ ID NO: 876046 - protein, 17 aa, Mycobacterium
VVAMLRLVADPTAGAAA

SEQ ID NO: 876047 - protein, 19 aa, Mycobacterium
VVANGTFTQTLFGDGGNGG

SEQ ID NO: 876048 - protein, 19 aa, Mycobacterium
VVANVAIARELAGWCWSLA

SEQ ID NO: 876049 - protein, 17 aa, Mycobacterium
VVAPALVGGLTAEIRHR

SEQ ID NO: 876050 - protein, 27 aa, Mycobacterium
VVAPDRARFVWGGRYEPRTLIWRSRWV

SEQ ID NO: 876051 - protein, 33 aa, Mycobacterium
VVAPFISITVFARGLLNRLFTRAYIPGKQLEND

SEQ ID NO: 876052 - protein, 26 aa, Mycobacterium
VVAPGAFLKTIATWKNSGNTLPGLFG

SEQ ID NO: 876053 - protein, 17 aa, Mycobacterium
VVAPLASYVPAVRTGDL

SEQ ID NO: 876054 - protein, 17 aa, Mycobacterium
VVAPLPDGIHRIVATVD

SEQ ID NO: 876055 - protein, 19 aa, Mycobacterium
VVAPRMRAYSDASAAVFEV

SEQ ID NO: 876056 - protein, 28 aa, Mycobacterium
VVAPWNRRLAYPRLQFSPLHSWVTDEDF

SEQ ID NO: 876057 - protein, 18 aa, Mycobacterium
VVAQANWTLWRDDNERLI

SEQ ID NO: 876058 - protein, 23 aa, Mycobacterium
VVAQANWTLWRDDNERLIPYRAS

SEQ ID NO: 876059 - protein, 32 aa, Mycobacterium
VVARDGLVLGELPPGSLVGTSSPRRAAQLRAL

SEQ ID NO: 876060 - protein, 33 aa, Mycobacterium
VVARDGLVLGELPPGSLVGTSSPRRAAQLRALG

SEQ ID NO: 876061 - protein, 19 aa, Mycobacterium
VVARDGLVLGELPVGSLVG

SEQ ID NO: 876062 - protein, 20 aa, Mycobacterium
VVARGRLMQALPAGGAMVAV

SEQ ID NO: 876063 - protein, 23 aa, Mycobacterium
VVARLAERAALYRDVVMAGRSHN

SEQ ID NO: 876064 - protein, 18 aa, Mycobacterium
VVARLTAEWVDRTVAGAP

SEQ ID NO: 876065 - protein, 35 aa, Mycobacterium
VVARYFPEQPGLYAARGWSMFPTIDRVYVNARARD

SEQ ID NO: 876066 - protein, 29 aa, Mycobacterium
VVASATGDFRFFAAPGTWTLRALSPSGNG

SEQ ID NO: 876067 - protein, 27 aa, Mycobacterium
VVASIPIKRLRQAGVLDLLLALAQETE

SEQ ID NO: 876068 - protein, 17 aa, Mycobacterium
VVASVRHAVSHGSRIGR

SEQ ID NO: 876069 - protein, 24 aa, Mycobacterium
VVASYLLADGLFQERLHACGADLV

SEQ ID NO: 876070 - protein, 25 aa, Mycobacterium
VVASYLLAEGLFQDRLREAGADLVT

SEQ ID NO: 876071 - protein, 29 aa, Mycobacterium
VVATAAQFWALIHGFVMLELAGYYGDDSS

SEQ ID NO: 876072 - protein, 34 aa, Mycobacterium
VVATGAWTRPFLAPYGVDIPIRVIREQIVTISPG

SEQ ID NO: 876073 - protein, 18 aa, Mycobacterium
VVATHRYPMVLDAIQDTS

SEQ ID NO: 876074 - protein, 33 aa, Mycobacterium
VVATITPWNYPLQMAVWKVIPALAAGCAVVIKP

SEQ ID NO: 876075 - protein, 28 aa, Mycobacterium
VVATITPWNYPLQMAVWKVMPALAAGCT

SEQ ID NO: 876076 - protein, 20 aa, Mycobacterium
VVAVDYRLAPEWPPPAQFDD

SEQ ID NO: 876077 - protein, 26 aa, Mycobacterium
VVAVISPWNFPMQLSNRSVAPALAVG

SEQ ID NO: 876078 - protein, 19 aa, Mycobacterium
VVAVLQALLDRHATLRLRV

SEQ ID NO: 876079 - protein, 24 aa, Mycobacterium
VVAVSIFVNPLQFGAGEDLGAYPR

SEQ ID NO: 876080 - protein, 32 aa, Mycobacterium
VVAVTPTVALPLFAGWRTMPLAGDAPARALQV

SEQ ID NO: 876081 - protein, 17 aa, Mycobacterium
VVAWLKDRYARRRAGDP

SEQ ID NO: 876082 - protein, 23 aa, Mycobacterium
VVAWTTQGFPPGAPYAGPTGKDF

SEQ ID NO: 876083 - protein, 24 aa, Mycobacterium
VVAYRNWQGLRPLSVWQRPEVIAV

SEQ ID NO: 876084 - protein, 19 aa, Mycobacterium
VVCEVGPANHYYRGVRLSD

SEQ ID NO: 876085 - protein, 18 aa, Mycobacterium
VVCSGAQAHWAMAPSPAV

SEQ ID NO: 876086 - protein, 25 aa, Mycobacterium
VVCTTDYALFWSLSFAVTADTWRTV

SEQ ID NO: 876087 - protein, 28 aa, Mycobacterium
VVCWQTPNWWEAHVLGLAVWHAGAVSCP

SEQ ID NO: 876088 - protein, 22 aa, Mycobacterium
VVDAFYHQLCPSCAALNRAKRD

SEQ ID NO: 876089 - protein, 17 aa, Mycobacterium
VVDAWLARKERIRQIHE

SEQ ID NO: 876090 - protein, 20 aa, Mycobacterium
VVDAWQRRGIDGTVTLPIGE

SEQ ID NO: 876091 - protein, 17 aa, Mycobacterium
VVDAYEIQLMNIRSRLA

SEQ ID NO: 876092 - protein, 24 aa, Mycobacterium
VVDAYLRLGALVTPAQFGGAVGTW

SEQ ID NO: 876093 - protein, 22 aa, Mycobacterium
VVDAYRYWRREAIVADIDRRRH

SEQ ID NO: 876094 - protein, 18 aa, Mycobacterium
VVDAYRYWTREAIVADID

SEQ ID NO: 876095 - protein, 30 aa, Mycobacterium
VVDDAHLLDRLSAALVYQLTVSGAAKLIAT

SEQ ID NO: 876096 - protein, 24 aa, Mycobacterium
VVDEVHGFRFFDNRDLLGFVDGTE

SEQ ID NO: 876097 - protein, 24 aa, Mycobacterium
VVDGDTVVPLLPAQDFKRVGDGDT

SEQ ID NO: 876098 - protein, 19 aa, Mycobacterium
VVDGLLRYRLPDGSALDDT

SEQ ID NO: 876099 - protein, 20 aa, Mycobacterium
VVDGLYSMQGDIAPMAGIAA

SEQ ID NO: 876100 - protein, 25 aa, Mycobacterium
VVDICPWALREGLILRKLDSEADGT

SEQ ID NO: 876101 - protein, 18 aa, Mycobacterium
VVDITVWIDLSAAAASDD

SEQ ID NO: 876102 - protein, 22 aa, Mycobacterium
VVDLCSRFLPAMVERGRGAVLN

SEQ ID NO: 876103 - protein, 26 aa, Mycobacterium
VVDLDHYLLKPWDPPEEKLYPVIDGL

SEQ ID NO: 876104 - protein, 27 aa, Mycobacterium
VVDLDHYLLKPWDPPQEKLYPVIDALL

SEQ ID NO: 876105 - protein, 23 aa, Mycobacterium
VVDLDLNLKLQPAKYRELLQEIL

SEQ ID NO: 876106 - protein, 18 aa, Mycobacterium
VVDLINDKIRYLLLSGAH

SEQ ID NO: 876107 - protein, 17 aa, Mycobacterium
VVDLMTTRLYAAVGTMR

SEQ ID NO: 876108 - protein, 21 aa, Mycobacterium
VVDNLLLRYGGTRAKHTGDGV

SEQ ID NO: 876109 - protein, 28 aa, Mycobacterium
VVDPANNVEFFFLRPKDIAIYVGSGELD

SEQ ID NO: 876110 - protein, 28 aa, Mycobacterium
VVDPGNNVEFFFLRPKDIAIYVGSGQLD

SEQ ID NO: 876111 - protein, 17 aa, Mycobacterium
VVDPQIAILRTVSGRHV

SEQ ID NO: 876112 - protein, 18 aa, Mycobacterium
VVDQLDGAPLNSDQAREL

SEQ ID NO: 876113 - protein, 28 aa, Mycobacterium
VVDRYGLPVLAPPIPRTVRFAEASASGA

SEQ ID NO: 876114 - protein, 26 aa, Mycobacterium
VVDSGLTLSWLLRNLKSRQPKSLRVC

SEQ ID NO: 876115 - protein, 26 aa, Mycobacterium
VVDSGLTLSWLLRNLSSRHPRSLRVC

SEQ ID NO: 876116 - protein, 27 aa, Mycobacterium
VVDSYTEIMFLATRLAKRQRVLVRVTP

SEQ ID NO: 876117 - protein, 19 aa, Mycobacterium
VVDTAWFKGNYPPEVSVEA

SEQ ID NO: 876118 - protein, 24 aa, Mycobacterium
VVDTCAAVLVWEPRRVVPTYAVPR

SEQ ID NO: 876119 - protein, 25 aa, Mycobacterium
VVDTFEAIRLFLNTPKTAYVLALNQ

SEQ ID NO: 876120 - protein, 20 aa, Mycobacterium
VVDTSYFTPAALVAHIYGVL

SEQ ID NO: 876121 - protein, 27 aa, Mycobacterium
VVDVFIGYLRRKLEAHGGPRLLHTVRG

SEQ ID NO: 876122 - protein, 26 aa, Mycobacterium
VVDVFIGYLRRKLEANGAPRLLHTVR

SEQ ID NO: 876123 - protein, 30 aa, Mycobacterium
VVDVSVEVALFIRLLGVPVIVVALPGTRVD

SEQ ID NO: 876124 - protein, 24 aa, Mycobacterium
VVDVYVRYLRRKLGARRFVTLRGM

SEQ ID NO: 876125 - protein, 21 aa, Mycobacterium
VVDYFDFVAPATGLALVLYRT

SEQ ID NO: 876126 - protein, 27 aa, Mycobacterium
VVEADPGRRLVLSWGWEGHGDPAPGES

SEQ ID NO: 876127 - protein, 17 aa, Mycobacterium
VVEAPWLKRLQALGEDV

SEQ ID NO: 876128 - protein, 31 aa, Mycobacterium; identical to SEQ ID NO: 133789

SEQ ID NO: 876129 - protein, 20 aa, Mycobacterium
VVECLRLSADCLICLTVRGK

SEQ ID NO: 876130 - protein, 26 aa, Mycobacterium
VVEDVLLDLVGWLRDRTDGDALCLAG

SEQ ID NO: 876131 - protein, 26 aa, Mycobacterium
VVEEYMQLLYQLWDSWDDDAIVYDRD

SEQ ID NO: 876132 - protein, 26 aa, Mycobacterium
VVEFARYRCFLLGLPEELLPSEPAGI

SEQ ID NO: 876133 - protein, 26 aa, Mycobacterium
VVEFMMLDRLFPRSIFHSLRLAEHNL

SEQ ID NO: 876134 - protein, 29 aa, Mycobacterium
VVEFMMLDRLFPRSIFYSLRLAEHSLDEL

SEQ ID NO: 876135 - protein, 28 aa, Mycobacterium
VVEFMMLDRLFPRSVYYSLRLAEHNLEE

SEQ ID NO: 876136 - protein, 18 aa, Mycobacterium
VVEFWLMGTHRGYLGKIP

SEQ ID NO: 876137 - protein, 24 aa, Mycobacterium
VVEGAPVAALLTLAKEVDADLIVV

SEQ ID NO: 876138 - protein, 24 aa, Mycobacterium
VVEGMLALTGYFAWHKICVDRGIL

SEQ ID NO: 876139 - protein, 17 aa, Mycobacterium
VVEGMLALTGYYAWHRI

SEQ ID NO: 876140 - protein, 24 aa, Mycobacterium
VVEGPFAEYPGFIGGAAPAPVLRV

SEQ ID NO: 876141 - protein, 25 aa, Mycobacterium
VVEHRTAVWLPVVDRVIVLGAAGEI

SEQ ID NO: 876142 - protein, 19 aa, Mycobacterium
VVEILFPEPAPEVESAVTD

SEQ ID NO: 876143 - protein, 18 aa, Mycobacterium
VVELNLNGCYWMAQACAQ

SEQ ID NO: 876144 - protein, 25 aa, Mycobacterium
VVELRLHLAALLADRGRHAEALGHC

SEQ ID NO: 876145 - protein, 24 aa, Mycobacterium
VVELTKVWAGPYAGKLLAMLGAEV

SEQ ID NO: 876146 - protein, 28 aa, Mycobacterium
VVEMLTRRRIFVPMLRVTAIEPGSVTLN

SEQ ID NO: 876147 - protein, 21 aa, Mycobacterium
VVERALLCLPVEQRAAVVAVD

SEQ ID NO: 876148 - protein, 33 aa, Mycobacterium
VVERIVDTLLFERDWLLIKIDFLLHAARHPDLA

SEQ ID NO: 876149 - protein, 32 aa, Mycobacterium
VVERVRPALVAYAEPLLHVGPLGSGQRVKLVN

SEQ ID NO: 876150 - protein, 26 aa, Mycobacterium
VVETLTWRTQLVTDARVWAVVDAELA

SEQ ID NO: 876151 - protein, 24 aa, Mycobacterium
VVEWLRLRESLGHSAYQLGVLERA

SEQ ID NO: 876152 - protein, 17 aa, Mycobacterium
VVEWPSRYLAAEVQAGA

SEQ ID NO: 876153 - protein, 18 aa, Mycobacterium
VVFANRAFAALVGQTPPQ

SEQ ID NO: 876154 - protein, 23 aa, Mycobacterium
VVFATAYYALRHLASVQQGQRIL

SEQ ID NO: 876155 - protein, 17 aa, Mycobacterium
VVFDRGGYTYGGRIAAL

SEQ ID NO: 876156 - protein, 19 aa, Mycobacterium
VVFDRGGYTYGGRIAALAD

SEQ ID NO: 876157 - protein, 24 aa, Mycobacterium
VVFDYPTVYSLTDYLATILPELLE

SEQ ID NO: 876158 - protein, 17 aa, Mycobacterium
VVFGEDAIFKLFRRITP

SEQ ID NO: 876159 - protein, 18 aa, Mycobacterium
VVFGLHASAYHVTSKEFA

SEQ ID NO: 876160 - protein, 17 aa, Mycobacterium
VVFIVLDDTGYGHLGCF

SEQ ID NO: 876161 - protein, 17 aa, Mycobacterium
VVFKPSELAPLAALRFG

SEQ ID NO: 876162 - protein, 18 aa, Mycobacterium
VVFKPSELAPLAALRFGE

SEQ ID NO: 876163 - protein, 17 aa, Mycobacterium
VVFKPYVGKAITAALLR

SEQ ID NO: 876164 - protein, 20 aa, Mycobacterium
VVFPLPAEQLPFLPAVTVVN

SEQ ID NO: 876165 - protein, 29 aa, Mycobacterium
VVFPTVTGATIVRWIIYQDTGTAGTSQLV

SEQ ID NO: 876166 - protein, 23 aa, Mycobacterium
VVFQDALLMPWLTVAENIAFAKR

SEQ ID NO: 876167 - protein, 27 aa, Mycobacterium
VVFRHGLQLFGAMGFTWENDVQFALKR

SEQ ID NO: 876168 - protein, 18 aa, Mycobacterium
VVFRVCHQLHGAVGFCDE

SEQ ID NO: 876169 - protein, 18 aa, Mycobacterium
VVFSVEALNAYISANSKE

SEQ ID NO: 876170 - protein, 20 aa, Mycobacterium
VVFVCHSMGGLVARWYISCE

SEQ ID NO: 876171 - protein, 18 aa, Mycobacterium
VVFVGRITRQKGVPHLLA

SEQ ID NO: 876172 - protein, 18 aa, Mycobacterium
VVFVPPKFAKDAIIEAID

SEQ ID NO: 876173 - protein, 26 aa, Mycobacterium
VVGAITPWNFPFEIISNKVGQILATG

SEQ ID NO: 876174 - protein, 26 aa, Mycobacterium
VVGAITPWNFPFEVVLNKLGQALATG

SEQ ID NO: 876175 - protein, 29 aa, Mycobacterium
VVGAITPWNVPFYLNIAETVPALMAGNTV

SEQ ID NO: 876176 - protein, 32 aa, Mycobacterium
VVGAIVAWNVPLFLAINKLGPALLAGCTVVLK

SEQ ID NO: 876177 - protein, 24 aa, Mycobacterium
VVGALLGDPLLGVPFSAPYSFDTP

SEQ ID NO: 876178 - protein, 18 aa, Mycobacterium
VVGALPFVTRSESLPKRT

SEQ ID NO: 876179 - protein, 23 aa, Mycobacterium
VVGELGFFFKEPWGSSTHSLAAQ

SEQ ID NO: 876180 - protein, 31 aa, Mycobacterium
VVGEWQLLADLSFADYLMWVARDDGALVCVA

SEQ ID NO: 876181 - protein, 33 aa, Mycobacterium; identical to SEQ ID NO: 751029

SEQ ID NO: 876182 - protein, 31 aa, Mycobacterium
VVGFKPAYGAIPAQGVWPLAASLDHVGVFAR

SEQ ID NO: 876183 - protein, 26 aa, Mycobacterium
VVGGVRLPHGNGETIRLARGASLSDF

SEQ ID NO: 876184 - protein, 23 aa, Mycobacterium
VVGHPFVDIWQAVKPARLGMKTW

SEQ ID NO: 876185 - protein, 28 aa, Mycobacterium
VVGHPYVDIWQAVKPQRLGLKQWPNVPR

SEQ ID NO: 876186 - protein, 20 aa, Mycobacterium
VVGIFPDRDALIRLVGAVLA

SEQ ID NO: 876187 - protein, 22 aa, Mycobacterium
VVGIFYNRELLSSLGLEVPKTL

SEQ ID NO: 876188 - protein, 23 aa, Mycobacterium
VVGKLVIRELLDHPVFELAAVLV

SEQ ID NO: 876189 - protein, 30 aa, Mycobacterium
VVGLELARALVKEWLGLEFDPQSASAAKVN

SEQ ID NO: 876190 - protein, 33 aa, Mycobacterium
VVGLHDLQPFPLPALPCLLRSITLRMTTAPVQR

SEQ ID NO: 876191 - protein, 18 aa, Mycobacterium
VVGLLTRTYYDYSGGTHT

SEQ ID NO: 876192 - protein, 18 aa, Mycobacterium
VVGLPRTLADRTGPSAID

SEQ ID NO: 876193 - protein, 20 aa, Mycobacterium
VVGMTLPIARDLASHRIRVM

SEQ ID NO: 876194 - protein, 19 aa, Mycobacterium
VVGNDLPFSITGTAAPPFG

SEQ ID NO: 876195 - protein, 24 aa, Mycobacterium
VVGPDRRFIVVVSSLQTANDVTAR

SEQ ID NO: 876196 - protein, 18 aa, Mycobacterium
VVGPFWKNNPWTAAYRQD

SEQ ID NO: 876197 - protein, 19 aa, Mycobacterium
VVGPNSAFLRHIGRVLPSL

SEQ ID NO: 876198 - protein, 19 aa, Mycobacterium
VVGPYRSKRTLPRTLRTMI

SEQ ID NO: 876199 - protein, 24 aa, Mycobacterium
VVGQLYSLLRPGGELRYLEHVAGT

SEQ ID NO: 876200 - protein, 31 aa, Mycobacterium
VVGQVTPWNYPFMMAIWKIGPALAAGNTVVL

SEQ ID NO: 876201 - protein, 29 aa, Mycobacterium
VVGSAPVVLQFPWKLMPGKYIAGIEEAAA

SEQ ID NO: 876202 - protein, 19 aa, Mycobacterium
VVGSDLPFTITGRAAPPFP

SEQ ID NO: 876203 - protein, 25 aa, Mycobacterium
VVGSSRFAAPKRIFLGSTASRILAG

SEQ ID NO: 876204 - protein, 18 aa, Mycobacterium
VVGTAEIIKLALTTKIKP

SEQ ID NO: 876205 - protein, 25 aa, Mycobacterium
VVGTAELIRFALTTKLKPYTYISTA

SEQ ID NO: 876206 - protein, 25 aa, Mycobacterium
VVGTDLPFSITGRAALPFTGSMRVS

SEQ ID NO: 876207 - protein, 24 aa, Mycobacterium
VVGTLARHPGLTRAYLTFNAHLLL

SEQ ID NO: 876208 - protein, 29 aa, Mycobacterium
VVGTWHGRSPRLWLITGGGLAVHDGEPGA

SEQ ID NO: 876209 - protein, 25 aa, Mycobacterium
VVGTYRKAHLWAAEPEIFATGVEAG

SEQ ID NO: 876210 - protein, 25 aa, Mycobacterium
VVGVALFLDLQLTVPGGAVLPMAGV

SEQ ID NO: 876211 - protein, 17 aa, Mycobacterium
VVGVHPYQLAYADPRVG

SEQ ID NO: 876212 - protein, 17 aa, Mycobacterium
VVGVLAVELFETTDGAL

SEQ ID NO: 876213 - protein, 17 aa, Mycobacterium
VVGVRNPLAPPLVVHHD

SEQ ID NO: 876214 - protein, 17 aa, Mycobacterium
VVGVVNYAAVFPACRAV

SEQ ID NO: 876215 - protein, 25 aa, Mycobacterium
VVGYLDRPFEVMFTHPGDVQMASRL

SEQ ID NO: 876216 - protein, 17 aa, Mycobacterium
VVGYRRRLLGEHHPHTL

SEQ ID NO: 876217 - protein, 22 aa, Mycobacterium
VVHAALAPGALIAELGNDAQLQ

SEQ ID NO: 876218 - protein, 19 aa, Mycobacterium
VVHAIEPSRKLTGNDWLAL

SEQ ID NO: 876219 - protein, 17 aa, Mycobacterium
VVHHIAIDHWSGGVLFA

SEQ ID NO: 876220 - protein, 17 aa, Mycobacterium
VVHIVVVLANPLYDGHG

SEQ ID NO: 876221 - protein, 19 aa, Mycobacterium
VVHLARPTLRETLGRLAPG

SEQ ID NO: 876222 - protein, 17 aa, Mycobacterium
VVHLGMSGQMLLGEVPR

SEQ ID NO: 876223 - protein, 18 aa, Mycobacterium
VVHLYNYLVAGANAARRA

SEQ ID NO: 876224 - protein, 31 aa, Mycobacterium
VVHNARLAPAPPLLALPAEEAWRLAAGGGGT

SEQ ID NO: 876225 - protein, 21 aa, Mycobacterium
VVHPPFRWQRRYAEGFSEQVA

SEQ ID NO: 876226 - protein, 27 aa, Mycobacterium
VVHQETFAPILYVLTYDTLDEAIALNN

SEQ ID NO: 876227 - protein, 23 aa, Mycobacterium
VVHQIWMPYHWGSVGLVDGDVVN

SEQ ID NO: 876228 - protein, 26 aa, Mycobacterium
VVHRETFAPILYVLDYDTLDEAIALN

SEQ ID NO: 876229 - protein, 18 aa, Mycobacterium
VVHRVDVGVLLGLSTAAG

SEQ ID NO: 876230 - protein, 17 aa, Mycobacterium
VVHSMHRLARNLEDLRR

SEQ ID NO: 876231 - protein, 24 aa, Mycobacterium
VVHTLFEEIGPFFADRNGGYTRII

SEQ ID NO: 876232 - protein, 19 aa, Mycobacterium
VVHVFAPMVTPANGWADVA

SEQ ID NO: 876233 - protein, 34 aa, Mycobacterium
VVHVGGYFNFGPGQIPLIDIKPAAGFFNATTGPS

SEQ ID NO: 876234 - protein, 22 aa, Mycobacterium
VVHVLHDVDFRVYPGQVTALVG

SEQ ID NO: 876235 - protein, 20 aa, Mycobacterium
VVHVPEMCALPQRVVDVLHR

SEQ ID NO: 876236 - protein, 17 aa, Mycobacterium
VVHWLPEYIGMGIDGVS

SEQ ID NO: 876237 - protein, 17 aa, Mycobacterium
VVICRDVRDLYAYLSHQ

SEQ ID NO: 876238 - protein, 25 aa, Mycobacterium
VVIDPGNPYLLGPQLLCAATELPLD

SEQ ID NO: 876239 - protein, 27 aa, Mycobacterium
VVIDPGNPYLLGPQLLCAAVELPLDQA

SEQ ID NO: 876240 - protein, 18 aa, Mycobacterium
VVIDTQNGLPFLARFAFG

SEQ ID NO: 876241 - protein, 18 aa, Mycobacterium
VVIERPIFVTGLVRTGTT

SEQ ID NO: 876242 - protein, 23 aa, Mycobacterium
VVIGLYPHWNISEAGIAAADKFL

SEQ ID NO: 876243 - protein, 26 aa, Mycobacterium
VVIHNHPYYVCVLAALGRLPDLVHQT

SEQ ID NO: 876244 - protein, 19 aa, Mycobacterium
VVIHRGRILGVVPKSYLPT

SEQ ID NO: 876245 - protein, 18 aa, Mycobacterium
VVINCSITKFRDGLTQWM

SEQ ID NO: 876246 - protein, 19 aa, Mycobacterium
VVINPFFQWGSDRAPRTSY

SEQ ID NO: 876247 - protein, 19 aa, Mycobacterium
VVIPAGSPLLLMLASANRD

SEQ ID NO: 876248 - protein, 26 aa, Mycobacterium
VVIPMECAFFSLRGLALLTDTVAKVR

SEQ ID NO: 876249 - protein, 18 aa, Mycobacterium
VVIPPKSTVSFGEPNAEP

SEQ ID NO: 876250 - protein, 18 aa, Mycobacterium
VVIRAWLAFNQELARQRA

SEQ ID NO: 876251 - protein, 18 aa, Mycobacterium
VVIRGQTPHFEYVCDAVT

SEQ ID NO: 876252 - protein, 19 aa, Mycobacterium
VVIRWLADAGISIAGTRAL

SEQ ID NO: 876253 - protein, 31 aa, Mycobacterium
VVISVAAQFWALIHGFVMLELAGFFGGESAT

SEQ ID NO: 876254 - protein, 19 aa, Mycobacterium
VVITPAVDGVLRVGAKPGT

SEQ ID NO: 876255 - protein, 17 aa, Mycobacterium
VVIWGTGFVGRMVIAEV

SEQ ID NO: 876256 - protein, 17 aa, Mycobacterium
VVIYMPMIPEAVIAMLA

SEQ ID NO: 876257 - protein, 43 aa, Mycobacterium
VVKEPIGVCGLITPWNWPINQIACKVFPALATGNTMVLKPSEV

SEQ ID NO: 876258 - protein, 26 aa, Mycobacterium
VVKETLRLHPPLIILMRVAKGEFEVE

SEQ ID NO: 876259 - protein, 24 aa, Mycobacterium
VVKETLRMRPVLALVSRRLTEPME

SEQ ID NO: 876260 - protein, 18 aa, Mycobacterium
VVKGGRRFSFTALVIVGD

SEQ ID NO: 876261 - protein, 20 aa, Mycobacterium
VVKHNLLHAANLRAVSHELV

SEQ ID NO: 876262 - protein, 17 aa, Mycobacterium
VVKISDEDLRWLDSRRS

SEQ ID NO: 876263 - protein, 23 aa, Mycobacterium
VVKKIELGYPRLGLIQTNLAFVI

SEQ ID NO: 876264 - protein, 19 aa, Mycobacterium
VVKLFDPAFASPRFECHFN

SEQ ID NO: 876265 - protein, 26 aa, Mycobacterium
VVKLTAIVALLHYQPEDLANGASDLI

SEQ ID NO: 876266 - protein, 19 aa, Mycobacterium
VVKVNYALGGPVPWRAEKL

SEQ ID NO: 876267 - protein, 17 aa, Mycobacterium
VVLAAPVTPYMLNTADN

SEQ ID NO: 876268 - protein, 28 aa, Mycobacterium
VVLADDEWPHLFLPFREGAAQESDLPAD

SEQ ID NO: 876269 - protein, 17 aa, Mycobacterium
VVLADPLSFVKRPDLWL

SEQ ID NO: 876270 - protein, 19 aa, Mycobacterium
VVLADVLAEPLDRATRALT

SEQ ID NO: 876271 - protein, 17 aa, Mycobacterium
VVLALVSGALRSYLKDR

SEQ ID NO: 876272 - protein, 17 aa, Mycobacterium
VVLARYMQILSPEFLNE

SEQ ID NO: 876273 - protein, 20 aa, Mycobacterium
VVLARYMQILTPEFLDAVGC

SEQ ID NO: 876274 - protein, 27 aa, Mycobacterium
VVLASEAPPWIGALDVLIVAGDDPGDP

SEQ ID NO: 876275 - protein, 31 aa, Mycobacterium
VVLASREQEIGWWLFLQRHHTDGVGLPLPEG

SEQ ID NO: 876276 - protein, 18 aa, Mycobacterium
VVLCHRFRDPRLYEALRA

SEQ ID NO: 876277 - protein, 20 aa, Mycobacterium
VVLCQLWGPMTDLPPAMPRF

SEQ ID NO: 876278 - protein, 19 aa, Mycobacterium
VVLDFTQVYMGPSCTQMLA

SEQ ID NO: 876279 - protein, 25 aa, Mycobacterium
VVLDGWSMPILLGDIFAAYYGQRLP

SEQ ID NO: 876280 - protein, 25 aa, Mycobacterium
VVLDLLRHCDVLLENFRPGTLEKWG

SEQ ID NO: 876281 - protein, 25 aa, Mycobacterium
VVLDNVFATPLLQQGFPLGVDVVVY

SEQ ID NO: 876282 - protein, 18 aa, Mycobacterium
VVLDRKGNRHFSFGIGVH

SEQ ID NO: 876283 - protein, 20 aa, Mycobacterium
VVLERQLWIAVLRAQRDLGI

SEQ ID NO: 876284 - protein, 18 aa, Mycobacterium
VVLESLVGIRRAGADIVL

SEQ ID NO: 876285 - protein, 25 aa, Mycobacterium
VVLETLVLSIFNFDSAVASAAARMA

SEQ ID NO: 876286 - protein, 18 aa, Mycobacterium
VVLGGDHSITWPAATAVA

SEQ ID NO: 876287 - protein, 26 aa, Mycobacterium
VVLGGGLLPGPLLAATLAQTATIRRL

SEQ ID NO: 876288 - protein, 18 aa, Mycobacterium
VVLGGNMMQYNWTINGQP

SEQ ID NO: 876289 - protein, 22 aa, Mycobacterium
VVLGLVFLEHAGEAEWKSLVGN

SEQ ID NO: 876290 - protein, 17 aa, Mycobacterium
VVLGQHVGPLPAGMIAY

SEQ ID NO: 876291 - protein, 17 aa, Mycobacterium
VVLHFEGDRNGGLRMVR

SEQ ID NO: 876292 - protein, 17 aa, Mycobacterium
VVLHYFLHAEPTGVAAW

SEQ ID NO: 876293 - protein, 24 aa, Mycobacterium
VVLIPELPGIHPGVLGLGNHLVDN

SEQ ID NO: 876294 - protein, 20 aa, Mycobacterium
VVLIPELPGLHPGVLGLGDH

SEQ ID NO: 876295 - protein, 25 aa, Mycobacterium
VVLIPEMPGLHPGVLALGNHLVDNG

SEQ ID NO: 876296 - protein, 22 aa, Mycobacterium
VVLKFFVRELLRRNPQLHEPEY

SEQ ID NO: 876297 - protein, 19 aa, Mycobacterium
VVLKGDGNGGWYVLTGFPK

SEQ ID NO: 876298 - protein, 18 aa, Mycobacterium
VVLKPATQTPLSALLLAE

SEQ ID NO: 876299 - protein, 17 aa, Mycobacterium
VVLKPSPLTPLAGLALA

SEQ ID NO: 876300 - protein, 23 aa, Mycobacterium
VVLKPSPLTPLAGLALARIIDEE

SEQ ID NO: 876301 - protein, 22 aa, Mycobacterium
VVLKPSPLTPLAGLALARIIHE

SEQ ID NO: 876302 - protein, 19 aa, Mycobacterium
VVLLKTRLRQGLPHDVLNP

SEQ ID NO: 876303 - protein, 17 aa, Mycobacterium
VVLLSLEIPIDTAVAAA

SEQ ID NO: 876304 - protein, 18 aa, Mycobacterium
VVLLTKNIALDYGPSGIR

SEQ ID NO: 876305 - protein, 28 aa, Mycobacterium
VVLMIPADTPPGLYPVGARLAVTDREAP

SEQ ID NO: 876306 - protein, 22 aa, Mycobacterium
VVLMQRFGLDRIIVNSAADWGR

SEQ ID NO: 876307 - protein, 25 aa, Mycobacterium
VVLMQRFGLERIIVNSAADWGRSDP

SEQ ID NO: 876308 - protein, 19 aa, Mycobacterium
VVLNYRKSHLFGDTERNVF

SEQ ID NO: 876309 - protein, 18 aa, Mycobacterium
VVLPDRELRRIAALCAAF

SEQ ID NO: 876310 - protein, 30 aa, Mycobacterium
VVLPGPPRELQPMWLRAVDTEPVRRAIAGR

SEQ ID NO: 876311 - protein, 17 aa, Mycobacterium
VVLPWDGRSHYLAAIYR

SEQ ID NO: 876312 - protein, 19 aa, Mycobacterium
VVLQAAFAQLLAWLTGHHD

SEQ ID NO: 876313 - protein, 17 aa, Mycobacterium
VVLQAIGFAPRTTGYGL

SEQ ID NO: 876314 - protein, 18 aa, Mycobacterium
VVLQALLDRHAMLRLRID

SEQ ID NO: 876315 - protein, 17 aa, Mycobacterium
VVLQIAGLLDAGLPTRI

SEQ ID NO: 876316 - protein, 26 aa, Mycobacterium
VVLQRSWVHVLPSRKEGWGLAVVEAA

SEQ ID NO: 876317 - protein, 20 aa, Mycobacterium
VVLRLYEHCGFVAAGRPNDW

SEQ ID NO: 876318 - protein, 17 aa, Mycobacterium
VVLRLYGELADHADSVV

SEQ ID NO: 876319 - protein, 18 aa, Mycobacterium
VVLRRRLNPPSASWVYEL

SEQ ID NO: 876320 - protein, 24 aa, Mycobacterium
VVLSLQHGVLPQSLHFENPSPHIP

SEQ ID NO: 876321 - protein, 19 aa, Mycobacterium
VVLSLQNGVLPQSLHFDNP

SEQ ID NO: 876322 - protein, 20 aa, Mycobacterium
VVLTPARRGFFRSEPERILI

SEQ ID NO: 876323 - protein, 23 aa, Mycobacterium
VVLTSRRYTGARWLGAAKSFVAG

SEQ ID NO: 876324 - protein, 19 aa, Mycobacterium
VVLTWRQYADRVQKIAAGL

SEQ ID NO: 876325 - protein, 32 aa, Mycobacterium
VVLVHQYRHAFGRRLWELPAGLLDSAGEDPHV

SEQ ID NO: 876326 - protein, 18 aa, Mycobacterium
VVLVSPPTLLPRGVENWP

SEQ ID NO: 876327 - protein, 27 aa, Mycobacterium
VVLVVFDPREVTYGQLLVQFWESHDPT

SEQ ID NO: 876328 - protein, 17 aa, Mycobacterium
VVLYFHGGGFVMGDLDT

SEQ ID NO: 876329 - protein, 17 aa, Mycobacterium
VVLYFHGGGFVVGDLDS

SEQ ID NO: 876330 - protein, 24 aa, Mycobacterium
VVLYIVGRLSLGNLPIEVGSRLTT

SEQ ID NO: 876331 - protein, 17 aa, Mycobacterium
VVMAAGSCVFFLGTLWH

SEQ ID NO: 876332 - protein, 24 aa, Mycobacterium
VVMAALARLGAVQNPIIPILREHE

SEQ ID NO: 876333 - protein, 26 aa, Mycobacterium
VVMASGPFHRPKLPGIPGIKDFKGHS

SEQ ID NO: 876334 - protein, 25 aa, Mycobacterium
VVMASGPFHRPKLPGIPGIKDFRGH

SEQ ID NO: 876335 - protein, 18 aa, Mycobacterium
VVMDWVWYHQEPVTVRDV

SEQ ID NO: 876336 - protein, 18 aa, Mycobacterium
VVMGLAWRNEIDGEFSYT

SEQ ID NO: 876337 - protein, 31 aa, Mycobacterium
VVMGNFTGIDPWRAPAGPVPAYPRASNDRDG

SEQ ID NO: 876338 - protein, 20 aa, Mycobacterium
VVMGRRTWDSLPAKVRPLPG

SEQ ID NO: 876339 - protein, 26 aa, Mycobacterium
VVMIDSLLHLFKAGGKRFRPLFTVLS

SEQ ID NO: 876340 - protein, 26 aa, Mycobacterium
VVMLALARMPVVQAPVLHLYRCREVC

SEQ ID NO: 876341 - protein, 30 aa, Mycobacterium
VVMPALKEIDGWLGLSLLVDRQSGTCIATS

SEQ ID NO: 876342 - protein, 19 aa, Mycobacterium
VVMPRFEPREFLRLITEHR

SEQ ID NO: 876343 - protein, 24 aa, Mycobacterium
VVMPVHLTSRPFHWVITLRGERRT

SEQ ID NO: 876344 - protein, 22 aa, Mycobacterium
VVMPVLKKWRIFEREDFTGEAA

SEQ ID NO: 876345 - protein, 22 aa, Mycobacterium
VVMPVLKKWRIFEREDFTGEGA

SEQ ID NO: 876346 - protein, 22 aa, Mycobacterium
VVMPVLRKWRIFERDDITGEGE

SEQ ID NO: 876347 - protein, 17 aa, Mycobacterium
VVMRVYFEKPRTTTGWK

SEQ ID NO: 876348 - protein, 18 aa, Mycobacterium
VVMSVFLELGQRPDEPGP

SEQ ID NO: 876349 - protein, 19 aa, Mycobacterium
VVMSYLPSCGTCRWCTDGQ

SEQ ID NO: 876350 - protein, 22 aa, Mycobacterium
VVMTALARLGAVQNPVLPIWRE

SEQ ID NO: 876351 - protein, 27 aa, Mycobacterium
VVMTDGLPWTWETFPDYLNALEAGRRD

SEQ ID NO: 876352 - protein, 26 aa, Mycobacterium
VVMTDGLPWTWETFPEFMDALEAGAR

SEQ ID NO: 876353 - protein, 27 aa, Mycobacterium
VVMTDGLPWTWETFPEYLDALEAGRRD

SEQ ID NO: 876354 - protein, 26 aa, Mycobacterium
VVMTDGLPWTWETFPEYMDALDAGKR

SEQ ID NO: 876355 - protein, 27 aa, Mycobacterium
VVMVDGLPWQWETFPEFLDAVASRQRD

SEQ ID NO: 876356 - protein, 26 aa, Mycobacterium
VVNCLRIQLMAFAYDGAWAEYTLAQA

SEQ ID NO: 876357 - protein, 21 aa, Mycobacterium
VVNDPWYRMRMAPSIFRHVWS

SEQ ID NO: 876358 - protein, 25 aa, Mycobacterium
VVNGAKLFITSGVRADFVTTAVRTG

SEQ ID NO: 876359 - protein, 25 aa, Mycobacterium
VVNGALGDLLPILTIPGESAQNVAN

SEQ ID NO: 876360 - protein, 22 aa, Mycobacterium
VVNGPAKLLTGRPLIGDGADGI

SEQ ID NO: 876361 - protein, 25 aa, Mycobacterium
VVNKFRGDPALLEPGLRQLHAITDR

SEQ ID NO: 876362 - protein, 19 aa, Mycobacterium
VVNKFRGDPSLLAPGLRQL

SEQ ID NO: 876363 - protein, 18 aa, Mycobacterium
VVNKLSVPPSWAGSTPVV

SEQ ID NO: 876364 - protein, 17 aa, Mycobacterium
VVNKTDLAPLVGADLQV

SEQ ID NO: 876365 - protein, 20 aa, Mycobacterium
VVNPDVGLLLREVGLEVLGS

SEQ ID NO: 876366 - protein, 26 aa, Mycobacterium
VVNRILVYVAPMLLGGPVSAVDDVGV

SEQ ID NO: 876367 - protein, 19 aa, Mycobacterium
VVNRVWFLDAVRGEADVYN

SEQ ID NO: 876368 - protein, 18 aa, Mycobacterium
VVNRVWFLDAVRGEVDVY

SEQ ID NO: 876369 - protein, 19 aa, Mycobacterium
VVNRVWFLDAVRGEVDVYN

SEQ ID NO: 876370 - protein, 31 aa, Mycobacterium
VVNSFSKYFAMTGWRLGWLLVPDELKRAVDR

SEQ ID NO: 876371 - protein, 33 aa, Mycobacterium
VVNSFSKYFAMTGWRLGWLLVPEKLRRAVDCLT

SEQ ID NO: 876372 - protein, 27 aa, Mycobacterium
VVNSIRKTLKAIAVKSPYFGDRRKAFL

SEQ ID NO: 876373 - protein, 21 aa, Mycobacterium
VVNSIRKTLKAVAVKAPFFGD

SEQ ID NO: 876374 - protein, 20 aa, Mycobacterium
VVNSIRKTLRAVAVKSPYFG

SEQ ID NO: 876375 - protein, 30 aa, Mycobacterium
VVNTDVATWPPMPYPDTWAVWQEDEGRKVI

SEQ ID NO: 876376 - protein, 21 aa, Mycobacterium
VVNTLGGDLLLLELLQQLAEA

SEQ ID NO: 876377 - protein, 20 aa, Mycobacterium
VVNYPPMRLARDGRDGTGCY

SEQ ID NO: 876378 - protein, 18 aa, Mycobacterium
VVPAAVDALLIGMAERYD

SEQ ID NO: 876379 - protein, 23 aa, Mycobacterium
VVPADVVFLAPGSLPRTSSGKLR

SEQ ID NO: 876380 - protein, 19 aa, Mycobacterium
VVPALRTVLVKLAAPRFQG

SEQ ID NO: 876381 - protein, 17 aa, Mycobacterium
VVPDALSVLVRLLASLH

SEQ ID NO: 876382 - protein, 18 aa, Mycobacterium
VVPDALSVLVRLLASLHD

SEQ ID NO: 876383 - protein, 24 aa, Mycobacterium
VVPDSMLFCFDLITEGTAADGARL

SEQ ID NO: 876384 - protein, 22 aa, Mycobacterium
VVPDYLGNVWFATGTGVVGVAK

SEQ ID NO: 876385 - protein, 18 aa, Mycobacterium
VVPELRRRGLFRHEYEST

SEQ ID NO: 876386 - protein, 25 aa, Mycobacterium
VVPEPLSLRPHYIKTLRIWGDNLEA

SEQ ID NO: 876387 - protein, 25 aa, Mycobacterium
VVPESLSFCWTLVRDSENMPDAELE

SEQ ID NO: 876388 - protein, 19 aa, Mycobacterium
VVPGGFSYGDYLRCGAIAK

SEQ ID NO: 876389 - protein, 18 aa, Mycobacterium
VVPGIARPGLSDDDLIAA

SEQ ID NO: 876390 - protein, 19 aa, Mycobacterium
VVPGISRPGLADDDLIAGA

SEQ ID NO: 876391 - protein, 25 aa, Mycobacterium
VVPGKPAVIVLPGPPRELQPMWGKA

SEQ ID NO: 876392 - protein, 25 aa, Mycobacterium
VVPGKPAVIVLPGPPRELQPMWHTA

SEQ ID NO: 876393 - protein, 25 aa, Mycobacterium
VVPGKPAVMVLPGPPRELQPMWHSA

SEQ ID NO: 876394 - protein, 24 aa, Mycobacterium
VVPGLVIPGKIDKLGYKGIDTTEL

SEQ ID NO: 876395 - protein, 17 aa, Mycobacterium
VVPGYMWGENLKGYFEH

SEQ ID NO: 876396 - protein, 25 aa, Mycobacterium
VVPIPAGWSFAAAASIPVAFLTAYG

SEQ ID NO: 876397 - protein, 24 aa, Mycobacterium
VVPIVPAAVIFDLPVGAWGARPTA

SEQ ID NO: 876398 - protein, 28 aa, Mycobacterium
VVPIVPAAVIFDLPVGGWRCRPDAAFGY

SEQ ID NO: 876399 - protein, 17 aa, Mycobacterium
VVPKLVGGTLRVLQMIE

SEQ ID NO: 876400 - protein, 17 aa, Mycobacterium
VVPKVDFRFSERAKRLF

SEQ ID NO: 876401 - protein, 17 aa, Mycobacterium
VVPLGIGAHLRKWGIPS

SEQ ID NO: 876402 - protein, 17 aa, Mycobacterium
VVPLLPAQDFKRVGEGD

SEQ ID NO: 876403 - protein, 29 aa, Mycobacterium
VVPLSFAQSRLWFIDQLHGPSPVYNMAAA

SEQ ID NO: 876404 - protein, 24 aa, Mycobacterium
VVPMQLCHHFAPAMVERGRGGIVL

SEQ ID NO: 876405 - protein, 18 aa, Mycobacterium
VVPNWMWHAHMNRSSEVD

SEQ ID NO: 876406 - protein, 18 aa, Mycobacterium
VVPPGDLRMALAALASDS

SEQ ID NO: 876407 - protein, 34 aa, Mycobacterium
VVPPIAEELAPAGGFLFIARGLGLPYASEGALKL

SEQ ID NO: 876408 - protein, 23 aa, Mycobacterium
VVPPISFGDALRYGLKPGDTLLI

SEQ ID NO: 876409 - protein, 24 aa, Mycobacterium
VVPPKPSASALRRVLRRARDGVAL

SEQ ID NO: 876410 - protein, 18 aa, Mycobacterium
VVPPLAPPPVVPPVVPPL

SEQ ID NO: 876411 - protein, 18 aa, Mycobacterium
VVPRRGGDKLAFAKGFMV

SEQ ID NO: 876412 - protein, 18 aa, Mycobacterium
VVPRRPVIRPVPVDDSGF

SEQ ID NO: 876413 - protein, 18 aa, Mycobacterium
VVPSLPVSSVLTIGLGKP

SEQ ID NO: 876414 - protein, 25 aa, Mycobacterium
VVPSSPADAYWLLRHAIACPDPVMY

SEQ ID NO: 876415 - protein, 23 aa, Mycobacterium
VVPTAALGGLGGAGGAGGNGGQL

SEQ ID NO: 876416 - protein, 19 aa, Mycobacterium
VVPTLPTASPRWVVDPDFN

SEQ ID NO: 876417 - protein, 20 aa, Mycobacterium
VVPVPGLRYTEAEWARMLAK

SEQ ID NO: 876418 - protein, 31 aa, Mycobacterium
VVPYDFALDRELWRWVPEHISLHLTRTPHVP

SEQ ID NO: 876419 - protein, 17 aa, Mycobacterium
VVQAALAVLLSKLTGSA

SEQ ID NO: 876420 - protein, 18 aa, Mycobacterium
VVQAYRNGITIQSAVRRA

SEQ ID NO: 876421 - protein, 27 aa, Mycobacterium
VVQGVAMLAAKTWWRGVKWSADVATTT

SEQ ID NO: 876422 - protein, 26 aa, Mycobacterium
VVQLGLATLLLLANPEQWALLVSQPD

SEQ ID NO: 876423 - protein, 25 aa, Mycobacterium
VVQLLLRVGVYARIKRAKKAGYRDC

SEQ ID NO: 876424 - protein, 28 aa, Mycobacterium
VVQMRAKYKRGFPISWLADEFGVHRNYV

SEQ ID NO: 876425 - protein, 25 aa, Mycobacterium
VVQNHLLQVLALVAMDPPVGPSADD

SEQ ID NO: 876426 - protein, 17 aa, Mycobacterium
VVQNHLLQVLALVTMEP

SEQ ID NO: 876427 - protein, 17 aa, Mycobacterium
VVQNKYGPWEWDGVLRA

SEQ ID NO: 876428 - protein, 25 aa, Mycobacterium
VVQPTPEWPLIVNLPATVEMATPNV

SEQ ID NO: 876429 - protein, 23 aa, Mycobacterium
VVQQVWMPYHWGGAGLVDGDVVN

SEQ ID NO: 876430 - protein, 32 aa, Mycobacterium
VVQRFPEAMVRPRWLWKFGKTLRPPDLRVPNQ

SEQ ID NO: 876431 - protein, 17 aa, Mycobacterium
VVQSALAVLLSKISASS

SEQ ID NO: 876432 - protein, 17 aa, Mycobacterium
VVQTALALLLAKLGATS

SEQ ID NO: 876433 - protein, 24 aa, Mycobacterium
VVQVKSSALLLQSALREGRAMHVP

SEQ ID NO: 876434 - protein, 30 aa, Mycobacterium
VVQVNRPLRGCYRIALLSLKGGVGKTTITA

SEQ ID NO: 876435 - protein, 18 aa, Mycobacterium
VVQVRRGAIPDCMAHWTL

SEQ ID NO: 876436 - protein, 25 aa, Mycobacterium
VVQWVPSHYWPAHSTVALAVDGRST

SEQ ID NO: 876437 - protein, 19 aa, Mycobacterium
VVQYWIDHGVKFFRVDNPH

SEQ ID NO: 876438 - protein, 17 aa, Mycobacterium
VVRAALPGLIADVSADA

SEQ ID NO: 876439 - protein, 21 aa, Mycobacterium
VVRAALSFLALPPADADEAAR

SEQ ID NO: 876440 - protein, 21 aa, Mycobacterium
VVRAALSYLALPPSDADEAAK

SEQ ID NO: 876441 - protein, 18 aa, Mycobacterium
VVRAPGRIGLLVFVATTD

SEQ ID NO: 876442 - protein, 19 aa, Mycobacterium
VVRAVGYRGLPTPGLPFDD

SEQ ID NO: 876443 - protein, 18 aa, Mycobacterium
VVRAVKGLGLPSDLIRVE

SEQ ID NO: 876444 - protein, 20 aa, Mycobacterium
VVRAVVLALADLFECEPSAA

SEQ ID NO: 876445 - protein, 21 aa, Mycobacterium
VVRDAWLPEDVAPGDLLAVAA

SEQ ID NO: 876446 - protein, 33 aa, Mycobacterium
VVRDLFGSLRFAVAFCYARFLRRGRKAPGFFVK

SEQ ID NO: 876447 - protein, 23 aa, Mycobacterium
VVREIVDRLLSGDTLRGITADLN

SEQ ID NO: 876448 - protein, 26 aa, Mycobacterium
VVREMGNGGLLLPLGVRRLRSHASTR

SEQ ID NO: 876449 - protein, 22 aa, Mycobacterium
VVREMVDRYLAGQSLRSLTIWL

SEQ ID NO: 876450 - protein, 17 aa, Mycobacterium
VVRFRGLLAGVLRSARL

SEQ ID NO: 876451 - protein, 18 aa, Mycobacterium
VVRGHQPVLWARLDSKPF

SEQ ID NO: 876452 - protein, 25 aa, Mycobacterium
VVRGPNVFAGYWGLPEATVQAFRGG

SEQ ID NO: 876453 - protein, 19 aa, Mycobacterium
VVRHLAHRVAVMNKGVIVE

SEQ ID NO: 876454 - protein, 25 aa, Mycobacterium
VVRISVPAKLIPLTGGYRAVMPGRV

SEQ ID NO: 876455 - protein, 30 aa, Mycobacterium
VVRITLPAKLIPFTGGYRAVLPGPVRALLE

SEQ ID NO: 876456 - protein, 17 aa, Mycobacterium
VVRLDGNKVEEGRAILA

SEQ ID NO: 876457 - protein, 19 aa, Mycobacterium
VVRLIALDPILIRDASTAT

SEQ ID NO: 876458 - protein, 17 aa, Mycobacterium
VVRLLDYMDRHGYTHAY

SEQ ID NO: 876459 - protein, 17 aa, Mycobacterium
VVRLLRITTDSPAVEAT

SEQ ID NO: 876460 - protein, 24 aa, Mycobacterium
VVRLPSPATAYRILRRLELTQPLF

SEQ ID NO: 876461 - protein, 18 aa, Mycobacterium
VVRLSPLVHSHLDHHGFA

SEQ ID NO: 876462 - protein, 21 aa, Mycobacterium
VVRLTGSRPELLLGGPVMSRL

SEQ ID NO: 876463 - protein, 26 aa, Mycobacterium
VVRPADRVIPLPPGISTRLAAGMLMK

SEQ ID NO: 876464 - protein, 19 aa, Mycobacterium
VVRPLRARAALARRYLAVE

SEQ ID NO: 876465 - protein, 24 aa, Mycobacterium
VVRPVVAELKRKFSVSAAETGSHE

SEQ ID NO: 876466 - protein, 19 aa, Mycobacterium
VVRPVVFLAYSGEARWRDS

SEQ ID NO: 876467 - protein, 19 aa, Mycobacterium
VVRPVVFMAYSGEARWRDS

SEQ ID NO: 876468 - protein, 26 aa, Mycobacterium
VVRREVIDILGLRKPVVIASGFDRPN

SEQ ID NO: 876469 - protein, 33 aa, Mycobacterium
VVRRGDTPLPVRTPLPVQLPEPMVEQLREAAAA

SEQ ID NO: 876470 - protein, 33 aa, Mycobacterium
VVRRGDTPLPVRTPLPVTLPEPMAAQLAAAQQQ

SEQ ID NO: 876471 - protein, 31 aa, Mycobacterium
VVRRGDTPLPVRTPLTVQLPEPMAQQLREAA

SEQ ID NO: 876472 - protein, 18 aa, Mycobacterium
VVRRLLAAGATIAGKSVC

SEQ ID NO: 876473 - protein, 25 aa, Mycobacterium
VVRRLNLPFRDVDWTEWGDLLQRVH

SEQ ID NO: 876474 - protein, 18 aa, Mycobacterium
VVRRRDLPIMYPLEVRFS

SEQ ID NO: 876475 - protein, 27 aa, Mycobacterium
VVRRSNALLDYAYGRRFEYAELMSTGR

SEQ ID NO: 876476 - protein, 17 aa, Mycobacterium
VVRRVCSPYYRLGQWVL

SEQ ID NO: 876477 - protein, 24 aa, Mycobacterium
VVRRYGMAFERPGPRLRDYVLAVK

SEQ ID NO: 876478 - protein, 25 aa, Mycobacterium
VVRRYGVAFERPGPRLRDYLFAVKA

SEQ ID NO: 876479 - protein, 26 aa, Mycobacterium
VVRSRGRLWLAHLPDMAVGLDSAGGG

SEQ ID NO: 876480 - protein, 17 aa, Mycobacterium
VVRSVGSGFLRGLGGPL

SEQ ID NO: 876481 - protein, 25 aa, Mycobacterium
VVRTRMFVTDITAWREIGSVHDEVF

SEQ ID NO: 876482 - protein, 17 aa, Mycobacterium
VVRVIGAIEIPVVAQEL

SEQ ID NO: 876483 - protein, 18 aa, Mycobacterium
VVRVLGAIEIPVVAQELA

SEQ ID NO: 876484 - protein, 24 aa, Mycobacterium
VVRVRALPNWLRVDARFGTVYLRR

SEQ ID NO: 876485 - protein, 32 aa, Mycobacterium
VVRVSELPFVLPIVELGFDYPDYLLAVVDHTG

SEQ ID NO: 876486 - protein, 17 aa, Mycobacterium
VVRVYLAAPDLQAGGFV

SEQ ID NO: 876487 - protein, 25 aa, Mycobacterium
VVSALEMTFFGALMHAGSGTFTYHQ

SEQ ID NO: 876488 - protein, 23 aa, Mycobacterium
VVSDAGMPLINDPGYRLVAACAE

SEQ ID NO: 876489 - protein, 24 aa, Mycobacterium
VVSDLIAWHWVGPSSAAMAAAATS

SEQ ID NO: 876490 - protein, 20 aa, Mycobacterium
VVSFTHFLQGPSATALLADL

SEQ ID NO: 876491 - protein, 27 aa, Mycobacterium
VVSGNPDYGMRLSWDFLARSTAGLRDW

SEQ ID NO: 876492 - protein, 18 aa, Mycobacterium
VVSGRWPDSTKEWAQLLM

SEQ ID NO: 876493 - protein, 26 aa, Mycobacterium
VVSHVTPIKMLLRLALDAGAGILYRL

SEQ ID NO: 876494 - protein, 27 aa, Mycobacterium
VVSHVTPIKMLLRLALEAGPGILYRLH

SEQ ID NO: 876495 - protein, 18 aa, Mycobacterium
VVSIDHVVLLSPNLTRTV

SEQ ID NO: 876496 - protein, 26 aa, Mycobacterium
VVSIGPILQIPGIRGALRSTSAPVIG

SEQ ID NO: 876497 - protein, 17 aa, Mycobacterium
VVSILPPPLARSAMTAF

SEQ ID NO: 876498 - protein, 17 aa, Mycobacterium
VVSLADVHYALAQRTLA

SEQ ID NO: 876499 - protein, 17 aa, Mycobacterium
VVSLDLDALRPLAGPQA

SEQ ID NO: 876500 - protein, 17 aa, Mycobacterium
VVSLIDCPGYMVGPAAE

SEQ ID NO: 876501 - protein, 19 aa, Mycobacterium
VVSLLAERGRIGEPIVGVC

SEQ ID NO: 876502 - protein, 18 aa, Mycobacterium
VVSLRRHLFDHLDGVDLK

SEQ ID NO: 876503 - protein, 27 aa, Mycobacterium
VVSLRRPALTRALLAYRHRRLPEARRA

SEQ ID NO: 876504 - protein, 23 aa, Mycobacterium
VVSNFVWQALSNAPLTIYGDGAQ

SEQ ID NO: 876505 - protein, 22 aa, Mycobacterium
VVSPYLVHKIQPGDLVRLGEIE

SEQ ID NO: 876506 - protein, 33 aa, Mycobacterium
VVSRARLQLTLAWTNVLLQRLAPAAAALKSFET

SEQ ID NO: 876507 - protein, 17 aa, Mycobacterium
VVSRYRDIRTALVDPRL

SEQ ID NO: 876508 - protein, 24 aa, Mycobacterium
VVSRYYNLVLADCGAGLFQKATRG

SEQ ID NO: 876509 - protein, 19 aa, Mycobacterium
VVSVSIIDPSARAARVVVP

SEQ ID NO: 876510 - protein, 23 aa, Mycobacterium
VVSWYDNEWGYSNRLADLVALVG

SEQ ID NO: 876511 - protein, 24 aa, Mycobacterium
VVSWYDNEWGYSNRLIDLVALVGK

SEQ ID NO: 876512 - protein, 23 aa, Mycobacterium
VVSWYDNEWGYSNRLVDLVALVG

SEQ ID NO: 876513 - protein, 19 aa, Mycobacterium
VVTADLWEQAPDAGFSSVM

SEQ ID NO: 876514 - protein, 22 aa, Mycobacterium
VVTAFPRRPALVAHSVARRAAQ

SEQ ID NO: 876515 - protein, 19 aa, Mycobacterium
VVTAIDIPLHRGRGIWKFV

SEQ ID NO: 876516 - protein, 24 aa, Mycobacterium
VVTEVTLRLLPPQNSPCTVVATFD

SEQ ID NO: 876517 - protein, 22 aa, Mycobacterium
VVTGWIEIIRYHALLAGCPSDE

SEQ ID NO: 876518 - protein, 18 aa, Mycobacterium
VVTGYRELLALAHDPRIS

SEQ ID NO: 876519 - protein, 24 aa, Mycobacterium
VVTGYWTMFKQNIGIMIAVAQLAA

SEQ ID NO: 876520 - protein, 19 aa, Mycobacterium
VVTHGMVLGRFLPPHAGHV

SEQ ID NO: 876521 - protein, 18 aa, Mycobacterium
VVTHLPQVAAYADAHLVV

SEQ ID NO: 876522 - protein, 25 aa, Mycobacterium
VVTHSVWFHQPLDVARWLRGRSMAC

SEQ ID NO: 876523 - protein, 24 aa, Mycobacterium
VVTLEPCNHFGRTPPCVDALIDAG

SEQ ID NO: 876524 - protein, 19 aa, Mycobacterium
VVTLWAPRWRDAGDEWEAF

SEQ ID NO: 876525 - protein, 23 aa, Mycobacterium
VVTMHLDRPFPGALLGTDGNVVP

SEQ ID NO: 876526 - protein, 18 aa, Mycobacterium
VVTNSATRWVWVNDAATP

SEQ ID NO: 876527 - protein, 19 aa, Mycobacterium
VVTNWRIATHPVAHSVSDL

SEQ ID NO: 876528 - protein, 19 aa, Mycobacterium
VVTPLGWVYPDLTNPKVQA

SEQ ID NO: 876529 - protein, 17 aa, Mycobacterium
VVTPLPPPVGRAAGLAP

SEQ ID NO: 876530 - protein, 26 aa, Mycobacterium
VVTPVGWLYPSERSGAPLREAALAGD

SEQ ID NO: 876531 - protein, 22 aa, Mycobacterium
VVTPVLDFALGLPGVDPDRVAL

SEQ ID NO: 876532 - protein, 25 aa, Mycobacterium
VVTSAALWMYAQPSASAIAAAEAEP

SEQ ID NO: 876533 - protein, 24 aa, Mycobacterium
VVTSPLLRCEQTVAPLAAALELIP

SEQ ID NO: 876534 - protein, 30 aa, Mycobacterium
VVTTLRRAGMIAPMRPDRYLKMAAAMRREG

SEQ ID NO: 876535 - protein, 24 aa, Mycobacterium
VVTTTDTWLVHRLCGAFVTDASTA

SEQ ID NO: 876536 - protein, 23 aa, Mycobacterium
VVTTTLQIPALRDLPLDEVLRKQ

SEQ ID NO: 876537 - protein, 26 aa, Mycobacterium
VVTTVGPYLRYGLPLVAACAAAGTDY

SEQ ID NO: 876538 - protein, 25 aa, Mycobacterium
VVTTVGPYMRYGLPLVAACAAAGTD

SEQ ID NO: 876539 - protein, 17 aa, Mycobacterium
VVTWRVPLGAGAVPHVA

SEQ ID NO: 876540 - protein, 25 aa, Mycobacterium
VVVASKILPVVPFPAVVKQRAQASA

SEQ ID NO: 876541 - protein, 18 aa, Mycobacterium
VVVAVRPGTNFTRTDSLN

SEQ ID NO: 876542 - protein, 19 aa, Mycobacterium
VVVAWPTAQIAVMGASGAV

SEQ ID NO: 876543 - protein, 32 aa, Mycobacterium
VVVCPGVVHVDLLPLAMALLRKGGICVLTGIT

SEQ ID NO: 876544 - protein, 22 aa, Mycobacterium
VVVDAGRWKPVMADLVPHVSDM

SEQ ID NO: 876545 - protein, 23 aa, Mycobacterium
VVVDALWQAFSSPTSMAALEILI

SEQ ID NO: 876546 - protein, 23 aa, Mycobacterium
VVVDGLRYGTAVRLGFGYDDIVA

SEQ ID NO: 876547 - protein, 18 aa, Mycobacterium
VVVDLETSGFQPGRARVI

SEQ ID NO: 876548 - protein, 21 aa, Mycobacterium
VVVDPEVGYFGTPLARNSLVT

SEQ ID NO: 876549 - protein, 17 aa, Mycobacterium
VVVDPRRIDLVRSPHIE

SEQ ID NO: 876550 - protein, 26 aa, Mycobacterium
VVVDWPHRYLAAQADLGLIDARTAIC

SEQ ID NO: 876551 - protein, 18 aa, Mycobacterium
VVVEWGEGLAERLSERHL

SEQ ID NO: 876552 - protein, 18 aa, Mycobacterium
VVVEWGEGLVERLAERHL

SEQ ID NO: 876553 - protein, 19 aa, Mycobacterium
VVVEWGEGLVERLAERHLD

SEQ ID NO: 876554 - protein, 17 aa, Mycobacterium
VVVGENFTFGKKAAGSV

SEQ ID NO: 876555 - protein, 17 aa, Mycobacterium
VVVGENFTFGKKATGNV

SEQ ID NO: 876556 - protein, 17 aa, Mycobacterium
VVVGLYPSWEISQDALD

SEQ ID NO: 876557 - protein, 23 aa, Mycobacterium
VVVHPPFRWQRRYAEGFAEQVAA

SEQ ID NO: 876558 - protein, 24 aa, Mycobacterium
VVVIGRGVTVGRPLGLLLTRRSEN

SEQ ID NO: 876559 - protein, 19 aa, Mycobacterium
VVVIGRGVTVGRPMGLLLT

SEQ ID NO: 876560 - protein, 21 aa, Mycobacterium
VVVILQALLDRHATLRLRAES

SEQ ID NO: 876561 - protein, 17 aa, Mycobacterium
VVVLACGPLGGARRALR

SEQ ID NO: 876562 - protein, 18 aa, Mycobacterium
VVVLDRANPFVAAVLRRL

SEQ ID NO: 876563 - protein, 20 aa, Mycobacterium
VVVLGLPRGGVPVAFEVARA

SEQ ID NO: 876564 - protein, 17 aa, Mycobacterium
VVVLGSGDLSRELAIAL

SEQ ID NO: 876565 - protein, 17 aa, Mycobacterium
VVVLLRDTFAEPERSRI

SEQ ID NO: 876566 - protein, 23 aa, Mycobacterium
VVVLQALLDRHAMLRLRAADTGD

SEQ ID NO: 876567 - protein, 20 aa, Mycobacterium
VVVLRDGGLILDKPIDDVSD

SEQ ID NO: 876568 - protein, 18 aa, Mycobacterium
VVVLRLSGELADHSASVV

SEQ ID NO: 876569 - protein, 17 aa, Mycobacterium
VVVLRTFSKAYGLAGLR

SEQ ID NO: 876570 - protein, 32 aa, Mycobacterium
VVVLTCGMFGNIIRLLPPLTIGDELLNEGLDI

SEQ ID NO: 876571 - protein, 17 aa, Mycobacterium
VVVLTRFAGFLADIGVE

SEQ ID NO: 876572 - protein, 18 aa, Mycobacterium
VVVPDRPAPKLAQSGLFQ

SEQ ID NO: 876573 - protein, 19 aa, Mycobacterium
VVVPLVNATMHVVAPDGTD

SEQ ID NO: 876574 - protein, 24 aa, Mycobacterium
VVVQEWIEGLPLAEIIRDGTREQR

SEQ ID NO: 876575 - protein, 21 aa, Mycobacterium
VVVRDLPALLYTRTPEYVRGA

SEQ ID NO: 876576 - protein, 24 aa, Mycobacterium
VVVRDLPVLLYTRTQEYVRGATGE

SEQ ID NO: 876577 - protein, 24 aa, Mycobacterium
VVVRELPALLYTRTPEYIRGATGE

SEQ ID NO: 876578 - protein, 25 aa, Mycobacterium
VVVRELPVLFYTRTPEYVRGAVGEI

SEQ ID NO: 876579 - protein, 18 aa, Mycobacterium
VVVRLDTHPAWRASDRRS

SEQ ID NO: 876580 - protein, 20 aa, Mycobacterium
VVVRMGFLPAPCRVVYVVDE

SEQ ID NO: 876581 - protein, 26 aa, Mycobacterium
VVVRPVSQLDPRLGQRRLRVLGAGRQ

SEQ ID NO: 876582 - protein, 20 aa, Mycobacterium
VVVSIFVNPLQFGAGEDLDA

SEQ ID NO: 876583 - protein, 24 aa, Mycobacterium
VVVSTPFRLVDLWQQHRAPIEEDF

SEQ ID NO: 876584 - protein, 30 aa, Mycobacterium
VVVSYRREALPRIQLWPFGPEGEYGEPEEI

SEQ ID NO: 876585 - protein, 25 aa, Mycobacterium
VVVTHDRWFLDTVATRTWEVVDGNV

SEQ ID NO: 876586 - protein, 25 aa, Mycobacterium
VVVTPTIPSIPLPFGLFLSSPEMQQ

SEQ ID NO: 876587 - protein, 17 aa, Mycobacterium
VVVVCDGRRLTFGQRIR

SEQ ID NO: 876588 - protein, 18 aa, Mycobacterium
VVVVDCGIGLKTELIRSV

SEQ ID NO: 876589 - protein, 18 aa, Mycobacterium
VVVVEHPGFFLSQDDDPA

SEQ ID NO: 876590 - protein, 19 aa, Mycobacterium
VVVVEWGEGLAERLSEHHL

SEQ ID NO: 876591 - protein, 23 aa, Mycobacterium
VVVVLQALLDRHPMLRLRVEDDG

SEQ ID NO: 876592 - protein, 29 aa, Mycobacterium
VVVVPTVPSIPLPFGLWIGSPQMQQGVAS

SEQ ID NO: 876593 - protein, 22 aa, Mycobacterium
VVVVRMGFLPAPCRVVYVVDEP

SEQ ID NO: 876594 - protein, 24 aa, Mycobacterium
VVVVSIFVNPLQFGPGEDLEAYPR

SEQ ID NO: 876595 - protein, 24 aa, Mycobacterium
VVVVSIFVNPLQFGPNEDLNAYPR

SEQ ID NO: 876596 - protein, 27 aa, Mycobacterium
VVVVTKNAYLRLYPDDVITARFVVING

SEQ ID NO: 876597 - protein, 20 aa, Mycobacterium
VVWALRRYGERQSGLTPLPQ

SEQ ID NO: 876598 - protein, 18 aa, Mycobacterium
VVWEADRGWFVTEPFSEP

SEQ ID NO: 876599 - protein, 26 aa, Mycobacterium
VVWFGAAAPLALLSSAAKAAGAAVTA

SEQ ID NO: 876600 - protein, 17 aa, Mycobacterium
VVWKPSELTPLTALATQ

SEQ ID NO: 876601 - protein, 18 aa, Mycobacterium
VVWTPTPTQWGNGFLELL

SEQ ID NO: 876602 - protein, 18 aa, Mycobacterium
VVWTVLMTSLSRFLVLEQ

SEQ ID NO: 876603 - protein, 18 aa, Mycobacterium
VVWVVIPAFNEAAVIAEV

SEQ ID NO: 876604 - protein, 24 aa, Mycobacterium
VVYATGYRPLDVRAFLGALASCYE

SEQ ID NO: 876605 - protein, 34 aa, Mycobacterium
VVYDDWNRAGSARAWWLLTTAGVANVRILDGGLG

SEQ ID NO: 876606 - protein, 21 aa, Mycobacterium
VVYDEPFWRADGLSGQSAAPG

SEQ ID NO: 876607 - protein, 22 aa, Mycobacterium
VVYDPWIEQTPLRIYSAEQLAE

SEQ ID NO: 876608 - protein, 28 aa, Mycobacterium
VVYEHPSMAPALRKTLGVPLFQEQLMQL

SEQ ID NO: 876609 - protein, 24 aa, Mycobacterium
VVYEPLMKRLPADVPVYGLERVEG

SEQ ID NO: 876610 - protein, 17 aa, Mycobacterium
VVYGYYDRPDATRDAYL

SEQ ID NO: 876611 - protein, 26 aa, Mycobacterium
VVYIHHLTGPRGLLIVVARSSPTLIS

SEQ ID NO: 876612 - protein, 18 aa, Mycobacterium
VVYPHHGAALIEAIETRT

SEQ ID NO: 876613 - protein, 28 aa, Mycobacterium
VVYRFIRDATWVSVRWFRPGGSRTAQEV

SEQ ID NO: 876614 - protein, 18 aa, Mycobacterium
VWAAECVYVPINYKLHPR

SEQ ID NO: 876615 - protein, 30 aa, Mycobacterium
VWAGSYPDRIIPCQLPWLLDPDVGAQMIYE

SEQ ID NO: 876616 - protein, 30 aa, Mycobacterium
VWATIGYDLPLPLPRISYADAMRRFGSDKP

SEQ ID NO: 876617 - protein, 18 aa, Mycobacterium
VWDFVEPLVRNDIRDADA

SEQ ID NO: 876618 - protein, 20 aa, Mycobacterium
VWDIRRLLSWIRLQEPESLI

SEQ ID NO: 876619 - protein, 25 aa, Mycobacterium
VWDNTLFIYIIGDNGAAPGGGLGGV

SEQ ID NO: 876620 - protein, 17 aa, Mycobacterium
VWEIFAPLLRGGRLVIV

SEQ ID NO: 876621 - protein, 21 aa, Mycobacterium
VWEKRATLSLLYAEKNHAPHG

SEQ ID NO: 876622 - protein, 19 aa, Mycobacterium
VWELETYGALFDRLKDGKI

SEQ ID NO: 876623 - protein, 18 aa, Mycobacterium
VWELETYGALFDRTKDGK

SEQ ID NO: 876624 - protein, 26 aa, Mycobacterium
VWEPGDEFLPFKPTAFRMLAMGKRPI

SEQ ID NO: 876625 - protein, 25 aa, Mycobacterium
VWEPGDEFLPFKPTAFRSLAMGHRP

SEQ ID NO: 876626 - protein, 27 aa, Mycobacterium
VWEPGDEFLPFKPTPFRSFAMGHRPIL

SEQ ID NO: 876627 - protein, 24 aa, Mycobacterium
VWERPYIAAGIFLYDQLGGAKSVP

SEQ ID NO: 876628 - protein, 18 aa, Mycobacterium
VWFEIHVNPLVDAENGLL

SEQ ID NO: 876629 - protein, 18 aa, Mycobacterium
VWFHAAADLSDWMLYDMA

SEQ ID NO: 876630 - protein, 18 aa, Mycobacterium
VWFRCRKHLPDDPVLHIC

SEQ ID NO: 876631 - protein, 18 aa, Mycobacterium
VWFRHLVSERPIGDGELV

SEQ ID NO: 876632 - protein, 18 aa, Mycobacterium
VWGAVPRVWEKLKAGIEF

SEQ ID NO: 876633 - protein, 29 aa, Mycobacterium
VWGEVIFPSLGMWGSTFRTPELLKACMRA

SEQ ID NO: 876634 - protein, 18 aa, Mycobacterium
VWGGVFTVMLAGTAVHVD

SEQ ID NO: 876635 - protein, 22 aa, Mycobacterium
VWGKRRLAYEIAKHTEGIYAVI

SEQ ID NO: 876636 - protein, 34 aa, Mycobacterium
VWHAVTSIFRDYGYRRLRSKARLKFLVKDWGVEK

SEQ ID NO: 876637 - protein, 19 aa, Mycobacterium
VWHETGLGPSFWVSDELAG

SEQ ID NO: 876638 - protein, 17 aa, Mycobacterium
VWHGQVHDFPLAADILP

SEQ ID NO: 876639 - protein, 24 aa, Mycobacterium
VWHPVDGWMSATWFQGPAAEFIEQ

SEQ ID NO: 876640 - protein, 20 aa, Mycobacterium
VWIGHDWGAAVVWNAPLLHP

SEQ ID NO: 876641 - protein, 19 aa, Mycobacterium
VWIKGFGEQVPFKTPTYAE

SEQ ID NO: 876642 - protein, 24 aa, Mycobacterium
VWINDWHMVNAMYPFGGVKQSGLG

SEQ ID NO: 876643 - protein, 26 aa, Mycobacterium
VWIVTPNGRFTIAAYAAPKSAGLWRE

SEQ ID NO: 876644 - protein, 19 aa, Mycobacterium
VWKSVKAAVPHLLAGGNGG

SEQ ID NO: 876645 - protein, 23 aa, Mycobacterium
VWLARRGLHVWGIDVSPVAITQA

SEQ ID NO: 876646 - protein, 18 aa, Mycobacterium
VWLGIAMHTTPGVPEFLD

SEQ ID NO: 876647 - protein, 18 aa, Mycobacterium
VWLNGVVDAYLRLGALVT

SEQ ID NO: 876648 - protein, 27 aa, Mycobacterium
VWLSDRYPKPLLRPVPSWFRELTYKPA

SEQ ID NO: 876649 - protein, 32 aa, Mycobacterium
VWLSPTSAFTASPFRWLSWLSESRATITAAPN

SEQ ID NO: 876650 - protein, 19 aa, Mycobacterium
VWLVIPAYNEGPVIADVIA

SEQ ID NO: 876651 - protein, 18 aa, Mycobacterium
VWPDGPWDTLGTRPHLAV

SEQ ID NO: 876652 - protein, 25 aa, Mycobacterium
VWQCASLLLSYPDDASLDAAARLLE

SEQ ID NO: 876653 - protein, 20 aa, Mycobacterium
VWQGLYEFIRARHGVALFSS

SEQ ID NO: 876654 - protein, 18 aa, Mycobacterium
VWQGYYCFAAELISPTSS

SEQ ID NO: 876655 - protein, 18 aa, Mycobacterium
VWQTYLKNKPGRNRYWVV

SEQ ID NO: 876656 - protein, 21 aa, Mycobacterium
VWRARICEIEGLLSHAVVVGE

SEQ ID NO: 876657 - protein, 22 aa, Mycobacterium
VWRGLAGLGVTGLLVPEDCGGS

SEQ ID NO: 876658 - protein, 26 aa, Mycobacterium
VWRLLTEPDLLRLWWAEGDVAAVVGH

SEQ ID NO: 876659 - protein, 17 aa, Mycobacterium
VWRTFAHERLEAMAGAA

SEQ ID NO: 876660 - protein, 18 aa, Mycobacterium
VWRTFGQDRLDAMAGVAT

SEQ ID NO: 876661 - protein, 18 aa, Mycobacterium
VWSDVGVFPILGMDWHDR

SEQ ID NO: 876662 - protein, 24 aa, Mycobacterium
VWSERWRQRWAPATPVPVTTGSGS

SEQ ID NO: 876663 - protein, 17 aa, Mycobacterium
VWSGGSYVRRPLSVPFR

SEQ ID NO: 876664 - protein, 31 aa, Mycobacterium
VWSMAAKLPPGWPMLVASWLAQAEGARGNAE

SEQ ID NO: 876665 - protein, 18 aa, Mycobacterium
VWSNLVMTARLRAPELLL

SEQ ID NO: 876666 - protein, 24 aa, Mycobacterium
VWSQWHSLVFDVSVWEIWGALLHG

SEQ ID NO: 876667 - protein, 24 aa, Mycobacterium
VWSRHLGRPLAADSSLLGAGIGSL

SEQ ID NO: 876668 - protein, 19 aa, Mycobacterium
VWTIELFHRNGYESVRWWH

SEQ ID NO: 876669 - protein, 27 aa, Mycobacterium
VWTQFHSYAFDFSVWEIWGALLHGGRL

SEQ ID NO: 876670 - protein, 29 aa, Mycobacterium
VWTRDTDGWFWLGRIAGPYFYDADEQAAA

SEQ ID NO: 876671 - protein, 25 aa, Mycobacterium
VWTSGAHLAHAFIVLARTAPLDPER

SEQ ID NO: 876672 - protein, 25 aa, Mycobacterium
VWTSGAHLAHAFIVLARTAPVDPTD

SEQ ID NO: 876673 - protein, 21 aa, Mycobacterium
VWTSLAHWAQWCFVVARTEKG

SEQ ID NO: 876674 - protein, 18 aa, Mycobacterium
VWVRGVGLGMDRVMHQHK

SEQ ID NO: 876675 - protein, 26 aa, Mycobacterium
VWVVTPNGRFTIAAYAAPKSAGLWRE

SEQ ID NO: 876676 - protein, 27 aa, Mycobacterium
VWVVTPNGRFTIAAYAAPKTAGLWREV

SEQ ID NO: 876677 - protein, 26 aa, Mycobacterium
VWVVTPNGRFTIAAYAAPKTGGLWRE

SEQ ID NO: 876678 - protein, 18 aa, Mycobacterium
VWYNRILPFAHNLSERRI

SEQ ID NO: 876679 - protein, 18 aa, Mycobacterium
VWYPQPPPVAHPWRTMPN

SEQ ID NO: 876680 - protein, 18 aa, Mycobacterium
VYAATRAVLPVLQSWLAR

SEQ ID NO: 876681 - protein, 21 aa, Mycobacterium
VYACPFAIHDKFLAGNILSDG

SEQ ID NO: 876682 - protein, 20 aa, Mycobacterium
VYACPFAIHDKFLAGNILTS

SEQ ID NO: 876683 - protein, 29 aa, Mycobacterium
VYAEMSAINPVFLLRGALSARAADLARAF

SEQ ID NO: 876684 - protein, 29 aa, Mycobacterium
VYAHIPDLLGFTRALRRLLADDGWLSIEV

SEQ ID NO: 876685 - protein, 17 aa, Mycobacterium
VYALYRAARDDGAGELA

SEQ ID NO: 876686 - protein, 18 aa, Mycobacterium
VYANLLAPHSIRVNSLHP

SEQ ID NO: 876687 - protein, 17 aa, Mycobacterium
VYAPAISPLVRLAETDA

SEQ ID NO: 876688 - protein, 19 aa, Mycobacterium
VYARETVGFALAIDGRVHS

SEQ ID NO: 876689 - protein, 17 aa, Mycobacterium
VYARRLAVAGVPTELHV

SEQ ID NO: 876690 - protein, 25 aa, Mycobacterium
VYARTAHWVGSYDWVLSALGADVHV

SEQ ID NO: 876691 - protein, 26 aa, Mycobacterium
VYARVNPFGFIETPYRKVSDGVVTDD

SEQ ID NO: 876692 - protein, 25 aa, Mycobacterium
VYARVNPFGFIETPYRKVVDGVVTD

SEQ ID NO: 876693 - protein, 18 aa, Mycobacterium
VYASLFTCGIAVPHMIAS

SEQ ID NO: 876694 - protein, 18 aa, Mycobacterium
VYAVLNLYPYNPGHLMVV

SEQ ID NO: 876695 - protein, 20 aa, Mycobacterium
VYAWAAGRFVLHARTYRVDG

SEQ ID NO: 876696 - protein, 19 aa, Mycobacterium
VYCCAILDCFSRMIVARTF

SEQ ID NO: 876697 - protein, 21 aa, Mycobacterium
VYDEPFWRSDGLSGQSAAPGS

SEQ ID NO: 876698 - protein, 17 aa, Mycobacterium
VYDGQLLPNVGFNAVVG

SEQ ID NO: 876699 - protein, 17 aa, Mycobacterium
VYDLVRRLRRRTGIDFD

SEQ ID NO: 876700 - protein, 26 aa, Mycobacterium
VYDPNFRPRLTTAEDARALLLEIAPR

SEQ ID NO: 876701 - protein, 23 aa, Mycobacterium
VYDQDLLRDLLRTGANRSTMSGS

SEQ ID NO: 876702 - protein, 25 aa, Mycobacterium
VYDRFMRYLTGCAGLFRKGISSVAQ

SEQ ID NO: 876703 - protein, 25 aa, Mycobacterium
VYDRFMRYLTGCANLFRKGISNVAQ

SEQ ID NO: 876704 - protein, 22 aa, Mycobacterium
VYDSAGLLWRRDLHAETGLSPN

SEQ ID NO: 876705 - protein, 20 aa, Mycobacterium
VYDSAVGWARRFVDGPPRAL

SEQ ID NO: 876706 - protein, 25 aa, Mycobacterium
VYDTSYANDWHYLPGPITGQVGVDP

SEQ ID NO: 876707 - protein, 18 aa, Mycobacterium
VYEALLAHKGIRGLVVCC

SEQ ID NO: 876708 - protein, 18 aa, Mycobacterium
VYERAVLIRDSRLGKEMV

SEQ ID NO: 876709 - protein, 21 aa, Mycobacterium
VYERAVLIRTPALGKEMVAAM

SEQ ID NO: 876710 - protein, 25 aa, Mycobacterium
VYETDLLRPVIDLVAARAPRGYDAG

SEQ ID NO: 876711 - protein, 20 aa, Mycobacterium
VYFDSPISPFGSWAELTQLD

SEQ ID NO: 876712 - protein, 29 aa, Mycobacterium
VYFELRLADAWVWDMYRPARFVKQVRVIT

SEQ ID NO: 876713 - protein, 26 aa, Mycobacterium
VYFTTPHFDGYPIVLIRLAAIEPDEL

SEQ ID NO: 876714 - protein, 21 aa, Mycobacterium
VYFVERLVDCLAYELKMDPAQ

SEQ ID NO: 876715 - protein, 18 aa, Mycobacterium
VYGDPVWSPPGRGCVSVT

SEQ ID NO: 876716 - protein, 24 aa, Mycobacterium
VYGEKIVKVMDLAIKTGRPLIGIN

SEQ ID NO: 876717 - protein, 25 aa, Mycobacterium
VYGERVFVGYRWYDARALEVTFPFG

SEQ ID NO: 876718 - protein, 24 aa, Mycobacterium
VYGFTAMLINLIRDEQPSHIAAAF

SEQ ID NO: 876719 - protein, 17 aa, Mycobacterium
VYGGLILEQAQLRGTDS

SEQ ID NO: 876720 - protein, 18 aa, Mycobacterium
VYGHSWFVDAARGLSVLL

SEQ ID NO: 876721 - protein, 17 aa, Mycobacterium
VYGIGGSWFRYAGNGQW

SEQ ID NO: 876722 - protein, 22 aa, Mycobacterium
VYGLMLQHRRPRPWLICVHGAE

SEQ ID NO: 876723 - protein, 29 aa, Mycobacterium
VYGQFAARPFGMLFGFAGYHAFTHRPTYR

SEQ ID NO: 876724 - protein, 18 aa, Mycobacterium
VYGSWNLHRASTGQPLDW

SEQ ID NO: 876725 - protein, 20 aa, Mycobacterium
VYGVPTMFIAMQNHPDFAER

SEQ ID NO: 876726 - protein, 17 aa, Mycobacterium
VYHAVALQAKAIHDAST

SEQ ID NO: 876727 - protein, 20 aa, Mycobacterium
VYHYYASKSLILFDIYRQAA

SEQ ID NO: 876728 - protein, 17 aa, Mycobacterium
VYIDHRVTPGPPRPGYL

SEQ ID NO: 876729 - protein, 21 aa, Mycobacterium
VYIVTAIPRSPLGKVLRRELP

SEQ ID NO: 876730 - protein, 24 aa, Mycobacterium
VYKGMLTTMQLPQYFLDLRDERCQ

SEQ ID NO: 876731 - protein, 18 aa, Mycobacterium
VYKMPWGTMHPTTISAPI

SEQ ID NO: 876732 - protein, 17 aa, Mycobacterium
VYKMPWGTMHPTTITAP

SEQ ID NO: 876733 - protein, 26 aa, Mycobacterium
VYLAPMGDFPLYLDLFAARHGFGPRI

SEQ ID NO: 876734 - protein, 17 aa, Mycobacterium
VYLAPPGYGEMFAALGF

SEQ ID NO: 876735 - protein, 28 aa, Mycobacterium
VYLDARAIGNFAIRFPTITAACAAAGID

SEQ ID NO: 876736 - protein, 24 aa, Mycobacterium
VYLDGELYITGRVKDLVIIDGRNH

SEQ ID NO: 876737 - protein, 28 aa, Mycobacterium
VYLHTARWTSLGLSLIEAMYLGMPVVAV

SEQ ID NO: 876738 - protein, 24 aa, Mycobacterium
VYLSPAPLYHTAPSFWSMVVQSLG

SEQ ID NO: 876739 - protein, 17 aa, Mycobacterium
VYLTLRGQPYLVSVAKP

SEQ ID NO: 876740 - protein, 17 aa, Mycobacterium
VYMMADCFDLTLDEVRF

SEQ ID NO: 876741 - protein, 29 aa, Mycobacterium
VYNAVLKRYWYHAWWFYAHSIVRGGIDKV

SEQ ID NO: 876742 - protein, 29 aa, Mycobacterium
VYNAVLKRYWYHAWWFYPHSIVRGGIDKV

SEQ ID NO: 876743 - protein, 17 aa, Mycobacterium
VYNIPVVLHLHGPWTPK

SEQ ID NO: 876744 - protein, 25 aa, Mycobacterium
VYPDGPAPYYGIYAAGRWGSLDAQW

SEQ ID NO: 876745 - protein, 25 aa, Mycobacterium
VYPHKPDMAAWLNQWAREFARNTPD

SEQ ID NO: 876746 - protein, 20 aa, Mycobacterium
VYPPGLEMVAAFYACARIGV

SEQ ID NO: 876747 - protein, 18 aa, Mycobacterium
VYPTALKIALGTATRTLE

SEQ ID NO: 876748 - protein, 18 aa, Mycobacterium
VYPTCHYVMGGIPTNIHG

SEQ ID NO: 876749 - protein, 20 aa, Mycobacterium
VYQDLAVVPALDIASNLYLG

SEQ ID NO: 876750 - protein, 17 aa, Mycobacterium
VYQHRRWYHQFYVDAAD

SEQ ID NO: 876751 - protein, 25 aa, Mycobacterium
VYQKYRAIFDWYDSLLVCLTATPKD

SEQ ID NO: 876752 - protein, 18 aa, Mycobacterium
VYQLRRWYQQFYVDVADI

SEQ ID NO: 876753 - protein, 18 aa, Mycobacterium
VYQMRRWYQQFYVDVADV

SEQ ID NO: 876754 - protein, 32 aa, Mycobacterium
VYQRRAIWVFAKPDFPIPRAARWALKYIPGLQ

SEQ ID NO: 876755 - protein, 17 aa, Mycobacterium
VYQRTAAGELPLPRCTR

SEQ ID NO: 876756 - protein, 18 aa, Mycobacterium
VYQRYMKYLTGCAQLFRD

SEQ ID NO: 876757 - protein, 25 aa, Mycobacterium
VYQVDHECLRLRWVSDEWPVYQCRI

SEQ ID NO: 876758 - protein, 23 aa, Mycobacterium
VYRAFSRPLNGVGAALLAPAPQP

SEQ ID NO: 876759 - protein, 19 aa, Mycobacterium
VYRAGERRVPRLEPTPLPA

SEQ ID NO: 876760 - protein, 18 aa, Mycobacterium
VYRALLLRVASGTPAAIV

SEQ ID NO: 876761 - protein, 19 aa, Mycobacterium
VYRARAVILAMGAAPRYLG

SEQ ID NO: 876762 - protein, 18 aa, Mycobacterium
VYRDETAPLLDFYSADLK

SEQ ID NO: 876763 - protein, 24 aa, Mycobacterium
VYRDETAPLLEYYSSQLKTVDAVG

SEQ ID NO: 876764 - protein, 24 aa, Mycobacterium
VYRDRGLLPPPLRVGRIALFNDTH

SEQ ID NO: 876765 - protein, 26 aa, Mycobacterium
VYREELTRIFYGPYWHPIAHRAELAE

SEQ ID NO: 876766 - protein, 17 aa, Mycobacterium
VYRFRPDERPLGEAEGA

SEQ ID NO: 876767 - protein, 20 aa, Mycobacterium
VYRHWASVDDLLIDALAAAC

SEQ ID NO: 876768 - protein, 27 aa, Mycobacterium
VYRLGTRLVPRLRWRPVTTEPVTLSSD

SEQ ID NO: 876769 - protein, 23 aa, Mycobacterium
VYRPADVLIWATGFDVNHQLGPI

SEQ ID NO: 876770 - protein, 24 aa, Mycobacterium
VYRQEMIRMFGLAESGLAETLRAA

SEQ ID NO: 876771 - protein, 17 aa, Mycobacterium
VYRVAAKLRLMADELIE

SEQ ID NO: 876772 - protein, 21 aa, Mycobacterium
VYRYLAGIFRRGLENEDLANR

SEQ ID NO: 876773 - protein, 18 aa, Mycobacterium
VYSIARPAAVLTPEHYYR

SEQ ID NO: 876774 - protein, 18 aa, Mycobacterium
VYSIRSPLGAAIAGARPG

SEQ ID NO: 876775 - protein, 28 aa, Mycobacterium
VYSLYDDARLLVHAIRRVWQLTEFRMLT

SEQ ID NO: 876776 - protein, 18 aa, Mycobacterium
VYSPLDALTIARDNPDRQ

SEQ ID NO: 876777 - protein, 17 aa, Mycobacterium
VYSSADILSAERRILAA

SEQ ID NO: 876778 - protein, 22 aa, Mycobacterium
VYSWVLEYRKDLAVRLSELDLL

SEQ ID NO: 876779 - protein, 26 aa, Mycobacterium
VYTDKGFLVLAERPGSWDPACIPLRY

SEQ ID NO: 876780 - protein, 25 aa, Mycobacterium
VYTLSSGWINDIWAGADPLNPIYGI

SEQ ID NO: 876781 - protein, 18 aa, Mycobacterium
VYTPAVGPLVRMVDTDAD

SEQ ID NO: 876782 - protein, 19 aa, Mycobacterium
VYTPPDDPGWRTVLPQDFS

SEQ ID NO: 876783 - protein, 19 aa, Mycobacterium
VYTPPWIWHRHYADDGRDV

SEQ ID NO: 876784 - protein, 22 aa, Mycobacterium
VYTREDLLKEVWHWDFGDLSTV

SEQ ID NO: 876785 - protein, 33 aa, Mycobacterium
VYTRLLQLAWRTLPDRILLIPLARNRIEYEKLV

SEQ ID NO: 876786 - protein, 22 aa, Mycobacterium
VYVADGTYFYRVGPDGSLDTVG

SEQ ID NO: 876787 - protein, 23 aa, Mycobacterium
VYVDAGHLRWHSAEDMAARLKQA

SEQ ID NO: 876788 - protein, 19 aa, Mycobacterium
VYVDLLPPCNAGCPAGENI

SEQ ID NO: 876789 - protein, 25 aa, Mycobacterium
VYVHRLRKYIGAYIATLGGADVISF

SEQ ID NO: 876790 - protein, 17 aa, Mycobacterium
VYVPEGVGHGFLALEDD

SEQ ID NO: 876791 - protein, 20 aa, Mycobacterium
VYVRATRVPPIAGAAPAVPD

SEQ ID NO: 876792 - protein, 19 aa, Mycobacterium
VYVRSFYFQDPDGITLEFA

SEQ ID NO: 876793 - protein, 22 aa, Mycobacterium
VYVVSLAQYFLGDPAAVVAHGS

SEQ ID NO: 876794 - protein, 20 aa, Mycobacterium
VYVWTPLGEQKVSAYFAICP

SEQ ID NO: 876795 - protein, 17 aa, Mycobacterium
VYWHNTSRLHSYLADVP

SEQ ID NO: 876796 - protein, 18 aa, Mycobacterium
VYWHSLTVLRQAIDLEDD

SEQ ID NO: 876797 - protein, 21 aa, Mycobacterium
VYYCVVDARMWLRDPTPLFRT

SEQ ID NO: 876798 - protein, 17 aa, Mycobacterium
VYYMMADARLRKLIRQL

SEQ ID NO: 876799 - protein, 17 aa, Mycobacterium
VYYQVVPEVLDALAGIV

SEQ ID NO: 876800 - protein, 21 aa, Mycobacterium
VYYRAMFSGRVTSWNLRDKHM

SEQ ID NO: 876801 - protein, 19 aa, Mycobacterium
WAAAALAGGRALLSSGRRA

SEQ ID NO: 876802 - protein, 31 aa, Mycobacterium
WAAADRQRLATLIRLFLLGTDEPRDRVGRAV

SEQ ID NO: 876803 - protein, 17 aa, Mycobacterium
WAAAQPWCDGNVGMIGI

SEQ ID NO: 876804 - protein, 18 aa, Mycobacterium
WAAAQPWCDGNVGMIGIS

SEQ ID NO: 876805 - protein, 26 aa, Mycobacterium
WAAARRADILFGATVAVIGLGAVGLC

SEQ ID NO: 876806 - protein, 33 aa, Mycobacterium
WAADLPGTQWQHRRFWRTPTPPPGTAALHDPAS

SEQ ID NO: 876807 - protein, 23 aa, Mycobacterium
WAAEGLFGYLPPDAQDRLLDHIT

SEQ ID NO: 876808 - protein, 24 aa, Mycobacterium
WAAEGLIGFLPPEAQDRLLDNITE

SEQ ID NO: 876809 - protein, 17 aa, Mycobacterium
WAAFIATRRNHHAAAAG

SEQ ID NO: 876810 - protein, 28 aa, Mycobacterium
WAAFTVHAALFLRPGGRMALVLPAELLS

SEQ ID NO: 876811 - protein, 17 aa, Mycobacterium
WAAHPELVAGRMALTGF

SEQ ID NO: 876812 - protein, 17 aa, Mycobacterium
WAAIEDIGRLRDGVGVA

SEQ ID NO: 876813 - protein, 21 aa, Mycobacterium
WAAMYLGTPRTPEGGLIKAAW

SEQ ID NO: 876814 - protein, 25 aa, Mycobacterium
WAAPPLPPLPPLPPLPRGSGVAPPA

SEQ ID NO: 876815 - protein, 21 aa, Mycobacterium
WAAQGWLHRIVDPRSDQNVCY

SEQ ID NO: 876816 - protein, 24 aa, Mycobacterium
WAAVAFERLFLFIRDRRKDLQANL

SEQ ID NO: 876817 - protein, 18 aa, Mycobacterium
WAAVHGVAALLITKPHLP

SEQ ID NO: 876818 - protein, 18 aa, Mycobacterium
WAAWNPQRRARVFMKFIQ

SEQ ID NO: 876819 - protein, 23 aa, Mycobacterium
WACGVTVVLPPPGTVGAVDCRGG

SEQ ID NO: 876820 - protein, 23 aa, Mycobacterium
WACLYCFFGRVGCMIQPVARHKT

SEQ ID NO: 876821 - protein, 19 aa, Mycobacterium
WACNPRWRNAATSPTSSPS

SEQ ID NO: 876822 - protein, 17 aa, Mycobacterium
WADAVIFGSPTRFGSVA

SEQ ID NO: 876823 - protein, 18 aa, Mycobacterium
WADHLAFLSDIRESIHLR

SEQ ID NO: 876824 - protein, 26 aa, Mycobacterium
WADLAEAALAIRAGALWVAANVDLTL

SEQ ID NO: 876825 - protein, 17 aa, Mycobacterium
WADLARAYRIPFARLDA

SEQ ID NO: 876826 - protein, 20 aa, Mycobacterium
WADMLAIWKAADNIDVFESG

SEQ ID NO: 876827 - protein, 20 aa, Mycobacterium
WADRGLRVIGLDAGGDTTLD

SEQ ID NO: 876828 - protein, 40 aa, Mycobacterium
WAEFEFHRLLNHVADRPKLAWFLLQAVRYTPHQLFAEDAS

SEQ ID NO: 876829 - protein, 21 aa, Mycobacterium
WAESRRYLGLDVLSKSRADHT

SEQ ID NO: 876830 - protein, 18 aa, Mycobacterium
WAEYLRPDELHLGFNFRL

SEQ ID NO: 876831 - protein, 20 aa, Mycobacterium
WAGAAVLRPDFQRALVSLSR

SEQ ID NO: 876832 - protein, 17 aa, Mycobacterium
WAGLAMAAARLGLGPLR

SEQ ID NO: 876833 - protein, 31 aa, Mycobacterium
WAGPYPERIIPCQLPWLLDPSAGAQLIHENA

SEQ ID NO: 876834 - protein, 26 aa, Mycobacterium
WAGQMDVAALRWLITDRGATSMFVPT

SEQ ID NO: 876835 - protein, 23 aa, Mycobacterium
WAGRPMRCHLFAFGVSYDGPIRH

SEQ ID NO: 876836 - protein, 17 aa, Mycobacterium
WAGSTLVGVGVARLDPA

SEQ ID NO: 876837 - protein, 30 aa, Mycobacterium
WAGSYPDRFIPIAILPTWTPEGMCNEIRRV

SEQ ID NO: 876838 - protein, 32 aa, Mycobacterium
WAGSYPERIIPCQLPWLLDPDLGARMIYENAE

SEQ ID NO: 876839 - protein, 18 aa, Mycobacterium
WAGTGFRRARTGSVADIV

SEQ ID NO: 876840 - protein, 36 aa, Mycobacterium
WAGVAAPVMIWSIAHAAWPLGRFWPVVSRPRMRGHD

SEQ ID NO: 876841 - protein, 19 aa, Mycobacterium
WAGVYRGAGARRVPLPTYA

SEQ ID NO: 876842 - protein, 17 aa, Mycobacterium
WAHAGIVPVLPADIAEL

SEQ ID NO: 876843 - protein, 17 aa, Mycobacterium
WAHGPQIDKGARWDPAE

SEQ ID NO: 876844 - protein, 19 aa, Mycobacterium
WAHYALKAPVMLVHNPDAV

SEQ ID NO: 876845 - protein, 17 aa, Mycobacterium
WAHYVGQEKIRPLTGFQ

SEQ ID NO: 876846 - protein, 18 aa, Mycobacterium
WAHYVRNGLRFPGEKGTT

SEQ ID NO: 876847 - protein, 26 aa, Mycobacterium
WAIGRVTPNTGWLPRAILDDDGFVRV

SEQ ID NO: 876848 - protein, 19 aa, Mycobacterium
WAILVVWELRSGTKTLPEL

SEQ ID NO: 876849 - protein, 18 aa, Mycobacterium
WAIRSMGVENVSHGCISL

SEQ ID NO: 876850 - protein, 21 aa, Mycobacterium
WAKASLITPEQYPAAVAAASR

SEQ ID NO: 876851 - protein, 19 aa, Mycobacterium
WAKKFYPDGLGGSAAELAA

SEQ ID NO: 876852 - protein, 30 aa, Mycobacterium
WAKSLTQRTILRLLDFSISAAGVMRAEKIL

SEQ ID NO: 876853 - protein, 20 aa, Mycobacterium
WAKVTRRSMMPPRSYAFIDG

SEQ ID NO: 876854 - protein, 17 aa, Mycobacterium
WALAGLWEGAVTVVLRD

SEQ ID NO: 876855 - protein, 26 aa, Mycobacterium
WALAHPDRTLAVLAALPAWSGRPESA

SEQ ID NO: 876856 - protein, 19 aa, Mycobacterium
WALDNWQWRTRGARLAELL

SEQ ID NO: 876857 - protein, 33 aa, Mycobacterium
WALDTAAGVPLVFLTAFYGLSDLAGVRAGQKVL

SEQ ID NO: 876858 - protein, 18 aa, Mycobacterium
WALLDARVSDGWWYATSA

SEQ ID NO: 876859 - protein, 17 aa, Mycobacterium
WALVLGALTGRDDVVFG

SEQ ID NO: 876860 - protein, 19 aa, Mycobacterium
WALVRVGCAGRLVYSPAVR

SEQ ID NO: 876861 - protein, 26 aa, Mycobacterium
WAMGEYPYHDLYMLENARQFVPLMRN

SEQ ID NO: 876862 - protein, 18 aa, Mycobacterium
WAMQRGVPHVLLADALAE

SEQ ID NO: 876863 - protein, 17 aa, Mycobacterium
WAMVGVTPMIGVNDDPR

SEQ ID NO: 876864 - protein, 17 aa, Mycobacterium
WANAIPGGARPPLRGFP

SEQ ID NO: 876865 - protein, 20 aa, Mycobacterium
WANRTIIVRRLLGLEDALSI

SEQ ID NO: 876866 - protein, 26 aa, Mycobacterium
WANVRPVKFLPGVLSPLRNADDHELD

SEQ ID NO: 876867 - protein, 18 aa, Mycobacterium
WAPKSGGALAYRALAREF

SEQ ID NO: 876868 - protein, 27 aa, Mycobacterium
WAPLPVQYIDYTLWQQARLGDLDDPGS

SEQ ID NO: 876869 - protein, 20 aa, Mycobacterium
WAPLRVQYADYAAWQRTFLG

SEQ ID NO: 876870 - protein, 29 aa, Mycobacterium
WAPQFGMYGIQRIHLLRNVMILAGAGVGG

SEQ ID NO: 876871 - protein, 18 aa, Mycobacterium
WAPRPAAEPIAAPLPPTL

SEQ ID NO: 876872 - protein, 26 aa, Mycobacterium
WAPTAYPVEFLSLGSAGLGVPVRATI

SEQ ID NO: 876873 - protein, 19 aa, Mycobacterium
WAPVLETQIADHVTIGITT

SEQ ID NO: 876874 - protein, 26 aa, Mycobacterium
WAPVPLLSVALYRKYRPATFAEVVGQ

SEQ ID NO: 876875 - protein, 21 aa, Mycobacterium
WAQAAQLPLALLTPDMRDRQI

SEQ ID NO: 876876 - protein, 24 aa, Mycobacterium
WAQDALAMYGYAASSAAAGTLNPL

SEQ ID NO: 876877 - protein, 24 aa, Mycobacterium
WAQDVAAMFGYHSGASAVAAALSP

SEQ ID NO: 876878 - protein, 26 aa, Mycobacterium
WAQHMSILSLFYRWAMDEGYAEAEPF

SEQ ID NO: 876879 - protein, 28 aa, Mycobacterium
WAQLPEWPQMLLRALMFRLAVHALHPRS

SEQ ID NO: 876880 - protein, 17 aa, Mycobacterium
WAQLPTLAMLEHVLIGC

SEQ ID NO: 876881 - protein, 19 aa, Mycobacterium
WAQLQLPRVPGMEPLVMGG

SEQ ID NO: 876882 - protein, 18 aa, Mycobacterium
WAQMLAVWQAADDIDVYE

SEQ ID NO: 876883 - protein, 18 aa, Mycobacterium
WAQWHSLVFDVSVHEIFG

SEQ ID NO: 876884 - protein, 18 aa, Mycobacterium
WAQWRAVQAPALLIEAGN

SEQ ID NO: 876885 - protein, 22 aa, Mycobacterium
WARDYWIAFDKFRRLDRVHTIQ

SEQ ID NO: 876886 - protein, 24 aa, Mycobacterium
WARDYWISFDRLRALDRVRTVHGA

SEQ ID NO: 876887 - protein, 23 aa, Mycobacterium
WARGRGWALWKALVSLRGHLEAG

SEQ ID NO: 876888 - protein, 26 aa, Mycobacterium
WARILVYEPPHRVVFSWDIGPTWQLE

SEQ ID NO: 876889 - protein, 17 aa, Mycobacterium
WARLPRANSTDIDRAVR

SEQ ID NO: 876890 - protein, 18 aa, Mycobacterium
WARNSGGLLLVTHDRWFL

SEQ ID NO: 876891 - protein, 30 aa, Mycobacterium
WARNTGGLLLVTHDRWFLDEVATTTWEVHD

SEQ ID NO: 876892 - protein, 27 aa, Mycobacterium
WARQDFPALAPAIRVPVRFSIAEHEKV

SEQ ID NO: 876893 - protein, 28 aa, Mycobacterium
WARQGEWHQALYGAGFFGTSWPKEFGGQ

SEQ ID NO: 876894 - protein, 17 aa, Mycobacterium
WARTVLALGMDTIDDEV

SEQ ID NO: 876895 - protein, 18 aa, Mycobacterium
WASLMFASIYLGMQQRIL

SEQ ID NO: 876896 - protein, 20 aa, Mycobacterium
WASMAYRLLNPSAGQITGDE

SEQ ID NO: 876897 - protein, 19 aa, Mycobacterium
WASYAPKPVALPDGSVKAS

SEQ ID NO: 876898 - protein, 33 aa, Mycobacterium
WATDLSVNLNGPFFLCRAALPHLLETGGNIVNV

SEQ ID NO: 876899 - protein, 19 aa, Mycobacterium
WATHRVPFLAAVEQGPLSA

SEQ ID NO: 876900 - protein, 30 aa, Mycobacterium
WATLDGARLLIWTTTPWTLPSNLAVAVNPE

SEQ ID NO: 876901 - protein, 29 aa, Mycobacterium
WATLPEWPQMLLRALIFRLAVHALHPRSS

SEQ ID NO: 876902 - protein, 27 aa, Mycobacterium
WAVAHPACWALLYGSPVPGYHAPPERT

SEQ ID NO: 876903 - protein, 30 aa, Mycobacterium
WAVALGYLTNVLFGRPLVSIGFAQPSWAQF

SEQ ID NO: 876904 - protein, 18 aa, Mycobacterium
WAVAYKYPPEEAQTRLLD

SEQ ID NO: 876905 - protein, 17 aa, Mycobacterium
WAVAYKYPPQEAQTKLL

SEQ ID NO: 876906 - protein, 18 aa, Mycobacterium
WAVNLRGRVRFAEAVRAA

SEQ ID NO: 876907 - protein, 17 aa, Mycobacterium
WAVTVTRTQRDKPLIMN

SEQ ID NO: 876908 - protein, 25 aa, Mycobacterium
WAWRRLRIPVIALIHGRCYGGGLQL

SEQ ID NO: 876909 - protein, 24 aa, Mycobacterium
WAYIGAEDITLPSIYYAHQRKVFG

SEQ ID NO: 876910 - protein, 17 aa, Mycobacterium
WAYQQLGVMPDVVSFGK

SEQ ID NO: 876911 - protein, 17 aa, Mycobacterium
WAYRDLIREQIGPWLAE

SEQ ID NO: 876912 - protein, 25 aa, Mycobacterium
WAYVNSNYFLLGMIVSIVNGRPTRD

SEQ ID NO: 876913 - protein, 20 aa, Mycobacterium
WCARQRGPVAESLLALGLPG

SEQ ID NO: 876914 - protein, 18 aa, Mycobacterium
WCAWMPAIARLFPEAKVI

SEQ ID NO: 876915 - protein, 17 aa, Mycobacterium
WCDAEVLRILRRRSLAA

SEQ ID NO: 876916 - protein, 17 aa, Mycobacterium
WCERVWTPKHVRQIAEA

SEQ ID NO: 876917 - protein, 18 aa, Mycobacterium
WCFATAETRQWWGGMWAD

SEQ ID NO: 876918 - protein, 26 aa, Mycobacterium
WCGYCHRLMSVLKSNGIPYEAVDIEH

SEQ ID NO: 876919 - protein, 17 aa, Mycobacterium
WCKAINQIGWTSPEPRG

SEQ ID NO: 876920 - protein, 17 aa, Mycobacterium
WCLAHHRESFLYTHFDE

SEQ ID NO: 876921 - protein, 25 aa, Mycobacterium
WCMTLGIELLLAADIRIAAAGTRFT

SEQ ID NO: 876922 - protein, 24 aa, Mycobacterium
WCMTLGIELLLASDIRIAAAGTRF

SEQ ID NO: 876923 - protein, 17 aa, Mycobacterium
WCPFAAPPGLAQTAGTA

SEQ ID NO: 876924 - protein, 17 aa, Mycobacterium
WCPFPAPPQLAQTAGTA

SEQ ID NO: 876925 - protein, 29 aa, Mycobacterium
WCRQEDIYNPLRFLKAGLTWCRKAQALGT

SEQ ID NO: 876926 - protein, 19 aa, Mycobacterium
WCSGPCRWSCWPARSAPTP

SEQ ID NO: 876927 - protein, 19 aa, Mycobacterium
WDAAAFCLVDKRSLHLTYG

SEQ ID NO: 876928 - protein, 22 aa, Mycobacterium
WDAAAFGLIDKRSLHLSFGEFS

SEQ ID NO: 876929 - protein, 20 aa, Mycobacterium
WDAATAPAWARPLLDDHRNL

SEQ ID NO: 876930 - protein, 17 aa, Mycobacterium
WDAAYTDRPLGAGLPDG

SEQ ID NO: 876931 - protein, 20 aa, Mycobacterium
WDAGLWDRLGQLGLTRLTGS

SEQ ID NO: 876932 - protein, 20 aa, Mycobacterium
WDAIEMAFYRGQLSDDEFEQ

SEQ ID NO: 876933 - protein, 29 aa, Mycobacterium
WDAPQEATPPWLQMTKPIICAVNGIACGA

SEQ ID NO: 876934 - protein, 26 aa, Mycobacterium
WDAQGLRLATKLTPWPAVDGERIAAV

SEQ ID NO: 876935 - protein, 19 aa, Mycobacterium
WDARMEVLPLLPKSKKRVI

SEQ ID NO: 876936 - protein, 25 aa, Mycobacterium
WDAVIGVNLTGTWRTLRATVPAMIE

SEQ ID NO: 876937 - protein, 17 aa, Mycobacterium
WDAWVVQGLADGRLVVL

SEQ ID NO: 876938 - protein, 18 aa, Mycobacterium
WDAYRRRYRNIQRLDRIL

SEQ ID NO: 876939 - protein, 22 aa, Mycobacterium
WDCQHLITERLIDYIRTSVSHA

SEQ ID NO: 876940 - protein, 21 aa, Mycobacterium
WDCYFIDGLGKIEGFPDGAFV

SEQ ID NO: 876941 - protein, 18 aa, Mycobacterium
WDDGAGQPWFAGGTVLVL

SEQ ID NO: 876942 - protein, 21 aa, Mycobacterium
WDDLGLRPHLAVAAGRVGAVS

SEQ ID NO: 876943 - protein, 21 aa, Mycobacterium
WDDLSWLRSLTELPLIVKGIC

SEQ ID NO: 876944 - protein, 24 aa, Mycobacterium
WDDVRLQRRQEMLVYIAMSRFGRR

SEQ ID NO: 876945 - protein, 21 aa, Mycobacterium
WDELIPLMRAEGFIPPHTEVS

SEQ ID NO: 876946 - protein, 20 aa, Mycobacterium
WDELKAMWRADARGLDLDRD

SEQ ID NO: 876947 - protein, 21 aa, Mycobacterium
WDELKTMWRADARGLDLDRDA

SEQ ID NO: 876948 - protein, 25 aa, Mycobacterium
WDFPIKEFHPFPRALLGVGAHDIIG

SEQ ID NO: 876949 - protein, 24 aa, Mycobacterium
WDGPGYFGPLTQPLPMSLRRHQRW

SEQ ID NO: 876950 - protein, 23 aa, Mycobacterium
WDGPRGYRKVIESLPLGANVATL

SEQ ID NO: 876951 - protein, 25 aa, Mycobacterium
WDGRPWTYRQRICAAPPDSLLAEAD

SEQ ID NO: 876952 - protein, 24 aa, Mycobacterium
WDGSTPWLIHGYDAIRALFTDSRT

SEQ ID NO: 876953 - protein, 18 aa, Mycobacterium
WDGTIRLVAYIQADLDSH

SEQ ID NO: 876954 - protein, 18 aa, Mycobacterium
WDGTIRLVAYIQADLDSQ

SEQ ID NO: 876955 - protein, 17 aa, Mycobacterium
WDGTMRLVAYIQADLDS

SEQ ID NO: 876956 - protein, 18 aa, Mycobacterium
WDGTMRLVAYIQADLDST

SEQ ID NO: 876957 - protein, 20 aa, Mycobacterium
WDHIAPLLSSTHRIVAPDLS

SEQ ID NO: 876958 - protein, 19 aa, Mycobacterium
WDHNPRWKGIKRDYTPEDV

SEQ ID NO: 876959 - protein, 19 aa, Mycobacterium
WDHNPRWKGITRTYTPQDV

SEQ ID NO: 876960 - protein, 17 aa, Mycobacterium
WDIDIVALSSIVHREDY

SEQ ID NO: 876961 - protein, 19 aa, Mycobacterium
WDIEALTTTYYRGVITAPH

SEQ ID NO: 876962 - protein, 31 aa, Mycobacterium
WDIGVRAPVLFRRTKLTAAMPTPLYGGDVSQ

SEQ ID NO: 876963 - protein, 18 aa, Mycobacterium
WDIRRLISWIRMQEPESL

SEQ ID NO: 876964 - protein, 30 aa, Mycobacterium
WDIVSSVGYTALLVAGWRALHALSPQPLVR

SEQ ID NO: 876965 - protein, 30 aa, Mycobacterium
WDIVSSVGYTALLVAGWRALHAVGPQPLVR

SEQ ID NO: 876966 - protein, 27 aa, Mycobacterium
WDIWKQRLERVLPRRPDFVFASEPYGE

SEQ ID NO: 876967 - protein, 36 aa, Mycobacterium
WDKPSFAKEIFLGRFPLELIHPFPKPSEAEEARIEA

SEQ ID NO: 876968 - protein, 26 aa, Mycobacterium
WDKQGLRLAQTLTPWPATDGQRIAAA

SEQ ID NO: 876969 - protein, 21 aa, Mycobacterium
WDKRFLGKHLITAHPMGGCAT

SEQ ID NO: 876970 - protein, 20 aa, Mycobacterium
WDLAGLFNPDPDVPGACYTR

SEQ ID NO: 876971 - protein, 19 aa, Mycobacterium
WDLAKATLAALVARHSVEL

SEQ ID NO: 876972 - protein, 27 aa, Mycobacterium
WDLELIGRIGWTCRDVWWAATQDPRSW

SEQ ID NO: 876973 - protein, 17 aa, Mycobacterium
WDLFKYPGIRSDSDMCT

SEQ ID NO: 876974 - protein, 17 aa, Mycobacterium
WDLFRYPGIRSDSDMHT

SEQ ID NO: 876975 - protein, 18 aa, Mycobacterium
WDLGAIQKVFETANGRAN

SEQ ID NO: 876976 - protein, 18 aa, Mycobacterium
WDLLRLTRMPTVQVDIGY

SEQ ID NO: 876977 - protein, 22 aa, Mycobacterium
WDLLRQRRALRDSGGDPREAEV

SEQ ID NO: 876978 - protein, 22 aa, Mycobacterium
WDLLRQRRALRESGGDPREAEV

SEQ ID NO: 876979 - protein, 22 aa, Mycobacterium
WDLLRQRRALRETGGDPREAHL

SEQ ID NO: 876980 - protein, 18 aa, Mycobacterium
WDLRRLVASIWVAGRHNG

SEQ ID NO: 876981 - protein, 17 aa, Mycobacterium
WDLRRSEILQRRGWIVV

SEQ ID NO: 876982 - protein, 19 aa, Mycobacterium
WDLVRDGIFVGYQLDRVFA

SEQ ID NO: 876983 - protein, 19 aa, Mycobacterium
WDMMGALLGRPVDLVPCES

SEQ ID NO: 876984 - protein, 19 aa, Mycobacterium
WDMRIPTGPLNSWLKEVVA

SEQ ID NO: 876985 - protein, 20 aa, Mycobacterium
WDNVRACHPVFAGDTLYASS

SEQ ID NO: 876986 - protein, 18 aa, Mycobacterium
WDPACIPLHHLVTADGEE

SEQ ID NO: 876987 - protein, 22 aa, Mycobacterium
WDPACIPLRYLVTEDGAEADDT

SEQ ID NO: 876988 - protein, 21 aa, Mycobacterium
WDPAELRLVVADLLAKSRPSV

SEQ ID NO: 876989 - protein, 21 aa, Mycobacterium
WDPAILVMPHGGFIELTVIND

SEQ ID NO: 876990 - protein, 19 aa, Mycobacterium
WDPLATLGFLAARTARIRL

SEQ ID NO: 876991 - protein, 25 aa, Mycobacterium
WDQASLLVQVGLLSADLLPVAGVAQ

SEQ ID NO: 876992 - protein, 36 aa, Mycobacterium
WDQDPDVLDTWFSSALWPFSTLGWPEKTPELEKFYP

SEQ ID NO: 876993 - protein, 24 aa, Mycobacterium
WDQFVRFATRLFGEQLGTIAYEYQ

SEQ ID NO: 876994 - protein, 26 aa, Mycobacterium
WDREIKRPWFLLNNLDNTEALAKAEV

SEQ ID NO: 876995 - protein, 18 aa, Mycobacterium
WDRLEKTVLLGELSLDGR

SEQ ID NO: 876996 - protein, 18 aa, Mycobacterium
WDRLFSQQPEIFDYLKEV

SEQ ID NO: 876997 - protein, 18 aa, Mycobacterium
WDRLLPIVQRKRAAGASR

SEQ ID NO: 876998 - protein, 21 aa, Mycobacterium
WDRMTLAQWLRKNLVSKAAHD

SEQ ID NO: 876999 - protein, 28 aa, Mycobacterium
WDRNYVHSLDWLWLTEPLSEGPGESWIH

SEQ ID NO: 877000 - protein, 17 aa, Mycobacterium
WDRVDNDPDIRCCILTG

SEQ ID NO: 877001 - protein, 17 aa, Mycobacterium
WDRVLNVTLTSVMRATR

SEQ ID NO: 877002 - protein, 18 aa, Mycobacterium
WDSLWVYDHFHTVPVPTG

SEQ ID NO: 877003 - protein, 29 aa, Mycobacterium
WDSTAQRGAIIWFTGLPASGKSTIAVAVE

SEQ ID NO: 877004 - protein, 19 aa, Mycobacterium
WDTARLVPLLAGLNELAPW

SEQ ID NO: 877005 - protein, 32 aa, Mycobacterium
WDTELDSILRNLGVRHLFLCGVNVDQCVYATL

SEQ ID NO: 877006 - protein, 25 aa, Mycobacterium
WDTPRRIEMSFVAATTDMLAAAGAD

SEQ ID NO: 877007 - protein, 19 aa, Mycobacterium
WDTTLVEAFLRGPMHGPVS

SEQ ID NO: 877008 - protein, 22 aa, Mycobacterium
WDTVQARIKWLMADKSKDYDDI

SEQ ID NO: 877009 - protein, 23 aa, Mycobacterium
WDTVQARIKWLMADKSKDYDDIV

SEQ ID NO: 877010 - protein, 21 aa, Mycobacterium
WDTVVDVNLNGTWRTIRAAVP

SEQ ID NO: 877011 - protein, 17 aa, Mycobacterium
WDVASLIRLVDTAHTRA

SEQ ID NO: 877012 - protein, 18 aa, Mycobacterium
WDVAVAEVGLPIAKVWGL

SEQ ID NO: 877013 - protein, 18 aa, Mycobacterium
WDVEAFFDPDPSTPGKVV

SEQ ID NO: 877014 - protein, 18 aa, Mycobacterium
WDVIGDTGIGFCLDTCHA

SEQ ID NO: 877015 - protein, 18 aa, Mycobacterium
WDVKRLVTSMAILGHDFG

SEQ ID NO: 877016 - protein, 19 aa, Mycobacterium
WDVLGAPVALPFGIAPTGF

SEQ ID NO: 877017 - protein, 18 aa, Mycobacterium
WDVLGQPVVLPFGIAPTG

SEQ ID NO: 877018 - protein, 27 aa, Mycobacterium
WDVPKHEGLTMFLVPIDHPGITLRRIT

SEQ ID NO: 877019 - protein, 28 aa, Mycobacterium
WDVPKHKGITFFIVPMKQPGIEIRPLVQ

SEQ ID NO: 877020 - protein, 26 aa, Mycobacterium
WDVRASFLPAIYFEGVGMAGGIASLL

SEQ ID NO: 877021 - protein, 18 aa, Mycobacterium
WDVSLGSHYARDLLIGGA

SEQ ID NO: 877022 - protein, 19 aa, Mycobacterium
WDWHGFPGARYRFDPPSGA

SEQ ID NO: 877023 - protein, 25 aa, Mycobacterium
WDYTFRLNVGAYFHLAKAAVPHMNP

SEQ ID NO: 877024 - protein, 31 aa, Mycobacterium
WDYTFRLNVGAYFYLAKAALPYLNAGSSIIG

SEQ ID NO: 877025 - protein, 31 aa, Mycobacterium
WDYTQLRFPKRQGMRIDFILASPALADRVTD

SEQ ID NO: 877026 - protein, 18 aa, Mycobacterium
WEAIALHTCFGIAERRGP

SEQ ID NO: 877027 - protein, 19 aa, Mycobacterium
WEAIKQAWGGCAYCGATGG

SEQ ID NO: 877028 - protein, 17 aa, Mycobacterium
WEALSAEGAERLAHLQF

SEQ ID NO: 877029 - protein, 18 aa, Mycobacterium
WEATLIEGLHDGAAAVIC

SEQ ID NO: 877030 - protein, 22 aa, Mycobacterium
WEATNISIFRYAGDNHWASEED

SEQ ID NO: 877031 - protein, 43 aa, Mycobacterium
WEAVTSIFRDYGYRRLRSKARLKFLIKDWGIEKFREVLETEYL

SEQ ID NO: 877032 - protein, 26 aa, Mycobacterium
WECDKTIYRAGWLRAGIVCPGQLGTA

SEQ ID NO: 877033 - protein, 18 aa, Mycobacterium
WECQDILVAVTRWTVRLE

SEQ ID NO: 877034 - protein, 19 aa, Mycobacterium
WEDAYAYAKFARIVLDTND

SEQ ID NO: 877035 - protein, 18 aa, Mycobacterium
WEDGGYGLIEWKMDLELG

SEQ ID NO: 877036 - protein, 24 aa, Mycobacterium
WEDIDWVRSITKMPVILKGIQHPD

SEQ ID NO: 877037 - protein, 25 aa, Mycobacterium
WEEIDLPSYGLTWKWPEVDCAHPLD

SEQ ID NO: 877038 - protein, 18 aa, Mycobacterium
WEEILGRPVLDPDADFFR

SEQ ID NO: 877039 - protein, 19 aa, Mycobacterium
WEERPLAVIVAKEGASVTA

SEQ ID NO: 877040 - protein, 18 aa, Mycobacterium
WEEYLRDVLAARPHRYDL

SEQ ID NO: 877041 - protein, 20 aa, Mycobacterium
WEFDGPDLFGWIATVPSPVK

SEQ ID NO: 877042 - protein, 20 aa, Mycobacterium
WEFESMPAAMRFLTSESPMH

SEQ ID NO: 877043 - protein, 25 aa, Mycobacterium
WEFPTKFDAICKPEWIPEGTRVVNE

SEQ ID NO: 877044 - protein, 18 aa, Mycobacterium
WEFRQLCLSDPAAAIRQV

SEQ ID NO: 877045 - protein, 21 aa, Mycobacterium
WEGEDGVIAWMLAGPEHTYQV

SEQ ID NO: 877046 - protein, 24 aa, Mycobacterium
WEGKAGEYLAIPPERHALHAIEDS

SEQ ID NO: 877047 - protein, 25 aa, Mycobacterium
WEGPPPEFMETFRAGLADLKRKGNA

SEQ ID NO: 877048 - protein, 24 aa, Mycobacterium
WEGRYRPFEPALRWSTEQASQSDH

SEQ ID NO: 877049 - protein, 25 aa, Mycobacterium
WEGSPLAALKRPGSFLARQVPQFLR

SEQ ID NO: 877050 - protein, 18 aa, Mycobacterium
WEGSWDDGALLRDRERGI

SEQ ID NO: 877051 - protein, 23 aa, Mycobacterium
WEHDAHLYIRRATVLQAFAGDQD

SEQ ID NO: 877052 - protein, 33 aa, Mycobacterium
WEHDAHLYLKRLLGWSAFLGGPDRYLTEIGARL

SEQ ID NO: 877053 - protein, 27 aa, Mycobacterium
WEHDLHLYLRRVTLYRAMFGTPEEHNR

SEQ ID NO: 877054 - protein, 20 aa, Mycobacterium
WEHFQDFFADAGYRTVAVSL

SEQ ID NO: 877055 - protein, 17 aa, Mycobacterium
WEHGRRNFGLRDEGVLA

SEQ ID NO: 877056 - protein, 17 aa, Mycobacterium
WEHTVGDKLWAPTFVRD

SEQ ID NO: 877057 - protein, 20 aa, Mycobacterium
WEHWDRCAFHWFPGNHLLHV

SEQ ID NO: 877058 - protein, 19 aa, Mycobacterium
WEIAVLHRDHHAPDGAGVR

SEQ ID NO: 877059 - protein, 17 aa, Mycobacterium
WEIGPAGPFDRWPTGLG

SEQ ID NO: 877060 - protein, 17 aa, Mycobacterium
WEIIDRCLQLHGGYGYI

SEQ ID NO: 877061 - protein, 18 aa, Mycobacterium
WEILLRLAGAVLGTAVPD

SEQ ID NO: 877062 - protein, 18 aa, Mycobacterium
WEINEAFAAVPLKTMRDL

SEQ ID NO: 877063 - protein, 25 aa, Mycobacterium
WEIPRVHVTILRRAATGPMEVIYER

SEQ ID NO: 877064 - protein, 20 aa, Mycobacterium
WEKPIELADVLDVGLRSAYV

SEQ ID NO: 877065 - protein, 18 aa, Mycobacterium
WELFKKERPDTAPDEIVR

SEQ ID NO: 877066 - protein, 20 aa, Mycobacterium
WELGVPRRDLHALAAQLGSD

SEQ ID NO: 877067 - protein, 18 aa, Mycobacterium
WELLAGAPIGRLVTNFEG

SEQ ID NO: 877068 - protein, 25 aa, Mycobacterium
WELQRGDVYFIPRAYPHHIEVVHAP

SEQ ID NO: 877069 - protein, 17 aa, Mycobacterium
WELTRVRLYNDGSRRVL

SEQ ID NO: 877070 - protein, 33 aa, Mycobacterium
WEMCTIGDPLLDLGWLLATWRQSDGASVFGHAL

SEQ ID NO: 877071 - protein, 29 aa, Mycobacterium
WEMNWHTPKLLAEFGFLYDSTLMDSDHPY

SEQ ID NO: 877072 - protein, 27 aa, Mycobacterium
WEMTTIGDPLLDLAWSLLGYDGEEPRA

SEQ ID NO: 877073 - protein, 23 aa, Mycobacterium
WENAFFQMRNQSYALGWSGAGGD

SEQ ID NO: 877074 - protein, 19 aa, Mycobacterium
WENYSGWFHHRSTTELYPV

SEQ ID NO: 877075 - protein, 24 aa, Mycobacterium
WEPADLSVTLRDYFADRDPERGFS

SEQ ID NO: 877076 - protein, 20 aa, Mycobacterium
WEPGTAQGYHMTTFGFILGE

SEQ ID NO: 877077 - protein, 18 aa, Mycobacterium
WEPKIPLGRMGRPEELTG

SEQ ID NO: 877078 - protein, 21 aa, Mycobacterium
WEPKRLRLHLFSIAARITRHA

SEQ ID NO: 877079 - protein, 19 aa, Mycobacterium
WEPSYFHRDALYPTKYKIP

SEQ ID NO: 877080 - protein, 23 aa, Mycobacterium
WEPTVPALMQLVAATAAPRLRSA

SEQ ID NO: 877081 - protein, 33 aa, Mycobacterium
WEQDPDVLDTWFSSALWPFSTLGWPDKTPELEK

SEQ ID NO: 877082 - protein, 36 aa, Mycobacterium
WEQDPDVLDTWFSSALWPFSTLGWPETTPELEKFYP

SEQ ID NO: 877083 - protein, 37 aa, Mycobacterium
WEQDSDVLDTWFSSALWPFSTLGWPELTPELEKFYPT

SEQ ID NO: 877084 - protein, 26 aa, Mycobacterium
WERAGRPHLASWLRDPLPVKQPRPGA

SEQ ID NO: 877085 - protein, 17 aa, Mycobacterium
WERFAALPFSEVRKATF

SEQ ID NO: 877086 - protein, 18 aa, Mycobacterium
WERGRPMELWQMDVVGGV

SEQ ID NO: 877087 - protein, 32 aa, Mycobacterium
WERNPERVWGWYLWRHYLVADVAPNPGHQAIA

SEQ ID NO: 877088 - protein, 18 aa, Mycobacterium
WERPYVAAGIFLYDQLGG

SEQ ID NO: 877089 - protein, 18 aa, Mycobacterium
WERRWPDLGLSVGAPADG

SEQ ID NO: 877090 - protein, 19 aa, Mycobacterium
WERTWSVLATSLNVTGLSA

SEQ ID NO: 877091 - protein, 17 aa, Mycobacterium
WESCRCPRAGPPPPPAI

SEQ ID NO: 877092 - protein, 21 aa, Mycobacterium
WESDIQLYFKRAHGSAQLLPP

SEQ ID NO: 877093 - protein, 21 aa, Mycobacterium
WESMVSALVDWWRHHPERSAD

SEQ ID NO: 877094 - protein, 17 aa, Mycobacterium
WETPLLNFIREVTADID

SEQ ID NO: 877095 - protein, 25 aa, Mycobacterium
WETRTRLLVVRAGFPAPQTQLVVRN

SEQ ID NO: 877096 - protein, 26 aa, Mycobacterium
WETTADTPFPYYGGVRLPDQAQFNPA

SEQ ID NO: 877097 - protein, 21 aa, Mycobacterium
WETVQARIKWLMADKSKDYDD

SEQ ID NO: 877098 - protein, 25 aa, Mycobacterium
WEVRGEPQHFLYSKLMCWVALDRAI

SEQ ID NO: 877099 - protein, 25 aa, Mycobacterium
WEWDSAAPAGVLWAAGLHASRLDGS

SEQ ID NO: 877100 - protein, 24 aa, Mycobacterium
WEWNPALLALRGELERVFLAGVRR

SEQ ID NO: 877101 - protein, 25 aa, Mycobacterium
WEWPEHPRFLMCTPLSHAGAAFFTP

SEQ ID NO: 877102 - protein, 24 aa, Mycobacterium
WEWPERPKFLMCTPLSHAGAAFFM

SEQ ID NO: 877103 - protein, 30 aa, Mycobacterium
WEWTASPLRPWPGFAPMIYQRYSQPFFDGD

SEQ ID NO: 877104 - protein, 30 aa, Mycobacterium
WEWTSSPLRPWPGFVPMLYERYSQPFFDGD

SEQ ID NO: 877105 - protein, 18 aa, Mycobacterium
WEWTVDWYTDTPSARPAA

SEQ ID NO: 877106 - protein, 17 aa, Mycobacterium
WEWVLDDEFGQHVVSSL

SEQ ID NO: 877107 - protein, 18 aa, Mycobacterium
WEYLDKGPEVWRIRITKL

SEQ ID NO: 877108 - protein, 18 aa, Mycobacterium
WEYRFGDRHTAMTVLACG

SEQ ID NO: 877109 - protein, 19 aa, Mycobacterium
WFAHGVTPVLMNLCRSYRL

SEQ ID NO: 877110 - protein, 18 aa, Mycobacterium
WFATRDVAMLDEDGYLFI

SEQ ID NO: 877111 - protein, 17 aa, Mycobacterium
WFDDAGVNIVYLTAPVL

SEQ ID NO: 877112 - protein, 18 aa, Mycobacterium
WFDDEAVYGPDGLALPMR

SEQ ID NO: 877113 - protein, 17 aa, Mycobacterium
WFEADPTYVLHFPNAFE

SEQ ID NO: 877114 - protein, 18 aa, Mycobacterium
WFEAQACDGFVLAATHMP

SEQ ID NO: 877115 - protein, 30 aa, Mycobacterium
WFEQGAALRYITRLLLRLGADDDAAFLHCA

SEQ ID NO: 877116 - protein, 26 aa, Mycobacterium
WFEQLRGFDAIFFGAVGWPELVPDHI

SEQ ID NO: 877117 - protein, 19 aa, Mycobacterium
WFERLNLKDVTLFVQDWGS

SEQ ID NO: 877118 - protein, 18 aa, Mycobacterium
WFEVLKPMSSECAGREIA

SEQ ID NO: 877119 - protein, 19 aa, Mycobacterium
WFFAFPMGSHTDEPIFWSD

SEQ ID NO: 877120 - protein, 19 aa, Mycobacterium
WFGRDHRVVWLAGESVETG

SEQ ID NO: 877121 - protein, 17 aa, Mycobacterium
WFHYHQMFAEFLRRRLE

SEQ ID NO: 877122 - protein, 17 aa, Mycobacterium
WFIKVTEFRDRMVQLNE

SEQ ID NO: 877123 - protein, 17 aa, Mycobacterium
WFLERGGRTLLTFTADP

SEQ ID NO: 877124 - protein, 18 aa, Mycobacterium
WFLPTYGDSRHIVGGGHG

SEQ ID NO: 877125 - protein, 17 aa, Mycobacterium
WFMVGWSPEFPVGEVRP

SEQ ID NO: 877126 - protein, 17 aa, Mycobacterium
WFNARWVAVAMQNRAQR

SEQ ID NO: 877127 - protein, 18 aa, Mycobacterium
WFNRQPAFRRRLAELPSA

SEQ ID NO: 877128 - protein, 27 aa, Mycobacterium
WFNSGTINSGWFNKGTNDFGLAHSGEL

SEQ ID NO: 877129 - protein, 17 aa, Mycobacterium
WFPTKDIAMLDDEGYLF

SEQ ID NO: 877130 - protein, 18 aa, Mycobacterium
WFPTKDIAMLDEDGYLFI

SEQ ID NO: 877131 - protein, 18 aa, Mycobacterium
WFQLYMWRDRDRSMALVK

SEQ ID NO: 877132 - protein, 18 aa, Mycobacterium
WFQLYMWRDRERSMELVR

SEQ ID NO: 877133 - protein, 24 aa, Mycobacterium
WFQSKWAPYQLADADWRIRAVNSA

SEQ ID NO: 877134 - protein, 20 aa, Mycobacterium
WFRREFGVWLTPQTGNFLFG

SEQ ID NO: 877135 - protein, 19 aa, Mycobacterium
WFRSYFGVPDSITSPDGRP

SEQ ID NO: 877136 - protein, 20 aa, Mycobacterium
WFRSYFGVPSSITAPDGRPV

SEQ ID NO: 877137 - protein, 18 aa, Mycobacterium
WFRTVTPRHYPIPTDGPA

SEQ ID NO: 877138 - protein, 17 aa, Mycobacterium
WFTGQLQGPSPVYNMAA

SEQ ID NO: 877139 - protein, 17 aa, Mycobacterium
WFTSAPMCDIFLVLAQA

SEQ ID NO: 877140 - protein, 18 aa, Mycobacterium
WFTTKYPVALHAGPIAWP

SEQ ID NO: 877141 - protein, 17 aa, Mycobacterium
WFTTVYPVRVAAGEAAI

SEQ ID NO: 877142 - protein, 18 aa, Mycobacterium
WFVEDLTRELAGQAWGHF

SEQ ID NO: 877143 - protein, 18 aa, Mycobacterium
WFVYSDALLTDVGYNDDQ

SEQ ID NO: 877144 - protein, 17 aa, Mycobacterium
WGAALAGRFRRLVHYSC

SEQ ID NO: 877145 - protein, 18 aa, Mycobacterium
WGAARPRRSITCRAPRQG

SEQ ID NO: 877146 - protein, 31 aa, Mycobacterium
WGAAVLTRLRGMFAFALWDTATLELFCARDP

SEQ ID NO: 877147 - protein, 21 aa, Mycobacterium
WGAEILKGPPATWGRPMWEHN

SEQ ID NO: 877148 - protein, 23 aa, Mycobacterium
WGAGFPERWWWGQAHDFDGADVS

SEQ ID NO: 877149 - protein, 31 aa, Mycobacterium
WGAGVGLAVGLFSPALLAAGLVGAATGAVAG

SEQ ID NO: 877150 - protein, 23 aa, Mycobacterium
WGAHLPFHEELPTWAMDAGADVC

SEQ ID NO: 877151 - protein, 29 aa, Mycobacterium
WGALPEWPQMLLRALMFRLAVHALHPRST

SEQ ID NO: 877152 - protein, 17 aa, Mycobacterium
WGAVKYQFGDIDGFWAA

SEQ ID NO: 877153 - protein, 17 aa, Mycobacterium
WGAVWLRGSDDADSTSS

SEQ ID NO: 877154 - protein, 18 aa, Mycobacterium
WGAWALGKLDDLNLLSRQ

SEQ ID NO: 877155 - protein, 26 aa, Mycobacterium
WGCGAKLVLLPRFSASSFWSDVAKYG

SEQ ID NO: 877156 - protein, 26 aa, Mycobacterium
WGDAERPLWVKPESLQPIGAFKMRGA

SEQ ID NO: 877157 - protein, 30 aa, Mycobacterium
WGDGRQRLFERLFLCVAFVNRFIPGFLRQG

SEQ ID NO: 877158 - protein, 19 aa, Mycobacterium
WGDIMDLVPKFNATGVAPI

SEQ ID NO: 877159 - protein, 27 aa, Mycobacterium
WGDLSLPALQLLISSLPKFLNLEKGVG

SEQ ID NO: 877160 - protein, 19 aa, Mycobacterium
WGDVELAWRLDAAGRYGPP

SEQ ID NO: 877161 - protein, 30 aa, Mycobacterium
WGDVELAWRLDAAGRYGPPRRWLVVTGTNG

SEQ ID NO: 877162 - protein, 17 aa, Mycobacterium
WGDVELAWRLDASGRYG

SEQ ID NO: 877163 - protein, 18 aa, Mycobacterium
WGDWKASLIGDLVRRCRL

SEQ ID NO: 877164 - protein, 21 aa, Mycobacterium
WGEAFLHNLRKLGLPTFESEQ

SEQ ID NO: 877165 - protein, 25 aa, Mycobacterium
WGEAQPLLRPVLRPQSYANQLVNNG

SEQ ID NO: 877166 - protein, 20 aa, Mycobacterium
WGEGLGLLLLERLSDARRNQ

SEQ ID NO: 877167 - protein, 19 aa, Mycobacterium
WGEGLVERLAERHLDIRLE

SEQ ID NO: 877168 - protein, 18 aa, Mycobacterium
WGEILLSQHADTWRRIKR

SEQ ID NO: 877169 - protein, 24 aa, Mycobacterium
WGELPPLIMRRVGYGAGQHNSLEA

SEQ ID NO: 877170 - protein, 17 aa, Mycobacterium
WGFHEDGAASGLRAARR

SEQ ID NO: 877171 - protein, 17 aa, Mycobacterium
WGFPKIMADFNVREGPK

SEQ ID NO: 877172 - protein, 18 aa, Mycobacterium
WGFRGWVMSDWGATPSWE

SEQ ID NO: 877173 - protein, 24 aa, Mycobacterium
WGGKLMWNQTPLLLKRAKNLPNRS

SEQ ID NO: 877174 - protein, 17 aa, Mycobacterium
WGGLLDPARVIVEYAAA

SEQ ID NO: 877175 - protein, 17 aa, Mycobacterium
WGGLTRLSRPFFVWLTV

SEQ ID NO: 877176 - protein, 25 aa, Mycobacterium
WGGPPIGALVFRDPSLISAFGSVSL

SEQ ID NO: 877177 - protein, 17 aa, Mycobacterium
WGGPWMITDGVEPEALA

SEQ ID NO: 877178 - protein, 17 aa, Mycobacterium
WGGRFAGGPAPALAALS

SEQ ID NO: 877179 - protein, 21 aa, Mycobacterium
WGGYTWEYWRDTRSIKPEEYQ

SEQ ID NO: 877180 - protein, 25 aa, Mycobacterium
WGHKHPTWPYFPFRGGEGVQDYQLG

SEQ ID NO: 877181 - protein, 26 aa, Mycobacterium
WGIISQGYYLATYGNPLGILGVASVT

SEQ ID NO: 877182 - protein, 25 aa, Mycobacterium
WGIKWDAIAPLLRRWHTGISSVEVQ

SEQ ID NO: 877183 - protein, 22 aa, Mycobacterium
WGIQLAGIWHLAGIYREQSLAA

SEQ ID NO: 877184 - protein, 26 aa, Mycobacterium
WGKSAVYFISAKLLRAAGHGPTVIVS

SEQ ID NO: 877185 - protein, 18 aa, Mycobacterium
WGKSWLETCQQAFAGLAV

SEQ ID NO: 877186 - protein, 20 aa, Mycobacterium
WGKYLGLRTDDLYLVAHLSR

SEQ ID NO: 877187 - protein, 17 aa, Mycobacterium
WGLAQKTAMTYPDAVRR

SEQ ID NO: 877188 - protein, 39 aa, Mycobacterium
WGLDSFQLFPNFVILFWGQGWYLTYHYWPTSHNTHIFEG

SEQ ID NO: 877189 - protein, 40 aa, Mycobacterium
WGLDSFQLFPNFVILFWGQGWYLTYHYWPTSYNSHLFEGT

SEQ ID NO: 877190 - protein, 40 aa, Mycobacterium
WGLDSFQLFPNFVMLFWGQGWYLTYHYWPTSYNSHIFEGT

SEQ ID NO: 877191 - protein, 38 aa, Mycobacterium
WGLDSFQLFPNFVMLFWGQGWYLTYHYWPTSYNTHTFE

SEQ ID NO: 877192 - protein, 17 aa, Mycobacterium
WGLWEEGVAVRGAAAAA

SEQ ID NO: 877193 - protein, 18 aa, Mycobacterium
WGMFTAAEFALIARRHMH

SEQ ID NO: 877194 - protein, 22 aa, Mycobacterium
WGNQMRSYVLHPYQMVKDLRTE

SEQ ID NO: 877195 - protein, 28 aa, Mycobacterium
WGPAFTDVSYFLGGSLPIEERRAHYDEL

SEQ ID NO: 877196 - protein, 20 aa, Mycobacterium
WGPLMREIIWRTTGKEIRDI

SEQ ID NO: 877197 - protein, 17 aa, Mycobacterium
WGPMPDLPRAIPRFTRE

SEQ ID NO: 877198 - protein, 26 aa, Mycobacterium
WGPNAIHQLIAPNAWRLPFEREWRDA

SEQ ID NO: 877199 - protein, 27 aa, Mycobacterium
WGPNAIHQLIAPNAWRLPFEREWRHAR

SEQ ID NO: 877200 - protein, 36 aa, Mycobacterium
WGQDSFEFFPNFTLLFWVPGWYLTYNYWPTGVDTHI

SEQ ID NO: 877201 - protein, 36 aa, Mycobacterium
WGQDSFEFFPNFTLLLWVPGWYLTYNYWPTDVDKHI

SEQ ID NO: 877202 - protein, 21 aa, Mycobacterium
WGRAARFYQALGYELDFETDH

SEQ ID NO: 877203 - protein, 34 aa, Mycobacterium
WGRERIVEFLALQRDLYAYLHDQTLRLLNQGYTG

SEQ ID NO: 877204 - protein, 28 aa, Mycobacterium
WGRPAILMSPVAFLQKPARWIQQLALNT

SEQ ID NO: 877205 - protein, 36 aa, Mycobacterium
WGRPLDLEWAIDRDGLLWWLQARPITTLPGDPNEMD

SEQ ID NO: 877206 - protein, 21 aa, Mycobacterium
WGRRRLAYEIAKHAEGIYAII

SEQ ID NO: 877207 - protein, 21 aa, Mycobacterium
WGRRRLAYEIAKHAEGIYAVI

SEQ ID NO: 877208 - protein, 19 aa, Mycobacterium
WGRRRLAYEIAKHSEGIYV

SEQ ID NO: 877209 - protein, 23 aa, Mycobacterium
WGSDAYTPLAWWGSATRRVRLGT

SEQ ID NO: 877210 - protein, 23 aa, Mycobacterium
WGSDAYTPLAWWGSSTQRLRLGT

SEQ ID NO: 877211 - protein, 24 aa, Mycobacterium
WGSTGPFRDYKGWEALVMAKTGVM

SEQ ID NO: 877212 - protein, 25 aa, Mycobacterium
WGTERLVEYLALQRDLYAYLHDQTL

SEQ ID NO: 877213 - protein, 20 aa, Mycobacterium
WGTFARYLGHYCRELGLMSL

SEQ ID NO: 877214 - protein, 25 aa, Mycobacterium
WGTLKPPFYPDLTQGPPTPVIDAVT

SEQ ID NO: 877215 - protein, 17 aa, Mycobacterium
WGTLSMTRAFAPILARN

SEQ ID NO: 877216 - protein, 20 aa, Mycobacterium
WGTRGARINSISPGVVSTPM

SEQ ID NO: 877217 - protein, 17 aa, Mycobacterium
WGTTPALNLIYAHLNRI

SEQ ID NO: 877218 - protein, 17 aa, Mycobacterium
WGVARHFDAVLGSGSLR

SEQ ID NO: 877219 - protein, 17 aa, Mycobacterium
WGVGPKTAKKLAAIGIT

SEQ ID NO: 877220 - protein, 19 aa, Mycobacterium
WGVIHGCQVFTPLLREQRF

SEQ ID NO: 877221 - protein, 17 aa, Mycobacterium
WGVVQYHFGDLGGLLMA

SEQ ID NO: 877222 - protein, 23 aa, Mycobacterium
WGYEAVLDIYRRIEDWQGKPDPQ

SEQ ID NO: 877223 - protein, 19 aa, Mycobacterium
WGYRGWVMSDWGGTPGWEC

SEQ ID NO: 877224 - protein, 33 aa, Mycobacterium
WHAGTLRALALLDTRWVVIGEPFLAAAETLRAA

SEQ ID NO: 877225 - protein, 17 aa, Mycobacterium
WHALLSPEPRRPKTERL

SEQ ID NO: 877226 - protein, 18 aa, Mycobacterium
WHAQRARIWARAISTELG

SEQ ID NO: 877227 - protein, 17 aa, Mycobacterium
WHCLGVAESFRDGEPHA

SEQ ID NO: 877228 - protein, 19 aa, Mycobacterium
WHDADALLASDYRARSLTI

SEQ ID NO: 877229 - protein, 18 aa, Mycobacterium
WHDVQWWQLDLVACEDEV

SEQ ID NO: 877230 - protein, 17 aa, Mycobacterium
WHEGWFANTIHAATPAG

SEQ ID NO: 877231 - protein, 20 aa, Mycobacterium
WHEIDGVVIPAPFDMRALLT

SEQ ID NO: 877232 - protein, 24 aa, Mycobacterium
WHERRRLFELPGSSWADYAPHAIS

SEQ ID NO: 877233 - protein, 17 aa, Mycobacterium
WHFCQRYPGAARRVIRH

SEQ ID NO: 877234 - protein, 20 aa, Mycobacterium
WHGEVGTAALPWLRDHQIHD

SEQ ID NO: 877235 - protein, 24 aa, Mycobacterium
WHHTACILCECNCGIVVQVENRTL

SEQ ID NO: 877236 - protein, 35 aa, Mycobacterium
WHIDEWCGSYPGRFLPMGLPILWDPELCAKEIRRN

SEQ ID NO: 877237 - protein, 17 aa, Mycobacterium
WHKAMHMFQLGFDVNPD

SEQ ID NO: 877238 - protein, 19 aa, Mycobacterium
WHLRKVFVKLGITSRRQLR

SEQ ID NO: 877239 - protein, 17 aa, Mycobacterium
WHLVAESADVPSLAAVS

SEQ ID NO: 877240 - protein, 18 aa, Mycobacterium
WHNAQVVPYGPITLDPSA

SEQ ID NO: 877241 - protein, 17 aa, Mycobacterium
WHNWRVTWNPSGMYFWL

SEQ ID NO: 877242 - protein, 17 aa, Mycobacterium
WHPRAHASARWADGGGD

SEQ ID NO: 877243 - protein, 17 aa, Mycobacterium
WHRAGSARAWWVLSAAG

SEQ ID NO: 877244 - protein, 19 aa, Mycobacterium
WHRDFFDAEIVACPDPSVI

SEQ ID NO: 877245 - protein, 17 aa, Mycobacterium
WHRRRPLWVGVATGGVV

SEQ ID NO: 877246 - protein, 27 aa, Mycobacterium
WHRTGPSIAIFAGPQGYISPSLYATKA

SEQ ID NO: 877247 - protein, 18 aa, Mycobacterium
WHSLARLAIRDDIYSSLR

SEQ ID NO: 877248 - protein, 20 aa, Mycobacterium
WHSRGIAYAPRRGGRALVYR

SEQ ID NO: 877249 - protein, 17 aa, Mycobacterium
WHSSGLLDRLDLAFSRD

SEQ ID NO: 877250 - protein, 22 aa, Mycobacterium
WHSTLLDRHRPLWETHIVEGLK

SEQ ID NO: 877251 - protein, 18 aa, Mycobacterium
WHTARLSPAPLLPEERKT

SEQ ID NO: 877252 - protein, 19 aa, Mycobacterium
WHTDVRGGLLFVWHDHEGN

SEQ ID NO: 877253 - protein, 22 aa, Mycobacterium
WHTDVTFVDRIPKASLLRAVTL

SEQ ID NO: 877254 - protein, 21 aa, Mycobacterium
WHTHEGLIYGIVKTGVLTHYG

SEQ ID NO: 877255 - protein, 20 aa, Mycobacterium
WHTMQEIWDRGFKAVMDDAV

SEQ ID NO: 877256 - protein, 19 aa, Mycobacterium
WHTPPRARKPQRRVRLRGE

SEQ ID NO: 877257 - protein, 20 aa, Mycobacterium
WHTRLDLPGTHWTLCENFGD

SEQ ID NO: 877258 - protein, 30 aa, Mycobacterium
WHVDEWCGAYPGRFIPCGILPLFDVAEAAK

SEQ ID NO: 877259 - protein, 18 aa, Mycobacterium
WHVYAGVRRAADGEALQA

SEQ ID NO: 877260 - protein, 17 aa, Mycobacterium
WHYLHIHNDVIPALKER

SEQ ID NO: 877261 - protein, 25 aa, Mycobacterium
WIAAGTPPIFFGFGSMPVESPSDTI

SEQ ID NO: 877262 - protein, 18 aa, Mycobacterium
WIAEAMELAVRWTEVSPP

SEQ ID NO: 877263 - protein, 29 aa, Mycobacterium
WIAEELSRRFGLPLWRFANSGTEATMDAV

SEQ ID NO: 877264 - protein, 24 aa, Mycobacterium
WIAEGLFGYLPPEAQDRLLDNITA

SEQ ID NO: 877265 - protein, 23 aa, Mycobacterium
WIAEGLLIYLPAAAQEQLFTGID

SEQ ID NO: 877266 - protein, 25 aa, Mycobacterium
WIAEGLLIYLPAAAQQQLFTGIDGL

SEQ ID NO: 877267 - protein, 17 aa, Mycobacterium
WIALNAGLASGAHMTLI

SEQ ID NO: 877268 - protein, 25 aa, Mycobacterium
WIATARKRGFLAPTTPGRRGAAPGP

SEQ ID NO: 877269 - protein, 20 aa, Mycobacterium
WIATGTPPIYFGFGSTPVTS

SEQ ID NO: 877270 - protein, 19 aa, Mycobacterium
WIDDGVYGEIYWGDSAGAR

SEQ ID NO: 877271 - protein, 25 aa, Mycobacterium
WIDEQLLGPYRIAPGGLSLTEWQGA

SEQ ID NO: 877272 - protein, 20 aa, Mycobacterium
WIDKHFHHPCDLGRAGLPEE

SEQ ID NO: 877273 - protein, 19 aa, Mycobacterium
WIDVTKIIHVGEGEKAPYG

SEQ ID NO: 877274 - protein, 19 aa, Mycobacterium
WIEAELRRRGFEVTGVAYG

SEQ ID NO: 877275 - protein, 17 aa, Mycobacterium
WIEQSTKANLWLTDGDA

SEQ ID NO: 877276 - protein, 37 aa, Mycobacterium
WIEYEPYGTVLIIGAWNYPFYLTLGPAVGAIAAGNAV

SEQ ID NO: 877277 - protein, 17 aa, Mycobacterium
WIFDFMMGSDLGPDGAT

SEQ ID NO: 877278 - protein, 17 aa, Mycobacterium
WIGEAREWMTLWTMGLN

SEQ ID NO: 877279 - protein, 18 aa, Mycobacterium
WIGHDWGAAVVWNAPLLH

SEQ ID NO: 877280 - protein, 18 aa, Mycobacterium
WIGIDDLVDIYLRALWDT

SEQ ID NO: 877281 - protein, 28 aa, Mycobacterium
WIGKYAEAFTLWRRLLTRSDLPENERQR

SEQ ID NO: 877282 - protein, 20 aa, Mycobacterium
WIGMAPFLRRDHLIQNLGDG

SEQ ID NO: 877283 - protein, 17 aa, Mycobacterium
WIGTSWKMNKGLAESRG

SEQ ID NO: 877284 - protein, 25 aa, Mycobacterium
WIGVNASHYFWRYGGDRASTLAPIA

SEQ ID NO: 877285 - protein, 25 aa, Mycobacterium
WIIRDMLGLPYEKPAAYTRDYLQVL

SEQ ID NO: 877286 - protein, 17 aa, Mycobacterium
WIKRFLAGEFVGGGWTE

SEQ ID NO: 877287 - protein, 17 aa, Mycobacterium
WILAFEAPELHRIVDLM

SEQ ID NO: 877288 - protein, 17 aa, Mycobacterium
WILRTILSLLSVRGPRH

SEQ ID NO: 877289 - protein, 27 aa, Mycobacterium
WINAAGEIFWVKYHFITDQGIDFLTQE

SEQ ID NO: 877290 - protein, 17 aa, Mycobacterium
WINLYRKRQRRPNEVPM

SEQ ID NO: 877291 - protein, 21 aa, Mycobacterium
WINSWINYGINWVNSLINWAF

SEQ ID NO: 877292 - protein, 18 aa, Mycobacterium
WIPRRAGERGALEAGALP

SEQ ID NO: 877293 - protein, 17 aa, Mycobacterium
WIQAAVACWKLGAVPQP

SEQ ID NO: 877294 - protein, 17 aa, Mycobacterium
WIQFEVHDWFSHGTTDS

SEQ ID NO: 877295 - protein, 18 aa, Mycobacterium
WIQPTWPRRHGGRSLGLA

SEQ ID NO: 877296 - protein, 18 aa, Mycobacterium
WIRDRTVLFDGERPHGIV

SEQ ID NO: 877297 - protein, 26 aa, Mycobacterium
WIRDSTFALWGLYTLGLDREADDFFS

SEQ ID NO: 877298 - protein, 17 aa, Mycobacterium
WIRFRDNGTTRYFEYSH

SEQ ID NO: 877299 - protein, 17 aa, Mycobacterium
WIRIRARMGPEYTELKS

SEQ ID NO: 877300 - protein, 17 aa, Mycobacterium
WIRQAITRGMADQSRTI

SEQ ID NO: 877301 - protein, 20 aa, Mycobacterium
WIRRRLHEVAVHRADAAIAL

SEQ ID NO: 877302 - protein, 17 aa, Mycobacterium
WIRYDPKKPNRKSTWFV

SEQ ID NO: 877303 - protein, 18 aa, Mycobacterium
WISNPLPVDFLSKFVTQM

SEQ ID NO: 877304 - protein, 22 aa, Mycobacterium
WITDGHWADMGLALMRTDPASS

SEQ ID NO: 877305 - protein, 27 aa, Mycobacterium
WITDVEGRRYLDCLAAYSAVNFGHRHP

SEQ ID NO: 877306 - protein, 17 aa, Mycobacterium
WITELWNGRPVAAELVT

SEQ ID NO: 877307 - protein, 17 aa, Mycobacterium
WITGAYYLGYDQSKFDS

SEQ ID NO: 877308 - protein, 19 aa, Mycobacterium
WITTIGSAVFAILPGAADG

SEQ ID NO: 877309 - protein, 18 aa, Mycobacterium
WITTLRLLKNNGVEAFRK

SEQ ID NO: 877310 - protein, 22 aa, Mycobacterium
WIVFDSIHLQRYGFLGVTHAQP

SEQ ID NO: 877311 - protein, 19 aa, Mycobacterium
WIVHEPVHAHPLPDQSWTQ

SEQ ID NO: 877312 - protein, 18 aa, Mycobacterium
WIVIPAFNEAAVIGDVIA

SEQ ID NO: 877313 - protein, 25 aa, Mycobacterium
WIVRDMLGLPYEKPAAYTRDYLEVL

SEQ ID NO: 877314 - protein, 19 aa, Mycobacterium
WKAETSWAQRVSLAHALIG

SEQ ID NO: 877315 - protein, 18 aa, Mycobacterium
WKAGMTGFPIVDAGMRQL

SEQ ID NO: 877316 - protein, 21 aa, Mycobacterium
WKAKQNYLFDVRQIRRGKIDD

SEQ ID NO: 877317 - protein, 18 aa, Mycobacterium
WKALPPKQLDLARVWPQY

SEQ ID NO: 877318 - protein, 29 aa, Mycobacterium
WKALSWADANVWRRVVPKGWFYNVMVTGV

SEQ ID NO: 877319 - protein, 18 aa, Mycobacterium
WKDNAYLSFWDTHNQVFG

SEQ ID NO: 877320 - protein, 25 aa, Mycobacterium
WKDRHGAMVALVHRLERWASEQDGA

SEQ ID NO: 877321 - protein, 26 aa, Mycobacterium
WKGDRHGNLLYRYSAANFNPECAPAG

SEQ ID NO: 877322 - protein, 29 aa, Mycobacterium
WKIRSLVKKYSDFIAWPIRMEVEKRTPPA

SEQ ID NO: 877323 - protein, 20 aa, Mycobacterium
WKKGMRHSVYFTHGTRNAVD

SEQ ID NO: 877324 - protein, 21 aa, Mycobacterium
WKKSFGVHPLLAFLDRPEIAG

SEQ ID NO: 877325 - protein, 24 aa, Mycobacterium
WKLSKDPLFVAKVRDLVGLYLNPP

SEQ ID NO: 877326 - protein, 19 aa, Mycobacterium
WKMSAMLTLGYPRGKWAVA

SEQ ID NO: 877327 - protein, 19 aa, Mycobacterium
WKNAPLFRQLREPQSAGAC

SEQ ID NO: 877328 - protein, 24 aa, Mycobacterium
WKNGPADEQALWQGLTQLAVGITH

SEQ ID NO: 877329 - protein, 27 aa, Mycobacterium
WKNILQKAAFYWACRRWPQRMRARLIE

SEQ ID NO: 877330 - protein, 18 aa, Mycobacterium
WKQFAPDDYAKALRRVPM

SEQ ID NO: 877331 - protein, 27 aa, Mycobacterium
WKRERPNWSFVPLARQTRRHPTSNSLP

SEQ ID NO: 877332 - protein, 19 aa, Mycobacterium
WKTIDDYVTAVAPELLPRI

SEQ ID NO: 877333 - protein, 18 aa, Mycobacterium
WKTVKAGIPHMIAGGRGG

SEQ ID NO: 877334 - protein, 29 aa, Mycobacterium
WKTYVKQAVVLFPYLEKAGEFFDASVAQW

SEQ ID NO: 877335 - protein, 18 aa, Mycobacterium
WKVNADLPTPAGFAGATQ

SEQ ID NO: 877336 - protein, 17 aa, Mycobacterium
WKVVESFPALGADGGAD

SEQ ID NO: 877337 - protein, 21 aa, Mycobacterium
WKYLMALFNAKIDENADPKVQ

SEQ ID NO: 877338 - protein, 23 aa, Mycobacterium
WKYLMALFNSKIDEHADPKVQIQ

SEQ ID NO: 877339 - protein, 22 aa, Mycobacterium
WKYLMALFSSKIDEYADPKVQI

SEQ ID NO: 877340 - protein, 23 aa, Mycobacterium
WKYLTALFNAKIDEHADPKVQIQ

SEQ ID NO: 877341 - protein, 18 aa, Mycobacterium
WLAADRWAVPLVHTAHTL

SEQ ID NO: 877342 - protein, 21 aa, Mycobacterium
WLADHAVGGVVIFPGAGFVEL

SEQ ID NO: 877343 - protein, 20 aa, Mycobacterium
WLADHEGAAVTWLPVDQAGT

SEQ ID NO: 877344 - protein, 22 aa, Mycobacterium
WLAEHLGLKRLLRSDILPLSFG

SEQ ID NO: 877345 - protein, 26 aa, Mycobacterium
WLAERLGVKRLLRSAILPLSFGFPFG

SEQ ID NO: 877346 - protein, 17 aa, Mycobacterium
WLAIAERFISAGAAEIE

SEQ ID NO: 877347 - protein, 17 aa, Mycobacterium
WLALGWPKEFGGQDRSV

SEQ ID NO: 877348 - protein, 21 aa, Mycobacterium
WLAQALAQRPVSEPLFDAVLA

SEQ ID NO: 877349 - protein, 21 aa, Mycobacterium
WLASHLQQRWARNTGGLLLVT

SEQ ID NO: 877350 - protein, 27 aa, Mycobacterium
WLATSRELPWRRPIASLNYLLSSHVWR

SEQ ID NO: 877351 - protein, 18 aa, Mycobacterium
WLDAFTHWRHNQNQPATA

SEQ ID NO: 877352 - protein, 19 aa, Mycobacterium
WLDALARVPMGGGTCYALP

SEQ ID NO: 877353 - protein, 18 aa, Mycobacterium
WLDDIFIGYLVERRREPR

SEQ ID NO: 877354 - protein, 25 aa, Mycobacterium
WLDDQPGYLPPVQLGEVIRAAGIGE

SEQ ID NO: 877355 - protein, 25 aa, Mycobacterium
WLDDQPGYLPPVRLGEVIRAAGIGE

SEQ ID NO: 877356 - protein, 25 aa, Mycobacterium
WLDDQPSYLPPVQLGEVIRAAGIGE

SEQ ID NO: 877357 - protein, 17 aa, Mycobacterium
WLDFNARVLALAADNSL

SEQ ID NO: 877358 - protein, 32 aa, Mycobacterium
WLDKAGYIIGKLQRVIFYAEGIKETNWSVTRP

SEQ ID NO: 877359 - protein, 28 aa, Mycobacterium
WLDPEMTSPYAWYQYFINTADADVVRYL

SEQ ID NO: 877360 - protein, 28 aa, Mycobacterium
WLDPEMTSPYAWYQYFVNTADADVIRYL

SEQ ID NO: 877361 - protein, 17 aa, Mycobacterium
WLDQIPTGKPLLFLAEG

SEQ ID NO: 877362 - protein, 26 aa, Mycobacterium
WLEADPRVTYVRWAGLPSHPHHDRAR

SEQ ID NO: 877363 - protein, 17 aa, Mycobacterium
WLEAVASSLTELFAPDL

SEQ ID NO: 877364 - protein, 19 aa, Mycobacterium
WLELLADDVDYWMPLRTNR

SEQ ID NO: 877365 - protein, 20 aa, Mycobacterium
WLEPLTTLAYIAGFTERVRL

SEQ ID NO: 877366 - protein, 17 aa, Mycobacterium
WLERVAIQAGREGAALP

SEQ ID NO: 877367 - protein, 18 aa, Mycobacterium
WLEVSADPEVRQLILLDA

SEQ ID NO: 877368 - protein, 18 aa, Mycobacterium
WLEVSGDPEVRQLILLDA

SEQ ID NO: 877369 - protein, 26 aa, Mycobacterium
WLGDHAVAGTVLFPGAGFVELALRAG

SEQ ID NO: 877370 - protein, 20 aa, Mycobacterium
WLGFTLDDIKDLLSLAEGGI

SEQ ID NO: 877371 - protein, 27 aa, Mycobacterium
WLGGSPPADLPWIDPLLSATERIRIVT

SEQ ID NO: 877372 - protein, 17 aa, Mycobacterium
WLGLHIDERHGGSGYGL

SEQ ID NO: 877373 - protein, 33 aa, Mycobacterium
WLGPASLSMASAFWPYVTWTSMVATQAGEAASQ

SEQ ID NO: 877374 - protein, 25 aa, Mycobacterium
WLGRRIERSPLPFGRPRWVAYHDAP

SEQ ID NO: 877375 - protein, 28 aa, Mycobacterium
WLGRTALDLLAPLGLPTLALASRARTIR

SEQ ID NO: 877376 - protein, 35 aa, Mycobacterium
WLGTGHWIPNAPARPIALLGTLLAWHTSHNSLSDR

SEQ ID NO: 877377 - protein, 24 aa, Mycobacterium
WLGVPIEEILLAALGRTLGRTRGE

SEQ ID NO: 877378 - protein, 19 aa, Mycobacterium
WLHAGLPEATGATTIDCQC

SEQ ID NO: 877379 - protein, 18 aa, Mycobacterium
WLHEIDEALPAPRWTRVG

SEQ ID NO: 877380 - protein, 28 aa, Mycobacterium
WLHSQLLRVPPIRRTLEVPSIEPAKDGY

SEQ ID NO: 877381 - protein, 18 aa, Mycobacterium
WLHTLGYRGHIISKSRRY

SEQ ID NO: 877382 - protein, 18 aa, Mycobacterium
WLIAHSAARTRVLDAALD

SEQ ID NO: 877383 - protein, 17 aa, Mycobacterium
WLIHGYEAIRALFTDSR

SEQ ID NO: 877384 - protein, 17 aa, Mycobacterium
WLKKMLSSARKTGSGGG

SEQ ID NO: 877385 - protein, 17 aa, Mycobacterium
WLLAQSDKPDLVFEATS

SEQ ID NO: 877386 - protein, 17 aa, Mycobacterium
WLLDLTAIALHDSPDLQ

SEQ ID NO: 877387 - protein, 17 aa, Mycobacterium
WLLGHGESPQWAADAKF

SEQ ID NO: 877388 - protein, 17 aa, Mycobacterium
WLLGHGESPQWSADAKF

SEQ ID NO: 877389 - protein, 20 aa, Mycobacterium
WLLKQAFYYSLTTINDAMRV

SEQ ID NO: 877390 - protein, 20 aa, Mycobacterium
WLLKQAFYYSLTTINEAMRE

SEQ ID NO: 877391 - protein, 20 aa, Mycobacterium
WLLMNPSREASLEAAIASTN

SEQ ID NO: 877392 - protein, 26 aa, Mycobacterium
WLLNGQKIWSSRAPFAERGFGLFRSD

SEQ ID NO: 877393 - protein, 17 aa, Mycobacterium
WLLRPVSVEAFLDEIWA

SEQ ID NO: 877394 - protein, 17 aa, Mycobacterium
WLMDEVGGDGFLITLHN

SEQ ID NO: 877395 - protein, 19 aa, Mycobacterium
WLNDVRLERAIPVRIQSHD

SEQ ID NO: 877396 - protein, 17 aa, Mycobacterium
WLNQTFKSALDALEDVL

SEQ ID NO: 877397 - protein, 25 aa, Mycobacterium
WLPAERICLCGNVFGPLFGHIPNLV

SEQ ID NO: 877398 - protein, 20 aa, Mycobacterium
WLPAPLGPLGVTMRLYAPRP

SEQ ID NO: 877399 - protein, 33 aa, Mycobacterium
WLPDIRRWATVVAQLLRPGGRLFMREGHPMLDT

SEQ ID NO: 877400 - protein, 18 aa, Mycobacterium
WLPDLALRPLGGAVIWAN

SEQ ID NO: 877401 - protein, 19 aa, Mycobacterium
WLPDRLWGGLTRLSRPFFV

SEQ ID NO: 877402 - protein, 17 aa, Mycobacterium
WLPGFVSGRLIAAIGMT

SEQ ID NO: 877403 - protein, 17 aa, Mycobacterium
WLPGIISGELIVAVAMT

SEQ ID NO: 877404 - protein, 19 aa, Mycobacterium
WLPKDQLPDNAIYQTPGSL

SEQ ID NO: 877405 - protein, 18 aa, Mycobacterium
WLPLERAVPLDSSADWVP

SEQ ID NO: 877406 - protein, 32 aa, Mycobacterium
WLPQHHDMGLISAYMFILLLGGSTHAMSPLDF

SEQ ID NO: 877407 - protein, 17 aa, Mycobacterium
WLPVHPVGRRTWPNGRV

SEQ ID NO: 877408 - protein, 18 aa, Mycobacterium
WLQFETHDWFSHGTDANR

SEQ ID NO: 877409 - protein, 20 aa, Mycobacterium
WLRAHGVVPIAYGDGLAGRL

SEQ ID NO: 877410 - protein, 21 aa, Mycobacterium
WLRAYLALPNYANNLLRSGFS

SEQ ID NO: 877411 - protein, 23 aa, Mycobacterium
WLRDELSLPLEQWVKKLQLAPLA

SEQ ID NO: 877412 - protein, 18 aa, Mycobacterium
WLRDGEQLRLLLRDVFIA

SEQ ID NO: 877413 - protein, 24 aa, Mycobacterium
WLREGPLIRLARAKGFRVIVTLHG

SEQ ID NO: 877414 - protein, 18 aa, Mycobacterium
WLRGPTVVRGYLGDPAIT

SEQ ID NO: 877415 - protein, 20 aa, Mycobacterium
WLRHIYTEWAGALNFSVPSF

SEQ ID NO: 877416 - protein, 17 aa, Mycobacterium
WLRNAAHANAMAARLSS

SEQ ID NO: 877417 - protein, 26 aa, Mycobacterium
WLRNSPQSPFLLTAGFFETHRPFPRE

SEQ ID NO: 877418 - protein, 23 aa, Mycobacterium
WLRRVADALRRKGCPLAWVAGKT

SEQ ID NO: 877419 - protein, 19 aa, Mycobacterium
WLSAFVERVRASVGMLTDL

SEQ ID NO: 877420 - protein, 23 aa, Mycobacterium
WLSGSCLLLRRTAFDAIGGFDPR

SEQ ID NO: 877421 - protein, 17 aa, Mycobacterium
WLSIFRGAFDEATQLVA

SEQ ID NO: 877422 - protein, 18 aa, Mycobacterium
WLSMVMLEWGSCGQLAVE

SEQ ID NO: 877423 - protein, 19 aa, Mycobacterium
WLSMVMLEWGSCGQLAVQA

SEQ ID NO: 877424 - protein, 17 aa, Mycobacterium
WLTAADDLLEALLSDVP

SEQ ID NO: 877425 - protein, 22 aa, Mycobacterium
WLTAGRFHPLFERALSRYVGAR

SEQ ID NO: 877426 - protein, 18 aa, Mycobacterium
WLTANGVIGFFPANAVGP

SEQ ID NO: 877427 - protein, 17 aa, Mycobacterium
WLTGIRIQDGLLKQLGS

SEQ ID NO: 877428 - protein, 28 aa, Mycobacterium
WLTSSAALTWRRPIASLNYLLTSHVWRQ

SEQ ID NO: 877429 - protein, 17 aa, Mycobacterium
WLTTVARNRALDRLRRE

SEQ ID NO: 877430 - protein, 22 aa, Mycobacterium
WLTVQQQPMGFWRAAWYVGTSY

SEQ ID NO: 877431 - protein, 18 aa, Mycobacterium
WLVLCCRAMEAGAQEALA

SEQ ID NO: 877432 - protein, 20 aa, Mycobacterium
WLVPADFIGFSQPIDDLPTA

SEQ ID NO: 877433 - protein, 19 aa, Mycobacterium
WLWAVRLTKTRPDAASACR

SEQ ID NO: 877434 - protein, 20 aa, Mycobacterium
WLYAARLRQMKSLLSEGLRS

SEQ ID NO: 877435 - protein, 17 aa, Mycobacterium
WLYDRVTAGWEVTVLLP

SEQ ID NO: 877436 - protein, 25 aa, Mycobacterium
WLYGGLRLLFPVEWERFRAGAPERD

SEQ ID NO: 877437 - protein, 18 aa, Mycobacterium
WLYSNMFHIRGAVLERIG

SEQ ID NO: 877438 - protein, 19 aa, Mycobacterium
WLYSNYYGLAKVGINGLTQ

SEQ ID NO: 877439 - protein, 19 aa, Mycobacterium
WLYSNYYGLAKVGLNGLTQ

SEQ ID NO: 877440 - protein, 17 aa, Mycobacterium
WLYTEYIVRQRSCADLA

SEQ ID NO: 877441 - protein, 17 aa, Mycobacterium
WLYTLGDVNHRALLTHQ

SEQ ID NO: 877442 - protein, 27 aa, Mycobacterium
WMACTYHGRILWRPGALPAFSDDRWEL

SEQ ID NO: 877443 - protein, 18 aa, Mycobacterium
WMAFLERIKRRELPGLAV

SEQ ID NO: 877444 - protein, 25 aa, Mycobacterium
WMDPQQRLMLEIAWEGLERAGYSPA

SEQ ID NO: 877445 - protein, 17 aa, Mycobacterium
WMEQAFPIALESATHEV

SEQ ID NO: 877446 - protein, 17 aa, Mycobacterium
WMFGIEHVRFVNDVPRG

SEQ ID NO: 877447 - protein, 26 aa, Mycobacterium
WMGFGLGVVQWGSWLGWIGNLGGYKC

SEQ ID NO: 877448 - protein, 17 aa, Mycobacterium
WMGGPYVGVRHGNLFAN

SEQ ID NO: 877449 - protein, 18 aa, Mycobacterium
WMGRGLAALGQPVSRDPA

SEQ ID NO: 877450 - protein, 30 aa, Mycobacterium
WMIATTLLTGRRTFVPWLATVVNVAVSDSW

SEQ ID NO: 877451 - protein, 20 aa, Mycobacterium
WMIKKFVHTARRYRTAKIKL

SEQ ID NO: 877452 - protein, 24 aa, Mycobacterium
WMNDRVTVLLRYLTDDHGLHVPVE

SEQ ID NO: 877453 - protein, 17 aa, Mycobacterium
WMPFGLRTMQIADMLAT

SEQ ID NO: 877454 - protein, 17 aa, Mycobacterium
WMPQVPDDFDCLSMVAL

SEQ ID NO: 877455 - protein, 17 aa, Mycobacterium
WMPQVPNDFDCLTMVAL

SEQ ID NO: 877456 - protein, 18 aa, Mycobacterium
WMQDLQTMMSIFGTPFFV

SEQ ID NO: 877457 - protein, 25 aa, Mycobacterium
WMREQWDGPFMLKGVMRIDDAKRAV

SEQ ID NO: 877458 - protein, 18 aa, Mycobacterium
WMRPEAVPGLRRLTDAVH

SEQ ID NO: 877459 - protein, 26 aa, Mycobacterium
WMSELRNGWPNRCLPILIANQSGWEL

SEQ ID NO: 877460 - protein, 26 aa, Mycobacterium
WMSGGRLMVTFGVGWLAKEFELLGVP

SEQ ID NO: 877461 - protein, 20 aa, Mycobacterium
WMTAFALHLEACNFESIIVA

SEQ ID NO: 877462 - protein, 18 aa, Mycobacterium
WMTAPAEAGQFLAQLQWR

SEQ ID NO: 877463 - protein, 25 aa, Mycobacterium
WMTELVYELLVPQPVTYTHVASLRA

SEQ ID NO: 877464 - protein, 19 aa, Mycobacterium
WMVATTLLSGRRTFVPWLS

SEQ ID NO: 877465 - protein, 17 aa, Mycobacterium
WNAGNVNTGFGGIGTYS

SEQ ID NO: 877466 - protein, 17 aa, Mycobacterium
WNAPPTDRRYYPLFAEC

SEQ ID NO: 877467 - protein, 19 aa, Mycobacterium
WNCQVFVLDAGLCPVPVGV

SEQ ID NO: 877468 - protein, 25 aa, Mycobacterium
WNEEHGFWALLKYEDIRYVSTNPAL

SEQ ID NO: 877469 - protein, 20 aa, Mycobacterium
WNEITPCNLSLDRLAKAVKE

SEQ ID NO: 877470 - protein, 20 aa, Mycobacterium
WNEITPCNLSLDRLAKSVKE

SEQ ID NO: 877471 - protein, 29 aa, Mycobacterium
WNETHLCRTLPWPAYLTEAFQNLGPEIFE

SEQ ID NO: 877472 - protein, 19 aa, Mycobacterium
WNEWKRWEGEAEPHFEMPR

SEQ ID NO: 877473 - protein, 27 aa, Mycobacterium
WNFTEVFRLPIQMALVNRRFEFTAITD

SEQ ID NO: 877474 - protein, 25 aa, Mycobacterium
WNGPMGVFEFPAFAAGTKGVAEAIA

SEQ ID NO: 877475 - protein, 22 aa, Mycobacterium
WNHLVKSYVLGAARPASPPRGS

SEQ ID NO: 877476 - protein, 18 aa, Mycobacterium
WNIFKQNIGIMIAVAQLA

SEQ ID NO: 877477 - protein, 20 aa, Mycobacterium
WNLARFAEALLPLLADDMQE

SEQ ID NO: 877478 - protein, 19 aa, Mycobacterium
WNLGQLFRHVGRGDRWAAQ

SEQ ID NO: 877479 - protein, 17 aa, Mycobacterium
WNLIRRQQQFRSALASR

SEQ ID NO: 877480 - protein, 17 aa, Mycobacterium
WNLKGDWFDVCSCKLPC

SEQ ID NO: 877481 - protein, 27 aa, Mycobacterium
WNNIPKNPFDAIPYVRKLVGDVLHGVE

SEQ ID NO: 877482 - protein, 19 aa, Mycobacterium
WNNPRDMALFGDYLDRIQA

SEQ ID NO: 877483 - protein, 27 aa, Mycobacterium
WNNWAEFFHSDSINNLAYGFPFDDVNS

SEQ ID NO: 877484 - protein, 23 aa, Mycobacterium
WNPQRRARVLMRFIELVNDHNDE

SEQ ID NO: 877485 - protein, 19 aa, Mycobacterium
WNQARIDPALPDREPLPRP

SEQ ID NO: 877486 - protein, 18 aa, Mycobacterium
WNRPVKLFIETKHPVRYG

SEQ ID NO: 877487 - protein, 18 aa, Mycobacterium
WNRYVIAGHLPIPKIPGA

SEQ ID NO: 877488 - protein, 31 aa, Mycobacterium
WNSSVPAWCELDLRIAFYPGITADEAWSEIT

SEQ ID NO: 877489 - protein, 17 aa, Mycobacterium
WNTADAYRPLYAHLMDL

SEQ ID NO: 877490 - protein, 18 aa, Mycobacterium
WNTARWLDAVAIGSGIPV

SEQ ID NO: 877491 - protein, 17 aa, Mycobacterium
WNTLLRARAIENTVYVV

SEQ ID NO: 877492 - protein, 28 aa, Mycobacterium
WNVATTAITWPLMRTAPGLYSLIRAAAT

SEQ ID NO: 877493 - protein, 23 aa, Mycobacterium
WNVKWQKWSLRIGFNPREGITLH

SEQ ID NO: 877494 - protein, 17 aa, Mycobacterium
WNVPKKLTTFAFWGNGV

SEQ ID NO: 877495 - protein, 30 aa, Mycobacterium
WNVPQCLIMPKLIPALIAGCTVIVKPAPET

SEQ ID NO: 877496 - protein, 18 aa, Mycobacterium
WNVTHIFGYPGDGINGLV

SEQ ID NO: 877497 - protein, 20 aa, Mycobacterium
WNVTWQKWSLRVGFNAREGL

SEQ ID NO: 877498 - protein, 18 aa, Mycobacterium
WNVVPYTVFRDGPAGVGM

SEQ ID NO: 877499 - protein, 19 aa, Mycobacterium
WPAALLRSGFDPAQPTAWI

SEQ ID NO: 877500 - protein, 23 aa, Mycobacterium
WPAALRTPPIWDAMRQRRYLHRR

SEQ ID NO: 877501 - protein, 18 aa, Mycobacterium
WPAAVPELRPALESWDIA

SEQ ID NO: 877502 - protein, 22 aa, Mycobacterium
WPAETAAAEPVLLWGDARVGNV

SEQ ID NO: 877503 - protein, 17 aa, Mycobacterium
WPAICAQLRETVGVADR

SEQ ID NO: 877504 - protein, 19 aa, Mycobacterium
WPAIITPVQRDQVLARMAG

SEQ ID NO: 877505 - protein, 17 aa, Mycobacterium
WPALDFVRPWDSLTDDE

SEQ ID NO: 877506 - protein, 25 aa, Mycobacterium
WPCAVRVHLAAWSGLRAAELAGLQV

SEQ ID NO: 877507 - protein, 17 aa, Mycobacterium
WPDALLLLGDQIYADDL

SEQ ID NO: 877508 - protein, 28 aa, Mycobacterium
WPDCDRAWATPWPGNAAPVAPLTGSVEQ

SEQ ID NO: 877509 - protein, 24 aa, Mycobacterium
WPDDPLAALWHATTLLREQRGDGH

SEQ ID NO: 877510 - protein, 17 aa, Mycobacterium
WPDLFIAGGGISRKADK

SEQ ID NO: 877511 - protein, 18 aa, Mycobacterium
WPDLPSVPLETTCLAIPG

SEQ ID NO: 877512 - protein, 20 aa, Mycobacterium
WPDMTKPVIGAINGAAVTGG

SEQ ID NO: 877513 - protein, 24 aa, Mycobacterium
WPDVVRRWRAAYFAALEEARGRDS

SEQ ID NO: 877514 - protein, 20 aa, Mycobacterium
WPDYLGALQALEADAPSAPP

SEQ ID NO: 877515 - protein, 17 aa, Mycobacterium
WPEALGVLSFRMYYRGH

SEQ ID NO: 877516 - protein, 17 aa, Mycobacterium
WPEAVRPLVRPQAPARY

SEQ ID NO: 877517 - protein, 19 aa, Mycobacterium
WPEDGIAPGTRWADIPEDW

SEQ ID NO: 877518 - protein, 20 aa, Mycobacterium
WPERLNLIRDLLATDTFEEG

SEQ ID NO: 877519 - protein, 35 aa, Mycobacterium
WPETKIEPSLTRISALMDLLGSPQLAYPCIHIAGT

SEQ ID NO: 877520 - protein, 32 aa, Mycobacterium
WPETRIEPSLTRISALMDLLGSPQLSYPSIHI

SEQ ID NO: 877521 - protein, 20 aa, Mycobacterium
WPEVRSQLAMTWGTETFIVP

SEQ ID NO: 877522 - protein, 25 aa, Mycobacterium
WPGAYGTWWQADPGADLILLYLIQH

SEQ ID NO: 877523 - protein, 21 aa, Mycobacterium
WPGAYGTWWQADPGADLVLIY

SEQ ID NO: 877524 - protein, 24 aa, Mycobacterium
WPGAYGTWWQADPSADLILIYLIQ

SEQ ID NO: 877525 - protein, 25 aa, Mycobacterium
WPGAYGTWWQADPSADLILLYLIQH

SEQ ID NO: 877526 - protein, 21 aa, Mycobacterium
WPGAYGTWWQADPSADVILIY

SEQ ID NO: 877527 - protein, 22 aa, Mycobacterium
WPGAYGTWWQADPTADLVLIYL

SEQ ID NO: 877528 - protein, 19 aa, Mycobacterium
WPGGLTVFDLRAEAVAPLV

SEQ ID NO: 877529 - protein, 23 aa, Mycobacterium
WPGGLTVFDVRAEAMAPLVELGA

SEQ ID NO: 877530 - protein, 17 aa, Mycobacterium
WPGLAEPVQLAQGPQGW

SEQ ID NO: 877531 - protein, 18 aa, Mycobacterium
WPGLRSDIDTPEDLVAAC

SEQ ID NO: 877532 - protein, 17 aa, Mycobacterium
WPGNPYPLGATYDGAGT

SEQ ID NO: 877533 - protein, 20 aa, Mycobacterium
WPGPTFTDSGGFQVLSLGSG

SEQ ID NO: 877534 - protein, 34 aa, Mycobacterium
WPGRQLWWSYYMRLLIYVTPRRALFWPTRDFTTA

SEQ ID NO: 877535 - protein, 27 aa, Mycobacterium
WPGVEHAWLEGWLLRAGSPTGRDTELP

SEQ ID NO: 877536 - protein, 17 aa, Mycobacterium
WPGVTRPTSIGGLGFSM

SEQ ID NO: 877537 - protein, 19 aa, Mycobacterium
WPHADAIRFAVNYLRMFAT

SEQ ID NO: 877538 - protein, 23 aa, Mycobacterium
WPIKPHHWYPALSEEQLVFARAN

SEQ ID NO: 877539 - protein, 28 aa, Mycobacterium
WPKNLSSHLMYGGWWTFPVPDIERTDLL

SEQ ID NO: 877540 - protein, 27 aa, Mycobacterium
WPLDRRIEGFLLRRGLVRLAEDGDAYG

SEQ ID NO: 877541 - protein, 19 aa, Mycobacterium
WPLLRWRMREYEHGRWGRE

SEQ ID NO: 877542 - protein, 39 aa, Mycobacterium
WPLRTFECAVPPGRLGWGWAKFAFNSWKALSWLDANVMR

SEQ ID NO: 877543 - protein, 28 aa, Mycobacterium
WPPAPRCRPGYWPWVDALANAMVLTGDL

SEQ ID NO: 877544 - protein, 22 aa, Mycobacterium
WPPIAGGAHALPFVVGFMSERQ

SEQ ID NO: 877545 - protein, 22 aa, Mycobacterium
WPQHHWAYRDLLGDPPPGLRII

SEQ ID NO: 877546 - protein, 32 aa, Mycobacterium
WPQKYGGRDAPLLHWVVFEEEYFRAGAPGRAS

SEQ ID NO: 877547 - protein, 18 aa, Mycobacterium
WPQPRICIEPKDLGYGPA

SEQ ID NO: 877548 - protein, 22 aa, Mycobacterium
WPQRMRARLIELARRQLPEGYD

SEQ ID NO: 877549 - protein, 17 aa, Mycobacterium
WPQVTIIWEIDAFADYA

SEQ ID NO: 877550 - protein, 18 aa, Mycobacterium
WPRDVLPFELAAETLRGG

SEQ ID NO: 877551 - protein, 17 aa, Mycobacterium
WPRGMRVIARRERPHPG

SEQ ID NO: 877552 - protein, 17 aa, Mycobacterium
WPRYVRIAADLPSTATH

SEQ ID NO: 877553 - protein, 17 aa, Mycobacterium
WPSALRAAGFDAARPTA

SEQ ID NO: 877554 - protein, 17 aa, Mycobacterium
WPSEWIPAKREAAQAKY

SEQ ID NO: 877555 - protein, 20 aa, Mycobacterium
WPSFADVPAGWRVVFGEASR

SEQ ID NO: 877556 - protein, 17 aa, Mycobacterium
WPSFFDPSASEAVILRP

SEQ ID NO: 877557 - protein, 20 aa, Mycobacterium
WPSHILVPAIHRNRAEVREI

SEQ ID NO: 877558 - protein, 19 aa, Mycobacterium
WPSMFRGYLNAEERYRKSF

SEQ ID NO: 877559 - protein, 17 aa, Mycobacterium
WPTGLGFEYFYGFLAGE

SEQ ID NO: 877560 - protein, 23 aa, Mycobacterium
WPTLEQDGMLFVWNDPEKNPPPP

SEQ ID NO: 877561 - protein, 26 aa, Mycobacterium
WPTLEQDGMLFVWNDPQRKPPPDDVT

SEQ ID NO: 877562 - protein, 18 aa, Mycobacterium
WPTMFHPMTYVGMARLAK

SEQ ID NO: 877563 - protein, 21 aa, Mycobacterium
WPTTPFDLVVLSEVCYYLQPA

SEQ ID NO: 877564 - protein, 19 aa, Mycobacterium
WPVFEISTVAREGLRPLIF

SEQ ID NO: 877565 - protein, 18 aa, Mycobacterium
WPVKKKHGNKISWADLII

SEQ ID NO: 877566 - protein, 18 aa, Mycobacterium
WPVKKKYGKNLSWADLIV

SEQ ID NO: 877567 - protein, 31 aa, Mycobacterium
WPVMPVDIVSFWLKPYGFFDRNPALDVPATP

SEQ ID NO: 877568 - protein, 30 aa, Mycobacterium
WPVMPVDVVSFWLKPFGFFDRNPALDVVGT

SEQ ID NO: 877569 - protein, 18 aa, Mycobacterium
WPVNGTVFAVTPTLREAY

SEQ ID NO: 877570 - protein, 19 aa, Mycobacterium
WPVVFPELPPSPDGGPRRP

SEQ ID NO: 877571 - protein, 18 aa, Mycobacterium
WPWTDHWLALWRNTIGYS

SEQ ID NO: 877572 - protein, 24 aa, Mycobacterium
WQAGDLNLPLSYRFDPGSSDDGVT

SEQ ID NO: 877573 - protein, 17 aa, Mycobacterium
WQAGPGEGSIGFTESKI

SEQ ID NO: 877574 - protein, 18 aa, Mycobacterium
WQALASKCYDAVGQVWRD

SEQ ID NO: 877575 - protein, 18 aa, Mycobacterium
WQALPGEQWPQRLAEAAA

SEQ ID NO: 877576 - protein, 20 aa, Mycobacterium
WQAMVRAMRNNGRPGLVSCA

SEQ ID NO: 877577 - protein, 24 aa, Mycobacterium
WQASYLHNGAVYKALATFPTKSSA

SEQ ID NO: 877578 - protein, 29 aa, Mycobacterium
WQAVGNGVLFPFAATYMKLYAGTSAADQR

SEQ ID NO: 877579 - protein, 18 aa, Mycobacterium
WQDRLDNFQWVVGSLAAQ

SEQ ID NO: 877580 - protein, 20 aa, Mycobacterium
WQDVAGLPPERIQRRGMADN

SEQ ID NO: 877581 - protein, 22 aa, Mycobacterium
WQEFRAELIPLLDAAYPRRADG

SEQ ID NO: 877582 - protein, 20 aa, Mycobacterium
WQEIDLQRYGLTWKWPQTDC

SEQ ID NO: 877583 - protein, 17 aa, Mycobacterium
WQEMIDVNLSGVWKSVK

SEQ ID NO: 877584 - protein, 19 aa, Mycobacterium
WQGDTGLTYQAWQAQWNQA

SEQ ID NO: 877585 - protein, 25 aa, Mycobacterium
WQGEEGIILVSSTEERVKAAVDVFK

SEQ ID NO: 877586 - protein, 18 aa, Mycobacterium
WQGIAKLVPGIGFRQMGS

SEQ ID NO: 877587 - protein, 25 aa, Mycobacterium
WQGLGSKVTLLARGSRLLPRMEPFV

SEQ ID NO: 877588 - protein, 20 aa, Mycobacterium
WQHLPVPFEVYADGIDLVIF

SEQ ID NO: 877589 - protein, 21 aa, Mycobacterium
WQHSRFWVTDRSAMSELAATH

SEQ ID NO: 877590 - protein, 31 aa, Mycobacterium
WQIDLALARCSLASWLALQGALFELQRHVTE

SEQ ID NO: 877591 - protein, 21 aa, Mycobacterium
WQIRERVLALPTVSVLRGGVA

SEQ ID NO: 877592 - protein, 26 aa, Mycobacterium
WQLDAYRFEIPLLAHPTDALVSPEFA

SEQ ID NO: 877593 - protein, 26 aa, Mycobacterium
WQLQSKLTNYFYPQQKLISKVRKGAK

SEQ ID NO: 877594 - protein, 17 aa, Mycobacterium
WQLRRRVLALGNVEIRQ

SEQ ID NO: 877595 - protein, 17 aa, Mycobacterium
WQLRSRVRALPNVEIRH

SEQ ID NO: 877596 - protein, 20 aa, Mycobacterium
WQLSRRTAEMLLALSSSRVS

SEQ ID NO: 877597 - protein, 25 aa, Mycobacterium
WQMDSAARATLFTRYGLPAPGHDDD

SEQ ID NO: 877598 - protein, 17 aa, Mycobacterium
WQMTPHTDPSWKIKGCY

SEQ ID NO: 877599 - protein, 25 aa, Mycobacterium
WQNWEEMFAIARFIGVSRPGYELDG

SEQ ID NO: 877600 - protein, 17 aa, Mycobacterium
WQPTVPALVNLVAASGA

SEQ ID NO: 877601 - protein, 26 aa, Mycobacterium
WQPVRTPLNQLLANTGLPLQSTDPEA

SEQ ID NO: 877602 - protein, 20 aa, Mycobacterium
WQQIAGFGRRHLAGAAGLDR

SEQ ID NO: 877603 - protein, 24 aa, Mycobacterium
WQRALPVLRSVALFGLDRLDPVGD

SEQ ID NO: 877604 - protein, 17 aa, Mycobacterium
WQRDCLQDRPRQPWTHI

SEQ ID NO: 877605 - protein, 22 aa, Mycobacterium
WQRFPIVDRVAAATGLPVRLGG

SEQ ID NO: 877606 - protein, 32 aa, Mycobacterium
WQRNPEKVWAWYLWRHYMMARVAPNEAHRTVA

SEQ ID NO: 877607 - protein, 25 aa, Mycobacterium
WQRRRALVGSRIRALRLERGLSQES

SEQ ID NO: 877608 - protein, 21 aa, Mycobacterium
WQTEQYPLIDPAGLPLRLLAH

SEQ ID NO: 877609 - protein, 17 aa, Mycobacterium
WQWLQDGAQVYVCGTAD

SEQ ID NO: 877610 - protein, 18 aa, Mycobacterium
WQYPIPLGPDPDGEGDVV

SEQ ID NO: 877611 - protein, 17 aa, Mycobacterium
WRAAAAVELGVCEAALA

SEQ ID NO: 877612 - protein, 18 aa, Mycobacterium
WRAAFDHEQICVAIIKHA

SEQ ID NO: 877613 - protein, 17 aa, Mycobacterium
WRAAFDHEQTCVAIIKH

SEQ ID NO: 877614 - protein, 22 aa, Mycobacterium
WRAATLSGFRRDPDAALVFALE

SEQ ID NO: 877615 - protein, 17 aa, Mycobacterium
WRACDPIVLFSALSQVT

SEQ ID NO: 877616 - protein, 17 aa, Mycobacterium
WRADLLGKRLHRALGPL

SEQ ID NO: 877617 - protein, 18 aa, Mycobacterium
WRAGRFWWDWSETGEPDG

SEQ ID NO: 877618 - protein, 19 aa, Mycobacterium
WRALALVTTTADLVGVARG

SEQ ID NO: 877619 - protein, 18 aa, Mycobacterium
WRALRPDADVMDRANPVY

SEQ ID NO: 877620 - protein, 18 aa, Mycobacterium
WRAMAGPTPRLNPWRTPI

SEQ ID NO: 877621 - protein, 23 aa, Mycobacterium
WRAPARFPEFTLPTNVGAKADEQ

SEQ ID NO: 877622 - protein, 25 aa, Mycobacterium
WRARAMALVMLALPGTVFIYNGSEL

SEQ ID NO: 877623 - protein, 26 aa, Mycobacterium
WRATAHHFVLRRTDAGWRIATRTSRV

SEQ ID NO: 877624 - protein, 17 aa, Mycobacterium
WRAVQTRVWRGRPDPVR

SEQ ID NO: 877625 - protein, 17 aa, Mycobacterium
WRAWRAIIDKTLVLVRQ

SEQ ID NO: 877626 - protein, 17 aa, Mycobacterium
WRCRNPLIYRAVSSWFV

SEQ ID NO: 877627 - protein, 18 aa, Mycobacterium
WRCYRLDAADRPAGWQPA

SEQ ID NO: 877628 - protein, 26 aa, Mycobacterium
WRDARWLAVVINYRAQRWSDVVKLLT

SEQ ID NO: 877629 - protein, 26 aa, Mycobacterium
WRDGDRILVPHLVVTHGARGATCVGQ

SEQ ID NO: 877630 - protein, 20 aa, Mycobacterium
WRDGQMALRWCAAGMVEAGK

SEQ ID NO: 877631 - protein, 18 aa, Mycobacterium
WRDGRVEQLGWPRVKIHY

SEQ ID NO: 877632 - protein, 18 aa, Mycobacterium
WRDHGLRYLLVINGSQLN

SEQ ID NO: 877633 - protein, 18 aa, Mycobacterium
WRDIDTVHRLWRGDPITF

SEQ ID NO: 877634 - protein, 36 aa, Mycobacterium
WRDLGRPLHLHRILLQRSWIAIFWGRFAQAVEMIAQ

SEQ ID NO: 877635 - protein, 31 aa, Mycobacterium
WRDNPERVWGWYLWRHYLVADVQPNTGHRAI

SEQ ID NO: 877636 - protein, 25 aa, Mycobacterium
WRDPRVWWQLRNPFTPSWGEPYLEI

SEQ ID NO: 877637 - protein, 18 aa, Mycobacterium
WRDVEVAGLPIVLHASYP

SEQ ID NO: 877638 - protein, 19 aa, Mycobacterium
WRDYTLFDHVERFDRPFLS

SEQ ID NO: 877639 - protein, 26 aa, Mycobacterium
WREIDGVVIPPPFDLRTLLSGGRVQA

SEQ ID NO: 877640 - protein, 20 aa, Mycobacterium
WREIVGPENYFLELMDHGLT

SEQ ID NO: 877641 - protein, 24 aa, Mycobacterium
WREQPLPFGFASRSALGLERRRWE

SEQ ID NO: 877642 - protein, 25 aa, Mycobacterium
WRERRKLIKVLRKRGRILQSAPNLQ

SEQ ID NO: 877643 - protein, 29 aa, Mycobacterium
WREVHRLRQPVLLIWGREDRVNPLDGALV

SEQ ID NO: 877644 - protein, 28 aa, Mycobacterium
WREVHRLRQPVLLIWGREDRVNPLDGSL

SEQ ID NO: 877645 - protein, 22 aa, Mycobacterium
WRFERLFRHVDVAEPWNGSLAH

SEQ ID NO: 877646 - protein, 17 aa, Mycobacterium
WRFGRFHSRVRRVPEVL

SEQ ID NO: 877647 - protein, 18 aa, Mycobacterium
WRFLWIQRERFWRYDPPH

SEQ ID NO: 877648 - protein, 19 aa, Mycobacterium
WRFVGVPDLSSLGREVLFL

SEQ ID NO: 877649 - protein, 17 aa, Mycobacterium
WRGAFLAHGSLTEPGRS

SEQ ID NO: 877650 - protein, 18 aa, Mycobacterium
WRGAFLAHGSLTEPGRSS

SEQ ID NO: 877651 - protein, 17 aa, Mycobacterium
WRGDDLLLIGGPFDARA

SEQ ID NO: 877652 - protein, 19 aa, Mycobacterium
WRGHDPVQLPIIPGHEFAG

SEQ ID NO: 877653 - protein, 18 aa, Mycobacterium
WRGKPIRIGFAVRSALEE

SEQ ID NO: 877654 - protein, 17 aa, Mycobacterium
WRGLLENRRIHLHNDDR

SEQ ID NO: 877655 - protein, 26 aa, Mycobacterium
WRGPEPYFYIVEILSHFDLIAVQEVR

SEQ ID NO: 877656 - protein, 20 aa, Mycobacterium
WRGPIQQRFLRSRANTIEGG

SEQ ID NO: 877657 - protein, 19 aa, Mycobacterium
WRGQRLRALAALPELIAAA

SEQ ID NO: 877658 - protein, 23 aa, Mycobacterium
WRHFSPAVARRYLRGYRSRGTGH

SEQ ID NO: 877659 - protein, 24 aa, Mycobacterium
WRHGGSPLLRRLIDAGTVELLGGP

SEQ ID NO: 877660 - protein, 18 aa, Mycobacterium
WRHGMWQGDLVVQGKRYK

SEQ ID NO: 877661 - protein, 26 aa, Mycobacterium
WRHHGQKFAWMRETKFLVDDEPLSPF

SEQ ID NO: 877662 - protein, 20 aa, Mycobacterium
WRIMREALAFERVGIARYAR

SEQ ID NO: 877663 - protein, 24 aa, Mycobacterium
WRITGQKVWTSYALMASWCVLAAC

SEQ ID NO: 877664 - protein, 35 aa, Mycobacterium
WRKQTWLGRFVSTYGWRAYALPVLAVLTAVVMYQT

SEQ ID NO: 877665 - protein, 17 aa, Mycobacterium
WRKVWQQVGRVEEIPEV

SEQ ID NO: 877666 - protein, 17 aa, Mycobacterium
WRKVWQQVGRVEELPEV

SEQ ID NO: 877667 - protein, 17 aa, Mycobacterium
WRLDPDAVSLTAAGGRV

SEQ ID NO: 877668 - protein, 19 aa, Mycobacterium
WRLIRVVGDYYKPGFHPSQ

SEQ ID NO: 877669 - protein, 25 aa, Mycobacterium
WRLKQNYLLDLQLIRRGRVDDEALE

SEQ ID NO: 877670 - protein, 20 aa, Mycobacterium
WRLLAACHNLRTLLLQHCSA

SEQ ID NO: 877671 - protein, 18 aa, Mycobacterium
WRLLASFRTEPATEIIAR

SEQ ID NO: 877672 - protein, 18 aa, Mycobacterium
WRLRGQGIFAVSVNFGPW

SEQ ID NO: 877673 - protein, 25 aa, Mycobacterium
WRLYTRARFAPYVEKLLLDGARSKL

SEQ ID NO: 877674 - protein, 25 aa, Mycobacterium
WRLYTRSRFAPYVEKLLLDGARTKL

SEQ ID NO: 877675 - protein, 29 aa, Mycobacterium
WRMYTRSRYAPYVEKLLLDGARSKLTRAA

SEQ ID NO: 877676 - protein, 20 aa, Mycobacterium
WRNALAPRMLFALPRYREGT

SEQ ID NO: 877677 - protein, 19 aa, Mycobacterium
WRNFLTCNANLAVTLPPGL

SEQ ID NO: 877678 - protein, 17 aa, Mycobacterium
WRNGFPDELFAELRRNR

SEQ ID NO: 877679 - protein, 22 aa, Mycobacterium
WRPGCPFCWRLRRALRRRRLPT

SEQ ID NO: 877680 - protein, 18 aa, Mycobacterium
WRQDCLQYWRLRPICASG

SEQ ID NO: 877681 - protein, 21 aa, Mycobacterium
WRQGQWLTARLCPAPLRSEER

SEQ ID NO: 877682 - protein, 17 aa, Mycobacterium
WRQVRRLPKLVGETASG

SEQ ID NO: 877683 - protein, 18 aa, Mycobacterium
WRRAQGLPVCAIAWGAWA

SEQ ID NO: 877684 - protein, 17 aa, Mycobacterium
WRRAQGLPVCAIGWGAW

SEQ ID NO: 877685 - protein, 24 aa, Mycobacterium
WRRARGLPATAIAWGAWAQIGRAT

SEQ ID NO: 877686 - protein, 19 aa, Mycobacterium
WRRGNIFILGDAAHLTPPF

SEQ ID NO: 877687 - protein, 18 aa, Mycobacterium
WRRNVMACTGIEFCKLSF

SEQ ID NO: 877688 - protein, 18 aa, Mycobacterium
WRRTFAVNIDSFFHVTKA

SEQ ID NO: 877689 - protein, 17 aa, Mycobacterium
WRRVWQQVGRVEELPEV

SEQ ID NO: 877690 - protein, 18 aa, Mycobacterium
WRRVWQQVGRVEELPEVG

SEQ ID NO: 877691 - protein, 18 aa, Mycobacterium
WRRYVALVVDAISVDERR

SEQ ID NO: 877692 - protein, 25 aa, Mycobacterium
WRSAETFLLQQTWMPDIVDIVTIAK

SEQ ID NO: 877693 - protein, 17 aa, Mycobacterium
WRSGAPLVLAPECDDPA

SEQ ID NO: 877694 - protein, 18 aa, Mycobacterium
WRSGRLPVESLVSSTIRL

SEQ ID NO: 877695 - protein, 18 aa, Mycobacterium
WRSKYFLTRKIGEQIYYD

SEQ ID NO: 877696 - protein, 19 aa, Mycobacterium
WRSLVPALDRIEVPALICG

SEQ ID NO: 877697 - protein, 29 aa, Mycobacterium
WRSPRAAAWTRRWRRCGRSRSVRRRRICP

SEQ ID NO: 877698 - protein, 18 aa, Mycobacterium
WRSRGGGFVFFAGARGDA

SEQ ID NO: 877699 - protein, 23 aa, Mycobacterium
WRSVTWTMLVTLFLRAYESRSPR

SEQ ID NO: 877700 - protein, 20 aa, Mycobacterium
WRTDLQSALGTLASLLGSVG

SEQ ID NO: 877701 - protein, 24 aa, Mycobacterium
WRTQMSFVIAVPDFIGAAATELAN

SEQ ID NO: 877702 - protein, 21 aa, Mycobacterium
WRTRLPRELFSIPKYGTVNLH

SEQ ID NO: 877703 - protein, 32 aa, Mycobacterium
WRVAHPFEAGFAVRLIVWFPSDREVVVALFSA

SEQ ID NO: 877704 - protein, 27 aa, Mycobacterium
WRVDGPAPVLPYLTLRLTGVASLTVDV

SEQ ID NO: 877705 - protein, 19 aa, Mycobacterium
WRVDWNTLVDATVPIALFT

SEQ ID NO: 877706 - protein, 22 aa, Mycobacterium
WRVGFCGFAPGFAYLVDGDARL

SEQ ID NO: 877707 - protein, 23 aa, Mycobacterium
WRVHSHLPALIFGLYCAAFMESL

SEQ ID NO: 877708 - protein, 20 aa, Mycobacterium
WRVLRVFERRGLPLTIFAVA

SEQ ID NO: 877709 - protein, 18 aa, Mycobacterium
WRVLSRLGDGFALAPRGL

SEQ ID NO: 877710 - protein, 20 aa, Mycobacterium
WRVMREALAFERVGIARYAR

SEQ ID NO: 877711 - protein, 21 aa, Mycobacterium
WRVRGFGDFFSYCLVAEGAVD

SEQ ID NO: 877712 - protein, 22 aa, Mycobacterium
WRVTGWFMIGWSAEYPVGEVKA

SEQ ID NO: 877713 - protein, 18 aa, Mycobacterium
WSAAFARYERTVGQVLLT

SEQ ID NO: 877714 - protein, 26 aa, Mycobacterium
WSADQRFLLNVPLFGREQRHPDVDKI

SEQ ID NO: 877715 - protein, 24 aa, Mycobacterium
WSAEGLIIYLPSAAQDLLFERVVA

SEQ ID NO: 877716 - protein, 17 aa, Mycobacterium
WSAEGLLRYLPATAQDL

SEQ ID NO: 877717 - protein, 24 aa, Mycobacterium
WSAEGLLVYLPPEAQDRLFDNIAA

SEQ ID NO: 877718 - protein, 17 aa, Mycobacterium
WSAGRIINLDIGGGSLE

SEQ ID NO: 877719 - protein, 24 aa, Mycobacterium
WSAHPWTTRFGFPVPGRPAPLHPN

SEQ ID NO: 877720 - protein, 24 aa, Mycobacterium
WSAITGIYAMFNRHELPAVDWVIA

SEQ ID NO: 877721 - protein, 29 aa, Mycobacterium
WSALPEWPQMLLRALMFRLAVHALHPRST

SEQ ID NO: 877722 - protein, 20 aa, Mycobacterium
WSATDLMVPGPRGVVAVLTP

SEQ ID NO: 877723 - protein, 20 aa, Mycobacterium
WSDAAQLPLALLEPHMRFRQ

SEQ ID NO: 877724 - protein, 23 aa, Mycobacterium
WSDAVQLPLCLLTQGMRGRRVID

SEQ ID NO: 877725 - protein, 24 aa, Mycobacterium
WSDFGFHEYLEVKSILGYAPDKSA

SEQ ID NO: 877726 - protein, 22 aa, Mycobacterium
WSDIGTWTRPHPPLYVGGGARA

SEQ ID NO: 877727 - protein, 18 aa, Mycobacterium
WSDLEVVDLPGLDWSTVK

SEQ ID NO: 877728 - protein, 24 aa, Mycobacterium
WSDLPGRERAKILWRIGDLIDEHA

SEQ ID NO: 877729 - protein, 24 aa, Mycobacterium
WSDPSLAALTWLANPQRLQNFFAG

SEQ ID NO: 877730 - protein, 20 aa, Mycobacterium
WSDYTIPLKGAPGTYTVSIA

SEQ ID NO: 877731 - protein, 20 aa, Mycobacterium
WSELAAVVYGLVLEGRETES

SEQ ID NO: 877732 - protein, 27 aa, Mycobacterium
WSETGLVQWLCAPTTYLDGDRPVDHLL

SEQ ID NO: 877733 - protein, 19 aa, Mycobacterium
WSFLYRHIIVALRDHFRCI

SEQ ID NO: 877734 - protein, 17 aa, Mycobacterium
WSFLYRNVIVALRDRFR

SEQ ID NO: 877735 - protein, 18 aa, Mycobacterium
WSFTGWYDTTEAQALLEF

SEQ ID NO: 877736 - protein, 21 aa, Mycobacterium
WSGAATFLFTRTTVGEIGIMP

SEQ ID NO: 877737 - protein, 21 aa, Mycobacterium
WSGAGTFLFTRTTVGEIGILP

SEQ ID NO: 877738 - protein, 19 aa, Mycobacterium
WSGPIENWIAACDAMIALE

SEQ ID NO: 877739 - protein, 21 aa, Mycobacterium
WSGRHLVDCLRLGADRFGWAA

SEQ ID NO: 877740 - protein, 17 aa, Mycobacterium
WSGTALHRRARRIALPT

SEQ ID NO: 877741 - protein, 18 aa, Mycobacterium
WSHLTPQLADEAAANHCF

SEQ ID NO: 877742 - protein, 18 aa, Mycobacterium
WSIHRKPPAFDQLEPRTE

SEQ ID NO: 877743 - protein, 17 aa, Mycobacterium
WSIHRKPPPFSELEPRT

SEQ ID NO: 877744 - protein, 17 aa, Mycobacterium
WSILNRSGELQESVWSY

SEQ ID NO: 877745 - protein, 17 aa, Mycobacterium
WSISDFAIRTLPPAIRS

SEQ ID NO: 877746 - protein, 18 aa, Mycobacterium
WSKRPRGAQLGAWASQQS

SEQ ID NO: 877747 - protein, 18 aa, Mycobacterium
WSKRPRGSQLGAWASQQS

SEQ ID NO: 877748 - protein, 21 aa, Mycobacterium
WSLARNPELLDLILAANPAAI

SEQ ID NO: 877749 - protein, 19 aa, Mycobacterium
WSLLSITAPGLFPNPAKFA

SEQ ID NO: 877750 - protein, 17 aa, Mycobacterium
WSLTNMGVFFNSMDFRY

SEQ ID NO: 877751 - protein, 18 aa, Mycobacterium
WSLTRADGRWRISKRTVL

SEQ ID NO: 877752 - protein, 24 aa, Mycobacterium
WSLVHGFSTLWLNDALDAQVRALD

SEQ ID NO: 877753 - protein, 25 aa, Mycobacterium
WSLVPDVLTAMLLMRAIRGERVDAN

SEQ ID NO: 877754 - protein, 20 aa, Mycobacterium
WSLVVLDINLDLSTAAGRMM

SEQ ID NO: 877755 - protein, 17 aa, Mycobacterium
WSMAVALRLAAFALLRA

SEQ ID NO: 877756 - protein, 19 aa, Mycobacterium
WSMLAVLVRNRGKLVGQKE

SEQ ID NO: 877757 - protein, 17 aa, Mycobacterium
WSMMRRNDQFRSALASR

SEQ ID NO: 877758 - protein, 23 aa, Mycobacterium
WSNAFLENLYGNEWELTKSPAGA

SEQ ID NO: 877759 - protein, 26 aa, Mycobacterium
WSNDDVWTFLMQTPNPWGYSNKELLT

SEQ ID NO: 877760 - protein, 23 aa, Mycobacterium
WSNEQIHERFGFSEIMMGTLEKD

SEQ ID NO: 877761 - protein, 19 aa, Mycobacterium
WSNLRYRDSRRIGRRAEVA

SEQ ID NO: 877762 - protein, 23 aa, Mycobacterium
WSNNPIVICSAAVSVFYVDHEGS

SEQ ID NO: 877763 - protein, 17 aa, Mycobacterium
WSNSLHWAGVHAGILAS

SEQ ID NO: 877764 - protein, 18 aa, Mycobacterium
WSPARYRQLLALHDERQR

SEQ ID NO: 877765 - protein, 26 aa, Mycobacterium
WSPEAKIVAERRLWLAVLRAQAELGV

SEQ ID NO: 877766 - protein, 21 aa, Mycobacterium
WSPKRLPDSLLHYMRTRGKNK

SEQ ID NO: 877767 - protein, 23 aa, Mycobacterium
WSPKRLPEALLHYMRTRGKNKVI

SEQ ID NO: 877768 - protein, 24 aa, Mycobacterium
WSPKRLPESLLHYMRTRGKGKVIF

SEQ ID NO: 877769 - protein, 23 aa, Mycobacterium
WSPKRLPESLLHYMRTRGPDKII

SEQ ID NO: 877770 - protein, 31 aa, Mycobacterium
WSPQAKVVAERRLWLAVLRAQRELGAKGTDV

SEQ ID NO: 877771 - protein, 25 aa, Mycobacterium
WSPQCRWMKPFGPLRQGTRTLNLNR

SEQ ID NO: 877772 - protein, 26 aa, Mycobacterium
WSQFHSYAFDFSVWEIWGALLHGGRL

SEQ ID NO: 877773 - protein, 20 aa, Mycobacterium
WSQMAVIVRSVPRAAARLPR

SEQ ID NO: 877774 - protein, 24 aa, Mycobacterium
WSQWHSLVFDVSVWEIWGALLHGG

SEQ ID NO: 877775 - protein, 25 aa, Mycobacterium
WSQWHSLVFDVSVWEIWGPLLHGGR

SEQ ID NO: 877776 - protein, 22 aa, Mycobacterium
WSQWHSMVFDVSVWEVWGALLH

SEQ ID NO: 877777 - protein, 17 aa, Mycobacterium
WSRDSVAAAMKVVAALN

SEQ ID NO: 877778 - protein, 26 aa, Mycobacterium
WSRQLPWLRGLGRVYTYDAPWHRGGD

SEQ ID NO: 877779 - protein, 21 aa, Mycobacterium
WSRRVCATWTGVASIKVVYES

SEQ ID NO: 877780 - protein, 18 aa, Mycobacterium
WSRSGAGHLPIVLGLNLT

SEQ ID NO: 877781 - protein, 28 aa, Mycobacterium
WSRTDHYGWISGLLLELGITSLDALTAV

SEQ ID NO: 877782 - protein, 29 aa, Mycobacterium
WSRTLDFDVPAFDGFWAAGALRLPTDDGL

SEQ ID NO: 877783 - protein, 25 aa, Mycobacterium
WSRVRYRNYAFIRVDVRPGALVSEM

SEQ ID NO: 877784 - protein, 17 aa, Mycobacterium
WSRYGIRTLCVAPGTIA

SEQ ID NO: 877785 - protein, 23 aa, Mycobacterium
WSSADDYLRFVRMLLGGGTIDGV

SEQ ID NO: 877786 - protein, 21 aa, Mycobacterium
WSSAPNFAFDLAARKTTDADL

SEQ ID NO: 877787 - protein, 21 aa, Mycobacterium
WSSAPNFAFDLAARRTSDEDL

SEQ ID NO: 877788 - protein, 17 aa, Mycobacterium
WSSLALKPERPWLELNS

SEQ ID NO: 877789 - protein, 17 aa, Mycobacterium
WSSQLPAELTWMAPLLT

SEQ ID NO: 877790 - protein, 27 aa, Mycobacterium
WSSTGNRWYDVFAQTWHESLSVDWRGT

SEQ ID NO: 877791 - protein, 27 aa, Mycobacterium
WSTADDYLRFVRMLLGEGTVDGVRVLS

SEQ ID NO: 877792 - protein, 20 aa, Mycobacterium
WSVGAVGLVAGWAARTLPSD

SEQ ID NO: 877793 - protein, 25 aa, Mycobacterium
WSVGMSYLVVGPELLASAATDLTRI

SEQ ID NO: 877794 - protein, 24 aa, Mycobacterium
WSVIGDFHGLPAWVTMVRSNTPEN

SEQ ID NO: 877795 - protein, 24 aa, Mycobacterium
WSVNHNGFQLVLSPELPALIERYL

SEQ ID NO: 877796 - protein, 24 aa, Mycobacterium
WSVTGIGQFLPLDGASPAIGSVGT

SEQ ID NO: 877797 - protein, 18 aa, Mycobacterium
WSVVLRGRGACATLDGAC

SEQ ID NO: 877798 - protein, 20 aa, Mycobacterium
WSWDAPFSYVAERYARDRDA

SEQ ID NO: 877799 - protein, 20 aa, Mycobacterium
WSWFRHPVKSHEFPARNERL

SEQ ID NO: 877800 - protein, 20 aa, Mycobacterium
WSYGGYLTQAALAFHPDEFA

SEQ ID NO: 877801 - protein, 26 aa, Mycobacterium
WSYTDPFPESLPIKGFLSFDDTRIDV

SEQ ID NO: 877802 - protein, 18 aa, Mycobacterium
WTAAHGVAALLIAKPHLP

SEQ ID NO: 877803 - protein, 23 aa, Mycobacterium
WTAFVPSFARWPYEVSLYPHRQV

SEQ ID NO: 877804 - protein, 17 aa, Mycobacterium
WTAGRFSFNVADGRCPT

SEQ ID NO: 877805 - protein, 18 aa, Mycobacterium
WTALDRTRYMQSSKTFVL

SEQ ID NO: 877806 - protein, 17 aa, Mycobacterium
WTAQFEHTLLVTDTGVE

SEQ ID NO: 877807 - protein, 17 aa, Mycobacterium
WTARRMPFRVHIAYYRY

SEQ ID NO: 877808 - protein, 18 aa, Mycobacterium
WTASGGSITARWAVLYEL

SEQ ID NO: 877809 - protein, 17 aa, Mycobacterium
WTATFSDALIGYGTKRR

SEQ ID NO: 877810 - protein, 25 aa, Mycobacterium
WTAYTELMCVAMRAKFTGPVLDYVK

SEQ ID NO: 877811 - protein, 17 aa, Mycobacterium
WTCYPGRAEYFTHWGGA

SEQ ID NO: 877812 - protein, 17 aa, Mycobacterium
WTDFGDRVAGVHFVDQD

SEQ ID NO: 877813 - protein, 24 aa, Mycobacterium
WTDGEPLLAAPFYPVTPHQWDRRV

SEQ ID NO: 877814 - protein, 18 aa, Mycobacterium
WTDGPLTRAVKAGAICYL

SEQ ID NO: 877815 - protein, 17 aa, Mycobacterium
WTDPAPLDMLSPIAWIT

SEQ ID NO: 877816 - protein, 30 aa, Mycobacterium
WTDRWEMGLLSQQRILLVGLGGIGRVIARK

SEQ ID NO: 877817 - protein, 17 aa, Mycobacterium
WTDSHLHRFSLGGGAFD

SEQ ID NO: 877818 - protein, 18 aa, Mycobacterium
WTEAAMFRGFEIILRGKD

SEQ ID NO: 877819 - protein, 26 aa, Mycobacterium
WTEEETYFFRLSAYTDRLLALYAERP

SEQ ID NO: 877820 - protein, 24 aa, Mycobacterium
WTEEQTYFFRLSAYADKLLAHYEA

SEQ ID NO: 877821 - protein, 25 aa, Mycobacterium
WTEEQTYFFRLSAYTDRLLALYEEH

SEQ ID NO: 877822 - protein, 20 aa, Mycobacterium
WTEVALWGQGWPLGVDRAIA

SEQ ID NO: 877823 - protein, 17 aa, Mycobacterium
WTFDPVRRQFYWHRFFS

SEQ ID NO: 877824 - protein, 23 aa, Mycobacterium
WTFDVLTHHWATLWPVRHRRVRA

SEQ ID NO: 877825 - protein, 20 aa, Mycobacterium
WTFSVQYRILRQPRPVTFSA

SEQ ID NO: 877826 - protein, 24 aa, Mycobacterium
WTGAQLRRLLAERAGLELSSASVS

SEQ ID NO: 877827 - protein, 18 aa, Mycobacterium
WTGPLGVTYPGVVTHGVV

SEQ ID NO: 877828 - protein, 23 aa, Mycobacterium
WTGQSVPAARLLGGITGAELIAI

SEQ ID NO: 877829 - protein, 20 aa, Mycobacterium
WTGRKIAELTNEPLWRVVQA

SEQ ID NO: 877830 - protein, 22 aa, Mycobacterium
WTGRKIAELVNEPLWRVVQAHP

SEQ ID NO: 877831 - protein, 22 aa, Mycobacterium
WTGRKIAELVSEPLWKVVQAHP

SEQ ID NO: 877832 - protein, 22 aa, Mycobacterium
WTGRVVPWDQAWPGWDLTAVWE

SEQ ID NO: 877833 - protein, 18 aa, Mycobacterium
WTGSERLFALQAHVLRAA

SEQ ID NO: 877834 - protein, 23 aa, Mycobacterium
WTGTELRRLLSERAGLELSAASV

SEQ ID NO: 877835 - protein, 24 aa, Mycobacterium
WTGVHEIWLRRQRFVDSHTTAAFD

SEQ ID NO: 877836 - protein, 24 aa, Mycobacterium
WTHPSGVWVPVPDSHRTISPGVVR

SEQ ID NO: 877837 - protein, 26 aa, Mycobacterium
WTIADLIWHVGVVHTFWRQVAVGAIT

SEQ ID NO: 877838 - protein, 25 aa, Mycobacterium
WTIAHQIGHLLWTDQMALLAVTDEA

SEQ ID NO: 877839 - protein, 20 aa, Mycobacterium
WTIETARLRRLYLDGRGLPT

SEQ ID NO: 877840 - protein, 20 aa, Mycobacterium
WTKDKLILVTLRDVVSHIEI

SEQ ID NO: 877841 - protein, 26 aa, Mycobacterium
WTLHARLVRRHLERGIYQGWDMHPAQ

SEQ ID NO: 877842 - protein, 19 aa, Mycobacterium
WTMAYPFVRLHQPSAFYGV

SEQ ID NO: 877843 - protein, 20 aa, Mycobacterium
WTMAYPFVRLHQPSAFYGVN

SEQ ID NO: 877844 - protein, 17 aa, Mycobacterium
WTMLGNLAYGRPKRLRL

SEQ ID NO: 877845 - protein, 17 aa, Mycobacterium
WTMVPGSYRAAGEAPTQ

SEQ ID NO: 877846 - protein, 20 aa, Mycobacterium
WTNATAPAWARPLITVNPVL

SEQ ID NO: 877847 - protein, 23 aa, Mycobacterium
WTNEQIHERFGFSEIMMGTLEKD

SEQ ID NO: 877848 - protein, 21 aa, Mycobacterium
WTPLGSIPEFNRDALVSTLQD

SEQ ID NO: 877849 - protein, 21 aa, Mycobacterium
WTPTGFPVEFLSLGTEGIGVP

SEQ ID NO: 877850 - protein, 25 aa, Mycobacterium
WTPTGFPVEFLSLGTGGLGVPVRAT

SEQ ID NO: 877851 - protein, 19 aa, Mycobacterium
WTPTGFPVEFLSLGTSGVG

SEQ ID NO: 877852 - protein, 18 aa, Mycobacterium
WTPVGKADGCGCPMWTAP

SEQ ID NO: 877853 - protein, 21 aa, Mycobacterium
WTPVTLLEGGTPLIAATRLSE

SEQ ID NO: 877854 - protein, 18 aa, Mycobacterium
WTQDATAMYGYAAASSAA

SEQ ID NO: 877855 - protein, 26 aa, Mycobacterium
WTQFHSYAFDFSVWEIWGALLHGGRL

SEQ ID NO: 877856 - protein, 19 aa, Mycobacterium
WTQRLVSLLVFDGPQLPAP

SEQ ID NO: 877857 - protein, 25 aa, Mycobacterium
WTQRYGQRCWLRQLTPHPTREQENR

SEQ ID NO: 877858 - protein, 36 aa, Mycobacterium
WTQTKIGARRYRHPLCLRVHFPAGTLLDDTGCIIHI

SEQ ID NO: 877859 - protein, 24 aa, Mycobacterium
WTRDDVRRYLWLNGTNDWDDVSYG

SEQ ID NO: 877860 - protein, 19 aa, Mycobacterium
WTRLHFEFVCPQYSEVVAD

SEQ ID NO: 877861 - protein, 26 aa, Mycobacterium
WTRNPDGLIVVGWSLGAAAAAGLTAD

SEQ ID NO: 877862 - protein, 17 aa, Mycobacterium
WTRPVVLAPQAAAPVVE

SEQ ID NO: 877863 - protein, 25 aa, Mycobacterium
WTRRKYQLLELPQLPGRGWVEYEPY

SEQ ID NO: 877864 - protein, 19 aa, Mycobacterium
WTRRVTDVRNWFVFSASER

SEQ ID NO: 877865 - protein, 18 aa, Mycobacterium
WTSFAQFSQRCILLTRTG

SEQ ID NO: 877866 - protein, 23 aa, Mycobacterium
WTTACAYDQLIPGRGVGVLLDDG

SEQ ID NO: 877867 - protein, 25 aa, Mycobacterium
WTTALLHPRLVRAIALISSPHPAAL

SEQ ID NO: 877868 - protein, 20 aa, Mycobacterium
WTTDKDGIIAALLASEILAV

SEQ ID NO: 877869 - protein, 25 aa, Mycobacterium
WTTDKDGIILALLASEIFAVTGKTP

SEQ ID NO: 877870 - protein, 26 aa, Mycobacterium
WTTDKDGIILALLASEILAVTGATPS

SEQ ID NO: 877871 - protein, 26 aa, Mycobacterium
WTTDKDGIILALLASEILAVTGSTPS

SEQ ID NO: 877872 - protein, 28 aa, Mycobacterium
WTTGLPAKGSRFIVCSQIQVVYPGVNLT

SEQ ID NO: 877873 - protein, 25 aa, Mycobacterium
WTTHGDLALPLLPTARELAAGDVLW

SEQ ID NO: 877874 - protein, 23 aa, Mycobacterium
WTTLQQDGMLFVWNDPERKPPPP

SEQ ID NO: 877875 - protein, 23 aa, Mycobacterium
WTTPREYRRWLQQQPLGPNVAAM

SEQ ID NO: 877876 - protein, 20 aa, Mycobacterium
WTTQGFPPGAPYMGPTGKDF

SEQ ID NO: 877877 - protein, 24 aa, Mycobacterium
WTTTFADALIEYAGKRRDIVAITA

SEQ ID NO: 877878 - protein, 25 aa, Mycobacterium
WTVPTRLALVRRLGSIDLDLTKARF

SEQ ID NO: 877879 - protein, 25 aa, Mycobacterium
WTVQQQLRQLESIGILLCLCTKNNA

SEQ ID NO: 877880 - protein, 24 aa, Mycobacterium
WTVRWVVMHLIEELSRHAGHADII

SEQ ID NO: 877881 - protein, 18 aa, Mycobacterium
WTWAHLRTGAEGMNPFDY

SEQ ID NO: 877882 - protein, 17 aa, Mycobacterium
WTWNQRWLNTIRNIRSS

SEQ ID NO: 877883 - protein, 21 aa, Mycobacterium
WTYAHIRPEFADRAQILAIAT

SEQ ID NO: 877884 - protein, 22 aa, Mycobacterium
WTYEDPFPEVAPIARYLAFYPD

SEQ ID NO: 877885 - protein, 17 aa, Mycobacterium
WVAACDAMIALDAPTVV

SEQ ID NO: 877886 - protein, 27 aa, Mycobacterium
WVAACLFRYYLDQYTLLYGPLDTATLD

SEQ ID NO: 877887 - protein, 18 aa, Mycobacterium
WVAALRTSLQARRDRLAA

SEQ ID NO: 877888 - protein, 18 aa, Mycobacterium
WVAALVGVCPELTPPHAR

SEQ ID NO: 877889 - protein, 24 aa, Mycobacterium
WVADFLEFVKKERLFATFLTPSEF

SEQ ID NO: 877890 - protein, 18 aa, Mycobacterium
WVADLDGEIVGCGALHVL

SEQ ID NO: 877891 - protein, 34 aa, Mycobacterium
WVADRDTTLGLLPIGYADGVYRALSGRIDVLIKG

SEQ ID NO: 877892 - protein, 24 aa, Mycobacterium
WVADRQIVPSLLKYGTEAQKSHFL

SEQ ID NO: 877893 - protein, 29 aa, Mycobacterium
WVAEAEVVDFPLHPGFAASWQGLRCAPVT

SEQ ID NO: 877894 - protein, 18 aa, Mycobacterium
WVAFPNVEQLERAVFDMV

SEQ ID NO: 877895 - protein, 17 aa, Mycobacterium
WVAGLRAALPDPVSVVA

SEQ ID NO: 877896 - protein, 17 aa, Mycobacterium
WVAIEDIGRLRDGVGAP

SEQ ID NO: 877897 - protein, 25 aa, Mycobacterium
WVALRNRINFKPGSRVLILGATGSS

SEQ ID NO: 877898 - protein, 23 aa, Mycobacterium
WVAMASEYRALAALPGVDQARIW

SEQ ID NO: 877899 - protein, 17 aa, Mycobacterium
WVAPANVAPVTTVGAGG

SEQ ID NO: 877900 - protein, 18 aa, Mycobacterium
WVAREGRIPLGYFNDPDA

SEQ ID NO: 877901 - protein, 23 aa, Mycobacterium
WVARGYVMTYQRAYTPRWDEAVE

SEQ ID NO: 877902 - protein, 20 aa, Mycobacterium
WVARIGTVVMSWRLRTRHGL

SEQ ID NO: 877903 - protein, 21 aa, Mycobacterium
WVARIGTVVMSWRLRTRHGLP

SEQ ID NO: 877904 - protein, 25 aa, Mycobacterium
WVARIGTVVMSWRLRTRHGLPVHDI

SEQ ID NO: 877905 - protein, 17 aa, Mycobacterium
WVARKAKKLALDLTTGA

SEQ ID NO: 877906 - protein, 21 aa, Mycobacterium
WVASIIGVHNWHLALFDQQAQ

SEQ ID NO: 877907 - protein, 35 aa, Mycobacterium
WVDDMHDWCISRQLWWGHRIPIWYGPDGEKVCVGP

SEQ ID NO: 877908 - protein, 35 aa, Mycobacterium
WVDDMHDWCISRQLWWGHRIPIWYGPNGEKVCVGP

SEQ ID NO: 877909 - protein, 32 aa, Mycobacterium
WVDEPLRNLGLIMSSLLLDARVVWGEVGLHTA

SEQ ID NO: 877910 - protein, 23 aa, Mycobacterium
WVDGELYITGRVKDLIIVDGRNH

SEQ ID NO: 877911 - protein, 19 aa, Mycobacterium
WVDGEPIGFALRDGKLHEL

SEQ ID NO: 877912 - protein, 24 aa, Mycobacterium
WVDGLVAYRRAHGLPAIGINWGPW

SEQ ID NO: 877913 - protein, 22 aa, Mycobacterium
WVDGPDRPALLAAVPEADALLV

SEQ ID NO: 877914 - protein, 20 aa, Mycobacterium
WVDGQYLLVTGRAKDVIIRN

SEQ ID NO: 877915 - protein, 17 aa, Mycobacterium
WVDGRPTPPGPLVNTAI

SEQ ID NO: 877916 - protein, 28 aa, Mycobacterium
WVDGSPWIGNIDLSFPYLDTEATRIIGV

SEQ ID NO: 877917 - protein, 22 aa, Mycobacterium
WVDRTRALYGAWYELFPRSTGG

SEQ ID NO: 877918 - protein, 19 aa, Mycobacterium
WVDSAREGHLAWGIQHFRK

SEQ ID NO: 877919 - protein, 25 aa, Mycobacterium
WVDSWYPDALAAVDAFLPVFDAAPV

SEQ ID NO: 877920 - protein, 17 aa, Mycobacterium
WVEALTGAGYQVYAVNP

SEQ ID NO: 877921 - protein, 18 aa, Mycobacterium
WVEGNTTYVLIRRENLPL

SEQ ID NO: 877922 - protein, 17 aa, Mycobacterium
WVEHVRKPVRFADGVAL

SEQ ID NO: 877923 - protein, 18 aa, Mycobacterium
WVEITSTTPARMFGLYGR

SEQ ID NO: 877924 - protein, 25 aa, Mycobacterium
WVELNPHPLYLPSRGLPPVGSGLAP

SEQ ID NO: 877925 - protein, 20 aa, Mycobacterium
WVERALPDYDNLRAAFGHAM

SEQ ID NO: 877926 - protein, 17 aa, Mycobacterium
WVERTYGHPCDVGRAGL

SEQ ID NO: 877927 - protein, 19 aa, Mycobacterium
WVETLGHRRGFLQFRWQRV

SEQ ID NO: 877928 - protein, 25 aa, Mycobacterium
WVETMLRLPDIRALLQRHLAGRPTR

SEQ ID NO: 877929 - protein, 19 aa, Mycobacterium
WVEYALRAPVMLVRNKDGA

SEQ ID NO: 877930 - protein, 18 aa, Mycobacterium
WVGLGRIVYASSSAQLTQ

SEQ ID NO: 877931 - protein, 32 aa, Mycobacterium
WVGPASISMISAIAPFISWLSAVAAQAEEAAS

SEQ ID NO: 877932 - protein, 25 aa, Mycobacterium
WVIANPHRALALAADMPKLIAACEW

SEQ ID NO: 877933 - protein, 18 aa, Mycobacterium
WVIAVQWHPEERLDDLRL

SEQ ID NO: 877934 - protein, 25 aa, Mycobacterium
WVIHGALFRFPKLKVGIVEAGSKWM

SEQ ID NO: 877935 - protein, 21 aa, Mycobacterium
WVIHGALFRHPKLKVGIVEAG

SEQ ID NO: 877936 - protein, 18 aa, Mycobacterium
WVIKRKLFQRYQDRYSME

SEQ ID NO: 877937 - protein, 21 aa, Mycobacterium
WVINDARFLLYPAMKELTLNI

SEQ ID NO: 877938 - protein, 19 aa, Mycobacterium
WVKPLPPQTLTGKTVAVVG

SEQ ID NO: 877939 - protein, 17 aa, Mycobacterium
WVLAPRSLATGRELGGA

SEQ ID NO: 877940 - protein, 18 aa, Mycobacterium
WVLFLWSLGRLWVTMLSK

SEQ ID NO: 877941 - protein, 19 aa, Mycobacterium
WVLFPNYFMTVRAGECHVI

SEQ ID NO: 877942 - protein, 19 aa, Mycobacterium
WVLGTANTPARLVLPGDVA

SEQ ID NO: 877943 - protein, 21 aa, Mycobacterium
WVLLQIAGPSMFRRWCRLVGR

SEQ ID NO: 877944 - protein, 19 aa, Mycobacterium
WVLMALGAAPHVELNWAIE

SEQ ID NO: 877945 - protein, 25 aa, Mycobacterium
WVLTPQHAKLWYQVVTAFLDENLRN

SEQ ID NO: 877946 - protein, 18 aa, Mycobacterium
WVMLYQYGNPANADAHYR

SEQ ID NO: 877947 - protein, 18 aa, Mycobacterium
WVMLYQYGNPANTDAHYR

SEQ ID NO: 877948 - protein, 19 aa, Mycobacterium
WVMSYPLYGVQQAGAKCPG

SEQ ID NO: 877949 - protein, 17 aa, Mycobacterium
WVNMLRTTLAAFGAGVG

SEQ ID NO: 877950 - protein, 22 aa, Mycobacterium
WVNRYHALVYPLVSQPAKTSDP

SEQ ID NO: 877951 - protein, 24 aa, Mycobacterium
WVNTIFLSTRFRAWRVGGYNEYLY

SEQ ID NO: 877952 - protein, 18 aa, Mycobacterium
WVPDLFKGLKGVYKKMPQ

SEQ ID NO: 877953 - protein, 18 aa, Mycobacterium
WVPHLFKGLKGVYKKMPN

SEQ ID NO: 877954 - protein, 18 aa, Mycobacterium
WVPLRELPSRLAYADERR

SEQ ID NO: 877955 - protein, 24 aa, Mycobacterium
WVPQLWKDMDTTLAAAPLGSGDTA

SEQ ID NO: 877956 - protein, 20 aa, Mycobacterium
WVPQVWRDMDTTLAAAPLSD

SEQ ID NO: 877957 - protein, 17 aa, Mycobacterium
WVPTFPNARYLLPAADY

SEQ ID NO: 877958 - protein, 17 aa, Mycobacterium
WVQAYDPNGPAGTTIDK

SEQ ID NO: 877959 - protein, 21 aa, Mycobacterium
WVQDYQLQLVPKMLRELRPDL

SEQ ID NO: 877960 - protein, 20 aa, Mycobacterium
WVQLLGLDRLPEHIVGKRVT

SEQ ID NO: 877961 - protein, 20 aa, Mycobacterium
WVQLMDRLGYDRFLAHGGDW

SEQ ID NO: 877962 - protein, 26 aa, Mycobacterium
WVRAETLLHLGVMPPGFVGASLNPVG

SEQ ID NO: 877963 - protein, 26 aa, Mycobacterium
WVRAETLLHLKVMPPGFVGASLNPVG

SEQ ID NO: 877964 - protein, 28 aa, Mycobacterium
WVRALADLRVARLLAYRAVALRDDPTAG

SEQ ID NO: 877965 - protein, 28 aa, Mycobacterium
WVRALVDLRVARLLAYRAVSLQDDPAAG

SEQ ID NO: 877966 - protein, 26 aa, Mycobacterium
WVRDSTFALWGLYTLGLDREADDFFS

SEQ ID NO: 877967 - protein, 19 aa, Mycobacterium
WVRDTLAVITMIEATVVIV

SEQ ID NO: 877968 - protein, 17 aa, Mycobacterium
WVRIAGVHFAPDTCSYY

SEQ ID NO: 877969 - protein, 22 aa, Mycobacterium
WVRPDMVRALRKRAPGMRFAGL

SEQ ID NO: 877970 - protein, 25 aa, Mycobacterium
WVRQRHLQPGISSPVAILAAASQRT

SEQ ID NO: 877971 - protein, 19 aa, Mycobacterium
WVRRQLTPLPLTGRPNVVI

SEQ ID NO: 877972 - protein, 20 aa, Mycobacterium
WVRRRLHEVVVHRADAAIAL

SEQ ID NO: 877973 - protein, 20 aa, Mycobacterium
WVRSRHLNAGKGKRALAVEL

SEQ ID NO: 877974 - protein, 27 aa, Mycobacterium
WVRTDDQWRWLANTLTVELLKELLPEA

SEQ ID NO: 877975 - protein, 17 aa, Mycobacterium
WVSAGPAPSAVAAMPEL

SEQ ID NO: 877976 - protein, 20 aa, Mycobacterium
WVSLFDPHRLADLLRMPDGA

SEQ ID NO: 877977 - protein, 17 aa, Mycobacterium
WVSNFAPDLPPLPIIGP

SEQ ID NO: 877978 - protein, 22 aa, Mycobacterium
WVSSIIGVHNWHLALFDQQAQE

SEQ ID NO: 877979 - protein, 25 aa, Mycobacterium
WVSTEFPLHVLTGHALSRVSPPAIG

SEQ ID NO: 877980 - protein, 18 aa, Mycobacterium
WVTAEQLHDLNWVPADRG

SEQ ID NO: 877981 - protein, 17 aa, Mycobacterium
WVTALTRDQWYADHIRS

SEQ ID NO: 877982 - protein, 20 aa, Mycobacterium
WVTAQWRWDTLATRLAGLLG

SEQ ID NO: 877983 - protein, 19 aa, Mycobacterium
WVTDLTFVPTWAGVAYVCF

SEQ ID NO: 877984 - protein, 18 aa, Mycobacterium
WVTGLRRVDAPTRANAPL

SEQ ID NO: 877985 - protein, 19 aa, Mycobacterium
WVTHGHHDVYWIRTGSLTL

SEQ ID NO: 877986 - protein, 18 aa, Mycobacterium
WVTILDRTGLRTGSRVSV

SEQ ID NO: 877987 - protein, 17 aa, Mycobacterium
WVTLLRSVGAHDTYLRT

SEQ ID NO: 877988 - protein, 26 aa, Mycobacterium
WVTPWSLVVVIPGLLEWHIDIGTTFA

SEQ ID NO: 877989 - protein, 19 aa, Mycobacterium
WVVARPDSVFGLPELSLGL

SEQ ID NO: 877990 - protein, 27 aa, Mycobacterium
WVVGHSYIVYAPLLLGATTVLYEGKPV

SEQ ID NO: 877991 - protein, 17 aa, Mycobacterium
WVVLERPAGKRLAPMLT

SEQ ID NO: 877992 - protein, 17 aa, Mycobacterium
WVVLSGSLPPGVPPQWY

SEQ ID NO: 877993 - protein, 35 aa, Mycobacterium
WVVPHFEKMLYDNALLLRFYGHLARRTGDALARRI

SEQ ID NO: 877994 - protein, 17 aa, Mycobacterium
WVVQEYLPPQYPPGAWD

SEQ ID NO: 877995 - protein, 25 aa, Mycobacterium
WVVSWFEHLNLWDVTLLVQDWGSLI

SEQ ID NO: 877996 - protein, 17 aa, Mycobacterium
WVVVEITDTATLLAVRR

SEQ ID NO: 877997 - protein, 18 aa, Mycobacterium
WVWDSWIETACELGAVLN

SEQ ID NO: 877998 - protein, 17 aa, Mycobacterium
WVYLHGHSDLVEQPLLA

SEQ ID NO: 877999 - protein, 19 aa, Mycobacterium
WVYWHNTSRLHGYLNDIPP

SEQ ID NO: 878000 - protein, 18 aa, Mycobacterium
WWANRYPGVRTDSEYSYY

SEQ ID NO: 878001 - protein, 20 aa, Mycobacterium
WWGRGEAALLRLAEERQIPV

SEQ ID NO: 878002 - protein, 25 aa, Mycobacterium
WWKDRGRAMVVLVDRLDRWAATQSD

SEQ ID NO: 878003 - protein, 20 aa, Mycobacterium
WWLKQAFYFSLTAVNDAVKD

SEQ ID NO: 878004 - protein, 17 aa, Mycobacterium
WWLRARTPSDIDGLGLS

SEQ ID NO: 878005 - protein, 17 aa, Mycobacterium
WWRETRFQAYQGVSIPY

SEQ ID NO: 878006 - protein, 18 aa, Mycobacterium
WWRGLRLRAEAYSGPWYI

SEQ ID NO: 878007 - protein, 18 aa, Mycobacterium
WWTAPFTLEDGVPRSALV

SEQ ID NO: 878008 - protein, 17 aa, Mycobacterium
WWTEAPQLPVLYLHGRD

SEQ ID NO: 878009 - protein, 17 aa, Mycobacterium
WYCSGLVRQFNIGALVI

SEQ ID NO: 878010 - protein, 17 aa, Mycobacterium
WYCSGLVRQFNIGSLLV

SEQ ID NO: 878011 - protein, 26 aa, Mycobacterium
WYEEAIRLHILPNINSKLKLKQLTPS

SEQ ID NO: 878012 - protein, 17 aa, Mycobacterium
WYGLHELARISAGDKVL

SEQ ID NO: 878013 - protein, 18 aa, Mycobacterium
WYGLSVNGPIARSVLDAA

SEQ ID NO: 878014 - protein, 19 aa, Mycobacterium
WYGLSVNGPLARSVLDAAL

SEQ ID NO: 878015 - protein, 28 aa, Mycobacterium
WYITEVQKIFVRLLTLPVPTVAAVNGHA

SEQ ID NO: 878016 - protein, 18 aa, Mycobacterium
WYLRILADERSAADVNAP

SEQ ID NO: 878017 - protein, 24 aa, Mycobacterium
WYLRQGDVYFIPRAYPHHIEVVDA

SEQ ID NO: 878018 - protein, 20 aa, Mycobacterium
WYPTPQFAHLGLGNIGSLSS

SEQ ID NO: 878019 - protein, 20 aa, Mycobacterium
WYQQLTQLWTRLASTPAALS

SEQ ID NO: 878020 - protein, 18 aa, Mycobacterium
WYRNRWVRTAHVCAALGE

SEQ ID NO: 878021 - protein, 19 aa, Mycobacterium
WYSFILASGGRRSGQRWRV

SEQ ID NO: 878022 - protein, 35 aa, Mycobacterium
WYSTGCEFKRPTPAWWFDDTHLHGPDGLTLPMTLN

SEQ ID NO: 878023 - protein, 20 aa, Mycobacterium
WYSWMPPELYNLPPHGTLNL

SEQ ID NO: 878024 - protein, 19 aa, Mycobacterium
WYTNLRTTVRFDQAVARAA

SEQ ID NO: 878025 - protein, 25 aa, Mycobacterium
YAAAHAPYLAWLAQASADSATMAAQ

SEQ ID NO: 878026 - protein, 18 aa, Mycobacterium
YAAAIFDWAIEGLAATVE

SEQ ID NO: 878027 - protein, 17 aa, Mycobacterium
YAAAKAALRTYSKGLAN

SEQ ID NO: 878028 - protein, 28 aa, Mycobacterium
YAAANSWLDAFAFWRRTQGLPGCAIAWG

SEQ ID NO: 878029 - protein, 29 aa, Mycobacterium
YAAANSWLDAFAYWRRAQGLPTTAIAWGA

SEQ ID NO: 878030 - protein, 22 aa, Mycobacterium
YAADETRALTLWALSEHLCTAS

SEQ ID NO: 878031 - protein, 29 aa, Mycobacterium
YAADPLDPAWLLDTLGLTDAARTTYRRLS

SEQ ID NO: 878032 - protein, 29 aa, Mycobacterium
YAADPLDPRWLLDTLGLTDAARTTYRRLS

SEQ ID NO: 878033 - protein, 29 aa, Mycobacterium
YAADPLDPTWLLDTLGLTDAARTTYRRLS

SEQ ID NO: 878034 - protein, 27 aa, Mycobacterium
YAADTRWLTDDFIPTVARRGTAIIEAR

SEQ ID NO: 878035 - protein, 23 aa, Mycobacterium
YAAEFFRWFAGEAVRLDGSVMLA

SEQ ID NO: 878036 - protein, 24 aa, Mycobacterium
YAAELASLGLPKRALVSSSAANVQ

SEQ ID NO: 878037 - protein, 17 aa, Mycobacterium
YAAFELAGFATFGAAAS

SEQ ID NO: 878038 - protein, 21 aa, Mycobacterium
YAAKSAWLMGAGRVLVVDHLD

SEQ ID NO: 878039 - protein, 17 aa, Mycobacterium
YAALFDRFGYRLVCCNS

SEQ ID NO: 878040 - protein, 23 aa, Mycobacterium
YAALRDALPRRHGVAVLSGSRVL

SEQ ID NO: 878041 - protein, 39 aa, Mycobacterium
YAAPLRDFLVSRFRDITLLTFQRLVFDGILQEVVLFCGV

SEQ ID NO: 878042 - protein, 24 aa, Mycobacterium
YAAPLREFLLSRFRDITLVTFERL

SEQ ID NO: 878043 - protein, 17 aa, Mycobacterium
YAAPSFVPGRPLVEVLR

SEQ ID NO: 878044 - protein, 24 aa, Mycobacterium
YAARAQLTPLVFEGSQFGGALMTT

SEQ ID NO: 878045 - protein, 24 aa, Mycobacterium
YAARPLLDLPWDIADSPPGRILAP

SEQ ID NO: 878046 - protein, 23 aa, Mycobacterium
YAASLAGLAVISGGRAAKPALPA

SEQ ID NO: 878047 - protein, 23 aa, Mycobacterium
YAASLLGLPIGAYPHSRPPQAEL

SEQ ID NO: 878048 - protein, 18 aa, Mycobacterium
YAATFATVPVLLDAIYNP

SEQ ID NO: 878049 - protein, 23 aa, Mycobacterium
YAAVKPVFKKWASLVVRAGEPGA

SEQ ID NO: 878050 - protein, 24 aa, Mycobacterium
YAAVSFLPERPLVEALRDLTTRIY

SEQ ID NO: 878051 - protein, 20 aa, Mycobacterium
YAAWEFLRDYLPPADGDRPR

SEQ ID NO: 878052 - protein, 18 aa, Mycobacterium
YAAWTDLVALMKVGLRRG

SEQ ID NO: 878053 - protein, 23 aa, Mycobacterium
YACAPVYSHLKYDIIPGAKHVVR

SEQ ID NO: 878054 - protein, 24 aa, Mycobacterium
YACAPVYSHLKYDVIPGAKHVVRH

SEQ ID NO: 878055 - protein, 26 aa, Mycobacterium
YACDHFDVWPGHDWFDTAVTDQIAFL

SEQ ID NO: 878056 - protein, 24 aa, Mycobacterium
YADAWVPIVIIRPTDYSRALEAVR

SEQ ID NO: 878057 - protein, 24 aa, Mycobacterium
YADEDAIAPLWKGSRFPMEICISG

SEQ ID NO: 878058 - protein, 33 aa, Mycobacterium
YADELRRRWGGLLSYRYIGRRYAQMDLGPVDNT

SEQ ID NO: 878059 - protein, 24 aa, Mycobacterium
YADGIWYVDLAPLADADLVPITTA

SEQ ID NO: 878060 - protein, 22 aa, Mycobacterium
YADGTLPYLAGPRTLSEFIVPT

SEQ ID NO: 878061 - protein, 37 aa, Mycobacterium
YADHLIEIPAVSTLFQPLLSTIPMQLFSAGVAQARGY

SEQ ID NO: 878062 - protein, 20 aa, Mycobacterium
YADMFALDDTGWYFTERRVD

SEQ ID NO: 878063 - protein, 21 aa, Mycobacterium
YADPLDLRPASRLGVVGLVEV

SEQ ID NO: 878064 - protein, 29 aa, Mycobacterium
YADRAFAAVPAALLRWGVAQFDADARPTQ

SEQ ID NO: 878065 - protein, 25 aa, Mycobacterium
YADRGFVGRLRRAFIVAVNCTEPGG

SEQ ID NO: 878066 - protein, 18 aa, Mycobacterium
YADTLAAIPVLLDAVYDP

SEQ ID NO: 878067 - protein, 17 aa, Mycobacterium
YADWLATAGVERGLLGP

SEQ ID NO: 878068 - protein, 22 aa, Mycobacterium
YADYDAYYWADNLRHTVRFSAA

SEQ ID NO: 878069 - protein, 28 aa, Mycobacterium
YAEAARRIHLLPMLRWKCVESPLGLNHP

SEQ ID NO: 878070 - protein, 29 aa, Mycobacterium
YAEALAEFAALRWQWHDLEVGRTAIVPDV

SEQ ID NO: 878071 - protein, 24 aa, Mycobacterium
YAEALRICNVLKIGVAQLADGAEH

SEQ ID NO: 878072 - protein, 24 aa, Mycobacterium
YAEDLAQTTPWPRFAEAAVKLGVR

SEQ ID NO: 878073 - protein, 32 aa, Mycobacterium
YAEDWDLESLWTALKTLYPVGIDHAPLTHHDA

SEQ ID NO: 878074 - protein, 29 aa, Mycobacterium
YAEDWDLETLWTALKTLYPVGIDHRDLID

SEQ ID NO: 878075 - protein, 25 aa, Mycobacterium
YAEGELYFPGSPVLSLHGSFAECVL

SEQ ID NO: 878076 - protein, 23 aa, Mycobacterium
YAEGLRALYLYATTFQDAVAAKT

SEQ ID NO: 878077 - protein, 22 aa, Mycobacterium
YAEGLRALYLYTAAHQDTTVAD

SEQ ID NO: 878078 - protein, 19 aa, Mycobacterium
YAEGPLPPDAVRCPPISFL

SEQ ID NO: 878079 - protein, 22 aa, Mycobacterium
YAELLSRLAARGFRRAFAAIAQ

SEQ ID NO: 878080 - protein, 17 aa, Mycobacterium
YAELNKLWTQEPVWPCL

SEQ ID NO: 878081 - protein, 23 aa, Mycobacterium
YAERLSTGILGVQPLRGYLSGSV

SEQ ID NO: 878082 - protein, 22 aa, Mycobacterium
YAERMAPVVAAERARWASAGGE

SEQ ID NO: 878083 - protein, 27 aa, Mycobacterium
YAEVSAFSRPAIWWSKLGGPVVSVAQR

SEQ ID NO: 878084 - protein, 18 aa, Mycobacterium
YAFERGRFYALDANAVIA

SEQ ID NO: 878085 - protein, 17 aa, Mycobacterium
YAFLVSEDDFDAIYGRI

SEQ ID NO: 878086 - protein, 24 aa, Mycobacterium
YAGAPVTLAALQLTALQSAVAAAV

SEQ ID NO: 878087 - protein, 25 aa, Mycobacterium
YAGATIHQTPLPTPGWMVLQQAALC

SEQ ID NO: 878088 - protein, 26 aa, Mycobacterium
YAGDRPWDSIYGLPLRLSGEARRFDV

SEQ ID NO: 878089 - protein, 23 aa, Mycobacterium
YAGEAWIHVQLLPSVDSKGLTEV

SEQ ID NO: 878090 - protein, 17 aa, Mycobacterium
YAGGEILRLLLAHPAYT

SEQ ID NO: 878091 - protein, 19 aa, Mycobacterium
YAGITRSGSYGRRPRAVLS

SEQ ID NO: 878092 - protein, 26 aa, Mycobacterium
YAGKRRVYAFRALLACTFGALEIQHH

SEQ ID NO: 878093 - protein, 26 aa, Mycobacterium
YAGLPTSPWYERAKALAPKGAGAVLA

SEQ ID NO: 878094 - protein, 20 aa, Mycobacterium
YAGMAGHLSALLYGVPHVLT

SEQ ID NO: 878095 - protein, 18 aa, Mycobacterium
YAGPGPFSLMAAAVAWDA

SEQ ID NO: 878096 - protein, 22 aa, Mycobacterium
YAGPGTGYRPSGARWEEMKRLR

SEQ ID NO: 878097 - protein, 17 aa, Mycobacterium
YAGVLKGAVGIGLGLVD

SEQ ID NO: 878098 - protein, 17 aa, Mycobacterium
YAGWVHLAAGRLSAARG

SEQ ID NO: 878099 - protein, 22 aa, Mycobacterium
YAHGWATWFAPDGPPRTGRFGP

SEQ ID NO: 878100 - protein, 17 aa, Mycobacterium
YAHVFYPMTGFTAEKHD

SEQ ID NO: 878101 - protein, 17 aa, Mycobacterium
YAIIRDDLFSTPIPGED

SEQ ID NO: 878102 - protein, 17 aa, Mycobacterium
YAILTKPSSFTGNTLLC

SEQ ID NO: 878103 - protein, 17 aa, Mycobacterium
YAIVPGPGSVVGTAIID

SEQ ID NO: 878104 - protein, 22 aa, Mycobacterium
YAKALQFYRDVFGWTVNTVADT

SEQ ID NO: 878105 - protein, 18 aa, Mycobacterium
YAKALRRYTFGPGVAKVD

SEQ ID NO: 878106 - protein, 24 aa, Mycobacterium
YAKELASLGLPKRALLSSSADQVQ

SEQ ID NO: 878107 - protein, 20 aa, Mycobacterium
YAKGFKFSTYATWWIRQAIT

SEQ ID NO: 878108 - protein, 18 aa, Mycobacterium
YAKLIRSWTAEEVRPALI

SEQ ID NO: 878109 - protein, 19 aa, Mycobacterium
YAKLMRDIPFRVGAVVGSP

SEQ ID NO: 878110 - protein, 20 aa, Mycobacterium
YAKRVPRLARTQTWPTLEQD

SEQ ID NO: 878111 - protein, 18 aa, Mycobacterium
YAKTWRTLAKLSLPNSYL

SEQ ID NO: 878112 - protein, 17 aa, Mycobacterium
YAKYMRYADQARRDGNS

SEQ ID NO: 878113 - protein, 19 aa, Mycobacterium
YALARLIQSYGVEPAIMAG

SEQ ID NO: 878114 - protein, 20 aa, Mycobacterium
YALEHDERFGIWGGLSERER

SEQ ID NO: 878115 - protein, 24 aa, Mycobacterium
YALGGGCELAMMCDLLIAADTAKF

SEQ ID NO: 878116 - protein, 18 aa, Mycobacterium
YALGGPVPWRAEKLQGVG

SEQ ID NO: 878117 - protein, 28 aa, Mycobacterium
YALKDTKGTPFLLLAGLEPDLKWERFVN

SEQ ID NO: 878118 - protein, 30 aa, Mycobacterium
YALLDDNDFARYPFLVKGYIGPKALHANNI

SEQ ID NO: 878119 - protein, 20 aa, Mycobacterium
YALPQSPQLFKQLLMVAGME

SEQ ID NO: 878120 - protein, 19 aa, Mycobacterium
YALRAVIQLDTDAGLTGLG

SEQ ID NO: 878121 - protein, 22 aa, Mycobacterium
YALRLRLPVIALTRNVILNSAW

SEQ ID NO: 878122 - protein, 31 aa, Mycobacterium
YALRRNFYRYCGTSFIIPWSAYEVPPELTVT

SEQ ID NO: 878123 - protein, 19 aa, Mycobacterium
YALRRRALLAEVYSGRTGV

SEQ ID NO: 878124 - protein, 28 aa, Mycobacterium
YALRSVNMFAPWIRRIFIATDSAPPRWL

SEQ ID NO: 878125 - protein, 30 aa, Mycobacterium
YALRSVNMFAPWIRRIFIATDSTPPPWLAE

SEQ ID NO: 878126 - protein, 27 aa, Mycobacterium
YALSEWQRILDINLTGVFLGIRAVVKP

SEQ ID NO: 878127 - protein, 20 aa, Mycobacterium
YALVVTSPGFAPSAPVLAAA

SEQ ID NO: 878128 - protein, 20 aa, Mycobacterium
YALYIDPPLGRAGMTAKQVR

SEQ ID NO: 878129 - protein, 19 aa, Mycobacterium
YAMGQCIVAVWVADVVGSE

SEQ ID NO: 878130 - protein, 33 aa, Mycobacterium
YAMGRIHRVSWLWALLLFRRRRIPDGAWIHASV

SEQ ID NO: 878131 - protein, 26 aa, Mycobacterium
YAMTPSGFEWELGWNPIVVDENTWEP

SEQ ID NO: 878132 - protein, 29 aa, Mycobacterium
YANFAIDEPPLKLVLFENPGQGGTINHLG

SEQ ID NO: 878133 - protein, 25 aa, Mycobacterium
YANFAITEPPLKLVLLENPGKGGSI

SEQ ID NO: 878134 - protein, 22 aa, Mycobacterium
YANFLSILDEGRIAIAALATGA

SEQ ID NO: 878135 - protein, 29 aa, Mycobacterium
YANFVVADPPLKLVLLETAGQGGTLNHLG

SEQ ID NO: 878136 - protein, 25 aa, Mycobacterium
YANHVDPLRRYAFRLTSNQTRSEDI

SEQ ID NO: 878137 - protein, 17 aa, Mycobacterium
YANLALPALLRERQISG

SEQ ID NO: 878138 - protein, 21 aa, Mycobacterium
YANRLLHAYVHTELHVFAATF

SEQ ID NO: 878139 - protein, 23 aa, Mycobacterium
YANRLLHAYVHTELHVIAAAFNG

SEQ ID NO: 878140 - protein, 23 aa, Mycobacterium
YANRLLHAYVHTELHVIAATFNG

SEQ ID NO: 878141 - protein, 24 aa, Mycobacterium
YANYVGKPLSYILATDPRPDDADN

SEQ ID NO: 878142 - protein, 23 aa, Mycobacterium
YAPAPPRIRWFEPAGNADQQIVE

SEQ ID NO: 878143 - protein, 25 aa, Mycobacterium
YAPDHYNGFFYKEMPPFCLATEAHA

SEQ ID NO: 878144 - protein, 23 aa, Mycobacterium
YAPESVARVYDEVLRRAEAAVTG

SEQ ID NO: 878145 - protein, 21 aa, Mycobacterium
YAPFSDLIWMETGTPDLELAK

SEQ ID NO: 878146 - protein, 22 aa, Mycobacterium
YAPFSDLIWMETGTPDLKLAKQ

SEQ ID NO: 878147 - protein, 19 aa, Mycobacterium
YAPGYFSLDDWGYASLIGD

SEQ ID NO: 878148 - protein, 17 aa, Mycobacterium
YAPIPVVEVILPAVRRA

SEQ ID NO: 878149 - protein, 17 aa, Mycobacterium
YAPLLPSVDEVAALLCS

SEQ ID NO: 878150 - protein, 17 aa, Mycobacterium
YAPMIGGLGYLLAPGAD

SEQ ID NO: 878151 - protein, 17 aa, Mycobacterium
YAPPDDPGWRSVLPQDF

SEQ ID NO: 878152 - protein, 18 aa, Mycobacterium
YAPPPPYPSPDPFEPFAV

SEQ ID NO: 878153 - protein, 19 aa, Mycobacterium
YAPPPPYPSPDPFEPFAVA

SEQ ID NO: 878154 - protein, 17 aa, Mycobacterium
YAPRIWYEDGAYLLGRP

SEQ ID NO: 878155 - protein, 34 aa, Mycobacterium
YAPRLAGTPVLLDAIYDPWPTPLAAAVTAAGGRV

SEQ ID NO: 878156 - protein, 20 aa, Mycobacterium
YAPVARYWPEFGQGGKESIT

SEQ ID NO: 878157 - protein, 38 aa, Mycobacterium
YAQEYQTFGAHMAAFHDQFVQTLKTGALAYTGAEAANA

SEQ ID NO: 878158 - protein, 17 aa, Mycobacterium
YAQGGIAVVLPAGVGSA

SEQ ID NO: 878159 - protein, 24 aa, Mycobacterium
YAQGRRELAAYPTFTFREGCVVRG

SEQ ID NO: 878160 - protein, 25 aa, Mycobacterium
YAQLPIAPMGFISTRYYVSMNVADK

SEQ ID NO: 878161 - protein, 32 aa, Mycobacterium
YAQQLTVVASAATRWVWLADAAGLDIAAVERA

SEQ ID NO: 878162 - protein, 22 aa, Mycobacterium
YAQRIMDWLNPDGELREQERAR

SEQ ID NO: 878163 - protein, 21 aa, Mycobacterium
YAQRRAVLLPALTSAGFSVDH

SEQ ID NO: 878164 - protein, 22 aa, Mycobacterium
YAQRRFGVGIAVRAGVHRGLVY

SEQ ID NO: 878165 - protein, 22 aa, Mycobacterium
YAQRRNLLLPAFREAGFTVDHS

SEQ ID NO: 878166 - protein, 17 aa, Mycobacterium
YAQRYRTPRPNPRRVVI

SEQ ID NO: 878167 - protein, 26 aa, Mycobacterium
YAQSKLANLLFTYELQRRLQAAGAET

SEQ ID NO: 878168 - protein, 20 aa, Mycobacterium
YARALSTLTWRVATNVTRLP

SEQ ID NO: 878169 - protein, 25 aa, Mycobacterium
YARDQWRLRKLDELGWIVIRVIAGD

SEQ ID NO: 878170 - protein, 20 aa, Mycobacterium
YARELASLGLPKRALVSQSA

SEQ ID NO: 878171 - protein, 28 aa, Mycobacterium
YARHPMLRAMLAHRWLAGVALGVFDRRW

SEQ ID NO: 878172 - protein, 18 aa, Mycobacterium
YARILADEAMRRGIWVEV

SEQ ID NO: 878173 - protein, 18 aa, Mycobacterium
YARIRGRWHAALPVGRLD

SEQ ID NO: 878174 - protein, 17 aa, Mycobacterium
YARLALGIGVHDITAGY

SEQ ID NO: 878175 - protein, 18 aa, Mycobacterium
YARLALGIGVHDITAGYR

SEQ ID NO: 878176 - protein, 20 aa, Mycobacterium
YARLIRLSDYLNRYGGPIDY

SEQ ID NO: 878177 - protein, 21 aa, Mycobacterium
YARLLAMKLFSERAVDYFRTA

SEQ ID NO: 878178 - protein, 26 aa, Mycobacterium
YARLNLDPPNPLLRSIFPNIVYVDAT

SEQ ID NO: 878179 - protein, 17 aa, Mycobacterium
YARLRVVHSLEASQRRV

SEQ ID NO: 878180 - protein, 25 aa, Mycobacterium
YARPDIPIHYLLADTFTICDQYHSS

SEQ ID NO: 878181 - protein, 24 aa, Mycobacterium
YARPDIPIHYLLADTFTVCDHYHS

SEQ ID NO: 878182 - protein, 24 aa, Mycobacterium
YARPPIGLLRLRAPQPALPWEGVR

SEQ ID NO: 878183 - protein, 18 aa, Mycobacterium
YARQLERGIIPPGTQLTP

SEQ ID NO: 878184 - protein, 24 aa, Mycobacterium
YARQRPQLLIDWLGGDPGDLDEDL

SEQ ID NO: 878185 - protein, 28 aa, Mycobacterium
YARRDLPALISAPDRLFRIPQGVPTDAE

SEQ ID NO: 878186 - protein, 18 aa, Mycobacterium
YARTLSTLTWRAATNVTK

SEQ ID NO: 878187 - protein, 22 aa, Mycobacterium
YARVLSPLHRLIRDIVGQGITE

SEQ ID NO: 878188 - protein, 20 aa, Mycobacterium
YARVPLIVLSANRPYELLGT

SEQ ID NO: 878189 - protein, 19 aa, Mycobacterium
YARYRKILAGANLSARDVD

SEQ ID NO: 878190 - protein, 22 aa, Mycobacterium
YARYWREAFRLPGMDLAAVGRQ

SEQ ID NO: 878191 - protein, 22 aa, Mycobacterium
YARYWREAFRLPSMDLPALAGE

SEQ ID NO: 878192 - protein, 21 aa, Mycobacterium
YASCKAALHRFTQGVAAELLD

SEQ ID NO: 878193 - protein, 33 aa, Mycobacterium
YASEPITWDLVTPPPPPTPMLRLSLVNQAPAYF

SEQ ID NO: 878194 - protein, 25 aa, Mycobacterium
YASFRTAMRLLTGPSLVEALAGVQV

SEQ ID NO: 878195 - protein, 17 aa, Mycobacterium
YASHLLRALRNAAANNV

SEQ ID NO: 878196 - protein, 18 aa, Mycobacterium
YASHLLRALRNAAPTNVA

SEQ ID NO: 878197 - protein, 24 aa, Mycobacterium
YASKAFLCTEVARWIKDEGLGLDV

SEQ ID NO: 878198 - protein, 18 aa, Mycobacterium
YASLKAAVATFTRGIART

SEQ ID NO: 878199 - protein, 21 aa, Mycobacterium
YASMKAALHRFTQGVAAELLD

SEQ ID NO: 878200 - protein, 25 aa, Mycobacterium
YASNAFLAVKLSYTNSLAALCAQVG

SEQ ID NO: 878201 - protein, 25 aa, Mycobacterium
YASPAVLLTMGTWFSDKYAEGTIGH

SEQ ID NO: 878202 - protein, 24 aa, Mycobacterium
YASPAVLLTMGTWFSDKYAEGTVG

SEQ ID NO: 878203 - protein, 23 aa, Mycobacterium
YASPAVLLTMGTWLSDKYAEGTI

SEQ ID NO: 878204 - protein, 17 aa, Mycobacterium
YASVTFPWYQLGRQVHI

SEQ ID NO: 878205 - protein, 42 aa, Mycobacterium
YATAEAANASPLEFLLDAVNAPTQTLFGRDLIGNGTDGAAGT

SEQ ID NO: 878206 - protein, 21 aa, Mycobacterium
YATARRPHPWEDARVVPLPLD

SEQ ID NO: 878207 - protein, 21 aa, Mycobacterium
YATDCAVLPHALAAVGRRPDL

SEQ ID NO: 878208 - protein, 26 aa, Mycobacterium
YATDEMRAWWGGMWAERILRSDLSAQ

SEQ ID NO: 878209 - protein, 25 aa, Mycobacterium
YATGRLRYLHQNVTLAWDFPVDEDA

SEQ ID NO: 878210 - protein, 31 aa, Mycobacterium; identical to SEQ ID NO: 224561

SEQ ID NO: 878211 - protein, 20 aa, Mycobacterium
YATHPADFLEYVNAPVGAGA

SEQ ID NO: 878212 - protein, 23 aa, Mycobacterium
YATMAQWCFLLARTSKGEKKQQG

SEQ ID NO: 878213 - protein, 18 aa, Mycobacterium
YATQLMAELTDRGEKLPA

SEQ ID NO: 878214 - protein, 30 aa, Mycobacterium
YATSASTPLFFAQAIGRFVRSRRPGEIASI

SEQ ID NO: 878215 - protein, 28 aa, Mycobacterium
YATSASTPLFFAQAIGRYVRSRTPGETA

SEQ ID NO: 878216 - protein, 22 aa, Mycobacterium
YATTNWALRQDLPVWTVQHHHA

SEQ ID NO: 878217 - protein, 20 aa, Mycobacterium
YAVAALRPPALRAICPWEGF

SEQ ID NO: 878218 - protein, 17 aa, Mycobacterium
YAVAPFATRALVKMSGR

SEQ ID NO: 878219 - protein, 17 aa, Mycobacterium
YAVDHGVRLALEPLHPV

SEQ ID NO: 878220 - protein, 17 aa, Mycobacterium
YAVGLDTGNRRLAHLAG

SEQ ID NO: 878221 - protein, 21 aa, Mycobacterium
YAVHPWGLYLARPTPGRVQFH

SEQ ID NO: 878222 - protein, 25 aa, Mycobacterium
YAVIGALMGLLQRGREPGGEVVDVA

SEQ ID NO: 878223 - protein, 19 aa, Mycobacterium
YAVISLSDRLKPWDVIARR

SEQ ID NO: 878224 - protein, 18 aa, Mycobacterium
YAVISLSDRLKPWKVIES

SEQ ID NO: 878225 - protein, 20 aa, Mycobacterium
YAVLNLYPYNPGHLMVVPYR

SEQ ID NO: 878226 - protein, 25 aa, Mycobacterium
YAVPDRFWAQVLPIVRSDFGDAWFV

SEQ ID NO: 878227 - protein, 25 aa, Mycobacterium
YAVSPDHPRFVWGGRYELGSLIWRS

SEQ ID NO: 878228 - protein, 26 aa, Mycobacterium
YAVTPSGFEWELGWNPIVVDESTWEP

SEQ ID NO: 878229 - protein, 22 aa, Mycobacterium
YAVTVLKVPLIVVLGHDSCGAV

SEQ ID NO: 878230 - protein, 29 aa, Mycobacterium
YAWKGETLEEYWWAAEQVLTWPDEPANMI

SEQ ID NO: 878231 - protein, 20 aa, Mycobacterium
YAWSTILARGATSGPVGLIL

SEQ ID NO: 878232 - protein, 17 aa, Mycobacterium
YAYLLWCTDFPSTSAVA

SEQ ID NO: 878233 - protein, 20 aa, Mycobacterium
YCAEHAIERIACGKVLVARD

SEQ ID NO: 878234 - protein, 18 aa, Mycobacterium
YCAGGWYTGDTLDITTAT

SEQ ID NO: 878235 - protein, 33 aa, Mycobacterium
YCAGSVAHFDWLVGCGVPFKAEFFSEPGWEPMG

SEQ ID NO: 878236 - protein, 17 aa, Mycobacterium
YCAVAKSLDLVGDRWTL

SEQ ID NO: 878237 - protein, 19 aa, Mycobacterium
YCAVLVLTREASLTLRDPK

SEQ ID NO: 878238 - protein, 25 aa, Mycobacterium
YCDDLDVLAAPFQFLEYREGLAIGG

SEQ ID NO: 878239 - protein, 19 aa, Mycobacterium
YCDVYVDSIRRSFGTDIIV

SEQ ID NO: 878240 - protein, 19 aa, Mycobacterium
YCEDNALLSPRWIGGADAD

SEQ ID NO: 878241 - protein, 28 aa, Mycobacterium
YCERNWGTGFPEHWWWGQAHDFDNADAS

SEQ ID NO: 878242 - protein, 17 aa, Mycobacterium
YCFGTAAGPHPFPMMVR

SEQ ID NO: 878243 - protein, 19 aa, Mycobacterium
YCHGVGLSVWEKPLMSRYH

SEQ ID NO: 878244 - protein, 17 aa, Mycobacterium
YCIFAGLGVLPDHTLPA

SEQ ID NO: 878245 - protein, 17 aa, Mycobacterium
YCLFTRTMPRVYPCRTC

SEQ ID NO: 878246 - protein, 21 aa, Mycobacterium
YCLQHGYQLRIIEQMPLDASH

SEQ ID NO: 878247 - protein, 24 aa, Mycobacterium
YCNKQVLTFDWPQGAASVMVYIAP

SEQ ID NO: 878248 - protein, 17 aa, Mycobacterium
YCRIVVGALAAVATCRI

SEQ ID NO: 878249 - protein, 20 aa, Mycobacterium
YCRLHHLIKTFRPGWTDTQH

SEQ ID NO: 878250 - protein, 20 aa, Mycobacterium
YCRNGIEIVIALTAIVKIRA

SEQ ID NO: 878251 - protein, 25 aa, Mycobacterium
YCRQRVLLLQAWVRQVSSIVGKTAD

SEQ ID NO: 878252 - protein, 29 aa, Mycobacterium
YCRTHHLVKTFWGWHDQQLPDGTLILTSP

SEQ ID NO: 878253 - protein, 17 aa, Mycobacterium
YCRYLDTKRWDDWRTLF

SEQ ID NO: 878254 - protein, 17 aa, Mycobacterium
YCSIFPNSTHDSTEYYT

SEQ ID NO: 878255 - protein, 25 aa, Mycobacterium
YCVTGDALVRLPFGQSMRIADVVPG

SEQ ID NO: 878256 - protein, 18 aa, Mycobacterium
YCVTSAFIMSQLAVPHML

SEQ ID NO: 878257 - protein, 30 aa, Mycobacterium
YCVVDARAWLRDATPLWRTNVDGLSGVLDV

SEQ ID NO: 878258 - protein, 17 aa, Mycobacterium
YCYASTSTSFLALPAFP

SEQ ID NO: 878259 - protein, 27 aa, Mycobacterium
YCYEHVALFGAVLQRLGFDFYGIQGRV

SEQ ID NO: 878260 - protein, 17 aa, Mycobacterium
YDAAPYDLGLHAAIADV

SEQ ID NO: 878261 - protein, 27 aa, Mycobacterium
YDADDPDWLRWNYATVVWGLATAHELY

SEQ ID NO: 878262 - protein, 25 aa, Mycobacterium
YDADSDPSARFGASGGKGGTGGNGG

SEQ ID NO: 878263 - protein, 22 aa, Mycobacterium
YDADWMRYGWPEKVGGLGGPAV

SEQ ID NO: 878264 - protein, 24 aa, Mycobacterium
YDAELRSVFRPIFARIAEGNVGRE

SEQ ID NO: 878265 - protein, 28 aa, Mycobacterium
YDAEPDLPTLLAAPYFRDAVEAGIDSWR

SEQ ID NO: 878266 - protein, 21 aa, Mycobacterium
YDAGFVDSFWKIVRAYQSEQT

SEQ ID NO: 878267 - protein, 26 aa, Mycobacterium
YDAGRRAPIPLPLKTSYAWAETDFHR

SEQ ID NO: 878268 - protein, 24 aa, Mycobacterium
YDALVAPVTFLAIAGRRVQLEIFT

SEQ ID NO: 878269 - protein, 17 aa, Mycobacterium
YDALVLATGSYAFVPPV

SEQ ID NO: 878270 - protein, 21 aa, Mycobacterium
YDALWTGRRFVVQDTGGWEPD

SEQ ID NO: 878271 - protein, 18 aa, Mycobacterium
YDANGMAALWTSSANEEV

SEQ ID NO: 878272 - protein, 21 aa, Mycobacterium
YDAPEVVIPMLVPEGAHAYPD

SEQ ID NO: 878273 - protein, 23 aa, Mycobacterium
YDAPEVVIPMLVPEGAHAYPDAA

SEQ ID NO: 878274 - protein, 17 aa, Mycobacterium
YDAPIPAPGALLDAVPL

SEQ ID NO: 878275 - protein, 35 aa, Mycobacterium
YDASQLCAGRWNLGALYLLPELRTDRFAPFRRRRA

SEQ ID NO: 878276 - protein, 28 aa, Mycobacterium
YDAYMELNYALFFLTQTVVRGMIAGGDG

SEQ ID NO: 878277 - protein, 21 aa, Mycobacterium
YDAYVWLRRAGYEPEQIVVAG

SEQ ID NO: 878278 - protein, 26 aa, Mycobacterium
YDCARLRFILTAQRDHYLPLKVIRAQ

SEQ ID NO: 878279 - protein, 19 aa, Mycobacterium
YDCSGLVMDAYRHAGVQLP

SEQ ID NO: 878280 - protein, 19 aa, Mycobacterium
YDDEYRLTESVWRIGSRAL

SEQ ID NO: 878281 - protein, 19 aa, Mycobacterium
YDDFFAMAYRVLPADGVML

SEQ ID NO: 878282 - protein, 19 aa, Mycobacterium
YDDFFKMCFDVLPEDGRMT

SEQ ID NO: 878283 - protein, 29 aa, Mycobacterium
YDDGQLARDFLLTWFVHAAYEVDYTKRLT

SEQ ID NO: 878284 - protein, 17 aa, Mycobacterium
YDDLAVAAIRQLREIGG

SEQ ID NO: 878285 - protein, 18 aa, Mycobacterium
YDDLHTEVALLERRLATG

SEQ ID NO: 878286 - protein, 27 aa, Mycobacterium
YDDYQVRIGCMWVMSFHSALVGDADQA

SEQ ID NO: 878287 - protein, 29 aa, Mycobacterium
YDDYVNAAQPIWWLVRALEFGQDFQTFIK

SEQ ID NO: 878288 - protein, 22 aa, Mycobacterium
YDEAAWRALAANGVLSLALPER

SEQ ID NO: 878289 - protein, 22 aa, Mycobacterium
YDEALWTMLCEQVGAAALVVPE

SEQ ID NO: 878290 - protein, 19 aa, Mycobacterium
YDEANGAPREGFPAGTPFA

SEQ ID NO: 878291 - protein, 19 aa, Mycobacterium
YDEDRPTTVLPGSGGTVAG

SEQ ID NO: 878292 - protein, 19 aa, Mycobacterium
YDEIFRALGIPHEPVRWRI

SEQ ID NO: 878293 - protein, 17 aa, Mycobacterium
YDEILPNRATFDHLLLT

SEQ ID NO: 878294 - protein, 26 aa, Mycobacterium
YDELFFPGLAAEWEKCGVRRPFVGGL

SEQ ID NO: 878295 - protein, 31 aa, Mycobacterium
YDELFSGVDLLPTLLSLLGIDIPADVEGLSH

SEQ ID NO: 878296 - protein, 24 aa, Mycobacterium
YDEPWGWMQPTRHALGALLLEQGR

SEQ ID NO: 878297 - protein, 17 aa, Mycobacterium
YDEQQSWIIMRRGRFGI

SEQ ID NO: 878298 - protein, 22 aa, Mycobacterium
YDERRRAAAERLAQIRESMRRD

SEQ ID NO: 878299 - protein, 23 aa, Mycobacterium
YDESFGLPGLARYCRDAIHANAD

SEQ ID NO: 878300 - protein, 19 aa, Mycobacterium
YDFFGIVFDGHPSLTRIEM

SEQ ID NO: 878301 - protein, 23 aa, Mycobacterium
YDFQFLIEELAVGAQFNLPYIHV

SEQ ID NO: 878302 - protein, 18 aa, Mycobacterium
YDFQQAYVDDLINVVDLD

SEQ ID NO: 878303 - protein, 17 aa, Mycobacterium
YDFRLLVDDAHGFGVLG

SEQ ID NO: 878304 - protein, 28 aa, Mycobacterium
YDFSIRWGAALAGRLRRLVHYSCLGMLG

SEQ ID NO: 878305 - protein, 24 aa, Mycobacterium
YDGAGFARQIGMLPMLGTRADRLV

SEQ ID NO: 878306 - protein, 31 aa, Mycobacterium
YDGALLLVTHDRRMLQNVRLDRAWAVDNGCV

SEQ ID NO: 878307 - protein, 26 aa, Mycobacterium
YDGALLLVTHDRRMLQNVRLDRRWLV

SEQ ID NO: 878308 - protein, 25 aa, Mycobacterium
YDGALLLVTHDRRMLQNVRLDRYWR

SEQ ID NO: 878309 - protein, 25 aa, Mycobacterium
YDGFTFNCLSWLEGLGFCGIGEAKD

SEQ ID NO: 878310 - protein, 18 aa, Mycobacterium
YDGHFLPGSRKGGATLLG

SEQ ID NO: 878311 - protein, 23 aa, Mycobacterium
YDGLAPSCELTEDSWRRALDVNL

SEQ ID NO: 878312 - protein, 24 aa, Mycobacterium
YDGMLPYLRAAQRTVRVCWRGHGP

SEQ ID NO: 878313 - protein, 23 aa, Mycobacterium
YDGPGLLAALHATAALGGADAMI

SEQ ID NO: 878314 - protein, 29 aa, Mycobacterium
YDGSVGGWALGPYTLLTPTAIDDTITQTF

SEQ ID NO: 878315 - protein, 23 aa, Mycobacterium
YDGSVLVDLIFCPHDRPVDANFL

SEQ ID NO: 878316 - protein, 17 aa, Mycobacterium
YDHPNVVWVAAGGGWAS

SEQ ID NO: 878317 - protein, 28 aa, Mycobacterium
YDHVALCQLWGPMPELPTAIPRFTRELR

SEQ ID NO: 878318 - protein, 30 aa, Mycobacterium
YDHVALCQLWGPMPGLPKAIPRFTRELRQL

SEQ ID NO: 878319 - protein, 37 aa, Mycobacterium
YDIERLVELFTAEAIWEMPPYAGWYRGARDIVTLIHQ

SEQ ID NO: 878320 - protein, 20 aa, Mycobacterium
YDIHRKGGHLSFGLGLHFCL

SEQ ID NO: 878321 - protein, 27 aa, Mycobacterium
YDIKKWINWAIQFFYSSPAYSQIYSEL

SEQ ID NO: 878322 - protein, 17 aa, Mycobacterium
YDIPAILELYKLGQLNL

SEQ ID NO: 878323 - protein, 29 aa, Mycobacterium
YDISDDFFGLFLDPTWVYTCAYFERDDMT

SEQ ID NO: 878324 - protein, 29 aa, Mycobacterium
YDISDEFFGLFLDPTWVYTCAYFERDDMT

SEQ ID NO: 878325 - protein, 25 aa, Mycobacterium
YDISNEFFALFLGPTMGYTCGYYER

SEQ ID NO: 878326 - protein, 29 aa, Mycobacterium
YDKGPVERFFLTVRQRFLQELPGYKGPDV

SEQ ID NO: 878327 - protein, 21 aa, Mycobacterium
YDKLFRAGPGALWRIPKEFEI

SEQ ID NO: 878328 - protein, 29 aa, Mycobacterium
YDLAVTGVTPKLFLPGLAGLNQGPGFPNL

SEQ ID NO: 878329 - protein, 18 aa, Mycobacterium
YDLCLYQVGALDGFLRAQ

SEQ ID NO: 878330 - protein, 18 aa, Mycobacterium
YDLLVQAVGGLMSVTGPD

SEQ ID NO: 878331 - protein, 26 aa, Mycobacterium
YDLSDDFFALFLDPSRTYSCAYFEPE

SEQ ID NO: 878332 - protein, 26 aa, Mycobacterium
YDLSDDFFALFLDPSRTYSCAYFERD

SEQ ID NO: 878333 - protein, 19 aa, Mycobacterium
YDLSDDFFGLCLDPTRTYS

SEQ ID NO: 878334 - protein, 26 aa, Mycobacterium
YDLSDEFFALFLDPTRTYSCAYFERD

SEQ ID NO: 878335 - protein, 26 aa, Mycobacterium
YDLSDEFFALFLDPTRTYSCAYFERE

SEQ ID NO: 878336 - protein, 17 aa, Mycobacterium
YDLSGLLILVTGGAALS

SEQ ID NO: 878337 - protein, 28 aa, Mycobacterium
YDLSLEIDGMLVCWAIPRSPSTDPKDKR

SEQ ID NO: 878338 - protein, 17 aa, Mycobacterium
YDLTSLRKGYYGASAMP

SEQ ID NO: 878339 - protein, 19 aa, Mycobacterium
YDMTAFWCRAGAAATITPP

SEQ ID NO: 878340 - protein, 24 aa, Mycobacterium
YDMTAFWCRAGTAATITPMGYAGM

SEQ ID NO: 878341 - protein, 24 aa, Mycobacterium
YDMTAFWCRAGTAATITPMGYQGM

SEQ ID NO: 878342 - protein, 20 aa, Mycobacterium
YDMTAFWCRAGTAATITPPG

SEQ ID NO: 878343 - protein, 18 aa, Mycobacterium
YDNEFGFGLWFNRTNHVR

SEQ ID NO: 878344 - protein, 23 aa, Mycobacterium
YDNEFPELPRRLALRGAEVLALP

SEQ ID NO: 878345 - protein, 28 aa, Mycobacterium
YDNKTLLTSLFFLGNSLYLPTGFAPARR

SEQ ID NO: 878346 - protein, 30 aa, Mycobacterium
YDNVLVHGPLQAALLARALGDWIGGRGRLV

SEQ ID NO: 878347 - protein, 21 aa, Mycobacterium
YDPARHLGGVLYLFVRGMCGP

SEQ ID NO: 878348 - protein, 25 aa, Mycobacterium
YDPEQIHLSRIGFDGLLRVCDELIG

SEQ ID NO: 878349 - protein, 25 aa, Mycobacterium
YDPHAANLFWRQLIQAHRVLSRFRS

SEQ ID NO: 878350 - protein, 20 aa, Mycobacterium
YDPIWPDHGIRIIPGPSSLW

SEQ ID NO: 878351 - protein, 17 aa, Mycobacterium
YDPLYDSTKVRHVLVRH

SEQ ID NO: 878352 - protein, 26 aa, Mycobacterium
YDPRRHLGGVLYLFVRGMCGAGTPIR

SEQ ID NO: 878353 - protein, 26 aa, Mycobacterium
YDPSKIPALLKGRRLKKPLIAAVEGA

SEQ ID NO: 878354 - protein, 29 aa, Mycobacterium
YDPSKIPGLLKGRRLTKPLIAAVEGPAIA

SEQ ID NO: 878355 - protein, 29 aa, Mycobacterium
YDQDAPRWGFSPLIALNGPVSLTGGQLDQ

SEQ ID NO: 878356 - protein, 28 aa, Mycobacterium
YDQIKDLLGRELLDQRFAGMKQALEGAT

SEQ ID NO: 878357 - protein, 29 aa, Mycobacterium
YDQIKDLLGRELLDQRFAGMKQALEGATD

SEQ ID NO: 878358 - protein, 24 aa, Mycobacterium
YDQKRTLIEQLARGVLKRPTTYGV

SEQ ID NO: 878359 - protein, 23 aa, Mycobacterium
YDQLGLVPMRAGNRWDISAPRNT

SEQ ID NO: 878360 - protein, 19 aa, Mycobacterium
YDQVLRRQLLASGRVTYFP

SEQ ID NO: 878361 - protein, 24 aa, Mycobacterium
YDQVRGVLLDELDGWWSGVDSDRE

SEQ ID NO: 878362 - protein, 21 aa, Mycobacterium
YDQWLARFELALKGLPEQQRQ

SEQ ID NO: 878363 - protein, 23 aa, Mycobacterium
YDRAWLSWGQLGAATRRVAALAA

SEQ ID NO: 878364 - protein, 29 aa, Mycobacterium
YDRETCWRDYRLGMLQAPLITVLGCAFAS

SEQ ID NO: 878365 - protein, 19 aa, Mycobacterium
YDREVFLTLKEFEPSLSQG

SEQ ID NO: 878366 - protein, 21 aa, Mycobacterium
YDRFFKMCYNVLPDDGRMLLH

SEQ ID NO: 878367 - protein, 30 aa, Mycobacterium
YDRGFFDDLISPFLGLYRDDNLRPNSSVEK

SEQ ID NO: 878368 - protein, 29 aa, Mycobacterium
YDRGFFDDLVTPFLGLYRDDNLRADSSAE

SEQ ID NO: 878369 - protein, 30 aa, Mycobacterium
YDRGFFDDLVTPFLGLYRDDNLRPNSSVEK

SEQ ID NO: 878370 - protein, 30 aa, Mycobacterium
YDRGFFDDLVTPFLGLYRDDNMRPDSSAEK

SEQ ID NO: 878371 - protein, 17 aa, Mycobacterium
YDRLAGLGYQYGPAFQG

SEQ ID NO: 878372 - protein, 17 aa, Mycobacterium
YDRLEITTCLRRGEIEM

SEQ ID NO: 878373 - protein, 24 aa, Mycobacterium
YDRLLRTYIFDTLGGTAVAAITPA

SEQ ID NO: 878374 - protein, 25 aa, Mycobacterium
YDRPQRTLLTVTLTGLPFGQEVFAH

SEQ ID NO: 878375 - protein, 17 aa, Mycobacterium
YDRRYGLDDTHLRAIAA

SEQ ID NO: 878376 - protein, 28 aa, Mycobacterium
YDRTREFIRLLRRLWREDDVTHRGEFYT

SEQ ID NO: 878377 - protein, 17 aa, Mycobacterium
YDRWSILERICEPERQI

SEQ ID NO: 878378 - protein, 23 aa, Mycobacterium
YDRYMHYLTGCANAFRVGYIDVN

SEQ ID NO: 878379 - protein, 22 aa, Mycobacterium
YDRYMKYLTGCAKLFRQGYTDV

SEQ ID NO: 878380 - protein, 23 aa, Mycobacterium
YDRYMRYLTGCAKAFRMGYIDCN

SEQ ID NO: 878381 - protein, 19 aa, Mycobacterium
YDSACAVVCLTIPRPSTQP

SEQ ID NO: 878382 - protein, 25 aa, Mycobacterium
YDSDAARLFWRQLLQAHRVMSQFRA

SEQ ID NO: 878383 - protein, 29 aa, Mycobacterium
YDSGNLPLLEPFRIISRLVSLIPGVHIPT

SEQ ID NO: 878384 - protein, 24 aa, Mycobacterium
YDSLFLMDHFYQLPMLGTPDQPML

SEQ ID NO: 878385 - protein, 20 aa, Mycobacterium
YDSLTLAQLRARLTSLSIGD

SEQ ID NO: 878386 - protein, 19 aa, Mycobacterium
YDSPFVCIFECHDGQIVSL

SEQ ID NO: 878387 - protein, 19 aa, Mycobacterium
YDSPYHLELDWWTAPFEVS

SEQ ID NO: 878388 - protein, 26 aa, Mycobacterium
YDSSYHAELYWWTGQFESIDGIPYSA

SEQ ID NO: 878389 - protein, 29 aa, Mycobacterium
YDSTGLPYPLMHPWWPLKGSDAEANRRVE

SEQ ID NO: 878390 - protein, 23 aa, Mycobacterium
YDSYHRFLRRAIDPDPSARFGSA

SEQ ID NO: 878391 - protein, 27 aa, Mycobacterium
YDSYLDLNYALFFLTQTVVAGMVAQTV

SEQ ID NO: 878392 - protein, 32 aa, Mycobacterium
YDTLINGLKQELPPDFKLPPGVFGPDYDTTDE

SEQ ID NO: 878393 - protein, 30 aa, Mycobacterium
YDTLVRMAQPWSLRYPLVDGQGNFGSPGND

SEQ ID NO: 878394 - protein, 25 aa, Mycobacterium
YDTSSLKVILIAGSALSPELSNRVQ

SEQ ID NO: 878395 - protein, 24 aa, Mycobacterium
YDTTRPYSLAFSGAYRALVIMFPR

SEQ ID NO: 878396 - protein, 23 aa, Mycobacterium
YDVDRLATFFELVQQDPVVSQVK

SEQ ID NO: 878397 - protein, 19 aa, Mycobacterium
YDVDRLSAFFDLVQQDPVV

SEQ ID NO: 878398 - protein, 43 aa, Mycobacterium
YDVKLPRELVLIGKQFLYVERYMKLLAPKWQMMSDPQLTGYFA

SEQ ID NO: 878399 - protein, 45 aa, Mycobacterium
YDVRLPRELVLISKQLLYVERYMKLLAPDWALLADPSFIGYFGNM

SEQ ID NO: 878400 - protein, 18 aa, Mycobacterium
YDVSDDFFALFQDPTRTY

SEQ ID NO: 878401 - protein, 26 aa, Mycobacterium
YDVSDEFFALFLDPTMAYTCAYFERD

SEQ ID NO: 878402 - protein, 22 aa, Mycobacterium
YDVTPDWNPVISRGPLDGLVIA

SEQ ID NO: 878403 - protein, 19 aa, Mycobacterium
YDVVHSHYWLSGQVGWLAR

SEQ ID NO: 878404 - protein, 18 aa, Mycobacterium
YDVVSAFIKSIRGSDVDA

SEQ ID NO: 878405 - protein, 22 aa, Mycobacterium
YDVYIHRLRKYIGAYMAVLGRT

SEQ ID NO: 878406 - protein, 32 aa, Mycobacterium
YDWSDIHQHWRDMGIFPVISELALRGTLGILD

SEQ ID NO: 878407 - protein, 23 aa, Mycobacterium
YDYACHAIDLMNFIAGVPLAVDG

SEQ ID NO: 878408 - protein, 36 aa, Mycobacterium
YDYAGHVLFTWHLPELWRRFTITLRRALRKSLKAAG

SEQ ID NO: 878409 - protein, 17 aa, Mycobacterium
YDYQPTLPVLTLARQMR

SEQ ID NO: 878410 - protein, 25 aa, Mycobacterium
YDYRRILDCLAAEQDFRSPLAREIG

SEQ ID NO: 878411 - protein, 21 aa, Mycobacterium
YDYRYCWIRDQCYTGQAVAAA

SEQ ID NO: 878412 - protein, 31 aa, Mycobacterium
YEAAFVATVPPPVIAANRALLMALMATNFLG

SEQ ID NO: 878413 - protein, 21 aa, Mycobacterium
YEAEPFIYLMPEGQLPRTGAV

SEQ ID NO: 878414 - protein, 20 aa, Mycobacterium
YEAFLAERGVDLQILGIGRN

SEQ ID NO: 878415 - protein, 24 aa, Mycobacterium
YEANLVRLTELPSGSPVAVVVRQL

SEQ ID NO: 878416 - protein, 21 aa, Mycobacterium
YEAWSFPDFTTGVAALRAVTQ

SEQ ID NO: 878417 - protein, 29 aa, Mycobacterium
YECDGNGNQWAWWGTPGPGAVVTGSHLDS

SEQ ID NO: 878418 - protein, 21 aa, Mycobacterium
YECLAHVPSYARWLSGQDWTP

SEQ ID NO: 878419 - protein, 53 aa, Mycobacterium
YEDAEYTNVSQWISGEFSKLVQFILNLVNAPSELLFGRMMIGNGADATEAGTA

SEQ ID NO: 878420 - protein, 23 aa, Mycobacterium
YEDKFGYVYLVCASGRSAEELLA

SEQ ID NO: 878421 - protein, 17 aa, Mycobacterium
YEDLGGGAYFIHFAWDS

SEQ ID NO: 878422 - protein, 17 aa, Mycobacterium
YEDLGLFGWCLIELVEA

SEQ ID NO: 878423 - protein, 21 aa, Mycobacterium
YEDPPPESVPIKGFLSFDEGA

SEQ ID NO: 878424 - protein, 27 aa, Mycobacterium
YEDRSFTFALKTPPAAKLLLKAAGVGK

SEQ ID NO: 878425 - protein, 31 aa, Mycobacterium
YEDRSFTFALKTPPAAKLLLKAAGVPKGSGE

SEQ ID NO: 878426 - protein, 32 aa, Mycobacterium
YEDRSFTFALKTPPAAKLLLKAAGVPKGSGEP

SEQ ID NO: 878427 - protein, 28 aa, Mycobacterium
YEDRSFTFALKTPPAAKLLLKAAGVQKG

SEQ ID NO: 878428 - protein, 32 aa, Mycobacterium
YEEARDYRFNPFDLTKVWPHGDYPLIDVGKMT

SEQ ID NO: 878429 - protein, 25 aa, Mycobacterium
YEEGRVMNHIYVTKTLVGAGLAAMM

SEQ ID NO: 878430 - protein, 20 aa, Mycobacterium
YEEHLTLDGLRLVYERNRAD

SEQ ID NO: 878431 - protein, 19 aa, Mycobacterium
YEEIFLGGERFAALKDAGA

SEQ ID NO: 878432 - protein, 21 aa, Mycobacterium
YEELRRTLPAKTKWVNSTVFK

SEQ ID NO: 878433 - protein, 26 aa, Mycobacterium
YEEPAFDIFTLVPPPAGVGLGRIGAL

SEQ ID NO: 878434 - protein, 26 aa, Mycobacterium
YEEPAFDVLALLPPPGDAGLGRIGAL

SEQ ID NO: 878435 - protein, 18 aa, Mycobacterium
YEETVFLPALVPSPSAFS

SEQ ID NO: 878436 - protein, 18 aa, Mycobacterium
YEFALAHAGTYWFHPHVG

SEQ ID NO: 878437 - protein, 22 aa, Mycobacterium
YEFALESISKIFTLALVIEQRG

SEQ ID NO: 878438 - protein, 19 aa, Mycobacterium
YEFIECPIWAGGAGAVGPP

SEQ ID NO: 878439 - protein, 18 aa, Mycobacterium
YEFTLFLVRNPEARVRVA

SEQ ID NO: 878440 - protein, 20 aa, Mycobacterium
YEFVGRLRLLWRGFDGGQEA

SEQ ID NO: 878441 - protein, 17 aa, Mycobacterium
YEGPPGLVHGGFLGVFF

SEQ ID NO: 878442 - protein, 17 aa, Mycobacterium
YEGQIIDVVQLRSTPKG

SEQ ID NO: 878443 - protein, 23 aa, Mycobacterium
YEGTSEMHLLSIGKALTGKAAFR

SEQ ID NO: 878444 - protein, 18 aa, Mycobacterium
YEGYLLYPYRGTSSKNQS

SEQ ID NO: 878445 - protein, 25 aa, Mycobacterium
YEHDKYLVTLVFRLGGVDTDAAERF

SEQ ID NO: 878446 - protein, 21 aa, Mycobacterium
YEHHFGHRFVMHMCGQDGASV

SEQ ID NO: 878447 - protein, 25 aa, Mycobacterium
YEHLHTARPVLFNFGARQILNVEGW

SEQ ID NO: 878448 - protein, 18 aa, Mycobacterium
YEHYLGCKVAAWVVDGYR

SEQ ID NO: 878449 - protein, 32 aa, Mycobacterium
YEIKVICDKGFPSYFLIVADLINYARSVGIRV

SEQ ID NO: 878450 - protein, 19 aa, Mycobacterium
YEINDVWYVVGLKGTGSNT

SEQ ID NO: 878451 - protein, 19 aa, Mycobacterium
YEIQLINIRQRIAEGAKVV

SEQ ID NO: 878452 - protein, 24 aa, Mycobacterium
YEIRTLFGVMFQDGALFGSMSLYD

SEQ ID NO: 878453 - protein, 20 aa, Mycobacterium
YEISDPQPLALLPEPNPGDL

SEQ ID NO: 878454 - protein, 24 aa, Mycobacterium
YEITPARRPGLGRISRVRLQVSGV

SEQ ID NO: 878455 - protein, 28 aa, Mycobacterium
YEKAHLPADAWPPTSWYADWVSGLDVFP

SEQ ID NO: 878456 - protein, 28 aa, Mycobacterium
YEKAHLPPGAWPPTSWYADWVSGLDVFP

SEQ ID NO: 878457 - protein, 19 aa, Mycobacterium
YEKIRSDRSFLDELDRLQT

SEQ ID NO: 878458 - protein, 19 aa, Mycobacterium
YEKISQLKPVFRPNGTVTA

SEQ ID NO: 878459 - protein, 20 aa, Mycobacterium
YEKISQLKPVFRPNGTVTAG

SEQ ID NO: 878460 - protein, 17 aa, Mycobacterium
YEKLEAFANFGFPESHS

SEQ ID NO: 878461 - protein, 24 aa, Mycobacterium
YEKNWIRLISDVDYTPAPLVPGVD

SEQ ID NO: 878462 - protein, 17 aa, Mycobacterium
YEKPGMALARSFFTPLG

SEQ ID NO: 878463 - protein, 32 aa, Mycobacterium
YEKTYQVNYLSPFLLTTLLLDVLVQSRATVVN

SEQ ID NO: 878464 - protein, 25 aa, Mycobacterium
YELDVIKQKGFPAYFLVVGDLVSHA

SEQ ID NO: 878465 - protein, 19 aa, Mycobacterium
YELEALLEMVFHRGSKMHD

SEQ ID NO: 878466 - protein, 19 aa, Mycobacterium
YELEALLEVVFHRGSKMHD

SEQ ID NO: 878467 - protein, 20 aa, Mycobacterium
YELFPINLTRMMLHTQGQTV

SEQ ID NO: 878468 - protein, 23 aa, Mycobacterium
YELGSLIWRSRWVTTDGIVECRE

SEQ ID NO: 878469 - protein, 18 aa, Mycobacterium
YELLGVPFAKRGKRMDEC

SEQ ID NO: 878470 - protein, 18 aa, Mycobacterium
YELLPAWDQAEVVFDALV

SEQ ID NO: 878471 - protein, 17 aa, Mycobacterium
YELQRRLAATPDAKTIA

SEQ ID NO: 878472 - protein, 25 aa, Mycobacterium
YELSEWHRILDVNLTGVFLGIRAAT

SEQ ID NO: 878473 - protein, 17 aa, Mycobacterium
YEMKPRDVARQRRDVGM

SEQ ID NO: 878474 - protein, 22 aa, Mycobacterium
YEMWRGYLDSTRLLLRALDRQL

SEQ ID NO: 878475 - protein, 24 aa, Mycobacterium
YENAMRWYHWDPFTHIAKEQATVG

SEQ ID NO: 878476 - protein, 25 aa, Mycobacterium
YENEWGWTWPLNRRVLYNRASADPQ

SEQ ID NO: 878477 - protein, 17 aa, Mycobacterium
YENLLGERGRGYAGFLR

SEQ ID NO: 878478 - protein, 17 aa, Mycobacterium
YENYVIILAQPLPGVDT

SEQ ID NO: 878479 - protein, 17 aa, Mycobacterium
YEPFGLVALEAAAAGTP

SEQ ID NO: 878480 - protein, 27 aa, Mycobacterium
YEPGSLIWRDRWITRDGIIECREALAF

SEQ ID NO: 878481 - protein, 18 aa, Mycobacterium
YEPSHVLVAADLPKKQID

SEQ ID NO: 878482 - protein, 19 aa, Mycobacterium
YEPTFILRGLTDINITFTP

SEQ ID NO: 878483 - protein, 32 aa, Mycobacterium
YEQDPDVLDTWFSSALWPFSTMGWPEATPELE

SEQ ID NO: 878484 - protein, 31 aa, Mycobacterium
YEQLRWTQDSFFPWIWRRLRGLSSADGREPK

SEQ ID NO: 878485 - protein, 17 aa, Mycobacterium
YEQMWLRDADAMCAYAD

SEQ ID NO: 878486 - protein, 29 aa, Mycobacterium
YEQRPPAGYGPPPGYPDQGYRQGPGGYGP

SEQ ID NO: 878487 - protein, 20 aa, Mycobacterium
YEQVFVLFRDRLRVGLEPGD

SEQ ID NO: 878488 - protein, 27 aa, Mycobacterium
YEQYLGFMALNYLYHLMNMIAEGVFER

SEQ ID NO: 878489 - protein, 23 aa, Mycobacterium
YERAWQLGELLEALNLYADEMIN

SEQ ID NO: 878490 - protein, 25 aa, Mycobacterium
YERAYDRLFTALDWLTECLATQRYL

SEQ ID NO: 878491 - protein, 23 aa, Mycobacterium
YERIKPAFKHWAAVVIHAGEPGA

SEQ ID NO: 878492 - protein, 25 aa, Mycobacterium
YERIKPAFKHWAAVVIHAGGPGAGT

SEQ ID NO: 878493 - protein, 24 aa, Mycobacterium
YERIREILGRRPTDAELAMYSVMW

SEQ ID NO: 878494 - protein, 17 aa, Mycobacterium
YERLDARGYGYGPAFRG

SEQ ID NO: 878495 - protein, 29 aa, Mycobacterium
YERLGGAGRWLLALPAHHIAGLQVLVRST

SEQ ID NO: 878496 - protein, 17 aa, Mycobacterium
YERLHAAITRLNRNMQR

SEQ ID NO: 878497 - protein, 19 aa, Mycobacterium
YERRTVVKHLAMRRTLWLV

SEQ ID NO: 878498 - protein, 28 aa, Mycobacterium
YERTYQVNYLAPFLLTTQLLDVLLESRA

SEQ ID NO: 878499 - protein, 26 aa, Mycobacterium
YERWKETAFQYAWLLAAAGCDTEAGE

SEQ ID NO: 878500 - protein, 24 aa, Mycobacterium
YERYMKYLTGCAKAFRIGYIDCNQ

SEQ ID NO: 878501 - protein, 24 aa, Mycobacterium
YERYMKYLTGCARAFRIGYIDCNQ

SEQ ID NO: 878502 - protein, 23 aa, Mycobacterium
YERYMRYLTGCAKAFRDGYIDIN

SEQ ID NO: 878503 - protein, 23 aa, Mycobacterium
YERYMRYLTGCANGFRVGYIDVN

SEQ ID NO: 878504 - protein, 17 aa, Mycobacterium
YESAFAATVPPALILEN

SEQ ID NO: 878505 - protein, 25 aa, Mycobacterium
YESARGIKLLRREPLGTYDSILALH

SEQ ID NO: 878506 - protein, 26 aa, Mycobacterium
YESEWGWTWPMNRRVLYNRASADPGG

SEQ ID NO: 878507 - protein, 27 aa, Mycobacterium
YESGWTFDHFYPIFSDPSGPCLEGWTT

SEQ ID NO: 878508 - protein, 24 aa, Mycobacterium
YESHWRRKLLRRETLNTYDSILAL

SEQ ID NO: 878509 - protein, 23 aa, Mycobacterium
YESLLKGGTFGVGTLPIPGAGIV

SEQ ID NO: 878510 - protein, 19 aa, Mycobacterium
YESLSGAPMPGWLAAALAA

SEQ ID NO: 878511 - protein, 21 aa, Mycobacterium
YESMTLPATVTMTLLRGKVTA

SEQ ID NO: 878512 - protein, 17 aa, Mycobacterium
YETAFAATVPPVSVAAN

SEQ ID NO: 878513 - protein, 21 aa, Mycobacterium
YETARLFLDPGFEQSVRETFG

SEQ ID NO: 878514 - protein, 25 aa, Mycobacterium
YETDLLRPIIDLVAARAPRGYDQGN

SEQ ID NO: 878515 - protein, 22 aa, Mycobacterium
YETPAEIRMLRTLGADLVGMST

SEQ ID NO: 878516 - protein, 22 aa, Mycobacterium
YETRIRLLVIRSGLPAPQTEIK

SEQ ID NO: 878517 - protein, 20 aa, Mycobacterium
YEVALRRARLSLANGRPVIL

SEQ ID NO: 878518 - protein, 18 aa, Mycobacterium
YEVARLLTHPRFLAQVRA

SEQ ID NO: 878519 - protein, 19 aa, Mycobacterium
YEVARMLTDPVFLASVRSQ

SEQ ID NO: 878520 - protein, 31 aa, Mycobacterium
YEVDKVLARRLPWGDRIRKGIDRLIEFNKKE

SEQ ID NO: 878521 - protein, 22 aa, Mycobacterium
YEVHLGSWRPGLSYRQLARELT

SEQ ID NO: 878522 - protein, 18 aa, Mycobacterium
YEVLPAVFDPEMAQLPGA

SEQ ID NO: 878523 - protein, 28 aa, Mycobacterium
YEVNEAFAPVPLAWLADTGADEAKLNPL

SEQ ID NO: 878524 - protein, 17 aa, Mycobacterium
YEVNEAFAPVPLAWLRD

SEQ ID NO: 878525 - protein, 24 aa, Mycobacterium
YEVPGLADAIRRSGLPKVPTSILS

SEQ ID NO: 878526 - protein, 24 aa, Mycobacterium
YEVVLDPRLRAAASWPAGVAAGRR

SEQ ID NO: 878527 - protein, 17 aa, Mycobacterium
YEWAPLRLPPEVTRLSA

SEQ ID NO: 878528 - protein, 17 aa, Mycobacterium
YEWILAFEAPELHRIVD

SEQ ID NO: 878529 - protein, 18 aa, Mycobacterium
YEYGSRAGLWRVLRVFEQ

SEQ ID NO: 878530 - protein, 19 aa, Mycobacterium
YEYGSRAGLWRVLRVFERR

SEQ ID NO: 878531 - protein, 19 aa, Mycobacterium
YEYQMLYGIREAEQRRLAG

SEQ ID NO: 878532 - protein, 17 aa, Mycobacterium
YFADEQRAIFRRTWLNV

SEQ ID NO: 878533 - protein, 24 aa, Mycobacterium
YFAEVNLVGFYDLASELGGITVCL

SEQ ID NO: 878534 - protein, 19 aa, Mycobacterium
YFAEYVTVRALYHDWEREE

SEQ ID NO: 878535 - protein, 21 aa, Mycobacterium
YFANLKREEFFTYHGTVTPWE

SEQ ID NO: 878536 - protein, 18 aa, Mycobacterium
YFASPVELAASVDVLVVA

SEQ ID NO: 878537 - protein, 19 aa, Mycobacterium
YFASWFERYARSFSGTIAG

SEQ ID NO: 878538 - protein, 17 aa, Mycobacterium
YFDAGELDVWEVWARVA

SEQ ID NO: 878539 - protein, 25 aa, Mycobacterium
YFDKAGRLFIIGRQDDLIISGGENV

SEQ ID NO: 878540 - protein, 18 aa, Mycobacterium
YFDTLTMIKQLLGGLAMR

SEQ ID NO: 878541 - protein, 17 aa, Mycobacterium
YFDTLTMIKQLLGGLDL

SEQ ID NO: 878542 - protein, 27 aa, Mycobacterium
YFDYLGFDIFYRVEGSGPPLLLIHGYP

SEQ ID NO: 878543 - protein, 18 aa, Mycobacterium
YFEAKAMLFDPSSPLRAR

SEQ ID NO: 878544 - protein, 19 aa, Mycobacterium
YFEGKPQEVIDRAKAAPPL

SEQ ID NO: 878545 - protein, 18 aa, Mycobacterium
YFEHCRDQWATGGPLRAF

SEQ ID NO: 878546 - protein, 30 aa, Mycobacterium
YFELRLSDAWVWDLFRPARFVKHVRVITFK

SEQ ID NO: 878547 - protein, 18 aa, Mycobacterium
YFENLGWRTVDVQALYVA

SEQ ID NO: 878548 - protein, 18 aa, Mycobacterium
YFERVFALQRDVFPRDWI

SEQ ID NO: 878549 - protein, 18 aa, Mycobacterium
YFESREAVLLELLDGALR

SEQ ID NO: 878550 - protein, 20 aa, Mycobacterium
YFETVGMGTALRPGLFGSDG

SEQ ID NO: 878551 - protein, 22 aa, Mycobacterium
YFEVLHELKLIVDLMYEGGIAR

SEQ ID NO: 878552 - protein, 26 aa, Mycobacterium
YFEVLHELKLIVDLMYEGGIARMNYS

SEQ ID NO: 878553 - protein, 18 aa, Mycobacterium
YFGFSYGTYLGVVYADMF

SEQ ID NO: 878554 - protein, 31 aa, Mycobacterium
YFGGTVEAYLHKRAADLPPAVGVLVEYEGSD

SEQ ID NO: 878555 - protein, 31 aa, Mycobacterium
YFGGTVEAYLHKRAADLPPAVGVLVEYESAS

SEQ ID NO: 878556 - protein, 23 aa, Mycobacterium
YFGPAYMINWLHNDLAPEFTVEV

SEQ ID NO: 878557 - protein, 22 aa, Mycobacterium
YFGPSFMINWLHNNYGGYKAES

SEQ ID NO: 878558 - protein, 26 aa, Mycobacterium
YFGQRLPAPVPYRRFVSWLAEQDNDA

SEQ ID NO: 878559 - protein, 18 aa, Mycobacterium
YFGTKIMRYMHDHGITEE

SEQ ID NO: 878560 - protein, 17 aa, Mycobacterium
YFHNKYFRLDNYRYGTE

SEQ ID NO: 878561 - protein, 17 aa, Mycobacterium
YFHQKAVANGLLAPDDV

SEQ ID NO: 878562 - protein, 22 aa, Mycobacterium
YFHVELMSIRRSATALKYLAGS

SEQ ID NO: 878563 - protein, 19 aa, Mycobacterium
YFIDLAKVWQSLPAAQQAP

SEQ ID NO: 878564 - protein, 19 aa, Mycobacterium
YFIDPADGKRRKMRFRQTV

SEQ ID NO: 878565 - protein, 19 aa, Mycobacterium
YFKGGVNPVSVWVSTEYVR

SEQ ID NO: 878566 - protein, 17 aa, Mycobacterium
YFNDHGAQIDRFANSLI

SEQ ID NO: 878567 - protein, 17 aa, Mycobacterium
YFNDHGAQIDRFASSLI

SEQ ID NO: 878568 - protein, 28 aa, Mycobacterium
YFNGWDPLLQTGLPEPTLAWLDETAPEG

SEQ ID NO: 878569 - protein, 18 aa, Mycobacterium
YFPDKRAFFAAVVKDEAD

SEQ ID NO: 878570 - protein, 17 aa, Mycobacterium
YFPDVRFATSDRDLTAG

SEQ ID NO: 878571 - protein, 19 aa, Mycobacterium
YFPFDPALRDRQDLGHQPV

SEQ ID NO: 878572 - protein, 17 aa, Mycobacterium
YFPGDLIDFQFSGDTIE

SEQ ID NO: 878573 - protein, 17 aa, Mycobacterium
YFPKLGKNGTKGKLLEY

SEQ ID NO: 878574 - protein, 17 aa, Mycobacterium
YFPKLGKQGTKGRLIDY

SEQ ID NO: 878575 - protein, 17 aa, Mycobacterium
YFQGLAGVVPPLPMVFA

SEQ ID NO: 878576 - protein, 19 aa, Mycobacterium
YFQVAQVFEKAILDGQLKP

SEQ ID NO: 878577 - protein, 20 aa, Mycobacterium
YFRAGQVPLLAVWGRGDEIF

SEQ ID NO: 878578 - protein, 19 aa, Mycobacterium
YFRASGVPLLAVWGRGDEI

SEQ ID NO: 878579 - protein, 17 aa, Mycobacterium
YFRERVLRAGRWDAGRG

SEQ ID NO: 878580 - protein, 18 aa, Mycobacterium
YFRFAQRTWDLENAFYQF

SEQ ID NO: 878581 - protein, 25 aa, Mycobacterium
YFRSDDWPKAVPVGRLFGYLRRFRA

SEQ ID NO: 878582 - protein, 26 aa, Mycobacterium
YFRTAHGIFGWGLQLTDRPGAFTIEL

SEQ ID NO: 878583 - protein, 23 aa, Mycobacterium
YFRTSPHLPMSWQRKLFQMMQPL

SEQ ID NO: 878584 - protein, 17 aa, Mycobacterium
YFSCRDKLFPTGIRRWG

SEQ ID NO: 878585 - protein, 20 aa, Mycobacterium
YFSDELLADLALSCALWVGM

SEQ ID NO: 878586 - protein, 27 aa, Mycobacterium
YFTDAALVPDPYPYFDHLRSKCPVTQA

SEQ ID NO: 878587 - protein, 17 aa, Mycobacterium
YFTEHLPATFVYAGIDV

SEQ ID NO: 878588 - protein, 26 aa, Mycobacterium
YFTEPGFKGWLKKVFFGGSGQVPIDR

SEQ ID NO: 878589 - protein, 20 aa, Mycobacterium
YFTVQTIKDRLGAKPLVIQL

SEQ ID NO: 878590 - protein, 19 aa, Mycobacterium
YFVHSYAAQRWEGSPDAVL

SEQ ID NO: 878591 - protein, 19 aa, Mycobacterium
YFYRAFTQGTSLTDAARTL

SEQ ID NO: 878592 - protein, 24 aa, Mycobacterium
YGAAKLGLVGLINTLSQEGAKYNI

SEQ ID NO: 878593 - protein, 23 aa, Mycobacterium
YGAAKLGLVGMINTLALEGAKYN

SEQ ID NO: 878594 - protein, 24 aa, Mycobacterium
YGAAKWALRGLTQTAAAELAPAGI

SEQ ID NO: 878595 - protein, 19 aa, Mycobacterium
YGAALPWPASGGEGARPAA

SEQ ID NO: 878596 - protein, 28 aa, Mycobacterium
YGAENATWRNFYLMGAYELRHGSVGTPV

SEQ ID NO: 878597 - protein, 27 aa, Mycobacterium
YGAENAVWRNFFLCGAAELRDGKFGTA

SEQ ID NO: 878598 - protein, 30 aa, Mycobacterium
YGAHVRDVFRIFLTRLRLMLAEDDPLFENW

SEQ ID NO: 878599 - protein, 18 aa, Mycobacterium
YGAITAPTLVLWTSDDPT

SEQ ID NO: 878600 - protein, 19 aa, Mycobacterium
YGARGWAMNALFDGIEALL

SEQ ID NO: 878601 - protein, 31 aa, Mycobacterium
YGASAVPLEWRRLLHGWPDMTARDLVALANT

SEQ ID NO: 878602 - protein, 25 aa, Mycobacterium
YGASKLANLLFTKELQRRLSAAGSP

SEQ ID NO: 878603 - protein, 26 aa, Mycobacterium
YGAVRPLPMVSWLYEYGNYRRFTHTV

SEQ ID NO: 878604 - protein, 17 aa, Mycobacterium
YGAWNLHTATASQPLDW

SEQ ID NO: 878605 - protein, 34 aa, Mycobacterium
YGAYKIHPYHYWNPATREPALPRPSYVDWDIRVC

SEQ ID NO: 878606 - protein, 24 aa, Mycobacterium
YGDDQFMAWRRSYDTPPPPIEKGS

SEQ ID NO: 878607 - protein, 20 aa, Mycobacterium
YGDGLANRVRILAPGGITAA

SEQ ID NO: 878608 - protein, 17 aa, Mycobacterium
YGDGPLAAGYFIAPTIM

SEQ ID NO: 878609 - protein, 19 aa, Mycobacterium
YGDGWCPFPAPPQLAQTAG

SEQ ID NO: 878610 - protein, 22 aa, Mycobacterium
YGDHMRVSHMLGFDTPDTMVAE

SEQ ID NO: 878611 - protein, 18 aa, Mycobacterium
YGDHRCRIRAVTGAAATA

SEQ ID NO: 878612 - protein, 27 aa, Mycobacterium
YGDLLRAYARIAGIWRAPVAVYGIDTS

SEQ ID NO: 878613 - protein, 36 aa, Mycobacterium
YGDPDRGWAWQVPLLELPQAQFLLMSATLGDVTFLR

SEQ ID NO: 878614 - protein, 30 aa, Mycobacterium
YGDQLPAPATYRSYLTWLAGQDRAAAQAAW

SEQ ID NO: 878615 - protein, 19 aa, Mycobacterium
YGDRIFLRFGDQQLTYRDA

SEQ ID NO: 878616 - protein, 22 aa, Mycobacterium
YGDSEWLRREFDRADGARVGCG

SEQ ID NO: 878617 - protein, 32 aa, Mycobacterium
YGDSRLGLFPFRRNLSLFAVDLALLTVSHPHT

SEQ ID NO: 878618 - protein, 26 aa, Mycobacterium
YGDTKMGLFPFRRNLSFYGVDLGMLS

SEQ ID NO: 878619 - protein, 27 aa, Mycobacterium
YGDTKMGLFPFRRNLSFYGVDLGMLSI

SEQ ID NO: 878620 - protein, 26 aa, Mycobacterium
YGDTKMGLFPFRRNLSFYGVDLGMMS

SEQ ID NO: 878621 - protein, 19 aa, Mycobacterium
YGDWPRSVGLSIWGTSAMR

SEQ ID NO: 878622 - protein, 17 aa, Mycobacterium
YGDYAFFGFFESEPDQA

SEQ ID NO: 878623 - protein, 33 aa, Mycobacterium
YGELGLAPVLGYEYELWIFRDGEGTSPPILGGR

SEQ ID NO: 878624 - protein, 25 aa, Mycobacterium
YGETKLIGEWLLRDAGRASGLRHTS

SEQ ID NO: 878625 - protein, 21 aa, Mycobacterium
YGEVAAFYRLAEEARMAPNLS

SEQ ID NO: 878626 - protein, 23 aa, Mycobacterium
YGEVLLDWIVERLANQKGSDDTP

SEQ ID NO: 878627 - protein, 18 aa, Mycobacterium
YGEWLRRGRRRTEARTQL

SEQ ID NO: 878628 - protein, 19 aa, Mycobacterium
YGFARDRFWLGDGRGPGGS

SEQ ID NO: 878629 - protein, 17 aa, Mycobacterium
YGFLGGETNQWYPDLVY

SEQ ID NO: 878630 - protein, 17 aa, Mycobacterium
YGFMGGETDQWYPDLTY

SEQ ID NO: 878631 - protein, 17 aa, Mycobacterium
YGGAIIPGNGGAGGSAG

SEQ ID NO: 878632 - protein, 20 aa, Mycobacterium
YGGERIFYYGGGGQGNHLGG

SEQ ID NO: 878633 - protein, 24 aa, Mycobacterium
YGGIYAPIRGLRNKGLELMEDVRK

SEQ ID NO: 878634 - protein, 26 aa, Mycobacterium
YGGMGGDYFALALALEELGKVDQSVA

SEQ ID NO: 878635 - protein, 25 aa, Mycobacterium
YGGMGGDYFALSLALEELGKVDQSV

SEQ ID NO: 878636 - protein, 19 aa, Mycobacterium
YGGNPLACAAALAVIDTIE

SEQ ID NO: 878637 - protein, 26 aa, Mycobacterium
YGGSKVALPLVRKALELMPNVGFVNA

SEQ ID NO: 878638 - protein, 25 aa, Mycobacterium
YGGTFRLIDKVFSQWGIRHTPVPVA

SEQ ID NO: 878639 - protein, 25 aa, Mycobacterium
YGGTFRLIDKVFTQWGVRYTPVALS

SEQ ID NO: 878640 - protein, 32 aa, Mycobacterium
YGGTIPWTMSPWAVTNLGLALMSFERMCKTLP

SEQ ID NO: 878641 - protein, 18 aa, Mycobacterium
YGGVLGYLDFAGNADFAI

SEQ ID NO: 878642 - protein, 30 aa, Mycobacterium
YGHAFVSFLDKFPNVLSPRSSLLVLGDGRN

SEQ ID NO: 878643 - protein, 26 aa, Mycobacterium
YGHATGMPAPIPLAPGPVHPGGTSPV

SEQ ID NO: 878644 - protein, 20 aa, Mycobacterium
YGHFGQAGGFIWADPEADLA

SEQ ID NO: 878645 - protein, 24 aa, Mycobacterium
YGHFGQAGGFIWVDPEADLALVVL

SEQ ID NO: 878646 - protein, 22 aa, Mycobacterium
YGHIGWFSRLAVRLARQQMFSQ

SEQ ID NO: 878647 - protein, 20 aa, Mycobacterium
YGHKILLIERERSNFEPQSV

SEQ ID NO: 878648 - protein, 31 aa, Mycobacterium
YGHTWTARRDTTLALLPVGYADGVFRSLGNR

SEQ ID NO: 878649 - protein, 22 aa, Mycobacterium
YGIALLSRYPVASWQVVRLPRI

SEQ ID NO: 878650 - protein, 25 aa, Mycobacterium
YGIARLRWLDRPTGRVIRRIESTAV

SEQ ID NO: 878651 - protein, 29 aa, Mycobacterium
YGIDFIEACAWIKENLPGVHISGGISNVS

SEQ ID NO: 878652 - protein, 28 aa, Mycobacterium
YGIRGMHLAYDLLEEWDTLVLVDAVPSR

SEQ ID NO: 878653 - protein, 20 aa, Mycobacterium
YGKDFEHWSIHRKPPAFSDL

SEQ ID NO: 878654 - protein, 22 aa, Mycobacterium
YGKPKVLVEGWLETALAALRGG

SEQ ID NO: 878655 - protein, 28 aa, Mycobacterium
YGKVDVLINNAFRVPSLKPFSGTSFQHI

SEQ ID NO: 878656 - protein, 22 aa, Mycobacterium
YGKVDVLINNAFRVPSMKPFAN

SEQ ID NO: 878657 - protein, 22 aa, Mycobacterium
YGKVDVLINNAFRVPSMKPLAG

SEQ ID NO: 878658 - protein, 18 aa, Mycobacterium
YGLAYIPDGVHLPAAVHM

SEQ ID NO: 878659 - protein, 17 aa, Mycobacterium
YGLDCILDHAGRLIDER

SEQ ID NO: 878660 - protein, 21 aa, Mycobacterium
YGLDPDWRHGMWQGDLVVQGK

SEQ ID NO: 878661 - protein, 21 aa, Mycobacterium
YGLEPERVLWMSPESAELAKY

SEQ ID NO: 878662 - protein, 26 aa, Mycobacterium
YGLEPQQLIQILQQNNQLPAMFADVR

SEQ ID NO: 878663 - protein, 25 aa, Mycobacterium
YGLERFLHNTWRFGIDRILTGVAMS

SEQ ID NO: 878664 - protein, 30 aa, Mycobacterium
YGLESQAWLDLYRNFWTSLFSTFYRVREMR

SEQ ID NO: 878665 - protein, 17 aa, Mycobacterium
YGLGLDYRGLDLDYRGL

SEQ ID NO: 878666 - protein, 17 aa, Mycobacterium
YGLGQVLFGIESALDEL

SEQ ID NO: 878667 - protein, 20 aa, Mycobacterium
YGLIEWKMDLELGAHYYVKF

SEQ ID NO: 878668 - protein, 27 aa, Mycobacterium
YGLIEWKMDLELGAHYYVKFGNPDVVT

SEQ ID NO: 878669 - protein, 20 aa, Mycobacterium
YGLIEWKMDLELGEHYYVKF

SEQ ID NO: 878670 - protein, 21 aa, Mycobacterium
YGLIRGSWLAAARLVKCGPWH

SEQ ID NO: 878671 - protein, 23 aa, Mycobacterium
YGLIVYQEQIMFIAQKVASYSMG

SEQ ID NO: 878672 - protein, 21 aa, Mycobacterium
YGLIVYQEQIMFIAQKVASYT

SEQ ID NO: 878673 - protein, 19 aa, Mycobacterium
YGLLRPVTGSASVLLCNNP

SEQ ID NO: 878674 - protein, 26 aa, Mycobacterium
YGLNAKWPVYLSTKNTILKAYDGMFK

SEQ ID NO: 878675 - protein, 18 aa, Mycobacterium
YGLNWRFGAENLMLVSAG

SEQ ID NO: 878676 - protein, 17 aa, Mycobacterium
YGLPELPGARERLRGAR

SEQ ID NO: 878677 - protein, 18 aa, Mycobacterium
YGLPELPGARERLRGARR

SEQ ID NO: 878678 - protein, 37 aa, Mycobacterium
YGLPGPLWSITTERFLNTPWWISPLPSARTRAMLWTP

SEQ ID NO: 878679 - protein, 26 aa, Mycobacterium
YGLSSGRFAVLITLGAAPEGRHTPSA

SEQ ID NO: 878680 - protein, 17 aa, Mycobacterium
YGLSWNPANLMDSLASI

SEQ ID NO: 878681 - protein, 26 aa, Mycobacterium
YGLTNSFFFGYGENAGVVAALTYVVD

SEQ ID NO: 878682 - protein, 21 aa, Mycobacterium
YGMIYFDLRPSSHAPTLELRV

SEQ ID NO: 878683 - protein, 18 aa, Mycobacterium
YGMVLWDEVFARVAQDYP

SEQ ID NO: 878684 - protein, 24 aa, Mycobacterium
YGNAGFYNAAVQNAGFVIAGVNTS

SEQ ID NO: 878685 - protein, 24 aa, Mycobacterium
YGNAIINTLLIYMENHRDELVVFG

SEQ ID NO: 878686 - protein, 25 aa, Mycobacterium
YGNAIINTLLLYMENHRDDLVVFGA

SEQ ID NO: 878687 - protein, 26 aa, Mycobacterium
YGNPRNAFWRIMGSLYGFAPDAAYSE

SEQ ID NO: 878688 - protein, 34 aa, Mycobacterium
YGNTRMGLYPFRRGLTFYYVDLGLMSVIQPERVR

SEQ ID NO: 878689 - protein, 36 aa, Mycobacterium
YGNTRVGLYPFRRGLTFYYLDLALMSVLQPDRVREL

SEQ ID NO: 878690 - protein, 24 aa, Mycobacterium
YGNVVRFLPPLSIGDDLLNEGLDV

SEQ ID NO: 878691 - protein, 27 aa, Mycobacterium
YGNWMSVQALRMTGTRPVYLINRRGDS

SEQ ID NO: 878692 - protein, 26 aa, Mycobacterium
YGPAAYLADLLRFLDAHPSQVAGRTV

SEQ ID NO: 878693 - protein, 19 aa, Mycobacterium
YGPHVGVFLPELELARAWE

SEQ ID NO: 878694 - protein, 18 aa, Mycobacterium
YGPKVLDLIGRHADGFIL

SEQ ID NO: 878695 - protein, 25 aa, Mycobacterium
YGPSYQHPPAWDLAGRRGDYVNGAV

SEQ ID NO: 878696 - protein, 21 aa, Mycobacterium
YGPTETTMWVALSAPLVAGSG

SEQ ID NO: 878697 - protein, 22 aa, Mycobacterium
YGPVRFPGVPTWFSKTPGRVRG

SEQ ID NO: 878698 - protein, 20 aa, Mycobacterium
YGPVRLPDAGPTPPPIAVIS

SEQ ID NO: 878699 - protein, 29 aa, Mycobacterium
YGPYSEVAALYFIYFRLCTPRHGIRSLLM

SEQ ID NO: 878700 - protein, 28 aa, Mycobacterium
YGQAKLANLLFTYELQRRLAPHGTTIAA

SEQ ID NO: 878701 - protein, 25 aa, Mycobacterium
YGQDRPADRPLWLGSIKSNIGHTSA

SEQ ID NO: 878702 - protein, 19 aa, Mycobacterium
YGQDRPPGRPLWLGSIKSN

SEQ ID NO: 878703 - protein, 30 aa, Mycobacterium; identical to SEQ ID NO: 134075

SEQ ID NO: 878704 - protein, 17 aa, Mycobacterium
YGQGLLLRLPPVGEAPD

SEQ ID NO: 878705 - protein, 18 aa, Mycobacterium
YGQIIFDGQCRNMGNHKG

SEQ ID NO: 878706 - protein, 17 aa, Mycobacterium
YGQLAWSLRSDARVVVV

SEQ ID NO: 878707 - protein, 25 aa, Mycobacterium
YGQLAWSLRTDPRVIVIERTNVRDL

SEQ ID NO: 878708 - protein, 26 aa, Mycobacterium
YGQPPGAFWLPRRLGGGAPTPEEARR

SEQ ID NO: 878709 - protein, 20 aa, Mycobacterium
YGQRLAAFVVLEPGAGATPD

SEQ ID NO: 878710 - protein, 19 aa, Mycobacterium
YGQRLPAPPSYRSYLMWLV

SEQ ID NO: 878711 - protein, 27 aa, Mycobacterium
YGQSKLANLLFAYELQRRLAAAGKPTI

SEQ ID NO: 878712 - protein, 30 aa, Mycobacterium
YGQSKLANLLFTYELQRRLAADPDAATIAV

SEQ ID NO: 878713 - protein, 30 aa, Mycobacterium
YGQSKLANLLFTYELQRRLAADSQAATIAV

SEQ ID NO: 878714 - protein, 26 aa, Mycobacterium
YGQSKLANLLFTYELQRRLAATPDAK

SEQ ID NO: 878715 - protein, 26 aa, Mycobacterium
YGQSKLANLLFTYELQRRLAGTNTVA

SEQ ID NO: 878716 - protein, 29 aa, Mycobacterium
YGQSKLANLLFTYELQRRLTGHQTTALAA

SEQ ID NO: 878717 - protein, 20 aa, Mycobacterium
YGQTFAWNQLGVTPMIGVND

SEQ ID NO: 878718 - protein, 22 aa, Mycobacterium
YGQVIGMVAGRQLFVCMDYDGT

SEQ ID NO: 878719 - protein, 20 aa, Mycobacterium
YGRAESAGAAVLQTVGADVL

SEQ ID NO: 878720 - protein, 17 aa, Mycobacterium
YGREAELAKALRVWEAK

SEQ ID NO: 878721 - protein, 19 aa, Mycobacterium
YGRFFKMAYQALPSDGVML

SEQ ID NO: 878722 - protein, 20 aa, Mycobacterium
YGRFLPAWHQVAGSSSPNHS

SEQ ID NO: 878723 - protein, 22 aa, Mycobacterium
YGRGFLTPRDSARQRCLFHELA

SEQ ID NO: 878724 - protein, 25 aa, Mycobacterium
YGRLGKWFWGFEQQGVVPDIVAIAK

SEQ ID NO: 878725 - protein, 17 aa, Mycobacterium
YGRLTPWGRLAAYRAEY

SEQ ID NO: 878726 - protein, 24 aa, Mycobacterium
YGRLVREIVLPGSSPRPYGFYFDE

SEQ ID NO: 878727 - protein, 17 aa, Mycobacterium
YGRLVREVMLPGSSPRP

SEQ ID NO: 878728 - protein, 23 aa, Mycobacterium
YGRLVRQVTLPGSSPRPYGGYFD

SEQ ID NO: 878729 - protein, 25 aa, Mycobacterium
YGRLWATILQHRFGGSGALAGHPIG

SEQ ID NO: 878730 - protein, 19 aa, Mycobacterium
YGRRFFGRYPSHTPTIHSD

SEQ ID NO: 878731 - protein, 33 aa, Mycobacterium
YGRVRRCGMVSPTVFWPIPRVYSGLVRIDRYET

SEQ ID NO: 878732 - protein, 27 aa, Mycobacterium
YGSASILPISWAYIRMMGADGLRAASL

SEQ ID NO: 878733 - protein, 27 aa, Mycobacterium
YGSASILPISWAYIRMMGAEGLRAASL

SEQ ID NO: 878734 - protein, 31 aa, Mycobacterium
YGSASILPITWAYIRMMGAAGLRSATLVAIA

SEQ ID NO: 878735 - protein, 27 aa, Mycobacterium
YGSASILPITWAYIRMMGADGLRAASL

SEQ ID NO: 878736 - protein, 29 aa, Mycobacterium
YGSASILPITWAYIRMMGPDGLRAASLTA

SEQ ID NO: 878737 - protein, 27 aa, Mycobacterium
YGSASILPITWMYIRMMGADGLRAATL

SEQ ID NO: 878738 - protein, 17 aa, Mycobacterium
YGSFHAVGDVTLSILPR

SEQ ID NO: 878739 - protein, 27 aa, Mycobacterium
YGSKRGLYLAALDRYLTGGGDPAQLVA

SEQ ID NO: 878740 - protein, 26 aa, Mycobacterium
YGTAQRDLAWRRPGVSAWQILVSEFM

SEQ ID NO: 878741 - protein, 27 aa, Mycobacterium
YGTHWHGLLDNDALRRDWLTEVAAAAG

SEQ ID NO: 878742 - protein, 20 aa, Mycobacterium
YGTIPLGLFCRKSLAEHMDA

SEQ ID NO: 878743 - protein, 21 aa, Mycobacterium
YGTKRGIIAIGKVAPFGVGFA

SEQ ID NO: 878744 - protein, 24 aa, Mycobacterium
YGTLDAIASGRLNPLPSVGKIIGL

SEQ ID NO: 878745 - protein, 21 aa, Mycobacterium
YGTLDRLSCGRLVLGVGIGSL

SEQ ID NO: 878746 - protein, 23 aa, Mycobacterium
YGTMPHSRKCRCARLVYANSMHV

SEQ ID NO: 878747 - protein, 17 aa, Mycobacterium
YGTPYFFSANAFHRDDF

SEQ ID NO: 878748 - protein, 24 aa, Mycobacterium
YGVDFVQNTWRFGIDRVLAGVAMS

SEQ ID NO: 878749 - protein, 23 aa, Mycobacterium
YGVDIERIILVGGGARSEAVRRI

SEQ ID NO: 878750 - protein, 19 aa, Mycobacterium
YGVDVSVIMPPFTNTDLIS

SEQ ID NO: 878751 - protein, 24 aa, Mycobacterium
YGVDVTIVEFLPRALPNEDADVSK

SEQ ID NO: 878752 - protein, 24 aa, Mycobacterium
YGVGLINWWDPAGARRTLSELKSL

SEQ ID NO: 878753 - protein, 20 aa, Mycobacterium
YGVILIYRGSWCPYCNAQLA

SEQ ID NO: 878754 - protein, 26 aa, Mycobacterium
YGVLAGYPLVNLKVTLLDGAFHEVDS

SEQ ID NO: 878755 - protein, 17 aa, Mycobacterium
YGVLFFASDASSYCSGQ

SEQ ID NO: 878756 - protein, 19 aa, Mycobacterium
YGVPHVLTAHSLEPMRPWK

SEQ ID NO: 878757 - protein, 19 aa, Mycobacterium
YGVPTMFIAELGLPDFTDY

SEQ ID NO: 878758 - protein, 19 aa, Mycobacterium
YGVPTMFIAMLGHPDFANF

SEQ ID NO: 878759 - protein, 18 aa, Mycobacterium
YGVQTRFFDDFFVAAGAA

SEQ ID NO: 878760 - protein, 26 aa, Mycobacterium
YGVRLPAAPSYRSFVTWLSEQDRGAA

SEQ ID NO: 878761 - protein, 17 aa, Mycobacterium
YGVRVLVIRPGQVRTRM

SEQ ID NO: 878762 - protein, 25 aa, Mycobacterium
YGVSVPAARRYLPGSLILETTWQTH

SEQ ID NO: 878763 - protein, 23 aa, Mycobacterium
YGVSYFIVQIPHIETFAKVIAEL

SEQ ID NO: 878764 - protein, 22 aa, Mycobacterium
YGVTIYYTAPTLIRTFMKLGHQ

SEQ ID NO: 878765 - protein, 23 aa, Mycobacterium
YGVTNPVPPWKTSLDGLCDALDR

SEQ ID NO: 878766 - protein, 19 aa, Mycobacterium
YGVVGVIAPWNGALAVAAS

SEQ ID NO: 878767 - protein, 32 aa, Mycobacterium
YGVVSAITPWNYPLYQVVAKVLPAIAAGCTVV

SEQ ID NO: 878768 - protein, 17 aa, Mycobacterium
YGWVFDNYRNGYLEADD

SEQ ID NO: 878769 - protein, 17 aa, Mycobacterium
YGYPYPAVPAGAGPAVP

SEQ ID NO: 878770 - protein, 20 aa, Mycobacterium
YGYVFGPYHMLIESTTTHAA

SEQ ID NO: 878771 - protein, 29 aa, Mycobacterium
YHAGVQDILLIAFALAWNEFLGSAGAPIG

SEQ ID NO: 878772 - protein, 18 aa, Mycobacterium
YHALNPELFYWAHASFVD

SEQ ID NO: 878773 - protein, 26 aa, Mycobacterium
YHANFGVPYAFGKYDQLFVPEFNAGA

SEQ ID NO: 878774 - protein, 25 aa, Mycobacterium
YHAYNPVLRLLLERPVHAKISRDNL

SEQ ID NO: 878775 - protein, 18 aa, Mycobacterium
YHCRAAKGFVLCSTGSIY

SEQ ID NO: 878776 - protein, 19 aa, Mycobacterium
YHDLWHVEKSFRMSKSDLD

SEQ ID NO: 878777 - protein, 18 aa, Mycobacterium
YHDPDLPPSHHYLAAYHW

SEQ ID NO: 878778 - protein, 25 aa, Mycobacterium
YHDVTEWMTSPLSWVASSALQFATE

SEQ ID NO: 878779 - protein, 19 aa, Mycobacterium
YHEAKAAGIIYQATLRREL

SEQ ID NO: 878780 - protein, 21 aa, Mycobacterium
YHEALLVPAMLLADKIERVLV

SEQ ID NO: 878781 - protein, 17 aa, Mycobacterium
YHEFGSRSGLLTRAWLR

SEQ ID NO: 878782 - protein, 25 aa, Mycobacterium
YHENRDYLFALWDALDLGDRVTLVL

SEQ ID NO: 878783 - protein, 17 aa, Mycobacterium
YHESPVPGLLRGFGHVG

SEQ ID NO: 878784 - protein, 18 aa, Mycobacterium
YHFGSREGLIRALISYRQ

SEQ ID NO: 878785 - protein, 29 aa, Mycobacterium
YHGIPAAALHFFPARLWASGGMSPLITAA

SEQ ID NO: 878786 - protein, 22 aa, Mycobacterium
YHGLHAFRWVADDGSARFVRYH

SEQ ID NO: 878787 - protein, 24 aa, Mycobacterium
YHGREFIELIAVGATYDLAAAAAL

SEQ ID NO: 878788 - protein, 23 aa, Mycobacterium
YHGRHQLNRWPDGLEKCIGCELC

SEQ ID NO: 878789 - protein, 22 aa, Mycobacterium
YHGWGFHEDGAASGLRAARRLG

SEQ ID NO: 878790 - protein, 17 aa, Mycobacterium
YHGYSQILLNGRWVKAT

SEQ ID NO: 878791 - protein, 19 aa, Mycobacterium
YHHFGGKTELFLAIFEQMA

SEQ ID NO: 878792 - protein, 18 aa, Mycobacterium
YHHFGSKAGLLVVIYDDF

SEQ ID NO: 878793 - protein, 25 aa, Mycobacterium
YHHGDLKRALSSAALSLVAEKGPKG

SEQ ID NO: 878794 - protein, 17 aa, Mycobacterium
YHLARQLLSLDHLSGGR

SEQ ID NO: 878795 - protein, 24 aa, Mycobacterium
YHLDRFPELVAAAPKGLFLTGTAL

SEQ ID NO: 878796 - protein, 20 aa, Mycobacterium
YHLGLAFQILDDIVGIWGDP

SEQ ID NO: 878797 - protein, 33 aa, Mycobacterium
YHLLANSMVWLSDRYPRPLLPSVPTWVRELTHE

SEQ ID NO: 878798 - protein, 21 aa, Mycobacterium
YHLNGGDLVWQIGTGYFGCRN

SEQ ID NO: 878799 - protein, 20 aa, Mycobacterium
YHLTHGLLEQPMLDDPLDSA

SEQ ID NO: 878800 - protein, 18 aa, Mycobacterium
YHLTRKLCKLAEELGVPC

SEQ ID NO: 878801 - protein, 17 aa, Mycobacterium
YHMTTFGFIMGEVFRRV

SEQ ID NO: 878802 - protein, 23 aa, Mycobacterium
YHNGHLYIAGRIKDLVIIDGRNH

SEQ ID NO: 878803 - protein, 18 aa, Mycobacterium
YHPAAKEVMRLAALQDRP

SEQ ID NO: 878804 - protein, 19 aa, Mycobacterium
YHPTRPLGKALLYGPGDTW

SEQ ID NO: 878805 - protein, 18 aa, Mycobacterium
YHQPMPDVPAPEDLPSVG

SEQ ID NO: 878806 - protein, 17 aa, Mycobacterium
YHRDSFRSHLLAARAYG

SEQ ID NO: 878807 - protein, 25 aa, Mycobacterium
YHRGQPLGYLLDLLDRYQPYCSRCL

SEQ ID NO: 878808 - protein, 17 aa, Mycobacterium
YHRKWASALDRLTFLID

SEQ ID NO: 878809 - protein, 18 aa, Mycobacterium
YHRKWGTGYFKQQSTRPQ

SEQ ID NO: 878810 - protein, 18 aa, Mycobacterium
YHRLRLATLVIVAGTAKA

SEQ ID NO: 878811 - protein, 24 aa, Mycobacterium
YHRMLDRRGPLVLPTAAAVGLATV

SEQ ID NO: 878812 - protein, 18 aa, Mycobacterium
YHSVARMRRGPGGGLVVT

SEQ ID NO: 878813 - protein, 20 aa, Mycobacterium
YHSWPKYFAALQRLVRPGGK

SEQ ID NO: 878814 - protein, 24 aa, Mycobacterium
YHTAWAAIPHLLAGQRGGAIVFTS

SEQ ID NO: 878815 - protein, 20 aa, Mycobacterium
YHTFGGWKRSGFGDLNQHGP

SEQ ID NO: 878816 - protein, 22 aa, Mycobacterium
YHTNGFATLHFLLGGDHLVVLE

SEQ ID NO: 878817 - protein, 24 aa, Mycobacterium
YHVDFVHNTWRFGIDRVLAGVAMS

SEQ ID NO: 878818 - protein, 17 aa, Mycobacterium
YHVRHSALPGPGRVREL

SEQ ID NO: 878819 - protein, 25 aa, Mycobacterium
YIAADLRSLHVAAETLRVGPQPEWR

SEQ ID NO: 878820 - protein, 27 aa, Mycobacterium
YIADGTYFYVLLADGTLRVGGMLFSAG

SEQ ID NO: 878821 - protein, 18 aa, Mycobacterium
YIAGFTERVRLSTNILLA

SEQ ID NO: 878822 - protein, 21 aa, Mycobacterium
YIALEFAQMYRRFGAPVTVVE

SEQ ID NO: 878823 - protein, 21 aa, Mycobacterium
YIALEFAQMYRRFGAQVTVVE

SEQ ID NO: 878824 - protein, 20 aa, Mycobacterium
YIDCRCCGGMLKPDIVYFGE

SEQ ID NO: 878825 - protein, 27 aa, Mycobacterium
YIDEWCAVAPERYIPLAILPTWDIDAC

SEQ ID NO: 878826 - protein, 21 aa, Mycobacterium
YIDFSWFDAVVMALDPAFGAH

SEQ ID NO: 878827 - protein, 22 aa, Mycobacterium
YIDGELYITGRVKDLVIVDGRN

SEQ ID NO: 878828 - protein, 19 aa, Mycobacterium
YIDTWLLRACAKLGVRLVH

SEQ ID NO: 878829 - protein, 31 aa, Mycobacterium
YIDVEAIRWTTWHAAWLIAHGRPLTEAGRAA

SEQ ID NO: 878830 - protein, 18 aa, Mycobacterium
YIDYSKHRITRDTISLLV

SEQ ID NO: 878831 - protein, 18 aa, Mycobacterium
YIDYSKHRLNRETLALLV

SEQ ID NO: 878832 - protein, 20 aa, Mycobacterium
YIELFYGRPLNQSSWELVTD

SEQ ID NO: 878833 - protein, 17 aa, Mycobacterium
YIELPVTVEIVVTHTEP

SEQ ID NO: 878834 - protein, 33 aa, Mycobacterium
YIFQSDRHPHWWQAPLRWSIRGALAARSAIVVR

SEQ ID NO: 878835 - protein, 18 aa, Mycobacterium
YIGGIQRLLEAGQTPDYM

SEQ ID NO: 878836 - protein, 24 aa, Mycobacterium
YIGIGVFLDGRWRWRSYSLTSSPV

SEQ ID NO: 878837 - protein, 17 aa, Mycobacterium
YIGLGNMGAPMATKMTE

SEQ ID NO: 878838 - protein, 17 aa, Mycobacterium
YIGLGNQGAPMAKRLLD

SEQ ID NO: 878839 - protein, 25 aa, Mycobacterium
YIGMTLGAYRWLRPSGRRSAKEIAA

SEQ ID NO: 878840 - protein, 21 aa, Mycobacterium
YIITGGLGGLGLFLAEKMATA

SEQ ID NO: 878841 - protein, 19 aa, Mycobacterium
YIKAFWNVVNWPDVQARFA

SEQ ID NO: 878842 - protein, 20 aa, Mycobacterium
YIKEDVAIRKLLATGLERAG

SEQ ID NO: 878843 - protein, 18 aa, Mycobacterium
YILIGADGPIRLVDVFDG

SEQ ID NO: 878844 - protein, 18 aa, Mycobacterium
YILLTTFTKDGRPKPTAI

SEQ ID NO: 878845 - protein, 21 aa, Mycobacterium
YILTPTLPQDLTPHSALPPAV

SEQ ID NO: 878846 - protein, 18 aa, Mycobacterium
YIMSMPRTDALSLKLTRL

SEQ ID NO: 878847 - protein, 21 aa, Mycobacterium
YINGRPAPLVAYWYGPDDENF

SEQ ID NO: 878848 - protein, 17 aa, Mycobacterium
YINRAFAAVGRLLHRHD

SEQ ID NO: 878849 - protein, 21 aa, Mycobacterium
YIPGAAFSPSGRFANALRLCF

SEQ ID NO: 878850 - protein, 17 aa, Mycobacterium
YIPLLAGVGRPVRKPRP

SEQ ID NO: 878851 - protein, 31 aa, Mycobacterium
YIPQDADWALFSRLMPVLPTTTESSGTGMAG

SEQ ID NO: 878852 - protein, 19 aa, Mycobacterium
YIQRAIAFQRGLDLAARLV

SEQ ID NO: 878853 - protein, 25 aa, Mycobacterium
YIRDQLPGTWLLASFYFRADVRGLD

SEQ ID NO: 878854 - protein, 31 aa, Mycobacterium
YIRKGIPGPRWIPKPLWKLVSAPLNAYTRLV

SEQ ID NO: 878855 - protein, 32 aa, Mycobacterium
YIRNSRLYDAIDQWAFCALSTSPGARAFYDQR

SEQ ID NO: 878856 - protein, 17 aa, Mycobacterium
YIRTIRGAGYRLAPSIS

SEQ ID NO: 878857 - protein, 21 aa, Mycobacterium
YISGAPQLWVVGTRPFGPICT

SEQ ID NO: 878858 - protein, 18 aa, Mycobacterium
YISIPLLIAEAGGDPWAI

SEQ ID NO: 878859 - protein, 23 aa, Mycobacterium
YISPGLMRIFDRLTPDTAAEIVT

SEQ ID NO: 878860 - protein, 32 aa, Mycobacterium
YITGQTLLVDGGLDLKWSHLGADNTSLFLKDE

SEQ ID NO: 878861 - protein, 31 aa, Mycobacterium
YITGQTLLVDGGLNLKWGHLGADNTSLFLKD

SEQ ID NO: 878862 - protein, 21 aa, Mycobacterium
YITKWDLPVRIGGHLKEPIDE

SEQ ID NO: 878863 - protein, 19 aa, Mycobacterium
YIVIFGADHVYRMDPEQMV

SEQ ID NO: 878864 - protein, 27 aa, Mycobacterium
YIVPAFSGLYSPYWATEARGLVVGLTS

SEQ ID NO: 878865 - protein, 29 aa, Mycobacterium
YIYTAEIPVFYGHYWRQGSPKHRHDWTDY

SEQ ID NO: 878866 - protein, 18 aa, Mycobacterium
YKALDYPLKIALESELLE

SEQ ID NO: 878867 - protein, 20 aa, Mycobacterium
YKALRETSPVFRSPQAVVLS

SEQ ID NO: 878868 - protein, 23 aa, Mycobacterium
YKANLRHVLLCTQRVARDMVAAE

SEQ ID NO: 878869 - protein, 19 aa, Mycobacterium
YKAPSSYTGPALPIVAVPT

SEQ ID NO: 878870 - protein, 20 aa, Mycobacterium
YKDFPLVLYQIQNKYRDEAR

SEQ ID NO: 878871 - protein, 20 aa, Mycobacterium
YKDFPVILYQIQTKYRDEAR

SEQ ID NO: 878872 - protein, 20 aa, Mycobacterium
YKDFPVLLYQIQNKYRDEAR

SEQ ID NO: 878873 - protein, 19 aa, Mycobacterium
YKEFELLKYLAQHAGRVFT

SEQ ID NO: 878874 - protein, 20 aa, Mycobacterium
YKEFLLEDVPNMAWCIGYTN

SEQ ID NO: 878875 - protein, 20 aa, Mycobacterium
YKEKWFTERPRQRLAVLLYE

SEQ ID NO: 878876 - protein, 21 aa, Mycobacterium
YKFMGKITPYPGTPLYQEYSD

SEQ ID NO: 878877 - protein, 20 aa, Mycobacterium
YKGLMFSGVPNFAITFGYTN

SEQ ID NO: 878878 - protein, 20 aa, Mycobacterium
YKGMLLTGMPNLAFTIGYTN

SEQ ID NO: 878879 - protein, 22 aa, Mycobacterium
YKGMLTTMQLPQYFPDLRDERC

SEQ ID NO: 878880 - protein, 19 aa, Mycobacterium
YKGRWPEIWVAAHGPRMLR

SEQ ID NO: 878881 - protein, 19 aa, Mycobacterium
YKHGFGPFAPEVYRAPMAY

SEQ ID NO: 878882 - protein, 17 aa, Mycobacterium
YKIVRRLRDHGVAMVYT

SEQ ID NO: 878883 - protein, 43 aa, Mycobacterium
YKLHPPMLRAMGLDHKLTLGAWFKPALYALRTARRVRGTRLDV

SEQ ID NO: 878884 - protein, 25 aa, Mycobacterium
YKLSAAIVNLCQMVKYLSAEGQRGD

SEQ ID NO: 878885 - protein, 17 aa, Mycobacterium
YKLYKRYASHEGGIADT

SEQ ID NO: 878886 - protein, 21 aa, Mycobacterium
YKNRIFTTPVITLPIVEKAIE

SEQ ID NO: 878887 - protein, 42 aa, Mycobacterium
YKPEIDVMVSWLPLFHDMGMVGFLTVPMFFGAELVKITPMDF

SEQ ID NO: 878888 - protein, 18 aa, Mycobacterium
YKPVAGEAPLWDFPDGTL

SEQ ID NO: 878889 - protein, 28 aa, Mycobacterium
YKQVALFSATMPTTIRRLTKKYLHDPVE

SEQ ID NO: 878890 - protein, 19 aa, Mycobacterium
YKRFRVRSQVWMFGLTPGT

SEQ ID NO: 878891 - protein, 23 aa, Mycobacterium
YKRLSRIVFVPDIPRLPSGKVLR

SEQ ID NO: 878892 - protein, 18 aa, Mycobacterium
YKRMFKPGIDDLVFIGFA

SEQ ID NO: 878893 - protein, 17 aa, Mycobacterium
YKRRLFGQIVAAAVRAT

SEQ ID NO: 878894 - protein, 20 aa, Mycobacterium
YKSFFREFRWSSGVADYIAG

SEQ ID NO: 878895 - protein, 35 aa, Mycobacterium
YKTLDLPFMESVIWAFKQLWDKGLAYEGNRVLPYC

SEQ ID NO: 878896 - protein, 33 aa, Mycobacterium
YKTLLYKIAERRPLRAALLWGRIGDHLSGQARI

SEQ ID NO: 878897 - protein, 35 aa, Mycobacterium
YKVGLASVRFLLAVGDLLIGWRLLVQAGVAHRALT

SEQ ID NO: 878898 - protein, 39 aa, Mycobacterium
YKVGLASVRYLLAVGDLIIGWRLLVQAGVAHAALANGPS

SEQ ID NO: 878899 - protein, 30 aa, Mycobacterium
YKVGLGSVRFLMAVGDLLSGWLLARQAAVA

SEQ ID NO: 878900 - protein, 19 aa, Mycobacterium
YKVLGGLAKRPALFVASYF

SEQ ID NO: 878901 - protein, 24 aa, Mycobacterium
YKVPKFIWVTAKQELPFTASGKVK

SEQ ID NO: 878902 - protein, 18 aa, Mycobacterium
YKYFGGKEDLLLATIVRI

SEQ ID NO: 878903 - protein, 19 aa, Mycobacterium
YLAAIYRTDLAERVDALVA

SEQ ID NO: 878904 - protein, 18 aa, Mycobacterium
YLADCGYRRSWGIGRHIQ

SEQ ID NO: 878905 - protein, 18 aa, Mycobacterium
YLADEYPEIGLKAPSSQH

SEQ ID NO: 878906 - protein, 21 aa, Mycobacterium
YLADFYARRRLSGPERALLQD

SEQ ID NO: 878907 - protein, 21 aa, Mycobacterium
YLAELTMLILAKAQAKDPSGG

SEQ ID NO: 878908 - protein, 22 aa, Mycobacterium
YLAELTMLILAKAQAKDPSGGY

SEQ ID NO: 878909 - protein, 18 aa, Mycobacterium
YLAGIYRTALHTVVSDLV

SEQ ID NO: 878910 - protein, 19 aa, Mycobacterium
YLAHLHDPLAAAAALDPAL

SEQ ID NO: 878911 - protein, 23 aa, Mycobacterium
YLAICDLMYRRQLAGASVFLGVD

SEQ ID NO: 878912 - protein, 20 aa, Mycobacterium
YLAIFDKGKALALYHTKRLA

SEQ ID NO: 878913 - protein, 26 aa, Mycobacterium
YLALEWLERMDLVDGKLICLVRAKSD

SEQ ID NO: 878914 - protein, 17 aa, Mycobacterium
YLALQWLEQMELVGGTL

SEQ ID NO: 878915 - protein, 18 aa, Mycobacterium
YLANMIRGLLDQLGIDSA

SEQ ID NO: 878916 - protein, 26 aa, Mycobacterium
YLAPTIDTDWYLAWLARQAEAAGITV

SEQ ID NO: 878917 - protein, 31 aa, Mycobacterium
YLARRDAEWMGPFLERMGLTVGWITEESTAE

SEQ ID NO: 878918 - protein, 29 aa, Mycobacterium
YLARRDSEWMGRVHRFLGLDVGVILSGMT

SEQ ID NO: 878919 - protein, 17 aa, Mycobacterium
YLATAPGGTIVGSEKKC

SEQ ID NO: 878920 - protein, 29 aa, Mycobacterium
YLATQLRAMQFLRGGRRWLLKSPQHLEQV

SEQ ID NO: 878921 - protein, 27 aa, Mycobacterium
YLATVIDCFSRRLVGWSIADHMSYMDS

SEQ ID NO: 878922 - protein, 25 aa, Mycobacterium
YLAVEPWVQYGFNLASWAVGWVPWI

SEQ ID NO: 878923 - protein, 20 aa, Mycobacterium
YLAVFDKGKALALYHSKRLA

SEQ ID NO: 878924 - protein, 28 aa, Mycobacterium
YLDAAWSLAPFTGLLPRRPKIEERTTGE

SEQ ID NO: 878925 - protein, 28 aa, Mycobacterium
YLDAMLAARLVPHPDWHGDWSAARGYEI

SEQ ID NO: 878926 - protein, 17 aa, Mycobacterium
YLDAWFEAVGITENVVL

SEQ ID NO: 878927 - protein, 25 aa, Mycobacterium
YLDDADVALLLRRLEHVPIATAVRL

SEQ ID NO: 878928 - protein, 20 aa, Mycobacterium
YLDDEPIFLGRNGRISVFPS

SEQ ID NO: 878929 - protein, 21 aa, Mycobacterium
YLDFTFAGLPAYKQGLGRKVR

SEQ ID NO: 878930 - protein, 20 aa, Mycobacterium
YLDFTFAGLPAYQQGLGRKV

SEQ ID NO: 878931 - protein, 19 aa, Mycobacterium
YLDGLLLPEVIQANRLSPA

SEQ ID NO: 878932 - protein, 17 aa, Mycobacterium
YLDGRVHQIALSPKVVN

SEQ ID NO: 878933 - protein, 33 aa, Mycobacterium
YLDHDWLEELGEQLPVYRPPLDLGRLFGEPAIG

SEQ ID NO: 878934 - protein, 21 aa, Mycobacterium
YLDHFGFGFVMFVNGYRADEV

SEQ ID NO: 878935 - protein, 18 aa, Mycobacterium
YLDHGGLAGLRRALQMSP

SEQ ID NO: 878936 - protein, 18 aa, Mycobacterium
YLDLFTWLRGDILVKADK

SEQ ID NO: 878937 - protein, 17 aa, Mycobacterium
YLDLLGVEGIWLNPVTR

SEQ ID NO: 878938 - protein, 17 aa, Mycobacterium
YLDLVRQVPYFTDVNDS

SEQ ID NO: 878939 - protein, 18 aa, Mycobacterium
YLDLVSDFATHAAIALVL

SEQ ID NO: 878940 - protein, 20 aa, Mycobacterium
YLDRAAILAAAAKAGARLIH

SEQ ID NO: 878941 - protein, 18 aa, Mycobacterium
YLDVLRRFDSMYSGPLPY

SEQ ID NO: 878942 - protein, 17 aa, Mycobacterium
YLDVVATLAQAYSGGER

SEQ ID NO: 878943 - protein, 26 aa, Mycobacterium
YLEADPLAPFGFSGWVGPEPHGAAMS

SEQ ID NO: 878944 - protein, 17 aa, Mycobacterium
YLEARLLAALAARRDAE

SEQ ID NO: 878945 - protein, 24 aa, Mycobacterium
YLEDLFVRPGFRRRGLARALLAAL

SEQ ID NO: 878946 - protein, 20 aa, Mycobacterium
YLEHSGLRGLIRVVGMEHPR

SEQ ID NO: 878947 - protein, 18 aa, Mycobacterium
YLEHYLGTGTLELRLQYG

SEQ ID NO: 878948 - protein, 25 aa, Mycobacterium
YLEKDGFVLQLLTFGGYPAPEEPER

SEQ ID NO: 878949 - protein, 21 aa, Mycobacterium
YLESIPLPRLVTDSWQRSLAT

SEQ ID NO: 878950 - protein, 35 aa, Mycobacterium
YLETDAPLVITMIWLHAAMPRVFRGRSVFSPYLVP

SEQ ID NO: 878951 - protein, 28 aa, Mycobacterium
YLETLDWYLDNLGMIVSDFLYFPDQRDR

SEQ ID NO: 878952 - protein, 20 aa, Mycobacterium
YLEVSQLIRVLARRSVTLAV

SEQ ID NO: 878953 - protein, 17 aa, Mycobacterium
YLEVWRTASDYDATKGS

SEQ ID NO: 878954 - protein, 20 aa, Mycobacterium
YLEYQGGKLARRFDPGTYVV

SEQ ID NO: 878955 - protein, 17 aa, Mycobacterium
YLFAHRPEWAAETAVGK

SEQ ID NO: 878956 - protein, 17 aa, Mycobacterium
YLFDVRQIRRGKIDDGL

SEQ ID NO: 878957 - protein, 18 aa, Mycobacterium
YLFETPERRLFSEYWDLV

SEQ ID NO: 878958 - protein, 30 aa, Mycobacterium
YLFGSGFMPAPLFDALLDDALLDGAKIREI

SEQ ID NO: 878959 - protein, 26 aa, Mycobacterium
YLFGSGFMPAPLFDALLDGAKIREIL

SEQ ID NO: 878960 - protein, 26 aa, Mycobacterium
YLFTNDYEWDLLLSKTGWTEADVRER

SEQ ID NO: 878961 - protein, 25 aa, Mycobacterium
YLGALGMTGLTAWIGMREIAKPRPG

SEQ ID NO: 878962 - protein, 24 aa, Mycobacterium
YLGAYLIRELLIQTEARISCLVRA

SEQ ID NO: 878963 - protein, 18 aa, Mycobacterium
YLGIIDRVRTAIPHAAIT

SEQ ID NO: 878964 - protein, 18 aa, Mycobacterium
YLGLGLSAYIEPTGAATG

SEQ ID NO: 878965 - protein, 18 aa, Mycobacterium
YLGLGQLLGRPVGQDRHA

SEQ ID NO: 878966 - protein, 17 aa, Mycobacterium
YLGLLPGPGSEPGESRI

SEQ ID NO: 878967 - protein, 18 aa, Mycobacterium
YLGLQAGELFLITHLSRA

SEQ ID NO: 878968 - protein, 19 aa, Mycobacterium
YLGLSNYVNNWLRLGFTEA

SEQ ID NO: 878969 - protein, 19 aa, Mycobacterium
YLGRMRGLPAQTLTVNRRL

SEQ ID NO: 878970 - protein, 19 aa, Mycobacterium
YLGSILARLHFWGVVSDMD

SEQ ID NO: 878971 - protein, 19 aa, Mycobacterium
YLGTQPRDFLAVATPGSGK

SEQ ID NO: 878972 - protein, 23 aa, Mycobacterium
YLGVVYADMFPGSTHRIVLDSAM

SEQ ID NO: 878973 - protein, 17 aa, Mycobacterium
YLGYFQGKVEGWQAPDP

SEQ ID NO: 878974 - protein, 25 aa, Mycobacterium
YLHAIVNRGFGNVIWTEIWRSDDCG

SEQ ID NO: 878975 - protein, 20 aa, Mycobacterium
YLHAKSREQIPDALWPVLKN

SEQ ID NO: 878976 - protein, 20 aa, Mycobacterium
YLHDDDIIDPIPLHNGRLSV

SEQ ID NO: 878977 - protein, 25 aa, Mycobacterium
YLHDRGLFGTSILWFESDEGRGPLP

SEQ ID NO: 878978 - protein, 19 aa, Mycobacterium
YLHFCVHRLAIDSGELSSL

SEQ ID NO: 878979 - protein, 17 aa, Mycobacterium
YLHPCGSAEFRPILGGR

SEQ ID NO: 878980 - protein, 19 aa, Mycobacterium
YLHPDLQPLSMLTASLARA

SEQ ID NO: 878981 - protein, 28 aa, Mycobacterium
YLHQSRINAMPAFRGRGFYWHSDFETWH

SEQ ID NO: 878982 - protein, 19 aa, Mycobacterium
YLHSIGLAYNDLKPENIMI

SEQ ID NO: 878983 - protein, 29 aa, Mycobacterium
YLIATGANPVIPPAFEGVAYLTSTTAMEV

SEQ ID NO: 878984 - protein, 25 aa, Mycobacterium
YLIDGRPVILTAPKRPAPSGPGRTR

SEQ ID NO: 878985 - protein, 26 aa, Mycobacterium
YLIDLDERLRYVLVGGIRSTGLTSGM

SEQ ID NO: 878986 - protein, 21 aa, Mycobacterium
YLIDQPLMRNVLADLAIEAEA

SEQ ID NO: 878987 - protein, 17 aa, Mycobacterium
YLILGACNPALAHRAIS

SEQ ID NO: 878988 - protein, 25 aa, Mycobacterium
YLKDRRVMPALRRLGWHVTTVVKED

SEQ ID NO: 878989 - protein, 19 aa, Mycobacterium
YLKFWDLVARRRDDGRSVL

SEQ ID NO: 878990 - protein, 17 aa, Mycobacterium
YLKLINWELASTTDAAP

SEQ ID NO: 878991 - protein, 18 aa, Mycobacterium
YLKNFTRRGLYQRVGLDG

SEQ ID NO: 878992 - protein, 17 aa, Mycobacterium
YLKRPLIDGPAPEPAKH

SEQ ID NO: 878993 - protein, 19 aa, Mycobacterium
YLLAMIRGDRTYRVIGSRG

SEQ ID NO: 878994 - protein, 17 aa, Mycobacterium
YLLDQNALPDAPLTAMV

SEQ ID NO: 878995 - protein, 27 aa, Mycobacterium
YLLEGRPVILTAPRRAAPAAATRTASG

SEQ ID NO: 878996 - protein, 22 aa, Mycobacterium
YLLGGHMGSLLQVCRLAARRAG

SEQ ID NO: 878997 - protein, 36 aa, Mycobacterium
YLLSQPGLRKLLPQEWLRFGWYFLVSRRDLAGLREW

SEQ ID NO: 878998 - protein, 17 aa, Mycobacterium
YLLSRAPGQLGLHAALT

SEQ ID NO: 878999 - protein, 20 aa, Mycobacterium
YLLVPLDQPGVQIRPIVQIT

SEQ ID NO: 879000 - protein, 18 aa, Mycobacterium
YLMARRLVRNSAHPAPAA

SEQ ID NO: 879001 - protein, 28 aa, Mycobacterium
YLMTKGEYQLKMEPPFVPGIETAGVVRS

SEQ ID NO: 879002 - protein, 25 aa, Mycobacterium
YLNRELSWLDFNARVLALAADESLP

SEQ ID NO: 879003 - protein, 22 aa, Mycobacterium
YLNRELSWLDFNARVLALAADN

SEQ ID NO: 879004 - protein, 24 aa, Mycobacterium
YLNRELSWLDFNARVLALADDNSL

SEQ ID NO: 879005 - protein, 37 aa, Mycobacterium
YLNRIYDYLMVSLRSLPLVMVIGRPEVRIPVVSFVLN

SEQ ID NO: 879006 - protein, 18 aa, Mycobacterium
YLNWEARSWRLDDGGDYD

SEQ ID NO: 879007 - protein, 19 aa, Mycobacterium
YLNWEARSWRLDEDGQYEE

SEQ ID NO: 879008 - protein, 18 aa, Mycobacterium
YLNWEARSWRLTDTGEYL

SEQ ID NO: 879009 - protein, 18 aa, Mycobacterium
YLPAWAHGVLFERVHALS

SEQ ID NO: 879010 - protein, 18 aa, Mycobacterium
YLPDQWTAQAFSDGWYRT

SEQ ID NO: 879011 - protein, 18 aa, Mycobacterium
YLPIISEFAKVQGGLRVI

SEQ ID NO: 879012 - protein, 24 aa, Mycobacterium
YLPKPFSMRVLVARVAALLRRTHR

SEQ ID NO: 879013 - protein, 17 aa, Mycobacterium
YLPLARLIHLQVAARQA

SEQ ID NO: 879014 - protein, 32 aa, Mycobacterium
YLPQDADWSLFTRLMPVLPTTETSSGAGMADP

SEQ ID NO: 879015 - protein, 19 aa, Mycobacterium
YLPSCLATHLPLDLVIIML

SEQ ID NO: 879016 - protein, 17 aa, Mycobacterium
YLPVIIDDPRERGRYDA

SEQ ID NO: 879017 - protein, 18 aa, Mycobacterium
YLQAAADAGLRRAVVSSS

SEQ ID NO: 879018 - protein, 17 aa, Mycobacterium
YLQENNQLPAMFADVRR

SEQ ID NO: 879019 - protein, 20 aa, Mycobacterium
YLQEQWAELEPLLASGTVPA

SEQ ID NO: 879020 - protein, 18 aa, Mycobacterium
YLQHDQWADALTADGWFR

SEQ ID NO: 879021 - protein, 26 aa, Mycobacterium
YLQKPYPARTTLFGGLPPGLLVEIDA

SEQ ID NO: 879022 - protein, 24 aa, Mycobacterium
YLQRLGVDGIWINPVTVSPMADHG

SEQ ID NO: 879023 - protein, 21 aa, Mycobacterium
YLRAAELLALDPSDCLAVEDS

SEQ ID NO: 879024 - protein, 18 aa, Mycobacterium
YLRAHPEAGLLLVTDPHA

SEQ ID NO: 879025 - protein, 17 aa, Mycobacterium
YLRDIHLIRRGKIDDEG

SEQ ID NO: 879026 - protein, 18 aa, Mycobacterium
YLRDIHLIRRGKIDDEGL

SEQ ID NO: 879027 - protein, 17 aa, Mycobacterium
YLRDIWPSIEEITEVIA

SEQ ID NO: 879028 - protein, 17 aa, Mycobacterium
YLRDLIALRRSQPGEDL

SEQ ID NO: 879029 - protein, 20 aa, Mycobacterium
YLRDRGAFDDLPLAEILQAL

SEQ ID NO: 879030 - protein, 22 aa, Mycobacterium
YLRELAFRDFYAAVLYDHPASA

SEQ ID NO: 879031 - protein, 24 aa, Mycobacterium
YLRELAFRDFYADVLHHWPASAWR

SEQ ID NO: 879032 - protein, 18 aa, Mycobacterium
YLRFGWAAARLDDLMNVL

SEQ ID NO: 879033 - protein, 17 aa, Mycobacterium
YLRFSALSGRESIEQHR

SEQ ID NO: 879034 - protein, 20 aa, Mycobacterium
YLRGRAALIDLKHAKPASAG

SEQ ID NO: 879035 - protein, 21 aa, Mycobacterium
YLRHVEWVKSWFEELRLAEAT

SEQ ID NO: 879036 - protein, 17 aa, Mycobacterium
YLRKAPGSLMFSTSSSS

SEQ ID NO: 879037 - protein, 17 aa, Mycobacterium
YLRLCGRRHDMVVRGGE

SEQ ID NO: 879038 - protein, 17 aa, Mycobacterium
YLRLFEMDGVELEFTDD

SEQ ID NO: 879039 - protein, 22 aa, Mycobacterium
YLRMDEFPARLIIVPGENDRLL

SEQ ID NO: 879040 - protein, 19 aa, Mycobacterium
YLRNFDAHRWVELVRTEGV

SEQ ID NO: 879041 - protein, 19 aa, Mycobacterium
YLRPLLDGELFSCYSMTEP

SEQ ID NO: 879042 - protein, 19 aa, Mycobacterium
YLRQHVHLGYAVTVHAAQG

SEQ ID NO: 879043 - protein, 18 aa, Mycobacterium
YLRTLVDVGLGYVRLGQP

SEQ ID NO: 879044 - protein, 19 aa, Mycobacterium
YLSDLFIKPTALADYTHTG

SEQ ID NO: 879045 - protein, 18 aa, Mycobacterium
YLSFWDTHNQVFGTFHVS

SEQ ID NO: 879046 - protein, 17 aa, Mycobacterium
YLSIIQNGQRRVAHEDI

SEQ ID NO: 879047 - protein, 17 aa, Mycobacterium
YLSIIQTGQRRIAVEDI

SEQ ID NO: 879048 - protein, 18 aa, Mycobacterium
YLSPAPLYHAAGVNYTMA

SEQ ID NO: 879049 - protein, 17 aa, Mycobacterium
YLSQVERGLRKPSADVL

SEQ ID NO: 879050 - protein, 19 aa, Mycobacterium
YLSSFPPLTPQQRAWLTLV

SEQ ID NO: 879051 - protein, 18 aa, Mycobacterium
YLSVSVLDAVRRGRRGDF

SEQ ID NO: 879052 - protein, 21 aa, Mycobacterium
YLTDAMAIDRIAPELRKKALD

SEQ ID NO: 879053 - protein, 20 aa, Mycobacterium
YLTDFRVFFICEGVTQYLTE

SEQ ID NO: 879054 - protein, 25 aa, Mycobacterium
YLTDLGIRFMPTVGWAERGDLRAEG

SEQ ID NO: 879055 - protein, 26 aa, Mycobacterium
YLTDNRKIIAWVNSAVIWNSDDQRST

SEQ ID NO: 879056 - protein, 20 aa, Mycobacterium
YLTEAMAIDRIAPELRKKAL

SEQ ID NO: 879057 - protein, 17 aa, Mycobacterium
YLTPAGLEFCGEQLGLS

SEQ ID NO: 879058 - protein, 19 aa, Mycobacterium
YLTRPLWYQQQLDTGVAMP

SEQ ID NO: 879059 - protein, 19 aa, Mycobacterium
YLTRPSLVHFLRTGEEFGW

SEQ ID NO: 879060 - protein, 24 aa, Mycobacterium
YLTVPTRNLVPKPAWLSFDEAACL

SEQ ID NO: 879061 - protein, 24 aa, Mycobacterium
YLVDAVFNYPTFSEAYKVAALDVM

SEQ ID NO: 879062 - protein, 20 aa, Mycobacterium
YLVDFPSPVSYDKCIIFWGV

SEQ ID NO: 879063 - protein, 28 aa, Mycobacterium
YLVDSGYLVPHWPKPWGRAADVLEQLVI

SEQ ID NO: 879064 - protein, 17 aa, Mycobacterium
YLVGGSVRDALLGRLSP

SEQ ID NO: 879065 - protein, 36 aa, Mycobacterium
YLVHNPALAFQYLVQLILFDWPTHILEIFISQPELL

SEQ ID NO: 879066 - protein, 26 aa, Mycobacterium
YLVHQRKLLPLIARSYALAFAQNELT

SEQ ID NO: 879067 - protein, 25 aa, Mycobacterium
YLVHSLHGYFLRPGNPNEPTVFLVD

SEQ ID NO: 879068 - protein, 36 aa, Mycobacterium
YLVNNAAIYGGMKLDLLLSVPWDYYKKFMSVNQDGA

SEQ ID NO: 879069 - protein, 20 aa, Mycobacterium
YLVPAYASELAGLPPAIVAT

SEQ ID NO: 879070 - protein, 19 aa, Mycobacterium
YLVRGIPPGHVGAAWRGTW

SEQ ID NO: 879071 - protein, 17 aa, Mycobacterium
YLVSEDRVTVLSARSQD

SEQ ID NO: 879072 - protein, 19 aa, Mycobacterium
YLVSYAVNLLCPEQVWQLR

SEQ ID NO: 879073 - protein, 24 aa, Mycobacterium
YLVTQLKALQFLRGGGRWVLKSPQ

SEQ ID NO: 879074 - protein, 18 aa, Mycobacterium
YLVVDYKTNWLGDPAGEL

SEQ ID NO: 879075 - protein, 17 aa, Mycobacterium
YLVVGGRRGGSAMAAAA

SEQ ID NO: 879076 - protein, 21 aa, Mycobacterium
YLWNVLVDYWFRMEIDGWENI

SEQ ID NO: 879077 - protein, 22 aa, Mycobacterium
YLYPRVEVEVGFILADDLPGAG

SEQ ID NO: 879078 - protein, 21 aa, Mycobacterium
YLYRRGEFADAPRPDLILLDL

SEQ ID NO: 879079 - protein, 20 aa, Mycobacterium
YLYRYDYAPRTLRWSGFGAT

SEQ ID NO: 879080 - protein, 17 aa, Mycobacterium
YLYVSDIVRAYTLVLEN

SEQ ID NO: 879081 - protein, 17 aa, Mycobacterium
YMAMRKWAQRFYEVPPV

SEQ ID NO: 879082 - protein, 17 aa, Mycobacterium
YMAQLGFRTFNEAVGQV

SEQ ID NO: 879083 - protein, 28 aa, Mycobacterium
YMASRTAFFDRFFLDATAAGIRQAVILA

SEQ ID NO: 879084 - protein, 22 aa, Mycobacterium
YMDFTFAGLPAFLQKKGRKVRF

SEQ ID NO: 879085 - protein, 19 aa, Mycobacterium
YMFSPKVLDRAFTFEFRVT

SEQ ID NO: 879086 - protein, 22 aa, Mycobacterium
YMGINWVGPALMRYGTEEQKAK

SEQ ID NO: 879087 - protein, 18 aa, Mycobacterium
YMIPTAVVTLDALPLTPN

SEQ ID NO: 879088 - protein, 25 aa, Mycobacterium
YMLACSILERIAFRLAPNAGPTTKV

SEQ ID NO: 879089 - protein, 17 aa, Mycobacterium
YMLIVHVESARALEGLL

SEQ ID NO: 879090 - protein, 18 aa, Mycobacterium
YMLTGVIAATEKALRRAG

SEQ ID NO: 879091 - protein, 18 aa, Mycobacterium
YMMAKLIIKLINSVAEIV

SEQ ID NO: 879092 - protein, 33 aa, Mycobacterium
YMMAQYLLAIIFQRYRLHLRPGWQPRQFFSLST

SEQ ID NO: 879093 - protein, 19 aa, Mycobacterium
YMPAHYSAGWWMDSSTSLA

SEQ ID NO: 879094 - protein, 29 aa, Mycobacterium
YMPTAPRELALIAALTQCPPLPPVPVEAH

SEQ ID NO: 879095 - protein, 17 aa, Mycobacterium
YMQILTPEFLDAVGCPL

SEQ ID NO: 879096 - protein, 19 aa, Mycobacterium
YMRLKRGEIPVLFDEDHRL

SEQ ID NO: 879097 - protein, 24 aa, Mycobacterium
YMSRESMDLLRRKRDAWLAAKAER

SEQ ID NO: 879098 - protein, 22 aa, Mycobacterium
YNALKAWLINVGEDGEWPLFLD

SEQ ID NO: 879099 - protein, 21 aa, Mycobacterium
YNAQVALLRRRLSSAGLGGVR

SEQ ID NO: 879100 - protein, 25 aa, Mycobacterium
YNAQVVLLRRRLDAAGLTRVRAGTV

SEQ ID NO: 879101 - protein, 20 aa, Mycobacterium
YNATILLQQIGFTSYLASGA

SEQ ID NO: 879102 - protein, 20 aa, Mycobacterium
YNDAMVAQYAPRIAGRPAAS

SEQ ID NO: 879103 - protein, 19 aa, Mycobacterium
YNDDFLIAHPDLAALHEAD

SEQ ID NO: 879104 - protein, 25 aa, Mycobacterium
YNDDITLLAVQRRAPTPPLNITEDA

SEQ ID NO: 879105 - protein, 23 aa, Mycobacterium
YNDFRRMLRLRPASDFNDLTDNP

SEQ ID NO: 879106 - protein, 21 aa, Mycobacterium
YNDIAAWSWTAVPSALGVTDH

SEQ ID NO: 879107 - protein, 27 aa, Mycobacterium
YNDPRTPERWNPRLRFVEEFNLVDAPE

SEQ ID NO: 879108 - protein, 22 aa, Mycobacterium
YNDRYVYDLAPGSSSFVSCKRI

SEQ ID NO: 879109 - protein, 32 aa, Mycobacterium
YNDWHIDQWCGAYPARFIPMALPVIWDAQACA

SEQ ID NO: 879110 - protein, 18 aa, Mycobacterium
YNEFGSCQAIWRLEHGYL

SEQ ID NO: 879111 - protein, 24 aa, Mycobacterium
YNERHGFWGLSRYADVDAALRDCA

SEQ ID NO: 879112 - protein, 24 aa, Mycobacterium
YNEYSTVLVNFLLQRKLETFVEHN

SEQ ID NO: 879113 - protein, 17 aa, Mycobacterium
YNFASPDAALTYGRGVC

SEQ ID NO: 879114 - protein, 19 aa, Mycobacterium
YNFQFTGQRFYRIRGGKLD

SEQ ID NO: 879115 - protein, 35 aa, Mycobacterium
YNGALDVDLVFSPFFNALPIRRLGIHEKAESLALP

SEQ ID NO: 879116 - protein, 19 aa, Mycobacterium
YNGVRPRNVMPVHGTWRML

SEQ ID NO: 879117 - protein, 18 aa, Mycobacterium
YNGVSGIGLFLAAHAAGS

SEQ ID NO: 879118 - protein, 17 aa, Mycobacterium
YNHWSTIGVLNELLPHA

SEQ ID NO: 879119 - protein, 35 aa, Mycobacterium
YNHYNTGWAWAFDTPFPYWKRFAGYEGGVADPLIV

SEQ ID NO: 879120 - protein, 29 aa, Mycobacterium
YNHYPIGWAMAFNTPYKLFKRYASHEGGI

SEQ ID NO: 879121 - protein, 33 aa, Mycobacterium
YNHYPIGWAMAFNTPYKLFKRYASHEGGIADPA

SEQ ID NO: 879122 - protein, 18 aa, Mycobacterium
YNIGFGNFGSKNLGFGNH

SEQ ID NO: 879123 - protein, 18 aa, Mycobacterium
YNIGFVTALLTEAIESGS

SEQ ID NO: 879124 - protein, 17 aa, Mycobacterium
YNITFPFFDPEFLSAPD

SEQ ID NO: 879125 - protein, 19 aa, Mycobacterium
YNKSILQRRLRDVRTAAQH

SEQ ID NO: 879126 - protein, 21 aa, Mycobacterium
YNLDRLHRRPVELEEFVTLCE

SEQ ID NO: 879127 - protein, 26 aa, Mycobacterium
YNLEFLDHIIAHPSLRWVGNANELNA

SEQ ID NO: 879128 - protein, 25 aa, Mycobacterium
YNLEFLDHIVAHPAIRWVGNANELN

SEQ ID NO: 879129 - protein, 25 aa, Mycobacterium
YNLEFLDHIVAHPTIRWVGSANELN

SEQ ID NO: 879130 - protein, 26 aa, Mycobacterium
YNLGFSLPIALPQRTVATFTPGPGDA

SEQ ID NO: 879131 - protein, 18 aa, Mycobacterium
YNLLRSGGYGGPGFGGLV

SEQ ID NO: 879132 - protein, 23 aa, Mycobacterium
YNLPIVTVILNNSGVYRGDEASG

SEQ ID NO: 879133 - protein, 19 aa, Mycobacterium
YNLVREHFTLLAAIVRDHD

SEQ ID NO: 879134 - protein, 18 aa, Mycobacterium
YNMGWHKYLDARATDEQR

SEQ ID NO: 879135 - protein, 20 aa, Mycobacterium
YNNGFLWRGDNQGLIFGEPG

SEQ ID NO: 879136 - protein, 26 aa, Mycobacterium
YNPLANGLHAPWNLAAIAAGKPVLSE

SEQ ID NO: 879137 - protein, 21 aa, Mycobacterium
YNPLPISLHGRWTRAALGAGK

SEQ ID NO: 879138 - protein, 25 aa, Mycobacterium
YNQRSLLSLWADHLELPPASTLRTA

SEQ ID NO: 879139 - protein, 24 aa, Mycobacterium
YNRHSGWTLAKFPPGYGGPADVFK

SEQ ID NO: 879140 - protein, 19 aa, Mycobacterium
YNRSRLPLGVRELARMAVA

SEQ ID NO: 879141 - protein, 17 aa, Mycobacterium
YNSFPLNDCPAELWSAL

SEQ ID NO: 879142 - protein, 25 aa, Mycobacterium
YNSHLFEGTLYFPAPRTPRERVAQE

SEQ ID NO: 879143 - protein, 18 aa, Mycobacterium
YNTGGPWGYTPKGGTGVP

SEQ ID NO: 879144 - protein, 19 aa, Mycobacterium
YNTGLFNSGSFNTGIANPG

SEQ ID NO: 879145 - protein, 25 aa, Mycobacterium
YNTRLEAHLIARLGVRFAEQSRGRG

SEQ ID NO: 879146 - protein, 24 aa, Mycobacterium
YNVANCLLALAILDSIGVSPEQAA

SEQ ID NO: 879147 - protein, 26 aa, Mycobacterium
YNVHTTTLYFPLVRTPMIAPTEAYTN

SEQ ID NO: 879148 - protein, 21 aa, Mycobacterium
YNVLDAFTPVLRQNPPAAIVN

SEQ ID NO: 879149 - protein, 18 aa, Mycobacterium
YNVLPQWAKLAGKPKTMF

SEQ ID NO: 879150 - protein, 28 aa, Mycobacterium
YNVNVKGVFLLTRALTPLLRAGATDDDP

SEQ ID NO: 879151 - protein, 20 aa, Mycobacterium
YPAAGLAELALARGAAVIEV

SEQ ID NO: 879152 - protein, 20 aa, Mycobacterium
YPAAGLPELALARGIPVIEV

SEQ ID NO: 879153 - protein, 17 aa, Mycobacterium
YPAALDAAIMGASDPSP

SEQ ID NO: 879154 - protein, 20 aa, Mycobacterium
YPADAGVLASLLLNRLTLEP

SEQ ID NO: 879155 - protein, 17 aa, Mycobacterium
YPADNPITLLPKSGATG

SEQ ID NO: 879156 - protein, 17 aa, Mycobacterium
YPAGTFLHAPAGSWHVP

SEQ ID NO: 879157 - protein, 37 aa, Mycobacterium
YPALQTTFDALYPKGLQWYWRGDFFRTIPDGAVQAHA

SEQ ID NO: 879158 - protein, 18 aa, Mycobacterium
YPALTKHGVIVVPKVLDY

SEQ ID NO: 879159 - protein, 25 aa, Mycobacterium
YPAPNKYVAPIAFNIVPLAGNYVDD

SEQ ID NO: 879160 - protein, 25 aa, Mycobacterium
YPARYLFVFLDHHGMLSVFGSPTWR

SEQ ID NO: 879161 - protein, 18 aa, Mycobacterium
YPATFWTEDTGPTRWLNG

SEQ ID NO: 879162 - protein, 25 aa, Mycobacterium
YPATWQAPLRWAIRGALAVRAGLVV

SEQ ID NO: 879163 - protein, 31 aa, Mycobacterium
YPAVIDRELRRYLPFLATTKVLMAAVRAGVG

SEQ ID NO: 879164 - protein, 23 aa, Mycobacterium
YPDGPAPYYGVYAAGRWGSLDAQ

SEQ ID NO: 879165 - protein, 17 aa, Mycobacterium
YPDGRYSYQLTIYIFRY

SEQ ID NO: 879166 - protein, 17 aa, Mycobacterium
YPDKIAICRTLSQAFTF

SEQ ID NO: 879167 - protein, 21 aa, Mycobacterium
YPDLKIPYHSRWRHFEAGGID

SEQ ID NO: 879168 - protein, 22 aa, Mycobacterium
YPDRLTVVHWLESLQGLPSATA

SEQ ID NO: 879169 - protein, 21 aa, Mycobacterium
YPDTHWRFQYSPESYTGTELQ

SEQ ID NO: 879170 - protein, 21 aa, Mycobacterium
YPDTQWRFEYSPESYTGTELE

SEQ ID NO: 879171 - protein, 20 aa, Mycobacterium
YPEAVLARELEICYAAIALV

SEQ ID NO: 879172 - protein, 21 aa, Mycobacterium
YPEAVLARELEMCYAAVALVT

SEQ ID NO: 879173 - protein, 21 aa, Mycobacterium
YPEAVLARELEMCYATIALVT

SEQ ID NO: 879174 - protein, 26 aa, Mycobacterium
YPEAWIEQMKRIGIFGLAVPEEYGGS

SEQ ID NO: 879175 - protein, 25 aa, Mycobacterium
YPEAWIEQMKRIGIFGLAVSEEYGG

SEQ ID NO: 879176 - protein, 20 aa, Mycobacterium
YPEAWIEQMKRIGIYGLAVP

SEQ ID NO: 879177 - protein, 29 aa, Mycobacterium
YPEHTFTWNTVLLIRQQLTQLGVRTAMTR

SEQ ID NO: 879178 - protein, 20 aa, Mycobacterium
YPEIFLPLHGEHQAHNAVLA

SEQ ID NO: 879179 - protein, 24 aa, Mycobacterium
YPEKWIEQMKQIGIYGLAIPEEYG

SEQ ID NO: 879180 - protein, 18 aa, Mycobacterium
YPELESQQIYHMLDRVYE

SEQ ID NO: 879181 - protein, 24 aa, Mycobacterium
YPELHGNILCIGFGGGMAAGITLL

SEQ ID NO: 879182 - protein, 28 aa, Mycobacterium
YPELSTGMLLRPVKPPPSEGWRRLLYEL

SEQ ID NO: 879183 - protein, 17 aa, Mycobacterium
YPERVRSLVLINASART

SEQ ID NO: 879184 - protein, 21 aa, Mycobacterium
YPEVTLAIYASPRQTVIAGPP

SEQ ID NO: 879185 - protein, 17 aa, Mycobacterium
YPFEHRQFWFSDNRAID

SEQ ID NO: 879186 - protein, 17 aa, Mycobacterium
YPFVLPPAVLEKMRFVH

SEQ ID NO: 879187 - protein, 18 aa, Mycobacterium
YPFVLPVAVLEKMRFVHT

SEQ ID NO: 879188 - protein, 18 aa, Mycobacterium
YPGDAGVLAALLLNRVSL

SEQ ID NO: 879189 - protein, 19 aa, Mycobacterium
YPGDAGVLASLLLNRLSLA

SEQ ID NO: 879190 - protein, 27 aa, Mycobacterium
YPGDTFLAGAKILRHYGLGPLPGVAMM

SEQ ID NO: 879191 - protein, 27 aa, Mycobacterium
YPGETMPNYTLLPPDDMNIVGTPHTVD

SEQ ID NO: 879192 - protein, 18 aa, Mycobacterium
YPGFLRGVTAGCPGEFVV

SEQ ID NO: 879193 - protein, 20 aa, Mycobacterium
YPGPEIARLHEHGLLHRLAN

SEQ ID NO: 879194 - protein, 20 aa, Mycobacterium
YPGTIASVAAVALYIGEVLG

SEQ ID NO: 879195 - protein, 21 aa, Mycobacterium
YPGTIASVAAVALYIGEVLGA

SEQ ID NO: 879196 - protein, 33 aa, Mycobacterium
YPGVHAVWGHRISHWLWLRGARLAARALAELTR

SEQ ID NO: 879197 - protein, 29 aa, Mycobacterium
YPGYAAFMPLNYFVHLATLIVEGVFGRHP

SEQ ID NO: 879198 - protein, 17 aa, Mycobacterium
YPHFFELKRTRTEPPEF

SEQ ID NO: 879199 - protein, 24 aa, Mycobacterium
YPHHVDLRAFVHLRQAPRGPVTAK

SEQ ID NO: 879200 - protein, 27 aa, Mycobacterium
YPHICVPAGYFCGLPVGLSLFAGAFQE

SEQ ID NO: 879201 - protein, 20 aa, Mycobacterium
YPHMWSWDAAFVAIGLAPLS

SEQ ID NO: 879202 - protein, 19 aa, Mycobacterium
YPHWTFDDPRWLVKHLPEH

SEQ ID NO: 879203 - protein, 17 aa, Mycobacterium
YPIARIDNYTEWFTRFD

SEQ ID NO: 879204 - protein, 17 aa, Mycobacterium
YPIRLDELITAIKTIHP

SEQ ID NO: 879205 - protein, 25 aa, Mycobacterium
YPKFATRVIRLLGLVPLGPSGLGGL

SEQ ID NO: 879206 - protein, 22 aa, Mycobacterium
YPKREGKLPPTSKLAPVIEAPK

SEQ ID NO: 879207 - protein, 23 aa, Mycobacterium
YPKREGKLPPTSKLAPVLEAPVV

SEQ ID NO: 879208 - protein, 21 aa, Mycobacterium
YPLDRGAAGIALLASMPPRPQ

SEQ ID NO: 879209 - protein, 30 aa, Mycobacterium
YPLDTFPGQVPFLRGPYPTMYVNQPWTIRQ

SEQ ID NO: 879210 - protein, 19 aa, Mycobacterium
YPLGLRRWEFPQGTAPDRQ

SEQ ID NO: 879211 - protein, 23 aa, Mycobacterium
YPLGTAFRPKVWPAARRIDGAYG

SEQ ID NO: 879212 - protein, 20 aa, Mycobacterium
YPLIEVGKWTLNRNPRNYFV

SEQ ID NO: 879213 - protein, 18 aa, Mycobacterium
YPLLAHVVLFGGGHVQRT

SEQ ID NO: 879214 - protein, 18 aa, Mycobacterium
YPLMLRQGHGHIVNTASM

SEQ ID NO: 879215 - protein, 18 aa, Mycobacterium
YPLTAIKDLPLNTSVANG

SEQ ID NO: 879216 - protein, 21 aa, Mycobacterium
YPLTFGPSPIHPLERLTKHLG

SEQ ID NO: 879217 - protein, 20 aa, Mycobacterium
YPLTFGPSPVHPLQRLSSHL

SEQ ID NO: 879218 - protein, 18 aa, Mycobacterium
YPLVARQLDMNFPVVHIY

SEQ ID NO: 879219 - protein, 17 aa, Mycobacterium
YPLVVKPVTGSLRDGQS

SEQ ID NO: 879220 - protein, 17 aa, Mycobacterium
YPLVWNMLLAARCEGYG

SEQ ID NO: 879221 - protein, 31 aa, Mycobacterium
YPMGGSAVRLVRQIPYTIACDMLLTGRHITA

SEQ ID NO: 879222 - protein, 30 aa, Mycobacterium
YPMNKGDWAMVLLPLLHRDPRVWADPERFD

SEQ ID NO: 879223 - protein, 26 aa, Mycobacterium
YPMPRRAGCPFAPPPGVMALAEARPL

SEQ ID NO: 879224 - protein, 22 aa, Mycobacterium
YPMQLSELLPDAAALAGGRAPG

SEQ ID NO: 879225 - protein, 30 aa, Mycobacterium
YPNLTALPTCPPLVIWDLTTPQPPQSDLLH

SEQ ID NO: 879226 - protein, 25 aa, Mycobacterium
YPNNTNIAVPDWLRAIPGTTTSYPG

SEQ ID NO: 879227 - protein, 28 aa, Mycobacterium
YPNQINNVLAFPGVFRGALDAGARRITQ

SEQ ID NO: 879228 - protein, 33 aa, Mycobacterium
YPNRPGFWHAAIGVAACWLGGARRVADPLYRCA

SEQ ID NO: 879229 - protein, 29 aa, Mycobacterium
YPPEAGGYPPQPGYPPPRPQDQGGYPEQG

SEQ ID NO: 879230 - protein, 21 aa, Mycobacterium
YPPEQGGYPPQQGYPPPRHPE

SEQ ID NO: 879231 - protein, 35 aa, Mycobacterium
YPPVGILHELPGQRLWFPVPGMYGGFRLALRGDEL

SEQ ID NO: 879232 - protein, 21 aa, Mycobacterium
YPPVNAIPSRGWFELADIITA

SEQ ID NO: 879233 - protein, 23 aa, Mycobacterium
YPPVNAIPSRGWFELAEAITAAG

SEQ ID NO: 879234 - protein, 28 aa, Mycobacterium
YPQELYDLWTLWHIASTNPWLSVTPVTE

SEQ ID NO: 879235 - protein, 19 aa, Mycobacterium
YPQLQSKYLFLGLKNQHRG

SEQ ID NO: 879236 - protein, 19 aa, Mycobacterium
YPQLVPRLQFSDLVLVRSA

SEQ ID NO: 879237 - protein, 17 aa, Mycobacterium
YPQMLLRVGWAPINADP

SEQ ID NO: 879238 - protein, 19 aa, Mycobacterium
YPQQRLYRPGLELHPQYVL

SEQ ID NO: 879239 - protein, 21 aa, Mycobacterium
YPQRVTMPLHCDPDRPGAVTL

SEQ ID NO: 879240 - protein, 25 aa, Mycobacterium
YPQSPAYEWWDWHDQYGTHEPSRWF

SEQ ID NO: 879241 - protein, 20 aa, Mycobacterium
YPRAKLSCLPMTGAPALVAS

SEQ ID NO: 879242 - protein, 23 aa, Mycobacterium
YPRDIAELFVAFLAAHDIEVVSM

SEQ ID NO: 879243 - protein, 20 aa, Mycobacterium
YPRGDFLVGDRDVLLGTLDI

SEQ ID NO: 879244 - protein, 25 aa, Mycobacterium
YPRGNLAFRWFLADEVPARPEVRLV

SEQ ID NO: 879245 - protein, 21 aa, Mycobacterium
YPRLHEYFRAGQVPLLAVWGR

SEQ ID NO: 879246 - protein, 20 aa, Mycobacterium
YPRLKVYRGPRRKGVRYFGP

SEQ ID NO: 879247 - protein, 17 aa, Mycobacterium
YPRLVKRWRRGQALTDA

SEQ ID NO: 879248 - protein, 17 aa, Mycobacterium
YPRLVVAVVRAVGDAAA

SEQ ID NO: 879249 - protein, 26 aa, Mycobacterium
YPRPGKTVLFLGRYDEPRKGVGVLLD

SEQ ID NO: 879250 - protein, 22 aa, Mycobacterium
YPRPVELPSGEKVLRTPAYNLA

SEQ ID NO: 879251 - protein, 20 aa, Mycobacterium
YPRRLHPSAYPFLAAIDHGL

SEQ ID NO: 879252 - protein, 17 aa, Mycobacterium
YPRVDMRHGNLAELPLE

SEQ ID NO: 879253 - protein, 19 aa, Mycobacterium
YPRVEVEVGFILAADLPGA

SEQ ID NO: 879254 - protein, 18 aa, Mycobacterium
YPSGIFWLRATMTTPLDG

SEQ ID NO: 879255 - protein, 25 aa, Mycobacterium
YPSGRLVDAPLPTWTHRRLLLSRES

SEQ ID NO: 879256 - protein, 19 aa, Mycobacterium
YPSGTYNWVLRSLSDLVQI

SEQ ID NO: 879257 - protein, 24 aa, Mycobacterium
YPSIQWYGFILVWHERHGRPPYWE

SEQ ID NO: 879258 - protein, 18 aa, Mycobacterium
YPSPDPFEPFAVAAVELA

SEQ ID NO: 879259 - protein, 19 aa, Mycobacterium
YPSPDPFEPFAVAAVELAD

SEQ ID NO: 879260 - protein, 19 aa, Mycobacterium
YPSQVFLTLFGLPLQDRER

SEQ ID NO: 879261 - protein, 23 aa, Mycobacterium
YPSTPLLRPIMDALLPTMPVRTA

SEQ ID NO: 879262 - protein, 19 aa, Mycobacterium
YPSVFAQGMFSAALLAGFA

SEQ ID NO: 879263 - protein, 27 aa, Mycobacterium
YPTGQDWVQLYLGPLAVALGDRVRYST

SEQ ID NO: 879264 - protein, 20 aa, Mycobacterium
YPTPPFARLAGQREWLRRPP

SEQ ID NO: 879265 - protein, 35 aa, Mycobacterium
YPTPVTFCEIFPPDDFPLYFYRKPSAPDLQIHPAE

SEQ ID NO: 879266 - protein, 35 aa, Mycobacterium
YPTPVTFCEIFPPDNFPLYFYRKPSAPDLQIRAEQ

SEQ ID NO: 879267 - protein, 38 aa, Mycobacterium
YPTRSVVERIIAWTATSRGRRIKLRYLGVDKNHSWLRT

SEQ ID NO: 879268 - protein, 19 aa, Mycobacterium
YPVELDTLYNLFAGASESI

SEQ ID NO: 879269 - protein, 18 aa, Mycobacterium
YPVFPDRSTWPVVFPDLP

SEQ ID NO: 879270 - protein, 19 aa, Mycobacterium
YPVIPMGSWVATTEFKLNL

SEQ ID NO: 879271 - protein, 17 aa, Mycobacterium
YPVIVWGTGVVGKLVIR

SEQ ID NO: 879272 - protein, 18 aa, Mycobacterium
YPVLWRNLTEAVAGILSA

SEQ ID NO: 879273 - protein, 23 aa, Mycobacterium
YPVQAGELLFRAQGRSLALTDCL

SEQ ID NO: 879274 - protein, 17 aa, Mycobacterium
YPVSLKPEELIASGEYG

SEQ ID NO: 879275 - protein, 20 aa, Mycobacterium
YPVTYFEMLGRPWRDARKLT

SEQ ID NO: 879276 - protein, 19 aa, Mycobacterium
YPYVARVRYFAPEKVVAQR

SEQ ID NO: 879277 - protein, 25 aa, Mycobacterium
YQADGFSWLATLYAHGLGGILADDM

SEQ ID NO: 879278 - protein, 23 aa, Mycobacterium
YQAGHRAVLRRLIGDKAVKMIFV

SEQ ID NO: 879279 - protein, 23 aa, Mycobacterium
YQAGHRAVLRRLIGDKAVKMVFV

SEQ ID NO: 879280 - protein, 20 aa, Mycobacterium
YQAILGALRGKLARLLVCDI

SEQ ID NO: 879281 - protein, 22 aa, Mycobacterium
YQARHRDWLEKLKELRENASDM

SEQ ID NO: 879282 - protein, 32 aa, Mycobacterium
YQATLRRELHQSLGFEWLPVDPATGMAEVAGI

SEQ ID NO: 879283 - protein, 17 aa, Mycobacterium
YQAWRADLAAGGDSILL

SEQ ID NO: 879284 - protein, 18 aa, Mycobacterium
YQAYITRALVEGSAGQLF

SEQ ID NO: 879285 - protein, 20 aa, Mycobacterium
YQDIYKLTYLRGPSGIIVML

SEQ ID NO: 879286 - protein, 21 aa, Mycobacterium
YQDRIFATPVITLPIVERALE

SEQ ID NO: 879287 - protein, 25 aa, Mycobacterium
YQDVAVQFPPIPSFSPEHFSVARGT

SEQ ID NO: 879288 - protein, 17 aa, Mycobacterium
YQEAFGLPDDGWVLDEL

SEQ ID NO: 879289 - protein, 18 aa, Mycobacterium
YQEWLDNNLVPLEKLPSG

SEQ ID NO: 879290 - protein, 18 aa, Mycobacterium
YQEWLEQGLFHLDELPPG

SEQ ID NO: 879291 - protein, 17 aa, Mycobacterium
YQFGDIDGFWAAVLHRT

SEQ ID NO: 879292 - protein, 18 aa, Mycobacterium
YQFQYYLEDGPAPSVLHL

SEQ ID NO: 879293 - protein, 20 aa, Mycobacterium
YQFTRPRMDGLWPAPDELDG

SEQ ID NO: 879294 - protein, 24 aa, Mycobacterium
YQGDISGNAYRWQLSHRSEDSPLK

SEQ ID NO: 879295 - protein, 17 aa, Mycobacterium
YQGRPVFVMSSYAPSRI

SEQ ID NO: 879296 - protein, 18 aa, Mycobacterium
YQGTIPRTLSPLASMNLG

SEQ ID NO: 879297 - protein, 27 aa, Mycobacterium
YQGTLARLPAPPLPATRLLPRQVPNRK

SEQ ID NO: 879298 - protein, 19 aa, Mycobacterium
YQGTLTLLERLSPTTVKIG

SEQ ID NO: 879299 - protein, 29 aa, Mycobacterium
YQGVSIPYFPNYLSLASPYAFIGLNFFNT

SEQ ID NO: 879300 - protein, 32 aa, Mycobacterium
YQGVSVPYFPNYLGLASPFAFSGLSFFHTIEY

SEQ ID NO: 879301 - protein, 18 aa, Mycobacterium
YQGYLRVCGRRLTLAEKE

SEQ ID NO: 879302 - protein, 24 aa, Mycobacterium
YQHHAIRVVFVLRHAWTVLIGSIS

SEQ ID NO: 879303 - protein, 18 aa, Mycobacterium
YQHTVAMLIALEEQLSGG

SEQ ID NO: 879304 - protein, 20 aa, Mycobacterium
YQHWAGRRWKYRRSLFDSYE

SEQ ID NO: 879305 - protein, 26 aa, Mycobacterium
YQIPSMLLPLWDSEIGAAFIATLRSI
